United States Patent 7,361,468 (METHODS FOR GENOTYPING POLYMORPHISMS IN HUMANS) - sequence listing, part 2

SEQ ID NO: 30448 - DNA, 50 bp, homo sapien
gtaaccacattttcaaggaagcgaamtaattgagcaggatccatccagtt

SEQ ID NO: 30449 - DNA, 50 bp, homo sapien
ggaagggagtgtgagacctataatcrctctctgaccatggaatttgggct

SEQ ID NO: 30450 - DNA, 50 bp, homo sapien
acagtcaggagtctatcattatacakcggtattagtgcaatgaagaaaag

SEQ ID NO: 30451 - DNA, 50 bp, homo sapien
acgaagaaatattaaagttattcaaygtggtacaagccctttcattgagg

SEQ ID NO: 30452 - DNA, 50 bp, homo sapien
tggaatattcttgctgtcttccaaaytgatgatagttcatgaaatagaaa

SEQ ID NO: 30453 - DNA, 50 bp, homo sapien
tgctttcttaaaattatctgaatgartaacctgccggtttataaaccaaa

SEQ ID NO: 30454 - DNA, 50 bp, homo sapien
actcggatctgtaaataaaagaatasagcaatctcaaagagaaatagaga

SEQ ID NO: 30455 - DNA, 50 bp, homo sapien
cgtagtacaggaatgtgatcccagascaaagagaagaagccgaagagagt

SEQ ID NO: 30456 - DNA, 50 bp, homo sapien
aactgtaaactaacaaatttgggagraagctcataaatacccaatgtttt

SEQ ID NO: 30457 - DNA, 50 bp, homo sapien
agtacctctgtttggcaggtgttgasgttttacttgctagcttaagccct

SEQ ID NO: 30458 - DNA, 50 bp, homo sapien
agcttttacaaggcaaccaccactasgtttctcaatgtactattatgtta

SEQ ID NO: 30459 - DNA, 50 bp, homo sapien
aaatgaatcctgaaactaaataggaycgtgaataccctgtcttctgagtt

SEQ ID NO: 30460 - DNA, 50 bp, homo sapien
gcagaattaccatggaaatggaaatraatcctgaaactaaataggaccgt

SEQ ID NO: 30461 - DNA, 50 bp, homo sapien
aacagtgtgtttgtggattgtctggwactgcctggatctgagcaaaatct

SEQ ID NO: 30462 - DNA, 50 bp, homo sapien
acagctgtgaagtgggataacccaayggatttgtgagctaagggccctgg

SEQ ID NO: 30463 - DNA, 50 bp, homo sapien
gagctgacatcaggtagatgaatgamgagattaacaatgggtgacaggtg

SEQ ID NO: 30464 - DNA, 50 bp, homo sapien
tgaccaggtcatgaaatataatcggraagatgaattgaacaaagcttaaa

SEQ ID NO: 30465 - DNA, 50 bp, homo sapien
ctctgggccactctctgactctcacyggaaatttatctctcaggcttggt

SEQ ID NO: 30466 - DNA, 50 bp, homo sapien
tagcttcactcttaaatctttctaaractaatattgtataaactattccc

SEQ ID NO: 30467 - DNA, 50 bp, homo sapien
agctgtatatacaactaaacttgccrgagcattatcagctttaagaagat

SEQ ID NO: 30468 - DNA, 50 bp, homo sapien
cttctcaatgggaagttcaagtttckcactaatcataaccaaagagattg

SEQ ID NO: 30469 - DNA, 50 bp, homo sapien
acatgatctcagttattaaaaaaatyatttgacattgttttatctgattt

SEQ ID NO: 30470 - DNA, 50 bp, homo sapien
tgatgtattgggatgaactggaaaartgtggaagtatacaaatgaggttt

SEQ ID NO: 30471 - DNA, 50 bp, homo sapien
cattgcttgcccaaatccggagcctyagcctggcacatacataaaccctt

SEQ ID NO: 30472 - DNA, 50 bp, homo sapien
gacacaaaaataaaggcaagaaccayggatgcaaagaggaggttttcttt

SEQ ID NO: 30473 - DNA, 50 bp, homo sapien
gtctacatattttcaaagtatttcaygacattcactcaactattcataaa

SEQ ID NO: 30474 - DNA, 50 bp, homo sapien
ttagattctgataatgtatacctaawaaaagagctaaactcattccattg

SEQ ID NO: 30475 - DNA, 50 bp, homo sapien
ggcttgggggacagacacatcagtayagcagtgagcgtgtccctcattac

SEQ ID NO: 30476 - DNA, 50 bp, homo sapien
tattcatggacaccatgattcctatmactggtcatgctcttcccttttca

SEQ ID NO: 30477 - DNA, 50 bp, homo sapien
aggtaagaaaactagttgagtattayaataatttgacaaaagatggcact

SEQ ID NO: 30478 - DNA, 50 bp, homo sapien
gggcctctattcatttcaattttatmacatgtgtttggataaatgtgaaa

SEQ ID NO: 30479 - DNA, 50 bp, homo sapien
ctcctgtatcagtaacagtttataartctgagaacttggagggtgagggg

SEQ ID NO: 30480 - DNA, 50 bp, homo sapien
acttctgttttctcttcttacactcycagtttctcagacttattcttaga

SEQ ID NO: 30481 - DNA, 50 bp, homo sapien
aacggaaataagtctgcttctgaacygaagaggaggaattatctacctac

SEQ ID NO: 30482 - DNA, 50 bp, homo sapien
ctgtgagggtgttggagtcctagaartccacataggttcatgtactgtcc

SEQ ID NO: 30483 - DNA, 50 bp, homo sapien
gctttctcttatctgctgtggtaaawagttccctgtgagggtgttggagt

SEQ ID NO: 30484 - DNA, 50 bp, homo sapien
catactgattctcagggacagttcaygcagagagtctagctccatgggcc

SEQ ID NO: 30485 - DNA, 50 bp, homo sapien
ataatagtaacattatcaagagtcaraaaattacagcaaagtggagtttg

SEQ ID NO: 30486 - DNA, 50 bp, homo sapien
tttggaaaaatgtcagcatgattagmaatggctcccacaatgaattggag

SEQ ID NO: 30487 - DNA, 50 bp, homo sapien
catagactcaaatataatcagggackacttagaagaaaaaggcagatgga

SEQ ID NO: 30488 - DNA, 50 bp, homo sapien
ctcttcacacggacatgcgtgacaaytactatataaaatccatgagctca

SEQ ID NO: 30489 - DNA, 50 bp, homo sapien
ctgttataagtaacttcccgaaaaayctttctcatgctttctgggactca

SEQ ID NO: 30490 - DNA, 50 bp, homo sapien
tgcaaatgtttccaaggctagtaacyctagaatgatcagcaggaaaggaa

SEQ ID NO: 30491 - DNA, 50 bp, homo sapien
ttcagtttccaacagtgagtactgayatttacaacctagaagtaaaacct

SEQ ID NO: 30492 - DNA, 50 bp, homo sapien
aggttaactgagaagtcccatgtaamagcaaaagttctagacacagccta

SEQ ID NO: 30493 - DNA, 50 bp, homo sapien
atcaacttctaaaaaaggcattgtawcagcttatacacagaacaggtggt

SEQ ID NO: 30494 - DNA, 50 bp, homo sapien
caaatctcctaggtgtccatgcatargtaggaggtagagctagcacagag

SEQ ID NO: 30495 - DNA, 50 bp, homo sapien
aaactctaccatccaagacccaacaygtggatgcctctgaactctgtgct

SEQ ID NO: 30496 - DNA, 50 bp, homo sapien
tattgtggagaattagtcagttaaaytggagcaaatttagaagactagct

SEQ ID NO: 30497 - DNA, 50 bp, homo sapien
agtagctgttgctcactttagatacygtatccttggtcaccaccattccc

SEQ ID NO: 30498 - DNA, 50 bp, homo sapien
aaatatttttccaaagaagacataaraattgatatgtagagaagtgttca

SEQ ID NO: 30499 - DNA, 50 bp, homo sapien
acatggaaaagagaatgagaaagagsaatttttgcacccaacacagagcc

SEQ ID NO: 30500 - DNA, 50 bp, homo sapien
tcacaggacagaattcagtcccagaytaccaatgacagattacagaaatg

SEQ ID NO: 30501 - DNA, 50 bp, homo sapien
ggcatcattgctccaaaaatgatcartactaaataggttgaagacaagac

SEQ ID NO: 30502 - DNA, 50 bp, homo sapien
caggaaaagagagacacatagagagrccaacaaagataaagacagaacaa

SEQ ID NO: 30503 - DNA, 50 bp, homo sapien
accctgtacaacagacatgggaagcwaaagtcttgagattgttaggggct

SEQ ID NO: 30504 - DNA, 50 bp, homo sapien
cccaaagtcttaactcattccagcaytcgtccaaaagttcaagtccaaag

SEQ ID NO: 30505 - DNA, 50 bp, homo sapien
cagttcctattggccaattatcaaamacagtttctggaatatgaccaatg

SEQ ID NO: 30506 - DNA, 50 bp, homo sapien
tcatcataatctgacatattgcagayaaggaatatagagatgcataggta

SEQ ID NO: 30507 - DNA, 50 bp, homo sapien
gggaaagcttcattctcaggaagacraaaggaccaaattccttgacccta

SEQ ID NO: 30508 - DNA, 50 bp, homo sapien
gttcagaatgtccccctgttatttamcaatcaattttaagtacctgtaac

SEQ ID NO: 30509 - DNA, 50 bp, homo sapien
ttcatagctagttgtgaaccaactcratgtatttgacacgtgtgaacaaa

SEQ ID NO: 30510 - DNA, 50 bp, homo sapien
gagagtcatttctcctattatctgarcctttaatcttctcctaaggtcag

SEQ ID NO: 30511 - DNA, 50 bp, homo sapien
gcttaagccttcagttcatttttacrcgagaatttttgcctatcgccttg

SEQ ID NO: 30512 - DNA, 50 bp, homo sapien
cagaaaggcataaaacttgaagttasgaacatctgagcaaaatcactgag

SEQ ID NO: 30513 - DNA, 50 bp, homo sapien
acagtaaataaattaaaacatcacaygaaagagaagtaataggaagtgag

SEQ ID NO: 30514 - DNA, 50 bp, homo sapien
gagggagccccttaaggagttatgaraatatagatatgagcctcaaatcc

SEQ ID NO: 30515 - DNA, 50 bp, homo sapien
aagagggtccactctatcttcttaamtctgatcagaccaggttcctctat

SEQ ID NO: 30516 - DNA, 50 bp, homo sapien
aaaaactggcatggttgatcccatasatagagataaagaaagctattttc

SEQ ID NO: 30517 - DNA, 50 bp, homo sapien
tctggagagaaattatatgatatccrcaaatattcacctctcacattctt

SEQ ID NO: 30518 - DNA, 50 bp, homo sapien
agtacattaaactcctaagtccaaartgacccttcagaaatgaaatgtaa

SEQ ID NO: 30519 - DNA, 50 bp, homo sapien
atgtgccttgaaagagagtctagaasctaaaaaaattgaatggagtggtc

SEQ ID NO: 30520 - DNA, 50 bp, homo sapien
gattccttcagctgcatttctagtaytacgatgcatattttttcccatgg

SEQ ID NO: 30521 - DNA, 50 bp, homo sapien
aataaaaagggaaaacaatagaatamataggaagagtaaggattgaaagg

SEQ ID NO: 30522 - DNA, 50 bp, homo sapien
ataggtattatgacattctgggtacrcacaagaaatatatcattttactc

SEQ ID NO: 30523 - DNA, 50 bp, homo sapien
ggagagggtggagttggatagcaatratatttaacagtcattgaactttt

SEQ ID NO: 30524 - DNA, 50 bp, homo sapien
tccagaggtgtcacgtttcctgtcasaacatcatatgcatataaacataa

SEQ ID NO: 30525 - DNA, 50 bp, homo sapien
aggtttagctgatttttaaaaccaaygaaaagatgttaatatcatgaatt

SEQ ID NO: 30526 - DNA, 50 bp, homo sapien
ttaataagattaacagtaaattagayccagcagaagaacatcctagtgaa

SEQ ID NO: 30527 - DNA, 50 bp, homo sapien
actccatctttagaacaaagatgacsagtagacatgaaaataatatccta

SEQ ID NO: 30528 - DNA, 50 bp, homo sapien
tgggattatgccaaataataaggcamcataacaaccagatggccggtgga

SEQ ID NO: 30529 - DNA, 50 bp, homo sapien
cataaaattcactctagtgcaaatcracgcttttaacttcagccttttaa

SEQ ID NO: 30530 - DNA, 50 bp, homo sapien
aaagaaatgtttaaaaagatgaatasagcagttaatccttgggggaaagg

SEQ ID NO: 30531 - DNA, 50 bp, homo sapien
ctagaaacgtggacaattctgaaacrgcggaaaatggttttgcttcttgg

SEQ ID NO: 30532 - DNA, 50 bp, homo sapien
gagtttctgctttcatatttctacarggggtgactgttggtgagctacta

SEQ ID NO: 30533 - DNA, 50 bp, homo sapien
aaacagtatctgaaaaatgcaataaygtgaggcataataaaacaaggtat

SEQ ID NO: 30534 - DNA, 32 bp, homo sapien
ctgtgtttaaataacgmagatataagttactt

SEQ ID NO: 30535 - DNA, 50 bp, homo sapien
tcattgtataatggagtaagaaacarcataggcttcagctacacagtcat

SEQ ID NO: 30536 - DNA, 50 bp, homo sapien
cctactgccattatcaaaaatccacmgggtgcttggaggaatttggggat

SEQ ID NO: 30537 - DNA, 50 bp, homo sapien
atctgccaagtttttaaaatcctacrattagttctccaatttccccaaat

SEQ ID NO: 30538 - DNA, 50 bp, homo sapien
ttgtactaaagaatgtgaactggccmagcgacatggctgttctccaactc

SEQ ID NO: 30539 - DNA, 50 bp, homo sapien
acctcaacttaactttgtctgacacygaaatctgagggttttttctctaa

SEQ ID NO: 30540 - DNA, 50 bp, homo sapien
tagtgtaggagaataattcactgccrctcacaggtgtctctaatggctgc

SEQ ID NO: 30541 - DNA, 50 bp, homo sapien
gctgggtccgtcctaagtgccaaggkacaaaagagagcaaaggagcatct

SEQ ID NO: 30542 - DNA, 50 bp, homo sapien
taattacaaagggatcagttcatcargagaatatagcaattgtaaatata

SEQ ID NO: 30543 - DNA, 50 bp, homo sapien
gaaagccccttccatttaggttgaargactgaatcataattgcaaataat

SEQ ID NO: 30544 - DNA, 50 bp, homo sapien
gcttcagagctacctggaatctctayggaagatactgatgggatattgtg

SEQ ID NO: 30545 - DNA, 50 bp, homo sapien
tactccagtaatgaacaagcagacckcaaatataaagtgtcaaaagactt

SEQ ID NO: 30546 - DNA, 50 bp, homo sapien
tactggcaactttataactcctatarctttagtctgcatcagaagcaagg

SEQ ID NO: 30547 - DNA, 50 bp, homo sapien
tacgcaatttggattaacacaattcrctttgaagaggctcatattctctc

SEQ ID NO: 30548 - DNA, 50 bp, homo sapien
caaagtcttaactcatttcatcaccrattcaaaagtccaatgtccagagt

SEQ ID NO: 30549 - DNA, 50 bp, homo sapien
ctctaacacatgaacttttggaagaygcatttaactatatgatttcattc

SEQ ID NO: 30550 - DNA, 50 bp, homo sapien
ggcactgctctgggtatcgagtgttraaagtcaaatgtagcatactgtct

SEQ ID NO: 30551 - DNA, 50 bp, homo sapien
atccagtttacagcacagtaagaaargcccataaattaccacagtaccca

SEQ ID NO: 30552 - DNA, 50 bp, homo sapien
caaactgttttattctctttcaaggrcactcagtatgaagttacacagtt

SEQ ID NO: 30553 - DNA, 50 bp, homo sapien
ggagacttcaacaacccgctgtcaayagtggataaagtaaatagacaatt

SEQ ID NO: 30554 - DNA, 50 bp, homo sapien
tcctgctgccaacaggctatctctaygcagcaggaaaaatggcctgtcag

SEQ ID NO: 30555 - DNA, 50 bp, homo sapien
ataaagtaaatagacaattaagacakaaaatactggaacaacactataat

SEQ ID NO: 30556 - DNA, 50 bp, homo sapien
cagaaaatgggaagagaagctgaccyggtagatcaacctgtaatctctac

SEQ ID NO: 30557 - DNA, 50 bp, homo sapien
aacaaaattgtttaagtggtgattakgcatttttttaacactgagctctg

SEQ ID NO: 30558 - DNA, 50 bp, homo sapien
agactgtctctgacctggtttgcaamaactgattatgccattcatagaga

SEQ ID NO: 30559 - DNA, 50 bp, homo sapien
gagctaagtcagctgaggcatgaagsaggtctgttgaagttagcaatggg

SEQ ID NO: 30560 - DNA, 50 bp, homo sapien
aacttctaacattcactggacgctaycacttacatttttccattttctga

SEQ ID NO: 30561 - DNA, 50 bp, homo sapien
gcagatgattacaatgaaatacaacraagtccatgatagagtttaaatag

SEQ ID NO: 30562 - DNA, 50 bp, homo sapien
aataattcatgtaaaacgcaaagaakcatatttagtataagcactcaata

SEQ ID NO: 30563 - DNA, 50 bp, homo sapien
tggctgcaggttatgtgctgccgtgragttactggcccatcttcctccaa

SEQ ID NO: 30564 - DNA, 50 bp, homo sapien
atggcgaaagagcaaggaagcaatayaggttttggagtccagaagccctg

SEQ ID NO: 30565 - DNA, 50 bp, homo sapien
tgattttggggccgtattttataccrcgctttgttagattttggtgggag

SEQ ID NO: 30566 - DNA, 50 bp, homo sapien
actgcagtaagcacagtgaatacacrgcagaatctgtgcccacatacatc

SEQ ID NO: 30567 - DNA, 50 bp, homo sapien
gggatgagatttagtctgtctaccayggatcacctgacaacggttggtct

SEQ ID NO: 30568 - DNA, 50 bp, homo sapien
acaatctcctattttggtcctttaargagtgtaggcaattatttattaca

SEQ ID NO: 30569 - DNA, 50 bp, homo sapien
tgaaatagacaaattcctagaaagayacattactgacactgactcagaag

SEQ ID NO: 30570 - DNA, 50 bp, homo sapien
tgaactgatttttctttttaactcarattactgatgaaggaatccttagg

SEQ ID NO: 30571 - DNA, 50 bp, homo sapien
gagttttcatatggcccaacagttayaatcctaggtacatatccaaggta

SEQ ID NO: 30572 - DNA, 50 bp, homo sapien
ccatagaaccatgattccttcctcaygaacgcttttctcaggatacaatt

SEQ ID NO: 30573 - DNA, 50 bp, homo sapien
acaaaactggccaaaatgacattgarattatctaccaattctatttatac

SEQ ID NO: 30574 - DNA, 50 bp, homo sapien
aattaaaacatacctacattttaaaytgtggtgtgtgttatcaaatttgt

SEQ ID NO: 30575 - DNA, 50 bp, homo sapien
atgttctgatttgtagttaggacaamatggaatctcataggctcctaagc

SEQ ID NO: 30576 - DNA, 50 bp, homo sapien
tccttatccaagcataactgagtcayggcctttttataagttggagtacc

SEQ ID NO: 30577 - DNA, 50 bp, homo sapien
accagtttactagaggccaagtcacygtatcaaaggctgagaatgtgggt

SEQ ID NO: 30578 - DNA, 50 bp, homo sapien
cctcaattatctggatttttccatayagatttttaaggccaactttatct

SEQ ID NO: 30579 - DNA, 50 bp, homo sapien
gttggttccttcaaaacacttgtaayatctctagtcatcagactggtgcc

SEQ ID NO: 30580 - DNA, 50 bp, homo sapien
gggagggatttgatgggtagagaagsataaatgtccaaccttcagattct

SEQ ID NO: 30581 - DNA, 50 bp, homo sapien
tagtttgttggccaagttcataggayggtaatggtggacaaaaggttcaa

SEQ ID NO: 30582 - DNA, 50 bp, homo sapien
agattcacatcagggttgttagaaaratgatcatactagtctagtacaaa

SEQ ID NO: 30583 - DNA, 50 bp, homo sapien
aacttcacccagtttagttacaccaratatgcttgtcaaatcattggaat

SEQ ID NO: 30584 - DNA, 50 bp, homo sapien
gcccgttactgtattttgatactcaygactttgtctatggcctgctttag

SEQ ID NO: 30585 - DNA, 50 bp, homo sapien
gcacatctctcttcagtaactctgaygtaatagcacaaaacacctggtag

SEQ ID NO: 30586 - DNA, 50 bp, homo sapien
agctttatctgatgcctgcatgtagyatgttgagcattagtataagtaaa

SEQ ID NO: 30587 - DNA, 50 bp, homo sapien
gaacatacccacttttcataacaaayccaaagctattttatcatcaatcc

SEQ ID NO: 30588 - DNA, 50 bp, homo sapien
cacattccaattcccgacgctcttawcattctctccctctgatctgtatc

SEQ ID NO: 30589 - DNA, 50 bp, homo sapien
aacattacgaaagtgcagctaaaccraattataataaagcaccaggcatc

SEQ ID NO: 30590 - DNA, 50 bp, homo sapien
gtagaattgtgaagttgaggtctcayggtaattttcaaaataaagaggtt

SEQ ID NO: 30591 - DNA, 50 bp, homo sapien
gctaatatgaaattttaaaacagtgmatcagtatctgctgactggaagtc

SEQ ID NO: 30592 - DNA, 50 bp, homo sapien
gaaaaccattcttggaatcaataacmaaactctctgaaagattactcaag

SEQ ID NO: 30593 - DNA, 50 bp, homo sapien
cttattaatggagtgtgtggtttgaytacctgaacgaccctactggcaga

SEQ ID NO: 30594 - DNA, 50 bp, homo sapien
aaaatccagataattgaggctaaaamattttctatggtaatttgtcagaa

SEQ ID NO: 30595 - DNA, 50 bp, homo sapien
tgaaaggccttgaatgtctaggtacrgcatttggacatcgtcctctgagt

SEQ ID NO: 30596 - DNA, 50 bp, homo sapien
tcaacgtgcctcctccttcttcatcratgctttatttaccattccttggt

SEQ ID NO: 30597 - DNA, 50 bp, homo sapien
ttaaaagtgtattagacattgcagawgagaatattggtgcatttgaagat

SEQ ID NO: 30598 - DNA, 50 bp, homo sapien
ctaatttgttgaaaatttttatcatsaaagtttgaaagtgtgctgaatat

SEQ ID NO: 30599 - DNA, 50 bp, homo sapien
atataataagcattttccttctcaaytatggttgccgtcacctaattcaa

SEQ ID NO: 30600 - DNA, 50 bp, homo sapien
aaaacacaataagagtatttaccacmggtctcctaggtatataaatagct

SEQ ID NO: 30601 - DNA, 50 bp, homo sapien
gtgtattgaaggaacaagtcatcccrcatatagtctcctattggagagtt

SEQ ID NO: 30602 - DNA, 50 bp, homo sapien
ggaagtgaaaagctgacggtttggaraaatttaacacaacatattgcgca

SEQ ID NO: 30603 - DNA, 50 bp, homo sapien
taagaatgagattttggaactgcccragtccatgtttcttgctatatggg

SEQ ID NO: 30604 - DNA, 50 bp, homo sapien
gccaaatgcgaggccgtgtagtgaartgggttccaatccagcctcagctg

SEQ ID NO: 30605 - DNA, 50 bp, homo sapien
tacattgcaatcacaatcaaaatcaragtgtcattttacagaaataggaa

SEQ ID NO: 30606 - DNA, 50 bp, homo sapien
acgtattctgaacttttaaattcackcattaattctaagtttagccatac

SEQ ID NO: 30607 - DNA, 50 bp, homo sapien
ggcaccagatatgggtaagctacaayattaggactgcaggtgccaagatc

SEQ ID NO: 30608 - DNA, 50 bp, homo sapien
tgagtgaatttaaaagttcagaataygtactcgcttaggcagcacagata

SEQ ID NO: 30609 - DNA, 50 bp, homo sapien
gcagaggcgtgggtgaatcggcccayacgtactgcacagtgtgttgagtg

SEQ ID NO: 30610 - DNA, 50 bp, homo sapien
acatgacaaatttcttgtatgctgtsaacacgtagcccaggaaacttaca

SEQ ID NO: 30611 - DNA, 50 bp, homo sapien
atttgaatcagtctgaacttgcctcrgaactcaaaatagtagggttcatg

SEQ ID NO: 30612 - DNA, 50 bp, homo sapien
cttataaggaggacattaaactgtayaaataggcaagcaaaggtcataat

SEQ ID NO: 30613 - DNA, 50 bp, homo sapien
gtaaagattattttgtgcttttgaamggacattaatcccaaaggaagaac

SEQ ID NO: 30614 - DNA, 50 bp, homo sapien
gacctggtaaatctacctgagattcsctcatgattccaatgtgactgaat

SEQ ID NO: 30615 - DNA, 50 bp, homo sapien
agatcctgaagcatgtctctgaagamctataataggagatgaaacatgac

SEQ ID NO: 30616 - DNA, 50 bp, homo sapien
catacacatgcagttaatgtttacartgaatgccatagaatacaaaattt

SEQ ID NO: 30617 - DNA, 50 bp, homo sapien
agaagtaccagtaaggcagcctctamaactggagttagactaagaaatcg

SEQ ID NO: 30618 - DNA, 50 bp, homo sapien
atggaaggtggatgtagaaggaaaayttgtcttcaccagttcattttaac

SEQ ID NO: 30619 - DNA, 50 bp, homo sapien
ttcaatttccgtaaagcctaaataakagagcctgtacgctgtgaaagcca

SEQ ID NO: 30620 - DNA, 50 bp, homo sapien
atatctctctcactttaataaaatamgtttttggcaaatagttgaaatga

SEQ ID NO: 30621 - DNA, 50 bp, homo sapien
gctggggaggaatatcagacataacrccggatataacaaatttcaaagct

SEQ ID NO: 30622 - DNA, 50 bp, homo sapien
agatttggaaaaatacacttgtatakgagtacactcagcctttatagttc

SEQ ID NO: 30623 - DNA, 50 bp, homo sapien
caattactctatgaaaatttccaaayctctgttctgaatgagtcaaggca

SEQ ID NO: 30624 - DNA, 50 bp, homo sapien
ttatattattatacatgagatacaaygattataggtctctgaataggttt

SEQ ID NO: 30625 - DNA, 50 bp, homo sapien
cctaaactttgacgtgagatacatayccaaaggacaggttggggcttttc

SEQ ID NO: 30626 - DNA, 50 bp, homo sapien
agagaaacgtccaagcaattgctgawcggaaatttacctttttctcttac

SEQ ID NO: 30627 - DNA, 50 bp, homo sapien
caagtctcagactaaattttgccacrgataagaacattagcaagcaggca

SEQ ID NO: 30628 - DNA, 50 bp, homo sapien
agtaactagctgatactagagccaaytctttcagcgagaattatgttcca

SEQ ID NO: 30629 - DNA, 50 bp, homo sapien
tactaactctctcttgccacatggarctcaatatttagctatatttaaag

SEQ ID NO: 30630 - DNA, 50 bp, homo sapien
gcatgaataaattaccaagggaataycagaaagtacaacgtattccttga

SEQ ID NO: 30631 - DNA, 50 bp, homo sapien
ttcaatcatcattctaaataacctgyagtgactccaattccaaaccaacc

SEQ ID NO: 30632 - DNA, 50 bp, homo sapien
agccctgcttcttcattcttgggaargtttgctcttacagtataacacga

SEQ ID NO: 30633 - DNA, 50 bp, homo sapien
tgaatgaataagtgaatgtatgactsactgccaaggccatttcagggtgc

SEQ ID NO: 30634 - DNA, 50 bp, homo sapien
ttttgtaaattgtattttcctagaasatcaagtctaagtgtggtcctagg

SEQ ID NO: 30635 - DNA, 50 bp, homo sapien
gtgaatctgcatctgccagtgatacrcagtgggtagcaagtcatttaact

SEQ ID NO: 30636 - DNA, 50 bp, homo sapien
gccttctctcagatattatttaaackgccagcctcagatacctctaatct

SEQ ID NO: 30637 - DNA, 50 bp, homo sapien
gatgtggcagcttacttcttcaaggsagcaatgtaaagagtctttctaat

SEQ ID NO: 30638 - DNA, 50 bp, homo sapien
gcagtttaaataatatctgagagaargcattcagtatatctagcatacag

SEQ ID NO: 30639 - DNA, 50 bp, homo sapien
gtttatgaggtgcaaatttgatttcyaatccagcctacatttacttcatg

SEQ ID NO: 30640 - DNA, 50 bp, homo sapien
aaacgaagacacaacaggctaaaaayttatggaatgtgggagcttccaag

SEQ ID NO: 30641 - DNA, 50 bp, homo sapien
attatctgtacttctggtcacactgkagacttttcagggaattgactggg

SEQ ID NO: 30642 - DNA, 50 bp, homo sapien
ttacctatggtatgtgcagtctttawctctatcatctttctctatcatca

SEQ ID NO: 30643 - DNA, 50 bp, homo sapien
gccacaccagcaagaggagggcatgmaactttccagaattttagttcact

SEQ ID NO: 30644 - DNA, 50 bp, homo sapien
gtagttttcaatgcttcttcattatraaacatcatagcaaaatagcagta

SEQ ID NO: 30645 - DNA, 50 bp, homo sapien
caacgtattccttgagtgggaaaagkataaagattagagttaacttcaca

SEQ ID NO: 30646 - DNA, 50 bp, homo sapien
cctcagaattcagaaaccagtcaccyattgttgtatgtcgtgtttgccag

SEQ ID NO: 30647 - DNA, 50 bp, homo sapien
ctaatctagttgaacatcactaatcragaatatttctggaacccatgttc

SEQ ID NO: 30648 - DNA, 50 bp, homo sapien
tcttctgtattccataatatatgacrgtagtaacaggattttaaataatt

SEQ ID NO: 30649 - DNA, 50 bp, homo sapien
ccaaaaagtctgatttaagaaattcrgaaacacagggttattacctactc

SEQ ID NO: 30650 - DNA, 50 bp, homo sapien
ttggtaactccattctcacaacaacscaagatgtccatattctgaagaag

SEQ ID NO: 30651 - DNA, 50 bp, homo sapien
gcactgggactatggtacagaaataraacagatgcacaaagaataactaa

SEQ ID NO: 30652 - DNA, 50 bp, homo sapien
tgccaagaccccagatgtgggtgagrccatattaaaacctccatctccag

SEQ ID NO: 30653 - DNA, 50 bp, homo sapien
actgcagcagccaacctgtgttcatsagaaaccttggaaatggatgctgc

SEQ ID NO: 30654 - DNA, 50 bp, homo sapien
aggatggtgacaacttccagagttayctcccaatcagcaaactggcttct

SEQ ID NO: 30655 - DNA, 50 bp, homo sapien
gtagggaagcataaagctactttgamgttatagatgttaaaaatgcagtt

SEQ ID NO: 30656 - DNA, 50 bp, homo sapien
tctttcatgttatgaccgaatcgtaycatttattcaccgaattttaactt

SEQ ID NO: 30657 - DNA, 50 bp, homo sapien
ctgaacatgccagttccatgcatcartaaagtctccttatgaatgaaaaa

SEQ ID NO: 30658 - DNA, 50 bp, homo sapien
aagttcaaggtttcagctatggtcaygcggatcatatcagacttgaagtg

SEQ ID NO: 30659 - DNA, 50 bp, homo sapien
ctgtgcacttagattttaagcagtastaactatccagattatttgacata

SEQ ID NO: 30660 - DNA, 50 bp, homo sapien
gtggtacccagctctcagttgagaargagatgtaatgtgaatgccactct

SEQ ID NO: 30661 - DNA, 50 bp, homo sapien
ggaaatgatcttttgtacagcatcaygagataactatacaaatgaactct

SEQ ID NO: 30662 - DNA, 50 bp, homo sapien
agagctcagttacactgtcttcaackctgcaacacctccccaggcattca

SEQ ID NO: 30663 - DNA, 50 bp, homo sapien
catttccaccgaatgtagcatgaaasggctctgctctacgtgccagcctt

SEQ ID NO: 30664 - DNA, 50 bp, homo sapien
tgaaatatcatcagaataagttgtcrcatcactgattcttcactaaaaca

SEQ ID NO: 30665 - DNA, 50 bp, homo sapien
agaagttgaagagccaaatccctcarcaaacaatcctttgagactattta

SEQ ID NO: 30666 - DNA, 50 bp, homo sapien
ttccaggtgaaaattctgaggtccaragtctgatgcatgacagaactcac

SEQ ID NO: 30667 - DNA, 50 bp, homo sapien
tgtgtgaacaaaggtaggtcgataayaagaggttatgcagattcaaccag

SEQ ID NO: 30668 - DNA, 50 bp, homo sapien
cccctgcagcgtattgaagactccayggtggttgttttgttttgttttga

SEQ ID NO: 30669 - DNA, 50 bp, homo sapien
tcttttttccctgcttcatttaatcraatcatacattgacagaaaatatt

SEQ ID NO: 30670 - DNA, 50 bp, homo sapien
tgagttgagcttgtaacccggtagaragaatcatagccttgactggggag

SEQ ID NO: 30671 - DNA, 50 bp, homo sapien
gatgatttgcaggtctctatgtctayggttcccttgcatcctactcacaa

SEQ ID NO: 30672 - DNA, 50 bp, homo sapien
ttatgagttcccttgtatatatgcamgaattcctccaggtaagatatgta

SEQ ID NO: 30673 - DNA, 50 bp, homo sapien
cctttattaaaaatttatgccttggyaggtactgtctaccctctagaaat

SEQ ID NO: 30674 - DNA, 50 bp, homo sapien
gacctttctgagctcaaacctttagratgacagatagacaaagactgaag

SEQ ID NO: 30675 - DNA, 50 bp, homo sapien
attcctatcctgtctgagcacctacraaccttggtttcagcattactact

SEQ ID NO: 30676 - DNA, 50 bp, homo sapien
tgcaggaaggaaaagtttccaagaartactggcctaaggagagatttctg

SEQ ID NO: 30677 - DNA, 50 bp, homo sapien
ccaatgtgttgaaaactctgacaacmatcttatgacatgggaattacttt

SEQ ID NO: 30678 - DNA, 50 bp, homo sapien
ccttagttttgttttctatcataaamaagtgttaaatttgcaatcagaga

SEQ ID NO: 30679 - DNA, 50 bp, homo sapien
ccacacagaagtagctgctttagaamgtatagtatctgttcatacagcat

SEQ ID NO: 30680 - DNA, 50 bp, homo sapien
aataaaagtattaatatgattcctasatcaatgagctaatcattagaagt

SEQ ID NO: 30681 - DNA, 50 bp, homo sapien
ctgaatatacctctactctgtgattyaacaattccacttctgaatatata

SEQ ID NO: 30682 - DNA, 50 bp, homo sapien
tgtggattgtgtgtctctgcccactsaagcagggaatttggttttgtcca

SEQ ID NO: 30683 - DNA, 50 bp, homo sapien
ctcttccctcttctaccgctttcctsaagctgcgtgcctggtgaaagcag

SEQ ID NO: 30684 - DNA, 50 bp, homo sapien
acttctccactagattggaactttcyaaaggcatcatcagtgtctggcac

SEQ ID NO: 30685 - DNA, 50 bp, homo sapien
agacagagggggacattttctgacasagcgttcaaggccagcagcagctc

SEQ ID NO: 30686 - DNA, 50 bp, homo sapien
gtaatagcgtttgtaaaatttgtcargtaggtcaagggcatagttcttca

SEQ ID NO: 30687 - DNA, 50 bp, homo sapien
cttcagaagcagagaatactaacagraattcaatttgagttgaacagtag

SEQ ID NO: 30688 - DNA, 50 bp, homo sapien
ggctgtctctggaacttgatctcaamgtatttttcatattgatttgtcat

SEQ ID NO: 30689 - DNA, 50 bp, homo sapien
acccaggaagttatgatttgaattayggagtttgcctcatgtaatccagt

SEQ ID NO: 30690 - DNA, 50 bp, homo sapien
gctgtatgttactaattctctgaaaygtattgagacgattttattgacta

SEQ ID NO: 30691 - DNA, 50 bp, homo sapien
catttcaattttttattcttataaasgatgctgtgataaaccacctgata

SEQ ID NO: 30692 - DNA, 50 bp, homo sapien
aatcataggtcttgggcctttaggarctcacatttttaacagagaaacag

SEQ ID NO: 30693 - DNA, 50 bp, homo sapien
attagagattagcacagaatgaaaaytaacttgaatcacataaccatccc

SEQ ID NO: 30694 - DNA, 50 bp, homo sapien
ttcacagactgagagctcacttagasataactggattccttataggatta

SEQ ID NO: 30695 - DNA, 50 bp, homo sapien
tcttatggcagtgacataagtgctaygatgcagacatacctaagactaca

SEQ ID NO: 30696 - DNA, 50 bp, homo sapien
tgacaagttgatctttgaacataatyagagtgaacatttctaattcttcc

SEQ ID NO: 30697 - DNA, 50 bp, homo sapien
tcaagcaatggggagccattgattakcctttttagcaggggaatgacata

SEQ ID NO: 30698 - DNA, 50 bp, homo sapien
cactcgttgggatcttgttacgtaaragttaaatcacaacatcgtattgg

SEQ ID NO: 30699 - DNA, 50 bp, homo sapien
ttgaattaaaaattgattgacagaastaaccaataagtcatttttttctt

SEQ ID NO: 30700 - DNA, 50 bp, homo sapien
gggtctctttttataccaggaggaaraaaattgtatgcatttattgagca

SEQ ID NO: 30701 - DNA, 50 bp, homo sapien
caaataacttttgtaattggattcamcttaggctaattgttagaattcat

SEQ ID NO: 30702 - DNA, 50 bp, homo sapien
ctgaaaaattgttagaactgtttggraaataatacgatacaattctggaa

SEQ ID NO: 30703 - DNA, 50 bp, homo sapien
ttaaaaattccacttctttgagatamgcatcgacttcaagtgttttaggg

SEQ ID NO: 30704 - DNA, 50 bp, homo sapien
cagataatttagacccattaattacyaactacaccaactttactactatt

SEQ ID NO: 30705 - DNA, 50 bp, homo sapien
gagctggttcttctcactccagagarcgcgagagaagagagacgtaggga

SEQ ID NO: 30706 - DNA, 50 bp, homo sapien
aaattctgaccattttataacaatcraaagagctccactgattaaagtaa

SEQ ID NO: 30707 - DNA, 50 bp, homo sapien
aactctgggagattctcctattgacscagaaagcgattccttcactgata

SEQ ID NO: 30708 - DNA, 50 bp, homo sapien
atctaattgaaaaagcatattaacaytaaacttagaacacctgacttact

SEQ ID NO: 30709 - DNA, 50 bp, homo sapien
cctattttgtaacttgttttaatcaygtccttactcatattggagttata

SEQ ID NO: 30710 - DNA, 50 bp, homo sapien
cttcaaacacttgccaaagcctgcawtaaacaattacccataatttggca

SEQ ID NO: 30711 - DNA, 50 bp, homo sapien
ataatctcatggcatcagttattgarctcatcacaaattgttttaagaca

SEQ ID NO: 30712 - DNA, 50 bp, homo sapien
tggaccaagaattacttcttcagggraatctttatcctaactgagagaac

SEQ ID NO: 30713 - DNA, 50 bp, homo sapien
ctcagagtcctcttctggtcagatcyaaaccaagtaagccttcactcctg

SEQ ID NO: 30714 - DNA, 50 bp, homo sapien
ctattaaaaaaaaaaaagatggtaastagccattcctgagctctactgag

SEQ ID NO: 30715 - DNA, 50 bp, homo sapien
atttcgataagcttgacttaaaaaawatgacctatacaggaaaattaagt

SEQ ID NO: 30716 - DNA, 50 bp, homo sapien
tcactctttggttcaagttatccacrgactatacctccttttttctgcag

SEQ ID NO: 30717 - DNA, 50 bp, homo sapien
aattattattatttttttctcatcamgggttagttatctggcaatggatt

SEQ ID NO: 30718 - DNA, 50 bp, homo sapien
caaggatgggaggccagaatttaccyagcaaagagtcagtgttctatcca

SEQ ID NO: 30719 - DNA, 50 bp, homo sapien
aaaagcctctccaggtggatctggaytattcttgccaaagcagaagatgg

SEQ ID NO: 30720 - DNA, 50 bp, homo sapien
atggtttttattacagttacaatcakacaaacacttgatgacagtgcccc

SEQ ID NO: 30721 - DNA, 50 bp, homo sapien
aggtcaaagatcctaagcatcagttyaaatttgttggtgcttataaggaa

SEQ ID NO: 30722 - DNA, 50 bp, homo sapien
ttgcagtagaaatgggatcatgtacrataaattttaatatgacatagctg

SEQ ID NO: 30723 - DNA, 50 bp, homo sapien
ctacaataaaacacttggaaagctcygagcccatggcaatactggcagtg

SEQ ID NO: 30724 - DNA, 50 bp, homo sapien
ctttctgtatcaagtttgggagaaaygcatatataattccaaaccttaaa

SEQ ID NO: 30725 - DNA, 50 bp, homo sapien
tttattaagaacttttagcctttagraacatgcttttatacctactgcca

SEQ ID NO: 30726 - DNA, 50 bp, homo sapien
gattctgttaattgaattcattttakagccaacttttcaggaacctatct

SEQ ID NO: 30727 - DNA, 50 bp, homo sapien
atttgaccaataccttctagtttaasaatgtttcacatcgatcttcccac

SEQ ID NO: 30728 - DNA, 50 bp, homo sapien
cccagttatgagaagagagagcttasccaatatgcgcaataatcaggcac

SEQ ID NO: 30729 - DNA, 50 bp, homo sapien
gtgggtaaatccctctgcgggccagyaggttttactctgttctggaatat

SEQ ID NO: 30730 - DNA, 50 bp, homo sapien
ccaatggaattttaaaatgatggacycaactctaagaagttgtctcactg

SEQ ID NO: 30731 - DNA, 50 bp, homo sapien
actggagttgctgacccacaagaacrcagggaatgaaaggcaagaagcaa

SEQ ID NO: 30732 - DNA, 50 bp, homo sapien
ctgtgtgtgtgtccactttcagctcyacaacactggacttgggctctgtg

SEQ ID NO: 30733 - DNA, 50 bp, homo sapien
gctgcccccaaagagtttaaggaaaygattattgctgtgtctccccaaaa

SEQ ID NO: 30734 - DNA, 50 bp, homo sapien
agagattctcgaactgtctgcccaamtcgacttgggttaggcaaaaggtt

SEQ ID NO: 30735 - DNA, 50 bp, homo sapien
gtgagatgctattccacatattgcaratacaacagtgaataacatagatt

SEQ ID NO: 30736 - DNA, 50 bp, homo sapien
cacttcttcaaagtcagccttagcamctacctgactttgcacagacaact

SEQ ID NO: 30737 - DNA, 50 bp, homo sapien
ttgtctggtgaatgaatagcagttayaatggtaattaggtcttcagtcat

SEQ ID NO: 30738 - DNA, 50 bp, homo sapien
tgatgcatactccaggcctgaaccaytgatcaatttgaaacatgcataac

SEQ ID NO: 30739 - DNA, 50 bp, homo sapien
atatctacaactactgcttaatcaamacttttcattgattcaacattatc

SEQ ID NO: 30740 - DNA, 50 bp, homo sapien
tttatgaaaccctatatagtctgacmcttggttagcataaaagtgacctc

SEQ ID NO: 30741 - DNA, 50 bp, homo sapien
gagtctggagcttgtaatatgcagaygaaaatgatttaacagagaaggag

SEQ ID NO: 30742 - DNA, 50 bp, homo sapien
tatacaatgcatcctggaataaacamtgatgtaaatatacatctattgac

SEQ ID NO: 30743 - DNA, 50 bp, homo sapien
ttgacatgactctgggtatgtgtatkaaattttatgagctgaaccaaggg

SEQ ID NO: 30744 - DNA, 50 bp, homo sapien
taacacactccaacttcttgtttccyatcctgagagtctgttatcaaaca

SEQ ID NO: 30745 - DNA, 50 bp, homo sapien
gacatgttgtgtgggacaaattgaawtgacatgatcaaaaacctttcata

SEQ ID NO: 30746 - DNA, 50 bp, homo sapien
tctcctgaaaatctcttactgatgasctatggattttttatgaaacctcc

SEQ ID NO: 30747 - DNA, 50 bp, homo sapien
ttggctgtccttcgttcactctgcakgtcaggctggctgtcccttcctcc

SEQ ID NO: 30748 - DNA, 50 bp, homo sapien
ttatcctgtcttccagagaaacttayggagataagaaacttatgcccacg

SEQ ID NO: 30749 - DNA, 50 bp, homo sapien
attaacaagttaatacaggtataacrcaagtaaatggacaacacaaatga

SEQ ID NO: 30750 - DNA, 50 bp, homo sapien
gtgtttctctcatgtcaaggtcttaygaaagagttaattatctatattga

SEQ ID NO: 30751 - DNA, 50 bp, homo sapien
gagtcacagttctctgcttcttggamcataaagaagtgctgagtgttgaa

SEQ ID NO: 30752 - DNA, 50 bp, homo sapien
agaagtcctacagggctgattgtaartgtaccttctgctttcttttaggg

SEQ ID NO: 30753 - DNA, 50 bp, homo sapien
gcacatctgtagtcccagctagtcaktaggccgaggcaggagaactgagg

SEQ ID NO: 30754 - DNA, 50 bp, homo sapien
ctagaaacatgttggaatttctggartacctgttcttgtaatctctaact

SEQ ID NO: 30755 - DNA, 50 bp, homo sapien
aacactaagagtagtgacgtagatarctttgagtctcaagatctatagcc

SEQ ID NO: 30756 - DNA, 50 bp, homo sapien
tcattttctttttctgtcttattgcrctggctagaatttccaacactaag

SEQ ID NO: 30757 - DNA, 50 bp, homo sapien
aaatgattttcattggtttataatgyattcctatagaaatcactttgata

SEQ ID NO: 30758 - DNA, 50 bp, homo sapien
tattctaacaaaactggaatagtaakctagcctggtctaatatgtaataa

SEQ ID NO: 30759 - DNA, 50 bp, homo sapien
atggtctaatatgtagaaaaccataygtacttcacaccaaagaaaactgt

SEQ ID NO: 30760 - DNA, 50 bp, homo sapien
caagagataatccacagacctaaaargtggaagtcaaactagacgagcag

SEQ ID NO: 30761 - DNA, 50 bp, homo sapien
aaatgccaggaatcaagtcgccttamaaaatgatcctcacactcaaagag

SEQ ID NO: 30762 - DNA, 50 bp, homo sapien
atcaaattttctcaggcaactaacaygaaaatggacaaatgggattacct

SEQ ID NO: 30763 - DNA, 50 bp, homo sapien
taactccctgcttactaagcatacaygagggatcttaaggaaaccagcac

SEQ ID NO: 30764 - DNA, 50 bp, homo sapien
gggatggaaaatagattttgagtcarccagtatatagtttctgccacaaa

SEQ ID NO: 30765 - DNA, 50 bp, homo sapien
tcgtttatatataaataatatggaarattacaaagaaatttgtggcagaa

SEQ ID NO: 30766 - DNA, 50 bp, homo sapien
tcaagcttatgactttgggtgtcaayttaagggaaatgatgtagaagacc

SEQ ID NO: 30767 - DNA, 50 bp, homo sapien
tgactagagatgccctgtagaaggtkaatcctgaatcattttgagcaagt

SEQ ID NO: 30768 - DNA, 50 bp, homo sapien
ttttttgctgtttattatgcaaagaygagtattcgtttccttcacttcaa

SEQ ID NO: 30769 - DNA, 50 bp, homo sapien
ggcctgaaaagaaagaaaatagcaaygctttgagtgtctattatgttcta

SEQ ID NO: 30770 - DNA, 50 bp, homo sapien
atctggccagtgtagcataacatgcrctacaactcagcaagcagaacctg

SEQ ID NO: 30771 - DNA, 50 bp, homo sapien
ggattttcttacatttaaagcagaaygacactactgatacacaaaagtaa

SEQ ID NO: 30772 - DNA, 50 bp, homo sapien
tttccttcagttgtagtttagccagracctcatggtgggtcactttagcc

SEQ ID NO: 30773 - DNA, 50 bp, homo sapien
gctataatgagaataataaagtatawggtgatgactgtttacttaccatt

SEQ ID NO: 30774 - DNA, 50 bp, homo sapien
ttttgggatcagatggccttaaattsaaaacctggatctaccagtgacta

SEQ ID NO: 30775 - DNA, 50 bp, homo sapien
tcctagtgattccagggcaaatagaytctacttgtgccatttcagaaaaa

SEQ ID NO: 30776 - DNA, 50 bp, homo sapien
aaacttaattgctaattctttcaaakgtatctggccctgtttggtgcaaa

SEQ ID NO: 30777 - DNA, 50 bp, homo sapien
ataaagcttcaaggagttgtttggaraagaaacaccataaattggtttta

SEQ ID NO: 30778 - DNA, 32 bp, homo sapien
gcaaatctatcataaartgtcaaaactagaag

SEQ ID NO: 30779 - DNA, 50 bp, homo sapien
ttaaaaggaaataaaaagtctgaaarcgatgtaccaaaaatctatcaaac

SEQ ID NO: 30780 - DNA, 50 bp, homo sapien
aaactggtcttttctcttggtagaartgaagtaaggcagaaataaaaatg

SEQ ID NO: 30781 - DNA, 50 bp, homo sapien
gcacatctgtggctacagccgttccrcatggagtgtcctcttttctgcct

SEQ ID NO: 30782 - DNA, 50 bp, homo sapien
tcttgtacaggatgcaaactaaaaayctaatccctgccatcaaatttatt

SEQ ID NO: 30783 - DNA, 50 bp, homo sapien
acaagtagtaagactcaggcacaaamttcctacttccccacccccagcca

SEQ ID NO: 30784 - DNA, 50 bp, homo sapien
tatgtaaagaggccaaatctatgaaycattgatatccctgaaagggaggg

SEQ ID NO: 30785 - DNA, 50 bp, homo sapien
ctgcagggaagtgagtctgtcttaaygtgtgccaaggcactgggcagcaa

SEQ ID NO: 30786 - DNA, 50 bp, homo sapien
tgctttttggctaatatattgcgtasagctttcacacagtttttcaactg

SEQ ID NO: 30787 - DNA, 50 bp, homo sapien
actaactcccacaaagcaaggtcacragagatcaatgtacaaatgaagca

SEQ ID NO: 30788 - DNA, 50 bp, homo sapien
gagctgaaggacaaaatagctagtawaaaaaagaagctagtgggtctgac

SEQ ID NO: 30789 - DNA, 50 bp, homo sapien
tctgggaatcagttagtaccacaaakcatgacttacattcatgcagcaga

SEQ ID NO: 30790 - DNA, 50 bp, homo sapien
ctgttaaagggcacatagccagtaayggtcagaattagaagcagcccagt

SEQ ID NO: 30791 - DNA, 50 bp, homo sapien
tatgtatattattcagtcaattaccyaacaatttaaaacatagtaagtgc

SEQ ID NO: 30792 - DNA, 50 bp, homo sapien
taactatttttatttctttttattayggtacacaattgtctaatgtggtt

SEQ ID NO: 30793 - DNA, 50 bp, homo sapien
ctcattaattctaagtttagccatasattcttttggattttctatataca

SEQ ID NO: 30794 - DNA, 50 bp, homo sapien
tgtagaggtctttggccagctgtgcrctacaattaaacccagctcccctt

SEQ ID NO: 30795 - DNA, 50 bp, homo sapien
atttgatggattacaagcaaagatayggttggaagatgcataattacata

SEQ ID NO: 30796 - DNA, 50 bp, homo sapien
tagatttcaataaacctggatgtcartcttacagctataacatataggat

SEQ ID NO: 30797 - DNA, 50 bp, homo sapien
taaagtcaggattttgttttagaagyatgcagaaagctatgtcactatat

SEQ ID NO: 30798 - DNA, 50 bp, homo sapien
tcaaccacagtaagtctaactgttgsaccaattttggaggaaaaaagagt

SEQ ID NO: 30799 - DNA, 50 bp, homo sapien
cacaaaattatttattggtggaagasagaacattggtattttggaaacat

SEQ ID NO: 30800 - DNA, 50 bp, homo sapien
tagttttaaattaaataggttgatamgcaactagcagaatagaaaaggga

SEQ ID NO: 30801 - DNA, 50 bp, homo sapien
tttttaagcacaagaaaatggaacaygatgagccctctgtttaaaaatta

SEQ ID NO: 30802 - DNA, 50 bp, homo sapien
ggcacttgttaaaaagtaagtactaratcaatgtttgctgtctatctgtt

SEQ ID NO: 30803 - DNA, 50 bp, homo sapien
gactgctctcaggcagaatgaaacaygatggcacctgccactcacgacca

SEQ ID NO: 30804 - DNA, 50 bp, homo sapien
aatctgcttctataattagagtaccraaacaagaggcattaatacctcca

SEQ ID NO: 30805 - DNA, 50 bp, homo sapien
atagggtcttagcttttaacttctaygcatgatcattaagaataaaagct

SEQ ID NO: 30806 - DNA, 50 bp, homo sapien
ttcattgtctcctacggctccaacawtgagacaaaaagtcatgtgtatgt

SEQ ID NO: 30807 - DNA, 50 bp, homo sapien
ttcatgatgccctgacctcccagcakaaagtatctgtaaacaaacttttt

SEQ ID NO: 30808 - DNA, 50 bp, homo sapien
caggatcacactggtgccactttaamtggaaagttttgagggattgtgaa

SEQ ID NO: 30809 - DNA, 50 bp, homo sapien
cataactcactcagaatctcattcartataaaatgcaagggactaatgtc

SEQ ID NO: 30810 - DNA, 50 bp, homo sapien
atgtatatgggctgaggactctaaargtgaagtagcaggattttctttgg

SEQ ID NO: 30811 - DNA, 50 bp, homo sapien
gggtctagaaggaaaaggtctgaaaragcagaacagtatctttagtagag

SEQ ID NO: 30812 - DNA, 50 bp, homo sapien
atctatctatacctatgaagatgaaycacaggtacttttgaggtaggttg

SEQ ID NO: 30813 - DNA, 50 bp, homo sapien
tctaagagctgtttaaatagagtgaytacatttcaggaatgcctgatgaa

SEQ ID NO: 30814 - DNA, 50 bp, homo sapien
atatcaaaatatcattaaaaaataaygtcagaagcaacctcatgtgtaat

SEQ ID NO: 30815 - DNA, 50 bp, homo sapien
gactaaaaaataagtcatactttaarcagattagttaggacagtgctatc

SEQ ID NO: 30816 - DNA, 50 bp, homo sapien
taggttaatactcccagaagtgatayagtaaatgctaatacaatgtttat

SEQ ID NO: 30817 - DNA, 50 bp, homo sapien
tgtttctggattgctggtgttcaacrggcatcttgtatataacgcatggc

SEQ ID NO: 30818 - DNA, 50 bp, homo sapien
tactacaaagacagttttgtaaaccratgtgttctggtgtcacactttac

SEQ ID NO: 30819 - DNA, 50 bp, homo sapien
agattttttgctcttttgatttaaaktgcagaggatgtctcgcaggggaa

SEQ ID NO: 30820 - DNA, 50 bp, homo sapien
ttaatttacaaccattatgtcaaaamgccttgaaatatgaaagcttttaa

SEQ ID NO: 30821 - DNA, 50 bp, homo sapien
caagctttgctcatcttcctgctgcratactggctcctatagaaggccgg

SEQ ID NO: 30822 - DNA, 50 bp, homo sapien
gtagtgtaattaccgttattacccartaggaacagaagtttacctaccct

SEQ ID NO: 30823 - DNA, 50 bp, homo sapien
agccttcatcacacctatttattaakgccaaggattcatactctgattca

SEQ ID NO: 30824 - DNA, 50 bp, homo sapien
aatagggataattccagtttttgtaygtcagcagctgggtggaaggtcat

SEQ ID NO: 30825 - DNA, 50 bp, homo sapien
tgctgaagggggactaggggtaaaasatggaataagctaaagaacaacag

SEQ ID NO: 30826 - DNA, 50 bp, homo sapien
tgaaaaagttttaataatacactcarctatggtagtcaatgtcctataga

SEQ ID NO: 30827 - DNA, 50 bp, homo sapien
tcaaataattcagctttatctgcaastattctagagtcttttggtgttca

SEQ ID NO: 30828 - DNA, 50 bp, homo sapien
gcacataaatccagagtattgctgcmcttatctttgctgctagcattaaa

SEQ ID NO: 30829 - DNA, 50 bp, homo sapien
acgctgatgctacttacccagatacygtacttgaagaatcactgtgttag

SEQ ID NO: 30830 - DNA, 50 bp, homo sapien
agaaaacaattggtcattcctaccastcaaagatcccacccacatctgtt

SEQ ID NO: 30831 - DNA, 50 bp, homo sapien
aatcatgcttatttgagtcactaggkaaattgtatcttatacattctaca

SEQ ID NO: 30832 - DNA, 50 bp, homo sapien
cactgttccccataggtcttaaatartatgaaagaaacaatggacaaatg

SEQ ID NO: 30833 - DNA, 50 bp, homo sapien
gctattctctacatcctatgtttccmagaggacagtgtttagagatctct

SEQ ID NO: 30834 - DNA, 50 bp, homo sapien
caaagtgagacttgctgtactaggarcgaaaacacactatgaaaccacat

SEQ ID NO: 30835 - DNA, 50 bp, homo sapien
atcttgcatacatgaatattcttgcraagtgaaaaaaacctaatctacaa

SEQ ID NO: 30836 - DNA, 50 bp, homo sapien
gttatttgtgatactttaagtgcaakgacatttatgtaactgtattatta

SEQ ID NO: 30837 - DNA, 50 bp, homo sapien
tacattatctctcaagcaaggtgacrcttttttcaaggttaattatttat

SEQ ID NO: 30838 - DNA, 50 bp, homo sapien
cacatatttatctgttgagtatcccrgaaaacaatctgaaattttacata

SEQ ID NO: 30839 - DNA, 50 bp, homo sapien
tttgtaatgaaaaaatatacttgtasatggatctgttaagagagaaaaaa

SEQ ID NO: 30840 - DNA, 50 bp, homo sapien
aaatgtgttagctctagtacttaaaygttggtttcaaatgccattctgta

SEQ ID NO: 30841 - DNA, 50 bp, homo sapien
cgcaaaacctacaatctctgaatctsagaatagtagcctagaaaacgtgg

SEQ ID NO: 30842 - DNA, 50 bp, homo sapien
aacaatttaaaaattccacctgatcrcctaacttttccttcagtcaagga

SEQ ID NO: 30843 - DNA, 50 bp, homo sapien
aaaacatgtgaacatttaactacacragaaagcacacaaaaataaatgct

SEQ ID NO: 30844 - DNA, 50 bp, homo sapien
tcaaaaataataacaatttgagaacygattccattacatttatactatga

SEQ ID NO: 30845 - DNA, 50 bp, homo sapien
aaataaaaacagcagcaaaagaaatsatctagtgaaactttggaactgag

SEQ ID NO: 30846 - DNA, 50 bp, homo sapien
gtttgaacttccaactgtttattaartctatcacctatcaatcatgtatg

SEQ ID NO: 30847 - DNA, 50 bp, homo sapien
gctgcatcctgaatgttgactagcaygagagttaaaattcctgggggaag

SEQ ID NO: 30848 - DNA, 50 bp, homo sapien
tcaacagatgtcaaattaaacaaaaygaagcacaacaaaatgcttatcta

SEQ ID NO: 30849 - DNA, 50 bp, homo sapien
aatctctggcgcatagtaggtttacmaatggagggctataccattaattc

SEQ ID NO: 30850 - DNA, 50 bp, homo sapien
ttatggtataaatagtgtctgtaacrgatgcttaaggcataattaaatac

SEQ ID NO: 30851 - DNA, 50 bp, homo sapien
ataaaataaaatagcaaatattcaaracactttcaccagtgttatctcat

SEQ ID NO: 30852 - DNA, 50 bp, homo sapien
ctctactcagtgagttactgttgtcrcactttccattaacttataaatat

SEQ ID NO: 30853 - DNA, 50 bp, homo sapien
ctactatgcgccagagattgcaccaratgctgggaatacagtggcatcca

SEQ ID NO: 30854 - DNA, 50 bp, homo sapien
tgtgtgtgtgtgtgtgtttaattcakagcaacctgttacattctttctat

SEQ ID NO: 30855 - DNA, 50 bp, homo sapien
caggtgtgagccaccaagccaggccractgcttaacatttagaatgtatg

SEQ ID NO: 30856 - DNA, 50 bp, homo sapien
aatagaacatatggatagacatatargtaaaaagattgaattagaaatca

SEQ ID NO: 30857 - DNA, 50 bp, homo sapien
cacatgagatttagagcagacaaaayatccaaaccataccatctaggaat

SEQ ID NO: 30858 - DNA, 50 bp, homo sapien
cagacacagtattcaggacttatgayctttctaaggacctgcaaaaaaaa

SEQ ID NO: 30859 - DNA, 50 bp, homo sapien
tgtactaaacaacaacaacctacgarctttattatttttcttcccagcaa

SEQ ID NO: 30860 - DNA, 50 bp, homo sapien
attcagagtcacaatctaacttgcayctcattaaaacttaaatcattcac

SEQ ID NO: 30861 - DNA, 50 bp, homo sapien
gtgacttgcaacgtacatgtgtttcwcctttatcttctctaagcgcaagg

SEQ ID NO: 30862 - DNA, 50 bp, homo sapien
aggttgtttaaatgacagcattctayagttgaagatgactagatgtagaa

SEQ ID NO: 30863 - DNA, 50 bp, homo sapien
gtacacaaataacttaaattgatgaygtaaaattgagaaaatatttttag

SEQ ID NO: 30864 - DNA, 50 bp, homo sapien
aaaactttgagtaggcatgagctgtraacatgtaatgacatggtggccct

SEQ ID NO: 30865 - DNA, 50 bp, homo sapien
cagtctcagctggtctggttacaaasggagctttttatcacaggtatctt

SEQ ID NO: 30866 - DNA, 50 bp, homo sapien
aaaaaaaaaagccacacagttttgawtaatgagcccagtaataaatcatt

SEQ ID NO: 30867 - DNA, 50 bp, homo sapien
tgtttttgtgtttactacaaatggarcatcattgtgaaaaggtatgacaa

SEQ ID NO: 30868 - DNA, 32 bp, homo sapien
gttttcaatttgctaartggatactaaaaatt

SEQ ID NO: 30869 - DNA, 50 bp, homo sapien
ctatttcaaagtgttcagtgcatcartatttttattcttttcatagattt

SEQ ID NO: 30870 - DNA, 50 bp, homo sapien
cagacacttgtgtttcatacctctayggtcgtggctttaatcagcatcac

SEQ ID NO: 30871 - DNA, 50 bp, homo sapien
gttcattaattttaatgctttctgasatttcatgacttactttcacaact

SEQ ID NO: 30872 - DNA, 50 bp, homo sapien
agctttgccttgtgtatttggaggartaggagattttcaggcagcagaga

SEQ ID NO: 30873 - DNA, 50 bp, homo sapien
attcttttctgctcctgaattttaaytgtgacttgcaacgtacatgtgtt

SEQ ID NO: 30874 - DNA, 50 bp, homo sapien
cttcgtgtgcttggaaaatgatcaayagaccaataccgtactgccaattc

SEQ ID NO: 30875 - DNA, 50 bp, homo sapien
aaaatacctaacaagcaaattgacaractatgaactaattctttcttttt

SEQ ID NO: 30876 - DNA, 50 bp, homo sapien
ttcttcttttagagacttatagtgcwcagcagcgccaaagagtcctgaga

SEQ ID NO: 30877 - DNA, 50 bp, homo sapien
catcattccagcacagtgagagaaaygttaaacttagcttattggtaaaa

SEQ ID NO: 30878 - DNA, 50 bp, homo sapien
tttgctgacctcagagagagtatgamccatcttagttttctaatatatct

SEQ ID NO: 30879 - DNA, 50 bp, homo sapien
gagccctttctccaggctaaataaawtcgatacaccattggtagaaatat

SEQ ID NO: 30880 - DNA, 50 bp, homo sapien
catatatcaacaggagacagcttcartagggacagtggtgatggaaatgg

SEQ ID NO: 30881 - DNA, 50 bp, homo sapien
ttctcacatccactccagcagatgcraaccttgggattagagttgggctg

SEQ ID NO: 30882 - DNA, 50 bp, homo sapien
gagccagttctaacttctaattacaygaggaaatgctgtttgaacataat

SEQ ID NO: 30883 - DNA, 50 bp, homo sapien
tttctctcttactagcagcctagcaraactgatttaaaatcatttctgaa

SEQ ID NO: 30884 - DNA, 50 bp, homo sapien
tgggtctgtaagctgtagtttagaaraaagcagtgtgatgatatgaacaa

SEQ ID NO: 30885 - DNA, 50 bp, homo sapien
aatcacaaattcctaatccctggaaragactaatcaatacaacacaatgt

SEQ ID NO: 30886 - DNA, 50 bp, homo sapien
agataaattaaagatccagttaaacrgaatgatatacccagagcttgttg

SEQ ID NO: 30887 - DNA, 50 bp, homo sapien
ttattaaatgcctgtaaggctgggasacttgtgttgactcctacacattt

SEQ ID NO: 30888 - DNA, 50 bp, homo sapien
tcttactctaaatatttgcagccackcttttgggactacctttaaggcca

SEQ ID NO: 30889 - DNA, 50 bp, homo sapien
ggtgattattatgctcgttgatttamaattaatcaactaagctttattgc

SEQ ID NO: 30890 - DNA, 50 bp, homo sapien
aaattctttactgctttaaaaacgayaaaataatgtgtctgaaaaatata

SEQ ID NO: 30891 - DNA, 50 bp, homo sapien
aactgagagctcagcccatatactasggttcttctgactttatttacagc

SEQ ID NO: 30892 - DNA, 50 bp, homo sapien
ttgggtaagacagaaaactagagtayagattggagactttgggacatgaa

SEQ ID NO: 30893 - DNA, 50 bp, homo sapien
gcactgaatttgaagccagaactaaytgagtgtgagtaaaattgtagtaa

SEQ ID NO: 30894 - DNA, 50 bp, homo sapien
atccatgccagggcacagaggattayagaataaaggctacgtggttaaca

SEQ ID NO: 30895 - DNA, 50 bp, homo sapien
tatatggagttaataaaagtgacaastaaaatctaaggctagagaaattt

SEQ ID NO: 30896 - DNA, 50 bp, homo sapien
actattgtaaggagatgctcttaaayaattttgtcttgtcaattctgttt

SEQ ID NO: 30897 - DNA, 50 bp, homo sapien
atatacagggccactccttagatgcyatggaattatgtatacccattctg

SEQ ID NO: 30898 - DNA, 50 bp, homo sapien
gcatttccactaacttagtgttttgmaaacttgtctatatcttggaatgt

SEQ ID NO: 30899 - DNA, 50 bp, homo sapien
cacatgcaaccacagtcttgctttcratgaacttataatgttgtcataca

SEQ ID NO: 30900 - DNA, 50 bp, homo sapien
aaaggccttaaattcctctgaataarctcttcatatacaagatttaaagt

SEQ ID NO: 30901 - DNA, 50 bp, homo sapien
tgggctcttctgggacattcctaaarcctgtatctgtatcagtgagggtc

SEQ ID NO: 30902 - DNA, 50 bp, homo sapien
acacaatggacactaattatgaggasagaaacaaagattcaaatatatag

SEQ ID NO: 30903 - DNA, 50 bp, homo sapien
tatctcaccaataattttctaagtcmcaagatctggaaatgcttctttat

SEQ ID NO: 30904 - DNA, 50 bp, homo sapien
accatacaatagaaatagtgctcaastcatttaatagttttctacagaat

SEQ ID NO: 30905 - DNA, 50 bp, homo sapien
cagaggatccatccaagtacttttasataattcatgtttcatcaaaggct

SEQ ID NO: 30906 - DNA, 50 bp, homo sapien
acaggaatttctagttatttcttcawgctctaccagtctttaagcttcat

SEQ ID NO: 30907 - DNA, 50 bp, homo sapien
tttttattctttgacactaacctaaygtgtcattgaaaagcagtatcccc

SEQ ID NO: 30908 - DNA, 50 bp, homo sapien
tgacttgttttgtgatcacctgctaygataactcaaaatctagagtaaaa

SEQ ID NO: 30909 - DNA, 50 bp, homo sapien
caaaatactcttaataatcccttaamtaggcaataaagtacatggctgag

SEQ ID NO: 30910 - DNA, 50 bp, homo sapien
gaggaataatatactttattatggamacttatgttaggctccttggtatg

SEQ ID NO: 30911 - DNA, 50 bp, homo sapien
ggtatgcatattaaagtgcgaggaaytcactttaataaagtggacaccaa

SEQ ID NO: 30912 - DNA, 50 bp, homo sapien
gttgaaccaggattgatcttgtggcraagaatcttcatcggctgctagga

SEQ ID NO: 30913 - DNA, 50 bp, homo sapien
gtactaacactgttttcttttaaaaktattcattctcatccattgttcat

SEQ ID NO: 30914 - DNA, 50 bp, homo sapien
ggatttctccatttcagttcaagaargtgatgagtttagtcacagtatga

SEQ ID NO: 30915 - DNA, 50 bp, homo sapien
gtacttgtatttttaagatccacagraaagtctaacatgagtcttgggcc

SEQ ID NO: 30916 - DNA, 50 bp, homo sapien
atccaagatcactggtcaaacttcaygtgattcctgaaactgcagtctgc

SEQ ID NO: 30917 - DNA, 50 bp, homo sapien
atatataatgctatttcactttttcrcagatggaagatgtccttggtgat

SEQ ID NO: 30918 - DNA, 50 bp, homo sapien
aaaaagcatggtgcttgttgtcaacrgacttggatttaagttctgaatct

SEQ ID NO: 30919 - DNA, 50 bp, homo sapien
aaacaaactctgctctaaatatgtayccaggatttgttttaatcagatat

SEQ ID NO: 30920 - DNA, 50 bp, homo sapien
atacacatataactcactatctttarcattttaggtatagagttcagtgg

SEQ ID NO: 30921 - DNA, 50 bp, homo sapien
tcacacttttccaagattattgtcayggaagggaatgggaataaactaag

SEQ ID NO: 30922 - DNA, 50 bp, homo sapien
taaagttatgggaaagaattttacaragatgattatcaaaatgtttttag

SEQ ID NO: 30923 - DNA, 50 bp, homo sapien
gtctatgggaaattggtctatactawtaaaggcaagtgaaacattggcag

SEQ ID NO: 30924 - DNA, 50 bp, homo sapien
ccacagagtcagttcttggcatgtargagatgctcaatgcacattgttca

SEQ ID NO: 30925 - DNA, 50 bp, homo sapien
taatataaacatagatgatagtgaaygtattttgtgttggtgttcaagaa

SEQ ID NO: 30926 - DNA, 50 bp, homo sapien
tactggagtgatttcatggaataatratgccctagctctatgaacagcaa

SEQ ID NO: 30927 - DNA, 50 bp, homo sapien
tgtaactaacaacgtgcagcaattaygtgaagaggcatttattaaagata

SEQ ID NO: 30928 - DNA, 50 bp, homo sapien
tttttatacttaatactgggtaacasgatagccttaatctgtgcagaaca

SEQ ID NO: 30929 - DNA, 50 bp, homo sapien
aatcaggaaggaatttattaagagakgttaaataattcacctagctattg

SEQ ID NO: 30930 - DNA, 50 bp, homo sapien
gaaaaaaatataagataaaataaggraagaaacatgaagtctaaaaaatc

SEQ ID NO: 30931 - DNA, 50 bp, homo sapien
ttcttctgtgttgtacctgagcaaarcaatacgatgagttcttggagacc

SEQ ID NO: 30932 - DNA, 50 bp, homo sapien
tacctcacatgaataaccattttgarctatgaaatgagtaagaaataaac

SEQ ID NO: 30933 - DNA, 50 bp, homo sapien
gggaaagtaaaggaaagttcagcaamtcctctcaatataaagcatacatt

SEQ ID NO: 30934 - DNA, 50 bp, homo sapien
tcttctttcccgtacatctgcataamagacaggtcaatttgcctaatgtc

SEQ ID NO: 30935 - DNA, 50 bp, homo sapien
tgaccttttgtgatatttatatagaygataggttgtacatagttatggag

SEQ ID NO: 30936 - DNA, 50 bp, homo sapien
caatctagctctctgtaagtaaatcycaacagtctttcaaaacgtaattt

SEQ ID NO: 30937 - DNA, 50 bp, homo sapien
tcaacactggaaacacttatccaatraaaccttctttatataccaatctc

SEQ ID NO: 30938 - DNA, 50 bp, homo sapien
gactttggcaccaccctaacgtatakagagaatatttgggtatgtgtagc

SEQ ID NO: 30939 - DNA, 50 bp, homo sapien
tgacctacataaagaaacttagtacraatgattcctcctttggggaatct

SEQ ID NO: 30940 - DNA, 50 bp, homo sapien
tggccatgggtcaagttctttcttasattttgaattgcctatttgacatc

SEQ ID NO: 30941 - DNA, 50 bp, homo sapien
catacatccatccataaacaattatwaaactccaacacaggttaccaaga

SEQ ID NO: 30942 - DNA, 32 bp, homo sapien
cgcaccacagatagagwatacacagtctggct

SEQ ID NO: 30943 - DNA, 50 bp, homo sapien
accagcattcaagaaagccaacataytaaagctatcaataaccaaggaat

SEQ ID NO: 30944 - DNA, 50 bp, homo sapien
caccatccctctggtcaatctatcaytccaaggaacattgccatcgtcca

SEQ ID NO: 30945 - DNA, 50 bp, homo sapien
aagtatgattttaaccatgctacggkaggataataatctttataaatcag

SEQ ID NO: 30946 - DNA, 50 bp, homo sapien
gttccacatgatatagctttaacacmgaaaaattctaggtccctgagtca

SEQ ID NO: 30947 - DNA, 50 bp, homo sapien
tcagggatgctctgatgtgcagttayaaattcagagagggcaaatattga

SEQ ID NO: 30948 - DNA, 50 bp, homo sapien
acttttctttttctctaaatttcctyaaacagagatagatcaatggaaag

SEQ ID NO: 30949 - DNA, 50 bp, homo sapien
atttagagaaaaagaaaagtaaccamcaagactaggaaaaatgaaaaatg

SEQ ID NO: 30950 - DNA, 50 bp, homo sapien
agaagggagagtaagaggtaggtccmaatttttctgccagatagattgca

SEQ ID NO: 30951 - DNA, 50 bp, homo sapien
tcatagccatctaatcattgatatayatgccatcagtatataacactgac

SEQ ID NO: 30952 - DNA, 50 bp, homo sapien
ccaagcagactcgattttgaagtaaygactgttcatatagttgtctcaga

SEQ ID NO: 30953 - DNA, 50 bp, homo sapien
actttaattcagagagaagtcttcastcattttaactctccttaacaagt

SEQ ID NO: 30954 - DNA, 50 bp, homo sapien
gtgacttttcatttatcttactggawatgttttacatctttattcttgaa

SEQ ID NO: 30955 - DNA, 50 bp, homo sapien
caccacctccactcaagttccagcasctttttctctattctggacctgcc

SEQ ID NO: 30956 - DNA, 50 bp, homo sapien
ttgcaggcagaaatatgtcaaggaakaatgaactcaatgatatgattcaa

SEQ ID NO: 30957 - DNA, 50 bp, homo sapien
gtttaagaacctgtgattaaacttaycaggcagaacataaaattcatttg

SEQ ID NO: 30958 - DNA, 50 bp, homo sapien
ggacacgtggcaagtaattggaaaastgggttgagatgagacagtaaagg

SEQ ID NO: 30959 - DNA, 50 bp, homo sapien
ctaacatagggagagaattgcaccarataaatgcaaaaatatatacaggt

SEQ ID NO: 30960 - DNA, 50 bp, homo sapien
gcaactgcctaagcagctcctagacratttgaggactcaactacttagca

SEQ ID NO: 30961 - DNA, 50 bp, homo sapien
gcaggaatgacttgcttaaggttgargatttttctctctcatacttacct

SEQ ID NO: 30962 - DNA, 50 bp, homo sapien
taaaacccctcagaatggttttggcrcttttaaataaatggttcagaatg

SEQ ID NO: 30963 - DNA, 50 bp, homo sapien
atgtggataagatgagtacttaaacractgtaaagattaaatgagttaat

SEQ ID NO: 30964 - DNA, 50 bp, homo sapien
tgttggatttacattgaatgaggacyatagagctggttagagaaagaagg

SEQ ID NO: 30965 - DNA, 50 bp, homo sapien
gggtctgacctataaatcatgggagraatgtagtacaaaatagtgaatga

SEQ ID NO: 30966 - DNA, 50 bp, homo sapien
atatcttactggttgatttagtacasatttcacatttgttcaatggccag

SEQ ID NO: 30967 - DNA, 50 bp, homo sapien
catactatgttgcaacgctttacccragagttattggcaacggaaaccag

SEQ ID NO: 30968 - DNA, 50 bp, homo sapien
tatacaattttaaaaccaaaagtcaktagattggtcagttcctttaacct

SEQ ID NO: 30969 - DNA, 50 bp, homo sapien
ttcataattatcctggatgttgatayagtatgctttgcttttgtgtggtt

SEQ ID NO: 30970 - DNA, 50 bp, homo sapien
gtaaagtactagaagagctgatcaaytcaaaagtgttttgcacattcttt

SEQ ID NO: 30971 - DNA, 50 bp, homo sapien
atgcatgagagatgcaataccaaggmatgtttaattatactcaccttcaa

SEQ ID NO: 30972 - DNA, 50 bp, homo sapien
catatgtgttgaaaagcaatacacaratatatagggtagaaagtaaaagg

SEQ ID NO: 30973 - DNA, 50 bp, homo sapien
tgacctgtctacctaaggctctgacycataaccgttttttatgctctaat

SEQ ID NO: 30974 - DNA, 50 bp, homo sapien
aaatttccatacgtatttgggaatayctccagacccaatgctgcgctatt

SEQ ID NO: 30975 - DNA, 50 bp, homo sapien
aaataggcagctgtcagagtggagartaaatcaaattgccatatggttcc

SEQ ID NO: 30976 - DNA, 50 bp, homo sapien
cgggttgtgacaaggtgtgctaaagraattcttaaggttccttctacctc

SEQ ID NO: 30977 - DNA, 50 bp, homo sapien
gatttttaaaaacttgttgcttatamactgatctgaaaatagcaatcctc

SEQ ID NO: 30978 - DNA, 50 bp, homo sapien
catgtgttaaaaacttaattctcacrgcaacagtgttgtgaagtggggtc

SEQ ID NO: 30979 - DNA, 50 bp, homo sapien
atattgtttggacaattacagaaaamtttctagaatacagaaagcaaata

SEQ ID NO: 30980 - DNA, 50 bp, homo sapien
atctgaagcatactttctttaccacyatgttacggtaatagattcatgtt

SEQ ID NO: 30981 - DNA, 50 bp, homo sapien
tataggatctgcactgtaaaaataamtatgtacaattggcaactttaaat

SEQ ID NO: 30982 - DNA, 50 bp, homo sapien
cattcttttccaacctgggtctccaygtctatatatatattttaaaagtt

SEQ ID NO: 30983 - DNA, 50 bp, homo sapien
tcttatttttatacatgtaggtaacraagctctattaacaataaaacttt

SEQ ID NO: 30984 - DNA, 50 bp, homo sapien
aaagtgaactgggttgatttctcccrcttagagctgcgaggaaaggaaat

SEQ ID NO: 30985 - DNA, 50 bp, homo sapien
ttctataatcctgtgagatcagaaasaccaatagttggcataagcagatg

SEQ ID NO: 30986 - DNA, 50 bp, homo sapien
aaatagcattcttagggaggaacaaycatcatacaatacatctagctatg

SEQ ID NO: 30987 - DNA, 50 bp, homo sapien
tattctcccctcatcaccagtttagraaaggaaagttaaattatgttcca

SEQ ID NO: 30988 - DNA, 50 bp, homo sapien
gagaagactctcagcttctgttcaaytgtagctgaaagggttcaagaatt

SEQ ID NO: 30989 - DNA, 50 bp, homo sapien
gataatttgattcactctagagagamgatatgcaaaagagaattgcgtgg

SEQ ID NO: 30990 - DNA, 50 bp, homo sapien
tatggaactgcatttgattgatttayagggaaaaatatggttaccaaaag

SEQ ID NO: 30991 - DNA, 50 bp, homo sapien
ataaccgttttcacacataacacatwagtagaatttcttttgaatatttg

SEQ ID NO: 30992 - DNA, 50 bp, homo sapien
tacatgtctatacttgcttggaaaarttatctgtaaatataatcctaata

SEQ ID NO: 30993 - DNA, 50 bp, homo sapien
cacactctcaactttgacggacagartaaagagggtatgaaaattcctgg

SEQ ID NO: 30994 - DNA, 50 bp, homo sapien
ggtcctattaaatttatcagctaccracacaagaattttgtgtgtgtgct

SEQ ID NO: 30995 - DNA, 50 bp, homo sapien
aataagttattgaagaaacaaaaatkaccatcacacattgttgattccaa

SEQ ID NO: 30996 - DNA, 50 bp, homo sapien
ttacttcattcattagttctgacaasggattgtatttgtatcattgcttg

SEQ ID NO: 30997 - DNA, 50 bp, homo sapien
tgtatgggggaggaatagaaacgtgwaattgttgttgtgaatgttatatt

SEQ ID NO: 30998 - DNA, 50 bp, homo sapien
aatgctgccctggcccttggagttaygtgacttgaagcatgtagctgaac

SEQ ID NO: 30999 - DNA, 50 bp, homo sapien
atatgcctttgaaaaactgcagaaarggatcaaaatagtcagtctcctaa

SEQ ID NO: 31000 - DNA, 32 bp, homo sapien
tcaaacactgctttgasatgaaagtacactaa

SEQ ID NO: 31001 - DNA, 50 bp, homo sapien
actttgagctcagatgtggaatgtargtaaagggcaagtgagaattttgg

SEQ ID NO: 31002 - DNA, 50 bp, homo sapien
gataaagcttaagacggatgttaaartgggtgtgttctgccttcatctag

SEQ ID NO: 31003 - DNA, 50 bp, homo sapien
tgacttcatgtctcatactacctggmcatattcattcctgtatctcccct

SEQ ID NO: 31004 - DNA, 50 bp, homo sapien
agcagtgagactggctagatggtgargcaattgtagagaagagggtggat

SEQ ID NO: 31005 - DNA, 50 bp, homo sapien
cttgctcagaaagttaaggctgtaartcaatgaataactttattgtttac

SEQ ID NO: 31006 - DNA, 50 bp, homo sapien
taactgctttacactctggtatttargtttgtacccagtcttgaggcctt

SEQ ID NO: 31007 - DNA, 50 bp, homo sapien
gctaatagcatagttcttattaactsactatagattcatggaccaaggaa

SEQ ID NO: 31008 - DNA, 50 bp, homo sapien
gcaagatcaattacaggaatccttcratcactatccaaataaagcagttc

SEQ ID NO: 31009 - DNA, 50 bp, homo sapien
ccacatctacagggatttctctaccwctggacctaatttaatggaactaa

SEQ ID NO: 31010 - DNA, 50 bp, homo sapien
gcactgcgcaagggttattcaaccarcaacgttcatttaacagatactta

SEQ ID NO: 31011 - DNA, 50 bp, homo sapien
gctttaaggctacaggtctaggagayagaatcatagaagatgattggaac

SEQ ID NO: 31012 - DNA, 50 bp, homo sapien
ctttattggtggtcaccaagatgcartgaaaggtcctgattttgtgaaca

SEQ ID NO: 31013 - DNA, 32 bp, homo sapien
acccagcgatgatgaartgcatactgacaaga

SEQ ID NO: 31014 - DNA, 50 bp, homo sapien
ggcaggaaggggaccatggctctaawggtccaaacactgacattatattt

SEQ ID NO: 31015 - DNA, 50 bp, homo sapien
ttgatgccctcattccatcattaagkattgcattgcacgtaacctgtgca

SEQ ID NO: 31016 - DNA, 50 bp, homo sapien
agccatctctacgtctttgaatctcratgtttgaattcttaagtttagag

SEQ ID NO: 31017 - DNA, 50 bp, homo sapien
gaagtactcagtgtccttggaagacyatctaaggaagaaccactgaacaa

SEQ ID NO: 31018 - DNA, 50 bp, homo sapien
ttttattgtatgtgtttcttttgtaygttaactcaattccactgtggaat

SEQ ID NO: 31019 - DNA, 50 bp, homo sapien
ttcatttgagagtttggttaataaartcacctcttctgagttagttttta

SEQ ID NO: 31020 - DNA, 50 bp, homo sapien
gaagtcttccaaacaatttctgctckatttttagttgtttcgaaaattaa

SEQ ID NO: 31021 - DNA, 50 bp, homo sapien
tagtcctcctttggagtgtgatagcsattaaagaccatagttcactgtaa

SEQ ID NO: 31022 - DNA, 50 bp, homo sapien
agattgtcatcaaggtatcctgtaaragtaactatcaactacatctcaaa

SEQ ID NO: 31023 - DNA, 50 bp, homo sapien
attcttagtatttggctatacaagckagatagatccttattcatgtattc

SEQ ID NO: 31024 - DNA, 50 bp, homo sapien
acacacacatcactctttattcaaamctccctaagatgtgtattcttatg

SEQ ID NO: 31025 - DNA, 50 bp, homo sapien
gttttcttcattcaattatcacaaasactccatgtggtaggaataacaca

SEQ ID NO: 31026 - DNA, 50 bp, homo sapien
tgaattaaaaacaagtgtacttttaygatgaacctaagtcaaagcgtggt

SEQ ID NO: 31027 - DNA, 50 bp, homo sapien
tgcctcatcatgcattttgactatawatatttagcagtccgttttattat

SEQ ID NO: 31028 - DNA, 50 bp, homo sapien
cagcaaatattttaaaaattaattgyaacaagcactagttaaggtatatc

SEQ ID NO: 31029 - DNA, 50 bp, homo sapien
tgtgtaaagcgcatgactgtacttcyatgggcaaaacgcagggaataaaa

SEQ ID NO: 31030 - DNA, 50 bp, homo sapien
tttttaatgtgcaggtattgaattayatggtctgacttaaatcataacta

SEQ ID NO: 31031 - DNA, 50 bp, homo sapien
agaaaacatgcctatgtcgtcagtaraagaaggataggatggcattttca

SEQ ID NO: 31032 - DNA, 50 bp, homo sapien
taaccgtgtacaagtgtagatgagamgaaataaacataaaggaacagaag

SEQ ID NO: 31033 - DNA, 50 bp, homo sapien
ccagccatccttcctgcaggtctcgragtaagagaaactccttccttctc

SEQ ID NO: 31034 - DNA, 50 bp, homo sapien
tgaattggccagtccattctttggaracctgaggatcaatacaaattctt

SEQ ID NO: 31035 - DNA, 50 bp, homo sapien
ggtggatcaagtggtcttggacaacygatttaccttctctcaatctaagt

SEQ ID NO: 31036 - DNA, 50 bp, homo sapien
gaatttatgggaatcagacaagtgaraggacattgcaaattgtaaagaac

SEQ ID NO: 31037 - DNA, 50 bp, homo sapien
atatgctattatttagttatgtaatkattaaaaagcaggagttggagaat

SEQ ID NO: 31038 - DNA, 50 bp, homo sapien
agcagtgctctgctcagtgtgactasagcagcgtaagcatgaggaggaga

SEQ ID NO: 31039 - DNA, 50 bp, homo sapien
tgtctaaaaacagctctgatcttgtmaatccctacttgaaaattttcagg

SEQ ID NO: 31040 - DNA, 50 bp, homo sapien
tgggagggcaaatgtctggtatgtargatgtctcatttgggagaagagac

SEQ ID NO: 31041 - DNA, 50 bp, homo sapien
aaatgtcacctcttcataataaagtracagctgcaacagtaactactaca

SEQ ID NO: 31042 - DNA, 50 bp, homo sapien
gatttttttttctgaaggaactttarccttttgccaattttaatacagat

SEQ ID NO: 31043 - DNA, 50 bp, homo sapien
aacagattaccagattcatggactayattatccagaaaacagattaagaa

SEQ ID NO: 31044 - DNA, 50 bp, homo sapien
gcaagcatttggagtcctccaacccraagataaaagatggtgaaaattaa

SEQ ID NO: 31045 - DNA, 50 bp, homo sapien
tgtacctacacatttagcatactaayatcactcttgcttaccagttttta

SEQ ID NO: 31046 - DNA, 50 bp, homo sapien
ggacagatgtgtcgccaacaaggcamcttactacagattgcactttgctc

SEQ ID NO: 31047 - DNA, 50 bp, homo sapien
ttgaagcttctgctcctgtggctccraaatatgaggaccctcatgacatt

SEQ ID NO: 31048 - DNA, 50 bp, homo sapien
cacaggcacattaaagtttgagagamcccgatgtaatgattataaataca

SEQ ID NO: 31049 - DNA, 50 bp, homo sapien
gtacaatttttgggagttacaaataygcttcagtgtttagccagtatggc

SEQ ID NO: 31050 - DNA, 50 bp, homo sapien
caatgtcatcactgagacaaatcatmaatctgataatagcttttaagaaa

SEQ ID NO: 31051 - DNA, 50 bp, homo sapien
attttcattatgaggaagtgaagtaygacaagaggaaatttaaatcagaa

SEQ ID NO: 31052 - DNA, 50 bp, homo sapien
gtttaaggaatgagctttatgatacraagagcagttctaaaaattaggga

SEQ ID NO: 31053 - DNA, 50 bp, homo sapien
ttgttcttgtagtaattcctgcaacrgaggtaaatcctaacactcataaa

SEQ ID NO: 31054 - DNA, 50 bp, homo sapien
gccagggagggacaagattgttaaamgtgtatacgagaaagtgattataa

SEQ ID NO: 31055 - DNA, 50 bp, homo sapien
ttctaagacttcccttactcggaaarcaacggaagtcaacaaaatgctca

SEQ ID NO: 31056 - DNA, 50 bp, homo sapien
gttcctgcttgttctaagagtcaacrgaaatctgaattccagagagggtt

SEQ ID NO: 31057 - DNA, 50 bp, homo sapien
cagtagcctacagggaacacacagartcattttcaacactctttctgtgg

SEQ ID NO: 31058 - DNA, 50 bp, homo sapien
gctctcttcctctctctgtgcttcaytagaggtataaatactggtacatt

SEQ ID NO: 31059 - DNA, 50 bp, homo sapien
catcaatatggccctatgtctggccraggaaataataaagattttgcatg

SEQ ID NO: 31060 - DNA, 50 bp, homo sapien
agctgctctgctgggcaaatcaaaargtgactgtcctgggaggggaagtt

SEQ ID NO: 31061 - DNA, 50 bp, homo sapien
ctgtttgaaacaatagcccaagactkacttctcagcagtttgattccttt

SEQ ID NO: 31062 - DNA, 50 bp, homo sapien
gagcctcttctggagaagcaaactargataactagtctacaagcatcaga

SEQ ID NO: 31063 - DNA, 50 bp, homo sapien
aagctctatatgcaccaatatggaayaatctccacgaaactttttttaac

SEQ ID NO: 31064 - DNA, 50 bp, homo sapien
tgttatgtatgtaaattatatctcartcaaacttattttgttaaaaaaag

SEQ ID NO: 31065 - DNA, 50 bp, homo sapien
tgtacagccaatgtgctttcaccaayaaagggtaacagacatcatatttc

SEQ ID NO: 31066 - DNA, 50 bp, homo sapien
caacctgccctcaggaaatagtggayatagcctagaaaactaatttttta

SEQ ID NO: 31067 - DNA, 50 bp, homo sapien
ggaatttaaaataaagtctccaagayagctttgtggataagatagagaaa

SEQ ID NO: 31068 - DNA, 50 bp, homo sapien
cagactaacttccatctgattcaagkcctctccactgagctatgttttta

SEQ ID NO: 31069 - DNA, 50 bp, homo sapien
gtaaggaagactttcgttccttccaytccaccaaacttgatgcaggtaaa

SEQ ID NO: 31070 - DNA, 50 bp, homo sapien
gaggacaggcttttaaaagcaacaaygtagaatgatgtgaaacaggaaaa

SEQ ID NO: 31071 - DNA, 50 bp, homo sapien
caacgatgtgctgctgattttgggaygttcagaaaagaggagctcaagga

SEQ ID NO: 31072 - DNA, 50 bp, homo sapien
atgaattctggcagagtatataccaytgagatacaatagatgcaggaatc

SEQ ID NO: 31073 - DNA, 50 bp, homo sapien
atctccaaaccttacagacaccctgmagtataggtatgctcatcctcata

SEQ ID NO: 31074 - DNA, 50 bp, homo sapien
tttgacaaatatacctgaatacatayaccctaataagtgttatctccaca

SEQ ID NO: 31075 - DNA, 50 bp, homo sapien
acagatgtctggaagatacaaagtakgagacaacgctccctccaaaaggg

SEQ ID NO: 31076 - DNA, 50 bp, homo sapien
agtagactttaagaaaggaaaattayccagatgggcctgacctaatcaga

SEQ ID NO: 31077 - DNA, 50 bp, homo sapien
cccaacaaagatcaactgaaaactcrgagtatcagacttttactttttac

SEQ ID NO: 31078 - DNA, 50 bp, homo sapien
atatctcctttcaaagtttcatacaygtggttacttatatagtttttgaa

SEQ ID NO: 31079 - DNA, 50 bp, homo sapien
agaatgtcaagggagtggcaataaarcacaaaataaaatgacacagaaag

SEQ ID NO: 31080 - DNA, 50 bp, homo sapien
gaagcagttgggaaagtgccttccartctgtaacccaaaagaattctcag

SEQ ID NO: 31081 - DNA, 50 bp, homo sapien
acagtgaaaatcaacacaattcacaycatggcttataaactgagtcatag

SEQ ID NO: 31082 - DNA, 50 bp, homo sapien
cctgtcgaattgtggatttgccttamgagatgccagcactaaatccaacc

SEQ ID NO: 31083 - DNA, 50 bp, homo sapien
atacctaggctgttgtttttaaatayggtgtttgatcaaatttaagttgc

SEQ ID NO: 31084 - DNA, 50 bp, homo sapien
ttagtggtttatttgaggtattgaayataagcacatatcactgggcttgg

SEQ ID NO: 31085 - DNA, 50 bp, homo sapien
aatgtacaaaatgtggaataaaaccyagtgacaattcaaaattaggcttt

SEQ ID NO: 31086 - DNA, 50 bp, homo sapien
tctaatggaagttcagatctcttaawgggcaaaactttgaactaaaaaat

SEQ ID NO: 31087 - DNA, 50 bp, homo sapien
agggtcctgaaggccttgctgatccrcatgcagtgtttggcggaggccca

SEQ ID NO: 31088 - DNA, 50 bp, homo sapien
gggttaactattttagccttgtaaaytagtctttcattgtctgtatattc

SEQ ID NO: 31089 - DNA, 50 bp, homo sapien
aaacatacaggagaaaaccatatgaygacatcgaaagaagatggccttct

SEQ ID NO: 31090 - DNA, 50 bp, homo sapien
agccacaagaacttcaaaaataacastattatttggccatataatattca

SEQ ID NO: 31091 - DNA, 50 bp, homo sapien
attcacatttgcacagccgttacaartagatggcaattagatatgatata

SEQ ID NO: 31092 - DNA, 50 bp, homo sapien
ctgtcctcaaataaactgattaacawgcaagagtgtactaattctacagc

SEQ ID NO: 31093 - DNA, 50 bp, homo sapien
gttgaataagtttgaaagccactgaygtatcatacccttctatcttccca

SEQ ID NO: 31094 - DNA, 50 bp, homo sapien
aaaattaaaatattttgacaagttcratgcttttttgagaatcatccaca

SEQ ID NO: 31095 - DNA, 50 bp, homo sapien
tttgttgcttgttagcctatgggaaygcagaattcagcttagagcaggga

SEQ ID NO: 31096 - DNA, 50 bp, homo sapien
tctacatgacccaaatccaatatcayggttttcccaaaatggtgaatcta

SEQ ID NO: 31097 - DNA, 50 bp, homo sapien
cctattttaggtcaacatctctagamgcagagcctgagacaagaatcaag

SEQ ID NO: 31098 - DNA, 50 bp, homo sapien
aggatacatatgcgtatttctgaagracctaatctaccacaaataaagat

SEQ ID NO: 31099 - DNA, 50 bp, homo sapien
ctcaaaagcagagagttttctcaaayggaacaaagcaatttctttgccaa

SEQ ID NO: 31100 - DNA, 50 bp, homo sapien
aaaactcttgtgctatgattagccaratttgagtcatatgctttacctct

SEQ ID NO: 31101 - DNA, 50 bp, homo sapien
gtatctctgtgttcactgtagtcaaytcaaggaaagagacagaatccaag

SEQ ID NO: 31102 - DNA, 50 bp, homo sapien
ctctgtgcagagaatctgattggaayttacaggtacttaaaccatgctag

SEQ ID NO: 31103 - DNA, 50 bp, homo sapien
tgaacacagagatacagtatgcagayggaccaggccttgctaatgtaccc

SEQ ID NO: 31104 - DNA, 50 bp, homo sapien
gagttgaaaggatagggaatgatacygaaatctaggtaaatttattctga

SEQ ID NO: 31105 - DNA, 50 bp, homo sapien
gcccctttcactttcagcgtgtctcraattcaaccctcctgatttatttt

SEQ ID NO: 31106 - DNA, 50 bp, homo sapien
acatgcatttgtgacctaagacaaawcctctcccggttgttggggaattg

SEQ ID NO: 31107 - DNA, 50 bp, homo sapien
catttccttatagaagcaaaatgaargtcactctcataatgaaatctgac

SEQ ID NO: 31108 - DNA, 50 bp, homo sapien
catggacaattttgtattatgtcacragactctgaatcttatctttactt

SEQ ID NO: 31109 - DNA, 50 bp, homo sapien
agctgttaattatagtatgacaacamctaatgccatgccagggtagaatt

SEQ ID NO: 31110 - DNA, 50 bp, homo sapien
tcatttttatgtgtccttttagggaygagaaacaagaccagagccctcct

SEQ ID NO: 31111 - DNA, 50 bp, homo sapien
agtcacttaccatttggattctctcrattgtcctattttccctaatcctc

SEQ ID NO: 31112 - DNA, 50 bp, homo sapien
gagaatccaaatggtaagtgactcaytgaaaatactcagtgcaatagaga

SEQ ID NO: 31113 - DNA, 50 bp, homo sapien
agatgatgtcaatgcatagagaaatyatttcagcttctcctctcttggta

SEQ ID NO: 31114 - DNA, 50 bp, homo sapien
gctttaattcgcatgcccatttatgwcagagattcagatgacctaagctt

SEQ ID NO: 31115 - DNA, 50 bp, homo sapien
taaaccttctctcatttataacttasaaaggtctcacaatacctgggagc

SEQ ID NO: 31116 - DNA, 50 bp, homo sapien
tcacccactcagtgggcatgcattcwagtcttttctggttctccatttcc

SEQ ID NO: 31117 - DNA, 50 bp, homo sapien
ttacttatctctgagttatatttgayggctaaattgcatagagcaatgcg

SEQ ID NO: 31118 - DNA, 50 bp, homo sapien
gtctgagattgttataaagtagctarcatctcagacagaaagctaataaa

SEQ ID NO: 31119 - DNA, 50 bp, homo sapien
tgtttacaaacagacagtgaaagaaygattgagctagtgatgaatgatca

SEQ ID NO: 31120 - DNA, 50 bp, homo sapien
tataaaagtcttcagcaacatatcarattgaatcaagcaatttatgaagg

SEQ ID NO: 31121 - DNA, 50 bp, homo sapien
caaaacatcttccactgttgtctacrgaatcatgtactttcgcaaaaaaa

SEQ ID NO: 31122 - DNA, 50 bp, homo sapien
ctttttgtaggccactgagcagaaakagtgttaagaccacagagcaggca

SEQ ID NO: 31123 - DNA, 50 bp, homo sapien
acttactaggtgaataatcttaggamaatccttgaaccactttgaggata

SEQ ID NO: 31124 - DNA, 50 bp, homo sapien
agtgtgaagatctaaaaaataaatayccatagctcagcatccttcaacca

SEQ ID NO: 31125 - DNA, 50 bp, homo sapien
ccatctgtatcagaagcagaataaaytgaagatatcatctacaggtattt

SEQ ID NO: 31126 - DNA, 50 bp, homo sapien
atacccaaataaatacaatgcaatcygatgtgctaaaagagagatatata

SEQ ID NO: 31127 - DNA, 50 bp, homo sapien
tttctctttctgatgccttctcttamatagttctcaaattcagacccaag

SEQ ID NO: 31128 - DNA, 50 bp, homo sapien
gccttaatggccatagtaggaaaaaygagcaatgttgcctgatcgctgca

SEQ ID NO: 31129 - DNA, 50 bp, homo sapien
tatagatagataagacatggacaaamatgaggtaaaaagtcatgtcacgt

SEQ ID NO: 31130 - DNA, 50 bp, homo sapien
tcttctggaaagaagagaaattaaamtctaccctctatagcaatgcagaa

SEQ ID NO: 31131 - DNA, 50 bp, homo sapien
aatcttcctagttacaaacactacasaatttattgtaattttttttatag

SEQ ID NO: 31132 - DNA, 50 bp, homo sapien
agaatctctaaagttgttttgagacraatttcttagcacttagtttcatc

SEQ ID NO: 31133 - DNA, 50 bp, homo sapien
cagctccccacacctattacatgtargaacccatgctaggcactggatgg

SEQ ID NO: 31134 - DNA, 50 bp, homo sapien
tataaatggctgattcaaaaatgtcycccagatcagaataacctcaacaa

SEQ ID NO: 31135 - DNA, 50 bp, homo sapien
ttcaagggttttctatatattctcastcagtatgtgttaactggatgctc

SEQ ID NO: 31136 - DNA, 50 bp, homo sapien
gatgagttcacatctggcgcagccaygctcaaaggaacctcatctgtttg

SEQ ID NO: 31137 - DNA, 50 bp, homo sapien
tgtactcctgtaccatcaaatgacasgatgaatccagatagaactcaagt

SEQ ID NO: 31138 - DNA, 50 bp, homo sapien
ggaggagagtccgtttaacataaaakaatgaaatgttgttctggttctaa

SEQ ID NO: 31139 - DNA, 50 bp, homo sapien
aaacattattttaattatcacaggcyaatgagaaaataacaaatcaggtt

SEQ ID NO: 31140 - DNA, 50 bp, homo sapien
aatccaggcgtgtccaattgccaaastgtgatagtgaaatgggctggaga

SEQ ID NO: 31141 - DNA, 50 bp, homo sapien
tcggaaactcagtagggaaaacttasgaatatggaaactattttgccatg

SEQ ID NO: 31142 - DNA, 50 bp, homo sapien
gacaatgttgaatcaattgttatcaratgggaagatttctgaatgctgaa

SEQ ID NO: 31143 - DNA, 50 bp, homo sapien
ggagttttatgccatggtattttgasgacaatgttgaatcaattgttatc

SEQ ID NO: 31144 - DNA, 50 bp, homo sapien
ggtgaatctttgttattgagaaataycctacattccttcttataaacatt

SEQ ID NO: 31145 - DNA, 50 bp, homo sapien
ttcttcacctttgagtcttcacttayggtattggtgaatctttgttattg

SEQ ID NO: 31146 - DNA, 50 bp, homo sapien
ttcatgctgtctactttatccagtasagccttagcatattaatcatggtt

SEQ ID NO: 31147 - DNA, 50 bp, homo sapien
agaagcttgatgtgcctatagttgayatacacgatgactacgagaagata

SEQ ID NO: 31148 - DNA, 50 bp, homo sapien
ggagtgatcaattttcctacagaccratcaggaaggactccaagggcttt

SEQ ID NO: 31149 - DNA, 50 bp, homo sapien
actattcctcaaatggacaggctaargataagagtctaatatcagcaaag

SEQ ID NO: 31150 - DNA, 50 bp, homo sapien
ttttaaaacttatctctgttattatyaggattggctcatgaagttttcag

SEQ ID NO: 31151 - DNA, 50 bp, homo sapien
cacaggctttgggagaaaacagttamgttcaggtcctaactccagtaatg

SEQ ID NO: 31152 - DNA, 50 bp, homo sapien
aaagatttcccagttttaaggaaccsggcattacctgcaaattgaaaagt

SEQ ID NO: 31153 - DNA, 50 bp, homo sapien
agataagaacagaaagtaggccaacrattacaaaacaatggctgccagag

SEQ ID NO: 31154 - DNA, 50 bp, homo sapien
aatattagacaaaacaagctcagaargaatatatgtaaaacctcagcaac

SEQ ID NO: 31155 - DNA, 50 bp, homo sapien
acaacaatgcagctgaagggcctgamaaaatgcccactatgagcaagcca

SEQ ID NO: 31156 - DNA, 50 bp, homo sapien
ataaaacgataggcaacctaagtaaygaaatagaggatgtaaaaagaata

SEQ ID NO: 31157 - DNA, 50 bp, homo sapien
tctagcaaactttattctctagaaaytatccaacttgttacatgcatcat

SEQ ID NO: 31158 - DNA, 50 bp, homo sapien
tgtgtgtatgctacagttaactcacrcaggcttacaagcagctgatttct

SEQ ID NO: 31159 - DNA, 50 bp, homo sapien
gtctcttatctgctgccacaattcarataaagtaacataacctgattcca

SEQ ID NO: 31160 - DNA, 50 bp, homo sapien
aacttgtggctggcgtctgcagtgargtaagtcttgttagggactgttcc

SEQ ID NO: 31161 - DNA, 50 bp, homo sapien
agaaaagtttataagcattgggttgyatatgaagatctcagcaagaatat

SEQ ID NO: 31162 - DNA, 50 bp, homo sapien
taaaggaaatacctgaatgacttcayagaataaggacaaggagctattgt

SEQ ID NO: 31163 - DNA, 50 bp, homo sapien
ctctttaaagctttcctcatcaatamaatgttaacagagtttagcctttg

SEQ ID NO: 31164 - DNA, 50 bp, homo sapien
atataatatctctatatttattgaaygggcaggaaaacaattgtgattca

SEQ ID NO: 31165 - DNA, 50 bp, homo sapien
cagttccctttacctgtaaaatgaakgtgttgaactaggagtttttgaag

SEQ ID NO: 31166 - DNA, 50 bp, homo sapien
agggtacctggaagaataaaaaatawaacagcgcacgagggacacatcct

SEQ ID NO: 31167 - DNA, 50 bp, homo sapien
atctaactttacaatatggtgaaaaygatagaacactggtgaaagaaatc

SEQ ID NO: 31168 - DNA, 50 bp, homo sapien
ggtaactaggaaaagtacagtaaagragagtaagttttgtaatgcagatg

SEQ ID NO: 31169 - DNA, 50 bp, homo sapien
gtgtgtgtattcatcaataacatcayctaagcactccttattgtcaagga

SEQ ID NO: 31170 - DNA, 50 bp, homo sapien
cttagagaatcccgtaggccggtccragagagtctgagaagcaaagttta

SEQ ID NO: 31171 - DNA, 50 bp, homo sapien
aagttttaggaggaaagatgaataakgctttttatatgtatttcttttaa

SEQ ID NO: 31172 - DNA, 50 bp, homo sapien
taccttggtcattataccatatgaartcatttctggtgagttttttatct

SEQ ID NO: 31173 - DNA, 50 bp, homo sapien
acatggtttagggccaaatattgaarccctagaattgagcttttagatgg

SEQ ID NO: 31174 - DNA, 50 bp, homo sapien
tattggcaaacacaaatggtgtctaygaaagcaccagataaaaatgttac

SEQ ID NO: 31175 - DNA, 50 bp, homo sapien
cccggctcagactggatgacgacgayggccagtggcaacttctctcctaa

SEQ ID NO: 31176 - DNA, 50 bp, homo sapien
agggcatgccatattcgttacaatakatcaagcagttagccctcttgggt

SEQ ID NO: 31177 - DNA, 50 bp, homo sapien
aaaactcaggcccttgaaatgaatamatcaagtcatggtaagatcttaca

SEQ ID NO: 31178 - DNA, 50 bp, homo sapien
ccttacaaaggacatctgccaaaaaytacatcctttgggttcctgttcga

SEQ ID NO: 31179 - DNA, 50 bp, homo sapien
gattttcagtcctaaatgctcgctaygcctaggaaaccaataaacccaca

SEQ ID NO: 31180 - DNA, 50 bp, homo sapien
cagtgacccagatgctgatttcccamggtcaaggatgtctgaagacaatg

SEQ ID NO: 31181 - DNA, 50 bp, homo sapien
ctcagagaattttaagctatgtcatragaaagataatttaaaaccccaca

SEQ ID NO: 31182 - DNA, 50 bp, homo sapien
ggaactggatcctcaggtgtatcacraacttactggatcggtattctgtg

SEQ ID NO: 31183 - DNA, 50 bp, homo sapien
gtctcatccttttgcctgtgcttaarctgcaaggttgaaaagtttaaagg

SEQ ID NO: 31184 - DNA, 50 bp, homo sapien
ccagaccatcctcttttcattagaartacataacaggagattaataaact

SEQ ID NO: 31185 - DNA, 50 bp, homo sapien
aggcatttaatacaggcttaacaaaycattgtgctgctttctttcctcta

SEQ ID NO: 31186 - DNA, 50 bp, homo sapien
tctggatagataaatgcccctcagastatgtatgcctcatggcaaaatag

SEQ ID NO: 31187 - DNA, 50 bp, homo sapien
cataaacaaatctttgtttataataygaccttactcaaactatagttcat

SEQ ID NO: 31188 - DNA, 50 bp, homo sapien
aagagataatgcatttccagattgarataacaaattgaattttatgaaga

SEQ ID NO: 31189 - DNA, 50 bp, homo sapien
acagcagccacggccacaactggaaycagaggtgaggctctgtggatgtg

SEQ ID NO: 31190 - DNA, 50 bp, homo sapien
gcaaatattggcatattcaggctgakaattagaaaaaatataaagttgtt

SEQ ID NO: 31191 - DNA, 50 bp, homo sapien
aatctaagggacttaaagcatgatarctgttttaaatagtttaaaaaaat

SEQ ID NO: 31192 - DNA, 50 bp, homo sapien
aaatggctggtgtgaggtttgctaayggcttctaggcctcctcctgagaa

SEQ ID NO: 31193 - DNA, 50 bp, homo sapien
tatactagactatctctttgcagaamagtttgtagttaagtaaaaaccga

SEQ ID NO: 31194 - DNA, 50 bp, homo sapien
agctttgtgttttaggactaggacayggtcttcttccttccttatcaggc

SEQ ID NO: 31195 - DNA, 50 bp, homo sapien
ccctgatgatttccctaaaattggaygttgaacctggtaatgatgcatat

SEQ ID NO: 31196 - DNA, 50 bp, homo sapien
cacagttcaaaatcttccagaaacarctcatattttctagcaatgatgat

SEQ ID NO: 31197 - DNA, 50 bp, homo sapien
ggatttgacatgtaatgatgaaggaycctaaaggaaatacaaaaatgtat

SEQ ID NO: 31198 - DNA, 50 bp, homo sapien
attctgtggaagtgcagctaataacrgattcaaggaggagtccagctgag

SEQ ID NO: 31199 - DNA, 50 bp, homo sapien
gcataaaaccttctacctgatctgamggtggcaacagcaggttcaatcac

SEQ ID NO: 31200 - DNA, 50 bp, homo sapien
agaggaaggaagaaaattgtagaccracttgattcaccagtatatgatac

SEQ ID NO: 31201 - DNA, 50 bp, homo sapien
tgctttccaaatattctaaatccaartggctagtgagcaaggtaggtctc

SEQ ID NO: 31202 - DNA, 50 bp, homo sapien
acatctgctcacgtcatgactgctaygttcttgtcttagtcaaaagataa

SEQ ID NO: 31203 - DNA, 50 bp, homo sapien
gtgctggtccaggttttccaagaaayagatgttgagatgggattttatca

SEQ ID NO: 31204 - DNA, 50 bp, homo sapien
tgcacagttactgtctgtgggaaatsagctcacgtaactggaccttttca

SEQ ID NO: 31205 - DNA, 50 bp, homo sapien
acccaattaattcataatcaataaaygtcaaacctcaaagacccagtaca

SEQ ID NO: 31206 - DNA, 50 bp, homo sapien
cttggaaagaatctaaaaatttctayagaggagatgccaagagaggaagt

SEQ ID NO: 31207 - DNA, 50 bp, homo sapien
cagagattctctcttaggagcgggtmaaaggccaaacatgttttttggaa

SEQ ID NO: 31208 - DNA, 50 bp, homo sapien
agcaagtcaacacaactagctagaakttagcattatgaaagggaaaacag

SEQ ID NO: 31209 - DNA, 50 bp, homo sapien
cagaggcctaggccttttgtgatatwagtggttccctgtcattccctgtg

SEQ ID NO: 31210 - DNA, 50 bp, homo sapien
gtcaaattaactaacagcttattaartggattttcatgagcacttggaaa

SEQ ID NO: 31211 - DNA, 50 bp, homo sapien
taatgctcttgttgggtattgatatyaagactattttagcctcatagaat

SEQ ID NO: 31212 - DNA, 50 bp, homo sapien
atattagcctgtggtctgctgttacmcaagaatgtatctataacaaaaat

SEQ ID NO: 31213 - DNA, 50 bp, homo sapien
ttacaaaaaagcgtgtcctgtgtgaygatgactgtgactgtcccaagctg

SEQ ID NO: 31214 - DNA, 50 bp, homo sapien
tgtctttgcaatccctttttcagaartaatcactttagcaatttgacact

SEQ ID NO: 31215 - DNA, 50 bp, homo sapien
tgtgtacagatctcaaagtgaaaccracggcaatataatttttatgagaa

SEQ ID NO: 31216 - DNA, 50 bp, homo sapien
agctgagattgcctgtgttgtgagcragggatgaaaggagtgggtattag

SEQ ID NO: 31217 - DNA, 50 bp, homo sapien
tgaaatctgatctgcatgtcaaccaygtttaagattcagattgcagtttt

SEQ ID NO: 31218 - DNA, 50 bp, homo sapien
gctctggcaatcgtttccgttcacaygctcaaggttgtggcttgacctat

SEQ ID NO: 31219 - DNA, 50 bp, homo sapien
tccaagtaaaaacgacaccaacacartgaatcttacctagaattcagctc

SEQ ID NO: 31220 - DNA, 50 bp, homo sapien
ttagaacttccttccttgcccataaycttagggccacatgaatcttctac

SEQ ID NO: 31221 - DNA, 50 bp, homo sapien
gacatcatttttctcaaatcacttaygttatgtgtttatttgcttattgt

SEQ ID NO: 31222 - DNA, 50 bp, homo sapien
agcaagagaatgaaagagtgagttayatcacacgctgccctctaatgaat

SEQ ID NO: 31223 - DNA, 50 bp, homo sapien
ccaagtaaatgccctcatagcacaastaattgtctagatttgtactactg

SEQ ID NO: 31224 - DNA, 50 bp, homo sapien
cacaaattgttcactttaaccaaggratgtatataaagacagcacttatc

SEQ ID NO: 31225 - DNA, 50 bp, homo sapien
tgacaaacacttcagcattagatcayctattctctgcactggcttatttc

SEQ ID NO: 31226 - DNA, 50 bp, homo sapien
gttggtggtttggctgctctaaccartaatttttgtcatccaatacccca

SEQ ID NO: 31227 - DNA, 50 bp, homo sapien
tatgtatatacccattgagcaattcscagatggctaataaataagaaagt

SEQ ID NO: 31228 - DNA, 50 bp, homo sapien
taggaaagctcactatgcactcatayatacaaaactgtagaaactcctta

SEQ ID NO: 31229 - DNA, 50 bp, homo sapien
atgtcagctctacatatctctggcaygaataaatgaatattttacacaca

SEQ ID NO: 31230 - DNA, 50 bp, homo sapien
cttccatccatttccaagaacatcartcttctaaaattctccccttgttt

SEQ ID NO: 31231 - DNA, 50 bp, homo sapien
tgctcttcacactctaggatggcacraatctcctttttttctgttttatc

SEQ ID NO: 31232 - DNA, 50 bp, homo sapien
taaaagaaagttatgtatatgaacamcaagttgagtgctttggaaaatct

SEQ ID NO: 31233 - DNA, 50 bp, homo sapien
tcagcattttcttgggcagccaaaawtctagttattagtaaacgtgggtc

SEQ ID NO: 31234 - DNA, 50 bp, homo sapien
tatgcaagggaaaaaactaatacaayctaccgacaactttaaaagtccac

SEQ ID NO: 31235 - DNA, 50 bp, homo sapien
agggaaatttcaacatgacagaaaaytataatccaagcagaaaaggccaa

SEQ ID NO: 31236 - DNA, 50 bp, homo sapien
aaagacccctgagaaaatgtccataratcctaatttgaaaaatactagtt

SEQ ID NO: 31237 - DNA, 50 bp, homo sapien
ttagactatattctgcttgctcttgyaggtgatctccagttagaaatcag

SEQ ID NO: 31238 - DNA, 50 bp, homo sapien
atacatgaatattttacagaattaarcaaattgaccagccatttaaacca

SEQ ID NO: 31239 - DNA, 50 bp, homo sapien
tgtccatggcttcatagttgttaatmatctttactgtagttcatggggac

SEQ ID NO: 31240 - DNA, 50 bp, homo sapien
aagagcacagcctcagaaaatgtatsaagtaccctcaaatgttaccttga

SEQ ID NO: 31241 - DNA, 50 bp, homo sapien
tttcctatgtcaagtggagatagaayatgttaatactgatgggccaccag

SEQ ID NO: 31242 - DNA, 50 bp, homo sapien
tatccaggacttatcaggaaattaawctctctacttttagtcttttccta

SEQ ID NO: 31243 - DNA, 50 bp, homo sapien
cctaaagtcaggctttgcttttatayggctactttgaaaatataaataaa

SEQ ID NO: 31244 - DNA, 50 bp, homo sapien
ctttatattacgctaataccataccrgagcttataagatcaggaaataca

SEQ ID NO: 31245 - DNA, 50 bp, homo sapien
ggtatttttctaatgggtgataatartaacagcagctaatgtgtattgaa

SEQ ID NO: 31246 - DNA, 50 bp, homo sapien
agctcccagagatcacacaagactargaaatataagttattgccaaccag

SEQ ID NO: 31247 - DNA, 50 bp, homo sapien
gcagtattgctgaattgaggaaaccrgcattaagttctcctcaacagtat

SEQ ID NO: 31248 - DNA, 50 bp, homo sapien
taatagattctaagcagaactatccrcttctctaaacattaataatagtc

SEQ ID NO: 31249 - DNA, 50 bp, homo sapien
cctctctgatgtcctgggaccagtcygactatagaatctggggaaactgc

SEQ ID NO: 31250 - DNA, 50 bp, homo sapien
cttttctagttccaaattttctacartaactattacactaataactggaa

SEQ ID NO: 31251 - DNA, 50 bp, homo sapien
gggctggcatttcacttctctattargattttcttttgggggagcagggc

SEQ ID NO: 31252 - DNA, 50 bp, homo sapien
tattaagagagtttaggaagattaascaggagctcattacaataatttag

SEQ ID NO: 31253 - DNA, 50 bp, homo sapien
ggtaaatgagtaagctgtttctaaawttgcctagaaaaaaaggttctata

SEQ ID NO: 31254 - DNA, 50 bp, homo sapien
tctgggccacatcctagaagatcacygtaacttctgtttcctgcatggct

SEQ ID NO: 31255 - DNA, 50 bp, homo sapien
cttggaccatgtgcaagaaagaataygaggtgaatccatgaaataaagtg

SEQ ID NO: 31256 - DNA, 50 bp, homo sapien
tgtgtggaggtccaggagtgagaccrggaaagaatgtgaaagtgactaca

SEQ ID NO: 31257 - DNA, 50 bp, homo sapien
attgcagtatttgatgatactggcaraagtcactaagagaatcctcaaaa

SEQ ID NO: 31258 - DNA, 50 bp, homo sapien
gcacatgctcaactacaggtgtctartaccttttccgataaagagaactg

SEQ ID NO: 31259 - DNA, 50 bp, homo sapien
accacaggtgtggccatggtgcacarcattgcaaggtccagggtcagtcg

SEQ ID NO: 31260 - DNA, 50 bp, homo sapien
agctcagggactttatgcacttaaayagggaacagagatgtcaggacatg

SEQ ID NO: 31261 - DNA, 50 bp, homo sapien
agcatttgtttatgggttttgctaartgatttcttggaagccaaagggtt

SEQ ID NO: 31262 - DNA, 50 bp, homo sapien
tattattatttgtgtctattggtatmaatcacattataaaataagcttta

SEQ ID NO: 31263 - DNA, 50 bp, homo sapien
cacagtccacctggaaaacgtaagamatctttagataaacaatgaagact

SEQ ID NO: 31264 - DNA, 50 bp, homo sapien
taaaagtgcaaagtgaagtagcaaaygctgatagagaagctgcagcaaga

SEQ ID NO: 31265 - DNA, 50 bp, homo sapien
cttctctagagaggagggaaagccayacaaaactgtttgattaagctcaa

SEQ ID NO: 31266 - DNA, 50 bp, homo sapien
accatcagctattatttaaaatgtcrctgtggagattaaacactgtctgc

SEQ ID NO: 31267 - DNA, 50 bp, homo sapien
cagtcactgggaggacatggtctaakgagcaaatagtttctgagactctg

SEQ ID NO: 31268 - DNA, 50 bp, homo sapien
gacatggcccaaaacaagagcatgtyaatatttacagcatctgcttcctt

SEQ ID NO: 31269 - DNA, 50 bp, homo sapien
aggagggatggtttaattcttaccaytcatctgccaaggacacatcggga

SEQ ID NO: 31270 - DNA, 50 bp, homo sapien
tcaaggtttgtaattggtttcttctsacttaggaaagaagaaaattattc

SEQ ID NO: 31271 - DNA, 50 bp, homo sapien
ttagtcctcagacatgccaggtattraaatgagtcacttacaaccaaata

SEQ ID NO: 31272 - DNA, 50 bp, homo sapien
ttacattctaaggtaattagctcagscgtttcaacacttggggtgggggt

SEQ ID NO: 31273 - DNA, 50 bp, homo sapien
ataatgactaatgttcctacatgatyaatattagaactatgagatagcaa

SEQ ID NO: 31274 - DNA, 50 bp, homo sapien
aaaaggtcatatggataatgcaatgraatggaaagatcactggactctgg

SEQ ID NO: 31275 - DNA, 50 bp, homo sapien
attgggagagagtctcaaaaccaacragtgatgtggagtcccactgcaga

SEQ ID NO: 31276 - DNA, 50 bp, homo sapien
ctctagtcctcctcagtacctaacayagagccttgtgcagagcagctcct

SEQ ID NO: 31277 - DNA, 50 bp, homo sapien
tatctgttcatgtgaagttagttacyactttataagaggaagagatgaca

SEQ ID NO: 31278 - DNA, 50 bp, homo sapien
tccattccctggacacctggccggasctgccaaatgcagaaaggaaataa

SEQ ID NO: 31279 - DNA, 50 bp, homo sapien
ttgtacagttcatcttggaattcaaycttaatattttgtgtagcctcatt

SEQ ID NO: 31280 - DNA, 50 bp, homo sapien
attgtcctgcactagttgcctaatayctcttaagtgcagcatcttaatta

SEQ ID NO: 31281 - DNA, 50 bp, homo sapien
caatgctatagttttctgtattgtcrctcttgcagttagttcatgccatg

SEQ ID NO: 31282 - DNA, 50 bp, homo sapien
tctgtccattctaataattcaccaamgatagccattccccatagagagag

SEQ ID NO: 31283 - DNA, 50 bp, homo sapien
ttccatcatctagtttaaaaatatasgaacaagctgttctttatcattgg

SEQ ID NO: 31284 - DNA, 50 bp, homo sapien
atcaaaaaaatgaaagtctacccaartctgaggtttgctataaagcccat

SEQ ID NO: 31285 - DNA, 50 bp, homo sapien
aggcttgggccttgtgattctttaasgattcttgtgccttctccattgtc

SEQ ID NO: 31286 - DNA, 50 bp, homo sapien
gcaagacgggttataagcatcagtarataaaagcaatttttttagcctat

SEQ ID NO: 31287 - DNA, 50 bp, homo sapien
gaaaatgcagaggatgacacacggcyaagatgagataatgcctgggatct

SEQ ID NO: 31288 - DNA, 50 bp, homo sapien
gttgtttccactcctcttgaaccaaygtgactcttgcataagctacttca

SEQ ID NO: 31289 - DNA, 50 bp, homo sapien
catatttgtaagtagagactacctgraaataatgaaattgtaataattcc

SEQ ID NO: 31290 - DNA, 50 bp, homo sapien
cgttctgactcagggaccatcaaacrcgggagtattaggcagggcctctg

SEQ ID NO: 31291 - DNA, 50 bp, homo sapien
tccctattctaatggactatgcagaraaacaggtgaaatgtgaaatctgc

SEQ ID NO: 31292 - DNA, 50 bp, homo sapien
agactgttgatatcagattatttcaytagggatcaaggagagccatttat

SEQ ID NO: 31293 - DNA, 50 bp, homo sapien
atctctgaatcaatttggaaagaacygccatcttgaaatagaagctttca

SEQ ID NO: 31294 - DNA, 50 bp, homo sapien
ccgaggttgtctatttattttaaaartctcattagcacttgaagtgtgtt

SEQ ID NO: 31295 - DNA, 50 bp, homo sapien
ttctcgtgtagtatacttttatacaraatatgcctgataaatttgacttc

SEQ ID NO: 31296 - DNA, 50 bp, homo sapien
tctgctaccatccatcctgttttgaygttacagtgttatgagagataaga

SEQ ID NO: 31297 - DNA, 50 bp, homo sapien
ctatacctgctgtctgtcctttccayggtcatctgccttgtagtcctctc

SEQ ID NO: 31298 - DNA, 50 bp, homo sapien
ctcccttaaaaaactgtagaaaaaasatttacatgatttcagcctaatta

SEQ ID NO: 31299 - DNA, 50 bp, homo sapien
tctctgtgcaggtgattggaaaccayattggactacaagaagacttttag

SEQ ID NO: 31300 - DNA, 50 bp, homo sapien
gagttctgggggcatcaggagacaarttgagagatgtagactggggtagg

SEQ ID NO: 31301 - DNA, 50 bp, homo sapien
acatgtcgcagcgtgtgtgtctatgsacgcgtgtgagtgtgtaaatgtgc

SEQ ID NO: 31302 - DNA, 50 bp, homo sapien
ctctgcctgctgctggcaaccttgaktatccttaatggggtgcagtgcac

SEQ ID NO: 31303 - DNA, 50 bp, homo sapien
caaagtaaaaggttagtggcaaacamagatgtggaataaattgtacccgt

SEQ ID NO: 31304 - DNA, 50 bp, homo sapien
tctctttgtctaagggagacagatckatacatgcctaaagctctaataat

SEQ ID NO: 31305 - DNA, 50 bp, homo sapien
ctctctttacctgttaaaaagactaygtgtcgttgctgtatgttctgagc

SEQ ID NO: 31306 - DNA, 50 bp, homo sapien
ttcctctttttctgtctgcgttaaasaaaatgaaaaccactgaaaagtta

SEQ ID NO: 31307 - DNA, 50 bp, homo sapien
gaaaatactatcctcatacttttaayacggaatcgattactttaaaaagc

SEQ ID NO: 31308 - DNA, 50 bp, homo sapien
gatctgctcatttattatactgtagycagtgtaagttgtaagttattata

SEQ ID NO: 31309 - DNA, 50 bp, homo sapien
gagtgagaacattaaaatgactaaaytgatgggacatatttaattgacta

SEQ ID NO: 31310 - DNA, 50 bp, homo sapien
tctcattttcttgagactgacttgaygaaagggcatatggtgtccccaaa

SEQ ID NO: 31311 - DNA, 50 bp, homo sapien
ttcctgcaaaaatctgaaccatctgyagtttaatgacaagtgctagtcag

SEQ ID NO: 31312 - DNA, 50 bp, homo sapien
aagtgccaaagttctgtctaacttaytaacacgtctagacccataactcc

SEQ ID NO: 31313 - DNA, 50 bp, homo sapien
aatctggactgtcctcatctcttcaygttccatttttcaaaggaatcttt

SEQ ID NO: 31314 - DNA, 50 bp, homo sapien
atggttaaacataggtaagcacttayactgctttgcaaaataattgagtt

SEQ ID NO: 31315 - DNA, 50 bp, homo sapien
gagccaaaaattagataagtacttaygagtagatggttcagaaaggggga

SEQ ID NO: 31316 - DNA, 50 bp, homo sapien
ggccaacaacttgttcatggctatcraagtggtagaatgttgaatttaca

SEQ ID NO: 31317 - DNA, 50 bp, homo sapien
gactccatttcaaacatataccaggratttttattcatttggagatatcc

SEQ ID NO: 31318 - DNA, 50 bp, homo sapien
tacaaagctgagtgaagtaggtttayggaagagatttgggaaatcagaga

SEQ ID NO: 31319 - DNA, 50 bp, homo sapien
tttcagtgtggtctatgttcatgaartggtctctggaaaaaatattccat

SEQ ID NO: 31320 - DNA, 50 bp, homo sapien
ttgactttttcttcctttccaagcaygattaattgagcccacttctattc

SEQ ID NO: 31321 - DNA, 50 bp, homo sapien
tggacatctgtactgggtgtagtacmaatggtgacctcctcatgcccccc

SEQ ID NO: 31322 - DNA, 50 bp, homo sapien
atagaaaatacatttaaaaacttgcygaatggtcctttaagccagaagtt

SEQ ID NO: 31323 - DNA, 50 bp, homo sapien
tgattacttgctccactccttagcamaagtttcactatcaccctttcagg

SEQ ID NO: 31324 - DNA, 50 bp, homo sapien
gacaatgaactaagtgctgaaaaacrgttgtaaaagtgaatatctaacat

SEQ ID NO: 31325 - DNA, 50 bp, homo sapien
ctattcagcaacttgctttagaacasggtgactcacaccaagtccaacca

SEQ ID NO: 31326 - DNA, 50 bp, homo sapien
gcaattatttccacttggttataggyagccttgataacatctccagcagc

SEQ ID NO: 31327 - DNA, 50 bp, homo sapien
ttctctgtgcagttacagctctaccrgccctaggtcccagcagatcaggc

SEQ ID NO: 31328 - DNA, 50 bp, homo sapien
tttatcactatacagttctgtgataygaatttagtacttacaaactctac

SEQ ID NO: 31329 - DNA, 50 bp, homo sapien
tcataattcttcttcaccattatcayagtagctcccatttattgactatg

SEQ ID NO: 31330 - DNA, 50 bp, homo sapien
ggctataatcactttcctaatctcargaacaaagtgtaatctcagaagag

SEQ ID NO: 31331 - DNA, 50 bp, homo sapien
tataaaacatcctagtgagacaaaayggagcaaacaaatataggtttttc

SEQ ID NO: 31332 - DNA, 50 bp, homo sapien
agaaattatattctgcatagctgaartatatcctgtggtagaagaggggg

SEQ ID NO: 31333 - DNA, 50 bp, homo sapien
gttccaaggagtgttctctgaatgasagtttcagcatcgcgtaatgtcaa

SEQ ID NO: 31334 - DNA, 50 bp, homo sapien
gccaagctcttcactgattaagccartgcagaatccacttgtgggcagtc

SEQ ID NO: 31335 - DNA, 50 bp, homo sapien
gggaggattcacacagaattcagccrctttctgatgcacagggcttctta

SEQ ID NO: 31336 - DNA, 50 bp, homo sapien
acccccagggaggcattctaacaccygatctcatgggatgatggcttttc

SEQ ID NO: 31337 - DNA, 50 bp, homo sapien
ctcaacacagtcccatgttgccctasgtcatcccaatagagagaaagctg

SEQ ID NO: 31338 - DNA, 50 bp, homo sapien
tctggcaaaactaaaacttacatgaycagagtggcacagattcctgccta

SEQ ID NO: 31339 - DNA, 50 bp, homo sapien
aatagatttaatattggtaacctaasagaaagtctttcaaagaccatggt

SEQ ID NO: 31340 - DNA, 50 bp, homo sapien
gaccccattccaccccaaacttgcayactcaattcacattatctgtcatg

SEQ ID NO: 31341 - DNA, 50 bp, homo sapien
cattagtcaaagcaagtaacgtgacyaagtctagagcccatgtgggcagg

SEQ ID NO: 31342 - DNA, 50 bp, homo sapien
gcctctagttcaggattgttccaaaygtacccatcgttcattcctgacca

SEQ ID NO: 31343 - DNA, 50 bp, homo sapien
ctgtgttctgctctggaggacagtakaacaggcacagggacctctcaccc

SEQ ID NO: 31344 - DNA, 50 bp, homo sapien
gtctccaggcagaaagccaggacaaytgcggagtttacctcatgtgtttc

SEQ ID NO: 31345 - DNA, 50 bp, homo sapien
aattattgcttagaaatgaagcaaaraaactaggagtagataaaaatgaa

SEQ ID NO: 31346 - DNA, 50 bp, homo sapien
atattggtttggctttttctgttgargaggtcaagatgaattattacagc

SEQ ID NO: 31347 - DNA, 50 bp, homo sapien
ggaattgagaagttttctagactccygaagtgtgcagttctccaagtata

SEQ ID NO: 31348 - DNA, 50 bp, homo sapien
tccaaatatgtaagtgtgagaaaagrcagcttaaatcctacataattcgt

SEQ ID NO: 31349 - DNA, 50 bp, homo sapien
tgaactctcaagtaaggccaaaatastaccaagaacttgattttgtttca

SEQ ID NO: 31350 - DNA, 50 bp, homo sapien
atatgataccagttttagtaagtacrgaaatataaggatatataaatagt

SEQ ID NO: 31351 - DNA, 50 bp, homo sapien
cagcaaatgttgtataaccaaggtcsagtaacattttcatagttggatga

SEQ ID NO: 31352 - DNA, 50 bp, homo sapien
tgaattattattggcttatgggagamattatatattgcagtgatgggctg

SEQ ID NO: 31353 - DNA, 50 bp, homo sapien
cagattctatgctgagcttttcataygttgacttatgaaatgttttgtca

SEQ ID NO: 31354 - DNA, 50 bp, homo sapien
aactggtagataaactgtagaatgcracacattttctttctttctttttt

SEQ ID NO: 31355 - DNA, 50 bp, homo sapien
aaccagtcccccaacaactgtaatayataggtactcacttaaatgcccaa

SEQ ID NO: 31356 - DNA, 50 bp, homo sapien
acatgtttaaaatagcaaggagggaygtataacactacatgtaaatttat

SEQ ID NO: 31357 - DNA, 50 bp, homo sapien
gagctctagagagtaagctatgctgyagtctgttccccttgaggcaaggg

SEQ ID NO: 31358 - DNA, 50 bp, homo sapien
ggacctggtatagagttgactggacsaagctgagccaataagatataatt

SEQ ID NO: 31359 - DNA, 50 bp, homo sapien
tgtttccccacctgtaaaataggaakgtagtgactggattagcaactcta

SEQ ID NO: 31360 - DNA, 50 bp, homo sapien
acacaaatggatgtagagagaccaayttaaggctcatataatctgcttcc

SEQ ID NO: 31361 - DNA, 50 bp, homo sapien
ttcattaggcacctattcaatacaaygccctgggaagaggatattggccc

SEQ ID NO: 31362 - DNA, 50 bp, homo sapien
ctctaggcccacaatttgtatcttayagctcatatttgcttacatgtctc

SEQ ID NO: 31363 - DNA, 50 bp, homo sapien
ggtctaggtccttcagaaagcagaamctgagcaaggattgaggttctaat

SEQ ID NO: 31364 - DNA, 50 bp, homo sapien
aaccattaattaggaaacgataaaaytgttcttgcagaaagctttattat

SEQ ID NO: 31365 - DNA, 50 bp, homo sapien
tcatcagaaaaaataaataaaggtcrcaaatatttgactcagttttcaaa

SEQ ID NO: 31366 - DNA, 50 bp, homo sapien
ccttgtccactggattgagtattaaygtccctctgcaaagcctatctttc

SEQ ID NO: 31367 - DNA, 50 bp, homo sapien
tgggacagggctagtttcttcggacmggcaaggcaagtgtcagttttctt

SEQ ID NO: 31368 - DNA, 50 bp, homo sapien
atattaatacatagtgattcctcaastcacaaatcttttgggagcaatgc

SEQ ID NO: 31369 - DNA, 50 bp, homo sapien
ttccattcactcatcggctgaatgaraaaagtgtgaagctgtgtgccaag

SEQ ID NO: 31370 - DNA, 50 bp, homo sapien
gagagatgagggtccagtatcctgaygtctaatcacctgctgtagtgggc

SEQ ID NO: 31371 - DNA, 50 bp, homo sapien
acatatttactggctcatgtagttaygatgaggatattagtgcagatcag

SEQ ID NO: 31372 - DNA, 50 bp, homo sapien
acttatttatcctgatcactgcatayagtcataaatattttcattaatga

SEQ ID NO: 31373 - DNA, 50 bp, homo sapien
ctcgttcataaatcaatcaatcatgraaatagatggaaatagagagttaa

SEQ ID NO: 31374 - DNA, 50 bp, homo sapien
tcagcaaatggtttatcaacttgtawaaaagcaatcttctcaacctgcaa

SEQ ID NO: 31375 - DNA, 50 bp, homo sapien
ctgggagatgtaaagtggataaaaaratatcaaatagaaaaagtttcaaa

SEQ ID NO: 31376 - DNA, 50 bp, homo sapien
gcaactccagtgtgcactgtctatasattggaacattttgcctaagcatt

SEQ ID NO: 31377 - DNA, 50 bp, homo sapien
ggcaagagagaaaggccagggtggcyaacttccttttaagcatgtggggc

SEQ ID NO: 31378 - DNA, 50 bp, homo sapien
agacctttggtaccacatcctactaygatgacgtgggcctgctctgtgaa

SEQ ID NO: 31379 - DNA, 50 bp, homo sapien
ccctaggggcagtgatttctcaacaygcagtccttggattacgttcaggt

SEQ ID NO: 31380 - DNA, 50 bp, homo sapien
ggtgatactgatactgctggtcccaygtgaacttcagtcaaccaagagtt

SEQ ID NO: 31381 - DNA, 50 bp, homo sapien
aattaacctaggtggtagctcgccarcattcacagaatcagtctcattgc

SEQ ID NO: 31382 - DNA, 50 bp, homo sapien
catttcatcctccgtatgttcgtgtraagtcagttctttgttatccatcc

SEQ ID NO: 31383 - DNA, 50 bp, homo sapien
tttgccagatgaaggtaataaataaygcttattgaatacttagctgcatt

SEQ ID NO: 31384 - DNA, 50 bp, homo sapien
ctaaatttggactttttctgtatgarcacttggaagatttgtagcgtttt

SEQ ID NO: 31385 - DNA, 50 bp, homo sapien
caaaaaagaagccttctaaccatcaygtttctgatcacagcaaatagcct

SEQ ID NO: 31386 - DNA, 50 bp, homo sapien
aagcagagggtgactgtcccagaagsctgaggaatgcaaataaacaaatt

SEQ ID NO: 31387 - DNA, 50 bp, homo sapien
taatcaaagagatgaaagacctctaygacaaaaatgacaaaacactgaag

SEQ ID NO: 31388 - DNA, 50 bp, homo sapien
ttctgacttcctcttatgtcctagcyaaaggatgacccaatggctcaccc

SEQ ID NO: 31389 - DNA, 50 bp, homo sapien
tcatagtaaataaaactctaagcaartgtatctacagtttttggttttgg

SEQ ID NO: 31390 - DNA, 50 bp, homo sapien
cgaaaatattaaaggaagttgtcaaractgaaaaaaattatatatactac

SEQ ID NO: 31391 - DNA, 50 bp, homo sapien
ggggctcacattctgttttaaatccrgccaattagaaattttttttctaa

SEQ ID NO: 31392 - DNA, 50 bp, homo sapien
gtcacagatgcacagattggcagaayagttacctgagcagtgtgacttca

SEQ ID NO: 31393 - DNA, 50 bp, homo sapien
tactttacatggaaaaattaacttaygccaccttataggtagaaaagctg

SEQ ID NO: 31394 - DNA, 50 bp, homo sapien
aaaaactttcactcttacttctatawaacatgcagtatacgtattccatt

SEQ ID NO: 31395 - DNA, 50 bp, homo sapien
acagacatcagcactctaggctacayaaaggatagtctgaaaactgtaag

SEQ ID NO: 31396 - DNA, 50 bp, homo sapien
aggagggaaggattagcactcttcaraaagtatcctgagtggataattgc

SEQ ID NO: 31397 - DNA, 50 bp, homo sapien
aaccacaatggtctttggccttgagractgccccttcccctggccattca

SEQ ID NO: 31398 - DNA, 50 bp, homo sapien
gttgtctcctaacaattttagaagartcagttttcattgtaagtataacc

SEQ ID NO: 31399 - DNA, 50 bp, homo sapien
gtatcaactcctaggtcatcagtaaytgtatatatgtaaacagctcaact

SEQ ID NO: 31400 - DNA, 50 bp, homo sapien
gggtggggcatcacagcatccaatamaatcactagtcatgatttttaaac

SEQ ID NO: 31401 - DNA, 50 bp, homo sapien
ccttaggaatgtcatcaaataatggkatggattgttgtacctgcttggtt

SEQ ID NO: 31402 - DNA, 50 bp, homo sapien
ctcaattaaatatttgctgattgaakttattttgggccaaagaccaggtt

SEQ ID NO: 31403 - DNA, 50 bp, homo sapien
gttaaagaaaggttattagatatcaratcaaagcattaaaaataaatcta

SEQ ID NO: 31404 - DNA, 50 bp, homo sapien
ttctggtgcttctcactgcttcccaygatggcaattactgacatgtcttc

SEQ ID NO: 31405 - DNA, 50 bp, homo sapien
gagacaaggtagaaaaccaatcccaratgaacaggagtactactgagacc

SEQ ID NO: 31406 - DNA, 50 bp, homo sapien
caagtcctatgagttcacagcttaargtcttcacagcaagtcagaccaat

SEQ ID NO: 31407 - DNA, 50 bp, homo sapien
agggaaaaaacatttgaaaaattgargtcacatgaaaagacttaaaaggg

SEQ ID NO: 31408 - DNA, 50 bp, homo sapien
gatgagaaaaatatgtgagctcacaraatgtctgcctctctcaggtgcag

SEQ ID NO: 31409 - DNA, 50 bp, homo sapien
gttacagttaaaacggaaatcaaagwcctttcgtgtcctacaaggcctcc

SEQ ID NO: 31410 - DNA, 50 bp, homo sapien
cagtgtcacttcatcatcctggaacscttttctaactcagcaaccagtgt

SEQ ID NO: 31411 - DNA, 50 bp, homo sapien
cctgttttatatcctaacacacagayactatttttttgtccccatggaat

SEQ ID NO: 31412 - DNA, 50 bp, homo sapien
ctgccttgtgtactgactctaaaacygtggatttgccaaacacaatctct

SEQ ID NO: 31413 - DNA, 50 bp, homo sapien
ctggctgccaataaatcacagtaggrcaaatgttaataagacaaaatgtt

SEQ ID NO: 31414 - DNA, 50 bp, homo sapien
ttttatatggtaggcactaatgaagkagtccacaaacactggttacatag

SEQ ID NO: 31415 - DNA, 50 bp, homo sapien
ccccagcctctaacataacacatgawatacagcggatgctcgataaacat

SEQ ID NO: 31416 - DNA, 50 bp, homo sapien
attagcttcctttttcatgaattaaygtgggtctgtggaatctacatttc

SEQ ID NO: 31417 - DNA, 50 bp, homo sapien
ttaattctgacttaatggccctttayacagatgctgaaagaagcctaggg

SEQ ID NO: 31418 - DNA, 50 bp, homo sapien
aacaggaagccctcagagagtcttayacaaagaatggccatggtggtggt

SEQ ID NO: 31419 - DNA, 50 bp, homo sapien
caaacataggattcacatgtgcaaastaacaaaatagatggtcctagctg

SEQ ID NO: 31420 - DNA, 50 bp, homo sapien
ggattattagctaccctatcattacsagaagcagaaattcatcctataac

SEQ ID NO: 31421 - DNA, 50 bp, homo sapien
ttaccaatgcatcttcaagtaagaartgttagcttaaatacaaattaata

SEQ ID NO: 31422 - DNA, 50 bp, homo sapien
acttaggtagtatgcctttcaaaaasatgtactatgaatctaatcctcat

SEQ ID NO: 31423 - DNA, 50 bp, homo sapien
cttacttcacaatgtgcccaggtcarctgtataaaataaatactgcattg

SEQ ID NO: 31424 - DNA, 50 bp, homo sapien
acattaaaagcttctaggaattacartagtctctcacacatacaatgatc

SEQ ID NO: 31425 - DNA, 50 bp, homo sapien
aacaataaggaggtataaatctgacmataccatggatttaggtttgaatg

SEQ ID NO: 31426 - DNA, 50 bp, homo sapien
gtgtgcaatagaagtgaagggaagaytagtgatattagttatgttctctg

SEQ ID NO: 31427 - DNA, 50 bp, homo sapien
actttcttatgttcctgtgtcttaawtggatgcaaaaaaacatgcaagaa

SEQ ID NO: 31428 - DNA, 50 bp, homo sapien
aaatgaaatagatttttgtaagttaygttaggcttgaatacatgcaaatc

SEQ ID NO: 31429 - DNA, 50 bp, homo sapien
aacagaatgatatttcattttaaagmccttgtggtatcaagtgataatac

SEQ ID NO: 31430 - DNA, 50 bp, homo sapien
tgctctcctccttttgcccagagaakaatgtccctctgctagccagtgtc

SEQ ID NO: 31431 - DNA, 50 bp, homo sapien
ttgggtaatttattggactttctgcrctttaattattattttcagggatt

SEQ ID NO: 31432 - DNA, 50 bp, homo sapien
caagagggatcatgtgcaagagctcrgagataagagagaccctaggacaa

SEQ ID NO: 31433 - DNA, 50 bp, homo sapien
tttgatagaagattctttttctccawagtctgcgtatcaggagagtcagt

SEQ ID NO: 31434 - DNA, 50 bp, homo sapien
cactgctgatgctccatactagagaytcatcctgtctgtgacctgacaaa

SEQ ID NO: 31435 - DNA, 50 bp, homo sapien
gctacaagtgttcattctataccaaragggatcatgtgcaagagctcgga

SEQ ID NO: 31436 - DNA, 50 bp, homo sapien
tcaaatctcacacatctgctactagrccatggatgctaggatagatcaaa

SEQ ID NO: 31437 - DNA, 50 bp, homo sapien
tttaatgagatcttcaacctattgaygaatgcccatgacagtagctcatg

SEQ ID NO: 31438 - DNA, 50 bp, homo sapien
ggtaaataccaaggagtaaaaggaawcattgttgacatgtgttttccttt

SEQ ID NO: 31439 - DNA, 50 bp, homo sapien
aagaacagagcaatgcctacagcaakttcaacggttctcctgaaacatat

SEQ ID NO: 31440 - DNA, 50 bp, homo sapien
aagaatttggagtgggtcgagagaaragagattgccatatttattggccc

SEQ ID NO: 31441 - DNA, 50 bp, homo sapien
tatttccaccacaagatacaatagaygttgatatggtttggctgtgtccc

SEQ ID NO: 31442 - DNA, 50 bp, homo sapien
taacaaatgtggaacccaaggttcaragaggtaagtgatttttcaaggtt

SEQ ID NO: 31443 - DNA, 50 bp, homo sapien
ggggctggggatacaaacatgataamgtcttagcctctgccatcagaaag

SEQ ID NO: 31444 - DNA, 50 bp, homo sapien
tccactagcatccatgaagaacccaktatgaaacaataactgctatgaag

SEQ ID NO: 31445 - DNA, 50 bp, homo sapien
ctactataaaacttaaaattatacaygtggctaacattgaatagtggtgc

SEQ ID NO: 31446 - DNA, 50 bp, homo sapien
cccttagtgccattttgtaaagaggyatcagtaatataactaagtttctc

SEQ ID NO: 31447 - DNA, 50 bp, homo sapien
gataaagcaggtcatatggctataarggataagaaaggaattctgggcca

SEQ ID NO: 31448 - DNA, 50 bp, homo sapien
tagtgctaaagatgtctctggtttasaatgttctgctaagctctgcaagg

SEQ ID NO: 31449 - DNA, 50 bp, homo sapien
ataaattatcaggactgttgagttayattcagtttttgtttttgtttttc

SEQ ID NO: 31450 - DNA, 50 bp, homo sapien
tatgggaagaagtaggcaaataaacygttccaaattgtgaaaagtgctga

SEQ ID NO: 31451 - DNA, 50 bp, homo sapien
cacattcttcactagggtctcttcaycttcgaattttgctgagcatcatc

SEQ ID NO: 31452 - DNA, 50 bp, homo sapien
ggacttaatggggagtaatggattaraagtgctgagatgccatttctgtg

SEQ ID NO: 31453 - DNA, 50 bp, homo sapien
gtaagccagctttttgttcttgtcarataaattctagagaccgtgaaaag

SEQ ID NO: 31454 - DNA, 50 bp, homo sapien
tgagactataggtgttggcggatacyacttcgttttgctggaatgccctt

SEQ ID NO: 31455 - DNA, 50 bp, homo sapien
gagtcaaggtataaaagagctttgcrgacgaaactaagaggaagagagct

SEQ ID NO: 31456 - DNA, 50 bp, homo sapien
agggaagtcagtgcctgacttgtcartacaatgcagcaggtccattctca

SEQ ID NO: 31457 - DNA, 50 bp, homo sapien
caatgtaggtgaaacagtcttcaacrgagaagataccatctagtacctta

SEQ ID NO: 31458 - DNA, 50 bp, homo sapien
aaatgagggtaagaatatccactcartaagtatatgataaaaagaaagtg

SEQ ID NO: 31459 - DNA, 50 bp, homo sapien
gatgttgtttcattcttctttgttayatgtggtgcctagtattggggctg

SEQ ID NO: 31460 - DNA, 50 bp, homo sapien
atttcaggtaaaatttcattcagtascaatgcctaaactggaggtcccag

SEQ ID NO: 31461 - DNA, 50 bp, homo sapien
aaaataagacaagaaagagaaagatsatagaaatacaggacactaatttg

SEQ ID NO: 31462 - DNA, 50 bp, homo sapien
gatacaagttgctattttttaattayatacttccacatatgaaaatgaaa

SEQ ID NO: 31463 - DNA, 50 bp, homo sapien
ttcgtgtgccctatttcacaaacgargtcagctagctgggaggacagtta

SEQ ID NO: 31464 - DNA, 50 bp, homo sapien
cacctaagtccttacagggaaaagayaacgatggctccaatgaaaagcat

SEQ ID NO: 31465 - DNA, 50 bp, homo sapien
tggtatgttactcaaataaccaccastgaatggaattacaatctttgggc

SEQ ID NO: 31466 - DNA, 50 bp, homo sapien
gggaggggaagggaagtgactggtasagtttcaaaaggtagcttgtgtac

SEQ ID NO: 31467 - DNA, 50 bp, homo sapien
agaaagcttaagttttttgccctaaracaataagatgcatttgcccaaat

SEQ ID NO: 31468 - DNA, 50 bp, homo sapien
cccaaatcataattcaacatataaarcatttacttcttgaattatatggg

SEQ ID NO: 31469 - DNA, 50 bp, homo sapien
ttaactcaggacagatggtgcttaayactgaccacacatgaagactggtg

SEQ ID NO: 31470 - DNA, 50 bp, homo sapien
ggtaatttgtgaaatttttttatgaygagaagtctgtgtcttgagtgtga

SEQ ID NO: 31471 - DNA, 50 bp, homo sapien
aaattactttttattgttacaatcasaggaattaaagcatgaacccagca

SEQ ID NO: 31472 - DNA, 50 bp, homo sapien
caaagaggaatctcagaggctggtayaaggatgagataggaggtcaagaa

SEQ ID NO: 31473 - DNA, 50 bp, homo sapien
gcatttgtcaagcaatgaaaaagcamaattaccttgaatggagccctgga

SEQ ID NO: 31474 - DNA, 50 bp, homo sapien
cataaaaaattagattgtatttggaygacatgtttgtataaccctttgga

SEQ ID NO: 31475 - DNA, 50 bp, homo sapien
tcatgtccttgctactagatttaggraaactcaacacagaccttgtctaa

SEQ ID NO: 31476 - DNA, 50 bp, homo sapien
gtggggtggaatggatagagaatgarctttgaagtcagacctaaatttaa

SEQ ID NO: 31477 - DNA, 50 bp, homo sapien
ggcaaaacaaattgaaatgccattcrcaacttagttatcatttaaattac

SEQ ID NO: 31478 - DNA, 50 bp, homo sapien
tgtttttgtccaatccgataacaacratatgtatagagactttcagatga

SEQ ID NO: 31479 - DNA, 50 bp, homo sapien
gtagaaagggtaaatgttgaaaacarctgtgttacggcagcaaagattca

SEQ ID NO: 31480 - DNA, 50 bp, homo sapien
cagtatcaagacagcatatgatagargtcaagagcaaggtactagaatta

SEQ ID NO: 31481 - DNA, 50 bp, homo sapien
ggtcccatttcaaatggtaaattcasgtagtattaatcctgtttcagagt

SEQ ID NO: 31482 - DNA, 50 bp, homo sapien
caatgctttggacgataagcatcagraaactctagattcaaataatttaa

SEQ ID NO: 31483 - DNA, 50 bp, homo sapien
catggctccttctcatcatagagggycatgtaaatgtcccctcctcagag

SEQ ID NO: 31484 - DNA, 50 bp, homo sapien
aaaaaatgattgaagtgcagttgaamaaaaataaagagagatgatttagt

SEQ ID NO: 31485 - DNA, 50 bp, homo sapien
ttaggaaagttgcactcagaatgggwacttactcagagaaatacagattt

SEQ ID NO: 31486 - DNA, 50 bp, homo sapien
agaggatgtagtatgtttcataaacrggttagttctcacaggaaggttca

SEQ ID NO: 31487 - DNA, 50 bp, homo sapien
ccattttcaagccaacactgactacsaagctcaagtggagaaacacaggc

SEQ ID NO: 31488 - DNA, 50 bp, homo sapien
atggttaccgtcagacgcccgaggaracctgagatgacctccttccttat

SEQ ID NO: 31489 - DNA, 50 bp, homo sapien
gctggatcctaggatgtatcctgagrcctattggaagccacaaaaatggt

SEQ ID NO: 31490 - DNA, 50 bp, homo sapien
gagtaagtctatagagtacaaatgayacatagctataattgacactgtaa

SEQ ID NO: 31491 - DNA, 50 bp, homo sapien
ttagcacagaacatgcaacatcaagsctcaatgggtttctctactccagg

SEQ ID NO: 31492 - DNA, 50 bp, homo sapien
caaaggaaaggaatgcagaggtatgmaaatgcacgtgtaatgtgccctgt

SEQ ID NO: 31493 - DNA, 50 bp, homo sapien
ggaacataggtatcatatttaactcrattacaatgccttgtgttttcaga

SEQ ID NO: 31494 - DNA, 50 bp, homo sapien
aggtttgagatatgtatcttttctakcatattttttacagaggtgtgatt

SEQ ID NO: 31495 - DNA, 50 bp, homo sapien
agccttagaagccaggataagagcayataatactcagaacaaaactgtgt

SEQ ID NO: 31496 - DNA, 50 bp, homo sapien
tgacctgtgagactctcccaccttarcaagttctagcccgtgcctacctc

SEQ ID NO: 31497 - DNA, 50 bp, homo sapien
aagctcctagccaggcaaagatctaygggaagagcattccaagcagaaag

SEQ ID NO: 31498 - DNA, 50 bp, homo sapien
agccctgtccacatcatgatcacaasttgccattctccttctgcgctctt

SEQ ID NO: 31499 - DNA, 50 bp, homo sapien
taattgatctggtttacaattaatamagaaaaagaaggcacagaaatgtg

SEQ ID NO: 31500 - DNA, 50 bp, homo sapien
agggcttctttcttctaccttgctcsatgacaatcaaacccaaaatgcct

SEQ ID NO: 31501 - DNA, 50 bp, homo sapien
tgatagtttagattaattggatcaartagaggtttatatttcatttattc

SEQ ID NO: 31502 - DNA, 50 bp, homo sapien
gattgattgactctcttctcctttamattgtaagatccataaaggcaagg

SEQ ID NO: 31503 - DNA, 50 bp, homo sapien
tagagtccccatctccttctggtgtracaattgctcataagcaaagggaa

SEQ ID NO: 31504 - DNA, 50 bp, homo sapien
agcaactttatctgcctcgaatgcawtaccattttggttgatggcctctg

SEQ ID NO: 31505 - DNA, 50 bp, homo sapien
ctatgtttagtgtgccagcagtaagsctacctcttccactgtactccagc

SEQ ID NO: 31506 - DNA, 50 bp, homo sapien
gataatttggcacagcagcccttagraatgactaccaacaccagtgatac

SEQ ID NO: 31507 - DNA, 50 bp, homo sapien
aactttcatctcatcttctgaaaaayaaggatgtcagtacttaactacag

SEQ ID NO: 31508 - DNA, 50 bp, homo sapien
taaaaaaaccctctcatttaagggargatatcaaaatgttaagaaagaag

SEQ ID NO: 31509 - DNA, 50 bp, homo sapien
gcacagcccctaaaacatcgaattawccagctgaaagatttgggtagtat

SEQ ID NO: 31510 - DNA, 50 bp, homo sapien
tgaagtagaaaatagacttttttggratattatcgatacatcagcagact

SEQ ID NO: 31511 - DNA, 50 bp, homo sapien
aaatgcataattcacaaaaggcccasaaagtgagtgttcttggtagaaaa

SEQ ID NO: 31512 - DNA, 50 bp, homo sapien
tctgcaaaggtaagatttcggtcaaraatctatagtcagctgggtgccgt

SEQ ID NO: 31513 - DNA, 50 bp, homo sapien
aaggtacagctgaagagagagttgamgaattaggtccaatatggcaacct

SEQ ID NO: 31514 - DNA, 50 bp, homo sapien
ttcaaaaccatttgatttttaactaygtgcttatttttgctttcataaaa

SEQ ID NO: 31515 - DNA, 50 bp, homo sapien
aataaataagtgttaactagcaatayggaagtaagaccaggaatgttgaa

SEQ ID NO: 31516 - DNA, 50 bp, homo sapien
gtatcactttaatttctgcaaaaaawttggcattttgataggacttgcat

SEQ ID NO: 31517 - DNA, 50 bp, homo sapien
gtgtgtgcatgggaactggggaatckcaatgtgctagagtaaggttttgt

SEQ ID NO: 31518 - DNA, 50 bp, homo sapien
gtaagagacacctgttgacttgaccrccacttagtaaccaacttctgatt

SEQ ID NO: 31519 - DNA, 50 bp, homo sapien
tacatttgctccttttctcctggtasagatctgctaaaagtaaaggaatc

SEQ ID NO: 31520 - DNA, 50 bp, homo sapien
aaatgtattagtgtgatatatcaggyatgctctagaacatctgtgtgtct

SEQ ID NO: 31521 - DNA, 50 bp, homo sapien
atattcatcatagagggctgaacgcraaatcaatttcccctctcaactgg

SEQ ID NO: 31522 - DNA, 50 bp, homo sapien
gattcataataaatttcaatttacawcaaactccagggaaatgtatgagg

SEQ ID NO: 31523 - DNA, 50 bp, homo sapien
tgggagaaatgacaaatacctcacarggaaattagaggactaaataatgc

SEQ ID NO: 31524 - DNA, 50 bp, homo sapien
ccttgtactttcacacttttacttaraaccctgtccaatggccatgtgaa

SEQ ID NO: 31525 - DNA, 50 bp, homo sapien
taatttttgaactcccactgtacggmagacctttatctcattattggaag

SEQ ID NO: 31526 - DNA, 50 bp, homo sapien
actagtatttgtgtagctggtgaaaytatcacacttctcctccttttgct

SEQ ID NO: 31527 - DNA, 50 bp, homo sapien
gcattaaataaacattccagactgasataaacgcaatgaagcagataaac

SEQ ID NO: 31528 - DNA, 50 bp, homo sapien
tacctatgcctctgttgaaatatcartgagtctgtctaataaatgcctgc

SEQ ID NO: 31529 - DNA, 50 bp, homo sapien
ttagaaactggtaatgataataatcratatttggcttgcatttttaatat

SEQ ID NO: 31530 - DNA, 50 bp, homo sapien
caggatctcatttgattcagtataasgaaacacaggtatttgtaaaaatt

SEQ ID NO: 31531 - DNA, 50 bp, homo sapien
tctcaaatcaggtatatgtgttagamgtcagtgaaatatgattgttggaa

SEQ ID NO: 31532 - DNA, 50 bp, homo sapien
gatgaatactttttagttgggaatayactcgttgtctaaaatgcagatga

SEQ ID NO: 31533 - DNA, 50 bp, homo sapien
actcaaaaggcttgaattgttaggasaaactagaaatagaccacagaatt

SEQ ID NO: 31534 - DNA, 50 bp, homo sapien
gatattaagttccaaccaattttaaytacatgtcgcttgtgcataatatt

SEQ ID NO: 31535 - DNA, 50 bp, homo sapien
tgttttcctttgtgctttacttggayattaagttccaaccaattttaatt

SEQ ID NO: 31536 - DNA, 50 bp, homo sapien
ttagcactcctaactccattttgttraaaggtcaactgtatatttctgtt

SEQ ID NO: 31537 - DNA, 50 bp, homo sapien
taaggaatattctcttacccttgtayggagaaggcagccctcccaaaaga

SEQ ID NO: 31538 - DNA, 50 bp, homo sapien
tgattaggtgctgcaatgtgtctgarcaaataaacttcctgaaataatcc

SEQ ID NO: 31539 - DNA, 50 bp, homo sapien
ctctacccatgaggaaaccaaacacmgtcacaggacacaatttatgggcc

SEQ ID NO: 31540 - DNA, 50 bp, homo sapien
aataaacttcctgaaataatccttaycttctacttgttttacattcatat

SEQ ID NO: 31541 - DNA, 50 bp, homo sapien
tacttaataaaatgtgtgttttagcrctgcagagaggaaaaaaattgaat

SEQ ID NO: 31542 - DNA, 50 bp, homo sapien
tccacaacttaaagctggtatttcamgtgtctggacattatccaaaatat

SEQ ID NO: 31543 - DNA, 50 bp, homo sapien
tattactaaggacattctaaaattcyatgacaggcaaaactccttgagat

SEQ ID NO: 31544 - DNA, 50 bp, homo sapien
tgttaagattggttctgcggctaaayaagtgtgagtattgctgggttaaa

SEQ ID NO: 31545 - DNA, 50 bp, homo sapien
aagttttttctatatctaacactcayctcactttttcctaaaataaattc

SEQ ID NO: 31546 - DNA, 50 bp, homo sapien
gtgtgactaaggacttgtcaggcaayttcaatatctaatgaattatagtc

SEQ ID NO: 31547 - DNA, 50 bp, homo sapien
cttagcaggtgctctataaacatcarcaaagactggataaatttctactg

SEQ ID NO: 31548 - DNA, 50 bp, homo sapien
actcaaatccaaaagggtctgtttgyaaagtccatgttctttctaccatc

SEQ ID NO: 31549 - DNA, 50 bp, homo sapien
gctcagatgctcatggccggtgagtsaatcaactggcatcattttaaagc

SEQ ID NO: 31550 - DNA, 50 bp, homo sapien
agatattttacaatttcatttatatkaagttcaaaataggcaaaactaat

SEQ ID NO: 31551 - DNA, 50 bp, homo sapien
atgaaatatgatttggaaaagagaastggatttgaaaattcaggcttgaa

SEQ ID NO: 31552 - DNA, 50 bp, homo sapien
acaatgctaagttaaaaacatggaartgcttcatcctgctgcacaggaga

SEQ ID NO: 31553 - DNA, 50 bp, homo sapien
ctgtctcattgatattaaccaaatgwcattgatactaactttttcaaatg

SEQ ID NO: 31554 - DNA, 50 bp, homo sapien
ccatgtctaaacaagcaatgtagaayaaaaggctgtgaaattatcaagca

SEQ ID NO: 31555 - DNA, 50 bp, homo sapien
ttgttgcttttcagatgatgcaaacmgtcttaggttgaatattcgctgtt

SEQ ID NO: 31556 - DNA, 50 bp, homo sapien
ccaattttcttatttcccagtatgasagtgattttcttttacaaaataaa

SEQ ID NO: 31557 - DNA, 50 bp, homo sapien
ctaagacaaggtagcattctgagacractactatgagtttcatgaaatgg

SEQ ID NO: 31558 - DNA, 50 bp, homo sapien
aatgagaaccctgctgtatttgagtmaccagttttatgtctttgctggct

SEQ ID NO: 31559 - DNA, 50 bp, homo sapien
gaacaaactactgttacctgcaacartataaataaagctcatagatgtga

SEQ ID NO: 31560 - DNA, 50 bp, homo sapien
tttccaaaaagaggtaaaagataaamccaagtgaatggagaatttggtat

SEQ ID NO: 31561 - DNA, 50 bp, homo sapien
tggaatactactaaatgtggctttayactaaactaaataaaccaagtagt

SEQ ID NO: 31562 - DNA, 50 bp, homo sapien
aaatctttataaacacaccatttcaracaatgctattttactctttctgg

SEQ ID NO: 31563 - DNA, 50 bp, homo sapien
tctaattgacgtttattgataagaaktcaacaagggagataaaatgaaac

SEQ ID NO: 31564 - DNA, 50 bp, homo sapien
gatgttcaataggaaaccaacacaaygtcagaaagaatagcaccctaaca

SEQ ID NO: 31565 - DNA, 50 bp, homo sapien
agtgaaaagtgagtgtgaacctaacmgacaactaactgaatacttccctc

SEQ ID NO: 31566 - DNA, 50 bp, homo sapien
agaacttaagcctgtccagttggaartagccaacaaacttatgtatatat

SEQ ID NO: 31567 - DNA, 50 bp, homo sapien
aggggttagggtttcaacataaacaytgggtgacacagttcaatttttgc

SEQ ID NO: 31568 - DNA, 50 bp, homo sapien
taaaacccatattgagaaccttctgyaagtgcatgtggagaggaagcaag

SEQ ID NO: 31569 - DNA, 50 bp, homo sapien
ctgcctggaatgaagatgaggtatargctgcactccgtttcatttttgac

SEQ ID NO: 31570 - DNA, 50 bp, homo sapien
ataatctaacacacaaaattttaacrcagccttttatcctcttttaatta

SEQ ID NO: 31571 - DNA, 50 bp, homo sapien
gttcttggcagagttttcactgatgyattgctaaatgaggaaggtaaaga

SEQ ID NO: 31572 - DNA, 50 bp, homo sapien
ggcatatgtcattccggactatgacractgtataaactattaaagatcga

SEQ ID NO: 31573 - DNA, 50 bp, homo sapien
agccgctcaggagatgaagtggaacycttgctaatttaatttgcatatgc

SEQ ID NO: 31574 - DNA, 50 bp, homo sapien
atcagtttctgagatcctatcaaaasaatgacaaatcaatttggaaaaga

SEQ ID NO: 31575 - DNA, 50 bp, homo sapien
tgggattaagaaacactggtatagasataaattttccttaacttttaaga

SEQ ID NO: 31576 - DNA, 50 bp, homo sapien
atgttttgatctgtctaaaatattaygtaggcattctcaagtgattaaga

SEQ ID NO: 31577 - DNA, 50 bp, homo sapien
ggacgcttgccaggaacagaaggtaygctgcacatggagagtgtttcgag

SEQ ID NO: 31578 - DNA, 50 bp, homo sapien
attgtctgaagaacataaaaaattakgcgatcatgctcttcctcattgtt

SEQ ID NO: 31579 - DNA, 50 bp, homo sapien
aagaggagcacccagtatagggaaartagatctcagagaatatatgtacc

SEQ ID NO: 31580 - DNA, 50 bp, homo sapien
aagtgtccttaaagtaaacaaactcrgaatattccagtcattaaaacagg

SEQ ID NO: 31581 - DNA, 50 bp, homo sapien
tacaagccctttacaatttcccttaygcttcttgagtttgggtgttgatt

SEQ ID NO: 31582 - DNA, 50 bp, homo sapien
tggtgtttgttaagtttaaggaataragaggccagtagagattttggtag

SEQ ID NO: 31583 - DNA, 50 bp, homo sapien
tcattaataaactgataagggctcawatacttgtcctcaattttatttat

SEQ ID NO: 31584 - DNA, 50 bp, homo sapien
agacctgtctgggaacatggagtgaracagaaactaagagagccaccact

SEQ ID NO: 31585 - DNA, 50 bp, homo sapien
cacctgaaaacactgatgtataagamgacaaatgtcacaggtgcctcaaa

SEQ ID NO: 31586 - DNA, 50 bp, homo sapien
aagagagaattctaaatagaacagargtaactgcccagtcaacaggtttt

SEQ ID NO: 31587 - DNA, 50 bp, homo sapien
acagccttgttcaatcattcaagcartatttatctagcaaggcattatgg

SEQ ID NO: 31588 - DNA, 50 bp, homo sapien
tttcagctctgaaaatgttgtcgcckatattgtaattgcaggttagatta

SEQ ID NO: 31589 - DNA, 50 bp, homo sapien
gtattttgatgattctaatactcacmgtctctgaaattaatacgttcctt

SEQ ID NO: 31590 - DNA, 50 bp, homo sapien
ttatagcagatctagaactggcaacraactgtagtaagccaaagagtgag

SEQ ID NO: 31591 - DNA, 50 bp, homo sapien
tgttaaaagttttcaaacttctaaayaatagtgaatacgccaagttttaa

SEQ ID NO: 31592 - DNA, 50 bp, homo sapien
gagagttttggctatttcttaatacygaactcatgcataggcaatcatac

SEQ ID NO: 31593 - DNA, 50 bp, homo sapien
cacgaccgtcaatttactcatctacrgaatggaagaaaatcaggtaactc

SEQ ID NO: 31594 - DNA, 50 bp, homo sapien
ccatgaaaactaagtgtaatcttcastcaataaaatatccactaaatact

SEQ ID NO: 31595 - DNA, 50 bp, homo sapien
taaagaaaacttaaatactaaatcaktaggccaacatcataaaaagaaat

SEQ ID NO: 31596 - DNA, 50 bp, homo sapien
accatctggatgctgtccacattttwaaaacacataaattaaaacccaag

SEQ ID NO: 31597 - DNA, 50 bp, homo sapien
agtttaataaatggcattaagaataragataaatgaaaaggttgactttg

SEQ ID NO: 31598 - DNA, 50 bp, homo sapien
taaaacactagatattatttatgaasaagtcaaaatatcagcatgtcctc

SEQ ID NO: 31599 - DNA, 50 bp, homo sapien
ggctacaaagagattgatggaatggrcaatttactgttcaataatgagtt

SEQ ID NO: 31600 - DNA, 50 bp, homo sapien
acttacatttagacacactcctacayacatcattgtgacacagtagatca

SEQ ID NO: 31601 - DNA, 50 bp, homo sapien
ccaatgtttgattgtcagtagtataragggcaatgtcttggtttcttcct

SEQ ID NO: 31602 - DNA, 50 bp, homo sapien
acacacatacacacacacaccacacrgtaacagtgagatgatgggtaagt

SEQ ID NO: 31603 - DNA, 50 bp, homo sapien
ttccctgtttttactactttttctaygcccaaaggatgtcaacatagctg

SEQ ID NO: 31604 - DNA, 50 bp, homo sapien
ggtggcttgtagaatgttcttttgaytaagatttaccttgatttgctttg

SEQ ID NO: 31605 - DNA, 50 bp, homo sapien
gtttggctatgcttgttcttggacaygaaaccactgatagatatggtttg

SEQ ID NO: 31606 - DNA, 50 bp, homo sapien
aagcttcaactatgtttggaatgtaycgaatcaataaattgctaattttt

SEQ ID NO: 31607 - DNA, 50 bp, homo sapien
aaaccagtcacattcaacaaataaakaatgaaaccagaaccctgctcagt

SEQ ID NO: 31608 - DNA, 50 bp, homo sapien
tctaaatggagacaggactgggatayaggagcttgtacggataaacaaca

SEQ ID NO: 31609 - DNA, 50 bp, homo sapien
acccaatcatatactggttatttgaygttagtgaaactaaggggcctctc

SEQ ID NO: 31610 - DNA, 50 bp, homo sapien
tcatattctacacaatgttctcccayggcccgaaactgacagtgttcatt

SEQ ID NO: 31611 - DNA, 50 bp, homo sapien
atttttaccccaacactgatattaaygggctgtatcgtagaaggctttca

SEQ ID NO: 31612 - DNA, 50 bp, homo sapien
gagaagaattgctgaaatttaaggaygttgatggtcaggactttcagagg

SEQ ID NO: 31613 - DNA, 50 bp, homo sapien
ctgtgaggagaccacttggaaaagasaagagaccttaggttgagagtaca

SEQ ID NO: 31614 - DNA, 50 bp, homo sapien
agccacttgaatccttcctgattccraaactactgctttttttctttcta

SEQ ID NO: 31615 - DNA, 50 bp, homo sapien
atctccctaccaccacccaaaaagaygtatgaacactaaaggctacagta

SEQ ID NO: 31616 - DNA, 50 bp, homo sapien
aaggcatgggaaaagaaatatgaaaygtaaatggtaaaatgttgaagcca

SEQ ID NO: 31617 - DNA, 50 bp, homo sapien
tcctggcctaaggtaggtgaccatgsagagtgatcattattccgaaaggt

SEQ ID NO: 31618 - DNA, 50 bp, homo sapien
gatggtgctagtagcagaaagtgagsaattcaataagcaaggattcattt

SEQ ID NO: 31619 - DNA, 50 bp, homo sapien
atcatggtgggacatttctgacatayaggtagaatgcaaatgacagttgg

SEQ ID NO: 31620 - DNA, 50 bp, homo sapien
gagaagacacagaaaacctggaaacygctggtggaaaaattgttacggat

SEQ ID NO: 31621 - DNA, 50 bp, homo sapien
cctaactgacttttctgatactactyacctctgatgtgcttttatcatga

SEQ ID NO: 31622 - DNA, 50 bp, homo sapien
taatgaaagaaaacttaatctaggargtgaaagagaaaccaagactggaa

SEQ ID NO: 31623 - DNA, 50 bp, homo sapien
tttttccctctgggaaatagcaatgmatgagttatccatacagagatcaa

SEQ ID NO: 31624 - DNA, 50 bp, homo sapien
gaggataaatgatctttcctaactgrattattgatacaggtagttcacat

SEQ ID NO: 31625 - DNA, 50 bp, homo sapien
tgctctaacatcttccttaaaagagsatgtttcatgtgaacacttcaacc

SEQ ID NO: 31626 - DNA, 50 bp, homo sapien
ctcttaaagttgtggtcagaattaartaagtcagtaatgtgaactacctg

SEQ ID NO: 31627 - DNA, 50 bp, homo sapien
caatgtctagagataaacatacctasctattttggtgtttcctgtgggag

SEQ ID NO: 31628 - DNA, 50 bp, homo sapien
gtctccagggcatggctcgtaattcycaacttagtttactaagttctgtg

SEQ ID NO: 31629 - DNA, 50 bp, homo sapien
tgcaaagtctcatgaaatcatcccaratattacatccatccaatccaaaa

SEQ ID NO: 31630 - DNA, 50 bp, homo sapien
gcctaaggtcatttttgaatgcttaygggaaaagtttgttttaggcactg

SEQ ID NO: 31631 - DNA, 50 bp, homo sapien
gatgtgctaaagtgagaagttaaaasatcgatcagttaggtgatgttttg

SEQ ID NO: 31632 - DNA, 50 bp, homo sapien
aaaatgatgctaaagctgcaactaaytgaataaacaaagcacacaaattc

SEQ ID NO: 31633 - DNA, 50 bp, homo sapien
ctctaagagcgtacttcttccaaacygaccagatttcccacacattggca

SEQ ID NO: 31634 - DNA, 50 bp, homo sapien
caatctcatgctgtgttatagatatsaacaactcattttcccttttcatg

SEQ ID NO: 31635 - DNA, 50 bp, homo sapien
gtatgcacccacctctctctggaaayctctatcagtgtgaaacattaagt

SEQ ID NO: 31636 - DNA, 50 bp, homo sapien
ttttctcatatacatcttgtacccamctttatttagcttgctgtataata

SEQ ID NO: 31637 - DNA, 50 bp, homo sapien
aatgttactgtgttattaatttatayattgtttatgctttctcagtagga

SEQ ID NO: 31638 - DNA, 50 bp, homo sapien
gccaccagcagactgtgggttagacyaagcataaagcattcctcaggctt

SEQ ID NO: 31639 - DNA, 50 bp, homo sapien
tgacatgcactgactaaaggaaacawctttaaacgtgaagataaattctg

SEQ ID NO: 31640 - DNA, 50 bp, homo sapien
atcacttctgtttgttacttgttacygggtataataaggaccagctctcc

SEQ ID NO: 31641 - DNA, 50 bp, homo sapien
agaagagcagcttacaactgaagaasagaaaatccagaaggatgatgtta

SEQ ID NO: 31642 - DNA, 50 bp, homo sapien
cccaagttaagcattttaacataacrgtggataagactaaacatatgaat

SEQ ID NO: 31643 - DNA, 50 bp, homo sapien
tacattggaaatgccggcatcaccartaatgactttaggcaatactgact

SEQ ID NO: 31644 - DNA, 50 bp, homo sapien
ttagaaaagctccactttatgattcracccgtgctgtcttcacttgacca

SEQ ID NO: 31645 - DNA, 50 bp, homo sapien
ttcctctgtcagacactggaactcayacaaatacacaaattctaaaacat

SEQ ID NO: 31646 - DNA, 50 bp, homo sapien
  misc_feature (5)..(5): n is a, c, g, or t
ttacncataaatgatgaattttagcsaagggaaggccatatactattgtg

SEQ ID NO: 31647 - DNA, 50 bp, homo sapien
cagtcataccatggtttgaaagaaamttatagagtgaaaccagaccttag

SEQ ID NO: 31648 - DNA, 50 bp, homo sapien
tttagcatcctaaagagcatcccaaygggcagtcttttattaaatgccta

SEQ ID NO: 31649 - DNA, 50 bp, homo sapien
ggtgaaatgaccacaatttgtctaaraagtactcaagcccgttctcaacc

SEQ ID NO: 31650 - DNA, 50 bp, homo sapien
aagtccccttccttatttttacagargattgtttgtggcacttacaagca

SEQ ID NO: 31651 - DNA, 50 bp, homo sapien
gagagcttgggccctcagatcactayaaagcaaactcttggaggtgacag

SEQ ID NO: 31652 - DNA, 50 bp, homo sapien
ggcgagggaagactaatacctacaaygattgaacttatttgcgtgattgg

SEQ ID NO: 31653 - DNA, 50 bp, homo sapien
attctcctccagcacatgacacaatyagagggagatgcattgtgcttaaa

SEQ ID NO: 31654 - DNA, 50 bp, homo sapien
acttattttttttctttcagtacaawctcatgttatttttgtggtcttaa

SEQ ID NO: 31655 - DNA, 50 bp, homo sapien
attcactgtgactgaaacaatctaayaaataaacgggttggaggatggga

SEQ ID NO: 31656 - DNA, 50 bp, homo sapien
ttttccccaggaatttgaaactagarcagagatagagaacagaatggatt

SEQ ID NO: 31657 - DNA, 50 bp, homo sapien
gcagtcttcagtcttgcagctgagcyatgaaatgtattcccagtttaaaa

SEQ ID NO: 31658 - DNA, 50 bp, homo sapien
cttccccaattatcattttataaggkactaattgagggccttctgttcca

SEQ ID NO: 31659 - DNA, 50 bp, homo sapien
ctcctcttatttatgctactccaaasaatgtgacaatgaacacttatgga

SEQ ID NO: 31660 - DNA, 50 bp, homo sapien
gcctatagaatgaatgacattgttcrcactaaaactttttagcaaagcga

SEQ ID NO: 31661 - DNA, 50 bp, homo sapien
tcacaaaaaatagggtgtgatgatcygagatgtgaattatctgcctatag

SEQ ID NO: 31662 - DNA, 50 bp, homo sapien
gtactttacaagtgtgcaagaatcayggtgttactgggcttggggtgccc

SEQ ID NO: 31663 - DNA, 50 bp, homo sapien
ctgaataagtggaacacggaagtaamaaaggattctgtcactatttacgc

SEQ ID NO: 31664 - DNA, 50 bp, homo sapien
taaggttaggtctagtgttcaagaaygcaacaggagatgacattaaagat

SEQ ID NO: 31665 - DNA, 50 bp, homo sapien
tcattaagcccaatatatattcaggwcagtttttgaacaggatgggaaca

SEQ ID NO: 31666 - DNA, 50 bp, homo sapien
aaaaagtttttttcctttgtatgaawattttgtgaagttcattcaaatgt

SEQ ID NO: 31667 - DNA, 50 bp, homo sapien
gggcttaacatgtagctgaatgtcaraaggtttcaacagggtttcagaga

SEQ ID NO: 31668 - DNA, 50 bp, homo sapien
gtgcttagtacatgcctacctgaggkacttaggattttttattccctctc

SEQ ID NO: 31669 - DNA, 50 bp, homo sapien
aggcctacgtccttaggatggcttayagcagtggttcccaaagtgtggtc

SEQ ID NO: 31670 - DNA, 50 bp, homo sapien
accaaaaaggagagagtcacaccgaraagtcagttttgagatcagtttag

SEQ ID NO: 31671 - DNA, 50 bp, homo sapien
acagcttgaagtcttaatattagtayaggagtggcaagtggaagcttgga

SEQ ID NO: 31672 - DNA, 50 bp, homo sapien
tggagggtgctgaggaaatgagaacmgtagaattagtctatacaaaattt

SEQ ID NO: 31673 - DNA, 50 bp, homo sapien
cctcccaggtgtttacccatctaaaytgtgtgatgaaatgtcttttgaac

SEQ ID NO: 31674 - DNA, 50 bp, homo sapien
cttgaaagatgttagggataaaaaawtgttcgcgggcagtgaagtctggg

SEQ ID NO: 31675 - DNA, 50 bp, homo sapien
tgaatactttggttgccaatgctagrcatatactaattccctgctcagta

SEQ ID NO: 31676 - DNA, 50 bp, homo sapien
aaacaaaacacaattttattatcgckcatggctttttttttttttttttc

SEQ ID NO: 31677 - DNA, 50 bp, homo sapien
attttccatagatttttcaagtcccracagtaacatttctataaaagcct

SEQ ID NO: 31678 - DNA, 50 bp, homo sapien
ttatttggatattgtttctattaccyattactgactagtgtaacacccga

SEQ ID NO: 31679 - DNA, 50 bp, homo sapien
agtttttttttaattctgctaaatawtaagtccaataataagtcctctct

SEQ ID NO: 31680 - DNA, 50 bp, homo sapien
tatggcattcttaggaggtgttaatyagattagtttggtagaggtaggtt

SEQ ID NO: 31681 - DNA, 50 bp, homo sapien
aagtgatagtgcagacaactaataasaaaataatgatagcaaaatagtaa

SEQ ID NO: 31682 - DNA, 50 bp, homo sapien
gtggggatcataactgaaaagctcarcggtacaatcatcgttcctaaata

SEQ ID NO: 31683 - DNA, 50 bp, homo sapien
aaagggatcacatttttcaaagttgyatgcttagactaagaataaccctg

SEQ ID NO: 31684 - DNA, 50 bp, homo sapien
taatgtagaagtgggtcacacgttgraggctgggaaattcttgcattgtt

SEQ ID NO: 31685 - DNA, 50 bp, homo sapien
gctcgtgagttttgaagactctcacmagggacattaatggacggaatatt

SEQ ID NO: 31686 - DNA, 50 bp, homo sapien
atacccatttggctagatcggcaaayggagacactgatgtatataaggtc

SEQ ID NO: 31687 - DNA, 50 bp, homo sapien
cttctagctttcaaattcactgaacygaatccaatctgaaacaactaggt

SEQ ID NO: 31688 - DNA, 50 bp, homo sapien
aaagcttatggcttttgacaggatayagaattttgtttacagaagttaaa

SEQ ID NO: 31689 - DNA, 50 bp, homo sapien
ctacagagaatgtgaggttatgcaakcaattaatccaatattgacagtgg

SEQ ID NO: 31690 - DNA, 50 bp, homo sapien
gaagtatatgagcccaggtcacagayataggtactgaaagaagcctgatt

SEQ ID NO: 31691 - DNA, 50 bp, homo sapien
catcactaatatatggtttctagtayaggaggaaatatagcacaagagag

SEQ ID NO: 31692 - DNA, 50 bp, homo sapien
tccttgtgccaaatacaaataatgayagtccgttcctaaagcttaacaaa

SEQ ID NO: 31693 - DNA, 50 bp, homo sapien
aggtcaacatgagcaaagtgaattarctcagaatctagtattaagtgtgt

SEQ ID NO: 31694 - DNA, 50 bp, homo sapien
tatgttcccatatacctagaatagtkcatacgttatggtagaaactctgt

SEQ ID NO: 31695 - DNA, 50 bp, homo sapien
gcacatcagtaagggtcagtctttgyacatttgtttcatcattacttcca

SEQ ID NO: 31696 - DNA, 50 bp, homo sapien
tccgtctaattgcatgtaattgctayattggcctcttctctgtttctgga

SEQ ID NO: 31697 - DNA, 50 bp, homo sapien
ttttaaagcttcatgtcctatctcaytacttatgaaactttgtatttgaa

SEQ ID NO: 31698 - DNA, 50 bp, homo sapien
cacgcaattcttttctcagcaaacartggaattacatccagcttggttgg

SEQ ID NO: 31699 - DNA, 50 bp, homo sapien
gcttgagcaactttgaaagcgtttcyatcaccagcaaccaaaggggcttc

SEQ ID NO: 31700 - DNA, 50 bp, homo sapien
ataattagttctcttctagaaaccayagtttagctgtactttccctccat

SEQ ID NO: 31701 - DNA, 50 bp, homo sapien
tcaaaggccagatagctctctcttayatggaagatgtggcctccaaagtc

SEQ ID NO: 31702 - DNA, 50 bp, homo sapien
attcaaacagtcatagaaaacttcasagagaggagaaacaggcaagacag

SEQ ID NO: 31703 - DNA, 50 bp, homo sapien
aaggaccttaaaggttaacaataaartctcaaattgaatcctcattctca

SEQ ID NO: 31704 - DNA, 50 bp, homo sapien
taggaattagcctacagaagtaacamgacaagttcaaaaaagtcacatgt

SEQ ID NO: 31705 - DNA, 50 bp, homo sapien
tgttatgtgacatggtgggttcaacmatagaaatatactcaatatgtggg

SEQ ID NO: 31706 - DNA, 50 bp, homo sapien
aactgcccccgaaatgtagaaaacaytgattaggacaaaatgctaagata

SEQ ID NO: 31707 - DNA, 50 bp, homo sapien
aaaggtaagcattcagttaattaccyggatgtcttgatatctgggcacat

SEQ ID NO: 31708 - DNA, 50 bp, homo sapien
tgtctagattcaaagtgcaagccttkaaccattactccattggttctcaa

SEQ ID NO: 31709 - DNA, 50 bp, homo sapien
tgggtcttgtttttgtctattctgayggtctctaccttttaattgaatta

SEQ ID NO: 31710 - DNA, 50 bp, homo sapien
cgcatttggttatgggtagcagccayctgtgttacctcatgttacatctc

SEQ ID NO: 31711 - DNA, 50 bp, homo sapien
atgaagctgataataaaagtgcttaygtttaagagttactatgagtatta

SEQ ID NO: 31712 - DNA, 50 bp, homo sapien
actggggataagctgtcactgtgaartaggcacaaaacacaatgctgggg

SEQ ID NO: 31713 - DNA, 50 bp, homo sapien
taggctctgtcatcctgaaggctacragttttattttaaaggaagggcag

SEQ ID NO: 31714 - DNA, 50 bp, homo sapien
ttcttttttgcagctttttaatatcmcgagaacaagtatagagcctcctc

SEQ ID NO: 31715 - DNA, 50 bp, homo sapien
gcagaatggctacttggttgcataaygctttcctgtggggttaagatgaa

SEQ ID NO: 31716 - DNA, 50 bp, homo sapien
cctctggaatttatcttcatctctayattttagcagcctctccctatgaa

SEQ ID NO: 31717 - DNA, 50 bp, homo sapien
ttaggaattgcctttgttgtgcttaycaaaatctgtaattattttgggag

SEQ ID NO: 31718 - DNA, 50 bp, homo sapien
aaatgcactaagctcagatccttacratttagcctcttcttctgtgtctc

SEQ ID NO: 31719 - DNA, 50 bp, homo sapien
cagtcggtctttctttgaacaagtawactgaactctgaaaattggacctg

SEQ ID NO: 31720 - DNA, 50 bp, homo sapien
acaaaatcttatctctccatattgayggttttcaaagtgttttcatatgg

SEQ ID NO: 31721 - DNA, 50 bp, homo sapien
ttgtaggcaaacaaatgtgagtacamgtgacatatgccacttcccagcag

SEQ ID NO: 31722 - DNA, 50 bp, homo sapien
ccttcaggaaaatcaggcccagtgasgataataccaataacatcatcaga

SEQ ID NO: 31723 - DNA, 50 bp, homo sapien
ttgggaaaaatatgaaagtgtagaamggatattagggtatcaaaagaaaa

SEQ ID NO: 31724 - DNA, 50 bp, homo sapien
ttaaaatgtaggccaatatagaggaraatgataatgggcatataagtatt

SEQ ID NO: 31725 - DNA, 50 bp, homo sapien
tgaaatatgcaaggcaaatgaactasaaagaaatacagccatatgtgaac

SEQ ID NO: 31726 - DNA, 50 bp, homo sapien
tagttcaaactaagttcaataaagasaatctgattagctgctggtcagcc

SEQ ID NO: 31727 - DNA, 50 bp, homo sapien
tttgcagaccttacaagaagcctaarcatattaagtaacagaccttttgg

SEQ ID NO: 31728 - DNA, 50 bp, homo sapien
aacagcttgtaagaagaccgttggastatcacaagctaaacataaataat

SEQ ID NO: 31729 - DNA, 50 bp, homo sapien
atatatacaaatagtacaagtttcaraagtgatcattgttataaagaaaa

SEQ ID NO: 31730 - DNA, 50 bp, homo sapien
tcaatatttaacatgtacatttaccrgcatctacacagatccatggtttt

SEQ ID NO: 31731 - DNA, 50 bp, homo sapien
aaaatacactgaaaacgaagacaaastattttctggcgaagtgctaactg

SEQ ID NO: 31732 - DNA, 50 bp, homo sapien
aggctgaacacagcacggaatgtgamaaagacagcgctgagaagctacac

SEQ ID NO: 31733 - DNA, 50 bp, homo sapien
cttgtgtgaggcacaaattttgacargtataaaactgatttgctctggtt

SEQ ID NO: 31734 - DNA, 50 bp, homo sapien
cccaggaaccagaggcaaataaatamcccgatgtttgctatgaaacgggc

SEQ ID NO: 31735 - DNA, 50 bp, homo sapien
attaattgtagaagcagaaaatgtaygcagagtaatcaaaatacaacatc

SEQ ID NO: 31736 - DNA, 50 bp, homo sapien
tgtcatgcattcacaagcaaccacamgtttattaaagaatagccagcatt

SEQ ID NO: 31737 - DNA, 50 bp, homo sapien
ttcattacaaaatagtgttatttaaytggcactctaacatgtaaagtgat

SEQ ID NO: 31738 - DNA, 50 bp, homo sapien
ttttcctttctctcccatttctgacwaactcaaatttactgggtgcctgc

SEQ ID NO: 31739 - DNA, 50 bp, homo sapien
tttggctgaagaaaatcacaacagaygagagataatgcaagagaaaaata

SEQ ID NO: 31740 - DNA, 50 bp, homo sapien
atttgagagagctgtgtagaagtcgsaggcttttctagattctctgagcc

SEQ ID NO: 31741 - DNA, 50 bp, homo sapien
tcttcaagctaacctttggtctcaamtacttcctctataatcttgatcaa

SEQ ID NO: 31742 - DNA, 50 bp, homo sapien
ttcttacaaatacatttttacaaaastctgctagaactgtaaatgatagg

SEQ ID NO: 31743 - DNA, 50 bp, homo sapien
atgtaaccttgctgtcttgacttgastaacagctactagatattaagcag

SEQ ID NO: 31744 - DNA, 50 bp, homo sapien
tataattctttgtgtgtctgtaaaayttatatatgtatgcatcattctgc

SEQ ID NO: 31745 - DNA, 50 bp, homo sapien
gttgtgttaatcataatagctggcaygtattaaattcttcataagcttat

SEQ ID NO: 31746 - DNA, 50 bp, homo sapien
tataatcatataagttgtttaaaaaktttcactgttatagataactgtaa

SEQ ID NO: 31747 - DNA, 50 bp, homo sapien
aaggcagttatggcctacaaattagkatttattctaccaaaggagacctc

SEQ ID NO: 31748 - DNA, 50 bp, homo sapien
aaaaaagaccaaagatcagtttccartatgcttttccaagtgtaatcaag

SEQ ID NO: 31749 - DNA, 50 bp, homo sapien
gcaaaggttcatgctattcgatagaygctttcactaaatgatgagtggga

SEQ ID NO: 31750 - DNA, 50 bp, homo sapien
atggagacaacattggataactctcyacattcaggctaggcagaattccc

SEQ ID NO: 31751 - DNA, 50 bp, homo sapien
acaaatcacttattccttgacaacaytatgtaaatgaaactgtacatggg

SEQ ID NO: 31752 - DNA, 50 bp, homo sapien
gttgctatttttactttatgcagtcmactatctttttaaaaaatgtttaa

SEQ ID NO: 31753 - DNA, 50 bp, homo sapien
ctaccgaaataaatcattatgaacaytcaacctcaaagaaaattatagca

SEQ ID NO: 31754 - DNA, 50 bp, homo sapien
gatacacataatttctaaacttttgratattagacactttcaattaaagc

SEQ ID NO: 31755 - DNA, 50 bp, homo sapien
agttcagtagttttccattcagcatkatgacagttctttttcaagctaag

SEQ ID NO: 31756 - DNA, 50 bp, homo sapien
agaatgtttataaatagttgggatgkaaagacaaaagcatggtggttttt

SEQ ID NO: 31757 - DNA, 50 bp, homo sapien
ttggtggaaatatattaattggacawaattgtgtgatggtgcaagcatga

SEQ ID NO: 31758 - DNA, 50 bp, homo sapien
gttgtttccaagatgaataatcttayaggttaatctttgcacacatctta

SEQ ID NO: 31759 - DNA, 50 bp, homo sapien
tatgatttctcaaccaacatatgatragcaaaaataactttcttgccttt

SEQ ID NO: 31760 - DNA, 50 bp, homo sapien
atctaataaagtgtgtaaaatctagsaactctccttttcagtatacacca

SEQ ID NO: 31761 - DNA, 50 bp, homo sapien
atggatgtctggcaaattatcttcamgtatgcattgttcataatttctta

SEQ ID NO: 31762 - DNA, 50 bp, homo sapien
atggcacgtaataggcatgtgagtgrataaatgcggaaaaaaataacagc

SEQ ID NO: 31763 - DNA, 50 bp, homo sapien
gtataaaggttaaagataacattgayggagaaatagtagctcttcaaatg

SEQ ID NO: 31764 - DNA, 50 bp, homo sapien
ggaataagagcttaatataaaggaaragtattggtagcccacataacttt

SEQ ID NO: 31765 - DNA, 50 bp, homo sapien
aaacagctatctttatatttgtaaasgaagtatgaacaactggcttaacc

SEQ ID NO: 31766 - DNA, 50 bp, homo sapien
aattggtgtccattcaaaaatttaaractaggaatgacattgcagaggac

SEQ ID NO: 31767 - DNA, 50 bp, homo sapien
taataaattattacacaacttacatraaacttgtaaagtttctctgatat

SEQ ID NO: 31768 - DNA, 50 bp, homo sapien
actattaatccatgatttattaagcyattagtcaaagatttcaacaccct

SEQ ID NO: 31769 - DNA, 50 bp, homo sapien
cagcaaaacgttaaagacctcctgayaaatggtaatgtaaggtctctcga

SEQ ID NO: 31770 - DNA, 50 bp, homo sapien
cactcttccaaagtacacaaaacagmacacttaatccataaaggagattt

SEQ ID NO: 31771 - DNA, 50 bp, homo sapien
aagcatgaagcactatgctaggtacmactacaataaaagatttggtaggg

SEQ ID NO: 31772 - DNA, 50 bp, homo sapien
aatgaaaatttcaaattgttcattayatttcaaatcagtttttaggaaag

SEQ ID NO: 31773 - DNA, 50 bp, homo sapien
tgcacaaacataactctaattcaaarcagatgtgatacttgctatagaaa

SEQ ID NO: 31774 - DNA, 50 bp, homo sapien
atgtgttccactcaagacttgagaaycaacacaaaaaatgaatatgtgtt

SEQ ID NO: 31775 - DNA, 50 bp, homo sapien
caattagagattggggctactcccaraaaagaaatctcccattactattc

SEQ ID NO: 31776 - DNA, 50 bp, homo sapien
aactctacttgtcctgacttgataamtaggcataagaaaatcctgtataa

SEQ ID NO: 31777 - DNA, 50 bp, homo sapien
tctaagtgcagtgggaagccattgayccaagcagtagttaagaagttcct

SEQ ID NO: 31778 - DNA, 50 bp, homo sapien
ccctgtctcaatcaatcaatcaatcrattaataaatgcttaagatgagcc

SEQ ID NO: 31779 - DNA, 50 bp, homo sapien
ccagaaatggcaacgctgtgagttaraggtgatatggtctttaggccaga

SEQ ID NO: 31780 - DNA, 50 bp, homo sapien
tgtcagatgcactcatctctgggaayttatttcatctgaaacttccagag

SEQ ID NO: 31781 - DNA, 50 bp, homo sapien
ttgccaatctttgttttctttgctayagtatcagagaaatggaactgaaa

SEQ ID NO: 31782 - DNA, 50 bp, homo sapien
catgaaaaccagggtttagctaggcmcttaatgtcttagtaggttacaag

SEQ ID NO: 31783 - DNA, 50 bp, homo sapien
gaaggtgggtacatctacaaatttargtctaccttactttctctagggtc

SEQ ID NO: 31784 - DNA, 50 bp, homo sapien
ttcttgtagtcctctttaaattgcasacattcaaacttattaagctgtgg

SEQ ID NO: 31785 - DNA, 50 bp, homo sapien
aatcaataggtattttcaaaaagtcwaagagtttccttctatactaacaa

SEQ ID NO: 31786 - DNA, 50 bp, homo sapien
ttccagcaaaccttatttcaagatargccctttcatctttcaagtggctt

SEQ ID NO: 31787 - DNA, 50 bp, homo sapien
tgttcctgctgaattctatagtccamattcttgtctacagctcaaagctg

SEQ ID NO: 31788 - DNA, 50 bp, homo sapien
ctgtggctagatctaggcacctaaakgaagaacatgttcccccttacccc

SEQ ID NO: 31789 - DNA, 50 bp, homo sapien
ggaatccctgagatattgacatcacrctaaagggttaagtttttagggca

SEQ ID NO: 31790 - DNA, 50 bp, homo sapien
tgtgttagagctgtaattgatttaargtctaaaactcattcaagagtatg

SEQ ID NO: 31791 - DNA, 50 bp, homo sapien
tggaaatcaaggcttgtagtttaaayagggaattaggaaagacttctatg

SEQ ID NO: 31792 - DNA, 50 bp, homo sapien
gatatctacataatctgattctccayagaaatgacgactgtactgatgcc

SEQ ID NO: 31793 - DNA, 50 bp, homo sapien
acaatctaaatgttcatcggctggaraatggaaaaataaattttggtttg

SEQ ID NO: 31794 - DNA, 50 bp, homo sapien
ggtggccgatatggcatccaatcaakaatttgtcagtcctttgtgaaagt

SEQ ID NO: 31795 - DNA, 50 bp, homo sapien
atgggcccttgtccctcaggctacartaacagttctgagagctgggtagt

SEQ ID NO: 31796 - DNA, 50 bp, homo sapien
agatctctcatccatgggatcaccaytggggacctagacaaacctcattt

SEQ ID NO: 31797 - DNA, 50 bp, homo sapien
ggatataacaaaaaattctcagagayctgttttagttgttagtgctattt

SEQ ID NO: 31798 - DNA, 32 bp, homo sapien
gattttgcttgattaaygcacttagcccaata

SEQ ID NO: 31799 - DNA, 50 bp, homo sapien
tctctttattaacttctatagcaatwacttcagattccttgtcatgccct

SEQ ID NO: 31800 - DNA, 50 bp, homo sapien
ttgcatatatttagggtatacaacaygatgttttgatatgtgtctacata

SEQ ID NO: 31801 - DNA, 50 bp, homo sapien
agtaaccatttcaaccttaaaatgartatcgtcagcaaacaaacgattat

SEQ ID NO: 31802 - DNA, 50 bp, homo sapien
ctcaaattaagagcccgtttattgcraaattgtccttaaaaagctaaatc

SEQ ID NO: 31803 - DNA, 50 bp, homo sapien
gagaaatgggaaagaaaatagaaaamggctgtgaaattagaatacaacgg

SEQ ID NO: 31804 - DNA, 50 bp, homo sapien
tgggcggtgcgatggtaataagaacrgtcaaatacagccaaggggacagt

SEQ ID NO: 31805 - DNA, 50 bp, homo sapien
ctagcctaatctcacctcccagagaygattcttttatgctgtcttccata

SEQ ID NO: 31806 - DNA, 50 bp, homo sapien
tggtgaagacttcaagttagtcctaygggaaggtcagtgcaagtgggaat

SEQ ID NO: 31807 - DNA, 50 bp, homo sapien
tttttcttcataatatttagtggaamgtatcttgcttttagggactgaat

SEQ ID NO: 31808 - DNA, 50 bp, homo sapien
tgttggacacagactcttgtggtcartacaaacccaaaattagaatttgt

SEQ ID NO: 31809 - DNA, 50 bp, homo sapien
gataccttcgggtgagtcataatctyactggtattctggccataaaatca

SEQ ID NO: 31810 - DNA, 50 bp, homo sapien
agaatttctcttttggcattctagaygtaggttagctttttctctaatct

SEQ ID NO: 31811 - DNA, 50 bp, homo sapien
gttttaattgagtacaatgctaaacyggaaaaaaaagtcttcgttaagga

SEQ ID NO: 31812 - DNA, 50 bp, homo sapien
aggttagctttttctctaatctgtckatcatatgcatgcatggggaaact

SEQ ID NO: 31813 - DNA, 50 bp, homo sapien
caccaagatctatttcattatttccragagcagtaatattggtgaaatca

SEQ ID NO: 31814 - DNA, 50 bp, homo sapien
gttctgcaactcacagagaaactaaytactttgctccctgatgagaagcc

SEQ ID NO: 31815 - DNA, 50 bp, homo sapien
tccagtaacaataccaaagagtagtraattacaggaaagatattttcctt

SEQ ID NO: 31816 - DNA, 50 bp, homo sapien
gttccatggaatgtttcaaggatgcygaaatgaaacatcaaccaatacgt

SEQ ID NO: 31817 - DNA, 50 bp, homo sapien
ttgaagtgataacaaatgattcaaartatcacataaacttaattgataaa

SEQ ID NO: 31818 - DNA, 50 bp, homo sapien
attagcttgaataacattggaaatayaacccatgagcttgtcactaaagc

SEQ ID NO: 31819 - DNA, 50 bp, homo sapien
tctatgcaagagtgtattcagtctcraagatatcaagaaaaaataagctg

SEQ ID NO: 31820 - DNA, 50 bp, homo sapien
ggaaaaatcccaggaagaactcttaygatgggagactccacactaatcca

SEQ ID NO: 31821 - DNA, 50 bp, homo sapien
tataaaaggtatgtgtaactgagacraaaagtaggtaaaccttgatgtga

SEQ ID NO: 31822 - DNA, 50 bp, homo sapien
tttccatatcagaaagtataaataayctgtggaacaatcacataatgcaa

SEQ ID NO: 31823 - DNA, 50 bp, homo sapien
ccttaacgtcgtagcattactcatawatttttggtgatgctggtgtaaac

SEQ ID NO: 31824 - DNA, 50 bp, homo sapien
cattctactcttaagttcctacttcrcgtctctcttttatttctaaaggg

SEQ ID NO: 31825 - DNA, 50 bp, homo sapien
tttctacaacattaagtgttctctaygcatttactatcaagtagatactt

SEQ ID NO: 31826 - DNA, 50 bp, homo sapien
ctccatttggctgatcatatattgaraattagagagattaagcaaattgc

SEQ ID NO: 31827 - DNA, 50 bp, homo sapien
ttatttgataatgcctttctactttyaaacatgagagtacactccagtac

SEQ ID NO: 31828 - DNA, 50 bp, homo sapien
caaattgcccaagacggcccaatcartgagtggtgggtctcaggtgtgtc

SEQ ID NO: 31829 - DNA, 50 bp, homo sapien
agctgaatttaattccatggaaaccmatctacaagcaacagcatcaagca

SEQ ID NO: 31830 - DNA, 50 bp, homo sapien
ttactctttaaattggaattagtgartatcctaacatgctttatttgtaa

SEQ ID NO: 31831 - DNA, 50 bp, homo sapien
tccctcttaatacatttattcattgyacattctaagactataggtaattt

SEQ ID NO: 31832 - DNA, 50 bp, homo sapien
ctgtgaaattgaacacaaccgtcatyaacactagttgagtttagtattgt

SEQ ID NO: 31833 - DNA, 50 bp, homo sapien
ccaattaaaatagagatttaggagaytagcgatttgcccactctcttttg

SEQ ID NO: 31834 - DNA, 50 bp, homo sapien
ttcattctaggactattaattttaastcaatggtatcaaagggcatcctg

SEQ ID NO: 31835 - DNA, 50 bp, homo sapien
cattccacatcacagcaactaaaagraggatgcattattcacccaaaagg

SEQ ID NO: 31836 - DNA, 50 bp, homo sapien
ttttctcaatcaagaaattgaaggcsagagcatttgaatgatatcactga

SEQ ID NO: 31837 - DNA, 50 bp, homo sapien
ctcagtcccttgttcattttaagacrgtaagtaacagaagataagaatgc

SEQ ID NO: 31838 - DNA, 50 bp, homo sapien
gaaaactcaaacaaagaataaatatwactctgtgttttttacagttaaaa

SEQ ID NO: 31839 - DNA, 50 bp, homo sapien
aagggggaaaagtaattattgcccaytgaagctcttattcagataggaat

SEQ ID NO: 31840 - DNA, 50 bp, homo sapien
agggatgaagggcaagcctttatccrgaacttgactgaaccataggaaac

SEQ ID NO: 31841 - DNA, 50 bp, homo sapien
aaatatcatggatggcctgcttttayggaaggtatgttggccaagaaaac

SEQ ID NO: 31842 - DNA, 50 bp, homo sapien
tactctgtcaagcctggggaattagycctgggttccaatgacagctagcc

SEQ ID NO: 31843 - DNA, 50 bp, homo sapien
atgtttccaacctggtgattgaggaygcagagctgaaacaaatggcttac

SEQ ID NO: 31844 - DNA, 50 bp, homo sapien
agatggatgtagctgaatctaagaakatgtgtacttgtcccaaatgtgca

SEQ ID NO: 31845 - DNA, 50 bp, homo sapien
ctgtaaccaacagcgctcgctccaaygtcaaacctgtgtggaccatctct

SEQ ID NO: 31846 - DNA, 50 bp, homo sapien
gccaggagctgaggagacggttatayaccaggaagttgagggagttccag

SEQ ID NO: 31847 - DNA, 50 bp, homo sapien
agaagctactattatcattcccattyaactaaagaagaaaataaagaaat

SEQ ID NO: 31848 - DNA, 50 bp, homo sapien
agtgcatgtttctagaaagtttagawggaaaatatctccaggtcccatgg

SEQ ID NO: 31849 - DNA, 50 bp, homo sapien
ataggtcatcgcttgtaggagctgtsacaagagaaacaagtagaataagt

SEQ ID NO: 31850 - DNA, 50 bp, homo sapien
aagtagaataagtaaattgagaaagsaatcaaacatctcatggagagcag

SEQ ID NO: 31851 - DNA, 50 bp, homo sapien
agagagataattagatgacatattgsaaaattgtaaattctgcaaaagat

SEQ ID NO: 31852 - DNA, 50 bp, homo sapien
atcaaaaggggatgaatagaatggawcacattgaatttagagagataatt

SEQ ID NO: 31853 - DNA, 50 bp, homo sapien
gcttttgttacgaagaataccaccamcactaacatcaacaaaacaaaaca

SEQ ID NO: 31854 - DNA, 50 bp, homo sapien
ctcattccaacctcattgcctgataygagaatgaatttagggtattgtct

SEQ ID NO: 31855 - DNA, 50 bp, homo sapien
caggggttgttcattgcatacagatsaagttctaactccactctctgaca

SEQ ID NO: 31856 - DNA, 50 bp, homo sapien
acttaatgccttctttagaacctatyagtgctatgtaaatcaagatagtt

SEQ ID NO: 31857 - DNA, 50 bp, homo sapien
tgaaagttacagtgtcaagtgatagwagcctcataatgtgtgaagtgctt

SEQ ID NO: 31858 - DNA, 50 bp, homo sapien
tccgtttggctccaaagtagtctcartaattaagtcatgtctctcctgct

SEQ ID NO: 31859 - DNA, 50 bp, homo sapien
ctccatcccatttatttttgacagaycttcttcttataaataattacatt

SEQ ID NO: 31860 - DNA, 50 bp, homo sapien
ctctactacggctttgaaagctaacyggaacctcattgtgcattcataat

SEQ ID NO: 31861 - DNA, 50 bp, homo sapien
tggtttttatgaattagttgaaagarcataaatcaagtcttgaagaggag

SEQ ID NO: 31862 - DNA, 50 bp, homo sapien
aatagtaaggagggatggttacaaartcatgctaattctcaagtaattat

SEQ ID NO: 31863 - DNA, 50 bp, homo sapien
agccctcatatttcctggaaaatcaraaagattgactagaatgacaccat

SEQ ID NO: 31864 - DNA, 50 bp, homo sapien
tccacctccctaaacataccaaaatwattcctgattctacaaactggaga

SEQ ID NO: 31865 - DNA, 50 bp, homo sapien
atataatgttacatggtaaaataggwattcttaaagacactcaagatctg

SEQ ID NO: 31866 - DNA, 50 bp, homo sapien
accttgttacttgtttctcctccaarttggaacaatctttcctcagatct

SEQ ID NO: 31867 - DNA, 50 bp, homo sapien
gggaaaaatgaatttcaaggttcacyaatcaactaactggtagtttctca

SEQ ID NO: 31868 - DNA, 50 bp, homo sapien
gcctgcctaccatagtctctgctgaygcacaccttagcagggcatccaaa

SEQ ID NO: 31869 - DNA, 50 bp, homo sapien
aacaaaacaaaaacaaaaacttatcyagttctcatgatgaacagtggtca

SEQ ID NO: 31870 - DNA, 50 bp, homo sapien
aaataaatgtgaagttctttatgtayagcaatgaagtttatgaaaaccag

SEQ ID NO: 31871 - DNA, 50 bp, homo sapien
cagtggtcaatctcaaagactcccartgcaactttggaataacagaattt

SEQ ID NO: 31872 - DNA, 50 bp, homo sapien
atctattgaacttccagaaatataaractagcccaaggtctccagttttt

SEQ ID NO: 31873 - DNA, 50 bp, homo sapien
ggttctacaaaaagcatggcttatamctcactagacgaggcaggaagaga

SEQ ID NO: 31874 - DNA, 50 bp, homo sapien
aagatctgagattaaggtagagatawataaatcattaaaaattgatagca

SEQ ID NO: 31875 - DNA, 50 bp, homo sapien
ggtaatatctaatagaaaatcaagasgtactgatataatcaatgttttta

SEQ ID NO: 31876 - DNA, 50 bp, homo sapien
agagtgttgaacagaccaaacaacargtatccagtaaaactatggatctc

SEQ ID NO: 31877 - DNA, 50 bp, homo sapien
agtctcagagtctatttacttgcacmagggtgacacttctttttatatcc

SEQ ID NO: 31878 - DNA, 50 bp, homo sapien
gaggtctataaatgggaaggtccacygagagaggcaatcagaataaaatt

SEQ ID NO: 31879 - DNA, 50 bp, homo sapien
gaagatcatctcaggtttggtaatgyaatgccctggtaatgagaaacaat

SEQ ID NO: 31880 - DNA, 50 bp, homo sapien
ctgattgaaccctgattgatacacargattaaaagcctacacagaatgga

SEQ ID NO: 31881 - DNA, 50 bp, homo sapien
gcacagagccaaaccgtaccaactaygttcattgtatttcacaattatct

SEQ ID NO: 31882 - DNA, 50 bp, homo sapien
ctggtatataaacacaacattactaygcttcttgatacaatatcttgtta

SEQ ID NO: 31883 - DNA, 50 bp, homo sapien
acagacctgactattggcttagaaasatatccatgatagaatattaggtg

SEQ ID NO: 31884 - DNA, 50 bp, homo sapien
gaattccatgtctagagaggaataasagtctctgtcagtaacattctcgt

SEQ ID NO: 31885 - DNA, 50 bp, homo sapien
agtgagaaaaaccagacaaaagaaaktagttcacggctagcacttttcct

SEQ ID NO: 31886 - DNA, 50 bp, homo sapien
agtctgtaaatacgatcaagttgctyacattttcaaaagaaacaaacaaa

SEQ ID NO: 31887 - DNA, 50 bp, homo sapien
tatttattcttcatttctctgcttaygcatcactttctcaaagaaccttt

SEQ ID NO: 31888 - DNA, 50 bp, homo sapien
catttggataaaaataatgaaaactsaataactctctcactgtaaagctt

SEQ ID NO: 31889 - DNA, 50 bp, homo sapien
aatctgcttcttctcctgaaaactayggttcttccctctggttttgaata

SEQ ID NO: 31890 - DNA, 50 bp, homo sapien
ggcattctattctcaaatattttcaractttcaacatgaaggtcttctga

SEQ ID NO: 31891 - DNA, 50 bp, homo sapien
ttctaagtgattgctgattaactggmagtaaggatattaatgtttcaata

SEQ ID NO: 31892 - DNA, 50 bp, homo sapien
aatcccttagctcagtcaagttgacrgataacattaattatcacaatcca

SEQ ID NO: 31893 - DNA, 50 bp, homo sapien
cagttagctaggagaagtaatgacarggacctttcatattttcccggtgt

SEQ ID NO: 31894 - DNA, 50 bp, homo sapien
catgcaaacacttatcaagagaaacyggaatgtaataagtgctcaataaa

SEQ ID NO: 31895 - DNA, 50 bp, homo sapien
ttttataaagcagcaagaatatttgycaaagtccttacagaaacactgag

SEQ ID NO: 31896 - DNA, 50 bp, homo sapien
tctaagacactctggttatagcttcraatccatttcttcattttatttcc

SEQ ID NO: 31897 - DNA, 50 bp, homo sapien
cacttcagtctgagaaatagagtgaraatcatctgtttaataaaaaataa

SEQ ID NO: 31898 - DNA, 50 bp, homo sapien
ttcggtaataagaaagtcggccaaartatagcctgattagtgcttagtta

SEQ ID NO: 31899 - DNA, 50 bp, homo sapien
tatacaacatgaggactatactgaawaatagtgtattgcattcagaattt

SEQ ID NO: 31900 - DNA, 50 bp, homo sapien
agtctgggcaccatcctctcagcaayatccatgtgggagtccatcacttt

SEQ ID NO: 31901 - DNA, 50 bp, homo sapien
cccagcctatgtttcactctgagaaygcaaaaaatattgtcaatttaagg

SEQ ID NO: 31902 - DNA, 50 bp, homo sapien
tcaaaccggttttgattacgagcaartctgtctacaggaagacacgccct

SEQ ID NO: 31903 - DNA, 50 bp, homo sapien
attgtgggccaaggagaaaatatgayggacatgaaaattattaattcagg

SEQ ID NO: 31904 - DNA, 50 bp, homo sapien
ttaacataacgcacttcaacagttayccataaatgtaaattttgtttttg

SEQ ID NO: 31905 - DNA, 50 bp, homo sapien
gagcattaatcacaaaataatagccyatacatagaaagaacgtgaaagac

SEQ ID NO: 31906 - DNA, 50 bp, homo sapien
ttcactgatgcaaaagctaattaaawctttgagaaatttttccaaggaag

SEQ ID NO: 31907 - DNA, 50 bp, homo sapien
caatgtgaactctacaataatagackggagtagaaaatggattttgtgta

SEQ ID NO: 31908 - DNA, 50 bp, homo sapien
agcatgagaaatcttattttcactawcttcctttaaaacattttcatagc

SEQ ID NO: 31909 - DNA, 50 bp, homo sapien
cattttataagcatagtgaagatcaytccacctttctgagtagaaagtat

SEQ ID NO: 31910 - DNA, 50 bp, homo sapien
tatatataaagaaaaggccttattgrataaactggtaaatgcatctctca

SEQ ID NO: 31911 - DNA, 50 bp, homo sapien
aatttaggggatgcagatttatgaaytgaacatcttaacattattgtata

SEQ ID NO: 31912 - DNA, 50 bp, homo sapien
tgtcgaaactttttcatattttaccygctattttgtggagaaatgtttca

SEQ ID NO: 31913 - DNA, 50 bp, homo sapien
tgaacattggtatttttagctaacayacatcctggaatagtttcagtagg

SEQ ID NO: 31914 - DNA, 50 bp, homo sapien
gaaagaaagtctactatccagcctcrgagattagatttaaaagccaagga

SEQ ID NO: 31915 - DNA, 50 bp, homo sapien
catttacatagccataactgtacacrggaagagttatgcatcagacctaa

SEQ ID NO: 31916 - DNA, 50 bp, homo sapien
cacaatcatacagctctgacagagargtctagcagcgtagatcatattct

SEQ ID NO: 31917 - DNA, 50 bp, homo sapien
tttaacttaatcttcttgggcaaaasgtcaacatgcctaatatatgttac

SEQ ID NO: 31918 - DNA, 50 bp, homo sapien
ttctttatctgtcttgtatgaaaaayttgtgttctacagggagccctggg

SEQ ID NO: 31919 - DNA, 50 bp, homo sapien
aagcttggtgctggtggcataggaaraatttatatgtgtgtgggaggtgt

SEQ ID NO: 31920 - DNA, 50 bp, homo sapien
acccagagaggaccaagcagaattayagagtgtaggcccatcaattatgc

SEQ ID NO: 31921 - DNA, 50 bp, homo sapien
aatccttttttaaaatgaataacackctatcaatttagacggtaaaccat

SEQ ID NO: 31922 - DNA, 50 bp, homo sapien
cacaaagtacatgtggaaggagggcrcttgaattaccaaactatgtgttt

SEQ ID NO: 31923 - DNA, 50 bp, homo sapien
aatggttgaaaaataaggaaccaacraagtttataaaagatgccagtttg

SEQ ID NO: 31924 - DNA, 50 bp, homo sapien
gcattagaacagctttttggattgaygatacttggccaaatgcttcaccg

SEQ ID NO: 31925 - DNA, 50 bp, homo sapien
attatgacttgccattgcctgttacsagttatcatttttccagactgcca

SEQ ID NO: 31926 - DNA, 50 bp, homo sapien
aagggaatcagctctgagagtttaamtgacttatccaaggtcccacaagc

SEQ ID NO: 31927 - DNA, 50 bp, homo sapien
atcagtgatttaaaggacagttttcyaatactatgctgcatcggtgaatg

SEQ ID NO: 31928 - DNA, 50 bp, homo sapien
cttttaatgtatctacaatgtctgaygaaagtaataaaacaggtggtcat

SEQ ID NO: 31929 - DNA, 50 bp, homo sapien
catattatgtagtatgtaaattatcwgagaagtgaagaagacatgaataa

SEQ ID NO: 31930 - DNA, 50 bp, homo sapien
atctaacatttattaaatactatgayctaggcactgaactaaaagcttta

SEQ ID NO: 31931 - DNA, 50 bp, homo sapien
agacagacttgaattctgattttaayatctaatagctctgggaccttggg

SEQ ID NO: 31932 - DNA, 50 bp, homo sapien
ttgagtttcaccagtagaggagtgartaacaggagaagaaacaaaactga

SEQ ID NO: 31933 - DNA, 50 bp, homo sapien
tgatggtctatccttcatcttagtcrccattcacatcttacctccaagta

SEQ ID NO: 31934 - DNA, 50 bp, homo sapien
ttttatgtaacacattttcaattcartcgttgtgaacttcaactgatctc

SEQ ID NO: 31935 - DNA, 50 bp, homo sapien
tgtctactaacatcaagaaatcgaartcaggtgaaagagggacgctaatg

SEQ ID NO: 31936 - DNA, 50 bp, homo sapien
ctattggaatgtaggctcccagagasaggaatttcttttgtctgtattgc

SEQ ID NO: 31937 - DNA, 50 bp, homo sapien
gagctgctacgtcctaagatatgaaracaaatgggggttggggagtcagt

SEQ ID NO: 31938 - DNA, 50 bp, homo sapien
tctcatttaatcctaacgataactcragagatagagaccattagcatgtc

SEQ ID NO: 31939 - DNA, 50 bp, homo sapien
accctctaacatctgttgactgcaaygattacctaaagttatggtcaaag

SEQ ID NO: 31940 - DNA, 50 bp, homo sapien
ccatcgaatagataaagaaattgatragggagttcttaacggttttgtga

SEQ ID NO: 31941 - DNA, 50 bp, homo sapien
caaatatgttcctattaaattacatmatattcaacgtggctgatgcagat

SEQ ID NO: 31942 - DNA, 50 bp, homo sapien
cagagaaaagtgtcagttactaaggragagaaataacagcaataagagtg

SEQ ID NO: 31943 - DNA, 50 bp, homo sapien
ctgccaatcaccctcagtctcagtayacgtttttgatgctacatcattgt

SEQ ID NO: 31944 - DNA, 50 bp, homo sapien
attctttttctgagtggataaaaatsattgtctctttttaaaagtatttg

SEQ ID NO: 31945 - DNA, 50 bp, homo sapien
caatggcagggcataggccaaaataygtgccatggaaagatgtttgtatt

SEQ ID NO: 31946 - DNA, 50 bp, homo sapien
ccgtgactgaaaattataaaatcggragtatgttaggaagaaaatatttc

SEQ ID NO: 31947 - DNA, 50 bp, homo sapien
ttatgatctatgtgctttatgtaaaygctcgagtctttataatcaccctt

SEQ ID NO: 31948 - DNA, 50 bp, homo sapien
gaaaatgaggccagtgatagttgacscataattgttttgagcgtttttaa

SEQ ID NO: 31949 - DNA, 50 bp, homo sapien
acaggtcattgcacgtgtgataaacycagcgaaagaaaagcatagcatat

SEQ ID NO: 31950 - DNA, 50 bp, homo sapien
gtaagccagaaatagaaagttaaacrctgcaaactatcactcatatatga

SEQ ID NO: 31951 - DNA, 50 bp, homo sapien
gggattctcatacttcattgagatcrgaaacatcaggagagtgttaaacc

SEQ ID NO: 31952 - DNA, 50 bp, homo sapien
tctcagttccttcattggtgaaatarataagttggcctgactttaggatt

SEQ ID NO: 31953 - DNA, 50 bp, homo sapien
ctcaataaatacacagagcaggagayggaatagcagttcaacagatgtga

SEQ ID NO: 31954 - DNA, 50 bp, homo sapien
tactataagaacatacctaaagacaygaccagatttatttgtcaaaggtg

SEQ ID NO: 31955 - DNA, 50 bp, homo sapien
ttagctcacttggctgcgttgggtcwcaaataataacgctttcatatccg

SEQ ID NO: 31956 - DNA, 50 bp, homo sapien
ttctttggtttgttgtaagcagggaygacaattagggaagctgtcaggta

SEQ ID NO: 31957 - DNA, 50 bp, homo sapien
taccgaatgctatgtaattttacacrcgttgttcgcttatttaacagtga

SEQ ID NO: 31958 - DNA, 50 bp, homo sapien
gtaaacagcatttcacctgtttgaayttaggagttttagaggctgaaggc

SEQ ID NO: 31959 - DNA, 50 bp, homo sapien
cacacacactactaaaaaataagcarcttgggagacaaagccaccagatc

SEQ ID NO: 31960 - DNA, 50 bp, homo sapien
agcaacttctgaaagtgcctatcaaygtggcagtgggagcaaaattaatg

SEQ ID NO: 31961 - DNA, 50 bp, homo sapien
taggaattcagtatttcagtgaatcyatgttaggaatgagtatgaatgtt

SEQ ID NO: 31962 - DNA, 50 bp, homo sapien
gcagtgtttatcaaaacacttaccaktaccatgacatagaagtaggtatt

SEQ ID NO: 31963 - DNA, 50 bp, homo sapien
ggactctttcttaaaatatggctagmatcctccctttgtccttgctcttc

SEQ ID NO: 31964 - DNA, 50 bp, homo sapien
cgttgtagtccacttccattttgaakatgcgcccgtcagcctgctgcaag

SEQ ID NO: 31965 - DNA, 50 bp, homo sapien
ttttcctcatctcaaattaggcaacygttctagcaactcacagtaatttt

SEQ ID NO: 31966 - DNA, 50 bp, homo sapien
atccagtctcttacttgacatgcacrcttttggaggttgccctggtaatc

SEQ ID NO: 31967 - DNA, 50 bp, homo sapien
caatgaacagtcagatttggttcacygaataagtggtgacaagaagtcag

SEQ ID NO: 31968 - DNA, 50 bp, homo sapien
ggacagaaggtctgtatctacagtayaaagggatttctatgaagaatgtg

SEQ ID NO: 31969 - DNA, 50 bp, homo sapien
ttctgaattatcaaatttcaagtaartctgccttcaccacatttgcaaaa

SEQ ID NO: 31970 - DNA, 50 bp, homo sapien
atcactgctatccatacaaggactasaaatatcacagcaagttcccgttc

SEQ ID NO: 31971 - DNA, 50 bp, homo sapien
agaaaatgagggcacagtatattaartaattaacctgaagtcatataacc

SEQ ID NO: 31972 - DNA, 50 bp, homo sapien
tgtctaataatgtatatttcactgaygattttaagacctatgtgtgaagt

SEQ ID NO: 31973 - DNA, 50 bp, homo sapien
gtagtactttctctagtcctggaaaygtcttctaacaagtaactaataaa

SEQ ID NO: 31974 - DNA, 50 bp, homo sapien
atcactgatgaagcctcctggtatakgaaactactgtgtttcactcacgt

SEQ ID NO: 31975 - DNA, 50 bp, homo sapien
tttccctagtaatctatttatcaaastttgactcttccttctcctataat

SEQ ID NO: 31976 - DNA, 50 bp, homo sapien
gatatactatacaacaacttcattgrattactgttgaattaccaagagga

SEQ ID NO: 31977 - DNA, 50 bp, homo sapien
ttaaaaataaaatcataagttaattwaaaaatatattcgagaagacataa

SEQ ID NO: 31978 - DNA, 50 bp, homo sapien
tacatccgccaccctcttattgaagwccaaagcgtggctgggagtgattt

SEQ ID NO: 31979 - DNA, 50 bp, homo sapien
ttcctgtgcctgcaatgcacttcccraggataagttttactcattactca

SEQ ID NO: 31980 - DNA, 50 bp, homo sapien
ggttttttctcaccaccacactctayaaaaactgctcttatcaaggtcac

SEQ ID NO: 31981 - DNA, 50 bp, homo sapien
tttactacactttccaatatgctaartagtagattttaaatggtggcttg

SEQ ID NO: 31982 - DNA, 50 bp, homo sapien
agcctagagttaaattcttactgcakagaaaattatatttgcttacatgg

SEQ ID NO: 31983 - DNA, 50 bp, homo sapien
caatggaactacagataaaaacttgmatgtcagtattatatgtattagtg

SEQ ID NO: 31984 - DNA, 50 bp, homo sapien
gtgcaaagagctgtaagggttactgraggttaagataagataatgcctct

SEQ ID NO: 31985 - DNA, 50 bp, homo sapien
tgctaattactgcacaagtcctgtayactgtatcaaaactcagcataaat

SEQ ID NO: 31986 - DNA, 50 bp, homo sapien
tagttctgatgcatcagtgtagttakcaagtgtgcccagctgggtggaaa

SEQ ID NO: 31987 - DNA, 50 bp, homo sapien
gataatgaaaaagtattagaaaccawtaagttagaggcaggggggaaaag

SEQ ID NO: 31988 - DNA, 50 bp, homo sapien
tactttttcattatctttaccttaawctcttagcatatgatttatggact

SEQ ID NO: 31989 - DNA, 50 bp, homo sapien
gttgaaggaaattgtccatgtgtcaytatttctaatcagtagttggtaac

SEQ ID NO: 31990 - DNA, 50 bp, homo sapien
gaaactgttacatttctcctcaaaarcaacatatttgactccccttttat

SEQ ID NO: 31991 - DNA, 50 bp, homo sapien
taaatagaatgattaacattgtcaamgtcctaaaccacttacctgtgcca

SEQ ID NO: 31992 - DNA, 50 bp, homo sapien
cctaccttgttacaagtgaccatgcygattgtaattatttttagaagata

SEQ ID NO: 31993 - DNA, 50 bp, homo sapien
tttatgaaaaggattactctggtgcrataatgagagagacagaagggagc

SEQ ID NO: 31994 - DNA, 50 bp, homo sapien
tgtaaaaatactcatatgagtagtcratgaagctgtatggacatctcttc

SEQ ID NO: 31995 - DNA, 50 bp, homo sapien
agcataaaggaaatgacaacggcctraacattagagggagctgcttgtgc

SEQ ID NO: 31996 - DNA, 50 bp, homo sapien
actacgcagggccctatttggtcaaytatctgtgcttttcattctttatg

SEQ ID NO: 31997 - DNA, 50 bp, homo sapien
tacagaactctctaaaactgtatgcrcttcaatagagcaaaagtagaaat

SEQ ID NO: 31998 - DNA, 50 bp, homo sapien
ctggcctgtagatataggccaaacaragaactagctaccacttgaaataa

SEQ ID NO: 31999 - DNA, 50 bp, homo sapien
taagtgggggcaagagccgacaaaakcctggtacatgtcactgggtctgg

SEQ ID NO: 32000 - DNA, 50 bp, homo sapien
aagctgggttgtgcacagtgatgtayaaaagtcaagtttatagaactcca

SEQ ID NO: 32001 - DNA, 50 bp, homo sapien
ttcaaaaaagtatctctatatttacwcttcatttacctaaggatactctg

SEQ ID NO: 32002 - DNA, 50 bp, homo sapien
gaaacacactcacaaatctactgaawctgttgtatcaaaggtcacataat

SEQ ID NO: 32003 - DNA, 50 bp, homo sapien
gtctcccaccagtagtagaagaccartaaaaccaggaattaagtgattca

SEQ ID NO: 32004 - DNA, 50 bp, homo sapien
gctgaattatatactatctaccaaakcctaatctagaaaactactaatat

SEQ ID NO: 32005 - DNA, 50 bp, homo sapien
ttgggaaagtaatttaacctctttawgtagtagtcttataataattaaaa

SEQ ID NO: 32006 - DNA, 50 bp, homo sapien
attgaccatgtatggtagtcttacaygtgacaagtgacaaaaaacacagg

SEQ ID NO: 32007 - DNA, 50 bp, homo sapien
tgctcgaagatgcaaattgcatcaaraccctttgccttcaaaaattcaca

SEQ ID NO: 32008 - DNA, 50 bp, homo sapien
ttgtgtcacaagaactgtactccacrcccgtgaagatttccttgcagtgt

SEQ ID NO: 32009 - DNA, 50 bp, homo sapien
tttggaagtttcaatctcaagataaygaaactgtctttgctcaaattttt

SEQ ID NO: 32010 - DNA, 50 bp, homo sapien
aagaaaagaaaagtgttattaatccragcctatattccacatacatatgc

SEQ ID NO: 32011 - DNA, 50 bp, homo sapien
tttctataactatggattgttactcrgaatgtctttccaaactttggtag

SEQ ID NO: 32012 - DNA, 50 bp, homo sapien
agcaccgacaacattctttccttcawtcaaagtacataaatcacttactt

SEQ ID NO: 32013 - DNA, 50 bp, homo sapien
tttttgttgattatgattaaacaatmaaagtaaagtctaactcagggtag

SEQ ID NO: 32014 - DNA, 50 bp, homo sapien
agacacaatcttatcttgcagattaygtgaattaatagtagaaatgttat

SEQ ID NO: 32015 - DNA, 50 bp, homo sapien
ccttttttgaaagcattattagagaytatcccctagcaagaaaaagaaaa

SEQ ID NO: 32016 - DNA, 50 bp, homo sapien
cttttgttatatatatagagagcggragcaaaacaaacaccaattgaata

SEQ ID NO: 32017 - DNA, 50 bp, homo sapien
tttttaatgccatcatatttagccartcttctggttttgctttgtatgct

SEQ ID NO: 32018 - DNA, 50 bp, homo sapien
aactgtacatgtttttctaccattarcataaatacctgcacagtatcctt

SEQ ID NO: 32019 - DNA, 50 bp, homo sapien
atacccaacatcaagtttttatcatyagaattcatacaataaaccaccac

SEQ ID NO: 32020 - DNA, 50 bp, homo sapien
tgctcactcacatactgcctagatamctcctgctttgcacgcatattcat

SEQ ID NO: 32021 - DNA, 50 bp, homo sapien
tcatttagagataaagtgactgaaartagtaaaatatcagcaaagtcaga

SEQ ID NO: 32022 - DNA, 50 bp, homo sapien
attcagattctctccatggcatgcamagccctgactcgctcctccctgcc

SEQ ID NO: 32023 - DNA, 50 bp, homo sapien
ggagaaaagatgatgatatgagaacraacaggaccttaggagccatctgc

SEQ ID NO: 32024 - DNA, 50 bp, homo sapien
ttgactgtgtataaagccctgtgtarattaatacagaactctatattttt

SEQ ID NO: 32025 - DNA, 50 bp, homo sapien
agtgaaatcatctaaaattcttaggycaaatgttccctgctctcctttag

SEQ ID NO: 32026 - DNA, 50 bp, homo sapien
aatatatgcctagtgttcagtcccargttaaatagacacacacacacaca

SEQ ID NO: 32027 - DNA, 50 bp, homo sapien
agaatgataaaataggcattctttayggtaaaactagggaaacaagccag

SEQ ID NO: 32028 - DNA, 50 bp, homo sapien
gaacagggaatacactgcatctagasaaattttaccaatctatcaagaac

SEQ ID NO: 32029 - DNA, 50 bp, homo sapien
gctctgggattccagaagttgtatayagcctagggagaaaaatcataagg

SEQ ID NO: 32030 - DNA, 50 bp, homo sapien
ctgcagcattctgtgggtagtacaayaatcaaatgaaccaatggaactgt

SEQ ID NO: 32031 - DNA, 50 bp, homo sapien
gggttcttggaacagaagtatgacamaacccgccacatgtcagaatccat

SEQ ID NO: 32032 - DNA, 50 bp, homo sapien
tgctaacagtctgtgaagtgccctayggattatttttatttacagaagaa

SEQ ID NO: 32033 - DNA, 50 bp, homo sapien
ggtataaataaataatcatgacaaarcaagtccatcagagctcatgactt

SEQ ID NO: 32034 - DNA, 50 bp, homo sapien
tccaaagcagaaatttcaagagagcwacattatttcatggtgaccacatt

SEQ ID NO: 32035 - DNA, 50 bp, homo sapien
actttgcatagggagaaatgaaatgkagtactagtcaatgtagaggtagg

SEQ ID NO: 32036 - DNA, 50 bp, homo sapien
ttcttcatttagacaacaagttttcmatgtttaacaatagtaaacttacc

SEQ ID NO: 32037 - DNA, 50 bp, homo sapien
gattattattaactcagaagatgtcraagattaatgccgattgatgagtg

SEQ ID NO: 32038 - DNA, 50 bp, homo sapien
catgacagtccactttagccaaggaratattgagtatggacctctgaaaa

SEQ ID NO: 32039 - DNA, 50 bp, homo sapien
aagttctcatctctttatctcagaasgcagcaaagactggtcttgacact

SEQ ID NO: 32040 - DNA, 50 bp, homo sapien
ggaaagtaaatattatttatgatcayggttaaaggaattggtttttgttt

SEQ ID NO: 32041 - DNA, 50 bp, homo sapien
tagctacactgataagtctggcatgyaatatttatcaggtaaaagttagc

SEQ ID NO: 32042 - DNA, 50 bp, homo sapien
tagaatagagataacaagtttatgcygcagttctgcttttcctatgtata

SEQ ID NO: 32043 - DNA, 50 bp, homo sapien
accttatctgtacccttaatgctacmatttcttgaaaatctggcctttta

SEQ ID NO: 32044 - DNA, 50 bp, homo sapien
gacactttgtcacagcatgcctgcaytcatatatcatattacattttata

SEQ ID NO: 32045 - DNA, 50 bp, homo sapien
taagtaaaacatagtatgtcccatcraattattaaagttaatattttcca

SEQ ID NO: 32046 - DNA, 50 bp, homo sapien
ttcaacataacatttttgagaattcyatatctgaaaataaaatgaagaaa

SEQ ID NO: 32047 - DNA, 50 bp, homo sapien
aatattagtcctacaactggctctcyatgtattcaacaagattcacactg

SEQ ID NO: 32048 - DNA, 50 bp, homo sapien
acaagtttgcctccttcattgacaargtatggttgctggagcagcagaac

SEQ ID NO: 32049 - DNA, 50 bp, homo sapien
tttgggttcatagaggtgtaactacracaaggagtactagtgttttggat

SEQ ID NO: 32050 - DNA, 50 bp, homo sapien
atatgtgcacagacccacagtgggaragattgctagacctgtgatttaaa

SEQ ID NO: 32051 - DNA, 50 bp, homo sapien
aatttacctcacagcctaagaagtamggagttgcattaaaaattcagaat

SEQ ID NO: 32052 - DNA, 50 bp, homo sapien
gagcatctgtctgggaaggttattcragtttaaggatgctgcagttacaa

SEQ ID NO: 32053 - DNA, 50 bp, homo sapien
aaagagtaagagttagctaattagaygaatgcaattctggaaagcagaca

SEQ ID NO: 32054 - DNA, 50 bp, homo sapien
gttgttttgaaactcatacaatcacraaagtctctcaagcagttgcatta

SEQ ID NO: 32055 - DNA, 50 bp, homo sapien
ccaggcacagagagacaattatcacyggttctcacataatatgtggaatc

SEQ ID NO: 32056 - DNA, 50 bp, homo sapien
tacacagcaaaaaggtcacgtgatarcacaaatagatggtggctgtctac

SEQ ID NO: 32057 - DNA, 50 bp, homo sapien
agagggaatgaaagaagacattggamtccaagaattttacaaaatgagaa

SEQ ID NO: 32058 - DNA, 50 bp, homo sapien
tcactgagttttctcccttatttaawcttgttatactccaattaaaggtt

SEQ ID NO: 32059 - DNA, 50 bp, homo sapien
aaataatgaagtatgctaatcaagaygtccataggcttttatttctttat

SEQ ID NO: 32060 - DNA, 50 bp, homo sapien
ttatcataagaacaaattcaaagatsataagattgcaaaagtcagatcat

SEQ ID NO: 32061 - DNA, 50 bp, homo sapien
ctccagaatttcttattagttcttaygatttttatctctttgttaaactt

SEQ ID NO: 32062 - DNA, 50 bp, homo sapien
agataatagtatatggctctatctaygtccacacattaaagttgatgaac

SEQ ID NO: 32063 - DNA, 50 bp, homo sapien
actttaaatatgtgcttattgtttasagagagatagatgagaagactttg

SEQ ID NO: 32064 - DNA, 50 bp, homo sapien
tactgtttgtattaattctccttccrcttgaaatactagagtgatcaaat

SEQ ID NO: 32065 - DNA, 50 bp, homo sapien
ggcttttgaaactccagtggtgatamataagtcaattacaattgctaaat

SEQ ID NO: 32066 - DNA, 50 bp, homo sapien
tacatatacactcatgtgttgcaaastattatattttcaactaatatcac

SEQ ID NO: 32067 - DNA, 50 bp, homo sapien
aaacctttctcatgaacttttctaaycagttgtctctctagtagcctctg

SEQ ID NO: 32068 - DNA, 50 bp, homo sapien
gagaagaatcaaatagacataataaraaaggatatatgggatgtcaccac

SEQ ID NO: 32069 - DNA, 50 bp, homo sapien
agactttgttaggttgaagggttaayatttaagcaaacaccatatttcta

SEQ ID NO: 32070 - DNA, 50 bp, homo sapien
accttgccaaatgttccattataaargttatagtatcaatgatagaaact

SEQ ID NO: 32071 - DNA, 50 bp, homo sapien
cttaaatgttaacccttcaacctaamaaagtctgatcccacatagctaag

SEQ ID NO: 32072 - DNA, 50 bp, homo sapien
agctgccaggggcctgctctctctamgaacagataggctcttctgttaac

SEQ ID NO: 32073 - DNA, 50 bp, homo sapien
tatagtatgttcagaatgcagaatcmctgaattttaagatggatccaaat

SEQ ID NO: 32074 - DNA, 50 bp, homo sapien
aagggtatgtggtggttcaaaatcarcttttattccttaaagagttaggc

SEQ ID NO: 32075 - DNA, 50 bp, homo sapien
ggaaggtcactcgaaatcagtgagartcgaaaaggacatagaaagcactt

SEQ ID NO: 32076 - DNA, 50 bp, homo sapien
tgctatcagctacttacggctatacrcttatcgatatcatttgcatttaa

SEQ ID NO: 32077 - DNA, 50 bp, homo sapien
tctgtgtagtgtattaaggtgctaaraattatttctacctctagagaaaa

SEQ ID NO: 32078 - DNA, 50 bp, homo sapien
catcagatatgtgatcagatgagatyaagcctcagaaccttatgatagtc

SEQ ID NO: 32079 - DNA, 50 bp, homo sapien
ggactttgctcagagagatcagtaaygtgactatcataaggttctgaggc

SEQ ID NO: 32080 - DNA, 50 bp, homo sapien
gcaaacaagaacaattagtaaatccraattttcatgaatcataattaaga

SEQ ID NO: 32081 - DNA, 50 bp, homo sapien
actacatattttgtgtattatagacygaagcagaggaaagcagccttcac

SEQ ID NO: 32082 - DNA, 50 bp, homo sapien
ccttgagcagatattttgaaacgaaragctctttagttagttttaatggg

SEQ ID NO: 32083 - DNA, 50 bp, homo sapien
gctcaggccacatatctcagcttaayatgcgtgggtgatgtgcttgaatc

SEQ ID NO: 32084 - DNA, 50 bp, homo sapien
tatacacttccttggtaaatagccarctgaggaaatacataaagttattg

SEQ ID NO: 32085 - DNA, 50 bp, homo sapien
ccatccatttcccaacagtagaacargattgaagattaaaatatcccaaa

SEQ ID NO: 32086 - DNA, 50 bp, homo sapien
ttacatacctgtatctttatatatcraaatgttgacgcatagctataaac

SEQ ID NO: 32087 - DNA, 50 bp, homo sapien
caagggcatggcagcggtatatcacracagctggtgaggtgattgcttac

SEQ ID NO: 32088 - DNA, 50 bp, homo sapien
gaaaggcacttgacctggacttggakaaattctgagacagttgcagcagg

SEQ ID NO: 32089 - DNA, 50 bp, homo sapien
tagtgagataagctgcttattaggakaaggtaggcagatattagattata

SEQ ID NO: 32090 - DNA, 50 bp, homo sapien
caggtattctgtgatcagttggaaamattaaggaagtgaaaaggatttga

SEQ ID NO: 32091 - DNA, 50 bp, homo sapien
gaaagaagaaagaattacacagaccratgtacaatggaccaagaagcttg

SEQ ID NO: 32092 - DNA, 50 bp, homo sapien
gcttctggagagaaatttgatagtgmatagcaaaaataattatgtgtata

SEQ ID NO: 32093 - DNA, 50 bp, homo sapien
aatagcaggtgtatttggagaacacratgctaatgaatgtcatattactc

SEQ ID NO: 32094 - DNA, 50 bp, homo sapien
aaattttttctttcaaattccaataygtataaacaaatgtaacacaagta

SEQ ID NO: 32095 - DNA, 50 bp, homo sapien
ctcatgtgagagtatgaacgctatcrcagtgttgacctgtagttttttta

SEQ ID NO: 32096 - DNA, 50 bp, homo sapien
ctctgactggcaaaaatctagatgaygtgcctgaatctttattgcaagag

SEQ ID NO: 32097 - DNA, 50 bp, homo sapien
aatacagaaggaataatatgagaacrgtctgaggcaattttaatgttttt

SEQ ID NO: 32098 - DNA, 50 bp, homo sapien
aaccctgatatttagctgatacttckattgtgcactaaggttttcttgac

SEQ ID NO: 32099 - DNA, 50 bp, homo sapien
tcaatggctttgacagtttaataaayacgattgcttaaaataaaatgatg

SEQ ID NO: 32100 - DNA, 50 bp, homo sapien
tgtcttgttcagcctcagaatcccakatagcaagacaagaaagctttgct

SEQ ID NO: 32101 - DNA, 50 bp, homo sapien
atatgattcctcacgcttgcctttgragatgaagttttctccttcaagca

SEQ ID NO: 32102 - DNA, 50 bp, homo sapien
agctgcctatatgaggtgtctgtccrctccaactggcaggtgtctcccag

SEQ ID NO: 32103 - DNA, 50 bp, homo sapien
atgaaaatgaaatgatatagccctcyaagaattgtcaaatcgtcaaatcc

SEQ ID NO: 32104 - DNA, 50 bp, homo sapien
ggaatactgtggccaggcactggtayagaagaaaagcagccccttctttt

SEQ ID NO: 32105 - DNA, 50 bp, homo sapien
atgagagcttattgtggcttacgtayaattggctgacagagtagggagga

SEQ ID NO: 32106 - DNA, 50 bp, homo sapien
ataggtactcatcaaaggatgataawgaaagtcaaaactcttgcaacttg

SEQ ID NO: 32107 - DNA, 50 bp, homo sapien
tataccacatgaagactataggtgayacgattttattttattagggaatt

SEQ ID NO: 32108 - DNA, 50 bp, homo sapien
gaaatatggaaggataatgccaacckcagaagtggctatggtggaaacca

SEQ ID NO: 32109 - DNA, 50 bp, homo sapien
gaaagttcccttgctcctgccatgcrcccattgaccactaaatggggcac

SEQ ID NO: 32110 - DNA, 50 bp, homo sapien
acatttttttgtgtgtagcggtttayaagactatcatcatcctttcacta

SEQ ID NO: 32111 - DNA, 50 bp, homo sapien
taataaatgttgatgttatgttcaawtaaaaattcttaggccaagcttgt

SEQ ID NO: 32112 - DNA, 50 bp, homo sapien
gttggggtatgtgacagttaactaartacatgaattatacagacaggcta

SEQ ID NO: 32113 - DNA, 50 bp, homo sapien
tttctagatgtaaaaggtatagttasaaaacaagtgctctgaaaacaaga

SEQ ID NO: 32114 - DNA, 50 bp, homo sapien
acatcacccgacatagtactgaataycattttcttgaaagcttgccagtt

SEQ ID NO: 32115 - DNA, 50 bp, homo sapien
ttcatgagaatataaggtaagcgagsaagaattcatttatatttgttttc

SEQ ID NO: 32116 - DNA, 50 bp, homo sapien
ctccaaaatccatctaaattgcaagrcaacaggcatttccattaaggcct

SEQ ID NO: 32117 - DNA, 50 bp, homo sapien
atttaattttatttgtggacataacragagtaatcatgaaatgctgactg

SEQ ID NO: 32118 - DNA, 50 bp, homo sapien
cttcaggcagataaaggtatacactsaatttttcattctctaggacttca

SEQ ID NO: 32119 - DNA, 50 bp, homo sapien
tatagacctatacaacctatataccrcaatccgtagaacaggggtgtgtg

SEQ ID NO: 32120 - DNA, 50 bp, homo sapien
aaccaatgcagtaataaattgttgcraaacagtacatatttgtagctcaa

SEQ ID NO: 32121 - DNA, 50 bp, homo sapien
gctatatgcatgtgtcatgcattatwaaatacaatttgttaaaggagaag

SEQ ID NO: 32122 - DNA, 50 bp, homo sapien
ttccataaacaacctacttcgatggraaattcaaagactctattcactta

SEQ ID NO: 32123 - DNA, 50 bp, homo sapien
atctaactgtagtatactataagagmcatatcatagccttaagattaatg

SEQ ID NO: 32124 - DNA, 50 bp, homo sapien
attatcacatactgcattatttaccwatccaattacttagttattaggtt

SEQ ID NO: 32125 - DNA, 50 bp, homo sapien
ttatacaatgcatcatctcataaaayagctggactttattgataactgca

SEQ ID NO: 32126 - DNA, 50 bp, homo sapien
attttcaagcataagttacatgggawaaaggtcagtttttggttgcagga

SEQ ID NO: 32127 - DNA, 50 bp, homo sapien
aatgtctggtgccatacactagagaraaatacattgtgcagaaggaagta

SEQ ID NO: 32128 - DNA, 50 bp, homo sapien
caaagagtgttgatagcaagttgcawggctatatagtttgagggtcaagg

SEQ ID NO: 32129 - DNA, 50 bp, homo sapien
aacagcatcttcaaagacttaaccayactgtccttattgaaaaagagtaa

SEQ ID NO: 32130 - DNA, 50 bp, homo sapien
gtggatgatattgtgaaactgacacsaacctctctcttctttttcctgtc

SEQ ID NO: 32131 - DNA, 50 bp, homo sapien
acctaaaaacctcaaatacatctcayctatacatgctgtgacattccatt

SEQ ID NO: 32132 - DNA, 50 bp, homo sapien
aatggaagaaaaaatggcataaaatkagtttcctgattattcctttatta

SEQ ID NO: 32133 - DNA, 50 bp, homo sapien
ttctactttatatttctcaaaggackcttattattatccttcgagatctg

SEQ ID NO: 32134 - DNA, 50 bp, homo sapien
gtaattttcttcctttttctggcacwccaataaaagatcaaataccaaac

SEQ ID NO: 32135 - DNA, 50 bp, homo sapien
aaaagatggtcaagaattggagtgayctttggataatggactcaggcact

SEQ ID NO: 32136 - DNA, 50 bp, homo sapien
ttaatcacatagccacagacctataygactgaactatccactcagaaacc

SEQ ID NO: 32137 - DNA, 50 bp, homo sapien
taccattccttttgttttattttcargtgctaacatttgcctatccctaa

SEQ ID NO: 32138 - DNA, 50 bp, homo sapien
atttgtagtccaacaactggcttaartggtaagtgttatgcattcaaaat

SEQ ID NO: 32139 - DNA, 50 bp, homo sapien
gcatttgaagagggaatagtatctcraacttatacagaactcccaacaac

SEQ ID NO: 32140 - DNA, 50 bp, homo sapien
gaggaagaaatatgtggtagtaacaygacaatcactaagcccagaatatt

SEQ ID NO: 32141 - DNA, 50 bp, homo sapien
gatacagttctttctttttcctaccraatcacacctatatggagatgggc

SEQ ID NO: 32142 - DNA, 50 bp, homo sapien
gaagggcattttaaactagagagtamatttctaacctttatattctacag

SEQ ID NO: 32143 - DNA, 50 bp, homo sapien
aattcctaatttagcatgaggctaakaagtaatcttactattctaaatat

SEQ ID NO: 32144 - DNA, 50 bp, homo sapien
tattgatgaaaagaataatgtgggasatataaagaactgaaaattccatg

SEQ ID NO: 32145 - DNA, 50 bp, homo sapien
cttctattaagcaaaaactgtgtacmacttatggagcattgtcacagaaa

SEQ ID NO: 32146 - DNA, 50 bp, homo sapien
gctttatcaataacatcactcctgaygataatgataccagtagataggca

SEQ ID NO: 32147 - DNA, 50 bp, homo sapien
ttttagctttttagaggaatatgaascacattaataactcagttttacat

SEQ ID NO: 32148 - DNA, 50 bp, homo sapien
ccagattaaaaattaatagtaaagamatatggaaaatcacatgtgtttga

SEQ ID NO: 32149 - DNA, 50 bp, homo sapien
tcttgtctgaatctgagttgataaaragtttcttcaagttggctcctgag

SEQ ID NO: 32150 - DNA, 50 bp, homo sapien
tgatgacaatatctaggtgacaaaakaataggaaagagggtaatgtatat

SEQ ID NO: 32151 - DNA, 50 bp, homo sapien
atttgaaagccattagtgattctaaygataacagttataatatactactc

SEQ ID NO: 32152 - DNA, 50 bp, homo sapien
ggatatcttgagagagtatatatagsacttagcaaatggttacattacaa

SEQ ID NO: 32153 - DNA, 50 bp, homo sapien
agagatatttattatgtaacaatcayaggtcagtgttccggatttggtag

SEQ ID NO: 32154 - DNA, 50 bp, homo sapien
aacctgttttgtttgatgaacaacawtcaccattttactcaagtatcaac

SEQ ID NO: 32155 - DNA, 50 bp, homo sapien
tctagcagaagcttgttcacttgtaygtaatatgagcattgcgccgagca

SEQ ID NO: 32156 - DNA, 50 bp, homo sapien
cccacatgcaaatgctttattaggakgaagagtacagtcacagagcaaca

SEQ ID NO: 32157 - DNA, 50 bp, homo sapien
gacaaatgtacaagatctttcaagcraaatctggcaattttactctccca

SEQ ID NO: 32158 - DNA, 50 bp, homo sapien
atttgtattagttaccatcctatatraacaaatagaaccaataggatgta

SEQ ID NO: 32159 - DNA, 50 bp, homo sapien
gtagtctctttctcgttcttttacaygatgataaatgaaaaacaaagact

SEQ ID NO: 32160 - DNA, 50 bp, homo sapien
acagttgcaagatgttttcaagatcmatcgcctggtataatcccctcaat

SEQ ID NO: 32161 - DNA, 50 bp, homo sapien
aaagctgtgcatttttgagtatgaawcattaattgacaacatattttctc

SEQ ID NO: 32162 - DNA, 50 bp, homo sapien
attgctacatataaaatgcaatgaarttatgtttacattgaaacacttta

SEQ ID NO: 32163 - DNA, 50 bp, homo sapien
atgttttgagatggacagtatgagcrcattagctgttttcttagggcaca

SEQ ID NO: 32164 - DNA, 50 bp, homo sapien
ccagcataatgccataaagctatctkagaccaacagaccttaaaaaccta

SEQ ID NO: 32165 - DNA, 50 bp, homo sapien
tttctgcattctggatatgtagcaaygtacaaataaccctgatagataaa

SEQ ID NO: 32166 - DNA, 50 bp, homo sapien
aaaaggaagttttatctttaatgacrcacaaaaataagatgtactcaagc

SEQ ID NO: 32167 - DNA, 50 bp, homo sapien
agagagagtgaggtcatgttggaaaratatacagaaattactataattat

SEQ ID NO: 32168 - DNA, 50 bp, homo sapien
caagactcagctttttcatctaaaaraggagagaataatacatacttcag

SEQ ID NO: 32169 - DNA, 50 bp, homo sapien
cataaggtgaatactaagtaaaatcrctaatctaatatcctcacacaggt

SEQ ID NO: 32170 - DNA, 50 bp, homo sapien
ctttgttcttccctataatcaatacratctaaaacaatagaaaaaatata

SEQ ID NO: 32171 - DNA, 50 bp, homo sapien
caggaaatgacagtaatgtaaattaygactcaactaagccaaaaaagcaa

SEQ ID NO: 32172 - DNA, 50 bp, homo sapien
aaaaaaattgaaatcatatcaagtcyctgtttaatcaaccacaatggtat

SEQ ID NO: 32173 - DNA, 50 bp, homo sapien
tatttacttctgtttttcttggaaaytttatgctatgctatttagatttg

SEQ ID NO: 32174 - DNA, 50 bp, homo sapien
agatttgttcttatgactgcagagaktcccttcgtatcgcatcatcattt

SEQ ID NO: 32175 - DNA, 50 bp, homo sapien
cttctacattggcacattctgctcartcttccacttcgacctcatggaaa

SEQ ID NO: 32176 - DNA, 50 bp, homo sapien
taagggctagtctttaacatgtgaaraacagcacacaaatgtggattagg

SEQ ID NO: 32177 - DNA, 50 bp, homo sapien
ggtgtagatctaggcagtcaaatatragatatgcagcccaggaagaactt

SEQ ID NO: 32178 - DNA, 50 bp, homo sapien
aaatacacaagtaaaaagagtctaarcactaccacagaagatttagggat

SEQ ID NO: 32179 - DNA, 50 bp, homo sapien
aggtagttgtttttgaccttgaggayggttataaaagtagcacggcagca

SEQ ID NO: 32180 - DNA, 50 bp, homo sapien
ttttctctgcacataaccttgcagamgatacttactagagatgcatctga

SEQ ID NO: 32181 - DNA, 50 bp, homo sapien
tgtaaaatttgttatcaactgataargatttgatccacccatttagttat

SEQ ID NO: 32182 - DNA, 50 bp, homo sapien
ggctatggatgtctagaatgaaagayggattgtagataacagtcttgtca

SEQ ID NO: 32183 - DNA, 50 bp, homo sapien
aataaatataacaagtgtatctctaycatgtacaagttataggaagacat

SEQ ID NO: 32184 - DNA, 50 bp, homo sapien
gttcttacctcactgagatataacaycacacattttttttctttctgctt

SEQ ID NO: 32185 - DNA, 50 bp, homo sapien
cttcctcactatattttggatgcacratgcctaaccagagtggccctctt

SEQ ID NO: 32186 - DNA, 50 bp, homo sapien
tatgtaattttgtaatgaggcttccragaaagaaagttatgaatgtttgc

SEQ ID NO: 32187 - DNA, 50 bp, homo sapien
atagtccttttaaattacctaactgmaccacagaaaaattattatgccaa

SEQ ID NO: 32188 - DNA, 50 bp, homo sapien
ttcatatgtgacaccatttaccgtaygttataatttgacaagcttagtga

SEQ ID NO: 32189 - DNA, 50 bp, homo sapien
gaaaaattattatgccaattttcaawcttatctgtttctcccaataacac

SEQ ID NO: 32190 - DNA, 50 bp, homo sapien
tgcaagcttaaagacagatgaataartgacaaattttagaaagctggagg

SEQ ID NO: 32191 - DNA, 50 bp, homo sapien
atagcaacaataacaacaaaaatacygatataaattgtatacccaaattc

SEQ ID NO: 32192 - DNA, 50 bp, homo sapien
atgcaaagaaacctatacatagagckcatggctgcttatacatgtcatca

SEQ ID NO: 32193 - DNA, 50 bp, homo sapien
ccacaatagtcattttgtttctcaaragtggaggtctatttaataacgtt

SEQ ID NO: 32194 - DNA, 50 bp, homo sapien
gtcttcattttcagtatctaaacacmgccttttctaggcagaattgttca

SEQ ID NO: 32195 - DNA, 50 bp, homo sapien
cttgtataataaacttgaactaccamagtattgtaagaagtgatgcatca

SEQ ID NO: 32196 - DNA, 50 bp, homo sapien
aggtcctcacatcagaggctcctcaygttttggaatgcctttctcaaaac

SEQ ID NO: 32197 - DNA, 50 bp, homo sapien
ctgatcattaataaaatagaaattgmaaccacaatgaaattcctctacac

SEQ ID NO: 32198 - DNA, 50 bp, homo sapien
tacagtattgttaaatctttgccatyatagaacatcgtgaaattcaagta

SEQ ID NO: 32199 - DNA, 50 bp, homo sapien
gatgaaaagctacactaaaagaacastaatgtggttggcacacacttaag

SEQ ID NO: 32200 - DNA, 50 bp, homo sapien
gacagaataattttcaatctagagakcagatagctcaagacagtgattct

SEQ ID NO: 32201 - DNA, 50 bp, homo sapien
atgagccagcaaaacactcatcaaayggtttattttcctaatcttggtgt

SEQ ID NO: 32202 - DNA, 50 bp, homo sapien
aaaggtttttagggcaatcactggcrcgtacttcagggtaagattttaaa

SEQ ID NO: 32203 - DNA, 50 bp, homo sapien
gcatcaacagctgctggcaagccacrgtggaagtgccagcaaaaagatgc

SEQ ID NO: 32204 - DNA, 50 bp, homo sapien
atgtatgcatcagaggccttcaaacsagggtgtctatcctcctggggtac

SEQ ID NO: 32205 - DNA, 50 bp, homo sapien
actataactattgctagtattaccaygtgtatctaaaatgaatatgaaaa

SEQ ID NO: 32206 - DNA, 50 bp, homo sapien
tcttccaaaacactcaggcaaattartaacatccaaaatttgaaaatctt

SEQ ID NO: 32207 - DNA, 50 bp, homo sapien
ttcagaggccctttcataatagtaakgacagggctcagaagccagcatag

SEQ ID NO: 32208 - DNA, 50 bp, homo sapien
tttttaagcttgttttcttacctgaracagtagcttatgatcaataagga

SEQ ID NO: 32209 - DNA, 50 bp, homo sapien
ttaaattatgctgttcaaatctcaawtatccttgccaatatggttttata

SEQ ID NO: 32210 - DNA, 50 bp, homo sapien
agaagtcagaccacaaaaatagttasaggtagagtttgagttattttaaa

SEQ ID NO: 32211 - DNA, 50 bp, homo sapien
gcattaaaaaagataaagagagtcamtaaataatgctaagaggttcaatt

SEQ ID NO: 32212 - DNA, 50 bp, homo sapien
actgatgcttgtttgtttgagaatayggtccctcttttggtctttgtaaa

SEQ ID NO: 32213 - DNA, 50 bp, homo sapien
ccctgacacacactattggtaaacaragcagaagtaatgtcacaaggcat

SEQ ID NO: 32214 - DNA, 50 bp, homo sapien
atgatggtggcttggactattagtgragacagtaagaggtgaatatatta

SEQ ID NO: 32215 - DNA, 50 bp, homo sapien
attttgaagaccatttatacattcamattgatatggaagactgaaaagga

SEQ ID NO: 32216 - DNA, 50 bp, homo sapien
aaacttccttgtagtcaatgggagargtaaacctgaacaaaatgtgtgtg

SEQ ID NO: 32217 - DNA, 50 bp, homo sapien
aaatgaaaaacaaggtaatttactcmatgaaaaacaaaatatcacacaaa

SEQ ID NO: 32218 - DNA, 50 bp, homo sapien
tccatctcaggtcaaaatccaatgayctagtacatactctgaatcttttc

SEQ ID NO: 32219 - DNA, 50 bp, homo sapien
aaagtcttcaatacatgactaataayggcataaaagaaccaataaaccat

SEQ ID NO: 32220 - DNA, 50 bp, homo sapien
agaactgagttcatatgtctcagaartagtaattgtttctattacatgga

SEQ ID NO: 32221 - DNA, 50 bp, homo sapien
acctttccctcctactacttcatacygctctcttctgtctataaattcct

SEQ ID NO: 32222 - DNA, 50 bp, homo sapien
attgtgttctatattgcatctcttastaacaaaggaagcacaatagatac

SEQ ID NO: 32223 - DNA, 50 bp, homo sapien
actgtatctatatctatctggcataygtttctgtacttttcaatggaaaa

SEQ ID NO: 32224 - DNA, 50 bp, homo sapien
attcattgacaaacaaggaaaatccratctggactggtggtggtttttaa

SEQ ID NO: 32225 - DNA, 50 bp, homo sapien
taggaaaatgtagatttagaagcacygggaaaatttatgttagaggttgt

SEQ ID NO: 32226 - DNA, 50 bp, homo sapien
ggtcctgctatcatttagaagagtcracctgtgcccaagatagcttaaag

SEQ ID NO: 32227 - DNA, 50 bp, homo sapien
aaaaagcaagtgtgtattattttatwaaaaaagcctaaacaaatgtctta

SEQ ID NO: 32228 - DNA, 50 bp, homo sapien
agctatgagcacttcaatgctaagakattagggagcaaaataagaaccaa

SEQ ID NO: 32229 - DNA, 50 bp, homo sapien
gacaaattgatgcctgcattctctcragcgtgcattattgtataccagaa

SEQ ID NO: 32230 - DNA, 50 bp, homo sapien
ccttagacaacggctgagattgagayatggcttggcttcttcccttctat

SEQ ID NO: 32231 - DNA, 50 bp, homo sapien
aattttgatttattatcttagttcamattaagcaagtcctgcatgatgat

SEQ ID NO: 32232 - DNA, 50 bp, homo sapien
atcatgattatattcaaaggtgtaaytgaggatatttctaaaatgtaatc

SEQ ID NO: 32233 - DNA, 50 bp, homo sapien
tttttagttattaggcccagatttasagtgaaatggcatgcttcaatatc

SEQ ID NO: 32234 - DNA, 50 bp, homo sapien
cctgtatgatatttggtatcataacwaagtataagccactgatgcactat

SEQ ID NO: 32235 - DNA, 50 bp, homo sapien
gggatgaaccactgctcatgcagtcrctagagatttaaaggtcagagctg

SEQ ID NO: 32236 - DNA, 50 bp, homo sapien
tccttattcgtaattcttgtgctaarggcaaccactatggttttgagaaa

SEQ ID NO: 32237 - DNA, 50 bp, homo sapien
taaaataaagattcttcccattatcrcatttaggacactcctctattact

SEQ ID NO: 32238 - DNA, 50 bp, homo sapien
attctagtccactctgtgtcatcacyactatggaactttgcactcagtat

SEQ ID NO: 32239 - DNA, 50 bp, homo sapien
taaggatgagaaagatagcaaaaaamgtttcctatattctggtagttttc

SEQ ID NO: 32240 - DNA, 50 bp, homo sapien
catatttaaaatgcatatcatgtaarcagcatacaagtaagcttgcattt

SEQ ID NO: 32241 - DNA, 50 bp, homo sapien
tttcctctgaaatttaggtaaatcartgaactcacctctctctcatgatc

SEQ ID NO: 32242 - DNA, 50 bp, homo sapien
tgctcttaccctactaggaaaaaaaytggacaatcctggtaattagcagg

SEQ ID NO: 32243 - DNA, 50 bp, homo sapien
atgaagactagaataaaaatggtgcsaggcatttagccacagaatatctg

SEQ ID NO: 32244 - DNA, 50 bp, homo sapien
cttctttcattggaatactcctgcayagtttgtaagtctaatattcacat

SEQ ID NO: 32245 - DNA, 50 bp, homo sapien
attcaatttgtcatttttttctttaygatcgatgttttctgagtactatc

SEQ ID NO: 32246 - DNA, 50 bp, homo sapien
tgtgtacaaacttgaaaattctaaartgttcccagattactgtaatttaa

SEQ ID NO: 32247 - DNA, 50 bp, homo sapien
gaggaaagaagattctttttaccaastcagtctgaaggcagagagaatta

SEQ ID NO: 32248 - DNA, 50 bp, homo sapien
tcctcaagtgccacgacctaaacaasatagaattcaacttctctttagtg

SEQ ID NO: 32249 - DNA, 50 bp, homo sapien
tgtattttaaacctaggagctacaawgaatttcctcacttcactcaaaac

SEQ ID NO: 32250 - DNA, 50 bp, homo sapien
tatttcattttactgctcaacactgmaacactttttagagaaaaactgga

SEQ ID NO: 32251 - DNA, 50 bp, homo sapien
tccactgtagaaatgcctgctgtaaytgaagcattgcgtcaagcattctg

SEQ ID NO: 32252 - DNA, 50 bp, homo sapien
gtatttcccaccctcttttacataaktactgccttgaatccattagagca

SEQ ID NO: 32253 - DNA, 50 bp, homo sapien
ttttgcacctcaaaaagttataagargaatcaaaactgtgggactctgca

SEQ ID NO: 32254 - DNA, 50 bp, homo sapien
tttggcaagagaagttgatcagaaargcattaaaataaaatttaataaaa

SEQ ID NO: 32255 - DNA, 50 bp, homo sapien
gctttcagctctccaaaaccagtgayctagtcgaattaatgttggcctca

SEQ ID NO: 32256 - DNA, 50 bp, homo sapien
gggggtgtgtgtgattcagtgaagamaggtaggaaaacatttttatcatt

SEQ ID NO: 32257 - DNA, 50 bp, homo sapien
ctttgagagttaaccctttctgtaartgcataatgtctccagaagctttc

SEQ ID NO: 32258 - DNA, 50 bp, homo sapien
actgacagacttgctgagccaataamgatgaaaacaacggcacctgtgtg

SEQ ID NO: 32259 - DNA, 50 bp, homo sapien
ccctacccctggctctttgtaaaaaytccttacattgttacaggcccatc

SEQ ID NO: 32260 - DNA, 50 bp, homo sapien
atcaagaagattatacatcatgatcragagagatgtatccctggccatgt

SEQ ID NO: 32261 - DNA, 50 bp, homo sapien
catgtgccagtctgggatcacccaamtgatagatattaacaccacaactc

SEQ ID NO: 32262 - DNA, 50 bp, homo sapien
agtaacaatatgggaaatcagcatamccggagacctagtatttattcata

SEQ ID NO: 32263 - DNA, 50 bp, homo sapien
aagccctataatattggtgccagaakaatttgttgtatacgtgttgataa

SEQ ID NO: 32264 - DNA, 50 bp, homo sapien
gagcagacttaatgaggcaaataaasatttatcagttccccagacacctt

SEQ ID NO: 32265 - DNA, 50 bp, homo sapien
tgttatcaataagttttagcaattawgatgttatgagtattcttattgta

SEQ ID NO: 32266 - DNA, 50 bp, homo sapien
tgatttgtactactaattatctgatsagcacccactcatgtttcaacctg

SEQ ID NO: 32267 - DNA, 50 bp, homo sapien
tgatctgcagaagtttgaactaaacrgtgatgatttagagcaagtttgtt

SEQ ID NO: 32268 - DNA, 50 bp, homo sapien
caagtgatctttaatcttccgatgcyctttacttttcctgctccttattg

SEQ ID NO: 32269 - DNA, 50 bp, homo sapien
tatatccctcacacttttagaacacrctaattgcctttagatttctgtgg

SEQ ID NO: 32270 - DNA, 50 bp, homo sapien
agcaagagcaccaaggcagaagtacyggaaaggtgatgctttatcattca

SEQ ID NO: 32271 - DNA, 50 bp, homo sapien
atcttcctgtcttctgaaccttccaygtctctagaaagtttcaagctttc

SEQ ID NO: 32272 - DNA, 50 bp, homo sapien
tctcagtttctgaagtcttataatcsatttaccatagagatacaggctta

SEQ ID NO: 32273 - DNA, 50 bp, homo sapien
atggtttttctatttgtttattcaaygggaagttcattaaagcatttttc

SEQ ID NO: 32274 - DNA, 50 bp, homo sapien
agaaggtgatttaagaaaaacagtgractccaatataaacagcaaaacag

SEQ ID NO: 32275 - DNA, 50 bp, homo sapien
tccattggcttccatcaatcaataamcaaaaatttggtgagcacacacag

SEQ ID NO: 32276 - DNA, 50 bp, homo sapien
cctgtgatttgtctcctccaacccastaggctagctttgtagtcttacct

SEQ ID NO: 32277 - DNA, 50 bp, homo sapien
tcttccaggagttcttgggacccatsatgagaaggaagtggtggagcatg

SEQ ID NO: 32278 - DNA, 50 bp, homo sapien
catttccatttaaaactgactagtaracatctgttgaaccaactagaaaa

SEQ ID NO: 32279 - DNA, 50 bp, homo sapien
cgtaggcattgtatggctcctgtcastatcaaatatagatgatatctact

SEQ ID NO: 32280 - DNA, 50 bp, homo sapien
tttgaaaacctccaatcaagtcaaasagaataatgtaataattccaaatg

SEQ ID NO: 32281 - DNA, 50 bp, homo sapien
aatgaaatttaaaatacatcaggtcraaaaatgttttaattactctgtct

SEQ ID NO: 32282 - DNA, 50 bp, homo sapien
aaataatttttaacagtggtcttcaycaagaaggaaatttagtccagaag

SEQ ID NO: 32283 - DNA, 50 bp, homo sapien
gagtaagaacactcagatcctatgaygtaagaccacatatattctccaaa

SEQ ID NO: 32284 - DNA, 50 bp, homo sapien
acctctattagaagaacagctaatcrcaatcattatctttataagttaag

SEQ ID NO: 32285 - DNA, 50 bp, homo sapien
ctacttttaatgatatactgcctgckcgattcccattcccagctccaaca

SEQ ID NO: 32286 - DNA, 50 bp, homo sapien
ctatcctgcttggcaactaatccacrgtcatataggcctcttttcacttc

SEQ ID NO: 32287 - DNA, 50 bp, homo sapien
tacagcgagagagatgtaagttaaayggcatggtcatgtccctaaagaag

SEQ ID NO: 32288 - DNA, 50 bp, homo sapien
tgtttctttgattttcaccaaactasaacagaaatttagaggaattttga

SEQ ID NO: 32289 - DNA, 50 bp, homo sapien
cagtggctaggcccttgagtctggartaaaaggctacagccgagacagtc

SEQ ID NO: 32290 - DNA, 50 bp, homo sapien
caaattttatatcctgatccaaatayatgtgtgattttaatttaaattta

SEQ ID NO: 32291 - DNA, 50 bp, homo sapien
catttattgtccttcttagttactaratcttagagagtttttatatccta

SEQ ID NO: 32292 - DNA, 50 bp, homo sapien
gagaagtggtcaataaagttgccgayaggtctcctttaaagtagtgcagt

SEQ ID NO: 32293 - DNA, 50 bp, homo sapien
cactaaatggagacacgaatctaaargatcaccggcaacagccctaaaag

SEQ ID NO: 32294 - DNA, 50 bp, homo sapien
tacccagttgagtatctacaatgtayccgaatagtaataaacactgtgga

SEQ ID NO: 32295 - DNA, 50 bp, homo sapien
attgattagtattaagagatattaaygactctaactatattgatctatga

SEQ ID NO: 32296 - DNA, 50 bp, homo sapien
gtatgattgtcctaatgaccaatgayatgaattactgaaaacctaattag

SEQ ID NO: 32297 - DNA, 50 bp, homo sapien
tttgtgcccacataattacatgccartacctttcctcaaattagaaatta

SEQ ID NO: 32298 - DNA, 50 bp, homo sapien
gtacttgaaccattaagttgaaagaktcttactcaaaggcccctgagaga

SEQ ID NO: 32299 - DNA, 50 bp, homo sapien
tatgtgaataatacttcaataaatckaatactaggaaaaatataggcata

SEQ ID NO: 32300 - DNA, 50 bp, homo sapien
aaaatagccaggttgaaattagatarctattactggcttatctctatatt

SEQ ID NO: 32301 - DNA, 50 bp, homo sapien
agttgtgtttccttaattaaaggacrcctaacacaatacaggttaactct

SEQ ID NO: 32302 - DNA, 50 bp, homo sapien
ctattttgacagtttgtatacccaawctaaaattatggtaagttaaatag

SEQ ID NO: 32303 - DNA, 50 bp, homo sapien
ttccattcaatcgtcttctggcaaaygtacagagttgtacaattgaatga

SEQ ID NO: 32304 - DNA, 50 bp, homo sapien
gcacttaagtttataatttagttaaygtccagcaattatgctttatttta

SEQ ID NO: 32305 - DNA, 50 bp, homo sapien
gtgcatttctccctatagtggaaagmatactcagatctggtactactgcc

SEQ ID NO: 32306 - DNA, 50 bp, homo sapien
ttaatctatgcagatttactaaaggkaataagagtgaaactgatataact

SEQ ID NO: 32307 - DNA, 50 bp, homo sapien
gttaacatcttctatttggaaacaaycattgtaatatttgagcctttatt

SEQ ID NO: 32308 - DNA, 50 bp, homo sapien
tgacttctctatctaactgtaaatgyagtagcaataatcttgctgctaat

SEQ ID NO: 32309 - DNA, 50 bp, homo sapien
tttccccttttctgccttctgtatcyagactgttgttcagtcctgtttat

SEQ ID NO: 32310 - DNA, 50 bp, homo sapien
ttctgaagagactgactctaactcarctttctaaagagatccacttacaa

SEQ ID NO: 32311 - DNA, 50 bp, homo sapien
tcagtatttagaaatcactaccttargatctgttccttaaagttatttcc

SEQ ID NO: 32312 - DNA, 50 bp, homo sapien
taggatacaaaatctaaacacttgargttcaaaagtagaatctaagtgtt

SEQ ID NO: 32313 - DNA, 50 bp, homo sapien
ttgggaaatgaaatggaatagtagckcacgtattggaaaataacagaggt

SEQ ID NO: 32314 - DNA, 32 bp, homo sapien
tggcagcataatttaayacagtgaatactaga

SEQ ID NO: 32315 - DNA, 50 bp, homo sapien
atagtatagatattttgtaatgtaawggtagctgtaaagcaagggaggaa

SEQ ID NO: 32316 - DNA, 50 bp, homo sapien
ctctgcctcttccttgatagcttaartcctgaattctgttcttaaatact

SEQ ID NO: 32317 - DNA, 50 bp, homo sapien
ttgggttcaaaagtgtattttctcaytctttcaggaacttttttatcttt

SEQ ID NO: 32318 - DNA, 50 bp, homo sapien
atctagcagtaggaagataaggtaaraggttattacttgagaatgtgagg

SEQ ID NO: 32319 - DNA, 50 bp, homo sapien
cagaggaaggacagtatgttccagaygggttttgcagtaagagtggctca

SEQ ID NO: 32320 - DNA, 50 bp, homo sapien
gagtggctcagtgacgctatcctcartcagaacagcaaggaggatggccc

SEQ ID NO: 32321 - DNA, 50 bp, homo sapien
gtagtaaaaccaattaaaagaccagrccatcttttatgcagaagtgaaat

SEQ ID NO: 32322 - DNA, 50 bp, homo sapien
tgggccagaggaaaatttgactaacrgatatcacaccaaaaacctgctct

SEQ ID NO: 32323 - DNA, 50 bp, homo sapien
gatcctgtaagtggtgagatccacargttcatctatggaggagctgggcc

SEQ ID NO: 32324 - DNA, 50 bp, homo sapien
gcttctcctcagtgaggatacacttwcaacgaactgtaagcattaagaga

SEQ ID NO: 32325 - DNA, 50 bp, homo sapien
gattttgggaactctgcatgaacagrcctaagatggcacagtggaaagga

SEQ ID NO: 32326 - DNA, 50 bp, homo sapien
agtgagaaaaggaagtttatttcccragctgtcctcttctgtctcatgta

SEQ ID NO: 32327 - DNA, 50 bp, homo sapien
gggcgggtgaaagaacagatgctgcyattaaccttatgattgactgaaac

SEQ ID NO: 32328 - DNA, 50 bp, homo sapien
agacctgtgtttagcttcgaactcamatgtttgttattaaaaacaggtgt

SEQ ID NO: 32329 - DNA, 50 bp, homo sapien
aattttcttggtacaaataagtaacratacactctaagcattgccaatgt

SEQ ID NO: 32330 - DNA, 50 bp, homo sapien
agaaaagatgacttttgtcactaaargatggaagaccaatttgaagaaag

SEQ ID NO: 32331 - DNA, 50 bp, homo sapien
atcagtacaagttctactcagtgaaygtggattacagcaaactaaagaaa

SEQ ID NO: 32332 - DNA, 50 bp, homo sapien
ccaaattgaactcaatggagtatackgtacaaatcctgtcttaggttgtg

SEQ ID NO: 32333 - DNA, 50 bp, homo sapien
cagcaaagtttcaaaaaaactcataragcatgaaataaaaaaggactcaa

SEQ ID NO: 32334 - DNA, 50 bp, homo sapien
cttggatgcttcttgacctgactaawgatctggcagagtatgtttgtggc

SEQ ID NO: 32335 - DNA, 50 bp, homo sapien
aggaggcagatagcagaatgtctgcrcttatcaacaactagaaaccttgt

SEQ ID NO: 32336 - DNA, 50 bp, homo sapien
tagtcaggacaggtgactcaggaaaraaaaagtgatggtataaacaagaa

SEQ ID NO: 32337 - DNA, 50 bp, homo sapien
acttctgattcagatacaagttagamagtgaaatggaaaaaccacagact

SEQ ID NO: 32338 - DNA, 50 bp, homo sapien
tcatggaccattctttaaggttataygacagagtaagactgtgaaatctt

SEQ ID NO: 32339 - DNA, 50 bp, homo sapien
caccattctgaagaggacacatgtargttctttggtagagccactatatt

SEQ ID NO: 32340 - DNA, 32 bp, homo sapien
ttaggctaggttagaargactgtatggttccc

SEQ ID NO: 32341 - DNA, 50 bp, homo sapien
cctcagcttaatgcagagtgagtcaragataaactccagctctcagcttc

SEQ ID NO: 32342 - DNA, 50 bp, homo sapien
acacttctaaataaccagcctaaaawgataattaagaaagaaagatcagg

SEQ ID NO: 32343 - DNA, 50 bp, homo sapien
ctttgggtggtgtatttgctcttccraaccttggctagaaagagacatct

SEQ ID NO: 32344 - DNA, 50 bp, homo sapien
accatgtaaggaaagattaaaggaargtaagttactataaaaatacaaaa

SEQ ID NO: 32345 - DNA, 50 bp, homo sapien
tgcgaggcagaatagagaaccataartatcaatgaagaaagggagagaga

SEQ ID NO: 32346 - DNA, 50 bp, homo sapien
ctgttcagttcttggaaacacatgcyctttggaaaaatacctaaagagat

SEQ ID NO: 32347 - DNA, 50 bp, homo sapien
gtaagggccctatacagatgtaccaygtttaccttttgtattgtcttttt

SEQ ID NO: 32348 - DNA, 50 bp, homo sapien
tgttttttgcctaatttaatatatargcaactgactaactacttctttgg

SEQ ID NO: 32349 - DNA, 50 bp, homo sapien
gtgtttactaagttggagactcttamattcctagagccttaaaaccaggg

SEQ ID NO: 32350 - DNA, 50 bp, homo sapien
aatgtgttaaaatgagttttcacaaygtgttcagaaaaagtctgctttat

SEQ ID NO: 32351 - DNA, 50 bp, homo sapien
tttgaaactctagatttaatgtcagsaggtatgttattttaagtgggagc

SEQ ID NO: 32352 - DNA, 50 bp, homo sapien
tggtaccatatttatacttgaattaygggatggtttgacatgacagctaa

SEQ ID NO: 32353 - DNA, 50 bp, homo sapien
cttgagtacaaagtattcatatttayggcctagtaggaaaatgttagtag

SEQ ID NO: 32354 - DNA, 50 bp, homo sapien
ttcctagctagctatttcacttaaaycaaaacagacagatcaagaattac

SEQ ID NO: 32355 - DNA, 50 bp, homo sapien
atttgttccaacaattgctgagatartaatgttagcatctataagtacga

SEQ ID NO: 32356 - DNA, 50 bp, homo sapien
gctgctgaaaccagtgttagattaartacaggcctcatggatgttttcca

SEQ ID NO: 32357 - DNA, 50 bp, homo sapien
ttatttatatgcttttgtgagactayggttaaataggcagatacattttc

SEQ ID NO: 32358 - DNA, 50 bp, homo sapien
gaatttggaggtgaagacttgggaaktaattaggtttaaatgtagtcatg

SEQ ID NO: 32359 - DNA, 50 bp, homo sapien
gtgataatgtcaaggtttactcttaygtgaaaggctttaacccccacaca

SEQ ID NO: 32360 - DNA, 50 bp, homo sapien
acctggggaagcttaaatcaaggaargaaacaagacagcctagtcacagg

SEQ ID NO: 32361 - DNA, 50 bp, homo sapien
agagagggatgggaagatgatgaaayggtatataggaagttgaaacctgg

SEQ ID NO: 32362 - DNA, 50 bp, homo sapien
ctttctttgaacgtatattttacctyagatgattttgactttttctcttg

SEQ ID NO: 32363 - DNA, 50 bp, homo sapien
aactatttttacaaaggaacacttaraaatattacatcatatcaggacca

SEQ ID NO: 32364 - DNA, 50 bp, homo sapien
tccaaacctgtaaagacactcaaaayggagttaatcatacatcccagttt

SEQ ID NO: 32365 - DNA, 50 bp, homo sapien
ttaaatttatgtattacccaggcaayttactttatgaaaatatgcaatct

SEQ ID NO: 32366 - DNA, 50 bp, homo sapien
attaattccactctccatctgtaaamgggttgcaatattagccatatttg

SEQ ID NO: 32367 - DNA, 50 bp, homo sapien
gtgttgagattcttccatgattaccygcaaagggcctagagaaacagcag

SEQ ID NO: 32368 - DNA, 50 bp, homo sapien
cattgttggaaataaacttttgagaygtcagaattatagtataagcaagt

SEQ ID NO: 32369 - DNA, 50 bp, homo sapien
agactcaaatgacaatcctggttgaytacttcttttcaagctacattaac

SEQ ID NO: 32370 - DNA, 50 bp, homo sapien
ttcaacagataaataaattcaaaaamttaagtacatctgggtgtgagtta

SEQ ID NO: 32371 - DNA, 50 bp, homo sapien
tgtctacaggatagaatcaacagaayctagtgatacattggatataaaag

SEQ ID NO: 32372 - DNA, 50 bp, homo sapien
tttttatactctttaaccactaaatwattctttctgcgaatgtggtatga

SEQ ID NO: 32373 - DNA, 50 bp, homo sapien
atgcaaaggccagaaaaaaataagartagcaatgaatttgtataaaagtc

SEQ ID NO: 32374 - DNA, 50 bp, homo sapien
gcaattgaaattggtgactatttgawgtaagactattttaatagatttgt

SEQ ID NO: 32375 - DNA, 50 bp, homo sapien
ttcatcatcgtgtaatagcgcaagaycaccactagatggaagcataggat

SEQ ID NO: 32376 - DNA, 50 bp, homo sapien
acacagagagaatgaaaataaaaagscttttccatgcttacatgaacatt

SEQ ID NO: 32377 - DNA, 50 bp, homo sapien
aaagacttttggaaatcatttagacwacatttaatgtctctcctgctctc

SEQ ID NO: 32378 - DNA, 50 bp, homo sapien
tttactttggctgacatgccgcaatyattaatttacttatctgattcaaa

SEQ ID NO: 32379 - DNA, 50 bp, homo sapien
ggaaaggtagtttgataggaagtggratagaagttttatagaaaagaggt

SEQ ID NO: 32380 - DNA, 50 bp, homo sapien
tcatgacaaaatgggatttattcctraattaaaagaatgactcaacatat

SEQ ID NO: 32381 - DNA, 50 bp, homo sapien
actattgttctttctacttttactayagctgtgcataaactcacctgttt

SEQ ID NO: 32382 - DNA, 50 bp, homo sapien
atacgctgggtattctcactgaacaycatttactgacattcttccctgaa

SEQ ID NO: 32383 - DNA, 50 bp, homo sapien
tccatcctgatgtatctgttacctayagtgtcctgcgcctctgaaatggt

SEQ ID NO: 32384 - DNA, 50 bp, homo sapien
agaaagtcaaatgattcataattagycaatgagggaaccaggattagaac

SEQ ID NO: 32385 - DNA, 50 bp, homo sapien
aatttggtatcagaaattcttgacartactacctaaaactcctcaaatct

SEQ ID NO: 32386 - DNA, 50 bp, homo sapien
atttttttaatgtatacaactgagaygaagccaatagaactttaccacag

SEQ ID NO: 32387 - DNA, 50 bp, homo sapien
tgtagcctggattttcaccaaaagastcaaccaaaataaagagttgtagg

SEQ ID NO: 32388 - DNA, 50 bp, homo sapien
tagctaccaatttagtaatcttttgmataagtatcaagttacagacctca

SEQ ID NO: 32389 - DNA, 50 bp, homo sapien
gcttccaggaagtaattgttattacyatgcacggaactttgcatgtaaca

SEQ ID NO: 32390 - DNA, 50 bp, homo sapien
ggcatcttacctcgctagatgttaaraaaaactatatgtaacacaaccta

SEQ ID NO: 32391 - DNA, 50 bp, homo sapien
ctgaggggacaaaagagggtcagcamtgatgtgtctccaagggaattcct

SEQ ID NO: 32392 - DNA, 50 bp, homo sapien
tgggttaaaacacaaaatattcagaytctactggtaagatggtgaattta

SEQ ID NO: 32393 - DNA, 50 bp, homo sapien
aagacaaatctcttgtaaggtaggaratgaggtggtgtgaacttggcaga

SEQ ID NO: 32394 - DNA, 50 bp, homo sapien
tgtagtagacatctgtgttacctccraaagtcgacaaaagatcatttaaa

SEQ ID NO: 32395 - DNA, 50 bp, homo sapien
agggtttgcagactgacactaaaatraacagctgagtgcttaagtgtggt

SEQ ID NO: 32396 - DNA, 50 bp, homo sapien
aattgtgtgcaactaattcctacaaygagaatcccgtacccactgtgatg

SEQ ID NO: 32397 - DNA, 50 bp, homo sapien
gggtataagtttttacaagtcataawctcacatgcacaaaaatgctttat

SEQ ID NO: 32398 - DNA, 50 bp, homo sapien
tgtccttaggagtacacgtaatatgmacactttgatgctcttattgctta

SEQ ID NO: 32399 - DNA, 50 bp, homo sapien
taaatcatattttaactcaatgcaartagtgaccaagttattttccacag

SEQ ID NO: 32400 - DNA, 50 bp, homo sapien
ttaactaggtcagattcaatttccaytcagtaagtctttaatcagtgtct

SEQ ID NO: 32401 - DNA, 50 bp, homo sapien
gaagtgcaacactagtttttaggaartcatgctatcccacgaatgtctca

SEQ ID NO: 32402 - DNA, 50 bp, homo sapien
cacgcactttcatctataatcacaaygaaccttttaataaacatgtttct

SEQ ID NO: 32403 - DNA, 50 bp, homo sapien
atctgtccccattcttgtgataccaragaaaaagtggctgggcagacgtg

SEQ ID NO: 32404 - DNA, 50 bp, homo sapien
ctggtatcacaagaatggggacagaygattttgagttcagctttctaacc

SEQ ID NO: 32405 - DNA, 50 bp, homo sapien
gcagtgattactagagtctctccaaygtgaatcaaattgaagaaaaacaa

SEQ ID NO: 32406 - DNA, 50 bp, homo sapien
tttaccagaagcccagccctggcaayagcagtaacagcagcaatgacaat

SEQ ID NO: 32407 - DNA, 50 bp, homo sapien
cagaaggacttctgaaatgcttatayatacaacctgacaggtacaatcag

SEQ ID NO: 32408 - DNA, 50 bp, homo sapien
gaaagctgaggcaatgctgtaataayaagagctatgtgaaaggtaaagta

SEQ ID NO: 32409 - DNA, 50 bp, homo sapien
aaagaaaaggtagatgtctaagcacygacaggaaattatcccaagatatg

SEQ ID NO: 32410 - DNA, 50 bp, homo sapien
atgagttctggaaagttctctactaytaactcttttaatattgttcctgc

SEQ ID NO: 32411 - DNA, 50 bp, homo sapien
cacagagagttcttacctgtagtcayggtggataactatttaataggctg

SEQ ID NO: 32412 - DNA, 50 bp, homo sapien
tctttaagtataaaataaggaagtayggtgcaggtccacgactgtcattc

SEQ ID NO: 32413 - DNA, 50 bp, homo sapien
atcatgaaaaagattgctctctaaayagtactcagttccttcttctggac

SEQ ID NO: 32414 - DNA, 50 bp, homo sapien
ctaattcatgggtaagaacaaatcasaagttgggagaagaacacagaaaa

SEQ ID NO: 32415 - DNA, 50 bp, homo sapien
aggcaccttcatgtcattcatattcrctgtcctaaagtctattagttgat

SEQ ID NO: 32416 - DNA, 50 bp, homo sapien
gaagacaatctgtgggtaactgacartactacttaagtatccagcaatgt

SEQ ID NO: 32417 - DNA, 50 bp, homo sapien
ggacaaagctggctaaacactaacamatttttccacttcaatcacttccc

SEQ ID NO: 32418 - DNA, 50 bp, homo sapien
agctaagtaaataatttggcagttayaaagaggaaaagcggcatatccca

SEQ ID NO: 32419 - DNA, 50 bp, homo sapien
aatttttggcaagctactttggtgaycctcattaagtttcatatgcaaat

SEQ ID NO: 32420 - DNA, 50 bp, homo sapien
agaaaaggaaggagagaggaaaacaytgttaagattcattccattatagc

SEQ ID NO: 32421 - DNA, 50 bp, homo sapien
tcagatatcccctccaacttataatraatctccctggactttggccattc

SEQ ID NO: 32422 - DNA, 50 bp, homo sapien
aaaaatgatgtgtatctagggtgaaygcagttgatttagggactaatttt

SEQ ID NO: 32423 - DNA, 50 bp, homo sapien
cacagttgccagctctacaacaaccrgaatgagatgagaaatggaggcaa

SEQ ID NO: 32424 - DNA, 50 bp, homo sapien
tttttcaagatactcagcatgtatamagtatatctgcaatccattttctg

SEQ ID NO: 32425 - DNA, 50 bp, homo sapien
gcattctatacatgcagaataaaacygtgaaaaagtggaatgctacctat

SEQ ID NO: 32426 - DNA, 50 bp, homo sapien
cttatgcagtccccaagtctttcacraaatatagtcccaactccctcctc

SEQ ID NO: 32427 - DNA, 50 bp, homo sapien
tgtgccaccagcacagggctccctcrctaagatttctttgttatggaata

SEQ ID NO: 32428 - DNA, 50 bp, homo sapien
ttcatttaaatgctcttgactatcasggaagataaggtgttccataaggg

SEQ ID NO: 32429 - DNA, 50 bp, homo sapien
tcaagagcacttcagctattcatagwcctcctggtaatttgatatttttc

SEQ ID NO: 32430 - DNA, 50 bp, homo sapien
ttttatcaacaaaaaattttgaaagkcctcaatggtgaagtttttggttg

SEQ ID NO: 32431 - DNA, 50 bp, homo sapien
tccttgcttctattaccagaattacygacattgtgctctaaaatttgttt

SEQ ID NO: 32432 - DNA, 50 bp, homo sapien
caagggtcaactgtattttgatccayaccatagtctccctaatccacata

SEQ ID NO: 32433 - DNA, 50 bp, homo sapien
aaactttcatattctacttcgcttawcaacataagttccaatttcagatc

SEQ ID NO: 32434 - DNA, 50 bp, homo sapien
agctaaatagaataggaagaggtaaygtatcatcagaggaatgtgaaaag

SEQ ID NO: 32435 - DNA, 50 bp, homo sapien
ttgtcctgtccttactgcacagtcartctacatgaaagaaagtcaggcct

SEQ ID NO: 32436 - DNA, 50 bp, homo sapien
ggaaaaaggggttgcaataaaagaastgatggcaaatggacctttcaaaa

SEQ ID NO: 32437 - DNA, 50 bp, homo sapien
aaaatgactgataagtaatcacatcratacagttaaaccaaaagcaactc

SEQ ID NO: 32438 - DNA, 50 bp, homo sapien
atttctctaaaataggaaacaaaacsatcttcagctagagagaggaagga

SEQ ID NO: 32439 - DNA, 50 bp, homo sapien
agtagatagaggtgttcaaatgcggrattctgttgatactacagtagtga

SEQ ID NO: 32440 - DNA, 50 bp, homo sapien
gaagtcacaactaacgtttggaaatsatatcttatgaggatgggacacca

SEQ ID NO: 32441 - DNA, 50 bp, homo sapien
tctttattactctatactttctgaayttcacatgtggtgtcctcagggtt

SEQ ID NO: 32442 - DNA, 50 bp, homo sapien
tttcaaaaatgcatctttgtggttcragtgtagagaatgaattggagaag

SEQ ID NO: 32443 - DNA, 50 bp, homo sapien
ttccaggaccatgacttctccaaccrcattcactgctactactgcttcca

SEQ ID NO: 32444 - DNA, 50 bp, homo sapien
gcagcaaagttacattcagaagaccrgaaattttccaaccgcaaaaagta

SEQ ID NO: 32445 - DNA, 50 bp, homo sapien
caaatccttctaattttatcaagaakaccacaattacagaaaaatagttt

SEQ ID NO: 32446 - DNA, 50 bp, homo sapien
ttgctaatttacctctgaaattggasccatggttcgcagtgctcctgctt

SEQ ID NO: 32447 - DNA, 50 bp, homo sapien
atggatgaatctacagttagaaagarccaattttaaggagcaagtaaagt

SEQ ID NO: 32448 - DNA, 50 bp, homo sapien
ctggctctggaaaggtagtactagakcacccggtggccttttactgtaag

SEQ ID NO: 32449 - DNA, 50 bp, homo sapien
ttctctgttcatatggtacacaggaygtaagctattcacttttctatttt

SEQ ID NO: 32450 - DNA, 50 bp, homo sapien
cttggttatacaagagaactaggaayctcacatgttagcaattgtagctc

SEQ ID NO: 32451 - DNA, 50 bp, homo sapien
ttttccttaacttactgaagcctgaratgtagcccattaatttgaaaatg

SEQ ID NO: 32452 - DNA, 50 bp, homo sapien
tcatcacagaccgaagaaaggatacrggatagaagaaccaagtacctcaa

SEQ ID NO: 32453 - DNA, 50 bp, homo sapien
aaaaattccaggcacagagagaatartagggcttttcatcacagaccgaa

SEQ ID NO: 32454 - DNA, 50 bp, homo sapien
tcatctatgaggtttcctttgtagaygtagaggaatggaaggggaattca

SEQ ID NO: 32455 - DNA, 50 bp, homo sapien
ctttcatgaaaagtaacaatgaacargtgtgataagaacaccagccaaaa

SEQ ID NO: 32456 - DNA, 50 bp, homo sapien
taaatgttcagaaactactgatcgaytaaagtattttcttttcattttac

SEQ ID NO: 32457 - DNA, 50 bp, homo sapien
atatgatactttctcttcctcaatamggtggtgagctggtgagctagggg

SEQ ID NO: 32458 - DNA, 50 bp, homo sapien
gggggtactcttcacaaaactggccrctatccatccattgcacctatagg

SEQ ID NO: 32459 - DNA, 50 bp, homo sapien
aatgtttgctgaattgaagtatggaratgacaagaagttacatatgttag

SEQ ID NO: 32460 - DNA, 50 bp, homo sapien
gaaggggtggatactaaagaatttgraagtcatctgcagagagacaattt

SEQ ID NO: 32461 - DNA, 50 bp, homo sapien
cttagattttataacagagtagctcratgaatatttttctgatagtgaag

SEQ ID NO: 32462 - DNA, 50 bp, homo sapien
taaacaaaacctatataggaaaaaargattaatattagtcatgtctaagt

SEQ ID NO: 32463 - DNA, 50 bp, homo sapien
tgcgtatagtacatagtggtacaacracagaaataaatcccataagaagc

SEQ ID NO: 32464 - DNA, 50 bp, homo sapien
aggatagaaatctcaccagtaaccaygtgccttgtacaatagcactgttt

SEQ ID NO: 32465 - DNA, 50 bp, homo sapien
aacagatttgagtggccaatgaatarcactgctggagtatatgacttttt

SEQ ID NO: 32466 - DNA, 50 bp, homo sapien
atttggagagattaaaactgagaaayatgaaaggatctattcagttttac

SEQ ID NO: 32467 - DNA, 50 bp, homo sapien
attatttttatattaaggaattacaktcatccaacatttagaaagcgaaa

SEQ ID NO: 32468 - DNA, 50 bp, homo sapien
gagaatgaaacaaagtaatttcacayctggttttatgaatcagctcacta

SEQ ID NO: 32469 - DNA, 50 bp, homo sapien
cacaaatctactcattaaccgaaaayccaatcagactctcagagttgggc

SEQ ID NO: 32470 - DNA, 50 bp, homo sapien
actaggacatgagttcaaagaggcamtagatcttgaagtatcttgtaggt

SEQ ID NO: 32471 - DNA, 50 bp, homo sapien
gagaatactaggcaggaagttcttaygcaaccttgtacaatattccttat

SEQ ID NO: 32472 - DNA, 50 bp, homo sapien
ttatattttgtaagtgggagaaacargaacatatttaaatactgaaggaa

SEQ ID NO: 32473 - DNA, 50 bp, homo sapien
atctatcaggttaatatggtctacartgcagcttaagcctgatgtttctt

SEQ ID NO: 32474 - DNA, 50 bp, homo sapien
aactggccccttagctggcagcctcrataaacagtggttctcagccttgg

SEQ ID NO: 32475 - DNA, 50 bp, homo sapien
agagatatagaacaggagtcaggtawatggatttctaaaatattaccttt

SEQ ID NO: 32476 - DNA, 50 bp, homo sapien
acaatgtaatgtgtcttcaagtagakagtgaacttctggaggtctggaat

SEQ ID NO: 32477 - DNA, 50 bp, homo sapien
aaatttaataaaagactgtccatgawatatccccattctcagaaggaaca

SEQ ID NO: 32478 - DNA, 50 bp, homo sapien
ttacaagataactggagaagtaaggyattcatcaataaaatactagagat

SEQ ID NO: 32479 - DNA, 50 bp, homo sapien
tcttttccctcagctcttggcttackaccctggtctgtctcctgtttatc

SEQ ID NO: 32480 - DNA, 50 bp, homo sapien
ttgaacactatcaggaaaactctagyaattgagatggcatttaaactaac

SEQ ID NO: 32481 - DNA, 50 bp, homo sapien
tggcctttgaaagtagtttctcttaycttgtgtaacttagctagtcaggc

SEQ ID NO: 32482 - DNA, 50 bp, homo sapien
tttttgagacataaagggtctgtaaygcagaagagggttggtatcatgat

SEQ ID NO: 32483 - DNA, 50 bp, homo sapien
ttaaaaaaaaggtttgatgatgccasactaatactaattcccatttttta

SEQ ID NO: 32484 - DNA, 50 bp, homo sapien
ctgtgaattacttaccagcctactargagatgatcattagcttagagatt

SEQ ID NO: 32485 - DNA, 50 bp, homo sapien
tatgagtacccagaagaaggatacawtggttctacctgaaaaaaaacagt

SEQ ID NO: 32486 - DNA, 50 bp, homo sapien
actcaatggtcaacatcattatcaayagttccagaaaggcaaacgtggtt

SEQ ID NO: 32487 - DNA, 50 bp, homo sapien
aacatgtctgtttcaaatgctaacayattgagcgaatttgatagtccccc

SEQ ID NO: 32488 - DNA, 50 bp, homo sapien
atgcatcttgggaataaattcagcawctatgttggaacatgcaggtgtag

SEQ ID NO: 32489 - DNA, 50 bp, homo sapien
acaagccaggtgtaaattatggtagrattgaaatcgatagtgctttgaag

SEQ ID NO: 32490 - DNA, 50 bp, homo sapien
taaccacactgctctactgcctaaaytcaggtaaccaacaaaagagttgc

SEQ ID NO: 32491 - DNA, 50 bp, homo sapien
gaaagaaagcattggcaaaggcatamaaacatggttctagtgtggtgttc

SEQ ID NO: 32492 - DNA, 50 bp, homo sapien
caagatatgattcccaattgaacaaygagctgaaattcaggaagctttca

SEQ ID NO: 32493 - DNA, 50 bp, homo sapien
agcccttgaattataatgatgggtcrctgagagacaaacttacattgaac

SEQ ID NO: 32494 - DNA, 50 bp, homo sapien
cttccctcagtcagattttatcctaycacatcttttcagtgcagagttgt

SEQ ID NO: 32495 - DNA, 50 bp, homo sapien
cttagcaaaatgccttcaagattcayccatatggtagcaagtgacaggat

SEQ ID NO: 32496 - DNA, 50 bp, homo sapien
attcatatcttgtgcagtttacctawtaagatgattttctttttcttagt

SEQ ID NO: 32497 - DNA, 50 bp, homo sapien
attggttcttaaatatctaattccaygatcctcaaacttttcccactgta

SEQ ID NO: 32498 - DNA, 50 bp, homo sapien
caaggatatttcaaccttaaggacaygataataaagccaatggaactggg

SEQ ID NO: 32499 - DNA, 50 bp, homo sapien
ttttatgataaaagtaacatgtgacmaacttaataacagcttcgttaata

SEQ ID NO: 32500 - DNA, 50 bp, homo sapien
caaaagaattctcttcctgaagtaaytgtttcatatgagaattttgctga

SEQ ID NO: 32501 - DNA, 50 bp, homo sapien
gttcaatcacaatctatttgtaaaayctatttagaatcagagtcacatag

SEQ ID NO: 32502 - DNA, 50 bp, homo sapien
gtgatactagcaagaagcctatgaaragggagtaataaatgaaagtcagg

SEQ ID NO: 32503 - DNA, 50 bp, homo sapien
aaagatactgttttagagccattatyagttctttcaaatttttctttcag

SEQ ID NO: 32504 - DNA, 50 bp, homo sapien
ttccagaaatctaatgactgggtaaygaatcattctgcaaattagattgt

SEQ ID NO: 32505 - DNA, 50 bp, homo sapien
ttgagaatctactatataccaggcaycacgctaagttcttggtaataggt

SEQ ID NO: 32506 - DNA, 50 bp, homo sapien
aaaagcacatgttttaaaactgaaaygtaagcaataccagcacaaaggaa

SEQ ID NO: 32507 - DNA, 32 bp, homo sapien
ccccatgtctaaggagkcctactgtactacta

SEQ ID NO: 32508 - DNA, 50 bp, homo sapien
acatataagtattcctgagttactaytagggtcatagaagaaaacatatt

SEQ ID NO: 32509 - DNA, 50 bp, homo sapien
ttgaaatgaacaaaatgttgatggcrctagcagtggagcccagctatagc

SEQ ID NO: 32510 - DNA, 50 bp, homo sapien
attaaccaaaatgttaggatgaagaygcagatcaactcaaactcgaggta

SEQ ID NO: 32511 - DNA, 50 bp, homo sapien
aaaaataaaattggatgaaattctaygaaccctttagaaagttaaaatac

SEQ ID NO: 32512 - DNA, 50 bp, homo sapien
ttcctccagcaaatcttgggagacartgacctggccacacttaaccactt

SEQ ID NO: 32513 - DNA, 50 bp, homo sapien
actggttaacccaccttagagctaaygtagattttccctgtaggtctttg

SEQ ID NO: 32514 - DNA, 50 bp, homo sapien
tctggtgagatcaaatatatcagcamcttgtgactatgtagaaagttgga

SEQ ID NO: 32515 - DNA, 50 bp, homo sapien
gagtcaaagctgcagtgccctccgcragaatgtgcctgttggtgttgtca

SEQ ID NO: 32516 - DNA, 50 bp, homo sapien
gaaaataacacaaatcatgtttttayaatgatggtatttgatacatcagg

SEQ ID NO: 32517 - DNA, 50 bp, homo sapien
gtgaactgaaaaatttgccctccaastagttcctgagatgtttgtaaaga

SEQ ID NO: 32518 - DNA, 50 bp, homo sapien
caagaaaaagtagtgaataaaatctyactcaagtagtgacattcaaacca

SEQ ID NO: 32519 - DNA, 50 bp, homo sapien
ctcccaatgaccacttatccattgaycagacctgtgtagtgaatataaaa

SEQ ID NO: 32520 - DNA, 50 bp, homo sapien
cgcatgctgttttacctgtgcttaargaggaaagtgtcacgcgtctctga

SEQ ID NO: 32521 - DNA, 50 bp, homo sapien
gcattaccaaacttgagttccaggaktaatcataataaatgatggtagct

SEQ ID NO: 32522 - DNA, 50 bp, homo sapien
ctacaccagcttcctcttcctgagaygactaggtatttactgtgatttga

SEQ ID NO: 32523 - DNA, 50 bp, homo sapien
tatcacacagatttttctgacatacratcttggtgtaattgaagacatac

SEQ ID NO: 32524 - DNA, 50 bp, homo sapien
cttttctgtcttttccatgtcagtarcctgtattgcttttcagctgagac

SEQ ID NO: 32525 - DNA, 50 bp, homo sapien
ttagcttctaaatgtggtgttaataraaacatatatgcccattctatata

SEQ ID NO: 32526 - DNA, 50 bp, homo sapien
gagacatggaagctcaggcatttagyatgtaggagcaaggatgctggata

SEQ ID NO: 32527 - DNA, 50 bp, homo sapien
gattcaaatttctaattgaatttacrgactttcatatcgtcgtcataaat

SEQ ID NO: 32528 - DNA, 50 bp, homo sapien
cttaaagaaatggagacatacactayatttatggatttaaagagtcaatg

SEQ ID NO: 32529 - DNA, 50 bp, homo sapien
cacaacactattaaaaaaatacatamatcttcatattaaatccaaatcca

SEQ ID NO: 32530 - DNA, 50 bp, homo sapien
agaataaatacatgaacataagtaasatttgttttgaagtcagtagtcta

SEQ ID NO: 32531 - DNA, 50 bp, homo sapien
atatgtaatgagtgtgtacactaaamcaaacattgagggagtggtgggta

SEQ ID NO: 32532 - DNA, 50 bp, homo sapien
gcctgtggatctttgctctgtaacawctctcaacccattcatcctttgca

SEQ ID NO: 32533 - DNA, 50 bp, homo sapien
ccgtggctaccctgcaacctataacrctgtactgggttttctggcctaca

SEQ ID NO: 32534 - DNA, 50 bp, homo sapien
aacaaaattcaagcaaatatggcaamtgctaatgtttttaaaatatgggt

SEQ ID NO: 32535 - DNA, 50 bp, homo sapien
ttcaataagttattcaaaacaaaacyctagatctgtacttctctatttct

SEQ ID NO: 32536 - DNA, 50 bp, homo sapien
gaaaataatggatatggtaacactaygcaggtaagacatggttttaccag

SEQ ID NO: 32537 - DNA, 50 bp, homo sapien
caaatctcctgattgtagtaaaaacrggaactatctatcttgttcaccag

SEQ ID NO: 32538 - DNA, 50 bp, homo sapien
gggagagaactgtcactaaactcagsaaggaagactttctcaccttgggt

SEQ ID NO: 32539 - DNA, 50 bp, homo sapien
attacttgccacataactattcccargatagtccccaaagcgaatatgtc

SEQ ID NO: 32540 - DNA, 50 bp, homo sapien
agcagagggagagttaaagggtttayagctatggcagcatgaggattttt

SEQ ID NO: 32541 - DNA, 50 bp, homo sapien
ctgtggcagtttgctgcaaattttayggatctgaaagtgtgttctaacct

SEQ ID NO: 32542 - DNA, 50 bp, homo sapien
tcaagcaaactttcgcaagctgacaratatgaccacatggaatagtcatg

SEQ ID NO: 32543 - DNA, 50 bp, homo sapien
aatttttctctatataatataaatasagactatgcacaacttttggttat

SEQ ID NO: 32544 - DNA, 50 bp, homo sapien
ggtttttagtccacaaatacagagargtaaaatgtagaaaatgagtgagt

SEQ ID NO: 32545 - DNA, 50 bp, homo sapien
gaacttcttgtgcttcttactgaaaytgggtgacaaagaaaggaaatgaa

SEQ ID NO: 32546 - DNA, 50 bp, homo sapien
cttgtcccaagtccggttttctagaygagaccctgcaaggggtgaagtga

SEQ ID NO: 32547 - DNA, 50 bp, homo sapien
ttatctgaactctgctcgtcaacctraaactcagggaccaaactgattct

SEQ ID NO: 32548 - DNA, 50 bp, homo sapien
actgagtatttttaagtgaataaatsaacgagaatgctgatgtgaagcct

SEQ ID NO: 32549 - DNA, 50 bp, homo sapien
gtgtcagttttatgtaaaatacagtyaagcctgcaatctatttttaaaaa

SEQ ID NO: 32550 - DNA, 50 bp, homo sapien
gtaacttatacctatgtctgctatayccaaaagttttctagaggagttta

SEQ ID NO: 32551 - DNA, 50 bp, homo sapien
ctagaattttatttttggtttacacygctatcttagatttcttcccaaat

SEQ ID NO: 32552 - DNA, 50 bp, homo sapien
agactaaattcattaggtttgtccayggtgaatgatgagctctaacagtc

SEQ ID NO: 32553 - DNA, 50 bp, homo sapien
ttgtatttttctgataatgtgcctcraaatctaacaatctgtttattctt

SEQ ID NO: 32554 - DNA, 50 bp, homo sapien
ataaaaagagaggatgtctattaaaycttaatttcaggtgaattaacaaa

SEQ ID NO: 32555 - DNA, 50 bp, homo sapien
ttggaacatggtaaatgaaaacgcaratgaaagttgttcaaaaaggattc

SEQ ID NO: 32556 - DNA, 50 bp, homo sapien
tgtattttcaaatacgaagtcagaargagtatccatcctttagatttact

SEQ ID NO: 32557 - DNA, 50 bp, homo sapien
gagtttgggatgaagtggctgattasaggtagaattcagaaagatttcca

SEQ ID NO: 32558 - DNA, 50 bp, homo sapien
gctcaattaatgtttgccaaataacraaaacacttagggaatgtaccata

SEQ ID NO: 32559 - DNA, 50 bp, homo sapien
ctgatcttctttgatgtcttttaagyccgaagtgaacacatactcctctg

SEQ ID NO: 32560 - DNA, 50 bp, homo sapien
ttcttgttccatcctaagtgcccggracatttctgatgctcaattaatgt

SEQ ID NO: 32561 - DNA, 50 bp, homo sapien
taaatgctttgggaatggtaccgaaracaggtgctataagaacccagagg

SEQ ID NO: 32562 - DNA, 50 bp, homo sapien
ccctcaggttagaaaaaaatgtcaasgagtaggaggttgaagccctctat

SEQ ID NO: 32563 - DNA, 50 bp, homo sapien
gatttgctaggtactatttcttagaracataattttagaaggaataatgt

SEQ ID NO: 32564 - DNA, 50 bp, homo sapien
gaaatagtacctagcaaatctgtaaygaattagggtaaaggtaaaaagaa

SEQ ID NO: 32565 - DNA, 50 bp, homo sapien
gactacagtagggctacagggtacamagtatcaagatcaccagtcagggc

SEQ ID NO: 32566 - DNA, 50 bp, homo sapien
agggtaattatagttgtatcaaatarctgaaaaaccttaggggattaaag

SEQ ID NO: 32567 - DNA, 50 bp, homo sapien
ggaacttcatgttcacagagggagarccttaattaaaccaatattcaatc

SEQ ID NO: 32568 - DNA, 50 bp, homo sapien
catcaggaaaaactagctacttagasgtgaaagcaatgtctttggaacat

SEQ ID NO: 32569 - DNA, 50 bp, homo sapien
atataacctcactctcctctaggcartatccctcgaccaaatacatgtct

SEQ ID NO: 32570 - DNA, 50 bp, homo sapien
aatatgagcataataatttcgtcaartgaaaccacaatcttctacccctc

SEQ ID NO: 32571 - DNA, 50 bp, homo sapien
atctgctctttagacctgtctagagyatttgcattcagtctcttttgtct

SEQ ID NO: 32572 - DNA, 50 bp, homo sapien
gcaatatttcttatgtatattacackgcaactttgatatttgcttaataa

SEQ ID NO: 32573 - DNA, 50 bp, homo sapien
tttgagttgggatctgaataactggsaagaaattattgcaaacagaggaa

SEQ ID NO: 32574 - DNA, 50 bp, homo sapien
cctaagccaaagtggctttctgatcyctgtcttgtttctgcataaaaaga

SEQ ID NO: 32575 - DNA, 50 bp, homo sapien
tttacttaagtgtctgaaggctagcraaaacttgcagatgattcatttta

SEQ ID NO: 32576 - DNA, 50 bp, homo sapien
aggataagggacaaatctttcatacmcaataattccaagtaatatacctc

SEQ ID NO: 32577 - DNA, 32 bp, homo sapien
tttgattttgttgatayatccagatttgacca

SEQ ID NO: 32578 - DNA, 50 bp, homo sapien
atctgtttaccagagagtactattarcaaatttgcatttttataatgaaa

SEQ ID NO: 32579 - DNA, 50 bp, homo sapien
gtggtttttgggaaagccactcaagwcataggccatagtttattcttgcc

SEQ ID NO: 32580 - DNA, 50 bp, homo sapien
caaggcctcctgctcataacttaccmaattatcttctgaaaaactgagca

SEQ ID NO: 32581 - DNA, 50 bp, homo sapien
gctgtttgctgaccttatcataaaayaaactgctatccctaccaattccc

SEQ ID NO: 32582 - DNA, 50 bp, homo sapien
ttcaaacaaattagataatttgatarccttagccactatgtaagaaacta

SEQ ID NO: 32583 - DNA, 50 bp, homo sapien
cggatatatcattgtgacttactaaygttaggattttcttcccccagcaa

SEQ ID NO: 32584 - DNA, 50 bp, homo sapien
tatttgacaggcaatgagtctatcartgagaacagtggcagttgaaggtt

SEQ ID NO: 32585 - DNA, 50 bp, homo sapien
tggtaacttgtattgaaaaagtgagsccatactgttcaaacttgtgttgc

SEQ ID NO: 32586 - DNA, 50 bp, homo sapien
ccgtgaatttccctcccttgtcaacwctagcacttacagattatacaatg

SEQ ID NO: 32587 - DNA, 50 bp, homo sapien
gttatgtttaagatggtgaactgatyaagcaataagtaaatgtatgagcc

SEQ ID NO: 32588 - DNA, 50 bp, homo sapien
taaaagtgcaggatttgagcatttakgtaaagtgcagagcttactctgtt

SEQ ID NO: 32589 - DNA, 50 bp, homo sapien
caaagaagatatatcaccaaataaamttggctacagcattatgccattca

SEQ ID NO: 32590 - DNA, 50 bp, homo sapien
aacaagatcgctcaggtgatgtgtaygcaagtcattaaaattagagaagc

SEQ ID NO: 32591 - DNA, 50 bp, homo sapien
caacaacacttaaaaagctgagaaamctgaaaaatcaacaaccttcttaa

SEQ ID NO: 32592 - DNA, 50 bp, homo sapien
gaacagaggaaatagaatccattagyagcctggttatccatatccacatg

SEQ ID NO: 32593 - DNA, 50 bp, homo sapien
aggtaacatatggagtggtcgactaratcatttttagtgttcactcgaag

SEQ ID NO: 32594 - DNA, 50 bp, homo sapien
aaacacctgggcactattacagtgasgattacacctataaacattattca

SEQ ID NO: 32595 - DNA, 50 bp, homo sapien
ctgaggtatccttacacataagatcmcaatatatgaaaggagcacaagaa

SEQ ID NO: 32596 - DNA, 50 bp, homo sapien
tcttaagcttggcctatcctgctagyaatacgtccaatagtattatgaag

SEQ ID NO: 32597 - DNA, 50 bp, homo sapien
ttttgtttcttgttattttgtacagmactataggaaattctcttgtttat

SEQ ID NO: 32598 - DNA, 50 bp, homo sapien
atcggcaaaatcctttttgccatatwacagaacatattcacagctttctg

SEQ ID NO: 32599 - DNA, 50 bp, homo sapien
agacagcaagagtgtttattaggagmatattaggtaactcatgtaaagca

SEQ ID NO: 32600 - DNA, 50 bp, homo sapien
tcattgtcgttagatgaaaattctawggaaaaacccaggatacagacata

SEQ ID NO: 32601 - DNA, 50 bp, homo sapien
aggaagttagtgtaagttctaaatamaatttcatcattcaggatttatgt

SEQ ID NO: 32602 - DNA, 50 bp, homo sapien
aacagctgaaggagtactattattawccttattttgtagataaagaattt

SEQ ID NO: 32603 - DNA, 50 bp, homo sapien
gttatttttatatggaaaatgctaakacagattctcatcttgggactacc

SEQ ID NO: 32604 - DNA, 50 bp, homo sapien
tctcaaaaacaaattaataattggcyactctttgagacatgagagttttc

SEQ ID NO: 32605 - DNA, 50 bp, homo sapien
tttctaaaccagctctgcaatatgaratgggtccgtccttttttcacctg

SEQ ID NO: 32606 - DNA, 50 bp, homo sapien
tttaaatgagccattatgtaggatgsaagtagattaatgactatttctca

SEQ ID NO: 32607 - DNA, 50 bp, homo sapien
ggaaaggctaaataacaatacaatamtaatgaagtgagaaaatgagtaca

SEQ ID NO: 32608 - DNA, 50 bp, homo sapien
gtcataaaatgtatgagattatctaygattggatatacatagagactatg

SEQ ID NO: 32609 - DNA, 50 bp, homo sapien
tttttaaaaaatgatttcgaaaaagracatgtatttgcaattcttaaatt

SEQ ID NO: 32610 - DNA, 50 bp, homo sapien
aactccggaagcttggataaagtgaygatccatacaaatgaagtagaaat

SEQ ID NO: 32611 - DNA, 50 bp, homo sapien
ctgcttgcttgctttgtttccaaaarcatgacacaaatgcaatgtattgt

SEQ ID NO: 32612 - DNA, 50 bp, homo sapien
ctggcattttccaaactaaagaatarcctcattccctaaaaatttatgtg

SEQ ID NO: 32613 - DNA, 50 bp, homo sapien
aactaataaatgatctataaattagwatcactcacaatctgaaaaagaat

SEQ ID NO: 32614 - DNA, 50 bp, homo sapien
agaaccccgttttctttgtagaggawcatcctgtggaactgatcttggaa

SEQ ID NO: 32615 - DNA, 50 bp, homo sapien
cagcaaggcacacaatcatcaggctraacaatgtgactacaacaattact

SEQ ID NO: 32616 - DNA, 50 bp, homo sapien
actgggaaagccacaaaaccaagacyagcagtgttacctgccacacctgt

SEQ ID NO: 32617 - DNA, 50 bp, homo sapien
actctggcctgtcggctacttttgcwcgtaccagcaggtgtgcactgccg

SEQ ID NO: 32618 - DNA, 50 bp, homo sapien
actggatttttagcagtttatttccracttttttgcatatggcttcagga

SEQ ID NO: 32619 - DNA, 50 bp, homo sapien
gtttgaaatcaactttggcttttaaycttagactccactgtcaagtttct

SEQ ID NO: 32620 - DNA, 50 bp, homo sapien
taataagccccctttacttgagccaygttaagtagatttctcttccctgc

SEQ ID NO: 32621 - DNA, 50 bp, homo sapien
ccatcttctctttctcgacttaagamaatcagcttcctggacccccttta

SEQ ID NO: 32622 - DNA, 50 bp, homo sapien
ccagagccactcccctttgcactagwagttcttgctttcaaagaatgagg

SEQ ID NO: 32623 - DNA, 50 bp, homo sapien
ggcaccaaatgccttgttctttccaygacaccatgctgccttcttgatga

SEQ ID NO: 32624 - DNA, 50 bp, homo sapien
aggaaactttgggagcatgcagtaasacagacagcctgaaaaacaaaata

SEQ ID NO: 32625 - DNA, 50 bp, homo sapien
tttaaagcttcacatatatcaaagarcttctacatatacaggtatatctc

SEQ ID NO: 32626 - DNA, 50 bp, homo sapien
aattggctttctcatttacccagaasgatcatagaatcaaagaaatgatc

SEQ ID NO: 32627 - DNA, 50 bp, homo sapien
agaataggcaaattcatagaaacagraagtaaattagaggttgccaaggg

SEQ ID NO: 32628 - DNA, 50 bp, homo sapien
aacaacaggtagaatgcataacaaaktgggtacacctgaccctaaggcag

SEQ ID NO: 32629 - DNA, 50 bp, homo sapien
gttttctccaatgggtttacttagcygacacaggaacatagtccattaca

SEQ ID NO: 32630 - DNA, 50 bp, homo sapien
tttgttttgtcttgaaatcctgaacracaataactgagatgcacacacaa

SEQ ID NO: 32631 - DNA, 50 bp, homo sapien
cattctttggcattgttcatgatgcygaatcgtgtcatttgaactgggca

SEQ ID NO: 32632 - DNA, 50 bp, homo sapien
aggtgaagcttcaaaagtgtcacaasaaaagtctagtgtggtggcgcata

SEQ ID NO: 32633 - DNA, 50 bp, homo sapien
taggtttctgtacaggatcttttaawatccagatttagactgtgtactat

SEQ ID NO: 32634 - DNA, 50 bp, homo sapien
ttgaaaggtagcattggtgtggctamtaatacagcttaagaactacgtgc

SEQ ID NO: 32635 - DNA, 50 bp, homo sapien
agagaaaaaactactaaaatactgarctgaaaatcagatataacaatcac

SEQ ID NO: 32636 - DNA, 50 bp, homo sapien
caggggagggtgtctttaccttgcastgatgacagcaggttaacagaggc

SEQ ID NO: 32637 - DNA, 50 bp, homo sapien
taaattatagatggtacatttgtcckcgtgagttatcagttatattcacg

SEQ ID NO: 32638 - DNA, 50 bp, homo sapien
gaggcatggagtcctctgctgcttgsacactgagcacggcagtttcctct

SEQ ID NO: 32639 - DNA, 50 bp, homo sapien
gggctagagaacttcaggaacctgcractggaaatggacatgactcacat

SEQ ID NO: 32640 - DNA, 50 bp, homo sapien
ccatacatttcagacttatatactaractcaagatgcacttttttcttca

SEQ ID NO: 32641 - DNA, 50 bp, homo sapien
gcttccaagaacagcagctcatccaytcaagcataagtaagaagtgccac

SEQ ID NO: 32642 - DNA, 50 bp, homo sapien
tactggaatggagaacttttgaactyaatgtgatttggaagagaaaaatt

SEQ ID NO: 32643 - DNA, 50 bp, homo sapien
taaactcagctagtacaatcgagtayacaaaagcaatgcaaatttctcag

SEQ ID NO: 32644 - DNA, 50 bp, homo sapien
tatctttctcaggcacgtgtcctcargttaggagacaggttttggccaag

SEQ ID NO: 32645 - DNA, 50 bp, homo sapien
aagtactacacaggagcaattcatcmagcatcgaggctacaaccatgtta

SEQ ID NO: 32646 - DNA, 50 bp, homo sapien
ttttttctggacctcagtttcctcartgagctggtaagaatgcactaacc

SEQ ID NO: 32647 - DNA, 50 bp, homo sapien
ttaagcttcactcccttccaggcaamgctgttaagtcccatgctgtcatc

SEQ ID NO: 32648 - DNA, 50 bp, homo sapien
ctctatagcaagtgatctctttaccmacagtagaatttgtgtcaaaattg

SEQ ID NO: 32649 - DNA, 50 bp, homo sapien
cccaaagcttattctttcgaaaagaytcacaaaattggcaatgggccaat

SEQ ID NO: 32650 - DNA, 50 bp, homo sapien
accccaaatgctatgcttttcttcamtatatcatatgtcccagcagaggg

SEQ ID NO: 32651 - DNA, 50 bp, homo sapien
tttgattatttatgttttcctagaamgttggctatttcattaagcattaa

SEQ ID NO: 32652 - DNA, 50 bp, homo sapien
ggcaagttgaaatactgtagacctarcaatccagagataaatgaaggcca

SEQ ID NO: 32653 - DNA, 50 bp, homo sapien
gtttaatgtttatttctgcatttgargtatgtttattttgttcattagtt

SEQ ID NO: 32654 - DNA, 50 bp, homo sapien
gccattcatgtattaagaatctatakgtaccagcctgtgcactagatgct

SEQ ID NO: 32655 - DNA, 50 bp, homo sapien
tcataaataaatccttttgcctaaaygaaagaatatacagtactcataaa

SEQ ID NO: 32656 - DNA, 50 bp, homo sapien
atagaaagagacggtccttggactaygcagcacctagactacatgggaaa

SEQ ID NO: 32657 - DNA, 50 bp, homo sapien
ttgggcagggtacagatcttccctamggctgtgaatgacaaggatttgtc

SEQ ID NO: 32658 - DNA, 50 bp, homo sapien
gatttgacccttatttactgttgccrggaagattaaactaaagtctttgg

SEQ ID NO: 32659 - DNA, 50 bp, homo sapien
tttataagtgctgtggctgtcgatayatagttgcatttatgtagactgac

SEQ ID NO: 32660 - DNA, 50 bp, homo sapien
agggaataaagcactggcagcgcaamtcattggtaattcactgtccaggc

SEQ ID NO: 32661 - DNA, 50 bp, homo sapien
acaaacacaacaagcaattgatagargcaaatttagaaagttacactgcc

SEQ ID NO: 32662 - DNA, 50 bp, homo sapien
ctttcctttacacctatgtttttaartagtcaaacttcaagaaacaatct

SEQ ID NO: 32663 - DNA, 50 bp, homo sapien
gtagttattccaaatctgtcacttarctgttttatctagaaagatagtaa

SEQ ID NO: 32664 - DNA, 50 bp, homo sapien
aaaatggctgccattagctgctagakaacttattttactatctttctaga

SEQ ID NO: 32665 - DNA, 50 bp, homo sapien
gaatccaagccttcaagacttattawcagcacatgtcgtgtcagcagaac

SEQ ID NO: 32666 - DNA, 50 bp, homo sapien
aaagctagacctcttataccaaatarccaagttgtaaatacaaaggaaaa

SEQ ID NO: 32667 - DNA, 50 bp, homo sapien
aattgacagagaagtggttaacagcragacacaattaatgccctggaaca

SEQ ID NO: 32668 - DNA, 50 bp, homo sapien
cagaggaagtgtcataaaataaccaygaaacaacaacgtcagacccactc

SEQ ID NO: 32669 - DNA, 50 bp, homo sapien
agtcatatcataaaagttcactgaaycctgataccaatttggcagacagt

SEQ ID NO: 32670 - DNA, 50 bp, homo sapien
caaactattttactaagtctgaaackagaggtaaactgagagggtggagg

SEQ ID NO: 32671 - DNA, 50 bp, homo sapien
ccagctcctgtgccttcaaggtccayggcagcttttcacagaggctgagg

SEQ ID NO: 32672 - DNA, 50 bp, homo sapien
cagacatcaccatggaggagtctcaycatgctaggtggaaaagcaatata

SEQ ID NO: 32673 - DNA, 50 bp, homo sapien
tttaggagcacagaagttttactagrcattttccctggttatggagaaat

SEQ ID NO: 32674 - DNA, 50 bp, homo sapien
caacagcaaattgggagaatttaaamgttcctaagtacgtgaattgtata

SEQ ID NO: 32675 - DNA, 50 bp, homo sapien
aagtgcttctggctccgggaaataaycattcttgtgtttgctggaggtcg

SEQ ID NO: 32676 - DNA, 50 bp, homo sapien
taatatttttgccaaattcaccctawccttagtagactacgtgagtgata

SEQ ID NO: 32677 - DNA, 50 bp, homo sapien
gacttcattgctccagattacaggayggaatatacttaaagtcctcttac

SEQ ID NO: 32678 - DNA, 50 bp, homo sapien
ataagttttcacagggctgtaaagaygtttcttcccagtggtccttcact

SEQ ID NO: 32679 - DNA, 50 bp, homo sapien
ccaaggcaaaaggtcatggctgtaaktgtctttcttcctgatcccctcta

SEQ ID NO: 32680 - DNA, 50 bp, homo sapien
tgattttaaagcagtaacacgaggayataggttatatacaggctcctgga

SEQ ID NO: 32681 - DNA, 50 bp, homo sapien
gtaccactggaaggataatgaaggcsatataacaacattatcaaaagctg

SEQ ID NO: 32682 - DNA, 50 bp, homo sapien
cagaaacgctgtgcccagttctggasagagagaattgcacagccccagtg

SEQ ID NO: 32683 - DNA, 50 bp, homo sapien
gaggtaatggattatgggatcattayctaggtcctagattggacaagaca

SEQ ID NO: 32684 - DNA, 50 bp, homo sapien
tatttaggcatttgtggatattagaracttggcttttctcttagttgttc

SEQ ID NO: 32685 - DNA, 50 bp, homo sapien
ctccacaatttcccagtgtagaaaayctctggtcaaggggaaggataggt

SEQ ID NO: 32686 - DNA, 50 bp, homo sapien
gaaatctcaacctatagaaagagaargttattgctaatatttctaagcta

SEQ ID NO: 32687 - DNA, 50 bp, homo sapien
gggctgggagcctcctgaagactaaracaacttgaggctaaatctacctt

SEQ ID NO: 32688 - DNA, 50 bp, homo sapien
ttccttttctattcatatagcccacrcgtttctgagtgagatgaacccaa

SEQ ID NO: 32689 - DNA, 50 bp, homo sapien
acctctgctctcagcactgtctttaraagtaattttcaccagatatacag

SEQ ID NO: 32690 - DNA, 50 bp, homo sapien
aaaatgtcagtggtcagatctgattsaagagtagcccagggatagtgagc

SEQ ID NO: 32691 - DNA, 50 bp, homo sapien
cacatatgctggttaagttactacamcctaaggatgaaaaaagttaattt

SEQ ID NO: 32692 - DNA, 50 bp, homo sapien
ccaaaaggtgaattcaaacaaaagartagacagatgtgaacattgaatct

SEQ ID NO: 32693 - DNA, 50 bp, homo sapien
caaggaggtaagataaagtatatggrcatagatgcagaaaggtggagact

SEQ ID NO: 32694 - DNA, 50 bp, homo sapien
gactggcagccttctttcacggaagscttcacggtctcaaatatcttctc

SEQ ID NO: 32695 - DNA, 50 bp, homo sapien
acaccaaaccatgctatctactccarcttctatgtacaaaaggtgacttc

SEQ ID NO: 32696 - DNA, 50 bp, homo sapien
tgctaaaaaaggatatgccataacargtgttctacaatgattttttcatt

SEQ ID NO: 32697 - DNA, 50 bp, homo sapien
ggccactttctcatctttaaaagagrcaaccaaatattaaaataaaacaa

SEQ ID NO: 32698 - DNA, 50 bp, homo sapien
aaaatcttagaaccatggtaaaatartagaattgggaaaattagtgaaca

SEQ ID NO: 32699 - DNA, 50 bp, homo sapien
gaaatggaagagaaatcagcactgawtatccagaaacattggagagggta

SEQ ID NO: 32700 - DNA, 50 bp, homo sapien
tctatatgaattattatccaaagacygtaacaggaattcctgcacctctt

SEQ ID NO: 32701 - DNA, 50 bp, homo sapien
aaggggcatatttgtgagggatgagrccactttcctctgctgaggcagtc

SEQ ID NO: 32702 - DNA, 50 bp, homo sapien
ctgaatgtaacagagatgactatgamccttgcagacagccagccttgcag

SEQ ID NO: 32703 - DNA, 50 bp, homo sapien
atgaaaaaaatggctaaactgatccraactgaatggcaactgatatccct

SEQ ID NO: 32704 - DNA, 50 bp, homo sapien
agaagatatattcattgctacaactyacatttctatctttttgaataaaa

SEQ ID NO: 32705 - DNA, 50 bp, homo sapien
cagaatgcacgcaactattttgtgayggaaaggaggaaaaattagaatct

SEQ ID NO: 32706 - DNA, 50 bp, homo sapien
tttctctcctctaaattgtctagccraagtcaccttttgtacatagaagt

SEQ ID NO: 32707 - DNA, 50 bp, homo sapien
cacggcttcacagaaaatagcatgayaactacccttttaaaagtgtttcc

SEQ ID NO: 32708 - DNA, 50 bp, homo sapien
tattttgcttatatttttcttaagasagtgtgtttttcatgttgtgtttg

SEQ ID NO: 32709 - DNA, 50 bp, homo sapien
tgcactttaatttctcctctcctcasattttatgttattaatatcacaat

SEQ ID NO: 32710 - DNA, 50 bp, homo sapien
gtatttgcatacctatctttttctaygcttctcaatgtaaatttgtcttt

SEQ ID NO: 32711 - DNA, 50 bp, homo sapien
taaattataatagctggcacttacaygatgctttcaataagatagagagt

SEQ ID NO: 32712 - DNA, 50 bp, homo sapien
ttaagtgcttcattacatcagtaaakgagtgcaaggaagtaattaagagg

SEQ ID NO: 32713 - DNA, 50 bp, homo sapien
ttttttttgtcactgttgatgctacrctttattgggaattttcaaattta

SEQ ID NO: 32714 - DNA, 50 bp, homo sapien
aagtaacatatctagtaactgatgayataaggattagaaccacttttgag

SEQ ID NO: 32715 - DNA, 50 bp, homo sapien
gcagacttaaatgaaaactgatctcraagaaaataaggatttgattggcc

SEQ ID NO: 32716 - DNA, 50 bp, homo sapien
aggctagagactgttcacacaaacargaagaaacgttgaggacatcaagg

SEQ ID NO: 32717 - DNA, 50 bp, homo sapien
aatgtcatcattatgaacatgtactyagcagatgacagtctttgaataga

SEQ ID NO: 32718 - DNA, 50 bp, homo sapien
ataaaagaaaggaaaaaaaccctaaygacttgctacttagaagaaaccca

SEQ ID NO: 32719 - DNA, 50 bp, homo sapien
agcaaatagttacttatgtagtatamgaactgtacgcacagaatgaacct

SEQ ID NO: 32720 - DNA, 50 bp, homo sapien
acctgttctccaccaagcactgtaamccaatacataaattatctcacttt

SEQ ID NO: 32721 - DNA, 50 bp, homo sapien
cttgctcaatatcaatagttccgtgmaaaatatctctctttgaagtcatt

SEQ ID NO: 32722 - DNA, 50 bp, homo sapien
atgaagcagtctcaaatatatgaaaraggtctgattttcagtaacatcag

SEQ ID NO: 32723 - DNA, 50 bp, homo sapien
agcttccatagctgacagaaattcayggaacactgataatggttaagccc

SEQ ID NO: 32724 - DNA, 50 bp, homo sapien
aatggcatttatgcagcttcccacaygctaggttttgtgctaggcacagt

SEQ ID NO: 32725 - DNA, 50 bp, homo sapien
tttccttatttaatttaaattgtcawcatttatcatattcactaccttgc

SEQ ID NO: 32726 - DNA, 50 bp, homo sapien
ctgtaaaatgtctctgctactaaaasacaaaactgattcccaggaagcac

SEQ ID NO: 32727 - DNA, 50 bp, homo sapien
tggttttaattttctctttaatgcarcagttatttaggaggtatgtttaa

SEQ ID NO: 32728 - DNA, 50 bp, homo sapien
ttctccatctaatttgcatggcatakactttatagtacaaaatgtccatt

SEQ ID NO: 32729 - DNA, 50 bp, homo sapien
tatgacactataaattgttcattcaygctaaactctagtgaatgttgtca

SEQ ID NO: 32730 - DNA, 50 bp, homo sapien
ggcatagtcaagatctgatcctgaartaatatctctgctatcctagatgt

SEQ ID NO: 32731 - DNA, 50 bp, homo sapien
ataaactcgctttcatgttactctayggactccctctaaattccttcttg

SEQ ID NO: 32732 - DNA, 50 bp, homo sapien
taaatgcattctgtagctcacctaartaggagtatacccagttaaggcag

SEQ ID NO: 32733 - DNA, 50 bp, homo sapien
ggtttaatgttgactctgtcgcctartagctggttcatttagcacccaat

SEQ ID NO: 32734 - DNA, 50 bp, homo sapien
tgggaaaaataatatttcatatatargattggcaaactcactttagagac

SEQ ID NO: 32735 - DNA, 50 bp, homo sapien
cttttttcctatttgacagtctttgmatcaggaagaatcctcctggaatc

SEQ ID NO: 32736 - DNA, 50 bp, homo sapien
tgatattgctgggtcatatgatagayggacaggcatacctcattttattg

SEQ ID NO: 32737 - DNA, 50 bp, homo sapien
ttggcttccatctttctttctgttcwctaattgataaccttcaccaaatg

SEQ ID NO: 32738 - DNA, 50 bp, homo sapien
aggttaccaaagtcccaggtccggcracacagacgttttttgtagtttgt

SEQ ID NO: 32739 - DNA, 50 bp, homo sapien
tgcaaattagttctagcacctgaaaygagggaatgatgaagattcaataa

SEQ ID NO: 32740 - DNA, 50 bp, homo sapien
gccacttctatctcccgtgaaggcaragttagagagatcaaggtgtacca

SEQ ID NO: 32741 - DNA, 50 bp, homo sapien
gtcttttaaatcacatttgaaaaaawccttaaatgatcatcaagtcgtaa

SEQ ID NO: 32742 - DNA, 50 bp, homo sapien
aaacaagtcttggaattggatttcaytcactctactggtctgacttctgt

SEQ ID NO: 32743 - DNA, 50 bp, homo sapien
aggctactcaatcataatttgtgaaytctaggagaaattaatgattctta

SEQ ID NO: 32744 - DNA, 50 bp, homo sapien
ccaactcagtgttttccaaacatcamtcaaaaatacaaatcacatgtata

SEQ ID NO: 32745 - DNA, 50 bp, homo sapien
gataatagaagtctccagagaagcartctaaagcaatccaaaacagaaca

SEQ ID NO: 32746 - DNA, 50 bp, homo sapien
cagtatgtgtctccaggtcaaatcaygagaaatctaaagggttaaaggct

SEQ ID NO: 32747 - DNA, 50 bp, homo sapien
tcaatcaacctttctgtgctccttayaaattcttgagttaaattggctgt

SEQ ID NO: 32748 - DNA, 50 bp, homo sapien
tcacctacaagagcttctacaactayggatgccaagactctatctttaga

SEQ ID NO: 32749 - DNA, 50 bp, homo sapien
agtgttttgagggtatatgatgttayattcaaatggattggccattttga

SEQ ID NO: 32750 - DNA, 50 bp, homo sapien
taaaatctgtggatgcttgaaaaaayacacctctgggtgtttgaaaaatt

SEQ ID NO: 32751 - DNA, 50 bp, homo sapien
aaaaaaataaatttgagatgatctcygaaagttctacttcattccaagga

SEQ ID NO: 32752 - DNA, 50 bp, homo sapien
aagtttcactcgagggactctgaaaytgttgattccattaacagatgggg

SEQ ID NO: 32753 - DNA, 50 bp, homo sapien
gttgctgtaaataccatgatttcaaygctttttatggctattatttcatg

SEQ ID NO: 32754 - DNA, 50 bp, homo sapien
accttcccctatttgcaaccttttarcattagcaagttcttgacttttca

SEQ ID NO: 32755 - DNA, 50 bp, homo sapien
atgtaaactataaatcaccacaaaartttgatagagaagtacataacagt

SEQ ID NO: 32756 - DNA, 50 bp, homo sapien
ttactccttaaacagagaaagtatasagtgagtgtgtatgtgctgtggtt

SEQ ID NO: 32757 - DNA, 50 bp, homo sapien
cagctctggtctataagaactcatartaattcaactagtgactactaaag

SEQ ID NO: 32758 - DNA, 50 bp, homo sapien
tggggaggagatatgtgggcggaaayctcaaaataggcacagagactgtg

SEQ ID NO: 32759 - DNA, 50 bp, homo sapien
ctaaaaggaactggagctctatgaasaaatgtctgattttaaggaacatt

SEQ ID NO: 32760 - DNA, 50 bp, homo sapien
cctcagggagggtgtcctcacgcagrcggtataccaggtgtgccagctgg

SEQ ID NO: 32761 - DNA, 50 bp, homo sapien
ctgtagggactaaaatggcattaackgctctatttataaacaaacgttgt

SEQ ID NO: 32762 - DNA, 50 bp, homo sapien
tatgcctacaaagttaagtatattasgtcaaggattcaattttgatattt

SEQ ID NO: 32763 - DNA, 50 bp, homo sapien
catgattctaagaatagacatcagaraatattaaaaagtaatgaatccat

SEQ ID NO: 32764 - DNA, 50 bp, homo sapien
tacagtatataatacatataatacasaaaatagttgttaatcgattatgt

SEQ ID NO: 32765 - DNA, 50 bp, homo sapien
gagtcagaaattgtattcattatagsattgtggttaaaggaaagctttca

SEQ ID NO: 32766 - DNA, 50 bp, homo sapien
aatctcttttcactcaaaaatgaacrgaagtataaagcctcaatgtgagt

SEQ ID NO: 32767 - DNA, 50 bp, homo sapien
agccagaaaataaggcaaggaattamagaaggctgtccaataacatttaa

SEQ ID NO: 32768 - DNA, 50 bp, homo sapien
tttacatatatacttccttttgaaaytcagtgattgtcctagagtttcca

SEQ ID NO: 32769 - DNA, 50 bp, homo sapien
cacagctcttctcttagatcagtaamtcaccttctctcatccattttatt

SEQ ID NO: 32770 - DNA, 50 bp, homo sapien
gatgctgtctccagaaagcacatgtwaaaggacctatatttgatcagatt

SEQ ID NO: 32771 - DNA, 50 bp, homo sapien
tgcatattgtgaacccagaaaatctraaacaggtctcaattaatttagaa

SEQ ID NO: 32772 - DNA, 50 bp, homo sapien
ctgtgtgccaagacctctacaaggakaaatgtaagctcaaggatatcgtt

SEQ ID NO: 32773 - DNA, 50 bp, homo sapien
taagagaagagctgtggtaataagcyatagagcaatgtaagtttttggta

SEQ ID NO: 32774 - DNA, 50 bp, homo sapien
tcaccgctgtctgcgaagatctcackctgcttgttcagttgttcacctcc

SEQ ID NO: 32775 - DNA, 50 bp, homo sapien
agggccaggcttataaccagcttgcrgatgttcgctgaatgaatggactc

SEQ ID NO: 32776 - DNA, 50 bp, homo sapien
cttagagggacttaaacaatggacaraagcacagatgtctggcacttgga

SEQ ID NO: 32777 - DNA, 50 bp, homo sapien
aatatctactgatttatcttaactaygtgacaatctcaggtaaaagcaaa

SEQ ID NO: 32778 - DNA, 50 bp, homo sapien
gatccccatcaaaaatgaactccaartaaatgaactcctttctgccatcc

SEQ ID NO: 32779 - DNA, 50 bp, homo sapien
gataaaagaaactttccatgatccaygagctgagaacaatcaagtccctc

SEQ ID NO: 32780 - DNA, 50 bp, homo sapien
taaaggcccctaggttgacgatgaawgacttaggcaatacaacttgcaat

SEQ ID NO: 32781 - DNA, 50 bp, homo sapien
gtagttgcattcatgcctgaagtgtsaacaacaatacaattatacttttc

SEQ ID NO: 32782 - DNA, 50 bp, homo sapien
cccacttctaattctgaggtctagakatacaatatgtagcatggcagagt

SEQ ID NO: 32783 - DNA, 50 bp, homo sapien
aatgacttggaaggaaaattgcttakactattgagttgatttttctgggc

SEQ ID NO: 32784 - DNA, 50 bp, homo sapien
ctagagatcaacaaaagacaatagargaaatggtatagccaataaaaatt

SEQ ID NO: 32785 - DNA, 50 bp, homo sapien
ttaagattggctactcattagaatcyactagggatattgacatctactaa

SEQ ID NO: 32786 - DNA, 50 bp, homo sapien
atgtcttcttcctgcttcctgttgcyatattagatattaacaaaatatac

SEQ ID NO: 32787 - DNA, 50 bp, homo sapien
gtaactcaaaatgaaggttctccaartaggtgatgtggcgccgtgtctct

SEQ ID NO: 32788 - DNA, 50 bp, homo sapien
ttcctggaggagatattaacatgacyatctgccttttggtggctggagta

SEQ ID NO: 32789 - DNA, 50 bp, homo sapien
ttaactttaaaccaaattctagatamtaagcaacactcaaagttgaatct

SEQ ID NO: 32790 - DNA, 50 bp, homo sapien
tcttttggggacattagagaggcacsataacaaagtagcggaaagctcat

SEQ ID NO: 32791 - DNA, 50 bp, homo sapien
catttcttacacaccctgttagttarggatgactattctcagattaaaaa

SEQ ID NO: 32792 - DNA, 50 bp, homo sapien
caatcagattctatgggaatgacagmaaattaaattgtataaccaagtcc

SEQ ID NO: 32793 - DNA, 50 bp, homo sapien
agctcttttgtcatttgagactcaasggggatcctctgtagacttctgga

SEQ ID NO: 32794 - DNA, 50 bp, homo sapien
acagtttggattttattttaaacacrctggatagccactagaagattttt

SEQ ID NO: 32795 - DNA, 50 bp, homo sapien
atagtttcttagatttcctttctaawtgagatttcctttctagatgacta

SEQ ID NO: 32796 - DNA, 50 bp, homo sapien
tgatcccaaccactgagttttgacasctaagtatcattccttttgatggg

SEQ ID NO: 32797 - DNA, 50 bp, homo sapien
atgagcttaacaattcctatctgtawctgtagtggcaaatgcagtagcat

SEQ ID NO: 32798 - DNA, 50 bp, homo sapien
attttctccagtttctccctttctcrccaactaggtccatccaaacttcc

SEQ ID NO: 32799 - DNA, 50 bp, homo sapien
gttatgcatgtttaaaggtgacagakgtcatgcgcccatataaaatcatg

SEQ ID NO: 32800 - DNA, 50 bp, homo sapien
tcttcatttcctcctattgtaaacaygcgctaatgacatacttactgcac

SEQ ID NO: 32801 - DNA, 50 bp, homo sapien
tggaggaatggaactgcaaccagtcrcaaaaataagaatattggccaggc

SEQ ID NO: 32802 - DNA, 50 bp, homo sapien
gcaaaatacatactctagcacacaaytaatgcttgataaataatagctct

SEQ ID NO: 32803 - DNA, 50 bp, homo sapien
gaaatttctaatgacaattttcttcraatgtatccctatcgttaagtgac

SEQ ID NO: 32804 - DNA, 50 bp, homo sapien
atgcttacatgcatgtgagtggtgargattagataacaaactgtggatgt

SEQ ID NO: 32805 - DNA, 50 bp, homo sapien
ctattagtgaaattggatgataatcragaagtatgttttaccttggttct

SEQ ID NO: 32806 - DNA, 50 bp, homo sapien
cattttaaactgaacaagtaactaamgtttgctaagtattcacatattat

SEQ ID NO: 32807 - DNA, 50 bp, homo sapien
gacaataaagaagtgggctaaaccarcgatgaaaagaaacagaagataaa

SEQ ID NO: 32808 - DNA, 50 bp, homo sapien
aaatgtaaactcttccctaaaaatayatgtcctgaattaccaattagtct

SEQ ID NO: 32809 - DNA, 50 bp, homo sapien
ttttatagatagcatcattattttayggatatcatgatatttttatgaat

SEQ ID NO: 32810 - DNA, 50 bp, homo sapien
aatgatgctatctataaaataatgaygatatctgtaaaagtaatgatatt

SEQ ID NO: 32811 - DNA, 50 bp, homo sapien
gaaaaagggtaaccagaataggagasagctgacatctgagcaatattaag

SEQ ID NO: 32812 - DNA, 50 bp, homo sapien
agagaaaaaaaacgtagattcatggwatttatatctgactgagctgaaaa

SEQ ID NO: 32813 - DNA, 50 bp, homo sapien
ttaattttgatgtcaaatggtctcayatgattaggcttactgatgtttca

SEQ ID NO: 32814 - DNA, 50 bp, homo sapien
gttttagatatagaaacttaggaaasaaggctgttaatttgataaagtgt

SEQ ID NO: 32815 - DNA, 50 bp, homo sapien
tgagtgctcaacagagagctcttcckgctgcaaagtaaaatcagacccta

SEQ ID NO: 32816 - DNA, 50 bp, homo sapien
aatgaatacctttgttagctttaaargatttgaggcattaaggagcaatt

SEQ ID NO: 32817 - DNA, 50 bp, homo sapien
tacaaaagaaaatgtctgccttgaawgtagctatcagaaagtaacatcac

SEQ ID NO: 32818 - DNA, 50 bp, homo sapien
tctctctgggaaagtagtaagtgcckcatctttggaggtgagcaagcgga

SEQ ID NO: 32819 - DNA, 50 bp, homo sapien
taaacagtgtagagaagacattaaamggcctgagggagatgaaaaccatg

SEQ ID NO: 32820 - DNA, 50 bp, homo sapien
tgctaccattagatgagtattaggarctccactttataaactagagttga

SEQ ID NO: 32821 - DNA, 50 bp, homo sapien
gctccaaagttctgttaaccttgccraaccatactctatgccaatggtga

SEQ ID NO: 32822 - DNA, 50 bp, homo sapien
gtttgtataccagttctggggatcaygggccttgtgaaaacttatcccaa

SEQ ID NO: 32823 - DNA, 50 bp, homo sapien
cacctggattttgcaattctaaaagractcctacttctcccccagccctt

SEQ ID NO: 32824 - DNA, 50 bp, homo sapien
ccaagacagggatcctgcattagacrgaaacggtggttcttaaccattgc

SEQ ID NO: 32825 - DNA, 50 bp, homo sapien
cttttaattattctcttttgggctamaaatctgtggatctgcatacctga

SEQ ID NO: 32826 - DNA, 50 bp, homo sapien
ggaggaaagaaaattggatagaagaragtattttaggtcataaagatgaa

SEQ ID NO: 32827 - DNA, 50 bp, homo sapien
aaatctctttcttggatcacaaaaaktattcacttaatttcctacccagc

SEQ ID NO: 32828 - DNA, 50 bp, homo sapien
ctcaactcagagtcagggtttgaacyatatccccggctggaatgggggcc

SEQ ID NO: 32829 - DNA, 50 bp, homo sapien
tgcattggcagacttttacacaccaygatctctgaaaaggaaccattggg

SEQ ID NO: 32830 - DNA, 50 bp, homo sapien
ggctataaggcaataacgttcattayacaaatcaccaaaatcaatcttta

SEQ ID NO: 32831 - DNA, 50 bp, homo sapien
aaatgattccaaatcatcaaatgccragagagtagctaaaaataaaaact

SEQ ID NO: 32832 - DNA, 50 bp, homo sapien
atattcacaatgagatagtgtttgayatttactgtaaacacaaggagaca

SEQ ID NO: 32833 - DNA, 50 bp, homo sapien
ctcaccaggtgatggaatctgacagsctactctgcttcatgcctcacata

SEQ ID NO: 32834 - DNA, 50 bp, homo sapien
cttctactccctttctctgaattcgwagagtcaactcatatgccagggta

SEQ ID NO: 32835 - DNA, 50 bp, homo sapien
aaatttgcatctcagcaaaatgacayggaacttcactctacagcattcaa

SEQ ID NO: 32836 - DNA, 50 bp, homo sapien
gagattcttgttcatgctgtctaaaycttttcaatgctgtgttgaagcca

SEQ ID NO: 32837 - DNA, 50 bp, homo sapien
gaactaggtttttgccaaagctataraacttcccaccagatgaaagcttt

SEQ ID NO: 32838 - DNA, 50 bp, homo sapien
cgtgactgtaaggtcttcctgcccayaggttgctcctggctattagtact

SEQ ID NO: 32839 - DNA, 50 bp, homo sapien
cacacacacacacacacacgaggaarctagaagaaaccttgtcaaaatat

SEQ ID NO: 32840 - DNA, 50 bp, homo sapien
agtgttacctgaccacaagtttactsaaaccaatggccttcctctgcagc

SEQ ID NO: 32841 - DNA, 50 bp, homo sapien
gaccagccctgacatgaacctgtaaygaagcagacaaaaacaaaaacaaa

SEQ ID NO: 32842 - DNA, 50 bp, homo sapien
ccattaatttcagttatctaggcacragttacaagaaagaaagaagaagg

SEQ ID NO: 32843 - DNA, 50 bp, homo sapien
tttatattcacctacaaagcaaatgrcatacacttatgcttaattgcctc

SEQ ID NO: 32844 - DNA, 50 bp, homo sapien
ggcaaaagcacaggataggagttagragacccagataagagtagcatcac

SEQ ID NO: 32845 - DNA, 50 bp, homo sapien
aactgagtcataggttaccctatcaytctcacaatacctgatatgtaaaa

SEQ ID NO: 32846 - DNA, 50 bp, homo sapien
caaagacttgaggtcagagtttccamgactgagcaaatgagaaaagagga

SEQ ID NO: 32847 - DNA, 50 bp, homo sapien
tgtctccagcacaaccttttgagaaracaaacatccttataggcaaggcc

SEQ ID NO: 32848 - DNA, 50 bp, homo sapien
aaaatgctgctaccctttgacaagayggtttcatttctagaaatctaagt

SEQ ID NO: 32849 - DNA, 50 bp, homo sapien
acttgctgccacatttataatggaawtctccaggtgggacatttgttcga

SEQ ID NO: 32850 - DNA, 50 bp, homo sapien
ggcatctgtaaattgccatattcccwgataatgaacatggagttagggca

SEQ ID NO: 32851 - DNA, 50 bp, homo sapien
ctcctccccagctacagacttatgarcaaaatgaatcattgttattgatc

SEQ ID NO: 32852 - DNA, 50 bp, homo sapien
gggattagaattgctactgaatgaawgtaaaagccaaaaccaattggtgg

SEQ ID NO: 32853 - DNA, 50 bp, homo sapien
agcaacagcacatgtttgacagttckcatgttctgtatcttgaagggctc

SEQ ID NO: 32854 - DNA, 50 bp, homo sapien
gattttgttcttaattcactctgaaraaacactatcagcattgagattgt

SEQ ID NO: 32855 - DNA, 50 bp, homo sapien
ctggactcaggagtcagggagatagscactagtcgtaaccttctatgtga

SEQ ID NO: 32856 - DNA, 50 bp, homo sapien
ctgtctccttgcttggagttcccagyatagtgcatggatgcagcattgat

SEQ ID NO: 32857 - DNA, 50 bp, homo sapien
ttcaacagtataatttagtcttccaycttattagtgttggatgatcagtt

SEQ ID NO: 32858 - DNA, 50 bp, homo sapien
ccagtttgagatagttgctttactaraattcctaaatatttctttgaaaa

SEQ ID NO: 32859 - DNA, 50 bp, homo sapien
ttagaattcctgtttccatccctgamtagctctgtgatctacagtaagtt

SEQ ID NO: 32860 - DNA, 50 bp, homo sapien
gtgaaaaaagcttggagttatgcagrcctcagttagaattcctgtttcca

SEQ ID NO: 32861 - DNA, 50 bp, homo sapien
agaagctcctagttatctactgatayaaaacactacccaaggtaacaaaa

SEQ ID NO: 32862 - DNA, 50 bp, homo sapien
gacaaggtgataagttagggaagaamgtagctaatagcaccaaataagga

SEQ ID NO: 32863 - DNA, 50 bp, homo sapien
agtggaaggccaggaatgttgtgtcsaaaaagtggtaccaaattagtgga

SEQ ID NO: 32864 - DNA, 50 bp, homo sapien
catgggtggtgtttaccctgactccrcagttggaatttgaacaggttaaa

SEQ ID NO: 32865 - DNA, 50 bp, homo sapien
gtcagggtcccttgcagagatgactkagaaccaagtgcacaaagcacaga

SEQ ID NO: 32866 - DNA, 50 bp, homo sapien
aagaagcagagagaaaggagccacartcatagaattctgaaacttggaag

SEQ ID NO: 32867 - DNA, 50 bp, homo sapien
ttgccctgtattatacacaaagtcaygcgggaatcattttatttggggag

SEQ ID NO: 32868 - DNA, 50 bp, homo sapien
agttattacaacactctctcttacawcagatgatagtgttaggcatattt

SEQ ID NO: 32869 - DNA, 50 bp, homo sapien
attttgcttccataaattttctatartaaacatccattacatttatgatt

SEQ ID NO: 32870 - DNA, 50 bp, homo sapien
gttctcaaaccttagccttctaagcwctcttgatgtttgttgctgcctga

SEQ ID NO: 32871 - DNA, 50 bp, homo sapien
ttcccttactagactgaaaggtgcayattttattattttgttcccaatca

SEQ ID NO: 32872 - DNA, 50 bp, homo sapien
tttagtgttacaactttggcttcagracaattaaaatgtatgaagaagta

SEQ ID NO: 32873 - DNA, 50 bp, homo sapien
taatggagcgggcggattcaatgackcccaattcaaattagtcacaagga

SEQ ID NO: 32874 - DNA, 50 bp, homo sapien
ggggtctgtgatcattgagttaaackgtctatctgttgaatgatatccaa

SEQ ID NO: 32875 - DNA, 50 bp, homo sapien
ctttcacaagcatcgtcttatttaastctcttattgctctgtgagttaga

SEQ ID NO: 32876 - DNA, 50 bp, homo sapien
aattccaaaaatggaaaatagacacsattgccctttactgccatcttgtt

SEQ ID NO: 32877 - DNA, 50 bp, homo sapien
tacaaagtggcatcagggaggaataygaggaggctctgaaaagctcacag

SEQ ID NO: 32878 - DNA, 50 bp, homo sapien
gttaccttggtatcttcagagagtaycagtttattgttaccatgagtctg

SEQ ID NO: 32879 - DNA, 50 bp, homo sapien
atcacatccatagacaaagcaaacartaatggagtctggaaatttcaaga

SEQ ID NO: 32880 - DNA, 50 bp, homo sapien
aaaatcaaactggccaagatgacaaytggttggaacagaagcaaaagtgg

SEQ ID NO: 32881 - DNA, 50 bp, homo sapien
tgttgatattattatttgcatccctsaatattgctttaagctaaaccata

SEQ ID NO: 32882 - DNA, 50 bp, homo sapien
caatggttataaggcactcactttayagtaagcgatcctcccattttcaa

SEQ ID NO: 32883 - DNA, 50 bp, homo sapien
ctgcagtaaaagtgagcaaagtggamtaaatggtgactacacagcttctg

SEQ ID NO: 32884 - DNA, 50 bp, homo sapien
caccccagcaccttcttgtataccarcatggcctctaatcattttcacag

SEQ ID NO: 32885 - DNA, 50 bp, homo sapien
cagccctcagtgcctagaaataggayaaatactgtaagctctatatctgt

SEQ ID NO: 32886 - DNA, 50 bp, homo sapien
ctataagatactggaaattccttgargatgaataggataatctgaatgta

SEQ ID NO: 32887 - DNA, 50 bp, homo sapien
cagtacttattataatgcattaaaayggtatgtcttgtttctaacacttt

SEQ ID NO: 32888 - DNA, 50 bp, homo sapien
acaacaagccagtgttgtagaagacyatcctggagttaaggagaggagga

SEQ ID NO: 32889 - DNA, 50 bp, homo sapien
cttcttttcctttgccactgcttcartccaagattttgtcgttttctgac

SEQ ID NO: 32890 - DNA, 50 bp, homo sapien
ggcttttagagcaggtactgtggaartgaggaagaaagtccctgccatca

SEQ ID NO: 32891 - DNA, 50 bp, homo sapien
actttcatcttctggagtatgagaawctgctaaaggctgttaagcagagg

SEQ ID NO: 32892 - DNA, 50 bp, homo sapien
tgaagtgataaatagctgggcaaaaraatggaataaacatatataaaaac

SEQ ID NO: 32893 - DNA, 50 bp, homo sapien
acctggcaacagtgccactccaacamgggtcaagtctattgtattcagcc

SEQ ID NO: 32894 - DNA, 50 bp, homo sapien
ccctttaaccaagaagatataactgsaattcatcacaagacaatcaaaga

SEQ ID NO: 32895 - DNA, 50 bp, homo sapien
gagtcttagtagtgttttacctgatkatattgagcaatagtgcatttcaa

SEQ ID NO: 32896 - DNA, 50 bp, homo sapien
aaagaaaggaccttgggttagtggayatgaccctggaatggaagttgaaa

SEQ ID NO: 32897 - DNA, 50 bp, homo sapien
ctactttcattcgccatatacaacaratatttaattgagcatttaagtgc

SEQ ID NO: 32898 - DNA, 50 bp, homo sapien
atagcaataatgataaccatgaagayaaaagtggatatattttgttttat

SEQ ID NO: 32899 - DNA, 50 bp, homo sapien
ggctgatggtgttccttttattttawagcatatgcaatagcttacagcaa

SEQ ID NO: 32900 - DNA, 50 bp, homo sapien
ttgctaaggctttctgtaatcacttkaaggaattcgagcagaactagaag

SEQ ID NO: 32901 - DNA, 50 bp, homo sapien
tctgcaggtgcaatggtgtaacacastctagtgctgaattttgagcagga

SEQ ID NO: 32902 - DNA, 50 bp, homo sapien
acacggtcttctttggagattgctayaaggtggattgtcttgataaaaca

SEQ ID NO: 32903 - DNA, 50 bp, homo sapien
cgtgatggtatattgggtagaaaacyatgatcattaatgcctcagttgaa

SEQ ID NO: 32904 - DNA, 50 bp, homo sapien
ttgactacgtgtgtgttgtactttaygcattgactttaaatcacagtcct

SEQ ID NO: 32905 - DNA, 50 bp, homo sapien
tgcatgaagggagaccagatggaagsctgttgcacaaaggtctggcagtt

SEQ ID NO: 32906 - DNA, 50 bp, homo sapien
tatggttcaaaacaaactggacttamggcctgaacacttgctgtgcttct

SEQ ID NO: 32907 - DNA, 50 bp, homo sapien
cctttgctgtttattggtgaacacayacaaggcttgattttagtgttcat

SEQ ID NO: 32908 - DNA, 50 bp, homo sapien
tttactttgttgtgagaacccaaccrgatggctctttgatcttgtagccc

SEQ ID NO: 32909 - DNA, 50 bp, homo sapien
gcaaacattacagatgaaaacataaytagtattaggccaattctccttta

SEQ ID NO: 32910 - DNA, 50 bp, homo sapien
ataagctccatgaaaacaggaactayctttttgcttcacatggtctcccc

SEQ ID NO: 32911 - DNA, 50 bp, homo sapien
tttttgtgtgttatattaaaaagccrgatgctaaagtataggtgaaccat

SEQ ID NO: 32912 - DNA, 50 bp, homo sapien
gtgacagaattttctgtttcatccayagtggtcataagggtgtaaaaagt

SEQ ID NO: 32913 - DNA, 50 bp, homo sapien
aatgtttggagacagattatggagarctttcaaggcactattaggaagtt

SEQ ID NO: 32914 - DNA, 50 bp, homo sapien
atctgtgggttgggtgttattatcartagtggcctcctcactttcaaaat

SEQ ID NO: 32915 - DNA, 50 bp, homo sapien
gatatctaccctaccattttaccacyacttttctgctaatgcatttggtt

SEQ ID NO: 32916 - DNA, 50 bp, homo sapien
gttaacttgctgccatttaacagatkatcagaaattgcaaactctctcaa

SEQ ID NO: 32917 - DNA, 50 bp, homo sapien
ctaaaatctggctacgtttatcttaygactttctgtgcctgacaccatca

SEQ ID NO: 32918 - DNA, 50 bp, homo sapien
gtctgctcagggatgtgaaaggagawgagttaattattcctatgtttcta

SEQ ID NO: 32919 - DNA, 50 bp, homo sapien
ctaatttttttaagtaaaactaacartgtctgctcagggatgtgaaagga

SEQ ID NO: 32920 - DNA, 50 bp, homo sapien
gttcttgccatgtaggttctgtatcratgtattcttatatggcttctata

SEQ ID NO: 32921 - DNA, 50 bp, homo sapien
gaccaagtggtatttatcccaagtaygcaaagctgtttcagcattcaaaa

SEQ ID NO: 32922 - DNA, 50 bp, homo sapien
tttcctcccaacattttactagttayctaattcaaacatctgaaataaac

SEQ ID NO: 32923 - DNA, 50 bp, homo sapien
cgagtcagaaattaactttgagacartgacaagaatcttagctcttatta

SEQ ID NO: 32924 - DNA, 50 bp, homo sapien
tgaggtcctacaactaatttttccayacatatcatctgtctttgcatggt

SEQ ID NO: 32925 - DNA, 50 bp, homo sapien
ctagccagaatcttctggggacacartaaaaacacaaacagttcttcact

SEQ ID NO: 32926 - DNA, 50 bp, homo sapien
tcttccttatgtaagtgataacttayatatgaggatgaaccagtatgtca

SEQ ID NO: 32927 - DNA, 50 bp, homo sapien
ttattttaaatttgctggggaaaggycattaaacactaaatttagggctt

SEQ ID NO: 32928 - DNA, 50 bp, homo sapien
tggccttaagcttgttattatacaayacgtttagtttgtagatttatact

SEQ ID NO: 32929 - DNA, 50 bp, homo sapien
aggtagaaaactggcaactcctattkaaactacatgatccaaagcagcat

SEQ ID NO: 32930 - DNA, 50 bp, homo sapien
cttgactgctcacaagagccttgtaygcatttatccattgggtaaaggcc

SEQ ID NO: 32931 - DNA, 50 bp, homo sapien
accccttttttgatcatcacaaaaayctccttcctagcaatctgaatata

SEQ ID NO: 32932 - DNA, 50 bp, homo sapien
gaaaaatactactttatgtttttgcyaacagttattttcagcttagtcca

SEQ ID NO: 32933 - DNA, 50 bp, homo sapien
gcaatcccactgctaggtatataacmaagagaaaggaaatcagtatatca

SEQ ID NO: 32934 - DNA, 50 bp, homo sapien
taggcttgtaattatgatgatacctmacttgcacttttcatataaaaata

SEQ ID NO: 32935 - DNA, 50 bp, homo sapien
caggtatgtgatttgtgagtgtagcrgacagagttgggggccctaggaca

SEQ ID NO: 32936 - DNA, 50 bp, homo sapien
gaggggtatttcaatctttggatccygagtgtcataagccagttttaatt

SEQ ID NO: 32937 - DNA, 50 bp, homo sapien
aattttagtcacataacagtgaagaygtttcccaaggagaacatcagtgg

SEQ ID NO: 32938 - DNA, 50 bp, homo sapien
cggcagctattcacagttggtgcatratacgttttttaatatataaaagc

SEQ ID NO: 32939 - DNA, 50 bp, homo sapien
tcctgcactgtgcctggcacatagcrgacgttttgtaattgtttgcttga

SEQ ID NO: 32940 - DNA, 50 bp, homo sapien
ccctgttcaccattttttgaataaartctttagaggaatatgccacaata

SEQ ID NO: 32941 - DNA, 50 bp, homo sapien
ctgacagaaagcccattaggatctawcttctaaccctcttcaactgctca

SEQ ID NO: 32942 - DNA, 50 bp, homo sapien
cctaaataatttaagctgggtaatcraagaaaataaataaattatatata

SEQ ID NO: 32943 - DNA, 50 bp, homo sapien
gaccacggatgttcctacagagaaarcatgagaagcagcagaaatatttg

SEQ ID NO: 32944 - DNA, 50 bp, homo sapien
gttgattcagagaacgaacgccggaygcaaaacgtagatgggcaaatacc

SEQ ID NO: 32945 - DNA, 50 bp, homo sapien
gcttggctgattgcagggagatttgyaaagtgctagagttttcagcggag

SEQ ID NO: 32946 - DNA, 50 bp, homo sapien
atttggtttccttctgctcatttaasaagaaagagtgttcagggagagtt

SEQ ID NO: 32947 - DNA, 50 bp, homo sapien
ctgttttctttaccatgaaatatackaatcattcaaaaaagccttgtgtt

SEQ ID NO: 32948 - DNA, 50 bp, homo sapien
caagactgattcacaaataacattaygacagttttggcttccccaaaaca

SEQ ID NO: 32949 - DNA, 50 bp, homo sapien
taaaagggccacaaggaaaacttagyaacggagtgtgaaatccaagcttt

SEQ ID NO: 32950 - DNA, 50 bp, homo sapien
agctttcctagcttgctgtattaaayaactttgggagttgtggtggttca

SEQ ID NO: 32951 - DNA, 50 bp, homo sapien
ttattcaataatctttcttacagtawaataaccagttggagcaatgtcaa

SEQ ID NO: 32952 - DNA, 50 bp, homo sapien
atgctcaattatacttaactatatartagtgctaaaaattctgacagtac

SEQ ID NO: 32953 - DNA, 50 bp, homo sapien
tgcagaaatgcctcacccagagtcaycttatcaccattgaggtaggaccc

SEQ ID NO: 32954 - DNA, 50 bp, homo sapien
cccacagtggtaactggtttgattakgcattctttgttggttcccttctt

SEQ ID NO: 32955 - DNA, 50 bp, homo sapien
gcctttagagagatgttccaatgccrcaaaaacatcctacagtaagagac

SEQ ID NO: 32956 - DNA, 50 bp, homo sapien
cttgaccaaagccacataaccagaartgagtgaagccaagattcaaactc

SEQ ID NO: 32957 - DNA, 50 bp, homo sapien
gctaggagctgtcagctaactctacwccttgtggcagattttgtcttgaa

SEQ ID NO: 32958 - DNA, 50 bp, homo sapien
aagaaatgtgaattttattctggccygcagggaaatgtgacagatctata

SEQ ID NO: 32959 - DNA, 50 bp, homo sapien
ccataccttcatcatttctcatctgracgtttcactggaagatgactgtc

SEQ ID NO: 32960 - DNA, 50 bp, homo sapien
tgtcacctggaatgcctacatatgayctcttaatttgggcagtctcaggt

SEQ ID NO: 32961 - DNA, 50 bp, homo sapien
tttcccagcattgtcattgtgctaargtttactgaaagaaaatgaaataa

SEQ ID NO: 32962 - DNA, 50 bp, homo sapien
ctaaatctgggaagacctgtttgacrggaaacacctacctaattgagagc

SEQ ID NO: 32963 - DNA, 50 bp, homo sapien
ctaatgggtgcttcttgagtaccagmaacggtgcttagtgctttgtttgt

SEQ ID NO: 32964 - DNA, 32 bp, homo sapien
catcaatatcaatgaaycgttatcttctctat

SEQ ID NO: 32965 - DNA, 50 bp, homo sapien
gagaggatacttcacatgaaggagawctttccaaaataagtactcaaatc

SEQ ID NO: 32966 - DNA, 50 bp, homo sapien
ttctttcttcagtaacagaacactayattttagttggacacatgtctgcc

SEQ ID NO: 32967 - DNA, 50 bp, homo sapien
aagtttcacaggcatttttgaaaacyaaccgacagcatcactggcttaag

SEQ ID NO: 32968 - DNA, 50 bp, homo sapien
tgtgaatgttaacaatgcaaaaaagwcttacatgcatggaatttcgacag

SEQ ID NO: 32969 - DNA, 50 bp, homo sapien
gttgaacactgtgtctctgcttcatragttacatccttgcaaacataata

SEQ ID NO: 32970 - DNA, 50 bp, homo sapien
ttagttttgttgtttttggtgagccrctagtaaccactggccttgataat

SEQ ID NO: 32971 - DNA, 50 bp, homo sapien
attggcttctggacatctgaacttayatgatggaggtcagtgctatctga

SEQ ID NO: 32972 - DNA, 50 bp, homo sapien
ctcacgcaagaatttgaggcatatcmataaagtgaaaacaagtttattga

SEQ ID NO: 32973 - DNA, 50 bp, homo sapien
ctatcatcaaagaacaagtgtaataragcagtctttagtttccgagatcc

SEQ ID NO: 32974 - DNA, 50 bp, homo sapien
acactaaggtagatgttctgagatayataagctatcctgctcagatataa

SEQ ID NO: 32975 - DNA, 50 bp, homo sapien
ccttgaagttattgtcaagaccaaargtaaccaacatatgtccttacatg

SEQ ID NO: 32976 - DNA, 50 bp, homo sapien
gtttctgcatcatactttatgtaaaycagttattttgaggcctctggaag

SEQ ID NO: 32977 - DNA, 50 bp, homo sapien
gcctctttataatgtgaaacctgtcraacatcaatcggcagaaacacctt

SEQ ID NO: 32978 - DNA, 50 bp, homo sapien
gaaatagttgaatttacaagacaaasgcttcatgaagacaagaaatgact

SEQ ID NO: 32979 - DNA, 50 bp, homo sapien
ttgagcaactaagttaatcattgackcgcacttgttccattaaattgata

SEQ ID NO: 32980 - DNA, 50 bp, homo sapien
acctcagctggaaaagggcattggaygatatggttgctctcagcacaatg

SEQ ID NO: 32981 - DNA, 50 bp, homo sapien
tactatatggcaggtaagataaataygggataaataatgaagtattcctt

SEQ ID NO: 32982 - DNA, 50 bp, homo sapien
atttgcttttttatctccatttcccraggtatctttgctcaacttagtgc

SEQ ID NO: 32983 - DNA, 50 bp, homo sapien
ctaggtgaattttcccaatgttataytagcctgataggtattttcctctt

SEQ ID NO: 32984 - DNA, 50 bp, homo sapien
gaccctggctgaatgatttccctacratccacagaatgtctcagccactg

SEQ ID NO: 32985 - DNA, 50 bp, homo sapien
ttagttattagtctatatattgagayagtgtaacttccccggcatcccta

SEQ ID NO: 32986 - DNA, 50 bp, homo sapien
ttggaaaagcttaggaggctgagtasgaagaaaccttgaggaattttgag

SEQ ID NO: 32987 - DNA, 50 bp, homo sapien
gttgataaaggccaagtgtgagcaartatgagagtacagaatccctaaga

SEQ ID NO: 32988 - DNA, 50 bp, homo sapien
atcattttctgagctgcagaatcccrgatacatcactctcctcagaagct

SEQ ID NO: 32989 - DNA, 50 bp, homo sapien
ccacttgtctgtgttctctaatctayggactcgaaatctcagagaagcca

SEQ ID NO: 32990 - DNA, 50 bp, homo sapien
gccacctccactgaatgtaaaactaytaaggtacacttccaaatgggtta

SEQ ID NO: 32991 - DNA, 50 bp, homo sapien
attacaaatcctagtttctccagaaktcagtttgaaaagaccaacattga

SEQ ID NO: 32992 - DNA, 50 bp, homo sapien
aagaattggaatgtaaatatgcctaygttcctcttatccacatcctttaa

SEQ ID NO: 32993 - DNA, 50 bp, homo sapien
tgggctcacccaattgataacctccratcctgatgacaaacgccaatttg

SEQ ID NO: 32994 - DNA, 50 bp, homo sapien
ttaataaacagtacctgctctcaaaytgaaaaaaacaaaaaaccaaaaag

SEQ ID NO: 32995 - DNA, 50 bp, homo sapien
tcctcagaggctaaaagtagctagamagattatcccctaagcccaggatc

SEQ ID NO: 32996 - DNA, 50 bp, homo sapien
tgaggatgttgagttaggccctacaygcaaagggaacagggtaaacaaag

SEQ ID NO: 32997 - DNA, 50 bp, homo sapien
attggcattttctatatttcctagcrccaccctctatgatttttaatccc

SEQ ID NO: 32998 - DNA, 50 bp, homo sapien
gctgatgcatttgattcctattgtgwagagagtgatgaggaggaagaaga

SEQ ID NO: 32999 - DNA, 50 bp, homo sapien
aggatctgatgtctggtgtttcatamagatggtgtgagaaggttgtgtgg

SEQ ID NO: 33000 - DNA, 50 bp, homo sapien
tcaacacatagatttctgtctttcarattcattttttgttccttaatctg

SEQ ID NO: 33001 - DNA, 50 bp, homo sapien
tggtcactctaacagccaaagttcckcaaattctcaaatcctgtactgtc

SEQ ID NO: 33002 - DNA, 50 bp, homo sapien
aactagaaaaggaacctgatgagtcrccatagggccaatagcgcagagag

SEQ ID NO: 33003 - DNA, 50 bp, homo sapien
tgaatggtgtgtgaaagtcggaaacmattttgctttcctttccattcaga

SEQ ID NO: 33004 - DNA, 50 bp, homo sapien
ttcagaaaggtgaacagagtcatgartagttgaaaaaatacactaaagga

SEQ ID NO: 33005 - DNA, 50 bp, homo sapien
tgtttccattttattttctcacttaygttggtacagcaaaataaaaaatg

SEQ ID NO: 33006 - DNA, 50 bp, homo sapien
agatgcccaggtgcttcctctatgcrctataaatttaagaagcactgatc

SEQ ID NO: 33007 - DNA, 50 bp, homo sapien
cacacatatgtttctttgttgaaaasagcttactaaaggcttttcttgac

SEQ ID NO: 33008 - DNA, 50 bp, homo sapien
aaacacaaaagatgacttagcattarccatctccctcaaagaaccagtga

SEQ ID NO: 33009 - DNA, 50 bp, homo sapien
atatgcttatttaaatctctggcatragtaggtatttaaagcatgctttg

SEQ ID NO: 33010 - DNA, 50 bp, homo sapien
aagaaatctgttccatttggaagaargagagaataattattgtcattcat

SEQ ID NO: 33011 - DNA, 50 bp, homo sapien
aggctgaaataaaaaatgatgcttamaaacgatccctctgtgactctatg

SEQ ID NO: 33012 - DNA, 50 bp, homo sapien
agccctttttgcctgcaaacaaataygtactcctcaggggaacattccat

SEQ ID NO: 33013 - DNA, 50 bp, homo sapien
ctgtgactctatgtctctatccacartccaacgtgagaaatttccttagg

SEQ ID NO: 33014 - DNA, 50 bp, homo sapien
attatgggtgattaatgcatgacaamgggttaatcacaagatttctttta

SEQ ID NO: 33015 - DNA, 50 bp, homo sapien
tgtgtattgctcactctaggcaaatwagatggattatgagattcaagatt

SEQ ID NO: 33016 - DNA, 50 bp, homo sapien
aaaaaaaagccaaaaataatggctaygtgtcagcattcccagagccaaag

SEQ ID NO: 33017 - DNA, 50 bp, homo sapien
ttctatctgagttttacatagtaaargtaaagctctaggccgactctatt

SEQ ID NO: 33018 - DNA, 50 bp, homo sapien
ctttcatgtgatgactcattaattcrgaaggatggctcttgcattgaatg

SEQ ID NO: 33019 - DNA, 50 bp, homo sapien
attttctcttaaaatatacttgttcraatgccaatgccaatttgaagata

SEQ ID NO: 33020 - DNA, 50 bp, homo sapien
ttgctgacattaaaaggtttccttaycttctctgacattaatctctccca

SEQ ID NO: 33021 - DNA, 50 bp, homo sapien
cctgcttcttttcccagaagagttayaggtagatagaaccctgattaaaa

SEQ ID NO: 33022 - DNA, 50 bp, homo sapien
atgcttcacatttacttgcatttatracaaattttttattttcttagcat

SEQ ID NO: 33023 - DNA, 50 bp, homo sapien
ttttagatacagctgttggacatgayattcagtaaaataacacaacctta

SEQ ID NO: 33024 - DNA, 50 bp, homo sapien
gggatgccagcaaagactctaagatsaattttgtaaacctgtaagctggt

SEQ ID NO: 33025 - DNA, 50 bp, homo sapien
ttctctgtcccaaattctactttacyactccttatctagatcataacaca

SEQ ID NO: 33026 - DNA, 50 bp, homo sapien
gcttagaagagatgctaacaatgcarctaaagaaagaaaattatttaaat

SEQ ID NO: 33027 - DNA, 50 bp, homo sapien
aatggaacagatttcttttaagcaargtaccatgaagccatgtaggctct

SEQ ID NO: 33028 - DNA, 50 bp, homo sapien
tgctacaactgccatgtttataaaaygagggacataattcttctcatgag

SEQ ID NO: 33029 - DNA, 50 bp, homo sapien
agtttcatctctgacatcatgttacrctacctaccatattgcatagatca

SEQ ID NO: 33030 - DNA, 50 bp, homo sapien
tgcaagtagtataagtcatggttcaytacctttaaagaattaaattctac

SEQ ID NO: 33031 - DNA, 50 bp, homo sapien
tacctaaattttgatccctaccatawccttgtggaaagcatactcatcct

SEQ ID NO: 33032 - DNA, 50 bp, homo sapien
aataaaatgacgtaggaactgcaaaktcttagtcaggatatcacccaaac

SEQ ID NO: 33033 - DNA, 50 bp, homo sapien
aagctgctataatagggtcagaaaarcatattcggccacacagattcact

SEQ ID NO: 33034 - DNA, 50 bp, homo sapien
tttaaatggtattcatagcttcaacygcgatgtaacttatcaaagacatc

SEQ ID NO: 33035 - DNA, 50 bp, homo sapien
atgtgacacaagaacccacagatgcrgattcgtcctgactggtggctttc

SEQ ID NO: 33036 - DNA, 50 bp, homo sapien
gaagtagagtaagtagaattctaccraagtaaaatgttcataatctattc

SEQ ID NO: 33037 - DNA, 50 bp, homo sapien
aacccttcagaccccctattctcgaygtaggaaaggcactttatatcatg

SEQ ID NO: 33038 - DNA, 50 bp, homo sapien
aacaaaaacaaaagtagatgaatgakattatattaaactaaaaggcctct

SEQ ID NO: 33039 - DNA, 50 bp, homo sapien
gtgacgtggggaagagggagataaaygtaaactgatagaaacggaaggag

SEQ ID NO: 33040 - DNA, 50 bp, homo sapien
ctcccacattttccaccaatttgcargctatcgttaaagaatatttcttc

SEQ ID NO: 33041 - DNA, 50 bp, homo sapien
tcattgtgtataaaagcagacttcartacacagtgggcacacatccctgc

SEQ ID NO: 33042 - DNA, 50 bp, homo sapien
cttttctaagccttttagcaagagayatttaacacctggctaaagttttg

SEQ ID NO: 33043 - DNA, 50 bp, homo sapien
ctcatttaccagcaaccgattgttawgagatagaaacaaggccaattaac

SEQ ID NO: 33044 - DNA, 50 bp, homo sapien
attcctgaaatgtctcatggaaaaarttaatggttttctgttgttattta

SEQ ID NO: 33045 - DNA, 50 bp, homo sapien
gtctgaccttcttatatatgcaaaaygagtatcttcaaaatccattagta

SEQ ID NO: 33046 - DNA, 50 bp, homo sapien
agcagaaattcttcaaattcacagamaccaagaaacaccttcctgcgttt

SEQ ID NO: 33047 - DNA, 50 bp, homo sapien
ctagcaaggtatttagatatccatayacaagaggttcaacaagcaccagg

SEQ ID NO: 33048 - DNA, 50 bp, homo sapien
ggtctgatcttctatccacaccaccraaactttctatcagtaataaggct

SEQ ID NO: 33049 - DNA, 50 bp, homo sapien
agcaggggtagagactagatcccatmaaacaaccccacaaagtcactgac

SEQ ID NO: 33050 - DNA, 50 bp, homo sapien
ggcctgcaagcaatgaaattgtacamgtccggattctgttgttttttggt

SEQ ID NO: 33051 - DNA, 50 bp, homo sapien
aggcccagcgaattgcaaactatackatttctgttcctatagctggtaaa

SEQ ID NO: 33052 - DNA, 50 bp, homo sapien
aaatctcaagagctaagtaaggccaraatgctcaagcggaggcatgagtt

SEQ ID NO: 33053 - DNA, 50 bp, homo sapien
cagaaatcgacccacataaatatagkcaagtgatctttgacaaaggagca

SEQ ID NO: 33054 - DNA, 50 bp, homo sapien
ctagaacctggatcagggtttcagargacattgttgttatggagatagag

SEQ ID NO: 33055 - DNA, 50 bp, homo sapien
agcagttcctattggttaaatcaaaygttacaagttgactttacttatat

SEQ ID NO: 33056 - DNA, 50 bp, homo sapien
cactggaattttgatctcactgttakgagcagaatatcacatccaaatta

SEQ ID NO: 33057 - DNA, 50 bp, homo sapien
attaaacctgatcttgcttggaccaraatttcataccttctaccaatcct

SEQ ID NO: 33058 - DNA, 50 bp, homo sapien
atgtcttctgggtctttgaaaaagcrctggaaaatggcagaagagccaac

SEQ ID NO: 33059 - DNA, 50 bp, homo sapien
caaccctaggaaactaatgcctgaargttatcacagtctaacaagaaacc

SEQ ID NO: 33060 - DNA, 50 bp, homo sapien
aaatagccaggagcacgctgatttcwagacgtccttgcttgttgcagaca

SEQ ID NO: 33061 - DNA, 50 bp, homo sapien
ttcagataacttctgagaaagtgaawtattgagtcacgtatatgttcact

SEQ ID NO: 33062 - DNA, 50 bp, homo sapien
agctgttattgcaaacatcaataatmatagcctgccatcaagaaagctac

SEQ ID NO: 33063 - DNA, 50 bp, homo sapien
aagaaaatgtctgccaaaatccccamgtctgattcaccatagtttgcctg

SEQ ID NO: 33064 - DNA, 50 bp, homo sapien
taagtcaaaacttgagtatgtaataraagttaggcagatgaagaatgagg

SEQ ID NO: 33065 - DNA, 50 bp, homo sapien
atacaaggaaataataatagcatgawgaatttgaaaaggaaaatcaccaa

SEQ ID NO: 33066 - DNA, 50 bp, homo sapien
agtgcctcaccagtacagctacttcwattaataaattaaattatttcatt

SEQ ID NO: 33067 - DNA, 50 bp, homo sapien
tctcttgtgttttaatgaacttccartatgtgtaacttcagactgaagta

SEQ ID NO: 33068 - DNA, 50 bp, homo sapien
gcttcccctgtggatttaaaagaccyagacatcacagccactggccaaaa

SEQ ID NO: 33069 - DNA, 50 bp, homo sapien
ttacagggatttcttctaggttgtcmatacattaaagacggctaaaaaga

SEQ ID NO: 33070 - DNA, 50 bp, homo sapien
agtggcaggcctaactcattaaagcyattggtgttttttaaatggaaatg

SEQ ID NO: 33071 - DNA, 50 bp, homo sapien
acaatacaaagctactataaaaacartctatgcttaggaataaatttaat

SEQ ID NO: 33072 - DNA, 50 bp, homo sapien
aatttccatcattactttggaccaasaggtaagtttatcaatttattcac

SEQ ID NO: 33073 - DNA, 50 bp, homo sapien
tatgtaatctctaaggaattctagaraggatgtttatgtcagtggaagac

SEQ ID NO: 33074 - DNA, 50 bp, homo sapien
ggcttaatttttaaggcttgaagacygcattaaaaaccatctaaaaccag

SEQ ID NO: 33075 - DNA, 50 bp, homo sapien
ccagtgctttggagtttagaggatasaacatatgtcatctcgacaggaag

SEQ ID NO: 33076 - DNA, 50 bp, homo sapien
tcataaaattatttgagggacatacrctacatatgtgcagtgaacaaaca

SEQ ID NO: 33077 - DNA, 50 bp, homo sapien
atttaaaacttgtttgaggtgaagtyaagcacatacataaaataagagaa

SEQ ID NO: 33078 - DNA, 50 bp, homo sapien
taagccttaattgttttacttacaaratagtattgtgcaaagcatgttgc

SEQ ID NO: 33079 - DNA, 50 bp, homo sapien
gcatatatcataggtgattgaggtayaggtggtctaggatcacaatttga

SEQ ID NO: 33080 - DNA, 50 bp, homo sapien
tatagcctttcggtcatagacataasgactgaagccataaacaacttata

SEQ ID NO: 33081 - DNA, 50 bp, homo sapien
tattgaactgtatacttaaaaatgcraaggtggtaatttttacgtgcttt

SEQ ID NO: 33082 - DNA, 50 bp, homo sapien
taagtagcctgctcaagatcaccaakttcatttgcataacagctggggtc

SEQ ID NO: 33083 - DNA, 50 bp, homo sapien
aacttaacactagtaaacctcatcaratcctgactattaaaattatgtct

SEQ ID NO: 33084 - DNA, 50 bp, homo sapien
accattaagcttagcagttgtcctaygcttccttggtttcctaataaaat

SEQ ID NO: 33085 - DNA, 50 bp, homo sapien
ctccaatacacaatttccgaatgtargacttattatagtttacttacttt

SEQ ID NO: 33086 - DNA, 50 bp, homo sapien
tattctctcattccctgagggtaccrgcacagagttgattctcttcaatt

SEQ ID NO: 33087 - DNA, 50 bp, homo sapien
tatcttccattttcattatctaaggrcacttttaacaatggatagacaca

SEQ ID NO: 33088 - DNA, 50 bp, homo sapien
agctttatttccctttatattgtcasctttccatagaggaattttaccga

SEQ ID NO: 33089 - DNA, 50 bp, homo sapien
taaggattattcctttttcatcaatkatccaagggccctcaattaatgag

SEQ ID NO: 33090 - DNA, 50 bp, homo sapien
tgaaggcagaactataaactcaaaaytgaaagcatacagatacaaaaatg

SEQ ID NO: 33091 - DNA, 50 bp, homo sapien
tgccagcttccacatagatttcagaygaagtttgggaaagcctaggtgcc

SEQ ID NO: 33092 - DNA, 50 bp, homo sapien
taaatcttaaatttctcagtatcatyaaatttggaagagttagcaatgaa

SEQ ID NO: 33093 - DNA, 50 bp, homo sapien
aggagctaccctctctcctgagaaawgaacacttgttgggatgacctgcc

SEQ ID NO: 33094 - DNA, 50 bp, homo sapien
ccaaatattttttaaattaccaagaragccatttgaaatatttagaaaag

SEQ ID NO: 33095 - DNA, 50 bp, homo sapien
gaaagggctgattttcatcaaaaccragacctttctgcagggatgatagt

SEQ ID NO: 33096 - DNA, 50 bp, homo sapien
aaagatcccatagcaatttcgttgcragttggaaagttggtgataatatt

SEQ ID NO: 33097 - DNA, 50 bp, homo sapien
catatattagtgtacagctcagtgamgttttataagccagcactcatatc

SEQ ID NO: 33098 - DNA, 50 bp, homo sapien
ccaattatgccacactctccttccaygattcctggtaacaaactccaagc

SEQ ID NO: 33099 - DNA, 50 bp, homo sapien
gatgcaaacttacagaagattgatargcagctaataagttctgtctagta

SEQ ID NO: 33100 - DNA, 50 bp, homo sapien
aatagaaaaaatgcttgctgtcttayggtgttttagatcaatagctcttc

SEQ ID NO: 33101 - DNA, 50 bp, homo sapien
ctatatgttccctgctttcttcttarctctgctgtgtccagttaattggc

SEQ ID NO: 33102 - DNA, 50 bp, homo sapien
ctttttttttctttcctgcagtaaamcttcctgcgttagcagtgattgat

SEQ ID NO: 33103 - DNA, 50 bp, homo sapien
ctgacaggctggcaccattagagackggttaaatcaaatatttctgtgac

SEQ ID NO: 33104 - DNA, 50 bp, homo sapien
tctcaattaattgtgaatctcttaaytataagctgggtaattataagctg

SEQ ID NO: 33105 - DNA, 50 bp, homo sapien
atatgataaagagcagctctctgaaygcttaagtggtgcacctcctctac

SEQ ID NO: 33106 - DNA, 50 bp, homo sapien
aaatggccaaaagtgatagggatagraccatctgtttttcaaatctcaca

SEQ ID NO: 33107 - DNA, 50 bp, homo sapien
agtaggcaatgatatcatagcagaaygttttcttttgtgtattaatcaat

SEQ ID NO: 33108 - DNA, 50 bp, homo sapien
tttactaggctcagtaagcagtatgrattatctttactggagaagaattt

SEQ ID NO: 33109 - DNA, 50 bp, homo sapien
aggagtcacttggatctgatggataraataacagaagtaagcttttgtgg

SEQ ID NO: 33110 - DNA, 50 bp, homo sapien
tgttgatgcccaaatttggaaaaaartctatgcaaagtttaaaaaaaatt

SEQ ID NO: 33111 - DNA, 50 bp, homo sapien
ttcagttcccctcttcttttctcacyctgtagcaacctgaattgtcctca

SEQ ID NO: 33112 - DNA, 50 bp, homo sapien
ggcaagcatctgaagagataactcayccaaataaaagcgtagaaatgagt

SEQ ID NO: 33113 - DNA, 50 bp, homo sapien
tcaaccggtgatgtgaaaccagacayagacaatataaataaaaaaggtgg

SEQ ID NO: 33114 - DNA, 50 bp, homo sapien
ttctccaccaccagaaggattgattkaaaaggtaactctgaccagtcact

SEQ ID NO: 33115 - DNA, 50 bp, homo sapien
tgcagactggaaatgtaaataacccrgaatctgaatgaactcgcctctgg

SEQ ID NO: 33116 - DNA, 50 bp, homo sapien
tttatttctcagcagtagattggtayggatgagtttcacaaacaccgtct

SEQ ID NO: 33117 - DNA, 50 bp, homo sapien
actccatttgtgaaaaagaggaggcratggaactattggccataaggtct

SEQ ID NO: 33118 - DNA, 50 bp, homo sapien
tgcaaattctgatctgggtgtctccratgcagttaagagttgattagggg

SEQ ID NO: 33119 - DNA, 50 bp, homo sapien
gaataccatttggcttactcaacaayaatatgtggtttttattgagtacc

SEQ ID NO: 33120 - DNA, 50 bp, homo sapien
cagatgagaatgatacaaacccagaycagagaagttacaaaggcttgtta

SEQ ID NO: 33121 - DNA, 50 bp, homo sapien
cggatttgttaattaaaatgagatamctcagggaattgaaattaattttg

SEQ ID NO: 33122 - DNA, 50 bp, homo sapien
attaattagggaaagatacagtagargcaatcatctatatgattttaaat

SEQ ID NO: 33123 - DNA, 50 bp, homo sapien
gtgcttgatatttatgaaccaaatcragggactcatgtaatgcaggtgac

SEQ ID NO: 33124 - DNA, 50 bp, homo sapien
tgttcgtataatccacatttttgaawcttggcctatatttgcaatcattt

SEQ ID NO: 33125 - DNA, 50 bp, homo sapien
atactacaaggcggctatagctaccraaacaacatggcactggtatacaa

SEQ ID NO: 33126 - DNA, 50 bp, homo sapien
cttggaatcctagtagtgacaagtamatggtaaccgttgggttggatgca

SEQ ID NO: 33127 - DNA, 50 bp, homo sapien
tgcctattctcaacttactaaatacygcagctcgattcatctttcccaaa

SEQ ID NO: 33128 - DNA, 50 bp, homo sapien
caacctataggagtggtagtttaatmagaatagggagcaaaatatgaaag

SEQ ID NO: 33129 - DNA, 50 bp, homo sapien
gcaggtggtgaggctttgagtatacrgcacatcatacttgtaagatacgg

SEQ ID NO: 33130 - DNA, 50 bp, homo sapien
caaacataacccaaatgacatggaakttacttgatttgtgacttacctct

SEQ ID NO: 33131 - DNA, 50 bp, homo sapien
ccttccctcattccctcaaaacagargataaagcatttcacattctcttc

SEQ ID NO: 33132 - DNA, 50 bp, homo sapien
tatatttgaagttctgtgttcatacyggagtaattattattccaatggta

SEQ ID NO: 33133 - DNA, 50 bp, homo sapien
atatttccaaatggatgaaatggacrgaccaaagtatattttgccaagat

SEQ ID NO: 33134 - DNA, 50 bp, homo sapien
aaaactattgcatatatgtttatgcrgaaagaaatttattcatagtaacg

SEQ ID NO: 33135 - DNA, 50 bp, homo sapien
acagtaacagaaaaggcaagtttaaygtcaattttctgtgtggtttcata

SEQ ID NO: 33136 - DNA, 50 bp, homo sapien
agatgataaaatctcttttccaatamggacttcaaaaataggatagatga

SEQ ID NO: 33137 - DNA, 50 bp, homo sapien
aattagccatgattggcaggacaaasgatatatgggaataaacgtgggca

SEQ ID NO: 33138 - DNA, 50 bp, homo sapien
atgactttaggagaactcctcatggycacaattctatacttcctggaatt

SEQ ID NO: 33139 - DNA, 50 bp, homo sapien
tgtgtttcttgcagaataaatctgartactcggtcaatattttaggtagt

SEQ ID NO: 33140 - DNA, 50 bp, homo sapien
acacagggcatcaaaaccatgacaamacgagagtgaagagaagtccaccg

SEQ ID NO: 33141 - DNA, 50 bp, homo sapien
ttggataacagtcctttatcagagaygtcttttggaaatattttcttcca

SEQ ID NO: 33142 - DNA, 50 bp, homo sapien
gatgggtagaatgaatacagcgaaartgacaatactgccaaaaacaatct

SEQ ID NO: 33143 - DNA, 50 bp, homo sapien
gtggatggcatgttagaatacaaaamgatactccacatcatatgtcatca

SEQ ID NO: 33144 - DNA, 50 bp, homo sapien
tatttagaactagtgctgagtgtgckctttgctactcttttattcatttt

SEQ ID NO: 33145 - DNA, 50 bp, homo sapien
tcctccaggataactctgaaccacayaatacaaacatattaaatattcac

SEQ ID NO: 33146 - DNA, 50 bp, homo sapien
aaatattgataactgtaacccatatsaataaaaaatcctctttgtggtcc

SEQ ID NO: 33147 - DNA, 50 bp, homo sapien
ctttgatggttgagaacctgcctacrgatagtaaatgatggctctgaatg

SEQ ID NO: 33148 - DNA, 50 bp, homo sapien
ttggtcttttctaaggctatgaggamatttattaatggcattcaagaaaa

SEQ ID NO: 33149 - DNA, 50 bp, homo sapien
ctgcctacggatagtaaatgatggcyctgaatgtgttttgctgcccactt

SEQ ID NO: 33150 - DNA, 50 bp, homo sapien
aattctatgccctcccctggttacayaaggacttgcatatcaggactgcc

SEQ ID NO: 33151 - DNA, 50 bp, homo sapien
aactacagagtacaatagcaaaaatmagcccttaatatgtttaatcctca

SEQ ID NO: 33152 - DNA, 50 bp, homo sapien
tcctcagaaggaaaatgctagattakatatatccaataccaaggatgaat

SEQ ID NO: 33153 - DNA, 50 bp, homo sapien
ccagggagcccaatctgagacaccaycggaacctctttgctgagtgaatt

SEQ ID NO: 33154 - DNA, 50 bp, homo sapien
aggtgatttttaaaagacctctgaayatgttttcttgggagttaatgcct

SEQ ID NO: 33155 - DNA, 50 bp, homo sapien
cacacacactctacatatgtttatargttgttatagaggtgatcatgtta

SEQ ID NO: 33156 - DNA, 50 bp, homo sapien
atgaaactaatgttcagaagagttargtaagttgttcatggccatgcggc

SEQ ID NO: 33157 - DNA, 50 bp, homo sapien
cagaggcatagactcatttttcagaytatctcaacgtgtacccctgccct

SEQ ID NO: 33158 - DNA, 50 bp, homo sapien
gcaaagaatgattcttttccaatacratgagaagcacaatgagttaaggc

SEQ ID NO: 33159 - DNA, 50 bp, homo sapien
gtaagttttcttatagaaaaaggatraaagtattgtagaagtcattccta

SEQ ID NO: 33160 - DNA, 50 bp, homo sapien
gctattcaaaccattcttttgagacrcataacctatcattaccccctttg

SEQ ID NO: 33161 - DNA, 50 bp, homo sapien
gtaaacagacaccaccatatcaatargttatcattttaatgaggcattac

SEQ ID NO: 33162 - DNA, 50 bp, homo sapien
ttagggaatgagaactcaaggaaacmgtcgtacaatagacttctgtatct

SEQ ID NO: 33163 - DNA, 50 bp, homo sapien
caaatactagaacttgaaatcgaaaygtgatgacactaataaaaatagaa

SEQ ID NO: 33164 - DNA, 50 bp, homo sapien
ttcacactgggtgtatatccaagccygcatataagactctgagtccactc

SEQ ID NO: 33165 - DNA, 50 bp, homo sapien
gcagaagcgccactaagccattgacrcagttggctatctgtccttcgggt

SEQ ID NO: 33166 - DNA, 50 bp, homo sapien
caagatgttgactgatgaagtaaacrcccgaaggacagatagccaactgc

SEQ ID NO: 33167 - DNA, 50 bp, homo sapien
gactaactttgtcagagtccttaaaraagaattattgtagtaggaatgat

SEQ ID NO: 33168 - DNA, 50 bp, homo sapien
gggctgcccaagtcctcctatttggkaataaattgaattgaaaatgaaat

SEQ ID NO: 33169 - DNA, 50 bp, homo sapien
atggtaacactgacaatagttaagayatgtcagtgatatcaagtacagtt

SEQ ID NO: 33170 - DNA, 50 bp, homo sapien
aagaaagaaagaaaaaggtagtgacrgagtttgacattgttctcaatggc

SEQ ID NO: 33171 - DNA, 50 bp, homo sapien
attaagaaattgaacatctagagaayaggagtccctaaagaagaaacgca

SEQ ID NO: 33172 - DNA, 50 bp, homo sapien
caccagttttattacaaagattgacraatcctgaatgttatgagtaattc

SEQ ID NO: 33173 - DNA, 50 bp, homo sapien
cctgagacatcaacctagaacaaccracattagataagttttaacaaaat

SEQ ID NO: 33174 - DNA, 50 bp, homo sapien
cttcatgaagctggaagaattgatayccgtagttttaggagtttcaaacc

SEQ ID NO: 33175 - DNA, 50 bp, homo sapien
tgaggttatcatatttgtatgtttgmaagctcatttaggatgccgtgaga

SEQ ID NO: 33176 - DNA, 50 bp, homo sapien
gcataaatgacaattagcggttaaartattgattgacagcagctggtgca

SEQ ID NO: 33177 - DNA, 50 bp, homo sapien
agaatctagtccatacgcttactcartaaaagtgaaaactcaggcttata

SEQ ID NO: 33178 - DNA, 50 bp, homo sapien
acctagccctttacttcacagaatargcccataatgtgtgtgttttgctt

SEQ ID NO: 33179 - DNA, 50 bp, homo sapien
tcagaaattcagggaacgcatatcartattaacctactgtgagcctcatg

SEQ ID NO: 33180 - DNA, 50 bp, homo sapien
ggacgggtgatgtgtaaaatagctgragaagtaaggatgtgaaagacaaa

SEQ ID NO: 33181 - DNA, 50 bp, homo sapien
ttctcaattctccaggctattagccrccggatttctgaaacagtagttgg

SEQ ID NO: 33182 - DNA, 50 bp, homo sapien
atcaaaattgtgtgtcctcttaatckattggactgttttcttatttatct

SEQ ID NO: 33183 - DNA, 50 bp, homo sapien
gaggaagaaagaaaaggtgtaggagkaatagtaatagaagacaagaccaa

SEQ ID NO: 33184 - DNA, 50 bp, homo sapien
caatggtatatctctggaatattccygaaaagtgttaatgaaaaccctgg

SEQ ID NO: 33185 - DNA, 50 bp, homo sapien
gagatataccattgaggatgcaagaygtgtgatcatggaggtggaatcag

SEQ ID NO: 33186 - DNA, 50 bp, homo sapien
gcccttatatggctactctgtccacrgctagtcagaaatctgttaacagg

SEQ ID NO: 33187 - DNA, 50 bp, homo sapien
tgaagtcagttacaaacaagtttaaygttagggctgttgttctcctgtta

SEQ ID NO: 33188 - DNA, 50 bp, homo sapien
agcaggtcatttggagtcataatcartaggtaatccttaacatctttata

SEQ ID NO: 33189 - DNA, 50 bp, homo sapien
tatttatgggcctgtgagcatatcaygtagtctttagctgttcctatatt

SEQ ID NO: 33190 - DNA, 50 bp, homo sapien
tcacaactcattttccctagtcaaasagtacacttgcaaaacaatctgtt

SEQ ID NO: 33191 - DNA, 50 bp, homo sapien
cattatcaccaagatgtctgttgtaraacttcctgtcttttgctttgttt

SEQ ID NO: 33192 - DNA, 50 bp, homo sapien
atgactcatctattaataatactgayctaatattttgcagctttgttgag

SEQ ID NO: 33193 - DNA, 50 bp, homo sapien
tttttctctaaaagtatttgcaaccrgctatagtgtaaaaagtgtttttt

SEQ ID NO: 33194 - DNA, 50 bp, homo sapien
atgactaggggttctgcaggaagaaratagtaacaagagaatttaggcca

SEQ ID NO: 33195 - DNA, 50 bp, homo sapien
gaaagctttatattgcccaggcttawgtaaaacaaaatactgattaattg

SEQ ID NO: 33196 - DNA, 50 bp, homo sapien
gtttatttatctatccaattagtaakgaagttgaataccattttgtatgt

SEQ ID NO: 33197 - DNA, 50 bp, homo sapien
aaatcatttcatgtgtctatgttcayactgagaaggcaacattcttaata

SEQ ID NO: 33198 - DNA, 50 bp, homo sapien
tgtctcgctcttcttggacgcaagtraaaacctggtaatagaatagaacc

SEQ ID NO: 33199 - DNA, 50 bp, homo sapien
aggcacaatggctacattcaaaggayactatttacaccaaatacttttca

SEQ ID NO: 33200 - DNA, 50 bp, homo sapien
tttataaactctcccataaattgtcraaaatacagagaaaactcattaga

SEQ ID NO: 33201 - DNA, 50 bp, homo sapien
atatctgtgtcttcttacttcagaayctactcattagaaagctttgcatc

SEQ ID NO: 33202 - DNA, 50 bp, homo sapien
gggaaagctacagggaggagcaagawtcctaaattgatggagtaattacc

SEQ ID NO: 33203 - DNA, 50 bp, homo sapien
ctttagctgaattgaccaaatctaaygcatattctagaagccagctaaga

SEQ ID NO: 33204 - DNA, 50 bp, homo sapien
aatggactcttgttaaagagacataygttaatgccatgtttatcagagtt

SEQ ID NO: 33205 - DNA, 50 bp, homo sapien
aaggctagcagcaagttagctgtgcrgaggcaagttgcaaagctcatttc

SEQ ID NO: 33206 - DNA, 50 bp, homo sapien
gaaatttattcttagtagcctttcayagagttttctgctataatctcagt

SEQ ID NO: 33207 - DNA, 50 bp, homo sapien
tgtattgacattttgaacagtcgacrctttccttgctagtcccttaccca

SEQ ID NO: 33208 - DNA, 50 bp, homo sapien
gttggtcacacctcctaaaataatasataaattgggaccagatgacaaag

SEQ ID NO: 33209 - DNA, 50 bp, homo sapien
tcttatttttaaccattgcagactargatttgcaagacaattagaaccaa

SEQ ID NO: 33210 - DNA, 50 bp, homo sapien
tcctggaatgaaacccagagaaataygtcaaggaatcagaagaaataata

SEQ ID NO: 33211 - DNA, 50 bp, homo sapien
tgacgaagaatgtccaattatccacmgtaaaatttggaaaacaccatgaa

SEQ ID NO: 33212 - DNA, 50 bp, homo sapien
attaaaaagtcctcctaatgattaarcgctctttttttgtttgaattaat

SEQ ID NO: 33213 - DNA, 50 bp, homo sapien
acagagtagattatttccttattatyaactaggtgaccttccagaatcta

SEQ ID NO: 33214 - DNA, 50 bp, homo sapien
agctaaactactcagttacaagatgragacacagcccagcaatgggacca

SEQ ID NO: 33215 - DNA, 50 bp, homo sapien
gttcagttgtcaaagctaactaaaamtttggatattatccaacactttat

SEQ ID NO: 33216 - DNA, 50 bp, homo sapien
ttttccaaagcccgcataagagataycataatctaacattaacatcttgc

SEQ ID NO: 33217 - DNA, 50 bp, homo sapien
aaaaatgtattgtgccacagtgaaartggtgtacaatgaaatgggagcat

SEQ ID NO: 33218 - DNA, 50 bp, homo sapien
gatttgttttactttttgccttctcrctcttcctagagggtcgccatcgg

SEQ ID NO: 33219 - DNA, 50 bp, homo sapien
actactggggttgctaatctacttcyatatttcctccacgtgaaatttta

SEQ ID NO: 33220 - DNA, 50 bp, homo sapien
gtacattgagattatgaaagacattyaataaacagttctgaatgggtaac

SEQ ID NO: 33221 - DNA, 50 bp, homo sapien
taaaaaaaaaatctcagtaagaaaasagaatttaaatgaccacaaatagg

SEQ ID NO: 33222 - DNA, 50 bp, homo sapien
tagtaacattcaagcaaataatagcrcaactttttaatgatagtagattt

SEQ ID NO: 33223 - DNA, 50 bp, homo sapien
ctcaaaaagcatttgttgagtagcayatcttaagaggtattcacttgaat

SEQ ID NO: 33224 - DNA, 50 bp, homo sapien
ttcaaggtgtttatggacctcttgawatctatagaaaagacaccttgggt

SEQ ID NO: 33225 - DNA, 50 bp, homo sapien
ttcattcttcttccacaagattctasagacacagaaacaagtcaaacaag

SEQ ID NO: 33226 - DNA, 50 bp, homo sapien
caactgaggctttgagtagtggagtsaatttctcaaagcacttgttttgc

SEQ ID NO: 33227 - DNA, 50 bp, homo sapien
acaggcaggaacagccagactttgaygaggcattgaaaatttgaggcctc

SEQ ID NO: 33228 - DNA, 50 bp, homo sapien
ctgggggcatcttcttgaatctgtaygtacttaaaggagagcattgtgag

SEQ ID NO: 33229 - DNA, 50 bp, homo sapien
acaggaaaaaatgtcatggagaacarggtagtgtcagggatggattgaaa

SEQ ID NO: 33230 - DNA, 50 bp, homo sapien
gagaatatgtgaccatcatttgccgyattttcccatcctgctcacatttt

SEQ ID NO: 33231 - DNA, 50 bp, homo sapien
tggggataggtgtagactatggctaygaaaattctagtgcgattaattta

SEQ ID NO: 33232 - DNA, 50 bp, homo sapien
attcattctcataagcagtgatttcsctgtgattagctcattaagtatat

SEQ ID NO: 33233 - DNA, 50 bp, homo sapien
tctgacctttcacctgtgttgcctayacttagcttttccttttaactttt

SEQ ID NO: 33234 - DNA, 50 bp, homo sapien
tcttaccatagtgctcatgttcttcragtctggtatcagcaatctcctct

SEQ ID NO: 33235 - DNA, 50 bp, homo sapien
gggaaaacaaaaataaatagaactakggggtactgtggagcactctggta

SEQ ID NO: 33236 - DNA, 50 bp, homo sapien
tgtgtcaaaaggacaatccttgttakacacctaagtatgagtcgtgaaag

SEQ ID NO: 33237 - DNA, 50 bp, homo sapien
gcaatcaatagtagtctggaaggaartacaacaaactaattaagttatct

SEQ ID NO: 33238 - DNA, 50 bp, homo sapien
cccggccaccctcaaactttaatgayaactaaaccatgtgtcaaaacaca

SEQ ID NO: 33239 - DNA, 50 bp, homo sapien
ccggggctttttccaggtcctgaaaytagaccagagattacctttattat

SEQ ID NO: 33240 - DNA, 50 bp, homo sapien
aaagggcccttactgaggatgatcartacgcataaagctatagaaaactg

SEQ ID NO: 33241 - DNA, 50 bp, homo sapien
aatgcctgtttaagtcatagccctgmaaactatacttctatatagtttcc

SEQ ID NO: 33242 - DNA, 50 bp, homo sapien
tgtctttggtgttgaacaaaggttgyaaaagtaatgagataatatgagaa

SEQ ID NO: 33243 - DNA, 50 bp, homo sapien
agagtctatgaccccagtaggttagraaccagtatccttggtcattttct

SEQ ID NO: 33244 - DNA, 50 bp, homo sapien
gctgtatcactcagccattattgtayagtaaccacaaaatctcaaaggaa

SEQ ID NO: 33245 - DNA, 50 bp, homo sapien
tgcagatgaacaggctgcagaagaaytcagtgtacttaatgagcatttaa

SEQ ID NO: 33246 - DNA, 50 bp, homo sapien
aggaaaatttatagcattgaaggcayatattggaaaagaagaaagaacta

SEQ ID NO: 33247 - DNA, 50 bp, homo sapien
tccacctacgcatctatgttcctaaygaatagtttgccagccttttctta

SEQ ID NO: 33248 - DNA, 50 bp, homo sapien
tttaaggaaggtgataatatgaaaartgattagactgtaagattcacaag

SEQ ID NO: 33249 - DNA, 50 bp, homo sapien
agctcacatggaatattttctaagaragaccacattttggggcataaaac

SEQ ID NO: 33250 - DNA, 50 bp, homo sapien
gagagaggacatgtgagtttaaatcrgaataaagggtccagctgagggac

SEQ ID NO: 33251 - DNA, 50 bp, homo sapien
cagccatccccacaactgctttgaargacataggattaattttacagtca

SEQ ID NO: 33252 - DNA, 50 bp, homo sapien
agtccaataacctggagtaggtgaargttatgaaagttgtcaagcactct

SEQ ID NO: 33253 - DNA, 50 bp, homo sapien
tcattcccagagaggtggtacacatyaagatctatgctacatataaggag

SEQ ID NO: 33254 - DNA, 50 bp, homo sapien
gagtgaaggagaagagaagagagccygaaactaaacagggaggaatccac

SEQ ID NO: 33255 - DNA, 50 bp, homo sapien
tacatttccttctataaccaaaaagragaagcctcatgcccatcagctct

SEQ ID NO: 33256 - DNA, 50 bp, homo sapien
atgagtagggcgtagtgaggcttaaratactgactgctcatcttcttgtc

SEQ ID NO: 33257 - DNA, 50 bp, homo sapien
aaaaggtttatatcatatttttaaartggcttgcttgagaaattggaagt

SEQ ID NO: 33258 - DNA, 50 bp, homo sapien
agttacctcccttctctttagtcacygtaatgagtaagtttcttttgttt

SEQ ID NO: 33259 - DNA, 50 bp, homo sapien
gttgaatgaggtagagtagggtcaargagccaggtcttctgccttcaaac

SEQ ID NO: 33260 - DNA, 50 bp, homo sapien
cctcctgccactcttaccagttcaaygacttaaatctatactacgtgtca

SEQ ID NO: 33261 - DNA, 50 bp, homo sapien
ctttcatgatcccacagtctagctayccaaaaaattaaaaactaacctca

SEQ ID NO: 33262 - DNA, 50 bp, homo sapien
gtattttctgatatattttgggcaawaaaagagaaagacatgaatggaaa

SEQ ID NO: 33263 - DNA, 50 bp, homo sapien
gtctataaagaaaggactacattacyagcttaaaaattagctttctataa

SEQ ID NO: 33264 - DNA, 50 bp, homo sapien
aaaaaaaagaaatccttatttgccamaagttgcatatgcatagggttata

SEQ ID NO: 33265 - DNA, 50 bp, homo sapien
tacctaattctgttctggatgactgrcacccaaagtggtgttttttgaca

SEQ ID NO: 33266 - DNA, 50 bp, homo sapien
atggttaaaaaatcatgataccataygaaagaccttgtaatcatcacaga

SEQ ID NO: 33267 - DNA, 50 bp, homo sapien
ggacactccttccttttctgtccatwaaaatgcggcccaaggccgggcac

SEQ ID NO: 33268 - DNA, 50 bp, homo sapien
aaggtagttattggtattgaaataawtgcagatctcagtaagtcccagct

SEQ ID NO: 33269 - DNA, 50 bp, homo sapien
aaacaaattctgaagttgaaaggtgyaatgactgaaatgaaaattttact

SEQ ID NO: 33270 - DNA, 50 bp, homo sapien
ggcatctccatgttatgcacttaacmgtatctagaagacagttgattttt

SEQ ID NO: 33271 - DNA, 50 bp, homo sapien
actatgaaacaaagaaaccaagcacrgaaagctaaatatccagataaact

SEQ ID NO: 33272 - DNA, 50 bp, homo sapien
ttcccaaaaaaaatttgacataagaytaagacctgtaaaggcaggtctgg

SEQ ID NO: 33273 - DNA, 50 bp, homo sapien
gccacatctttatgataaaggacacygtgaatgtaaaatgttcagaatat

SEQ ID NO: 33274 - DNA, 50 bp, homo sapien
tgcagagaactgtgtaaaagaactawaaactttgtgtaatatttcttggt

SEQ ID NO: 33275 - DNA, 50 bp, homo sapien
acgtttagctattggtggagatcaaraccttaaaaatgcaagtgtaaaag

SEQ ID NO: 33276 - DNA, 32 bp, homo sapien
tgtaagtagagaatcaycaatagacatgaaaa

SEQ ID NO: 33277 - DNA, 50 bp, homo sapien
taaatcagaaaaaataacacttggaracggatggtcacaaggaatttaaa

SEQ ID NO: 33278 - DNA, 50 bp, homo sapien
atgcagacctctgacttacttacttyaagggattaatcagaggtgagaaa

SEQ ID NO: 33279 - DNA, 50 bp, homo sapien
gtttcctgtaaagaaaagcctaccawcagggacaccttagtttgtaaacc

SEQ ID NO: 33280 - DNA, 50 bp, homo sapien
tgactcaagagattttaaaaattcaygccttttgagaataatgcacattg

SEQ ID NO: 33281 - DNA, 50 bp, homo sapien
tatgacttgggagtttgaaaatcggragccgttttttgtgtgaatattag

SEQ ID NO: 33282 - DNA, 50 bp, homo sapien
ggcagttcgggcccagacttagtaartagataaaaatgattagcatatct

SEQ ID NO: 33283 - DNA, 50 bp, homo sapien
acacctttatgatttacaagctctaygattaagtattgaagatgtgatag

SEQ ID NO: 33284 - DNA, 50 bp, homo sapien
gataagatgtaaagcaattgagaaayaaggagataattcaatgtgattac

SEQ ID NO: 33285 - DNA, 50 bp, homo sapien
tatttctcaattgctttacatcttaycttttcctcagctctgctctgaaa

SEQ ID NO: 33286 - DNA, 50 bp, homo sapien
gtgccactaacaaagaccactattayaggttagaagaagatgccatcctt

SEQ ID NO: 33287 - DNA, 50 bp, homo sapien
tctctgctgcataaattatttagaaktgtgtagtgtaatttccaataatt

SEQ ID NO: 33288 - DNA, 50 bp, homo sapien
ttctggggagtggtgggtaaacagaragagagaacgctttttttaaggaa

SEQ ID NO: 33289 - DNA, 50 bp, homo sapien
ttttttaaggaaagaaaaagtagaargataatagcacatatcataaaatc

SEQ ID NO: 33290 - DNA, 50 bp, homo sapien
ctctgaatgaacagcatcagcataaygtgggatcttgttagaaaggcaaa

SEQ ID NO: 33291 - DNA, 50 bp, homo sapien
tttaacttgagcttaagcaacttaamattgagttataaaagcaatattgt

SEQ ID NO: 33292 - DNA, 50 bp, homo sapien
ccattaaactcagttgttttcatacyggtatctgtgcaacatccgccctt

SEQ ID NO: 33293 - DNA, 50 bp, homo sapien
aaaagttcattatttacacttcacasatttactttttttaagatctggct

SEQ ID NO: 33294 - DNA, 50 bp, homo sapien
tttaaacatgaaatctgaaagttatwacactgagttcaacaaaaacttga

SEQ ID NO: 33295 - DNA, 50 bp, homo sapien
gaaactgaatctcagagaactgtgcratcgtgctttttgtctcctagtcc

SEQ ID NO: 33296 - DNA, 50 bp, homo sapien
aatgtatttattttaaaaattattaracactgataagagactaagaatga

SEQ ID NO: 33297 - DNA, 50 bp, homo sapien
aagtgaagaaaaaagtgatggccacmattatgctacaaacaatgctgtaa

SEQ ID NO: 33298 - DNA, 50 bp, homo sapien
tttagcttcctttaattacttctaawgactgcgatttatcacacaaggaa

SEQ ID NO: 33299 - DNA, 50 bp, homo sapien
ggtaaaagggtcaaagtatcctgaaygaagactgcttttaaatagtaaga

SEQ ID NO: 33300 - DNA, 50 bp, homo sapien
tagtttttgatttatagtttttacaktattctgatcaataaaatgaaagc

SEQ ID NO: 33301 - DNA, 50 bp, homo sapien
cccagctcttacctttacctacctargtccaatctaaagtttccgacttt

SEQ ID NO: 33302 - DNA, 50 bp, homo sapien
ccttgctagggaagtctctgtccacraatagttatgcctgaagcatttta

SEQ ID NO: 33303 - DNA, 50 bp, homo sapien
ggaaaagtaattacctgaggagttgwattattggttcccaacctttaaat

SEQ ID NO: 33304 - DNA, 50 bp, homo sapien
taggaaaaaaggtaatattaaaatcsaaagttcccacatttgtgaaataa

SEQ ID NO: 33305 - DNA, 50 bp, homo sapien
aaggaattttctaacagtgtgatacmatggctcttggatacatttggaga

SEQ ID NO: 33306 - DNA, 50 bp, homo sapien
tgtcctgttggctgacaggggcacckaattccatccttagggaaaactat

SEQ ID NO: 33307 - DNA, 50 bp, homo sapien
aacaagcaaaagctcaactgttacasagagaaaggaaagtcaaaggccta

SEQ ID NO: 33308 - DNA, 50 bp, homo sapien
aatgctatagtttgtaattctttcakacattgcacagccccaagttccac

SEQ ID NO: 33309 - DNA, 50 bp, homo sapien
cacagggaaagtgatcaatgaaaagkccaaaagtttacatttatctcctc

SEQ ID NO: 33310 - DNA, 50 bp, homo sapien
ggctctcttccatgtctgactgacayagtgtttttctcttgcctccttgc

SEQ ID NO: 33311 - DNA, 50 bp, homo sapien
agtgctgtgtaaagcatgtgaccagwaaacaagtgctgaagcttctgcac

SEQ ID NO: 33312 - DNA, 50 bp, homo sapien
tttttgggttttagtgttaaaagaaycttagaaccatctaattcaggagt

SEQ ID NO: 33313 - DNA, 50 bp, homo sapien
tacatatactttgaaagtgctcaaarcgaatttatgggataatgggaggt

SEQ ID NO: 33314 - DNA, 50 bp, homo sapien
aagaaacaaaaacactggacgctaaygctataaagactgaagacgtaata

SEQ ID NO: 33315 - DNA, 50 bp, homo sapien
agagctagaagcaggtctaaaatgarcatctggtaccatacaggttgacg

SEQ ID NO: 33316 - DNA, 50 bp, homo sapien
ttatttgtacctcaatatctgtacamatagttccctgtcctgaccctcct

SEQ ID NO: 33317 - DNA, 50 bp, homo sapien
caagcggaccttaaaatctccatctsactttgacactatcacgaagtgtg

SEQ ID NO: 33318 - DNA, 50 bp, homo sapien
aaatagggattgtaacaggactagargaagccaggtgactaatgtggaaa

SEQ ID NO: 33319 - DNA, 50 bp, homo sapien
tgaaaactgcattccatgaataagaraactggaaataatcaaagaactat

SEQ ID NO: 33320 - DNA, 50 bp, homo sapien
gacattggaatgtatcaattctaacyacatacctgtcttaacaaagctta

SEQ ID NO: 33321 - DNA, 50 bp, homo sapien
aataataaacctgtgaaattcagtaracctagttcgctccatttagcctt

SEQ ID NO: 33322 - DNA, 50 bp, homo sapien
catcatcctcatagagcctcaaaaawtaaacaattcaatagattagtaga

SEQ ID NO: 33323 - DNA, 50 bp, homo sapien
tctaaaaatgtgaactatacacagarcatttgtatcctgaatctccacca

SEQ ID NO: 33324 - DNA, 50 bp, homo sapien
aaggaaggggcctattatataagtargaaggtgcatatgggaaaacttgt

SEQ ID NO: 33325 - DNA, 50 bp, homo sapien
aattggagtaaagaatatcccaaaargagccttggtaaacatcccatact

SEQ ID NO: 33326 - DNA, 50 bp, homo sapien
ttactggaaggataggaaactaagarcactagaaactatcctactcatca

SEQ ID NO: 33327 - DNA, 50 bp, homo sapien
ctcttcatctgattcatctgagggtraagctctttttctgctggaaccct

SEQ ID NO: 33328 - DNA, 50 bp, homo sapien
atatttatggtgttacctcacatcartatctagaaaaatggttttactta

SEQ ID NO: 33329 - DNA, 50 bp, homo sapien
gtgaaaatggggtaccttggaaatasctacattagtttatctgcatgttt

SEQ ID NO: 33330 - DNA, 50 bp, homo sapien
gtaatagatgatgtgttggactgacractgactaaatggtccattgacat

SEQ ID NO: 33331 - DNA, 50 bp, homo sapien
atccagggccctagtaaagtacccartcatctcttggtaccccacacttt

SEQ ID NO: 33332 - DNA, 50 bp, homo sapien
gacctcatagagttcattcctacaayatcccaacccactgcttagacaag

SEQ ID NO: 33333 - DNA, 50 bp, homo sapien
aaccattgatttatttgattggtaaygcatcagatttatttggtttcttt

SEQ ID NO: 33334 - DNA, 50 bp, homo sapien
taggaatgaactctatgaggtcccartacagtgagaagccttggagtgac

SEQ ID NO: 33335 - DNA, 50 bp, homo sapien
aattacacgtgccagtccaagcatasagttatcctaaatctatctaatgt

SEQ ID NO: 33336 - DNA, 50 bp, homo sapien
gagatgccaagacactgctgtgttawgaagttgaatcatgaatttgaatg

SEQ ID NO: 33337 - DNA, 50 bp, homo sapien
aatactggtcctagaggatgaagaamaatttggaaggttgaaggtggcct

SEQ ID NO: 33338 - DNA, 50 bp, homo sapien
agttcctatgatctcagttcaactckccgtctcaaaacttctctaaattg

SEQ ID NO: 33339 - DNA, 50 bp, homo sapien
ttgtattcctgcttaatttttagacycatttggaagcagtgcatttttat

SEQ ID NO: 33340 - DNA, 50 bp, homo sapien
ccaaatgagagaatagccaattgccrgaaaacacaataagcagctgaatt

SEQ ID NO: 33341 - DNA, 50 bp, homo sapien
agctttctctttcgttaatgcaaacratttccttctcagctttttcttct

SEQ ID NO: 33342 - DNA, 50 bp, homo sapien
cactagggtttcaacaattcccacaktactttattgtgtagtatcctcta

SEQ ID NO: 33343 - DNA, 50 bp, homo sapien
ttttctggaaggtataactgacttayggaggctgcctaagagtcatataa

SEQ ID NO: 33344 - DNA, 50 bp, homo sapien
gagaaagaagtagacagtagacaaarttgttgttcaaagtataatcaaga

SEQ ID NO: 33345 - DNA, 50 bp, homo sapien
acttcgcatagcaaggccgtgttagsaatgtagcacaggccgagctactc

SEQ ID NO: 33346 - DNA, 50 bp, homo sapien
tttgcaacatgttaagtcatggatgmaagtaggtgacatccttcccagtg

SEQ ID NO: 33347 - DNA, 50 bp, homo sapien
gtccagaaagatgagcctgactccamgtagggccccagtttaaagtatag

SEQ ID NO: 33348 - DNA, 50 bp, homo sapien
attttacatttgtagataagtttccraagtgtttgtagaaatactttcag

SEQ ID NO: 33349 - DNA, 50 bp, homo sapien
ctattgctactactactactattacygccattagtattataggtgttaga

SEQ ID NO: 33350 - DNA, 50 bp, homo sapien
gtccttaataaataaagaaacaccaytaggataagctgcagagagattaa

SEQ ID NO: 33351 - DNA, 50 bp, homo sapien
caaaatgctgctttaattattttccrctcattcctttcttatactcggta

SEQ ID NO: 33352 - DNA, 50 bp, homo sapien
tgcagatatgattttgttaattgtcyatatctaactatctcttgtctttg

SEQ ID NO: 33353 - DNA, 50 bp, homo sapien
atactatttggctagagtcagattgraacactctcgacagtgtcttctta

SEQ ID NO: 33354 - DNA, 50 bp, homo sapien
ctcaatgcagactttttactaagtcrgaatttatgatcactcaaaataaa

SEQ ID NO: 33355 - DNA, 50 bp, homo sapien
tctaactctgcatagacagggtctarattttgttaacccaaatgtataac

SEQ ID NO: 33356 - DNA, 50 bp, homo sapien
tattaatgttattatgactacaaccyaactaataaggaatggaccatttc

SEQ ID NO: 33357 - DNA, 50 bp, homo sapien
aaaggtgttctaccaacacaataatragagctaaagtactgagcaaatgt

SEQ ID NO: 33358 - DNA, 50 bp, homo sapien
agtcaattcaatttgcctaattgacraaattttccattgcagggtaaata

SEQ ID NO: 33359 - DNA, 50 bp, homo sapien
aaagaaacagtcgtgcaaaaataacracatattgctctatgtgcaaaagg

SEQ ID NO: 33360 - DNA, 50 bp, homo sapien
aactgagaggatcactggtttcataraatgcatggtaaaatataactgaa

SEQ ID NO: 33361 - DNA, 50 bp, homo sapien
aatacaactaactatggaagtgaaakatgtctacaaccagaattacaaaa

SEQ ID NO: 33362 - DNA, 50 bp, homo sapien
gggaattaatttttccatctaattaygacctccttcgccacttacagtat

SEQ ID NO: 33363 - DNA, 50 bp, homo sapien
tcatgaatgtttaatttttttagcaycatttattgaaaaaaccatgcatg

SEQ ID NO: 33364 - DNA, 50 bp, homo sapien
gccaaccaggaggacaggagtgttcsaatttacagagtaggccatgcaac

SEQ ID NO: 33365 - DNA, 50 bp, homo sapien
gtgtcacttgaactccagagttctamagtcgcgtgatgtacatgagtcca

SEQ ID NO: 33366 - DNA, 32 bp, homo sapien
actgactagaataatayaaacctggagctgtc

SEQ ID NO: 33367 - DNA, 50 bp, homo sapien
aatttttttctttgcatatgccaaaytgaattctgtcacaaccaaaaaag

SEQ ID NO: 33368 - DNA, 50 bp, homo sapien
cagccccaggaaattaagacagccaycatttagtaaacactaagacatgg

SEQ ID NO: 33369 - DNA, 50 bp, homo sapien
agaataaactgttacattcatttaawataaacgcatgtataatatcacat

SEQ ID NO: 33370 - DNA, 50 bp, homo sapien
ttcatctgactctaataaaagaaacygcaaatcttcatacttttaaaagt

SEQ ID NO: 33371 - DNA, 50 bp, homo sapien
tcttcttaatttaactatggcactaygaaaatattttgcatcagatataa

SEQ ID NO: 33372 - DNA, 50 bp, homo sapien
ctctcatcctgtgttagggatattckgaactaattagagttctgtaactt

SEQ ID NO: 33373 - DNA, 50 bp, homo sapien
atctctgtcactgaggtagttcgcaracattttactaagtcttcagtagg

SEQ ID NO: 33374 - DNA, 50 bp, homo sapien
tgcatagtgtactaatgatagggtarctgaacatgaaaaaaggtgtgcaa

SEQ ID NO: 33375 - DNA, 50 bp, homo sapien
aagacactagggtgtgattccaacarctttgactccgtttaggagccggt

SEQ ID NO: 33376 - DNA, 50 bp, homo sapien
cagtatttttcatgctgctttcatayccattagtgggccataaaactgat

SEQ ID NO: 33377 - DNA, 50 bp, homo sapien
gaatttaagaactccttcaaactacrgaaaatcaactgaatgaacgaaaa

SEQ ID NO: 33378 - DNA, 50 bp, homo sapien
agtaaatctcatactaaatgctaatragccaaggttctccttcctttccc

SEQ ID NO: 33379 - DNA, 50 bp, homo sapien
atccactgaaagaatgaatctggtcyaagtgttcctacagtgctgggatc

SEQ ID NO: 33380 - DNA, 50 bp, homo sapien
atcttcaaaattataaatagattacrgagatttagaactggttataattt

SEQ ID NO: 33381 - DNA, 50 bp, homo sapien
gtaagtgttactgttgttatctataygcattcttttatgagtagcttcat

SEQ ID NO: 33382 - DNA, 50 bp, homo sapien
tgtaacacatttcaatattactatargaaataactgagacaacctatttt

SEQ ID NO: 33383 - DNA, 50 bp, homo sapien
atcagtcattaaagaagcatgtaaaktacctgacgctagtatgagacttt

SEQ ID NO: 33384 - DNA, 50 bp, homo sapien
cctcagagtatttttatactgcctaragttctttggagaaagacaaaatg

SEQ ID NO: 33385 - DNA, 50 bp, homo sapien
ccttgtgagttaagcgtaggatccaygggtgttggagttatcagctactt

SEQ ID NO: 33386 - DNA, 50 bp, homo sapien
ttggagttatcagctacttggagatyaggaaagggaagttctattaggga

SEQ ID NO: 33387 - DNA, 50 bp, homo sapien
caatgtaagggctaaaaacaagaaasgcatgggatgtattctttggttat

SEQ ID NO: 33388 - DNA, 50 bp, homo sapien
tgtacatcctgatcttgtggactaartaccttcttgtgtatcagttccca

SEQ ID NO: 33389 - DNA, 50 bp, homo sapien
ttactggagtttgcaacttggagaartataatcattcacctgtgaaaatt

SEQ ID NO: 33390 - DNA, 50 bp, homo sapien
ttcaaaattagttgttaccaagtacrgggtcatatttcaagagtttaagt

SEQ ID NO: 33391 - DNA, 50 bp, homo sapien
agcttatttagatcttatgttagaaragaatatctgattctgaaaattga

SEQ ID NO: 33392 - DNA, 50 bp, homo sapien
tagtaactaatggtcaacttcaaaayatagtttatatcagaaaaagggaa

SEQ ID NO: 33393 - DNA, 50 bp, homo sapien
aagaactgaggggaagggaacattcyagttagaggaaatattgtgcacca

SEQ ID NO: 33394 - DNA, 50 bp, homo sapien
gatgatttcagcagcatcttaaaaaytagtgaattcttcctacccaggtg

SEQ ID NO: 33395 - DNA, 50 bp, homo sapien
agaatatctccccttgccatgaagcratacttaatgtcttgaacagtgag

SEQ ID NO: 33396 - DNA, 50 bp, homo sapien
attaaaaagttgtcctcctcgtaagycaaattatttcattcaagtttcat

SEQ ID NO: 33397 - DNA, 50 bp, homo sapien
aggcttctacctactgtttatttaayggcttacatcctcttaagatgtat

SEQ ID NO: 33398 - DNA, 50 bp, homo sapien
aggtgacttcctctttcctaggttaygggcatcttgaaggcaggagccac

SEQ ID NO: 33399 - DNA, 50 bp, homo sapien
tcacatttttccatttgtctctcagraacatatatgactttgtataatgg

SEQ ID NO: 33400 - DNA, 50 bp, homo sapien
cttctcttaactgtaaagctgtctgmataactccctcttatctatgtagt

SEQ ID NO: 33401 - DNA, 50 bp, homo sapien
acaatcttgactaaagcctataacakactgtctaatagaaatgcaatatg

SEQ ID NO: 33402 - DNA, 50 bp, homo sapien
tgaagaagtgctaaatgtttgatgargtggcactgaagattgtacacctt

SEQ ID NO: 33403 - DNA, 50 bp, homo sapien
attccatagtggaatactattacacygcggaatatatatcacattttctt

SEQ ID NO: 33404 - DNA, 50 bp, homo sapien
agagagcatttctcatacagtcttayggatttcagcacaggtattatgag

SEQ ID NO: 33405 - DNA, 50 bp, homo sapien
gaagtcgtttgtgagaacgaaggagraagataacaactccgtcttcagaa

SEQ ID NO: 33406 - DNA, 50 bp, homo sapien
aatgtgtgagaatcactgggataagratgagccctcagcatctctaaatg

SEQ ID NO: 33407 - DNA, 50 bp, homo sapien
attgtattttcctatcaggtaatacrcatccagcgagaatccataatagg

SEQ ID NO: 33408 - DNA, 50 bp, homo sapien
caacagagatggtgctaacaaatgaygtgagacacagatcagtgacctct

SEQ ID NO: 33409 - DNA, 50 bp, homo sapien
taccagtgagttttctatcttcacaygattacttattattcattaacagc

SEQ ID NO: 33410 - DNA, 50 bp, homo sapien
gatctttgcttattttcacataatawatccaaatgtatgtaatattatgc

SEQ ID NO: 33411 - DNA, 50 bp, homo sapien
agcagctgccttccgtccaaaaccaygtaagagtcagcaaacacttttac

SEQ ID NO: 33412 - DNA, 50 bp, homo sapien
tttgttgtgttaattttctcttcccrctggacaaccaaatgtcaaaatca

SEQ ID NO: 33413 - DNA, 32 bp, homo sapien
aacaaaacaaaagtcaygggcctactgaccac

SEQ ID NO: 33414 - DNA, 50 bp, homo sapien
gccagccccatcctagatgtttagcrcgtattatttcatgtagctctggc

SEQ ID NO: 33415 - DNA, 50 bp, homo sapien
atattgcatgtatgcttatttctgarctattactaatgcagttttttatt

SEQ ID NO: 33416 - DNA, 50 bp, homo sapien
atacaaattattctcagggtgctcaragaagccatcagaaaaatttgggt

SEQ ID NO: 33417 - DNA, 50 bp, homo sapien
actatcaaatccctagtgtctaaaaytaaaactaagataccttgaatcca

SEQ ID NO: 33418 - DNA, 50 bp, homo sapien
tgatttttctgtataaggtagaattraaccagggccaattgtatcactgt

SEQ ID NO: 33419 - DNA, 50 bp, homo sapien
caacaagtagtgttagcatattacawaaaccatgatttcatggtcaagaa

SEQ ID NO: 33420 - DNA, 50 bp, homo sapien
gagcaccttttaacacttctgatgaygatttatatgtcttctttggaaga

SEQ ID NO: 33421 - DNA, 50 bp, homo sapien
aaaatgacatgttaaatattgcaaakgataatctatctatctatcatcta

SEQ ID NO: 33422 - DNA, 50 bp, homo sapien
atcggtggtgaaatatacaatcaggrcctacatttttttaaaaaaatata

SEQ ID NO: 33423 - DNA, 50 bp, homo sapien
ggctttgtttctatggccgtatgcaygtcttttggcaggttttatattga

SEQ ID NO: 33424 - DNA, 50 bp, homo sapien
ttttccttctctctcaggaataccartcactcacaggtttggtcacttta

SEQ ID NO: 33425 - DNA, 50 bp, homo sapien
gccaagggaagaaccagaaagtagaycaccatttgagggaagacagagga

SEQ ID NO: 33426 - DNA, 50 bp, homo sapien
tggcacataggctcccagaaatctayaactctccaggcacacaggcaaaa

SEQ ID NO: 33427 - DNA, 50 bp, homo sapien
tcctaaagatagatttatttaaaaayatgcatgagttgagatctaaaggg

SEQ ID NO: 33428 - DNA, 50 bp, homo sapien
tactaaaacattcagttagtattcamatttccctgtttggctcataaatg

SEQ ID NO: 33429 - DNA, 50 bp, homo sapien
gactttgtccctcaactcataagcargattattcccactaggcaggatcg

SEQ ID NO: 33430 - DNA, 50 bp, homo sapien
tcatagcctagtaacaacgccagaawaattttgagaccaaaggaaagttc

SEQ ID NO: 33431 - DNA, 50 bp, homo sapien
ttagtttgatggagaaatttacaacsgtcagtcaagtcatttactaaaat

SEQ ID NO: 33432 - DNA, 50 bp, homo sapien
aaatccattgtgaatacttgaactawgtgttaaaatattcctgagcatag

SEQ ID NO: 33433 - DNA, 50 bp, homo sapien
ggtcaatacttagcaattcctaaaamgcaatgtaacacagtagaaaattc

SEQ ID NO: 33434 - DNA, 50 bp, homo sapien
aaagaggaagcacttcctgtaaaaawtaacttgatactagaaaggaattt

SEQ ID NO: 33435 - DNA, 50 bp, homo sapien
tctctaaccagggaattggttacagractcctatggataacaaaatttat

SEQ ID NO: 33436 - DNA, 50 bp, homo sapien
gaatcaggaacaaacatttcagagaytaaagaagaaaagtttcttggaat

SEQ ID NO: 33437 - DNA, 50 bp, homo sapien
cacctcctgttttcatcatcaagaamttctcaataggcctcatttccccc

SEQ ID NO: 33438 - DNA, 50 bp, homo sapien
agcatttactgagaacacttataaaycagaatggcattgtcaaagtgagg

SEQ ID NO: 33439 - DNA, 50 bp, homo sapien
tgaatttcatttcaggccttataccyagctaattatgagaagaaaaagac

SEQ ID NO: 33440 - DNA, 50 bp, homo sapien
tttccacttgtgcttcaaaggtaggratctctttaatgagttaacatttc

SEQ ID NO: 33441 - DNA, 50 bp, homo sapien
tgaaggatattaaacattttctggayctattccaaaccctcaatatagca

SEQ ID NO: 33442 - DNA, 50 bp, homo sapien
caacttaacttcgttgtactttgaargctgataacaggaggctttttttt

SEQ ID NO: 33443 - DNA, 50 bp, homo sapien
acacaatcaatttttggtgtaatacraaagacataattacctgaaaaggg

SEQ ID NO: 33444 - DNA, 50 bp, homo sapien
ataattctacaaccttagctagtaartccctgtcactcctttccagtcct

SEQ ID NO: 33445 - DNA, 50 bp, homo sapien
gcccaagctgactaatgcaccataartagaaattgtagatcagtattcat

SEQ ID NO: 33446 - DNA, 50 bp, homo sapien
tgtgtccttcaaatggctactgggastatgataattaaaacatttaaaat

SEQ ID NO: 33447 - DNA, 50 bp, homo sapien
tagaggtgaaatcaaatggttgaaasgaaccctgctttgatcactttttg

SEQ ID NO: 33448 - DNA, 50 bp, homo sapien
gcctagaactacttacattatattasgaaatgtctcactaagtgcatatg

SEQ ID NO: 33449 - DNA, 50 bp, homo sapien
cacggaagtttccaagtgttatttaratgttgtaggtacaatgcgataga

SEQ ID NO: 33450 - DNA, 50 bp, homo sapien
acagagcatagtgcttgagagcttaraatgctgagactatcttggtccta

SEQ ID NO: 33451 - DNA, 50 bp, homo sapien
cccctgattctgacacagtaacgtayatttttttcaaataggtttcgacc

SEQ ID NO: 33452 - DNA, 50 bp, homo sapien
tgaaagaataaagattggatggatamcagcaggacagcaacttactttat

SEQ ID NO: 33453 - DNA, 50 bp, homo sapien
caactttgtatccagtatcaacttawaaggcaacagtaacatccatacag

SEQ ID NO: 33454 - DNA, 50 bp, homo sapien
atcaggagagatgactctgtccttaygaagtgtaatttaataaatagaag

SEQ ID NO: 33455 - DNA, 50 bp, homo sapien
ggtgatagatatggaatgatgaaccrgatcaggagagatgactctgtcct

SEQ ID NO: 33456 - DNA, 50 bp, homo sapien
tctactcatgctctgcttggctgatwactttctataaggatcaaacacta

SEQ ID NO: 33457 - DNA, 50 bp, homo sapien
agttagaagctattttagagtataayaggtgctctctgctcgtgtcagct

SEQ ID NO: 33458 - DNA, 50 bp, homo sapien
tcaggtaagttactaaagccaacccraattcaaagaaagggagctaaact

SEQ ID NO: 33459 - DNA, 50 bp, homo sapien
acttaactttctttgactgcactgakaattgctaatgatttcccatgaga

SEQ ID NO: 33460 - DNA, 50 bp, homo sapien
gcagtccccaagagcagccaaaatartaaaccattccaaatctgcttcca

SEQ ID NO: 33461 - DNA, 50 bp, homo sapien
gacctaggaaatacattgagccatarggcattgaaatacaacctgccttt

SEQ ID NO: 33462 - DNA, 50 bp, homo sapien
acaaacaattgttgagcaacaactaygtaccaggatgcatattgctgaaa

SEQ ID NO: 33463 - DNA, 50 bp, homo sapien
actaatgagagtctggcctgtatccrcaatttaaattcttggccttgcct

SEQ ID NO: 33464 - DNA, 50 bp, homo sapien
ttatggcagaaaattcatgaagatamcacaggcgcaagctggaaagtagt

SEQ ID NO: 33465 - DNA, 50 bp, homo sapien
ttgaccatgcccttgggattttcacygccaagcagcttaccagccagata

SEQ ID NO: 33466 - DNA, 50 bp, homo sapien
ttaaaacattaatctctggaggtagmaaccattgcttcttcgtacactgt

SEQ ID NO: 33467 - DNA, 50 bp, homo sapien
agctttcttaaaatatcttctataaytcatccttttcaaatgtcaagcat

SEQ ID NO: 33468 - DNA, 50 bp, homo sapien
tctgactcactgtccctttcaataartccaaatacagaaatacaagggat

SEQ ID NO: 33469 - DNA, 50 bp, homo sapien
agctttatgaaatgactctcaaacartgatgaggtaaccaataatgaata

SEQ ID NO: 33470 - DNA, 50 bp, homo sapien
gctattaaagtcatgctttcagacartatttaatgacatggaaaacacat

SEQ ID NO: 33471 - DNA, 50 bp, homo sapien
tgtgaagcaataaaggtacattacartggtcattatgaggacaatctgtg

SEQ ID NO: 33472 - DNA, 50 bp, homo sapien
ataattcctttaatatatcacaaaayagatgtgttcaatgcgtgttgttg

SEQ ID NO: 33473 - DNA, 50 bp, homo sapien
gtctcacaaaccaactgcaatacaayatggaagaagaaccacacaagggt

SEQ ID NO: 33474 - DNA, 50 bp, homo sapien
tagaaggtacaattactttactttcrctcactgaggtctttatattgaac

SEQ ID NO: 33475 - DNA, 50 bp, homo sapien
gattggaaaggtgtcaaatgagccartcagtaatatttgctgctgtccat

SEQ ID NO: 33476 - DNA, 50 bp, homo sapien
tatagcagcacaaataaactaagacrataggttaagcaaaatggaaatta

SEQ ID NO: 33477 - DNA, 50 bp, homo sapien
ccacacagagactctgtattaaaagracttctagtaactcaatgcagagt

SEQ ID NO: 33478 - DNA, 50 bp, homo sapien
atatctggtgttttgcttgttttackcgttgggaggagcctaaaagtagc

SEQ ID NO: 33479 - DNA, 50 bp, homo sapien
taggataagagtgctgataaaaacartctttcagatccttatgactgtga

SEQ ID NO: 33480 - DNA, 50 bp, homo sapien
gggctggaacagtggagaaagatgaragggattataaaggagtatgagga

SEQ ID NO: 33481 - DNA, 50 bp, homo sapien
gcacagatcacttagtgctctaacayggtgctcctgatcacagcataagt

SEQ ID NO: 33482 - DNA, 50 bp, homo sapien
cacggtgctcctgatcacagcataartcacactttaattttaacctttgc

SEQ ID NO: 33483 - DNA, 50 bp, homo sapien
ttttagaagaagcatgaataagcagmaatttgcactgtacatacagagat

SEQ ID NO: 33484 - DNA, 50 bp, homo sapien
atctttatgcctcacttgacaagccractaatacattactaagcctcccc

SEQ ID NO: 33485 - DNA, 50 bp, homo sapien
agattactatcacttttctggttaasaatcactatatttggaaagacaga

SEQ ID NO: 33486 - DNA, 50 bp, homo sapien
gagaagtaggagggaggcatatcacrgaaaggagttagatttcttttcaa

SEQ ID NO: 33487 - DNA, 50 bp, homo sapien
tgtgttcttttaaattcatattagawcacatcagtcccctacttaaaaac

SEQ ID NO: 33488 - DNA, 50 bp, homo sapien
ctccactccactccagttctccaagkataagaagtgacatttcaagcatt

SEQ ID NO: 33489 - DNA, 50 bp, homo sapien
tgtatgtgatgctcaaacataactakagacttgaacccaatttgtacaga

SEQ ID NO: 33490 - DNA, 50 bp, homo sapien
gcaaggctgcctgtaaccttagggayctatagtcatattctacatataaa

SEQ ID NO: 33491 - DNA, 50 bp, homo sapien
tatcatgaaaatgcaattcatgctgracaataaataaggtcattattcac

SEQ ID NO: 33492 - DNA, 50 bp, homo sapien
tacagcttattaatgtaaatcgatcracaaaatctttagtgaaataagtt

SEQ ID NO: 33493 - DNA, 50 bp, homo sapien
ggagttcctcatctatcttataagcygcatttagaactgcctactagaaa

SEQ ID NO: 33494 - DNA, 50 bp, homo sapien
ttctataacctttaaaatctggttgyattaaatgttatgtaatgaaaact

SEQ ID NO: 33495 - DNA, 50 bp, homo sapien
tactttgcatttacacaggattagtyaaagtgtggagaagaaaagtaatc

SEQ ID NO: 33496 - DNA, 50 bp, homo sapien
cagatgactagcatttctctaaaaastgacataaccaaacttatctttct

SEQ ID NO: 33497 - DNA, 50 bp, homo sapien
tgctccctagtgggattgtcttaatracttacgggcaagaacatgcacag

SEQ ID NO: 33498 - DNA, 50 bp, homo sapien
tgtctacagataacataacaataacmacaggatctgcggggttcctgcat

SEQ ID NO: 33499 - DNA, 50 bp, homo sapien
tgaataatttgatggaagtcaaacasctatacaagagaagttcagactca

SEQ ID NO: 33500 - DNA, 50 bp, homo sapien
taaactggcttggaagatagagatarcgtctcctccagaacagtggcaag

SEQ ID NO: 33501 - DNA, 50 bp, homo sapien
tgtggaaagattgagtaatttgactraaagattgtactgtattctgtgga

SEQ ID NO: 33502 - DNA, 50 bp, homo sapien
cactcacaggttaaagggagagttaygatagttccactgaactaataaga

SEQ ID NO: 33503 - DNA, 50 bp, homo sapien
aactaaattttaattgtagatgtacmagatcaatactggaagataaccag

SEQ ID NO: 33504 - DNA, 50 bp, homo sapien
tctaccctggaaattctgtggtagcraatctgaggtagcatttcagaaat

SEQ ID NO: 33505 - DNA, 50 bp, homo sapien
gatggaatgggatgcaaataccaacyagcctcagaaacccgtcccttacc

SEQ ID NO: 33506 - DNA, 50 bp, homo sapien
caactaagagagttttgttgtttagycaattgtttcttagtgtcaccgtg

SEQ ID NO: 33507 - DNA, 50 bp, homo sapien
tttcttttaccaggaatcagtttacyaagctagctgttgtttggatgggc

SEQ ID NO: 33508 - DNA, 50 bp, homo sapien
tcctaaaagagtacttttaacttacraaaagaatggaaagaatatgtgca

SEQ ID NO: 33509 - DNA, 50 bp, homo sapien
ggtcttgctctgataacttctataarcgtcttaaaggacttgaataatat

SEQ ID NO: 33510 - DNA, 50 bp, homo sapien
tatgttcttagacacatagcctatckgagctggtatgacagttaagggaa

SEQ ID NO: 33511 - DNA, 50 bp, homo sapien
gtatttctcaggactaccattgctcyaacagaagggtttgcccctcagga

SEQ ID NO: 33512 - DNA, 50 bp, homo sapien
gctgctgaaacatgttgggactctaygactgttacctaccactgtaagtc

SEQ ID NO: 33513 - DNA, 50 bp, homo sapien
atccctgcccatcagattctctgatkaatgtaaaactgccagtgttatca

SEQ ID NO: 33514 - DNA, 50 bp, homo sapien
tattctcatgtttttccaacagttayctcataccaaaccacattaccatg

SEQ ID NO: 33515 - DNA, 50 bp, homo sapien
tttaacttgtgataattagataagayactggatgttttatcctttgtctg

SEQ ID NO: 33516 - DNA, 50 bp, homo sapien
ctttccctgtgggctcatgtcctacyagtatctttctgacttttatgtct

SEQ ID NO: 33517 - DNA, 50 bp, homo sapien
ttattatgtgttctgtaaatgtatartagcaaaatatcgcatgtccctca

SEQ ID NO: 33518 - DNA, 50 bp, homo sapien
tctccagaagaccaaaataaataaartcaagtagggcatataagtctata

SEQ ID NO: 33519 - DNA, 50 bp, homo sapien
gtaatatgccaggattaatgtattcrattttgagtgcataaattaaggtc

SEQ ID NO: 33520 - DNA, 50 bp, homo sapien
acaaataaagaaaatgtggtttatayacacaatgaaatactattcagcca

SEQ ID NO: 33521 - DNA, 50 bp, homo sapien
aatagctgttctaacttgggtaagaygatatgttattgtggctttgattg

SEQ ID NO: 33522 - DNA, 50 bp, homo sapien
cttagtctctgaccctctgagtagaygaatagagctgtgcctatccctcc

SEQ ID NO: 33523 - DNA, 50 bp, homo sapien
gcttaatacagtatctctctaaccartatttttcctaacatagaggcatt

SEQ ID NO: 33524 - DNA, 50 bp, homo sapien
atgaatgctccagtaggtgaatgcaraggcccactaagaggtttggagcc

SEQ ID NO: 33525 - DNA, 50 bp, homo sapien
atgagggatagtcttaaaaacagccygcatgtaatcttgcaaagtatcaa

SEQ ID NO: 33526 - DNA, 50 bp, homo sapien
ggcattgtttaaactttgatggaagrcataatgggaaatacgaaaaaact

SEQ ID NO: 33527 - DNA, 50 bp, homo sapien
cttgctcataggaaacccttagtacrcattcaactatattagacagaact

SEQ ID NO: 33528 - DNA, 50 bp, homo sapien
cattcactttccatattcaacactckcctacttcctgggttttaattttc

SEQ ID NO: 33529 - DNA, 50 bp, homo sapien
ttcatttaaaatattttcaaaatcayaccaattagaagccataaagaaag

SEQ ID NO: 33530 - DNA, 50 bp, homo sapien
ggcccaagtaaatggttttaaatcayggtgctaggtctgaggaaattatt

SEQ ID NO: 33531 - DNA, 50 bp, homo sapien
cttaagccttgtgctgctttagttaycctgtagaataaatggaaaagtaa

SEQ ID NO: 33532 - DNA, 50 bp, homo sapien
ccgaggagatgttgcatatttattcrctgcttttaatagaactgccccaa

SEQ ID NO: 33533 - DNA, 50 bp, homo sapien
agaaatgtttaatatttcacttttaycttcaagtggcagttctgttgtgt

SEQ ID NO: 33534 - DNA, 50 bp, homo sapien
ctaaagaccagtctgagttagtgtarataaaccaggctttggaaaatata

SEQ ID NO: 33535 - DNA, 50 bp, homo sapien
aaactatgtattcctaacttaaacayggaagacttcaacagagagatatt

SEQ ID NO: 33536 - DNA, 50 bp, homo sapien
tgagcataattattaattttttgtayagtttgtgttaggaaaaatggctt

SEQ ID NO: 33537 - DNA, 50 bp, homo sapien
ttttttgtttttttattttgagggcraagacccaggtggcatttaaccaa

SEQ ID NO: 33538 - DNA, 50 bp, homo sapien
tttcagtgattgctgctgctttttcrcgataaccctcctgtggataatca

SEQ ID NO: 33539 - DNA, 50 bp, homo sapien
tcagtttgtgtctttttttaaggtcrcaatcacattgctgaaaggaaaag

SEQ ID NO: 33540 - DNA, 50 bp, homo sapien
aatagtccatctttttcttttcaagwcataaatcatcatatgttatattc

SEQ ID NO: 33541 - DNA, 50 bp, homo sapien
ttttggcaattaaaaaatgtgtgaarttatgatgcttgagacttcttcta

SEQ ID NO: 33542 - DNA, 50 bp, homo sapien
cacaaatttgcatcaatttctaaaakgttatatgacaatcatcttgaaat

SEQ ID NO: 33543 - DNA, 50 bp, homo sapien
caatactatttgttgtttttctctgragaagcctaatacagattagaaac

SEQ ID NO: 33544 - DNA, 50 bp, homo sapien
ctttagctgaaaaggaattcatctayaaccaaatataaaaacagtgataa

SEQ ID NO: 33545 - DNA, 50 bp, homo sapien
tgttgctagtttctatacaatggttwaaaatgaagctgcccgcctgtgct

SEQ ID NO: 33546 - DNA, 50 bp, homo sapien
aatgtggtccttgactattagtggamaaagatcccaagcacagaaaattc

SEQ ID NO: 33547 - DNA, 50 bp, homo sapien
aagtaattcatgattctgtttgttcyctgagatgagagttaaggtgcaca

SEQ ID NO: 33548 - DNA, 50 bp, homo sapien
gaacttctctttggaatggagagtaygactttaagttttgagtcctactg

SEQ ID NO: 33549 - DNA, 50 bp, homo sapien
aggaaactagtaactggatagaaaargttctcagcgattgtaacagtaat

SEQ ID NO: 33550 - DNA, 50 bp, homo sapien
ctgtcaagcttttcaaagacacccamaaactgtcaccaagagcttgtaca

SEQ ID NO: 33551 - DNA, 50 bp, homo sapien
aacaagataattttatacagtagtargtgttgtgaaggtgacgtaggcaa

SEQ ID NO: 33552 - DNA, 50 bp, homo sapien
caaacttcttagcctggctttaaagrctctttaggatttctcaatacaga

SEQ ID NO: 33553 - DNA, 50 bp, homo sapien
tgtttccattcttcaggcatcagtcyaaccatgacctcagtggaatggct

SEQ ID NO: 33554 - DNA, 50 bp, homo sapien
tattcaggataatgtgtatttacaaytataggtcatatgccagaaatttt

SEQ ID NO: 33555 - DNA, 50 bp, homo sapien
ctgcattgtttcctgtgctagcatamggtcagcctatcaaacgcggcaat

SEQ ID NO: 33556 - DNA, 50 bp, homo sapien
tcagaagtgagtagaggaagatagartagggtcttataaatcagaatgaa

SEQ ID NO: 33557 - DNA, 50 bp, homo sapien
tatcttcctctactcacttctgagawcatacattcatagctttaactgtc

SEQ ID NO: 33558 - DNA, 50 bp, homo sapien
gactgacttctttatgttgaattaamggtcaaaggcttgaaatgtagtta

SEQ ID NO: 33559 - DNA, 50 bp, homo sapien
cctacattggactaagtgtcagggaracccacatagatgaaaaagcttct

SEQ ID NO: 33560 - DNA, 50 bp, homo sapien
gactgttatactttgaggagtaattraaaacctatttaagatgcattaca

SEQ ID NO: 33561 - DNA, 50 bp, homo sapien
acttagaagcagttggttggaatacyagccatgaagaaacactgatgaag

SEQ ID NO: 33562 - DNA, 50 bp, homo sapien
ccaaagagttagccgatatctataamtatgaacctgtacaattttgtgaa

SEQ ID NO: 33563 - DNA, 50 bp, homo sapien
agaccagaatgtttctaagaagtgasatgaccaccaactagagtttattt

SEQ ID NO: 33564 - DNA, 50 bp, homo sapien
atatcttgcccactttgagttcatayattccagatggtactgtacctgta

SEQ ID NO: 33565 - DNA, 50 bp, homo sapien
tttcaaatgatataatataaatcaaygtggccagagtgacctaattttat

SEQ ID NO: 33566 - DNA, 50 bp, homo sapien
cagctgtagaaatggtaaaacctcamgaagtaagcatgtgtactattcta

SEQ ID NO: 33567 - DNA, 50 bp, homo sapien
ttggaccatatattcaacattctaarcatgcatatgaaaaagggtgacat

SEQ ID NO: 33568 - DNA, 50 bp, homo sapien
tagagagagcagtttaaacagttacraaaattgtgtagcatactgattac

SEQ ID NO: 33569 - DNA, 50 bp, homo sapien
atgtcattaccttcttactaagtcawgctggattatttcaatataaggca

SEQ ID NO: 33570 - DNA, 50 bp, homo sapien
tacataagtgatataattactgaacscttgttttaatgacttaatcaggg

SEQ ID NO: 33571 - DNA, 50 bp, homo sapien
gaattcttcttgcccaatctggttakaatgaattctgtatttgcaaagga

SEQ ID NO: 33572 - DNA, 50 bp, homo sapien
gattaaatccaacaaagatttcccastctactacatgcttgttccatgct

SEQ ID NO: 33573 - DNA, 50 bp, homo sapien
acaaaaagtttactgttgtcaattamattagctaaatatgagtcaagtcc

SEQ ID NO: 33574 - DNA, 50 bp, homo sapien
ttccgattctctgcaacaaagatggyaaagtttgcaaggagtgaaaatca

SEQ ID NO: 33575 - DNA, 50 bp, homo sapien
gtaagtggtatatgctgaatgaatayggaagaaactaaggtgttaaaaat

SEQ ID NO: 33576 - DNA, 50 bp, homo sapien
aattgaatagatagcaacctaagagragatttaattttcagagaagactc

SEQ ID NO: 33577 - DNA, 50 bp, homo sapien
ctataaaaattgccacatagagtaamctggaaaaaatgtttgctgtgatg

SEQ ID NO: 33578 - DNA, 50 bp, homo sapien
cttgggccataagtaacttaacaatyagtggaaggaaagatcaagtaagt

SEQ ID NO: 33579 - DNA, 50 bp, homo sapien
gagaatagtcttcaggccataaatartaagacacagtttagtggaagaag

SEQ ID NO: 33580 - DNA, 50 bp, homo sapien
gcttgaatttgaatttgggaggaaarttaataagaacactgaatgttatc

SEQ ID NO: 33581 - DNA, 50 bp, homo sapien
agcctcttacttgacaagatgaatakgaaagagcagagattggttgcatt

SEQ ID NO: 33582 - DNA, 50 bp, homo sapien
atattataagttaacacaatttacaygcattggttgttcatagcagtcca

SEQ ID NO: 33583 - DNA, 50 bp, homo sapien
ggaggaagtacacctgcaaatctaartaagactagccttcatcgagaagg

SEQ ID NO: 33584 - DNA, 50 bp, homo sapien
gggagtgatttgctccagttttcagragattgagaggttgggaagtaggt

SEQ ID NO: 33585 - DNA, 50 bp, homo sapien
cagagagctagacaggttaccaggayattcataaaactgttgaccaaaaa

SEQ ID NO: 33586 - DNA, 50 bp, homo sapien
attttaaaagtggttatttcttctaygggacaatggttctggtaatgaca

SEQ ID NO: 33587 - DNA, 50 bp, homo sapien
gaataattattattgaaaaatgcttmaaaggagatcaatacacttaataa

SEQ ID NO: 33588 - DNA, 50 bp, homo sapien
agtggccagcaacctgaactatgacrgcttctagcacaaaattcaaaggt

SEQ ID NO: 33589 - DNA, 50 bp, homo sapien
ctgagaatcctcagtagtacagagaraggttttgcatttagaattctatt

SEQ ID NO: 33590 - DNA, 50 bp, homo sapien
gtggtagtgaagtgtaaatggtttawcagaaattgtattactaaagatat

SEQ ID NO: 33591 - DNA, 50 bp, homo sapien
ggtaaaactgacagtcacttagaaargattgaaattggtcaagtgaggac

SEQ ID NO: 33592 - DNA, 50 bp, homo sapien
acattttcagtaagctagaagagaaygtgatcatagcatttcaagaatca

SEQ ID NO: 33593 - DNA, 50 bp, homo sapien
gtgaaatttgagaaacactgacctargattaaatatctatgcctataact

SEQ ID NO: 33594 - DNA, 50 bp, homo sapien
ctgtattagtattaagtatccaagaktctagacaaatatagtaccttgac

SEQ ID NO: 33595 - DNA, 50 bp, homo sapien
tgtttctcaaatttcactgtgtatcrgaattacctggagagcttgctaga

SEQ ID NO: 33596 - DNA, 50 bp, homo sapien
agtcattatttagaagaaccaagacraaaggtatgtgaataagaaggatt

SEQ ID NO: 33597 - DNA, 50 bp, homo sapien
tggcacagctgtcagcatttacctaygaaagcatttagcttgcttatcta

SEQ ID NO: 33598 - DNA, 50 bp, homo sapien
gcatgaaggacttatgttaaatttcrctactgatttattgaaacaagctt

SEQ ID NO: 33599 - DNA, 50 bp, homo sapien
gagaattttaggaagctcttaaaaakaaatttctgacaagcttcaagcca

SEQ ID NO: 33600 - DNA, 50 bp, homo sapien
caaagaaaacagcaggctgaaaccartgatatcagagatgcagaataaga

SEQ ID NO: 33601 - DNA, 50 bp, homo sapien
tgacaattagttatataccaatgtawtaagtgctttaatagtggtacatt

SEQ ID NO: 33602 - DNA, 50 bp, homo sapien
tagggtatatatattatgtggtgtaygtaatagctgactagaaaaaaata

SEQ ID NO: 33603 - DNA, 50 bp, homo sapien
gcactttggggaactcatgatgctayataactagccccaagagcttatag

SEQ ID NO: 33604 - DNA, 50 bp, homo sapien
acactacgcggacatcaggcatagcrattcacacattcctctacaaagag

SEQ ID NO: 33605 - DNA, 50 bp, homo sapien
gaaagatagttggcgattagagacgrattttactttgggtctgatttcaa

SEQ ID NO: 33606 - DNA, 50 bp, homo sapien
tctctgtgaaagagttctgcatgtamaaggtatatttatgagtgcttttg

SEQ ID NO: 33607 - DNA, 50 bp, homo sapien
tgccacttcacaaattacttaccagmatgaggtctagtgagtccttgctc

SEQ ID NO: 33608 - DNA, 50 bp, homo sapien
tttaactcccgaatttcactcactayggtatctaaaataaaagccttaaa

SEQ ID NO: 33609 - DNA, 50 bp, homo sapien
accaggtgtaacttgtttgcctaaawgttggcaccggtcctgtcagaatc

SEQ ID NO: 33610 - DNA, 50 bp, homo sapien
taataaaagctcccttcagtgaacgrcctctgaaagccaaccaatcaatg

SEQ ID NO: 33611 - DNA, 50 bp, homo sapien
cagattatttttggctccatttaacrgctcgtaaaataattttctgtctt

SEQ ID NO: 33612 - DNA, 50 bp, homo sapien
atttggtataaaggaattataattamacttcagtcatcctctcctacaga

SEQ ID NO: 33613 - DNA, 50 bp, homo sapien
agaagaaacttctatttggaaatacrcgagagcagaaagtcttgaagaaa

SEQ ID NO: 33614 - DNA, 50 bp, homo sapien
cttatcttcatggtcagtgactcccrgagacattacttagccctctgtgt

SEQ ID NO: 33615 - DNA, 50 bp, homo sapien
tttccccaagggacaaccaatcggcratacattattttagcttgttaaca

SEQ ID NO: 33616 - DNA, 50 bp, homo sapien
tagcaccttctaagtcctggaatccrccaagaaggaggaagggagatggt

SEQ ID NO: 33617 - DNA, 50 bp, homo sapien
taaagtgtaaaatttcattttaagartcctacaatccttgaaaacatcgt

SEQ ID NO: 33618 - DNA, 50 bp, homo sapien
gagatgataaaggataaagctgctcmaatattattagtagtagtattgat

SEQ ID NO: 33619 - DNA, 50 bp, homo sapien
tccaaacaaataccttgagaccaaaygtttatacacatgaagaacttatt

SEQ ID NO: 33620 - DNA, 50 bp, homo sapien
tttgcacaggacagtaaaagactaakgtgcagtaaagctgatctgaataa

SEQ ID NO: 33621 - DNA, 50 bp, homo sapien
caaaatttagacgttcccaaaatacsaacaagcctggttaaaagatagat

SEQ ID NO: 33622 - DNA, 50 bp, homo sapien
gacagtgatgcttgaaggaagtccaktgcataaatctcaacaagatgtcc

SEQ ID NO: 33623 - DNA, 50 bp, homo sapien
agagccactgtgaccaggcagccaarggaacgttagtgctggatcgccag

SEQ ID NO: 33624 - DNA, 50 bp, homo sapien
tctctccacacataggatgtgtttargtttccttaataaaagtcttctct

SEQ ID NO: 33625 - DNA, 50 bp, homo sapien
gcttttgaaaagcatttgttctccaygtcacaaaacaaacttaaacaaaa

SEQ ID NO: 33626 - DNA, 50 bp, homo sapien
cattttttcctttaattcatacacarataaataatttcccctcaattgcc

SEQ ID NO: 33627 - DNA, 50 bp, homo sapien
atatatctgtagaaaagagttcagaratcaaagttaccagttcctaagac

SEQ ID NO: 33628 - DNA, 50 bp, homo sapien
gaaggataaatctctttgctgtgtartaaacagaggagaaacataggtaa

SEQ ID NO: 33629 - DNA, 50 bp, homo sapien
aaagggggagttagacactttacatractagcacaggaggaagagagctg

SEQ ID NO: 33630 - DNA, 50 bp, homo sapien
ggttaggtgatgtttggaatctgatraaggctgtcaaggaatataaaggt

SEQ ID NO: 33631 - DNA, 50 bp, homo sapien
taaggactccccacaaatcaacgtgraaaattagtctctacaaacagtga

SEQ ID NO: 33632 - DNA, 50 bp, homo sapien
atggttccaaaattcttatgtggaayagcttactggtggcagtcccgttg

SEQ ID NO: 33633 - DNA, 50 bp, homo sapien
agaagctctccacgatatgtcataarataataaatgttgacaatggtgga

SEQ ID NO: 33634 - DNA, 50 bp, homo sapien
actagagtcactcagaggcctctatwactaagcagagagatctggcagcc

SEQ ID NO: 33635 - DNA, 50 bp, homo sapien
ttctgatataaagttctaaagtgcartctgacagagaatgtggcaaaaat

SEQ ID NO: 33636 - DNA, 50 bp, homo sapien
gaggaagtgaatggaaagtgtaaaasccaggatgtgccagagattaaaag

SEQ ID NO: 33637 - DNA, 50 bp, homo sapien
ttagtgtcttcaataacatttcccartcactatgaaaattgaacattctt

SEQ ID NO: 33638 - DNA, 50 bp, homo sapien
aaaaaaaaaattggaggaataacccrgaaagtagacaactatttccctcc

SEQ ID NO: 33639 - DNA, 50 bp, homo sapien
gtagagaatcttatatgcttgcaatmaaaaaagtgcagaatttaaagaga

SEQ ID NO: 33640 - DNA, 50 bp, homo sapien
aaacggatttcatccaatgtgctacycaatattctgtctttggaattttg

SEQ ID NO: 33641 - DNA, 50 bp, homo sapien
agacatggtttgccttaaactgaggyataaagccccactgctaactgata

SEQ ID NO: 33642 - DNA, 50 bp, homo sapien
ttatactatcagtaattttcctgcaktctctccatactaaacttaattgc

SEQ ID NO: 33643 - DNA, 50 bp, homo sapien
aaaaagtttgctggcagagcaaggaytcacagtggaataaacaccacatg

SEQ ID NO: 33644 - DNA, 50 bp, homo sapien
cactttctagttaaggattttggatyaaagtcgattctagaattctgaat

SEQ ID NO: 33645 - DNA, 50 bp, homo sapien
catatagaattgtccaatgataagasagtaataaggaacacttgcaagac

SEQ ID NO: 33646 - DNA, 50 bp, homo sapien
agatccaaaccatatcaaaggacacrgtaaaaaataacatgaatttagat

SEQ ID NO: 33647 - DNA, 50 bp, homo sapien
gtaaacaatactgacatagtttggaygtgtttccctgccctgatctcatg

SEQ ID NO: 33648 - DNA, 50 bp, homo sapien
gaggagaaagaaggctgggaaaacaygtacactaaagctgagacaggaca

SEQ ID NO: 33649 - DNA, 50 bp, homo sapien
atacatcatttcatgtaacaactcaytgactataaggtgattattatcct

SEQ ID NO: 33650 - DNA, 50 bp, homo sapien
caaagcttttcactcaagtggccaamtaggtttacgttagtgtcttgagc

SEQ ID NO: 33651 - DNA, 50 bp, homo sapien
ttttgcggcattgtgcatatctccartataccacatcctgccttctatgg

SEQ ID NO: 33652 - DNA, 50 bp, homo sapien
tttttgctaggcaactatttccaaaygctgtcttctttcaagacacgact

SEQ ID NO: 33653 - DNA, 50 bp, homo sapien
tcagactgccgttcacctgcagagaygtcacattcatttactttgatttc

SEQ ID NO: 33654 - DNA, 50 bp, homo sapien
gacacggactggatgagaaaagatargccaaacaggcagattccctccct

SEQ ID NO: 33655 - DNA, 50 bp, homo sapien
agtgacataatttccatttacagatsaagacaaggactttttgatgctag

SEQ ID NO: 33656 - DNA, 50 bp, homo sapien
cagaatgtgttagatgtctacattargaatctctgttggtgatggcagca

SEQ ID NO: 33657 - DNA, 50 bp, homo sapien
caacataatggtctcaagaaacgcayatcaaggcaattctacagcagatt

SEQ ID NO: 33658 - DNA, 50 bp, homo sapien
taaaagcttaattatgatttggagcracacactgcatatcagtggggcaa

SEQ ID NO: 33659 - DNA, 50 bp, homo sapien
atagacctaagttgagaaaataatcrgagaagtgaatttctcacctctca

SEQ ID NO: 33660 - DNA, 50 bp, homo sapien
agactcatgcagttccctatgaagasgatcattatgcaaaagacccagac

SEQ ID NO: 33661 - DNA, 50 bp, homo sapien
atctctctggttgacttaagagacastgtcagatactccagggaaggaag

SEQ ID NO: 33662 - DNA, 50 bp, homo sapien
tgaggcttctttcttgagaagagacygggacgtatagcacatcagcagct

SEQ ID NO: 33663 - DNA, 50 bp, homo sapien
caatcttttctattggccaaattgckatgaaacaattattatttttcacc

SEQ ID NO: 33664 - DNA, 50 bp, homo sapien
taattttataaactgatgattacacraaaagagaaagaaaggcggcacaa

SEQ ID NO: 33665 - DNA, 50 bp, homo sapien
ggcagaagggcaagacaagatgaaarccagtgagcaagagggggctgaac

SEQ ID NO: 33666 - DNA, 50 bp, homo sapien
aaaatggaaacaattttatcgaccgwaaaaatcatggagacgtatttagg

SEQ ID NO: 33667 - DNA, 50 bp, homo sapien
aatttttgacaagtcatttcaacacmgtaaaatcattttactggttttag

SEQ ID NO: 33668 - DNA, 50 bp, homo sapien
ttgcccttttttcttcctccttaaaygtgtgatggtacatccgtcttgtt

SEQ ID NO: 33669 - DNA, 50 bp, homo sapien
actctaatcaggtagctactctaaaygtttaactctcagcaatcacaatt

SEQ ID NO: 33670 - DNA, 50 bp, homo sapien
gctggtttcaaccttatttgggaagrcaagattgaaacaatgaaatagtt

SEQ ID NO: 33671 - DNA, 50 bp, homo sapien
aatctcagataacaccatggtattaygtgcatgtagaaagactttagttg

SEQ ID NO: 33672 - DNA, 50 bp, homo sapien
ggtaaaggtgctattaaacagccatratattaattcataaaagaatataa

SEQ ID NO: 33673 - DNA, 50 bp, homo sapien
actcctgtaatactagtgattcttcratcaggaatacaacttttctataa

SEQ ID NO: 33674 - DNA, 50 bp, homo sapien
aagctgttttgtccattaaccaaagragaagtctcaaaatgcttgggaca

SEQ ID NO: 33675 - DNA, 50 bp, homo sapien
tttgtaatgttaatgatgctaccaaraataaagaatgaggaattaagact

SEQ ID NO: 33676 - DNA, 50 bp, homo sapien
ctacttaatgagaattatttataaasttcatgaggaatttgaattaaagg

SEQ ID NO: 33677 - DNA, 50 bp, homo sapien
ggagacatgaccacaatgtccactayagaatcccattgtttatcaaaatc

SEQ ID NO: 33678 - DNA, 50 bp, homo sapien
cctgactctcttctcaattgatagaygctgccttatgtttaaaagttttt

SEQ ID NO: 33679 - DNA, 50 bp, homo sapien
gttcataattgcatcttgagaatgayatagagcttggatctggaagtggt

SEQ ID NO: 33680 - DNA, 50 bp, homo sapien
gaagaaagggaggttgtgtcatttasaagttgcaaagagttttctttctc

SEQ ID NO: 33681 - DNA, 50 bp, homo sapien
acactggcagctctggcacctactcygaatttgtggattttctgtgctgt

SEQ ID NO: 33682 - DNA, 50 bp, homo sapien
actcagcaaagatacaactgaaaaamttagccatctgaaaatcaggaacc

SEQ ID NO: 33683 - DNA, 50 bp, homo sapien
ccctggttttaaagccaatcgtacayctaagtgaatttgtcaggcaccaa

SEQ ID NO: 33684 - DNA, 50 bp, homo sapien
gaagtgccacagcaagaaatcatgcrcttggaaaactaagcaaaacaagg

SEQ ID NO: 33685 - DNA, 50 bp, homo sapien
tggggtttggtcttagaaactcaagwccaattaacttaaacataaaggga

SEQ ID NO: 33686 - DNA, 50 bp, homo sapien
gtttaattacatcatatggcattcaytatactgttgtcagcactttctta

SEQ ID NO: 33687 - DNA, 50 bp, homo sapien
aaagatatattaacattgctatggaygaccaatgatcttgtctgattgat

SEQ ID NO: 33688 - DNA, 50 bp, homo sapien
aggtcacccgatttgggtttgagtcrccattgtatcatttactaacagct

SEQ ID NO: 33689 - DNA, 50 bp, homo sapien
gaaaaaaatccataaattagaatcaycatgcttgcagtgttttgagtttt

SEQ ID NO: 33690 - DNA, 50 bp, homo sapien
cccttccttcattcacgtcctgtcaytctggctaacaaaaattagctggg

SEQ ID NO: 33691 - DNA, 50 bp, homo sapien
aactaacatatatcttggagtcttakctttcctagactaaacatcttcaa

SEQ ID NO: 33692 - DNA, 50 bp, homo sapien
tatcagagaaaggtaaaaatggaaaytgtataaggaaatttttaaaagaa

SEQ ID NO: 33693 - DNA, 50 bp, homo sapien
agtatacatattgtgacgttttctcrctgctaacttagacaaaaatatat

SEQ ID NO: 33694 - DNA, 50 bp, homo sapien
ctaatgtggactatcttctcttgcakatttctaactatttagagatctcc

SEQ ID NO: 33695 - DNA, 50 bp, homo sapien
attcaagaggagaaacattagcaagsacaacatttaatacgctgtgtgcc

SEQ ID NO: 33696 - DNA, 50 bp, homo sapien
gcagcttgtccacggtacacaattcrgaatcacccaaccacttaggacac

SEQ ID NO: 33697 - DNA, 50 bp, homo sapien
attgtgtggacttatctgagtacaarcatcccaaatgtaggtatgacatt

SEQ ID NO: 33698 - DNA, 50 bp, homo sapien
caaagcaacattggcatacttccaarccaattaagtattttagctcttaa

SEQ ID NO: 33699 - DNA, 50 bp, homo sapien
cagaattagagtagtggtatgattawcaagtgttgtttctgtttcatgac

SEQ ID NO: 33700 - DNA, 50 bp, homo sapien
aaccataaagcaatcagtgctttgaytaagtttggatcagtttttagtac

SEQ ID NO: 33701 - DNA, 50 bp, homo sapien
agtagcaaaaccactttgtccttaaygataaaagaagaaccattggctgt

SEQ ID NO: 33702 - DNA, 50 bp, homo sapien
gaaaagcatgatcatggcagatacayggaataagaaactattcaaaataa

SEQ ID NO: 33703 - DNA, 50 bp, homo sapien
attgcattgcttaccctgtgacagamaaatttagaaatacttgagagttt

SEQ ID NO: 33704 - DNA, 50 bp, homo sapien
gggtgcaaacagggaagggtaagtayaaaataagattaaaaatgaaagtg

SEQ ID NO: 33705 - DNA, 50 bp, homo sapien
tgtttacgtaattttttgttacatcrcactttttagtcagatcaggaggt

SEQ ID NO: 33706 - DNA, 50 bp, homo sapien
gcatagtttgagatgtttaatcatayccaggtagatacgttgagtacata

SEQ ID NO: 33707 - DNA, 50 bp, homo sapien
gttttaactatactgttagacactgraatacaacacatcagtcatatatt

SEQ ID NO: 33708 - DNA, 50 bp, homo sapien
tagcatataatctgctctcttattcrataacacaatttattttcagattc

SEQ ID NO: 33709 - DNA, 50 bp, homo sapien
ataaaggaagggttccaatataatcracgtgcaaacagttgtttggggaa

SEQ ID NO: 33710 - DNA, 50 bp, homo sapien
taatgggtcacgtttgactgttggcraaagagtcactaattagatgtaaa

SEQ ID NO: 33711 - DNA, 50 bp, homo sapien
tgacctaaggttgcgcagtaaagcayggttagtcccatcacttagtttat

SEQ ID NO: 33712 - DNA, 50 bp, homo sapien
ggtactttagtataaaatagaggcaygtttctaaaattaagacaaatata

SEQ ID NO: 33713 - DNA, 50 bp, homo sapien
tgaaaaattaatcctgaaattcaaayggaagagaaagtaaacataagcac

SEQ ID NO: 33714 - DNA, 50 bp, homo sapien
gtgttatgtgtatatggctaaagtcrctaatatggtttggctctgtgtcc

SEQ ID NO: 33715 - DNA, 50 bp, homo sapien
tgtagtaatcttttggtgatctcatyagtaatagtttttcacatgtagta

SEQ ID NO: 33716 - DNA, 50 bp, homo sapien
gaaatcaatggtaaggaaaaaaatgracaggtcatctaatatgtaaacaa

SEQ ID NO: 33717 - DNA, 50 bp, homo sapien
aagaaagaacaaaatcagatgaccaygatgttagacaaattctataacaa

SEQ ID NO: 33718 - DNA, 50 bp, homo sapien
tgttcaagcaactttgattaatataycctttaacataaataccaaatatc

SEQ ID NO: 33719 - DNA, 50 bp, homo sapien
atctactttagaaaagataaaactaygccaaaatgactaacccatgggta

SEQ ID NO: 33720 - DNA, 50 bp, homo sapien
gcagggtttagctgtgccaccgaaargatgctattttcagcttttaaacc

SEQ ID NO: 33721 - DNA, 50 bp, homo sapien
attgagacagatttttttgacattcrctaatctgaatagtactgttacct

SEQ ID NO: 33722 - DNA, 50 bp, homo sapien
ctccatttgcagtcaaattgtgggcrgaaacgtagcaaatctctaaaaca

SEQ ID NO: 33723 - DNA, 50 bp, homo sapien
tggtctttgcatggtaggaatttgaygaaacctcagcagtcttgatgatg

SEQ ID NO: 33724 - DNA, 50 bp, homo sapien
ctgttgagaagatgatgaaatgtcaygggcttaatggaaactttaagcat

SEQ ID NO: 33725 - DNA, 50 bp, homo sapien
ccaatcagaatgggtaagccttttayactacaaacacttcaccaaagaac

SEQ ID NO: 33726 - DNA, 50 bp, homo sapien
aacagaaaaattggtactttgcatargccaattaacctctcttggtttca

SEQ ID NO: 33727 - DNA, 50 bp, homo sapien
agatcccctgaatcatatgcataacscagtgaaaattttatggacttcat

SEQ ID NO: 33728 - DNA, 50 bp, homo sapien
ttattcaagaaatcagatgataagayagaggacttcagcatagaactgag

SEQ ID NO: 33729 - DNA, 50 bp, homo sapien
tcaatcaataacctgaaaattccgayaactttgaaaacattgttaccata

SEQ ID NO: 33730 - DNA, 50 bp, homo sapien
agatatagaacactaaaattttcaaraactcacaagccttaagaattaaa

SEQ ID NO: 33731 - DNA, 50 bp, homo sapien
tattcgtcttattcttagttacaaartaagtgtgacgctatagtcatcct

SEQ ID NO: 33732 - DNA, 50 bp, homo sapien
ggaaaaattcaatgccttagttaaasatattcgtcttattcttagttaca

SEQ ID NO: 33733 - DNA, 50 bp, homo sapien
tacatggcttcttttatttctcactracaagaggtttttaaaacaattac

SEQ ID NO: 33734 - DNA, 50 bp, homo sapien
tagagtttacaaatgaaataaaacartctatgctaagacaattatcacag

SEQ ID NO: 33735 - DNA, 50 bp, homo sapien
actacctgattcgttcttcacattcraaggtttgtattctatgtcagtga

SEQ ID NO: 33736 - DNA, 50 bp, homo sapien
acgaatcaggtagtgagttagaatcratgctttaagtgttaatgttgctg

SEQ ID NO: 33737 - DNA, 50 bp, homo sapien
aaagaaatcaagttgaagaggtcatrataagtacagtatagtctggaatt

SEQ ID NO: 33738 - DNA, 50 bp, homo sapien
gttcagaaaagcaaaaactgttttgsaccttatcactgttgattcattct

SEQ ID NO: 33739 - DNA, 50 bp, homo sapien
actggcattcagattaaaaaattaamcattgtgagcacttcagagtaatc

SEQ ID NO: 33740 - DNA, 50 bp, homo sapien
actatatgactcacagttgaagctayggacttgtctggactgcatcttct

SEQ ID NO: 33741 - DNA, 50 bp, homo sapien
ctatgcaatattgtttaaggatgtaygcagacgtggttaaactataaaga

SEQ ID NO: 33742 - DNA, 50 bp, homo sapien
tattacattattagttttgccagagwctaagcagctccagtatgccatcc

SEQ ID NO: 33743 - DNA, 50 bp, homo sapien
aaaggtgcaaacacccactcacataygctcaaaaacacacatgcacacac

SEQ ID NO: 33744 - DNA, 50 bp, homo sapien
tagcacagcgtgttccatttagggcyagtctcgcaagttagagttgggaa

SEQ ID NO: 33745 - DNA, 50 bp, homo sapien
tattttacacatgataactactaaartgatttcaattaaataatatttta

SEQ ID NO: 33746 - DNA, 50 bp, homo sapien
tagcattgagataacagtagtttgcrgataattttggctatgtccattag

SEQ ID NO: 33747 - DNA, 50 bp, homo sapien
aaccagaatactttgtgtatttctayggaattgtccatatttacttcaca

SEQ ID NO: 33748 - DNA, 50 bp, homo sapien
gcacataaataacaatcctaaaccamatacattgtgttaagtgctaaact

SEQ ID NO: 33749 - DNA, 50 bp, homo sapien
tctaaaaatttattaccctagaaaayggtgttattatccatttcaaaaat

SEQ ID NO: 33750 - DNA, 50 bp, homo sapien
agtatatatcatcttctttccttaartggtacctttgtgtctaggaatcc

SEQ ID NO: 33751 - DNA, 50 bp, homo sapien
gttgtttaacttccccaggaacacarggcttaaagcaaaatttcaaactt

SEQ ID NO: 33752 - DNA, 50 bp, homo sapien
tgacgatcttatactttgataatgayatttacttgatgcaaataagaact

SEQ ID NO: 33753 - DNA, 50 bp, homo sapien
tcttaatgatattcttaataccatargagatgacattaatgatgttaata

SEQ ID NO: 33754 - DNA, 50 bp, homo sapien
gacaaaatcacctataaaaagatcaraactgaagattttttttgttgaga

SEQ ID NO: 33755 - DNA, 50 bp, homo sapien
gaagtaactttattctggtttggtaytaaagttattctgactttataaaa

SEQ ID NO: 33756 - DNA, 50 bp, homo sapien
accagatctcatgagaatgctatcaytatatagtaataagggggaatggt

SEQ ID NO: 33757 - DNA, 50 bp, homo sapien
tacacaaacactcagaagcacattasaattaaattactgaaaagcaatga

SEQ ID NO: 33758 - DNA, 50 bp, homo sapien
aagcaagctacccataaacatacaarcatcaagcattcgtactggcatta

SEQ ID NO: 33759 - DNA, 50 bp, homo sapien
aaactaaaataagtgaaagtttagaygcatagaggataaattcagaagat

SEQ ID NO: 33760 - DNA, 50 bp, homo sapien
gaatagaaaatccactgtagctaccratattaatcagcttagatctttct

SEQ ID NO: 33761 - DNA, 50 bp, homo sapien
attattctcacttttctatttctacmcacagttgagaaatatttataaat

SEQ ID NO: 33762 - DNA, 50 bp, homo sapien
ttaaatagtgagtttctagagctgaygccatttttaatgaaggactgccc

SEQ ID NO: 33763 - DNA, 50 bp, homo sapien
tcttctctaatctagctgaatattckacttgttctgcttggctgaagctc

SEQ ID NO: 33764 - DNA, 50 bp, homo sapien
gacacttgcttcacattctgacacaygtaaagccttcattacattgaagg

SEQ ID NO: 33765 - DNA, 50 bp, homo sapien
taacatctagcataaccatgttacartgatgaaaaccaaataattacatt

SEQ ID NO: 33766 - DNA, 50 bp, homo sapien
agtctttctctaagggatataaaagscaacgctgagccaagttccgttgg

SEQ ID NO: 33767 - DNA, 50 bp, homo sapien
ttttcctataacatttgactatagawcacctaattaaaaagatgtcatat

SEQ ID NO: 33768 - DNA, 50 bp, homo sapien
ggtcacagtcttgctcctacatcaargcgatctctgagttgctgtgctgt

SEQ ID NO: 33769 - DNA, 50 bp, homo sapien
taatttaagtgtttaaaggtatccartaaacaagcaatgtccttaaataa

SEQ ID NO: 33770 - DNA, 50 bp, homo sapien
gaagggaggaaatccaaaagactgarcatttatcccaaatggactcaacc

SEQ ID NO: 33771 - DNA, 50 bp, homo sapien
tcccttttttatattacctcttctcrgacagatcaaccttctccttccta

SEQ ID NO: 33772 - DNA, 50 bp, homo sapien
gcttcatgatgacattcactttcaamgtctgcaggtctggcactgaaccc

SEQ ID NO: 33773 - DNA, 50 bp, homo sapien
aagacactcggatggcaataagcacrcatgagttttaatgttggtgattt

SEQ ID NO: 33774 - DNA, 50 bp, homo sapien
atgtgtgtgtatgtgggggcaccaaraaggcaccgtgaaaataggaagct

SEQ ID NO: 33775 - DNA, 50 bp, homo sapien
tggatttaacaggccaaagaggttamagaaggtacattagggaagacagt

SEQ ID NO: 33776 - DNA, 50 bp, homo sapien
aaaaataaaacaaactcattctcacygtagataaagacatgctaaaaagt

SEQ ID NO: 33777 - DNA, 50 bp, homo sapien
tgaagaaagacttttggtacttaaaygaatacaaaacattggaaagcact

SEQ ID NO: 33778 - DNA, 50 bp, homo sapien
taacagtgatcttgagggccctctaygttgtggaaattcagatagggcat

SEQ ID NO: 33779 - DNA, 50 bp, homo sapien
tgcacccatctacttcatcctctacrgtaccactactactattgcatccc

SEQ ID NO: 33780 - DNA, 50 bp, homo sapien
ggagtgataataatttacctttgaaygaaaaactctatgtctctacacca

SEQ ID NO: 33781 - DNA, 50 bp, homo sapien
aatcaaccaagcttaggcaaaaataygtacttgatatctaaagcaacaca

SEQ ID NO: 33782 - DNA, 50 bp, homo sapien
taatgattaggcagaagcctggaccrgagaatgggatgtggtggtcttct

SEQ ID NO: 33783 - DNA, 50 bp, homo sapien
actagttctttgattttaaggcaaasttctttagtaaagttcctaatcat

SEQ ID NO: 33784 - DNA, 50 bp, homo sapien
agcaggttagagcattttgaggagtyaatattaatgtgttgctgtgagcc

SEQ ID NO: 33785 - DNA, 50 bp, homo sapien
ctcttgttttccctgtgataaaagtraattctgatgagaggttgtgaatt

SEQ ID NO: 33786 - DNA, 50 bp, homo sapien
gatgagaggttgtgaattcaggaagwctgggaagctcctacttttatatg

SEQ ID NO: 33787 - DNA, 50 bp, homo sapien
tcctttatgtgatgttaaaatcaagkactataatggtccatctaattttt

SEQ ID NO: 33788 - DNA, 50 bp, homo sapien
agttggttggtttattagctacagcraggtgtttacctgatttggctatg

SEQ ID NO: 33789 - DNA, 50 bp, homo sapien
cctcgctgtagctaataaaccaaccracttctttgctttgcttctgtggt

SEQ ID NO: 33790 - DNA, 50 bp, homo sapien
tggtgctaaagaaatatttgcccttyaaaatactgtgctacactgcaaaa

SEQ ID NO: 33791 - DNA, 50 bp, homo sapien
aaataacaacagatgttacttgtacrgatttatgaaattttaaatgatgg

SEQ ID NO: 33792 - DNA, 50 bp, homo sapien
gagatgaagtgtagaacagaaggccragtagtttacagtcatttgagcat

SEQ ID NO: 33793 - DNA, 50 bp, homo sapien
tgattctcttgaatgccttagaacayagtagaaacccttgcttttatcct

SEQ ID NO: 33794 - DNA, 50 bp, homo sapien
agctatttgttttcataataaggaaygtgagtaaccgtgaaaaaggttca

SEQ ID NO: 33795 - DNA, 50 bp, homo sapien
cggctcaccacacgcacagaactgaygtaagagggaatgtttgcattggg

SEQ ID NO: 33796 - DNA, 50 bp, homo sapien
gagacattccaacaaaggcatatacrgtacgaaaagaatacagaaaatgc

SEQ ID NO: 33797 - DNA, 50 bp, homo sapien
gcacatattggacatttaaaaatacygagaacatagcattctcctgggag

SEQ ID NO: 33798 - DNA, 50 bp, homo sapien
gacaggagccatctatttgttaataragagctatagacaacataaggaaa

SEQ ID NO: 33799 - DNA, 50 bp, homo sapien
atgatctggacactaccacagaagamggagtgatagagagacagaaaatg

SEQ ID NO: 33800 - DNA, 50 bp, homo sapien
cacgaaacaaaaggacaatttaggascaaaaatgatctcatcaagtcatt

SEQ ID NO: 33801 - DNA, 50 bp, homo sapien
gccaaaatgcagtgtgtcagctcatyatccttgcgttcattgaccatgat

SEQ ID NO: 33802 - DNA, 50 bp, homo sapien
acagatctgcaaacagataaatgtcwcatagtttgatgaggggaagaata

SEQ ID NO: 33803 - DNA, 50 bp, homo sapien
tttgggactacaaaataattcccaargtatgtgtaactctgaactcctca

SEQ ID NO: 33804 - DNA, 50 bp, homo sapien
attaaaactagagccacactttctawattcctcactctaatacagtttcc

SEQ ID NO: 33805 - DNA, 50 bp, homo sapien
gggatgctcatattacaacgagggarcaggtagctttaaatctcaaacct

SEQ ID NO: 33806 - DNA, 50 bp, homo sapien
agagtctagcaagaaaggacctaccyaagtacaagggattgtcatcaagg

SEQ ID NO: 33807 - DNA, 50 bp, homo sapien
caacgatagggatcttgtgtttgccrctattccaggtaactatctctctt

SEQ ID NO: 33808 - DNA, 50 bp, homo sapien
gaaactcaggagaaaagaatgtcctwacctattgagagagatttcagtgt

SEQ ID NO: 33809 - DNA, 50 bp, homo sapien
cctgtgttgagtactcgggaatatarcggtgaaccaaatgaaggcagtaa

SEQ ID NO: 33810 - DNA, 50 bp, homo sapien
tgagagtggaactgacacatcatggycaatgaacgcaaggatgatgagct

SEQ ID NO: 33811 - DNA, 50 bp, homo sapien
gtatgtttataatcatttatccaaasttcataacatatttttgctgtaga

SEQ ID NO: 33812 - DNA, 50 bp, homo sapien
tttcctgagacagggagacaacatcragcactgtaaagttacactaaatt

SEQ ID NO: 33813 - DNA, 50 bp, homo sapien
actcagggctatcccgtttatttaaygaacttggcaagagagtacctatt

SEQ ID NO: 33814 - DNA, 50 bp, homo sapien
tggaatagatcataaaggtttaaggycatatagggtcacagttggaaata

SEQ ID NO: 33815 - DNA, 50 bp, homo sapien
gacttgcacagccataaatattggcrctatctttaacatgattttcactt

SEQ ID NO: 33816 - DNA, 50 bp, homo sapien
agcttgacagtagatcattaaatgtkacagatattcctaaactgttccta

SEQ ID NO: 33817 - DNA, 50 bp, homo sapien
gctttcatctgtctggtgattaagascataaaccaagtggtgtgatgaga

SEQ ID NO: 33818 - DNA, 50 bp, homo sapien
aacagccacagcgcaattgtggagayacatggcacaagtacacaaaataa

SEQ ID NO: 33819 - DNA, 50 bp, homo sapien
gatgtttgcagccaccctgagatgaygttgcaaactttggatttttcaaa

SEQ ID NO: 33820 - DNA, 50 bp, homo sapien
atttagctaataactaatatgttcawtcttttcagtaacaagacctatag

SEQ ID NO: 33821 - DNA, 50 bp, homo sapien
gtcctagctatggcaaaacagaataygatgagcaaacggaattcctgaaa

SEQ ID NO: 33822 - DNA, 50 bp, homo sapien
gggaataactacaagctgtgcgtaayatagggtcttacattcagcagtct

SEQ ID NO: 33823 - DNA, 50 bp, homo sapien
ccttttcttcaaccccatgttcaatyagtcgctgagctgctggtaaatcc

SEQ ID NO: 33824 - DNA, 50 bp, homo sapien
ttggtgccagacccccgtatgtctgyagaaaggtagacatgttggtggac

SEQ ID NO: 33825 - DNA, 50 bp, homo sapien
agtagactaactgaacaaaacaccaytaatcaaatttcactgaagccatg

SEQ ID NO: 33826 - DNA, 50 bp, homo sapien
attgcaatttgtacatgttacagtgrattagaagagatgatagggttatt

SEQ ID NO: 33827 - DNA, 50 bp, homo sapien
tacaagatttgggtggatattagctsactggtttagtacttactgactta

SEQ ID NO: 33828 - DNA, 50 bp, homo sapien
ttagatttaaaacatgcggaagagayagttttggtatgaccatttattat

SEQ ID NO: 33829 - DNA, 50 bp, homo sapien
actttctacaaacactaagtttatgycaaggttagtgtcacagaacagac

SEQ ID NO: 33830 - DNA, 50 bp, homo sapien
aggcttatctgtcttctgatactacygagccctgcagcatgatgttgcca

SEQ ID NO: 33831 - DNA, 50 bp, homo sapien
aacagagggaatgatgaacacattayggagaaaaaatcaaacgtctctgg

SEQ ID NO: 33832 - DNA, 50 bp, homo sapien
gggaatgcagaaactggggctcaaamgagaagttaaagctaaaaagagag

SEQ ID NO: 33833 - DNA, 50 bp, homo sapien
tattagtttacgacaagactagccamgtaggatctttcctgccctgtccc

SEQ ID NO: 33834 - DNA, 50 bp, homo sapien
tggagttcataaagattttccacagkaggtctgataatataaccccaagt

SEQ ID NO: 33835 - DNA, 50 bp, homo sapien
gcatgcacaataattgtttgtggaayggagaatacgatggaacatgctgg

SEQ ID NO: 33836 - DNA, 50 bp, homo sapien
ctaacagcactaacctcacatcttaygacatttaatctttgtaacaagtc

SEQ ID NO: 33837 - DNA, 50 bp, homo sapien
aatggtggtgggtaaattgattatawctgtactataaaggtcaaaaaaca

SEQ ID NO: 33838 - DNA, 50 bp, homo sapien
tctatgactagcttatcctcctatayactgagtactttttacctggctta

SEQ ID NO: 33839 - DNA, 50 bp, homo sapien
ttggaaaacgtttgtatgcgttccaygagtagtctgaagctgcctgttca

SEQ ID NO: 33840 - DNA, 50 bp, homo sapien
ggaggtacctgtaaagttgtggagargccctaatggcacacatagaagcc

SEQ ID NO: 33841 - DNA, 50 bp, homo sapien
tgataatagcagtactttactactcrgaaacagtactaatatgacaacca

SEQ ID NO: 33842 - DNA, 50 bp, homo sapien
agttcaagtccttagggtcaaatgamatacatgctaaaagagcaaaacaa

SEQ ID NO: 33843 - DNA, 50 bp, homo sapien
tgtaagtattgactaaggcaaggacraatgttatcctctgacttggaaaa

SEQ ID NO: 33844 - DNA, 50 bp, homo sapien
acatttcctatctccagtcgtttaaygcttcaactatccaaaattgcttc

SEQ ID NO: 33845 - DNA, 50 bp, homo sapien
caaaaccattctgtgaagataaagcraacatttgggagaacaaaaataaa

SEQ ID NO: 33846 - DNA, 50 bp, homo sapien
cctcatttgaaagatggtaatacacygggttctttagaggtactatgtta

SEQ ID NO: 33847 - DNA, 50 bp, homo sapien
tgaatggtccaatattcttgctatawatcattttaaaaacacttatcagt

SEQ ID NO: 33848 - DNA, 50 bp, homo sapien
ttttgcttccttttatctaaagccargataataatactgacctcatgaat

SEQ ID NO: 33849 - DNA, 50 bp, homo sapien
aaggaatgtatcactgagtacattayctgagtatattcattagaagagta

SEQ ID NO: 33850 - DNA, 50 bp, homo sapien
ttctgaggactctccagatttttgtsaatgagatctcaatagtcatccat

SEQ ID NO: 33851 - DNA, 50 bp, homo sapien
ttgaatctcatggcctctcagagctraaagaatcattctgctctttgctt

SEQ ID NO: 33852 - DNA, 50 bp, homo sapien
catgcatgcagaaaagcctagcgtcragaagaccctgactgcctggtgaa

SEQ ID NO: 33853 - DNA, 50 bp, homo sapien
tttttctcttgattctctaatagcaytaacctcacatgttatgacatttc

SEQ ID NO: 33854 - DNA, 50 bp, homo sapien
tgttaacaaagtgaatgaatgtatamcacaaatggttgagccttccatgg

SEQ ID NO: 33855 - DNA, 50 bp, homo sapien
catcttcaagccaaggagaatgaccygcaacaggttcttccctcacagcc

SEQ ID NO: 33856 - DNA, 50 bp, homo sapien
gacccatacaatatggtttcaattaygtggaagatgaaaggaagaacagt

SEQ ID NO: 33857 - DNA, 50 bp, homo sapien
gagaagacttcatgcaggttacccayggtacaaggcagtagtgatggccc

SEQ ID NO: 33858 - DNA, 50 bp, homo sapien
aaagggacacatgtattaaggtctasaacatgaaatagtaggaagagtta

SEQ ID NO: 33859 - DNA, 50 bp, homo sapien
ccctccttcagctgtaaaagcaacaratgtcctaatgggcttttccatcc

SEQ ID NO: 33860 - DNA, 50 bp, homo sapien
tttgggaaataccatgtttgagagamagtgtgttttgatagtatttgaat

SEQ ID NO: 33861 - DNA, 50 bp, homo sapien
aagacaccctttctggaaagatatarccctgcaggtccatagattggtaa

SEQ ID NO: 33862 - DNA, 50 bp, homo sapien
aagatgaccttcaccttgatgaagargtccgaacagagtatccccattta

SEQ ID NO: 33863 - DNA, 50 bp, homo sapien
agggaaggatcatcaccaagaccaayggtaattcctcagataacacagat

SEQ ID NO: 33864 - DNA, 50 bp, homo sapien
caactgggtttgatggtggctattayggtagatcatttctcaacattccc

SEQ ID NO: 33865 - DNA, 50 bp, homo sapien
tcatcttctgaaacttccttttaacrctgagaacacagacattgagagtg

SEQ ID NO: 33866 - DNA, 50 bp, homo sapien
ggaaataaaaggattctgtgcacaargcaagtagttcacagtgcactatt

SEQ ID NO: 33867 - DNA, 50 bp, homo sapien
agggctgcagagcataaggacgaccrctggattgaattcggacacattcc

SEQ ID NO: 33868 - DNA, 50 bp, homo sapien
aggggtaatacaacctttatcttacrgaaaggatgtaggaaaatcacaga

SEQ ID NO: 33869 - DNA, 50 bp, homo sapien
ctgatatggaggatgattgaattgaygtgaatctggagaaaggaatacaa

SEQ ID NO: 33870 - DNA, 50 bp, homo sapien
atgatgtcactagctcccctataaasgttctcaaagtaagtaatttccag

SEQ ID NO: 33871 - DNA, 50 bp, homo sapien
actctgcacccttgtatgctcattgwcaaaagaggtgggtgtcttgggat

SEQ ID NO: 33872 - DNA, 50 bp, homo sapien
ctcttcctgtatgtcaaaccaaaaasagtggtgtccagaaaatgcagtgt

SEQ ID NO: 33873 - DNA, 50 bp, homo sapien
atgtgattctgaaactgatttgaaamagcctggttcatttttactgtgtt

SEQ ID NO: 33874 - DNA, 50 bp, homo sapien
cagacagattattctcttttgttccrcattttcatagcactttccatttg

SEQ ID NO: 33875 - DNA, 50 bp, homo sapien
gtggacctttgcacttgcgtacttaygtaaaactgccgctcaggagagtc

SEQ ID NO: 33876 - DNA, 50 bp, homo sapien
gaaacagtaacactgggtgaggcagraagctcttcataagccttaggcct

SEQ ID NO: 33877 - DNA, 50 bp, homo sapien
ctctccagagtgacatacttgaggayagttctttagacaatagctaagct

SEQ ID NO: 33878 - DNA, 50 bp, homo sapien
ctggtggcagaattatagacatgacmataagctggtatagagctaccttg

SEQ ID NO: 33879 - DNA, 50 bp, homo sapien
aaaatctgcaaaacataattgggtcraagttaaaaatctagcttgtttgg

SEQ ID NO: 33880 - DNA, 50 bp, homo sapien
ccctgatattgatgaccaatcccaaygtaatagacatgttcaacatattc

SEQ ID NO: 33881 - DNA, 50 bp, homo sapien
ctataataacagaagtgacattaatsaaatcagtgatggtatccataaag

SEQ ID NO: 33882 - DNA, 50 bp, homo sapien
gtcccatgaaattggaacaataagamattaaaagtttggacatatttttc

SEQ ID NO: 33883 - DNA, 50 bp, homo sapien
gtgcttctcaaggtagaaaggtgccracactcatccagggagaagccccg

SEQ ID NO: 33884 - DNA, 50 bp, homo sapien
tgtcctctttttgcccaaactatagsataatggtgataaaactacatgat

SEQ ID NO: 33885 - DNA, 50 bp, homo sapien
gagtgaggagggagagaaaaccagargtcccggtaccagaaaagaaagtt

SEQ ID NO: 33886 - DNA, 50 bp, homo sapien
gtcaactgcattacgggtaataagarcaaagccgtataatactttactat

SEQ ID NO: 33887 - DNA, 50 bp, homo sapien
ataatgctttgcttctcagtttgcaraatttaatgcatctaattctgata

SEQ ID NO: 33888 - DNA, 50 bp, homo sapien
tttgactagctcattgtgagagataraaaattcaaattggagaaggtccc

SEQ ID NO: 33889 - DNA, 50 bp, homo sapien
aaaagctaacttccaatttaatgtayatcatgtccaagtcatttatataa

SEQ ID NO: 33890 - DNA, 50 bp, homo sapien
agaagaggcagatctcttgaagataygtctggcatcaagtcacagagcca

SEQ ID NO: 33891 - DNA, 50 bp, homo sapien
gatgggagtgatttattcaagaaaartgagatggagcttcacaaatggaa

SEQ ID NO: 33892 - DNA, 50 bp, homo sapien
gcttttttaaagaataccttgtaatragctgaaatgcaactttaggagaa

SEQ ID NO: 33893 - DNA, 50 bp, homo sapien
gaaagtctcctgtgtgaaaaaatctraacactatatacacattcaaattt

SEQ ID NO: 33894 - DNA, 50 bp, homo sapien
catgagttggtaacgttgagggtgartagtagatacatggacatttatta

SEQ ID NO: 33895 - DNA, 50 bp, homo sapien
gcaacgtaacttgtgtttgaaccaaytatacacacacacacacatatgca

SEQ ID NO: 33896 - DNA, 50 bp, homo sapien
ctgagcaatctcaggttgttatgagragtagagaatatgtaaatatggga

SEQ ID NO: 33897 - DNA, 50 bp, homo sapien
ttcattgtcggttccattgtagatasagactgagacagacaggaggcagc

SEQ ID NO: 33898 - DNA, 50 bp, homo sapien
tctcagagatgctcaattgtattcartctccactcattcaactctgttca

SEQ ID NO: 33899 - DNA, 50 bp, homo sapien
taagcacttggagatttatttaactraaggagtcattccaccagaaagca

SEQ ID NO: 33900 - DNA, 50 bp, homo sapien
tttacttgtaagctaacaatttaaayggccacagttttatgcatgctggt

SEQ ID NO: 33901 - DNA, 50 bp, homo sapien
ttgtccgcaggccttctctaaacacragacttgggcccgatctgtagctt

SEQ ID NO: 33902 - DNA, 50 bp, homo sapien
gcagcctttatctttgatttataaarctctagaatggacttctcccacac

SEQ ID NO: 33903 - DNA, 50 bp, homo sapien
attgttctcttctattgttctatccwaatgataatttctaagagacttaa

SEQ ID NO: 33904 - DNA, 50 bp, homo sapien
tttaacagaattgtacggaaaagaaygggctgccttagaagagactggcc

SEQ ID NO: 33905 - DNA, 50 bp, homo sapien
tttaaagcaaacccagatcttatacyggaatgtcttattagagtttttcc

SEQ ID NO: 33906 - DNA, 50 bp, homo sapien
gaaggtgaaggactcagcttcaccasatacacttgagactcctttatagg

SEQ ID NO: 33907 - DNA, 50 bp, homo sapien
gcagctcacttctgtctcttctctaygttgggcctaactgaagattttca

SEQ ID NO: 33908 - DNA, 50 bp, homo sapien
tttggacaggattatttataaaagargtctatgcacatttttagatgtct

SEQ ID NO: 33909 - DNA, 50 bp, homo sapien
ttaattaatcctgcattatgtctagyaaaacatcacgcgcccttgagaac

SEQ ID NO: 33910 - DNA, 50 bp, homo sapien
taacaagagtgagaaagtcaaggaaygtggaaagtgaatattatttgaag

SEQ ID NO: 33911 - DNA, 50 bp, homo sapien
taagtgtgtaagtgaattgtaggggwagaaaaagagatggtatttaaact

SEQ ID NO: 33912 - DNA, 50 bp, homo sapien
gtgtgtaactgtaagggttgtgtaaktaaaggtgacacagaaaagggaac

SEQ ID NO: 33913 - DNA, 50 bp, homo sapien
gtgagagaacggaatataactctaartcaagcgtaaaaaatgctatatgg

SEQ ID NO: 33914 - DNA, 50 bp, homo sapien
aataccaagtgccgtctcaaatctayctggatggcttgagatatgagagt

SEQ ID NO: 33915 - DNA, 50 bp, homo sapien
ctcaggccattgcttgagcctcaccyaataatttggattctgatatgaaa

SEQ ID NO: 33916 - DNA, 50 bp, homo sapien
gattgtaaaggctttgtaagtattarctatcattaactcacctggaaggg

SEQ ID NO: 33917 - DNA, 50 bp, homo sapien
tcgtctaatactatttctcaaaagastattttcaacaattgtggttattt

SEQ ID NO: 33918 - DNA, 50 bp, homo sapien
ctggaaatgaagtccatctgactccratgaaatgccaaattcattgagta

SEQ ID NO: 33919 - DNA, 50 bp, homo sapien
ggcctgtggaagggggcacaaaggaragcaagttgcacaagctgtggagg

SEQ ID NO: 33920 - DNA, 50 bp, homo sapien
atgattcctgccagagggcttgtgayggctccttttttgcttttcacaat

SEQ ID NO: 33921 - DNA, 50 bp, homo sapien
agatgctagagagataaaaatataargcatgaaccttggcctcacagaca

SEQ ID NO: 33922 - DNA, 50 bp, homo sapien
tcaggtattcatttgaattatcaacratttttggacattcttaataataa

SEQ ID NO: 33923 - DNA, 50 bp, homo sapien
gttcctttgggttcaaactttgtaamctgagattctaaggcctttcttgt

SEQ ID NO: 33924 - DNA, 50 bp, homo sapien
tttgcctgtctctaaacacattcaayttcaaatttaaccccttcttccag

SEQ ID NO: 33925 - DNA, 50 bp, homo sapien
ctctgaaagcttcttctgattttgaragtctatatattcaaagatttatg

SEQ ID NO: 33926 - DNA, 50 bp, homo sapien
gtgtgtgtttaaggtgtctcctttayagcttgataattatgtttggagta

SEQ ID NO: 33927 - DNA, 50 bp, homo sapien
tgctttgatgcgggctcgtttctcaygttccagtctagaataaaaaaagc

SEQ ID NO: 33928 - DNA, 50 bp, homo sapien
caagtcttgtctaagatgtctgaacyattaaatttaccattttgtttttc

SEQ ID NO: 33929 - DNA, 50 bp, homo sapien
gccttttgtcattccacttggaaagrcaatttagtgctatgttttttgaa

SEQ ID NO: 33930 - DNA, 50 bp, homo sapien
atgagagaatgattagattttagtayatctctctggatactgatttctgt

SEQ ID NO: 33931 - DNA, 50 bp, homo sapien
ctaatacaaccctctgcttacagaartgggcaaactgaggctgaaagttg

SEQ ID NO: 33932 - DNA, 50 bp, homo sapien
ctctttcagctgtgactgaggactgmcactttgtgctttgacattgaaaa

SEQ ID NO: 33933 - DNA, 50 bp, homo sapien
atgttgctaatttgtgtacttacagrcactttagaaaatgtttagactgc

SEQ ID NO: 33934 - DNA, 50 bp, homo sapien
tagggggctcatttatggagctgaaytgcaacgtccgtctaaggaacagg

SEQ ID NO: 33935 - DNA, 50 bp, homo sapien
cagaatcactcacatgagacgtgtayacatgtaatagactttactgaatg

SEQ ID NO: 33936 - DNA, 50 bp, homo sapien
acacagaatcaaagccaaacaaccasacaatatacattacagtcataccc

SEQ ID NO: 33937 - DNA, 50 bp, homo sapien
agagcccatatctcaattgacaggaraagaacacggaggagggggaaaga

SEQ ID NO: 33938 - DNA, 50 bp, homo sapien
ttctgggttacatagatgaattacayagtgatgaagtctgaaattttagt

SEQ ID NO: 33939 - DNA, 50 bp, homo sapien
ggggagagccttatgcagaattaccragtaaaagatgtctctcttcggca

SEQ ID NO: 33940 - DNA, 50 bp, homo sapien
tggatgtgcctccttcctttggacastattgctctttgtctcatatttaa

SEQ ID NO: 33941 - DNA, 50 bp, homo sapien
ccaagtgacaagttgagagagaaaartgatcgttcacatgatgcataaaa

SEQ ID NO: 33942 - DNA, 50 bp, homo sapien
attgctgatcacttgattatttgggyataatgttccaaatggaatacatg

SEQ ID NO: 33943 - DNA, 50 bp, homo sapien
ctttcaatgtcacagcagaaaacacygagaataactggaattttatgctt

SEQ ID NO: 33944 - DNA, 50 bp, homo sapien
gtactttggactgcgggaagaagacrgtctctgcctctgctgctacttct

SEQ ID NO: 33945 - DNA, 50 bp, homo sapien
ctcattgcacatacctatattgtacyacttatcccacagtgtaccattat

SEQ ID NO: 33946 - DNA, 50 bp, homo sapien
aatgctttgctgatacaactcaatayacactttgaaaagtaaaacattca

SEQ ID NO: 33947 - DNA, 50 bp, homo sapien
gactcagaaatgacattaataaaggkaatagcagacaaggaacttgaaat

SEQ ID NO: 33948 - DNA, 50 bp, homo sapien
gttaatttcagagctgaatggctgakactataaattttgactactgtaaa

SEQ ID NO: 33949 - DNA, 50 bp, homo sapien
tttgctttcttgcccactatgtatcrcctatgtagacttggacaagctac

SEQ ID NO: 33950 - DNA, 50 bp, homo sapien
attttatctgtgtaaactaagagtcrcatcacaaggcctccaggatattt

SEQ ID NO: 33951 - DNA, 32 bp, homo sapien
ctactttaagactttayaggtaattgaactaa

SEQ ID NO: 33952 - DNA, 50 bp, homo sapien
ggttattgttttttgcttgttgataygtttaagttcatggtggattctgg

SEQ ID NO: 33953 - DNA, 50 bp, homo sapien
aaaggtaaaaataaacgtgcattaartaaataagattacacatttagtga

SEQ ID NO: 33954 - DNA, 50 bp, homo sapien
ttggccaataaatgcaaaccacacayaattttgaacccattctttatacc

SEQ ID NO: 33955 - DNA, 50 bp, homo sapien
aatctttgtatattagttcacatggrataattttgcaatttgaaggcaat

SEQ ID NO: 33956 - DNA, 50 bp, homo sapien
ttcatctttctcaactttaatcttcycaatctcttacatatcaatacaga

SEQ ID NO: 33957 - DNA, 50 bp, homo sapien
taataaaatattttcaacctaaatawtatgatatctgcaatcattatgtt

SEQ ID NO: 33958 - DNA, 50 bp, homo sapien
tcatgcaatgctacttgttatcacamcgattcagatctaaaacagatcca

SEQ ID NO: 33959 - DNA, 50 bp, homo sapien
atgagccacggcgcccggccatctargcatttttagagctccataatgct

SEQ ID NO: 33960 - DNA, 50 bp, homo sapien
ggtgctgaagcttagatgcataaacygaacaaatcatcaggaagctataa

SEQ ID NO: 33961 - DNA, 50 bp, homo sapien
ttactaatgatgcaactgaggcccgyaggagtcaggttgcctataaaggc

SEQ ID NO: 33962 - DNA, 50 bp, homo sapien
ggaacaagaaaagaagtttgccacaytatttatattaccaaaaagttgaa

SEQ ID NO: 33963 - DNA, 50 bp, homo sapien
acttaacagtttctactttgtgtcaygcctaggctagagaatacttttca

SEQ ID NO: 33964 - DNA, 50 bp, homo sapien
gacacaaagtagaaactgttaagtgyagcaaaaatagagaaaattacata

SEQ ID NO: 33965 - DNA, 50 bp, homo sapien
tgctctcttgatcttttatatcacawcttctgtgtagggatttgcacagc

SEQ ID NO: 33966 - DNA, 50 bp, homo sapien
aacagtcccagaccaagaaaatacaktgcatactccagaagggtgaaagc

SEQ ID NO: 33967 - DNA, 50 bp, homo sapien
ttaataaaaacttcccaaactgaaaygtaaacatcgtttaaaaagaacaa

SEQ ID NO: 33968 - DNA, 50 bp, homo sapien
gccgggcagctttgcacctagccagraatctttgatcccaggaaaaagag

SEQ ID NO: 33969 - DNA, 50 bp, homo sapien
gctgcaaatttaagaggtgagaaaargaatatgtttgttcctaggtttgt

SEQ ID NO: 33970 - DNA, 50 bp, homo sapien
agagatggtcctaagtcagaagtcaygagcttgtgtccagacaattggac

SEQ ID NO: 33971 - DNA, 50 bp, homo sapien
tttagtaaaggtaacaaaggaaaackattatgtaagtacctacttttcaa

SEQ ID NO: 33972 - DNA, 50 bp, homo sapien
aacttgatttaaaatctataagcagrattgttcaagacttggagttttga

SEQ ID NO: 33973 - DNA, 50 bp, homo sapien
ctccttccccattttgagtgcatgawgtgaaaacttagcttgtccagcca

SEQ ID NO: 33974 - DNA, 50 bp, homo sapien
cgagaaaggacctgaatctacacatsaagttaggactcaaatgagctgat

SEQ ID NO: 33975 - DNA, 50 bp, homo sapien
gtatcttcacatgtgatagggcgaawaatgaataaatatgtaagatgatg

SEQ ID NO: 33976 - DNA, 50 bp, homo sapien
aacattactaataatcaggaaaatasatcataagcaactataagatacca

SEQ ID NO: 33977 - DNA, 50 bp, homo sapien
aatacatgcactgacaaatattccaytaaaggagagacttgtttacagca

SEQ ID NO: 33978 - DNA, 50 bp, homo sapien
gatgcctatttgctcctgctcaaaaycttcttttattcactgtgagttcc

SEQ ID NO: 33979 - DNA, 50 bp, homo sapien
acataacatttatatcagtagttctsaaacattaataagtgaagaagtcc

SEQ ID NO: 33980 - DNA, 50 bp, homo sapien
atcttagagataaagaaatgaagacmcatagagttgaaatgatttcaaaa

SEQ ID NO: 33981 - DNA, 50 bp, homo sapien
caaaaattagcagtccacttgataayctacttcatttaaaatctgctaca

SEQ ID NO: 33982 - DNA, 50 bp, homo sapien
tggagttcaaagtctggtggggaaayggcaaatctgacaagtaagcaaaa

SEQ ID NO: 33983 - DNA, 50 bp, homo sapien
atgaaatagagtaaaaaacattgaawctataatcagcaaaagggtaagca

SEQ ID NO: 33984 - DNA, 50 bp, homo sapien
aaatgaaaaaggactcaaaatatcamgtcaaggtcagtcaaactttgatt

SEQ ID NO: 33985 - DNA, 50 bp, homo sapien
tcagctatttgtcagaaaaataagaygcttaatcaatcagtgaaaatctt

SEQ ID NO: 33986 - DNA, 50 bp, homo sapien
gacccaatgccccaatacatgctcakaaaaaggtaactagagataatgaa

SEQ ID NO: 33987 - DNA, 50 bp, homo sapien
aaccccaaggccctgtcagataatayggattatgtgcttcatttgaatat

SEQ ID NO: 33988 - DNA, 50 bp, homo sapien
acataaaatctaaacagacgcttcayagacggtgaaatttcccttctctt

SEQ ID NO: 33989 - DNA, 50 bp, homo sapien
tatcaatgaagcctttataaataccwatatcttatgtcttattattttca

SEQ ID NO: 33990 - DNA, 50 bp, homo sapien
ctctagacactagatgaatgtctagsacttaataagctctcagtatgcat

SEQ ID NO: 33991 - DNA, 50 bp, homo sapien
accggggttggaaactggtagcctayggactatatcaggattcaaaactc

SEQ ID NO: 33992 - DNA, 50 bp, homo sapien
gtttggtgtcaacaatagtagcaaasagaacagagaagtgaatcactatg

SEQ ID NO: 33993 - DNA, 50 bp, homo sapien
tcacataaaaatgaggtgttaaacaytaattgcatacctggcacctgtgt

SEQ ID NO: 33994 - DNA, 50 bp, homo sapien
tgtgagatacaaacaacttcaaggarctcacaaatccagttcaagacaga

SEQ ID NO: 33995 - DNA, 50 bp, homo sapien
tggaaatccatctgacagaaaggatragaactcaagtttatttcagttga

SEQ ID NO: 33996 - DNA, 50 bp, homo sapien
tcataggggtttttgtaattccagaygcaataatgtatgcacagtgccca

SEQ ID NO: 33997 - DNA, 50 bp, homo sapien
tgtttttagttttaaccataatagaygatgcagcagagaacattttgata

SEQ ID NO: 33998 - DNA, 50 bp, homo sapien
ggtaagagcaggataaagcataagcratcctcaaagagtattgagggtgc

SEQ ID NO: 33999 - DNA, 50 bp, homo sapien
agatatacctattaaaaggaccatayagttactcatgttcttggtccaga

SEQ ID NO: 34000 - DNA, 50 bp, homo sapien
atattttggggtaccatagttataamggcgaataaacatctatacttgcg

SEQ ID NO: 34001 - DNA, 50 bp, homo sapien
gcaaaggtttggtaagaatctagacygtagatcgatgtattaatagtttg

SEQ ID NO: 34002 - DNA, 50 bp, homo sapien
atattgtgttaatagtatcatctaayaggtgctgagaacttggtgtgagc

SEQ ID NO: 34003 - DNA, 50 bp, homo sapien
ttcaaagggattagcatgtagttgawctagaagtagatgcttaatgcatc

SEQ ID NO: 34004 - DNA, 50 bp, homo sapien
ccgtggtcttttaaaagagaaagtayggttatagagatatacacatttgt

SEQ ID NO: 34005 - DNA, 50 bp, homo sapien
tagtaaaaactaagtttctaaacatkatagtcctgtgatctggacctgaa

SEQ ID NO: 34006 - DNA, 50 bp, homo sapien
aaactaacttttctgtcatcccataygctatttagaagttcatctcaagt

SEQ ID NO: 34007 - DNA, 50 bp, homo sapien
tataatgttcattttaagaatcaaastgaggttctgagcgtttagatgac

SEQ ID NO: 34008 - DNA, 50 bp, homo sapien
atttattcatactttccgtcgtcctsaatcatgttattataagacaaagc

SEQ ID NO: 34009 - DNA, 50 bp, homo sapien
ggccctcgagtcatatttcttgaagscaaagtagtctcctctgtccctag

SEQ ID NO: 34010 - DNA, 50 bp, homo sapien
aatagattattcagctacaccttctwacatatcctgcaaccagatgtagt

SEQ ID NO: 34011 - DNA, 50 bp, homo sapien
gtcattgttgacacttcaccttctawtaattttaattttgaaaatgatcg

SEQ ID NO: 34012 - DNA, 50 bp, homo sapien
cttgtcacctgtgccattgcctttaygtttgtgcattttgtttcttgttt

SEQ ID NO: 34013 - DNA, 50 bp, homo sapien
gagaaggagagaagagaggagataaragctgtggccccttggggagccga

SEQ ID NO: 34014 - DNA, 50 bp, homo sapien
agtgtgaaaacagactaatacatcaygcaaaatctgggagccccaaagca

SEQ ID NO: 34015 - DNA, 50 bp, homo sapien
ttgcattgtttatgtcagaatcgtarggacaactttctgaccagttttcc

SEQ ID NO: 34016 - DNA, 50 bp, homo sapien
ccattccctgcgttgcctgttaaagraaactcattctacaagacacatct

SEQ ID NO: 34017 - DNA, 50 bp, homo sapien
gctagtttcagacttttattctgcarcttctccacatctcttagccttca

SEQ ID NO: 34018 - DNA, 50 bp, homo sapien
ctgtctgtctttggcagttttgatayctgacatttattaagagttttcca

SEQ ID NO: 34019 - DNA, 50 bp, homo sapien
tcacctgcatttattatgaaaggcaktgattatttagcattttaacctga

SEQ ID NO: 34020 - DNA, 50 bp, homo sapien
gaataaagcatagctttgttcaggtyaaaatgctaaataatcactgcctt

SEQ ID NO: 34021 - DNA, 50 bp, homo sapien
tctacacattcattagtactaacacrctatgctccatcctggtccttaaa

SEQ ID NO: 34022 - DNA, 50 bp, homo sapien
tctaggacttttgcaaagcatcttasaatgcaagaattacagcttgttag

SEQ ID NO: 34023 - DNA, 50 bp, homo sapien
ttatttcctccttgggccattcagascgtcgagtctcctaaatgtcagta

SEQ ID NO: 34024 - DNA, 50 bp, homo sapien
ataagtattacttgaatgcctatcaygtgtcgggcactggtaagtcctgt

SEQ ID NO: 34025 - DNA, 50 bp, homo sapien
gtcaaaaagtagaggacccagaaaaygttggcactgaatacattttgagt

SEQ ID NO: 34026 - DNA, 50 bp, homo sapien
cccgggtggaagagatgagctattgmaggtggatacagacttggcgcagg

SEQ ID NO: 34027 - DNA, 50 bp, homo sapien
tagactgaagttactgagcaataggkagataagatagtgatgcatttcaa

SEQ ID NO: 34028 - DNA, 50 bp, homo sapien
aaataacttgctcagtgtcatatagyaagtcggaggcaagactagaacta

SEQ ID NO: 34029 - DNA, 50 bp, homo sapien
aatcccatctaatctataatgcaacyggctggattcaagcaaaaacacgg

SEQ ID NO: 34030 - DNA, 50 bp, homo sapien
ggccttgcctttctggagcaacataygtagacgtgggtgcacacccacac

SEQ ID NO: 34031 - DNA, 50 bp, homo sapien
agagcatcatcactacttccatagtwacaacatcaacagcgatataacag

SEQ ID NO: 34032 - DNA, 50 bp, homo sapien
attgaacaattcatcatgttcatgaraatcagagacagcctctggcattt

SEQ ID NO: 34033 - DNA, 50 bp, homo sapien
tagatgggatttattacatggggacsaaaagatgtggaaatttataggtg

SEQ ID NO: 34034 - DNA, 50 bp, homo sapien
agagtttggacttggccctgtttgcmaaatatgttgttaaccttagctgc

SEQ ID NO: 34035 - DNA, 50 bp, homo sapien
tatttactaaaaagaaatcctagccrataaaaatttcaatgatgcttatg

SEQ ID NO: 34036 - DNA, 50 bp, homo sapien
tttggaggaaggaacactgggctcgratcaaggacatttaaattccagac

SEQ ID NO: 34037 - DNA, 50 bp, homo sapien
tgggttgttctttgccggcatatagraatacaattgatttctacatatta

SEQ ID NO: 34038 - DNA, 50 bp, homo sapien
tcccagctgggagaaaccaacatgaygaaaagacaaagaatactggagaa

SEQ ID NO: 34039 - DNA, 50 bp, homo sapien
aaataaaaccatttttttgtgaacartgtgatcatatatgtagaaaatcc

SEQ ID NO: 34040 - DNA, 50 bp, homo sapien
ttttcagggggacagtgtgttataaktgcattttgaaaatgaacaaagca

SEQ ID NO: 34041 - DNA, 50 bp, homo sapien
agtgttgctcaaaggacctggtgtaraaagtgtaagagtcttggatgtac

SEQ ID NO: 34042 - DNA, 50 bp, homo sapien
ccctgtttatactcgggcctcttgaraacagggaatgtgctttacccatt

SEQ ID NO: 34043 - DNA, 50 bp, homo sapien
caacagttatcctacaattagtctcyatgtctgattaacttgcttatttc

SEQ ID NO: 34044 - DNA, 50 bp, homo sapien
ttgaaacaacccagatcaggagagarattgtactatggccaaatgataga

SEQ ID NO: 34045 - DNA, 50 bp, homo sapien
attgtgaccagagaaagtcttatcastattgcattcgatactcaagcttt

SEQ ID NO: 34046 - DNA, 50 bp, homo sapien
ttttaacaaattaataaacaaaggcragactgctgtaagtttaaaatagg

SEQ ID NO: 34047 - DNA, 50 bp, homo sapien
gttacatcaggagcatttaatgaagmagctatttgtaaagctggaacttt

SEQ ID NO: 34048 - DNA, 50 bp, homo sapien
ccgggcaccatgcaaagatcattacrgaatacacgccttcaggaagacca

SEQ ID NO: 34049 - DNA, 50 bp, homo sapien
agtggtgggaatttggccgagtccaygtgtcagtccatccacactcactc

SEQ ID NO: 34050 - DNA, 50 bp, homo sapien
caacatctctatccaccctactacaycaatggcactgagaagtcaactca

SEQ ID NO: 34051 - DNA, 50 bp, homo sapien
aaattcaaactctgcaatgatacacwaagccctttaagatctccgcgtcc

SEQ ID NO: 34052 - DNA, 50 bp, homo sapien
taacccatgtctgtgaacaccacaayggcgatttgtgtctcctgtgtcat

SEQ ID NO: 34053 - DNA, 50 bp, homo sapien
ctaagataggataactggatacactraagtaagtacaaaatactactaac

SEQ ID NO: 34054 - DNA, 50 bp, homo sapien
agagtatttatttgcatttacatgawtagtgatattggccatctttcata

SEQ ID NO: 34055 - DNA, 50 bp, homo sapien
tggtcataatttaagctgaaaggaartatgagtgaaagcactgaaagaaa

SEQ ID NO: 34056 - DNA, 50 bp, homo sapien
agcaatgaatttatggaaagcatacratagatacagcattttcaactcta

SEQ ID NO: 34057 - DNA, 50 bp, homo sapien
tgaattgatccattttatcctctgasgaactgagagctttttctagccaa

SEQ ID NO: 34058 - DNA, 50 bp, homo sapien
ttataattaaaaattaaggtctgaayaatagagaaatcaatctcagtaaa

SEQ ID NO: 34059 - DNA, 50 bp, homo sapien
gaaccactctaataaaaacaagtcarctttcctctgagaaccacgtactt

SEQ ID NO: 34060 - DNA, 50 bp, homo sapien
tgtataaccaacacattcatcaagayatacaacatttcacttgggaaaat

SEQ ID NO: 34061 - DNA, 50 bp, homo sapien
caagtaatatggacgtagaggatggmagaattctgtaaaaccacttctgg

SEQ ID NO: 34062 - DNA, 50 bp, homo sapien
cagatttgattccacatttttaacaktaagcccattttatgcctgtttag

SEQ ID NO: 34063 - DNA, 50 bp, homo sapien
atgttactaagtagaaaccaatgccratgatattaaataagtaaccatac

SEQ ID NO: 34064 - DNA, 50 bp, homo sapien
cagcacagaggtactggattaagtayaaagaggagtaaagagaatgggaa

SEQ ID NO: 34065 - DNA, 50 bp, homo sapien
atggtcattactcatacttctggctraaatcaccttcatatgcactaatt

SEQ ID NO: 34066 - DNA, 50 bp, homo sapien
ggggaaaggcagacaaggatatcacracttcttaaataattctttcaact

SEQ ID NO: 34067 - DNA, 50 bp, homo sapien
actggtgtgaagctgacacaagatamgtcacacaaagttatcagaacaat

SEQ ID NO: 34068 - DNA, 50 bp, homo sapien
cttctcttttcatattcaagtttcartcatgttcagaaaaataaaacaca

SEQ ID NO: 34069 - DNA, 50 bp, homo sapien
cttgaacttcagtccatcacattacrgcattgttacagcttcaattaaat

SEQ ID NO: 34070 - DNA, 50 bp, homo sapien
gtggtcaatcctcaaaatgataatawcctatcaaaggactgacctacact

SEQ ID NO: 34071 - DNA, 50 bp, homo sapien
ctactctataacttaaggtcacctarcatattgtcttaaaaaccattcaa

SEQ ID NO: 34072 - DNA, 50 bp, homo sapien
ctttattttcattcatttgcacatayccttattgaaaagtataaacaaag

SEQ ID NO: 34073 - DNA, 50 bp, homo sapien
aataggtagatcaatggatagatgayggatagacagagggatagatagat

SEQ ID NO: 34074 - DNA, 50 bp, homo sapien
atttatctatctatacattcatcaayctatctatccctccatctatctat

SEQ ID NO: 34075 - DNA, 50 bp, homo sapien
catcaacatcattagcaaaacatgaytcaggtgttcggctgggcagaccc

SEQ ID NO: 34076 - DNA, 50 bp, homo sapien
cggagagatcattccaccatcttaayaacaacagagtttttctgattaat

SEQ ID NO: 34077 - DNA, 50 bp, homo sapien
aactaatacaggttgtgtggctaaaytgcatctttcggattgaggccccc

SEQ ID NO: 34078 - DNA, 50 bp, homo sapien
atgattaatttcattgatggttaacrcatttgattgtcaaggaagagacg

SEQ ID NO: 34079 - DNA, 50 bp, homo sapien
caacatgtctccaccagtatcatacmgactggtttccgcaccttaaaact

SEQ ID NO: 34080 - DNA, 50 bp, homo sapien
ttctagtaacggccattaggtgttaygtttgaagttggtttagaagagat

SEQ ID NO: 34081 - DNA, 50 bp, homo sapien
tatctcttaatgtgatcagaatatayggtttagaaaaagccttctgtcta

SEQ ID NO: 34082 - DNA, 50 bp, homo sapien
tgtttcatttcctgtcactgtaaacyaattcatcgtgtggcttttgtggg

SEQ ID NO: 34083 - DNA, 50 bp, homo sapien
aagtcttctacacattgagtatctgratttacatcacttcagtcaagggt

SEQ ID NO: 34084 - DNA, 50 bp, homo sapien
taatatagaaccaaatgagaataaaygattggatttttttttcagtcatc

SEQ ID NO: 34085 - DNA, 50 bp, homo sapien
tacttttgtttgtagagagatgcaasgacttaaaaaaagcattctctgtg

SEQ ID NO: 34086 - DNA, 50 bp, homo sapien
agcccagctcacagccctgccatcamaggtgccacacactcacatcaggc

SEQ ID NO: 34087 - DNA, 50 bp, homo sapien
ccccggccctgaattttgggttacartatgcttctcaagaaaactcagag

SEQ ID NO: 34088 - DNA, 50 bp, homo sapien
ggggcagcactgtcagtgatccttarcaggtaagacaaattcaaatttta

SEQ ID NO: 34089 - DNA, 50 bp, homo sapien
tgtcatgttgcccctcagctaaatasgaccttcccgttctgaggaaagct

SEQ ID NO: 34090 - DNA, 50 bp, homo sapien
accatgcccctcacgtgttaactacrccatcctcacagcagctggatgag

SEQ ID NO: 34091 - DNA, 50 bp, homo sapien
tgccagatctgagtttggttccaggratctggtgatcaataagataaacc

SEQ ID NO: 34092 - DNA, 50 bp, homo sapien
aaagatgttttcaatttattgcgtamctgtgttcccaggctatctaagga

SEQ ID NO: 34093 - DNA, 50 bp, homo sapien
aaagatcattttgattgtaagtcttmaacatgtggacatcttatgttttc

SEQ ID NO: 34094 - DNA, 50 bp, homo sapien
aaagtttgtatccaagtgtctaacayacggtaaatgctcagaagatgtct

SEQ ID NO: 34095 - DNA, 50 bp, homo sapien
aacagatcagaagaaagattcaaaasaaatattcagagaacacaatagta

SEQ ID NO: 34096 - DNA, 50 bp, homo sapien
taaagtaatggagaaattgaaagtcrcttgcttaatggaaaaatatgtag

SEQ ID NO: 34097 - DNA, 50 bp, homo sapien
acagaaagaaatattttatggccaayataatagtgtatcaaaccactttt

SEQ ID NO: 34098 - DNA, 50 bp, homo sapien
acacccaggacaaatgcattgataasaaaaacatttaaaagcttgaaaca

SEQ ID NO: 34099 - DNA, 50 bp, homo sapien
aggggagagtggaatggtgcaatgaygcttgatgtggcatgtttggaggg

SEQ ID NO: 34100 - DNA, 50 bp, homo sapien
actgtgatgatctgatcaaaactcgsaaggctgaaacagtcatctttgtc

SEQ ID NO: 34101 - DNA, 50 bp, homo sapien
taattcatttaacaggtggacttaakagtatcttataaaatttgatgaaa

SEQ ID NO: 34102 - DNA, 50 bp, homo sapien
taacctcttcctgttgtcttaaataygctttaaccaacgaaaaagttttt

SEQ ID NO: 34103 - DNA, 50 bp, homo sapien
gaacccagactttttctgaagcctargatacttgcaccatgccaattaac

SEQ ID NO: 34104 - DNA, 50 bp, homo sapien
gacttcaataacatacaaataaacaragtatacagagcaacaacctggat

SEQ ID NO: 34105 - DNA, 50 bp, homo sapien
ctagactgatatgccactcaatcggrcagtcatttagcttattcaccacc

SEQ ID NO: 34106 - DNA, 50 bp, homo sapien
tgggagagaggttgatatttgagcaytagaaagaaggcctgtgtaacagg

SEQ ID NO: 34107 - DNA, 50 bp, homo sapien
agactgaagagataagcacaggctaygacagaagggtcttttaggtcatt

SEQ ID NO: 34108 - DNA, 50 bp, homo sapien
accaaagcaacaatctccaaaaagcrgctagtgacagaaataagcctgca

SEQ ID NO: 34109 - DNA, 50 bp, homo sapien
taagcctgcagatcctgagggccaasgtatgctgacaaatgaattagaca

SEQ ID NO: 34110 - DNA, 50 bp, homo sapien
agctcaatcaattcttttgcgctcaraatgtacagctgatattgtgaagt

SEQ ID NO: 34111 - DNA, 50 bp, homo sapien
gcaggcaggtcatgggtggcgtgtaratcacataggaagaggcgtatggc

SEQ ID NO: 34112 - DNA, 50 bp, homo sapien
tatcttgtcaacaggtcagtggatgracaaattatggctatatcaatacc

SEQ ID NO: 34113 - DNA, 50 bp, homo sapien
agcttctagtgttcagatggcttgaygaaaatttcaggagcagtacctga

SEQ ID NO: 34114 - DNA, 50 bp, homo sapien
ctagttcctgcctggaatgtctgtgragcccaccgtgaagttccccagct

SEQ ID NO: 34115 - DNA, 50 bp, homo sapien
actttatactgtacatttgattaacyggacaatctttaggaaaatataaa

SEQ ID NO: 34116 - DNA, 50 bp, homo sapien
agactcaggctaactttgtggagtgmaaacggaaaacagaactgccctgg

SEQ ID NO: 34117 - DNA, 50 bp, homo sapien
atggaattaatattacgttggtcaarttacctagataattgctttcattt

SEQ ID NO: 34118 - DNA, 50 bp, homo sapien
atataagactgtggtaaggtacaaasgcaaatgcaatttgcgttgactaa

SEQ ID NO: 34119 - DNA, 50 bp, homo sapien
atattatttctctacacaccttgaamatttagtgtattactggtaccctt

SEQ ID NO: 34120 - DNA, 50 bp, homo sapien
tagttcttgaattctagcatatttayggtttcaaacattggcacccgttt

SEQ ID NO: 34121 - DNA, 50 bp, homo sapien
aacacacctccagcctttgttggccrccgagcacaagtaaatcacacgcc

SEQ ID NO: 34122 - DNA, 50 bp, homo sapien
aaaattttacataatttaaaagttcsattcaacgttgaggttatagaaat

SEQ ID NO: 34123 - DNA, 50 bp, homo sapien
gggcccatccttggctgatcacataygttatacctgctctagaccttgtc

SEQ ID NO: 34124 - DNA, 50 bp, homo sapien
ggccatgttttcacaggtgagtagaygcacacaactaaatcggactaaag

SEQ ID NO: 34125 - DNA, 50 bp, homo sapien
ggatgtgcaaggtcaataacctcagrcccttcttggagtatgatcatttt

SEQ ID NO: 34126 - DNA, 50 bp, homo sapien
agggctgtttaaaggttttgttacaytctttacatttgcagggtttatct

SEQ ID NO: 34127 - DNA, 50 bp, homo sapien
atgctcaccaactttccagccagaayaagtgaggcttgaggggagttctg

SEQ ID NO: 34128 - DNA, 50 bp, homo sapien
gaagaattaacacacccttgagtagwaaatgatttgtacctttcactttc

SEQ ID NO: 34129 - DNA, 50 bp, homo sapien
tcacacagtgtatttgtagggtgtgkaataccgtattagtatttgtaaac

SEQ ID NO: 34130 - DNA, 50 bp, homo sapien
acggggatagaaataaataagatccragtcctgctctcaaggatacacag

SEQ ID NO: 34131 - DNA, 50 bp, homo sapien
atgtcattaagccagcatgaaaatcsaagttgaactcacaataagatatc

SEQ ID NO: 34132 - DNA, 50 bp, homo sapien
caatgctcagagtgcacttgggaaaycataagcaggtgattatcattgag

SEQ ID NO: 34133 - DNA, 50 bp, homo sapien
ggagtttgacactcatgtccctaaakatgtcattaagcaggccaacttgg

SEQ ID NO: 34134 - DNA, 50 bp, homo sapien
aaattagacaggacctcagaagtcamtaatgttatttggaacactatttg

SEQ ID NO: 34135 - DNA, 50 bp, homo sapien
gggttacaactccctggtctttctcraatgatcacccagagaagtagacc

SEQ ID NO: 34136 - DNA, 50 bp, homo sapien
ctgcctattctaggctaactataaartggtacttcatctttaaagctttt

SEQ ID NO: 34137 - DNA, 50 bp, homo sapien
ggtgctgcctttgtccactgaactcsgaaacagagccctaggagcccagt

SEQ ID NO: 34138 - DNA, 50 bp, homo sapien
ggctctttagctcagaaacagtcaargtggaaactctgcttgtaaaccct

SEQ ID NO: 34139 - DNA, 50 bp, homo sapien
agaccccctgattgcagagttacacraataattgaataaaaatcacaagt

SEQ ID NO: 34140 - DNA, 50 bp, homo sapien
agcttttattaatttgtatttgaackatttgcttacacagctctccgtcc

SEQ ID NO: 34141 - DNA, 50 bp, homo sapien
tgctgttagaccatttttaatttgarcaactaagaggttatttaaatcag

SEQ ID NO: 34142 - DNA, 50 bp, homo sapien
tgcagcaagcttttatgatcaaggasattctgttctacctttgggactgg

SEQ ID NO: 34143 - DNA, 50 bp, homo sapien
agatatttgcataactaaaagggagwcaagtactaatatccaagacaatg

SEQ ID NO: 34144 - DNA, 50 bp, homo sapien
ttgttactgaatagttcttaagcaawataaggattggatatagcacgagg

SEQ ID NO: 34145 - DNA, 50 bp, homo sapien
taagtttgaaaattttttgagtagaygggatatggtttgattataatcag

SEQ ID NO: 34146 - DNA, 50 bp, homo sapien
ttcataacagctttctctttttataygttaggatttaaccatgagatttc

SEQ ID NO: 34147 - DNA, 50 bp, homo sapien
aatgttaacaatattttctgtaaaayagatgatcagtctcacctccaatg

SEQ ID NO: 34148 - DNA, 50 bp, homo sapien
gctgaatgcaattgccttagtagccmagttaacatccaggccccatggag

SEQ ID NO: 34149 - DNA, 50 bp, homo sapien
ggccgatggtttagcctgctgatgayaaacaatattaaattttaagattt

SEQ ID NO: 34150 - DNA, 50 bp, homo sapien
ggaatcaagcttccttatgtggtatraatttcccattacaagaaacaaac

SEQ ID NO: 34151 - DNA, 50 bp, homo sapien
tattgtttgtcatcagcaggctaaaycatcggcctaggtttaaaaggcaa

SEQ ID NO: 34152 - DNA, 50 bp, homo sapien
aactatgttatgatagcttatatcaygtttttacacacttcatctccttt

SEQ ID NO: 34153 - DNA, 50 bp, homo sapien
aaatgctgcagttttcattgaactgsaaccttttattcagtctggatacc

SEQ ID NO: 34154 - DNA, 50 bp, homo sapien
cagatggagcggaaattaggagaaaygtagaacaggtacggttgacagtc

SEQ ID NO: 34155 - DNA, 50 bp, homo sapien
aaagcaaagcacagttctcaaaccarattgagtgtaaaatttcaatgcag

SEQ ID NO: 34156 - DNA, 50 bp, homo sapien
aaagagagagagtaagagatacagayggcatctcctgaacatcacagaca

SEQ ID NO: 34157 - DNA, 50 bp, homo sapien
cattgtatttcaagttcctctgttasaatcacaagtattgagaatgtggg

SEQ ID NO: 34158 - DNA, 50 bp, homo sapien
ggttcgagctctctgtgtgtgttacsggaagtccagaagtgccaggggag

SEQ ID NO: 34159 - DNA, 50 bp, homo sapien
gaaacctgactggctttgcaccggaycttctgtggatgaaattggaagtt

SEQ ID NO: 34160 - DNA, 50 bp, homo sapien
aagctttaagtttctggatggcaagraccatattatttatcagtatgtat

SEQ ID NO: 34161 - DNA, 50 bp, homo sapien
gtacagtggggtagagcttctgggastacgagattgctgatatagaagga

SEQ ID NO: 34162 - DNA, 50 bp, homo sapien
aaccagttcaccacaactattactcragagaatctgaactgaagtattgt

SEQ ID NO: 34163 - DNA, 50 bp, homo sapien
attattaaagaaagaaaaaaagatcragacttgccaaaaaaatccttaat

SEQ ID NO: 34164 - DNA, 50 bp, homo sapien
catcctaatcattctttcctgcataygtccagcttgattctcatctttta

SEQ ID NO: 34165 - DNA, 50 bp, homo sapien
tcttgggaaatattattcaaagacartgtcaccttatctttggatcagta

SEQ ID NO: 34166 - DNA, 50 bp, homo sapien
tgctttcgtgatgattaatttttaartgccaaatttgcaacaacaacaac

SEQ ID NO: 34167 - DNA, 50 bp, homo sapien
atgagcactgtgtctggccttgtaayccgttttcttaccagcacacttct

SEQ ID NO: 34168 - DNA, 50 bp, homo sapien
tctccacaacacatgaggagtgttayaaaagttatagctcttcaggtgga

SEQ ID NO: 34169 - DNA, 50 bp, homo sapien
ttggtctttgttactgtcttcctacyaggtacgagggcctgaaagtcact

SEQ ID NO: 34170 - DNA, 50 bp, homo sapien
tgtgtctacatgcacaagtgtgtgamatataggcatagttgagattgttt

SEQ ID NO: 34171 - DNA, 50 bp, homo sapien
aaaattaacttacctgcctgtattcyaaaattatcttgggtaatggatga

SEQ ID NO: 34172 - DNA, 50 bp, homo sapien
cactttgtactcacaatatcactccraggtaggtcttactattatcctat

SEQ ID NO: 34173 - DNA, 50 bp, homo sapien
cccatcttcttcttgtgctttgaaaktttaatcttcctattctttcatct

SEQ ID NO: 34174 - DNA, 50 bp, homo sapien
ctgcccgcagacatatctgccttaawaagagctattcctgttatatttgc

SEQ ID NO: 34175 - DNA, 50 bp, homo sapien
caagtgcagagaaaactgaatgtagkcctgattatttatggtctttgccc

SEQ ID NO: 34176 - DNA, 50 bp, homo sapien
ctgtgattgtaataaaatttgacaaygtactgaatattttatatttggac

SEQ ID NO: 34177 - DNA, 50 bp, homo sapien
gatatattccttgtactgtgttactraagttatgccgttgattagctgtt

SEQ ID NO: 34178 - DNA, 50 bp, homo sapien
gacagatttttactaacctcatttayggatacagaaaatgaagactcaga

SEQ ID NO: 34179 - DNA, 50 bp, homo sapien
tgatagaaaaggaaagtgaatatgcrgaaaagaagattggaaatacagaa

SEQ ID NO: 34180 - DNA, 50 bp, homo sapien
ccaaaagatagcatatactaacatamcgattggaagacaatgactcagga

SEQ ID NO: 34181 - DNA, 50 bp, homo sapien
atctttccatctgggatcttttctasctacaaggaatgaggacccagggg

SEQ ID NO: 34182 - DNA, 50 bp, homo sapien
ctttactgacaatgccaatagttgcratcttaggggggccatttattgag

SEQ ID NO: 34183 - DNA, 50 bp, homo sapien
ccatatgagaacacagtctgactgayaccttgcttttagcctagtgagtt

SEQ ID NO: 34184 - DNA, 50 bp, homo sapien
tgcggggttttctgtggaatcgttaygggaaagtcagggtcacactgtgg

SEQ ID NO: 34185 - DNA, 50 bp, homo sapien
gacaggcaagtggttgagggagcaamaatgagaccagacagagatgaaaa

SEQ ID NO: 34186 - DNA, 50 bp, homo sapien
tgtacagaaactgtgtggcccataaytaaagaccacattggcccacattg

SEQ ID NO: 34187 - DNA, 50 bp, homo sapien
ggacactccggagatgaaactttgartatgacttgagcttatttatgaga

SEQ ID NO: 34188 - DNA, 50 bp, homo sapien
actgtttgcgttacataaagcgttcrgaacccactccaaacttgttttcc

SEQ ID NO: 34189 - DNA, 50 bp, homo sapien
cctgacgccagttagcggtttgcccragttacccaattggagctagttta

SEQ ID NO: 34190 - DNA, 50 bp, homo sapien
atcttaattctcagaacatccctgaktaggtagtacgcttatccttaaca

SEQ ID NO: 34191 - DNA, 50 bp, homo sapien
ggaaggaaatacaaaagaggttatgragtgtctttccctgagaaatccga

SEQ ID NO: 34192 - DNA, 50 bp, homo sapien
aggagtcttgctgatagcccgaaacsatcttataaaaatgtcctcaggtc

SEQ ID NO: 34193 - DNA, 50 bp, homo sapien
cgcagtaatgacttcctgaggaaacrgagaaattggatgttttgtgattt

SEQ ID NO: 34194 - DNA, 50 bp, homo sapien
aatgctgaaagattaaatgcttttcmaaagtagaaacaaggcaaagatat

SEQ ID NO: 34195 - DNA, 50 bp, homo sapien
agctcggaagcagttatttcaaagarcggggtcaggcaggtctcagtgaa

SEQ ID NO: 34196 - DNA, 50 bp, homo sapien
agataatgttaggtaaggtgtgcaayacgatttgaaaaggtggcttttta

SEQ ID NO: 34197 - DNA, 50 bp, homo sapien
gcctggcacctcctaggcagtcaatraatagttgtggaatgaatgcagat

SEQ ID NO: 34198 - DNA, 50 bp, homo sapien
atggataatggactttaggttcttaygtgagaataagggggcaaacaatg

SEQ ID NO: 34199 - DNA, 50 bp, homo sapien
agtcctgactaatcagaaactaacartgatggtcctggcaactggagacc

SEQ ID NO: 34200 - DNA, 50 bp, homo sapien
aggtcattctccctggagtaatagcractgccttcaaaagagagtcacag

SEQ ID NO: 34201 - DNA, 50 bp, homo sapien
tcaggaagacagagagtggtatgtaygcatgtgacttatgtgacaagaaa

SEQ ID NO: 34202 - DNA, 50 bp, homo sapien
gtttcaaaaggaagccattaaaatakctaccgtaaatcaaaaagttcaag

SEQ ID NO: 34203 - DNA, 50 bp, homo sapien
aataaaataaaataaggtttccaacrgtgagattgagtggaaagcccctg

SEQ ID NO: 34204 - DNA, 50 bp, homo sapien
tagcacgatagacttggtaacaaggkactttctgaacctgaacaggaaac

SEQ ID NO: 34205 - DNA, 50 bp, homo sapien
tccgtattctcaacataagcctttgratctggtacctttgctcacctcct

SEQ ID NO: 34206 - DNA, 50 bp, homo sapien
aacacagaggttaactttaaggacartcttcaataaaataatgtattcat

SEQ ID NO: 34207 - DNA, 50 bp, homo sapien
gagctgtttcttcctaacttcaagawctcatgggaataggtacattaaaa

SEQ ID NO: 34208 - DNA, 50 bp, homo sapien
cattaaacattgtacaaatcttactsaaacattactttgattatggagta

SEQ ID NO: 34209 - DNA, 50 bp, homo sapien
taaacatgtcccttaagtaagccaaygactttatcttgtgtttgttagag

SEQ ID NO: 34210 - DNA, 50 bp, homo sapien
caggaatacaaggagcagctcaccaygttgaagagaaaactgaagaacca

SEQ ID NO: 34211 - DNA, 50 bp, homo sapien
tccgcctgtgtgtcagctgtttgaaytgaatagtggacactaaaactctg

SEQ ID NO: 34212 - DNA, 50 bp, homo sapien
gagccttgtgggtagattgttaacaygcagctcaaaaaattctaagccag

SEQ ID NO: 34213 - DNA, 50 bp, homo sapien
ctccttattttgcctgaaatcaggasgtgtatagtgtaagaaaatggctc

SEQ ID NO: 34214 - DNA, 50 bp, homo sapien
ttttcagtttactctttaaagcaaartgtgagctgtatgtcatttaattg

SEQ ID NO: 34215 - DNA, 50 bp, homo sapien
aaattgctttctgcctatgtatgtaygcctgaaacatttgcatgagagct

SEQ ID NO: 34216 - DNA, 50 bp, homo sapien
caggctaagaaattatctccaagacragtttcttaatactcaagtttaaa

SEQ ID NO: 34217 - DNA, 50 bp, homo sapien
aggaagatttgctgaataattagctyagcgatattgaggactgagaggaa

SEQ ID NO: 34218 - DNA, 50 bp, homo sapien
acagctcagcctagaactgcaacaasaataaataggaagcccacagtaag

SEQ ID NO: 34219 - DNA, 50 bp, homo sapien
ctatctattaataggagtcacatacrattctcatcactggcaaactcttc

SEQ ID NO: 34220 - DNA, 50 bp, homo sapien
aatacaaatagttccataggacaagwatagataatatatgaggttaaaaa

SEQ ID NO: 34221 - DNA, 50 bp, homo sapien
aactgaggcatccaagtaactgaggrcaacttcataaaaagaatgtggct

SEQ ID NO: 34222 - DNA, 50 bp, homo sapien
ccaaaaaagacataaaacatacagascttttgatccaataattccatttc

SEQ ID NO: 34223 - DNA, 50 bp, homo sapien
atatttgcagacaattcacttgagcmgaacactaatcattttgtggacac

SEQ ID NO: 34224 - DNA, 50 bp, homo sapien
ttacgagtggccacccaataaataaycattgttctataaatataaaatga

SEQ ID NO: 34225 - DNA, 50 bp, homo sapien
ctaatctaaagacaaatattgatggracattcatagcattgtggcatatg

SEQ ID NO: 34226 - DNA, 50 bp, homo sapien
aattaaaatttaaacagtgaagaaartttatgtttgtggttctaatctaa

SEQ ID NO: 34227 - DNA, 50 bp, homo sapien
accttcttcatgtggaaattgattayggacttcatctcatccactttggc

SEQ ID NO: 34228 - DNA, 50 bp, homo sapien
gttggttttctatggaaagtgcaaayggggagactaagagacttttactt

SEQ ID NO: 34229 - DNA, 50 bp, homo sapien
ttattatgaagtagaatctttaacawtcctgttttaaataatatgtttta

SEQ ID NO: 34230 - DNA, 50 bp, homo sapien
tagcctgtcattcaatgctaaatackctagcctcaaagggcttttctggc

SEQ ID NO: 34231 - DNA, 50 bp, homo sapien
ccagtgtttattttcttatatctccsgaaagctaatttttatctagcatc

SEQ ID NO: 34232 - DNA, 50 bp, homo sapien
tgagattacatatgttaaaagactcyattgtaggtgcagaacacacttta

SEQ ID NO: 34233 - DNA, 50 bp, homo sapien
tacctatccaaacacttgagaaccarctgtattaaagaggcacgatttgg

SEQ ID NO: 34234 - DNA, 50 bp, homo sapien
taattataccatttttctaaagcaawccgacccatgttaatgtgaacatt

SEQ ID NO: 34235 - DNA, 50 bp, homo sapien
acttgtacataaaatctcactaaaaytgtaaagtcatgtaagataaaata

SEQ ID NO: 34236 - DNA, 50 bp, homo sapien
gaagtctgagtacagtaaccaatacrggaagtgtgctccatagacttcaa

SEQ ID NO: 34237 - DNA, 50 bp, homo sapien
gaatggctttaaacagagagttgacragtagcagagtgaaatccaaacta

SEQ ID NO: 34238 - DNA, 50 bp, homo sapien
ctcccaggaatgtggccatgataaaygagaaatacgtataaagtgtgagc

SEQ ID NO: 34239 - DNA, 50 bp, homo sapien
gaaagctttttgaggtaggaataacrattcgtgctttatatagctggtct

SEQ ID NO: 34240 - DNA, 50 bp, homo sapien
agagccttttaagtaatccagaactkactgtcacctcatctttagtttgg

SEQ ID NO: 34241 - DNA, 50 bp, homo sapien
ctgattggcagcaattgtcctggaastaggcaggtttgaaaaatactctg

SEQ ID NO: 34242 - DNA, 50 bp, homo sapien
agtctttccataatatgttaaaatayaccctcagcagagctttctaggac

SEQ ID NO: 34243 - DNA, 50 bp, homo sapien
tgtggtgaaaagatttatgttaggaygtatgaatgatgcctctgtgtaca

SEQ ID NO: 34244 - DNA, 50 bp, homo sapien
aataatttagtgacttccttcagagratccttattgagcattttctatga

SEQ ID NO: 34245 - DNA, 50 bp, homo sapien
ggtttgaaatcagccaaatctggackcttttccgctcctgaccctcagtg

SEQ ID NO: 34246 - DNA, 50 bp, homo sapien
catgaacccaataatctcggtcccayggtgttattgtccatattgtctcc

SEQ ID NO: 34247 - DNA, 50 bp, homo sapien
atttggaagagccaaggtatcatagmaaatgctcaataaggattctctga

SEQ ID NO: 34248 - DNA, 50 bp, homo sapien
gacttggaggctcaagaaatttagasgatcatgtattaggtaagatgcac

SEQ ID NO: 34249 - DNA, 50 bp, homo sapien
gggtgtgttagctcattaaaacaaaygcttgctagattctgtagcaagct

SEQ ID NO: 34250 - DNA, 50 bp, homo sapien
aatattaacaattcttatgatagtgmaattatgccatatatagcagcaat

SEQ ID NO: 34251 - DNA, 50 bp, homo sapien
cctttgctggagtgtggttaaatacycagaggttgatcactgttttgtgg

SEQ ID NO: 34252 - DNA, 50 bp, homo sapien
tgtgagctcttggaaacctcactaaygggaagaacagctccatttccctg

SEQ ID NO: 34253 - DNA, 50 bp, homo sapien
aaggagagtggtagacacttttacaygtgttatgtctacacgtgttatgt

SEQ ID NO: 34254 - DNA, 50 bp, homo sapien
acatattttcttggccatcaaaaagyccccttctggtactggatatgtca

SEQ ID NO: 34255 - DNA, 50 bp, homo sapien
aaggaaagtccaagtcatgggaaaayttaaggataatccaaagattaatg

SEQ ID NO: 34256 - DNA, 50 bp, homo sapien
acagccaaagcaaagatgaatatgayataggccaggatggcaaataagtt

SEQ ID NO: 34257 - DNA, 50 bp, homo sapien
cacctaacacctactgggagtatatwagtcagagtttttcagagaaacaa

SEQ ID NO: 34258 - DNA, 50 bp, homo sapien
ctggagtaggcaaaacgtagcaccasgcacatttcatgttagactgtact

SEQ ID NO: 34259 - DNA, 50 bp, homo sapien
gcacacacacgagtttaattgcctayggaactatgtttgaaaagcaatat

SEQ ID NO: 34260 - DNA, 50 bp, homo sapien
ccttcagcaattatttcttagcatawggctttcttctagtatggagcttc

SEQ ID NO: 34261 - DNA, 50 bp, homo sapien
tctttaagtgtctttaaaatagttcrcagataaaaatctgttttatagat

SEQ ID NO: 34262 - DNA, 50 bp, homo sapien
ctttgcaaataaaaaatctgaacaayctgggaaactagaacacttgttaa

SEQ ID NO: 34263 - DNA, 50 bp, homo sapien
atagacatgctcaagattttagttaycttaatttgcatattattgtacag

SEQ ID NO: 34264 - DNA, 50 bp, homo sapien
ggtcaataaaaatgtgttcatgttargctccatggggaatagtgcctggc

SEQ ID NO: 34265 - DNA, 50 bp, homo sapien
atctaatgccatattgtcactttaamtccctctcataactcaacataata

SEQ ID NO: 34266 - DNA, 50 bp, homo sapien
tcaatatctgagggttagagtagtaygtacaaaatgagaaaatatccccc

SEQ ID NO: 34267 - DNA, 50 bp, homo sapien
tgggagccttgctctaacttgtacamccatctcgtatcaccacagtgcag

SEQ ID NO: 34268 - DNA, 50 bp, homo sapien
acccagatataggcagatatttactsagattgtacattaaacctctgttt

SEQ ID NO: 34269 - DNA, 50 bp, homo sapien
ataacaaactataaatgatacctgamagaaagcatgtgaaaatgggggac

SEQ ID NO: 34270 - DNA, 50 bp, homo sapien
ttcacctgtttgtcaattcttttacyaaaacaataatgtcctgatggctg

SEQ ID NO: 34271 - DNA, 50 bp, homo sapien
tttcaacaaatggtgctaaaacaacyggacatctacatgcaaaaataaat

SEQ ID NO: 34272 - DNA, 50 bp, homo sapien
aaagcatgttcttatttgatatataygatcctcttattggcaatagtttt

SEQ ID NO: 34273 - DNA, 50 bp, homo sapien
ctccttgtgaataggaatgaaagaaytgtcacctctatcatttataatga

SEQ ID NO: 34274 - DNA, 50 bp, homo sapien
tgaagtacccaacagaggctaaaaaytcagaagcggcttttccctttctt

SEQ ID NO: 34275 - DNA, 50 bp, homo sapien
actctgtgatgctgggccaagaccaygcaaagaattagtgtcaagggttg

SEQ ID NO: 34276 - DNA, 50 bp, homo sapien
aatcattatctgagtttggaggaaartaaggaatatggagaggtcaaaag

SEQ ID NO: 34277 - DNA, 50 bp, homo sapien
gtatgtttaagcagtaaaatttatasatctatgggattacttttcctgtg

SEQ ID NO: 34278 - DNA, 50 bp, homo sapien
attgtaagcttctagaagacagaaartatcttaatcatgtttatatttcc

SEQ ID NO: 34279 - DNA, 50 bp, homo sapien
gttatttccaagtctcataccataaycatattagaacctataaaaataat

SEQ ID NO: 34280 - DNA, 50 bp, homo sapien
tgacgaaaacaaaaatgaatccaaawtagaaagagaacataaaagacgga

SEQ ID NO: 34281 - DNA, 50 bp, homo sapien
gaaaagagcaggatactggtgaacasagaggaaaggactttgacaataag

SEQ ID NO: 34282 - DNA, 50 bp, homo sapien
atatatgaaatgcacatattaactckactcttgtggaattcacaggattt

SEQ ID NO: 34283 - DNA, 50 bp, homo sapien
tcctaagtgtagtttttacatgatasagaaagtacagtgaaaaaaattac

SEQ ID NO: 34284 - DNA, 50 bp, homo sapien
atagatactgatttgtctctttaatkacctgtgctttaaatttgatctga

SEQ ID NO: 34285 - DNA, 50 bp, homo sapien
tttaagaaactatgcccttgtatcarattagctctattcctggactaagt

SEQ ID NO: 34286 - DNA, 50 bp, homo sapien
attttagaagtaatcagatgcctacrataatttccctactgaaatagtat

SEQ ID NO: 34287 - DNA, 50 bp, homo sapien
tatgtgtatgcatgctacatgtgtcraattcagctgctctggttgaagct

SEQ ID NO: 34288 - DNA, 50 bp, homo sapien
acaaaatataaaggtcaatgataccrcaaagaaactgcatcaactagtgt

SEQ ID NO: 34289 - DNA, 50 bp, homo sapien
ctcaggagtcagagaagatgttacaraagccatatgctaaaaaatgcttc

SEQ ID NO: 34290 - DNA, 50 bp, homo sapien
atttgaacataacattaaatgcttgyataattccaaaaaaaaccccaaaa

SEQ ID NO: 34291 - DNA, 50 bp, homo sapien
caaatagaacatcatcactgctaaayggagatcggtatgtagaggttgac

SEQ ID NO: 34292 - DNA, 50 bp, homo sapien
agagattatatgacttgttcaaggcyatgcagtaagtcatggtccagatt

SEQ ID NO: 34293 - DNA, 50 bp, homo sapien
aagaatctgactctttaatgtccatraatttctactgtattctgttcaat

SEQ ID NO: 34294 - DNA, 50 bp, homo sapien
ggggaagtcactagtattcaacccamaagaaggagtcaaccacaaggaat

SEQ ID NO: 34295 - DNA, 50 bp, homo sapien
cagcagccaccagaagttaggagaayggtatggaacagatgctctctcag

SEQ ID NO: 34296 - DNA, 50 bp, homo sapien
aaaaacttactgaggccacacttgarctacattcttactaatgaatcaac

SEQ ID NO: 34297 - DNA, 50 bp, homo sapien
ctggcacttcaaagtgtattctttayctctaagcaggagtttctattcct

SEQ ID NO: 34298 - DNA, 50 bp, homo sapien
agtgatgggctcactgttagatatgmcagcaccaggaaagaggttatggc

SEQ ID NO: 34299 - DNA, 50 bp, homo sapien
tgctcagtattcagaagaatggataygataattaaacacactttttctcc

SEQ ID NO: 34300 - DNA, 50 bp, homo sapien
atcctttgtttttaagcagtttgtayaatgtgaaattaaatagcaaagct

SEQ ID NO: 34301 - DNA, 50 bp, homo sapien
ggcttcctccattagcgaattggacracagatgtatcctacggtctcttg

SEQ ID NO: 34302 - DNA, 50 bp, homo sapien
atcacttaacgtagtgtctgacacartgcaagagtacaggagtgtgaact

SEQ ID NO: 34303 - DNA, 50 bp, homo sapien
ttatcagggatgtatttttccatacyagaagggcacaaaacacaactgaa

SEQ ID NO: 34304 - DNA, 50 bp, homo sapien
tacttaccttctagtggctagtgtcraacagaaacgaaatacactggacg

SEQ ID NO: 34305 - DNA, 50 bp, homo sapien
taatgatatccagagcttctaatgcygacataatgtaaggcatttaatca

SEQ ID NO: 34306 - DNA, 50 bp, homo sapien
atgtcataccaatagaaaaggacaamtgatcaaaaatcaatgaataaata

SEQ ID NO: 34307 - DNA, 50 bp, homo sapien
gtcaacaaagtgagactctaattcakgtatcacttgggcaaaaagtgaag

SEQ ID NO: 34308 - DNA, 50 bp, homo sapien
cacctgtggtacatgaagccctgaaygaaacggaccagttttcactccag

SEQ ID NO: 34309 - DNA, 50 bp, homo sapien
tggttgttaggaagtgaaagtaccaytatgataaacagaattatcagtct

SEQ ID NO: 34310 - DNA, 50 bp, homo sapien
attaaaagtttcacattctaccaccrctttggtacattaaaagagctgtg

SEQ ID NO: 34311 - DNA, 50 bp, homo sapien
gaggctcagagcttaattaaaccaarcactattctataaattgtaaagta

SEQ ID NO: 34312 - DNA, 50 bp, homo sapien
tttatggtttgcatttattctcaacrgtatgaatcccaaattgtcaaatt

SEQ ID NO: 34313 - DNA, 50 bp, homo sapien
agataaaactaaaagtcccatatccyggaaacttcttcagtcccaggcaa

SEQ ID NO: 34314 - DNA, 50 bp, homo sapien
tacctgaatttgaatttagacttccrcagttactagctatgtgacttagg

SEQ ID NO: 34315 - DNA, 50 bp, homo sapien
taaaattgttatcctaatggtcacasatcacaataccttcactcagttgt

SEQ ID NO: 34316 - DNA, 50 bp, homo sapien
gttgtattcactcatagacttattaygttccttttctctaaatttgaaat

SEQ ID NO: 34317 - DNA, 50 bp, homo sapien
tgccacattagtggtgaataaaaagwctgttcagtagtcacagctggata

SEQ ID NO: 34318 - DNA, 50 bp, homo sapien
acaaacagacagaatgcttatttggwagcagattgttgcctcacatgtaa

SEQ ID NO: 34319 - DNA, 50 bp, homo sapien
gaacttctctttcttttactgtgaartatatgtaacacattttaaagttt

SEQ ID NO: 34320 - DNA, 50 bp, homo sapien
ttatttgtttcaacgttttgtagagwaaatctggagttgtgggtggcaaa

SEQ ID NO: 34321 - DNA, 50 bp, homo sapien
gaatgaagagtgtatcctgaatctgkataatataaagaaaactctaaatt

SEQ ID NO: 34322 - DNA, 50 bp, homo sapien
gaacaaagcagagttacaaaatggasaacaatggagtcttccagtctatt

SEQ ID NO: 34323 - DNA, 50 bp, homo sapien
ggagatgcagctgcgtgcttccatgracatttagacttttatcaggctgg

SEQ ID NO: 34324 - DNA, 50 bp, homo sapien
ccaatctttttggtggtgagaatccrgagccttttcttgaaatttctgca

SEQ ID NO: 34325 - DNA, 50 bp, homo sapien
aggaatttcaattctagttggtatcsatgcaaagacattagaccctgatg

SEQ ID NO: 34326 - DNA, 50 bp, homo sapien
gcttataaaaagttgcatgcaattcyaaatttaacgcatctaatctcact

SEQ ID NO: 34327 - DNA, 50 bp, homo sapien
ctcttccatccgcccgatgagctaayaatatctacccagttggcttgttt

SEQ ID NO: 34328 - DNA, 50 bp, homo sapien
taaaaatatgaggacatttacaatarggcagagcttttttttctggatgt

SEQ ID NO: 34329 - DNA, 50 bp, homo sapien
ttacagtctgataggtccgggtttgmatgttggcttactgcttggctact

SEQ ID NO: 34330 - DNA, 50 bp, homo sapien
caactgaatgcccaatgtcttaggcrcaataaactaaagagagaaagaaa

SEQ ID NO: 34331 - DNA, 50 bp, homo sapien
aggcaaatgagtctgtctgccaaacrctcatgtgcagtggtagcagcagc

SEQ ID NO: 34332 - DNA, 50 bp, homo sapien
aactctgacgtccactagctctgcaytgcacaagttacttaataatctct

SEQ ID NO: 34333 - DNA, 50 bp, homo sapien
gggatatgaacccaggaaatacatarcagacaatctacatcctcgactgt

SEQ ID NO: 34334 - DNA, 50 bp, homo sapien
ccatgttacctgcaatatgtgatgaytataactatgattagagatgtggc

SEQ ID NO: 34335 - DNA, 50 bp, homo sapien
gtacagagtaatatggtgctaaaccygaattaaatttgtgactcggaaat

SEQ ID NO: 34336 - DNA, 50 bp, homo sapien
gaaccacagcttctgtcaacttgcaygtaaaaatatggagttggagatcc

SEQ ID NO: 34337 - DNA, 50 bp, homo sapien
gaggaggagtagagcttgactttgayctgggaaaataggctgtaggtggg

SEQ ID NO: 34338 - DNA, 50 bp, homo sapien
ttagatataaaaagatagagaagaaygtaagagaagaaacaaatccagtg

SEQ ID NO: 34339 - DNA, 50 bp, homo sapien
aaggaacatacgaagcaaaaggtacrgcagagtcctatacctgtggcgaa

SEQ ID NO: 34340 - DNA, 50 bp, homo sapien
ttgtttgtttccaagtcctcttcaaytgatttgtttacctatccaacaga

SEQ ID NO: 34341 - DNA, 50 bp, homo sapien
aacaacttaagagtacttttgtggckcagataaagaaatctgaaacttaa

SEQ ID NO: 34342 - DNA, 50 bp, homo sapien
gttgacagacacagatagctctgaasacatggaaataaagcattgtaaat

SEQ ID NO: 34343 - DNA, 50 bp, homo sapien
aagtaccatgtaaactgatagatgaygttaaggttctcaaggtggtgact

SEQ ID NO: 34344 - DNA, 50 bp, homo sapien
cttttcctttgcaacgtttcttcccyatatggtggtgaatacagaagata

SEQ ID NO: 34345 - DNA, 50 bp, homo sapien
ataaataaaactgaaactatgggtgyaaatgacttcaggtcttcttgaaa

SEQ ID NO: 34346 - DNA, 50 bp, homo sapien
cattgagaatcatccttcccagtaasaaaattgtgctttgcaagttccat

SEQ ID NO: 34347 - DNA, 50 bp, homo sapien
gaaatgaaacggctctttaaaacacrcagaggaacatatacagaattttt

SEQ ID NO: 34348 - DNA, 50 bp, homo sapien
aggtttgtactgatgatggaatgacrcatggtcaccaagtactactcagc

SEQ ID NO: 34349 - DNA, 50 bp, homo sapien
tactgtaaatctcaagggccataagkaatagcttctttaacccacggatt

SEQ ID NO: 34350 - DNA, 50 bp, homo sapien
aagcaaagtagctcatgttacaatgyaaggtggtccgcattgtacccttt

SEQ ID NO: 34351 - DNA, 50 bp, homo sapien
aaaggcttatgctagttctgagtaawgaaaaaatgtattggaacacatag

SEQ ID NO: 34352 - DNA, 50 bp, homo sapien
atgcacttaatccagcagatagacayagtgttcaggaggttaactaatca

SEQ ID NO: 34353 - DNA, 50 bp, homo sapien
aaaaataataactacaacaatttgtyaagagatagacagtacaaaaagat

SEQ ID NO: 34354 - DNA, 50 bp, homo sapien
acacaaaatatattctttgttactayagctaactgtggatcttaattcat

SEQ ID NO: 34355 - DNA, 50 bp, homo sapien
caaggatgcagctttttgggactcawtagatttgtcctccttgaacttgg

SEQ ID NO: 34356 - DNA, 50 bp, homo sapien
acaagccttcccacaaggcataaaayaatggatcaatctgaattaccttc

SEQ ID NO: 34357 - DNA, 50 bp, homo sapien
taaaattaaagctttggcctttgacwatcattaccttgaatagaaagaca

SEQ ID NO: 34358 - DNA, 50 bp, homo sapien
ggccccagtatttcagtgcagttcayggacaactcatgcatctaaaattg

SEQ ID NO: 34359 - DNA, 50 bp, homo sapien
tgcaaaagctggtgagcttactaacraatctatcatgttgagaaggtttc

SEQ ID NO: 34360 - DNA, 50 bp, homo sapien
agggtgctctggagagtgtgtgttamcctgctgagaaaatcctggcggtc

SEQ ID NO: 34361 - DNA, 50 bp, homo sapien
tgctctgttcccaggttggtcctccrcatacctcccactgcaggatcctg

SEQ ID NO: 34362 - DNA, 50 bp, homo sapien
gggttttaatggactccttcaagaamagagggttgtctgtccacttgcct

SEQ ID NO: 34363 - DNA, 50 bp, homo sapien
cattctttgagctgcgactgagccaygtagtctgcttatatattccacct

SEQ ID NO: 34364 - DNA, 50 bp, homo sapien
cagagaacactcagctacctttagcrccataattctgattccaatataga

SEQ ID NO: 34365 - DNA, 50 bp, homo sapien
gcaactgtgtgtcagccactatcacrggaacttgaagcataatgcatttc

SEQ ID NO: 34366 - DNA, 50 bp, homo sapien
aaaatgtctgagatattactggatakgtcatagaagaaatatggagaaat

SEQ ID NO: 34367 - DNA, 50 bp, homo sapien
aactagaatgatctgtgtgattctargtaagtcttataatcttgctgttc

SEQ ID NO: 34368 - DNA, 50 bp, homo sapien
cattattcttggtgagtctcagacayggaagcagggtcaagtcagaggag

SEQ ID NO: 34369 - DNA, 50 bp, homo sapien
aaagggtactctctcatgagtcaaartttaatgacctggcaaggcactta

SEQ ID NO: 34370 - DNA, 50 bp, homo sapien
cacactgctctccctcctggccataraacctgggctccaaactttcaact

SEQ ID NO: 34371 - DNA, 50 bp, homo sapien
tgtaaaatttaagacattcagacaartgagatactgctataaagtattat

SEQ ID NO: 34372 - DNA, 50 bp, homo sapien
gaagggtggagaacactggaatgaayggaagccatattgcagtggattct

SEQ ID NO: 34373 - DNA, 50 bp, homo sapien
cgtcacttcctacactaactacgtargtcattttctcttgctctgcctca

SEQ ID NO: 34374 - DNA, 50 bp, homo sapien
taatgacaacaaccaggtttctgaayggatcaaaggtattatcagacata

SEQ ID NO: 34375 - DNA, 50 bp, homo sapien
tcgagcatactgggctgttccagacyaagacttttgatcttgaatgcaga

SEQ ID NO: 34376 - DNA, 50 bp, homo sapien
ttgcatgttaatgtaattatttggartcagtgttagaaaatcactctttc

SEQ ID NO: 34377 - DNA, 50 bp, homo sapien
attcatatgctgtcttaactttttamaacaatgtgctgatgggaagctca

SEQ ID NO: 34378 - DNA, 50 bp, homo sapien
tacttgaggttagggacagatctccraagaagggtccgtcgttagtgatg

SEQ ID NO: 34379 - DNA, 50 bp, homo sapien
gtatctaggctaaacaattatttgartaacagcagtgtgaataacctgaa

SEQ ID NO: 34380 - DNA, 50 bp, homo sapien
gtgggagattattttgtttatcaagracactaatgagagaaggaaaaggc

SEQ ID NO: 34381 - DNA, 50 bp, homo sapien
tttctttccctcactcccttcctctsacatacttctactttcaagtgaat

SEQ ID NO: 34382 - DNA, 50 bp, homo sapien
ttgcatccagactatacagcataccrgatcatgaaatatactaaaatgga

SEQ ID NO: 34383 - DNA, 50 bp, homo sapien
cggtcagactgatatgtcaaaattamgcgtgactggcagaaacccagagg

SEQ ID NO: 34384 - DNA, 50 bp, homo sapien
gttcctgaacattttgtgagcagaayttaatgcttgtgggaagggcttca

SEQ ID NO: 34385 - DNA, 50 bp, homo sapien
tgctttgaataggtgaatctgttccraagcaattgattaaattagaggta

SEQ ID NO: 34386 - DNA, 50 bp, homo sapien
ttccactcccacagcgaggaagccgraatctccagaggctctggcaagag

SEQ ID NO: 34387 - DNA, 50 bp, homo sapien
taatgggatttatatcagatatttamagcaagtactggagcaaatggctc

SEQ ID NO: 34388 - DNA, 50 bp, homo sapien
tctaggagtaggtccattttgattayacagatggtcacatcagggtacta

SEQ ID NO: 34389 - DNA, 50 bp, homo sapien
agtatcttccccaacatggttcccasagtttcctgttcaggttcagaaag

SEQ ID NO: 34390 - DNA, 50 bp, homo sapien
acggttaagaacagtttgatgaaaaygggttggagttagttaaagaaaat

SEQ ID NO: 34391 - DNA, 50 bp, homo sapien
caagcctgcctcccttaagtcttccyatctcagtaagtggaaacttcatt

SEQ ID NO: 34392 - DNA, 50 bp, homo sapien
atgttctcttctgtattgacaccaayagttcatgttattaaaattagaaa

SEQ ID NO: 34393 - DNA, 50 bp, homo sapien
aaattacagtgcatctatacaaaaamtcccttcaacaatttcaaatatta

SEQ ID NO: 34394 - DNA, 50 bp, homo sapien
catttgagttgtgatgtaagtattamgtagaaaagaaaatgaggattatt

SEQ ID NO: 34395 - DNA, 50 bp, homo sapien
aagctgctctgaacattctcataaargtcttattgtggtatttgttttgg

SEQ ID NO: 34396 - DNA, 50 bp, homo sapien
gatccacatcctgcctttaaaataayagatttccatgagacacactgaac

SEQ ID NO: 34397 - DNA, 50 bp, homo sapien
ccctgaccttagtccttgctcttccrctaaatcatccttttactatgaaa

SEQ ID NO: 34398 - DNA, 50 bp, homo sapien
aacaagagaacacgtacaggccccaytatgaattacctagttggttgaaa

SEQ ID NO: 34399 - DNA, 50 bp, homo sapien
tttttcgacgacgttccactgtctaktaagttagagtgagctcatggcca

SEQ ID NO: 34400 - DNA, 50 bp, homo sapien
tgtgctcaaagcactttggtattacyggggcactaggtccccatctgcaa

SEQ ID NO: 34401 - DNA, 50 bp, homo sapien
ttctattactcagtcttctcttaggraaaacaaagtgaaacactagacat

SEQ ID NO: 34402 - DNA, 50 bp, homo sapien
ggaaaaaaagtgtgagcaatccctayaggtttaccagcggatgcaggggt

SEQ ID NO: 34403 - DNA, 50 bp, homo sapien
ccgatatggactaggaaaaaattaaytgtccttgtatatctgtgctaaga

SEQ ID NO: 34404 - DNA, 50 bp, homo sapien
gtatcactttactctctaaacaacaygaatgatcacacatgcatacattt

SEQ ID NO: 34405 - DNA, 50 bp, homo sapien
ttttttccaatgctccagaggcaaartctatctttaagggaagagttcaa

SEQ ID NO: 34406 - DNA, 50 bp, homo sapien
ttaagaaaaatatgcatttcaaggaraagaaaaggagaagaatttctgga

SEQ ID NO: 34407 - DNA, 50 bp, homo sapien
cccgtatcccatgaacatattaagaygggaaaagatactacgcatggaaa

SEQ ID NO: 34408 - DNA, 50 bp, homo sapien
tgcatatccttgaataagtggtttawcgttgtttcatagaagttttttcc

SEQ ID NO: 34409 - DNA, 50 bp, homo sapien
atgggattgggatatgactacatcasagatagtatttacccactctttct

SEQ ID NO: 34410 - DNA, 50 bp, homo sapien
tatgatgtaagactatcagagaacayggagatatgcagagaaactagtca

SEQ ID NO: 34411 - DNA, 50 bp, homo sapien
cacacatcaagtcaaataattctaastaagctaacactggtttctttgat

SEQ ID NO: 34412 - DNA, 50 bp, homo sapien
aagaaagctggtagcagctgttactyacttatatctctgaatttgtttaa

SEQ ID NO: 34413 - DNA, 50 bp, homo sapien
tacacctgatgtttttctatacacamtgtcaatacttagtacataaatat

SEQ ID NO: 34414 - DNA, 50 bp, homo sapien
tgataaatatttaggttatcttcaayttcagagatcattaaaaaaaggct

SEQ ID NO: 34415 - DNA, 50 bp, homo sapien
taatctgactcactaactataattgyaaaattttcaggacccagagaagt

SEQ ID NO: 34416 - DNA, 50 bp, homo sapien
cacaaggatgtgattatcaggagacraggctcattggaaccatctagggg

SEQ ID NO: 34417 - DNA, 50 bp, homo sapien
attgccctttggctggtttggataaytaagagtttactaaataaatattt

SEQ ID NO: 34418 - DNA, 50 bp, homo sapien
tggcaattcttattgacaatgttctyactctaaatctgacttttctttcc

SEQ ID NO: 34419 - DNA, 50 bp, homo sapien
tgatgttttgcctaggagtcttactwaactaaaagaaaagctattttttt

SEQ ID NO: 34420 - DNA, 50 bp, homo sapien
caaatataaagcatcagcgcagaaamcaatttaaatcgaggttctaccat

SEQ ID NO: 34421 - DNA, 50 bp, homo sapien
tttcttttgcaccttaaactgcaacygcaacaagtggattttgatgaaac

SEQ ID NO: 34422 - DNA, 50 bp, homo sapien
tctgttggttcttttgtgatacagayagagtttcatcaaaatccacttgt

SEQ ID NO: 34423 - DNA, 50 bp, homo sapien
gttttatagcagaacagttagactakgctccatttattataaacatttgg

SEQ ID NO: 34424 - DNA, 50 bp, homo sapien
tgatctcagcacatggtaggttatawgagaatgtctataattactattta

SEQ ID NO: 34425 - DNA, 50 bp, homo sapien
aagatttagtagaaaataagtgctcracaactaatccagattacagtatg

SEQ ID NO: 34426 - DNA, 50 bp, homo sapien
ataaataattcctgctttagacttawcatgttgtgtacattgtaatcgaa

SEQ ID NO: 34427 - DNA, 50 bp, homo sapien
agggacatgggttactagaggcaaayactcactagcgaagacacaagtat

SEQ ID NO: 34428 - DNA, 50 bp, homo sapien
gagattcagccaaatattgggcacarcaagttatagagccaggaagttca

SEQ ID NO: 34429 - DNA, 50 bp, homo sapien
ctaggacccaaacacaacaaagaaaytcattatctagtaggcttagacac

SEQ ID NO: 34430 - DNA, 50 bp, homo sapien
gagttgaattgagcaggcaccaaagragacactaacacttgccagcttta

SEQ ID NO: 34431 - DNA, 50 bp, homo sapien
actagttgtgcatctgacgcacttcrcttaccctctctgggctgctgttt

SEQ ID NO: 34432 - DNA, 50 bp, homo sapien
aaattcaattagtctagtaatctgayaccatacagttatgaaatcctcca

SEQ ID NO: 34433 - DNA, 50 bp, homo sapien
cccaagtgggcagatgcaagttacargatccacaagagatccaagaaagg

SEQ ID NO: 34434 - DNA, 50 bp, homo sapien
gagatggctacaaacacctttcatcsaattcattactgtagggcttaatt

SEQ ID NO: 34435 - DNA, 50 bp, homo sapien
ctcctttcttcagttcttcccatacygggtttctctttttctttatgtcc

SEQ ID NO: 34436 - DNA, 50 bp, homo sapien
acaagtgagttttaagagtttaccaygtctaagactgtgagatcagacca

SEQ ID NO: 34437 - DNA, 50 bp, homo sapien
ttctgtgatatgtattggtacggagraatcactgcattcagattgtaaac

SEQ ID NO: 34438 - DNA, 50 bp, homo sapien
ttatgtgtttggaatataaacttaamcctagtcattactgtgttggggag

SEQ ID NO: 34439 - DNA, 50 bp, homo sapien
ctatttaaatagaaagttagacaaarttctcatgtcactccagacataca

SEQ ID NO: 34440 - DNA, 50 bp, homo sapien
atacagacatgaactgtatttaataygcatactttggaacacagcattta

SEQ ID NO: 34441 - DNA, 50 bp, homo sapien
tgattcaacttataacactagaatasaaagcgtaattcatatatacttca

SEQ ID NO: 34442 - DNA, 50 bp, homo sapien
aaggtattggaacatggaggaaaatsagttttgagggttgtataggaaca

SEQ ID NO: 34443 - DNA, 50 bp, homo sapien
gtaggtctgtccaatatggtgagtartaagtagttaatctatagccaaaa

SEQ ID NO: 34444 - DNA, 50 bp, homo sapien
acaggatttttatctccattgtatgyaacttgccttgggtcactctgcta

SEQ ID NO: 34445 - DNA, 50 bp, homo sapien
ccatcgaaaagttcagaaaaccgaaygattaacttagctctttgaggaaa

SEQ ID NO: 34446 - DNA, 50 bp, homo sapien
ggaggttgtaattgtaccttcctcayagacttgcagtaaatattaagagt

SEQ ID NO: 34447 - DNA, 50 bp, homo sapien
atatccttttaaacgtcttctttaaygagcatccctacagagtttgtatt

SEQ ID NO: 34448 - DNA, 50 bp, homo sapien
atgggttaatattagtattaggaaakgatccaagtacaaatctacagaac

SEQ ID NO: 34449 - DNA, 50 bp, homo sapien
taaattggtttctacttcagtaattsaatgtgcttgcagactattctttc

SEQ ID NO: 34450 - DNA, 50 bp, homo sapien
tgcatagctgtataaatttactagamgatgtatggtcatctcttactgga

SEQ ID NO: 34451 - DNA, 50 bp, homo sapien
attttacagcaaagtctacttaccartgatgaacagctaatattttaaaa

SEQ ID NO: 34452 - DNA, 50 bp, homo sapien
gagatagctgcctgcctacaaaagamgagcaaaaataaatgttcaaataa

SEQ ID NO: 34453 - DNA, 50 bp, homo sapien
aatcaacatataagccattaaaatayagattgagtataattgaatctctt

SEQ ID NO: 34454 - DNA, 50 bp, homo sapien
tcagctataattagattggtccttayggcataatactccacaattgcagt

SEQ ID NO: 34455 - DNA, 50 bp, homo sapien
ttcctcagagggaatattagtcaaamctttaatcattttagttgctatct

SEQ ID NO: 34456 - DNA, 50 bp, homo sapien
tagtctaaccaggatattgatgaaaytggtttagtgcaaatggcatccta

SEQ ID NO: 34457 - DNA, 50 bp, homo sapien
caagccacaatgcctggtctaaaaaktactctggcagcaacaaagctttg

SEQ ID NO: 34458 - DNA, 50 bp, homo sapien
gattagttgagagagtccatattcaytccttaagctctctgagctgctga

SEQ ID NO: 34459 - DNA, 50 bp, homo sapien
gaatgagggtgttataatctatttcrgaaaaagctcagagaattattcta

SEQ ID NO: 34460 - DNA, 50 bp, homo sapien
ggttgtgtactgtgccttctttcacyatggttttacattacaaaatagag

SEQ ID NO: 34461 - DNA, 50 bp, homo sapien
cccctataagcaaatgtatacgtgaraatatacagggatgacatgcattt

SEQ ID NO: 34462 - DNA, 50 bp, homo sapien
ctcagtgtggtactaaaagtggccartacagacatgtgccttctgggagg

SEQ ID NO: 34463 - DNA, 50 bp, homo sapien
ttagaaaggtctgttgtcagagctcrccagtaatgatgatttgtctagta

SEQ ID NO: 34464 - DNA, 50 bp, homo sapien
tcacacttgtctctttcaaaggctakattttagtctgtaatgggtcgtat

SEQ ID NO: 34465 - DNA, 50 bp, homo sapien
tgtgaatatttaaggctacaaagaaycttagagctcatattgcttaatcc

SEQ ID NO: 34466 - DNA, 50 bp, homo sapien
gaaatacgtgtcaaactaactaaaayatcaggattccaattgctcgggtt

SEQ ID NO: 34467 - DNA, 50 bp, homo sapien
agagttattttcaggtgcacatggakagtatagaagcaattaattccaag

SEQ ID NO: 34468 - DNA, 50 bp, homo sapien
caggaactttgggtaacattaagtaygcacctgcccagagttcacttgga

SEQ ID NO: 34469 - DNA, 50 bp, homo sapien
agatggacctgatcctgaagacagtyaagtcaactaaagtaaaaacacaa

SEQ ID NO: 34470 - DNA, 50 bp, homo sapien
gggtcaacaaaatccacattattgtwaaaacaagttgttgggtcattcac

SEQ ID NO: 34471 - DNA, 50 bp, homo sapien
cacacaatgctgttgacccaaattcratagagtaggtgatttttcctacc

SEQ ID NO: 34472 - DNA, 50 bp, homo sapien
ttctaaagttggtgcaccattttccrcactcctaataattactaataatt

SEQ ID NO: 34473 - DNA, 50 bp, homo sapien
ttattctctttttttttctcagttaygtggccgggagacctccttcttct

SEQ ID NO: 34474 - DNA, 50 bp, homo sapien
tatttttctatcttctatactaaaartagtgcaaaatcattcaactttat

SEQ ID NO: 34475 - DNA, 50 bp, homo sapien
atacagagtgctggattggccactayattttgctgagaaaaggaaggaaa

SEQ ID NO: 34476 - DNA, 50 bp, homo sapien
tccaagagctacagcttagttgtackgagaacctaacaggcattgtgcat

SEQ ID NO: 34477 - DNA, 50 bp, homo sapien
atctaattccatccattctttatggycagttaaatgcagtatacttgtca

SEQ ID NO: 34478 - DNA, 50 bp, homo sapien
ctccttaacatgcaggtaatttgtakcatattgatcatgctaatgcctgt

SEQ ID NO: 34479 - DNA, 50 bp, homo sapien
tgaacaaaaatctatcttcaatgtawctagcctgttagtgtcaacctctc

SEQ ID NO: 34480 - DNA, 50 bp, homo sapien
ccttagacccttctctctgagtctcsaatctgtagtcaagaagaaaggat

SEQ ID NO: 34481 - DNA, 50 bp, homo sapien
caactagtcatgtaatattgtcgaamcgaagaaattctcctgaatagaat

SEQ ID NO: 34482 - DNA, 50 bp, homo sapien
gtgaccagctagagtcaactactggmaaatacaagagacctaaaatgttt

SEQ ID NO: 34483 - DNA, 50 bp, homo sapien
tattttgtgacaaaactacattaaakttcacagcattttccaaacatcta

SEQ ID NO: 34484 - DNA, 50 bp, homo sapien
atatctgaaaataaatattctgaaastgatatgtgggttagcatcttaat

SEQ ID NO: 34485 - DNA, 50 bp, homo sapien
actattgtacttctgtgatcattcawcaagtatttaatattgtgcctgac

SEQ ID NO: 34486 - DNA, 50 bp, homo sapien
tatagttctaaaataaatcttttaaygagtggacacaattctgaaaccta

SEQ ID NO: 34487 - DNA, 50 bp, homo sapien
cactattagtaatagtaatactgaaraacactttgtaccattgtaaagaa

SEQ ID NO: 34488 - DNA, 50 bp, homo sapien
catatactagacccaaatttttagastacagccaaagtaaatccacgtac

SEQ ID NO: 34489 - DNA, 50 bp, homo sapien
ttggaaacactcactcaaacatgccrgatatttaactgaacttccaattc

SEQ ID NO: 34490 - DNA, 50 bp, homo sapien
cttttttttcttcctctagtacccaygtgatatggttaggctttgtgttc

SEQ ID NO: 34491 - DNA, 50 bp, homo sapien
agcattccccaagtgtcagaataacrgtagggtattttagccaaaggaac

SEQ ID NO: 34492 - DNA, 50 bp, homo sapien
catcttcatttattgctctcttaaaygaaaaagtttggagagtcaaggaa

SEQ ID NO: 34493 - DNA, 50 bp, homo sapien
actaaatttttacagaactaactgaygcactcatgattatttaaaaggac

SEQ ID NO: 34494 - DNA, 50 bp, homo sapien
catatgacttcataatttttatccargaaacaacttcttaaaacagggca

SEQ ID NO: 34495 - DNA, 50 bp, homo sapien
aagaaaaaagaaagggaccttaggcrgactttcaatgcaacacacttcta

SEQ ID NO: 34496 - DNA, 50 bp, homo sapien
agaatcacaggaggcagcccaagaamggattatcacagaagctgaaccag

SEQ ID NO: 34497 - DNA, 50 bp, homo sapien
ataagggagttcaccctgcatcgatraggatgtcttcagaccgctgtgct

SEQ ID NO: 34498 - DNA, 50 bp, homo sapien
atcattatgatgatacagctaggaaraaaagtacctgtgaaccagaaatc

SEQ ID NO: 34499 - DNA, 50 bp, homo sapien
ctgtcaccgaaaggtataaaaagackagatatcctcagagttgaaggtaa

SEQ ID NO: 34500 - DNA, 50 bp, homo sapien
gagggaataattactagaactgtcaycgaaaggtataaaaagacgagata

SEQ ID NO: 34501 - DNA, 50 bp, homo sapien
tcctcttctattccattcttttcagrctagagcccatgttgaaagcaaag

SEQ ID NO: 34502 - DNA, 50 bp, homo sapien
tgagaatgtgggctatgaaaaacacrcaagatggcatatgttctaggaga

SEQ ID NO: 34503 - DNA, 50 bp, homo sapien
tgtagaaaactagtctgtgagaaggmactgcaggaataagaatttaataa

SEQ ID NO: 34504 - DNA, 50 bp, homo sapien
atatttttatatgtcaaaatcagaartcactctagaaatggatatgaata

SEQ ID NO: 34505 - DNA, 50 bp, homo sapien
gtcactctgaagacacatgcaaaacyggcttaattccttccctacagttc

SEQ ID NO: 34506 - DNA, 50 bp, homo sapien
aataaattcccacgccaatcatggaraaaaccaaagaactatccatcgca

SEQ ID NO: 34507 - DNA, 50 bp, homo sapien
ataccccaattagacattacttagarctgataggagaatggtaataggtc

SEQ ID NO: 34508 - DNA, 50 bp, homo sapien
ctacagttcacatccctgaattctcrataataaagacttaaaggatctat

SEQ ID NO: 34509 - DNA, 50 bp, homo sapien
gggaggaatgaagaattttccacaaygatacgcaaatgtgtttctatgac

SEQ ID NO: 34510 - DNA, 50 bp, homo sapien
agggagtctacaatttaattaaaagrctatcttgtgttggacatgaaacc

SEQ ID NO: 34511 - DNA, 50 bp, homo sapien
tagacaagcaagagggactttttccyagcctgaggtttcatgtccaacac

SEQ ID NO: 34512 - DNA, 50 bp, homo sapien
cctagctcatcaagttgaaattatawgcaaagcaaaacaaaaatacagag

SEQ ID NO: 34513 - DNA, 50 bp, homo sapien
aagacagcctgaacctgaccaccaaygtcggtatttgtgtggaggaaaga

SEQ ID NO: 34514 - DNA, 50 bp, homo sapien
gattcattttattttcattattcacrctttctctttctcattttgatcag

SEQ ID NO: 34515 - DNA, 50 bp, homo sapien
taaagttcatgatgcagctgaaagartcaaccagtacaaggccttaaata

SEQ ID NO: 34516 - DNA, 50 bp, homo sapien
actttcagggggtgttgcaagcacayggaacagacatcaaataactttaa

SEQ ID NO: 34517 - DNA, 50 bp, homo sapien
ataatttgaaaccagagttcatgackgctttattttcagtgaggtaaata

SEQ ID NO: 34518 - DNA, 50 bp, homo sapien
cactcaaaaccactttattgagtacrcatcctacattattaactagagca

SEQ ID NO: 34519 - DNA, 50 bp, homo sapien
gctctcagatatttaaactgcttcakcccaaacctggaagactgtttcat

SEQ ID NO: 34520 - DNA, 50 bp, homo sapien
aaatattttattgtcttttagaaaayttgataaacctacagaaaaaattc

SEQ ID NO: 34521 - DNA, 50 bp, homo sapien
attcaataaaatttctaaattagagraacagaagtattgatatgataaaa

SEQ ID NO: 34522 - DNA, 50 bp, homo sapien
agattcttgccctttcctgacattayagtaaataacaagttaaagaaact

SEQ ID NO: 34523 - DNA, 50 bp, homo sapien
aacagtgaaagttcaatgaccataawttaagggttaggaagctttgtgct

SEQ ID NO: 34524 - DNA, 50 bp, homo sapien
ttataaggagaaacacatttgatccrgaatattcattgaaatatcttagt

SEQ ID NO: 34525 - DNA, 50 bp, homo sapien
ctttgaggagaaggagccatagggaktcagtaaacaagttgagaggtgag

SEQ ID NO: 34526 - DNA, 50 bp, homo sapien
gtttaaccttccagtatctggtactyaaagaatcttggcaagctaccgat

SEQ ID NO: 34527 - DNA, 50 bp, homo sapien
aaaaaccctgctgttcttggtatccraaggcagtcagacctggtaatggg

SEQ ID NO: 34528 - DNA, 50 bp, homo sapien
cagtgatgatactatacatagatgcsatagagctctaaggagagtaaaat

SEQ ID NO: 34529 - DNA, 50 bp, homo sapien
tgagagttagattttagtaagacaaytgagtacacagctgatttctataa

SEQ ID NO: 34530 - DNA, 50 bp, homo sapien
taggcagaataggcatcagtattccmaatttccagaaaaggaaattaaag

SEQ ID NO: 34531 - DNA, 50 bp, homo sapien
cctctgtggatttgcatttaggaagwacccatctggctgacaaagagaaa

SEQ ID NO: 34532 - DNA, 50 bp, homo sapien
tgattatagacctgtagatctaatgracatgataacagtagctgacattt

SEQ ID NO: 34533 - DNA, 50 bp, homo sapien
ttcgtcatttttaatccctttctacmaactgtgatcatctaagacagaag

SEQ ID NO: 34534 - DNA, 50 bp, homo sapien
tattgttagtgcacaaatagcttaaracagatcgtaaagtccccagtgat

SEQ ID NO: 34535 - DNA, 50 bp, homo sapien
agaagctgaaggaaactgagttttasgtagagcaactggtcaaggcctcc

SEQ ID NO: 34536 - DNA, 50 bp, homo sapien
ccaatcttaaatgaatagttgtccaycaagtcaatactttcaaaatattt

SEQ ID NO: 34537 - DNA, 50 bp, homo sapien
gatgaattggagtcttaacttctacygaatgaatcaagaacccaggaaga

SEQ ID NO: 34538 - DNA, 50 bp, homo sapien
acagagtgagaccctgtctttaagamgggatttggactagatcagtagtt

SEQ ID NO: 34539 - DNA, 50 bp, homo sapien
aggcacacagggttataagataaacwagagacataacctctgcctttatt

SEQ ID NO: 34540 - DNA, 50 bp, homo sapien
tcttgtgttttccataaatctgagasagtgatatgatcagcaagcttatt

SEQ ID NO: 34541 - DNA, 50 bp, homo sapien
ggtaaggccttttgtcccagctttawgatacagggataaaattctttctg

SEQ ID NO: 34542 - DNA, 50 bp, homo sapien
acaataaatactgaggcaaatacacyagtcagaagtaaagtaaattaata

SEQ ID NO: 34543 - DNA, 50 bp, homo sapien
ttagctgttatttttaattgactaawgatagccataagattcactgagct

SEQ ID NO: 34544 - DNA, 50 bp, homo sapien
catgttaaaaagtttactggagcaaragtattgagattgggtgacaggac

SEQ ID NO: 34545 - DNA, 50 bp, homo sapien
atttacgggagggcttcaaaagtaaygcttggtgatgattatagttaagc

SEQ ID NO: 34546 - DNA, 50 bp, homo sapien
aaggtcacattctgaggttcccaccratgttaatattttgggatactatt

SEQ ID NO: 34547 - DNA, 50 bp, homo sapien
ctctcatctgttggcagatttttcaratgaattcctactcaatgaaaaac

SEQ ID NO: 34548 - DNA, 50 bp, homo sapien
tggtgtacagagataagtcaccttamaaagataacattatacagacaaat

SEQ ID NO: 34549 - DNA, 50 bp, homo sapien
ttaatttgaacaatgttatttgcacrctacttctaaatttagtgcttttc

SEQ ID NO: 34550 - DNA, 50 bp, homo sapien
cagtccagaggggaagagacccacamaaccttcaaacacttcgaagctta

SEQ ID NO: 34551 - DNA, 50 bp, homo sapien
ggagggggaaaaatcgctacaaggcygaggtaaacaggaggcaatttcac

SEQ ID NO: 34552 - DNA, 50 bp, homo sapien
tatacaataaaaggaatctaccaaartcgtacatcattaaaatgtatatt

SEQ ID NO: 34553 - DNA, 50 bp, homo sapien
ttaattcaaaattactcattaaacckgaaattcatttatttttaaataca

SEQ ID NO: 34554 - DNA, 50 bp, homo sapien
gtatatcgtgattttaaagagcagayggcatagcttggtgaagtttacaa

SEQ ID NO: 34555 - DNA, 50 bp, homo sapien
gtttcctactacattagcaatttcawctttgtagtaattttgtagtaata

SEQ ID NO: 34556 - DNA, 50 bp, homo sapien
ctatgaagcattcattagtcccacayggtcaagaagtatacaaccttttc

SEQ ID NO: 34557 - DNA, 50 bp, homo sapien
taaaaaaaatacctgaagttactggkaaattatagttttgagtgaactag

SEQ ID NO: 34558 - DNA, 50 bp, homo sapien
tgtttgagggattttctctaatatamgtcttgaaggcagacaacttaact

SEQ ID NO: 34559 - DNA, 50 bp, homo sapien
aaggataactttaaatgattttttamagtaagaatgcataaatgttctaa

SEQ ID NO: 34560 - DNA, 50 bp, homo sapien
tgagggtgttgtcaaaagaagttaayatttgagtcagtggactaggaaag

SEQ ID NO: 34561 - DNA, 50 bp, homo sapien
ttctatggtacattataatgtggtayagatggttgattcagaccacctgg

SEQ ID NO: 34562 - DNA, 50 bp, homo sapien
tagatctgctatgatagcatgataaygttgaagaggtaatgcagaactac

SEQ ID NO: 34563 - DNA, 50 bp, homo sapien
cacacatacgcaactttaacagcacmcctaaatatacgtgtagaaggtac

SEQ ID NO: 34564 - DNA, 50 bp, homo sapien
aataggataaaaattctcatgtaccragaaaagataataaaaaatcttca

SEQ ID NO: 34565 - DNA, 50 bp, homo sapien
tccatcagaattatttgtgccaatayataatatagtttagtgttaattct

SEQ ID NO: 34566 - DNA, 50 bp, homo sapien
agccctttgtccttcaagagcatatkataaaaccacagaaatgaacataa

SEQ ID NO: 34567 - DNA, 50 bp, homo sapien
acatagtacatttccatataccctaygcaggatcctctattattagaagc

SEQ ID NO: 34568 - DNA, 50 bp, homo sapien
aatattggtcaaaagctatatgatamctgtttgttgcagggaggtagagg

SEQ ID NO: 34569 - DNA, 50 bp, homo sapien
gaaaggtgtctcagagagaaggaacrgcaagtctaaccctagccctgacc

SEQ ID NO: 34570 - DNA, 50 bp, homo sapien
tcgctgctcctacttggatctcatckccagttttctcccttgttcacctc

SEQ ID NO: 34571 - DNA, 50 bp, homo sapien
gggcaaggatcatttttaatgaccasagatatcaaagtattcttaataat

SEQ ID NO: 34572 - DNA, 50 bp, homo sapien
acatgcatgcatattatgcttgaaasagatataagcaaatactttggtta

SEQ ID NO: 34573 - DNA, 50 bp, homo sapien
cccatcagatctgcataaattggaamctctaaataaccaaagtatttgct

SEQ ID NO: 34574 - DNA, 50 bp, homo sapien
taagtgaacagtaacactaaatatcrcagtgccagccgaccattttatat

SEQ ID NO: 34575 - DNA, 50 bp, homo sapien
agctttgccaatgtcagaagcgttcratataaagggagcatgctaggcat

SEQ ID NO: 34576 - DNA, 50 bp, homo sapien
acttcaaagtaagttcagtgaaataygacagccgaatgcagggacctaga

SEQ ID NO: 34577 - DNA, 50 bp, homo sapien
caaaggatttattatattacataaasttggtaaagcagcaagtatctcaa

SEQ ID NO: 34578 - DNA, 50 bp, homo sapien
gagccctatgagaaattatttttacracagagctgagtggttttcaagtt

SEQ ID NO: 34579 - DNA, 50 bp, homo sapien
aaataacatgcctactctataccagrcctacttcctggggtctgtagaag

SEQ ID NO: 34580 - DNA, 50 bp, homo sapien
gacagatcacgtgagcacttaaaaayatcagtgtcccattaggaggaagg

SEQ ID NO: 34581 - DNA, 50 bp, homo sapien
ttggctaaattaatcaacatgtttcwcgaggtctaaagggaggagctcat

SEQ ID NO: 34582 - DNA, 50 bp, homo sapien
caagtacagaaggcaatgaaagaaarggtcacctgccttcctcctaatgg

SEQ ID NO: 34583 - DNA, 50 bp, homo sapien
cacaaagaacaattagaggcataaawatgttcaaataaatgcattttttc

SEQ ID NO: 34584 - DNA, 50 bp, homo sapien
agcactgagagagcactggactgaayctgagaaaaacgcctgatgggaaa

SEQ ID NO: 34585 - DNA, 50 bp, homo sapien
tctatgggactaatttattcaattcragcagggatgatagaaaatactag

SEQ ID NO: 34586 - DNA, 50 bp, homo sapien
cacctagtactgactgttaatctgawgtaataacctatgttatctaggac

SEQ ID NO: 34587 - DNA, 50 bp, homo sapien
ttaaaaaatctctgcccccatggaakttacctgaatacaatattcacgtg

SEQ ID NO: 34588 - DNA, 50 bp, homo sapien
tttagtttttgaacactggatataaytgcacagccaaaaataaattttta

SEQ ID NO: 34589 - DNA, 50 bp, homo sapien
gagactctggatactactttgaaatratctgaggtagtgtcataaaaaca

SEQ ID NO: 34590 - DNA, 50 bp, homo sapien
agcttcccccaagaggcttaatcaaratattagctgtatacacaaagatg

SEQ ID NO: 34591 - DNA, 50 bp, homo sapien
gacaatctattgaaaactaatactaygggactttgactctaattcataga

SEQ ID NO: 34592 - DNA, 50 bp, homo sapien
gattacatgtttccttatcccattayagtttcaacagaagcaatcaatat

SEQ ID NO: 34593 - DNA, 50 bp, homo sapien
atttgcaattttaagctgatagtaakctaaaatagaaacttcccctttat

SEQ ID NO: 34594 - DNA, 50 bp, homo sapien
taattctgtggtttgcgggagtcaarattacatgttccggaaaagcccaa

SEQ ID NO: 34595 - DNA, 50 bp, homo sapien
tcttatttttggaatgacacatctaygttacttgatgactacaaatagat

SEQ ID NO: 34596 - DNA, 50 bp, homo sapien
tctgtggcagctatagccttatgaartatatatcctagataataaaaatt

SEQ ID NO: 34597 - DNA, 50 bp, homo sapien
aggaccctatttaaacactgtgccarctagcaagtaaatccattagtata

SEQ ID NO: 34598 - DNA, 50 bp, homo sapien
atgagccatttcttaaaagcgttcayctaatcttaagaaaggaggtagcc

SEQ ID NO: 34599 - DNA, 50 bp, homo sapien
aagactagtttttagcaagatgatargtgtaaaattatagctcagttttc

SEQ ID NO: 34600 - DNA, 50 bp, homo sapien
ttctattttttatcacttttgtctawatctttaagtctcctttcagcatg

SEQ ID NO: 34601 - DNA, 50 bp, homo sapien
gtacataaacgaccactgtagatgayagaaaaaaaaatagagcatgtgta

SEQ ID NO: 34602 - DNA, 50 bp, homo sapien
aattgaatggagatagtcttcaaaamacgatgctaaaacaattgtatagt

SEQ ID NO: 34603 - DNA, 50 bp, homo sapien
tgatcaactcacacattctctgttaygtttcatgccaatgaagtaatatc

SEQ ID NO: 34604 - DNA, 50 bp, homo sapien
atgatgcatgagtctatttttggackctctattcctctccacttgtctat

SEQ ID NO: 34605 - DNA, 50 bp, homo sapien
aaagcaggtgataagcagaggtacamctaataatttttgaacttttatat

SEQ ID NO: 34606 - DNA, 50 bp, homo sapien
atgaaagctaccagctctccttcaawtctaagtatcatattatagtgtgt

SEQ ID NO: 34607 - DNA, 50 bp, homo sapien
gtggacttcatttggcttaaataagraatgtactagttaggagtagcttt

SEQ ID NO: 34608 - DNA, 50 bp, homo sapien
agatttcttagcagttttctttagaygagaagaacttgctcaatgcagtc

SEQ ID NO: 34609 - DNA, 50 bp, homo sapien
agaaacacaatccaaacatcttacartatagcaaacaatcataaatacta

SEQ ID NO: 34610 - DNA, 50 bp, homo sapien
gttgtagctgcctgtagagagcacasagttcttggccatagagtagtaaa

SEQ ID NO: 34611 - DNA, 50 bp, homo sapien
gaatgaatgagctgagtgtgtaaagragtgtgtccataacataagtatac

SEQ ID NO: 34612 - DNA, 50 bp, homo sapien
tctacaaagtctggactttatttgawcagctagaggctattctactgcaa

SEQ ID NO: 34613 - DNA, 50 bp, homo sapien
tcatttcaaacaagtataccttcaartcttagcattcttcccccgccttc

SEQ ID NO: 34614 - DNA, 50 bp, homo sapien
caattgatggtgttatcttagctcaygtcctggtttagaacaagaaagaa

SEQ ID NO: 34615 - DNA, 50 bp, homo sapien
gaataatagttctgacatattttcaraagttctaggcatgactcctggag

SEQ ID NO: 34616 - DNA, 50 bp, homo sapien
atccaaatgatagcccaaatttaaaygatccagattaatctatcaataaa

SEQ ID NO: 34617 - DNA, 50 bp, homo sapien
gttactccacactgaattagtaaaastttgcataagtatgagtttaacac

SEQ ID NO: 34618 - DNA, 50 bp, homo sapien
attagaacacccattaattaatccayctggaatgagaaataaaagttaac

SEQ ID NO: 34619 - DNA, 50 bp, homo sapien
gtaattgagatatcagactggattcyctctataagcacagtagaactgcc

SEQ ID NO: 34620 - DNA, 50 bp, homo sapien
ctgatactgctgctttttgctataaytgacacatcctgcctcacctacag

SEQ ID NO: 34621 - DNA, 50 bp, homo sapien
tgggatagttgctgatacttcaggcygatctaataaagtcatgagaggaa

SEQ ID NO: 34622 - DNA, 50 bp, homo sapien
catttatggaatacctatattgttcmaagatttagtcaaaacactaggaa

SEQ ID NO: 34623 - DNA, 50 bp, homo sapien
atatttagataggtctggacataccragaggaaattcaggcacctggagg

SEQ ID NO: 34624 - DNA, 50 bp, homo sapien
attgtcagcccaaagataccttggayaatgtctgttttgtccatcactgt

SEQ ID NO: 34625 - DNA, 50 bp, homo sapien
attactgaaatatccacatcatttargcaataaagcagccaagaaaatgt

SEQ ID NO: 34626 - DNA, 50 bp, homo sapien
ggtcaattatctaaaagaagataaamcctaattacttgaataattagttc

SEQ ID NO: 34627 - DNA, 50 bp, homo sapien
gagtgtttatgtgtgcttgaccagaraaagctattaatccctattgatct

SEQ ID NO: 34628 - DNA, 50 bp, homo sapien
agaaacaggctctgtcatgtaactaygctctccaaaatgatcaatgcctc

SEQ ID NO: 34629 - DNA, 50 bp, homo sapien
gtcattatttcgtaggttattattaragaagcacaacagtgaggaaattc

SEQ ID NO: 34630 - DNA, 50 bp, homo sapien
aaggccaaaaaaaaaactactggaamtaatgtcgagtaatttggaagtat

SEQ ID NO: 34631 - DNA, 50 bp, homo sapien
ttttctgcttcagtgtatgagacaayttagagaataccaatttaacacgg

SEQ ID NO: 34632 - DNA, 50 bp, homo sapien
tgaaaatgcagcacctgaccttttaygcagctcactgttactctgtgcca

SEQ ID NO: 34633 - DNA, 50 bp, homo sapien
cagtccctgaaatataacaatgagayggaactcctgtgtccctgagttta

SEQ ID NO: 34634 - DNA, 50 bp, homo sapien
attttttacaaaaaggatggtcttgraaggttgtcataaactcagggaca

SEQ ID NO: 34635 - DNA, 50 bp, homo sapien
gtctggactcagcatgagtagctccragaaagaagtgagcctacttaacc

SEQ ID NO: 34636 - DNA, 50 bp, homo sapien
aaggcaatgagataaaatttcggcayaatagagatagataccttacactt

SEQ ID NO: 34637 - DNA, 50 bp, homo sapien
tccaaattaaggaaagatgagtggaraatatatgtaatgtgagtttaggg

SEQ ID NO: 34638 - DNA, 50 bp, homo sapien
tcattgattgttctattaatacaccygaggaaaaaaatgaagaataaatc

SEQ ID NO: 34639 - DNA, 50 bp, homo sapien
tgttgccacatctctttttgctccartcctctaagatcaactgtgtgctg

SEQ ID NO: 34640 - DNA, 50 bp, homo sapien
aacaaggcacttggaataaattgcaractatactcagcatggagaccaca

SEQ ID NO: 34641 - DNA, 50 bp, homo sapien
gaaatcacaatgctagttggaatgaygttttgcaacaagtgcctcctgga

SEQ ID NO: 34642 - DNA, 50 bp, homo sapien
tcatggatgggagcagcctggtaacygacagaaaaagaaatgctatatat

SEQ ID NO: 34643 - DNA, 50 bp, homo sapien
atggcttaactggggagatagaactyaatctggactttgaaagaaaaggc

SEQ ID NO: 34644 - DNA, 50 bp, homo sapien
tttttagcacatactagcccacgackgcttactgggacaccagctgtttg

SEQ ID NO: 34645 - DNA, 50 bp, homo sapien
gaattaatgttttaaataatatcaakgattctacaatttaaataaggata

SEQ ID NO: 34646 - DNA, 50 bp, homo sapien
acatacacatggatacacagatacawccaagaggtacttttctctctctg

SEQ ID NO: 34647 - DNA, 50 bp, homo sapien
ggcatgatatgctcttcagaaatcaygttttgaaattacagaagataaat

SEQ ID NO: 34648 - DNA, 50 bp, homo sapien
aaatctcctcacagtgtaaattctamattcctccaaataagataaagttt

SEQ ID NO: 34649 - DNA, 50 bp, homo sapien
cacatcagagtatagcctttgaagaycctgtttctgtgcaatggtacaat

SEQ ID NO: 34650 - DNA, 50 bp, homo sapien
aaaaaaagaaaaaagcagctctatgyatgattcattgtattgggctcctt

SEQ ID NO: 34651 - DNA, 50 bp, homo sapien
tatataaaagtgtgaaacacctggastatagagccacttgcttaagtgta

SEQ ID NO: 34652 - DNA, 50 bp, homo sapien
tgtgtacacggtacttctggttatgraacaccactggggcctggaagaaa

SEQ ID NO: 34653 - DNA, 50 bp, homo sapien
ttgcaaaatcactcagtgagtaacayaccaaaaggaacagttcacttttt

SEQ ID NO: 34654 - DNA, 50 bp, homo sapien
gggctgctctgattattttacacaaragtctgaagtttaacagactcttt

SEQ ID NO: 34655 - DNA, 50 bp, homo sapien
gtcttaaagctaagactagctgactyagattagaatacaagatgaattgt

SEQ ID NO: 34656 - DNA, 50 bp, homo sapien
gccaattctggtttgatgttgacaaygtatttattagctattgtgaggat

SEQ ID NO: 34657 - DNA, 50 bp, homo sapien
gattactttcatctgggcattaggamatcaggaaagacagaatgaccaga

SEQ ID NO: 34658 - DNA, 50 bp, homo sapien
attcttatagtattatgtccatgaawctctcaattcctttcactatcatg

SEQ ID NO: 34659 - DNA, 50 bp, homo sapien
tctgttagttacatctgaggcaaccrattctgctgccttctatcttctgt

SEQ ID NO: 34660 - DNA, 50 bp, homo sapien
tatgtaaaaattaatgtgaaggtacyaggattgtatttttgttaatcttt

SEQ ID NO: 34661 - DNA, 50 bp, homo sapien
accttctaatttttcagtttcagtcwatcaataacatgtgccttcaatta

SEQ ID NO: 34662 - DNA, 50 bp, homo sapien
tgatcatcttggtgtggattcttacygatgtcataaacccatttccaaca

SEQ ID NO: 34663 - DNA, 50 bp, homo sapien
gagagggatggttatttcggtacaaygtagcccacagagaataaaaggcg

SEQ ID NO: 34664 - DNA, 50 bp, homo sapien
caggtatttagaggaagctgatgtayctaaagtatgtgggtcttctggtt

SEQ ID NO: 34665 - DNA, 50 bp, homo sapien
tagagttccagtcattgcagtctacycagaattgctctactaagcttgtg

SEQ ID NO: 34666 - DNA, 50 bp, homo sapien
catgaagaccttacttaatgttagartactagatacactggaagtggaag

SEQ ID NO: 34667 - DNA, 50 bp, homo sapien
tctgaatgctgaacattcttcctgartatcttagcattttatttgtttgg

SEQ ID NO: 34668 - DNA, 50 bp, homo sapien
tgtatagacataaatgaaaagccaamatttacaccttctagtcaacaaat

SEQ ID NO: 34669 - DNA, 50 bp, homo sapien
attacaagcactcttatttatggtaytacagagttttcttctccagccgt

SEQ ID NO: 34670 - DNA, 50 bp, homo sapien
ttgttattggaatggtggtagcttgkaactgaggtaacctgtcctcatcc

SEQ ID NO: 34671 - DNA, 50 bp, homo sapien
gtcaaatgcatcaggatatttaatgsagtggaagaagccattatttcata

SEQ ID NO: 34672 - DNA, 50 bp, homo sapien
gattaaatagttgtaaccgatggaasgattgaaagtgacaacagctgaga

SEQ ID NO: 34673 - DNA, 50 bp, homo sapien
acattccaggttctttttactattckacattggcaccaaattagttataa

SEQ ID NO: 34674 - DNA, 50 bp, homo sapien
atagcacatttcctttcaggctcacrataacctcaatgtagggggcagca

SEQ ID NO: 34675 - DNA, 50 bp, homo sapien
ggatagttgctaattagatttctgcragggaagggtagagcccgatgact

SEQ ID NO: 34676 - DNA, 50 bp, homo sapien
ggaactaagtagtcctgcgccagcarcaaagactttggaaatctcttatc

SEQ ID NO: 34677 - DNA, 50 bp, homo sapien
tatcacagactagaagacatacgaamaatagaaatttatttctcacaact

SEQ ID NO: 34678 - DNA, 50 bp, homo sapien
atttttatcaccatggtccaagtacrcatccagagttcaagccaacaatc

SEQ ID NO: 34679 - DNA, 50 bp, homo sapien
ttggtataacttcttttcctatttcsaccattgtcatacttttttactaa

SEQ ID NO: 34680 - DNA, 50 bp, homo sapien
taaagtagcaccccagtctaaaaaawttgtgggaatcatggggaactaca

SEQ ID NO: 34681 - DNA, 50 bp, homo sapien
ttctactaatttcaaatagcaatggrattttgaactatgtaaaatgatag

SEQ ID NO: 34682 - DNA, 50 bp, homo sapien
caaaatgataaccacttcagaaaaaktgacaggtgaggagaaaggacatt

SEQ ID NO: 34683 - DNA, 50 bp, homo sapien
tgtataatcattccattattgctagyatattgccaaatatatgcttttat

SEQ ID NO: 34684 - DNA, 50 bp, homo sapien
tctcagtcttttttggttgttgttcyaatgatgtgctgtaacttctttgc

SEQ ID NO: 34685 - DNA, 50 bp, homo sapien
ttttcaaattgaattatgtcaaggawgtcttttcaaatacttttgtttct

SEQ ID NO: 34686 - DNA, 50 bp, homo sapien
ggaaaaatgttatttttggcaatcaratttagagattatatccttaaaag

SEQ ID NO: 34687 - DNA, 50 bp, homo sapien
tagggggatgcataagctacataaawcatttagggtatgtttgggttagt

SEQ ID NO: 34688 - DNA, 50 bp, homo sapien
tgcccttgctgttcttttgtgtgaaragttctgtcaccagacactcacat

SEQ ID NO: 34689 - DNA, 50 bp, homo sapien
gtgccagataggcatttttctcacasgttattgcaatcctccttccccca

SEQ ID NO: 34690 - DNA, 50 bp, homo sapien
ctaaatgtcttacaaactgtttcaakcaaaggcaaaatgcacatcaggct

SEQ ID NO: 34691 - DNA, 50 bp, homo sapien
ttgttttaaaaagtgtgaagatattyaaatgtaaaagataaagaggagat

SEQ ID NO: 34692 - DNA, 50 bp, homo sapien
accctggaggctaaagggcctaaaayatgtaaatggaatgggaagcttgt

SEQ ID NO: 34693 - DNA, 50 bp, homo sapien
cgaacttccgtatctttggtacttawcacatcatactaaaaaaatagact

SEQ ID NO: 34694 - DNA, 50 bp, homo sapien
aggagaggcccagaagcaaaattacsagaatcctgtggccccagacattg

SEQ ID NO: 34695 - DNA, 50 bp, homo sapien
gaaattcactcaactcctactcacasgccaaatgaatatccattgtggct

SEQ ID NO: 34696 - DNA, 50 bp, homo sapien
tagaatagtagagcagacaatgaaayggtggtccttaaattatttgtttc

SEQ ID NO: 34697 - DNA, 50 bp, homo sapien
atcaaacaagttacaattcaagggaytatactctttctaccatgagcagg

SEQ ID NO: 34698 - DNA, 50 bp, homo sapien
ccctgaccatatgtgtatcaatttaycaaacagccttatatgtgcttggg

SEQ ID NO: 34699 - DNA, 50 bp, homo sapien
aaacagtcttattaagccatttcaaygatgatgtaattgagtctcatgga

SEQ ID NO: 34700 - DNA, 50 bp, homo sapien
accagctggtcttcctctaagaaagyagatatgctaaagtaaataatcct

SEQ ID NO: 34701 - DNA, 50 bp, homo sapien
cagctgccgtctgtacgtatcctcasggggtcttttctctgcatgcacat

SEQ ID NO: 34702 - DNA, 32 bp, homo sapien
ttttgagaataaatggrcagagaagacaaaag

SEQ ID NO: 34703 - DNA, 50 bp, homo sapien
gttgagatgagaatatagggattccragtctgtgagactgcagggatgcc

SEQ ID NO: 34704 - DNA, 50 bp, homo sapien
ttcatgctactcttctggtacataawcaattcccattacctttgtatcac

SEQ ID NO: 34705 - DNA, 50 bp, homo sapien
aatagagccgttcagagatcaggaargtggagaaagtttgatgttggaaa

SEQ ID NO: 34706 - DNA, 50 bp, homo sapien
tttggtaaggaaaaatatctggagasgacaacatatttggctcatgttaa

SEQ ID NO: 34707 - DNA, 50 bp, homo sapien
catttattgactggataacttcaaartatttctagtgagcctccttaact

SEQ ID NO: 34708 - DNA, 50 bp, homo sapien
atcctatttacgtaatcatcaagcaktatttgtaactgaatatattttac

SEQ ID NO: 34709 - DNA, 50 bp, homo sapien
cagcgagctagctaaacatcaaatasaagtgtcccttttctcatatcaaa

SEQ ID NO: 34710 - DNA, 50 bp, homo sapien
aaaatgaggaccatatacctacccayaagtgtcacagtatttgcaaagta

SEQ ID NO: 34711 - DNA, 50 bp, homo sapien
tcaacaaatactagaaaactgaatcygacaacacatcacaaagataatat

SEQ ID NO: 34712 - DNA, 50 bp, homo sapien
aaatgtctagttaaggaagcagttcraagttccacagaggcaatggattg

SEQ ID NO: 34713 - DNA, 50 bp, homo sapien
taggaaaggaatttcagacacagcaratctgttgggtgcagtggctcaca

SEQ ID NO: 34714 - DNA, 50 bp, homo sapien
aaattcttgaagaatgtaaacagatwaagtaagttgtttaggtaagtggg

SEQ ID NO: 34715 - DNA, 50 bp, homo sapien
aggaaaaaaggctcccttgcctttasattggcgagtagcccatgagctgc

SEQ ID NO: 34716 - DNA, 50 bp, homo sapien
tttcttttttaataacggaattaaartgcttacctaactaacacccacat

SEQ ID NO: 34717 - DNA, 50 bp, homo sapien
aactcccatcccacactctatcttakaaagtgcagatcataatggattaa

SEQ ID NO: 34718 - DNA, 50 bp, homo sapien
gagttggagtgtttgcctaacttaaytgcagaagtgttgttggaaccagg

SEQ ID NO: 34719 - DNA, 50 bp, homo sapien
ctggttttcctgtaggattagcagargaagaaggcatctgcagactgtta

SEQ ID NO: 34720 - DNA, 50 bp, homo sapien
gttggtatagttacaattcttacacrgtagctgtcaatttgccagagcta

SEQ ID NO: 34721 - DNA, 50 bp, homo sapien
tggatggaagcccaaatgccaagatraaggtgcccgactgacaaaatgcc

SEQ ID NO: 34722 - DNA, 50 bp, homo sapien
agaatgaagcgtgcttaccaagtagraaaactgtagtttaagaagtgaat

SEQ ID NO: 34723 - DNA, 50 bp, homo sapien
acatttagtatttcccagctaacaayggaatgcaatgattcatatctgtt

SEQ ID NO: 34724 - DNA, 50 bp, homo sapien
tggttggatttcatatggatcaatamagcatgtcaactctagtacaagga

SEQ ID NO: 34725 - DNA, 50 bp, homo sapien
atttgtttgaataaagttttctaccrcctgttattcagaatgaacataag

SEQ ID NO: 34726 - DNA, 50 bp, homo sapien
tttctttattcattcattcattgatkaacaaagatttatttggtatcttg

SEQ ID NO: 34727 - DNA, 50 bp, homo sapien
agttgggtgaaataagggatgggccraagagatgtgacactggaacccag

SEQ ID NO: 34728 - DNA, 50 bp, homo sapien
agaaatgtatgaatgctatataaackgtactgtagtctctatgaagttac

SEQ ID NO: 34729 - DNA, 50 bp, homo sapien
aatcaaatgatctgtacttaatttaycactcactaattgtttggcccttg

SEQ ID NO: 34730 - DNA, 50 bp, homo sapien
ttttctacaggacagagagatgtaayaggtagtggtctctgcatcttctt

SEQ ID NO: 34731 - DNA, 50 bp, homo sapien
tacatgtccatcaatagaagggggasagagtatcgtgataaaagaaaaat

SEQ ID NO: 34732 - DNA, 50 bp, homo sapien
attcaccaaggctcggctagattcastctcagtaacctaggagaaactgg

SEQ ID NO: 34733 - DNA, 50 bp, homo sapien
tcttgctgtcaagtgtctgctagaaycaaggaaaatgatgtctccttcat

SEQ ID NO: 34734 - DNA, 50 bp, homo sapien
tttctgccttcagcttaggtctcttyaaacgtgtgcaatcataagaatct

SEQ ID NO: 34735 - DNA, 50 bp, homo sapien
gaacacatttctaatagaaacagaawgtaaagccataataagagtcaaga

SEQ ID NO: 34736 - DNA, 50 bp, homo sapien
actgttgtaaactctggaggtaaaasttgttaaaacagcagacgagatgc

SEQ ID NO: 34737 - DNA, 50 bp, homo sapien
acatatttctaatctgtaaaagaggkataatgatgtttatcatattgccg

SEQ ID NO: 34738 - DNA, 50 bp, homo sapien
tttcaaagtatttttactactaaggraaatcagttaaatttttctggcaa

SEQ ID NO: 34739 - DNA, 50 bp, homo sapien
tatattatggtgagtgagtgattacygtaactgggaatttaagatatata

SEQ ID NO: 34740 - DNA, 50 bp, homo sapien
ggcctatgtcttcttttgtggcttargtactatttagtgggcttatggaa

SEQ ID NO: 34741 - DNA, 50 bp, homo sapien
ttttagaaaggtcactcctgctgcamcaaatgtctatagtacctatttat

SEQ ID NO: 34742 - DNA, 50 bp, homo sapien
ttcccctaaagctaaaagcactgtargaaagtggaaaagtgttaaaacct

SEQ ID NO: 34743 - DNA, 50 bp, homo sapien
catggttaattaagaatggacagaaygtaagcacacagtaaagaaaattt

SEQ ID NO: 34744 - DNA, 50 bp, homo sapien
gtggttcggacctccattttacacartaccaaaaaccatcaataagcact

SEQ ID NO: 34745 - DNA, 50 bp, homo sapien
cccttggactaacaaaggagcaaaarccttaaatgcctcacccacatctc

SEQ ID NO: 34746 - DNA, 50 bp, homo sapien
ctcaacatttttatcattatcattamcctaagaaagtttcttttgaggat

SEQ ID NO: 34747 - DNA, 50 bp, homo sapien
gaaagtttggccttgtagactttgawctggttgacctggagtcatgggac

SEQ ID NO: 34748 - DNA, 50 bp, homo sapien
ttaagcttggttagctccacagtaartctactaccaattacagaatatat

SEQ ID NO: 34749 - DNA, 50 bp, homo sapien
catgttccttacagtaaaggctatayattgatgctaccagggaaaggatt

SEQ ID NO: 34750 - DNA, 50 bp, homo sapien
attttacagaagtagactacattatsaaaactacatacacttttttccct

SEQ ID NO: 34751 - DNA, 50 bp, homo sapien
gggtctatattcaacattcttaaatraataatcttcaaccaataatttca

SEQ ID NO: 34752 - DNA, 50 bp, homo sapien
aagtttactttgcatcataatattamcattgaaactttctttggattatg

SEQ ID NO: 34753 - DNA, 50 bp, homo sapien
aagacttgaaattattcctagagaaygaaaaataagtgtctcagagaatg

SEQ ID NO: 34754 - DNA, 50 bp, homo sapien
agaccacaagggcataccactcaagkataaaagtaagagatgagttaaaa

SEQ ID NO: 34755 - DNA, 50 bp, homo sapien
cattgcttagatgattttcctggacsatccaagccaaatcagtgctggct

SEQ ID NO: 34756 - DNA, 50 bp, homo sapien
aaatttgtgtagatttcatgttaaaygcactttccatgcaaaagggggac

SEQ ID NO: 34757 - DNA, 50 bp, homo sapien
cacaatgaagcatttttaaggatcaractaaatcacatgtgaaaatgctt

SEQ ID NO: 34758 - DNA, 50 bp, homo sapien
tggtccccagtagttgtcactgtgarctaggcaagcctttctgttattgg

SEQ ID NO: 34759 - DNA, 50 bp, homo sapien
gggaaaatgaaagaatagtccttaamacctgtacaattatgtatcttttt

SEQ ID NO: 34760 - DNA, 50 bp, homo sapien
ttttattgagagatatctaaatgatmaggtgtttctgagagacaaataga

SEQ ID NO: 34761 - DNA, 50 bp, homo sapien
ctagtatttggtactccagctgatgyaacatggtgggagaccgggcaaga

SEQ ID NO: 34762 - DNA, 50 bp, homo sapien
catttgactgcttagccaaatatacragtagttcctagaaaactacatca

SEQ ID NO: 34763 - DNA, 50 bp, homo sapien
gtttttaaataatagatttgcatcawgacttgtatatctggacaaactgc

SEQ ID NO: 34764 - DNA, 50 bp, homo sapien
ttggtcaattattcaattttaaaaakatactgatctctagaaacctttaa

SEQ ID NO: 34765 - DNA, 50 bp, homo sapien
tttagcttgttaagttcaacatgcargatgcggtagatggagatgtttac

SEQ ID NO: 34766 - DNA, 50 bp, homo sapien
ccttttgcaaagctctaagcaactcrattgttttgtaggaagtgtattgg

SEQ ID NO: 34767 - DNA, 50 bp, homo sapien
atccattgcccaataataccaactcygagattagaagttaaaaatagtat

SEQ ID NO: 34768 - DNA, 50 bp, homo sapien
gtcacccaaacatcttggctaagctsagcctaaatcaccaacctacagaa

SEQ ID NO: 34769 - DNA, 50 bp, homo sapien
ttggggtgggtttattatgaacaaaygtaaactcatgtgaagactgtttt

SEQ ID NO: 34770 - DNA, 50 bp, homo sapien
atgattgcttttattgtagtatagakatcacttgtcaactcttgctgcca

SEQ ID NO: 34771 - DNA, 50 bp, homo sapien
tccataaaggattgttttcagtagaygattttgataactgctggctgatt

SEQ ID NO: 34772 - DNA, 50 bp, homo sapien
ccaaaatgtgaaacaaatattaagamctaatgatgggatgatatatgcaa

SEQ ID NO: 34773 - DNA, 50 bp, homo sapien
ttcataccactctggcccttttgaaygaacttggtctgtgcaatctcacc

SEQ ID NO: 34774 - DNA, 50 bp, homo sapien
attatacccattttaaatgtattcaycaggttactaccatgaggcagata

SEQ ID NO: 34775 - DNA, 50 bp, homo sapien
ccagttttattgatttatttatgtgyacctatagtgttagaagaaagtac

SEQ ID NO: 34776 - DNA, 50 bp, homo sapien
tttcttgcctgcttcaaagtaaccartccttttccgagctcagcttcttg

SEQ ID NO: 34777 - DNA, 50 bp, homo sapien
agcattgtcaactccaagttagtcayggttgaagatttaaccaagcccac

SEQ ID NO: 34778 - DNA, 50 bp, homo sapien
cctttcaagggccaatttgtccagaraagtatgagataaacatacattgt

SEQ ID NO: 34779 - DNA, 50 bp, homo sapien
actaggtgagtacattaatgtcatgraatcttggaatattaaattggatt

SEQ ID NO: 34780 - DNA, 50 bp, homo sapien
gagaattggcttctgtcttcatcatyagcatcttaggttggtgtattttc

SEQ ID NO: 34781 - DNA, 50 bp, homo sapien
tgtcacaaaaatgacccatgtcagartctgaaacaaaatagaatccacaa

SEQ ID NO: 34782 - DNA, 50 bp, homo sapien
gattgatttgaagttgataaaaaaawttgggagtcagtagatttctaatg

SEQ ID NO: 34783 - DNA, 50 bp, homo sapien
gtgatatgtaatatatccaagtccasatgcagtatttcatgttcattgac

SEQ ID NO: 34784 - DNA, 50 bp, homo sapien
tttacacttggccttttccaggaagscttcatcgattttcaagtctagaa

SEQ ID NO: 34785 - DNA, 50 bp, homo sapien
ggagatagaaattttctgtagcgtckccttagagatttccatgaagttaa

SEQ ID NO: 34786 - DNA, 50 bp, homo sapien
gatgacatcaaactatcattgtttasagatattatcattcagacacaccc

SEQ ID NO: 34787 - DNA, 50 bp, homo sapien
caaatgaattggtatgctatgtgaaraatactttcatgttctcaagaaac

SEQ ID NO: 34788 - DNA, 50 bp, homo sapien
ctaaaatattccagtgtctttttccrcatatctaagagttcattagaatc

SEQ ID NO: 34789 - DNA, 50 bp, homo sapien
aagagtgctgtttaaattccaaatcygacaaagaaaccttacacccactg

SEQ ID NO: 34790 - DNA, 50 bp, homo sapien
ggtattagtgatagcaatatgcaaartgtagaccaaatgagtcctgagca

SEQ ID NO: 34791 - DNA, 50 bp, homo sapien
aaaacacttttagattgcaagcatgycagaatgtagaaactgttaccctc

SEQ ID NO: 34792 - DNA, 50 bp, homo sapien
atatgctaagtgtgtacctttgcaayacctactggagtagtcttctcatt

SEQ ID NO: 34793 - DNA, 50 bp, homo sapien
atgtgttaggcactcgctgtataccyggcctattccaagcacctcacatg

SEQ ID NO: 34794 - DNA, 50 bp, homo sapien
tatattatgtggattctaggtacaargcactgtattttatcattatattt

SEQ ID NO: 34795 - DNA, 50 bp, homo sapien
atgtattgtgaccatctccttttgaraatcctgaatcagtacatctatgc

SEQ ID NO: 34796 - DNA, 50 bp, homo sapien
tgtaagcttactcatcttctttttayggtctttaagatcagaccaatggt

SEQ ID NO: 34797 - DNA, 50 bp, homo sapien
agcaaagaaaatatggaatgggtacyggaaacaagtcgtagatatcacaa

SEQ ID NO: 34798 - DNA, 50 bp, homo sapien
ctgtaagaatcaaattatgtccttakcatcttcaacaataatgaaagtac

SEQ ID NO: 34799 - DNA, 50 bp, homo sapien
cctgaggtataagacacatccaggaytagaggatcttaaacatgacaaaa

SEQ ID NO: 34800 - DNA, 50 bp, homo sapien
attggctctgaagtttctatcttagkaaaccgggcgtctgtgatgcttct

SEQ ID NO: 34801 - DNA, 50 bp, homo sapien
aataaggttggggaccactgtattasgcacttaaattgtgaaatgtgatg

SEQ ID NO: 34802 - DNA, 50 bp, homo sapien
agttcttataattttcattccttcaytcacttatctatatcctatgtccc

SEQ ID NO: 34803 - DNA, 50 bp, homo sapien
tcccaccactgtgacaccaggaggayaacatatgggcccttttatattaa

SEQ ID NO: 34804 - DNA, 50 bp, homo sapien
gtttcattatactgtggttgaataasgtactcggcatgacttcaatcttc

SEQ ID NO: 34805 - DNA, 50 bp, homo sapien
ccagatgtatcttatcagcttaacawcctcagtggaaaaaggagactttc

SEQ ID NO: 34806 - DNA, 50 bp, homo sapien
tttccttgggcacacgagtggttggwcatatgatccagccctatcaaatc

SEQ ID NO: 34807 - DNA, 50 bp, homo sapien
attatagttgtgggtaacattattcmaaggagcctcttttgcttaagtcc

SEQ ID NO: 34808 - DNA, 50 bp, homo sapien
actttcagttgttcaataccccggcraatacttggtatggtttttaattg

SEQ ID NO: 34809 - DNA, 50 bp, homo sapien
gaagttcattcactttgacaaaagaracaaaagcaaaaagttttaattgt

SEQ ID NO: 34810 - DNA, 50 bp, homo sapien
caatagaatactaaagtataacaacmatgctgcgcctccagctggaggaa

SEQ ID NO: 34811 - DNA, 50 bp, homo sapien
tgaggtggaaacacaaattcacttaragcaaccaactatttttcaatctt

SEQ ID NO: 34812 - DNA, 50 bp, homo sapien
gaagacaataattaagttttccctgragaactaggctcatttgttatacc

SEQ ID NO: 34813 - DNA, 50 bp, homo sapien
gatttctcattagagttgtgaaagamgcaattgacaaagccctagattcc

SEQ ID NO: 34814 - DNA, 50 bp, homo sapien
tttgtggtaaatattaaaaacaacaytatatgctacagaaaaataaggag

SEQ ID NO: 34815 - DNA, 50 bp, homo sapien
tttttccttaagtcagttaacaaaartcttctctattcatttaaaagtgt

SEQ ID NO: 34816 - DNA, 50 bp, homo sapien
ttcagatcccagttatgtcaccatawgtgtaaatctaaataacagagaga

SEQ ID NO: 34817 - DNA, 50 bp, homo sapien
tttgtggatatttagaagaagaaaarctggtgaagtggactagcaaaaac

SEQ ID NO: 34818 - DNA, 50 bp, homo sapien
ataaagtaatgggaaaagtaaggcawctcaaggaacatattctgcaaggg

SEQ ID NO: 34819 - DNA, 50 bp, homo sapien
ggttcttgattgccaagctaaggaayctggtgtttattggttagagatga

SEQ ID NO: 34820 - DNA, 50 bp, homo sapien
aaaggttacttctttgtcatgaaagscgtcctcagttttcagagacagtg

SEQ ID NO: 34821 - DNA, 50 bp, homo sapien
atactaagttgaggatccagttagayagaagcgaaaaagttctgctagtt

SEQ ID NO: 34822 - DNA, 50 bp, homo sapien
aaagtttgaggattttagtttgctayataaaaccttacctgaattggcct

SEQ ID NO: 34823 - DNA, 50 bp, homo sapien
tatgaattatttcttttgatcttcaygaaccggtgaggttattggttcct

SEQ ID NO: 34824 - DNA, 50 bp, homo sapien
ttaccaacttgtctgcaatatggttmaaaatagttatagataagtgtgta

SEQ ID NO: 34825 - DNA, 50 bp, homo sapien
aggatcaaaagaacaggagagttaasacagtaacagtcaacacaaggaag

SEQ ID NO: 34826 - DNA, 50 bp, homo sapien
ttatcaggcaacatcaaagtttcacyaccacatgacaaaaacacagtgta

SEQ ID NO: 34827 - DNA, 50 bp, homo sapien
acaatagccaggctctcccaggactraatactcaaataaatgttctcttt

SEQ ID NO: 34828 - DNA, 50 bp, homo sapien
catcaagagttctaaaatctggatamtagggattccaaaaggagaaaaag

SEQ ID NO: 34829 - DNA, 50 bp, homo sapien
ctctggtatattttgattaaactaartaagcagttaaagatctaatctct

SEQ ID NO: 34830 - DNA, 50 bp, homo sapien
aaagtactctgctttggacaaaaaaycttggcattgtatttagactaaac

SEQ ID NO: 34831 - DNA, 50 bp, homo sapien
cctggctgtgccagctcagtttctgyatctgctaaataaaagcttggagg

SEQ ID NO: 34832 - DNA, 50 bp, homo sapien
ctataaaacctcaacttttctttcartcggcttcagtgttttgtccagta

SEQ ID NO: 34833 - DNA, 50 bp, homo sapien
ctgagagttagaaaggaattttagaygatgttttctagctttatgaaacc

SEQ ID NO: 34834 - DNA, 50 bp, homo sapien
tttttttcttgaaaccttggcagacwctaattgcacttctgatctatttt

SEQ ID NO: 34835 - DNA, 50 bp, homo sapien
gcccccaatatacagtactcctgtgraggtagactaatgataggattgta

SEQ ID NO: 34836 - DNA, 50 bp, homo sapien
tttcactctgtacagctctaaataayttacttttgaagtcccaggtgact

SEQ ID NO: 34837 - DNA, 50 bp, homo sapien
aattccaggtgttacactgacctcartccaatttacataatttacataaa

SEQ ID NO: 34838 - DNA, 50 bp, homo sapien
agaatctaattttaatgaactctaawtgaacacttaacagataaattctg

SEQ ID NO: 34839 - DNA, 50 bp, homo sapien
tgtttgcagaatatttaactttgaastgtcttgacttattgaaaatagtt

SEQ ID NO: 34840 - DNA, 50 bp, homo sapien
cttactgctttgttttaatgctgtaygttaacttgatataaaagaagagc

SEQ ID NO: 34841 - DNA, 50 bp, homo sapien
aggacagtttgtgagtatgagtgacyaatgctgaaacagtcagggcatgc

SEQ ID NO: 34842 - DNA, 50 bp, homo sapien
tgactttaagccaattgagcttatakgttgagaagaagaagttgaataga

SEQ ID NO: 34843 - DNA, 50 bp, homo sapien
caactattaggtggcagatgtagaaytcatatccaggttcccaaacccca

SEQ ID NO: 34844 - DNA, 50 bp, homo sapien
tggcctggatcttgttcctgttaacrgaatagacaaaccgcagagcagtc

SEQ ID NO: 34845 - DNA, 50 bp, homo sapien
gctgcttttccaggtgttttccatcrcatcgggtttctaatgaatcttgc

SEQ ID NO: 34846 - DNA, 50 bp, homo sapien
aaaaataaaagcctgtagaagaatasatacattagaccaggcatggtggc

SEQ ID NO: 34847 - DNA, 50 bp, homo sapien
tgagaagcactgatctgcagcattayaccatttaactgtcagagcagcta

SEQ ID NO: 34848 - DNA, 50 bp, homo sapien
ccataaggacttgaaactagaagcargtatctcaactgctagggacaaga

SEQ ID NO: 34849 - DNA, 50 bp, homo sapien
atcaccttcctgatgactcctcttarcactattacatcacagaataatga

SEQ ID NO: 34850 - DNA, 50 bp, homo sapien
ccgatgtcaactgtgtaattgaacakgtgaccctattttaatttgacatt

SEQ ID NO: 34851 - DNA, 50 bp, homo sapien
gaaagggacatgtaagaactacaaargtaatggcatagatgaattttttg

SEQ ID NO: 34852 - DNA, 50 bp, homo sapien
catgtgtatactctcaaaacttaaargcaattcaactggagaatatgtgt

SEQ ID NO: 34853 - DNA, 50 bp, homo sapien
tggatttatcatccagacataggaaraagagttttaacatgagtcatcta

SEQ ID NO: 34854 - DNA, 50 bp, homo sapien
tcatgtcttcccacttccacagtaaygctcatattagtcctttcaccctg

SEQ ID NO: 34855 - DNA, 50 bp, homo sapien
ttaaacaacccatggatttgttcacrgagaggaagaatcaatatcattaa

SEQ ID NO: 34856 - DNA, 50 bp, homo sapien
taaaaagacacatcttggacagtaayggagagaccttctgcttatgaaca

SEQ ID NO: 34857 - DNA, 50 bp, homo sapien
aaatcatatcaacctaaaagactgaygagtgttaatttaagtaattttga

SEQ ID NO: 34858 - DNA, 50 bp, homo sapien
cacgtctcttttgataatctttgctyaaagtatgtttgctaagatttttc

SEQ ID NO: 34859 - DNA, 50 bp, homo sapien
acagaaactttgtatcaagaggtccragatttatgaagttgtcaaactaa

SEQ ID NO: 34860 - DNA, 50 bp, homo sapien
tgatgtttcaagaactaactggcaamgactatcagattttagaaacaaag

SEQ ID NO: 34861 - DNA, 50 bp, homo sapien
tgggcattagatcctataccttgaartcatatataatctgtcatattcct

SEQ ID NO: 34862 - DNA, 50 bp, homo sapien
attttggctgtttcatgcatattatyaagcagggattcagggagaaaaag

SEQ ID NO: 34863 - DNA, 50 bp, homo sapien
tgaagcatacttgccaatgagttacrcttcgggaacttcagttattacct

SEQ ID NO: 34864 - DNA, 50 bp, homo sapien
ctagatatcctgcagacttcatacawcatgggaattcagctttaactaca

SEQ ID NO: 34865 - DNA, 50 bp, homo sapien
ctcttaattatatctacagatgctaygttctaactctttcatggcagttt

SEQ ID NO: 34866 - DNA, 50 bp, homo sapien
gtgcacaggcatgtgcctcaacctamaatacactaggccagccatgtcct

SEQ ID NO: 34867 - DNA, 50 bp, homo sapien
ttcatggcagttttaatttgggagaygttcaatacatatttgttgagtga

SEQ ID NO: 34868 - DNA, 50 bp, homo sapien
ccaaaatccaccgagacctcgttagraagcagatgtttccttgctgtgaa

SEQ ID NO: 34869 - DNA, 50 bp, homo sapien
tcttagaatcagaaaattacaagacracacatagaaaattccaagatgac

SEQ ID NO: 34870 - DNA, 50 bp, homo sapien
ttctcaataagcttcttgaataccamcttcacatagagactgtgtagtag

SEQ ID NO: 34871 - DNA, 50 bp, homo sapien
ttttcctgtggattgtgttttaataycctctggctatttatctattgcgg

SEQ ID NO: 34872 - DNA, 50 bp, homo sapien
aaaacttctggaagatactatcacamggttacattttatcagccatagac

SEQ ID NO: 34873 - DNA, 50 bp, homo sapien
attgttgtcaaggccccattttgagrctattggttaagttgctaatggat

SEQ ID NO: 34874 - DNA, 50 bp, homo sapien
tgaaataaatggcaatgataaccaarttgccggaaaaaaatgagcaggca

SEQ ID NO: 34875 - DNA, 50 bp, homo sapien
cctctactcttttctttctgtttccwaatgatacactcctttcttgaact

SEQ ID NO: 34876 - DNA, 50 bp, homo sapien
atttttggccatcaacttatagcaayaattccagaaatgaaattgcatac

SEQ ID NO: 34877 - DNA, 50 bp, homo sapien
gaatgaataaatgggccttagcagasaggttggcgtaatggttaaaaaca

SEQ ID NO: 34878 - DNA, 50 bp, homo sapien
gtttactttcacatgtatatgctacsagcaaatgacacaaatactgccta

SEQ ID NO: 34879 - DNA, 50 bp, homo sapien
aaaactcacttagatacatgtgtaaygctttaaaagaaaattaatctaaa

SEQ ID NO: 34880 - DNA, 50 bp, homo sapien
tgaaaaaatggagacttagagcattkaaaccagtgcttgagaattttaac

SEQ ID NO: 34881 - DNA, 50 bp, homo sapien
tagtacaaatttaaaatttgatctartacatttacaattcatctattata

SEQ ID NO: 34882 - DNA, 50 bp, homo sapien
gactagttttgccatatcctagccayattaccttggagaagttatatctg

SEQ ID NO: 34883 - DNA, 50 bp, homo sapien
gaagtttttattgacaagtaatgtaratattcacctgatctaagttaccc

SEQ ID NO: 34884 - DNA, 50 bp, homo sapien
actcgtacccttaagcaaagtaatckcttgtgcctcagtctcctcctttt

SEQ ID NO: 34885 - DNA, 50 bp, homo sapien
gagcaggacagctccagttttttccrgcttaagttatgagttcatgctcc

SEQ ID NO: 34886 - DNA, 50 bp, homo sapien
ttttgaatactttgccacttctgaayagtttagtgtttttctgttctatc

SEQ ID NO: 34887 - DNA, 50 bp, homo sapien
aaaattgacatcaagtgaacacttaygtatctgctaatagatattaaatt

SEQ ID NO: 34888 - DNA, 50 bp, homo sapien
atcctctggatttcaggtcataagasacatctattagtgccttcacctag

SEQ ID NO: 34889 - DNA, 50 bp, homo sapien
taatttagctgttcacttaatttggratgatataatctagccatttgagt

SEQ ID NO: 34890 - DNA, 50 bp, homo sapien
ctgctaatctggtgggcagacgccayagtgcagagaaacctggtatgcag

SEQ ID NO: 34891 - DNA, 50 bp, homo sapien
tttcagttgccttgagaagggataasaatattttcaaaactacatcttta

SEQ ID NO: 34892 - DNA, 50 bp, homo sapien
tacaaaaatgttgaacctgaggttamgacttgtgcaaatgcagccttatt

SEQ ID NO: 34893 - DNA, 50 bp, homo sapien
acagaggcatcttgctggcaccataygaaagaagattggtctctaggtga

SEQ ID NO: 34894 - DNA, 50 bp, homo sapien
caatcggatctgaaataaatgtaaawcctgcaataagtgaatgaatttca

SEQ ID NO: 34895 - DNA, 50 bp, homo sapien
ttttatttgcacaagtttgattcacraggctggaaaaactcttctatgag

SEQ ID NO: 34896 - DNA, 50 bp, homo sapien
gtctatgttgtcacaattacctagaygggtgctgtttactacagcggcca

SEQ ID NO: 34897 - DNA, 50 bp, homo sapien
attcatacattgtcatgtaaaattaygagaagtctttcacatgctaattc

SEQ ID NO: 34898 - DNA, 50 bp, homo sapien
tcaacaaaggccaagaaatgcagccmgaaaatcaaggtggtttaagacct

SEQ ID NO: 34899 - DNA, 50 bp, homo sapien
aataatacaccatagattaggaagargtacagatttccatattgcttccc

SEQ ID NO: 34900 - DNA, 50 bp, homo sapien
gctcttcaccaaaggtgatacgcgartaagaacagttgccctgtggcatg

SEQ ID NO: 34901 - DNA, 50 bp, homo sapien
tccaatattatggtctacgtaaaaayagattccaatcacataaaaaatag

SEQ ID NO: 34902 - DNA, 50 bp, homo sapien
gaacaatggaaaggttacagataaamgtccagattgaagagatgcatagg

SEQ ID NO: 34903 - DNA, 50 bp, homo sapien
atgatttgatcttagctggagtagaygaaacatacacatacacaggcaat

SEQ ID NO: 34904 - DNA, 50 bp, homo sapien
gtgtagtcatgatcctagctctccamattttactttttttcatctataaa

SEQ ID NO: 34905 - DNA, 50 bp, homo sapien
gtttacccgtttattataaagaacawtggaaaggttacagataaaagtcc

SEQ ID NO: 34906 - DNA, 50 bp, homo sapien
gatttcctagggatttggagagtaamaacaaatataattatcatcgaaca

SEQ ID NO: 34907 - DNA, 50 bp, homo sapien
tatatggaaatagattaagatgtgawgaaaagaagggagatggccactaa

SEQ ID NO: 34908 - DNA, 50 bp, homo sapien
ttgggctaccttctgtgcaaggcctraatagatggtataacacctccttt

SEQ ID NO: 34909 - DNA, 50 bp, homo sapien
attgaaacctatttcagagctatgayaactagttgatttcaactggacaa

SEQ ID NO: 34910 - DNA, 50 bp, homo sapien
ttataatgacaatatgcatgtatcartactaaataacagctgaataagac

SEQ ID NO: 34911 - DNA, 50 bp, homo sapien
ggtgttctgagaaatgtcttgagcaygaggagtaccaagagaagtagaca

SEQ ID NO: 34912 - DNA, 50 bp, homo sapien
gggaaaagagtctttgcagaggtgartaagctaaggattttgcgatgggg

SEQ ID NO: 34913 - DNA, 50 bp, homo sapien
ggttcatgagattgaaggaaagaagycatttctgtatcataagagtgcaa

SEQ ID NO: 34914 - DNA, 50 bp, homo sapien
ctgggaggtaaacaaaatccaaatcratgtcattaaaagaactatacctg

SEQ ID NO: 34915 - DNA, 50 bp, homo sapien
cacagtaataaactagttgaaatcawccaaatggaccaaatgtggtagag

SEQ ID NO: 34916 - DNA, 50 bp, homo sapien
atagataaccataaatttcaacatgmattgagtaaaaactaaaaattgtg

SEQ ID NO: 34917 - DNA, 50 bp, homo sapien
gtgaactactgaatcatcagcatgamgtatagacgttaactcaccatagg

SEQ ID NO: 34918 - DNA, 50 bp, homo sapien
ttagctgctatgtgttcgattgcacygtcccaaatattgctacttaatta

SEQ ID NO: 34919 - DNA, 50 bp, homo sapien
aagcctgggagcatgacaatctcacraaggttcaataggcacagagtggg

SEQ ID NO: 34920 - DNA, 50 bp, homo sapien
gacgtctcagcgggataacaagtagrcagccatgttgtgtaatggaaatt

SEQ ID NO: 34921 - DNA, 50 bp, homo sapien
tcagattacaacatgggctatttggmagaaatttccttaaagacaaagta

SEQ ID NO: 34922 - DNA, 50 bp, homo sapien
accacgtgaaatgaatttggataaargagatacgtttttgccccttccca

SEQ ID NO: 34923 - DNA, 50 bp, homo sapien
tctctttcataaggttataataacaygctccttgggacttatgtggtgct

SEQ ID NO: 34924 - DNA, 50 bp, homo sapien
attagtgaacctacaaatacagcaaygttacctatgcaagatgaatcaca

SEQ ID NO: 34925 - DNA, 50 bp, homo sapien
atgtgcctgagtcctccagattcaartcatccattacctaatacttttct

SEQ ID NO: 34926 - DNA, 50 bp, homo sapien
gaaggacaagcatcagtcaacatagyattcaaaaatccctttaaaacatc

SEQ ID NO: 34927 - DNA, 50 bp, homo sapien
aaccaagaagatgcaagacggttackgctgaacagaaaggcgggggagat

SEQ ID NO: 34928 - DNA, 50 bp, homo sapien
ggatatccagttaaagttgaaggaamccaactacagagaacaaattatat

SEQ ID NO: 34929 - DNA, 50 bp, homo sapien
cccatacccacatgttgatagcctgmcaccaaaggtaaagaccaaaaaag

SEQ ID NO: 34930 - DNA, 50 bp, homo sapien
gagtattaacttctccacacttctakaatgtacacttctgagtaactact

SEQ ID NO: 34931 - DNA, 50 bp, homo sapien
aaaggccatatagaagacaaaaataycaactgtatctatctcttacatga

SEQ ID NO: 34932 - DNA, 50 bp, homo sapien
taataatataaactaaacatttatascttacactcttcaagcatttgcca

SEQ ID NO: 34933 - DNA, 50 bp, homo sapien
ataaaaaaatcagtaattgttaccaygtgaaatgaatttggataaaagag

SEQ ID NO: 34934 - DNA, 50 bp, homo sapien
aaaatattagtaaattgaattcagcrgcatataagaagaaatatatacca

SEQ ID NO: 34935 - DNA, 50 bp, homo sapien
ttacaagaaaactagtcttgaaacayatatgtaaaaacctaaacaaaata

SEQ ID NO: 34936 - DNA, 50 bp, homo sapien
gagatgaaagtacctaacatagaaaraggcatgaatattcttgaaaagag

SEQ ID NO: 34937 - DNA, 50 bp, homo sapien
aaaacattttctcttactatcactayaaaaaatgtcagtaattctggccg

SEQ ID NO: 34938 - DNA, 50 bp, homo sapien
tgactcatattttgttgactatttayagaaattacaaaaggagagaaaaa

SEQ ID NO: 34939 - DNA, 50 bp, homo sapien
tgaaaactgtgtagatcatgcatcayaggtgaagtttatgtacaaaacca

SEQ ID NO: 34940 - DNA, 50 bp, homo sapien
gtatcacctctgcttaatagcatcargatattccaaattacctataccaa

SEQ ID NO: 34941 - DNA, 50 bp, homo sapien
aacattttcatcatggagtggggtasaaataattaccgtgaaatacgcta

SEQ ID NO: 34942 - DNA, 50 bp, homo sapien
tacaggatggaaaacttaacttagaraatggatctgccaatgcttttggt

SEQ ID NO: 34943 - DNA, 50 bp, homo sapien
tttctttaacttggtatctggtatgkaataagtgtacgatacgttacttc

SEQ ID NO: 34944 - DNA, 50 bp, homo sapien
atgagccctgtaacaggaactctgcragcgaaatactaatactttgcact

SEQ ID NO: 34945 - DNA, 50 bp, homo sapien
gaaaataaaagctaggaagtcagaayccatggagaaatctgcaagtatta

SEQ ID NO: 34946 - DNA, 50 bp, homo sapien
ttgacgtgcacatcagcattagagaycaaaagggactctgtgtctgtagg

SEQ ID NO: 34947 - DNA, 50 bp, homo sapien
gatagcgccacgtgcaagtttttagyaaggataccacgtaggtggtgctg

SEQ ID NO: 34948 - DNA, 50 bp, homo sapien
ctgggaaggaaagttaggctcagaakgtaggaagccttacatgccatttt

SEQ ID NO: 34949 - DNA, 50 bp, homo sapien
gtgtgaaagcaggctaaaggaaaagrcaactcactgtaatttgttgatta

SEQ ID NO: 34950 - DNA, 50 bp, homo sapien
ggaaaggtcataatagacactcactkaattgattttttctagttttatgg

SEQ ID NO: 34951 - DNA, 50 bp, homo sapien
gtaccaaactattactgaatttgttwaaatgtaatgataggttgtgcatg

SEQ ID NO: 34952 - DNA, 50 bp, homo sapien
ggccattatgggaagtgggagttgamatgcatcattatacctcttccgca

SEQ ID NO: 34953 - DNA, 50 bp, homo sapien
aataggactgcagagatctaaacacratagtatctgatatggtttggctg

SEQ ID NO: 34954 - DNA, 50 bp, homo sapien
gttcatctatgtatgaggatattccrcactgtatatcaaagctctgtggg

SEQ ID NO: 34955 - DNA, 50 bp, homo sapien
caaacctaatgttataaaatacttamatgctgactgagcttgtacttgtg

SEQ ID NO: 34956 - DNA, 50 bp, homo sapien
cgtttttaataaagtctgatattaasatttgtcagttaaaaactgagctc

SEQ ID NO: 34957 - DNA, 50 bp, homo sapien
ggctttctacagctgacacaataaartctaaactccttaaaatggcatgt

SEQ ID NO: 34958 - DNA, 50 bp, homo sapien
gaaaagcatattactaattaatggartagaaccaggtaggaatttcttgg

SEQ ID NO: 34959 - DNA, 50 bp, homo sapien
tcattgtcacttcactaaaaatagamgcaaaactacacctttgtttagtt

SEQ ID NO: 34960 - DNA, 50 bp, homo sapien
ggaaaaggcaccaaattactggctcygaatgcaaaatgtctgcatgccac

SEQ ID NO: 34961 - DNA, 50 bp, homo sapien
cgtgtattgtctcagctgcaggtaaytggaatccatatgcattagctcca

SEQ ID NO: 34962 - DNA, 50 bp, homo sapien
gtgcttagtgtgtagtatgtgctaartattttgtatcagttcattgactt

SEQ ID NO: 34963 - DNA, 50 bp, homo sapien
attttagattttttacttttcagcaygtgacttaaagttctgttgacttg

SEQ ID NO: 34964 - DNA, 50 bp, homo sapien
ctggtcttcaagattactgtcttgaycactaaatgtcttttgaatgtcaa

SEQ ID NO: 34965 - DNA, 50 bp, homo sapien
taaatgattttgaggttccaatcacratttcttaaaagtatgcacctaga

SEQ ID NO: 34966 - DNA, 50 bp, homo sapien
tcagcgaagatcacaacaaaacttcmaagcgcgtgtgaagtcacaggata

SEQ ID NO: 34967 - DNA, 50 bp, homo sapien
catcacagattgtaacttttcagtayctttatgcttcaaatataagcaaa

SEQ ID NO: 34968 - DNA, 50 bp, homo sapien
ttacagatgggaaaacttgcactaartgtttgagtcacatgctaatacta

SEQ ID NO: 34969 - DNA, 50 bp, homo sapien
tttaatttctagtttaagatgtggcmatagtcaatttcatttttgctgtg

SEQ ID NO: 34970 - DNA, 50 bp, homo sapien
aagttttgaaaagacttacaataaarccatatggatatagatctttgcaa

SEQ ID NO: 34971 - DNA, 50 bp, homo sapien
ttgtctccacagtaagtcccacgttyaacatagatgactacctgcccgat

SEQ ID NO: 34972 - DNA, 50 bp, homo sapien
aattcagcatgaattttcaatgcctsaattcttagttcaatttctaagca

SEQ ID NO: 34973 - DNA, 50 bp, homo sapien
agagtttaggagaaataacaatcacmaagtttgaatttgcaaaaccttta

SEQ ID NO: 34974 - DNA, 50 bp, homo sapien
aaggatgcttaacttgaaatagaccmaacagattctctcttccaaaataa

SEQ ID NO: 34975 - DNA, 50 bp, homo sapien
taaagaaactacaactggattactamattacttcaactccaatctggtca

SEQ ID NO: 34976 - DNA, 50 bp, homo sapien
aggcaacacattatctcatcttaagycctggagttctaagagctacactc

SEQ ID NO: 34977 - DNA, 50 bp, homo sapien
atttaaatacagtacttattcctgaygattgtggtattttcaggaagact

SEQ ID NO: 34978 - DNA, 50 bp, homo sapien
tttccataccacacttttattaagcygaatttactgtatacaatttaaaa

SEQ ID NO: 34979 - DNA, 50 bp, homo sapien
gattccaaaaatctgtgcctaaccayactcccatatcttctctattgatc

SEQ ID NO: 34980 - DNA, 50 bp, homo sapien
tagtttagagctgtatactacagtgratacaacatctacttttttcatga

SEQ ID NO: 34981 - DNA, 50 bp, homo sapien
ctaatcttcacaagggcttccttaayctctaaactatgttgagctcttgt

SEQ ID NO: 34982 - DNA, 50 bp, homo sapien
tttataaattgcctgtggaaagtaasgaaagaaaataaccacatgttcaa

SEQ ID NO: 34983 - DNA, 50 bp, homo sapien
tcagcactctcctctgttcttcagtsaaatacaaatctgcctaatggatt

SEQ ID NO: 34984 - DNA, 50 bp, homo sapien
cacagaaagcctttttcaaagagagsatattagaaatgatattcaagacc

SEQ ID NO: 34985 - DNA, 50 bp, homo sapien
attctgtgatgtgaaaggcactatcratcatgtgaaatcactgaacccta

SEQ ID NO: 34986 - DNA, 50 bp, homo sapien
atccaaaaaagttatcgtaaggcaakttaagagttgtctttatagctgtg

SEQ ID NO: 34987 - DNA, 50 bp, homo sapien
ggatgtgaacaaaatagggtattgastaagtaaggaataggcagttttct

SEQ ID NO: 34988 - DNA, 50 bp, homo sapien
ctgttggcaaccattaattgatagaygtaggtatggcctgtacttataaa

SEQ ID NO: 34989 - DNA, 50 bp, homo sapien
ttttctctgcacaaaatcctcagtaygaaatttgtagcctttcctaatcc

SEQ ID NO: 34990 - DNA, 50 bp, homo sapien
tgtcagatgaaatgggagcagtggamgaatgtaagtacaataaaggcagg

SEQ ID NO: 34991 - DNA, 50 bp, homo sapien
cctctttgattttgaatataggttayatcccgtatccctggcttttccac

SEQ ID NO: 34992 - DNA, 50 bp, homo sapien
atgtttaaatgcttaccattctgtgwattattgctttatgtgttccaagg

SEQ ID NO: 34993 - DNA, 50 bp, homo sapien
atcttccattccattttgcaggtatkacaacaattaataataaccaaaat

SEQ ID NO: 34994 - DNA, 50 bp, homo sapien
cctggtattctccatgggatctagcraagtcccacacacatagtagcagg

SEQ ID NO: 34995 - DNA, 50 bp, homo sapien
gcctagctgtaattttgcacttcaawcacctttaaaatacaaacaaaata

SEQ ID NO: 34996 - DNA, 50 bp, homo sapien
taccgagggaagagctagctggctckcatgatactacagaaccagatctg

SEQ ID NO: 34997 - DNA, 50 bp, homo sapien
aattgtgcattttctcatatctccarcagtcaataaaatgtaatcataat

SEQ ID NO: 34998 - DNA, 50 bp, homo sapien
gtgaagttatctctgaaagagtatcygagaaaatatagcaagttttccaa

SEQ ID NO: 34999 - DNA, 50 bp, homo sapien
gcggaattattttcaacttactgtayctactttgatggtgggttggagtg

SEQ ID NO: 35000 - DNA, 50 bp, homo sapien
atgccagtccatttcatgctcaaagraatctcatttactcccacagcagc

SEQ ID NO: 35001 - DNA, 50 bp, homo sapien
agtatatttttgatgctgcataaaawtagagctgaaatatttgtacacta

SEQ ID NO: 35002 - DNA, 50 bp, homo sapien
agaaggctgttattactgagacctcrattcacataacatgaatttacata

SEQ ID NO: 35003 - DNA, 50 bp, homo sapien
acggtgctctgggataatcacatacractatccatttggaaacagggctc

SEQ ID NO: 35004 - DNA, 50 bp, homo sapien
tttactcaaaattatgccatgtaaartgcataaagacttcacaaacttta

SEQ ID NO: 35005 - DNA, 50 bp, homo sapien
gttttcctttattctgtgaattaccyaatgttcttccatgctagggtgca

SEQ ID NO: 35006 - DNA, 50 bp, homo sapien
attaatgatagctataaatgtactaygtctaccctgtgctcataaaaatt

SEQ ID NO: 35007 - DNA, 50 bp, homo sapien
ttgatatgctgtgactgccaggctakctcctatctatttttatttcttgc

SEQ ID NO: 35008 - DNA, 50 bp, homo sapien
gttgatgcagtggttcaaagatacargatccacaggcagggtggtggtgc

SEQ ID NO: 35009 - DNA, 50 bp, homo sapien
actttcacctttcaacatgtaaaacygggtaatcaatctttatattagaa

SEQ ID NO: 35010 - DNA, 50 bp, homo sapien
tgcctgcaagacaacaattgcctaakctgtgtaacatttctctatttaga

SEQ ID NO: 35011 - DNA, 50 bp, homo sapien
aatacctaagacaaggttttgcatasaaaaataggagcttagcatatgct

SEQ ID NO: 35012 - DNA, 50 bp, homo sapien
ttttttgcctctaatattttcaagckatgatacagaacaaacgtctttaa

SEQ ID NO: 35013 - DNA, 50 bp, homo sapien
tggaaggatgtacaggaactgaggayaggttttcagagtgcagtcagcta

SEQ ID NO: 35014 - DNA, 50 bp, homo sapien
tgaatcagaccattcattctgtgacraatccaagtactaagaaaatgaga

SEQ ID NO: 35015 - DNA, 50 bp, homo sapien
cttacttttattgcaataaactaaakaaattttgatgaacaactggcaca

SEQ ID NO: 35016 - DNA, 50 bp, homo sapien
gatagctttgtgatattttttgggckaccaaattgtgtgtttatagaagg

SEQ ID NO: 35017 - DNA, 50 bp, homo sapien
ttttccttcatttcaactttaaagawtcggacaattatgtgtcttcgagt

SEQ ID NO: 35018 - DNA, 50 bp, homo sapien
gttaccagagatcaattgttcctaaygtaaaaaggaagtgctaatctagt

SEQ ID NO: 35019 - DNA, 50 bp, homo sapien
ggcaaagcttctgtgaccctgcagartatttttatgagaattcaaaaatg

SEQ ID NO: 35020 - DNA, 50 bp, homo sapien
gctggaaaccttaggaaagaaatccraatatatagtaactatatgtatca

SEQ ID NO: 35021 - DNA, 50 bp, homo sapien
gaccatatcaccaccagggcttcaartaccaaatatatgcagttacctcc

SEQ ID NO: 35022 - DNA, 50 bp, homo sapien
aaagtcttcttttaaactgatagtcratattttgatctgtgcagagtttg

SEQ ID NO: 35023 - DNA, 50 bp, homo sapien
atggaatccaaaggattttgttaaaygctgaagtactttgaacccaagta

SEQ ID NO: 35024 - DNA, 50 bp, homo sapien
tgaggaagtggcactgctttaattaygtcttgaatgacttagaaaagagg

SEQ ID NO: 35025 - DNA, 50 bp, homo sapien
ggctcttattacgttagagcccagasgtaacttacaatgttgagtgtgtc

SEQ ID NO: 35026 - DNA, 50 bp, homo sapien
gaaatattgagagactctttttagckatagtatgaagtaattaagaaaag

SEQ ID NO: 35027 - DNA, 50 bp, homo sapien
aaagctttaaaatcagcttttctcartatgtacttgccagacatctttca

SEQ ID NO: 35028 - DNA, 50 bp, homo sapien
tacaatattttccttgagaataacaytatttgtcctataaaatataacat

SEQ ID NO: 35029 - DNA, 50 bp, homo sapien
gcaatttgttaaaaatgtcctactcmcattgagatataaccaattgaaat

SEQ ID NO: 35030 - DNA, 50 bp, homo sapien
taggtaaatttctccatcaggataasagtcaggaatttgatggagactgt

SEQ ID NO: 35031 - DNA, 50 bp, homo sapien
taggcataaaatgcttaggaatacawtcttttacatagtgaactatcttg

SEQ ID NO: 35032 - DNA, 50 bp, homo sapien
agattcagatgttgatattaagttaygagaatcattcttcaacaaaattg

SEQ ID NO: 35033 - DNA, 50 bp, homo sapien
gtatatatgaatacagaagataatawgcccaatatagaatatttttgttc

SEQ ID NO: 35034 - DNA, 50 bp, homo sapien
taaagctcagacacatgtggataatraacaatccttccccttcacctata

SEQ ID NO: 35035 - DNA, 50 bp, homo sapien
ctactagtcagtattaaccatagaawcctaagaactgaaacctaggctaa

SEQ ID NO: 35036 - DNA, 50 bp, homo sapien
attttttttgtatttatccttcaaaktcaaactgtagccttattttcttt

SEQ ID NO: 35037 - DNA, 50 bp, homo sapien
aggacagcagagcatcagagagcccrgaataaatcatcccatgcagaagg

SEQ ID NO: 35038 - DNA, 50 bp, homo sapien
aaggatgaaatgaactacactattgragctactataaagatgaaagaaga

SEQ ID NO: 35039 - DNA, 50 bp, homo sapien
gggtggttttggtcacccaattttarcatgcctctctgatagtgtttgag

SEQ ID NO: 35040 - DNA, 50 bp, homo sapien
atatttagtatcatagtcagccctamagtttgaaatattctcttctgtta

SEQ ID NO: 35041 - DNA, 50 bp, homo sapien
catattcggcccatcattgatcaaawtgtcatcatgtggtgcatgtctgt

SEQ ID NO: 35042 - DNA, 50 bp, homo sapien
tttaaaaagcacaaagttaacagtawcaagaaaagtactctatcataagt

SEQ ID NO: 35043 - DNA, 50 bp, homo sapien
agcctttgattgtctccagttcctamcaatttaatttccctacatttgtc

SEQ ID NO: 35044 - DNA, 50 bp, homo sapien
tctctctctttccgtcttgaaaatcrcacctctttgacattgatattatg

SEQ ID NO: 35045 - DNA, 50 bp, homo sapien
cttacatctatttataatgtctagaraataatgttccttgaaggagtaga

SEQ ID NO: 35046 - DNA, 50 bp, homo sapien
aagatacagaaaagatctgaacataytaaaaaatgagatgaggccattaa

SEQ ID NO: 35047 - DNA, 50 bp, homo sapien
cacaggactccttttgatactctaartgttggaagacatcttgccagcag

SEQ ID NO: 35048 - DNA, 50 bp, homo sapien
ttgattgccttccttgtgtaaatgcrctttatggaggaaaaaagaaagta

SEQ ID NO: 35049 - DNA, 50 bp, homo sapien
atttactcctgttacaggctatagaygttaaacaggaaaaaataaaacac

SEQ ID NO: 35050 - DNA, 50 bp, homo sapien
aatgatgtctgatataaaaaacagcrgagaagtatgtgttttatttattt

SEQ ID NO: 35051 - DNA, 50 bp, homo sapien
ctgaccctcaggtctgttgtgacgaytaaataagttaatataggttatga

SEQ ID NO: 35052 - DNA, 50 bp, homo sapien
gatcattaaatgagaaaatgcattcrgaatgagtagcaaagtgcctgtca

SEQ ID NO: 35053 - DNA, 50 bp, homo sapien
acagctctgtgggaaagcaaacttasactgggctctgcagccatttattc

SEQ ID NO: 35054 - DNA, 50 bp, homo sapien
aaaatggaagttgagcagcatttgargtatcatttctttcagcacaatac

SEQ ID NO: 35055 - DNA, 50 bp, homo sapien
aggggcctgaaaaagagcctagctastacagaaatataactcacctgaaa

SEQ ID NO: 35056 - DNA, 50 bp, homo sapien
cctgacttgttagggaggtttcctcratgtatttctggactataggcttt

SEQ ID NO: 35057 - DNA, 50 bp, homo sapien
accctagattggtttgaaactcagarctgatgggcaatcaaatatgcttc

SEQ ID NO: 35058 - DNA, 50 bp, homo sapien
ttatagctctttagatataaaaacartgaagcatatttgattgcccatca

SEQ ID NO: 35059 - DNA, 50 bp, homo sapien
acagggtctccaaacagaagtatccrgcaaacaatgcaagaattgtagtg

SEQ ID NO: 35060 - DNA, 50 bp, homo sapien
tctaatggctcccactagctccatayggcctctcgatgttctattccctg

SEQ ID NO: 35061 - DNA, 50 bp, homo sapien
agaggcccagttctttccaaaaggcycagtgtacatggttaagaagcttt

SEQ ID NO: 35062 - DNA, 50 bp, homo sapien
aaaatatgatataaaagataaaatargatagaactgtgtagggcacttac

SEQ ID NO: 35063 - DNA, 50 bp, homo sapien
gaagggagacaggagttactttgctsaatctgtggtaaccgcagtaatca

SEQ ID NO: 35064 - DNA, 50 bp, homo sapien
tgtaagcaacatgtgttacataggcratagtattatctcaattctataaa

SEQ ID NO: 35065 - DNA, 50 bp, homo sapien
gagttatgaatttcaatttgtaagaktaaattgcagtagggcatcaaatg

SEQ ID NO: 35066 - DNA, 50 bp, homo sapien
acatacaacccagacaaccacatacrgcctgaaatggtttgatgttgtgt

SEQ ID NO: 35067 - DNA, 50 bp, homo sapien
tatcagatgtagttgccagaataaamcacatactccactagaaggacaat

SEQ ID NO: 35068 - DNA, 50 bp, homo sapien
gtaccagtgcatttaataaacttcartaaatatgttggctactgttacta

SEQ ID NO: 35069 - DNA, 50 bp, homo sapien
ggattcaatcaggtgggaacctgaamgtctgtgacatctgaagtgtgtag

SEQ ID NO: 35070 - DNA, 50 bp, homo sapien
ctcaaattttgaacttcctggatgayaataaagacacataccagagcaaa

SEQ ID NO: 35071 - DNA, 50 bp, homo sapien
ttcaacaatatgctatagccctctaygtagtcatttcctttctcaaaaga

SEQ ID NO: 35072 - DNA, 50 bp, homo sapien
gcaacaggtagtgtgaaggataagayactagctgaaaagaaatcaaacaa

SEQ ID NO: 35073 - DNA, 50 bp, homo sapien
agacaggagcacgtaagagggagatyacaacacagtgtgagaagtacaaa

SEQ ID NO: 35074 - DNA, 50 bp, homo sapien
ctgtggtggcaggtgttaatcctaakggttctgatcatctggatgttgag

SEQ ID NO: 35075 - DNA, 50 bp, homo sapien
cctcattgttataaggctccgtctayctctggtttttctccattctgaga

SEQ ID NO: 35076 - DNA, 50 bp, homo sapien
ccagttcagagagctattttgagagwccttaggaaacagacctcccccca

SEQ ID NO: 35077 - DNA, 50 bp, homo sapien
attttgcttttctatagcttttgtasagtgaaaaattattcagagctaca

SEQ ID NO: 35078 - DNA, 50 bp, homo sapien
tctcagtttcataaccaggaatccaractctttctgcttactggaacaca

SEQ ID NO: 35079 - DNA, 50 bp, homo sapien
ctttttcttttaatagcaaatatacygaggaagttgttctgccaggacct

SEQ ID NO: 35080 - DNA, 50 bp, homo sapien
aaaatcctaaatctccaattactaaygataacaattcatgtaatgtatat

SEQ ID NO: 35081 - DNA, 50 bp, homo sapien
cactgtatgtcagcatgtctgagtaytaaaggaacaaagctgtagacact

SEQ ID NO: 35082 - DNA, 50 bp, homo sapien
gctgtgtgcaaaatggagatcaaaasgagatactggaggcttgaaaggga

SEQ ID NO: 35083 - DNA, 50 bp, homo sapien
catcacattgttattctaattcttcyattggctacttctctaactttcaa

SEQ ID NO: 35084 - DNA, 50 bp, homo sapien
taataaaattactgagcaaaactgartactttaaaatatcaaccataagg

SEQ ID NO: 35085 - DNA, 50 bp, homo sapien
ggctacaatgatagttcactgaagcrctataaaagtaacacacaatatgg

SEQ ID NO: 35086 - DNA, 50 bp, homo sapien
gcccactgcctccctagcattgcagraagagacaatgatattaagtaggt

SEQ ID NO: 35087 - DNA, 50 bp, homo sapien
agaattaggtaataataatgactaaycaaaaatacttgtattaaatgttg

SEQ ID NO: 35088 - DNA, 50 bp, homo sapien
taccagatcagtttcttttctcaccrcttctgtagagatgaactaagatg

SEQ ID NO: 35089 - DNA, 50 bp, homo sapien
aaaaatttatcacactttaaagaggrattactagaactctctatacatac

SEQ ID NO: 35090 - DNA, 50 bp, homo sapien
tcagaaatcattttgtaaggaatcaygagaaaatctttaaaaagttgtat

SEQ ID NO: 35091 - DNA, 50 bp, homo sapien
catctgatcagaaaatgagagtcgartatataggctatgtaaaccagtgc

SEQ ID NO: 35092 - DNA, 50 bp, homo sapien
ctaaataggtattagcaaaaacacayaatttagtctgattatcactatag

SEQ ID NO: 35093 - DNA, 50 bp, homo sapien
tttgaatttataatatccactagaaygttttactggtgtagtacttagta

SEQ ID NO: 35094 - DNA, 50 bp, homo sapien
atactggaggcttgaaagggatctayggagacagactttattccaagagc

SEQ ID NO: 35095 - DNA, 50 bp, homo sapien
tccaagagcactgggcagtctctgamaggttttaatcagggtaggacaca

SEQ ID NO: 35096 - DNA, 50 bp, homo sapien
aattctttctgggtttatttatagayagtagagaccagaggagaacactt

SEQ ID NO: 35097 - DNA, 50 bp, homo sapien
aaaaggaggtccatcttcattactartaaagcctagggtgtagagcatgt

SEQ ID NO: 35098 - DNA, 50 bp, homo sapien
aaaagctctctatatgcttatgtaartgttcctccatgaaatgaaatata

SEQ ID NO: 35099 - DNA, 50 bp, homo sapien
aatggccattatcctaaagccatatraagaataaggacagatttctcaat

SEQ ID NO: 35100 - DNA, 50 bp, homo sapien
agaaaatatagtggctgaaatcatcygagtgccaggaaactcactgctga

SEQ ID NO: 35101 - DNA, 50 bp, homo sapien
ttttctctgtcattacctttgattaygaaaaagccctgagcaggtgtcag

SEQ ID NO: 35102 - DNA, 50 bp, homo sapien
acaatttgccttaactaatttctatracaaacaatgcctatgggaatgaa

SEQ ID NO: 35103 - DNA, 50 bp, homo sapien
tattaaggtaaaatacataggaatartatcaacatgcttataatttataa

SEQ ID NO: 35104 - DNA, 50 bp, homo sapien
gagttcattgttcaataatttgaaaygagctgtgaatgaaaacgtgatgt

SEQ ID NO: 35105 - DNA, 50 bp, homo sapien
caggcaaactacatttacagctaaargtcaatattaacacaatttccatt

SEQ ID NO: 35106 - DNA, 50 bp, homo sapien
atacatagaatacaaacttgtgttayaaaaagtgaggtcaatttaagaaa

SEQ ID NO: 35107 - DNA, 50 bp, homo sapien
cgatgttttataatccctgttttccrgatgataaaaatgatctggagaag

SEQ ID NO: 35108 - DNA, 50 bp, homo sapien
ttcaggctgctcttgagtataaaccrgaagatatggcagagtttttttaa

SEQ ID NO: 35109 - DNA, 50 bp, homo sapien
ggaaaatagcctgtggtcaaaatagycactgaattagaggaaatgcacat

SEQ ID NO: 35110 - DNA, 50 bp, homo sapien
gacttagaaaccaacagtatcaagawgtgtttataattaatcaagatgag

SEQ ID NO: 35111 - DNA, 50 bp, homo sapien
taaaatttaagttgttgccaatatcycaacaagtctaattaggaaataaa

SEQ ID NO: 35112 - DNA, 50 bp, homo sapien
gtatattttggaacattcacaactaygaaagaactgtaaaagaatgtgcc

SEQ ID NO: 35113 - DNA, 50 bp, homo sapien
ctttagtatgcatattttgagagccyagtttattgatgtataatcactcc

SEQ ID NO: 35114 - DNA, 50 bp, homo sapien
gcattggctatatatagtaaaactgsagcctacttttaatcaatatctag

SEQ ID NO: 35115 - DNA, 50 bp, homo sapien
ttcctatgcaccagggcagtttttcrcttcctttacatcacctccagccc

SEQ ID NO: 35116 - DNA, 50 bp, homo sapien
tccatatattctgtgctaggtttaayggaagaattcaaagacttcaaaat

SEQ ID NO: 35117 - DNA, 50 bp, homo sapien
ctgctctcagtatgtttggaatttckctagggattctaagaactctggaa

SEQ ID NO: 35118 - DNA, 50 bp, homo sapien
gaaataactaagtcaaatacttagaraaaatactgtcaaattagtcatgg

SEQ ID NO: 35119 - DNA, 50 bp, homo sapien
aatcttaccttttaatgttagtcaamgatagtttttgtctctcctctcat

SEQ ID NO: 35120 - DNA, 50 bp, homo sapien
gaaggaaggtccttataccacttaawaattttctcttctacaagtacata

SEQ ID NO: 35121 - DNA, 50 bp, homo sapien
actcaattatagaatcatacagtcaragcacattgtgattatttggttag

SEQ ID NO: 35122 - DNA, 50 bp, homo sapien
ataataatgtatgttgtcctttcaasaatgttttcagtgaagaatatttc

SEQ ID NO: 35123 - DNA, 50 bp, homo sapien
agtttaactggtatatgaatcctcarctgataaggagaaaaagccctcaa

SEQ ID NO: 35124 - DNA, 50 bp, homo sapien
agcttcattcaggcgtgagttatacmactattgaccatgacttcaatgtt

SEQ ID NO: 35125 - DNA, 50 bp, homo sapien
tctgacactttttaggcacaatattsaaagaacagtgttaaacaaattaa

SEQ ID NO: 35126 - DNA, 50 bp, homo sapien
ctgatatttttctctaaccagaaagraacctgttttgaagactgtgtttt

SEQ ID NO: 35127 - DNA, 50 bp, homo sapien
cagaaccgtacataagatgaccaaartctctaccaccatgctttgaattt

SEQ ID NO: 35128 - DNA, 50 bp, homo sapien
tggatcatatgcctgttagagttaasattccagccagaaacagaaccgta

SEQ ID NO: 35129 - DNA, 50 bp, homo sapien
gcagtattgtattttattcaatgaamgtttagattagatcaagttagttc

SEQ ID NO: 35130 - DNA, 50 bp, homo sapien
agaaagcaaaggtccaaaacattgarcattgaagtctatgaatgtaacta

SEQ ID NO: 35131 - DNA, 50 bp, homo sapien
cagttctacacttataacgtggaaasttcttattcatttccctgccttca

SEQ ID NO: 35132 - DNA, 50 bp, homo sapien
gtctcagacttaaaagtaataaaaaytgtatctcaataaaactaagcaca

SEQ ID NO: 35133 - DNA, 50 bp, homo sapien
gccgtcttgatgtgggtatgtatgcycttgttatttgagaagcactgctc

SEQ ID NO: 35134 - DNA, 50 bp, homo sapien
tccacgtttggcaatataggtagcawgattgtgaagatacatccatggta

SEQ ID NO: 35135 - DNA, 50 bp, homo sapien
cctgttaaagaatgagcaatagaagmaggctgccagaatagtcctggagc

SEQ ID NO: 35136 - DNA, 50 bp, homo sapien
aggtattgaaagttatggtctcaccratggacttgattcccacctcagct

SEQ ID NO: 35137 - DNA, 50 bp, homo sapien
ggggaagtcatctgaggctagtttaraacaaaagtaactgagtgccttaa

SEQ ID NO: 35138 - DNA, 50 bp, homo sapien
tgaggcagtgtatgacaggttatatyaccccaagatatcacaaataaaat

SEQ ID NO: 35139 - DNA, 50 bp, homo sapien
cctgtgtctacttgtgagctaaatcyctaggtatctgtccacaccctagg

SEQ ID NO: 35140 - DNA, 50 bp, homo sapien
agtatcactgttcttatcatgccacrgtctcttgtaaatgttgttctgtt

SEQ ID NO: 35141 - DNA, 50 bp, homo sapien
ggttatgggtatctccataaattcawcatcaactgaggtatgttataccc

SEQ ID NO: 35142 - DNA, 50 bp, homo sapien
taacagcaaaggtaaatgagcaataratgagatgaatgagaaaagggggc

SEQ ID NO: 35143 - DNA, 50 bp, homo sapien
acaagtcccaaacctaatctgtcatsaagacctgctacttatttcaccaa

SEQ ID NO: 35144 - DNA, 50 bp, homo sapien
ggattccatgattttaacgcatttaycttttaagtgtattatttccctat

SEQ ID NO: 35145 - DNA, 50 bp, homo sapien
atatctgcaatctaatgattttttamcatccgcattgctaccagtctggc

SEQ ID NO: 35146 - DNA, 50 bp, homo sapien
aacaaaagccctgggagagtaagtawcttgcacggttggacacctaagtg

SEQ ID NO: 35147 - DNA, 50 bp, homo sapien
tcccctccacaaaagacagctttacrgggttacttcagttttgctggctc

SEQ ID NO: 35148 - DNA, 50 bp, homo sapien
aaacaaacaaaaacgaaagggcttargataatggaataagatcagggtgg

SEQ ID NO: 35149 - DNA, 50 bp, homo sapien
ttaaattttaatttttttctgattaytaagacctgacagcagtggctatt

SEQ ID NO: 35150 - DNA, 50 bp, homo sapien
tttaagagaagttagggatgtccacrgatttaagtaaaactacttttcag

SEQ ID NO: 35151 - DNA, 50 bp, homo sapien
tatgaaaataattgggcagcaaagasagatataataggtcacctcaaaaa

SEQ ID NO: 35152 - DNA, 50 bp, homo sapien
cttttcaagttgaaaagcaggtatayatcaattgttctattaaacaacat

SEQ ID NO: 35153 - DNA, 50 bp, homo sapien
agttgcagtttcaatggtagatgaarttcaaaggtcaaagtacctaaaaa

SEQ ID NO: 35154 - DNA, 50 bp, homo sapien
tttaaatttgctcacgtcttccatcygaaataaaggagtttcactaatta

SEQ ID NO: 35155 - DNA, 50 bp, homo sapien
ataaactgtggattagaaaaggaaayaagtagtagccaacaaataatttt

SEQ ID NO: 35156 - DNA, 50 bp, homo sapien
caaaatatagctcaggcagttaagaygagatgaaagatttcttttcacca

SEQ ID NO: 35157 - DNA, 50 bp, homo sapien
ctcttatcagtctataatgttgagaktcaattagctattggtaatgttca

SEQ ID NO: 35158 - DNA, 50 bp, homo sapien
aggttaagtttttttcctaaatatgmagatgattatgtacttagaaactt

SEQ ID NO: 35159 - DNA, 50 bp, homo sapien
acttaattgttatgttgaatatagaytatgaaggagctttattttgttaa

SEQ ID NO: 35160 - DNA, 50 bp, homo sapien
tgaatttttcctgctcctaatcccayagtgtcattatttgccttatatta

SEQ ID NO: 35161 - DNA, 50 bp, homo sapien
aggtagttattaacaaacacacaagrctagcaataaaattcaatgatgtt

SEQ ID NO: 35162 - DNA, 50 bp, homo sapien
gtacatggctggaggataaggtagaygaaaagagatggttgaaatcactt

SEQ ID NO: 35163 - DNA, 50 bp, homo sapien
catctgtatgatatttagcttgacartaagcctgggttcccagaactgtt

SEQ ID NO: 35164 - DNA, 50 bp, homo sapien
tggttgcaatttcttaagccagataygaagaagaatgttttaagtctcac

SEQ ID NO: 35165 - DNA, 50 bp, homo sapien
gtgaccacgactgtgtggataagtcygacgaggtcaactgctgtgagtgc

SEQ ID NO: 35166 - DNA, 50 bp, homo sapien
atgctttggttctagcctgtaaagakcactgagtcatgggatgacaatag

SEQ ID NO: 35167 - DNA, 50 bp, homo sapien
agaaccactgtataaatgtgactaakaatactgaaacaataatattatac

SEQ ID NO: 35168 - DNA, 50 bp, homo sapien
aataaatgttatctgaattgagatayagtgttactagtgctctttccaga

SEQ ID NO: 35169 - DNA, 50 bp, homo sapien
tcaaacctgtgtcactaggcaataayggaagattcaggaaaagctgaaga

SEQ ID NO: 35170 - DNA, 50 bp, homo sapien
ggaatttttagaattggactttggakctcttaatttggttggctttttgt

SEQ ID NO: 35171 - DNA, 50 bp, homo sapien
ttaggaaaaaaaaaaaaaaccatacygaaatgcagaaaagtactcaaaaa

SEQ ID NO: 35172 - DNA, 50 bp, homo sapien
catcaagggaatagtgtgaatatcaygaataaatgtggaatgaacagaaa

SEQ ID NO: 35173 - DNA, 50 bp, homo sapien
tttagatttagaaatgagacatggamgaacataaggacatcaagggaata

SEQ ID NO: 35174 - DNA, 50 bp, homo sapien
tgaagtacgaattgtgatttagttaygataggagaataagagtcaatgtg

SEQ ID NO: 35175 - DNA, 50 bp, homo sapien
tgtgggtctttggcaagtttgcttasctttctttgaatcattgtacacat

SEQ ID NO: 35176 - DNA, 50 bp, homo sapien
atgaacctctatgcctggcctagcaytcaattcttttataaaaacacttt

SEQ ID NO: 35177 - DNA, 50 bp, homo sapien
aaaatagaaaggatattgataaaacrgggtagactttgaatgcctactac

SEQ ID NO: 35178 - DNA, 50 bp, homo sapien
atacacagacttcgttacctcttgayagctcattggttacttttttaaaa

SEQ ID NO: 35179 - DNA, 50 bp, homo sapien
ttttaatatgttgattgtttcataamtctctctgctcccatttttattgc

SEQ ID NO: 35180 - DNA, 50 bp, homo sapien
agagtggtacctagtatatgttaaasgtagcatctcaaaacattgagaca

SEQ ID NO: 35181 - DNA, 50 bp, homo sapien
gtccagtgaaataaatagattgataygtattccagtgatatatgtaatcc

SEQ ID NO: 35182 - DNA, 50 bp, homo sapien
cctctcaagagagtcaactcttctcwctgtaatagctctatagttctagt

SEQ ID NO: 35183 - DNA, 50 bp, homo sapien
ttgtgacaaagtagaaataattcaayggttaaataggaagataagagaga

SEQ ID NO: 35184 - DNA, 50 bp, homo sapien
taaggagagtagagaaatttgagagycctcttgaatacggcttttaagca

SEQ ID NO: 35185 - DNA, 50 bp, homo sapien
ctaaaaatcacagctatttgagatgragtacaagtcaaaatgttgagtct

SEQ ID NO: 35186 - DNA, 50 bp, homo sapien
aatgttgtccagagacattttcctaygatgttctctatggcaaacctatc

SEQ ID NO: 35187 - DNA, 50 bp, homo sapien
ttcctgacatacagtggtctctcaayacagataggtttcacaaatgaatg

SEQ ID NO: 35188 - DNA, 50 bp, homo sapien
gggattactgggaaagagttggtgaygtttttataaaacagactgtatta

SEQ ID NO: 35189 - DNA, 50 bp, homo sapien
tgggtcttcctttttgagaatctgaygctatagttggctattaaattata

SEQ ID NO: 35190 - DNA, 50 bp, homo sapien
tcaagttgtagtacatcacctggaayggatagagcttcatttcttttggt

SEQ ID NO: 35191 - DNA, 50 bp, homo sapien
cctagaatatccaataattaattaartgtcatccttaacttcaagagtct

SEQ ID NO: 35192 - DNA, 50 bp, homo sapien
atgcattaaatagaatggaatttgaraagtagagtctagagtctatagat

SEQ ID NO: 35193 - DNA, 50 bp, homo sapien
aagtaaagtattgcctttgggattaygctaatgatatcagctcaagctat

SEQ ID NO: 35194 - DNA, 50 bp, homo sapien
cctttctcattaagctcactattaamacttgaaatcttaagggccaaaaa

SEQ ID NO: 35195 - DNA, 50 bp, homo sapien
tctcatctataaaatgtgtatggtawctctgtagacccttgacattccca

SEQ ID NO: 35196 - DNA, 50 bp, homo sapien
tttggcccatatttataaaacttggyccaaaaaactggtattccatgttc

SEQ ID NO: 35197 - DNA, 50 bp, homo sapien
caaggttttcactgtcatggaagaaytaaaactgtgacttaagcttcaca

SEQ ID NO: 35198 - DNA, 50 bp, homo sapien
cctccaagtttagtttccattatgaygaaaagttgcaaggttttcactgt

SEQ ID NO: 35199 - DNA, 50 bp, homo sapien
tgtttctgtaggtagggaatagagamcttaggaagagcagggcaggccac

SEQ ID NO: 35200 - DNA, 50 bp, homo sapien
tgtccatgcaattcagatttatcaaytctttcattccatagaaatttagt

SEQ ID NO: 35201 - DNA, 50 bp, homo sapien
ttagaaagatttcatgtaagaaactragaattaataggggaataaatgag

SEQ ID NO: 35202 - DNA, 50 bp, homo sapien
taacaaatatctgctaaataataaarccctgatttaaatgaatatttccc

SEQ ID NO: 35203 - DNA, 50 bp, homo sapien
agaaaaaaataaacagcaaaggcaayggtaagatattggaaaacatttga

SEQ ID NO: 35204 - DNA, 50 bp, homo sapien
ttagtcaaactgaagaaacactggcygaaaagttttagactagatggcat

SEQ ID NO: 35205 - DNA, 50 bp, homo sapien
tatattgtcactacttatttgcctcraaacacaagagaaactaggggaac

SEQ ID NO: 35206 - DNA, 50 bp, homo sapien
aaaaagattagggatataaatccaartagtgtgagttctagtttgctaat

SEQ ID NO: 35207 - DNA, 50 bp, homo sapien
actgttcaactctttttcagaaacaycagaattagcaaactagaactcac

SEQ ID NO: 35208 - DNA, 50 bp, homo sapien
gaattctgattctggctaaacactamatctgaacttgcttgggaaggtca

SEQ ID NO: 35209 - DNA, 50 bp, homo sapien
actgggcaagacatttagaacaggayaagcacttgaaaaaaaaatgtgca

SEQ ID NO: 35210 - DNA, 50 bp, homo sapien
tcctcattcaaaaactgcatgtgctraacaacagctaacatcatgataca

SEQ ID NO: 35211 - DNA, 50 bp, homo sapien
ctactgacagatcctgctctcctaamgcatgcagacctctctgacttgct

SEQ ID NO: 35212 - DNA, 50 bp, homo sapien
gctatgaaggtatggtgaatttcaayatggtcttcctcattcaaaaactg

SEQ ID NO: 35213 - DNA, 50 bp, homo sapien
taaagcaaaagacagagaagttaaaygagatctcagagaggcagagtgcc

SEQ ID NO: 35214 - DNA, 50 bp, homo sapien
atttctttccatattgtagcatgggmatgtaaggttagataagcatacat

SEQ ID NO: 35215 - DNA, 50 bp, homo sapien
tctagaaaatcatatttacaaatcaygccgcttcagtgggtataaagaaa

SEQ ID NO: 35216 - DNA, 50 bp, homo sapien
cactggatgttctggatgtttccaayggttctggaagttttgtggacact

SEQ ID NO: 35217 - DNA, 50 bp, homo sapien
cagtaaattactcaagtccacataaratttaacttgacttcagatttcat

SEQ ID NO: 35218 - DNA, 50 bp, homo sapien
aatgttcttccctcagtcacccagargatgttttcctgaacatcattcag

SEQ ID NO: 35219 - DNA, 50 bp, homo sapien
acatatattaaaggcataattaagayaatatgtgacacatggtatgtgct

SEQ ID NO: 35220 - DNA, 50 bp, homo sapien
tggctttaatccaacacatataagaracttctagcttgtatgtagctatg

SEQ ID NO: 35221 - DNA, 50 bp, homo sapien
gagataaaagtttatgtatacattcmatcctttttacctgcataaaatcc

SEQ ID NO: 35222 - DNA, 50 bp, homo sapien
acctaatgctacagacaaaacaagaygaccaaagagcgtttactcaatca

SEQ ID NO: 35223 - DNA, 50 bp, homo sapien
tatctaatatgtgacatgagtaagasagtatggtaataatcatctcaagg

SEQ ID NO: 35224 - DNA, 50 bp, homo sapien
catatctccaaacaccttagaaagcraaaattaggccgatcatggtggct

SEQ ID NO: 35225 - DNA, 50 bp, homo sapien
ttggcactggcattactatcacaacrgtgtgtcctgaacttccactgtga

SEQ ID NO: 35226 - DNA, 50 bp, homo sapien
aaaaattttgtaacaaaacaagataygagatgagagtttaaaatattcaa

SEQ ID NO: 35227 - DNA, 50 bp, homo sapien
tgaatgtcctactcattctgcaatayaaaagtaaattaccaaataataaa

SEQ ID NO: 35228 - DNA, 50 bp, homo sapien
caagaaagcaggtggtactattggastaaagatcaagacaacagcataca

SEQ ID NO: 35229 - DNA, 50 bp, homo sapien
gattgcatcctaaatatgtgagttcyctgttattttaatgtgcacagctt

SEQ ID NO: 35230 - DNA, 50 bp, homo sapien
taaaaaattgctttgtaatttaaaargatcaattccattacacattcact

SEQ ID NO: 35231 - DNA, 50 bp, homo sapien
gggagaaacatgaaggagaaataacrggcatattcccaatttaggaactt

SEQ ID NO: 35232 - DNA, 50 bp, homo sapien
ttttctctgccatcttttaacatcaygttagtttttctgagtttgagtca

SEQ ID NO: 35233 - DNA, 50 bp, homo sapien
taaaagtgcttgtattgtgtccttayggaaatataatcctgcgaagagtt

SEQ ID NO: 35234 - DNA, 50 bp, homo sapien
cacgcacacaaacacgcatgcataaygttaaaaagtaaagttcttataga

SEQ ID NO: 35235 - DNA, 50 bp, homo sapien
ggacatctgtcctcacatttcaatcycttttcaactaaagtcagctttca

SEQ ID NO: 35236 - DNA, 50 bp, homo sapien
agactgctctacctttgtattttcamgttagggaccaccatgatgtttca

SEQ ID NO: 35237 - DNA, 50 bp, homo sapien
agcagattgaaagctctgagtacatragctatttaagtacatgagcacgt

SEQ ID NO: 35238 - DNA, 50 bp, homo sapien
tggtaattattattctattctcaagragctcatagtctagtagggaaagg

SEQ ID NO: 35239 - DNA, 50 bp, homo sapien
tcatctaaaagagatcaaatttttaraatcaatctatcacactttaatat

SEQ ID NO: 35240 - DNA, 50 bp, homo sapien
tagtttataaagttcttgtctgctaraatcatgtaacacttcaaagatta

SEQ ID NO: 35241 - DNA, 50 bp, homo sapien
tctgccttcttcatctcctctcttgwattaatgtcccacaccttcattct

SEQ ID NO: 35242 - DNA, 50 bp, homo sapien
ttaattacatttagacataattgacrcttttatttgtaatgcaaaatatc

SEQ ID NO: 35243 - DNA, 50 bp, homo sapien
ctcatacatacacatttatctaaaawttaattggttctcttaatagactc

SEQ ID NO: 35244 - DNA, 50 bp, homo sapien
cttatggccagatgacgtcaactctyactataaaagatgatgttttccat

SEQ ID NO: 35245 - DNA, 50 bp, homo sapien
gtaagttattttccagaaaatagtarcctttcattattaccaaacatcca

SEQ ID NO: 35246 - DNA, 50 bp, homo sapien
tgagttcaaacaatgtaatcaagaaycttccgtttccctcttttatctat

SEQ ID NO: 35247 - DNA, 50 bp, homo sapien
cagcagagaagccacagtaactaatwatgagactttactggatgtttggt

SEQ ID NO: 35248 - DNA, 50 bp, homo sapien
attccaatctcagtggaaggacataygtataaataattacaatgcattac

SEQ ID NO: 35249 - DNA, 50 bp, homo sapien
ttctacaatctcaaccagtacttcartaatgcaaaaatgcagggggagca

SEQ ID NO: 35250 - DNA, 50 bp, homo sapien
attcattcaaccaacatttactatgwatcaggcactgctctaggtacttg

SEQ ID NO: 35251 - DNA, 50 bp, homo sapien
tttgatataactctcagagatcagasataagaaatacataatgagaaaat

SEQ ID NO: 35252 - DNA, 50 bp, homo sapien
gttactccttcattcatgcaacatayattgtgatgtcctattatgtgcta

SEQ ID NO: 35253 - DNA, 50 bp, homo sapien
taaaatgcctagaatgtctaacccayaataggcatactagagtgaatgaa

SEQ ID NO: 35254 - DNA, 50 bp, homo sapien
atgagacaatggtatagttcacataygaatttggagtacttttcaggttt

SEQ ID NO: 35255 - DNA, 50 bp, homo sapien
ataactgtcagtgttatttattgtawatactggtcactgcaaacaattgc

SEQ ID NO: 35256 - DNA, 50 bp, homo sapien
tatattttgattgccaactaattcartaatactcttatttgagttggaaa

SEQ ID NO: 35257 - DNA, 50 bp, homo sapien
ggtagagattttgttaccatgataayccatcaagttccactatgagaggg

SEQ ID NO: 35258 - DNA, 50 bp, homo sapien
aaactctataatcattttcctccaastctaagctacagaagtggggggtt

SEQ ID NO: 35259 - DNA, 50 bp, homo sapien
attgcataaacatcacaatattcctraattatatgagttaatacaatttt

SEQ ID NO: 35260 - DNA, 50 bp, homo sapien
tacaaaatgtaaaattatatgctaartattagtacagactatgagataca

SEQ ID NO: 35261 - DNA, 50 bp, homo sapien
tacccttaagcttgtggtgcaaaaayggcctctcattaaatatcaattca

SEQ ID NO: 35262 - DNA, 50 bp, homo sapien
actcattgagacttaacaaaaacgcyattgatattcttcaaatttctttt

SEQ ID NO: 35263 - DNA, 50 bp, homo sapien
tgtgtaagccaatggtgaattttacracacaccattctcatagttcagaa

SEQ ID NO: 35264 - DNA, 50 bp, homo sapien
tatcaaataacaaagtctgcctatayatgaacttcattagcaattataat

SEQ ID NO: 35265 - DNA, 50 bp, homo sapien
attatttagcgaatgtcttctagacmaaatacagagtagaaaaaataatc

SEQ ID NO: 35266 - DNA, 50 bp, homo sapien
agatctgtttggtctttcctctgaawcatctttccctccatataggagtc

SEQ ID NO: 35267 - DNA, 50 bp, homo sapien
cacctcttatctgcttggacctggakaattggtataacactcccccaacc

SEQ ID NO: 35268 - DNA, 50 bp, homo sapien
aagataaagatttatcttgtttaackctaaaagatataaagaaactaagc

SEQ ID NO: 35269 - DNA, 50 bp, homo sapien
tgcctactttgtacccagtgctttaygaaaaggagttaattaacatacta

SEQ ID NO: 35270 - DNA, 50 bp, homo sapien
tatatatttttaaaagcgctcatcarattgtagctagatatttgtgccta

SEQ ID NO: 35271 - DNA, 50 bp, homo sapien
tctttcccctcaatttgctagtgacragattggaagaaactgcttctgca

SEQ ID NO: 35272 - DNA, 50 bp, homo sapien
caatattctatcttgttaactgtccygatattctatcttgttaactgtct

SEQ ID NO: 35273 - DNA, 50 bp, homo sapien
tcctctgcttttacatccaaaaataycatgtagcttgctcaatggaaaaa

SEQ ID NO: 35274 - DNA, 50 bp, homo sapien
acatacaataattgaacacacaattyaattatttcagtgacttgctttca

SEQ ID NO: 35275 - DNA, 50 bp, homo sapien
ttgaacctaatattgaaatgtcctargaaagatagcacacatgatcttgt

SEQ ID NO: 35276 - DNA, 50 bp, homo sapien
accatttacttctcacctatatcackatctaacaagagttgtggggttgt

SEQ ID NO: 35277 - DNA, 50 bp, homo sapien
aaataggactgcaatttgaatgcaayggaatattggcctttatgaaaata

SEQ ID NO: 35278 - DNA, 50 bp, homo sapien
tggtaaagaaatatttcatcctgaaraaatctaggtgttttaacaaagaa

SEQ ID NO: 35279 - DNA, 50 bp, homo sapien
aaaaactctatttgcttgaatgttaygaccgtctagagactttaaaataa

SEQ ID NO: 35280 - DNA, 50 bp, homo sapien
ctccccacttcttacttacctcctayagaccttctacgaactacctaagg

SEQ ID NO: 35281 - DNA, 50 bp, homo sapien
aaggtcaggcatatagggaactttcratcatattagctctattctttcca

SEQ ID NO: 35282 - DNA, 50 bp, homo sapien
attaagagcaatgtacatgccataaraactattaaataatttggtcacat

SEQ ID NO: 35283 - DNA, 50 bp, homo sapien
tcactttctgtcttttgtaggaaggycaaacccaatttataaaatatgta

SEQ ID NO: 35284 - DNA, 50 bp, homo sapien
ggtcattctgataccatatgttacaygtattcctaaacagccttgaattc

SEQ ID NO: 35285 - DNA, 50 bp, homo sapien
gtatatgacttttttgggataaagayggtatatcaaaaaattgatgttat

SEQ ID NO: 35286 - DNA, 50 bp, homo sapien
gaaaaaaggacagttgaacattaaaytcagctagtatatgtaggagtaat

SEQ ID NO: 35287 - DNA, 50 bp, homo sapien
gctcaaatgtcaaaatgatcgattaygttatgttggatgtgattattatt

SEQ ID NO: 35288 - DNA, 50 bp, homo sapien
atcagacatgaaatgtgctttctaartgaagacgtcccttcttcctacac

SEQ ID NO: 35289 - DNA, 50 bp, homo sapien
tattactcatagcatataactctgayatgttcgttaagatgttatatact

SEQ ID NO: 35290 - DNA, 50 bp, homo sapien
aatgaatgactgtctaagtaactaaytccttcacgtattcccatgccatt

SEQ ID NO: 35291 - DNA, 50 bp, homo sapien
aacatgtagtattgtagtattgtagwcagccttaacagaaagcttcatgc

SEQ ID NO: 35292 - DNA, 50 bp, homo sapien
aagttttccaccagccgagagccaamaatttagcttgagttatagagaac

SEQ ID NO: 35293 - DNA, 50 bp, homo sapien
caaagctttgcagctactatctcgamtaaacagccatgtcctgcactcag

SEQ ID NO: 35294 - DNA, 50 bp, homo sapien
ttctgacacccaggatctctgaatcraccattttctttcttccttttttc

SEQ ID NO: 35295 - DNA, 50 bp, homo sapien
gaaagtaagagataattaaataaacygcatggaattgataatttatgtca

SEQ ID NO: 35296 - DNA, 50 bp, homo sapien
catagactttgcaagaaactgtaacratgtctttcaatgtggctttattt

SEQ ID NO: 35297 - DNA, 50 bp, homo sapien
gtcacatatataggaacaacgataaraactgtagcagacttctcatcaga

SEQ ID NO: 35298 - DNA, 50 bp, homo sapien
attttgaaaactcatgaggtaaaatsatcacatatggtagagaactgaac

SEQ ID NO: 35299 - DNA, 50 bp, homo sapien
tcttcagagcttcagtattattacaktctttcacaaaagtactgtggcaa

SEQ ID NO: 35300 - DNA, 50 bp, homo sapien
acaaaacacctttgcacataatagcrattaacaattttaaaaattaagaa

SEQ ID NO: 35301 - DNA, 50 bp, homo sapien
gaaaatgatgtcaagttcaatctaaytgttacactgagttaaatgtagaa

SEQ ID NO: 35302 - DNA, 50 bp, homo sapien
tcaccatgtgtcagttattcaaatckccttgcatggacaactaatttgaa

SEQ ID NO: 35303 - DNA, 50 bp, homo sapien
ttttcaaagcaaattaagaaaaaccmgaagtgtggattgcattacattct

SEQ ID NO: 35304 - DNA, 50 bp, homo sapien
tactatgtaagataatacatcctcargttccaagaattaggatgtggata

SEQ ID NO: 35305 - DNA, 50 bp, homo sapien
cctgcctaggatatatttattctcayggctcaagttgttcagaatcacat

SEQ ID NO: 35306 - DNA, 50 bp, homo sapien
tcatttttctacttggctcctctaaygggatatggcatacatttttaacc

SEQ ID NO: 35307 - DNA, 50 bp, homo sapien
caaaaagcaattaaaatagaatgcartaagtattaatgacattaggtgtt

SEQ ID NO: 35308 - DNA, 50 bp, homo sapien
tattttttacacttttggcagttagraatacattaaaacccacagtatat

SEQ ID NO: 35309 - DNA, 50 bp, homo sapien
gcttatctctgaacagtctgccagargagttaaaaatatagtcaagcagt

SEQ ID NO: 35310 - DNA, 50 bp, homo sapien
aaaatggtctttacttttctctcaayggcagcattattttaattacatat

SEQ ID NO: 35311 - DNA, 50 bp, homo sapien
attttgttctatccaaagctattgaygggaaactattggaggattagagc

SEQ ID NO: 35312 - DNA, 50 bp, homo sapien
actaacaataccactctccaaagatmaaatgttagactaatattctggta

SEQ ID NO: 35313 - DNA, 50 bp, homo sapien
ggagaaagtgttatgccaagggcaawgtgggtattaattttctgtatggt

SEQ ID NO: 35314 - DNA, 50 bp, homo sapien
tgaagagtaaagttgttacaagagargatagttttgtgtgtatgtgtgtg

SEQ ID NO: 35315 - DNA, 50 bp, homo sapien
ctctgctatttagtaaaaatggatcwcataaatgttaaatttgtgctatt

SEQ ID NO: 35316 - DNA, 50 bp, homo sapien
ggagggatatgatggttaatatacaygcaatcattgaatttgttataatt

SEQ ID NO: 35317 - DNA, 50 bp, homo sapien
agaatcagttttagcaacaattcaaytcatctcaataaatatttactggg

SEQ ID NO: 35318 - DNA, 50 bp, homo sapien
gcacagtgcttgccacatgagagtcrcccagtaaatatttattgagatga

SEQ ID NO: 35319 - DNA, 50 bp, homo sapien
caagtgttattcccatcacaagagasagcaaggattgctttgcagattgg

SEQ ID NO: 35320 - DNA, 50 bp, homo sapien
tgtctttttcaagttcaaaaaaagamtagagttttattcatcagatagga

SEQ ID NO: 35321 - DNA, 50 bp, homo sapien
aaagcatgttgagcaaattattggcrcatatttggaaattttatatagat

SEQ ID NO: 35322 - DNA, 50 bp, homo sapien
gtgcagaacaaaaaccacatctgacragcacaggctgccagcttggtgac

SEQ ID NO: 35323 - DNA, 50 bp, homo sapien
catctctcaccttgatcattccaacyatgtcctgctaaaacagttatcac

SEQ ID NO: 35324 - DNA, 50 bp, homo sapien
cattttcctgaccttgggtaacacakccataaatgtcttggactttcagt

SEQ ID NO: 35325 - DNA, 50 bp, homo sapien
ctaatgataataaagacgttttgaamaattcatgtctttgagtcaattgt

SEQ ID NO: 35326 - DNA, 50 bp, homo sapien
atctttttaattgggactttgtagayattttaagctgatagtattttctt

SEQ ID NO: 35327 - DNA, 50 bp, homo sapien
ctaaatgtattctttgactatcatamctataatactttattatatttaaa

SEQ ID NO: 35328 - DNA, 50 bp, homo sapien
agaataaaataccttataatgaaaartatgtcgaaatttgtagttaatga

SEQ ID NO: 35329 - DNA, 50 bp, homo sapien
tattccatgtgtagtatactatgaasatataaaaacacattttaaatttt

SEQ ID NO: 35330 - DNA, 50 bp, homo sapien
tctctgccagtctggattcttccaayagatgtccctgtagaaccatagta

SEQ ID NO: 35331 - DNA, 50 bp, homo sapien
tagaaattaccagccctttgattagmcctgatatgttttatgtatcatag

SEQ ID NO: 35332 - DNA, 50 bp, homo sapien
acctttggtcataaagtgaaacccayattagcaagtacttggcaatgctc

SEQ ID NO: 35333 - DNA, 50 bp, homo sapien
aaagtggtggcaggtaacttttaatragaattcagaagagtcccaggcta

SEQ ID NO: 35334 - DNA, 50 bp, homo sapien
aatttctgtggaagatataaggaaarttattaaaccctacagaaatgtac

SEQ ID NO: 35335 - DNA, 50 bp, homo sapien
gtctctgaataatgatgacctgtacrcattactgggacattatctgatag

SEQ ID NO: 35336 - DNA, 50 bp, homo sapien
actggggaaagataatgatggaatayacctgggagagctgtaggagaagg

SEQ ID NO: 35337 - DNA, 50 bp, homo sapien
gcctgaagagctgaggttgtggaaaracattcaacttttctctcctctga

SEQ ID NO: 35338 - DNA, 50 bp, homo sapien
ctgataagctgtatattccctgtaayctctgtgatcctcattcatcaatg

SEQ ID NO: 35339 - DNA, 50 bp, homo sapien
ctacaaatactgtattacaacaaaaytataccattacaactttctctgtt

SEQ ID NO: 35340 - DNA, 50 bp, homo sapien
tcctttttattgattctctattttcyctgttttataaatgagagatttgg

SEQ ID NO: 35341 - DNA, 50 bp, homo sapien
tattgtccttcaagttaggccttagyccgaagtatttggtcatagatgaa

SEQ ID NO: 35342 - DNA, 50 bp, homo sapien
tgtttttatttctgaaagagtgggayactacctcaaagttgggaacatat

SEQ ID NO: 35343 - DNA, 50 bp, homo sapien
tatagctgcactgaaaattcaatagragcactcaacaacatactagttta

SEQ ID NO: 35344 - DNA, 50 bp, homo sapien
aatcttgttttgtatcctcgtaaaayagccaagaaggaagttggtgataa

SEQ ID NO: 35345 - DNA, 50 bp, homo sapien
tttgtggcataattctatagtaaagraaattgatgtaatttagtccaaat

SEQ ID NO: 35346 - DNA, 50 bp, homo sapien
taccttctttgataaaggcttataaygcctgaggatcattttttgtaata

SEQ ID NO: 35347 - DNA, 50 bp, homo sapien
caaaaactctaaaaactgactctaargtatactctaatgggatctaattg

SEQ ID NO: 35348 - DNA, 50 bp, homo sapien
agttgaaaagattatgtaatttacckacagtggctaaaacatgaactgat

SEQ ID NO: 35349 - DNA, 50 bp, homo sapien
gtatgagaatgagtcccagatcaaaygtaattagtaacagttgataatga

SEQ ID NO: 35350 - DNA, 50 bp, homo sapien
agcttgagaaactgcacaaagcaaartttataatatttatatgagtcact

SEQ ID NO: 35351 - DNA, 50 bp, homo sapien
attagaaaagtttcaaagttataatwatgtttagcaacaagagataatac

SEQ ID NO: 35352 - DNA, 50 bp, homo sapien
tgcaaagatttgggtcgccatcgaamacttgaaatatgcataggtgaaaa

SEQ ID NO: 35353 - DNA, 50 bp, homo sapien
gagctatgaatgcgatttttagaacrgtgcatagattagttcagtaaatg

SEQ ID NO: 35354 - DNA, 50 bp, homo sapien
ctgtaggttgcaggacagctttgcasacaaaaggctaagatgacacataa

SEQ ID NO: 35355 - DNA, 50 bp, homo sapien
ttcaaaggaaaacatttttggtaaaygttctctagcagctgatgttcatg

SEQ ID NO: 35356 - DNA, 50 bp, homo sapien
tgccgtccctaccaacttcatcaccrctctaactgatcagtagacatggg

SEQ ID NO: 35357 - DNA, 50 bp, homo sapien
ttgaaaatacacacacgctacagtawcataaggcctaaaattctgtgagc

SEQ ID NO: 35358 - DNA, 50 bp, homo sapien
acgccgtggcggtccatttaagcagkaaagcgttgggaactgattggatt

SEQ ID NO: 35359 - DNA, 50 bp, homo sapien
ctgagctgtcacaacaacgtaacaasagacaattcagtgccttaaaacag

SEQ ID NO: 35360 - DNA, 50 bp, homo sapien
atccagctaattggtgtcatgagacraagcagtaaacaaaacagatggta

SEQ ID NO: 35361 - DNA, 50 bp, homo sapien
aggggacacacttgtattccaagtargcacatcttataaacatgcatcga

SEQ ID NO: 35362 - DNA, 50 bp, homo sapien
attgggggcagaaaatgtatgaccargtgtattgaatatgtttaggaacc

SEQ ID NO: 35363 - DNA, 50 bp, homo sapien
gtcaagtctcttaataaagaagcaaragtaatgactacagtaaaatctcc

SEQ ID NO: 35364 - DNA, 50 bp, homo sapien
gataaaccacatagctaaagcagaarattaaagtcaagtctcttaataaa

SEQ ID NO: 35365 - DNA, 50 bp, homo sapien
agttctcatgtcagggaactgtttcyatgcattctctgctgtaagactct

SEQ ID NO: 35366 - DNA, 50 bp, homo sapien
atttcaggagtgtaaagaatcttgaygtcaccttatggaaaggggatgaa

SEQ ID NO: 35367 - DNA, 50 bp, homo sapien
tacaggtaaatacagtctcaggcackgaaggaaatctggtatttattcag

SEQ ID NO: 35368 - DNA, 50 bp, homo sapien
ccccaatagagtcatcatacttaccragagcagtattccattttttgaga

SEQ ID NO: 35369 - DNA, 50 bp, homo sapien
gctaaagaaaaggtttaaggcgatcyattaactgtcaatccacccagctt

SEQ ID NO: 35370 - DNA, 50 bp, homo sapien
cctataccgtgaagctggccaaaacrgtataatctcaatatttacactta

SEQ ID NO: 35371 - DNA, 50 bp, homo sapien
gtttactaccaccttggattcataamattaggctattgtgctagagggaa

SEQ ID NO: 35372 - DNA, 50 bp, homo sapien
acacattttactagatttataggtawgcaatttgatgtgacaaggagtat

SEQ ID NO: 35373 - DNA, 50 bp, homo sapien
atattcacagttataaaatcatcacygaaatctaattgtagaaatattcc

SEQ ID NO: 35374 - DNA, 50 bp, homo sapien
catgagtaagttatatgactgattarcctactacaactcttttgctattg

SEQ ID NO: 35375 - DNA, 50 bp, homo sapien
atgataagctatcaacaactgccaaygtaagagattttgtttttttttat

SEQ ID NO: 35376 - DNA, 50 bp, homo sapien
gctagatgttaatgtcatcataagcratttttaaaaattatcctaactct

SEQ ID NO: 35377 - DNA, 50 bp, homo sapien
atataatattagggccaatataagcracatacacattatatttaatgggg

SEQ ID NO: 35378 - DNA, 50 bp, homo sapien
gaaaaatatttgttgatccataagcyaatgagtaatttttaatttgcaat

SEQ ID NO: 35379 - DNA, 50 bp, homo sapien
taaatgatgatcatatgaattaaaartgatatatgaagttcctgaatgaa

SEQ ID NO: 35380 - DNA, 50 bp, homo sapien
attcctatcaatatgcatcagattayacgaaaacacaagttgaccgatag

SEQ ID NO: 35381 - DNA, 50 bp, homo sapien
caaatgacagaaaagacttcaaaagsattaatgagttcttccaaattctt

SEQ ID NO: 35382 - DNA, 50 bp, homo sapien
ttatttagtgatttttaaatttgtcycaacaatgtactgtagtattatat

SEQ ID NO: 35383 - DNA, 50 bp, homo sapien
aacaatgtataaggaatctctgacartcccgtgttgaacctgtttacact

SEQ ID NO: 35384 - DNA, 50 bp, homo sapien
gtattcaattgctatggtaattttgkagcgccaaagacaaattttctaaa

SEQ ID NO: 35385 - DNA, 50 bp, homo sapien
tctcagctgtgtgttattaaggaagyccctgatccgtcgtcaatcttact

SEQ ID NO: 35386 - DNA, 50 bp, homo sapien
cacctaaactagtaatttccacctcratttattatctatttaattgcctg

SEQ ID NO: 35387 - DNA, 50 bp, homo sapien
tgaatgcatctttattaagatttaaraattcttgagttacaaatttctga

SEQ ID NO: 35388 - DNA, 50 bp, homo sapien
aaaaactgttgggaaataactgttaycctagtatttgttaatatgataaa

SEQ ID NO: 35389 - DNA, 50 bp, homo sapien
aacttcgaaatggcaattacagagcrcaccagttttaaaatagtttatac

SEQ ID NO: 35390 - DNA, 50 bp, homo sapien
ggcatgtgaattacatataaataaaytgcattgtgaaaataataaaaata

SEQ ID NO: 35391 - DNA, 50 bp, homo sapien
ctgcaattttttgagctcctcttgayataaatgtagccattctgtgcatt

SEQ ID NO: 35392 - DNA, 50 bp, homo sapien
tatatatctttttcaagttattagcracccgttaccatgacctttcacct

SEQ ID NO: 35393 - DNA, 50 bp, homo sapien
acatctcattaaaaacatgtatagarcagtagaggtgatatgaaatagcc

SEQ ID NO: 35394 - DNA, 50 bp, homo sapien
acttcaaaattcattatttcaacatsatggtatttatgacttgatgagaa

SEQ ID NO: 35395 - DNA, 50 bp, homo sapien
ttttaatgagatgtggcttaataggwaaattttacttgttactagatgtc

SEQ ID NO: 35396 - DNA, 50 bp, homo sapien
aggaaattaccaaatgtttgatggaragaaggatccttattcatcacata

SEQ ID NO: 35397 - DNA, 50 bp, homo sapien
tcatgggaaaatcggcatgtaacatsagtcttttggtattgaggtctcat

SEQ ID NO: 35398 - DNA, 50 bp, homo sapien
aacattgccctggcaactgtggtaartgctttaaataaagtactatgagg

SEQ ID NO: 35399 - DNA, 50 bp, homo sapien
tttaaaatatgtcaaattctgagacscaattgacaaagaattgctgaatc

SEQ ID NO: 35400 - DNA, 50 bp, homo sapien
cctagtttgattcctatttcactagwctagattttacctattatttatgt

SEQ ID NO: 35401 - DNA, 50 bp, homo sapien
gatggaatttagtgctttttcttaayggaagtaacctgcttaaaaacatc

SEQ ID NO: 35402 - DNA, 50 bp, homo sapien
gtcttagctttcaattcagactcaartgtaaaaacaaatcaatttttttc

SEQ ID NO: 35403 - DNA, 50 bp, homo sapien
tttggcgaaatgtgctgtcttttcamctgcaaattcctagtgtcagcatc

SEQ ID NO: 35404 - DNA, 50 bp, homo sapien
agtgaaaatctgtgacatcacttaakcgactgagaataaactagcacatt

SEQ ID NO: 35405 - DNA, 50 bp, homo sapien
ggtgtccctggcaataatcctaaagrcatataataaagtaacattcactg

SEQ ID NO: 35406 - DNA, 50 bp, homo sapien
atttggacccattaaatataactcaycctgcagtacctagattgtcctga

SEQ ID NO: 35407 - DNA, 50 bp, homo sapien
agtagataagcttctgacattttacragaaagaaatgagacaacagcagg

SEQ ID NO: 35408 - DNA, 50 bp, homo sapien
tcttcaagatatatttcctcttagayccaaatcataaaataaattgccaa

SEQ ID NO: 35409 - DNA, 50 bp, homo sapien
ctaaaattcagcactgagctctccaracactaccctttccctattgaaga

SEQ ID NO: 35410 - DNA, 50 bp, homo sapien
gaggctgtccaggtcactgattccaytattcctgaggctgaaatccctcc

SEQ ID NO: 35411 - DNA, 50 bp, homo sapien
tttagacagaaggcatctataatacrattgacctttgcagaatatatttt

SEQ ID NO: 35412 - DNA, 50 bp, homo sapien
atttaaaatattgcctcttgcataamcttaacatataaataatagtgttt

SEQ ID NO: 35413 - DNA, 50 bp, homo sapien
attgggccaaaataactaatgttaartctgacaatctttttttgtgctct

SEQ ID NO: 35414 - DNA, 50 bp, homo sapien
agaatatatttgcaaccactaccaayatgcagaattcttaatttaagaca

SEQ ID NO: 35415 - DNA, 50 bp, homo sapien
attagaattagattgagtaatttacmatcaaatgtcctgttttgctttct

SEQ ID NO: 35416 - DNA, 50 bp, homo sapien
cagaatttacactgtctgaaataagkacacagataaataaaaaagtcaat

SEQ ID NO: 35417 - DNA, 50 bp, homo sapien
atgccaggccctttactacctcacaytcaaattacagcaatagcatcaca

SEQ ID NO: 35418 - DNA, 50 bp, homo sapien
aattacaccatttgttttacttaacrgattgcttacatggaattagccaa

SEQ ID NO: 35419 - DNA, 50 bp, homo sapien
atcagaagtttttcttttaacatackcattacaaaagtgttgcttggttg

SEQ ID NO: 35420 - DNA, 50 bp, homo sapien
cccttacagatttctcagcacctacrcatgaacttccttgcctcacagtc

SEQ ID NO: 35421 - DNA, 50 bp, homo sapien
caagacagtctgctctacagaaagawtcggatgcacagagaaaaaaggga

SEQ ID NO: 35422 - DNA, 50 bp, homo sapien
ctgaatttggaacaagattgtcaaayattatactcaaaaaaggtattttc

SEQ ID NO: 35423 - DNA, 50 bp, homo sapien
atgttgtgcttgtgtataacatgtcyattaattctattaggtcaattctt

SEQ ID NO: 35424 - DNA, 50 bp, homo sapien
gtgttgatctaaaatgtgtccaattraaatttatctgtcaaaacacaatg

SEQ ID NO: 35425 - DNA, 50 bp, homo sapien
ttcctatactttcacataaagaaagmaaaaagttgtgagataatcaagtc

SEQ ID NO: 35426 - DNA, 50 bp, homo sapien
ttgtttttatatctgcaaaaattagraaatcatgcctactttacaggaga

SEQ ID NO: 35427 - DNA, 50 bp, homo sapien
tgtcaaggcagagggacgttttgtayatgaatttaattaagcaataggcc

SEQ ID NO: 35428 - DNA, 50 bp, homo sapien
accgtgcaataatagtctcataaaaktattctctggagggccttatttct

SEQ ID NO: 35429 - DNA, 50 bp, homo sapien
tgaacattggaaaattcaatcaaaaktcaaaccattttaagtaataaaaa

SEQ ID NO: 35430 - DNA, 50 bp, homo sapien
tgaccttacctcatactttggagagmaaattgatataattgtttaagaac

SEQ ID NO: 35431 - DNA, 50 bp, homo sapien
actgacaggaatatcagagacaaaayttggacatgaaatacataccttgc

SEQ ID NO: 35432 - DNA, 50 bp, homo sapien
ttaatcaattcacattaaaacatccmagaatcgcataggtaatattgaca

SEQ ID NO: 35433 - DNA, 50 bp, homo sapien
tacaagctctgttatctaatgggtaygaaaaatatgttgatcttcagttt

SEQ ID NO: 35434 - DNA, 50 bp, homo sapien
gtgctttaaagatgatctatggaaaygaaacctttcccacagaaaatgta

SEQ ID NO: 35435 - DNA, 50 bp, homo sapien
tactttgctaaaacaaggataataaytctgaacattcagtctcaaattct

SEQ ID NO: 35436 - DNA, 50 bp, homo sapien
gacttatatattagtacaaaatatamgtgagtcaaagattttattttact

SEQ ID NO: 35437 - DNA, 50 bp, homo sapien
gtacctgagtttctgtcttggtaaamttacttaggcaagagtcttcttct

SEQ ID NO: 35438 - DNA, 50 bp, homo sapien
tatgaaattataacagggacccaaarttctcacagtgtcttttcttaccc

SEQ ID NO: 35439 - DNA, 50 bp, homo sapien
cttatatatagatgtgcttttatcayggcatttaatacacataattattc

SEQ ID NO: 35440 - DNA, 50 bp, homo sapien
ttctttagaagtcagccaatactatracagaggctatcataattatgatc

SEQ ID NO: 35441 - DNA, 50 bp, homo sapien
tcatgtaagatgaaagtgaggtataygaggttaaggtatccccaggacct

SEQ ID NO: 35442 - DNA, 50 bp, homo sapien
tgaatgaatggccagtaccttcttayatgttgcataatcaaagctttaat

SEQ ID NO: 35443 - DNA, 50 bp, homo sapien
aatcctttctgatgacaagtcctaastcagtgaagttcatcattgattat

SEQ ID NO: 35444 - DNA, 50 bp, homo sapien
atgaatatgttgaaatttttaggtaygaatcttgtttatggtttatattc

SEQ ID NO: 35445 - DNA, 50 bp, homo sapien
aacaatttcaactccattacaaaaamgagttcagatatgaaaatggtatg

SEQ ID NO: 35446 - DNA, 50 bp, homo sapien
tctaccagacttcttcaaaaagcaaktataaagcaaaggaacataccatt

SEQ ID NO: 35447 - DNA, 50 bp, homo sapien
actctcaaaagccttcttcctataaycctgtctcatattccatttccatg

SEQ ID NO: 35448 - DNA, 50 bp, homo sapien
gtactgatagatccaggtgtttaaartaatgtctgttatgcaattgagac

SEQ ID NO: 35449 - DNA, 50 bp, homo sapien
agctgaaatggcacaggctgttacaraaacttgatacccagctccacaga

SEQ ID NO: 35450 - DNA, 50 bp, homo sapien
tcttcaaacctgctcttcataaaaawacagcctatgttaatctctcttat

SEQ ID NO: 35451 - DNA, 50 bp, homo sapien
taaataagaaatccatatttagctgsaattatataggctagtagaattat

SEQ ID NO: 35452 - DNA, 50 bp, homo sapien
aataaaatctcagttttatgtaagcraaaatgttcttttaagaggttgag

SEQ ID NO: 35453 - DNA, 50 bp, homo sapien
tttccaataaatcattataccctcayggcaggaactgggcctgtcttgtt

SEQ ID NO: 35454 - DNA, 50 bp, homo sapien
catctctccttcttcaacatgttaaytaccaaaacacaactcagataccg

SEQ ID NO: 35455 - DNA, 50 bp, homo sapien
tacttacaagtcagcattactaaccyaaatctaaattattcattacactc

SEQ ID NO: 35456 - DNA, 50 bp, homo sapien
gtctgctactggaccttagtagaaaytgaatacatagacaccaagtcaat

SEQ ID NO: 35457 - DNA, 50 bp, homo sapien
actccttaagcctgattaggtggaaraatgtttatattcacattgactgt

SEQ ID NO: 35458 - DNA, 50 bp, homo sapien
acaacaacaacgaaattaaaccacgragatatagtgcattgatatgtact

SEQ ID NO: 35459 - DNA, 50 bp, homo sapien
tccagtaaggtgaggaaaggaccaartagtattagaagagaatttaaaac

SEQ ID NO: 35460 - DNA, 50 bp, homo sapien
aaagaggtgaggagatgattgaagcrccataggtcaaagatagcctttgg

SEQ ID NO: 35461 - DNA, 50 bp, homo sapien
cagaacatctttaaagcataagtcaracagaacctataaaacaaaaatac

SEQ ID NO: 35462 - DNA, 50 bp, homo sapien
agggtcatatataaggtcagcaatcrgaacttagttgactaatgaatgac

SEQ ID NO: 35463 - DNA, 50 bp, homo sapien
aggaaagtaagagcaagtccataatkatcaacagcctgacactgtatttt

SEQ ID NO: 35464 - DNA, 50 bp, homo sapien
ttctgatgtttttctcactactcacmaatgaacaattaagccatctctac

SEQ ID NO: 35465 - DNA, 50 bp, homo sapien
acttgttatgtaaaatgatgaagaargaccaacataacctttaaagatgt

SEQ ID NO: 35466 - DNA, 50 bp, homo sapien
aagagaacacttcatacaaagttaamtggttataatgtccttggcttcct

SEQ ID NO: 35467 - DNA, 50 bp, homo sapien
agtaatgtgtgtaaaattaatcacargaagagagaatcattcacaagaat

SEQ ID NO: 35468 - DNA, 50 bp, homo sapien
tcaatacagaactttaccctctctcracctttctcttaactccaataaaa

SEQ ID NO: 35469 - DNA, 50 bp, homo sapien
agtggtgaaaattgttgtcattgaaytgggtaaaatgagtcatttccaag

SEQ ID NO: 35470 - DNA, 50 bp, homo sapien
tttaaaattacatggcccttgatacractaatggacaaatatttgttact

SEQ ID NO: 35471 - DNA, 50 bp, homo sapien
ctaagtcaatataccaatctagcaaygagttcatgtcaaccaacagcaaa

SEQ ID NO: 35472 - DNA, 50 bp, homo sapien
aagagtaaatatggaaattggctaawgttataaaacaatttacactctgc

SEQ ID NO: 35473 - DNA, 50 bp, homo sapien
tcattctctttctgtgatatccttaygaaaattatgcaagcgtgttgtaa

SEQ ID NO: 35474 - DNA, 50 bp, homo sapien
atgaaatggctctgattccataccasggtcaagatctacctctctactgg

SEQ ID NO: 35475 - DNA, 50 bp, homo sapien
cattatctctccaagacttcacttaycttaaacttgtttctttaacctta

SEQ ID NO: 35476 - DNA, 50 bp, homo sapien
caaccacgtagtaaaaaaggtcatayggctgtgccccacaaggcactgag

SEQ ID NO: 35477 - DNA, 50 bp, homo sapien
ttaaaaaacataaaggatatgttaayattgaagagacacaaaataccata

SEQ ID NO: 35478 - DNA, 50 bp, homo sapien
tatgtctacatattaggtaaatttcrcgttatataattacaagtgtaatc

SEQ ID NO: 35479 - DNA, 50 bp, homo sapien
tatgcttattttctcaaataatgacractctataactcaattttgctttt

SEQ ID NO: 35480 - DNA, 50 bp, homo sapien
atttttaatagtagcactcattgacrcttgaatgcaactcatcagtaata

SEQ ID NO: 35481 - DNA, 50 bp, homo sapien
agacaactgagatttagaaggaaaamtttctgcagttatatagatagttg

SEQ ID NO: 35482 - DNA, 50 bp, homo sapien
cagtggtcatcaatcccagtttgggwcattatgcaacattctctgcatct

SEQ ID NO: 35483 - DNA, 50 bp, homo sapien
tttatttaatcctcagaacaatatcragaagtagacatattactatctta

SEQ ID NO: 35484 - DNA, 50 bp, homo sapien
gagattatgatgaagtatcaatagtsaaaatgttagagatttatagctat

SEQ ID NO: 35485 - DNA, 50 bp, homo sapien
gacttttgtcaactgaaaagtgtcastatgatcttgatatcaagaaagag

SEQ ID NO: 35486 - DNA, 50 bp, homo sapien
atggcaaaaacaaacaaataagaaayagatgtggtgaatttcaaaaactt

SEQ ID NO: 35487 - DNA, 50 bp, homo sapien
gaaacgttgaacacaggttactttawatgttgccacaagtaactggaatc

SEQ ID NO: 35488 - DNA, 50 bp, homo sapien
ccttgtgttttacattcaccatttawctttactttctgtaaaataatgat

SEQ ID NO: 35489 - DNA, 50 bp, homo sapien
tctcctctgacactatcattctgtckagatgatcccatacatacatgccc

SEQ ID NO: 35490 - DNA, 50 bp, homo sapien
accataatgaataatattgtcaaaargagtctattccagaatacataaac

SEQ ID NO: 35491 - DNA, 50 bp, homo sapien
tagagaagagctagaaagctagatasatagatgattgcattttaagataa

SEQ ID NO: 35492 - DNA, 50 bp, homo sapien
agaaaacctccctgaaataaaaacargttacttaggagaacaataacaat

SEQ ID NO: 35493 - DNA, 50 bp, homo sapien
atagttttctattttcgaagaatgamgttgctatggtttgaatgtgctcc

SEQ ID NO: 35494 - DNA, 50 bp, homo sapien
tgggcaccactcacttaacagaatayagtcaactcccagtgatttgggca

SEQ ID NO: 35495 - DNA, 50 bp, homo sapien
ttgcaaacatctcaatttgagcaagmctcttggcatttctgtgggttaat

SEQ ID NO: 35496 - DNA, 50 bp, homo sapien
caccagactattcaaagtcaatactraagaaaatttcttacagacagcta

SEQ ID NO: 35497 - DNA, 50 bp, homo sapien
aaagaaagcagtcacattttataggrcaaagaaagcacaaaatgagatgg

SEQ ID NO: 35498 - DNA, 50 bp, homo sapien
tgatgtagagagagaattaaaatcarcccaacaattatgagtactttcaa

SEQ ID NO: 35499 - DNA, 50 bp, homo sapien
aataggtctgtttaaaatatcccaamattgtggtgatgctaaatttcatt

SEQ ID NO: 35500 - DNA, 50 bp, homo sapien
gcctaaaagtaaatagattcaacacratagccctgttttgagatatcctt

SEQ ID NO: 35501 - DNA, 50 bp, homo sapien
cgctcctgcctttcttgtaaaacaaycttctcttaggtcccttttacatg

SEQ ID NO: 35502 - DNA, 50 bp, homo sapien
atacatgggaaggaggaaagagatakgaaaatccaagtatggaaaacgat

SEQ ID NO: 35503 - DNA, 50 bp, homo sapien
caatattcattccctcattccagaaratcagctaaaatctgatacatggg

SEQ ID NO: 35504 - DNA, 50 bp, homo sapien
tagattccacaaagaatagttcaaayggcaaatagtcaaaacgtatttat

SEQ ID NO: 35505 - DNA, 50 bp, homo sapien
ttagaaggtgcttcagaatgcatcaycattgtattggttgtgaatttatg

SEQ ID NO: 35506 - DNA, 50 bp, homo sapien
cctcataaactactatcaatcaaatmatcatacttagaattaaaaaggaa

SEQ ID NO: 35507 - DNA, 50 bp, homo sapien
cattctgcaactgtctgagactacamtaccaaatcatgagaagataaaag

SEQ ID NO: 35508 - DNA, 50 bp, homo sapien
ccaaccagcaacaatagttttagtayattctgcaactgtctgagactaca

SEQ ID NO: 35509 - DNA, 50 bp, homo sapien
gcttgttttgtgttctctctctgaartctagccatagttctgaaaagaat

SEQ ID NO: 35510 - DNA, 50 bp, homo sapien
taagacatggagtgattaagtgttayggcagaagtatagagcaggttgtt

SEQ ID NO: 35511 - DNA, 50 bp, homo sapien
tattgtaaaaacctaatcagcttaayatcaggtgctttatgtttgtagtt

SEQ ID NO: 35512 - DNA, 50 bp, homo sapien
tttggacatctgttggagttaggaakatcaagaaacattacatatttttt

SEQ ID NO: 35513 - DNA, 50 bp, homo sapien
aagcacaacagtgatagatctcacaratattatgttgaatggaagaagtc

SEQ ID NO: 35514 - DNA, 50 bp, homo sapien
acacattttcctggtttagtggagayaagtaagttggaattattggggaa

SEQ ID NO: 35515 - DNA, 50 bp, homo sapien
ctatctgaaggtgggacccagccaastatatttttcaaagcttcccagat

SEQ ID NO: 35516 - DNA, 50 bp, homo sapien
cacctcccagacatggttctactaaragaggagacttaattgggagacta

SEQ ID NO: 35517 - DNA, 50 bp, homo sapien
attaggaggcaaccactcggtgactragggaaatctgaaaaatgtatttg

SEQ ID NO: 35518 - DNA, 50 bp, homo sapien
cagcaatgacttcctacctgagccartactcatctgattaaaaaaacact

SEQ ID NO: 35519 - DNA, 50 bp, homo sapien
acaactattataagattaaactcacyggggcatcttttgtaggatagtga

SEQ ID NO: 35520 - DNA, 50 bp, homo sapien
taaaacatagttacaatgttctcaaytcttagtgtccttcacaacatcaa

SEQ ID NO: 35521 - DNA, 50 bp, homo sapien
acacactctgctatgtaatcatcaawgtacagtgggaaatttaacatcca

SEQ ID NO: 35522 - DNA, 50 bp, homo sapien
acaatatcttccatgttaggccctamactatttcaacatataaaattgct

SEQ ID NO: 35523 - DNA, 50 bp, homo sapien
gcaatgtgcagtcctcttttcctcartgaatcaaagttcactggccatat

SEQ ID NO: 35524 - DNA, 50 bp, homo sapien
ccatatacagagaaattatactaacygaacttgtgaaaataatttattga

SEQ ID NO: 35525 - DNA, 50 bp, homo sapien
caagcatgtgactacattaggatgcratcaccttcaattttagttacaaa

SEQ ID NO: 35526 - DNA, 50 bp, homo sapien
gatgctgctgtttatctcacctttawgctgtgaaattcttgggatgatat

SEQ ID NO: 35527 - DNA, 50 bp, homo sapien
tgatgccacaaactgtgttcttaagkagatttgtagattttcttgaatga

SEQ ID NO: 35528 - DNA, 50 bp, homo sapien
caaactcagattcaatgtgagaatayagatggatatcagaaagcacgaca

SEQ ID NO: 35529 - DNA, 50 bp, homo sapien
gcgtcaaaggtctatcagagatgcaytgaagtcaggacaaacagtggcag

SEQ ID NO: 35530 - DNA, 50 bp, homo sapien
cctttattgtcaggctacaaatagayatgggtgctgggtagaaacgtgtt

SEQ ID NO: 35531 - DNA, 50 bp, homo sapien
agtcatgttttctttctttgttacaygcctggtaattctttattggctga

SEQ ID NO: 35532 - DNA, 50 bp, homo sapien
attatacttgtaattctcaattttargaatcaaatgtatacctttaatga

SEQ ID NO: 35533 - DNA, 50 bp, homo sapien
catggcaagagaatagagcatgtcartcataaacatttgtctctaggctc

SEQ ID NO: 35534 - DNA, 50 bp, homo sapien
aggaaatgttgtaccatatactctcratagatccttctctagaccgtaca

SEQ ID NO: 35535 - DNA, 50 bp, homo sapien
aaattgcagagaatagagaatgacartacaagtgtttctcaaaaactgtc

SEQ ID NO: 35536 - DNA, 50 bp, homo sapien
aatccactcttcacatggctatcagwctcatatttctaaaatgcaaatgt

SEQ ID NO: 35537 - DNA, 50 bp, homo sapien
cccgagttgactgagatcttaaaaasgctcttcttggctgtttctttcct

SEQ ID NO: 35538 - DNA, 50 bp, homo sapien
gaaccttttcaagtcttctggcttaygaggctaaggtaggtgtcagcaaa

SEQ ID NO: 35539 - DNA, 50 bp, homo sapien
gaagttctctcttctacaattaacaycttgtgcacacatgtatctttgca

SEQ ID NO: 35540 - DNA, 50 bp, homo sapien
tcctgagccaagggattcagctttawcacacagtaattaaactaatctcc

SEQ ID NO: 35541 - DNA, 50 bp, homo sapien
ctttgaaacaaggttgcctaccgtgrattatagcaaacaaacggaagtat

SEQ ID NO: 35542 - DNA, 50 bp, homo sapien
gcactaaggactgaggagacaataaycaactagtctctgagaatagcctg

SEQ ID NO: 35543 - DNA, 50 bp, homo sapien
ctacagtaaaatcaacaatcagttawcacaactcatcataataaatataa

SEQ ID NO: 35544 - DNA, 50 bp, homo sapien
ctcatgaataaacctatgctggcatsaaactattcttttgcagcttcctc

SEQ ID NO: 35545 - DNA, 50 bp, homo sapien
caacagcacatcaaaaagattatacwctatgatgaactgggatttatctc

SEQ ID NO: 35546 - DNA, 50 bp, homo sapien
atccttttctttaatattggtaacartggctcctcgcaataagaataaga

SEQ ID NO: 35547 - DNA, 50 bp, homo sapien
ttaagcttactgtttaatattcacawtctaaaaaacaaatatgtttccat

SEQ ID NO: 35548 - DNA, 50 bp, homo sapien
tctccagtcaagctattaagttaccrcagttcactgaggacatatcacat

SEQ ID NO: 35549 - DNA, 50 bp, homo sapien
aaggagatgtaaagactgagacaacsaaagtggagacaattggttaggaa

SEQ ID NO: 35550 - DNA, 50 bp, homo sapien
tacactagattaactagaaatttagmaaggagatgtaaagactgagacaa

SEQ ID NO: 35551 - DNA, 50 bp, homo sapien
caaattctatcaatactggatgagaygccatatttgggatgagtgcagca

SEQ ID NO: 35552 - DNA, 50 bp, homo sapien
tgagttgttatatctgagatccctgmaattaaaggtaagttctggacact

SEQ ID NO: 35553 - DNA, 50 bp, homo sapien
ttgagtaacaaactgtctaaatccaytggagctaattattttcttaccaa

SEQ ID NO: 35554 - DNA, 50 bp, homo sapien
atgtttgatagaagacctcttattarattggaaagtttctaacctcagtg

SEQ ID NO: 35555 - DNA, 50 bp, homo sapien
tggaggagaggatgggcatgtttgayagaagacctcttattagattggaa

SEQ ID NO: 35556 - DNA, 50 bp, homo sapien
cagatatctttaggagataatcaccrctacattgcttttataacaatgtt

SEQ ID NO: 35557 - DNA, 32 bp, homo sapien
gagactttcaaaataawgtcactaataacaat

SEQ ID NO: 35558 - DNA, 50 bp, homo sapien
ctatttcaagcttcttttagcaaaawtaagtgcttatgaatattgtaaat

SEQ ID NO: 35559 - DNA, 50 bp, homo sapien
aatgagacatcttatttcgatgaagscatctacttgaagttactggaaaa

SEQ ID NO: 35560 - DNA, 50 bp, homo sapien
accctgtattgtactttttcttgatsaagcaacatgtttacacactagtt

SEQ ID NO: 35561 - DNA, 50 bp, homo sapien
tagagattctgatatctatttgatakgtattaatctcactgttatgaaac

SEQ ID NO: 35562 - DNA, 50 bp, homo sapien
agaccattaagaatatatttcaaagrcaagctaacaaagttcaagtaaaa

SEQ ID NO: 35563 - DNA, 50 bp, homo sapien
atcttgctggaaccatcaatttgaawaaagtgttctataatttactcagt

SEQ ID NO: 35564 - DNA, 50 bp, homo sapien
ttccttacttcataagttatgcaacsacatgtattaattcataacaatgc

SEQ ID NO: 35565 - DNA, 50 bp, homo sapien
atctggtagctggctccaaatttgakctaggaaaccaatattttgatcta

SEQ ID NO: 35566 - DNA, 50 bp, homo sapien
tttatctttatttagaatgaatttayggtgcacaaaatgaagaaaaacat

SEQ ID NO: 35567 - DNA, 50 bp, homo sapien
gctaaaaagaaacacaacactagackaacattttctatccttttaaatat

SEQ ID NO: 35568 - DNA, 50 bp, homo sapien
ctagttctgcttagcactaaatcacyggtattcaaagttttattgcacat

SEQ ID NO: 35569 - DNA, 50 bp, homo sapien
gcagtccagcctgcacgcaaagccaygttaattttcctaaagcactgttt

SEQ ID NO: 35570 - DNA, 50 bp, homo sapien
ataagattaagttaattgagcgaaakaccatatctatctgttgagcttga

SEQ ID NO: 35571 - DNA, 50 bp, homo sapien
tattgctccttgggcaatgcaatgcrattaccaaatagtaatattcacag

SEQ ID NO: 35572 - DNA, 50 bp, homo sapien
agagccagaaccatttccaaaaaaakgctaatcatgtcagatctctctct

SEQ ID NO: 35573 - DNA, 50 bp, homo sapien
agtcaagacttctgatctctcaatgmaaatactgtgattaaaattagcaa

SEQ ID NO: 35574 - DNA, 50 bp, homo sapien
aacaaaaacttctaaacaagacctaygaggctctacatggacttgtcttt

SEQ ID NO: 35575 - DNA, 50 bp, homo sapien
cacactccatgacaaaatgtgttacyacttcataataaagactggggatt

SEQ ID NO: 35576 - DNA, 50 bp, homo sapien
tattatcatgatgttattaatttagrccaagataataataagatggtgtc

SEQ ID NO: 35577 - DNA, 50 bp, homo sapien
tattgaagaatgtattcttgtatgayggttatggctgagatatgctttct

SEQ ID NO: 35578 - DNA, 50 bp, homo sapien
acaaacaaaagcaaataaatgacacrctggatgaatttttcttatctata

SEQ ID NO: 35579 - DNA, 50 bp, homo sapien
tacatattaaacttcaaaaggtaackctgaaactaaatacagtattggaa

SEQ ID NO: 35580 - DNA, 50 bp, homo sapien
ttcctgtttttccttatcagtcaaayttccctgttgtgtgttaccatagc

SEQ ID NO: 35581 - DNA, 50 bp, homo sapien
gtcaacttaacagggtgtctattatraatgagtgattatgataagtgctg

SEQ ID NO: 35582 - DNA, 50 bp, homo sapien
atataacacgaactcttaagatggcrgatgctcagtcagcttggatcctt

SEQ ID NO: 35583 - DNA, 50 bp, homo sapien
ccttacaaacatacggtaagtgacakaacatgtattatcattagattgag

SEQ ID NO: 35584 - DNA, 50 bp, homo sapien
tcatctgtaaatgagagcaccgttgyattcagaggtagatgtttgctatt

SEQ ID NO: 35585 - DNA, 50 bp, homo sapien
tatttttatttcctttagccattgcygacattatttgagttagagtacca

SEQ ID NO: 35586 - DNA, 50 bp, homo sapien
aattcacactcaggccctgcctaaartacacagcatatatgttatactac

SEQ ID NO: 35587 - DNA, 50 bp, homo sapien
atctcatagctaaagggagaaagccrcaaatatttgacttccttatccat

SEQ ID NO: 35588 - DNA, 50 bp, homo sapien
gtctaccaaaagctggcaatatttasagtctagccactctgagtaacata

SEQ ID NO: 35589 - DNA, 50 bp, homo sapien
aactatgaaaacttgagaaagaaagragatccatgaaactgttttctcat

SEQ ID NO: 35590 - DNA, 50 bp, homo sapien
agtatttaatgattgtattattcaamatcttcactttaggaatgagaaaa

SEQ ID NO: 35591 - DNA, 50 bp, homo sapien
aataaaataattggtcaatgaattayacttatgtttacgtaacacttttg

SEQ ID NO: 35592 - DNA, 50 bp, homo sapien
aaacaaaatgcccttttgtctgaaakatgttagatggattagggatggtt

SEQ ID NO: 35593 - DNA, 50 bp, homo sapien
atttaattttgaaacaatggatgtaygaaagccctgtgttggatatttaa

SEQ ID NO: 35594 - DNA, 50 bp, homo sapien
ttactttcttctgtccagtaggtaawgtgctctattaagagatagtcttt

SEQ ID NO: 35595 - DNA, 50 bp, homo sapien
catattccataaatattttctatcaratcggaagagtttaatagcactat

SEQ ID NO: 35596 - DNA, 50 bp, homo sapien
actctctgatttctttacagtgaaayttaatgactgctattgctcttaaa

SEQ ID NO: 35597 - DNA, 50 bp, homo sapien
ccaatcatagcatgtctctttcttcygaaaaactcatctaacttcccccc

SEQ ID NO: 35598 - DNA, 50 bp, homo sapien
aaccaataccattaatgttctaatcycaaggttgcaccatctgtgctatt

SEQ ID NO: 35599 - DNA, 50 bp, homo sapien
aatcatttgtagataatattatagaraagtttaatgcaacaacaataatg

SEQ ID NO: 35600 - DNA, 50 bp, homo sapien
acaaagcaagaggaagtgataaggasataggtgagctgatgatacaagtt

SEQ ID NO: 35601 - DNA, 50 bp, homo sapien
tctgcacattcaatgaacagtattargtacctactgggttgtatactggg

SEQ ID NO: 35602 - DNA, 50 bp, homo sapien
aacagttctaggagatgccatgagcragagggcgggtgcccacaattcca

SEQ ID NO: 35603 - DNA, 32 bp, homo sapien
caaagagattaaataaygttgacagggatcct

SEQ ID NO: 35604 - DNA, 50 bp, homo sapien
cttgaagccatgagaccctgtaagasgagaattttttatgatcgggtgta

SEQ ID NO: 35605 - DNA, 50 bp, homo sapien
attacatgctggaaggaaactactargatagccaaaggacctgagctttt

SEQ ID NO: 35606 - DNA, 50 bp, homo sapien
ctttgaaatgtgttgttagaacatcrcctaggcaaggccaataaacatga

SEQ ID NO: 35607 - DNA, 50 bp, homo sapien
cttattttggtttaatttggaacacragaccaacagtatttttgaccaat

SEQ ID NO: 35608 - DNA, 50 bp, homo sapien
attctaccaaaagttaataacagtcmacttgaagtacagaagaacttgaa

SEQ ID NO: 35609 - DNA, 50 bp, homo sapien
cacctagccatgctggaagggaaaamgttaggatagagagtgaaagcgat

SEQ ID NO: 35610 - DNA, 50 bp, homo sapien
gttacagattccactgacatttatcraagccctcttctactaagtacctt

SEQ ID NO: 35611 - DNA, 50 bp, homo sapien
aatacttacataacatactggaaaargtggctacacaaagaaaggaaaaa

SEQ ID NO: 35612 - DNA, 50 bp, homo sapien
cttaaaacatctgttcctaccacacraatatgaataagaataaaaatgca

SEQ ID NO: 35613 - DNA, 50 bp, homo sapien
tttgtattcatatttacaagatcaartcctattttattgctcactcttcc

SEQ ID NO: 35614 - DNA, 50 bp, homo sapien
attacttttaggtagaaccagaaaarcaatcgtactattctgttctcaca

SEQ ID NO: 35615 - DNA, 50 bp, homo sapien
acaatttcatacaattaaattaaccmgctcaaggtcactataattacaga

SEQ ID NO: 35616 - DNA, 50 bp, homo sapien
atggataatggtgtaaaaggctaaamggttaatgaaaaactcctgaaact

SEQ ID NO: 35617 - DNA, 50 bp, homo sapien
acagtcataactgacaacattgaacracttcctatataaagagttagagt

SEQ ID NO: 35618 - DNA, 50 bp, homo sapien
acttgcagaccaaagaatcctaaaakttatagcccaatgcatcactaatg

SEQ ID NO: 35619 - DNA, 50 bp, homo sapien
gtgttaaacatgaaaggaattagatsagagagggttttgtttatctgtgt

SEQ ID NO: 35620 - DNA, 50 bp, homo sapien
attcaggtggtaacaagatgtcggartagaaatgagtgagttatagagtc

SEQ ID NO: 35621 - DNA, 50 bp, homo sapien
cccagaactgtccctgcaaggaacaygtactcacatcattcaggtggtaa

SEQ ID NO: 35622 - DNA, 50 bp, homo sapien
attctgcttaattactacaacagaartgattccaaccatttgaaaaaagg

SEQ ID NO: 35623 - DNA, 50 bp, homo sapien
aaggaaccatctcactgtgtgtaaayatgacttccaagctggccgtggct

SEQ ID NO: 35624 - DNA, 50 bp, homo sapien
tggctgtgggaatcagttgacataayacatgaaacaatcaacactgtgcc

SEQ ID NO: 35625 - DNA, 50 bp, homo sapien
cctggggtggattcagtacttacacrcgtgatccttgagcaatgtcacat

SEQ ID NO: 35626 - DNA, 50 bp, homo sapien
ttttaacaactaaacaaccatctcaygctgggattgtatgtcctctgcct

SEQ ID NO: 35627 - DNA, 50 bp, homo sapien
atcagcattttcttccaccagtatamcatccaacttcatcaactgtgatt

SEQ ID NO: 35628 - DNA, 50 bp, homo sapien
ctggtggaagaaaatgctgatatctkacattggagaaataatgaggaaaa

SEQ ID NO: 35629 - DNA, 50 bp, homo sapien
gtaaggaagaagacgtggttcaaaayatatcaagttgtgcttagaagttt

SEQ ID NO: 35630 - DNA, 50 bp, homo sapien
aactcactgtgggatccctgtcaaayattgagtcaaagacttgctattgc

SEQ ID NO: 35631 - DNA, 50 bp, homo sapien
ctcctagattcaggaggtagggccamcttcggctttcttggacatttgtt

SEQ ID NO: 35632 - DNA, 50 bp, homo sapien
ggtgtagagagctgattaaaacacasatctgatcctgacaccctcttact

SEQ ID NO: 35633 - DNA, 50 bp, homo sapien
cctatctacccttcttctcacttctyaaatacacacaatcaagtaagcct

SEQ ID NO: 35634 - DNA, 50 bp, homo sapien
tgtaactgttaaatcctttgttaagwcctcagaaagataaaaggtgttgc

SEQ ID NO: 35635 - DNA, 50 bp, homo sapien
agccctcctggcctggacttcacaasatgagtaagagggtgtcaggatca

SEQ ID NO: 35636 - DNA, 50 bp, homo sapien
tggctggcagaaagctgggaaagtasgctagtcctggcagccctcctggc

SEQ ID NO: 35637 - DNA, 50 bp, homo sapien
tggcttataaggattctgtggaaagkaacataattcccagtgccattgat

SEQ ID NO: 35638 - DNA, 50 bp, homo sapien
aactaataaacatacggtaaactagwatggagaacagtatggatgtcttt

SEQ ID NO: 35639 - DNA, 50 bp, homo sapien
taatatctatttgttctgcaatgaaraggaattaaaggagaggaaaatag

SEQ ID NO: 35640 - DNA, 50 bp, homo sapien
tcttggaggcaaactcaattaattcmaggatgtgataaataacattcagt

SEQ ID NO: 35641 - DNA, 50 bp, homo sapien
tttttcattctgtgtgtgcacataartaagagctcagttgtattttagga

SEQ ID NO: 35642 - DNA, 50 bp, homo sapien
tatcaaaatatatttggtaacaaaakccacgtaagcgctcaagattacca

SEQ ID NO: 35643 - DNA, 50 bp, homo sapien
atcctgaacttataaattcataaagrcttaatagcatactaaaatttgaa

SEQ ID NO: 35644 - DNA, 50 bp, homo sapien
atagaaaattacattataaacaaggwagactaattttaacttgatatttt

SEQ ID NO: 35645 - DNA, 50 bp, homo sapien
attcttgcctcttctcaaattattayctcttttgtagcccaaacactgtg

SEQ ID NO: 35646 - DNA, 50 bp, homo sapien
aatgacacttccagggttgaaagtcrccttgatttcagtgtttggaagaa

SEQ ID NO: 35647 - DNA, 50 bp, homo sapien
aggttagaagaaagagcacattaatmagaggatagcgatgcagaggaaga

SEQ ID NO: 35648 - DNA, 50 bp, homo sapien
gaagcttctctcaatcaaaattgcargtccatttccagccgggtgccttg

SEQ ID NO: 35649 - DNA, 50 bp, homo sapien
cttggccacaaaacaaggctcagtamgtttaaaaaaagggaaattgggat

SEQ ID NO: 35650 - DNA, 50 bp, homo sapien
ttcagttgaattcagcatagcaacayggaggacctcctgtagggagaaag

SEQ ID NO: 35651 - DNA, 50 bp, homo sapien
aagtaactgtaacacatggtttgacygccttaggaaaatacaaagcagaa

SEQ ID NO: 35652 - DNA, 50 bp, homo sapien
tttaaaaacctagatatgcagatgasacaggtatacacaaaatactatgg

SEQ ID NO: 35653 - DNA, 50 bp, homo sapien
aaagtattttattacgagttcctcaratgattgatgtactaattactgta

SEQ ID NO: 35654 - DNA, 50 bp, homo sapien
tttaaatttatttggaagattgtcartaaagaagaggcagatgtaagtgg

SEQ ID NO: 35655 - DNA, 50 bp, homo sapien
aaacaaccatttgtgtaaccattcawataacatgtactaagcaaattctc

SEQ ID NO: 35656 - DNA, 50 bp, homo sapien
ctctgattcctattttatgtaataaktcaatcttcatattgccttcattt

SEQ ID NO: 35657 - DNA, 50 bp, homo sapien
ttttagcattgcgtaagattctgccrctacggttaataaaaaatccagaa

SEQ ID NO: 35658 - DNA, 50 bp, homo sapien
gagatcatctgttttagtcttcttcmattcttggcaaaaacaaaggaaaa

SEQ ID NO: 35659 - DNA, 50 bp, homo sapien
tgatctctttttcttctatgtttgaygattagccaaagtatcttagagct

SEQ ID NO: 35660 - DNA, 50 bp, homo sapien
aaacaggaaattgtccaccctcgtcratttttctagacctgcttccccaa

SEQ ID NO: 35661 - DNA, 50 bp, homo sapien
ttcttctaaccttcctcttcatcagyctgaatctcaaaattttacctgat

SEQ ID NO: 35662 - DNA, 50 bp, homo sapien
ttccattccagagctttccagtatawcattacaaagtaacagtgatgatg

SEQ ID NO: 35663 - DNA, 50 bp, homo sapien
cttatatgcaaatataaaataaatcrgaatggaaaataagtccagagcaa

SEQ ID NO: 35664 - DNA, 50 bp, homo sapien
acagcctgtgacttcctactcaccayataaggcatgaaaataaaccttat

SEQ ID NO: 35665 - DNA, 50 bp, homo sapien
gatttacaggtcaaaaaatagatgargttggacgcatggttctgggattg

SEQ ID NO: 35666 - DNA, 50 bp, homo sapien
ctctggtgcaacatgagaacgtgcawtcaagagaagaatttgcctctatt

SEQ ID NO: 35667 - DNA, 50 bp, homo sapien
ttttcttcacctgcccagaagacagraatatcaggagaaagttcagaaga

SEQ ID NO: 35668 - DNA, 50 bp, homo sapien
gaagctttgggaagtaagtcattgayagactgagagtcatcttccacagt

SEQ ID NO: 35669 - DNA, 50 bp, homo sapien
tgccaagtattcaggtgatgttctaygctagcactgactatgttaggaca

SEQ ID NO: 35670 - DNA, 50 bp, homo sapien
agcttgaaaacaaatattgtctttamccttcataataactctgccaacta

SEQ ID NO: 35671 - DNA, 50 bp, homo sapien
taaacttataaggtagatataataawtccttttcacagatgatgaaactg

SEQ ID NO: 35672 - DNA, 50 bp, homo sapien
aaaaaatgagtgctgtgtaacaaggwatatctccatgccttaaaagaaaa

SEQ ID NO: 35673 - DNA, 50 bp, homo sapien
tagacagctccagttaaatcttgcaragtcctgaccatttaagagaatct

SEQ ID NO: 35674 - DNA, 50 bp, homo sapien
ttactctttctatacagaagatacartacagtggactcattctctcctat

SEQ ID NO: 35675 - DNA, 50 bp, homo sapien
gagccaacctaacatactattaatayctggtgaaatcgtgaccccttctc

SEQ ID NO: 35676 - DNA, 50 bp, homo sapien
ctgtgtatatacattgagataccaarccttcttttcccaccattcatcct

SEQ ID NO: 35677 - DNA, 50 bp, homo sapien
agctcttgtgagattttattgggtaygtaacatttaccatactgtgggaa

SEQ ID NO: 35678 - DNA, 50 bp, homo sapien
actctaatgcatttggagtttccaargatatggtagagctgttctcaaga

SEQ ID NO: 35679 - DNA, 50 bp, homo sapien
tttaaaaacttccacctgtcctcagraatgacgaagttcttttacataaa

SEQ ID NO: 35680 - DNA, 50 bp, homo sapien
ctgttttgctttatgttttcctaaarttctcttcacacattggtctcact

SEQ ID NO: 35681 - DNA, 50 bp, homo sapien
gaagtagttctcttctctgcctagamaaaataaaactatcattaggcaga

SEQ ID NO: 35682 - DNA, 50 bp, homo sapien
tgttgaaagggaggatagaattctgraatagcatacagtgatctagtcac

SEQ ID NO: 35683 - DNA, 50 bp, homo sapien
acagattcccttcaggtttcacactyaaaagagatgttggcccacaaaag

SEQ ID NO: 35684 - DNA, 50 bp, homo sapien
agcatttatttcctccacttgaggaycttgttgttagagttgtttgtgga

SEQ ID NO: 35685 - DNA, 50 bp, homo sapien
taatttgacaagatgtaatgtctgaytaaatccaaggaggtaagggaaag

SEQ ID NO: 35686 - DNA, 50 bp, homo sapien
ggtaagtgtcttgaattcctaagtcrctttccttatttgtgaaatgaagg

SEQ ID NO: 35687 - DNA, 50 bp, homo sapien
gccaggaggtaccagggcaatctcasaatcatagtaagttgtttgactgc

SEQ ID NO: 35688 - DNA, 50 bp, homo sapien
tcactaattaatatttattgggtgcycagacatcttgcttggctttgaaa

SEQ ID NO: 35689 - DNA, 50 bp, homo sapien
agagacagaaaaagaaaacctaaaaytcagacttaaatgtggccacacgc

SEQ ID NO: 35690 - DNA, 50 bp, homo sapien
aaagaaaatgtcaactgatgattcckcaattgtagtttcatctttatcca

SEQ ID NO: 35691 - DNA, 50 bp, homo sapien
gtaaattcaccttgagtaatttgtamctgtttcaaaatatgtttcatgga

SEQ ID NO: 35692 - DNA, 50 bp, homo sapien
actacaaaaatatgattcgagagcargtaagtactaatgaactgtatata

SEQ ID NO: 35693 - DNA, 50 bp, homo sapien
tcagatgaacagaggatggctctgcrattggttatatgagatatagttca

SEQ ID NO: 35694 - DNA, 50 bp, homo sapien
gcctatttgcagtagaactctttgcmcagatctggaccctcagcccttat

SEQ ID NO: 35695 - DNA, 50 bp, homo sapien
aacagagaaagcagagtggaggaaaytatcaaaccaacattatgagaaaa

SEQ ID NO: 35696 - DNA, 50 bp, homo sapien
acctccctcatcagggactgattcgragaactctagtgggcaagcacctc

SEQ ID NO: 35697 - DNA, 50 bp, homo sapien
tgtagggatgagtgataaaacacaayaaattacacaatgtgagcatgaga

SEQ ID NO: 35698 - DNA, 50 bp, homo sapien
aaaacagctaattgaattttataaayctggttgaacatctattgtgttca

SEQ ID NO: 35699 - DNA, 50 bp, homo sapien
aggagaagacaccagagatgcaaccrcacagagaaaaggtcatgtgagca

SEQ ID NO: 35700 - DNA, 50 bp, homo sapien
tccacaggtggtttttgtggacacawtgcagtttagaacatcagatctcc

SEQ ID NO: 35701 - DNA, 50 bp, homo sapien
aaaaaagttgatactgatactctacyatgcaggtaaccatatttataaaa

SEQ ID NO: 35702 - DNA, 50 bp, homo sapien
agatttctcaggtttacttttgtgascttagcacatgtagaacatttaca

SEQ ID NO: 35703 - DNA, 50 bp, homo sapien
tacagacagattgggtcctcagctawgtttgctttcccaaagtggccact

SEQ ID NO: 35704 - DNA, 50 bp, homo sapien
actgtcagtggacaattatttgggaycaagctgtgagactaagtgtctaa

SEQ ID NO: 35705 - DNA, 50 bp, homo sapien
ttcaggcaggggttctgataaaacaygcaagctacagaacacggtgacca

SEQ ID NO: 35706 - DNA, 50 bp, homo sapien
tattacaacaaaaatacaaaaatgcrcaaggaccaaaagaatggaagagg

SEQ ID NO: 35707 - DNA, 50 bp, homo sapien
tctgcaaatattaaatggaaaggaasagaaataaacaactatgttttaaa

SEQ ID NO: 35708 - DNA, 50 bp, homo sapien
ataactagaatgacttcctactcctraaaattctccttgactgataggca

SEQ ID NO: 35709 - DNA, 50 bp, homo sapien
attctaaagacttaaaagttactggyccaaattaaacatgtaatctgtgt

SEQ ID NO: 35710 - DNA, 50 bp, homo sapien
ggccactttatagaatttggaaatargcaataatactagagtataatgga

SEQ ID NO: 35711 - DNA, 50 bp, homo sapien
tcatctcctggcttagtgcaccaacratagtgaaagctgtatgtgtagtt

SEQ ID NO: 35712 - DNA, 50 bp, homo sapien
gcattatcaaggtaactgatgaagayagtttgtacgtgacctcttgagga

SEQ ID NO: 35713 - DNA, 50 bp, homo sapien
agatgttaagaccattcttcacaaaygacttcaataacacatttgctact

SEQ ID NO: 35714 - DNA, 50 bp, homo sapien
gaaaggaactttgcagtggttgtgayagagagtctttcacttatcttttg

SEQ ID NO: 35715 - DNA, 50 bp, homo sapien
aaactccaagcagtagacctatactsagaaaaaaggcttaggtcaggcat

SEQ ID NO: 35716 - DNA, 50 bp, homo sapien
ctgcttgttgcaagccaagttctaayattaaagccagtactaaaaaatca

SEQ ID NO: 35717 - DNA, 50 bp, homo sapien
aggaaaaccatatactcaacacttaygtattagatacttaatatatgtac

SEQ ID NO: 35718 - DNA, 50 bp, homo sapien
tttatgtgcccaacgtacggagtctyaccttacgcatatgcagtctggta

SEQ ID NO: 35719 - DNA, 50 bp, homo sapien
aagtctagttccaatgttcacgataygcatgggtgtttgtttttattatg

SEQ ID NO: 35720 - DNA, 50 bp, homo sapien
tacaaaatactttcacatctattaartctgtttcgacacacactttgata

SEQ ID NO: 35721 - DNA, 50 bp, homo sapien
acaaatactgttaacataattcctgsattttatactttctcttagaattt

SEQ ID NO: 35722 - DNA, 50 bp, homo sapien
tgaattcggtatgatttccatgttaygttggctttggcacagcctttcta

SEQ ID NO: 35723 - DNA, 50 bp, homo sapien
gtacccatgtcatagctcattagccraccttgcttagctaactaccattt

SEQ ID NO: 35724 - DNA, 50 bp, homo sapien
taccaagaagcttactgagaaataayggaaaagtgtgagtccctttctgg

SEQ ID NO: 35725 - DNA, 50 bp, homo sapien
acgcaggtgaacatagagcatagctwattggcctaacagttttgtttctc

SEQ ID NO: 35726 - DNA, 50 bp, homo sapien
aatctagagtcaggaacctgccataygactgtcaaccctatgtttgttag

SEQ ID NO: 35727 - DNA, 50 bp, homo sapien
taagaaacatctgaataacaacgatraatgggaaactagtgttgaaatag

SEQ ID NO: 35728 - DNA, 50 bp, homo sapien
cttggaccacaccagacagtctatastaaaatgtaattagtgttggggct

SEQ ID NO: 35729 - DNA, 50 bp, homo sapien
gtggtataaaggactagttatccaaygcccattttcttcctgtaggtaag

SEQ ID NO: 35730 - DNA, 50 bp, homo sapien
gtggtcaaataatatagtcattagcyacctaaacattttaattccagata

SEQ ID NO: 35731 - DNA, 50 bp, homo sapien
tttggtctttcatatgcattagttamatcccttaaagtagacattcataa

SEQ ID NO: 35732 - DNA, 50 bp, homo sapien
caaatggagagttgtacagttttacrgaagtcaatcacaatcttcaaatc

SEQ ID NO: 35733 - DNA, 50 bp, homo sapien
gcagaatcttgccagtgattggaaaygggtcatctaaatattctttattt

SEQ ID NO: 35734 - DNA, 50 bp, homo sapien
tagaattcccaggaatgatgatttasagtggacagggacctaatgcagca

SEQ ID NO: 35735 - DNA, 50 bp, homo sapien
tgagaaagaaaatctgtaaggaatamattctggattcaggtactggaatc

SEQ ID NO: 35736 - DNA, 50 bp, homo sapien
ccttcatttctctctcatgggggcaygtcagctgtattttaaggacctgg

SEQ ID NO: 35737 - DNA, 50 bp, homo sapien
tcccacacgaatgaagcctcttttcyacttggaatttattttaactgtgt

SEQ ID NO: 35738 - DNA, 50 bp, homo sapien
tgttgctcaaccagtcagattagcaygatgccgtcaatatagtggaccaa

SEQ ID NO: 35739 - DNA, 50 bp, homo sapien
ttctctctcacaaaactctccaaaasgacatggctttctactagatacca

SEQ ID NO: 35740 - DNA, 50 bp, homo sapien
atgtcaaagaatcacagcataaaaaygaacacatgaacgtttagacctag

SEQ ID NO: 35741 - DNA, 50 bp, homo sapien
agactctgtaactaagttctcctggwaaatacttttgtaacagtttttag

SEQ ID NO: 35742 - DNA, 50 bp, homo sapien
atgggggaaggacatagtgacaagtracctggagtcagcactacctgtgt

SEQ ID NO: 35743 - DNA, 50 bp, homo sapien
attctaagtgaggaatttactttcarcatgctatggtcttaataggagct

SEQ ID NO: 35744 - DNA, 50 bp, homo sapien
ccataaagaagttaaagaaagaccasaatttaattaatataaaacatatt

SEQ ID NO: 35745 - DNA, 50 bp, homo sapien
cacaaccaggatgcaggactttctcrctgcaaagctggtgcttcttctga

SEQ ID NO: 35746 - DNA, 50 bp, homo sapien
aactgtagcactctagagtcaggtamaaagtgtgatcaagctttcttacc

SEQ ID NO: 35747 - DNA, 50 bp, homo sapien
ccttccccctgggcagcaaactgtarcactctagagtcaggtaaaaagtg

SEQ ID NO: 35748 - DNA, 50 bp, homo sapien
gacaatgcatagagtctttggtgcayaataattttaagatttatatatgt

SEQ ID NO: 35749 - DNA, 50 bp, homo sapien
taaaaggcccaggccaccactaagcratgtatccgtgtaacacaactata

SEQ ID NO: 35750 - DNA, 50 bp, homo sapien
cctcaccacactctacaatcgtccartaggccactagattttgttgggac

SEQ ID NO: 35751 - DNA, 50 bp, homo sapien
ataaaatattttgtctggaaattgaytagttcacctacaaagcttatgtt

SEQ ID NO: 35752 - DNA, 50 bp, homo sapien
aaaccttagactcattcaatccaaaygttatcaaagaacttgaggccctg

SEQ ID NO: 35753 - DNA, 50 bp, homo sapien
cagtgctattagacacagatgttcartaactatttgttcatttaaattaa

SEQ ID NO: 35754 - DNA, 50 bp, homo sapien
aagcaaagtttgagagaagtaaagaygagtgagtgggaggagataattaa

SEQ ID NO: 35755 - DNA, 50 bp, homo sapien
tccacacattttcacaccttagatamcggtgtcactactgcagtgagtgt

SEQ ID NO: 35756 - DNA, 50 bp, homo sapien
atcttagattatttgcatcgtaaccyataatatttatcgtattggtctta

SEQ ID NO: 35757 - DNA, 50 bp, homo sapien
ctgcatttctcatcctgttatcccgwagacaaagtggggccacctcaaag

SEQ ID NO: 35758 - DNA, 50 bp, homo sapien
tttgagagctgatgggatttataacrgattgttgtatgcagttgcatttt

SEQ ID NO: 35759 - DNA, 50 bp, homo sapien
ctgtaatcatgctatcaagactgtcrgaaacatattcccattcacatatc

SEQ ID NO: 35760 - DNA, 50 bp, homo sapien
aaaccaggaaactagctattgaggarctttggaaacacaagctttcagct

SEQ ID NO: 35761 - DNA, 50 bp, homo sapien
gagctgtccattggtgagcttcctakatatgatttcaatgctccggccct

SEQ ID NO: 35762 - DNA, 50 bp, homo sapien
cgactaagacagcaagcattctctasgatcatcatggtgccttagccctg

SEQ ID NO: 35763 - DNA, 50 bp, homo sapien
aaaggagtgcatattattaaagaaarccacatcaaacaaacagtaacaaa

SEQ ID NO: 35764 - DNA, 50 bp, homo sapien
ttatgaaaacaagtttaaacctaaaracagcctggatgccttaaaaatgt

SEQ ID NO: 35765 - DNA, 50 bp, homo sapien
gaacttgtggctgcagacacgtcgaycttttgagatgtgtttttctcatt

SEQ ID NO: 35766 - DNA, 50 bp, homo sapien
ccatcacactgatgttttccacatcyataacctgacccatcgactgctct

SEQ ID NO: 35767 - DNA, 50 bp, homo sapien
aatcaactcccctgatcgtttctcawctctcctattgaatcctgaagaat

SEQ ID NO: 35768 - DNA, 50 bp, homo sapien
acctagtcattctcctcatttttgawgacttcagacccagttaattgcct

SEQ ID NO: 35769 - DNA, 50 bp, homo sapien
catttatcgagtactttctaaggacragtcactgtggtaatacaagtaca

SEQ ID NO: 35770 - DNA, 50 bp, homo sapien
atatacgaataaggtgaatagcaaastccatttttattgacccacaattt

SEQ ID NO: 35771 - DNA, 50 bp, homo sapien
ttgtgcaattttaagcatgtgaaaasactagatatttcaaataggactta

SEQ ID NO: 35772 - DNA, 50 bp, homo sapien
taagagaaagtgaagacaactgttcyagatttatcttctgtataagatct

SEQ ID NO: 35773 - DNA, 50 bp, homo sapien
ctacaaagacccttgatctcataagwctctgggtgaagctgatcccactt

SEQ ID NO: 35774 - DNA, 50 bp, homo sapien
taaccccattatatatgatcagttgkattcatgtattactacctaactgg

SEQ ID NO: 35775 - DNA, 50 bp, homo sapien
tctcaacagggacacttatcttccawccacaaagccgtgtgaacttccct

SEQ ID NO: 35776 - DNA, 50 bp, homo sapien
tagagttagcatcaatctatcttaascaacgtggagtagactcaagaact

SEQ ID NO: 35777 - DNA, 50 bp, homo sapien
taggggtagaagtggggagaatttawctgacagctcccatcccataatat

SEQ ID NO: 35778 - DNA, 50 bp, homo sapien
aggtaatacctccctccctgcatacrctcacggggactctgctacagttc

SEQ ID NO: 35779 - DNA, 50 bp, homo sapien
ccatatcatgcattgtgtgtgggaamtaaacaaatacaaatagcagtggg

SEQ ID NO: 35780 - DNA, 50 bp, homo sapien
tttggaaagcacaatttgccctataycaaccaccatacaggtaatacctc

SEQ ID NO: 35781 - DNA, 50 bp, homo sapien
gaaataccaaagtgtgaaacaaaacragaagggaagaagtaaagctttta

SEQ ID NO: 35782 - DNA, 50 bp, homo sapien
atctttcttaaagtcagttaaacaaygaacccaatatgcccattaagtgt

SEQ ID NO: 35783 - DNA, 50 bp, homo sapien
ctgtggaacttttaatcatgcatccyatacatagccacgctcctattaat

SEQ ID NO: 35784 - DNA, 50 bp, homo sapien
tttttcactattactaatatttcgaycctgaatatcaatctgaactatga

SEQ ID NO: 35785 - DNA, 50 bp, homo sapien
atgcaagcatgaatgctccctagagkaaggtaatctcattcatagcatga

SEQ ID NO: 35786 - DNA, 50 bp, homo sapien
gcttctacgaatctaataatcttaaygtgtatgtgaaagttcacaactgc

SEQ ID NO: 35787 - DNA, 50 bp, homo sapien
gaatcaaccagtgccttgagcccatyaatacatagtccagattgaaccag

SEQ ID NO: 35788 - DNA, 50 bp, homo sapien
ctcattcaaaggtcatcagcctcaamggtcaaacatagataaatccatga

SEQ ID NO: 35789 - DNA, 50 bp, homo sapien
ttccaactggatagaacatgaaaaaytaaggagagaaggaccatccaaca

SEQ ID NO: 35790 - DNA, 50 bp, homo sapien
ggcatccagtaagcagttagatacasaagaagttcatggagaaaaaaaaa

SEQ ID NO: 35791 - DNA, 50 bp, homo sapien
attacctgaaataatttgcataaagwacctagactggaacacagtaaaca

SEQ ID NO: 35792 - DNA, 50 bp, homo sapien
tcccagtggttaattaccttggtcaractgcttaaaatctagttcctgaa

SEQ ID NO: 35793 - DNA, 50 bp, homo sapien
gaattagttttgtcctttatcgcaamattgatgtagtacaaaaaacacag

SEQ ID NO: 35794 - DNA, 50 bp, homo sapien
ccagaactggagaggaagtaagaagmagctgagtagggaggtggagcaga

SEQ ID NO: 35795 - DNA, 50 bp, homo sapien
ataaatcttaagagttgaaagataartcaagggtatcatattcctcctga

SEQ ID NO: 35796 - DNA, 50 bp, homo sapien
aatgatagaattcaggtgtatggtarcaacaaaagtatactgtcaaaaag

SEQ ID NO: 35797 - DNA, 50 bp, homo sapien
ttctctagaagcttctccaaatgaarcatttctcagttcacacatctaaa

SEQ ID NO: 35798 - DNA, 50 bp, homo sapien
gtgtgtgtacatgtttatgcatagaygtatataggaacaaaatgtttagc

SEQ ID NO: 35799 - DNA, 50 bp, homo sapien
tgaagaatctttttaaggagccatgyatgtttctagtactgtgtgcactc

SEQ ID NO: 35800 - DNA, 50 bp, homo sapien
cagatgagaatagaatactactctayggctaaatgaaaagaacaacttaa

SEQ ID NO: 35801 - DNA, 50 bp, homo sapien
tataatctataagacccttctattgraaaaaacaatgtcttgtaatgttt

SEQ ID NO: 35802 - DNA, 50 bp, homo sapien
tcatcccttactactttatatcacckcctactaaaaggcttctctgactt

SEQ ID NO: 35803 - DNA, 50 bp, homo sapien
ttcgtactttaggatagaggataagraactacttacggttgtccctaaac

SEQ ID NO: 35804 - DNA, 50 bp, homo sapien
acatttgctatgagactttcctgaayaattggaggtttggcatatgcaga

SEQ ID NO: 35805 - DNA, 50 bp, homo sapien
tttctaagcctgctttatttctaacycaacttttcactacaaggagaggg

SEQ ID NO: 35806 - DNA, 50 bp, homo sapien
ctcaagagaagcaaaaatagtaaaawttggtttatgctgctttagcaata

SEQ ID NO: 35807 - DNA, 50 bp, homo sapien
tttacagcagagaagtgaaatacatsaggattggttctatgaccatccta

SEQ ID NO: 35808 - DNA, 50 bp, homo sapien
aatattttaggtgcctactatttacyaaggactgttttaggttgatgatt

SEQ ID NO: 35809 - DNA, 50 bp, homo sapien
ttataaaatgctataacctgcttaartattattgctgttgaaatttttta

SEQ ID NO: 35810 - DNA, 50 bp, homo sapien
agggtttgtgctataattaaatgcarcgtttaaattacataatccaagtg

SEQ ID NO: 35811 - DNA, 50 bp, homo sapien
agccttagttaggcttagctgttcaragaatattcaaatagggatgccct

SEQ ID NO: 35812 - DNA, 50 bp, homo sapien
cagtgactttttcaattatgtggaayactttgaaaaaaatgtatgtcacc

SEQ ID NO: 35813 - DNA, 50 bp, homo sapien
gtttcttcaaaacaggaaattctatraaggaagcaaatttaaaatcagga

SEQ ID NO: 35814 - DNA, 50 bp, homo sapien
catctactgagttagtctatgaacamgttattttgaaaaccttcaaattt

SEQ ID NO: 35815 - DNA, 50 bp, homo sapien
aggttgccattaggttggggtaagcracagactagtagactagctagttt

SEQ ID NO: 35816 - DNA, 50 bp, homo sapien
cacacatttgcatttcaatagcaackcctgggtatgtttaaaaaaatacc

SEQ ID NO: 35817 - DNA, 50 bp, homo sapien
tgttgcaaagcaaaaatatttatgawatgtagagatgttacaaacttgta

SEQ ID NO: 35818 - DNA, 50 bp, homo sapien
attgttattggggctgatttaagagwcagagtagatgcatctcagtgttt

SEQ ID NO: 35819 - DNA, 50 bp, homo sapien
ttagaaaagatcatgtaactataaargtacaccaggtatgaaggaagcac

SEQ ID NO: 35820 - DNA, 50 bp, homo sapien
gctctctcataatgcctgatggtgcyagagggcaaatacgtgtgaattgc

SEQ ID NO: 35821 - DNA, 50 bp, homo sapien
agaaagcagccattttgtattgcccrggatgtcatatggcttcataagct

SEQ ID NO: 35822 - DNA, 50 bp, homo sapien
tgacatgtgtttgactctgatttaaytgctgatttttgtcttgactcatg

SEQ ID NO: 35823 - DNA, 50 bp, homo sapien
acaaagagacttccacttgagcaaargctaccagttaagtgctctgctgc

SEQ ID NO: 35824 - DNA, 50 bp, homo sapien
cttctgccaagcttggctttttgcartagtacagtagtctccagggagca

SEQ ID NO: 35825 - DNA, 50 bp, homo sapien
gacagcagtgtcaggagaaatttaartagagagatctcttatccatattt

SEQ ID NO: 35826 - DNA, 50 bp, homo sapien
ttatcattatatagtgtctctcttcrccttttttaactgctgttgcttaa

SEQ ID NO: 35827 - DNA, 50 bp, homo sapien
tggtttaatgcattagaatcaaagartcattatagtatctaaactagacc

SEQ ID NO: 35828 - DNA, 50 bp, homo sapien
ctacaattgtacatggtctgatacayaatttataatactttttggtggct

SEQ ID NO: 35829 - DNA, 50 bp, homo sapien
ttggcaaaaatttagatatggacaamtgtaataggcaagaataggcttat

SEQ ID NO: 35830 - DNA, 50 bp, homo sapien
ataaaagttcagatacaaaaggagcrctgtaaaactggtaggagctatgg

SEQ ID NO: 35831 - DNA, 50 bp, homo sapien
ttaaaatttaagataacttctccaamacaaaatgggtcacagttttaata

SEQ ID NO: 35832 - DNA, 50 bp, homo sapien
gcccaaacagaaaacattttgttcartcttgtggcggctctgagaaaaca

SEQ ID NO: 35833 - DNA, 50 bp, homo sapien
gagagaattgagagaggaaagctgargcccgtatgacactgagaaagtca

SEQ ID NO: 35834 - DNA, 50 bp, homo sapien
ggggaagattagatgaattaagcaarttaaatatatagagtggtatctga

SEQ ID NO: 35835 - DNA, 50 bp, homo sapien
tcagcacaactatgtagttatatacrcctcttataacctctagactaaca

SEQ ID NO: 35836 - DNA, 50 bp, homo sapien
aaagggtttctgctgaaagttctacrattagcctgttggaagtattacta

SEQ ID NO: 35837 - DNA, 50 bp, homo sapien
agaaaatgtcataaaccacttaggamaatttctggcataataaaaacaga

SEQ ID NO: 35838 - DNA, 50 bp, homo sapien
ttcccgcctttctgaacttctgtcckcatctgtgagtaatgggtctggac

SEQ ID NO: 35839 - DNA, 50 bp, homo sapien
ttgcttcaaagatttgcctgtgtaayggattcttaagaggaattctagag

SEQ ID NO: 35840 - DNA, 50 bp, homo sapien
gatcatgtattacctctcattaatcycatttttcttcacctggtccacag

SEQ ID NO: 35841 - DNA, 50 bp, homo sapien
ttattttatcttaaattatttagtcyaaggtgagttttaacagcatgatt

SEQ ID NO: 35842 - DNA, 50 bp, homo sapien
agaagagagtgagaaaggtggaagakcctaacttctggtatggccaacag

SEQ ID NO: 35843 - DNA, 50 bp, homo sapien
aaattatcatttaatatttggagtaygtaacatttgcttaatgcgcatca

SEQ ID NO: 35844 - DNA, 50 bp, homo sapien
ttaagaaaattgaatggtagaaaagkctaaggcaatatagatgaattaaa

SEQ ID NO: 35845 - DNA, 50 bp, homo sapien
atcaaatttaatatgcgtgactcccratgataaaggtcagaaaattactg

SEQ ID NO: 35846 - DNA, 50 bp, homo sapien
acaaatcaacaaaatgaagaaaacartatttgaccagaatgataataata

SEQ ID NO: 35847 - DNA, 50 bp, homo sapien
aatatactttgcataaaaattacaartcaaggttggtaaacagtgaaaca

SEQ ID NO: 35848 - DNA, 50 bp, homo sapien
atatcatatatctctatttttaggawcagtcaatggcacccttattttgt

SEQ ID NO: 35849 - DNA, 50 bp, homo sapien
ttaaacttttcttccctaaactgacwactacttgattgcctattcttcaa

SEQ ID NO: 35850 - DNA, 50 bp, homo sapien
gcagatgttgatgcatgactacaaayatcaagaacaatcaggacaacatg

SEQ ID NO: 35851 - DNA, 50 bp, homo sapien
ttggaaaagagcaaaattgtccaaayggttttgcagatatttaatttact

SEQ ID NO: 35852 - DNA, 50 bp, homo sapien
gtttgtatcccaaagccacctgtgcrataacatgaaaagtatgggtgaaa

SEQ ID NO: 35853 - DNA, 50 bp, homo sapien
ttcaatcaaggtcagaagtcgttaamctgtattccaagaacttttgagtt

SEQ ID NO: 35854 - DNA, 50 bp, homo sapien
tgaggaagagactcctggtgaaaaawtgctaatgataactattgctgaca

SEQ ID NO: 35855 - DNA, 50 bp, homo sapien
agcagctttgattatacgtttccaaratcattcccaagccttttttgtct

SEQ ID NO: 35856 - DNA, 50 bp, homo sapien
ctggtagtgttaattaggaacataarctattataatgcttctttcatgat

SEQ ID NO: 35857 - DNA, 50 bp, homo sapien
ttataaactcaggagatgtaagttaraaatatgctcccagccagtcaaaa

SEQ ID NO: 35858 - DNA, 50 bp, homo sapien
ggcctgtgctcatagctccaaaacaraagtctacagctaaaacctctctt

SEQ ID NO: 35859 - DNA, 50 bp, homo sapien
tgttatcattactggtacataaaaaragtaaatggataaagtcaataaac

SEQ ID NO: 35860 - DNA, 50 bp, homo sapien
aattttaattatacttccagaatgarattaaatgttgtaaaccttgacca

SEQ ID NO: 35861 - DNA, 50 bp, homo sapien
cttgataaacctaaaagcaaagaaartattcaggtaatagacacagcaca

SEQ ID NO: 35862 - DNA, 50 bp, homo sapien
cctaagcttagaactttcagggaatkagtttatgatcccaggcagctttc

SEQ ID NO: 35863 - DNA, 50 bp, homo sapien
ctttacaattagagccctagaagaamatactccactctttctatcttgaa

SEQ ID NO: 35864 - DNA, 50 bp, homo sapien
tttggtcattcttgcccttgtgctayagttctgctgcgataatctgaatt

SEQ ID NO: 35865 - DNA, 50 bp, homo sapien
tctggataaggagtttttgagactamgatggttcctaaaaacacctgtgt

SEQ ID NO: 35866 - DNA, 50 bp, homo sapien
ctgtccattgccacctgatcaaatcrcaaatgtcaaccctgagcatatct

SEQ ID NO: 35867 - DNA, 50 bp, homo sapien
gtctcttatcctatcaattaccatgratcattctgagtcttcttttaggt

SEQ ID NO: 35868 - DNA, 50 bp, homo sapien
tacaccttttcctaattactcaaaawaactaagcatagataataatgtaa

SEQ ID NO: 35869 - DNA, 50 bp, homo sapien
gttttgtttgatcaaaagagttccastgcgtcagcaatcatttggaaact

SEQ ID NO: 35870 - DNA, 50 bp, homo sapien
catgcacagataaaaagaatattatyagacaaagtgaagactggatttct

SEQ ID NO: 35871 - DNA, 50 bp, homo sapien
aattgcactatgactttatgccgtayacttcagtaagcagatatacaccc

SEQ ID NO: 35872 - DNA, 50 bp, homo sapien
aaacactatgggcaagatgtaattckaacttaagtcaaataaatggcaaa

SEQ ID NO: 35873 - DNA, 50 bp, homo sapien
ctgagactaatctgattttagtttayatggaagctggtttatcctattag

SEQ ID NO: 35874 - DNA, 50 bp, homo sapien
ggtcactggagactaagaatgttacraagggtgaagatttgtgttaccct

SEQ ID NO: 35875 - DNA, 50 bp, homo sapien
ttttgctagaatttttatttcactcrcttgtgatctaagatctttagcat

SEQ ID NO: 35876 - DNA, 50 bp, homo sapien
ttggtggagaagttgattgcatacayatattcttctttatttgggctttc

SEQ ID NO: 35877 - DNA, 50 bp, homo sapien
aggaaaatgtgataagttgtgtaagwcattttgatatgagaagaggaaat

SEQ ID NO: 35878 - DNA, 50 bp, homo sapien
gttctgaggtttgaaggagataataygtgaggaaggcatttgtaaactct

SEQ ID NO: 35879 - DNA, 50 bp, homo sapien
gtgtaattttgttggctttccatgayattgctttatgttaaaatgcttct

SEQ ID NO: 35880 - DNA, 50 bp, homo sapien
tcctctgtgcaactacagactcttayaggaacgtcaatgattgcatttaa

SEQ ID NO: 35881 - DNA, 50 bp, homo sapien
gatgggctggatttcaggcggacgargtttccataaaaaggaatcaaagt

SEQ ID NO: 35882 - DNA, 50 bp, homo sapien
catcttgacaatttaaagatttttaratatgagcagtaatcaatgtccag

SEQ ID NO: 35883 - DNA, 50 bp, homo sapien
catgtcaccaattttttttgccaccrcctcacaaatttagtaagttttta

SEQ ID NO: 35884 - DNA, 50 bp, homo sapien
agacaggaatcccatagaaatcttayggaaaaatctacagtacatcgatg

SEQ ID NO: 35885 - DNA, 50 bp, homo sapien
cttctcttcctcacaatgtacaaaayatgtctatatccatacttaagttt

SEQ ID NO: 35886 - DNA, 50 bp, homo sapien
gagttgaagaaagtgaacgctggaayagccatgggcagagggaagaattt

SEQ ID NO: 35887 - DNA, 50 bp, homo sapien
ttacaaaatacctacgaatgcaacayagtaacattgtcagtagaaaatca

SEQ ID NO: 35888 - DNA, 50 bp, homo sapien
ttatgaagaaaatctgaaaagtgtargcaaaatatagagtgcaattaaca

SEQ ID NO: 35889 - DNA, 50 bp, homo sapien
agacttgctcacattggtatgtatcrcacttctgaagcatcacttcaaaa

SEQ ID NO: 35890 - DNA, 50 bp, homo sapien
actcttttaattccttgactcagtayaggctaaaaattagcggcaaaaac

SEQ ID NO: 35891 - DNA, 50 bp, homo sapien
catggtgcaattctcaatcagtggckattcatatttaatttaattatgtg

SEQ ID NO: 35892 - DNA, 50 bp, homo sapien
gccatcgatctgaaaaatctgtggamattcgtgaactatgtggcaagtct

SEQ ID NO: 35893 - DNA, 50 bp, homo sapien
atattccaaatgccttgcatcaagamgtcaaaaactctgctcagcccact

SEQ ID NO: 35894 - DNA, 50 bp, homo sapien
tacttgatgagctctttaaagagaartgggtgatttgcagcaaaattctt

SEQ ID NO: 35895 - DNA, 50 bp, homo sapien
tttgaattgcacctgctcaggcccargcgatgggtggaagaagcttttca

SEQ ID NO: 35896 - DNA, 50 bp, homo sapien
tttttttcatgcaatattacagacayggtgactgtcattggatagaatta

SEQ ID NO: 35897 - DNA, 50 bp, homo sapien
ataatcagcgcatcttatggtaatcracaaaactgaacaaggtaatttta

SEQ ID NO: 35898 - DNA, 50 bp, homo sapien
gtcttaggtctaagccttatcttacsaaccagatggaaaacctctcaagg

SEQ ID NO: 35899 - DNA, 50 bp, homo sapien
aaaggcctctaattggttgtaaatgratcaatacccatcagtttcacaaa

SEQ ID NO: 35900 - DNA, 50 bp, homo sapien
aaaacacttcaaccatgattatacaraagtgaaattacacatcaagctct

SEQ ID NO: 35901 - DNA, 50 bp, homo sapien
atccagaaaataaaagaattatccargaacagtacgccagggaaaattct

SEQ ID NO: 35902 - DNA, 50 bp, homo sapien
tcttggtgtttatcataagctaataycaaaatttctttacacttcattgt

SEQ ID NO: 35903 - DNA, 50 bp, homo sapien
ttttactacctactttgtaaatatcracggataatcaagcattcaccagg

SEQ ID NO: 35904 - DNA, 50 bp, homo sapien
gacaaaatagaatgcaagtaaaacartgagtgatgagataggtgctaagt

SEQ ID NO: 35905 - DNA, 50 bp, homo sapien
ctatctttcatttctgcatgattcawtaaaattagacaacaacttcatga

SEQ ID NO: 35906 - DNA, 50 bp, homo sapien
aggaagatcactactctgattggaartatgaatcggaaatattggaaatg

SEQ ID NO: 35907 - DNA, 50 bp, homo sapien
aggaaaagacaatgagtgatggaacyaaatcaggtctgccactgtggggt

SEQ ID NO: 35908 - DNA, 50 bp, homo sapien
aagcttatttttgtaaatagttgtgragaccttagatggaatgggtgttc

SEQ ID NO: 35909 - DNA, 50 bp, homo sapien
tgaacagaacggttttcccaacagargattgtcattattcattttaagaa

SEQ ID NO: 35910 - DNA, 50 bp, homo sapien
atgtgttttcctccttgccagtatcratccctgcttcctcaatctcagtg

SEQ ID NO: 35911 - DNA, 50 bp, homo sapien
aaattttaaagttgtccagacctaaratttgttcttggactgtggtgcca

SEQ ID NO: 35912 - DNA, 50 bp, homo sapien
ctgagttattgtcaaacagaaattgmaatagttgatgaaaaggttaaaat

SEQ ID NO: 35913 - DNA, 50 bp, homo sapien
gaaaatgaacaaaaagaatggagaayttaaaactggtctgactgtatcaa

SEQ ID NO: 35914 - DNA, 50 bp, homo sapien
tcagaaaaattcccttagtagacgaragagttgggagagtgtgaatctga

SEQ ID NO: 35915 - DNA, 50 bp, homo sapien
aggttttactctagatatgggtggamtagacagaactgacatttccaatc

SEQ ID NO: 35916 - DNA, 50 bp, homo sapien
taatatggcagatttggagacactcyaagctacacaatgaacttaaaaag

SEQ ID NO: 35917 - DNA, 50 bp, homo sapien
gaaaatccataaggtctgaacttcaycatatcagttctcagtctcctgac

SEQ ID NO: 35918 - DNA, 50 bp, homo sapien
atatgaccaagataggtgaccaaaayatagactgtgatcaaattacaaaa

SEQ ID NO: 35919 - DNA, 50 bp, homo sapien
ttttcgaggagatacaggtaagctcygaaaggttgaaattagtcttggca

SEQ ID NO: 35920 - DNA, 50 bp, homo sapien
atgcctttgaagtcaccaacgataargtgcaatggagcgtatgtggtgag

SEQ ID NO: 35921 - DNA, 50 bp, homo sapien
tgcttttctaagttcaaagatctcayagcatgtgtcccagctgaatagaa

SEQ ID NO: 35922 - DNA, 50 bp, homo sapien
actcaggtaaactggcctcatgaaawccactacgtgcttatttcatttgc

SEQ ID NO: 35923 - DNA, 50 bp, homo sapien
tagccaattgatctttgataaagtcracaagagtatacactggggaaagg

SEQ ID NO: 35924 - DNA, 50 bp, homo sapien
atatctaagcttgatcttgagagatraataggagccttttgttttggaga

SEQ ID NO: 35925 - DNA, 50 bp, homo sapien
tagaatgtagtaaataagggtcccartggattttgcaaatggaaacacaa

SEQ ID NO: 35926 - DNA, 50 bp, homo sapien
gaaaacatttcaattagaagaaacarcatttagcagacttagaagatctg

SEQ ID NO: 35927 - DNA, 50 bp, homo sapien
ccctttccattgagcggaggaagaarcgctctactggggtcttgctgcct

SEQ ID NO: 35928 - DNA, 50 bp, homo sapien
atattcaaaatactattgctaagacrctaagaccaacatcaagaaggttt

SEQ ID NO: 35929 - DNA, 50 bp, homo sapien
atttaatggaagcataaaacattaaytatctgtgcaaaggggtacttttg

SEQ ID NO: 35930 - DNA, 50 bp, homo sapien
cagagaattcttaaaggtagtccaaycattagagggaattagccaggcgg

SEQ ID NO: 35931 - DNA, 50 bp, homo sapien
tatttctctctttgcatatgaatgarcgacgataccattgcccttctttg

SEQ ID NO: 35932 - DNA, 50 bp, homo sapien
gtgtgtttgttttgattatcacataygaattcagctttgtccaaatattt

SEQ ID NO: 35933 - DNA, 50 bp, homo sapien
tttcttgtgaatcatcttctgaacasacttagagttgatgatgggaagta

SEQ ID NO: 35934 - DNA, 50 bp, homo sapien
agcacaaaatgatttctctagctaartcatcacagcagttcttaaatcag

SEQ ID NO: 35935 - DNA, 50 bp, homo sapien
gccacaaaccatctcagtcataccamattctcgtcccagtctgtatcctt

SEQ ID NO: 35936 - DNA, 50 bp, homo sapien
aacattttaataaataactctcttcygaacatatttaaccatggtgagag

SEQ ID NO: 35937 - DNA, 50 bp, homo sapien
ctaaagtttagaaaccgcaaggcaayggaagattcacaaagacctacaga

SEQ ID NO: 35938 - DNA, 50 bp, homo sapien
ttcaatctcagaatatttgtaaatarctccctgaatttgtgtggactgaa

SEQ ID NO: 35939 - DNA, 50 bp, homo sapien
acacaaggtgttgttcttcatctacmatttggatgcatgcaaacagctaa

SEQ ID NO: 35940 - DNA, 50 bp, homo sapien
tgaactttaaaagtgttagtgaccaractgaaatctcttttaaacaccat

SEQ ID NO: 35941 - DNA, 50 bp, homo sapien
aaggtttgctggcccctggtctagcraatagtgatggtgactggatcaat

SEQ ID NO: 35942 - DNA, 50 bp, homo sapien
tttttaaaaatatatttggacttaamatattatgatatctagttaaataa

SEQ ID NO: 35943 - DNA, 50 bp, homo sapien
attctgaatccaccaaataatcacaygtcctgtcacaagtccatcaacgc

SEQ ID NO: 35944 - DNA, 50 bp, homo sapien
gtatgggatccaatttcaagtttacyattactgtttttcaacgttattca

SEQ ID NO: 35945 - DNA, 50 bp, homo sapien
gatcttcaacatgcattccaaggacrcaaaacagggaaattattgtttct

SEQ ID NO: 35946 - DNA, 50 bp, homo sapien
aaaagctcacgtacaaatgttgccartaaggacttaagaaagcatttcta

SEQ ID NO: 35947 - DNA, 50 bp, homo sapien
ctatatgataattttgtcctgctgartatatggacttaaaaatccatgaa

SEQ ID NO: 35948 - DNA, 50 bp, homo sapien
catattaatagaacgtcttaatagakcctcaagttcttattaacataagc

SEQ ID NO: 35949 - DNA, 50 bp, homo sapien
gactgtgcagttgttctgttacttasagctcctctcctcaactttgagtt

SEQ ID NO: 35950 - DNA, 50 bp, homo sapien
acaatgacttagatattggtagtccygctttaatgtgaaaatgtgcttgg

SEQ ID NO: 35951 - DNA, 50 bp, homo sapien
cattgattcaaattaagaaaggtaayaaacaggcatttggatataagaag

SEQ ID NO: 35952 - DNA, 50 bp, homo sapien
atcatcttaaaattagcatcccttaygtattgatttgatgagaactcttt

SEQ ID NO: 35953 - DNA, 50 bp, homo sapien
gtcagtgagagagactgaagcataayaccgtaaattaataatgacctcat

SEQ ID NO: 35954 - DNA, 50 bp, homo sapien
tttaaaggacggtccttccagaattyaaagaatgttatttgtctcatcat

SEQ ID NO: 35955 - DNA, 50 bp, homo sapien
gctctacagttaattgaacattccayctgctaatcataaaaaaaggtaaa

SEQ ID NO: 35956 - DNA, 50 bp, homo sapien
ctcacagtaccatggctaaccactcmaagggttgtttctcactcagacaa

SEQ ID NO: 35957 - DNA, 50 bp, homo sapien
aaaagcactatcatttccagaggccratgcatgttagaaacctattcctg

SEQ ID NO: 35958 - DNA, 50 bp, homo sapien
aggatactgtggataacacagagcargtttctttttccttactggtggcg

SEQ ID NO: 35959 - DNA, 50 bp, homo sapien
ctattgttcaactgttcactgaagayaggctttgcagttacatttcccct

SEQ ID NO: 35960 - DNA, 32 bp, homo sapien
tttacaagtacataaakcaacagtggttaggt

SEQ ID NO: 35961 - DNA, 50 bp, homo sapien
gataagatggtcaccctggtaatggkaacagaaacattcaggcctgcaag

SEQ ID NO: 35962 - DNA, 50 bp, homo sapien
ttcttgtttctgatgtggtaatagcraaccttttaatttcctgagggttg

SEQ ID NO: 35963 - DNA, 50 bp, homo sapien
aaattccacttttcattatagaatamtacccgaactgctgaaaataaagc

SEQ ID NO: 35964 - DNA, 50 bp, homo sapien
tttcctttaatctctagttatattargtaccatcttagttgcagatacat

SEQ ID NO: 35965 - DNA, 50 bp, homo sapien
aggacagggataaagagcacggtgaraaacaaatcttgagtacagtgggg

SEQ ID NO: 35966 - DNA, 50 bp, homo sapien
gctgggcttacaggtgtgtggctaaycttttgtattgacaaattccttaa

SEQ ID NO: 35967 - DNA, 50 bp, homo sapien
gttttccctcaaagcctagtagttcyatacccttatatttaggaacagca

SEQ ID NO: 35968 - DNA, 50 bp, homo sapien
attatagatcttagagaatgagaagsacttctatgggacttctagtctca

SEQ ID NO: 35969 - DNA, 50 bp, homo sapien
tgtcattcttgtttttcaatggacamgagaagctatcttcttggtaaagc

SEQ ID NO: 35970 - DNA, 50 bp, homo sapien
ttttcatttcaatgggacattgataygattgatttccaagagcatggact

SEQ ID NO: 35971 - DNA, 50 bp, homo sapien
ataaatggtaaaattgtatttcctaygagttttgcaggatgggcacaaaa

SEQ ID NO: 35972 - DNA, 50 bp, homo sapien
cttttccaccagattggaacctaaamgatgtagcagtgaagcttccacat

SEQ ID NO: 35973 - DNA, 50 bp, homo sapien
caaataattttttgcatgttgaatayagtacttctaatttctttctccag

SEQ ID NO: 35974 - DNA, 50 bp, homo sapien
ctaaacacacacaaggagagcaatartagctgctggacctccaattatcc

SEQ ID NO: 35975 - DNA, 50 bp, homo sapien
atcacttgcccttcttattgctaaargaaccaacagagcaccaaagagac

SEQ ID NO: 35976 - DNA, 50 bp, homo sapien
ctggactgacaattgtcatccaaaartacatatcatgaaaacaaatgatc

SEQ ID NO: 35977 - DNA, 50 bp, homo sapien
tcacttatttgtacataaaatgatasgacctttctttgaagaaaacaggc

SEQ ID NO: 35978 - DNA, 50 bp, homo sapien
agtcatttctttataaaagtaaacaraagaagcatatcacagaatctctt

SEQ ID NO: 35979 - DNA, 50 bp, homo sapien
agatgtgataataatttctacaacartctccaagaaatatgtattattat

SEQ ID NO: 35980 - DNA, 50 bp, homo sapien
aataaaaatattggcctgactaatayctaacatttactgtgggcttactt

SEQ ID NO: 35981 - DNA, 50 bp, homo sapien
atgaacaattccaagatatatttagraaagttgcaaaactacaaggattt

SEQ ID NO: 35982 - DNA, 50 bp, homo sapien
aataagtctttattcaccgactctayagttaatctgaaaatttaagtttc

SEQ ID NO: 35983 - DNA, 50 bp, homo sapien
attacttctcaatttgtatctactgratgcttttatatcacccaacagac

SEQ ID NO: 35984 - DNA, 50 bp, homo sapien
caggttgaggacaatttacaagtcaygatactagatccaacttaattgca

SEQ ID NO: 35985 - DNA, 50 bp, homo sapien
tcatcaatggttttattaggccacartgaatgaggtatacagcctgttca

SEQ ID NO: 35986 - DNA, 50 bp, homo sapien
tatctagtagcacatttaatactcarcttcactctgctacataacctttt

SEQ ID NO: 35987 - DNA, 50 bp, homo sapien
gttaaatagtgacgaactgttgatayactaaaacagcccaagtctcatgt

SEQ ID NO: 35988 - DNA, 50 bp, homo sapien
atgtcaattcaatgcagttcagaaarttagagggtatctgaatacttact

SEQ ID NO: 35989 - DNA, 50 bp, homo sapien
acaaagagatgacttgaaatgtacaratcagactaaatcagtgaggagcc

SEQ ID NO: 35990 - DNA, 50 bp, homo sapien
agactggagacaacaggaatggtaaygacttctcaagaggagttgggatt

SEQ ID NO: 35991 - DNA, 50 bp, homo sapien
ttacctcactagaacatctgcttggrattcagcctgttgctactgatcat

SEQ ID NO: 35992 - DNA, 50 bp, homo sapien
aaatatctcaccttctaacctatackcactgtaggtgtgatgaagtccag

SEQ ID NO: 35993 - DNA, 50 bp, homo sapien
gtttatgcgtgcttccggtccgcgakccctgagagctaacttggggtctt

SEQ ID NO: 35994 - DNA, 50 bp, homo sapien
gtttacttctctcgtcttcgttaccrctgttaatcggcacttaggaggta

SEQ ID NO: 35995 - DNA, 50 bp, homo sapien
gggaagacagccgtgtggtagaaagwataaactgactggttgaaacatgg

SEQ ID NO: 35996 - DNA, 50 bp, homo sapien
taggaagatggaaaacactttagaaytgttaacatataatgatagtgacc

SEQ ID NO: 35997 - DNA, 50 bp, homo sapien
atggtttactttaaggatgtgggaarctccattatttgacagtattttgt

SEQ ID NO: 35998 - DNA, 50 bp, homo sapien
tttatattattttcctcctttgtgcyaagtatagagaatatgacctgaga

SEQ ID NO: 35999 - DNA, 50 bp, homo sapien
tcctccttcatgaggttcatagtccratgaggtgacaaatattatttact

SEQ ID NO: 36000 - DNA, 50 bp, homo sapien
gatattacaggaagctaattagacaygagttacataaaacaaatgtcaaa

SEQ ID NO: 36001 - DNA, 50 bp, homo sapien
ttgtggtattttataattgaagtcawaatattagaatggtacacaaacta

SEQ ID NO: 36002 - DNA, 50 bp, homo sapien
tgtaaaaagacaacaatatcttaccrcaaagcattgccagttataaactg

SEQ ID NO: 36003 - DNA, 50 bp, homo sapien
aacaatgttgtgactaattggcttcyattatttccctagagtaggttctg

SEQ ID NO: 36004 - DNA, 50 bp, homo sapien
cttgtgtgtgtatgtaaagaaaaagycagtattgagccaaaggactttct

SEQ ID NO: 36005 - DNA, 50 bp, homo sapien
cacacaaaaaaatctagcttaattgycaactggtatctaatcttatttca

SEQ ID NO: 36006 - DNA, 50 bp, homo sapien
ctccagtgtttagcacagtgctcaawaacgtttggttgatctataccatt

SEQ ID NO: 36007 - DNA, 50 bp, homo sapien
taggatgggaataccagttccttccratgtcaaaggtagctccttgcaag

SEQ ID NO: 36008 - DNA, 50 bp, homo sapien
acaccacaccctctggttttcaaagkcactcttcacaggtaacccggcaa

SEQ ID NO: 36009 - DNA, 50 bp, homo sapien
gattggagaattatgagcaaatacarggatgtgattttaagccatttaat

SEQ ID NO: 36010 - DNA, 50 bp, homo sapien
gtctccattttgcgtttagaaaaccmgacttagatgctggaggggcaccg

SEQ ID NO: 36011 - DNA, 50 bp, homo sapien
tatgtccacttaatcagttcaagccyaataattccttgatttgggtatag

SEQ ID NO: 36012 - DNA, 50 bp, homo sapien
gactcatgtgtcccgtgggtacagtyaattcacagtatctgttctggctt

SEQ ID NO: 36013 - DNA, 50 bp, homo sapien
gaatacatttaaatgatcacttatgmaccttgtaaaaactttcaagttac

SEQ ID NO: 36014 - DNA, 50 bp, homo sapien
taataattgctggacttttactccayaagaaacttgctataggcccatct

SEQ ID NO: 36015 - DNA, 50 bp, homo sapien
cacagtatctgttctggcttttttcrctttaattctgttctgcacattct

SEQ ID NO: 36016 - DNA, 50 bp, homo sapien
tttaacacctttactttgagcaacaytaataataatattctaaattgttg

SEQ ID NO: 36017 - DNA, 50 bp, homo sapien
atacaaatatatttttcacattttayggtcatatcacatataaagttcct

SEQ ID NO: 36018 - DNA, 50 bp, homo sapien
cttaactggagtagggaaatttagamataggaagctaaacaatctccaac

SEQ ID NO: 36019 - DNA, 50 bp, homo sapien
tatttacctattctacctacttcaartgcttttttgctgtcattgtttgg

SEQ ID NO: 36020 - DNA, 50 bp, homo sapien
ttttattctagttctgtccttgaaakctaagaaacctgttctagttattt

SEQ ID NO: 36021 - DNA, 50 bp, homo sapien
aagaacaactgtacaaatgctgttaycaaaggatgtatgagtcaggcgga

SEQ ID NO: 36022 - DNA, 50 bp, homo sapien
aatgaaagaacagaaaggtactcagraatatataactgaaattacaaatt

SEQ ID NO: 36023 - DNA, 50 bp, homo sapien
gaatgaaggaaaagtagcttctgggycattgtaatcaagtgttttgtctg

SEQ ID NO: 36024 - DNA, 50 bp, homo sapien
aagttaaaattttcctgtaaacttayggaggattcattcatattgcaata

SEQ ID NO: 36025 - DNA, 50 bp, homo sapien
atttcctcataacttatatacggttsaaatcaccgaaataaatgagggca

SEQ ID NO: 36026 - DNA, 50 bp, homo sapien
tgatttgttattatttatattcatcrattcatgtcataatgccttccctc

SEQ ID NO: 36027 - DNA, 50 bp, homo sapien
atgtgtctctaccacttccaactgcragatacaacaatgcctatagcaag

SEQ ID NO: 36028 - DNA, 50 bp, homo sapien
tcgctgaacctggatgttttaagtayccaaggcaacagacatttcaagct

SEQ ID NO: 36029 - DNA, 50 bp, homo sapien
aacaacaacaacaacagaactctacrgccatgttaggaagaaactatttt

SEQ ID NO: 36030 - DNA, 50 bp, homo sapien
taatgactaaattttagttgcaaacmaatttttcattggaacccaagtaa

SEQ ID NO: 36031 - DNA, 50 bp, homo sapien
agatttgtgttttaatgattacaccrggtcagtatgaggaatgaattaaa

SEQ ID NO: 36032 - DNA, 50 bp, homo sapien
ttttgatacatcaggttgaacctcaragatggtggacagtagtatatgat

SEQ ID NO: 36033 - DNA, 50 bp, homo sapien
taaaatattatttgattcatgggaawtattacttgccatttaaaatatta

SEQ ID NO: 36034 - DNA, 50 bp, homo sapien
ataaaacaaaacaaaacagttatccmatacacagagattgagagaaaaca

SEQ ID NO: 36035 - DNA, 50 bp, homo sapien
caatctaacaatatagactcacccamattaatgccaaatatacttcctgt

SEQ ID NO: 36036 - DNA, 50 bp, homo sapien
tacacaggactttatagaatacagcrgaggaaatgaaaatcaaaaagaaa

SEQ ID NO: 36037 - DNA, 50 bp, homo sapien
agatttaaccttcattcgcttattcragattcctaaatcttgaataatga

SEQ ID NO: 36038 - DNA, 50 bp, homo sapien
atttacacctagtttctcatagatcrcttgctttcttttcacagccaagc

SEQ ID NO: 36039 - DNA, 50 bp, homo sapien
taaatctatacccttggaattgaagraaagttctagccctgtgtctgcac

SEQ ID NO: 36040 - DNA, 50 bp, homo sapien
tgacccaggcaggcatttggccttasatgacaaaaattaaattccaacaa

SEQ ID NO: 36041 - DNA, 50 bp, homo sapien
caaattaggtagttcgtcctagatcmaggagatgtctcctctactctcaa

SEQ ID NO: 36042 - DNA, 50 bp, homo sapien
caagacaccctgtgataccctactcrcaatgacttagtgtcctgaatgtt

SEQ ID NO: 36043 - DNA, 50 bp, homo sapien
ttattttcctcatcagtagaataagrataatgaaactacatatctcataa

SEQ ID NO: 36044 - DNA, 50 bp, homo sapien
aggggaaatattttcagactttctcrcagtgttcattatataatttgtcc

SEQ ID NO: 36045 - DNA, 50 bp, homo sapien
ttaatagctctctcacctgtggaccraaaagcatttgcggatatgggctg

SEQ ID NO: 36046 - DNA, 50 bp, homo sapien
gcctcttcagaatctcagcttgaacygataaaggtcgaacagcaagtttg

SEQ ID NO: 36047 - DNA, 50 bp, homo sapien
acagagaaacaggggcagagacccaytacaaagctgtctcagataggcat

SEQ ID NO: 36048 - DNA, 50 bp, homo sapien
tcaaataactatgtggtgagtgttaygtccatgatacaatttagaagggt

SEQ ID NO: 36049 - DNA, 50 bp, homo sapien
gtgcacagcctcctgaaccacctgcsattcctaataaggaacagatgggg

SEQ ID NO: 36050 - DNA, 50 bp, homo sapien
atcacaagtatcactcattaaacatraaattacatttgttgataactggc

SEQ ID NO: 36051 - DNA, 50 bp, homo sapien
ggaatatgagaggcatggtaaattamggtatttattgaatcctttctatg

SEQ ID NO: 36052 - DNA, 50 bp, homo sapien
ttttacatactggaaagtctcattamggatttcaagattaagaaattttc

SEQ ID NO: 36053 - DNA, 50 bp, homo sapien
attagaaaaatgtgcaatgtatgccyaaaaattctataataagggccagg

SEQ ID NO: 36054 - DNA, 50 bp, homo sapien
tgcaaataatttcatcaggagtaaaygtgaaaatggacctagagaattgt

SEQ ID NO: 36055 - DNA, 50 bp, homo sapien
tggggaagagtgagactattaaaaargatctaaatgtgtgtcgctgaaat

SEQ ID NO: 36056 - DNA, 50 bp, homo sapien
tctgtctccccaaatgtattctctaycacaaggactgccacagattctag

SEQ ID NO: 36057 - DNA, 50 bp, homo sapien
gtatgtaatgacacctggtagactcrataaatacgtattcagtgaataaa

SEQ ID NO: 36058 - DNA, 50 bp, homo sapien
aaagtttaataattttttataaacargtctgccatcactacttgctaaaa

SEQ ID NO: 36059 - DNA, 50 bp, homo sapien
tttaccgtgtgttttttaactgtgargatcagcaataaaccccttaaaat

SEQ ID NO: 36060 - DNA, 50 bp, homo sapien
tttttgaggcttctttggttcctcaraatgaccaagcactccatgtatat

SEQ ID NO: 36061 - DNA, 50 bp, homo sapien
ggttatgggcaggtctgtgatttcarcttggtatcattgcccagattggt

SEQ ID NO: 36062 - DNA, 50 bp, homo sapien
aaaagcatgtcaatacctaggagacratagatgagtgctttcattcccaa

SEQ ID NO: 36063 - DNA, 50 bp, homo sapien
agagagagtaattttattatctgtgracattgatatgtaatacttaccaa

SEQ ID NO: 36064 - DNA, 50 bp, homo sapien
aagtttggtcaaatttggatgcttayaattttgattcacatcttagaagt

SEQ ID NO: 36065 - DNA, 50 bp, homo sapien
aatatatatgctacttcattacttcrctgtagtccccacttctcaatgtc

SEQ ID NO: 36066 - DNA, 50 bp, homo sapien
tggttaacactcaggctagaagatargaccacaaaaaataagtcagctgc

SEQ ID NO: 36067 - DNA, 50 bp, homo sapien
tatgaaaagactttagagaactctgraaataccatgaattaatgccatga

SEQ ID NO: 36068 - DNA, 50 bp, homo sapien
atacaactagttgcattattattccsagatccaatttctgtactacctct

SEQ ID NO: 36069 - DNA, 50 bp, homo sapien
agcaatattgaaaaatctgtattatsaggaaacaccaccaaagctgctgg

SEQ ID NO: 36070 - DNA, 50 bp, homo sapien
tacaatgattagaatatattcagcakaatgacattgcaacagagttataa

SEQ ID NO: 36071 - DNA, 50 bp, homo sapien
aatatacatgtcaaaccacatacaarccaaattgtgcagagggagaaaca

SEQ ID NO: 36072 - DNA, 50 bp, homo sapien
acgcattatttgaatacactccagcrattggtaaatttaaagcaatgtat

SEQ ID NO: 36073 - DNA, 50 bp, homo sapien
taggattatttatacctggtacaaaytcaaagtacaagattttgtaaaag

SEQ ID NO: 36074 - DNA, 50 bp, homo sapien
tcttcagctgcattgtttctatcacygagcactattcatgtcactcctga

SEQ ID NO: 36075 - DNA, 50 bp, homo sapien
gggaggtatgtgtgatgcatgttaarataaaagtaaagctgctcaatgga

SEQ ID NO: 36076 - DNA, 50 bp, homo sapien
ggctcacgtgtcatctgtaaagcatratgactaatttgaaagaaagatgg

SEQ ID NO: 36077 - DNA, 50 bp, homo sapien
agaaagatggtttcaaagtacaagcmatggaaggtacgtagggcatgtgg

SEQ ID NO: 36078 - DNA, 50 bp, homo sapien
agtagagaactacaaagtagtgtaaragttgcaattaagcatgaggcaac

SEQ ID NO: 36079 - DNA, 50 bp, homo sapien
ctgaggtttgtactactaaataatarcacattaataattccccattctag

SEQ ID NO: 36080 - DNA, 50 bp, homo sapien
ttctctctatgtctaaagtcaatacrgtaagattcttctttctcaagtag

SEQ ID NO: 36081 - DNA, 50 bp, homo sapien
aaaatagagttcttcttaaatatcaytctttgctgtttttagatttcttc

SEQ ID NO: 36082 - DNA, 50 bp, homo sapien
ttacttcaacacaaatgctaactgcrgataactctcatgggttaatatgg

SEQ ID NO: 36083 - DNA, 50 bp, homo sapien
atggttcattgattttcagggaacakatctacttcaatacaaaaattagc

SEQ ID NO: 36084 - DNA, 50 bp, homo sapien
tgcatttcaagacaaaaaactaaccrctggctgacacacctgagcaaaag

SEQ ID NO: 36085 - DNA, 50 bp, homo sapien
atgccgtctataagaaagaaacagasaaatcgagtaatatgatttagaaa

SEQ ID NO: 36086 - DNA, 50 bp, homo sapien
agtgctaatgtgatattatcacaaaygtagtgcttctctatctaccgttt

SEQ ID NO: 36087 - DNA, 50 bp, homo sapien
ctgcattttatccttagctcatctayaatacctaaaacagagccttttac

SEQ ID NO: 36088 - DNA, 50 bp, homo sapien
gtgcagaagaaacctagatggcaccragttaaaggcagaacagaaggaga

SEQ ID NO: 36089 - DNA, 50 bp, homo sapien
acccccaaaaagtctaattcagaccygggatagcttaggctgatactcag

SEQ ID NO: 36090 - DNA, 50 bp, homo sapien
ggaacagctggttccaaggtaagctraactactgcttaattcatatctgc

SEQ ID NO: 36091 - DNA, 50 bp, homo sapien
tcagactaacataataataaaaaacratgtaaaacagaatttttttctta

SEQ ID NO: 36092 - DNA, 50 bp, homo sapien
aaatactctatcatggaataaaacayaccagggacaccatttgccaccta

SEQ ID NO: 36093 - DNA, 50 bp, homo sapien
ctaagcttttgcaaatgtcataaacrgctattgaatgtagtcagttactt

SEQ ID NO: 36094 - DNA, 50 bp, homo sapien
ttactacttttgtaaaacacaactcrccttactccaacttcatagaaact

SEQ ID NO: 36095 - DNA, 50 bp, homo sapien
caatccaatactcatagtgggcttayggtgtacccggcacttttccaaac

SEQ ID NO: 36096 - DNA, 50 bp, homo sapien
tccagaggtagggaaaacagtcagaygtgaagtgattggggctttcatca

SEQ ID NO: 36097 - DNA, 50 bp, homo sapien
tgacagttgggatctcttatcagtaytaacattctattttgttttgtgtg

SEQ ID NO: 36098 - DNA, 50 bp, homo sapien
tcccttttactatgaaattttactayggaatcactttacagtcttatatt

SEQ ID NO: 36099 - DNA, 50 bp, homo sapien
ctactgaagaatatatttttgttgarggattatttatatcaagtgttagt

SEQ ID NO: 36100 - DNA, 50 bp, homo sapien
gtcttggttttctagacaatgatggkaaaattgagttccagaagttgtac

SEQ ID NO: 36101 - DNA, 50 bp, homo sapien
tgtgtcatgaacttaataggacagamtaaaagctgatttgtgctatgcta

SEQ ID NO: 36102 - DNA, 50 bp, homo sapien
ttaccacattatccaactgtacaaarcactgtcccatacattatcccctt

SEQ ID NO: 36103 - DNA, 50 bp, homo sapien
cacagttggtgagcggaattcattaratattatccacgtacatacagaac

SEQ ID NO: 36104 - DNA, 50 bp, homo sapien
aagaggtcatcagaagtcttgagaasatgccgaggccagaaaagcacagg

SEQ ID NO: 36105 - DNA, 50 bp, homo sapien
gagaaagtcaaatgtttggcacaggracataaaacactgtaagcagggac

SEQ ID NO: 36106 - DNA, 50 bp, homo sapien
cttaaagaaaaagacacttgccctargtcaacaaagtttatttcagaata

SEQ ID NO: 36107 - DNA, 50 bp, homo sapien
taaggatttcaagtcacaggtcccaytacagttaatatagtttccaatgt

SEQ ID NO: 36108 - DNA, 50 bp, homo sapien
tgactttgtggaagcagagtatttcrattagggttttgatggaagggaga

SEQ ID NO: 36109 - DNA, 50 bp, homo sapien
tagcacatgaaatcttcagtgtttaygggctattgagttagtgactataa

SEQ ID NO: 36110 - DNA, 50 bp, homo sapien
ctgatagattgtaagcaagcaaatartatgatcagattttcagtaactcg

SEQ ID NO: 36111 - DNA, 50 bp, homo sapien
tcctaaggagactggacaaacaccamtcttgtttctaggataaagggtct

SEQ ID NO: 36112 - DNA, 50 bp, homo sapien
aaaattatttagtttggagtatctaygaagttcatctttttgctcattcc

SEQ ID NO: 36113 - DNA, 50 bp, homo sapien
gtatcaacttatatggatattcttascatcggaaaaagttccttgagaaa

SEQ ID NO: 36114 - DNA, 50 bp, homo sapien
tgaaatcttaggagttctagggctcmgagcaagatatttttaagacagga

SEQ ID NO: 36115 - DNA, 50 bp, homo sapien
atattgataaaaatcacagcattaarcattcaaaaatgatgtttttaata

SEQ ID NO: 36116 - DNA, 50 bp, homo sapien
atgatatgattacatgcaaactgtasaactctgtgaatatactcaaaact

SEQ ID NO: 36117 - DNA, 50 bp, homo sapien
gaagctcacatccactgggcagaaasgtgatttcattgctacagatttca

SEQ ID NO: 36118 - DNA, 50 bp, homo sapien
gttaaaataactctgagacaaaaagwattccataactgaaatcccataat

SEQ ID NO: 36119 - DNA, 50 bp, homo sapien
agattgaaaaacactgtgccaaaaartaatagtaaatcaagtgatcagta

SEQ ID NO: 36120 - DNA, 50 bp, homo sapien
atttcttcctgatacactccattgayggttttgtttcaaatggtgcaacc

SEQ ID NO: 36121 - DNA, 50 bp, homo sapien
cttccctgatacacactattagcaartaagaacttttttgaaggagagga

SEQ ID NO: 36122 - DNA, 50 bp, homo sapien
ggaatatggtgaatttaaagggatcracagtaaaataattgaatttataa

SEQ ID NO: 36123 - DNA, 50 bp, homo sapien
cacatttggtttctattgtttggaaktaatatttttgaaacagaaattgg

SEQ ID NO: 36124 - DNA, 50 bp, homo sapien
gggtgatgcacagccgtttgtgttgyactaagctctcaaggtgattctgg

SEQ ID NO: 36125 - DNA, 50 bp, homo sapien
aaccatacataggataatctcattcyactgtatgtcaacagaacaacctg

SEQ ID NO: 36126 - DNA, 50 bp, homo sapien
gatgatagagttaaggtgttatgacygaaatctataaaataaagaaatgg

SEQ ID NO: 36127 - DNA, 50 bp, homo sapien
tataataaattttcactctgttttcrctcttatctgatatgctctctatt

SEQ ID NO: 36128 - DNA, 50 bp, homo sapien
tactattgtgaaaataccagtataamatgtcaagggaaaagttgattcta

SEQ ID NO: 36129 - DNA, 50 bp, homo sapien
aatatttatttcaacacagtggatargagcaaactgttggaaacaatcaa

SEQ ID NO: 36130 - DNA, 50 bp, homo sapien
gtattttcaaataaaagccaaaatasagggcattgcaaattcacttagaa

SEQ ID NO: 36131 - DNA, 50 bp, homo sapien
ttaatttattactttaaggtgattayacaggcaatgcaaactaattcctt

SEQ ID NO: 36132 - DNA, 50 bp, homo sapien
acaaaaatattttctttgaagtgtaytaagttctgtgagtttcagaaata

SEQ ID NO: 36133 - DNA, 50 bp, homo sapien
cttgttctaggcactagactagcagratttattaaaagcatcaatagata

SEQ ID NO: 36134 - DNA, 50 bp, homo sapien
agggactgtagcttaaaaataactgraactcagaccatattaaccagatt

SEQ ID NO: 36135 - DNA, 50 bp, homo sapien
tcaaggtccttcatttccagggtgaraagtgtgtagttaattctaaggca

SEQ ID NO: 36136 - DNA, 50 bp, homo sapien
aaaaaatggcattttcaggagtgatragaacttcagggtgtctggtgtgt

SEQ ID NO: 36137 - DNA, 50 bp, homo sapien
cagagattctcatgtgagaattgccygaatatctgctttaatgaatccaa

SEQ ID NO: 36138 - DNA, 50 bp, homo sapien
taagaaagaaatgtctctatccatcwcctacgagtctgtagaaaatttac

SEQ ID NO: 36139 - DNA, 50 bp, homo sapien
gcctgggtagaagcagatttaagtgsaaagtaacaatgagagtgtgaaat

SEQ ID NO: 36140 - DNA, 50 bp, homo sapien
cctatgattatcatgtactgaggaasaaactaaatgaattaactccaata

SEQ ID NO: 36141 - DNA, 50 bp, homo sapien
cacactcattttaaaacaattagaarcataccgtcagaaaagtaccaaac

SEQ ID NO: 36142 - DNA, 50 bp, homo sapien
cttagaattaagatctacaggagaakgcaagtctagaacaggacaaaaga

SEQ ID NO: 36143 - DNA, 50 bp, homo sapien
ggaaaaaattatgacaaattatgctyaagttagagtttaggcaaaatcct

SEQ ID NO: 36144 - DNA, 50 bp, homo sapien
tcatacctttgttcttgttttgtccrcatgtatctgcaactaagatggta

SEQ ID NO: 36145 - DNA, 50 bp, homo sapien
catatagtaaaatttgttggaacaaytgtcataatttaagtggactgtta

SEQ ID NO: 36146 - DNA, 50 bp, homo sapien
attacatttctgaaagtggaactcawaacaagattagcaatagggatatg

SEQ ID NO: 36147 - DNA, 50 bp, homo sapien
agggtgggtctggtttaggagaaccrgatttgatttggtacctacaacac

SEQ ID NO: 36148 - DNA, 50 bp, homo sapien
agatgaatgactttaaacaatttcawataattcactaagtatttctggaa

SEQ ID NO: 36149 - DNA, 50 bp, homo sapien
ctaggttagtgaagaaaatgcattcratggccagtctgcattccagcagc

SEQ ID NO: 36150 - DNA, 50 bp, homo sapien
taaaactattaagaatctaagaaaargtaatcctgaaatatagtggtacg

SEQ ID NO: 36151 - DNA, 50 bp, homo sapien
caaatgctatagggacaacaacttcraattaacccaaggatctaaataat

SEQ ID NO: 36152 - DNA, 50 bp, homo sapien
ttaccactattaagctatcatttagraagattgtagatatcaaagattta

SEQ ID NO: 36153 - DNA, 50 bp, homo sapien
gaaaccacctgaaacagcgctattayaggaggtgactacttttaagtcaa

SEQ ID NO: 36154 - DNA, 50 bp, homo sapien
attattttttccttaggaatttgcaracacttctggatgatgaaggtgat

SEQ ID NO: 36155 - DNA, 50 bp, homo sapien
taagacctattcaacttccaggacasgattttgtttgcttgtgtgtgttt

SEQ ID NO: 36156 - DNA, 50 bp, homo sapien
caggcagtgacatgtgtactggccaytgctagaagagcgtcttcaaataa

SEQ ID NO: 36157 - DNA, 50 bp, homo sapien
tggaaacctgggtttcctgccaccasatttccaatttattccagtggagg

SEQ ID NO: 36158 - DNA, 50 bp, homo sapien
catgtttcaagatgagttgttcttayatggaataatttgctcagtcatgg

SEQ ID NO: 36159 - DNA, 50 bp, homo sapien
tcatttacaatacacatttttgttargattaaatgctgtaattcttatga

SEQ ID NO: 36160 - DNA, 50 bp, homo sapien
actagtccacctggctatacattgaraagactgcttagcacttattaggg

SEQ ID NO: 36161 - DNA, 50 bp, homo sapien
atcaatctagcactacattaaatggrccaagtacagtaaatatatagttt

SEQ ID NO: 36162 - DNA, 50 bp, homo sapien
catgatatggttctcagaggcctcamgtaaatttctcaaagggcagactg

SEQ ID NO: 36163 - DNA, 50 bp, homo sapien
ctctataatgaatggtattttaatarggcaatctttaactttctgtttca

SEQ ID NO: 36164 - DNA, 50 bp, homo sapien
gttctgtttggtgatttgacaaaagkaggtgattaaattcttgcaaaatg

SEQ ID NO: 36165 - DNA, 50 bp, homo sapien
acatcagttcttaagggttttaagcraattgtattctagataagaatatt

SEQ ID NO: 36166 - DNA, 50 bp, homo sapien
ttatacttacccgatgtcattcttaraagtcactcactcaaatggaaagt

SEQ ID NO: 36167 - DNA, 50 bp, homo sapien
caggatcagttcttccaaaccttgamcattactaaacttgaatacaaata

SEQ ID NO: 36168 - DNA, 50 bp, homo sapien
ttcggattgatggcagagtgcaggcyatatacattgacaattattccaga

SEQ ID NO: 36169 - DNA, 50 bp, homo sapien
agtgcatcccgtcttttacgatggcyatacaacatcacacaaatcaaggt

SEQ ID NO: 36170 - DNA, 50 bp, homo sapien
agtctagcaattagagaattcaaaastcagaaaagcaaatttaacaactt

SEQ ID NO: 36171 - DNA, 50 bp, homo sapien
tagagtaattacattgtgttagacastaaactaagtacttgcaactcatt

SEQ ID NO: 36172 - DNA, 50 bp, homo sapien
acagcaacaacagcaaaatactaccrgccaatgtcactcttgatataaat

SEQ ID NO: 36173 - DNA, 50 bp, homo sapien
gtttaaagtgtttatgggatgttaaytgactaaatttgaaaatgagatta

SEQ ID NO: 36174 - DNA, 50 bp, homo sapien
taaatagctgatgaaattaaaaatcygagttaagtaatttatgtaacatt

SEQ ID NO: 36175 - DNA, 50 bp, homo sapien
accacaattctaatcagagaagacartgcagttccacacatacaaaacta

SEQ ID NO: 36176 - DNA, 50 bp, homo sapien
atattttgaaatgttatctttaatcwcatatgttttgtttcatcacatgt

SEQ ID NO: 36177 - DNA, 50 bp, homo sapien
cttgatttgttggttgaagaataaargttctcatgcaaattacattctgt

SEQ ID NO: 36178 - DNA, 50 bp, homo sapien
tgatttttaaatatccctcatcatarggactggttgtagagacactagag

SEQ ID NO: 36179 - DNA, 50 bp, homo sapien
tttataaataggcagaatgataggawaagtcatgatgtaattctactaca

SEQ ID NO: 36180 - DNA, 50 bp, homo sapien
gtactctcaaattctacttctaaaayaagactgtgctcattccataatca

SEQ ID NO: 36181 - DNA, 50 bp, homo sapien
aaatatttctggagacttcatactastaaattatcagcaagtgtaggtga

SEQ ID NO: 36182 - DNA, 50 bp, homo sapien
gaaagcaagctaaattgcaacaacawattgatttaacatttaaatacaag

SEQ ID NO: 36183 - DNA, 50 bp, homo sapien
attttttttaatcttaattcttaccrccaaactgcttgacctaaaattat

SEQ ID NO: 36184 - DNA, 50 bp, homo sapien
tttatatactttataagcactaaaawtatgtagattatgatttgcattct

SEQ ID NO: 36185 - DNA, 50 bp, homo sapien
gagagcaaatgagactttaaaggacygtaactacatttaactacattttg

SEQ ID NO: 36186 - DNA, 50 bp, homo sapien
cagacccacagatacacaatattaasacacctgatcccaagcactatatg

SEQ ID NO: 36187 - DNA, 50 bp, homo sapien
tcgggtctattttatggtaatgtackatttgtcggagtgtcaaaatgact

SEQ ID NO: 36188 - DNA, 50 bp, homo sapien
tagtacattaccataaaatagacccraaagactgatgttttccaaattat

SEQ ID NO: 36189 - DNA, 50 bp, homo sapien
ttatgatatctgaatagctaggtaaytagaaaataaaaggttgtcttttt

SEQ ID NO: 36190 - DNA, 50 bp, homo sapien
tgtatgatgggaaccagggcagaaaytaaatatagatttttaaaaattat

SEQ ID NO: 36191 - DNA, 50 bp, homo sapien
tataatcgagaaaaaatgtaatcaayataagtaagcccagttatagaata

SEQ ID NO: 36192 - DNA, 50 bp, homo sapien
ttgttgtccagaacactggagtaatractaataattcagtctgtcttaga

SEQ ID NO: 36193 - DNA, 50 bp, homo sapien
tcaagaagtacttgtttaaatcccawgtcttaagataatttgcctgtcct

SEQ ID NO: 36194 - DNA, 50 bp, homo sapien
ctatcacatcaccctatttcagtcayaaaacagtgctggtcatagagaag

SEQ ID NO: 36195 - DNA, 50 bp, homo sapien
ggctgggtgaccagttttggttgggwatccagagattgtctttttgtaga

SEQ ID NO: 36196 - DNA, 50 bp, homo sapien
ccttttgttttgtttccaggtagagraaatgttcagtgcaaaagttcaaa

SEQ ID NO: 36197 - DNA, 50 bp, homo sapien
tatcatctaattgcttaaatatataygctggagtaaaaaggtaacttctg

SEQ ID NO: 36198 - DNA, 50 bp, homo sapien
cacacactgtaacctctagataagcrcctgtccagaggttctcaatcaga

SEQ ID NO: 36199 - DNA, 50 bp, homo sapien
ggaggttctcaataaacatgtgctgmattatgagatctgacaacattgtc

SEQ ID NO: 36200 - DNA, 50 bp, homo sapien
gctctcttcatttgtttttctttcargcaacgtctatttaaattagtagc

SEQ ID NO: 36201 - DNA, 50 bp, homo sapien
gttatatataggatgattggagacaytcctaaagacaatgaggcactagc

SEQ ID NO: 36202 - DNA, 50 bp, homo sapien
acaaactgacaataggttcaccaaasttaagagacgaatttaagggggac

SEQ ID NO: 36203 - DNA, 50 bp, homo sapien
ttccaagttacagaatactaactaasagtggcttaagcccttgctactca

SEQ ID NO: 36204 - DNA, 50 bp, homo sapien
tcatagcatatcaaatagagtttaaratggacaattactgtgcatacttg

SEQ ID NO: 36205 - DNA, 50 bp, homo sapien
ccacagaaatgatatttgaataaaayaagtttcctactcttgggttatta

SEQ ID NO: 36206 - DNA, 50 bp, homo sapien
agattaatgactgttcatggtagaarattcaaattgcatgaaaagactct

SEQ ID NO: 36207 - DNA, 50 bp, homo sapien
cccactatacctgagttatcagaaawgacaagaatcaagctcacttctga

SEQ ID NO: 36208 - DNA, 50 bp, homo sapien
gccatgttatcttgttggttagcacrattatgcaaacaagttgctcagtg

SEQ ID NO: 36209 - DNA, 50 bp, homo sapien
ctaacaggaacttggtatatttctaygtccataccaaagaaacttccacc

SEQ ID NO: 36210 - DNA, 50 bp, homo sapien
ggcctacccactaagagagagaacaytgataaaggaccagatttacgggt

SEQ ID NO: 36211 - DNA, 50 bp, homo sapien
atagttactatgtaagcaaaagtacrgacgcatataacagataaaatttg

SEQ ID NO: 36212 - DNA, 50 bp, homo sapien
tcacagaattaagagtgcatagaaayggagaggaaaggaaacagcctttc

SEQ ID NO: 36213 - DNA, 50 bp, homo sapien
gactcttctgctatagcaagctcagmataaataacctttgcttttctcat

SEQ ID NO: 36214 - DNA, 50 bp, homo sapien
aagctttctctctcaatttattccartagggcataatttctttatgatgt

SEQ ID NO: 36215 - DNA, 50 bp, homo sapien
cattgttgactctctggtgttccagsattgcggcgactcagcattttatc

SEQ ID NO: 36216 - DNA, 50 bp, homo sapien
attcagtgccctcaaccatcagtgaragttaatcattgcactttcctctt

SEQ ID NO: 36217 - DNA, 50 bp, homo sapien
aggtcctgtcactgtatgatttggartaagttccttcagcgtgctcatct

SEQ ID NO: 36218 - DNA, 50 bp, homo sapien
tataccgggaaaaggagctcttggaracaagaaaaaaagtagagaataca

SEQ ID NO: 36219 - DNA, 50 bp, homo sapien
aagaaggacttgcaataccagatacragaatgcattattaaaatattgtg

SEQ ID NO: 36220 - DNA, 50 bp, homo sapien
tgttactagatagttatgtgaaaatwatagatacagaaaaaaattgagtg

SEQ ID NO: 36221 - DNA, 50 bp, homo sapien
tgggctatacaaagtgtcagcgtcamacccattgacatgtgaagggctgc

SEQ ID NO: 36222 - DNA, 50 bp, homo sapien
gcatgagatacacagtagaaacaccmgaaacatattcttccatttttgaa

SEQ ID NO: 36223 - DNA, 50 bp, homo sapien
gtaactttgtaaactaatattctgtyaaacttggcgatttgttttttttg

SEQ ID NO: 36224 - DNA, 50 bp, homo sapien
taatctagcagatttgtatcagaacygaaatagcatatactatggggaaa

SEQ ID NO: 36225 - DNA, 50 bp, homo sapien
agcccacagaagccaccgaatatcawcctctctccttagttaggtatttt

SEQ ID NO: 36226 - DNA, 50 bp, homo sapien
ttttcctctttccaacttttcatgayactataaaaagaaatggaatggat

SEQ ID NO: 36227 - DNA, 50 bp, homo sapien
ataatctttcctcctactggattacyattagaattgtgaaacaattgaat

SEQ ID NO: 36228 - DNA, 50 bp, homo sapien
cagaagcaactagtcttagaaaggayatactttactttgtacaccattgg

SEQ ID NO: 36229 - DNA, 50 bp, homo sapien
gggcatatgaatcccaactcagagayaccaaggtgcaaagtcagagagaa

SEQ ID NO: 36230 - DNA, 50 bp, homo sapien
tgagtgccaagctttcttgtctatakgttaatgatgtccgttctgtaatc

SEQ ID NO: 36231 - DNA, 50 bp, homo sapien
agaaccaatttaaattactttcagcyctgatgagaaatgggaagagactg

SEQ ID NO: 36232 - DNA, 50 bp, homo sapien
tctgcgtttccagatctaaagtgcaktagcgctctcagcacttagctgat

SEQ ID NO: 36233 - DNA, 50 bp, homo sapien
atttagggagggtaagttggaggcakaattaaatgtaaaacttggattca

SEQ ID NO: 36234 - DNA, 50 bp, homo sapien
gtgccctccctaagagcacataccasaatcacctgtgaggctttctcagc

SEQ ID NO: 36235 - DNA, 50 bp, homo sapien
tgataactggttgtgtattgttttgratgctttactactactggaattgt

SEQ ID NO: 36236 - DNA, 50 bp, homo sapien
cgcattatttgtatttaggatatackcaggaacattttacatttgtctct

SEQ ID NO: 36237 - DNA, 50 bp, homo sapien
agtagtatcctgtatcctgatagtgycacaatttgcttttccattctcta

SEQ ID NO: 36238 - DNA, 50 bp, homo sapien
ctgtcttgagccatcaccatctcacygacttcattcatggtgggctctat

SEQ ID NO: 36239 - DNA, 50 bp, homo sapien
ttatttgtagtgaagacgttctctargtaaccttgcctattctccacatg

SEQ ID NO: 36240 - DNA, 50 bp, homo sapien
agtgttaagtggttgattctgcctgyaatcttagagcttgaataatattt

SEQ ID NO: 36241 - DNA, 50 bp, homo sapien
aaaagaatattataactctcctgtawcacaaattaaactgaaataattta

SEQ ID NO: 36242 - DNA, 50 bp, homo sapien
cttagggtctctttctaggcatacayataaccatcttcccacattggatc

SEQ ID NO: 36243 - DNA, 50 bp, homo sapien
cttgaagtgaaggcacctgtcatcawtctttttgtaaatggttgatttga

SEQ ID NO: 36244 - DNA, 50 bp, homo sapien
tagctatcatagaagttatacctccratcaaatcaaccatttacaaaaag

SEQ ID NO: 36245 - DNA, 50 bp, homo sapien
ctcctggtgggccttttgaaataaaygctccatcttaaaaatgccaggac

SEQ ID NO: 36246 - DNA, 50 bp, homo sapien
cattggagcaccggaaggagacgcgragccgaggccaggccttccggcgg

SEQ ID NO: 36247 - DNA, 50 bp, homo sapien
gcttaatggttttaagaccctaagaratggtttacatcaggacttgggaa

SEQ ID NO: 36248 - DNA, 50 bp, homo sapien
aattttgctcatatttggatgagaawaccataaggacatacattaaaatc

SEQ ID NO: 36249 - DNA, 50 bp, homo sapien
ctaagactatttccaataaactggaygtagtaaaaggattttcctaggga

SEQ ID NO: 36250 - DNA, 50 bp, homo sapien
gctcagaagaagtaatgtctcctacyagaattcgaaagaaagtctctact

SEQ ID NO: 36251 - DNA, 50 bp, homo sapien
aaattgccaacacaacattcacaaaycctcttaacttgcatctccagcct

SEQ ID NO: 36252 - DNA, 50 bp, homo sapien
taaatttgagttataataaaggaacratgtgagaacaaagttgttagaac

SEQ ID NO: 36253 - DNA, 50 bp, homo sapien
ctccacaaggaaggagtcttattctkactgagatctaagaatagcctatt

SEQ ID NO: 36254 - DNA, 50 bp, homo sapien
ctagccaacatctcatcttccaaaastttattgacatacctcatttcccg

SEQ ID NO: 36255 - DNA, 50 bp, homo sapien
tttcctaggtttagatttgatcctcratgtcttagatactgtccactgat

SEQ ID NO: 36256 - DNA, 50 bp, homo sapien
gaatttgctgaccgtctctatgccaratatcaccacttttacaaatgcag

SEQ ID NO: 36257 - DNA, 50 bp, homo sapien
aatcaccctgatactgaaacattgcrgaaataatattgcaacattatctt

SEQ ID NO: 36258 - DNA, 50 bp, homo sapien
ccaattaactaaattgcacatcatayacaaagtgatatttgggaagatgg

SEQ ID NO: 36259 - DNA, 50 bp, homo sapien
tcctgaatcccctttcattctccccrctcaaataattgatcacgactaga

SEQ ID NO: 36260 - DNA, 50 bp, homo sapien
tgttgaggattactacagaaaattawatttcaggattgtttttcttggtt

SEQ ID NO: 36261 - DNA, 50 bp, homo sapien
ggctcatccctcactttcccttttaygtgcctgcattgcttgggtaattt

SEQ ID NO: 36262 - DNA, 50 bp, homo sapien
ggtaaggatttggtaagtactatacmgaaatacttaacatacttcatttc

SEQ ID NO: 36263 - DNA, 50 bp, homo sapien
agaacccactatatcagagttcctcrataatccacgtaaatttggctctg

SEQ ID NO: 36264 - DNA, 50 bp, homo sapien
tttcaaatgttttaatagacaaagaygcaatgtaaaattttcttagaaag

SEQ ID NO: 36265 - DNA, 50 bp, homo sapien
caattcattgttaatatgcctgttaycatagtagtgttgttttggcattg

SEQ ID NO: 36266 - DNA, 50 bp, homo sapien
acctccacatctcatccttcatggcmaatgagtctgtttggagtttattt

SEQ ID NO: 36267 - DNA, 50 bp, homo sapien
ttgtgttgtttctttggttactatcraggatcaacatgcttgcatatatg

SEQ ID NO: 36268 - DNA, 50 bp, homo sapien
tttattttttacatttttctacatgsactgaaggtcaaaagagttcttag

SEQ ID NO: 36269 - DNA, 50 bp, homo sapien
cataaagacctcaggcaaacagataygaaaactggtagggtccctgttga

SEQ ID NO: 36270 - DNA, 50 bp, homo sapien
aaaatgtcaaagttaatatagtttcyacataaagacctcaggcaaacaga

SEQ ID NO: 36271 - DNA, 50 bp, homo sapien
agaaagtatatgacaatttctaataygggacactgtggtaagaccaaaat

SEQ ID NO: 36272 - DNA, 50 bp, homo sapien
tagaataatcattttataccgaaaayggagtaagttctataaattctatc

SEQ ID NO: 36273 - DNA, 50 bp, homo sapien
tagtgttctttttattatggtgtaaygagtttctagtctacctgaaatat

SEQ ID NO: 36274 - DNA, 50 bp, homo sapien
tagaagtcagattttaaaatggaagraattgtagagactgtgttcatgaa

SEQ ID NO: 36275 - DNA, 50 bp, homo sapien
cagattgtgactgactagataaagargattgagactagcattaaaaaaaa

SEQ ID NO: 36276 - DNA, 50 bp, homo sapien
tctgcccaactctttaaacttgtccrattaattatttggctctcactgtt

SEQ ID NO: 36277 - DNA, 50 bp, homo sapien
aaaatttaacagtagaaacatttgamgaaaacatggatatttatttataa

SEQ ID NO: 36278 - DNA, 50 bp, homo sapien
tgcaaatcaagactctatttaggtaraagtttcaagtcagagggcctgtt

SEQ ID NO: 36279 - DNA, 50 bp, homo sapien
ttttccacttgttccatgcagcctaygttattcttttcctcttttcatag

SEQ ID NO: 36280 - DNA, 50 bp, homo sapien
gaaggtttcagatgatctgtaacaasaaatttctccaagctaaaggagga

SEQ ID NO: 36281 - DNA, 50 bp, homo sapien
agctgtaggtactaaagccagatgargaatcccttaattatttgaaagta

SEQ ID NO: 36282 - DNA, 50 bp, homo sapien
aaaatgtgaacatcttttataaaaaktaggccactaaatctgatttcctt

SEQ ID NO: 36283 - DNA, 50 bp, homo sapien
ataaatatttagcttgtcataataartgtatcgatatatacttggcaaat

SEQ ID NO: 36284 - DNA, 50 bp, homo sapien
gaggtaacaataatattatctacaartgtcatatatatcaacacatgctt

SEQ ID NO: 36285 - DNA, 50 bp, homo sapien
tcagggtctaatcttacacatatgcsatttgaaaattaactatgttcttt

SEQ ID NO: 36286 - DNA, 50 bp, homo sapien
ttttaaactctccaactattattaastcaccagtattcaccttaaataat

SEQ ID NO: 36287 - DNA, 50 bp, homo sapien
gtatgatgcattattgctgtctgaartgaaattgaagtttgacacaccca

SEQ ID NO: 36288 - DNA, 50 bp, homo sapien
tggaaatcatagttaagttagataaygtaatcatagataagaaatcatag

SEQ ID NO: 36289 - DNA, 50 bp, homo sapien
ttgttttcttctaactcaatgataartgacagatgggatttgggataatg

SEQ ID NO: 36290 - DNA, 50 bp, homo sapien
atggtatgcaaacccaatggttagcrctgtgatattatccatatgtacat

SEQ ID NO: 36291 - DNA, 50 bp, homo sapien
ggtatagttgtatcaatgtggcctarccctttaactggagactccatagg

SEQ ID NO: 36292 - DNA, 50 bp, homo sapien
acctgaggtcaagtgagcacaagtcragtaacattaatgggacattgagg

SEQ ID NO: 36293 - DNA, 50 bp, homo sapien
ttattaggcataaagttaaaagagaygaaggatagggctaatatgttttt

SEQ ID NO: 36294 - DNA, 50 bp, homo sapien
gaaatcgtaggatcacgatgtccaamtctatataacaaattcagaccttt

SEQ ID NO: 36295 - DNA, 50 bp, homo sapien
gcaacacagtgaaataaatgttgtamgtaataacacacttaattcttacc

SEQ ID NO: 36296 - DNA, 50 bp, homo sapien
aaactcctcaatgtaaacactaaaamaattatttgagcttgaagtaaact

SEQ ID NO: 36297 - DNA, 50 bp, homo sapien
gaatagctcacataagctgaaaaaamtaatacctcaggctttgtttgtgg

SEQ ID NO: 36298 - DNA, 50 bp, homo sapien
atgatatattaaaataaatatggtaraaaacagccaaagtcaaacaattg

SEQ ID NO: 36299 - DNA, 50 bp, homo sapien
acatttggatttgctcctttaatacrctgccaaatactctcttagctcca

SEQ ID NO: 36300 - DNA, 50 bp, homo sapien
ctgctggagcataggcagcagcacgratgacaagaagtggatatttttcc

SEQ ID NO: 36301 - DNA, 50 bp, homo sapien
tagcatgttccctaacttaccctgayatagcacacttcaagcctcttgaa

SEQ ID NO: 36302 - DNA, 50 bp, homo sapien
agtaatggaagctgatacaaagttaraggaaaatagcagttggttaagta

SEQ ID NO: 36303 - DNA, 50 bp, homo sapien
actgccttagagtcctgtttaatcayatatagccaaaggaacttcaaatg

SEQ ID NO: 36304 - DNA, 50 bp, homo sapien
tgaggctcctaacaacagggatcccraaaagtcaatggagggagtgatta

SEQ ID NO: 36305 - DNA, 50 bp, homo sapien
ccatggctggtagtgattatgactaraattagaataaggatagcaaatgc

SEQ ID NO: 36306 - DNA, 50 bp, homo sapien
acgtgagaacagacagtacaacagayggaaagttccaggagaaagaagga

SEQ ID NO: 36307 - DNA, 50 bp, homo sapien
attacagagaaaatgagctgctacgraggagaactgaaaatatcccatta

SEQ ID NO: 36308 - DNA, 50 bp, homo sapien
tctacactgaagcaatgacagattcraataatttttatgaccactgaagc

SEQ ID NO: 36309 - DNA, 50 bp, homo sapien
tgataaaaattctgcttaatgaatcycttggtcaatgctttctgtttgat

SEQ ID NO: 36310 - DNA, 50 bp, homo sapien
taataaagctcctaacatctcatcaygcttatttgagaagaaactctact

SEQ ID NO: 36311 - DNA, 50 bp, homo sapien
taataaatgtatttatttaagattgsaataaaagtagagatcagggagct

SEQ ID NO: 36312 - DNA, 50 bp, homo sapien
aggatttaacatcctgtagtatatgwaatgggtagttaatttcagacatc

SEQ ID NO: 36313 - DNA, 50 bp, homo sapien
ttgtaacatctacatagtaactgaartaggtagactcaatctggaatgat

SEQ ID NO: 36314 - DNA, 50 bp, homo sapien
aaatatgagcaaaaattggattagcraagagggaaaaaattgtatctcaa

SEQ ID NO: 36315 - DNA, 50 bp, homo sapien
gatttcaacactccactgacaatatkagacataactttgaggcagaaaat

SEQ ID NO: 36316 - DNA, 50 bp, homo sapien
aatcccaaattcagtgactgtaaaakgtattaagactgtgtgtcttagga

SEQ ID NO: 36317 - DNA, 50 bp, homo sapien
atagtgttccctgaatgctgtatgawgtagtgcaagaagaatggaaattt

SEQ ID NO: 36318 - DNA, 50 bp, homo sapien
cttctcagtgctgggcaattgcttayacccttcagccacggaggctgagg

SEQ ID NO: 36319 - DNA, 50 bp, homo sapien
ccctttgtcagtgtgtaaatgaaaargaatgatcagtgtcttaatcatac

SEQ ID NO: 36320 - DNA, 50 bp, homo sapien
agaagacaccactccagctcagtcawtcttgtttaggacttgagcagaat

SEQ ID NO: 36321 - DNA, 50 bp, homo sapien
taccaaagccaaagaagtaaaaatgycactgccttaaatgttgacctacc

SEQ ID NO: 36322 - DNA, 50 bp, homo sapien
tgggatctggtagctaaaacagcgamatatgactgaactagtggaaaaac

SEQ ID NO: 36323 - DNA, 50 bp, homo sapien
gacttaaaaaaataaagcaggaacamgtttttcatttgctatgacattgc

SEQ ID NO: 36324 - DNA, 50 bp, homo sapien
ctttgcatcagcaataaggtgacaasaacattatgtgcctcacgttgtac

SEQ ID NO: 36325 - DNA, 50 bp, homo sapien
tttctaaaatagtagttttgattccrcattctgcaactcctggccaaata

SEQ ID NO: 36326 - DNA, 50 bp, homo sapien
gacaagattgatgggtgagtgcacaraaagagttgggtgccgctgtgggc

SEQ ID NO: 36327 - DNA, 50 bp, homo sapien
aatattgatcaacttgactcacagawattattaatgtaatcacacaagac

SEQ ID NO: 36328 - DNA, 50 bp, homo sapien
tacagatgttaccttttcaacaatasgtttatacatgctatatatactgg

SEQ ID NO: 36329 - DNA, 50 bp, homo sapien
tctgaatctattttgtctagtaaaawattgaagagctagagattagaaat

SEQ ID NO: 36330 - DNA, 50 bp, homo sapien
tttgaaaaaaaacctttacaatgtaygagaaatgacatagaaagatataa

SEQ ID NO: 36331 - DNA, 50 bp, homo sapien
gctaaaatgttggactatcataaaaycattttcaaagtgtgagacaagaa

SEQ ID NO: 36332 - DNA, 50 bp, homo sapien
tatgatgaatttatagatgcaaagaygattgacaaaagcctggcctttaa

SEQ ID NO: 36333 - DNA, 50 bp, homo sapien
cagtagagtggctgatttattatagrcgctgttcaataatttgtttttaa

SEQ ID NO: 36334 - DNA, 50 bp, homo sapien
catatttttagttactctcctatcayagcttaataattccttatactaga

SEQ ID NO: 36335 - DNA, 50 bp, homo sapien
tgtaagtttatcaacgcataaaagayaggacttgttgatttgttacctct

SEQ ID NO: 36336 - DNA, 50 bp, homo sapien
gtcaaaggtcatccagaacttcccasatacaggcacaaacaaactataag

SEQ ID NO: 36337 - DNA, 50 bp, homo sapien
agaagatggcaagagaagtactatcrcaaaaggaagtcagacgctaataa

SEQ ID NO: 36338 - DNA, 50 bp, homo sapien
taaaacaccaaaaaacaaagtaatayagttttgagtagaaaaagcaatac

SEQ ID NO: 36339 - DNA, 50 bp, homo sapien
agaaaccaaaaggaatctggttaaaygaagccaaatcactcacataatcc

SEQ ID NO: 36340 - DNA, 50 bp, homo sapien
tcatacagtgtctgctagttaagtgyatatatgtctgtttcctccacaga

SEQ ID NO: 36341 - DNA, 50 bp, homo sapien
attgaaaaaccagataatcgcagaaratgaacggatttttttaaagaaat

SEQ ID NO: 36342 - DNA, 50 bp, homo sapien
ccctgtaactttattgagtttaaaaygcttgaagcagattactgggtttc

SEQ ID NO: 36343 - DNA, 50 bp, homo sapien
acttattttgtattctataacatacragactgtaaagatgtgacagtgta

SEQ ID NO: 36344 - DNA, 50 bp, homo sapien
taggtggtttcagcagcaacgataartaatgcagaattcagctccagcac

SEQ ID NO: 36345 - DNA, 50 bp, homo sapien
ttatttcttaaacatgcactcaggasaatatatgaaaagtgagagatatt

SEQ ID NO: 36346 - DNA, 50 bp, homo sapien
aactgacttagcaccaaagaggtcayggtgacaagcctgggcctgatagt

SEQ ID NO: 36347 - DNA, 50 bp, homo sapien
gctctaatttctatgttaagcgttaygtttctgtagtacctttagtagct

SEQ ID NO: 36348 - DNA, 50 bp, homo sapien
tctcttgtgctgtcatgaagggtacrgatctatcattgactccaagacca

SEQ ID NO: 36349 - DNA, 50 bp, homo sapien
accacagtccagatttctcacagtaycttttgttcattttactgctcctt

SEQ ID NO: 36350 - DNA, 50 bp, homo sapien
cctagggtattcacacttgcccttcrcttctctaggaaggatatttcctc

SEQ ID NO: 36351 - DNA, 50 bp, homo sapien
aggcaactcaagcatatgtgcaaccragtacatgaaaagaatttgtatgt

SEQ ID NO: 36352 - DNA, 50 bp, homo sapien
tttcaaaagaaagacatgaaaagtarccaaatttctaaagtaagtcagca

SEQ ID NO: 36353 - DNA, 50 bp, homo sapien
ccgtgtggcacctagttttaactackctcatgatttctcatctgacattt

SEQ ID NO: 36354 - DNA, 50 bp, homo sapien
gaatcttatttttacgctacttactractgataattctattttattctaa

SEQ ID NO: 36355 - DNA, 50 bp, homo sapien
ttggaaaccgaggaaataggaaacasagtaaccaattaaagcaaaacatg

SEQ ID NO: 36356 - DNA, 50 bp, homo sapien
tgataccgaggcccaaagtcctaaaygtggaaactgaaaggagagccccc

SEQ ID NO: 36357 - DNA, 50 bp, homo sapien
agtgaggattaatatttgagtaatcygactacctgccagacactaatata

SEQ ID NO: 36358 - DNA, 50 bp, homo sapien
gatgagtaaatattaaaatgaggtastaatcagtcttgccaaagccagtg

SEQ ID NO: 36359 - DNA, 50 bp, homo sapien
ctaacagtaggtaatataagaacacygagaaaagtaggaaagtcttcatg

SEQ ID NO: 36360 - DNA, 50 bp, homo sapien
taccactatgttaatgcagggaaaasttgcacgtgtattattaaatatta

SEQ ID NO: 36361 - DNA, 50 bp, homo sapien
ttgtaataagtcagaaagggacatasgattcacatatcagactgttaggg

SEQ ID NO: 36362 - DNA, 50 bp, homo sapien
gtgagtatatttgtgttatctcttaygaatcttttggcagttaactctag

SEQ ID NO: 36363 - DNA, 50 bp, homo sapien
tactagataaaacagacacatggaargtatatagtttgttctgcacatca

SEQ ID NO: 36364 - DNA, 50 bp, homo sapien
gtgactccaatgtcttagaattgtcyatatatgaaatttatccttctaaa

SEQ ID NO: 36365 - DNA, 50 bp, homo sapien
aactgctggcttatttccaaggaaamgcaaatagaggttattgtgtacat

SEQ ID NO: 36366 - DNA, 50 bp, homo sapien
cagccccatgcacaactttgcttacyagttgtaatgatctttgagtttct

SEQ ID NO: 36367 - DNA, 50 bp, homo sapien
caagttgaatatgtgccaagattacratgtggtggccagcaacccaattt

SEQ ID NO: 36368 - DNA, 50 bp, homo sapien
tctctcagtggtgtaaacaaataacragacttaatgtaatgaatttaata

SEQ ID NO: 36369 - DNA, 50 bp, homo sapien
cttctctgcagactcttaggaaaaayattgcttgcctctaaccttaaggg

SEQ ID NO: 36370 - DNA, 50 bp, homo sapien
ttgccctgagcacataggtagtaaawagcagagctgaaactggaattcat

SEQ ID NO: 36371 - DNA, 50 bp, homo sapien
ggcttgctttacagtacaggttcacrggcttattcttcacaatataagct

SEQ ID NO: 36372 - DNA, 50 bp, homo sapien
gcatttttaacttggataaattgaamgtgtttacattaatgtctaatgtt

SEQ ID NO: 36373 - DNA, 50 bp, homo sapien
gaaaattgctatcctttatatctaaytgaaatcccacaggttattagaat

SEQ ID NO: 36374 - DNA, 50 bp, homo sapien
catggaaagatatatatgtttccaayttaaaagaactccaggagattcca

SEQ ID NO: 36375 - DNA, 50 bp, homo sapien
ttattcaacattttcaagccaaagawtatcaagcatgacaaaaattgaag

SEQ ID NO: 36376 - DNA, 50 bp, homo sapien
gtctaataactattcatgtttggaayggagctttgacaaaattctggtaa

SEQ ID NO: 36377 - DNA, 50 bp, homo sapien
gacaaaacaaattaggcagatgatamaacatttcgttttaaaaagtataa

SEQ ID NO: 36378 - DNA, 50 bp, homo sapien
cttccccatttgactcatttggttckcacttaagttttaaacatatttgc

SEQ ID NO: 36379 - DNA, 50 bp, homo sapien
atgacaagtctcttaaatgtatgtcyaacttatttgggaaattcatttgt

SEQ ID NO: 36380 - DNA, 50 bp, homo sapien
gcagtgatctaatgtttatattatcrccacatacagtggactgaatagca

SEQ ID NO: 36381 - DNA, 50 bp, homo sapien
tgtgataacgtgaatttttgtgtggwattattacattttccttttggacc

SEQ ID NO: 36382 - DNA, 50 bp, homo sapien
caaaaattgatacgacaaaacgctawgcacattctaatttttaaagaaat

SEQ ID NO: 36383 - DNA, 50 bp, homo sapien
ccaagctggttgctctctcttacaaygcttcattaatcaagtaccctttt

SEQ ID NO: 36384 - DNA, 50 bp, homo sapien
gaagtaatttttaaacatcagtcagyctgaaattaaactagttaaaaata

SEQ ID NO: 36385 - DNA, 50 bp, homo sapien
gaggtaattgttaaaagcatggacaragatgaaagacagtcactccctcc

SEQ ID NO: 36386 - DNA, 50 bp, homo sapien
atatcaaagatagataaagaggtaaktgttaaaagcatggacaaagatga

SEQ ID NO: 36387 - DNA, 50 bp, homo sapien
aactaaaggtggatatgccatgtacragagagtcttcaaaaagttcatag

SEQ ID NO: 36388 - DNA, 50 bp, homo sapien
ggtctaattactcagaaaataactcyaccagatgtcttcaaaatctcaag

SEQ ID NO: 36389 - DNA, 50 bp, homo sapien
ggcagctggcatatttacttaaaacratgaaccaagtgagctctcctttg

SEQ ID NO: 36390 - DNA, 50 bp, homo sapien
ataattaactttctagtttgtgttayacttctctttgcttaaaaaataaa

SEQ ID NO: 36391 - DNA, 50 bp, homo sapien
acaggagctaacaaaaatgctgtagragagagttattgtctcaggcttct

SEQ ID NO: 36392 - DNA, 50 bp, homo sapien
tggaggtgagacttagaataacccayggtcacaaagtttggtggagccag

SEQ ID NO: 36393 - DNA, 50 bp, homo sapien
gccaagagattaaaattacctttggracccatcagaaaattaatatatgt

SEQ ID NO: 36394 - DNA, 50 bp, homo sapien
gaacatatctcatagacacttctcayacaagtcatataagcagtggtcca

SEQ ID NO: 36395 - DNA, 50 bp, homo sapien
aaacacactgaatatgtcagcgatamattaaaaagtgtacaataatacag

SEQ ID NO: 36396 - DNA, 50 bp, homo sapien
aaacattttttaaacctcattgaaamctctattctttcaactcctccttc

SEQ ID NO: 36397 - DNA, 50 bp, homo sapien
atttcctggtcacagaagatctttarctttggagcatataaaagaatgtg

SEQ ID NO: 36398 - DNA, 50 bp, homo sapien
gaaatttaaaattagtgttacatcayagaagttaaggctaaaacaaaaat

SEQ ID NO: 36399 - DNA, 50 bp, homo sapien
gtaattatcgacgtgaaacgcaaacrcactcttcttttggaatgttctaa

SEQ ID NO: 36400 - DNA, 50 bp, homo sapien
tggtaaagaagatatatgactgtacyaaagttctaatattgtgtttttaa

SEQ ID NO: 36401 - DNA, 50 bp, homo sapien
tcaccacagcacggcaaagtgactayggccagactttctctctagattct

SEQ ID NO: 36402 - DNA, 50 bp, homo sapien
tttttaaaaactagaatagaaaataygatcaatgactttattaagctaat

SEQ ID NO: 36403 - DNA, 50 bp, homo sapien
tctcattctggtatctcatctaaaaygtctttcacatattttgctttcat

SEQ ID NO: 36404 - DNA, 50 bp, homo sapien
gaaatggacttcagggatctttcaayatagttcattctagtccaccaccc

SEQ ID NO: 36405 - DNA, 50 bp, homo sapien
gtggtctacaaaagtttaaagtcacractataagataaccttttattgtt

SEQ ID NO: 36406 - DNA, 50 bp, homo sapien
agaagttcaacacagtttataagtaygaaaaatcacaaacacttactttt

SEQ ID NO: 36407 - DNA, 50 bp, homo sapien
aatagacttattgcagagtagttaayaggtaaaggaagtgaaacatttta

SEQ ID NO: 36408 - DNA, 50 bp, homo sapien
gagtaagagccttatggtcaaataaygacttggcgtgaaactgcttcaga

SEQ ID NO: 36409 - DNA, 50 bp, homo sapien
agagcatcattgagaccatggagcarcatctgaagcagtttcacgccaag

SEQ ID NO: 36410 - DNA, 50 bp, homo sapien
tgtcaaatagctttctcctctccaaygtcctgcacgtgcctaatctcaac

SEQ ID NO: 36411 - DNA, 50 bp, homo sapien
aattatttcccaggcaatatttaccyacaattttgatgtctctcctgaca

SEQ ID NO: 36412 - DNA, 50 bp, homo sapien
gcttaacttggccaagtctgcttcaktcatctgtcaacaagattctaggg

SEQ ID NO: 36413 - DNA, 50 bp, homo sapien
gtcattgcggagagctcttctggatmaagaaaatgagattaacgtggcgt

SEQ ID NO: 36414 - DNA, 50 bp, homo sapien
acagagcagatcaagggaaattcaasaggtgaaattagcatgaactggtg

SEQ ID NO: 36415 - DNA, 50 bp, homo sapien
gacaagcttagaacactcttttcaarcccaaattaaatgcaggcaaattc

SEQ ID NO: 36416 - DNA, 50 bp, homo sapien
gatttattgtatcattcactgcataracttgactcaatggcttaagcttt

SEQ ID NO: 36417 - DNA, 50 bp, homo sapien
tatagttactagaggaaaatggtcaygtactcttggaattctaatctata

SEQ ID NO: 36418 - DNA, 50 bp, homo sapien
gtatgtattctgaaattgtatgtaamattttttggcctgaggtagagagt

SEQ ID NO: 36419 - DNA, 50 bp, homo sapien
attctcagccatttttatacacaagsctactctactcttaaagacatttt

SEQ ID NO: 36420 - DNA, 50 bp, homo sapien
acttctgtaccttagctatacatcawcctacattaaatactgcctcagga

SEQ ID NO: 36421 - DNA, 50 bp, homo sapien
atactatcagatatgatccaccaacragaaatatatttagtgacaagggc

SEQ ID NO: 36422 - DNA, 50 bp, homo sapien
tgagtctgctaaccagtgaaagaggmcacaggaaagctcctaagtagaga

SEQ ID NO: 36423 - DNA, 50 bp, homo sapien
cttgaaaatgtggactgatggttcamcataaaatacttgcagccaagttg

SEQ ID NO: 36424 - DNA, 50 bp, homo sapien
ttttttccttttctatcccaacaacratacatacaagtgaaacaacttag

SEQ ID NO: 36425 - DNA, 50 bp, homo sapien
attcaaagaaatgcaagaaagacaaygtggtgtaattaaataaggaaaat

SEQ ID NO: 36426 - DNA, 50 bp, homo sapien
tatgtttaaatgcaaaaaacaggatragatgccactttattcatcactgc

SEQ ID NO: 36427 - DNA, 50 bp, homo sapien
gacatataagagagtagcctcaattsaataatcctgtttccatcgtgtat

SEQ ID NO: 36428 - DNA, 50 bp, homo sapien
ggcacagccttgatgaaccttacaawctgctctcagtgagtggttctcat

SEQ ID NO: 36429 - DNA, 50 bp, homo sapien
aacttacgggaacagaatagttaacwcacagcagtaggcttagaaaatga

SEQ ID NO: 36430 - DNA, 50 bp, homo sapien
gtgagagatgtgactgtggaggaaawctaggtctttattaggacaaacct

SEQ ID NO: 36431 - DNA, 50 bp, homo sapien
tgaaacgtatgttggtagggctcgamgcaatgctaagccaagattttttt

SEQ ID NO: 36432 - DNA, 50 bp, homo sapien
tttaattgaaagtaagtcatcaaaakcccgttcacataggtcatttgatg

SEQ ID NO: 36433 - DNA, 50 bp, homo sapien
cagcttcttctccttcagtttctcartcgtgtctgtatcatccctaagtt

SEQ ID NO: 36434 - DNA, 50 bp, homo sapien
tttgttcctgagcagtaggtttcaayagcgggcttagtatacttagtaaa

SEQ ID NO: 36435 - DNA, 50 bp, homo sapien
ctttacttttaatcaactgccagtckctttacatcaataacaaagagaaa

SEQ ID NO: 36436 - DNA, 50 bp, homo sapien
aagctgttacaagcagataaagggaragcaattagaaagaactcctaaga

SEQ ID NO: 36437 - DNA, 50 bp, homo sapien
ttccatcaaagtattaggcatcatamaaagggaaagtaccataaattgat

SEQ ID NO: 36438 - DNA, 50 bp, homo sapien
ataagtttgaatgtggattgaataasagtgaattactaccaatcaatagg

SEQ ID NO: 36439 - DNA, 50 bp, homo sapien
attactatcccttctgaagactatawcctgtatgaagttcatattgaagc

SEQ ID NO: 36440 - DNA, 50 bp, homo sapien
tggatttacagaactccaacacttaygctggatccaggtttggaaattac

SEQ ID NO: 36441 - DNA, 50 bp, homo sapien
ggaaacattggccgatacaataaaayaagacaccatttgaaaagccaaag

SEQ ID NO: 36442 - DNA, 50 bp, homo sapien
gagttcagatcagctctatgaattaytaaatatctctcaaagcagatggg

SEQ ID NO: 36443 - DNA, 50 bp, homo sapien
aaaagggaagccatcctgttatatcrcttggagaatttctcttttcggca

SEQ ID NO: 36444 - DNA, 50 bp, homo sapien
tggctaggatttggatagtggaaaayaattaagaaggtagttcgccgggt

SEQ ID NO: 36445 - DNA, 50 bp, homo sapien
agctgagcacttctaacatggattayaaaaattaccctcattaacacttt

SEQ ID NO: 36446 - DNA, 50 bp, homo sapien
tttaaatgtgtaggtgttccttctayaatggatttagttaaatttaaaag

SEQ ID NO: 36447 - DNA, 50 bp, homo sapien
ttctcaacttgtatatatacttttcraattgagtctttacttacattatc

SEQ ID NO: 36448 - DNA, 50 bp, homo sapien
actcaggcagaatcctagaaaggaastgaaatttgatctgggcaattttt

SEQ ID NO: 36449 - DNA, 50 bp, homo sapien
gagcagtttactagtttctggataamccgggcctttattcttccctccct

SEQ ID NO: 36450 - DNA, 50 bp, homo sapien
gtctaagcatagtttccaatcagacrctttcagaagagttgcctatattc

SEQ ID NO: 36451 - DNA, 50 bp, homo sapien
acgtgtgtaagctacaagagtttcartacctttaagaagaagaggagggg

SEQ ID NO: 36452 - DNA, 50 bp, homo sapien
taacaacacagactgagggtttaacyactcataggctttcattgaaggca

SEQ ID NO: 36453 - DNA, 50 bp, homo sapien
tgtttcttaaaagaaagacactgaamactacttctaccttctttttagtg

SEQ ID NO: 36454 - DNA, 50 bp, homo sapien
ttcagtgaggagagcacctctttcawccataaatatgtcatcaacagtct

SEQ ID NO: 36455 - DNA, 50 bp, homo sapien
aatctattcaaaatctttcagaaaayggaagagaagggaatactgccaca

SEQ ID NO: 36456 - DNA, 50 bp, homo sapien
aacaaaatataaagaagtattagaasaagtaaaaaacagaatactgcaaa

SEQ ID NO: 36457 - DNA, 50 bp, homo sapien
ccttctattccttcatgttgcagaaytgactcctttcaaatgcttttttg

SEQ ID NO: 36458 - DNA, 50 bp, homo sapien
cattatctctaaattttgagaccaasaatcttttggtagagccaaggaag

SEQ ID NO: 36459 - DNA, 50 bp, homo sapien
ccatgatcaggaaacaaccaccaaaytgggtattcaggatagcatttgcc

SEQ ID NO: 36460 - DNA, 50 bp, homo sapien
ctgagagaactacccttccttgttayaaatggaacagccggcttcctctg

SEQ ID NO: 36461 - DNA, 50 bp, homo sapien
ggacttaatgtctgaggagataacaygaaaatactgtgagcagcagccaa

SEQ ID NO: 36462 - DNA, 50 bp, homo sapien
aaaagcactttgcaattaactggagracattttattcctaattctcctcc

SEQ ID NO: 36463 - DNA, 50 bp, homo sapien
aaatatctgttagtggcttattcgargtgtgtcagttgatgaatttcctt

SEQ ID NO: 36464 - DNA, 50 bp, homo sapien
atagatgtgacatcaaggcctcatartaagtgactggaaaatgtgggttt

SEQ ID NO: 36465 - DNA, 50 bp, homo sapien
tctgtgtgttcacttgaccttatcarggcgaattgccaatatgtgacttt

SEQ ID NO: 36466 - DNA, 50 bp, homo sapien
tttcatatatcaatttattttccaartgctcaaatatatcagaatatcat

SEQ ID NO: 36467 - DNA, 50 bp, homo sapien
ggtcagaagatttcacagtaaatcartctgaaacaattgctcagccaacg

SEQ ID NO: 36468 - DNA, 50 bp, homo sapien
agctaattgttgctgaatggtgttakgtagattgatagtgaggagtgggg

SEQ ID NO: 36469 - DNA, 50 bp, homo sapien
tctgacaaatgtccgagttcagtgaratattagaaatcagtcttgtggcc

SEQ ID NO: 36470 - DNA, 50 bp, homo sapien
tctgtgaataattgtttcttttgaaygttttagcactttgtatgttttta

SEQ ID NO: 36471 - DNA, 50 bp, homo sapien
atgtcaaaaggagaaagtgaaaaacsgtgacctatagatttagtttgtta

SEQ ID NO: 36472 - DNA, 50 bp, homo sapien
aaagacatacaaagtctctggcaaamaaataagtgatagcttacagcctt

SEQ ID NO: 36473 - DNA, 50 bp, homo sapien
ttagcaggtctaaaacgactctatcragggtcttcatgagttgtctaaga

SEQ ID NO: 36474 - DNA, 50 bp, homo sapien
tttgggttggttccatgtataatgasaagatttctatcagaatttgtttc

SEQ ID NO: 36475 - DNA, 50 bp, homo sapien
atattaaaaacaactcaatcaagatmaaatagggaaacatggacaacatt

SEQ ID NO: 36476 - DNA, 50 bp, homo sapien
catgattgtcctattcttctaaatcrcaattgtctaaggtaatgtagaaa

SEQ ID NO: 36477 - DNA, 50 bp, homo sapien
tattacaatccgcttcataataacastctactacataaataatgatatca

SEQ ID NO: 36478 - DNA, 50 bp, homo sapien
tatagagagtgagttgtaaaatttakgagtcactttacattcgccctact

SEQ ID NO: 36479 - DNA, 50 bp, homo sapien
acaccaatgaagttgtatatttaaawctaatagaatgtgacacattagga

SEQ ID NO: 36480 - DNA, 50 bp, homo sapien
cttcttgaaaaacccattagtcacargctctaatttgtatattagattca

SEQ ID NO: 36481 - DNA, 50 bp, homo sapien
tttacttgtgtttctatcctgctaawcccaatggtcttgaggactgacct

SEQ ID NO: 36482 - DNA, 50 bp, homo sapien
tggaacaaagttaaacatacagttayatatcaagaccataaaaatctata

SEQ ID NO: 36483 - DNA, 50 bp, homo sapien
gagacaaaactcagaaataattagawggaacaaagttaaacatacagtta

SEQ ID NO: 36484 - DNA, 50 bp, homo sapien
caaaaatgtacaaaatgtacgaaagraaaaatcctcagtatcactactct

SEQ ID NO: 36485 - DNA, 50 bp, homo sapien
gatgagagtattattgttgatgtcayggaattgtcttggccaatttgaaa

SEQ ID NO: 36486 - DNA, 50 bp, homo sapien
tcaaatctactcaataataatatcarctaatcctctggcacttatgatat

SEQ ID NO: 36487 - DNA, 50 bp, homo sapien
taacatcttcaaaaccaacgagatayaaaaagcaacaggagtctataggt

SEQ ID NO: 36488 - DNA, 50 bp, homo sapien
ctacttgatgaagtaataggctttgyacagactgctaaactatcatttgt

SEQ ID NO: 36489 - DNA, 50 bp, homo sapien
attattggtttgtgaatgagtaagakaatggtgagagatgggaacacaaa

SEQ ID NO: 36490 - DNA, 50 bp, homo sapien
taagaatgcccggaagttcttggtaygtggaactgtaaaaccaacagtat

SEQ ID NO: 36491 - DNA, 50 bp, homo sapien
tgtgtgttttgttttttgcaggtacyatatttgcctatggacagactgct

SEQ ID NO: 36492 - DNA, 50 bp, homo sapien
gaatacttactcataattacactcaycaataatgtctttatgaagcagag

SEQ ID NO: 36493 - DNA, 50 bp, homo sapien
aaatttttctgcccaacagtttgaayggtcaccctgcttcaacatgacaa

SEQ ID NO: 36494 - DNA, 50 bp, homo sapien
aattactcaaaatttgttctttaaawatctcaaatctgatcacatcccaa

SEQ ID NO: 36495 - DNA, 50 bp, homo sapien
caaggcctggggaaagtcagttaaakgttgtctatctgcctttactttat

SEQ ID NO: 36496 - DNA, 50 bp, homo sapien
ttctgcctcaaaatgtcttgaagaamcagccttttaaagacaaaagttag

SEQ ID NO: 36497 - DNA, 50 bp, homo sapien
ccttctccttatcagtagatcagtcmagtttgttaaaattcctgcacagt

SEQ ID NO: 36498 - DNA, 50 bp, homo sapien
tctcttgaattggttaacacttgacracagaagctgaattccgtaggttg

SEQ ID NO: 36499 - DNA, 50 bp, homo sapien
agtgaaattcttcaaatatttaaacrggaaaaatcatgtcatgtgaagct

SEQ ID NO: 36500 - DNA, 50 bp, homo sapien
gtaatttggtattgggtaagacctaygatttgtatgagtttgttttgaca

SEQ ID NO: 36501 - DNA, 50 bp, homo sapien
gaataaaatggtatgtaggattatgmaggaaatttacgtctcagacacat

SEQ ID NO: 36502 - DNA, 50 bp, homo sapien
ttctgtaatggcagtggtaatgatgwcatcagcaaaataactaagtgcac

SEQ ID NO: 36503 - DNA, 50 bp, homo sapien
gcatggcttggcttctgactgcttayactaaaatatgagaagagaaaaac

SEQ ID NO: 36504 - DNA, 50 bp, homo sapien
aaaaattatgtctgaatttttttcargattatacaaaaagtcactaaaaa

SEQ ID NO: 36505 - DNA, 50 bp, homo sapien
cagaaatcatttaagcagtataaaaktttaagtcatttccattttaaatg

SEQ ID NO: 36506 - DNA, 50 bp, homo sapien
cctatgtttttcacaggatgatctawattctaaggaaacggaaacaaaac

SEQ ID NO: 36507 - DNA, 50 bp, homo sapien
agttgtagaaccaaagttgtgggaartggactccttgttaagcccacata

SEQ ID NO: 36508 - DNA, 50 bp, homo sapien
tacaaactacattttaagtgtgtaartggagacatcagaagaatgtttta

SEQ ID NO: 36509 - DNA, 50 bp, homo sapien
ccactatccacttcagagccaaacayagatctgcttctgcctcagctttc

SEQ ID NO: 36510 - DNA, 50 bp, homo sapien
gttggaaagcattgcttatgaagaastgtaatggaggagctataaattgg

SEQ ID NO: 36511 - DNA, 50 bp, homo sapien
tttactgaattttttatcggaaaaartctggaaatctcatgaaagaggat

SEQ ID NO: 36512 - DNA, 50 bp, homo sapien
tgcagaaattaaaatagaattgtgamccagttacaacaaattggaggata

SEQ ID NO: 36513 - DNA, 50 bp, homo sapien
ttcatgttttgttaattcaattatcratttccatatcataaaatatagaa

SEQ ID NO: 36514 - DNA, 50 bp, homo sapien
ttaagcatttatcacacactcactgmattatattttcctattgatctgtc

SEQ ID NO: 36515 - DNA, 50 bp, homo sapien
atcctaaactcaaatgtacatctacrctagaaaatgactgatcttacata

SEQ ID NO: 36516 - DNA, 50 bp, homo sapien
tggacccacccaaaaatcccttctargcactaaacaagtagatttttcaa

SEQ ID NO: 36517 - DNA, 50 bp, homo sapien
catttctgattttcctaaatcaatayagcagctaaacaagacaatggttc

SEQ ID NO: 36518 - DNA, 50 bp, homo sapien
acttttaacatcacattcattatcayccagttagtacagaaagcaatagt

SEQ ID NO: 36519 - DNA, 50 bp, homo sapien
tttgaaagaaatgggaagtaattctraaacaggaggcctaaaacagctgg

SEQ ID NO: 36520 - DNA, 50 bp, homo sapien
tcctatttcttttttaagcatttcaytccttatattctccaatatattat

SEQ ID NO: 36521 - DNA, 50 bp, homo sapien
tagagagcagagggcccagtgctcartgacagaaagcaaggcagcaatac

SEQ ID NO: 36522 - DNA, 50 bp, homo sapien
gtgtctcattgacatctttttttaaygtaataagttgatgttcatttgcc

SEQ ID NO: 36523 - DNA, 50 bp, homo sapien
agaaaaagcagagttaaagcatcatragttacagtcacagaagaaagcag

SEQ ID NO: 36524 - DNA, 50 bp, homo sapien
tgtgaataaattatatgaaaaagagycatgtgcaaatgtgttctcatcta

SEQ ID NO: 36525 - DNA, 50 bp, homo sapien
caaatgtttgtggagcacctctataygctgaagactcttctaagacacag

SEQ ID NO: 36526 - DNA, 50 bp, homo sapien
taatatataaatttttaagatatgcrccagtaacatagaacatgtagaag

SEQ ID NO: 36527 - DNA, 50 bp, homo sapien
atttttaagaaataaacacctgtagrcatacccaaattattgaacttgtg

SEQ ID NO: 36528 - DNA, 50 bp, homo sapien
ggggatgaggttgaaggtcaaattaygaatggttgttttatggtctggga

SEQ ID NO: 36529 - DNA, 50 bp, homo sapien
tatgcagcaggctatatagtctctcrcctgagtctcaagaagactgtaag

SEQ ID NO: 36530 - DNA, 50 bp, homo sapien
cctttaacccactgtgaataagcaaygttttagcctgcagctctcatgcc

SEQ ID NO: 36531 - DNA, 50 bp, homo sapien
gagacaaatcatggtttctgcatcamaacttgggaagtaccagggtgtga

SEQ ID NO: 36532 - DNA, 50 bp, homo sapien
cctttccataaaaaatgcacatatamcccaaattctgcgtcaactttagg

SEQ ID NO: 36533 - DNA, 50 bp, homo sapien
aaagataaagtaaatcttgtaaacayaacactgggtgacatacagcaaat

SEQ ID NO: 36534 - DNA, 50 bp, homo sapien
aattcagtgaaaacatttgggtgaargttcctatgccacaaagttaaata

SEQ ID NO: 36535 - DNA, 50 bp, homo sapien
agcaagaatggcacagcaagatgtamggctgaaggcataggctggagcca

SEQ ID NO: 36536 - DNA, 50 bp, homo sapien
agccctgctgctgctcatttacctayctgcgtcttctgaagtagctgaat

SEQ ID NO: 36537 - DNA, 50 bp, homo sapien
ctcatagcacaatgttactcatgaamagtagatgatttggaaatactatt

SEQ ID NO: 36538 - DNA, 50 bp, homo sapien
gtgaaaagagtgccctgactaagaaraggatttgtccaaagtattcttta

SEQ ID NO: 36539 - DNA, 50 bp, homo sapien
ggaaactggtttgggtcagaaataaytcactaaaatagcctagcacatta

SEQ ID NO: 36540 - DNA, 50 bp, homo sapien
gtatgtcccacacacacgtaaaagaygaacttcctaaaataccatcccct

SEQ ID NO: 36541 - DNA, 50 bp, homo sapien
tatttgccttcaaagtgaaggtccartagaagttttgtttatcacaaatc

SEQ ID NO: 36542 - DNA, 50 bp, homo sapien
acgttgagtgtgaagaaccttcttayaggtctgaaactgagaaaaggaaa

SEQ ID NO: 36543 - DNA, 50 bp, homo sapien
aaggaagaatgtcccattgcttggarcatttcaggaactgaaaaggttga

SEQ ID NO: 36544 - DNA, 50 bp, homo sapien
gtatctggcacaaaccaccacattcratatgattagcagtcatgacaagg

SEQ ID NO: 36545 - DNA, 50 bp, homo sapien
agacatccccaaaatgtttgaaactsaagatgtacaaagcagaattcctt

SEQ ID NO: 36546 - DNA, 50 bp, homo sapien
gtacccaacctcattgagctgttacraaaaaggattgatataataaataa

SEQ ID NO: 36547 - DNA, 50 bp, homo sapien
tcaataatgtcaggaccaaaactgaragaacgtcaacttctttttttctt

SEQ ID NO: 36548 - DNA, 50 bp, homo sapien
gctttccatgactttgttgcaaatakaatcaatttacttatttttaaaac

SEQ ID NO: 36549 - DNA, 50 bp, homo sapien
atcatgaaaccctgtctactctcctraaacgaggaagaaaaataaatcct

SEQ ID NO: 36550 - DNA, 50 bp, homo sapien
tttgtgaacatgttagcagttggtcyatttacatacatgtctggcacaga

SEQ ID NO: 36551 - DNA, 50 bp, homo sapien
agagtttgctaaatatttaagctcaygattgaggcctactgctcagaaaa

SEQ ID NO: 36552 - DNA, 50 bp, homo sapien
aaaaggtcatccatttaacatttaaytatgtgccaagtactgcgaataca

SEQ ID NO: 36553 - DNA, 50 bp, homo sapien
cttctaaagcactggctactacaccraggaacattacattttgcatttaa

SEQ ID NO: 36554 - DNA, 50 bp, homo sapien
ctgtcattattaaggttgtcactaasgtttagctggaacattataacagc

SEQ ID NO: 36555 - DNA, 50 bp, homo sapien
agcttaaatgagtcactcccttgtawacatcctaaattctcttgctcctc

SEQ ID NO: 36556 - DNA, 50 bp, homo sapien
gatttttttttccttcctaacatcarggatctctaatgatagcctcggaa

SEQ ID NO: 36557 - DNA, 50 bp, homo sapien
ttcaaatcttgagtgagctatcttayggtctaggcttacagatgggatta

SEQ ID NO: 36558 - DNA, 50 bp, homo sapien
taaccattactctcttccagatccaytattgcaggtttgatgttatgtgt

SEQ ID NO: 36559 - DNA, 50 bp, homo sapien
atggtacttctcagatcttctgtcamtatttctgtgtcctcttttagact

SEQ ID NO: 36560 - DNA, 50 bp, homo sapien
cagccaggggctggatatagaggtasaacctagctttgaggtgtcatgac

SEQ ID NO: 36561 - DNA, 50 bp, homo sapien
caccaaacaaagaatggtctgatccrcaatgtcagtaatgctctcctttg

SEQ ID NO: 36562 - DNA, 50 bp, homo sapien
aaacaaggtagtgatgtataactaayaaaaattggcttcaataaaaagtc

SEQ ID NO: 36563 - DNA, 50 bp, homo sapien
acattgcaaaatacacttggtagaayacaacctcattgacagcaaagact

SEQ ID NO: 36564 - DNA, 50 bp, homo sapien
atttctcaagaaactaatagtagagycattaccatacaatccaagaatcc

SEQ ID NO: 36565 - DNA, 50 bp, homo sapien
cccagtactctccagaagactctccrcctatatctgccaggtcctatatg

SEQ ID NO: 36566 - DNA, 50 bp, homo sapien
gatatctggtcagatagagaaaagaygactttaaaatctaacatcttctc

SEQ ID NO: 36567 - DNA, 50 bp, homo sapien
tgggaaaaattataatagcatttacygaaggatccaaatttttttaaata

SEQ ID NO: 36568 - DNA, 50 bp, homo sapien
actactgtctcttctaaaaataagcrccatggatccagggacctgttact

SEQ ID NO: 36569 - DNA, 50 bp, homo sapien
tgtgcttgttctgagaagaggacaasctaattagaaaagatcagttagtc

SEQ ID NO: 36570 - DNA, 50 bp, homo sapien
attttattatctgaaaaatgccttasagcaattatttggtgttatgattg

SEQ ID NO: 36571 - DNA, 50 bp, homo sapien
taatacattctaaacaggtatgcaartcattttggctaaagaaaagctgt

SEQ ID NO: 36572 - DNA, 50 bp, homo sapien
gatttaatctcagcatcgctaattgyataatgttatctgttaaaataaat

SEQ ID NO: 36573 - DNA, 50 bp, homo sapien
taaagagctttcaccaaagacatcckactaaattatcatacaggtatgga

SEQ ID NO: 36574 - DNA, 50 bp, homo sapien
gaataggtaagaaaaagagaatagamtcatatacaggaaaaaaatgatca

SEQ ID NO: 36575 - DNA, 50 bp, homo sapien
agctaacacttatggtgttgttacartatgccaggtactgtgatgttggt

SEQ ID NO: 36576 - DNA, 50 bp, homo sapien
tacccatcagccacggtttattgacratcctttatgtgccagacactcta

SEQ ID NO: 36577 - DNA, 50 bp, homo sapien
atttgagaggccattgcaggtaaaaraaggcaagcaattactctgcccat

SEQ ID NO: 36578 - DNA, 50 bp, homo sapien
gcatcatttctgatacttgagaacaytgctgtttttcagtcaaaactgtg

SEQ ID NO: 36579 - DNA, 50 bp, homo sapien
cttctacttttctacaaacgtagaargacagcatgtaatttgagaggcca

SEQ ID NO: 36580 - DNA, 50 bp, homo sapien
ttaatgttcaaagtataaataggatsataaattaacacaggagttcagat

SEQ ID NO: 36581 - DNA, 50 bp, homo sapien
aaatgtttcaacactaactgatgtgrataacgtttgccttctttgcaaaa

SEQ ID NO: 36582 - DNA, 50 bp, homo sapien
tcaccaatgagtacaatgttacctgyaggattttagtagatagtttttat

SEQ ID NO: 36583 - DNA, 50 bp, homo sapien
tgtacggtaaattaagaaaccagaawgctaaccatatcaataaatactag

SEQ ID NO: 36584 - DNA, 50 bp, homo sapien
aaggccataagaatctcagagattamctttttgcccgttcatcccttgac

SEQ ID NO: 36585 - DNA, 50 bp, homo sapien
ggactttgttcctctaaattaggacmattctaagctaattagggaaagat

SEQ ID NO: 36586 - DNA, 50 bp, homo sapien
ggaaaacatgaatttgttcaaacacygagaatcaaaggacaagtagagtt

SEQ ID NO: 36587 - DNA, 50 bp, homo sapien
taaaggaggatcatgaggaacacacraaagagatgttgaacattctttga

SEQ ID NO: 36588 - DNA, 50 bp, homo sapien
caaaattgtacagcaattctgtcacygtattgacaaaaaagggaaaaaag

SEQ ID NO: 36589 - DNA, 50 bp, homo sapien
tttcaagtttaaggaacttcagaaakgtttatcatgtcagggtatatcag

SEQ ID NO: 36590 - DNA, 50 bp, homo sapien
cctattgagcacctattatgtacaargtaccatgctgagtactgccagga

SEQ ID NO: 36591 - DNA, 50 bp, homo sapien
gttgtcttctttcccgctctcgatayggggtgaagtgttgagcaacataa

SEQ ID NO: 36592 - DNA, 50 bp, homo sapien
gggtcaagttttgatattgggtctaygttactggaccatagttggtggcc

SEQ ID NO: 36593 - DNA, 50 bp, homo sapien
aggaaaactctgagaaattaagatayggaaaaatctccagaaaactgcat

SEQ ID NO: 36594 - DNA, 50 bp, homo sapien
gagtctagaatctgaatattaaccastactctacactacatcacatttta

SEQ ID NO: 36595 - DNA, 50 bp, homo sapien
ttcaacctttattcctgtatttatcrgagtccaaagtaaaacagtatctt

SEQ ID NO: 36596 - DNA, 50 bp, homo sapien
gcatgggatatctaaaaataaggaayagtaattgatgcgtccaggaagac

SEQ ID NO: 36597 - DNA, 50 bp, homo sapien
ctattccagccccatatgtgttacartaatttttctgcctccacctctgt

SEQ ID NO: 36598 - DNA, 50 bp, homo sapien
tgaaaactgaaataactgccactcaytattatactcttcagaaacaggta

SEQ ID NO: 36599 - DNA, 50 bp, homo sapien
gtccaccccagttgtgcctatgtgartaatgcgtgccagtggctaactag

SEQ ID NO: 36600 - DNA, 50 bp, homo sapien
gtaacttatagttcaaggttaaaaaktaatgttccatagaaaaagaagga

SEQ ID NO: 36601 - DNA, 50 bp, homo sapien
gaccatttcagctgatttccatgtayaatcctaatcttataattcacttc

SEQ ID NO: 36602 - DNA, 50 bp, homo sapien
gcattgagtatacatttagaagtgaygtcccaggatttaagacatctgta

SEQ ID NO: 36603 - DNA, 50 bp, homo sapien
cactttcaatgttgtctctctgatastagaaaataacaaaacagatgctt

SEQ ID NO: 36604 - DNA, 50 bp, homo sapien
agaggttggggacccttgccatagarggagaaagaagactgaggatagat

SEQ ID NO: 36605 - DNA, 50 bp, homo sapien
tgaaaatataataatctctactgaaytgactgaatagtgaataaaatgaa

SEQ ID NO: 36606 - DNA, 50 bp, homo sapien
aaatagcatcaacacaggtgaattayctatgacatttattcacatgtgcg

SEQ ID NO: 36607 - DNA, 50 bp, homo sapien
gtctttaattaaaatgaataattccrcctcattaatatcttgacattcct

SEQ ID NO: 36608 - DNA, 50 bp, homo sapien
ttatattgattacatgttgaggtgayaatattttggatatgttgttaaat

SEQ ID NO: 36609 - DNA, 50 bp, homo sapien
tgaataatactgaaacaaaacaaggwacctcattcattccagcaaaccac

SEQ ID NO: 36610 - DNA, 50 bp, homo sapien
ttgatgctactgtgcttggtttgacractgggaaattagggttacctggg

SEQ ID NO: 36611 - DNA, 50 bp, homo sapien
agctacctctgtaccctcaaaattayagcatcacattttaaacctacagt

SEQ ID NO: 36612 - DNA, 50 bp, homo sapien
ggcttcatccaaactaagtgtgaaaytaaaacagaagtccttggtctttt

SEQ ID NO: 36613 - DNA, 50 bp, homo sapien
tgagattgaagcccataaaggtgaartaatgcacccaacatagaacccaa

SEQ ID NO: 36614 - DNA, 50 bp, homo sapien
actgtcaaggaggtgaggacaataaygaacgtgatgcctaagaaataaat

SEQ ID NO: 36615 - DNA, 50 bp, homo sapien
tttattctgattaaggcctggtgtawatctttgataatgaagcccattaa

SEQ ID NO: 36616 - DNA, 50 bp, homo sapien
gggttttggtctgccataatagaaayatatcgtccaacttaaggaaaatg

SEQ ID NO: 36617 - DNA, 50 bp, homo sapien
ttttaggccttcaaacccagactgcracattattggctctctggctctta

SEQ ID NO: 36618 - DNA, 50 bp, homo sapien
tatgaagcaacatcctcaaagtaccraagagtaaaaatatcattactata

SEQ ID NO: 36619 - DNA, 50 bp, homo sapien
atttgcacagcaggaaattaggagayaccactaaggaaagacagagtcat

SEQ ID NO: 36620 - DNA, 50 bp, homo sapien
aaaatatcattactatagaatggtartaagttgaaaaaactttctaagga

SEQ ID NO: 36621 - DNA, 50 bp, homo sapien
gatgatgaggagagaaaacacaggasagccaggccttcttggtttatgca

SEQ ID NO: 36622 - DNA, 50 bp, homo sapien
gtgagtccaaacggtttcaaagcccraaggctgtgtgagttgtagaatgt

SEQ ID NO: 36623 - DNA, 50 bp, homo sapien
cactcagtgcagtgactcttggcccrcattctgtagataagaaacacctt

SEQ ID NO: 36624 - DNA, 50 bp, homo sapien
gcagcagataagaatcttaggcaagyaaagggctagcactagcgaactgg

SEQ ID NO: 36625 - DNA, 50 bp, homo sapien
gaagctttgtttttggagcatgtacrccatttcagtttcaagaggactaa

SEQ ID NO: 36626 - DNA, 50 bp, homo sapien
aaaattcagtttttctttccttagakgctctcagtcagtgttggccatcc

SEQ ID NO: 36627 - DNA, 50 bp, homo sapien
aacaagtcaggtataaatatatccawctttggaaacaaaatcaggagaca

SEQ ID NO: 36628 - DNA, 50 bp, homo sapien
ttttcttgaaagaacactgctccaayggactgattttgattatcacagca

SEQ ID NO: 36629 - DNA, 50 bp, homo sapien
tagttggggggaatagatgagttaasaattcctctgcttgaaatagtggc

SEQ ID NO: 36630 - DNA, 50 bp, homo sapien
aagaggccatagaactagtgggtggmcaagaaaaactctattttgtgaca

SEQ ID NO: 36631 - DNA, 50 bp, homo sapien
tgctttgccatccaaatacaagtacraggatatacacttagggtaataac

SEQ ID NO: 36632 - DNA, 50 bp, homo sapien
gtatttcaaatccatctggatgtccygctgtatcaacttatttatttaaa

SEQ ID NO: 36633 - DNA, 50 bp, homo sapien
tttttttttctgttatggaattcagyatctttcatgtagattaacatcac

SEQ ID NO: 36634 - DNA, 50 bp, homo sapien
ttcccattatttaacagtacctctaraagataacaacacagaaaaagctt

SEQ ID NO: 36635 - DNA, 50 bp, homo sapien
aaattcttgtttaaaaccagtggtasatctcagcaaactgggtggagact

SEQ ID NO: 36636 - DNA, 50 bp, homo sapien
gtccacagtttcagctagtgagttamgttttgggctactgggctactgtt

SEQ ID NO: 36637 - DNA, 50 bp, homo sapien
gggcacaaagcatacacattgtcacwctaggatctgaaaagtctatataa

SEQ ID NO: 36638 - DNA, 50 bp, homo sapien
agatccctactttctcaagaggcagratgtaaactgaagtcatcagaata

SEQ ID NO: 36639 - DNA, 50 bp, homo sapien
aatcgtctccttttaaagtagagaastatgttgtgaagattatacatatg

SEQ ID NO: 36640 - DNA, 50 bp, homo sapien
tggcgttttcacacatatggccacasgctgtgctatcctggagaagcagg

SEQ ID NO: 36641 - DNA, 50 bp, homo sapien
tgtggccatatgtgtgaaaacgccaytctgaaaagctgaaagcttactct

SEQ ID NO: 36642 - DNA, 50 bp, homo sapien
tagtaggcaaatgtaaatatgtatawctgtaagcatgtgtatatgtatat

SEQ ID NO: 36643 - DNA, 50 bp, homo sapien
tcttcacatggctttcaggaggtcartaagaaatctaaacagagaatgag

SEQ ID NO: 36644 - DNA, 50 bp, homo sapien
ctgccagtggcttaacatcaactcasagaaagagctcaaggcaagcttca

SEQ ID NO: 36645 - DNA, 50 bp, homo sapien
attatgattggctccatgctaaaaayagtaggaattgtttcaaagagtaa

SEQ ID NO: 36646 - DNA, 50 bp, homo sapien
caagaaagtgtttccttatttaatcratctaatgataccctggtcacatg

SEQ ID NO: 36647 - DNA, 50 bp, homo sapien
agcctttcccttcaatgggctgacayataaacagataattttttacaccc

SEQ ID NO: 36648 - DNA, 50 bp, homo sapien
ttactaaaataatatctatttttagrcagcatttaacctcagaaagtgct

SEQ ID NO: 36649 - DNA, 50 bp, homo sapien
agtctaactcactgtagttcctcaamgtgcagtactgtttatagaacgtg

SEQ ID NO: 36650 - DNA, 50 bp, homo sapien
accgagtgcctttaacagcatccaartcacttcttcaatgcttttctggt

SEQ ID NO: 36651 - DNA, 50 bp, homo sapien
ctatacagtttatttttaatgtccgmatgttaatcttgtttgtaacagta

SEQ ID NO: 36652 - DNA, 50 bp, homo sapien
caccgaaagttctattggatagcacrgatctagagattcttcactgtctt

SEQ ID NO: 36653 - DNA, 50 bp, homo sapien
gctatttagactggtagaaaaatcaytcaggtgaaaaattgcaccatctt

SEQ ID NO: 36654 - DNA, 50 bp, homo sapien
caagataccaggaaaaattagaatamatgatctggactaacttggagaaa

SEQ ID NO: 36655 - DNA, 50 bp, homo sapien
ccttcagaagagctggatctagatamctttaagtccaagttgattggagg

SEQ ID NO: 36656 - DNA, 50 bp, homo sapien
ttaagtgccaatttttacctttgaaygattgcctgtttaaagttttctga

SEQ ID NO: 36657 - DNA, 50 bp, homo sapien
aaccactgctctagatgcttcctaaygataaaattccctttggttttcta

SEQ ID NO: 36658 - DNA, 50 bp, homo sapien
cattagcttgttaaattattgattaygcttttagttctcataaaatgtga

SEQ ID NO: 36659 - DNA, 50 bp, homo sapien
aaaagcttctttcttcaacaccaaaygcaaacagtatatgtacttcaatg

SEQ ID NO: 36660 - DNA, 50 bp, homo sapien
agcagcccttctagaaccacatggartatgggatgtccgtttcccccaaa

SEQ ID NO: 36661 - DNA, 50 bp, homo sapien
ttaagaatatgaatgaattagtcacycagatagagcgttcgaaaaatgta

SEQ ID NO: 36662 - DNA, 50 bp, homo sapien
atcttaaattggagtactctttcacrccaagattgcatagcaaaacattt

SEQ ID NO: 36663 - DNA, 50 bp, homo sapien
aatgaaaaaagacttatgaaactaayactagtcaaaataaacttagcata

SEQ ID NO: 36664 - DNA, 50 bp, homo sapien
gtgaagacaggtttcagataaacaaytacaaagggcatagggtgaaggat

SEQ ID NO: 36665 - DNA, 50 bp, homo sapien
cacagtgccatcagactttcaaacartgaatacaagatgataactaagta

SEQ ID NO: 36666 - DNA, 50 bp, homo sapien
agcctcagtttcctcataaagaaagkcaaggcaggttttacgacaaggaa

SEQ ID NO: 36667 - DNA, 50 bp, homo sapien
cagctccattttgttaattatttccygaaaggtagcagaagaactagttg

SEQ ID NO: 36668 - DNA, 50 bp, homo sapien
tcccaccactgttctgtcatacttaycttatgggccacatatcgctcagt

SEQ ID NO: 36669 - DNA, 50 bp, homo sapien
atgtcagtaaccaaactgatattcamtaatgtagcaattaacaattcctg

SEQ ID NO: 36670 - DNA, 50 bp, homo sapien
cttgagtttgttatttcatatgaagsatgtgccagataaaaacccttaga

SEQ ID NO: 36671 - DNA, 50 bp, homo sapien
caactcgaaatcaacaagtcagacaragggtagtaatatagtttgctaca

SEQ ID NO: 36672 - DNA, 50 bp, homo sapien
agaatcttaaaacaggtcaatgaagmatttacttgtgttaaactatgttc

SEQ ID NO: 36673 - DNA, 50 bp, homo sapien
tatattaagaagggctacagggatgracaagttggtttgtgttttctgca

SEQ ID NO: 36674 - DNA, 50 bp, homo sapien
agccatgtcttaatattagggccaaygttcagtaatatatagtgtattct

SEQ ID NO: 36675 - DNA, 50 bp, homo sapien
tttaaatatccatataatctgtcagycgatgtgtttaaatgcaacagtta

SEQ ID NO: 36676 - DNA, 50 bp, homo sapien
gccttatgtagaagacagatggataygtgattaatacaaattcttgcttt

SEQ ID NO: 36677 - DNA, 50 bp, homo sapien
tccataaacttccctaggatgcagcrattcacatgccctttcaggagaca

SEQ ID NO: 36678 - DNA, 50 bp, homo sapien
ttattatggcctgtttagacatatasgcttatacgggaattttaactaga

SEQ ID NO: 36679 - DNA, 50 bp, homo sapien
actgttaaaataaaatggctacttcraccaatttttatcatgtactaggg

SEQ ID NO: 36680 - DNA, 50 bp, homo sapien
gtaaacctgtttcacatttttttggyataaattcagattttctgtttgaa

SEQ ID NO: 36681 - DNA, 50 bp, homo sapien
tcactgactagaatttgatggaagastatatttttattaaaatcattcat

SEQ ID NO: 36682 - DNA, 50 bp, homo sapien
ctgaatttttcagtaaaaatgctacygagtcaaatagtttatcaacattt

SEQ ID NO: 36683 - DNA, 50 bp, homo sapien
ctgttttgcatttaacatatctaaamggcctcatgcacaatataagtaaa

SEQ ID NO: 36684 - DNA, 50 bp, homo sapien
gatgaataaatacataggccattaayatatatgatgagcaaatgtgttga

SEQ ID NO: 36685 - DNA, 50 bp, homo sapien
aattaagtaatttggatactgaaagscttatttgttccaaaacttaagta

SEQ ID NO: 36686 - DNA, 50 bp, homo sapien
cttcaatgtagtacaaggtatgcaarcacttaattaactttacaaggcag

SEQ ID NO: 36687 - DNA, 50 bp, homo sapien
ttctttatctgaaatataggagtccygacttatctatgattttgctttct

SEQ ID NO: 36688 - DNA, 50 bp, homo sapien
tcaaacaccttgtaaatgccattgaycctcaaatcatctttttaataaaa

SEQ ID NO: 36689 - DNA, 50 bp, homo sapien
ctgttcttaagctgaaccactcttaraacaacccagattttaaaaattat

SEQ ID NO: 36690 - DNA, 50 bp, homo sapien
tcacaggcctggcacgtcataatacraaaatgcaccactaattactgtgg

SEQ ID NO: 36691 - DNA, 50 bp, homo sapien
taataagttaattgtgtatataagcrcaaagaaacagagtctaacaggtt

SEQ ID NO: 36692 - DNA, 50 bp, homo sapien
caccttagctgttatttttgttataygggtactagcagaagaaaaagaga

SEQ ID NO: 36693 - DNA, 50 bp, homo sapien
tcttggttttgccagaaccctggtaygtaaattctctcctacttggtgaa

SEQ ID NO: 36694 - DNA, 32 bp, homo sapien
acatagaattcattgasagcaagaaggttagc

SEQ ID NO: 36695 - DNA, 50 bp, homo sapien
ttaagacacaagggacatcgtgaaakgatcactttaacataacttctttg

SEQ ID NO: 36696 - DNA, 50 bp, homo sapien
tgggcaaagttttgctagatttacaygggattctagtttacagggttctt

SEQ ID NO: 36697 - DNA, 50 bp, homo sapien
ctaagcaggaaatcctatctctatckctatatgttcatagtactatagac

SEQ ID NO: 36698 - DNA, 50 bp, homo sapien
ttctgcaaaaatgtagttctagcaawggttaagacaacaaactaaaatac

SEQ ID NO: 36699 - DNA, 50 bp, homo sapien
gttacagacactgtaactaacataarggtccagttctgtagggaatcaat

SEQ ID NO: 36700 - DNA, 50 bp, homo sapien
taaattgtaactaagaaagctgatawtaactgctcaaatatgaataacat

SEQ ID NO: 36701 - DNA, 50 bp, homo sapien
ctcctaacaccacaagagtgatatgmagaactgatagccctatctcttct

SEQ ID NO: 36702 - DNA, 50 bp, homo sapien
aattcttgttactgctattaaaaaaytccaagcctttatttaagatggat

SEQ ID NO: 36703 - DNA, 50 bp, homo sapien
catgtgaatctcaatactctactagmccttcttgaacttcaaatacatgc

SEQ ID NO: 36704 - DNA, 50 bp, homo sapien
gtctctaaggagcttaaaccatgacrggtaactctattagggaagtcagg

SEQ ID NO: 36705 - DNA, 50 bp, homo sapien
aatgagaagaatcaaattgagagaayctgattgcatgttgagagaaagaa

SEQ ID NO: 36706 - DNA, 50 bp, homo sapien
taattgaagaaggaagagtttgacaygaagtaaaagtctctgatattgat

SEQ ID NO: 36707 - DNA, 50 bp, homo sapien
aatcttgattaatattctaaggcacrcggcaagatatgaagaagaatgaa

SEQ ID NO: 36708 - DNA, 50 bp, homo sapien
gaagagcactgaggactaagcaacaygttagagaggaactgaggtcaaga

SEQ ID NO: 36709 - DNA, 50 bp, homo sapien
atctgatgtttcctttgcaaggctamcttaaaaatttcctctttttattt

SEQ ID NO: 36710 - DNA, 50 bp, homo sapien
gtactttagctacaacagagttagcrctattcaactcaatcaagcttaac

SEQ ID NO: 36711 - DNA, 50 bp, homo sapien
atgattatgtgaggtcctgcataaaygttaggcttgagagaagtggaaag

SEQ ID NO: 36712 - DNA, 50 bp, homo sapien
aagagtgtggactgaaaggaggccaygagatggagatgatgcagcagggg

SEQ ID NO: 36713 - DNA, 50 bp, homo sapien
tgagagaaatggtaaaagttagagayggtgtgatttataaagcaagagtc

SEQ ID NO: 36714 - DNA, 50 bp, homo sapien
tataacatgttggtctcaaatcataygtagtggtttttttttttgtttgt

SEQ ID NO: 36715 - DNA, 50 bp, homo sapien
tgccaatgcactgcctgcggacaacmgatgatcttcatacaccatttatt

SEQ ID NO: 36716 - DNA, 50 bp, homo sapien
gactaatgatatactattatttgacyagaattggctaatttccaacataa

SEQ ID NO: 36717 - DNA, 50 bp, homo sapien
gcaaagctttattattacagttgctraagggaaagtacagaatcatggcc

SEQ ID NO: 36718 - DNA, 50 bp, homo sapien
taaaggtctattgatttggtggccayagtctgtatttgcttttcacctat

SEQ ID NO: 36719 - DNA, 50 bp, homo sapien
cattattacaagcacagttttcacastataatgtagtataaagtacctga

SEQ ID NO: 36720 - DNA, 50 bp, homo sapien
tttgaaagaggatcagcaccaatgamatttttaaaattggaagtagcacc

SEQ ID NO: 36721 - DNA, 50 bp, homo sapien
tttgaaacattcctcattttttagawgttgttggacactttatatttgtt

SEQ ID NO: 36722 - DNA, 50 bp, homo sapien
tgaaatcagaccaactttgcagagaygataacaaatgcctttgtgtccat

SEQ ID NO: 36723 - DNA, 50 bp, homo sapien
atatgacaagttaccattgagacaaytcatgtgaaaaagaaaagaatagg

SEQ ID NO: 36724 - DNA, 50 bp, homo sapien
catccacaggatggagtcctaatacmattacagggaagagactattcagt

SEQ ID NO: 36725 - DNA, 50 bp, homo sapien
ggctattttttgttgttaaataccastaagttaagagagaataatttcca

SEQ ID NO: 36726 - DNA, 50 bp, homo sapien
gttagctattaatattgtggtaaaargtgtgagaacaaaatatgtaaggt

SEQ ID NO: 36727 - DNA, 50 bp, homo sapien
actgcagtcacattcctggctcaackctcatgttctgatctcccttgatg

SEQ ID NO: 36728 - DNA, 50 bp, homo sapien
aagactggaaaaaaacacaaacgccyatgtaatggattatatacagcctg

SEQ ID NO: 36729 - DNA, 50 bp, homo sapien
catgggccataatataccttcttcayggagttaattgctcagtctttagt

SEQ ID NO: 36730 - DNA, 50 bp, homo sapien
gtacaattagcaatggatgctgctayatgaaagaatgctatctattccct

SEQ ID NO: 36731 - DNA, 50 bp, homo sapien
agaggtcatttggaaaggataaaagragatctgtagtgaacagaggagac

SEQ ID NO: 36732 - DNA, 50 bp, homo sapien
atgtaaaatagacaaactatacacaraacacatttacttcaattctgcaa

SEQ ID NO: 36733 - DNA, 50 bp, homo sapien
ttcttggaattaaatgcaatacaaawtgagttcactctcagatatgttta

SEQ ID NO: 36734 - DNA, 50 bp, homo sapien
tgatacttactctatggcactaatamtaactctgtagcaaatacttactc

SEQ ID NO: 36735 - DNA, 50 bp, homo sapien
aatgttcctgcaaagcaaaatataarcctagcgataacgggtacctacag

SEQ ID NO: 36736 - DNA, 50 bp, homo sapien
gcaggaaagcaaaaaggcgtatttgyaaagaatggttgcaaattgttctc

SEQ ID NO: 36737 - DNA, 50 bp, homo sapien
aggtgttgcaacacttaaatcaaaayagagagttagtaaatcaggccagg

SEQ ID NO: 36738 - DNA, 50 bp, homo sapien
agagaaagggtcccatatgaagcagraaacagtcttctttgatggcatta

SEQ ID NO: 36739 - DNA, 50 bp, homo sapien
ttagaggagggggcatttgctaaaakcactcaacgaacatgctgttaatg

SEQ ID NO: 36740 - DNA, 50 bp, homo sapien
ttgactaagagagaaaagtatccaaygctagttctaggcgcacagattat

SEQ ID NO: 36741 - DNA, 50 bp, homo sapien
agacattgcttttcttcttatcttcrcatactttaaaataatttgtactt

SEQ ID NO: 36742 - DNA, 50 bp, homo sapien
tctgtatccattttgttccctcacamtctacgtctatttcattcattacc

SEQ ID NO: 36743 - DNA, 50 bp, homo sapien
tggctcaagacagccttgagctcacygggaaaagaaaatgactgttaaaa

SEQ ID NO: 36744 - DNA, 50 bp, homo sapien
cccagttagtagctgggtgggttgcrctaaacaatcttctcagttttttt

SEQ ID NO: 36745 - DNA, 50 bp, homo sapien
ctacaaagtgatgatttcctcaaagrcaattgatgcgggctatgttgaca

SEQ ID NO: 36746 - DNA, 50 bp, homo sapien
ccccttctcaaacatattttctgaaygaatcactctcagcaggaaagtgg

SEQ ID NO: 36747 - DNA, 50 bp, homo sapien
aatctttacaatacccttaattccaygtgctatttccagttttctgagag

SEQ ID NO: 36748 - DNA, 50 bp, homo sapien
ctgctcaaatgatggttgtaactaartaagaatgagcatgctggtattct

SEQ ID NO: 36749 - DNA, 50 bp, homo sapien
acaggcaatgagactccagtgagaartcgatgctaatgtccagattacat

SEQ ID NO: 36750 - DNA, 50 bp, homo sapien
cagcctgggtaacgtcttttgtattsaaagatcacactggagactgttta

SEQ ID NO: 36751 - DNA, 50 bp, homo sapien
aagttttcctcaatgttggaagatarggatcattaagacaatgaatgaag

SEQ ID NO: 36752 - DNA, 50 bp, homo sapien
gccaacctctctcaaagcaaatatawcttcaatgaaaataggagttgtta

SEQ ID NO: 36753 - DNA, 50 bp, homo sapien
ttcaaaggctcctccaggtctatggwagttttagcaacgcttataatagt

SEQ ID NO: 36754 - DNA, 50 bp, homo sapien
atttagaatactctgttatgaacaaygaaaatactatataatatgaagca

SEQ ID NO: 36755 - DNA, 50 bp, homo sapien
tcttgttctaggttcattaatcagamaatttaacttgaatcctctgtgtc

SEQ ID NO: 36756 - DNA, 50 bp, homo sapien
ttaataatattgtctagtcacacaarcatataaatctaaacactggtaat

SEQ ID NO: 36757 - DNA, 50 bp, homo sapien
gtgaagatgggaatgaagaacacccrgcactggaaaaggactcagaggca

SEQ ID NO: 36758 - DNA, 50 bp, homo sapien
aatcaagtcagataaggactgataasaagagtgttctattgtaacccaca

SEQ ID NO: 36759 - DNA, 50 bp, homo sapien
ttctgataaactgttactgctactcraggaggaatttgctataatgtata

SEQ ID NO: 36760 - DNA, 50 bp, homo sapien
tgatttgcttctcacaactaacaagrcaatattcctataaaagcccatta

SEQ ID NO: 36761 - DNA, 50 bp, homo sapien
ctgagcatcttaatatatgaaagtaratggtggcagaatgaatgtggctt

SEQ ID NO: 36762 - DNA, 50 bp, homo sapien
tgtcaaagtatcaaataagattctayggtgaaggtgcgtgcatcagaaag

SEQ ID NO: 36763 - DNA, 50 bp, homo sapien
aggagctgaaaatgcactttgaactsagatgtaaagacctatggagtcca

SEQ ID NO: 36764 - DNA, 50 bp, homo sapien
gtttctattaattagtatcctccacrattagtactgggagtcttcattct

SEQ ID NO: 36765 - DNA, 50 bp, homo sapien
aggtgccccatgacatttctatgcaytagacagaattactcataatactg

SEQ ID NO: 36766 - DNA, 50 bp, homo sapien
acccacttagggcctataattagaarggcatctcttctttccaagggtaa

SEQ ID NO: 36767 - DNA, 50 bp, homo sapien
agaagagtaatgatagacaaacattsaagatcttggttagagcatttcac

SEQ ID NO: 36768 - DNA, 50 bp, homo sapien
ataaaaaatgtgcaactattatctaycaaacccatttaggaggctatcta

SEQ ID NO: 36769 - DNA, 50 bp, homo sapien
aatagcttgcttgactgtgaagggayggtcagagatatcctcacccttat

SEQ ID NO: 36770 - DNA, 50 bp, homo sapien
taaaaacacaaatctattaaagagasactatggaaaatccttaagtgtca

SEQ ID NO: 36771 - DNA, 50 bp, homo sapien
tcagaaaattctccaagtagtcccaktgagtatgaactggatcctaattg

SEQ ID NO: 36772 - DNA, 50 bp, homo sapien
taaaataattgccttgtgcaaattarcattgttcaagtgcaatcctaaat

SEQ ID NO: 36773 - DNA, 50 bp, homo sapien
atgaactaaacaagtatctctgttayctaaatggatagttttaatggtta

SEQ ID NO: 36774 - DNA, 50 bp, homo sapien
agctgtagggatcaaacctattagaygcgataaacaatataattccttct

SEQ ID NO: 36775 - DNA, 50 bp, homo sapien
ctccccaccagcaacttcagtgtcaygagagtagagaatgagactcaggc

SEQ ID NO: 36776 - DNA, 50 bp, homo sapien
tagttaattttaggagtcaatccaamggttaacccaataaatctgaggtt

SEQ ID NO: 36777 - DNA, 50 bp, homo sapien
tagaacttagtagcattaaatgatgmactttattgtacataacagcactg

SEQ ID NO: 36778 - DNA, 50 bp, homo sapien
tcccaaaggtatttgcagaaaataastgatgtagcgtttattttcttgga

SEQ ID NO: 36779 - DNA, 50 bp, homo sapien
ggctcataaaggtcatttttgaaccrcttgggacaaagagccacgtccat

SEQ ID NO: 36780 - DNA, 50 bp, homo sapien
tgattctcacttctcaactagttacrcgaaaactaattctccccatgact

SEQ ID NO: 36781 - DNA, 50 bp, homo sapien
tattctttaaagtcaaatccagttaygttaaagcaagggaatgatattac

SEQ ID NO: 36782 - DNA, 50 bp, homo sapien
gactgtgggtacattttcaatagccyaatctatataaaaagcttctcttt

SEQ ID NO: 36783 - DNA, 50 bp, homo sapien
aactatgaaacacattcaaagtcaargtgagaattacacaaatttaattt

SEQ ID NO: 36784 - DNA, 50 bp, homo sapien
cacacacaaaaataggtcaataacgyaattttctatagttcactcagttt

SEQ ID NO: 36785 - DNA, 50 bp, homo sapien
acttaaagctcatgaaaggtatagamccctggtatgctttgtgagttcac

SEQ ID NO: 36786 - DNA, 50 bp, homo sapien
ttcaatgagcactttgcacagggaaracaagcaatatagaatttttatgg

SEQ ID NO: 36787 - DNA, 50 bp, homo sapien
cattaattattatagtcacaatgctraaaaataagagagcaattttaatg

SEQ ID NO: 36788 - DNA, 50 bp, homo sapien
atataagaaatgtatgcatacttaayatcaacagcaaaactaattaacag

SEQ ID NO: 36789 - DNA, 50 bp, homo sapien
gcagttggttgataaagatgaagaakttcaatgtaaaggaagaggaaaga

SEQ ID NO: 36790 - DNA, 50 bp, homo sapien
cataattgctttgagtggttataaayattgcctttagaaagctacatcac

SEQ ID NO: 36791 - DNA, 50 bp, homo sapien
tcatcatgactctcctaataattaamctttggcttagctttagggattct

SEQ ID NO: 36792 - DNA, 50 bp, homo sapien
tgaatcacaaaattgattatcatagycgcaaaattgattatcacagtttt

SEQ ID NO: 36793 - DNA, 50 bp, homo sapien
atgtgttaattatgaacttatgatasgacttttatgaatttaacaagaat

SEQ ID NO: 36794 - DNA, 50 bp, homo sapien
caacaatttcaacttttattttagaytcaaagagaacatgtgcaggtgtg

SEQ ID NO: 36795 - DNA, 50 bp, homo sapien
cacagattattagctgcccataaaawtgctgataatgaaactggtgatga

SEQ ID NO: 36796 - DNA, 50 bp, homo sapien
taataatgaggaattagaagagacastaaatacagatgctttttaaagca

SEQ ID NO: 36797 - DNA, 50 bp, homo sapien
actttttcagaaatgttaatgggtaragcaagaaataccaatcataagtg

SEQ ID NO: 36798 - DNA, 50 bp, homo sapien
atgggccagaaagaagatttacagaygagatttacttggggatatttgta

SEQ ID NO: 36799 - DNA, 50 bp, homo sapien
gcatactttatattggcccaacctgraagatctactagcttttgcttcct

SEQ ID NO: 36800 - DNA, 50 bp, homo sapien
cttcaaataattgagctgtgaacaargcactgtgaaacaaaagggatgga

SEQ ID NO: 36801 - DNA, 50 bp, homo sapien
tatgtttcatataatgcttgatcaaygagtaggttttcaattaagttcta

SEQ ID NO: 36802 - DNA, 50 bp, homo sapien
tggagaaatttggccaaaaggaaaartgttaggaaagcatatccagctat

SEQ ID NO: 36803 - DNA, 50 bp, homo sapien
aatggcttctataatgcgagtaacamtaaaaatgaaagttcttagttttg

SEQ ID NO: 36804 - DNA, 50 bp, homo sapien
atttgataagcgtatactaatatggrcatgatatattgatgaattagaac

SEQ ID NO: 36805 - DNA, 50 bp, homo sapien
gggtttgatgataaagctagactgayataagaacaatttctatatttgag

SEQ ID NO: 36806 - DNA, 50 bp, homo sapien
aaaacaaaaacatattaagaagtccrcatttctaacaaacaccttgcaaa

SEQ ID NO: 36807 - DNA, 50 bp, homo sapien
tttaaatatggtattttaccaagcakcaggaactaatttgcaataacttt

SEQ ID NO: 36808 - DNA, 50 bp, homo sapien
gagaacctgggtaggacctagactaygttgttgcaatatctttggaaatt

SEQ ID NO: 36809 - DNA, 50 bp, homo sapien
aagcagggggatcaaaacttaaggcractaactcatcttggtttggcagg

SEQ ID NO: 36810 - DNA, 50 bp, homo sapien
agctccaggatttgtgtgctgttgcygaatactcaggacggacctgaatt

SEQ ID NO: 36811 - DNA, 50 bp, homo sapien
taagatttggggttaatttttactgkatcataacccaacccatcttgatt

SEQ ID NO: 36812 - DNA, 50 bp, homo sapien
aggaaaaatcaactacgaacatctcrataaacaagcaaagtcatttcagg

SEQ ID NO: 36813 - DNA, 50 bp, homo sapien
aaaaagtggtagtaatagtttaaaargactggttttgcacctatactact

SEQ ID NO: 36814 - DNA, 50 bp, homo sapien
ctgcaattcatacaatagctcaggayatgtagaaggtacacaaaaaagtt

SEQ ID NO: 36815 - DNA, 50 bp, homo sapien
acaaacattctttacctagtaagcaktgattgaagttcttacctagggta

SEQ ID NO: 36816 - DNA, 50 bp, homo sapien
ttaactttagaggtgagtggcctatracctcttggctctgcctctagtat

SEQ ID NO: 36817 - DNA, 50 bp, homo sapien
taaactatcataatgtataagcacakaaatgattgaagttctagcacaga

SEQ ID NO: 36818 - DNA, 50 bp, homo sapien
ccccttcatcctctttcctactgccraggtgatctttctcctattactcc

SEQ ID NO: 36819 - DNA, 50 bp, homo sapien
gacagattttagaaagaggaggagamcgctccaaggtggccaaataggaa

SEQ ID NO: 36820 - DNA, 50 bp, homo sapien
cctttacaaatttatgtcgcacttayaggcaaacaggtggagggcagagg

SEQ ID NO: 36821 - DNA, 50 bp, homo sapien
gctgttaatgtttagaagggcaaaawgtactgtctattataaaaaaaact

SEQ ID NO: 36822 - DNA, 50 bp, homo sapien
tgaattcattgtctatcttctaaacyggttacctttctcaactctgctat

SEQ ID NO: 36823 - DNA, 50 bp, homo sapien
agctttagagaaaggaatgggattaraagagacgagatcaaggggaatgg

SEQ ID NO: 36824 - DNA, 50 bp, homo sapien
aaattatgtgattctattatttcaayggatggtacccatttttgtaactc

SEQ ID NO: 36825 - DNA, 50 bp, homo sapien
ttgcattataccattgaagtaagacraaaacatcagatgacaatagcata

SEQ ID NO: 36826 - DNA, 50 bp, homo sapien
gggaaacaaacaaaaagcacactgtytcattgttccacatctgggctccc

SEQ ID NO: 36827 - DNA, 50 bp, homo sapien
aatccttaaataagaggtatgtcackctagagactgttagataagactac

SEQ ID NO: 36828 - DNA, 50 bp, homo sapien
taaaaagtgttcaaagaaatatatcycttggaatgtagaaagggaaagaa

SEQ ID NO: 36829 - DNA, 50 bp, homo sapien
ctttatttaaacttacttacatgacyctaatttctttctgagaccatagc

SEQ ID NO: 36830 - DNA, 50 bp, homo sapien
agaaataagctttcaatgtgagagaygtagtatgcaaagaaattcccttt

SEQ ID NO: 36831 - DNA, 50 bp, homo sapien
atgaaattgctgctctcaatagataygtacaaacatctatactcatccat

SEQ ID NO: 36832 - DNA, 50 bp, homo sapien
tctccctggaatttttcaatgtatcrgagagatcatcatttcttggattt

SEQ ID NO: 36833 - DNA, 50 bp, homo sapien
caatagggagtcctggcagaagatcsaatagaagcagaatattgagttca

SEQ ID NO: 36834 - DNA, 50 bp, homo sapien
tggagttcaaagaaagagtgaaagcragatagagaatcacagaattaaaa

SEQ ID NO: 36835 - DNA, 50 bp, homo sapien
caaattttcagggaattatctccacraaaatgttgtctgtaagctatgag

SEQ ID NO: 36836 - DNA, 50 bp, homo sapien
cgactcgcaaagcccttccttcggayaacgaatgcattctgataagaaaa

SEQ ID NO: 36837 - DNA, 50 bp, homo sapien
cttcctctctcacactccatatacartctgtcaggaaatggcatctgctt

SEQ ID NO: 36838 - DNA, 50 bp, homo sapien
aaaagagagagaatgagagagattaygtaattgtatatattgggtatttt

SEQ ID NO: 36839 - DNA, 50 bp, homo sapien
cttgctgcttcacatagactttcatktaacggaaatggcttcttttttaa

SEQ ID NO: 36840 - DNA, 50 bp, homo sapien
tcgtaacagcttgctttaattttacraatctaacggacacaacccagtaa

SEQ ID NO: 36841 - DNA, 50 bp, homo sapien
tggacggaagataaagtaatagtaarcattatgcagcacttcaaatagga

SEQ ID NO: 36842 - DNA, 50 bp, homo sapien
aggggcatctgtgtgtctaaggaccrgaaataatctccatgaagagggtg

SEQ ID NO: 36843 - DNA, 50 bp, homo sapien
cataccaataccctaagattataaaytcattgatgtaacagataaaaact

SEQ ID NO: 36844 - DNA, 50 bp, homo sapien
ctcctcgcataaaatccatctcttaygttgtttcagctgcagtataactg

SEQ ID NO: 36845 - DNA, 50 bp, homo sapien
gttttggcccatgtttgtgactacaygggcctcctatggttgtttagaag

SEQ ID NO: 36846 - DNA, 50 bp, homo sapien
aaatgatatctaaggagcatcagaayacctacatctaatttgaattacaa

SEQ ID NO: 36847 - DNA, 50 bp, homo sapien
cacaggccaagtaatggcataagatmaggaaaagccctggtctggcagca

SEQ ID NO: 36848 - DNA, 50 bp, homo sapien
acacaacatcctaccagctaggctaycagatattgataattgtcaaaaag

SEQ ID NO: 36849 - DNA, 50 bp, homo sapien
aagtaactaactacaatggtataacraatcagtcaggtctgggaaagaaa

SEQ ID NO: 36850 - DNA, 50 bp, homo sapien
gtggaagaaacaaatactatcttgakggtgagaataccaaaaaataaagt

SEQ ID NO: 36851 - DNA, 50 bp, homo sapien
gaaatatttcaatttttcactccaaytcatactgatagttcccaaaatga

SEQ ID NO: 36852 - DNA, 50 bp, homo sapien
cccaacatcctctcctctttttaacsaattcttactcataaatttaagtt

SEQ ID NO: 36853 - DNA, 50 bp, homo sapien
cttagtctcttttgtgctgctatcayagaatactgaaggctgggtaattt

SEQ ID NO: 36854 - DNA, 50 bp, homo sapien
ttttttaggcatgcgttgagaaataygttatactctgatgccatcttctc

SEQ ID NO: 36855 - DNA, 50 bp, homo sapien
gtaagcacttggtatttacaattccyacaactatttgaatctggtactgc

SEQ ID NO: 36856 - DNA, 50 bp, homo sapien
tgggaatttaaattgggtcttgtaawgggaatatgattttagtatgggga

SEQ ID NO: 36857 - DNA, 50 bp, homo sapien
aagcattactccagtgcatacagtaratgggagaagaatgatgtgagaag

SEQ ID NO: 36858 - DNA, 50 bp, homo sapien
tatttaattttccagttctttgacaytgcaacccagttcaacccaattca

SEQ ID NO: 36859 - DNA, 50 bp, homo sapien
tgtagtcttgctataatcacagaacmatcgtggtattggtctatcgcaaa

SEQ ID NO: 36860 - DNA, 50 bp, homo sapien
ctcaattgtgaaaatagccactgaayggatgtaacaagatgctctaatgc

SEQ ID NO: 36861 - DNA, 50 bp, homo sapien
agatacactacgaaggtgtgtggtayaattaaacatgtttctgatctttg

SEQ ID NO: 36862 - DNA, 50 bp, homo sapien
atttagaaatcagacttaaaacttcmaaaattatactgaaatagcttccc

SEQ ID NO: 36863 - DNA, 50 bp, homo sapien
ctgctgtaatcatgcagactgaataktaagtttaccctcctcagagattt

SEQ ID NO: 36864 - DNA, 50 bp, homo sapien
cgccctgtgatttaaagcctgtctgwataccttttatccaatttgattgc

SEQ ID NO: 36865 - DNA, 50 bp, homo sapien
tttttgttatgtagggactgcagaaytaattggttggtaagcaaaatact

SEQ ID NO: 36866 - DNA, 50 bp, homo sapien
aatcttaaacattgcattttgagtayggttcatgctagaaagataaagga

SEQ ID NO: 36867 - DNA, 50 bp, homo sapien
cagaccatcaataaatagcttgaacmaattaagatccaactttttggcta

SEQ ID NO: 36868 - DNA, 50 bp, homo sapien
gcagaagttcagtccagtcctcaaamcaggttttcaataaatgtctgtgt

SEQ ID NO: 36869 - DNA, 50 bp, homo sapien
taccttccctgcataacattccatayctcattcccactattcaggaccat

SEQ ID NO: 36870 - DNA, 50 bp, homo sapien
tgtgtttttttcttgttcctagcacygagtctcttcaaaaactttacaca

SEQ ID NO: 36871 - DNA, 50 bp, homo sapien
tgggttaacatccctacgtttggccrctctcttaccttgtcagcctccac

SEQ ID NO: 36872 - DNA, 50 bp, homo sapien
ttttccccctgaataaatcttgactyaaatggtaaatgtgatggattgct

SEQ ID NO: 36873 - DNA, 50 bp, homo sapien
gaaattaaatacacaactaggaagasaactgaataggagtcatctgctgt

SEQ ID NO: 36874 - DNA, 50 bp, homo sapien
taccatgaggaattcctttaccggakaacatgctgtcacaataggttaaa

SEQ ID NO: 36875 - DNA, 50 bp, homo sapien
gagttttgagctaagttttggagtayagatagaagataaccacatgagca

SEQ ID NO: 36876 - DNA, 32 bp, homo sapien
aactgaaactgtcatcmaaatagtagattatg

SEQ ID NO: 36877 - DNA, 50 bp, homo sapien
tttaattcttctatctcatcctttaygacattgttaacctaaaaggaaaa

SEQ ID NO: 36878 - DNA, 50 bp, homo sapien
gagttctattaatctggcaggtaatkaagcaatttaaaagaggtcatatt

SEQ ID NO: 36879 - DNA, 50 bp, homo sapien
aaatatctctgtagaactgaacttayaaggttacttaacttataatgagg

SEQ ID NO: 36880 - DNA, 50 bp, homo sapien
tgctatgccaaataattgaacagtgmataagccttggtgccatggttgtt

SEQ ID NO: 36881 - DNA, 50 bp, homo sapien
gaaaagcttgctttcctggattgcargtgaataaagtgattgaagaaggt

SEQ ID NO: 36882 - DNA, 50 bp, homo sapien
acaccaagcttcacagagctctccaygatttgagttagagctgtctgctt

SEQ ID NO: 36883 - DNA, 50 bp, homo sapien
tacaaagtaccataagcatatatttwaaaaagtcagtggtaattcaatac

SEQ ID NO: 36884 - DNA, 50 bp, homo sapien
atttcagctgtatctgtatgtcgctkaactcagtttttgtttacttgttg

SEQ ID NO: 36885 - DNA, 50 bp, homo sapien
taatcactctgtacagatccctctawgctgtaatcaaaagcatctcttga

SEQ ID NO: 36886 - DNA, 50 bp, homo sapien
ctaagtgtctataaaatccagaagtsaatgaatataacttaaaaataaat

SEQ ID NO: 36887 - DNA, 50 bp, homo sapien
agacaaagagcaaattatcagagaargttgaggtgtacacataatgccgg

SEQ ID NO: 36888 - DNA, 50 bp, homo sapien
acaaaatcaaaaaaattgatattaargtactaccatgcacctgatttact

SEQ ID NO: 36889 - DNA, 50 bp, homo sapien
gggagtctagttaatgaatttaaaasgaaaagtacatatagaggctgatc

SEQ ID NO: 36890 - DNA, 50 bp, homo sapien
acctcagttcaagcatgaatattatwaggaacaatgaaaggtctacttat

SEQ ID NO: 36891 - DNA, 50 bp, homo sapien
ttggagaggtctagtatgtgactatsagaaagaacagaggttctggaaaa

SEQ ID NO: 36892 - DNA, 50 bp, homo sapien
aagcttataaggctagaagttttacraaatcccaactgtcattgccataa

SEQ ID NO: 36893 - DNA, 50 bp, homo sapien
attatttctggaaccgtgataatctraaagcagttttaaaacttcctgat

SEQ ID NO: 36894 - DNA, 50 bp, homo sapien
tatttttctttattgctggaatagasctttggctgtcctttgtggccttc

SEQ ID NO: 36895 - DNA, 50 bp, homo sapien
cttttataatttgtttaaagttaacrctgaatatgacatatttttaaata

SEQ ID NO: 36896 - DNA, 50 bp, homo sapien
aacaaaatctttgtcagatgtcttayagcagatactcaaaaagtacaaga

SEQ ID NO: 36897 - DNA, 50 bp, homo sapien
cagaaaatccctggcattgtataaartgaagagcaccttgttggcaatgg

SEQ ID NO: 36898 - DNA, 50 bp, homo sapien
agaaacctaattgaatcggagtagaygaggactaaaagcataaggaataa

SEQ ID NO: 36899 - DNA, 50 bp, homo sapien
tattaggaagcttgtctagtaaaccsaagacagtattgtgtaataggcaa

SEQ ID NO: 36900 - DNA, 50 bp, homo sapien
aaagctcatttttccagtcactgtargacataaaacctgttgaattttgt

SEQ ID NO: 36901 - DNA, 50 bp, homo sapien
atgcttgtagatcaaaatggtgtgaracttaatgggaagggaacctgcaa

SEQ ID NO: 36902 - DNA, 50 bp, homo sapien
gtttctttcattctttagttgaggayaataaggatctcatcatctaaatc

SEQ ID NO: 36903 - DNA, 50 bp, homo sapien
cactttctataagtaaaaacagttcyatcaggtggctgtctgttacatca

SEQ ID NO: 36904 - DNA, 50 bp, homo sapien
caaagtggcagaactaagagtatccrctaacctcagaagagtagacagat

SEQ ID NO: 36905 - DNA, 50 bp, homo sapien
ttggggctgttgtgtttaagtgtgaygttgaatgcccattttagcatgag

SEQ ID NO: 36906 - DNA, 50 bp, homo sapien
aacatcagtacattcttttaagtgayaatttcctgtatttaagataggtg

SEQ ID NO: 36907 - DNA, 50 bp, homo sapien
actcattattaaattcagcagcaacmaatatctctaccctatgactggtg

SEQ ID NO: 36908 - DNA, 50 bp, homo sapien
acctttcacctggatcatttcacacratggaaactattgatttttaatca

SEQ ID NO: 36909 - DNA, 50 bp, homo sapien
ttctttttccaccaaaaaaatacaaytggaggtaagagtaagcagaggtt

SEQ ID NO: 36910 - DNA, 50 bp, homo sapien
agtagtgtgattcaggatgcttaaayggtataatgagttaagtgagaaaa

SEQ ID NO: 36911 - DNA, 50 bp, homo sapien
gtttttcactgttgaagaaaacagcraacaagatttggcattctgaggag

SEQ ID NO: 36912 - DNA, 50 bp, homo sapien
cttctgttccactgttgaaagttacrgaacattatttctcatctcaaact

SEQ ID NO: 36913 - DNA, 50 bp, homo sapien
tgtcattgctttattctctttttgcrctgcatacttcctaagagactgta

SEQ ID NO: 36914 - DNA, 50 bp, homo sapien
tggatgtcttaaaccccatcaataasagaaggagccccaactcatctgct

SEQ ID NO: 36915 - DNA, 50 bp, homo sapien
tttctcatgcaatgttcgacaaatayctgtttaaaagtgactattaaatg

SEQ ID NO: 36916 - DNA, 50 bp, homo sapien
tgggccatgtcatgaaaggctaaaaragatgagccatttacctcctccct

SEQ ID NO: 36917 - DNA, 50 bp, homo sapien
tccttcttagtctgggtttatcccaraaatgatgagccactttcaagcaa

SEQ ID NO: 36918 - DNA, 50 bp, homo sapien
acttatctgtagtccatctagaaaakaatatacggaacttagggaccaat

SEQ ID NO: 36919 - DNA, 50 bp, homo sapien
ttgcagaaagcttgtttctgaaacastcgaatcttggcaaaacccaggaa

SEQ ID NO: 36920 - DNA, 50 bp, homo sapien
ttttaaattcattgtctgagagatcrcacgtctccatcactttagggtca

SEQ ID NO: 36921 - DNA, 50 bp, homo sapien
tgagaatgcttgtgcagaggtataasagtctcatgtattggttggctttt

SEQ ID NO: 36922 - DNA, 50 bp, homo sapien
taatgattttttaaatcattttatamccaccataatatttaatatttata

SEQ ID NO: 36923 - DNA, 50 bp, homo sapien
ttgtaggtcaagtaattcacttaaaytggttgaaattcagcaactgattt

SEQ ID NO: 36924 - DNA, 50 bp, homo sapien
cttggaggaaaacgttcaggcacacygtatgaggaagcagaacactggtt

SEQ ID NO: 36925 - DNA, 50 bp, homo sapien
tagattgctgccttattatagttgasgcaaagttgtacaaaaaaggagat

SEQ ID NO: 36926 - DNA, 50 bp, homo sapien
ccttttacactttgccctgagaatayggaatgtgcttttccttcacttct

SEQ ID NO: 36927 - DNA, 50 bp, homo sapien
acaaacatttcagtgttgatagcaargaaccaagcaaatgatccaataat

SEQ ID NO: 36928 - DNA, 50 bp, homo sapien
ctcactattccaggttgttttttcayagaactgagatttcctatccctgt

SEQ ID NO: 36929 - DNA, 50 bp, homo sapien
caaactgtgaaaccactaacattgcmgaaactctccatgacattgatctg

SEQ ID NO: 36930 - DNA, 50 bp, homo sapien
aacaaactcagagagaatgtctggtwacaagaatgtgtgttctataacct

SEQ ID NO: 36931 - DNA, 50 bp, homo sapien
cagacattctctctgagtttgtttawcttggaccaaagacctcctggcct

SEQ ID NO: 36932 - DNA, 50 bp, homo sapien
taaattggaccactccatgaagataygataatttttgataccctatgata

SEQ ID NO: 36933 - DNA, 50 bp, homo sapien
ctagaggaaaactttagcctaataaygacacatgtagtatttattttcat

SEQ ID NO: 36934 - DNA, 50 bp, homo sapien
aacacggagatgctcggagaccacaycaggaacagtttccatggaatgat

SEQ ID NO: 36935 - DNA, 50 bp, homo sapien
taaaggactgtctgattggggaagaygaatagatactcagaaatctttct

SEQ ID NO: 36936 - DNA, 50 bp, homo sapien
agtactttcaaggaaatcagcaggarctttgtaaacttgctctgttttcc

SEQ ID NO: 36937 - DNA, 50 bp, homo sapien
atagagtagactgaaattaatttacygacaaatgaaacagggaaaattct

SEQ ID NO: 36938 - DNA, 50 bp, homo sapien
gaaacaacgcaaatacatacagacamccagttctaagaacatcaggacct

SEQ ID NO: 36939 - DNA, 50 bp, homo sapien
tagaaaacgaatcttattaactttarcttttcaactgtatttcatcataa

SEQ ID NO: 36940 - DNA, 50 bp, homo sapien
ggtaggtgttcaaatcaggctgtgakcattacacaaatacatctgtggct

SEQ ID NO: 36941 - DNA, 50 bp, homo sapien
ccatgttgctatttaactataacatraaagtcacaaatcaaactcagttt

SEQ ID NO: 36942 - DNA, 50 bp, homo sapien
cttggatggaggagccttcactttgraagaagtcgatttagtggtgcagc

SEQ ID NO: 36943 - DNA, 50 bp, homo sapien
tttatctgcctccggccttctatcckcagccagtctgtcctgtacatttc

SEQ ID NO: 36944 - DNA, 50 bp, homo sapien
agaagggacttgttgggtaagaaaamagttctgaattaataaactaaaag

SEQ ID NO: 36945 - DNA, 50 bp, homo sapien
tgtcagacagcatgggaaagtgataragtggcctacaagtccccagtgaa

SEQ ID NO: 36946 - DNA, 50 bp, homo sapien
ttaggagggaaggcaggttacttcaygctcactgccatacatgattagct

SEQ ID NO: 36947 - DNA, 50 bp, homo sapien
tgcaaatgcatggaatattaaatagrattggaaaaaatagctaatggaag

SEQ ID NO: 36948 - DNA, 50 bp, homo sapien
tgttctataatgttaaagtgtgttaygggcatatgcatatgtcaaatcgc

SEQ ID NO: 36949 - DNA, 50 bp, homo sapien
taagctcttcttatttcctggctacratttatagcactgagccaagtcca

SEQ ID NO: 36950 - DNA, 50 bp, homo sapien
aaagaaatcactgataagaggactasagtggaggtaggaagtctctttac

SEQ ID NO: 36951 - DNA, 50 bp, homo sapien
acatctaccactgatgattatattasacctagaagtattctaaaacaaat

SEQ ID NO: 36952 - DNA, 50 bp, homo sapien
aatggcttaaattatgaagttaaaaytttgctgtatatgacattgaacct

SEQ ID NO: 36953 - DNA, 50 bp, homo sapien
ctaaactgagattaaatattaatgaygaaaatgtagtatatgagttgaca

SEQ ID NO: 36954 - DNA, 50 bp, homo sapien
aaccaatacaaaaattattaatgagwcattttaccttcttcaaaatcttt

SEQ ID NO: 36955 - DNA, 50 bp, homo sapien
ggcattttaggttaattgcttaagakagtctcaatttgaaaccccatatt

SEQ ID NO: 36956 - DNA, 50 bp, homo sapien
gaataaatgtctacagagttgtacaygactaataagacttttacacaaac

SEQ ID NO: 36957 - DNA, 50 bp, homo sapien
cttgctgtaatacaaataaaggtgamaatgttattactgatctggataat

SEQ ID NO: 36958 - DNA, 50 bp, homo sapien
tgataattttagaattcgtggttaartcctctgttaccaggaagaaggtg

SEQ ID NO: 36959 - DNA, 50 bp, homo sapien
attaaagacttaaatgtaagatatcraactacaaaaatcctagaagaaaa

SEQ ID NO: 36960 - DNA, 50 bp, homo sapien
aggttgcctattgttaactgcttaaktcatatcagaaagattttaatgaa

SEQ ID NO: 36961 - DNA, 50 bp, homo sapien
tgtttatttcaaaaggaaaaaagcayactaattgacaaccatatgtttaa

SEQ ID NO: 36962 - DNA, 50 bp, homo sapien
acacaaaaagggaaactataatgacrctacatacacctcacccagattaa

SEQ ID NO: 36963 - DNA, 50 bp, homo sapien
ttatcttccaaggagcatgctccaakgcactcatcatgacaaagtacctg

SEQ ID NO: 36964 - DNA, 50 bp, homo sapien
ggctctatcctgtgggtgatagtcaytgacagatgataataaggagaatg

SEQ ID NO: 36965 - DNA, 50 bp, homo sapien
caaatgcatttcattaagtcatccaygtgaccaggatttcctattgtgaa

SEQ ID NO: 36966 - DNA, 50 bp, homo sapien
gttgtctcttgatttctaggtttccrgcacaaccactagctctcccctag

SEQ ID NO: 36967 - DNA, 50 bp, homo sapien
gtaatccccatcctcagttgcaaaartcttgtgtttcaggcaagcatttg

SEQ ID NO: 36968 - DNA, 50 bp, homo sapien
cagaaataccgaaattataccaatcrgaaaaatgacaaacacccttttaa

SEQ ID NO: 36969 - DNA, 50 bp, homo sapien
caagaaatatagtcagggatttgaamtgcggtaatgtctttgaagtctag

SEQ ID NO: 36970 - DNA, 50 bp, homo sapien
agaccgtgctcatatgctaaattcaytcagagagtacctacaaatccatc

SEQ ID NO: 36971 - DNA, 50 bp, homo sapien
tttatttgtaataaaaaatataataygtgctgtttctcagataagatttt

SEQ ID NO: 36972 - DNA, 50 bp, homo sapien
actagaaaggcctgtgtaagaagcamtcagactgctggaagtagagtaaa

SEQ ID NO: 36973 - DNA, 50 bp, homo sapien
ataagaataaagatagacagttgaamgtgcacaaaaagacagagattata

SEQ ID NO: 36974 - DNA, 50 bp, homo sapien
attatttaaacaaaactaatgtatargcaaaaagtcacataaaactgata

SEQ ID NO: 36975 - DNA, 50 bp, homo sapien
cttatcagctgagagtgaagaataaraaatggatggtgaaggtttgaaga

SEQ ID NO: 36976 - DNA, 50 bp, homo sapien
ttttactaaactatttgccacattaygtaaattatgaatatctaaagaca

SEQ ID NO: 36977 - DNA, 50 bp, homo sapien
cttgttggtaatatgtacttgaaaawtttgtttgtaatcattttcactgt

SEQ ID NO: 36978 - DNA, 50 bp, homo sapien
ttattcttcactctcagctgataagrcaagcagaataaaaaaccttttcc

SEQ ID NO: 36979 - DNA, 50 bp, homo sapien
aacccaaacttttttattctgcacaratagagtaaaatttcatggtaatg

SEQ ID NO: 36980 - DNA, 50 bp, homo sapien
ggacagacttggtaatctggagaacygtgcacttaacctcgagtgtggct

SEQ ID NO: 36981 - DNA, 50 bp, homo sapien
aaaatttttggtttactgttagcaaytctcatggccttttgcagtttcca

SEQ ID NO: 36982 - DNA, 50 bp, homo sapien
acaagtccagaaaagatgcatacacmaagaaggcttgagagacccccaga

SEQ ID NO: 36983 - DNA, 50 bp, homo sapien
ttcaaagtctccataaccaattataraagggaatgtcacatgagaaattc

SEQ ID NO: 36984 - DNA, 50 bp, homo sapien
gggaaagtccctgcggtgaacagagyatgagttgtatgccataataaagg

SEQ ID NO: 36985 - DNA, 50 bp, homo sapien
cttagtacataaaattctaagtttaygttttgagactataaaggtgtaaa

SEQ ID NO: 36986 - DNA, 50 bp, homo sapien
ttctcacagcttggaatgtttggaayctatggtcagaaacaaggtggcca

SEQ ID NO: 36987 - DNA, 50 bp, homo sapien
gtggttccagagagacacttaataaygtgcttcacactgattcagttgac

SEQ ID NO: 36988 - DNA, 50 bp, homo sapien
aggatttttatttgaaccagcttaayggcaatggagtcctgtgagattct

SEQ ID NO: 36989 - DNA, 50 bp, homo sapien
gattatttcctttctagctacaagawagactcttttggaccccctaggac

SEQ ID NO: 36990 - DNA, 50 bp, homo sapien
taaatattattatttttcataattcrgaagtctaacaactctgtgtgtgt

SEQ ID NO: 36991 - DNA, 50 bp, homo sapien
tatcgaggtgtcatatgtaatgagcsaatatttacatagaataattatgt

SEQ ID NO: 36992 - DNA, 50 bp, homo sapien
ctactatttatttttaatagtcaggwagtcaaaacatagtaaaatgtcat

SEQ ID NO: 36993 - DNA, 50 bp, homo sapien
atacattgatttgtcatgatacacaytgaatttgatccaatagtttaagg

SEQ ID NO: 36994 - DNA, 50 bp, homo sapien
cataattctgactagggaatgagcaraacttcctagagaatgtttgtcaa

SEQ ID NO: 36995 - DNA, 50 bp, homo sapien
gtacatggcacaaaataaagtatacmagagttacgaagcatgatatgtgc

SEQ ID NO: 36996 - DNA, 50 bp, homo sapien
aatattacatttttcttatttatgckctttttgacctttattgccttttc

SEQ ID NO: 36997 - DNA, 50 bp, homo sapien
attgattcttctcaagttttgccatwagtgttctcttctctctctctgcc

SEQ ID NO: 36998 - DNA, 50 bp, homo sapien
cactctaagagtgctctctaggaagsctgtactaatatgcttgcctataa

SEQ ID NO: 36999 - DNA, 50 bp, homo sapien
aaagtaaatcatgcatgataaataayatggatccctctccaaaagtaaat

SEQ ID NO: 37000 - DNA, 50 bp, homo sapien
ctgactggatgcacatataaggaaartgaggtaaacttcattactgagca

SEQ ID NO: 37001 - DNA, 50 bp, homo sapien
atggatattaagtatatttcagtagmcaggcattgaatataagcacagat

SEQ ID NO: 37002 - DNA, 50 bp, homo sapien
gatggttattattattgctggtgaamttatagctcctgttggttaaattt

SEQ ID NO: 37003 - DNA, 50 bp, homo sapien
ttaacatagttccccaaaaagatgcmaatgaaaataggtttctaaattta

SEQ ID NO: 37004 - DNA, 50 bp, homo sapien
ccccagtataattatgttaatctccraatttataacaaaaaaatatagaa

SEQ ID NO: 37005 - DNA, 50 bp, homo sapien
cacagcatatctataaagacaatackagagctaaacaatgactacataat

SEQ ID NO: 37006 - DNA, 50 bp, homo sapien
tatttgtggcttctgctattaccgaycttgtccctgaggattatatttca

SEQ ID NO: 37007 - DNA, 50 bp, homo sapien
cttgtattctccatatcaacacagaraaaggaaagtacagtattgaataa

SEQ ID NO: 37008 - DNA, 50 bp, homo sapien
atctgcatctggcctcaccatctcayacaaagtaatatagttaaaatata

SEQ ID NO: 37009 - DNA, 50 bp, homo sapien
tttaaaatactgtactacataaatamctttttgaagcagtactgcataat

SEQ ID NO: 37010 - DNA, 50 bp, homo sapien
ttgacaaataatgactgatatgtgcraagtacaattttttttttcatttt

SEQ ID NO: 37011 - DNA, 50 bp, homo sapien
caatttcccatattagtttttgatgratgaggaactatataagctttcca

SEQ ID NO: 37012 - DNA, 50 bp, homo sapien
ctataaatgtctgtctgacttaaaakatcattaaatcatgtcatctcact

SEQ ID NO: 37013 - DNA, 50 bp, homo sapien
atttccaaagctttcttttgtgactmaaattgtggcttcacctagcatta

SEQ ID NO: 37014 - DNA, 50 bp, homo sapien
aattgcctttgagacccacctatcasaatgactaatatgtgttttggtca

SEQ ID NO: 37015 - DNA, 50 bp, homo sapien
atttatatacttacttggaaagctarcaattaaatttttacttcagactt

SEQ ID NO: 37016 - DNA, 50 bp, homo sapien
actccaagcaatagctctactacacwcctttcttaacaccacgtatacta

SEQ ID NO: 37017 - DNA, 50 bp, homo sapien
agtaatcctcatgaagtttggctatraaaagcactcatgggttctgaaca

SEQ ID NO: 37018 - DNA, 50 bp, homo sapien
gtgataaacagtaggcaattcttcawctcattgagacatctaggattctt

SEQ ID NO: 37019 - DNA, 50 bp, homo sapien
aattaattcttactcatgggtgtcastcttacagtaaaaaagaaaaatga

SEQ ID NO: 37020 - DNA, 50 bp, homo sapien
tgacaatgcaaacaaatcagattatsaattaacaaaacatatcctgtgtt

SEQ ID NO: 37021 - DNA, 50 bp, homo sapien
ttaatgaaagtatggaatagagtcayctggaataaagaggaaaaaagaac

SEQ ID NO: 37022 - DNA, 50 bp, homo sapien
aagtttcttggatacaagtttctagratatatcatttgtacctgactaat

SEQ ID NO: 37023 - DNA, 50 bp, homo sapien
gctctctaaaactaatagtgattcarataaacttataccaggagactgac

SEQ ID NO: 37024 - DNA, 50 bp, homo sapien
tcttgtttagcagacaaaactgagaratttccaaaaggtaaaatacttaa

SEQ ID NO: 37025 - DNA, 50 bp, homo sapien
gtcatttcagaaaacatctatcaccrcataccgggagtccagcaggaaag

SEQ ID NO: 37026 - DNA, 50 bp, homo sapien
ccaaacaatgccatcttgtcctacasagtgttcccaaagcagccttttct

SEQ ID NO: 37027 - DNA, 50 bp, homo sapien
gccagagagacatgacgtcttgatakgaggaccttgagtcagttgcaact

SEQ ID NO: 37028 - DNA, 50 bp, homo sapien
ttttagaaaaacttttgtcattgaamacaggtaatgcaaatcacagaaaa

SEQ ID NO: 37029 - DNA, 50 bp, homo sapien
attacatctataagccttgctctcamattcaaaatgtatgcctttaggaa

SEQ ID NO: 37030 - DNA, 50 bp, homo sapien
tcaaattgagaaagcatagcagatamcttggctcaaatgcctgctgcccc

SEQ ID NO: 37031 - DNA, 50 bp, homo sapien
aatttagtagagacagaagatagaasagtagatagaagagaagatagaaa

SEQ ID NO: 37032 - DNA, 50 bp, homo sapien
acaccagtacatcaccatgatagacycaaactttataccaggcactactg

SEQ ID NO: 37033 - DNA, 50 bp, homo sapien
ctataggatacttgagaggcttaccwagtttttaggctgtttgctggctc

SEQ ID NO: 37034 - DNA, 50 bp, homo sapien
tttatattttgaagtcttacacttaracatttaatccatcttgagttact

SEQ ID NO: 37035 - DNA, 50 bp, homo sapien
aagtggaattgtgattgatttttaargtaaatagtagttctatattcaac

SEQ ID NO: 37036 - DNA, 50 bp, homo sapien
taatgattttatctccatcattattsaaatgtgtgttagtactttctgta

SEQ ID NO: 37037 - DNA, 50 bp, homo sapien
tgtagatacagttctccaagcatgargtttctggatctgcaagtaggaac

SEQ ID NO: 37038 - DNA, 50 bp, homo sapien
cttgatctttgatagttattttgtawgtaattttaaatatctgctataga

SEQ ID NO: 37039 - DNA, 50 bp, homo sapien
ggtgcaaatgctggaaatcacatggkaaaaagtcgaagttatcgctcagt

SEQ ID NO: 37040 - DNA, 50 bp, homo sapien
tatagacacaaacatgtattggataygcacagcttaaatgcagaaaatag

SEQ ID NO: 37041 - DNA, 50 bp, homo sapien
gtcaataataaagagatgtgacccawtaattacatgtaatatatattttt

SEQ ID NO: 37042 - DNA, 50 bp, homo sapien
ccctacagttactttgggacaatagmactaatgctgataaaggaggggga

SEQ ID NO: 37043 - DNA, 50 bp, homo sapien
tcatgagaacaaatgtttttctttayaggccttttgctttacagggtcac

SEQ ID NO: 37044 - DNA, 50 bp, homo sapien
cacatttgctaatgtctcattggctsaaactattcacatggccatggcca

SEQ ID NO: 37045 - DNA, 50 bp, homo sapien
ttgggtgactaactgggtgaaaattmaattaccagaataaaagtttagag

SEQ ID NO: 37046 - DNA, 50 bp, homo sapien
ctagcagggaatggtaggacctcaartagcacagcaggtatacttctgta

SEQ ID NO: 37047 - DNA, 50 bp, homo sapien
gatcttgcctatgccctactctgacygcatgaccttgagcccatcactaa

SEQ ID NO: 37048 - DNA, 50 bp, homo sapien
gcatcatggttttatttatacttccratttgggatgccccttctcccatt

SEQ ID NO: 37049 - DNA, 50 bp, homo sapien
tggtattgggcttttatgttggtcaraaggtggagctggtgaggctggtg

SEQ ID NO: 37050 - DNA, 50 bp, homo sapien
gtttagatcactgcaccatctctagyaagttgaatatgttttaggtctta

SEQ ID NO: 37051 - DNA, 50 bp, homo sapien
agagtcattgatggataacaggtcaratagatttaggaaactctgaggcc

SEQ ID NO: 37052 - DNA, 50 bp, homo sapien
gacactttgcctctatcatcataaakttaggacattgggaaagtattttt

SEQ ID NO: 37053 - DNA, 50 bp, homo sapien
ggtgatgcttctcacagtggagtacygaaaaggagtactgaagggttcca

SEQ ID NO: 37054 - DNA, 50 bp, homo sapien
taatgtgcaggaagctaaatagtacractaccaatcactcccagatggct

SEQ ID NO: 37055 - DNA, 50 bp, homo sapien
catcagtgaacattggactctactakatacttgtgcacatatgtcgtctt

SEQ ID NO: 37056 - DNA, 50 bp, homo sapien
aatatttaattatgtatctatgaaarctaaagatcctttataaaaaacac

SEQ ID NO: 37057 - DNA, 50 bp, homo sapien
gaaaaataaatacaacaataacccaygagtcatctgcatttgatcacaat

SEQ ID NO: 37058 - DNA, 50 bp, homo sapien
aaagagcagccttgtgataaaagacygagtagaggtccaaaacatttact

SEQ ID NO: 37059 - DNA, 50 bp, homo sapien
agtaaatagacataagggtttgcaaktaactatatggatataaatgaaaa

SEQ ID NO: 37060 - DNA, 50 bp, homo sapien
gagaacaatggtagcactgacctccragagtggttgcgaggattaaacga

SEQ ID NO: 37061 - DNA, 50 bp, homo sapien
aactattagtagttggttgactggasaggagtaaacagaatggagaaatt

SEQ ID NO: 37062 - DNA, 50 bp, homo sapien
gcacaatcatttgagagctacccaaygcaaactgagctctgcaactatcc

SEQ ID NO: 37063 - DNA, 50 bp, homo sapien
ggcaggaagtagttctgttagccgargaaatacatgacctggagaagagc

SEQ ID NO: 37064 - DNA, 50 bp, homo sapien
taacaaggatttgtagtaaggaattwaaaatgtgcctttgtaaaaatgat

SEQ ID NO: 37065 - DNA, 50 bp, homo sapien
aaaaattccattacaaattttgctayaatacacagcctatttttttcaca

SEQ ID NO: 37066 - DNA, 50 bp, homo sapien
aatgtaaaatttatcagaatagtacrccttaatgcttattgtaaagaaat

SEQ ID NO: 37067 - DNA, 50 bp, homo sapien
tcattctcttcaccagtttaaacaaycttaacaatgactaatttcaaaca

SEQ ID NO: 37068 - DNA, 50 bp, homo sapien
gaacgttttaaacagaatacagccartgcaagttaccaagatgtgatcaa

SEQ ID NO: 37069 - DNA, 50 bp, homo sapien
aaaattcaatggattacaatggaaaytattgcctaaagctcaaactgaaa

SEQ ID NO: 37070 - DNA, 50 bp, homo sapien
gggagaccacctgctttatagtctcsgaattaacagagtttttaggtaaa

SEQ ID NO: 37071 - DNA, 50 bp, homo sapien
cattccatataaagtactgaaaaaayttataattagtgtccattagatgc

SEQ ID NO: 37072 - DNA, 50 bp, homo sapien
taatttatttgagatccttctctccrctaatcctatgtagaattatgata

SEQ ID NO: 37073 - DNA, 50 bp, homo sapien
ggtgtctttttgctagtatatccaasagcatattaaaaagacaacacacc

SEQ ID NO: 37074 - DNA, 50 bp, homo sapien
tcagaaggtgtttaactataggaaakctctagttggtctcagttggtcag

SEQ ID NO: 37075 - DNA, 50 bp, homo sapien
gccaacaccaggcattgtttttaaayttgaacatcttattctaaatcaag

SEQ ID NO: 37076 - DNA, 50 bp, homo sapien
aatcattttagttttcttctcatgcwacttgatttaagtgttgagcagta

SEQ ID NO: 37077 - DNA, 50 bp, homo sapien
ttctagttagtgttgcaagagtgaasagttgtagcatgctgcttccttac

SEQ ID NO: 37078 - DNA, 50 bp, homo sapien
cagcaaaaagacaaatgtccatctaygaattaacaagtacaaaatgaaga

SEQ ID NO: 37079 - DNA, 50 bp, homo sapien
ttttatatctatatttcaggtaaaartaaacttacaatatatcctataaa

SEQ ID NO: 37080 - DNA, 50 bp, homo sapien
gtagacattttagagagaccatatamagctacaagtaccatgaataaata

SEQ ID NO: 37081 - DNA, 50 bp, homo sapien
cttcttttctggttttgccactaacsatcacttattacataactgtttga

SEQ ID NO: 37082 - DNA, 50 bp, homo sapien
ggtgggaaaacatcatcttgtttaayctgacctgttgtgtcccactagta

SEQ ID NO: 37083 - DNA, 50 bp, homo sapien
gacactgaagaaaaaagactttagayatggagtttatcagaaggaaatta

SEQ ID NO: 37084 - DNA, 50 bp, homo sapien
ataatttaaaaaatagcgtaacaacsattttagagccaaaaatgctcaaa

SEQ ID NO: 37085 - DNA, 50 bp, homo sapien
gaaccagagtttccaacacaaaatcrgagctcaggcttaataaatcttat

SEQ ID NO: 37086 - DNA, 50 bp, homo sapien
taggcttctcgaggcatggttgccayacatcttcaatttaaaaacaaaaa

SEQ ID NO: 37087 - DNA, 50 bp, homo sapien
gtgttcacttggtttctgtgtttcamgtattggtaattcttgcaatattt

SEQ ID NO: 37088 - DNA, 50 bp, homo sapien
ttagaaattctgtcacagatgtctgmaattgttaaaattagcatgtttta

SEQ ID NO: 37089 - DNA, 50 bp, homo sapien
tctttaaattggataataaatagtaygtctcatccaactgattaagaaca

SEQ ID NO: 37090 - DNA, 50 bp, homo sapien
caagaatataagaatcaaagtattgraaagttacagttagaaaatattaa

SEQ ID NO: 37091 - DNA, 50 bp, homo sapien
aactagaaaatgttattggataaaawaattctgtctttctagttgttggt

SEQ ID NO: 37092 - DNA, 50 bp, homo sapien
agagagagtaattagctccttcttarcaagtcagaaaatgcttcattgaa

SEQ ID NO: 37093 - DNA, 50 bp, homo sapien
tacaggatgtctattgtaattatgaytagagcttaaaaaacaaacaagaa

SEQ ID NO: 37094 - DNA, 50 bp, homo sapien
ctaactgttgaatcaaaatagctgarcataaaaatccacaggctacctat

SEQ ID NO: 37095 - DNA, 50 bp, homo sapien
attctaaaaatcctagggcccttaakaactctgataaatctactcttcct

SEQ ID NO: 37096 - DNA, 50 bp, homo sapien
ctcaaatgtccaggtgcttctggagraacatatagcagtgtcctctggca

SEQ ID NO: 37097 - DNA, 50 bp, homo sapien
ggaacattgttttataacttattagrccttgtgtgttacgatattgctct

SEQ ID NO: 37098 - DNA, 50 bp, homo sapien
tctcacatacagtacaatattaagckcaaacaacatatgtctccatggtt

SEQ ID NO: 37099 - DNA, 50 bp, homo sapien
ctgtctagggattgctaagtttttakgccttgtagagtgaaacctttttt

SEQ ID NO: 37100 - DNA, 50 bp, homo sapien
tattcagtctttaacactccagatgmacagggtactaagatgactatgtc

SEQ ID NO: 37101 - DNA, 50 bp, homo sapien
tagatggaatattaaatagacaaackccaatccatatattctttatactt

SEQ ID NO: 37102 - DNA, 50 bp, homo sapien
atgctccagagaagatttgaagagayacgtgataatgcatgctgcttatt

SEQ ID NO: 37103 - DNA, 50 bp, homo sapien
aggaggagaaaggtcatattgtattwaaaaaaaagccctgaaagatggaa

SEQ ID NO: 37104 - DNA, 50 bp, homo sapien
ttatagaagatgactttcataactcmataaaccaaagaatcatatattta

SEQ ID NO: 37105 - DNA, 50 bp, homo sapien
gtttttattttcaaattgctttaaayatgtgtatcagtaatcaatattac

SEQ ID NO: 37106 - DNA, 50 bp, homo sapien
aactagagactgaatactgattcaawgcatatttatatttattaaattct

SEQ ID NO: 37107 - DNA, 50 bp, homo sapien
cccaaacatctgccttctcagagttraacctgacataatttaaattaagt

SEQ ID NO: 37108 - DNA, 50 bp, homo sapien
aaaagataagatcagtgtgagtttaraaaggaaaggctctctgaagaaat

SEQ ID NO: 37109 - DNA, 50 bp, homo sapien
gtttaaatcaagccacaatgaaagayatgatagtaaaaagtgggtatctt

SEQ ID NO: 37110 - DNA, 50 bp, homo sapien
tgacttttctaaataccgctctggargtcaaagtcatttccaaagccaga

SEQ ID NO: 37111 - DNA, 50 bp, homo sapien
aaagttgtagctgttggtatgtgaasagagtaaaactaaaataaataaac

SEQ ID NO: 37112 - DNA, 50 bp, homo sapien
ttatagttaagtagactaaagtgacrccttaatacattttcgattatcta

SEQ ID NO: 37113 - DNA, 50 bp, homo sapien
agtaactgcctaaaaacaaaatgaaratcagtgttaggaattcttgatga

SEQ ID NO: 37114 - DNA, 50 bp, homo sapien
aaataaatatgtgaattaatataacraggaatgcgagacgtgtcaaatga

SEQ ID NO: 37115 - DNA, 50 bp, homo sapien
attagtatcttaaaatatgaaaataygtgaataagtgtatgtaatgtgta

SEQ ID NO: 37116 - DNA, 50 bp, homo sapien
gtagtgaaaataaagtggaagttacyaagtaagcagagaaaactgtgtaa

SEQ ID NO: 37117 - DNA, 50 bp, homo sapien
acctggtagtatctgtttccaagtgyagttgttctgcaagattgtcttag

SEQ ID NO: 37118 - DNA, 50 bp, homo sapien
tgtcattttgcctctgaaatctgtawaaattgtgttatcatcacaccata

SEQ ID NO: 37119 - DNA, 50 bp, homo sapien
gtatattttgcattttacagaagacrcttttactgtgattgcagaatagt

SEQ ID NO: 37120 - DNA, 50 bp, homo sapien
tagagtgtgaaaaataatttccatarctttaaatgcatcattattcctca

SEQ ID NO: 37121 - DNA, 50 bp, homo sapien
gagaaaatgaaaagattcaattcagraagctcaaaggagatatatccaac

SEQ ID NO: 37122 - DNA, 50 bp, homo sapien
taccttttataaaacatgacataagrcaatataattaagactaaacttat

SEQ ID NO: 37123 - DNA, 50 bp, homo sapien
gacttgactcttttatgtgtgtctasaattattcctctatggttttgttg

SEQ ID NO: 37124 - DNA, 50 bp, homo sapien
ccaccaaaagcaacatcttttttaartaggctagtagaattcataaacag

SEQ ID NO: 37125 - DNA, 50 bp, homo sapien
tcctgccctgcctgtgtttgactgaycgcctactgtaacagtagttgctg

SEQ ID NO: 37126 - DNA, 50 bp, homo sapien
gtagcaattacatttcaattgaacasagggtaaaagagaagcttgctggc

SEQ ID NO: 37127 - DNA, 50 bp, homo sapien
aatgacttcctaaaggtattcctcartgacactctggtagtccatattac

SEQ ID NO: 37128 - DNA, 50 bp, homo sapien
ttttttgtgcaaggggagatcaagartaattgcctatgaatttataaaac

SEQ ID NO: 37129 - DNA, 50 bp, homo sapien
cagtgcattactacagtgtcagcaayagaattcttggtttattataaaca

SEQ ID NO: 37130 - DNA, 50 bp, homo sapien
tatgcaaaatgtcagcttcacagtaycctttaaattattttatttctctc

SEQ ID NO: 37131 - DNA, 50 bp, homo sapien
taaatcctgatctattatgtgaagamagtaacacaagattattccctaat

SEQ ID NO: 37132 - DNA, 50 bp, homo sapien
aagaatactgtatgatcatgcctccraaagtcagattaagactatgattc

SEQ ID NO: 37133 - DNA, 50 bp, homo sapien
tacactgatttgtctccttctagatragtaatcgagtaatcatttttgtt

SEQ ID NO: 37134 - DNA, 50 bp, homo sapien
catcaaagaaattacattgttgacayggttctaatattatttcttacatt

SEQ ID NO: 37135 - DNA, 50 bp, homo sapien
tattgcatggcatttgtcttgcttamctactctgtgccagatgttttaca

SEQ ID NO: 37136 - DNA, 50 bp, homo sapien
attctttttagttaacatttcttcartctgagacatatggatcatttatc

SEQ ID NO: 37137 - DNA, 50 bp, homo sapien
attttatattaaaaacaaccttccawgggaataaacagatatgagaatac

SEQ ID NO: 37138 - DNA, 50 bp, homo sapien
gcagagaccttttctggaccacagakagttcttaatttagagcacagaga

SEQ ID NO: 37139 - DNA, 50 bp, homo sapien
tcccctcctgacacctccagtacgakaaaatgtgctagattacatgttcg

SEQ ID NO: 37140 - DNA, 50 bp, homo sapien
gcgaaattatgtgatcagaggttccrgccataaccacagaggaattggag

SEQ ID NO: 37141 - DNA, 50 bp, homo sapien
ccttaatttgtctttcactctgcacsataaagataactaagtgctccatt

SEQ ID NO: 37142 - DNA, 50 bp, homo sapien
ctagcaggacaatgaatttgcaccastcaatcaaaacaaataaggactat

SEQ ID NO: 37143 - DNA, 50 bp, homo sapien
tgagattcaagtctgtcacctgcctraaaaagtatccattcttacctttg

SEQ ID NO: 37144 - DNA, 50 bp, homo sapien
gaacactaaaaaggcctttactccartgataacatatccaagccattccc

SEQ ID NO: 37145 - DNA, 50 bp, homo sapien
ttgactcttccctaagtggtctacawcctctctccacttctcctcttatg

SEQ ID NO: 37146 - DNA, 50 bp, homo sapien
tgtggaagtgacatcattaacaaaarcctgaactgacaacaataagctca

SEQ ID NO: 37147 - DNA, 50 bp, homo sapien
taaatggtgatttaagtagaggataycgaataacaagttagattaacagc

SEQ ID NO: 37148 - DNA, 50 bp, homo sapien
gacacaacgcttgggatataatccamctaatagaacctaatgactataat

SEQ ID NO: 37149 - DNA, 50 bp, homo sapien
catacaaactgatccacaaaacccawgtaaagatttgctcagaagtggta

SEQ ID NO: 37150 - DNA, 50 bp, homo sapien
ttgttcagtttacacattaacccagmaaaagtccactgaaacaatatgta

SEQ ID NO: 37151 - DNA, 50 bp, homo sapien
aggaacttattgtttagctttgaaartagagactgagagaggtttttcta

SEQ ID NO: 37152 - DNA, 50 bp, homo sapien
atattcttgcttctctaaatatttgracttggagaaattactttgaagcc

SEQ ID NO: 37153 - DNA, 50 bp, homo sapien
aaacccccaagaaaattaatgccgaktattctcaacaaatatctatttat

SEQ ID NO: 37154 - DNA, 50 bp, homo sapien
accatctaagtaccgggaggcaccartgcatatcccactccaccttctct

SEQ ID NO: 37155 - DNA, 50 bp, homo sapien
tgtcttccagttgttcaatgtaccckgagttgatttttatccttcccacc

SEQ ID NO: 37156 - DNA, 50 bp, homo sapien
aaggaccccaaaactcaatgttgtaygaaaataagcattttactcttttg

SEQ ID NO: 37157 - DNA, 50 bp, homo sapien
gcttgggaaagtaagtggaaagagarcctatggagagaattcaaaggcag

SEQ ID NO: 37158 - DNA, 50 bp, homo sapien
cctgaaggtagcgtgggacagaatcrccgatttttctacctacacatttt

SEQ ID NO: 37159 - DNA, 50 bp, homo sapien
tgcatgacaaaggtcaagtcaggtcwagtatttctacaaggatccaaaaa

SEQ ID NO: 37160 - DNA, 50 bp, homo sapien
gctgagaagagaaatattggtgcaasagggagtggtatgaattaaacatc

SEQ ID NO: 37161 - DNA, 50 bp, homo sapien
tgttcactgggcctgtgtgaatccamatcactgagaataaattgcacaac

SEQ ID NO: 37162 - DNA, 50 bp, homo sapien
caaagcttatgtgtgaatctgacaargttaaaaactccaggcacaataag

SEQ ID NO: 37163 - DNA, 50 bp, homo sapien
tctttgtcagttaatggtgctataamaaattaccatagactaggtggctt

SEQ ID NO: 37164 - DNA, 50 bp, homo sapien
ctatttaatattatacctgttaaacratgagaaaaagataaactaggaca

SEQ ID NO: 37165 - DNA, 50 bp, homo sapien
aagttcatataaatacatattacaartaccctgagaaataagtgatgtgc

SEQ ID NO: 37166 - DNA, 50 bp, homo sapien
tgttttgggaacattagaccaattarcattactatcaatagaagttgcta

SEQ ID NO: 37167 - DNA, 50 bp, homo sapien
gcatagcatagtaccttgcttttatsacaggcattcagtaaaatgtttct

SEQ ID NO: 37168 - DNA, 50 bp, homo sapien
aattatgtagacttatcttgtaagamtcacataaaaatcatatagtggat

SEQ ID NO: 37169 - DNA, 50 bp, homo sapien
agatgtatttagtccaataattactracataaaagaaaagagtggaggta

SEQ ID NO: 37170 - DNA, 50 bp, homo sapien
cctgaaaaggctcacttttgaaagcragtaataacacttttgatatgaat

SEQ ID NO: 37171 - DNA, 50 bp, homo sapien
ataattagtaagtcagaatcactaasgcatactttccttcaagtttccaa

SEQ ID NO: 37172 - DNA, 50 bp, homo sapien
acagactttgattatgtgcaacatargagtcaatgtatttaactaatggc

SEQ ID NO: 37173 - DNA, 50 bp, homo sapien
taaattgggctgtttcactaccactragtaaattctgacataattctttg

SEQ ID NO: 37174 - DNA, 50 bp, homo sapien
cattacagtaaatcttctctaatcaytacagttgctgaaatactagacat

SEQ ID NO: 37175 - DNA, 50 bp, homo sapien
tccatggtgatgattttgctagtcaygttaggttattttggtttgtgtta

SEQ ID NO: 37176 - DNA, 50 bp, homo sapien
gctttcagaaattatttattttgaawctggtaatgtattagttcattctc

SEQ ID NO: 37177 - DNA, 50 bp, homo sapien
tcacacagcacactgttgcctataayggaagctgctctagttaatttaaa

SEQ ID NO: 37178 - DNA, 50 bp, homo sapien
agtggatcattctattctattacacygctattgtaacatgtactccttca

SEQ ID NO: 37179 - DNA, 50 bp, homo sapien
atttacttataatagacaaacctaaygattgaatacacctaattattctg

SEQ ID NO: 37180 - DNA, 50 bp, homo sapien
acttagatttcatgaaacctgaaagmcctggtaaggaagtaaagcacagc

SEQ ID NO: 37181 - DNA, 50 bp, homo sapien
tccaatagaactctcttgaatagtgraaatgttttacatctgctttgtcc

SEQ ID NO: 37182 - DNA, 50 bp, homo sapien
aaaatcctgcacatgaattgtgtgamctataagctctatgaagtgatagt

SEQ ID NO: 37183 - DNA, 50 bp, homo sapien
ctgaacattggtagacaacatactayctcattgaatctttagcagctgtg

SEQ ID NO: 37184 - DNA, 50 bp, homo sapien
tatgacatcacttgtgtatggtgacmagatttaactcaactaaaacctca

SEQ ID NO: 37185 - DNA, 50 bp, homo sapien
tattattttaaaacatacaataaaargaacatgtaaaagtatttttttta

SEQ ID NO: 37186 - DNA, 50 bp, homo sapien
ctttctttttgtttcttatcagttgraagcgattaggtgctaatctggag

SEQ ID NO: 37187 - DNA, 50 bp, homo sapien
tgacgtctcagcaactaaaacctaaytggccatctgctagaactgctgta

SEQ ID NO: 37188 - DNA, 50 bp, homo sapien
acatttctaaatcattcagccttgargtactcataattttacttcatatt

SEQ ID NO: 37189 - DNA, 50 bp, homo sapien
agtgatagagtttgccaattccagartctgcagggtgggtcagcaggctg

SEQ ID NO: 37190 - DNA, 50 bp, homo sapien
aatataaatggatttttgtcgtccaratattcttcaatagacagaacgaa

SEQ ID NO: 37191 - DNA, 50 bp, homo sapien
gttaatttggctgggccgcagtgctyagatatgtggtcgaatattctaga

SEQ ID NO: 37192 - DNA, 50 bp, homo sapien
tcattgtgcatcagctttcacgcccractcttaccggcaagcccccattt

SEQ ID NO: 37193 - DNA, 50 bp, homo sapien
cagaggaattgtttgaaacaggaaartcaatgcgggatagtgtgacatgg

SEQ ID NO: 37194 - DNA, 50 bp, homo sapien
tcaccatggtagtgccaagctaatayagtcacaacggttttcaactgtac

SEQ ID NO: 37195 - DNA, 50 bp, homo sapien
cttaaacaccagcaaatataaatgcsatgaattaacggtatatataaata

SEQ ID NO: 37196 - DNA, 50 bp, homo sapien
ttttcaatttattcctcaaattaaartgtatgcaaatataaaatctatta

SEQ ID NO: 37197 - DNA, 50 bp, homo sapien
gagcatgagggctttgatagaaataytacgcaaaggtggattgcaaatta

SEQ ID NO: 37198 - DNA, 50 bp, homo sapien
atcagttgcctagtccatccagtaakaacatttctaatatcttacatctt

SEQ ID NO: 37199 - DNA, 50 bp, homo sapien
aaaaattaaatgcttaaataaacaaratactgtaatcaacactgatatgc

SEQ ID NO: 37200 - DNA, 50 bp, homo sapien
ttaatatcattttcttttggtggaastacacaatgatttaaaaattcaat

SEQ ID NO: 37201 - DNA, 50 bp, homo sapien
tctaaattgttttgtatgtcattgarcttctttaatatacttatttttaa

SEQ ID NO: 37202 - DNA, 50 bp, homo sapien
cctcatctaacaagataaaagctccracagttataggttttttactgaat

SEQ ID NO: 37203 - DNA, 50 bp, homo sapien
tgggacaatatatggaggtagaggayggtgatattgactatcctgaccct

SEQ ID NO: 37204 - DNA, 50 bp, homo sapien
tatataagtacatgataattaaataygactttccccaaatgccttgagat

SEQ ID NO: 37205 - DNA, 50 bp, homo sapien
agtaagcttagtagacattaagagaktagtaatgaaccaaagaatgattt

SEQ ID NO: 37206 - DNA, 50 bp, homo sapien
agatttaaccaagttaaatctggtakagggtaatagctaaagataccaac

SEQ ID NO: 37207 - DNA, 50 bp, homo sapien
ggaattgcacagccataaggtgagayactatcaaaggagagatactacca

SEQ ID NO: 37208 - DNA, 50 bp, homo sapien
aaatgacaagccatggagtataaaargaaacctgcaatactcagaatata

SEQ ID NO: 37209 - DNA, 50 bp, homo sapien
atctatttcctgtgcaggatgttcaygtcctctgagctcaatcactctta

SEQ ID NO: 37210 - DNA, 50 bp, homo sapien
gatatcacatcactaagagagaaaasgtaacacaacctccttcaccaact

SEQ ID NO: 37211 - DNA, 50 bp, homo sapien
agccacatgcattttatgttttcccraggaaagattcttgttggtctcag

SEQ ID NO: 37212 - DNA, 50 bp, homo sapien
ggctcctttccatgacagagggaaayactaagtgaatgttttagtgtgtc

SEQ ID NO: 37213 - DNA, 50 bp, homo sapien
attttacaattagagagaacttttaratatagagctgagcttccagggtc

SEQ ID NO: 37214 - DNA, 50 bp, homo sapien
tcctctttcttaaaaatcaaaagaartggttgagagcttattgagttgaa

SEQ ID NO: 37215 - DNA, 50 bp, homo sapien
aatgcatttaacaaattattcctcayagttcatttgggtacactactggc

SEQ ID NO: 37216 - DNA, 50 bp, homo sapien
tcacaacatatacactgttgacaatmagtttcagtttttgaatggtaaac

SEQ ID NO: 37217 - DNA, 50 bp, homo sapien
gggttgatgcttttagaactgaatakgaactcaactccctaaacacatct

SEQ ID NO: 37218 - DNA, 50 bp, homo sapien
aaataagtaagtaaaatatttagtaygctagtgatggtctgtatggtgaa

SEQ ID NO: 37219 - DNA, 50 bp, homo sapien
ttccatctgccatctacctctgtaamctggccaaggaattttcacctaat

SEQ ID NO: 37220 - DNA, 50 bp, homo sapien
tggaataagttctgtaggctcaccartgatttacagcctgtttctcttgc

SEQ ID NO: 37221 - DNA, 50 bp, homo sapien
ttctttttcgttggagaatctgataygcctttctccacctcttaaaatta

SEQ ID NO: 37222 - DNA, 50 bp, homo sapien
tactcactctgttaactggaaatgayctatgtatattcagttatagagcc

SEQ ID NO: 37223 - DNA, 50 bp, homo sapien
gctagtaataggtctaggtacacaaygaaagaaatgggagagaaaaggaa

SEQ ID NO: 37224 - DNA, 50 bp, homo sapien
tacttaataatacctgtctctccatmatgaggtgtgaataaagcaatggg

SEQ ID NO: 37225 - DNA, 50 bp, homo sapien
attttgggtgacataaaatgtcccasgtagccactagtaattataaaaca

SEQ ID NO: 37226 - DNA, 50 bp, homo sapien
tttttaaaaatgtattgagaagaacsaaaattagtttgggattaagcatc

SEQ ID NO: 37227 - DNA, 50 bp, homo sapien
ccattgcattaattttccttacatayctgtgaatcaaggcactacaaatt

SEQ ID NO: 37228 - DNA, 50 bp, homo sapien
caatccagctggtatgataaagaccrggtcagcccaggagaatctctcaa

SEQ ID NO: 37229 - DNA, 50 bp, homo sapien
ttagaacagtgaaattctataactcraatgtaagctatacaaagatttga

SEQ ID NO: 37230 - DNA, 50 bp, homo sapien
cagatcctctgtaattcttcacatarcatcgtattttacattatcagtta

SEQ ID NO: 37231 - DNA, 50 bp, homo sapien
ttattgattttcacctgttcagtcasgatcagaacacagatttccatgtg

SEQ ID NO: 37232 - DNA, 50 bp, homo sapien
acgtatttatttgctggcctatgaayacaaaaatggcttattgattttca

SEQ ID NO: 37233 - DNA, 50 bp, homo sapien
tgcctatatgagcagattggaaggartatccaagcaatgaatcctgattg

SEQ ID NO: 37234 - DNA, 50 bp, homo sapien
agggttaaaggtaaatatgctgttcyaatgtagagtttgattccatcaaa

SEQ ID NO: 37235 - DNA, 50 bp, homo sapien
tattattattgtcatcattatttaaycaacttggctttatgtgctaaaaa

SEQ ID NO: 37236 - DNA, 50 bp, homo sapien
gctaagagagcatatgctaaatgctkacctaaaatcctcagtggctattc

SEQ ID NO: 37237 - DNA, 50 bp, homo sapien
caacattcactgtgctttccactaarccatacttcattatttaatggtat

SEQ ID NO: 37238 - DNA, 50 bp, homo sapien
aaagaaaccaacttctttagagtcartacctgccaagtcaattggtttat

SEQ ID NO: 37239 - DNA, 50 bp, homo sapien
gctttgataaaattcaagtaattccyaaatacctttttgctattctaatt

SEQ ID NO: 37240 - DNA, 50 bp, homo sapien
atattttataaaagtgcttcctactyacccagattttttataaaataagt

SEQ ID NO: 37241 - DNA, 50 bp, homo sapien
tcacactgtacccttccacctgaatyaggagagtcccttcttttctgtat

SEQ ID NO: 37242 - DNA, 50 bp, homo sapien
aagctagaagctacaatgtttataaygatggtgaagaaagtactgaactc

SEQ ID NO: 37243 - DNA, 50 bp, homo sapien
agcttctgtacatacaagttcacaartcttccttcttctctgaaaccttc

SEQ ID NO: 37244 - DNA, 50 bp, homo sapien
aggaatgattaattcttaaggagaamtgaggagtaggagaggtggagaag

SEQ ID NO: 37245 - DNA, 50 bp, homo sapien
gtgggtcccatcagtttggcctagayaccaaactgctgtggctttcatca

SEQ ID NO: 37246 - DNA, 50 bp, homo sapien
gaggaaacaaaatctccctttagtcragcaagtcacaaggaagagggaga

SEQ ID NO: 37247 - DNA, 50 bp, homo sapien
gtgtatgagagtgtttatttccacaygttaagaactaattcattgcaatt

SEQ ID NO: 37248 - DNA, 50 bp, homo sapien
cagactgtgcacatcacattttatcraagtagttagccttaaggaactgt

SEQ ID NO: 37249 - DNA, 50 bp, homo sapien
tggggagggaaaatgaagccaaataygtggagagagagatatgtgttttt

SEQ ID NO: 37250 - DNA, 50 bp, homo sapien
acttagccataaaagctcacatgaaytctcaatcacatatgtttgataag

SEQ ID NO: 37251 - DNA, 50 bp, homo sapien
acacaactaccacaatacaaactacyatgactcatcctgtaactattaaa

SEQ ID NO: 37252 - DNA, 50 bp, homo sapien
aatgttttcctgtttttcctgattaygtaatttcattttattttttagag

SEQ ID NO: 37253 - DNA, 50 bp, homo sapien
caagtaacatatcttaatttcacaaygacttgtaagatctataatatcct

SEQ ID NO: 37254 - DNA, 50 bp, homo sapien
atttacatgcttacggcttgtctaaycttgagtgcgaagagctcagtaca

SEQ ID NO: 37255 - DNA, 50 bp, homo sapien
gagtctatttcaggaaatgtgcctasacttaaaatagatatgcacataga

SEQ ID NO: 37256 - DNA, 50 bp, homo sapien
aattttctgagtcttaatatatcccragtataacagaccttgtatataaa

SEQ ID NO: 37257 - DNA, 50 bp, homo sapien
tggaaacactgctcaaagattataartagttccctgagtgcttacttgcc

SEQ ID NO: 37258 - DNA, 50 bp, homo sapien
aatacataagacactaaaaactgccsagatctttaaagtttactgtgtaa

SEQ ID NO: 37259 - DNA, 50 bp, homo sapien
acatttaaaagaaaggagtcacatayaatttatctttttttcattatgga

SEQ ID NO: 37260 - DNA, 50 bp, homo sapien
aaataaatgtaacttcttttttccaytaccctgcagtagcagatttatta

SEQ ID NO: 37261 - DNA, 50 bp, homo sapien
tggttaggcagctcttaatagattaygggttatttccttattatgtttgc

SEQ ID NO: 37262 - DNA, 50 bp, homo sapien
ctggatgtggtgcttctattttctaygtagtggccagagtcgtcctgtta

SEQ ID NO: 37263 - DNA, 50 bp, homo sapien
aactgctactgaatggtaaatggcartaaaaagagatctaaaatgaaatc

SEQ ID NO: 37264 - DNA, 50 bp, homo sapien
aaaatgttcggttcatttttgtacamccagggtcatgtgcattgatagcc

SEQ ID NO: 37265 - DNA, 50 bp, homo sapien
catttttttaaaaagataataaagargagaatggaaaatatgagtgtact

SEQ ID NO: 37266 - DNA, 50 bp, homo sapien
ttaattgaattgggataaacaagaaragagttatctagacttataaaaac

SEQ ID NO: 37267 - DNA, 50 bp, homo sapien
ttccagtactatgttgtatatcagcragtaaagtgggcagttttgccttg

SEQ ID NO: 37268 - DNA, 50 bp, homo sapien
gtttggcagtcttaattgagacaccrctggcaagaatgctttcaacttct

SEQ ID NO: 37269 - DNA, 50 bp, homo sapien
caaaaacagctatatgttatctccartctactctcataccagcttttctt

SEQ ID NO: 37270 - DNA, 50 bp, homo sapien
gagtataaaaaatataagcaaaatayggactttgcctttcaggtattcat

SEQ ID NO: 37271 - DNA, 50 bp, homo sapien
atgcattaattgtaaatttgccaaaraaggtgcattgtttgcttaggttg

SEQ ID NO: 37272 - DNA, 50 bp, homo sapien
tcaatccattcttcatactttcctcraagatatgttagtaaaattcatca

SEQ ID NO: 37273 - DNA, 50 bp, homo sapien
cactaatacagggcaatgtttctcartatgggcttcacattaaatctatc

SEQ ID NO: 37274 - DNA, 50 bp, homo sapien
tttttattttatagaaatcaagatcmaaaaaattcgtatagcatacataa

SEQ ID NO: 37275 - DNA, 50 bp, homo sapien
aaaaaaagaaaaacaaaattgaaaakacagtctgaagagcaaaataagtc

SEQ ID NO: 37276 - DNA, 50 bp, homo sapien
gaagaaggctgtgccatgttagataytacttgcaaaagaaaaatatccag

SEQ ID NO: 37277 - DNA, 50 bp, homo sapien
cactaggttttggcagacttctttarcaaactgcactgttggactctcca

SEQ ID NO: 37278 - DNA, 50 bp, homo sapien
ttggggtcagaacctcagctgataayaaagtatgtgagcatgggatcact

SEQ ID NO: 37279 - DNA, 50 bp, homo sapien
atgaaggaaaataataactaattcasaggatccttgtaatgtttaaatga

SEQ ID NO: 37280 - DNA, 50 bp, homo sapien
agagggactaaaattagtttttccayatcgaggagaaggtgtattaaaat

SEQ ID NO: 37281 - DNA, 50 bp, homo sapien
aaaacattctaagtgctttgtttgarctctggtgtactgggctgccaaga

SEQ ID NO: 37282 - DNA, 50 bp, homo sapien
cagtacaaatttataaggagtaaaaratgaggagatgaattgcaaagagg

SEQ ID NO: 37283 - DNA, 50 bp, homo sapien
taagccattttaaacagactataagratcctaaatgtaaatcaagcacct

SEQ ID NO: 37284 - DNA, 50 bp, homo sapien
attatttccattaacactggctaacmcatcatctaagatcttgcctattt

SEQ ID NO: 37285 - DNA, 50 bp, homo sapien
atgctcactacctgggttattggatsaattatattccaaacctcaacatc

SEQ ID NO: 37286 - DNA, 50 bp, homo sapien
atttaaaagtaacaacagtaattcaractagactagtgagctgttagtaa

SEQ ID NO: 37287 - DNA, 50 bp, homo sapien
aaacagaaaatctaaatcacctgaargtaatggagccaattaagctggaa

SEQ ID NO: 37288 - DNA, 50 bp, homo sapien
taactacctttccaggctgatcttamgcaacattcaccaaattaccgata

SEQ ID NO: 37289 - DNA, 50 bp, homo sapien
tccctgaaaggtgtgagttgagatayatgtttcccaatataaacttgggt

SEQ ID NO: 37290 - DNA, 50 bp, homo sapien
gtataaatccccacacgtatggcatratatctggctctcatcacataatt

SEQ ID NO: 37291 - DNA, 50 bp, homo sapien
aactatatgtgaatcctcttctttayactgtaatttagttattgatgtat

SEQ ID NO: 37292 - DNA, 50 bp, homo sapien
aaaatacttgagtttaactaagaaaratctcattaaattattttgtaatc

SEQ ID NO: 37293 - DNA, 50 bp, homo sapien
acctgcatattttcatttggctaccyaaagatcttttaagggattatctg

SEQ ID NO: 37294 - DNA, 50 bp, homo sapien
aaaaacttgttttgacagcacatttkaaatgccgagtgttttgttatgtc

SEQ ID NO: 37295 - DNA, 50 bp, homo sapien
tcaatgtccttaacccattattggamaaataaacatatatcaaatctccc

SEQ ID NO: 37296 - DNA, 50 bp, homo sapien
gcttcccaccacccagagcctgggaycatgcaagctgggagagaagctac

SEQ ID NO: 37297 - DNA, 50 bp, homo sapien
catagacccgaaagaaatgaaagagracgtttggagtaggtatgggaatg

SEQ ID NO: 37298 - DNA, 50 bp, homo sapien
gctcctgagctgaccctctgctgaaygttaaagaaagggttaaagttggc

SEQ ID NO: 37299 - DNA, 50 bp, homo sapien
tgaaagcactctcttcattgtggccyatgtatcaaatctaatctcaaaaa

SEQ ID NO: 37300 - DNA, 50 bp, homo sapien
ccagaaggggaggagtcacatataargaagcgaaaaacagaaattccatt

SEQ ID NO: 37301 - DNA, 50 bp, homo sapien
ttcaaataaaattacatgattgtaargaaaaaaagcccatgtatttaagt

SEQ ID NO: 37302 - DNA, 50 bp, homo sapien
atgtctgcatagttgagaaggactaygtaaaaacttattttgtagccatt

SEQ ID NO: 37303 - DNA, 50 bp, homo sapien
aaagcatagacagcaatatctgccarccatatttattaagattgaatgca

SEQ ID NO: 37304 - DNA, 50 bp, homo sapien
ttgaaaataagaaagggtaattcaaytgtgtaagaatgagaatgtacaga

SEQ ID NO: 37305 - DNA, 50 bp, homo sapien
aaccatttttacaaaattatttagamcacgtgagatagtgagttatcaat

SEQ ID NO: 37306 - DNA, 50 bp, homo sapien
agaatcgattttattttgacgacaargaatgacaggtccaggagcaatgc

SEQ ID NO: 37307 - DNA, 50 bp, homo sapien
ttgaaatttagttaagggctccctargttgctagaaattagtctgatatt

SEQ ID NO: 37308 - DNA, 50 bp, homo sapien
agactccagttttcttctgtgtagayccttgtgtgaagccctgcactttg

SEQ ID NO: 37309 - DNA, 50 bp, homo sapien
tgtgccttccaggaggggcatctcastctatgaatcaaactttaagattg

SEQ ID NO: 37310 - DNA, 50 bp, homo sapien
tttaaagcccatataaatgagaataygataaaatggttaaaactgagcaa

SEQ ID NO: 37311 - DNA, 50 bp, homo sapien
ggcttttcagtttccaaaattcctartacttacttagtagaagtatgctt

SEQ ID NO: 37312 - DNA, 50 bp, homo sapien
taacacactctatgggaagcatatcratggacgtctattggccttgcttc

SEQ ID NO: 37313 - DNA, 50 bp, homo sapien
agctttaagaaccgtagaatgcaccragagaatttttttaagtgctatgt

SEQ ID NO: 37314 - DNA, 50 bp, homo sapien
tctaaagcttccagaacaagatatakggcaatgaaaagtttctttagaaa

SEQ ID NO: 37315 - DNA, 50 bp, homo sapien
taaacagcttatacgtatgaaaaaarttctggactattttcattttaaaa

SEQ ID NO: 37316 - DNA, 50 bp, homo sapien
tggcttaccaacattaagttaaacamcatgtaagggttagaaatatgaat

SEQ ID NO: 37317 - DNA, 50 bp, homo sapien
ttggtcttcgtccttatctttattgyaatggcagttagatgtacttcttt

SEQ ID NO: 37318 - DNA, 50 bp, homo sapien
cttttggtctgcattcttgttcacamagttttaagtaatgatcaatccta

SEQ ID NO: 37319 - DNA, 50 bp, homo sapien
aatgactggtacatttagctttacasgttgataagacttggttcctgttc

SEQ ID NO: 37320 - DNA, 50 bp, homo sapien
tccagagagaaaaatctagacagaawcttcagacttaatcttcactatag

SEQ ID NO: 37321 - DNA, 50 bp, homo sapien
ttttttatttttgtacaattaagagraaaatacattaataaggtacttgg

SEQ ID NO: 37322 - DNA, 50 bp, homo sapien
aacagttgtcagtctgaaggagtgcrcatttttatccaagaaagattgag

SEQ ID NO: 37323 - DNA, 50 bp, homo sapien
tgtctggtggaggaaaggcctggaaytgtttagtccactcaaccagccct

SEQ ID NO: 37324 - DNA, 50 bp, homo sapien
cctttcccatccctgtgtctcttctraaatggctcctggtgtatgggaaa

SEQ ID NO: 37325 - DNA, 50 bp, homo sapien
gtttatggatatactatgtaattgcwgatataatttataataaaaccagc

SEQ ID NO: 37326 - DNA, 50 bp, homo sapien
gtttatattggctatctcttaacaarttggtgtagtttttattatttttg

SEQ ID NO: 37327 - DNA, 50 bp, homo sapien
tctgagaagtccaaatctaaaaataygtggttcgattagggtctttaata

SEQ ID NO: 37328 - DNA, 50 bp, homo sapien
agggatgcaaaatcatttaagtgaayggttcttagcctttcgtgagtttg

SEQ ID NO: 37329 - DNA, 50 bp, homo sapien
tcctctttctaaagaaatgcaatacrctctaaagaggtcactgcatttac

SEQ ID NO: 37330 - DNA, 50 bp, homo sapien
gtaaattaattccacaatttgccaaygtattgtgtctgtgtagcttgaag

SEQ ID NO: 37331 - DNA, 50 bp, homo sapien
aataattacaattcacataagaaaartgtttccataccttctaaattatg

SEQ ID NO: 37332 - DNA, 50 bp, homo sapien
tactgcggtagagaattgtgtagccrgagaatactcctctctgttgattt

SEQ ID NO: 37333 - DNA, 50 bp, homo sapien
actcttgatttggacaacttaactckatcattagactaaaagcaccttta

SEQ ID NO: 37334 - DNA, 50 bp, homo sapien
agagatggctgcctgctgcattttamagaacttagtaaatgctagctatg

SEQ ID NO: 37335 - DNA, 50 bp, homo sapien
gcttatttttcaaaaatctcctaaaytacccactttgattgtgcaatcta

SEQ ID NO: 37336 - DNA, 50 bp, homo sapien
ggcaagattaatttattagaggtccmatgtttaattttaagacatggaat

SEQ ID NO: 37337 - DNA, 50 bp, homo sapien
agtggactcacattaactagaccccragagactgagatgtatgcctgaat

SEQ ID NO: 37338 - DNA, 50 bp, homo sapien
agataaaacgtttaagttatattgcygagtaaagaatttaaaaagcataa

SEQ ID NO: 37339 - DNA, 50 bp, homo sapien
agtggagtttgtgaacatgaaatcaraatacatgttcttagttagatcca

SEQ ID NO: 37340 - DNA, 50 bp, homo sapien
acaatgatgtgtacgcccagaatccygaagtattaatttcccatgaaaat

SEQ ID NO: 37341 - DNA, 50 bp, homo sapien
tcggagggaattcttagggctcaacrcggctgaaaaactgctgacctcga

SEQ ID NO: 37342 - DNA, 50 bp, homo sapien
acaggccaattcttatgcacagtaamgtctaagaaacattattattgttc

SEQ ID NO: 37343 - DNA, 50 bp, homo sapien
taatttataaaaggctctcaagtcartatcaagaaaaactaacccaaata

SEQ ID NO: 37344 - DNA, 50 bp, homo sapien
attgatggaatgttaaatactattgragtgaataaaagacagaagctttt

SEQ ID NO: 37345 - DNA, 50 bp, homo sapien
ttgcatgtatatcacattctcacaayaccatgaataatatataagaatca

SEQ ID NO: 37346 - DNA, 50 bp, homo sapien
ttgtctttatagctgccagtacccasaaagtaattggccaaatatcaggt

SEQ ID NO: 37347 - DNA, 50 bp, homo sapien
gacaacaggcaatcatgctataaatraggagtacctcccatgtgccaagc

SEQ ID NO: 37348 - DNA, 50 bp, homo sapien
aggagccctctctcttatagctccaygaaattttaatgaaaatcaaataa

SEQ ID NO: 37349 - DNA, 50 bp, homo sapien
cctgccaaggtaaactagttcatacrgcttatgtgacatcctttgggatc

SEQ ID NO: 37350 - DNA, 50 bp, homo sapien
atcgcaacaacatttcactaaaaaamgctcttagcaatacactgagtggc

SEQ ID NO: 37351 - DNA, 50 bp, homo sapien
agggaatatgacattatattgcaggractctagatacggttaagaattta

SEQ ID NO: 37352 - DNA, 50 bp, homo sapien
agacactggagttacagccgagccaratggtagaaaccttgctgaacgtg

SEQ ID NO: 37353 - DNA, 50 bp, homo sapien
aggaaaagtacattccatgcagtatragcaaatttaaagaattaattttt

SEQ ID NO: 37354 - DNA, 50 bp, homo sapien
atcctatgccccaagtggtaaactawatctaaatcccatgcaaggacact

SEQ ID NO: 37355 - DNA, 50 bp, homo sapien
caggttattttgcctgggcttctaaycgatcagttataaatcagagttcc

SEQ ID NO: 37356 - DNA, 50 bp, homo sapien
gactcaacagtcaaatggtttagacratttttagatttaaagcctggagc

SEQ ID NO: 37357 - DNA, 50 bp, homo sapien
ataggaaccacctatattttattgargcaaaactgagactctttgactct

SEQ ID NO: 37358 - DNA, 50 bp, homo sapien
cagaaacattagaccagaacgacagragactagattcccaaggccacccc

SEQ ID NO: 37359 - DNA, 50 bp, homo sapien
gattaagagaacattctgtacctgaygtccaaaaaacaaagaaccctgta

SEQ ID NO: 37360 - DNA, 50 bp, homo sapien
ccagcaatagggaaatactgggtatmagttctaaatgtttccatactttc

SEQ ID NO: 37361 - DNA, 50 bp, homo sapien
tcatttcacctgattttcacacagcratcgagatgagacgccatgcagat

SEQ ID NO: 37362 - DNA, 50 bp, homo sapien
tgtaactttattgtatgctgtaaaawgtgatagagtgagtcgacagctag

SEQ ID NO: 37363 - DNA, 50 bp, homo sapien
cgtttttgcactttcttaaatgaggmcatagacttcaaccatctactata

SEQ ID NO: 37364 - DNA, 50 bp, homo sapien
ggagtagggaaaattgaacccacgayaattaagcacattgtaatgatcac

SEQ ID NO: 37365 - DNA, 50 bp, homo sapien
caaacctaatcctggtagcacgaacmattatattccaccagggaattact

SEQ ID NO: 37366 - DNA, 50 bp, homo sapien
taatactatatgtggtctctgtatasgaaattgaatatgtgcatgtatta

SEQ ID NO: 37367 - DNA, 50 bp, homo sapien
taataataaatacaaatatttaatcraattcaaaatcctgttttataatg

SEQ ID NO: 37368 - DNA, 50 bp, homo sapien
gataaaatcatgccaatgagacttcmatgtttactcacagaatttctcaa

SEQ ID NO: 37369 - DNA, 50 bp, homo sapien
aagaagacataccgataagttgtcayatggtatagaaaaatgttttaatg

SEQ ID NO: 37370 - DNA, 50 bp, homo sapien
gtctggactctcttcatcttcctaartcagtaggcagttcataagctggg

SEQ ID NO: 37371 - DNA, 50 bp, homo sapien
cagaggcttcaataacacctacttaygactgtttcagatttcaattcaaa

SEQ ID NO: 37372 - DNA, 50 bp, homo sapien
ttataagagtgtgatcattttaaaamtttgcataagagatcttaaataat

SEQ ID NO: 37373 - DNA, 50 bp, homo sapien
ctgttgagattttgggtagaatcaayggatcaaccaattttccccagaga

SEQ ID NO: 37374 - DNA, 50 bp, homo sapien
agaaggaattaacctggagtgagaargaacacgatgtggtggaaaactgc

SEQ ID NO: 37375 - DNA, 50 bp, homo sapien
ctaccatcagcattactttctccackaatgtatgggcatttgtcaccaga

SEQ ID NO: 37376 - DNA, 50 bp, homo sapien
attttgtgtgggtctgaaaaaacaargagcacaagatgatcaaaaaacat

SEQ ID NO: 37377 - DNA, 50 bp, homo sapien
taatgaatgcaaactcattactgttkaaatcgatgcatgcatagcagaag

SEQ ID NO: 37378 - DNA, 50 bp, homo sapien
ataaaaaatttaatatcccttttgcyaggtacggtggcttatgcctgtaa

SEQ ID NO: 37379 - DNA, 50 bp, homo sapien
ataaaaggaaggagactagtgtcttmaacattctgtaggtgtgtttgttg

SEQ ID NO: 37380 - DNA, 50 bp, homo sapien
gtctaacttaggcacatgtgttatargcaaatgaataaatagcttcacct

SEQ ID NO: 37381 - DNA, 50 bp, homo sapien
gcctcatcacaggactatggataaasaagtggaaattccagaagtgcatt

SEQ ID NO: 37382 - DNA, 50 bp, homo sapien
tgtaattttttatgagaaactttcartaaatatgccgttggagaaactga

SEQ ID NO: 37383 - DNA, 50 bp, homo sapien
acaaataaaatatgtagaataagacrgaagtaataggcaagtttatgttg

SEQ ID NO: 37384 - DNA, 50 bp, homo sapien
atttgtcatttcatacatcatttacracttgctgcagtgattttggtggt

SEQ ID NO: 37385 - DNA, 50 bp, homo sapien
tgctgcaatgcatatagtcataatcrcataagttttcttggaatttcttt

SEQ ID NO: 37386 - DNA, 50 bp, homo sapien
ttagcagatttcaaggatacaatacrgagagttctctacttaaaattttt

SEQ ID NO: 37387 - DNA, 50 bp, homo sapien
tgtttggctcgcttgagacaaaggcygatgtctgattcttacataaatgc

SEQ ID NO: 37388 - DNA, 50 bp, homo sapien
aacagtgattgtgcctctgatatgargttaatttgtttagaaaaccagtc

SEQ ID NO: 37389 - DNA, 50 bp, homo sapien
ttaaaaattattttaatatacctacrcaaagaatgaatgcatcaaaatta

SEQ ID NO: 37390 - DNA, 50 bp, homo sapien
acacattgcggttgggaactctaaarcataccgagttacctctctgattt

SEQ ID NO: 37391 - DNA, 50 bp, homo sapien
tatcaaaagaagaatgagtataaaartggaatatgacaaaatacttaaag

SEQ ID NO: 37392 - DNA, 50 bp, homo sapien
taagcttctagttaggaaattgaagsctccgtcattgctataggcatttc

SEQ ID NO: 37393 - DNA, 50 bp, homo sapien
tttggtatggggacccaaagcattaragtatcaggaggaggcgtggctta

SEQ ID NO: 37394 - DNA, 50 bp, homo sapien
ggtactgttcaaatctcttgtggaaycttcactaatccctggcgttcggc

SEQ ID NO: 37395 - DNA, 50 bp, homo sapien
gacctcagtacagcattccaggccamagatccagaatgttcccttactgg

SEQ ID NO: 37396 - DNA, 50 bp, homo sapien
atatcctaaaattaaggaaagacacragaaaatattttaaggatgttacc

SEQ ID NO: 37397 - DNA, 50 bp, homo sapien
aacatttaagttcacaagtaatcaargatacatatttaaaaacacaaagc

SEQ ID NO: 37398 - DNA, 50 bp, homo sapien
tttcaatttttagtacgtgatttgaraactctagtaacctgccacaaaaa

SEQ ID NO: 37399 - DNA, 50 bp, homo sapien
aggggcttgcaatctcttcttatacygtaacatgagcaaatttctggcct

SEQ ID NO: 37400 - DNA, 50 bp, homo sapien
aaaaacttggggaagccataattgargagtttaaaaaaaagaaagttaag

SEQ ID NO: 37401 - DNA, 50 bp, homo sapien
taagatgaagtttgcacaactctaayaaagacaatgtaatgaaaaccaat

SEQ ID NO: 37402 - DNA, 50 bp, homo sapien
ttaaatgatcttattgaattgaggaygataattatttacatgaaggtaga

SEQ ID NO: 37403 - DNA, 50 bp, homo sapien
cgatatgtttaaagtgtcagcgttayctgtctgctactagaaaagagcct

SEQ ID NO: 37404 - DNA, 50 bp, homo sapien
ttggaactttgattatctcccatcarataagaaataggaaattggccagg

SEQ ID NO: 37405 - DNA, 50 bp, homo sapien
aactccagatgaattaaaggctgaaytactaataaagtagccaagctttt

SEQ ID NO: 37406 - DNA, 50 bp, homo sapien
tgtcacctctcttctttatgctggaygctgatagaggcagtggaagtgaa

SEQ ID NO: 37407 - DNA, 50 bp, homo sapien
atagaaattgaaatgcaagaatacascgggagttctgcttctggtatgac

SEQ ID NO: 37408 - DNA, 50 bp, homo sapien
cacaacaagcaaaagtcattaagtcragacaattaaaaggatatagaagg

SEQ ID NO: 37409 - DNA, 50 bp, homo sapien
agaagctttataatcatcaatgtcasacacatggagttttgtatattcta

SEQ ID NO: 37410 - DNA, 50 bp, homo sapien
tgggatcaaggcccacagaaatgtcraataaaaatcccgcttatgcttat

SEQ ID NO: 37411 - DNA, 50 bp, homo sapien
atagaagcgcaaaccttatcgtgaartgcacatgtgagggatctaggttg

SEQ ID NO: 37412 - DNA, 50 bp, homo sapien
tgaagtgggaggagcagtaagcatcrgaattcattctccgtgccaccatc

SEQ ID NO: 37413 - DNA, 50 bp, homo sapien
ccccgtcttctgctaaaccagtacamcagtttccacgagcagtttcccga

SEQ ID NO: 37414 - DNA, 50 bp, homo sapien
agcaccgtgttcttcagtaccagcayggtctcctggccagcccctaggtg

SEQ ID NO: 37415 - DNA, 50 bp, homo sapien
gaaaccagtttgtctttttttcctayactgtgtatcatatatgccttcaa

SEQ ID NO: 37416 - DNA, 50 bp, homo sapien
tctctagtcatgcaatttatgtccckgaaaaatgctatgatagggaaatt

SEQ ID NO: 37417 - DNA, 50 bp, homo sapien
tactttgaaggactggaggaagctaygtaaagtggacaaggaaagtgggg

SEQ ID NO: 37418 - DNA, 50 bp, homo sapien
aataactgctggcctagcaaaaatamcctttcaaatggcaggtgaactaa

SEQ ID NO: 37419 - DNA, 50 bp, homo sapien
tgaactaagaatacattcagacaaaygaaaatagagataatttgtcataa

SEQ ID NO: 37420 - DNA, 50 bp, homo sapien
acaaagcaattgttagtattttagarcatcaaatcttttcttcactatta

SEQ ID NO: 37421 - DNA, 50 bp, homo sapien
taatcattaaattcattcaaccagaycttagagagttaaaaacatatatt

SEQ ID NO: 37422 - DNA, 50 bp, homo sapien
aatgaaaataaaacagaaagtgccayagtatgttacagaaagcaaagatg

SEQ ID NO: 37423 - DNA, 50 bp, homo sapien
aaaaagaatggcttctaaatctgtcrctaacttttaaatttggaaaacct

SEQ ID NO: 37424 - DNA, 50 bp, homo sapien
gaacctcaaatagattcaatttagayaggtcctctctgaggcatgttata

SEQ ID NO: 37425 - DNA, 50 bp, homo sapien
ggtaggtatttatttaggctcttacrgtaaataattagaaagagtcaggt

SEQ ID NO: 37426 - DNA, 50 bp, homo sapien
gttagcaacccaagccatttatggarcattcgtaactctatttactcctt

SEQ ID NO: 37427 - DNA, 50 bp, homo sapien
ctcatcttgggattttaaaaaaatastattatccatcaaccactagagaa

SEQ ID NO: 37428 - DNA, 50 bp, homo sapien
actgatgttctgaaagtgacatgatyaaaaaatagtctcatccagaaatt

SEQ ID NO: 37429 - DNA, 50 bp, homo sapien
tgtatcgttaatcataacagtaaaarttggacacagcttaaatatccaat

SEQ ID NO: 37430 - DNA, 50 bp, homo sapien
ttataaatagctgtaacagagcatayagtaatggtccttgagcttctcag

SEQ ID NO: 37431 - DNA, 50 bp, homo sapien
ttcatttgatcgttaagaattcaccraagatcggacctgccatttggttt

SEQ ID NO: 37432 - DNA, 50 bp, homo sapien
tttgatgtctaatacatattagcacrctggcaaacacaattttgaacttt

SEQ ID NO: 37433 - DNA, 50 bp, homo sapien
atattcaaaattatgtcagagcaaaygaactattatgggaaaagttgtat

SEQ ID NO: 37434 - DNA, 50 bp, homo sapien
tttatattttctacattagtggactyactttagccatactttcttctgag

SEQ ID NO: 37435 - DNA, 50 bp, homo sapien
aatgtgaggtgtgcttatgaatctaygatcttgaggacttttttaagggg

SEQ ID NO: 37436 - DNA, 50 bp, homo sapien
gtcagagtaatagaggtagaaagtaraatagtggttaccaggggctggag

SEQ ID NO: 37437 - DNA, 50 bp, homo sapien
atagaaccagtcttacttgacttaakgtatacagtaacgcctgagtagac

SEQ ID NO: 37438 - DNA, 50 bp, homo sapien
catatacttacatgggactctctaamatttatcattatgagggctatcaa

SEQ ID NO: 37439 - DNA, 50 bp, homo sapien
aagttaagtgatggggctaaaaaaastaatgagccccaggaagacctggg

SEQ ID NO: 37440 - DNA, 50 bp, homo sapien
cttttaaagatttaacaacctaatgraaaggacagatgtttacatagttt

SEQ ID NO: 37441 - DNA, 50 bp, homo sapien
gagctctctcttacccttttaaagaytcatttggccatattttgagagtc

SEQ ID NO: 37442 - DNA, 50 bp, homo sapien
caccttatttttaatgcaagtataamaattcccatcataaaactcttctg

SEQ ID NO: 37443 - DNA, 50 bp, homo sapien
tgtgtgttgttaaaagtttcaaaaamgtttcatgctaccagttttataaa

SEQ ID NO: 37444 - DNA, 50 bp, homo sapien
gctgaagctatcaagaatgatgacarggaataggactatgaaccaaaggc

SEQ ID NO: 37445 - DNA, 50 bp, homo sapien
actcaggtcaatggcacagatcacaraaggtttatgcaccaaacgaacag

SEQ ID NO: 37446 - DNA, 50 bp, homo sapien
caaatgctagaagtgacatgtgttaygaaggaaacctagggaagctccag

SEQ ID NO: 37447 - DNA, 50 bp, homo sapien
tttcagagctttaaatgttttgctawataggatttgctgtttgacatttt

SEQ ID NO: 37448 - DNA, 50 bp, homo sapien
ttcctagtatcacattataggttaasaacagctaaagaacaagaaagatg

SEQ ID NO: 37449 - DNA, 50 bp, homo sapien
tggtaagtgcatcatttaattaccasgttggtaccgaccaccgcctttct

SEQ ID NO: 37450 - DNA, 50 bp, homo sapien
catgagtattcttatttttatgacartacagttatttgcaatagttcaac

SEQ ID NO: 37451 - DNA, 50 bp, homo sapien
gagccatgtgggattttcaccttgayaggtcaggcagcgtatgttggctc

SEQ ID NO: 37452 - DNA, 50 bp, homo sapien
tagtcagttatctctaactcataaamtgtacctgataaaccctgatttat

SEQ ID NO: 37453 - DNA, 50 bp, homo sapien
gtatatcgtacatgataacatttaartatctccaaaatatattcttacat

SEQ ID NO: 37454 - DNA, 50 bp, homo sapien
aagctgtttatagctataatctgaasgattcactatagcagaagataact

SEQ ID NO: 37455 - DNA, 50 bp, homo sapien
ggtggctggagtgagatctttaagayggaagaagaaatacaatttagcag

SEQ ID NO: 37456 - DNA, 50 bp, homo sapien
tcccacactgacctttcgacagttasagcagttcatcttcaagaagaaac

SEQ ID NO: 37457 - DNA, 50 bp, homo sapien
agaaaatatgcgaacctgaaggatayataactcaaaactacagacctctc

SEQ ID NO: 37458 - DNA, 50 bp, homo sapien
ttacccttaatcaggcagttaaggcrattacagaaatggccgtggtagga

SEQ ID NO: 37459 - DNA, 50 bp, homo sapien
tttccacaactatttggagagcatamtaacaagaaattcttacaagaagt

SEQ ID NO: 37460 - DNA, 50 bp, homo sapien
gcacaatattaaatttgttaatagcratccatgaacaaaatcctgttatt

SEQ ID NO: 37461 - DNA, 50 bp, homo sapien
agggaagccttggagtccgtccttayaggtttgcaagtatcattagcaag

SEQ ID NO: 37462 - DNA, 50 bp, homo sapien
ttctttcctctactatttttcttcckcttaatgctccatgctgggttctc

SEQ ID NO: 37463 - DNA, 50 bp, homo sapien
tgtacatattggcttcttgagggccrgatagctacataggttttggggtg

SEQ ID NO: 37464 - DNA, 50 bp, homo sapien
aacataaatgattattcactgcttayggtggagaggaaggaatacttact

SEQ ID NO: 37465 - DNA, 50 bp, homo sapien
atttgatataatgaaaataatttacraagacaaaataaatgacaagtggt

SEQ ID NO: 37466 - DNA, 50 bp, homo sapien
ttagactctttcccaatagtcgtaamacaggttcccaatcactgactttc

SEQ ID NO: 37467 - DNA, 50 bp, homo sapien
aggagtcaactctgagaagtaaggayatttctctctccatagctcgctct

SEQ ID NO: 37468 - DNA, 50 bp, homo sapien
atttgtagatatccattctgttattyaagccatcttttgtgttacactga

SEQ ID NO: 37469 - DNA, 50 bp, homo sapien
taggtagtactagttagcatattcayagttgtagtctagaactaatagtt

SEQ ID NO: 37470 - DNA, 50 bp, homo sapien
aaaaaaaaagaacctgattaagttarcacgtggcacttaaactgaagtat

SEQ ID NO: 37471 - DNA, 50 bp, homo sapien
tagcaatgttgacatctctgcctatwagagagaattccagatttttttct

SEQ ID NO: 37472 - DNA, 50 bp, homo sapien
tatgaacccaacatactcaactcaayggctttcttttacaataacccttt

SEQ ID NO: 37473 - DNA, 50 bp, homo sapien
aatttgactttttctgttgacataartattagagctatgctttcttttcc

SEQ ID NO: 37474 - DNA, 50 bp, homo sapien
gataggtttatattaacattgtcatraagatctttcagctgcttaatcat

SEQ ID NO: 37475 - DNA, 50 bp, homo sapien
taaagttactagattttctattttgractattcttccaattctgagataa

SEQ ID NO: 37476 - DNA, 50 bp, homo sapien
tttacaaaaccttaaactgtagcatragaaaattaaaatcgtagctcaat

SEQ ID NO: 37477 - DNA, 50 bp, homo sapien
aagccatcctcagtaaacagtgcgcyctttatcttagtgtacatattggc

SEQ ID NO: 37478 - DNA, 50 bp, homo sapien
gaacttcattctgattagaaaagaaygtgatatagaacagtagcatcact

SEQ ID NO: 37479 - DNA, 50 bp, homo sapien
tccaaaatgtgctagagcattgaaamggataaaaaattatttagtcaatt

SEQ ID NO: 37480 - DNA, 50 bp, homo sapien
ttgtagaatatcctatggcctatcaygaagaggaagagcttatttgaaat

SEQ ID NO: 37481 - DNA, 50 bp, homo sapien
agaacatgcccttcactggttgtatwaaaaaactgtagagtgacactcaa

SEQ ID NO: 37482 - DNA, 50 bp, homo sapien
acccgtgggcagttcctttgccctaygtggatttagtgagctgctacccc

SEQ ID NO: 37483 - DNA, 50 bp, homo sapien
cagcacacacagtgccttctacatawgactcaggatagactgattaaata

SEQ ID NO: 37484 - DNA, 50 bp, homo sapien
tctttctttaatattcttccagtgaygccatggtttatcaaatttaataa

SEQ ID NO: 37485 - DNA, 50 bp, homo sapien
agttaactcttatcaattgtgtttaygactcgatttagttacaaaggtca

SEQ ID NO: 37486 - DNA, 50 bp, homo sapien
aacaattctgcctttttctctgtatraattgaaaccatatataattttta

SEQ ID NO: 37487 - DNA, 50 bp, homo sapien
cagcagttctcagccatttgaatacracatcactctgctcatcaaacgaa

SEQ ID NO: 37488 - DNA, 50 bp, homo sapien
aaatattagctattatatgctgaggraaaacagcgtatattcaattacaa

SEQ ID NO: 37489 - DNA, 50 bp, homo sapien
agataaattttagtgttaaacgtcawccttcagataaaatgatcacctct

SEQ ID NO: 37490 - DNA, 50 bp, homo sapien
caaacggggcactcaagcaggtcaaygagggagtctctaagaacggaaac

SEQ ID NO: 37491 - DNA, 50 bp, homo sapien
acccggcccctatgtacatccttaaygcaacacagacatgtacaaatgca

SEQ ID NO: 37492 - DNA, 50 bp, homo sapien
caactttctggctctcagcacagaarcctttttgctacatccagtccttc

SEQ ID NO: 37493 - DNA, 50 bp, homo sapien
cctagactttggagaattgctggaaracattttagcatccaattcatcga

SEQ ID NO: 37494 - DNA, 50 bp, homo sapien
gagaacgaaagtgccagcgatttgaygatcggacactcttcgagcctgaa

SEQ ID NO: 37495 - DNA, 50 bp, homo sapien
caaatatgcacaatgccggtcatatyaagccatctctccctcctctctgc

SEQ ID NO: 37496 - DNA, 50 bp, homo sapien
ttgggaaaaatcctgagtatactaaytattgcttgataggggttgaatca

SEQ ID NO: 37497 - DNA, 50 bp, homo sapien
tcctagaaaatcttttattaagccawtcacattctataactatcagaaag

SEQ ID NO: 37498 - DNA, 50 bp, homo sapien
aaaataatgacataaccactcttaamaaagtcaatggctattgaaaacaa

SEQ ID NO: 37499 - DNA, 50 bp, homo sapien
aaagagtgggagcactactttgagayactgataaacaactttcaaataga

SEQ ID NO: 37500 - DNA, 50 bp, homo sapien
cacttccaaatgtttctggagctacwcttcttaatctccttcctcctttc

SEQ ID NO: 37501 - DNA, 50 bp, homo sapien
taatccactttctgaaaacataccartgcgtatacaccattcatatacga

SEQ ID NO: 37502 - DNA, 50 bp, homo sapien
cccgcagaactgtgtttctagggccrcagacagatccacagtgtaacttt

SEQ ID NO: 37503 - DNA, 50 bp, homo sapien
gatgatgtgaatcttctgaaacttayacatgattcaaagacactggggag

SEQ ID NO: 37504 - DNA, 50 bp, homo sapien
ccatgtttctaaagctgaaaatctcrctagtctacaaaaatgacatcagg

SEQ ID NO: 37505 - DNA, 50 bp, homo sapien
tactcaaatattagagcagggtacartctaacctgtaaaaaattcattat

SEQ ID NO: 37506 - DNA, 50 bp, homo sapien
aagtaaaaggaaacctgactatagakaattctgtgcctcccttctctgag

SEQ ID NO: 37507 - DNA, 50 bp, homo sapien
cattcctcttgtgagctcctgctcaytattcaacacgtggctcaaggttt

SEQ ID NO: 37508 - DNA, 50 bp, homo sapien
cgtaacttccatgatctttaaaaacratgctttgaaatagtgttctcatc

SEQ ID NO: 37509 - DNA, 50 bp, homo sapien
caagactgacagccacactcaataakaactggaatagagccatgtaattg

SEQ ID NO: 37510 - DNA, 50 bp, homo sapien
agggcccaaagcaaatattagtaggratttagctgtcaggtgttcatctc

SEQ ID NO: 37511 - DNA, 50 bp, homo sapien
tgttcactcctctgccattggagtawcaacattcacggcacaaatgagaa

SEQ ID NO: 37512 - DNA, 50 bp, homo sapien
tggcacatctacaatggcctgcttayaatatgattttacaaggccactgt

SEQ ID NO: 37513 - DNA, 50 bp, homo sapien
gggctctaaatccttttgcacagaaytatggtataaaacagcatgtatgc

SEQ ID NO: 37514 - DNA, 50 bp, homo sapien
gcctatcaagccttgctctcacataygcagaataagcaccttgtagcctg

SEQ ID NO: 37515 - DNA, 50 bp, homo sapien
ttccttcaacttaagtctcactcagrattacctacagtcaccaaagcctt

SEQ ID NO: 37516 - DNA, 50 bp, homo sapien
tatccaaaaactggcagatattgccraatactttcacaacttgaaagaac

SEQ ID NO: 37517 - DNA, 50 bp, homo sapien
actgaccttacctgatatggagaacyggaaattcaggttgcctgagtcgc

SEQ ID NO: 37518 - DNA, 50 bp, homo sapien
ggtcctgttgagactctgtcaatgamaaaatgttcttctcatctctgcca

SEQ ID NO: 37519 - DNA, 50 bp, homo sapien
ttcttagtggtaggctctaaactgcractcaggcaacctgaatttccagt

SEQ ID NO: 37520 - DNA, 50 bp, homo sapien
tggggagtcccagtggcttccaacaycgtttggacaaaatgtagtgggag

SEQ ID NO: 37521 - DNA, 50 bp, homo sapien
gcctaccactaagaaattttcctgaycactaggtgcttcagtttcctcat

SEQ ID NO: 37522 - DNA, 50 bp, homo sapien
ttcttcaactgaatagctttaatagyctagctttcttgtttctctgataa

SEQ ID NO: 37523 - DNA, 50 bp, homo sapien
atcatataaaatattagtaccatgaraaaatgtagatgaatcataaattc

SEQ ID NO: 37524 - DNA, 50 bp, homo sapien
ctatggcatgtgaggcactctctaargatatagtggcaaataagacccag

SEQ ID NO: 37525 - DNA, 50 bp, homo sapien
cccatggggctagggaagagatgacraaaatggtaatgggtaagagaatc

SEQ ID NO: 37526 - DNA, 50 bp, homo sapien
acacctgtggaattttgccttagaamataatttgtgtatcttaaacaaac

SEQ ID NO: 37527 - DNA, 50 bp, homo sapien
agactggggtacgtttataggatccragtcccaaaacatggcttccgccc

SEQ ID NO: 37528 - DNA, 50 bp, homo sapien
ccatcttagaggcagaagtcaggaaygttattagcaaagtgctcatctac

SEQ ID NO: 37529 - DNA, 50 bp, homo sapien
cagaaggcaagttagtaatgagtgasgtcttgaggaagagattccagtta

SEQ ID NO: 37530 - DNA, 50 bp, homo sapien
gtattgtgagatggcacagcacttayagagaattagaagaagtttggaat

SEQ ID NO: 37531 - DNA, 50 bp, homo sapien
gggttataacagctaccaggagataygttattttgcagttagaagcttag

SEQ ID NO: 37532 - DNA, 50 bp, homo sapien
taaaaatctatttataggcacacgcrctaacaaacatctttacatgaata

SEQ ID NO: 37533 - DNA, 50 bp, homo sapien
gtgctctcctggataatagaagtgargtgttattatcaaactcttgtcag

SEQ ID NO: 37534 - DNA, 50 bp, homo sapien
agaacttctcttcaaacctgattatsagaaactctgtattaaacattgaa

SEQ ID NO: 37535 - DNA, 50 bp, homo sapien
ttttacatgccttcaaaagagatgamattataggttttctgcttacaagt

SEQ ID NO: 37536 - DNA, 50 bp, homo sapien
tttactcctaatttcttgggaagtcratctttcattgttattagaatact

SEQ ID NO: 37537 - DNA, 50 bp, homo sapien
ttgcaaatttagctctcccaaaaaarttgttgaatctttgcaaaatattg

SEQ ID NO: 37538 - DNA, 50 bp, homo sapien
atcaatattggccaacatacgtgggwcatgaacatcacacatgactttta

SEQ ID NO: 37539 - DNA, 50 bp, homo sapien
atggaacaataatgtgaatgtaagcrccaatgaagtgtacacttaaaagt

SEQ ID NO: 37540 - DNA, 50 bp, homo sapien
acctcagccataaattactttaacawctggcacaataggctctgaatata

SEQ ID NO: 37541 - DNA, 50 bp, homo sapien
atattcatacaaaaatacagacaatmatacaatgacatacctgcgtaccc

SEQ ID NO: 37542 - DNA, 50 bp, homo sapien
ttctattgattgacttacagtaaagsatatcagaaaagaataatattgtc

SEQ ID NO: 37543 - DNA, 50 bp, homo sapien
ttccttgcaagttagaacttctacaygttgattcaagtcccattcacatg

SEQ ID NO: 37544 - DNA, 50 bp, homo sapien
tatattgggagctggtatacaaaacrgtgcatcccacacttccatagtta

SEQ ID NO: 37545 - DNA, 50 bp, homo sapien
tctctggacttcatgggcatttcaakgtatctttgtgggtggagtgggaa

SEQ ID NO: 37546 - DNA, 50 bp, homo sapien
cttgcacaaaagcagcttggaaatckcacgtaaaatacatacactcaagt

SEQ ID NO: 37547 - DNA, 50 bp, homo sapien
tatcaaggaatttccctttaatcaartgttcacataaaagacaacaaata

SEQ ID NO: 37548 - DNA, 50 bp, homo sapien
tggaaaagaagctggaaaaggacatsataaactcactaatatgccttggc

SEQ ID NO: 37549 - DNA, 50 bp, homo sapien
tcaggatagtgcaataattctgtgaygataaatgagaattggatttgaaa

SEQ ID NO: 37550 - DNA, 50 bp, homo sapien
aaattggtgcttgagttgggattagraagaagatttattttagaggagtg

SEQ ID NO: 37551 - DNA, 50 bp, homo sapien
gttatgttcaaagtattaactcataractcatatgaagatcaaacgagat

SEQ ID NO: 37552 - DNA, 50 bp, homo sapien
tctcagctctagaatgtaccgaaaaycattcagctaactttccttcagct

SEQ ID NO: 37553 - DNA, 50 bp, homo sapien
ctccattatctgtcatttttgttccrattcagacagacgtatgagatcgg

SEQ ID NO: 37554 - DNA, 50 bp, homo sapien
tggagtaaagtctgggtcaagaaagwatttgaagattttaatcatggaaa

SEQ ID NO: 37555 - DNA, 50 bp, homo sapien
atgaagatagtgtttgtgttactacmgggccagtgagggggtgtgagccc

SEQ ID NO: 37556 - DNA, 50 bp, homo sapien
agaagcctgagacaggcacagagtaragcagagacaagtgaccatgcagc

SEQ ID NO: 37557 - DNA, 50 bp, homo sapien
atacttcctgacagacctgcctaaarctgttttgcagttaactttttttt

SEQ ID NO: 37558 - DNA, 50 bp, homo sapien
gtctatttcttaaactgatgatacarcctttaaatttatcttttctctca

SEQ ID NO: 37559 - DNA, 50 bp, homo sapien
tgccaggcactttggagaaaacatcracagaagataatacagaatccctg

SEQ ID NO: 37560 - DNA, 50 bp, homo sapien
ccaaataaagcttcatcctgacaacrtgttcaacaaagttctcaataaac

SEQ ID NO: 37561 - DNA, 50 bp, homo sapien
ttatatatgaaaatatatacatatarggcatctaaaataatgattaatat

SEQ ID NO: 37562 - DNA, 50 bp, homo sapien
tttcaaaagactggagagtatatgaygtactttaaaatatttgtatttaa

SEQ ID NO: 37563 - DNA, 50 bp, homo sapien
atcttttcaagcttaccctgtccacrctgagctccatctatttaaattgt

SEQ ID NO: 37564 - DNA, 50 bp, homo sapien
attttttaaatatgtttatatctacmcaatgttttggttgtatgtgtttt

SEQ ID NO: 37565 - DNA, 50 bp, homo sapien
tactgtagcaatttataggactctgsatcaagataaatgccagaaaaaat

SEQ ID NO: 37566 - DNA, 50 bp, homo sapien
cctttggaatgtgtgtggacaagaaygtgagcaggtgggtttcatgatgg

SEQ ID NO: 37567 - DNA, 50 bp, homo sapien
tggtttataaaagatataactacacygctgtattccatgttgatttcaat

SEQ ID NO: 37568 - DNA, 50 bp, homo sapien
cagaaatctaggaatgtattatcaamatgaagtgagcactcttgaggtct

SEQ ID NO: 37569 - DNA, 50 bp, homo sapien
agcagagaacagggctcatcataccrctgatttccagatatttgaaagtt

SEQ ID NO: 37570 - DNA, 50 bp, homo sapien
gactcatgcttggccggctctgcaastgtgtcctaagttcacaacatcat

SEQ ID NO: 37571 - DNA, 50 bp, homo sapien
attaatacatacttgatatgctaagrcaatgtgaaaactcccattcttgt

SEQ ID NO: 37572 - DNA, 50 bp, homo sapien
ggaaataggatcacattaagtctgayagtagttagccaaaagtgcacttc

SEQ ID NO: 37573 - DNA, 50 bp, homo sapien
atgagattggtgtcctagcaataaascaatcagttgccctgttttaaatt

SEQ ID NO: 37574 - DNA, 50 bp, homo sapien
ttatactctttgcataggctgaggtsaagaaagtataatgtgtgttttct

SEQ ID NO: 37575 - DNA, 50 bp, homo sapien
cagccacgtggttgctaggcatatcraaagtcaccaagtgttttatagct

SEQ ID NO: 37576 - DNA, 50 bp, homo sapien
cagctatcaccagacccttggatgasagtaaaatgcaggttagttcactg

SEQ ID NO: 37577 - DNA, 50 bp, homo sapien
tgaggaattctcaagatgaagagccrcatagtcctccctgtctctgcctc

SEQ ID NO: 37578 - DNA, 50 bp, homo sapien
gtctttaaatttatagcataaacaaygtcaacagaaaaattacagaagaa

SEQ ID NO: 37579 - DNA, 50 bp, homo sapien
tgtttcaacaaaagcaaggccagacmagacttcctcttccttttacctgc

SEQ ID NO: 37580 - DNA, 50 bp, homo sapien
agtgtgaggattaaatgagatatcaygtgaagacttgatactgggcccag

SEQ ID NO: 37581 - DNA, 50 bp, homo sapien
aacatgcaagagaaaattttaaggawcacagagatgcagaagatctttaa

SEQ ID NO: 37582 - DNA, 50 bp, homo sapien
aagataggcactgtgatagaagccarcataaaccaccaacaccccctacc

SEQ ID NO: 37583 - DNA, 50 bp, homo sapien
tttcctgcctataactatttaccacmagctagtaaccaaccactgacttt

SEQ ID NO: 37584 - DNA, 50 bp, homo sapien
catcctctactctggaataagtcaamcgcagtcttttctacctttttttc

SEQ ID NO: 37585 - DNA, 50 bp, homo sapien
tactaagggatcagcagccagtgtamatcaggagattagaatagagaagg

SEQ ID NO: 37586 - DNA, 50 bp, homo sapien
ctttcttaccccactctggtgtttayggccttgtgttgcatgtatatgtt

SEQ ID NO: 37587 - DNA, 50 bp, homo sapien
cgactgggcttttcttttagcagacragtaacaggctcagcgcctactga

SEQ ID NO: 37588 - DNA, 50 bp, homo sapien
gtcaaatggaaggcagagaatatcartgagaaagaatatatggtagggag

SEQ ID NO: 37589 - DNA, 50 bp, homo sapien
tggaaaatggaaaatgtagggatgcygagtttatgctaatgaggtgactc

SEQ ID NO: 37590 - DNA, 50 bp, homo sapien
tatgctgcttattctctaggtttctsacatcacttaaactttttgccttc

SEQ ID NO: 37591 - DNA, 50 bp, homo sapien
ttagaaatgcccctgagacattgacsatggcttattcaaattaaagaaag

SEQ ID NO: 37592 - DNA, 50 bp, homo sapien
tgctttgactggttgtgggctcagamaccctggcggtaactcaagccaac

SEQ ID NO: 37593 - DNA, 50 bp, homo sapien
cccttggccatgacacaggtaagcartcttaagagatgtggccctgtgcc

SEQ ID NO: 37594 - DNA, 50 bp, homo sapien
atcatcctaaaatgttatatattgcycaatacaagctcctgtgtttaata

SEQ ID NO: 37595 - DNA, 50 bp, homo sapien
agaacagtagttttctttattcttgsaacacctgttaagaggttataggg

SEQ ID NO: 37596 - DNA, 50 bp, homo sapien
atcctgtcttcaggggagtgacttgmaacttatggaacatatcacatgtg

SEQ ID NO: 37597 - DNA, 50 bp, homo sapien
aggagcaacttgagaaaattttttcmacagtaccatagagccaaactact

SEQ ID NO: 37598 - DNA, 50 bp, homo sapien
gtcaatgaaactttcaacccttaggmactctgcaaattttgctttcaacc

SEQ ID NO: 37599 - DNA, 50 bp, homo sapien
tggatggatgaggttaaacaaaataktatcaaggccaaagacagtatttg

SEQ ID NO: 37600 - DNA, 50 bp, homo sapien
aataatcagggctattgatttatgcyatatctaactgtagcttgaaatta

SEQ ID NO: 37601 - DNA, 50 bp, homo sapien
tttaaaatctacccaagtaactaagmatgtaatgtatccacctaactgag

SEQ ID NO: 37602 - DNA, 50 bp, homo sapien
actcatattcaatttcagatccatgmaagtttacagcatagtatccttca

SEQ ID NO: 37603 - DNA, 50 bp, homo sapien
agctggtccatattttcagtgagtarctttctcagcctgtttatttccca

SEQ ID NO: 37604 - DNA, 50 bp, homo sapien
taaacttgcatggatctgaaattgamtatgagtggtattgttaaaaatat

SEQ ID NO: 37605 - DNA, 50 bp, homo sapien
atgatatgttagtaattagtaatacsaattaatgaacattctctaactct

SEQ ID NO: 37606 - DNA, 50 bp, homo sapien
tttgtctaccaacaattagtctgtawatctctttaatcctaatgcttagc

SEQ ID NO: 37607 - DNA, 50 bp, homo sapien
ataaaaatttatagtgacagtttccrattgcttaacacttttgtctacca

SEQ ID NO: 37608 - DNA, 50 bp, homo sapien
gtatgtttgcagatttcagttgtacyatacaaggtgtttttggcaaagag

SEQ ID NO: 37609 - DNA, 50 bp, homo sapien
aaaaagactttcagaaatcacacaaygtaaagaatttcagattgttaata

SEQ ID NO: 37610 - DNA, 50 bp, homo sapien
cccagatcccttcagatgcccttcaygtttttgtttgtttgtttgtttgt

SEQ ID NO: 37611 - DNA, 50 bp, homo sapien
agagaataaatccctgaaaagcctcracaaacgtgtaaagaactttcttt

SEQ ID NO: 37612 - DNA, 50 bp, homo sapien
atttctttaagaccctttataaaaayaatgtacgcttgcggcttaaagtc

SEQ ID NO: 37613 - DNA, 50 bp, homo sapien
cgttattgaatatacaatttagagtmacacaaaaatattttaagggccag

SEQ ID NO: 37614 - DNA, 50 bp, homo sapien
attcaaaagagtcaacaataacttcrctctgacttggtaaaaactgcttt

SEQ ID NO: 37615 - DNA, 50 bp, homo sapien
taaaagaacattttatgtgtatgtgmatacctttgaacaatgtggagata

SEQ ID NO: 37616 - DNA, 50 bp, homo sapien
gtctaatctggaaaggaactattagsaagtgccatctggctctcacaaga

SEQ ID NO: 37617 - DNA, 50 bp, homo sapien
aacagaggcacttaggagcccaggayggaaaagagatttaataatataaa

SEQ ID NO: 37618 - DNA, 50 bp, homo sapien
gaaatagaggcttattcattactggmaaagattactgacaaagagggaac

SEQ ID NO: 37619 - DNA, 50 bp, homo sapien
caatattttataggaaaacttcatgsatagagaaccactattaggtatat

SEQ ID NO: 37620 - DNA, 50 bp, homo sapien
ataaatacatgaaattctcaagaaartctgaggctaaatatattgtgaaa

SEQ ID NO: 37621 - DNA, 50 bp, homo sapien
ttgggctagttataataaaatgtcaraaaggaacattgtgttgaatgtgt

SEQ ID NO: 37622 - DNA, 50 bp, homo sapien
atctgaactggataggaagttccaartagcatacttttgtcctaagtgaa

SEQ ID NO: 37623 - DNA, 50 bp, homo sapien
acagccctaatccccttaattcctaycgattactattaccttagtcaact

SEQ ID NO: 37624 - DNA, 50 bp, homo sapien
gttgttgtttggtttgacttccatartaaacagatttcttcaacaggcaa

SEQ ID NO: 37625 - DNA, 50 bp, homo sapien
aagcttcaaactagactacttctccrcaaaatttatcccagtagtgctat

SEQ ID NO: 37626 - DNA, 50 bp, homo sapien
gatctggtctagaataaatgtttgtyaaaattctcatgtgttggaggaca

SEQ ID NO: 37627 - DNA, 50 bp, homo sapien
tgcttttgcatgttatcaaaagaaamgtaggaatttccagaagtaattgt

SEQ ID NO: 37628 - DNA, 50 bp, homo sapien
cagagtttagctctatgtgatgacaytatgattgaaatacattttgtgtg

SEQ ID NO: 37629 - DNA, 50 bp, homo sapien
tctgcttggaaataggagaatagtgraacaaattaaaggaaaatgagaca

SEQ ID NO: 37630 - DNA, 50 bp, homo sapien
aggcaaaagttcatgggttattctgmaaattgccttaattccttgaatta

SEQ ID NO: 37631 - DNA, 50 bp, homo sapien
gaatagttcaattccatcaagaactyactgcttgctagtgataatcactc

SEQ ID NO: 37632 - DNA, 50 bp, homo sapien
caccttcctgtaaacactgagcttcyctttatgaatccacctgctctctc

SEQ ID NO: 37633 - DNA, 50 bp, homo sapien
gagttatgtgtatggttttagcagarcttaataaatattttgagtctggt

SEQ ID NO: 37634 - DNA, 50 bp, homo sapien
gtcttatccagtctcaaaatacatayctttaaaaatcttttcatatttga

SEQ ID NO: 37635 - DNA, 50 bp, homo sapien
tactcaatttgggtattatcagaaaygctgtagaatcaattgatcttcag

SEQ ID NO: 37636 - DNA, 50 bp, homo sapien
acacttgagcaaactcattttgttargaactaggaatacacttgttcacg

SEQ ID NO: 37637 - DNA, 50 bp, homo sapien
ctagttttgaatgtaaaagattttaygctacagagaaacattggcctcat

SEQ ID NO: 37638 - DNA, 50 bp, homo sapien
tgaaatccaaaacactaagagcagcwaatgctaacaaaaatgtgtagcaa

SEQ ID NO: 37639 - DNA, 50 bp, homo sapien
aggtcatgtgtttagaagccatatgyattaaggtataaggaaagctctta

SEQ ID NO: 37640 - DNA, 50 bp, homo sapien
taatgatctcatatgtaagtttcaaygtctcactaaataatgacattcaa

SEQ ID NO: 37641 - DNA, 50 bp, homo sapien
atattacagaataatgtagagtcatsatataacatcgtaagagatgtcta

SEQ ID NO: 37642 - DNA, 50 bp, homo sapien
taattagagaaagctggtaattaaaygcttctgatgactgaagagaagag

SEQ ID NO: 37643 - DNA, 50 bp, homo sapien
ggagaagagtgaaaataagaagtgaygtttatttcaaatttatggtactc

SEQ ID NO: 37644 - DNA, 50 bp, homo sapien
aatattaacattttaacatgaaatcmatcaatataaaattgtgaatgagc

SEQ ID NO: 37645 - DNA, 50 bp, homo sapien
atgctcattgcatactacaagaaaaytgtgctgacataagttattaaata

SEQ ID NO: 37646 - DNA, 50 bp, homo sapien
tgaggctttgactgaaataatattcragaatgtgcataaaatgcctagct

SEQ ID NO: 37647 - DNA, 50 bp, homo sapien
agaaatttacctctgttttctaattyaaggtacaagaatgactcaaagag

SEQ ID NO: 37648 - DNA, 50 bp, homo sapien
ctaattgctcttatcacccataatgkcaaacttctatgaaaggtggagaa

SEQ ID NO: 37649 - DNA, 50 bp, homo sapien
caaattccagtgcctatgcgaagacrgaaatacgttatttggcattgcct

SEQ ID NO: 37650 - DNA, 50 bp, homo sapien
tatgaaagaacagggtctaaaaggartattaacaacttaagtgtgaagag

SEQ ID NO: 37651 - DNA, 50 bp, homo sapien
gagttaaaagttcactttgaagtcaytgaaagttaaaataaagatgcaaa

SEQ ID NO: 37652 - DNA, 50 bp, homo sapien
tctacattttaaatcatacaaattcmctagttttcataaccaaatcatta

SEQ ID NO: 37653 - DNA, 50 bp, homo sapien
gcttaattaagatgtcaagcatgaamttagtggaatagagggtgtgtttg

SEQ ID NO: 37654 - DNA, 50 bp, homo sapien
ctgtagctaactttattattggctayatgtaaactatttttaaattaaaa

SEQ ID NO: 37655 - DNA, 50 bp, homo sapien
gataaatatatgttactgaattttgwaaatgcaatgtaatgaggtaacat

SEQ ID NO: 37656 - DNA, 50 bp, homo sapien
gagtcaaaatgtctatccatgtctaycatactgctgtaagtcttaaggtt

SEQ ID NO: 37657 - DNA, 50 bp, homo sapien
attaataatgtctactcaccttacakaaacactgtgaagtctcattgatt

SEQ ID NO: 37658 - DNA, 50 bp, homo sapien
gtaatgaattgaactagttagaaaaygattaatggaagactttaataaaa

SEQ ID NO: 37659 - DNA, 50 bp, homo sapien
aaaaaatgattaaacaggtggagaaytaaagcctatctggaggttattgt

SEQ ID NO: 37660 - DNA, 50 bp, homo sapien
gtctctttaatgagataatctattgmaaaatgagcccttgaacagccaga

SEQ ID NO: 37661 - DNA, 50 bp, homo sapien
atttaccttttcaaatggtttcacaktataatcttatttcatcctttttg

SEQ ID NO: 37662 - DNA, 50 bp, homo sapien
aatatttcattgtcctttattattaygtggaaatcttgttttagggagga

SEQ ID NO: 37663 - DNA, 50 bp, homo sapien
tgtgaaaacatatccagtacagaaawtaaagtttgaaaaaataagcaata

SEQ ID NO: 37664 - DNA, 50 bp, homo sapien
gttacttgctatattttagaagacaygcatatatttatctacttggattt

SEQ ID NO: 37665 - DNA, 50 bp, homo sapien
tgtgtgtgtgtaaagtcagatacaaygtacccttagcttttaggatttag

SEQ ID NO: 37666 - DNA, 50 bp, homo sapien
gagccagagggaccaaattatttacsaatgcttaaaatctaattggtagt

SEQ ID NO: 37667 - DNA, 50 bp, homo sapien
atgcccataacatctaaaagggtagwaatgtgtgtcctactatgaaaaga

SEQ ID NO: 37668 - DNA, 50 bp, homo sapien
gtaaattttatcaaagagaagcagaktcaaagcagaggacaaggtaaaag

SEQ ID NO: 37669 - DNA, 50 bp, homo sapien
ccagatagaataatatatctacatcwataattgcggattagaattttaaa

SEQ ID NO: 37670 - DNA, 50 bp, homo sapien
ggaagcagcttacgaagtactaatgsaatctagcctcagtagctgctatc

SEQ ID NO: 37671 - DNA, 50 bp, homo sapien
acggctgacatcacagaatttagtgkaataactcaactgtttttttttat

SEQ ID NO: 37672 - DNA, 50 bp, homo sapien
cctgtaaaggagattggtttaatgargcaaccccatctgatgaacgcagg

SEQ ID NO: 37673 - DNA, 50 bp, homo sapien
attattccttaggttccatcttctargagaactgatcttgatgtaggttt

SEQ ID NO: 37674 - DNA, 50 bp, homo sapien
aaaacacttttaaatctcttattacycaactctagccagaaaaaatgtgt

SEQ ID NO: 37675 - DNA, 50 bp, homo sapien
gtaacctcccaagcaatacaaataarccttagctactaacctacagcact

SEQ ID NO: 37676 - DNA, 50 bp, homo sapien
taagttaatttttctattctttgccraattttgtgagtcaaattaccaat

SEQ ID NO: 37677 - DNA, 50 bp, homo sapien
gtgtcttctttttctattcaaatacrattttgagaactgagtgcaattta

SEQ ID NO: 37678 - DNA, 50 bp, homo sapien
accgtttcttacctgacttgttttayagaacctttattatttggattgtt

SEQ ID NO: 37679 - DNA, 50 bp, homo sapien
ctgcacaaagtaagcgtacacactaycttgtcactattccactcttctca

SEQ ID NO: 37680 - DNA, 50 bp, homo sapien
cacaattcttcagaagagctatgtartaatgttatgtgtccttgggggta

SEQ ID NO: 37681 - DNA, 50 bp, homo sapien
cttattacgcctggtataacaaagarctgatcaaaaacacttcataattc

SEQ ID NO: 37682 - DNA, 50 bp, homo sapien
ccaaagctcacttgctttgtctatcyatctataccttaacatgtaaatat

SEQ ID NO: 37683 - DNA, 50 bp, homo sapien
cttacagcaaagccctatcccggagractacagagcttaaaaatcggtga

SEQ ID NO: 37684 - DNA, 50 bp, homo sapien
gagccaccgcgcccggctgagaatamgatatttggcaaagacttgaagaa

SEQ ID NO: 37685 - DNA, 50 bp, homo sapien
ttgggtggggacagagagctaaacartatcagctttcttatctaattgta

SEQ ID NO: 37686 - DNA, 50 bp, homo sapien
attctcattgataagctatgtgttaygattttctacatattatagatgat

SEQ ID NO: 37687 - DNA, 50 bp, homo sapien
agaggccccactccgtccaagttgargtggttttctgtcttccttcaaga

SEQ ID NO: 37688 - DNA, 50 bp, homo sapien
tagaaagtagatggcacattcaaaamagatgttaaatcaaggccaaggca

SEQ ID NO: 37689 - DNA, 50 bp, homo sapien
tggcccattatattctatcagaagaycatttccaactatcttagctttta

SEQ ID NO: 37690 - DNA, 50 bp, homo sapien
ccacttttgctattatgatagcaacrcctaatatctaatgtccttatcaa

SEQ ID NO: 37691 - DNA, 50 bp, homo sapien
attgttggtcacctaactcaacacartgtaatttgcagaaaaaaaaaaat

SEQ ID NO: 37692 - DNA, 50 bp, homo sapien
aaagtattaaatgttattctaatgcyattttctcactctcatttttttaa

SEQ ID NO: 37693 - DNA, 50 bp, homo sapien
caagaacctaagatactctctattakaaggaaacacgttaagcaaatata

SEQ ID NO: 37694 - DNA, 50 bp, homo sapien
tccataatggatcctgttgggtctgmaaccttggaacatataataactca

SEQ ID NO: 37695 - DNA, 50 bp, homo sapien
cttgacaatacaataatttatttaaycaaaagtctatccttactatttta

SEQ ID NO: 37696 - DNA, 50 bp, homo sapien
gtgcaggacagagatgggagacaaamtttcttgagtggcagctctgtgca

SEQ ID NO: 37697 - DNA, 50 bp, homo sapien
aagcttacaaatttcatcatagtaarcatcttgaaggaagacagaaaacc

SEQ ID NO: 37698 - DNA, 50 bp, homo sapien
tccacaaatacaggaaatgttaatayagattgactcaaattcaattcatg

SEQ ID NO: 37699 - DNA, 50 bp, homo sapien
tctactttctaccttcttaccatcaygctaattcgtatccttatcatcta

SEQ ID NO: 37700 - DNA, 50 bp, homo sapien
ctaattcgtatccttatcatctatcwcagggaatagtgtatttattcttg

SEQ ID NO: 37701 - DNA, 50 bp, homo sapien
tgcattttcattgccttctgaagtayagtagtaaagtcgtgctgtcccta

SEQ ID NO: 37702 - DNA, 50 bp, homo sapien
taaactgcattgatctctagattcasaagtggttactgcagacactgcag

SEQ ID NO: 37703 - DNA, 50 bp, homo sapien
aagatttaaatgtattcaatacatcrctaaagaataaactgacaaacaag

SEQ ID NO: 37704 - DNA, 50 bp, homo sapien
ttagtttagagattaaggacactgayagttgtataattaaaaacattaaa

SEQ ID NO: 37705 - DNA, 50 bp, homo sapien
gacagtaatagatatagtcatacackagaaaatagctagacaacctgaga

SEQ ID NO: 37706 - DNA, 50 bp, homo sapien
tcacccaattattgaatggatttagwcagttctcctggcaggtatctcct

SEQ ID NO: 37707 - DNA, 50 bp, homo sapien
agaccttagaaatattcatttatcayggtcaaaaggagattcagagttgg

SEQ ID NO: 37708 - DNA, 50 bp, homo sapien
cactatgcctttctatattaggtctsaacataaacacaagatgtaatact

SEQ ID NO: 37709 - DNA, 50 bp, homo sapien
agttaaagaatatttgccaaccctayggaatgatcaaaaactgactgaca

SEQ ID NO: 37710 - DNA, 50 bp, homo sapien
agagaaaacttcaaaaaggattggcratttgaactgagccttcacgaact

SEQ ID NO: 37711 - DNA, 50 bp, homo sapien
tctttatattgctaagtgaaataacwctatattcagtatctaaaaccctc

SEQ ID NO: 37712 - DNA, 50 bp, homo sapien
ctaagaacatctcagtaatccaactraactgtacttcactgtgtgatttt

SEQ ID NO: 37713 - DNA, 50 bp, homo sapien
tattataatttttacttttccgccaktacattggttttcctatgacagaa

SEQ ID NO: 37714 - DNA, 50 bp, homo sapien
tcaaataaagctcacccagatgaaasaagaattgcaacactaacagcctg

SEQ ID NO: 37715 - DNA, 50 bp, homo sapien
agaaaatgaaataaacatgatttcaytcctcgctagattttctattatta

SEQ ID NO: 37716 - DNA, 50 bp, homo sapien
ttccaaatgcttattaactcgttgarctatgtgttactttgttctccacc

SEQ ID NO: 37717 - DNA, 50 bp, homo sapien
aaactggttagaatatgcaaaatackccttgacttggattttcacatttc

SEQ ID NO: 37718 - DNA, 50 bp, homo sapien
aaatggctcttccaaaacaactttawcactttaacagataagatatgctg

SEQ ID NO: 37719 - DNA, 50 bp, homo sapien
cacatggagatttagagctgtacgcrcttactgaacatcaaggcaagtgc

SEQ ID NO: 37720 - DNA, 50 bp, homo sapien
agacaaattgtgtgttgggttttacmaaataccggctaggatactcttga

SEQ ID NO: 37721 - DNA, 50 bp, homo sapien
aaaaacacttcatttctgtaatagaygtagagctgtttcttcccgttgat

SEQ ID NO: 37722 - DNA, 50 bp, homo sapien
atccagtgtgttatttattcccttgmcaaagttgatggtattaatagtaa

SEQ ID NO: 37723 - DNA, 50 bp, homo sapien
caaatgaggaagccactgaagattayagcaaaaacattttcgatacagtg

SEQ ID NO: 37724 - DNA, 50 bp, homo sapien
tggcctgattaaattggcattgttcraagagtaatcttgtggtgtcctgt

SEQ ID NO: 37725 - DNA, 50 bp, homo sapien
caccttggatgtgtttttgaaacaaygtgggatataaataaataaaacat

SEQ ID NO: 37726 - DNA, 50 bp, homo sapien
gtggatatacttctctaagctatcasaaaatctttaagatatgacagagt

SEQ ID NO: 37727 - DNA, 50 bp, homo sapien
acctgtcattaataatttttttctaygagagggatcaaaaagacttcttg

SEQ ID NO: 37728 - DNA, 50 bp, homo sapien
aaaggaactgccgcatgcgtgaaatracgctacaaaattaagggtggcag

SEQ ID NO: 37729 - DNA, 50 bp, homo sapien
ctagtcacattcatagcattcaagargttcattctcagttaacaatccat

SEQ ID NO: 37730 - DNA, 50 bp, homo sapien
tttagtttcaagataattttttaaakaactgaaatagcagatgtccctaa

SEQ ID NO: 37731 - DNA, 50 bp, homo sapien
tttatgctgccaattattctcactckaaggttacatcatattctcaccat

SEQ ID NO: 37732 - DNA, 50 bp, homo sapien
gcctaaagaaagaaagtaaacaggargagaatacaatgtgtttaaaaaaa

SEQ ID NO: 37733 - DNA, 50 bp, homo sapien
ggtttaaacttgtttatgttttccaytgaaaattactaggaaagcaatcc

SEQ ID NO: 37734 - DNA, 50 bp, homo sapien
caggatctaataataaagaatgagargtaatctaaagccagaataattgt

SEQ ID NO: 37735 - DNA, 50 bp, homo sapien
ctatttgctacttaaaactgaactcraaaaatgaataaacacttccacat

SEQ ID NO: 37736 - DNA, 50 bp, homo sapien
tatagtttgctttattctacagagaygggaaactgaaaattaatgcagtg

SEQ ID NO: 37737 - DNA, 50 bp, homo sapien
aaaaagtactaatgaataccaggtgrataaaaagcactaatgaataccag

SEQ ID NO: 37738 - DNA, 50 bp, homo sapien
attttttcatgtatcagttatttaaytatgttactggtaagaaatttata

SEQ ID NO: 37739 - DNA, 50 bp, homo sapien
caattctcattctgtcaataaaagckgctacacaacatatttctttaacc

SEQ ID NO: 37740 - DNA, 50 bp, homo sapien
tatttctagtaatgaccagtattccrctactttcaaaactgcaaagatgt

SEQ ID NO: 37741 - DNA, 50 bp, homo sapien
aatgaaatatttatgccctttggaartctcaattacaatgctgctttccg

SEQ ID NO: 37742 - DNA, 50 bp, homo sapien
gtaccgctaagcttaaaagcattgaygtgtagatacctgtgtcttatttt

SEQ ID NO: 37743 - DNA, 50 bp, homo sapien
taatttatttttatccatttggaggycattaccaggctttagacatttta

SEQ ID NO: 37744 - DNA, 50 bp, homo sapien
aaaagcaactttataactcatctcaraaccatatattttgccaatgagag

SEQ ID NO: 37745 - DNA, 50 bp, homo sapien
agtaaaaattaaccagttaaaatcasgagcattttgtgacatacacatat

SEQ ID NO: 37746 - DNA, 50 bp, homo sapien
tatgtattaattatagacttcagaargtatttttaaaaggtctcaacaat

SEQ ID NO: 37747 - DNA, 50 bp, homo sapien
gaaagagaagaagagtctaatatgartagttttgtgctgacttttgacaa

SEQ ID NO: 37748 - DNA, 50 bp, homo sapien
gttgagtggatagttttattatctgsaagttgttgctggtcctttgcaag

SEQ ID NO: 37749 - DNA, 50 bp, homo sapien
gattctcccaagtagttcacaaaagwatgtatttttaattcaatcttttt

SEQ ID NO: 37750 - DNA, 50 bp, homo sapien
gtttgacatttattttctgctaaacmctttgaaacaaactatgcaacatg

SEQ ID NO: 37751 - DNA, 50 bp, homo sapien
tccttaaaagaagaaaggatattccrgagtttatagacaggattgtagaa

SEQ ID NO: 37752 - DNA, 50 bp, homo sapien
caggatcacagaccagtgaaacagartacggtcaaccatcagatgcctgc

SEQ ID NO: 37753 - DNA, 50 bp, homo sapien
cttggagaacagcaattctagaaacycaacagtgctctgttgctcaggca

SEQ ID NO: 37754 - DNA, 50 bp, homo sapien
aaaatggtacaaccattttggaacayagtttgacaatttatttcaaggct

SEQ ID NO: 37755 - DNA, 50 bp, homo sapien
tctagaaatcaagaaaaaggaacaamtgtagcaatgtgtggaaatacttt

SEQ ID NO: 37756 - DNA, 50 bp, homo sapien
ttacagttgtttacctacttacatakcgctaaacactaaaacatgcaagt

SEQ ID NO: 37757 - DNA, 50 bp, homo sapien
accagagaacaattgtttttgaaaakgtgaccaccatagaaaaagaagtg

SEQ ID NO: 37758 - DNA, 50 bp, homo sapien
aaagtgtcttaaacagcaaaaaggasacgaggagcatatttgctggaatt

SEQ ID NO: 37759 - DNA, 50 bp, homo sapien
ttatttactttttatgattccagcarctattttaatcttggaattcactg

SEQ ID NO: 37760 - DNA, 50 bp, homo sapien
ctgagactctgagagaccaacataaygagttaggcaacattgtcttcctt

SEQ ID NO: 37761 - DNA, 50 bp, homo sapien
tctcaaatgaatgaaacagtggttamatttcctggtctctattgcaaagt

SEQ ID NO: 37762 - DNA, 50 bp, homo sapien
tctgtaatgtttaaggtgttatgatragcgttatgaaaagagggcagatt

SEQ ID NO: 37763 - DNA, 50 bp, homo sapien
ttaaagatgacagtaagacactttaygaagggtgacattttctagacatt

SEQ ID NO: 37764 - DNA, 50 bp, homo sapien
tgcaggtctgtttgattttcagtatwaaaaatataatgtgcattacattt

SEQ ID NO: 37765 - DNA, 50 bp, homo sapien
tgtcttgtcaagaatctttgtataaygcacagttgtggaagataaagata

SEQ ID NO: 37766 - DNA, 50 bp, homo sapien
agaccctcatctcctttgcataagcrctgtatacatcagatgttgggata

SEQ ID NO: 37767 - DNA, 50 bp, homo sapien
tcatgcaattgccccttaagtttcaragttccttgatcaatacacaggtt

SEQ ID NO: 37768 - DNA, 50 bp, homo sapien
atactcatgaacattgatgaccaaayacaggaatgtagcatctgtctcta

SEQ ID NO: 37769 - DNA, 50 bp, homo sapien
gtgtgtgtgtgtgtgtgtaatttatraggaacaatggaaaatttgaaagc

SEQ ID NO: 37770 - DNA, 50 bp, homo sapien
gtttcttttataggcaagtgagtaaktaacactttttattatgctttcaa

SEQ ID NO: 37771 - DNA, 50 bp, homo sapien
ctggagtaagaaacttaagatataamctatgccaaaatgaaaagggattt

SEQ ID NO: 37772 - DNA, 50 bp, homo sapien
accgctgctattaatatgttcattasaatacaaataaatggacatttatt

SEQ ID NO: 37773 - DNA, 50 bp, homo sapien
gtaacttgcatgtacaaaataattartaattagcatgaaggttattccac

SEQ ID NO: 37774 - DNA, 50 bp, homo sapien
accccttactagttacgtggtcttawacaatgtcctttaacaagctttta

SEQ ID NO: 37775 - DNA, 50 bp, homo sapien
ctgaaagagattgataggtcttaaargataaaagtggattatcataaact

SEQ ID NO: 37776 - DNA, 50 bp, homo sapien
tgtaccatttttatgcctaatatacmaaatcttttccgttattcatgagg

SEQ ID NO: 37777 - DNA, 50 bp, homo sapien
tctttcagaatacaaataggtagatwaaatgatggtattataggcataac

SEQ ID NO: 37778 - DNA, 50 bp, homo sapien
ggctttatagtagaataattcaccawtcataatgccaaaggtaaagcttt

SEQ ID NO: 37779 - DNA, 50 bp, homo sapien
aagaaatgcatgactttatattgtamggctgtcagtgaataagtgtgata

SEQ ID NO: 37780 - DNA, 50 bp, homo sapien
ggcagggggcgggtacttggaattakagaataagaagttgagcaggctgt

SEQ ID NO: 37781 - DNA, 50 bp, homo sapien
aatgagttcgtcaccttggaaaatartagtcattctgatttacttgttac

SEQ ID NO: 37782 - DNA, 50 bp, homo sapien
tatttgtcaatactgaagagttgacraagatactgaggactagtttttaa

SEQ ID NO: 37783 - DNA, 50 bp, homo sapien
atttctctaatgttgagttgtaacaytgtgggccattaaaacaatttcct

SEQ ID NO: 37784 - DNA, 50 bp, homo sapien
cctcaagtatgttaaacttctgaacmaactacttaaaaaccaaagttacg

SEQ ID NO: 37785 - DNA, 50 bp, homo sapien
aaatagaattggtattataaaacaamaggtcagttttttataacaaccaa

SEQ ID NO: 37786 - DNA, 50 bp, homo sapien
ttccatagaaacagattttatgacayggtaatcagttgctggtgtctttt

SEQ ID NO: 37787 - DNA, 50 bp, homo sapien
acctcagttacctatagagaaagaamgatgaaatgggcagaataaacctc

SEQ ID NO: 37788 - DNA, 50 bp, homo sapien
aattttctatcaatatgtatcttggsaatagttctggtggtgaatttcag

SEQ ID NO: 37789 - DNA, 50 bp, homo sapien
agatacatattgatagaaaattagamgctagcctgcactgatggcttatg

SEQ ID NO: 37790 - DNA, 50 bp, homo sapien
atccaaaccatatcatcatccaagarcttgtcatataagttaagacatca

SEQ ID NO: 37791 - DNA, 50 bp, homo sapien
aaagaaacattctggaaagacagagratggtcattgaaagctgttctttg

SEQ ID NO: 37792 - DNA, 50 bp, homo sapien
gcaagcaaagttacaaactcaactarcacaacctgtggaatcaaatttga

SEQ ID NO: 37793 - DNA, 50 bp, homo sapien
tgaatccaagcttgcttccagatgcrcctgagctacggacatcaagttaa

SEQ ID NO: 37794 - DNA, 50 bp, homo sapien
gtcttaccgagcctatggtagatgaygatagatttttgacaaatttcatg

SEQ ID NO: 37795 - DNA, 50 bp, homo sapien
atgcaagcattcttatgacatggaakgaggatatgggtgttaacattgac

SEQ ID NO: 37796 - DNA, 50 bp, homo sapien
gctttacataagtatctcaaagtaartagcttcccctatgtatatgcaga

SEQ ID NO: 37797 - DNA, 50 bp, homo sapien
cgactacttataggttttgcctgtamacggagtcacttcattctttattg

SEQ ID NO: 37798 - DNA, 50 bp, homo sapien
aattgaggaacatacatttttaaacygagtattcatacacatattgcata

SEQ ID NO: 37799 - DNA, 50 bp, homo sapien
tgaaaaggatttgaatgtaaactccratagagaatcatgctagtcttaaa

SEQ ID NO: 37800 - DNA, 50 bp, homo sapien
tcacttcattctttattgaaaaaaawactgctttgcatcatcttctatag

SEQ ID NO: 37801 - DNA, 50 bp, homo sapien
cttgaaaaataaaattccaaatctcraaaggccctatataattttggtgt

SEQ ID NO: 37802 - DNA, 50 bp, homo sapien
aaaataaaaaatgtattttggattayattatcagtaagtcacgaccacaa

SEQ ID NO: 37803 - DNA, 50 bp, homo sapien
ctgcaagtcccagacacatttctacrcttgactccatcattaactcatga

SEQ ID NO: 37804 - DNA, 50 bp, homo sapien
tcttatgataggagcctagcaagtcmagcaatctgttaccattctagctc

SEQ ID NO: 37805 - DNA, 50 bp, homo sapien
tactatctatccaactaatagttaakgtggctaagtaaagcataaaaaat

SEQ ID NO: 37806 - DNA, 50 bp, homo sapien
atctgtcaagttgacacctcatatgsatgaaataagccttacacatttga

SEQ ID NO: 37807 - DNA, 50 bp, homo sapien
ttagtagtggctgacactgagtccaratagtcttgattcctagaaataaa

SEQ ID NO: 37808 - DNA, 50 bp, homo sapien
gccacttctcaccattgcagccctaygaagccactcttagttcccctata

SEQ ID NO: 37809 - DNA, 50 bp, homo sapien
agactttatgttttttaacactactyacatataacagaggaggaagcttt

SEQ ID NO: 37810 - DNA, 50 bp, homo sapien
aagagaggtgtttgatagttattcartatgtatttgtagcatgaatgaac

SEQ ID NO: 37811 - DNA, 50 bp, homo sapien
aagaaggtccagataaaagtaagaayagattacaaagtgagggaatctca

SEQ ID NO: 37812 - DNA, 50 bp, homo sapien
cagagtgtaacagcagcaggataaaygaagaagaaggtccagataaaagt

SEQ ID NO: 37813 - DNA, 50 bp, homo sapien
ttacatatttaatgatgaccactccratgttaatacaagtcacataatgt

SEQ ID NO: 37814 - DNA, 50 bp, homo sapien
agttactttcagatttaaactgaaasgaatgcatcgattgagtactgcac

SEQ ID NO: 37815 - DNA, 50 bp, homo sapien
tgctagagctactgttgaaatttaamtcacttcaaatcacactgttttga

SEQ ID NO: 37816 - DNA, 50 bp, homo sapien
ctagatcttgtgagggctcttgatamatgatttaaggtgacactaatatc

SEQ ID NO: 37817 - DNA, 50 bp, homo sapien
atgcctggcagaaacgttacggctayaccctgcatatggcaaatgggtct

SEQ ID NO: 37818 - DNA, 50 bp, homo sapien
ggcagctaacaaatcgaaaaaactgwatcagcttccctgtgaggaagaac

SEQ ID NO: 37819 - DNA, 50 bp, homo sapien
gtgagtttataatatcatgcagtaaytcaaactaatgtggctcaaaaatg

SEQ ID NO: 37820 - DNA, 50 bp, homo sapien
tatgacaatgactaagctccaagtayaacacacaaaactggtttgagaat

SEQ ID NO: 37821 - DNA, 50 bp, homo sapien
aggttgcagtcacaaaagacccatakgacagacatgaaggttggttctag

SEQ ID NO: 37822 - DNA, 50 bp, homo sapien
agtacagggaagcaaggagaatttayatatttaatgatgaccactccaat

SEQ ID NO: 37823 - DNA, 50 bp, homo sapien
tttctaaatgatatatagtatttccrgacccaacatgatcagatgcaggc

SEQ ID NO: 37824 - DNA, 50 bp, homo sapien
ttggcataactgtattttagatgtcractttaagtaagacttttaaagaa

SEQ ID NO: 37825 - DNA, 50 bp, homo sapien
agatatttttgttatgtaggcaaacratttgggcttcagattggaatcct

SEQ ID NO: 37826 - DNA, 50 bp, homo sapien
gtaagtacttcagtggtaaaaatgaraacccagagagattattggacttg

SEQ ID NO: 37827 - DNA, 50 bp, homo sapien
ggcaaacagagtagtagagaagtagwatgtaactgtcatagctggcttcc

SEQ ID NO: 37828 - DNA, 50 bp, homo sapien
gtcagctgtaccaactttactggcayatgtattacttgtttgtggcttca

SEQ ID NO: 37829 - DNA, 50 bp, homo sapien
ttctcattattcccttttttctaagycagaattataagagacagaatctc

SEQ ID NO: 37830 - DNA, 50 bp, homo sapien
aggactgaattgagttgcttgcgtaraagtatcttcccatctaagaaaat

SEQ ID NO: 37831 - DNA, 50 bp, homo sapien
ttagtcactttttctttctgataacractttgcgtgtgccacgttgttac

SEQ ID NO: 37832 - DNA, 50 bp, homo sapien
cttgaaacacttgcttattaatcaamaaataggattcattatattgatag

SEQ ID NO: 37833 - DNA, 50 bp, homo sapien
acaaaacctttgattcttgacatgaygaaattgtgaagcctaagctggga

SEQ ID NO: 37834 - DNA, 50 bp, homo sapien
ttgtcaagggctctgtttacatctayacattttgaagatgaaatttttag

SEQ ID NO: 37835 - DNA, 50 bp, homo sapien
aaatccacagactaatttttcgatayagtattcctggttctggtccttaa

SEQ ID NO: 37836 - DNA, 50 bp, homo sapien
caacatttaataatattaggaatggycaatttatcatcaaaacaacacta

SEQ ID NO: 37837 - DNA, 50 bp, homo sapien
gtcaatgagattttttcagtcaagaratctagtcagaatgtaggaaatat

SEQ ID NO: 37838 - DNA, 50 bp, homo sapien
ttttgctaacatatatcattgtataygtttgaggattgagctcaagtaag

SEQ ID NO: 37839 - DNA, 50 bp, homo sapien
caaaaactacaaagtagaagagagaygattgtatttaactgacccaactt

SEQ ID NO: 37840 - DNA, 50 bp, homo sapien
catagaaatacccagaaatgctttasgatggaggacattacaataagatg

SEQ ID NO: 37841 - DNA, 50 bp, homo sapien
atttagagaaaacaatcgcacatatkaattgtaactttctataaaagaaa

SEQ ID NO: 37842 - DNA, 50 bp, homo sapien
cgtaaagcatttctgggtatttctayggggtatctcacttgtgcttataa

SEQ ID NO: 37843 - DNA, 50 bp, homo sapien
gttgccttaagcatacctattcaaayaacctctctaaaatactttccttt

SEQ ID NO: 37844 - DNA, 50 bp, homo sapien
catgagttttagatgagatctgagtyaagatacctagaaaatattgtcca

SEQ ID NO: 37845 - DNA, 50 bp, homo sapien
tccaggcactaacctcatcctcaatraatcagtctaactttgttataata

SEQ ID NO: 37846 - DNA, 50 bp, homo sapien
taaaaaagcccactaccattaaagamtatctcacaaagaggataggaaag

SEQ ID NO: 37847 - DNA, 50 bp, homo sapien
gccttggaaaagagcaggtgccttaygaaaaagaaactagatttgtgaga

SEQ ID NO: 37848 - DNA, 50 bp, homo sapien
tgtgctctctgggatccaagtcttaraatacatatttgccagtatcctct

SEQ ID NO: 37849 - DNA, 50 bp, homo sapien
tctttccctacctctgtcccggatcyagactgcaatcagttatctctcaa

SEQ ID NO: 37850 - DNA, 50 bp, homo sapien
aagttatacagcctcaatgaaatgawaaaggaccatgactttgcatataa

SEQ ID NO: 37851 - DNA, 50 bp, homo sapien
tactgcacaagccttctcacggaccrccctactgtcagtcttgtcttcct

SEQ ID NO: 37852 - DNA, 50 bp, homo sapien
ataaagtaaaatgccactagattaawgaattctggattcaggtgagttta

SEQ ID NO: 37853 - DNA, 50 bp, homo sapien
agtcttggcacttggcctagacagcrattagatgtgtccttcttggactc

SEQ ID NO: 37854 - DNA, 50 bp, homo sapien
acaggaaagatttcaggaaataataygagtcacacatgttggttctatag

SEQ ID NO: 37855 - DNA, 50 bp, homo sapien
aacagaagggcttcatacaaactaaygactgtgaaagatgacacagggtt

SEQ ID NO: 37856 - DNA, 50 bp, homo sapien
ttttcttgcttccctgtgattattcraaggattctatcttctccttcttt

SEQ ID NO: 37857 - DNA, 50 bp, homo sapien
aaccttaaagtagatatcataagackgacaaaacaggctctttgtggcaa

SEQ ID NO: 37858 - DNA, 50 bp, homo sapien
gcctgtgacctgaacctctcaattayctcatctatcaaatagggacaata

SEQ ID NO: 37859 - DNA, 50 bp, homo sapien
tatgtattgctttattaggtcaagaygatttcccacaatacttaaacctg

SEQ ID NO: 37860 - DNA, 50 bp, homo sapien
attttgaaaattattaatgtgcttaycttttttctggtctgaggacatga

SEQ ID NO: 37861 - DNA, 50 bp, homo sapien
cacctcacacccttgggcttagagargttgcttagatgatattgagaggt

SEQ ID NO: 37862 - DNA, 50 bp, homo sapien
tattcactttacctagcagggaaaartacacaaaaactgcagatacttca

SEQ ID NO: 37863 - DNA, 50 bp, homo sapien
gacttccctcccatggtgttcccaawgcatcctgtatctgcttgctaatg

SEQ ID NO: 37864 - DNA, 50 bp, homo sapien
aatcttatttccctaatgatacaacraactctttgattacagatattatg

SEQ ID NO: 37865 - DNA, 50 bp, homo sapien
ggaagagagaacctctttttttctaratggcatgtatgccaacagcttat

SEQ ID NO: 37866 - DNA, 50 bp, homo sapien
aattgtggattacatgtggtcttctsaaggtttctgtcagttggttccat

SEQ ID NO: 37867 - DNA, 50 bp, homo sapien
agtagtatagagctctatgcttcagrctaactgatgccttctgactcctg

SEQ ID NO: 37868 - DNA, 50 bp, homo sapien
gaacagggaagtggaataagaggccrctacgaagtgagaggtagcttcca

SEQ ID NO: 37869 - DNA, 50 bp, homo sapien
ttaggaaagaaaataaagtaacaccratgagaacagggaagtggaataag

SEQ ID NO: 37870 - DNA, 50 bp, homo sapien
ctggcttgcaaattaagcctgaaccrgatatgccatagaactattatttt

SEQ ID NO: 37871 - DNA, 50 bp, homo sapien
tttccagttatacatctagtagagawgaggtcattgataggaatgggaag

SEQ ID NO: 37872 - DNA, 50 bp, homo sapien
tttcatcttctgtgtctatcacaccrgcatagaattaccaagagcactgt

SEQ ID NO: 37873 - DNA, 50 bp, homo sapien
gcttaattgtcattttccctaaaacrctcattagccacagccattttttt

SEQ ID NO: 37874 - DNA, 50 bp, homo sapien
cctgcagaacaaatgaaatctcaaaraggagaacaggcccagttgaacat

SEQ ID NO: 37875 - DNA, 50 bp, homo sapien
aaaatacaggaactattagtgaagargccggttatatgcagaaactggca

SEQ ID NO: 37876 - DNA, 50 bp, homo sapien
atgtgttgtgagtcttgtgctaataytagaaaaggtctgggctagggctg

SEQ ID NO: 37877 - DNA, 50 bp, homo sapien
ttctgtggatttaagagattaaggcraattagttctgataacagggcata

SEQ ID NO: 37878 - DNA, 50 bp, homo sapien
aaggtatatatgtgaagactatacayggttatatttataggaagcttaga

SEQ ID NO: 37879 - DNA, 50 bp, homo sapien
acttagaaaagagtaactaatgcaargaatagttttgttataaaatgtgc

SEQ ID NO: 37880 - DNA, 50 bp, homo sapien
tgtgggttcagtaaaagtttcttcaygtcctccaatatagatcgtaaata

SEQ ID NO: 37881 - DNA, 50 bp, homo sapien
atagatggttggatggatggtgtaaygtttgattaataaggagatatatg

SEQ ID NO: 37882 - DNA, 50 bp, homo sapien
tctatttctggaagttattcagatayggttgataaaatccaatgaaagat

SEQ ID NO: 37883 - DNA, 50 bp, homo sapien
tgatgcgcacttccagatatggagayagataatgaagaacatttgcaaca

SEQ ID NO: 37884 - DNA, 50 bp, homo sapien
agataatgaagaacatttgcaacackcagcaaggtgcctgggtaattgta

SEQ ID NO: 37885 - DNA, 50 bp, homo sapien
aaggaagctcagaaccttgatgaaasgttacaggaactgctaactagaat

SEQ ID NO: 37886 - DNA, 50 bp, homo sapien
gctgcataagccattccagaagtaarggacctaaaacaatactttatggt

SEQ ID NO: 37887 - DNA, 50 bp, homo sapien
cattgtctgctcagagtttaagagargtacatgtcttttaacaaattata

SEQ ID NO: 37888 - DNA, 50 bp, homo sapien
ataacagtatatgcagtatgtgtagkagtaaaaagcatttctcaaatatg

SEQ ID NO: 37889 - DNA, 50 bp, homo sapien
gggttgttagggtttctgcaagtagyaaataaaatataagaaaactcaag

SEQ ID NO: 37890 - DNA, 50 bp, homo sapien
tcttaaactccttgtcaaggtttaaktactccaatatagaagcaaccaaa

SEQ ID NO: 37891 - DNA, 50 bp, homo sapien
gttagtagagatgctgatgcactctsacatattcggccattcatcaatat

SEQ ID NO: 37892 - DNA, 50 bp, homo sapien
ctcctattctccagttttgtcctacrcctagaatatcaacagattttaag

SEQ ID NO: 37893 - DNA, 50 bp, homo sapien
tttgctaaacatttgctgtatgcatsaatgctatttgagagggtaaaatg

SEQ ID NO: 37894 - DNA, 50 bp, homo sapien
caatgtccaagcccataaaagttaaytgcaagaatttaggtatagtttta

SEQ ID NO: 37895 - DNA, 50 bp, homo sapien
aataaaaatacacttccctatataamaatgttacagtcattagcctgaat

SEQ ID NO: 37896 - DNA, 50 bp, homo sapien
acagcaagaaaatgccattcttggarcacattactaatctccttctataa

SEQ ID NO: 37897 - DNA, 50 bp, homo sapien
aatctaagtgactgcttgtgatccaygacaaatctattttttgtgtgtgt

SEQ ID NO: 37898 - DNA, 50 bp, homo sapien
cttctaaattaaacctacaccttgaygcttcaggcctgcacctaataaga

SEQ ID NO: 37899 - DNA, 50 bp, homo sapien
tctgccattttcactgatatcatacygagatgtaagtattaaaagactga

SEQ ID NO: 37900 - DNA, 50 bp, homo sapien
actaaagaaacaatggtaagtgtaakgttgatgttaatttaggaaaatac

SEQ ID NO: 37901 - DNA, 50 bp, homo sapien
cttctgcaaataagaatacacccaawgagataaacataaaatatgactct

SEQ ID NO: 37902 - DNA, 50 bp, homo sapien
ctctaatctaatatgtgtgaaaatargatcagataaaatatatgtggaaa

SEQ ID NO: 37903 - DNA, 50 bp, homo sapien
gatctgcccttatttttgatcatagrccaataaggtagagaaaaccaact

SEQ ID NO: 37904 - DNA, 50 bp, homo sapien
tttttttttctttttaatgctcaacmatgaatgagattccacaaatttgt

SEQ ID NO: 37905 - DNA, 50 bp, homo sapien
tgtattttcagtttgttgaaaccackggccaattgaagcaagttaacaca

SEQ ID NO: 37906 - DNA, 50 bp, homo sapien
ttcacttggctacacatgaaagggaygcttaaaaggagagaaagccaaag

SEQ ID NO: 37907 - DNA, 50 bp, homo sapien
agaagtattcactcatattgttaaaygttttccatggagtctggaacttg

SEQ ID NO: 37908 - DNA, 50 bp, homo sapien
tctccaaatagtgagtctggaactcrcttctatccaggatttcatctcag

SEQ ID NO: 37909 - DNA, 50 bp, homo sapien
tttcataatttaatgagtaaacgcartgaaatgagatgaagtggcactca

SEQ ID NO: 37910 - DNA, 50 bp, homo sapien
aaagcttaatcctacattgggtaacrcatggtttttgtctttgattgatt

SEQ ID NO: 37911 - DNA, 50 bp, homo sapien
tgttctctgaattctttcaaattcarcaatgccagaaaaataaaaatata

SEQ ID NO: 37912 - DNA, 50 bp, homo sapien
ataattgcccaaggaagtcagagaaygaattgactaaggaaatgtactag

SEQ ID NO: 37913 - DNA, 50 bp, homo sapien
aactgcttattgagtagactactaarccaaagaatcttaaagctttctct

SEQ ID NO: 37914 - DNA, 50 bp, homo sapien
gaaaatgaaggacctaaaacccacgmacttagcaaaatttttctcacttt

SEQ ID NO: 37915 - DNA, 50 bp, homo sapien
ctgctttgatagttgactcattacayacctgaaactggaaaagttttctt

SEQ ID NO: 37916 - DNA, 50 bp, homo sapien
cctgctacgtgatactcaactgataktacctgcaagatgcctcccaccac

SEQ ID NO: 37917 - DNA, 50 bp, homo sapien
atttattaatactagggaacttgaamagaaacatcggctagtcatactta

SEQ ID NO: 37918 - DNA, 50 bp, homo sapien
aaaacctgtcacacaatttctattayggtgacttgaagctactaggagga

SEQ ID NO: 37919 - DNA, 50 bp, homo sapien
atggtagatttctaccagcaaaggartagtcgaagttgtaaaatgatttt

SEQ ID NO: 37920 - DNA, 50 bp, homo sapien
aactgctgaggaaaatggaactagaygtaatgtcaaaagtagctctaaat

SEQ ID NO: 37921 - DNA, 50 bp, homo sapien
aaatcatcctttagaaactcagaaaktgttattaaataaattgaaaacta

SEQ ID NO: 37922 - DNA, 50 bp, homo sapien
tcctcagcagtttcattaccagcaartctaaatcataatctgtatgggat

SEQ ID NO: 37923 - DNA, 50 bp, homo sapien
agttaaaaacattcagctgtgattasaaattgcagtgattggccaggcgt

SEQ ID NO: 37924 - DNA, 50 bp, homo sapien
tgtggaagtgtctgaatctccctcaratgtcagtagagtacagtgagata

SEQ ID NO: 37925 - DNA, 50 bp, homo sapien
atgagaataaattgaatgaaaaaaawataatacgggactctcccaccaag

SEQ ID NO: 37926 - DNA, 50 bp, homo sapien
atgatatgtacaattcaaagagcaartggattagttttatgttgctgcag

SEQ ID NO: 37927 - DNA, 50 bp, homo sapien
cagacttttgtgagtgaaaagaaaaytaggtaaggtgagctgtgaggtca

SEQ ID NO: 37928 - DNA, 50 bp, homo sapien
aaatttacaattccacgatgaattarattgaaactctcagatcaaaataa

SEQ ID NO: 37929 - DNA, 50 bp, homo sapien
gaggagtgaggaaggaaatggtggcyaagtattaggatatgggtgtctgc

SEQ ID NO: 37930 - DNA, 50 bp, homo sapien
catgtgccaaagcattatacaactaygaaggaaaagagcctggagacctt

SEQ ID NO: 37931 - DNA, 50 bp, homo sapien
gagtcagtgatgtgacaatagacacrggtcagagttatgtggccatgagc

SEQ ID NO: 37932 - DNA, 50 bp, homo sapien
caagttttgtgtgaactactcactaygcttctgaaaatgcctagaagcag

SEQ ID NO: 37933 - DNA, 50 bp, homo sapien
attttgcacatcttactgtcttcaartaatatttacagcttttaatgcat

SEQ ID NO: 37934 - DNA, 50 bp, homo sapien
catggttccagggagtaaggatagcragtgttggaaacaaaatcagtgta

SEQ ID NO: 37935 - DNA, 50 bp, homo sapien
gcattaaaagtatctcttccctacaytcttcagtgactaattcaaaaaat

SEQ ID NO: 37936 - DNA, 50 bp, homo sapien
cataatgtgggtttattattgttcaraatattagggaaatttaaaaatca

SEQ ID NO: 37937 - DNA, 50 bp, homo sapien
aaatgccgattttagaaattggccaygtagaaatctcagtctaaattttc

SEQ ID NO: 37938 - DNA, 50 bp, homo sapien
atctaatttttcccattccatgtgawtacaaaccatttcttatctgtttg

SEQ ID NO: 37939 - DNA, 50 bp, homo sapien
atattttctacttcctatgtttcacrcttaatgtactaaatttatatatt

SEQ ID NO: 37940 - DNA, 50 bp, homo sapien
tgaaggtcaccaccagcaggtcacartgtaactagatctgtactctcagc

SEQ ID NO: 37941 - DNA, 50 bp, homo sapien
tgcacatttaagaaaattggttgaamatataactaaatgtaagtttctca

SEQ ID NO: 37942 - DNA, 50 bp, homo sapien
tttgtctattctagacctttctacaytctgatccagtccagtcctgtctg

SEQ ID NO: 37943 - DNA, 50 bp, homo sapien
tgaataatatcaggtgaaaccgatgraatcagtaggtataatttcttgtc

SEQ ID NO: 37944 - DNA, 50 bp, homo sapien
tagtctccagcactgtcagaaatagscattctacccaaaagtcatcacag

SEQ ID NO: 37945 - DNA, 50 bp, homo sapien
ttatcaacttgacacctaaagcctakggtgcttaaattgatgtttacttg

SEQ ID NO: 37946 - DNA, 50 bp, homo sapien
tgcagaacactactgcaaataaatargtagtgttgctcatatcatttcta

SEQ ID NO: 37947 - DNA, 50 bp, homo sapien
caattctgatttctaattcttcctcrctatcttcacagaaattacataac

SEQ ID NO: 37948 - DNA, 50 bp, homo sapien
atttaatgaatatcattttccttaaygtttgctgatatgtccattcaatg

SEQ ID NO: 37949 - DNA, 50 bp, homo sapien
cctgcattttatgcttagccttacaytcaagcctataccccaaatcatta

SEQ ID NO: 37950 - DNA, 50 bp, homo sapien
gagcttgtgaaatatgtggaaaccaytatctaaccatttacaagctacct

SEQ ID NO: 37951 - DNA, 50 bp, homo sapien
agaaaacatttgataaagcacaaacygtatttgagaaaaccaggcccaca

SEQ ID NO: 37952 - DNA, 50 bp, homo sapien
atgggaaagttgatatgggttacatraaatcccttctcatagatttgcta

SEQ ID NO: 37953 - DNA, 50 bp, homo sapien
cagctagtaactacatcaacaaatarctggaaatactcacagagagaaaa

SEQ ID NO: 37954 - DNA, 50 bp, homo sapien
tggtaaataaatgagtaaacgctaayagcatgaagcaaacttgccaatgc

SEQ ID NO: 37955 - DNA, 50 bp, homo sapien
tcttccaaagacataatattcaactraaaatgtgacatgaggtcataata

SEQ ID NO: 37956 - DNA, 50 bp, homo sapien
agaggtaaacactaaatataaaaccrggaattagaagctggccttgggtt

SEQ ID NO: 37957 - DNA, 50 bp, homo sapien
gttaggtgtctcaaatggagagagawgttcatagttgtattctaggatgt

SEQ ID NO: 37958 - DNA, 50 bp, homo sapien
tgggggtctttttaatttctgcaagyaggatgttaggtgtctcaaatgga

SEQ ID NO: 37959 - DNA, 50 bp, homo sapien
agttgaggagacagagagataaatasaggtaggcaactgcattttcctgt

SEQ ID NO: 37960 - DNA, 50 bp, homo sapien
taccatgctcatggtgtttaatatgraaagcattccttagagtacagtgc

SEQ ID NO: 37961 - DNA, 50 bp, homo sapien
cagtttttgtaagacagtgtgatagragctatgatagcagtatactgagc

SEQ ID NO: 37962 - DNA, 32 bp, homo sapien
cctgattccttccattkaagaccgatatttaa

SEQ ID NO: 37963 - DNA, 50 bp, homo sapien
tggatcactgctcaaaaagtgggtayctatggaatcaagtaaaaatccat

SEQ ID NO: 37964 - DNA, 50 bp, homo sapien
ttcaagcaggagatcagagctcataygttggtttgaccaaaaggatctca

SEQ ID NO: 37965 - DNA, 50 bp, homo sapien
ctttttcatttgtgatcatatgttcyagaggtttattgatccattcttct

SEQ ID NO: 37966 - DNA, 50 bp, homo sapien
cttcctgctctggagatggtgacagsacttggtatttgagcagctacagc

SEQ ID NO: 37967 - DNA, 50 bp, homo sapien
ctctccataagtgagatggactttayagttgctgaatgctggaagatatc

SEQ ID NO: 37968 - DNA, 50 bp, homo sapien
gaagaggaattagaagaaagtgagcrcaatcgatgaacacagatcaactg

SEQ ID NO: 37969 - DNA, 50 bp, homo sapien
gtgtaagtttgtgattctcatgaagkagcactctgaagatactattgagc

SEQ ID NO: 37970 - DNA, 50 bp, homo sapien
tagtgtttgatgaaaccacacatgaycgactgacttacaacatcccttat

SEQ ID NO: 37971 - DNA, 50 bp, homo sapien
tgcatgtcagaccctagtggatcaamctaccgaattcaagtcattagaaa

SEQ ID NO: 37972 - DNA, 50 bp, homo sapien
tttgtgttctgctcacagataacaaytataggttaaacattataaacatt

SEQ ID NO: 37973 - DNA, 50 bp, homo sapien
acattttctgaagtctttttgttgcyatcagacacttccattcccctcac

SEQ ID NO: 37974 - DNA, 50 bp, homo sapien
tgaattaacacacacaaatcatttasagcaatgcacaacacataaccata

SEQ ID NO: 37975 - DNA, 50 bp, homo sapien
ggaaaaatataactcttgcttgaacraaagatctaagattgggggaacac

SEQ ID NO: 37976 - DNA, 50 bp, homo sapien
ttattttcaggagatgaacttaaaayctaagaatgcagaaagcttaaaag

SEQ ID NO: 37977 - DNA, 50 bp, homo sapien
cacttcagtaggaaatcaggaattayatatgctgttagatctgctatatt

SEQ ID NO: 37978 - DNA, 50 bp, homo sapien
actgatctgtgcatagggccctccargaagtgataaaatagcatctaaat

SEQ ID NO: 37979 - DNA, 50 bp, homo sapien
atttcttattttaattcagaaggaartattgactagtgttttctaatgga

SEQ ID NO: 37980 - DNA, 50 bp, homo sapien
tacaaagcctcagataattttcttaygctttttgaaactgttttctcaat

SEQ ID NO: 37981 - DNA, 50 bp, homo sapien
cactctccaatcacatccttatacakagacatcaattgttgcccatctat

SEQ ID NO: 37982 - DNA, 50 bp, homo sapien
tgccaaggcaaatatgcaacttaaarcactttttcatgatgccctctctg

SEQ ID NO: 37983 - DNA, 50 bp, homo sapien
ttgggttggtgatcatcatcaatgargcaaataacaacctttgagaaagt

SEQ ID NO: 37984 - DNA, 50 bp, homo sapien
caaattttttcagtcttatcacaaawaagtagtttgaggaagagtatgga

SEQ ID NO: 37985 - DNA, 50 bp, homo sapien
ataatcctttaatctataagtagcaytgacaattctccattgaaagaggt

SEQ ID NO: 37986 - DNA, 50 bp, homo sapien
ctaatagaatatgggttttcaaagastaacatattattcttaaaatgtat

SEQ ID NO: 37987 - DNA, 50 bp, homo sapien
aatcatgctctacttgattaaaaaartggtaaatcaaataaaaaattcca

SEQ ID NO: 37988 - DNA, 50 bp, homo sapien
cctacgcaatacagctaactccaaaygtatttttagaagtggtataaaac

SEQ ID NO: 37989 - DNA, 50 bp, homo sapien
acttgctgagcttttaaccgagacayagaaattaggtaaagatattaagt

SEQ ID NO: 37990 - DNA, 50 bp, homo sapien
ctttatttccttctgtatcctactcraagttttaaggaagtaatgccatg

SEQ ID NO: 37991 - DNA, 50 bp, homo sapien
tatggatgtttaatggtctctagcastgaactatcaccagctctgccttt

SEQ ID NO: 37992 - DNA, 50 bp, homo sapien
atttctatagtgaagagaataatacraaacacaaaacatccacactgaga

SEQ ID NO: 37993 - DNA, 50 bp, homo sapien
gcaagtcatcgatgtctctgatagakgccatttagttcactcaacccagg

SEQ ID NO: 37994 - DNA, 50 bp, homo sapien
tgaaaatacctgtgtgatcttagagraacagcttagtattttcatttcat

SEQ ID NO: 37995 - DNA, 50 bp, homo sapien
aaaactgcaagtcctatctacttaaygaacacctgggttgagtgaactaa

SEQ ID NO: 37996 - DNA, 50 bp, homo sapien
ttttttctaactttaggataaggatyaagagatttgtaagtcatagaaag

SEQ ID NO: 37997 - DNA, 50 bp, homo sapien
aatacgtaaaatcaatgctaactaakgtgcacaaataattatctgaatgt

SEQ ID NO: 37998 - DNA, 50 bp, homo sapien
gagaattagcttctcagagacagaarggtcttacagcagtggaagagcat

SEQ ID NO: 37999 - DNA, 50 bp, homo sapien
taaaaacaaatttaggcagaaaatamatggaatcaacattattcttattt

SEQ ID NO: 38000 - DNA, 50 bp, homo sapien
ggctttctattagaattaaaactcaytaccataaggagagcaaacaaata

SEQ ID NO: 38001 - DNA, 50 bp, homo sapien
cccaatagaatgcctccaacatatamaagtttcaataattatgtgtaaca

SEQ ID NO: 38002 - DNA, 50 bp, homo sapien
aatcaaggcaccacattttccatacrcagtacaataccagaaaggacaga

SEQ ID NO: 38003 - DNA, 50 bp, homo sapien
aaaaaccacacagcaatcaaacctcrataaatatataaataaaaattgtg

SEQ ID NO: 38004 - DNA, 50 bp, homo sapien
tgatcttttgtttgcaatgttacaargaaatgtgtctgaataatgacaaa

SEQ ID NO: 38005 - DNA, 50 bp, homo sapien
tgagacccaatgttaaaaatgagtaratgctaattacagaaatgggggag

SEQ ID NO: 38006 - DNA, 50 bp, homo sapien
acaaagaaggcagaaacaggctgacyggattatacatctgtccatgtacg

SEQ ID NO: 38007 - DNA, 50 bp, homo sapien
agtgctacccccaaaacagtgcaaasatcctatctctgggaaggaacaag

SEQ ID NO: 38008 - DNA, 50 bp, homo sapien
agtagctctaaacctgcaataccaartctcttcaggtgtttccagatata

SEQ ID NO: 38009 - DNA, 50 bp, homo sapien
tttatttatccagatactgattacckactttctgcaatgtgctaaggaaa

SEQ ID NO: 38010 - DNA, 50 bp, homo sapien
atataattgtgaatatacattcttascatgtgattgtgatttaaaatagg

SEQ ID NO: 38011 - DNA, 50 bp, homo sapien
ttgaatcttcagtcttagaaagttayggcccagtgcggtggctcacacct

SEQ ID NO: 38012 - DNA, 50 bp, homo sapien
ctaagggcacaaaacacaaataaaakgtcattctgcttcatagaagctta

SEQ ID NO: 38013 - DNA, 50 bp, homo sapien
catcgatcttctcttctccagtttasacacttttcatcacatagcagcat

SEQ ID NO: 38014 - DNA, 50 bp, homo sapien
tctacatctaagcattgtgctgataygtagaaggatgtctatagtctgtt

SEQ ID NO: 38015 - DNA, 50 bp, homo sapien
gaataagccactgcagctatgtaacrgtaagtctctgatgccatgcaacc

SEQ ID NO: 38016 - DNA, 50 bp, homo sapien
ctcagcttctttactctgacttttaygatttattaaaatatttgagaaac

SEQ ID NO: 38017 - DNA, 50 bp, homo sapien
tttatacttaatggtataatgtgtcyaactgaattttgagtgtttcatag

SEQ ID NO: 38018 - DNA, 50 bp, homo sapien
ttcaaggatctctttcaatgtaagartaatctttggagagttgcaggaaa

SEQ ID NO: 38019 - DNA, 50 bp, homo sapien
tttaaatttccaactattaacgactraaagttcaattgcagattagtatt

SEQ ID NO: 38020 - DNA, 50 bp, homo sapien
cctgggaaaaactctcccagacacartgaaatctgctccagctgtggtgg

SEQ ID NO: 38021 - DNA, 50 bp, homo sapien
cctctaaagaagagggtagagactasaactgaatgagatggacatagaga

SEQ ID NO: 38022 - DNA, 50 bp, homo sapien
aataggaagcaatgtgatcaagatayctagtgtggagtatcagaagaccc

SEQ ID NO: 38023 - DNA, 50 bp, homo sapien
acagtccattgcaaatgcttacacawcctatgccccgataaaccagggtg

SEQ ID NO: 38024 - DNA, 50 bp, homo sapien
ctttaatgttttctgagttttctacratgagagtttactagttcgaggag

SEQ ID NO: 38025 - DNA, 50 bp, homo sapien
gcaaatcgtggccatgtaatgtacamctggccaaaaaaataaacaaatgt

SEQ ID NO: 38026 - DNA, 50 bp, homo sapien
tttgtggaaaagaatgattgatagasaaaatattacctgtactagttttc

SEQ ID NO: 38027 - DNA, 50 bp, homo sapien
caaaaatatactaccgagactctaasggaaaaacacaagcaccttgctat

SEQ ID NO: 38028 - DNA, 50 bp, homo sapien
gtcttatgtgtttgaaatgtacgaaragacccaagaaacctagatgaaca

SEQ ID NO: 38029 - DNA, 50 bp, homo sapien
ttaaaaagggtgaaaaaacagatgaygagtggaaacacaaataatgatca

SEQ ID NO: 38030 - DNA, 50 bp, homo sapien
tcattgttgggtacctgtttttccayggttgttatgcacacataacttac

SEQ ID NO: 38031 - DNA, 50 bp, homo sapien
ttaacagtggaagtgagttgtggaargtttacctgaaattgaagtggctt

SEQ ID NO: 38032 - DNA, 50 bp, homo sapien
aaactatggagacagtagaaatgatyaacgtacaaaaaatagagaatgtc

SEQ ID NO: 38033 - DNA, 50 bp, homo sapien
cttcgaaatcaatgaatagtcctcaratgttactgtttttaattttcttc

SEQ ID NO: 38034 - DNA, 50 bp, homo sapien
tggtgtgagcagtggaaaagaatagractgtcatgaattgtgattgggaa

SEQ ID NO: 38035 - DNA, 50 bp, homo sapien
ccaacttgaaaaagtcactttatgtmacagtggataataatactacctac

SEQ ID NO: 38036 - DNA, 50 bp, homo sapien
acaaagcttgaagctctcatattgaycttggagttcaggcaaagaaggct

SEQ ID NO: 38037 - DNA, 50 bp, homo sapien
tttaatttctagccttacctgaagtsaaccagaatgtattcttcatttgg

SEQ ID NO: 38038 - DNA, 50 bp, homo sapien
tctcctttctctgtcctaagaaatcmaacaataattccacactttttctg

SEQ ID NO: 38039 - DNA, 50 bp, homo sapien
caagtaacctgcagacagagggcttstcaagtataaaacctttaatcatt

SEQ ID NO: 38040 - DNA, 50 bp, homo sapien
aagtaacagaaagttcataaatccastcaaatcccatcccagtttccaag

SEQ ID NO: 38041 - DNA, 50 bp, homo sapien
gccagagggatatgtctaaaatttcragttgattctatcactcttttctt

SEQ ID NO: 38042 - DNA, 50 bp, homo sapien
catgtctctgcaaaactcatttttayggttctatcaggccctggtgactt

SEQ ID NO: 38043 - DNA, 50 bp, homo sapien
tacatataaaacacttagcaaattaygcacctgaaatcttacttatatga

SEQ ID NO: 38044 - DNA, 50 bp, homo sapien
aatccaagactttttagttagcaagycagtggcctgtcatttcccttgaa

SEQ ID NO: 38045 - DNA, 50 bp, homo sapien
cctgtacaaaaattttatgcaaagaycatgaaataaataaatttcctaaa

SEQ ID NO: 38046 - DNA, 50 bp, homo sapien
tctttgttagcattatctaagtttargttgagattattgcattattgact

SEQ ID NO: 38047 - DNA, 50 bp, homo sapien
tatataaataggctgtattccaccaytggtagagtaagactcaaatccaa

SEQ ID NO: 38048 - DNA, 50 bp, homo sapien
ctgtcactgacaagaaattacctatraatcacaagttgttaatgcaagat

SEQ ID NO: 38049 - DNA, 50 bp, homo sapien
ctatcagcctcttcatcatctgtacsaacaatctcttcttaactggctct

SEQ ID NO: 38050 - DNA, 50 bp, homo sapien
cacatcatcataaacaagacttacaycaacaatcatgggggaatttgaat

SEQ ID NO: 38051 - DNA, 50 bp, homo sapien
gtattttagatacgagaaatagagaygtaaggtttaatgcttgactccaa

SEQ ID NO: 38052 - DNA, 50 bp, homo sapien
aaacaccttctgtaactattcattaygccatcagattctccaagctctaa

SEQ ID NO: 38053 - DNA, 50 bp, homo sapien
ccctctaagtgcaatcaactacgtcyactggcttcggaattgactgtatg

SEQ ID NO: 38054 - DNA, 50 bp, homo sapien
agaaatggacatacttctctacatcsagttattgttaaagatacctttgc

SEQ ID NO: 38055 - DNA, 50 bp, homo sapien
ttgtcagagattgatgacctaaacartcactgaaacttaataacagcgtt

SEQ ID NO: 38056 - DNA, 50 bp, homo sapien
tataaaacattagtgagatgaaagamgcggaacttaggaactaactacac

SEQ ID NO: 38057 - DNA, 50 bp, homo sapien
gttacgtaagggataacaacactacrattggccaaaatatgcataaaatg

SEQ ID NO: 38058 - DNA, 50 bp, homo sapien
tttacaacttacaagttagtgttaasaaaatgtataaagatggtgatatg

SEQ ID NO: 38059 - DNA, 50 bp, homo sapien
taatatgtttcaaaatggcatatcamcatctttatacattttgttaacac

SEQ ID NO: 38060 - DNA, 50 bp, homo sapien
aagtatcttcttgtacaacagtgaartaaaattagaaatcaataccaaga

SEQ ID NO: 38061 - DNA, 50 bp, homo sapien
aaccagaatggtactaaaaccaataratatatgagaagaaaatgaatagt

SEQ ID NO: 38062 - DNA, 50 bp, homo sapien
atgaaataaagaaaacgaacggacamagactttaggaatgatgtttgatt

SEQ ID NO: 38063 - DNA, 50 bp, homo sapien
aagtgagcagcaggcattgaactacrattttcattcctcttgttgaaggg

SEQ ID NO: 38064 - DNA, 50 bp, homo sapien
gttttattcactttgtagtccacaaygcttatcgatttgtgttgctgcaa

SEQ ID NO: 38065 - DNA, 50 bp, homo sapien
cagattcttaattttatggtgctcartctttgctgaagtttgtctgtttt

SEQ ID NO: 38066 - DNA, 50 bp, homo sapien
tactctatcctataattaaatgccastactgtttctccacataaccatcc

SEQ ID NO: 38067 - DNA, 50 bp, homo sapien
gagcaagacaccgattcaaagatacrgaaagatgaatggagttaccttta

SEQ ID NO: 38068 - DNA, 50 bp, homo sapien
gcaacacttggactgaataacaaacycgaaagttgctgaaatctgcataa

SEQ ID NO: 38069 - DNA, 50 bp, homo sapien
gaaacaattggcataggggcagatamgctagaagtgttctttgaatgaat

SEQ ID NO: 38070 - DNA, 50 bp, homo sapien
ccaccaaagaacttacacatgtgacygaataccacctgtttcccgaaaac

SEQ ID NO: 38071 - DNA, 50 bp, homo sapien
ctggctgagttatagaaatgattaaygttttattcaattgaagactcaaa

SEQ ID NO: 38072 - DNA, 50 bp, homo sapien
tctgcaattaaaatgtaagatctgayactagaaagttaataggtcttgtg

SEQ ID NO: 38073 - DNA, 50 bp, homo sapien
cagcactttggttcaccttttcttcratattgtgattctttttgtcataa

SEQ ID NO: 38074 - DNA, 50 bp, homo sapien
tgcgaccaatttgtctctcctcatarcaagatattttaataactctgatc

SEQ ID NO: 38075 - DNA, 50 bp, homo sapien
tcttgttgtagacactgctcctctcrccacttttattgcaggggaacagt

SEQ ID NO: 38076 - DNA, 50 bp, homo sapien
gtgatggtagatgacaatacttgaayggatagtcttgcctcacttaacga

SEQ ID NO: 38077 - DNA, 50 bp, homo sapien
tggcaaccttgagtaatgtcgtggcygcagctacataaaatacaaggcta

SEQ ID NO: 38078 - DNA, 50 bp, homo sapien
ttagtctgcctaagtcaaatattacrctctgagccaacataaaattcccc

SEQ ID NO: 38079 - DNA, 50 bp, homo sapien
agaagccatgttttaatagtcttagraaaaacaagccatgttagatcaat

SEQ ID NO: 38080 - DNA, 50 bp, homo sapien
taccaaaggcaatgcttaacccacarggaatggaaattgatggataaaca

SEQ ID NO: 38081 - DNA, 50 bp, homo sapien
gctactattgatatataaatgttaaygaaacgtatccactattatatttt

SEQ ID NO: 38082 - DNA, 50 bp, homo sapien
ccagaaacttctattggccttctcaytacctgtaagttaaaataagttca

SEQ ID NO: 38083 - DNA, 50 bp, homo sapien
tacaatctgcttcgtgattacctatracatttcttgggcaaaataaacta

SEQ ID NO: 38084 - DNA, 50 bp, homo sapien
tacttttcaaatcaagagttaattcrcaatgttttcaaagtttatcacaa

SEQ ID NO: 38085 - DNA, 50 bp, homo sapien
gtagaatagagtactagaaagagtcratttgtgatgaagggagaaaagga

SEQ ID NO: 38086 - DNA, 50 bp, homo sapien
tccttacattagcaacttaaaaaccyggtgaatgaagagataaactatat

SEQ ID NO: 38087 - DNA, 50 bp, homo sapien
ccccatcaacatttcaaatgatgtayagttttagaagagcttattattca

SEQ ID NO: 38088 - DNA, 50 bp, homo sapien
tttttagtaactcttcataatcataycttggcataaaccctgaaatattt

SEQ ID NO: 38089 - DNA, 50 bp, homo sapien
aagaaaatatgtggatacacttttargtaactaccctgttttggacacaa

SEQ ID NO: 38090 - DNA, 50 bp, homo sapien
cagcattcctaaggcgggtattagartccaacatgagaagaatgcagagg

SEQ ID NO: 38091 - DNA, 50 bp, homo sapien
tgtagataaaggactggcgccacaaygtctatatggactaaacttttcat

SEQ ID NO: 38092 - DNA, 50 bp, homo sapien
aatatattttaaaaacttcttgttaygatttccatcaggaataggatcta

SEQ ID NO: 38093 - DNA, 50 bp, homo sapien
agcctcagacagaggtctgctatgamacagttaattctgaaaagttttct

SEQ ID NO: 38094 - DNA, 50 bp, homo sapien
agatcttcaaattaattacatttgcrataaccatttttccaaataagata

SEQ ID NO: 38095 - DNA, 50 bp, homo sapien
atatcttctttttctgcccttataayggtacttatcagtctgaatatcaa

SEQ ID NO: 38096 - DNA, 50 bp, homo sapien
aggctctttaaacatgattgtgataygtggtcgcccttaataagagcact

SEQ ID NO: 38097 - DNA, 50 bp, homo sapien
cattagtcaagaaatttaacttttcragacttagatttctcatctataat

SEQ ID NO: 38098 - DNA, 50 bp, homo sapien
acagatacaaaaggtacagagtaaamaagaagacaacacaggcaagggaa

SEQ ID NO: 38099 - DNA, 50 bp, homo sapien
attgccaggtgatttcaatgtgtagyataggatttaaaggcctttgaaac

SEQ ID NO: 38100 - DNA, 50 bp, homo sapien
gtcttcttgatatgcacccacatccrattgatcactatttcactgccaag

SEQ ID NO: 38101 - DNA, 50 bp, homo sapien
ctatcagtgacttgtcaaatatgtcraacagatgtctgaacaaatcagct

SEQ ID NO: 38102 - DNA, 50 bp, homo sapien
ctgtgaataaaatacaacaacttaamcaagtgggagcaaaacattttatg

SEQ ID NO: 38103 - DNA, 50 bp, homo sapien
aataatgagataaagttttgttgtasagtcgtgatagtggaccctgtgaa

SEQ ID NO: 38104 - DNA, 50 bp, homo sapien
tgtataagtaagagccaagaatcaaygaatctccctttttagctcaaaca

SEQ ID NO: 38105 - DNA, 50 bp, homo sapien
gtaccttaaactcagaaatgttagaragccctgaaattgccttacacatt

SEQ ID NO: 38106 - DNA, 50 bp, homo sapien
ggaagatgtaatgtgaatatgctaawtaaactatgttttaaacttaattc

SEQ ID NO: 38107 - DNA, 50 bp, homo sapien
tgatgggataatttagagaacatacyatcatacttttccctaacacattc

SEQ ID NO: 38108 - DNA, 50 bp, homo sapien
gttcttaaaacagacaattacaatgractaagtagacgaataattacctt

SEQ ID NO: 38109 - DNA, 50 bp, homo sapien
cagtaatctacagacatgacactgtraagagaggaaattcattacataag

SEQ ID NO: 38110 - DNA, 50 bp, homo sapien
caggagcggtactaagggagaagaaracagttattacagctgagtgtctt

SEQ ID NO: 38111 - DNA, 50 bp, homo sapien
ttgaggagaggaatggtgaggtaggycaactctttgttaaggcagtagat

SEQ ID NO: 38112 - DNA, 50 bp, homo sapien
atagcaatgcaaaaacaaagtaatargtaagcacagcaggatttggcatt

SEQ ID NO: 38113 - DNA, 50 bp, homo sapien
agcttggggaagacattctagtggcrcattagtctccttcacattgttct

SEQ ID NO: 38114 - DNA, 50 bp, homo sapien
gttcctactctgattacattgagaargctacaggttgaagccataaaata

SEQ ID NO: 38115 - DNA, 50 bp, homo sapien
ttcttgtttgctcaaaataaactgasaatgtgactcgtaatatataaaaa

SEQ ID NO: 38116 - DNA, 50 bp, homo sapien
caggttgaagccataaaatacctcaycaatactgactactcctttggata

SEQ ID NO: 38117 - DNA, 50 bp, homo sapien
ggatctgtgcttcagaaataagtcartaaagatacatttacatagatgtt

SEQ ID NO: 38118 - DNA, 50 bp, homo sapien
caccaatgcaaggcctcaaaaattaygaataagcaaggaaaccatgacac

SEQ ID NO: 38119 - DNA, 50 bp, homo sapien
tatatgtcttggaacaaatccatcaraagaaattttcaggatagtaactg

SEQ ID NO: 38120 - DNA, 50 bp, homo sapien
atgtgtctgcttaacaagaatcttarctgtcttcaatgtctttactggct

SEQ ID NO: 38121 - DNA, 50 bp, homo sapien
gcatttgcatttctttgcattgttaracccaacttaacaaatgctttcat

SEQ ID NO: 38122 - DNA, 50 bp, homo sapien
cttcatcacatttctagtaaagttayaaagccactatgtacaagatactg

SEQ ID NO: 38123 - DNA, 50 bp, homo sapien
tctaacgttctcacctgtgatcaccraatagatatgctctgcctgacaca

SEQ ID NO: 38124 - DNA, 50 bp, homo sapien
caataggttcacttcgaataaagatyagaggacatttttaacagaatgca

SEQ ID NO: 38125 - DNA, 50 bp, homo sapien
cattcttggcccaggatatcacacamctaaggactcagaagaaagttgat

SEQ ID NO: 38126 - DNA, 50 bp, homo sapien
tctataattttgtgttgtgcttcatkaacgctaatggttcatgaaggttt

SEQ ID NO: 38127 - DNA, 50 bp, homo sapien
cattctgaatctttgcaaatccataygaaattagacacagtacatgtact

SEQ ID NO: 38128 - DNA, 50 bp, homo sapien
ttccctgcatcataaatcacaaaaaygtaaagattatccctatatgattt

SEQ ID NO: 38129 - DNA, 50 bp, homo sapien
ctcttgaaatacacattttaataccraaggagcatcccacaaaacatcta

SEQ ID NO: 38130 - DNA, 50 bp, homo sapien
aacgccatgcttttgtttaatcatcragaccagacagaacattgaggata

SEQ ID NO: 38131 - DNA, 50 bp, homo sapien
ttaaatgtgtgtgagctgatacttaygaacttgacagaagaaagctgagt

SEQ ID NO: 38132 - DNA, 50 bp, homo sapien
gaaaggacagcactattaaaagaggscataatcctatctacatggcaata

SEQ ID NO: 38133 - DNA, 50 bp, homo sapien
cataatactattaatatttgcaaaayctcttgtaccttctgtcactatga

SEQ ID NO: 38134 - DNA, 50 bp, homo sapien
caaataaatgtagaatatggagccaraaagtatcctctaacaacacaata

SEQ ID NO: 38135 - DNA, 50 bp, homo sapien
ccaatgagactgtggtagtacttgtsaaacttacaggaagtaattaaaga

SEQ ID NO: 38136 - DNA, 50 bp, homo sapien
aactgagtgccctcttgtaaggtaaytgcctccaaggattgacagactaa

SEQ ID NO: 38137 - DNA, 50 bp, homo sapien
aatactgaatcatctatcaagtataygtctgagaccagagtctgcctttg

SEQ ID NO: 38138 - DNA, 50 bp, homo sapien
ctagttacatagtaaaattatctgayggaacttttataatcattccaatt

SEQ ID NO: 38139 - DNA, 50 bp, homo sapien
tggtttatttcataattgttacagaygatgcaatatatggtggttgcttg

SEQ ID NO: 38140 - DNA, 50 bp, homo sapien
gtagctaaagaaaaacaacaagatayatttctgtgtaatttttattattt

SEQ ID NO: 38141 - DNA, 50 bp, homo sapien
atgggttttctgattcgattgagaayaaaggatgtgaaattataaaaatc

SEQ ID NO: 38142 - DNA, 50 bp, homo sapien
tgtacacttttgtcatgaataattckatatgtgattcagtgttgataaga

SEQ ID NO: 38143 - DNA, 50 bp, homo sapien
aagcagatatggattctaatcccaartctagcaaatcacttaacttcatt

SEQ ID NO: 38144 - DNA, 50 bp, homo sapien
gctaatgtatggatcaagtgggatarcgcaggcaaggtgaagcacagcat

SEQ ID NO: 38145 - DNA, 50 bp, homo sapien
ttttaagcattctatattgttttacyattgataagcaaaaaaaagaaata

SEQ ID NO: 38146 - DNA, 50 bp, homo sapien
cctcaagttagagagtagagttacayggatcaagaaatgtataaatacaa

SEQ ID NO: 38147 - DNA, 50 bp, homo sapien
tgtctcctacaccaaagatactgaasaaagactcattgttctgaacaagg

SEQ ID NO: 38148 - DNA, 50 bp, homo sapien
gcacttatctggttaacagacaatascaattaaaaagataggaaaaaaaa

SEQ ID NO: 38149 - DNA, 50 bp, homo sapien
ggctgaccttaataagagacccaggraacagttcatctactggtaatgga

SEQ ID NO: 38150 - DNA, 50 bp, homo sapien
ctgacaagaaagttattggtacaagmaaactacatcattgcaataatgtt

SEQ ID NO: 38151 - DNA, 50 bp, homo sapien
cttttttaaccacatacagaatacaytggtttactttattaataagcatg

SEQ ID NO: 38152 - DNA, 50 bp, homo sapien
aattgttcagttattaacacttttayacatactcactagtctttctaaaa

SEQ ID NO: 38153 - DNA, 50 bp, homo sapien
ggattatatctattttacaaaaggtyacattaatttcagcaaaatgcaca

SEQ ID NO: 38154 - DNA, 50 bp, homo sapien
agaatataggcagttagctaagaccrcttttaatgatagggctagaatat

SEQ ID NO: 38155 - DNA, 50 bp, homo sapien
atcagctaagagtttaggagctcaayttcaggccagctcccactggcagg

SEQ ID NO: 38156 - DNA, 50 bp, homo sapien
gtccccacttacaagtagaaacaacratagaaagccaaatacactcccca

SEQ ID NO: 38157 - DNA, 50 bp, homo sapien
atgactataaatgagttatataaatsagtaacaaaatctttgagaaattc

SEQ ID NO: 38158 - DNA, 50 bp, homo sapien
cttgctgaccttctttgggtgacagrccatttaaaattttcagttaggtg

SEQ ID NO: 38159 - DNA, 50 bp, homo sapien
gactgatattgagaagtgagtgataygctagaaactctttaagaaactta

SEQ ID NO: 38160 - DNA, 50 bp, homo sapien
ccaaaacaatgaaaaagacttggacrctaaccaaaagtagttctgtggtc

SEQ ID NO: 38161 - DNA, 50 bp, homo sapien
atagcaggctagctggagctattcayatgcacagagcaaagagaagagaa

SEQ ID NO: 38162 - DNA, 50 bp, homo sapien
ctgggcctattcccagaaatgagcckccagtagcttttttcttttctcca

SEQ ID NO: 38163 - DNA, 50 bp, homo sapien
gtgtgaacaaaacatctaatgattcrgaagcagaaatagagcagtaaaca

SEQ ID NO: 38164 - DNA, 50 bp, homo sapien
aggtgaacaggtataatgctgtgcastagtatttaaggaaaaggaaatag

SEQ ID NO: 38165 - DNA, 50 bp, homo sapien
taatattgatcaagagccatattagraagggaccatcagttctaaaaatc

SEQ ID NO: 38166 - DNA, 50 bp, homo sapien
cagttaactttgttctccttattagraactttccctgcatacacttgcat

SEQ ID NO: 38167 - DNA, 50 bp, homo sapien
tctgaaaattgcaattacgcttacayagctactttataggaatattacag

SEQ ID NO: 38168 - DNA, 50 bp, homo sapien
gattcatagctcaacctgctctccartaatttgtgtatagtgtgacctac

SEQ ID NO: 38169 - DNA, 50 bp, homo sapien
tgtctttctcctcttaggataaaacrctagaggcttatctggaactgttc

SEQ ID NO: 38170 - DNA, 50 bp, homo sapien
gtgtcaattatcaacaattagctaargaataattcaacatttaattaaat

SEQ ID NO: 38171 - DNA, 50 bp, homo sapien
tcctggacttccattgaccttaatcrccatttgttcaaccattctcgctt

SEQ ID NO: 38172 - DNA, 50 bp, homo sapien
aagttgaaattaatactatgagtaaycctgaactcaattacagcaactga

SEQ ID NO: 38173 - DNA, 50 bp, homo sapien
aagggaaaagaaagaatgagggaatmaatatagttagctgagggagtaac

SEQ ID NO: 38174 - DNA, 50 bp, homo sapien
gtgtaaaaggctttaactttaggtarctgacagcagtggacagtattgct

SEQ ID NO: 38175 - DNA, 50 bp, homo sapien
tactatttagaaatgaactacttccratcttttttgaactgataactaac

SEQ ID NO: 38176 - DNA, 50 bp, homo sapien
gacagcatagaaaaaattcctagaarccacattggaaagaaatagcagat

SEQ ID NO: 38177 - DNA, 50 bp, homo sapien
ctatggctcttgctatattcagggaraaattgtaattgaaatacaacttt

SEQ ID NO: 38178 - DNA, 50 bp, homo sapien
cactgcacatgttccaggacctacayctgaatgttttctataggtgtgat

SEQ ID NO: 38179 - DNA, 50 bp, homo sapien
taacctataaatcagttgatagagawctgggaaccctgaattatgtgttc

SEQ ID NO: 38180 - DNA, 50 bp, homo sapien
cacatcttttaggctaaccacacaarttacagggtgaaattttatcatat

SEQ ID NO: 38181 - DNA, 50 bp, homo sapien
aaagtaattgtggttgttgccattaygaatgcccttataaatacatggca

SEQ ID NO: 38182 - DNA, 50 bp, homo sapien
ttgccttttcttcatcacttctacarctataaatacagacatcatgctaa

SEQ ID NO: 38183 - DNA, 50 bp, homo sapien
tacacatctttatcaagatcaagtayaatcaattgtgttgctgccaatac

SEQ ID NO: 38184 - DNA, 50 bp, homo sapien
aatgttgcatatatttagtagctcaytcaactgctttttataagtgtttg

SEQ ID NO: 38185 - DNA, 50 bp, homo sapien
tttcactctctttccataaggcacckctcaaatgaacagttttgttctta

SEQ ID NO: 38186 - DNA, 50 bp, homo sapien
gaagcttcttggacaaatgggatcaygcaaatgtgtggaagaaaagtctc

SEQ ID NO: 38187 - DNA, 50 bp, homo sapien
cccaaaataatttttgattacaccayaatttaacgctgaaatgatattct

SEQ ID NO: 38188 - DNA, 50 bp, homo sapien
tttattagaacacagtggtttgacayacaagttgctagagtatgcaatat

SEQ ID NO: 38189 - DNA, 50 bp, homo sapien
ctgataaatgtgcagtttgggaagayggaaagtttgaccaagagatctca

SEQ ID NO: 38190 - DNA, 50 bp, homo sapien
tggattccatgcacagtagtggacakaatctaagaacacaggttgacaca

SEQ ID NO: 38191 - DNA, 50 bp, homo sapien
aaattccagtttggaatcaccttacyctgaaaaaagatgagttaggaatg

SEQ ID NO: 38192 - DNA, 50 bp, homo sapien
caaatatttagagcaagagtttggawaatgacacatagtagatgagcagt

SEQ ID NO: 38193 - DNA, 50 bp, homo sapien
ccgcagggatactgggtggaagagaratcctggctgaaggtgtagcaaga

SEQ ID NO: 38194 - DNA, 50 bp, homo sapien
ttgccaaatttggccaggcggatcastcctttcaaatctaagtctctgtg

SEQ ID NO: 38195 - DNA, 50 bp, homo sapien
atgcaggaaataaaggagaattttaygtatcttagcaaacgtaggggtag

SEQ ID NO: 38196 - DNA, 50 bp, homo sapien
atgagtctgtcatccaccggattagwataatttaacaattacaaaaactt

SEQ ID NO: 38197 - DNA, 50 bp, homo sapien
gtttaaaattaataggccacatttarcaaaaactttatattattaaattt

SEQ ID NO: 38198 - DNA, 50 bp, homo sapien
aaattcagaaagtcagcttaaacacrcaagtcatcattcttataatggtc

SEQ ID NO: 38199 - DNA, 50 bp, homo sapien
cagtaactcttttaagcactttgtaygtattagttcaattaatttcagta

SEQ ID NO: 38200 - DNA, 50 bp, homo sapien
ggacagtgttacataattatgatgayacagaagctggtgtccatgaaaaa

SEQ ID NO: 38201 - DNA, 50 bp, homo sapien
tgaggtggcagttccagtcgacttasgttagggaaaaggaagagagattc

SEQ ID NO: 38202 - DNA, 50 bp, homo sapien
aatcctgacatacttggcacctagayagaaaagataaggctatgattttt

SEQ ID NO: 38203 - DNA, 50 bp, homo sapien
acttaacagccaaaattagttaacamtcagttaggcaggggagctaaaag

SEQ ID NO: 38204 - DNA, 50 bp, homo sapien
ggtagaatctctaccttgaatgctasgagaaattgtaggtaatcaaaagc

SEQ ID NO: 38205 - DNA, 50 bp, homo sapien
ggtttgtttagtgttagatcccgaaygcttctcgcatctgacgctatcca

SEQ ID NO: 38206 - DNA, 50 bp, homo sapien
ggacatcagacaatgaaatgttagayaaagagagagttccgaaagtacaa

SEQ ID NO: 38207 - DNA, 50 bp, homo sapien
atgtaagccacaaggcgttatgggamacaatccggcagtcagcacgcaat

SEQ ID NO: 38208 - DNA, 50 bp, homo sapien
tagctgaataaattgcattatctcckattgtatcatcaataacctgtctg

SEQ ID NO: 38209 - DNA, 50 bp, homo sapien
aatgtttagagatcttaagattgaaygtcatggtttttacttatcaatca

SEQ ID NO: 38210 - DNA, 50 bp, homo sapien
agtctgtatagcaggacaaagtatarctaacttccagcttgctgctgcct

SEQ ID NO: 38211 - DNA, 50 bp, homo sapien
cttgcatggagaaaattcccggtcarctaggtacatcagcagcattcttg

SEQ ID NO: 38212 - DNA, 50 bp, homo sapien
tgggtgggtggcagagagcagatcartctgggaaaccatgaatctaagag

SEQ ID NO: 38213 - DNA, 50 bp, homo sapien
cataccaaccatatacatggaaccaycattctaacgcgcctgagttttac

SEQ ID NO: 38214 - DNA, 50 bp, homo sapien
ttggtaactgtggtaaaagcaacacrgccaatttttagctggggaggcag

SEQ ID NO: 38215 - DNA, 50 bp, homo sapien
catttggagagactgattaatatagrcctgcagctaactaattgtctctc

SEQ ID NO: 38216 - DNA, 50 bp, homo sapien
aaaaaggtagaggaagagaagatgaygatagcacacatgctagtgatttt

SEQ ID NO: 38217 - DNA, 50 bp, homo sapien
aatactaattccttgtagaaacactragtaggcctaacggatagtttaga

SEQ ID NO: 38218 - DNA, 50 bp, homo sapien
atgtaatactatctcattcacataawctgttgaagagcatacatttcttt

SEQ ID NO: 38219 - DNA, 50 bp, homo sapien
ggagaccctggaaagagttggattcmatttagaataagatgaagagtctt

SEQ ID NO: 38220 - DNA, 50 bp, homo sapien
catatacagaacgctgttcattctamatacacgttgcattctaattagaa

SEQ ID NO: 38221 - DNA, 50 bp, homo sapien
tagaaaagtatgtttcattgataaasaaggttctgaaaaatgaatgggga

SEQ ID NO: 38222 - DNA, 50 bp, homo sapien
gctgtgatgaattagggttgatctayatcatttccagagtcttttgttct

SEQ ID NO: 38223 - DNA, 50 bp, homo sapien
aataaatgttaaatattgctgttatkaatgtgaataaggtccagatttaa

SEQ ID NO: 38224 - DNA, 50 bp, homo sapien
gaagtgaatatcacacaatgatggcragagtcatatgaggagatacctgg

SEQ ID NO: 38225 - DNA, 50 bp, homo sapien
atatgaggagatacctggataccaartacttgaagatgttcggaagttgg

SEQ ID NO: 38226 - DNA, 50 bp, homo sapien
aatcgtgattatacctttatttttayaggaagagatgatgtaactagagt

SEQ ID NO: 38227 - DNA, 50 bp, homo sapien
aaattaactaggatgaattctacatsaaataaaatagtctgtaggaatca

SEQ ID NO: 38228 - DNA, 50 bp, homo sapien
tagaattcatcctagttaatttggcmagaaaatcaatggaagtaaatcag

SEQ ID NO: 38229 - DNA, 50 bp, homo sapien
tgttgtggaaagggtcggagttatargtgagagtcaaaatcttcaaaaat

SEQ ID NO: 38230 - DNA, 50 bp, homo sapien
aaacaaaacagcctccttactactawccattggtcacccattccaagact

SEQ ID NO: 38231 - DNA, 50 bp, homo sapien
atgccctcttttaagtactaaactawgttgcatttttcagattacacagc

SEQ ID NO: 38232 - DNA, 50 bp, homo sapien
caaggtgacaggagaggccataccakatcagagagatgtgtttcaggttg

SEQ ID NO: 38233 - DNA, 50 bp, homo sapien
actgtgtcattcctctcatgcataawtctgcttgtaaccaataaaattag

SEQ ID NO: 38234 - DNA, 50 bp, homo sapien
gcataaatctgcttgtaaccaataarattagccagtgtcttgtgaaaagc

SEQ ID NO: 38235 - DNA, 50 bp, homo sapien
gagatagaatctggagcatgctttgkagatattgatgtttcatatgcatg

SEQ ID NO: 38236 - DNA, 50 bp, homo sapien
aataaagatgagcactggaaaagaaratgatgaatttgtctggaaataca

SEQ ID NO: 38237 - DNA, 50 bp, homo sapien
tctagaaagctggtagatagttttcrcaatcctcaaagttgcaaatcgcc

SEQ ID NO: 38238 - DNA, 50 bp, homo sapien
agtatgagaaggaaagaataaaatgraattagtgctgtgggagatttgag

SEQ ID NO: 38239 - DNA, 50 bp, homo sapien
ccactatttctttacttcatataacrctcaaatctcccacagcactaatt

SEQ ID NO: 38240 - DNA, 50 bp, homo sapien
cataatagcttatattagtaattctkaaatatttggacttctttacatga

SEQ ID NO: 38241 - DNA, 50 bp, homo sapien
agacagtcttctcttcttgctattcratggtttaacagactgcgtatcct

SEQ ID NO: 38242 - DNA, 50 bp, homo sapien
ggataaactagaaattgtgaaggaaygacactagccatttaactgtcaac

SEQ ID NO: 38243 - DNA, 50 bp, homo sapien
taatgatcacttcctaatcgtaaaayagaaatgcctccaaactctgcaac

SEQ ID NO: 38244 - DNA, 50 bp, homo sapien
agaaagcctaatgtgaaactaacaaraatgcttattaagaatgtaggtga

SEQ ID NO: 38245 - DNA, 50 bp, homo sapien
ttgaagacatagggtcctaatgagtyaatgaaatgtcaacgtatcatcct

SEQ ID NO: 38246 - DNA, 50 bp, homo sapien
tagtgacacacttgtgtaaacaatgyatttattaactgtattaatgttgg

SEQ ID NO: 38247 - DNA, 50 bp, homo sapien
aggcacataggtaggcatttccggamgttttaccatccaggcacctccat

SEQ ID NO: 38248 - DNA, 50 bp, homo sapien
aatatttgttgagcatgccaagctckcgggtaataatagactcctttcca

SEQ ID NO: 38249 - DNA, 50 bp, homo sapien
agaggcaaaagtatcagtgttttatyaattgcttgaaaggctacaaatag

SEQ ID NO: 38250 - DNA, 50 bp, homo sapien
gtgtacagcccctattcttaaaaagkcttgttgcttctcattacttaacc

SEQ ID NO: 38251 - DNA, 50 bp, homo sapien
ccagttaagcatgtcagcttaatcayaggaatttgtcatggtttaaaaaa

SEQ ID NO: 38252 - DNA, 50 bp, homo sapien
gaagcagtgataagtatgaaccagamcattgtgagaaaaaaaaaaaattt

SEQ ID NO: 38253 - DNA, 50 bp, homo sapien
gctttctacattgattcatatatcaytctctcttgtccaagccctgactc

SEQ ID NO: 38254 - DNA, 50 bp, homo sapien
ctaaaattagtttatcatcattctayagcttatataaaaacaagttacag

SEQ ID NO: 38255 - DNA, 50 bp, homo sapien
cttcattttcaaagactttcacaaaygtagaagcaaatacaaatgtgcaa

SEQ ID NO: 38256 - DNA, 50 bp, homo sapien
taggatagagaatgcatattcttacrggaagaaacacaatacttcatagg

SEQ ID NO: 38257 - DNA, 50 bp, homo sapien
gttaatggataaagagaaatttcccrcgatgacataatttggtcatcaag

SEQ ID NO: 38258 - DNA, 50 bp, homo sapien
agcacgaaggtgggctaattacaagsagttcaattataacaagtctctgg

SEQ ID NO: 38259 - DNA, 50 bp, homo sapien
ggaagtgtggacacctaaacagatgscatactgtgtgaacaggcacatct

SEQ ID NO: 38260 - DNA, 50 bp, homo sapien
tttaaatgacaaaatacagagatgartaacagattaggattgttgggagt

SEQ ID NO: 38261 - DNA, 50 bp, homo sapien
caagttctgttcagttacaataccaycttttgggatactcttccaagctt

SEQ ID NO: 38262 - DNA, 50 bp, homo sapien
ttcctgctcatctcttctaattacartgagcaaaatgaggcccaaggaag

SEQ ID NO: 38263 - DNA, 50 bp, homo sapien
catgaagatacatttcacctaaaaaratagagatggcaaataaacacatg

SEQ ID NO: 38264 - DNA, 50 bp, homo sapien
atcaattcaacagatattctcttcayctaagtatttttattatacacagt

SEQ ID NO: 38265 - DNA, 50 bp, homo sapien
attccctattccatgctttgccaccrctatgtattatcagcaagctaaaa

SEQ ID NO: 38266 - DNA, 50 bp, homo sapien
tttttctttttcttgcactgaatcasaagctgagattttctaatattgtg

SEQ ID NO: 38267 - DNA, 50 bp, homo sapien
tttatctacttatgtaaatcacctcrcttaatgtattctgacagttggcc

SEQ ID NO: 38268 - DNA, 50 bp, homo sapien
tgttgtatttatgctgattatctaayagaccatttaaaaacaaatagatt

SEQ ID NO: 38269 - DNA, 50 bp, homo sapien
tgagacaatcatagtagttataacaycatagttgaagatcttgtttatta

SEQ ID NO: 38270 - DNA, 50 bp, homo sapien
ctggctccttctgatgttcatattayactttgtagactatcatttcatcc

SEQ ID NO: 38271 - DNA, 50 bp, homo sapien
aatggaatacaaaagttattaggaawgacattggtgaagtagtgcattag

SEQ ID NO: 38272 - DNA, 50 bp, homo sapien
ggagaaatcaccaatattccagcaasagagagtcagctccatctcaggag

SEQ ID NO: 38273 - DNA, 50 bp, homo sapien
gatccatcgtggcttgaactgttcaygcagtaccccatcacaactattct

SEQ ID NO: 38274 - DNA, 50 bp, homo sapien
ttttttttcctttgccaaacattccraataaatttactttattaagtaaa

SEQ ID NO: 38275 - DNA, 50 bp, homo sapien
taaaaatgggtaagtgttctcaaaasaggaagacatacatgtgaccaaca

SEQ ID NO: 38276 - DNA, 50 bp, homo sapien
atgactggagaccactttaaattcaygctgtctgatgggaggatgggagg

SEQ ID NO: 38277 - DNA, 50 bp, homo sapien
ctaaagtcacccacatttgtcatttraaaaagtatatataaataaaagat

SEQ ID NO: 38278 - DNA, 50 bp, homo sapien
ataaggatgagggtggacaatcgaawgccggtttgttacacctttagggg

SEQ ID NO: 38279 - DNA, 50 bp, homo sapien
tgtgatctgttctaaccttagagaamcaccggcaaacgactcgttacctg

SEQ ID NO: 38280 - DNA, 50 bp, homo sapien
tttaattcttcgtaagtcatcactcrcagcatagtgttattctttttact

SEQ ID NO: 38281 - DNA, 50 bp, homo sapien
tagtccaaatgtctgattctattaarcatcaaaggaatctttttcttaaa

SEQ ID NO: 38282 - DNA, 50 bp, homo sapien
tggaaaaaaatatctaagaccataayacgtttgctttaaagttgtgatta

SEQ ID NO: 38283 - DNA, 50 bp, homo sapien
aaaagaactgtaataggtaacaagayatgctagggtttacagaaaaagaa

SEQ ID NO: 38284 - DNA, 50 bp, homo sapien
tctctaaagctttggatcaataaatrattgccaatatgaatctctaatat

SEQ ID NO: 38285 - DNA, 50 bp, homo sapien
tccaggcataactgggtgaactaaartaaagattggactgtcaaagcagt

SEQ ID NO: 38286 - DNA, 50 bp, homo sapien
catcaaaagtctatgatgattcacartgagaggcttttataactgaaatc

SEQ ID NO: 38287 - DNA, 50 bp, homo sapien
agtatgacaaccagtggattacagcyataatggattttggtacagatgat

SEQ ID NO: 38288 - DNA, 50 bp, homo sapien
ggccccctgtgcatggaaaattgtawctcagcaggtgctacctggaatct

SEQ ID NO: 38289 - DNA, 50 bp, homo sapien
gagcattttgcaataattatcactaycatcattatttcaacttcatgaaa

SEQ ID NO: 38290 - DNA, 50 bp, homo sapien
ccaaagagacgaaatagatcttagasaccttagaatattaatatccttag

SEQ ID NO: 38291 - DNA, 50 bp, homo sapien
agattctttgcaaaagatttggtcaratatctggaagtcttccacttttg

SEQ ID NO: 38292 - DNA, 50 bp, homo sapien
agtttccacccaagccaaatacaaaycaatattgaacaggtgagcataga

SEQ ID NO: 38293 - DNA, 50 bp, homo sapien
ggcagtctttcaacatgtatgccaawcagaagtctttaacagatgtaaaa

SEQ ID NO: 38294 - DNA, 50 bp, homo sapien
ttgaaagactgcctcaagatcgaaakgcggaatgttcctcaaaagccata

SEQ ID NO: 38295 - DNA, 50 bp, homo sapien
agagataaaaataacttatcatgaaractgaagattcacttttagctcat

SEQ ID NO: 38296 - DNA, 50 bp, homo sapien
tatctttatacttaagcctttaaaayatcacttaattataaccccagagt

SEQ ID NO: 38297 - DNA, 50 bp, homo sapien
ttttgttattgttgtcttgtaattcygaaggccttaaaagtgttattttg

SEQ ID NO: 38298 - DNA, 50 bp, homo sapien
gaaaattctgactgctttaatagacygtataagattaaaacctacatata

SEQ ID NO: 38299 - DNA, 50 bp, homo sapien
ttcacatgctatgtctcccataggaytcatttctttctctttaatttgaa

SEQ ID NO: 38300 - DNA, 50 bp, homo sapien
gacagaatttttttttatattgtaaraggctgatgtatgaaattaatgtg

SEQ ID NO: 38301 - DNA, 50 bp, homo sapien
caggtactgaagatatagggaaagayaaaagtcgtggaagttctataatc

SEQ ID NO: 38302 - DNA, 50 bp, homo sapien
attcaaacaaaataacatagtttacycttgccgtttcttctgcttggaat

SEQ ID NO: 38303 - DNA, 50 bp, homo sapien
cttgagagacttccgtgggatagcayaagaggagatctccttgtacacat

SEQ ID NO: 38304 - DNA, 50 bp, homo sapien
catttgcaagcttcaggttgtaaccrcttttgatttcaacctttgctttt

SEQ ID NO: 38305 - DNA, 50 bp, homo sapien
agggatggatatgctggttttctcgyaggcttctgctgataccaccctac

SEQ ID NO: 38306 - DNA, 50 bp, homo sapien
caaatgactccatatgatgttaaaaraactatgattccttctaagtattt

SEQ ID NO: 38307 - DNA, 50 bp, homo sapien
cagtagttactgctttggaaagaaawgataagccgagcactttggaatgc

SEQ ID NO: 38308 - DNA, 50 bp, homo sapien
aagacaaaacaagttttcctctgcartctctgtgttatgccatggcccat

SEQ ID NO: 38309 - DNA, 50 bp, homo sapien
tccagaaaattgttgagtagttaagyaaaaagctaatttgtctggttatt

SEQ ID NO: 38310 - DNA, 50 bp, homo sapien
ttacatgtgaagctaaacattttaaytacaaacgaatggattttctttgc

SEQ ID NO: 38311 - DNA, 50 bp, homo sapien
aaattcttacttatagtgctaagaaygtatatgtctttttttattaaaga

SEQ ID NO: 38312 - DNA, 50 bp, homo sapien
gccagggggcatagtaccataattargttaaaatgtaatgttatgtgtaa

SEQ ID NO: 38313 - DNA, 50 bp, homo sapien
aaatacagagaggaacactaagatcrgaataagcaaacaaaaaagcaaaa

SEQ ID NO: 38314 - DNA, 50 bp, homo sapien
gctattttctttatctttgtgtaaamtcaatggaaataataatagtagct

SEQ ID NO: 38315 - DNA, 50 bp, homo sapien
tctccccatacatttgtctctcttamaatatgtttgtgtacacgttttct

SEQ ID NO: 38316 - DNA, 50 bp, homo sapien
taaagaaaaatagagtagaaatagaraaaattgtgctacatttatttgct

SEQ ID NO: 38317 - DNA, 50 bp, homo sapien
gtgatcagagttcatagtatctccartctgcatgcttcggatgaccactc

SEQ ID NO: 38318 - DNA, 50 bp, homo sapien
gaaggaataacaggtatgaaagtaarctgctacgatgagtctgtcaggat

SEQ ID NO: 38319 - DNA, 50 bp, homo sapien
ccagtagccacagtacaaagaaagcyattcgaacagacttttcatatgtt

SEQ ID NO: 38320 - DNA, 50 bp, homo sapien
aattccaaaaaggatcagaggttgartacaataaagaacaccgatttaaa

SEQ ID NO: 38321 - DNA, 50 bp, homo sapien
ctttctttcacatcatatttgaaackgatacaacctttccagttgtgcat

SEQ ID NO: 38322 - DNA, 50 bp, homo sapien
tgcattttggtaatcacatataaccrgaactagagtaccactgaatcaaa

SEQ ID NO: 38323 - DNA, 50 bp, homo sapien
caatactaaagtgttggtgagaatayggaacagtagaaaaatctcaaaac

SEQ ID NO: 38324 - DNA, 50 bp, homo sapien
gcaacgttaacattttcaacattcastattggtacggaggtgtgaactaa

SEQ ID NO: 38325 - DNA, 50 bp, homo sapien
agaaagacagaatagaaggctagtargtgataatacccacatccaaattg

SEQ ID NO: 38326 - DNA, 50 bp, homo sapien
agtaaatacaaaagtgtagcaacaaytgagtttgctgtctcactaccctc

SEQ ID NO: 38327 - DNA, 50 bp, homo sapien
ttgggatttaaggggaactattggascatgaagccaaatccaaaaaaaaa

SEQ ID NO: 38328 - DNA, 50 bp, homo sapien
tctgcccttgtaactgacactcatcrgacgaatccatttcaaattaaagc

SEQ ID NO: 38329 - DNA, 50 bp, homo sapien
aagctagaagcagcactgtggagaaragaatcctgctgacacaattcctt

SEQ ID NO: 38330 - DNA, 50 bp, homo sapien
aaaacctttgctccccagctatgatyaagagtttgaaatttaaatcagga

SEQ ID NO: 38331 - DNA, 50 bp, homo sapien
ggcaggcaacaagggcattgtttacrgggtatcctaaaaatcttagtgca

SEQ ID NO: 38332 - DNA, 50 bp, homo sapien
tatttggatttgcttatcaggaagasacatttagaaagacaatgcacttg

SEQ ID NO: 38333 - DNA, 50 bp, homo sapien
ttccggtatattgcttttgagttaarcgtaattcatgatgaagagcttaa

SEQ ID NO: 38334 - DNA, 50 bp, homo sapien
aatctgttttttagtgtagtcttcaycaatgacctcagctagatcttgtg

SEQ ID NO: 38335 - DNA, 50 bp, homo sapien
ctggtgtaaaaggtaatgcagttgaraggacagggaacatttattgagca

SEQ ID NO: 38336 - DNA, 50 bp, homo sapien
tgcttattaataccatcctggtgcayggaggacgaataaaccgccagcag

SEQ ID NO: 38337 - DNA, 50 bp, homo sapien
gagacctttaatggattccctcataygcccatttagtattttgctgtgtc

SEQ ID NO: 38338 - DNA, 50 bp, homo sapien
attcatgtgaagagaaacgtccacastctcttgattaaatacttgcatct

SEQ ID NO: 38339 - DNA, 50 bp, homo sapien
ccgaatatgacattttgcagtgactsaagttttagatattgctcaaaaga

SEQ ID NO: 38340 - DNA, 50 bp, homo sapien
aaaatgcccattggaattggcaagaygaagtcccaggtatcactgacagt

SEQ ID NO: 38341 - DNA, 50 bp, homo sapien
attccaggtgtgaaataagagaaaasttgttagtatacatgtccaaggat

SEQ ID NO: 38342 - DNA, 50 bp, homo sapien
tacccaggaactgacaactaattagwcctcttcatgtcgaactggaagct

SEQ ID NO: 38343 - DNA, 50 bp, homo sapien
aaagttattacaatttacgatcaaaytcactagccataaatgtttttgat

SEQ ID NO: 38344 - DNA, 50 bp, homo sapien
agacatttaaaattccttgcagcaawtagtttgtatataacgaactttcc

SEQ ID NO: 38345 - DNA, 50 bp, homo sapien
cctggctagtagagaggtatctgacygaccaggaaaattgatccagggag

SEQ ID NO: 38346 - DNA, 50 bp, homo sapien
aatatgcagttttgaaagttgatctkaaatacatcacttataattgcctt

SEQ ID NO: 38347 - DNA, 50 bp, homo sapien
tatatatgaataaataatttacagasaatgtgactattcataatattttt

SEQ ID NO: 38348 - DNA, 50 bp, homo sapien
ttttatgaattatctcactttggctyaaagatgttttcagcaaaggctgt

SEQ ID NO: 38349 - DNA, 50 bp, homo sapien
gaactcatatccatttgagaagttayagaaggacaataaaattaagaact

SEQ ID NO: 38350 - DNA, 50 bp, homo sapien
atcagtatcagcatgcagaaaaggawctgtgtttaactcatctgattggt

SEQ ID NO: 38351 - DNA, 50 bp, homo sapien
aaatagtccctaaaccataatgttasaagtgttacaggaatgatgtttct

SEQ ID NO: 38352 - DNA, 50 bp, homo sapien
atgacttttgcatgttgtttaaagcragtttctagatctcatcttttgat

SEQ ID NO: 38353 - DNA, 50 bp, homo sapien
aatgaggtttgctaccccttacaaaytaagatgtgtgaaatacattcaaa

SEQ ID NO: 38354 - DNA, 50 bp, homo sapien
gtatttactatgtggtagcttatagraaaaaaacgtactgacccctggcc

SEQ ID NO: 38355 - DNA, 50 bp, homo sapien
aagacattaagatgaatcagaggcaratcataaagagacgaatggaatag

SEQ ID NO: 38356 - DNA, 50 bp, homo sapien
ctacagcacctagcacaatgcctggsaagtgaacaataagcatattggcc

SEQ ID NO: 38357 - DNA, 50 bp, homo sapien
ttttttattatttatgaagtgtgaayagtaatgcttgggagtgcagaaaa

SEQ ID NO: 38358 - DNA, 50 bp, homo sapien
ggcattgtgctaggtgctgtagccayaacgggaagcagacttaacacatt

SEQ ID NO: 38359 - DNA, 50 bp, homo sapien
tttactaatttcaactattctattcraatttcaccggtttaaaatatcgg

SEQ ID NO: 38360 - DNA, 50 bp, homo sapien
tttccctatttgggtccttattgcaktaaacacacgtatgttattgcaaa

SEQ ID NO: 38361 - DNA, 50 bp, homo sapien
ggcttttctaacttctgtagccgaawtaaaactggagaaataagaactcc

SEQ ID NO: 38362 - DNA, 50 bp, homo sapien
gactgccttctattagcttcttaggyatttgttttagacattgctttcta

SEQ ID NO: 38363 - DNA, 50 bp, homo sapien
tataaagcttctacgtgcatccaagrcttcacgtaaatattctctttctc

SEQ ID NO: 38364 - DNA, 50 bp, homo sapien
aactcttttaaatttaggatgtatarcccattcatgattattgctatagg

SEQ ID NO: 38365 - DNA, 50 bp, homo sapien
gtgatgtgaagtcctttgagtgtgayaatggaaaaaatgggattatttct

SEQ ID NO: 38366 - DNA, 50 bp, homo sapien
tattatgtattatgtgtaaagttgaygtatgtatgaccataaaaagcagg

SEQ ID NO: 38367 - DNA, 50 bp, homo sapien
ttttggggaggctttattaaaaagaygaagattcatatgcactatgagaa

SEQ ID NO: 38368 - DNA, 50 bp, homo sapien
agaggccccagagagaagaagtaacragcagataccatcatgggaaatga

SEQ ID NO: 38369 - DNA, 50 bp, homo sapien
ttcttaagggctgaaagcacctgtcratatattttccagagttccagttt

SEQ ID NO: 38370 - DNA, 50 bp, homo sapien
tacttaccaatcaaaatcccattaawctcttagaggtagctacaagtgaa

SEQ ID NO: 38371 - DNA, 50 bp, homo sapien
tttcttgaaatgtgtcccgtaccatractactccttgtcgtggggataaa

SEQ ID NO: 38372 - DNA, 50 bp, homo sapien
accgaccttctgagaatctcttgggkagtttatttttgagcaaggaggtg

SEQ ID NO: 38373 - DNA, 50 bp, homo sapien
ggttcgtacttgattgagctggtaamgtccctgattagttcacactcctt

SEQ ID NO: 38374 - DNA, 50 bp, homo sapien
cagtagaaatccctgagttatcctaygaaaaacatggcaaaaaggccagg

SEQ ID NO: 38375 - DNA, 50 bp, homo sapien
atcaacttttaatgccgggaattgayagagaatgatggaacccagctctt

SEQ ID NO: 38376 - DNA, 50 bp, homo sapien
aacctgactgtgcatatatttgagcmacagggatttctattgcgagtcca

SEQ ID NO: 38377 - DNA, 50 bp, homo sapien
aaacgcaactgacatgaacaaatccyaatatacagaatattgtgacaagg

SEQ ID NO: 38378 - DNA, 50 bp, homo sapien
aggagacaaaaattgaacatcaggaygcagctaggaaaaggggttcctgg

SEQ ID NO: 38379 - DNA, 50 bp, homo sapien
attcatctaaacatggaaaatatcartgacctagagagatgagttggagc

SEQ ID NO: 38380 - DNA, 50 bp, homo sapien
gactacgcttttactcctatctaaaytgatgtcatataggtggtcccaaa

SEQ ID NO: 38381 - DNA, 50 bp, homo sapien
cctggaagtgtatatcagcagcaacragagtaaagacccagaggcatgag

SEQ ID NO: 38382 - DNA, 50 bp, homo sapien
tgtatgtgacagtgaacaagaaatgratgacaaaacaaaacaaggcagaa

SEQ ID NO: 38383 - DNA, 50 bp, homo sapien
acactcccattttattgagttcttayagaggcttctcaaaagatggtaga

SEQ ID NO: 38384 - DNA, 50 bp, homo sapien
agataatggatacattttagagactkaacgtacacatactatctcaaatt

SEQ ID NO: 38385 - DNA, 50 bp, homo sapien
gtggctcatgccgtcatattcttaayggcctcctttaaaatggaagggct

SEQ ID NO: 38386 - DNA, 50 bp, homo sapien
cacctacatcttcactattaggtaargccctacacacaaagcctgcaatc

SEQ ID NO: 38387 - DNA, 50 bp, homo sapien
tttgaacatctttcaaactgaattaygagaactagaaattaaattattat

SEQ ID NO: 38388 - DNA, 50 bp, homo sapien
atttgcaaacacagcacagttcaatraatattagcaaaggtcatgtggtt

SEQ ID NO: 38389 - DNA, 50 bp, homo sapien
acagaaaaggcaagtgtaataacctwaatgctgaaacaaaagctgcagaa

SEQ ID NO: 38390 - DNA, 50 bp, homo sapien
gcaggtaccccatgacagttgcaaakgtgaaagagtgagagcagtatctc

SEQ ID NO: 38391 - DNA, 50 bp, homo sapien
attaattaaggtagataccatctcaratatgcaatgcataggatactatc

SEQ ID NO: 38392 - DNA, 50 bp, homo sapien
cactaaacctcaagactggtgagtawcaaaaaaaatatatgtttaactta

SEQ ID NO: 38393 - DNA, 50 bp, homo sapien
ctgaagcatcaacgtgatattacatsagagtcaagctaatttgaatgtta

SEQ ID NO: 38394 - DNA, 50 bp, homo sapien
acataatttcctaaataatgatttckaagagtacaacaacaaacatttta

SEQ ID NO: 38395 - DNA, 50 bp, homo sapien
ttcaagtaattttacaaacaggaacygctgtatagctaagtatgggtgtg

SEQ ID NO: 38396 - DNA, 50 bp, homo sapien
aacggaactagtgtctggcaagagcragcaagtgatattttgaatgattg

SEQ ID NO: 38397 - DNA, 50 bp, homo sapien
catggagcttgaagtatattagtccrgcttaaatcaagattagttttatt

SEQ ID NO: 38398 - DNA, 50 bp, homo sapien
attgcgagtatttttataactaagcratatgcaagaagcatgcctctaat

SEQ ID NO: 38399 - DNA, 50 bp, homo sapien
aataaagaagtgttgcctacagatarggtttttataggtcgtgaaaattg

SEQ ID NO: 38400 - DNA, 50 bp, homo sapien
tgccactaagctaagtatgtatagayattgagaatgaatgagattaaatt

SEQ ID NO: 38401 - DNA, 50 bp, homo sapien
gggcttgaatattttaactggacaayggcaatttatgtgatgcctatcta

SEQ ID NO: 38402 - DNA, 50 bp, homo sapien
ggatagtggttgatctctcagcttgragtacatggtgggttccgtgaacg

SEQ ID NO: 38403 - DNA, 50 bp, homo sapien
tggcccacttgtccataaacatggcraaaacttagaagctgctgagccct

SEQ ID NO: 38404 - DNA, 50 bp, homo sapien
ttttttaaagaagactatttgtcgcrgaaactgatttttaacaactgtgg

SEQ ID NO: 38405 - DNA, 50 bp, homo sapien
tgcagacattgaggatacagtagtgractaaatagacaaagctccctcat

SEQ ID NO: 38406 - DNA, 50 bp, homo sapien
aaatgttttgattctgtttccaaaastataccaaattcctgcaagtaata

SEQ ID NO: 38407 - DNA, 50 bp, homo sapien
aaatctctgcccacagaaatgggcgyataatgttttccctcaggggagtt

SEQ ID NO: 38408 - DNA, 50 bp, homo sapien
atggaataaaaaagcagaggagaggmcaattcggtctcttccggagctgg

SEQ ID NO: 38409 - DNA, 50 bp, homo sapien
aagaagctgacttctgggtaataacrcattaatttaatatgaccagaaca

SEQ ID NO: 38410 - DNA, 50 bp, homo sapien
gaatgaagagataatctgtagatagmatttgagagattaggaaaagaagc

SEQ ID NO: 38411 - DNA, 50 bp, homo sapien
ctgtttttattttctgcatgattgaraacaagactgcttacataacacgt

SEQ ID NO: 38412 - DNA, 50 bp, homo sapien
aaaatgttttgatggtctatctccargttacagattcagaacctatggag

SEQ ID NO: 38413 - DNA, 50 bp, homo sapien
agagctgcattcctgacattgtgcaygcaagaggatgtttatttgattag

SEQ ID NO: 38414 - DNA, 50 bp, homo sapien
tgcatgtccaactacagtatcattckcatctcttacttgaggttttgcca

SEQ ID NO: 38415 - DNA, 50 bp, homo sapien
gtgtctccctgatgggaaagagcgaygggatccttacaggctttcaggga

SEQ ID NO: 38416 - DNA, 50 bp, homo sapien
tttccactttccttctgttttaaaakatttgaggcttgaagtttgtcatc

SEQ ID NO: 38417 - DNA, 50 bp, homo sapien
cttttgtttggtgaggaatgaaaackctcttgaacatgtgtctctcctag

SEQ ID NO: 38418 - DNA, 50 bp, homo sapien
tgtgtgtacttacccccaagctgcamggagaaggagggtgagcccagtat

SEQ ID NO: 38419 - DNA, 50 bp, homo sapien
atgaaagaaccatattactattcaaytggcttttttcctctctttttaac

SEQ ID NO: 38420 - DNA, 50 bp, homo sapien
ttgagagaatgagggagaatagtgaycagcgcagggagaccaggtgtaag

SEQ ID NO: 38421 - DNA, 50 bp, homo sapien
ctccctcctcagatgcagaaaaccarctcgtaaggagatgagtcctagga

SEQ ID NO: 38422 - DNA, 50 bp, homo sapien
tataaacactaaatcaagggcttgcmaacaaccagttacaggaagcaaac

SEQ ID NO: 38423 - DNA, 50 bp, homo sapien
ctctcaagaaagtatattttccgaastgtcccgatagattgaaatatctg

SEQ ID NO: 38424 - DNA, 50 bp, homo sapien
gaggattttgtttatttataatgacrctattttattttcagcacatcaca

SEQ ID NO: 38425 - DNA, 50 bp, homo sapien
agccattcacccagtttctcccaatraggacatcttacattaatctggaa

SEQ ID NO: 38426 - DNA, 50 bp, homo sapien
atgttggccaccatatgcatctcaaygtgaattaaaaccagctctggttt

SEQ ID NO: 38427 - DNA, 50 bp, homo sapien
aaattacatgtctattatacatggasgacttcagaaataatataaaaaat

SEQ ID NO: 38428 - DNA, 50 bp, homo sapien
tcctcttctgaaattagcgatgatasaaactaccagaatgagttcagagg

SEQ ID NO: 38429 - DNA, 50 bp, homo sapien
agatgactgcaaggccaaatgtatcmatgaagtgcacatattagaagcac

SEQ ID NO: 38430 - DNA, 50 bp, homo sapien
agtctatgttaccaccttatgcaacmactgtggagcctcagcagcaccct

SEQ ID NO: 38431 - DNA, 50 bp, homo sapien
ggaagtgtgcacaagaataaataaarcagtgtgtctgcaaggaaggagtt

SEQ ID NO: 38432 - DNA, 50 bp, homo sapien
gccattccggctactgggtacaacasaacagcacaatttgggagggacaa

SEQ ID NO: 38433 - DNA, 50 bp, homo sapien
tcctgggagttctgagatttaaataygtagacacagagagagaggtcagc

SEQ ID NO: 38434 - DNA, 50 bp, homo sapien
gaattttctgaacttagaatacaccrgactcctcaaagtcaggaagcata

SEQ ID NO: 38435 - DNA, 50 bp, homo sapien
gtccttctgccatggcgtatcttacygggatgcactctctggattcacac

SEQ ID NO: 38436 - DNA, 50 bp, homo sapien
caagtaaagcagaaggtatggaagargactttaaagcagagaaaagaaac

SEQ ID NO: 38437 - DNA, 50 bp, homo sapien
tttggctgcctgactgatcctaacamctcctatgtccttctgccatggcg

SEQ ID NO: 38438 - DNA, 50 bp, homo sapien
gctctcccagtcagagaaggcaggasagataatccactcaaccagaccaa

SEQ ID NO: 38439 - DNA, 50 bp, homo sapien
tgaacttgaggttgttgaatagtaaygaagaaatgcttctgcagagactg

SEQ ID NO: 38440 - DNA, 50 bp, homo sapien
tctgaaagcttgggttcatgccaggmacaagttgtctaatacagagtctg

SEQ ID NO: 38441 - DNA, 50 bp, homo sapien
acatttctaccttaaaatggtccacygtatgtgttacctttctaccttga

SEQ ID NO: 38442 - DNA, 32 bp, homo sapien
agaaccaccgatggtgrcaaaaaaacgaggct

SEQ ID NO: 38443 - DNA, 50 bp, homo sapien
acgtgctgccgttttagccgggtagycctttgattgtaaaatcatagaag

SEQ ID NO: 38444 - DNA, 50 bp, homo sapien
ccccttctgctgcagaaatagcataygttggtttgaaatgaaacctagta

SEQ ID NO: 38445 - DNA, 50 bp, homo sapien
ccaggtcctgaatcctgtattaagaygctcacatgagttttgtgatattt

SEQ ID NO: 38446 - DNA, 50 bp, homo sapien
ttccatggctctcggtggcttgtaaytctcagacttcagtggagattctc

SEQ ID NO: 38447 - DNA, 50 bp, homo sapien
tgtctaggtaaaccatatgtgtgcargttaattacttagaagagaagctg

SEQ ID NO: 38448 - DNA, 50 bp, homo sapien
atgtgcctgatgatgcatctcacagratatgttcccactgttaagccaaa

SEQ ID NO: 38449 - DNA, 50 bp, homo sapien
tacttttaatgaaactattatcaacyggacaaaaaattgtggcaaaatat

SEQ ID NO: 38450 - DNA, 50 bp, homo sapien
aaagataatggtcactatttcatagragtaatgtttgataggactcaaca

SEQ ID NO: 38451 - DNA, 50 bp, homo sapien
taaatattgccttcacatgatcaacmaccggttccaatttaaccctgaga

SEQ ID NO: 38452 - DNA, 50 bp, homo sapien
gttcagatacacaagtgaacgtcggmatccaggaagtgaagtcaagcggt

SEQ ID NO: 38453 - DNA, 50 bp, homo sapien
aagcaaaactttacatataattaaayacggtgataatcttttatgatcat

SEQ ID NO: 38454 - DNA, 50 bp, homo sapien
tgctgctgctactaataataaaaaartagaacgcctgtgccttgttccga

SEQ ID NO: 38455 - DNA, 50 bp, homo sapien
ctaacaatgaatatgagtatcacgakgtgttcagcaaacaaaagctgacc

SEQ ID NO: 38456 - DNA, 50 bp, homo sapien
taagctttacctttctctgtagtcakaaaaataccagtgtggggtgggaa

SEQ ID NO: 38457 - DNA, 50 bp, homo sapien
ttagcctctgatttgtaaatgggaarctactcaggtaacatctttggtat

SEQ ID NO: 38458 - DNA, 50 bp, homo sapien
ctcatgcacagttttgaataatataygatactactgatagtggtgtattt

SEQ ID NO: 38459 - DNA, 50 bp, homo sapien
gatctttagttttctttttttcacaracaagatgttatctgaaattaaat

SEQ ID NO: 38460 - DNA, 50 bp, homo sapien
ttatatgcatgccaagatgttggtaygtttcatgaatcaaatccaaactc

SEQ ID NO: 38461 - DNA, 50 bp, homo sapien
tgcatgtaaagtaattgtgtataaaytatttaagacgtttatagcaaatt

SEQ ID NO: 38462 - DNA, 50 bp, homo sapien
gccattccccgtgaaaaggcacatgmaaaatggtggaagatttgccaccc

SEQ ID NO: 38463 - DNA, 50 bp, homo sapien
aaaaagagactattttcgtagttaaygatgctcaaaaccgtttgtttgct

SEQ ID NO: 38464 - DNA, 50 bp, homo sapien
tgcaaaagtttaatttggaatatcakgttatggtacagaattgctgcatt

SEQ ID NO: 38465 - DNA, 50 bp, homo sapien
attgcttttattgaaagactttccasaaataaggtctcttgacatgcaat

SEQ ID NO: 38466 - DNA, 50 bp, homo sapien
atggatacaattttacttggtttccwctaaatgatgtacctgcctgatga

SEQ ID NO: 38467 - DNA, 50 bp, homo sapien
aagagcaatcccatagaaagacccaygtctcatgctcaatggtgagagaa

SEQ ID NO: 38468 - DNA, 50 bp, homo sapien
cctctaggcagctgacaatcgcagayggaacgcttttggaggcctctctc

SEQ ID NO: 38469 - DNA, 50 bp, homo sapien
accaggtcacagccggcagggatcaytcaattcagaggcactccaaggga

SEQ ID NO: 38470 - DNA, 50 bp, homo sapien
gatgaagaagagccacagtgaccgcmaaagaaaccgatttagaacagttt

SEQ ID NO: 38471 - DNA, 50 bp, homo sapien
atacacttggagataagttaccaaayaagagtgtaggagaaccaaatgat

SEQ ID NO: 38472 - DNA, 50 bp, homo sapien
agaatctttgatttgataactttaaygtagcaaaatatttacattaaaaa

SEQ ID NO: 38473 - DNA, 50 bp, homo sapien
gataatagaacacggcattttccacrgagatcccgaatttgctttgtcta

SEQ ID NO: 38474 - DNA, 50 bp, homo sapien
ggtagcaagagattttgagtgtataygccaaattagaaaaaacaaaaagg

SEQ ID NO: 38475 - DNA, 50 bp, homo sapien
cgaagcatcctttgaatgtgaaaackggttagatcaaaacatcaaagtgc

SEQ ID NO: 38476 - DNA, 50 bp, homo sapien
tcaaaaagttataacaactcatggtracaccaataatatatgagcctgct

SEQ ID NO: 38477 - DNA, 50 bp, homo sapien
agcaaccctactctttctcattctawctgtctttggttatcatttagagt

SEQ ID NO: 38478 - DNA, 32 bp, homo sapien
gttggcttcttacatgyattagctcagagaag

SEQ ID NO: 38479 - DNA, 50 bp, homo sapien
gagtgaggtttgttattagatccaarggaaatagagataggaatgaagcc

SEQ ID NO: 38480 - DNA, 50 bp, homo sapien
gctagtgctctctcgtggtaaagtamccaattttgcacatttactttaat

SEQ ID NO: 38481 - DNA, 50 bp, homo sapien
gatgctctgcaaacattgctgatcaygcatcactatcaatcaaacatttt

SEQ ID NO: 38482 - DNA, 50 bp, homo sapien
ttaatctcaaagcattatatatagaygttgaccaaggttattgattaata

SEQ ID NO: 38483 - DNA, 50 bp, homo sapien
cactggaatcaatgacaatttaggarcagaaaaaagatgtgctcgagata

SEQ ID NO: 38484 - DNA, 50 bp, homo sapien
ggagaaacggaagcacagatgtaaaytgcacaatgccatgcagctgtcag

SEQ ID NO: 38485 - DNA, 50 bp, homo sapien
ctttgcataaaacagaattttcttcycatagacttgaattagagtgatga

SEQ ID NO: 38486 - DNA, 50 bp, homo sapien
aaattccacgaaggacaaagcatccrcatattttgttagatgtgggtctg

SEQ ID NO: 38487 - DNA, 50 bp, homo sapien
gaaatcattgtctttttctatcatcrgaattaaggaaaatggtagaatat

SEQ ID NO: 38488 - DNA, 50 bp, homo sapien
tacactgctcattttctgtaggtaayataatttaattggaaaaataagtg

SEQ ID NO: 38489 - DNA, 50 bp, homo sapien
acatatgcacgagtgggaagaatacrcaggaaatcaggagttcatggcag

SEQ ID NO: 38490 - DNA, 50 bp, homo sapien
acaatggaaatgtcattttactgtaygcttaataaattgtgcttttttga

SEQ ID NO: 38491 - DNA, 50 bp, homo sapien
aaatctaccattacaccacatgaccyatttttgtattttaaacaatttgg

SEQ ID NO: 38492 - DNA, 50 bp, homo sapien
atgtatacactatgtcaggaactgcratgactgctggaaatttgttacca

SEQ ID NO: 38493 - DNA, 50 bp, homo sapien
acccccaaggcccgtgctaactcaawcacacttttacatgtctcaggcca

SEQ ID NO: 38494 - DNA, 50 bp, homo sapien
aaagcttgcattagggctgcccttgragtttttcaccttctgtatttccc

SEQ ID NO: 38495 - DNA, 50 bp, homo sapien
tccattcattctgtatagtttcaacrgcaaactgtcctaaaggatcccct

SEQ ID NO: 38496 - DNA, 50 bp, homo sapien
attaagaaattgaaattcataacacrcaaatgtaagggaagagctgctta

SEQ ID NO: 38497 - DNA, 50 bp, homo sapien
agttcccactgaatggtgagccgcgmagatgcaggaagcacgctgtccac

SEQ ID NO: 38498 - DNA, 50 bp, homo sapien
tctctgcaaaatattacttgtcctaycttcatctaatactgtcaaactgc

SEQ ID NO: 38499 - DNA, 50 bp, homo sapien
cctgtttggttttctcctccttggcraacacatgtctcctggaacacagc

SEQ ID NO: 38500 - DNA, 50 bp, homo sapien
agcggcaaccgctgctcggaacgagycattccaacaagacacagaggcga

SEQ ID NO: 38501 - DNA, 50 bp, homo sapien
tagccattccttttgctatgtcaccraatagattagaagcctgtgtcatt

SEQ ID NO: 38502 - DNA, 50 bp, homo sapien
attgaataagctagtaaatgaacaartgaattccaaggggtggaatgaaa

SEQ ID NO: 38503 - DNA, 50 bp, homo sapien
ccccagtgcctgggtgagtcagtaakattgtggtacccaatggctctggg

SEQ ID NO: 38504 - DNA, 50 bp, homo sapien
gctttgctttactgcacttcacagawactgttttttcacaaattgagggt

SEQ ID NO: 38505 - DNA, 50 bp, homo sapien
gtgcggtgtgcaatttgggacttagraagcgttgatacatggtcgttact

SEQ ID NO: 38506 - DNA, 50 bp, homo sapien
cagagaaggactatatgatgggtacyagaagagagagatgaaagtatcag

SEQ ID NO: 38507 - DNA, 50 bp, homo sapien
ggtgggggcataaaggttagccaaasttgaaaataaatatttggttcact

SEQ ID NO: 38508 - DNA, 50 bp, homo sapien
gagttccagtttctgcatttagaccratctcgggttgggaagcttccata

SEQ ID NO: 38509 - DNA, 50 bp, homo sapien
ctctcacgacctaatcagcaagtaaktcccagagataaaaggcaccattt

SEQ ID NO: 38510 - DNA, 50 bp, homo sapien
ccatgaaaagaggcagaactctcaartcatatctgaaaaatagctatcac

SEQ ID NO: 38511 - DNA, 50 bp, homo sapien
gagatgacagttgttatagatatacyggtttaattacttgtcagcttatg

SEQ ID NO: 38512 - DNA, 50 bp, homo sapien
ctctatctggagacaggatctttagsaatgtagttaagttaaatgagtcc

SEQ ID NO: 38513 - DNA, 50 bp, homo sapien
atgggaataaaacgtagattcttacrgattagatgacttattcaatgaat

SEQ ID NO: 38514 - DNA, 50 bp, homo sapien
gacactggatgccactatatagcaaygagagagtgaaaggaaaaatactg

SEQ ID NO: 38515 - DNA, 50 bp, homo sapien
atgtgaccatcaccttttgctataaraactggtatttatccactccactg

SEQ ID NO: 38516 - DNA, 50 bp, homo sapien
taatcccatgtacttaacctttgcartaatcaaatctatatttggttctt

SEQ ID NO: 38517 - DNA, 50 bp, homo sapien
aggtcctttacctgaaggaataacckagaatctctgtcataccctgcttt

SEQ ID NO: 38518 - DNA, 50 bp, homo sapien
ttcccagtcagtttttaactgtgtcracttgaatggattaagaaatatgt

SEQ ID NO: 38519 - DNA, 50 bp, homo sapien
cactcatgcattggttcaggtgtaartgatctttcagtgctgactgattg

SEQ ID NO: 38520 - DNA, 50 bp, homo sapien
taatcttgtccacgttttcttcacaygagaggagtgttcttggtgaaatg

SEQ ID NO: 38521 - DNA, 50 bp, homo sapien
atccaagtggaaaggccatatattaycctaggattctaaaacttcagagt

SEQ ID NO: 38522 - DNA, 50 bp, homo sapien
atcttttcaacagtcatttgcataamgtgtgacataagtcacctcacttt

SEQ ID NO: 38523 - DNA, 50 bp, homo sapien
aatcagtgtccagcctgaagatacaytggcagacatgcctagtagctaat

SEQ ID NO: 38524 - DNA, 50 bp, homo sapien
gatacttccctgcttgtctctgagasagtacatccaattctctgggtcct

SEQ ID NO: 38525 - DNA, 50 bp, homo sapien
attagattctatgcttgtgtatatayggaaaatggacttatcactactgg

SEQ ID NO: 38526 - DNA, 50 bp, homo sapien
aaaacatcagatatttttgcaattcratccctaacaaatgccctgctcat

SEQ ID NO: 38527 - DNA, 50 bp, homo sapien
gctgcttagtaagccacggttgccayctttgaagataccctcactgtaca

SEQ ID NO: 38528 - DNA, 50 bp, homo sapien
gtatatacggaaaatggacttatcaytactgggcatgttgcaataaggta

SEQ ID NO: 38529 - DNA, 50 bp, homo sapien
atcactactgggcatgttgcaataasgtaactgcagaaagaaactgacta

SEQ ID NO: 38530 - DNA, 50 bp, homo sapien
gaggcccgcgcagccccaaccagaaygtaatttgtaattaactgtcattt

SEQ ID NO: 38531 - DNA, 50 bp, homo sapien
attcatccttaatgcatctaattacyacctagaaaatataagcattatta

SEQ ID NO: 38532 - DNA, 50 bp, homo sapien
tgataatgataggtaataatgataaygataatgataggtatctaccgagt

SEQ ID NO: 38533 - DNA, 50 bp, homo sapien
gaaagtgtcgcctggctgctttatcsatactgtgtacctgtcagggtttc

SEQ ID NO: 38534 - DNA, 50 bp, homo sapien
ttaccatgaaatctattcccaaacayattttagtacagtgcagtattgtg

SEQ ID NO: 38535 - DNA, 50 bp, homo sapien
ggttacagcaatggccgatagagaarattatggctgtatcagacacaagt

SEQ ID NO: 38536 - DNA, 50 bp, homo sapien
gcttgcaggtgcctgtgggagaacasagcttgggttgcccgcagagtccg

SEQ ID NO: 38537 - DNA, 50 bp, homo sapien
agtaacactgcagtctcgctattgcygaaacgtggagtcttcctcaactg

SEQ ID NO: 38538 - DNA, 50 bp, homo sapien
actctccaagcttttagggtattgargttacattttttttcccagtcagt

SEQ ID NO: 38539 - DNA, 50 bp, homo sapien
acatgtgggacaaacagaaaccgaasagtaatatagtgaacttaaatcca

SEQ ID NO: 38540 - DNA, 50 bp, homo sapien
aatagcgagactgcagtgttactgcragaaactcacgtggctgagcccgt

SEQ ID NO: 38541 - DNA, 50 bp, homo sapien
aagtttgaaatgctatgagaattatyaaagtaggacacagagacatgaag

SEQ ID NO: 38542 - DNA, 50 bp, homo sapien
tgaggcaccttaatcctatctttgcsacttaacttaatccgtagtcacgg

SEQ ID NO: 38543 - DNA, 50 bp, homo sapien
gaataaatgggaggtaggcttatatkactgaccaagttaacgaacatttc

SEQ ID NO: 38544 - DNA, 50 bp, homo sapien
ccataaggaaatgaatctctctgaaycttaacatttaggcagtcaaactg

SEQ ID NO: 38545 - DNA, 50 bp, homo sapien
cttagtgcttggttcctttggagaayaccaggatgatgatcagattcatt

SEQ ID NO: 38546 - DNA, 50 bp, homo sapien
ggttgtgtagtttgctggccatagcratgaggagctgaaactgagacagg

SEQ ID NO: 38547 - DNA, 50 bp, homo sapien
gctgtggtctggtagcaatcctatgyagtgagagtcctactgggaggcat

SEQ ID NO: 38548 - DNA, 50 bp, homo sapien
taaaattcttcaactgtagtgtgtartaaaacagataattggccagttct

SEQ ID NO: 38549 - DNA, 50 bp, homo sapien
atacttcaaatcctatgttcatggargttctgaaaacaagagagaaaggc

SEQ ID NO: 38550 - DNA, 50 bp, homo sapien
acttccaaaggacccatctccataaygtgtgttctacatagctagattaa

SEQ ID NO: 38551 - DNA, 50 bp, homo sapien
aatttaaaaaattctaaacatctaaygtcagaggaaagaaagataaagaa

SEQ ID NO: 38552 - DNA, 50 bp, homo sapien
accagggacattcgattgcatgatgyacaatttttcacgctgattcttct

SEQ ID NO: 38553 - DNA, 50 bp, homo sapien
cagaagcctgagccttttgctcacakgtttgccagtgcgtaggctggatg

SEQ ID NO: 38554 - DNA, 50 bp, homo sapien
gggggttgatgggctatttcagaccraactaaacagcacaggacctgcgc

SEQ ID NO: 38555 - DNA, 50 bp, homo sapien
gattctgtaatttggtttctaaacarctgaaagaatcacctcttccatct

SEQ ID NO: 38556 - DNA, 50 bp, homo sapien
ccattatcctgttagtctttaaaacyattatggctgctttcactagttta

SEQ ID NO: 38557 - DNA, 50 bp, homo sapien
tgcatggggcccagtcagactccaamcaatgtcgtggccaggcattccaa

SEQ ID NO: 38558 - DNA, 50 bp, homo sapien
tcaaaagcccagcatgttgtgatgayaaaaaatttggaaggctgtggccg

SEQ ID NO: 38559 - DNA, 50 bp, homo sapien
gaatactccaacatgcatcaatcaarcacataaagaatcaatcatggagg

SEQ ID NO: 38560 - DNA, 50 bp, homo sapien
ctttcttctaaacctgcttttaaagractaacagaagctgccaggtccac

SEQ ID NO: 38561 - DNA, 50 bp, homo sapien
ctggagagtttttctttgtttggcargatacatttataatttcttctaca

SEQ ID NO: 38562 - DNA, 50 bp, homo sapien
cagagattcataagatcaactgatayacctttgtgcccagccaagaaaga

SEQ ID NO: 38563 - DNA, 50 bp, homo sapien
tattggtcaccactgtgcctgagacratttataatctcatttctacactc

SEQ ID NO: 38564 - DNA, 50 bp, homo sapien
tgctatgcagaacatgcctttgtcasgatgctgataacagttaccactag

SEQ ID NO: 38565 - DNA, 50 bp, homo sapien
tcaagttggtttggcaactgactcartaatgaaggttaaatagctttctt

SEQ ID NO: 38566 - DNA, 50 bp, homo sapien
aaaagtactcttctcaaatccccaaygtgtttccaactgtcaatacaatc

SEQ ID NO: 38567 - DNA, 50 bp, homo sapien
acttcccatggctttcgaatctcagragttgttcttactctttttgatat

SEQ ID NO: 38568 - DNA, 50 bp, homo sapien
cctccagacacagatgttaggcttayggtgccatgtgcagattttcatct

SEQ ID NO: 38569 - DNA, 50 bp, homo sapien
acccctgcccttagtttaaaggcaaygacatatatttctagaacaatact

SEQ ID NO: 38570 - DNA, 50 bp, homo sapien
acaggcaattccaagagagaggtgaycattgaggactgtcagccatagca

SEQ ID NO: 38571 - DNA, 50 bp, homo sapien
agaagtctatcattagcagtgtatcrccgattaaatggataaagttattc

SEQ ID NO: 38572 - DNA, 50 bp, homo sapien
agcactaaaactcagaaaattaatakagatgtacataaaataatgtcaat

SEQ ID NO: 38573 - DNA, 50 bp, homo sapien
aacttaaataataaaagacctaaaamttgcaagaggttaaaagaatattg

SEQ ID NO: 38574 - DNA, 50 bp, homo sapien
acacatttctttcctatcacacttasggccaaatcacatttctaaagtga

SEQ ID NO: 38575 - DNA, 50 bp, homo sapien
gctttgaaattattgtcttactttasaagaaatggccagaaaccctcccc

SEQ ID NO: 38576 - DNA, 50 bp, homo sapien
tatttccacatattgttgtgctggamgtctagtaggtataaaaagcacta

SEQ ID NO: 38577 - DNA, 50 bp, homo sapien
taccgtgtggcccagtgacacttcaycagcatcccagagaacaggtaggg

SEQ ID NO: 38578 - DNA, 50 bp, homo sapien
tccagacagtcccaggccatggcaargtgtaaccagtagtgatggccgca

SEQ ID NO: 38579 - DNA, 50 bp, homo sapien
ttcccagaagcataatctatgtgacmaatttatctattttagtaatgtga

SEQ ID NO: 38580 - DNA, 50 bp, homo sapien
taccccttaacctcacaactctccamacttaggtttattaaccacctctg

SEQ ID NO: 38581 - DNA, 50 bp, homo sapien
gtctattcacaggatatgtgtgttaycctaaattatcaggtttgtaagaa

SEQ ID NO: 38582 - DNA, 50 bp, homo sapien
ttcctgggctaaggcatgtaaggaartagaggctcgggagaatggaatgg

SEQ ID NO: 38583 - DNA, 50 bp, homo sapien
tgtaatcacaattccaaacatcaacrgaaggatttttctgggcatttctt

SEQ ID NO: 38584 - DNA, 50 bp, homo sapien
ctgtttccctctccctttctgctggratggaacactcgggccatctgcct

SEQ ID NO: 38585 - DNA, 50 bp, homo sapien
atccactcagataatagataatagcrcttatgatgatgataaaaggtttt

SEQ ID NO: 38586 - DNA, 50 bp, homo sapien
tagaaaaatgtacaccacaagaatgsaagcagcctgacaaatgaccaacg

SEQ ID NO: 38587 - DNA, 50 bp, homo sapien
aagctaattagtttgagagaaaggasagaattccagactcttcatttcca

SEQ ID NO: 38588 - DNA, 50 bp, homo sapien
agcacaaaattactcacttttagtaygcaagataaatattagccccatct

SEQ ID NO: 38589 - DNA, 50 bp, homo sapien
ttggaatgtacaggtacaggatctcrgaatcttaagttttggttgttctt

SEQ ID NO: 38590 - DNA, 50 bp, homo sapien
ttaaaccccttcttggatccataaaraggtgaagacaaagggcaaactgc

SEQ ID NO: 38591 - DNA, 50 bp, homo sapien
aacaccctcatctctatctctgcacrccaaacacagaattctctcttggc

SEQ ID NO: 38592 - DNA, 50 bp, homo sapien
tatgtttcctaaatcgctgagaagayaaatgtactaaacaatacatcatc

SEQ ID NO: 38593 - DNA, 50 bp, homo sapien
gaagtctcaaaaatgggcaatttccraccttgcaatggagagtcaattta

SEQ ID NO: 38594 - DNA, 50 bp, homo sapien
ctagtttcagtctacggtcatctcaytattagcatgcaagtatctttcat

SEQ ID NO: 38595 - DNA, 50 bp, homo sapien
ggaaacacgaaattaagaaccgggayaatctttataagacagagaattgc

SEQ ID NO: 38596 - DNA, 50 bp, homo sapien
gattgaaaggtgatgtagagacagcrcttttgattaagacactcattttg

SEQ ID NO: 38597 - DNA, 50 bp, homo sapien
tttctcatttctcctatctaatccartctagggtattctagtatttcatt

SEQ ID NO: 38598 - DNA, 50 bp, homo sapien
tttaaaaacacataaattgaatagcracttttttttgtggtaggactgta

SEQ ID NO: 38599 - DNA, 50 bp, homo sapien
ttgacattgcctgggatggcacggcsgaaatgaatacacctgctgttctg

SEQ ID NO: 38600 - DNA, 50 bp, homo sapien
ccagagtctgtgtttaccttccaatragggagcgcaggttaaagtcaaca

SEQ ID NO: 38601 - DNA, 50 bp, homo sapien
tccaagaaaaaccataatatttgcarctcttcagccatttatttattcac

SEQ ID NO: 38602 - DNA, 50 bp, homo sapien
ctaacgacctactttagatataccaratctacacaattcacagataaccc

SEQ ID NO: 38603 - DNA, 50 bp, homo sapien
acgtgtttttctctctgtgttcttayagtatatacctttacttctcaact

SEQ ID NO: 38604 - DNA, 50 bp, homo sapien
cctggtgaattctaaatccatgaacyctaactgcatggtattttttttaa

SEQ ID NO: 38605 - DNA, 50 bp, homo sapien
agttcaaggtgactgagctggtaagsaggaaagccagcccgggaagctca

SEQ ID NO: 38606 - DNA, 50 bp, homo sapien
gtgggcagcacctatttgataagaarccttctcacttgttttagatttcc

SEQ ID NO: 38607 - DNA, 50 bp, homo sapien
taaataacacagcgtatttattcaargagcagatctggaggaggtttggg

SEQ ID NO: 38608 - DNA, 50 bp, homo sapien
agtgcttaggctgggagttaattcarattcctctcaaaccaaggaagcac

SEQ ID NO: 38609 - DNA, 50 bp, homo sapien
agtcctgcaaagcacagaaggatgargccaaaggatgatggcaaactggg

SEQ ID NO: 38610 - DNA, 50 bp, homo sapien
aaaggaggggcttaggttcagggtcsacttaatcgcattcctgtccctgg

SEQ ID NO: 38611 - DNA, 50 bp, homo sapien
tgaattaactcccagcctaagcactsaaggtaaaaatgataagctttcta

SEQ ID NO: 38612 - DNA, 50 bp, homo sapien
ggaggtagaccaatcaaaatggttaygaagactgataaagtctttgaata

SEQ ID NO: 38613 - DNA, 50 bp, homo sapien
aaccatatggtttgaatacttttaaygtcaccaattatagctcatttctg

SEQ ID NO: 38614 - DNA, 50 bp, homo sapien
ctccctgcttcttccaggtcttatasaagttgcaaggccacaactaagtt

SEQ ID NO: 38615 - DNA, 50 bp, homo sapien
gtggatttctatttcaagcaatatgscagactaaatagaaggccactcca

SEQ ID NO: 38616 - DNA, 50 bp, homo sapien
aaaagggtagaaggctaaaagtttgraagtccataaatcagaaatttgat

SEQ ID NO: 38617 - DNA, 50 bp, homo sapien
agcctagtgctttggacctaagacayagatatagggaatggcatacctga

SEQ ID NO: 38618 - DNA, 50 bp, homo sapien
gtgtaacatatatgcccttagaggayggtgagcaatgccaggagttcatt

SEQ ID NO: 38619 - DNA, 50 bp, homo sapien
ggtgccagttttcagccatcagatcracctgctttgtgaagtcaatgaac

SEQ ID NO: 38620 - DNA, 50 bp, homo sapien
cattcttctttccaaaatctttgaamcttatggtggatttgtcctagacc

SEQ ID NO: 38621 - DNA, 50 bp, homo sapien
taccaaaccagccatacgatcgatamggaagacagataaaaccacacagg

SEQ ID NO: 38622 - DNA, 50 bp, homo sapien
taccttctctttgtactgtaatctaygatcatgcataagtctttctctga

SEQ ID NO: 38623 - DNA, 50 bp, homo sapien
catatttccagtactaaaaacagcaygttgccttcctgggttgcactgga

SEQ ID NO: 38624 - DNA, 50 bp, homo sapien
ctaaaataaacagaagactttaatgsaaaactattgcagagacatgaatt

SEQ ID NO: 38625 - DNA, 50 bp, homo sapien
tgtctctaaaatttcctcagatcaaygtaataaagtgaacttacatattt

SEQ ID NO: 38626 - DNA, 50 bp, homo sapien
tcccagaattatccctgttgtcggaycatctcagttaaggcagctcttta

SEQ ID NO: 38627 - DNA, 50 bp, homo sapien
tcaagtttcactcttttgcattcaaygtatttttgttcccagaattatcc

SEQ ID NO: 38628 - DNA, 50 bp, homo sapien
gatatacatgccacttctatcggcaracaaactaggtactcttctcctgc

SEQ ID NO: 38629 - DNA, 50 bp, homo sapien
aaactattcagtttgatggtttggaragtacttcaaaacactgtatatta

SEQ ID NO: 38630 - DNA, 50 bp, homo sapien
tcctgtaccacattcatcttcaagartcttcagtgctccgtaaagccagc

SEQ ID NO: 38631 - DNA, 50 bp, homo sapien
tcttgtaggaagttgagctgtctacrcttacagagatgaaagccagcaat

SEQ ID NO: 38632 - DNA, 50 bp, homo sapien
acctcaatactttatgcatgattctraaaaagttaaggtcaaaggtttaa

SEQ ID NO: 38633 - DNA, 50 bp, homo sapien
cttttcattggttatatgaaactgcygaaaaaggttatagctctccaacc

SEQ ID NO: 38634 - DNA, 50 bp, homo sapien
attaatagaaacttaatttagagacygatatcaactgcacagttactagt

SEQ ID NO: 38635 - DNA, 50 bp, homo sapien
accttaaatcaactcatgtgcaaaamctttgtcattctttttaaaatgat

SEQ ID NO: 38636 - DNA, 50 bp, homo sapien
actctaagttaatttgtaaatgggcragttcttctggaacccataaaggt

SEQ ID NO: 38637 - DNA, 50 bp, homo sapien
taatctttgaaatggaagcaaatcaygaagtatgcaattacatgattttt

SEQ ID NO: 38638 - DNA, 50 bp, homo sapien
tgaaaatgtttttctaactttcagartaaatcaggaacattaacactgtc

SEQ ID NO: 38639 - DNA, 50 bp, homo sapien
tcattttaggtcattttgtgcaaaartaactatcctcctttgcaaataga

SEQ ID NO: 38640 - DNA, 50 bp, homo sapien
agaataaatattgaattaccaaaggratgaatcattacaaagcaatagta

SEQ ID NO: 38641 - DNA, 32 bp, homo sapien
agagtaggcaggcttayggcctattataaaag

SEQ ID NO: 38642 - DNA, 50 bp, homo sapien
attaacttaaagcatgttcttctgayagagattcaatagcatcacctttt

SEQ ID NO: 38643 - DNA, 50 bp, homo sapien
ctatagaagtattctggaaaggacartctagaataaagccaattattatc

SEQ ID NO: 38644 - DNA, 50 bp, homo sapien
tgctctgaagaaatgctcctgtcaaygatgcgaccttggaatctttgagg

SEQ ID NO: 38645 - DNA, 50 bp, homo sapien
tagacataaatagagagatgatagayggttggtaggtaggtaggtagata

SEQ ID NO: 38646 - DNA, 50 bp, homo sapien
atgcgaccttggaatctttgaggatyacaagaggctggtttaaagatgct

SEQ ID NO: 38647 - DNA, 50 bp, homo sapien
tctgtatttctgtatatatctgtcayctttctttgtcatctgtctatatc

SEQ ID NO: 38648 - DNA, 50 bp, homo sapien
ttttcagtcagtgtataatcagaaartgctcactggagatgtttcagata

SEQ ID NO: 38649 - DNA, 50 bp, homo sapien
tgttttgaaactcgggatcatggaakgttttattcagtcagggccttcag

SEQ ID NO: 38650 - DNA, 50 bp, homo sapien
ggagggcttggatcaggccagaaatkaatactcagaagcacaagaaagaa

SEQ ID NO: 38651 - DNA, 50 bp, homo sapien
ctgcagtttcagtactgcaacacatraagtgaaaatgctgggcactgata

SEQ ID NO: 38652 - DNA, 50 bp, homo sapien
ctttctacagcaagctgcatgaggcrattgaagaataggctacttaagtg

SEQ ID NO: 38653 - DNA, 50 bp, homo sapien
atttatgctggaaattgatgacttaygctcctttttcttgagtagtaata

SEQ ID NO: 38654 - DNA, 50 bp, homo sapien
ggtcaattcttcctgagtatcataasaaaccaagtagggttcatggagaa

SEQ ID NO: 38655 - DNA, 50 bp, homo sapien
ccttatggccatgattccaagcacartgaatacatctggttatgttacct

SEQ ID NO: 38656 - DNA, 50 bp, homo sapien
gacgaggtttatgtaatgaaggcaayggatcatgagtcaacaggaacaca

SEQ ID NO: 38657 - DNA, 50 bp, homo sapien
gcctatttctgggtgttcagcataaytgtccttggtttgactgttctcct

SEQ ID NO: 38658 - DNA, 50 bp, homo sapien
gagtaaaagaaaattaatataatcaygtcataaggcaatggatttttgtc

SEQ ID NO: 38659 - DNA, 50 bp, homo sapien
tttctttgtcatctgtctatatctarctatctatgtctatcatctctccc

SEQ ID NO: 38660 - DNA, 50 bp, homo sapien
cttaagagcgagaactgcagattagyaaggcttgatagagtaaaagacaa

SEQ ID NO: 38661 - DNA, 50 bp, homo sapien
atgacaagcctgtagattgcataccraaaattacttagttgttaactaat

SEQ ID NO: 38662 - DNA, 50 bp, homo sapien
atgcaatcccaccactgaaactactracatgatgggtcacaattggctca

SEQ ID NO: 38663 - DNA, 50 bp, homo sapien
tttcattaaaatagattcactgtgawgagaataacccaccagttctcctc

SEQ ID NO: 38664 - DNA, 50 bp, homo sapien
ttccacaggaatacaatagtggtgayaaaagtgagctacattaaataata

SEQ ID NO: 38665 - DNA, 50 bp, homo sapien
tgtgtagtgatttttaactagaatayccatgtctatgatgatggctgcac

SEQ ID NO: 38666 - DNA, 50 bp, homo sapien
tgcccctctgctatgggagtcagcawtacctagcaattaagaatattcat

SEQ ID NO: 38667 - DNA, 50 bp, homo sapien
ctggtttctaagttgtgttattaagwctcatttatttcagaatttttcac

SEQ ID NO: 38668 - DNA, 50 bp, homo sapien
agttgtaaaaaatgaatgtgatgtgrcaattatagtgcttggcagagtga

SEQ ID NO: 38669 - DNA, 50 bp, homo sapien
gcattttctgagtaaggagtaagaartaagaagtctcaaagtagatccaa

SEQ ID NO: 38670 - DNA, 50 bp, homo sapien
gagggtgagaaaagaggttacatggmaataataaaggttaatcaattcat

SEQ ID NO: 38671 - DNA, 50 bp, homo sapien
agctcatgcttgttccaataagcaayataatgttaggactgtgaggataa

SEQ ID NO: 38672 - DNA, 50 bp, homo sapien
tatatagatatatataaaaaaaacayctggatcagagcatccgactccat

SEQ ID NO: 38673 - DNA, 50 bp, homo sapien
gcctcttggccaagaatgaaaaaccrgagaaagtcatggatcccaggcat

SEQ ID NO: 38674 - DNA, 50 bp, homo sapien
gcacacaacagcataaaggaatgtcrcccgcttagcgttgaccaaaagaa

SEQ ID NO: 38675 - DNA, 50 bp, homo sapien
aaaggaaacagaaaccccatagagartcatgcacaagtgaaaagaggaga

SEQ ID NO: 38676 - DNA, 50 bp, homo sapien
taccaagacctgtgttatgtcggagmaaacaaaagacaacagatattcct

SEQ ID NO: 38677 - DNA, 50 bp, homo sapien
agctgcatttcattctcatataatcratgctgaacaaagattaaatgtga

SEQ ID NO: 38678 - DNA, 50 bp, homo sapien
ttttcattatattttttgagtatgawtatgcacacattagaaagtacaaa

SEQ ID NO: 38679 - DNA, 50 bp, homo sapien
tttagttttccaggaaatattgctaygttatcatgaactgcctaagtaga

SEQ ID NO: 38680 - DNA, 50 bp, homo sapien
ctacttccccctcaacccttacatcsaattagttgtcaagctttacctct

SEQ ID NO: 38681 - DNA, 50 bp, homo sapien
ccctgggcatgcctcatagtgtttayaataaatgtttatcttttaaaaaa

SEQ ID NO: 38682 - DNA, 50 bp, homo sapien
ttgttcaggaaaagaccagaaacaayagaagagtgatgtcaggtgagtaa

SEQ ID NO: 38683 - DNA, 50 bp, homo sapien
actaacatatactttgtaaataggawccatagaacccatgcgatttgaca

SEQ ID NO: 38684 - DNA, 50 bp, homo sapien
ttctttccataagtgttctccaaacygaacgtgaaatctttgttattctc

SEQ ID NO: 38685 - DNA, 50 bp, homo sapien
ataacagtgccagctcctcggaacamgtatgagcatcaatttgggaggaa

SEQ ID NO: 38686 - DNA, 50 bp, homo sapien
tcactccattggagaatagacacacwcaaatctcatcaagatcatctttc

SEQ ID NO: 38687 - DNA, 50 bp, homo sapien
tggcaaaaattatgtgctctagtacratagcggtcaatttctacagtgaa

SEQ ID NO: 38688 - DNA, 50 bp, homo sapien
caaaaaggcttgttcaaaccacttaygcacaaatagacaaaaaaggctgt

SEQ ID NO: 38689 - DNA, 50 bp, homo sapien
acttgctagagcttttccattcaccraagttcagagagggatatatactg

SEQ ID NO: 38690 - DNA, 50 bp, homo sapien
gggtttctaggtagctgacaacaccraccaaaaaaaatagactatagtta

SEQ ID NO: 38691 - DNA, 50 bp, homo sapien
atcttgtgtctgtgtcaaattctaasagtgttctgattcagagagttcta

SEQ ID NO: 38692 - DNA, 50 bp, homo sapien
ttgcaggctgtcttcatgtgactgcraaggggatagatgcaatctgaaga

SEQ ID NO: 38693 - DNA, 50 bp, homo sapien
aacctagagtccatgtaatgagttargttctcccgttcaggaaacgtctc

SEQ ID NO: 38694 - DNA, 50 bp, homo sapien
tgaaactgtatgtagcaacagaaatraggctaaacattgcagggatggag

SEQ ID NO: 38695 - DNA, 50 bp, homo sapien
aacttagaccacttactggcaattasgaagcactaaaaaattttgacaat

SEQ ID NO: 38696 - DNA, 50 bp, homo sapien
ctgacagtcttctcatttgtaagccygataatcattataccagtaaagtt

SEQ ID NO: 38697 - DNA, 50 bp, homo sapien
ccattgtaattgtccagccaatttcyaaatttgatgtatatctgaataac

SEQ ID NO: 38698 - DNA, 50 bp, homo sapien
cttaatttcctgagctatgtgcataygtcttcactgaaataccctgtgag

SEQ ID NO: 38699 - DNA, 50 bp, homo sapien
tgtgtgctaaattcctcaagcctccwacactttttgagtcccctcccttt

SEQ ID NO: 38700 - DNA, 50 bp, homo sapien
cttctttcagttttgcctctcataaytggtaatccacaatggtgactttc

SEQ ID NO: 38701 - DNA, 50 bp, homo sapien
ctttaataaatagctctccttgtgayaatgtagcacacattgcttcaatt

SEQ ID NO: 38702 - DNA, 50 bp, homo sapien
tggaggattcttgtggagagaagcaygatctcataggtaagcccagtgta

SEQ ID NO: 38703 - DNA, 50 bp, homo sapien
aacatatattaatgatggtggaaaakaaacacagtaaaaatgttcacagt

SEQ ID NO: 38704 - DNA, 50 bp, homo sapien
gggtacaagtacaagatctgtctggwacttgagtcaaaaaacaaggaagg

SEQ ID NO: 38705 - DNA, 50 bp, homo sapien
tttgggaaaacaagggaaacttacamctacatattggtcttaaaccactg

SEQ ID NO: 38706 - DNA, 50 bp, homo sapien
tttgtaaacaggcattctgtggagamggtctttaaaactatgcatgtagt

SEQ ID NO: 38707 - DNA, 50 bp, homo sapien
agtagaagagatcagtttagaatcayacattagttgtcaactaatcaatc

SEQ ID NO: 38708 - DNA, 50 bp, homo sapien
actgggcttctaattctagcatggawctagatatataacctaacttctga

SEQ ID NO: 38709 - DNA, 50 bp, homo sapien
tctgattagctgtgagtaaatatgcrgattgttctaagttactcaaacca

SEQ ID NO: 38710 - DNA, 50 bp, homo sapien
acacagaaaagtagagatagcgataytaactaaaaaatcaagctcaaggc

SEQ ID NO: 38711 - DNA, 50 bp, homo sapien
cagatataatgaacatcaatgaagayattttgtagacattaagagcatag

SEQ ID NO: 38712 - DNA, 50 bp, homo sapien
tggtgttgatgttcactcagttcatraagagtatttattgcatgcctatg

SEQ ID NO: 38713 - DNA, 50 bp, homo sapien
tttagagtagtataaaaattttgtayggtgagaagcaaatactgagttga

SEQ ID NO: 38714 - DNA, 50 bp, homo sapien
agacactggcagaaatgtacaatgaygaatctgctatttgtggactggta

SEQ ID NO: 38715 - DNA, 50 bp, homo sapien
gcaagctaagtgattgaaagttaacygatccaatagagacaattttaatg

SEQ ID NO: 38716 - DNA, 50 bp, homo sapien
ggcaatggtgaagttaggatcagacygatgtaggtgagacaattctgcac

SEQ ID NO: 38717 - DNA, 50 bp, homo sapien
atagtgcagctctagatctcttttaygctcaagttgtgggcttatgttcc

SEQ ID NO: 38718 - DNA, 50 bp, homo sapien
ttttaattttgaaaagtttttttcaygtggagtcatagatgtatgaagac

SEQ ID NO: 38719 - DNA, 50 bp, homo sapien
tttctttcttcaggatggattataayagttttcaaacatctctgcaatag

SEQ ID NO: 38720 - DNA, 50 bp, homo sapien
tcaagcaggtgtagaatgggtttcayactcaagtggctttgtgtagacaa

SEQ ID NO: 38721 - DNA, 50 bp, homo sapien
taggttgctgctgctcctgcttttawacaattaggatatgcttcagttat

SEQ ID NO: 38722 - DNA, 50 bp, homo sapien
cccttgcctgtgcgtccctctcttcrctttttttagtatttaagttttca

SEQ ID NO: 38723 - DNA, 32 bp, homo sapien
tatgaactcactagaayatagtacctaaggtc

SEQ ID NO: 38724 - DNA, 50 bp, homo sapien
caccaaaaggaacattttagaaaaaytgatggagttcgtgaacatttcca

SEQ ID NO: 38725 - DNA, 50 bp, homo sapien
ccctctggtgccttgcattagattaracgattcatccattgctataaaga

SEQ ID NO: 38726 - DNA, 50 bp, homo sapien
taactacataatggcattgaggagartcctgttattaggagaccccctag

SEQ ID NO: 38727 - DNA, 50 bp, homo sapien
tttaaattcaacatttttgacattayacctaatcttcaggataatgccct

SEQ ID NO: 38728 - DNA, 50 bp, homo sapien
tgtattcaagaggagaaaatgagacraaatatgcatttacacaacatttg

SEQ ID NO: 38729 - DNA, 50 bp, homo sapien
gtttaaactgacatttgtctggagaraaaccttcaacccttttaaccaca

SEQ ID NO: 38730 - DNA, 50 bp, homo sapien
actttcaatggattatctcatttaaygttcactgtgatccccagggatgg

SEQ ID NO: 38731 - DNA, 50 bp, homo sapien
agatttttagatcctaagaagctgartagagaacctcaaagagaatggca

SEQ ID NO: 38732 - DNA, 50 bp, homo sapien
tgcatcagacacttaattcaacataycttaaatgtacattaatcagtcag

SEQ ID NO: 38733 - DNA, 50 bp, homo sapien
tcaagtgcctccaaagaaactcttaygattggagaaactggaaaatcact

SEQ ID NO: 38734 - DNA, 50 bp, homo sapien
ctgtccttgtcaaggcttaattccamataggagttaccaatgccaaaaag

SEQ ID NO: 38735 - DNA, 50 bp, homo sapien
tccccatggacgccatggtgcaacarccggaattacttccccccaaccgg

SEQ ID NO: 38736 - DNA, 50 bp, homo sapien
caactcccaacagtggtatttaaaaytctctacatgattccagcctgcag

SEQ ID NO: 38737 - DNA, 50 bp, homo sapien
agtctatgggttctcacaactcaacygtatgcttaagaagaaggcaagca

SEQ ID NO: 38738 - DNA, 50 bp, homo sapien
atctgagagactttcataggtgacaygtattgtaatttgattcaagcata

SEQ ID NO: 38739 - DNA, 50 bp, homo sapien
aaccatatcagttgtcactaccaaaygaaaaattagagatgccaaaatgg

SEQ ID NO: 38740 - DNA, 50 bp, homo sapien
ataaatttgaaatcacatttccactsaagtaattgcatatactctaaagc

SEQ ID NO: 38741 - DNA, 50 bp, homo sapien
aataagcaaataaaacaaatagaccrcatggcaagactatgtatctatac

SEQ ID NO: 38742 - DNA, 50 bp, homo sapien
tatactctaaagcaatgattcctaakatcttcaaggatcctttttgaata

SEQ ID NO: 38743 - DNA, 50 bp, homo sapien
ttacagaaacgattggtaggtgcaarcaggaattcagaatattcaaaagt

SEQ ID NO: 38744 - DNA, 50 bp, homo sapien
tttgaatatattttctaagttagccrgaagcaatataattacagtacact

SEQ ID NO: 38745 - DNA, 50 bp, homo sapien
tttagaaaaggactctttgaagatayaattaagaacctagagaagagggg

SEQ ID NO: 38746 - DNA, 50 bp, homo sapien
tctcctttctgttgcttcccaaagcmgatgattacaacacagcgagaagt

SEQ ID NO: 38747 - DNA, 50 bp, homo sapien
aggtgggagagacaatctattaacargcaaacgaataaacaaataataca

SEQ ID NO: 38748 - DNA, 50 bp, homo sapien
tatttctactttttgaacatatggawtatagagttgaaaggttgaagtct

SEQ ID NO: 38749 - DNA, 50 bp, homo sapien
gtaaaatattctgggctccatcaaakatgtctgagtgttatatttaacag

SEQ ID NO: 38750 - DNA, 50 bp, homo sapien
atttgtaagtcacacaaccaagaaargattagcttctataatataaaaag

SEQ ID NO: 38751 - DNA, 50 bp, homo sapien
tagcattaatcatgaacactggaaamgatattcaataaaaatagttttag

SEQ ID NO: 38752 - DNA, 50 bp, homo sapien
acttcatgagagagaaaatacatagrccaacaactgctcgaagcatcata

SEQ ID NO: 38753 - DNA, 50 bp, homo sapien
tggaattttctttcccttccactcasgatatacaactaaaaacattgtca

SEQ ID NO: 38754 - DNA, 50 bp, homo sapien
ttatttttcttattgtagaccagtawctcttctctgttagagagttttag

SEQ ID NO: 38755 - DNA, 50 bp, homo sapien
gtctaatgatgaagtggaactgccaygacttcaaattattatttcaaaat

SEQ ID NO: 38756 - DNA, 50 bp, homo sapien
ccacccatccttctggaaacatgackaagcctttttataacagagctatc

SEQ ID NO: 38757 - DNA, 50 bp, homo sapien
tgttgaaagattgagaactaaagaastacatggtaaaacaacaaataaat

SEQ ID NO: 38758 - DNA, 50 bp, homo sapien
aagatggacagtggttgttacttcartagatgttttctgcctttctagag

SEQ ID NO: 38759 - DNA, 50 bp, homo sapien
attaatgagatagactgtgatttccrccaaggcttcgtggagttcttctt

SEQ ID NO: 38760 - DNA, 50 bp, homo sapien
cccatctacctctccgtgagtggaaygtgaaaactatcagccaataccac

SEQ ID NO: 38761 - DNA, 50 bp, homo sapien
cattgttttgagttcttgtagtgtasgtcttccaacatttccctgcagaa

SEQ ID NO: 38762 - DNA, 50 bp, homo sapien
tggaaggttgtgaacagctgggtgawcatctgtcaaagaggctgtaaact

SEQ ID NO: 38763 - DNA, 50 bp, homo sapien
cttgtggggttgcaggtacaagctamatccaagaagttgcactgcgtcat

SEQ ID NO: 38764 - DNA, 50 bp, homo sapien
ctgtgtcacaaacttccctctagttraaagaagtaggactcaaatcccca

SEQ ID NO: 38765 - DNA, 50 bp, homo sapien
ggatggtcaggacctgataaggaaarcactgatctctagagcagccacgg

SEQ ID NO: 38766 - DNA, 50 bp, homo sapien
gacaaaatgctcatctaaaactgcckaaaatgctatcttttaaaatctat

SEQ ID NO: 38767 - DNA, 50 bp, homo sapien
caaatgacataacagcatctaaaagyccaagtttgtaggatttgctgact

SEQ ID NO: 38768 - DNA, 50 bp, homo sapien
tctgtaatttagaactttagaaatcrgatcatccaatgacagtactaaaa

SEQ ID NO: 38769 - DNA, 50 bp, homo sapien
taaaacttctagagataaaagatacrataacaaaaataaaaatccaccta

SEQ ID NO: 38770 - DNA, 50 bp, homo sapien
tgcagggttctctgtacttaatcacrcaatgcagatcttcccttggctgt

SEQ ID NO: 38771 - DNA, 50 bp, homo sapien
aagaagttacactagagatgttgtaygttttactctgaaataaagaccac

SEQ ID NO: 38772 - DNA, 50 bp, homo sapien
tatgctgtttaatgaagccactagcyattaaaaagtaagtcaatgatatt

SEQ ID NO: 38773 - DNA, 50 bp, homo sapien
gtcagccaccatctctattatcatcratgtatttagtcatgcgttaccat

SEQ ID NO: 38774 - DNA, 50 bp, homo sapien
agagttggctttgaatgaatggtaaygcatgactaaatacatcgatgata

SEQ ID NO: 38775 - DNA, 50 bp, homo sapien
gtaaaataaccgttcacttagaaaaygatgaagttgggatatgaactcag

SEQ ID NO: 38776 - DNA, 50 bp, homo sapien
cattagattctcatagaagcgtgaaycctcttgtgaactggtcatgcaag

SEQ ID NO: 38777 - DNA, 50 bp, homo sapien
aagaccacagtctcttaaagatcccraaaggatgaagtcagagcgtgaat

SEQ ID NO: 38778 - DNA, 50 bp, homo sapien
acatcaaaaggagaacaatattatcmaaatgagcatgcagttaaatttga

SEQ ID NO: 38779 - DNA, 50 bp, homo sapien
gaaaactgcaaactacattagacacrggacctcagaaagcagtttccaaa

SEQ ID NO: 38780 - DNA, 50 bp, homo sapien
gaatgatcaattcagagggaacatcycattaactttccggagcgatttca

SEQ ID NO: 38781 - DNA, 50 bp, homo sapien
accacttttcctcttcattcaggaasgtcaatgaatatctacatatttgt

SEQ ID NO: 38782 - DNA, 50 bp, homo sapien
cagtaccttgctttttaaaacaacaygatagcttacaaaagaaatgaagc

SEQ ID NO: 38783 - DNA, 50 bp, homo sapien
taagccaggctttactgttgctaackgaaggaattgaggtatctaaatat

SEQ ID NO: 38784 - DNA, 50 bp, homo sapien
tagaaatggattttgtaaaagaatgwatgaccacttaaaggtcaattggc

SEQ ID NO: 38785 - DNA, 50 bp, homo sapien
tgacaatgaggagttcaacccttcaygagcacaagagtccaatcttccat

SEQ ID NO: 38786 - DNA, 50 bp, homo sapien
gtaaaatagtgcccaggtcaatagaractgtgagttctctaagaaacagt

SEQ ID NO: 38787 - DNA, 50 bp, homo sapien
aagttatagtaaatgtaaaataaaartgcatagctgagattgcaataaag

SEQ ID NO: 38788 - DNA, 50 bp, homo sapien
gagtaaaaggggaaagtatcaaagasaaattgggaagcccaggggaaagg

SEQ ID NO: 38789 - DNA, 50 bp, homo sapien
aacattttaaggtattaaagcagtayaggtacatccctaagcacatacat

SEQ ID NO: 38790 - DNA, 50 bp, homo sapien
agaaagtgctggctacatgtcaacarctaaactaagtaccatggttacca

SEQ ID NO: 38791 - DNA, 50 bp, homo sapien
ttacaggagctttcaggtgtgcatasataaggtagaagtaatggtttgtg

SEQ ID NO: 38792 - DNA, 50 bp, homo sapien
gtaaatatgtaactaggaattgagargttcttagaagaaaaaaatatata

SEQ ID NO: 38793 - DNA, 50 bp, homo sapien
atgtgtccatctacacgagcctagakagagaggtcctacagtggcagcca

SEQ ID NO: 38794 - DNA, 50 bp, homo sapien
agaggcaagaaggtactgcaaattcycagtttgtacagcctagcatgcca

SEQ ID NO: 38795 - DNA, 50 bp, homo sapien
tgtctcctgcagtagacagcctgagratgaaacatgacttggagcctcac

SEQ ID NO: 38796 - DNA, 50 bp, homo sapien
accaagtgtgactccaaattgcagayaaaatgtttttatagttacatggt

SEQ ID NO: 38797 - DNA, 50 bp, homo sapien
cccatatccactctcttgaatttcaratatgtgcatccaactacctgcct

SEQ ID NO: 38798 - DNA, 50 bp, homo sapien
acagatgactggaaataatgtaaaartagaaatccaattttaaaatacat

SEQ ID NO: 38799 - DNA, 50 bp, homo sapien
taatgattaatgcctaaaatagagayacctaaaatagagatgctgtaaaa

SEQ ID NO: 38800 - DNA, 50 bp, homo sapien
acataagaccttcttacattatctayagtgaaatatttaaaaggtcttaa

SEQ ID NO: 38801 - DNA, 50 bp, homo sapien
ggataattcccatattagggctgaakacctttgtcaaatgcataccaatg

SEQ ID NO: 38802 - DNA, 50 bp, homo sapien
gaccaggtattgtgctataggctgamggtacaacatttggatctgcctaa

SEQ ID NO: 38803 - DNA, 50 bp, homo sapien
ttaaagtaaattctattttaaataartgctgcttgctagatgagtcacct

SEQ ID NO: 38804 - DNA, 50 bp, homo sapien
aacaatgtctagatattcttataackgaaattctcatttgtgtctccaaa

SEQ ID NO: 38805 - DNA, 50 bp, homo sapien
ttagatttgaagacagtaaatgatcycatgaccaataaaatatgggctat

SEQ ID NO: 38806 - DNA, 50 bp, homo sapien
cgtgggtccctatggaatcaaacatyatgctgcatttcaaacacatttta

SEQ ID NO: 38807 - DNA, 50 bp, homo sapien
aaatatgtagaaatgaaacagactaygctacatttctataaccactattt

SEQ ID NO: 38808 - DNA, 50 bp, homo sapien
taaattttttttggtacttgaatttraaaaggatcatataattaaccact

SEQ ID NO: 38809 - DNA, 50 bp, homo sapien
tccatcttgatatataataatggccrcatggtaaactgttggggctgcat

SEQ ID NO: 38810 - DNA, 50 bp, homo sapien
tgccaggcatctcctagtgttgtgamtatataatgccatgttctccatct

SEQ ID NO: 38811 - DNA, 50 bp, homo sapien
attctccctggatcactatttccacrtctcattggccttttggcgttcct

SEQ ID NO: 38812 - DNA, 50 bp, homo sapien
tccataagctatgacggatgccttaraagtccaattttcagtgtttattt

SEQ ID NO: 38813 - DNA, 50 bp, homo sapien
actgaactttaatttatacaactacyggagcattacacttggacacattt

SEQ ID NO: 38814 - DNA, 50 bp, homo sapien
tcataaccatgagattgctagtcacraagatgagtcagggccagttttct

SEQ ID NO: 38815 - DNA, 50 bp, homo sapien
atacgtaaattagcttcatggaatarcttacaggcatttttaaaataagg

SEQ ID NO: 38816 - DNA, 50 bp, homo sapien
ggacataaaacttcaatgataagaaytgtaggcaagtttaaaaagggagg

SEQ ID NO: 38817 - DNA, 50 bp, homo sapien
aggcgtgagcacggccgaaatgttcrctcttttaagtgaaaatatcattc

SEQ ID NO: 38818 - DNA, 50 bp, homo sapien
tatatgtcagctggaatacccaaaaytgtagaatcgtgtatttcatgaga

SEQ ID NO: 38819 - DNA, 50 bp, homo sapien
gcaccagctttctggattaagccaaygtatttcttaaatatacttggctg

SEQ ID NO: 38820 - DNA, 50 bp, homo sapien
gtctgaaacgaagcaactgcatttgraacttctaacacaggccacgagct

SEQ ID NO: 38821 - DNA, 50 bp, homo sapien
agctttgtgatggttctattctttayaacaattgcacaggattccttttt

SEQ ID NO: 38822 - DNA, 50 bp, homo sapien
acatccaaacagcagccagatgaacracggactttaacgtctgaaacgaa

SEQ ID NO: 38823 - DNA, 50 bp, homo sapien
attattttctaagaatgtgtgatagraaacatatattttaaagatatgtt

SEQ ID NO: 38824 - DNA, 50 bp, homo sapien
aaaccatttcttcaaattattaatcraggttgcaataaaaagtttaatca

SEQ ID NO: 38825 - DNA, 50 bp, homo sapien
aacagaaagataaacttgaaagggarctgttagcaagaaagagagaatat

SEQ ID NO: 38826 - DNA, 50 bp, homo sapien
gtgattagcaaccttaattttatcarcaaccttggttctacctcaccata

SEQ ID NO: 38827 - DNA, 50 bp, homo sapien
attgttaggtgatattttctgactawgtaactgacatcttttaatgcatg

SEQ ID NO: 38828 - DNA, 50 bp, homo sapien
tcaatgaaatctctaccaaacttgawataccctactacatagcaaaatag

SEQ ID NO: 38829 - DNA, 50 bp, homo sapien
ctaacgtataaattgggtaagaagartaggaaggattagctcattggtaa

SEQ ID NO: 38830 - DNA, 50 bp, homo sapien
cctcatttaacaagtgttaactatgmatataccataatccaagatcacac

SEQ ID NO: 38831 - DNA, 50 bp, homo sapien
catataaaaaaatacaatgggtatcygaagaattaatgtttatatcttaa

SEQ ID NO: 38832 - DNA, 50 bp, homo sapien
tttgaaaagctttaaatgactgtcaratagattacattcaaaagtacttt

SEQ ID NO: 38833 - DNA, 50 bp, homo sapien
tgatgcaagaacttgtgttataatcycactgcaggtgttcacttgctcta

SEQ ID NO: 38834 - DNA, 50 bp, homo sapien
tgtcttctacttgtaaaatctaatartaagtaccaattaatataaaggac

SEQ ID NO: 38835 - DNA, 50 bp, homo sapien
cagaaagcttccgcattgcaatgaarccatactcattcttttatgatcta

SEQ ID NO: 38836 - DNA, 50 bp, homo sapien
aataactcagctggctggatctataraagtcagttccaaaatatgttctg

SEQ ID NO: 38837 - DNA, 50 bp, homo sapien
attttaagaaaaatctactattttcraccatctatcctcattcttgacaa

SEQ ID NO: 38838 - DNA, 50 bp, homo sapien
gagggtaaaactcccaagtttagacrgaaacacttgttcataatacatta

SEQ ID NO: 38839 - DNA, 50 bp, homo sapien
tggcttccattacaaacaaaaattaygaaacacactcatccactgtcatg

SEQ ID NO: 38840 - DNA, 50 bp, homo sapien
cactggatatgtgacaaaggtctgckcttagtttaagaattctgttaagt

SEQ ID NO: 38841 - DNA, 50 bp, homo sapien
tgtacccaaggccatccacccataamcatgtggccaacactgaagtcatc

SEQ ID NO: 38842 - DNA, 50 bp, homo sapien
aactttgagcatctatcatctctggyataggtgactgcagaagacttcta

SEQ ID NO: 38843 - DNA, 50 bp, homo sapien
tgccatcaccacaccttcatttaggycagtggttgtgctgcatggaggaa

SEQ ID NO: 38844 - DNA, 50 bp, homo sapien
gcttcagaacatggcaagggccttayaggttactgtcaagaataaacgtg

SEQ ID NO: 38845 - DNA, 50 bp, homo sapien
tatataaaatgctgtttaattcatcraaagttaattctcatgtgtagtac

SEQ ID NO: 38846 - DNA, 50 bp, homo sapien
gaaaatgttgcaaaaatttgtcaaaygttctaaggacaactccaactttt

SEQ ID NO: 38847 - DNA, 50 bp, homo sapien
tcagcaagcattaatctattttatgycaccctcaagtgattccacatagt

SEQ ID NO: 38848 - DNA, 50 bp, homo sapien
caactgctggcatatttctggaaacrcaacaggcttaatggaattggtag

SEQ ID NO: 38849 - DNA, 50 bp, homo sapien
gcaaatcattttgtcagaggactgcraacctagtcattggccaaatatta

SEQ ID NO: 38850 - DNA, 50 bp, homo sapien
cttttctcaggcttgcttagacctasaaccttaaaaatgagaatccctcc

SEQ ID NO: 38851 - DNA, 50 bp, homo sapien
cccatactcttccataataaaaacaytaaataagcagaaatagaaagtaa

SEQ ID NO: 38852 - DNA, 50 bp, homo sapien
ttaagtcctagcaacacaatatttayctggacagcaaacagtcaagctgc

SEQ ID NO: 38853 - DNA, 50 bp, homo sapien
attttatataaaataaagtaaatgtsaaaagatagaggagaggaaataag

SEQ ID NO: 38854 - DNA, 50 bp, homo sapien
tgtggggacattgaggccaaaattcragtttcaagataggtctaagaaca

SEQ ID NO: 38855 - DNA, 50 bp, homo sapien
tataacaagttattttagctgataayaccttaactttgattgcgtaaaaa

SEQ ID NO: 38856 - DNA, 50 bp, homo sapien
ctttggggactgcaagtaattttgcyacttaggaacctttatagcaggag

SEQ ID NO: 38857 - DNA, 50 bp, homo sapien
cattagatagtgaactttttgagcgkagtcatatttgtatcctgttggcc

SEQ ID NO: 38858 - DNA, 50 bp, homo sapien
gtcataaatgaatgcacaagtttcaratatgtacaggagtgctgtaagcc

SEQ ID NO: 38859 - DNA, 50 bp, homo sapien
aaagatgactctggaacatgaataarttaaaagaaagccaaagacccaat

SEQ ID NO: 38860 - DNA, 50 bp, homo sapien
gtagtaagtacttaatgccaggtcartcatcccttttaagacacagatat

SEQ ID NO: 38861 - DNA, 50 bp, homo sapien
cgtagagagctagatttcgaactgaygaagaaaggaaaacactgtagatc

SEQ ID NO: 38862 - DNA, 50 bp, homo sapien
tcatcttccattcaactttcaaacaytgtccatactgttgtgtagtaacc

SEQ ID NO: 38863 - DNA, 50 bp, homo sapien
tacggtacaaaggttggcaattttargagagaaataaggacttggtatgt

SEQ ID NO: 38864 - DNA, 50 bp, homo sapien
atattaagctttttaatttttgtgaytagtttgatgtgtttgtatttaaa

SEQ ID NO: 38865 - DNA, 50 bp, homo sapien
cagagataaatgcataattgaaaaaygaataccactagaaataaagcaaa

SEQ ID NO: 38866 - DNA, 50 bp, homo sapien
gggttaaattctgagttaaggttgcrcagaggttaaaagaacaaagctta

SEQ ID NO: 38867 - DNA, 50 bp, homo sapien
gggatctgttgaactgaaccttcaayaatcctgcacaaatcatcatattc

SEQ ID NO: 38868 - DNA, 50 bp, homo sapien
gctgctctctctaggtttgattcgayggtcatctgcagcactttcaaaga

SEQ ID NO: 38869 - DNA, 50 bp, homo sapien
caggaaacctctattaactctgtcartagaacaattaccagccctaatct

SEQ ID NO: 38870 - DNA, 50 bp, homo sapien
aggtcccacagactatgggaacgaamcttgatttatctgaaaccaggaag

SEQ ID NO: 38871 - DNA, 50 bp, homo sapien
aagttacaaaactaaaattctaataygaaagcagaagcaaaataagctga

SEQ ID NO: 38872 - DNA, 50 bp, homo sapien
gcaaggatgattttaaaagaagaggkatggtctgccttttaattctgtat

SEQ ID NO: 38873 - DNA, 50 bp, homo sapien
acagggtattgggagcactgaaatasaaactgggaaaattactcttagtt

SEQ ID NO: 38874 - DNA, 50 bp, homo sapien
ccacaatttattgaattatctgtacwactaattgatttaattctaacaat

SEQ ID NO: 38875 - DNA, 50 bp, homo sapien
tagaaaatagaaataacatctatcayagaatcgtgtctcagggagcttta

SEQ ID NO: 38876 - DNA, 50 bp, homo sapien
agattttttcccttcaatatttctamaggtgacgagagctgctaatggag

SEQ ID NO: 38877 - DNA, 50 bp, homo sapien
tacaaaatgctcagttgatacataamggaaaacacagtgccaataaatac

SEQ ID NO: 38878 - DNA, 50 bp, homo sapien
taagaaggaagaatctgaaaggcacratgatataagtgaatatttaccaa

SEQ ID NO: 38879 - DNA, 50 bp, homo sapien
ccactgtcatctgtgcacccctaacragagcctggggatggacccgccaa

SEQ ID NO: 38880 - DNA, 50 bp, homo sapien
gaaggtatcgaaggaggcgaagaaastatttccagcagtgaagtgaacta

SEQ ID NO: 38881 - DNA, 50 bp, homo sapien
tggaaatagtttcttcgcctccttcrataccttccaatttaaggtttgat

SEQ ID NO: 38882 - DNA, 50 bp, homo sapien
aaattcccaggggcatcaggatgaayagaaactccgaagtatgccagaaa

SEQ ID NO: 38883 - DNA, 50 bp, homo sapien
ctacatagctatagtaattaaaacastggcataaaaacagacacacagtc

SEQ ID NO: 38884 - DNA, 50 bp, homo sapien
aatatgtgtcaattccacaatccacmaagagttttttctcttcaccaaac

SEQ ID NO: 38885 - DNA, 50 bp, homo sapien
ctaagtctagatttatttttactggrcatttatctaattcaaaaagaact

SEQ ID NO: 38886 - DNA, 50 bp, homo sapien
cattatgtcttgtcctgttgttgacygagtctatcttaattcattttcaa

SEQ ID NO: 38887 - DNA, 50 bp, homo sapien
tttgaaaggaacttgaactgacatartataaaaattcctttgaattcatt

SEQ ID NO: 38888 - DNA, 50 bp, homo sapien
catatacagtttatgttgccaaataygcattgaacatgagcataccttca

SEQ ID NO: 38889 - DNA, 50 bp, homo sapien
aatggaacactatgcaacagtgaaaktgtattaaataaaactcagcacgc

SEQ ID NO: 38890 - DNA, 50 bp, homo sapien
attttttctgctgaagacagaatcartcatgtcctcagagcatctgggtt

SEQ ID NO: 38891 - DNA, 50 bp, homo sapien
ttttccacttgatttagggttcatgmaagaagagcaagctgaactgcaga

SEQ ID NO: 38892 - DNA, 50 bp, homo sapien
tcttacagcttgagcacctgagtaasaagaagcaaagtttccctccaccc

SEQ ID NO: 38893 - DNA, 50 bp, homo sapien
tcattaactttatttctggaatttayattagtttgtattaatgaagttga

SEQ ID NO: 38894 - DNA, 50 bp, homo sapien
ttagataaagcaatgatggtgagaamcttttagaatatttggaaaaagat

SEQ ID NO: 38895 - DNA, 50 bp, homo sapien
tgtacatagataagcattacctaagrcattgcatcaagagtgtctacctc

SEQ ID NO: 38896 - DNA, 50 bp, homo sapien
acaatgtgagacatgagctgacgaayggtcacgtgtcctgaacgcacgag

SEQ ID NO: 38897 - DNA, 50 bp, homo sapien
cccaccaagcatgttgtgagtttcayagacttgactaaagatttcaggga

SEQ ID NO: 38898 - DNA, 50 bp, homo sapien
accatatcacacttggatagaaatayaagagcgggacattctttatttag

SEQ ID NO: 38899 - DNA, 50 bp, homo sapien
attcagatttcaaggatgttaatacratggaaaaatagatgaagatttta

SEQ ID NO: 38900 - DNA, 50 bp, homo sapien
aaaaaaaaaaaagaaagcaagagtamaaactacactaagatttgaactta

SEQ ID NO: 38901 - DNA, 50 bp, homo sapien
tgtttaggaagattacattgattcamgaatatggctatttcatttaataa

SEQ ID NO: 38902 - DNA, 50 bp, homo sapien
tgcatagacaaatttacagcataccracagcacaaatacaggttttaaaa

SEQ ID NO: 38903 - DNA, 50 bp, homo sapien
gggccaagtagtgtctgaaggtctargaaaacaaaaatcaggcagagttc

SEQ ID NO: 38904 - DNA, 50 bp, homo sapien
tttaacccactgaactgaactatcargacacctgctacaggctactgccg

SEQ ID NO: 38905 - DNA, 50 bp, homo sapien
gtaatcacaaaaagcaaagtactcayggattaagtcttgcttcccagttt

SEQ ID NO: 38906 - DNA, 50 bp, homo sapien
caacagaagatctttgtacattccaraataaaagataagcaccttttata

SEQ ID NO: 38907 - DNA, 50 bp, homo sapien
tatgaatttaagcagcgtttctccasctaggcttttgtattataatatgc

SEQ ID NO: 38908 - DNA, 50 bp, homo sapien
tcagaatgaatggtcatgccaaaacygggctaaggtatgcttctgaaata

SEQ ID NO: 38909 - DNA, 50 bp, homo sapien
tttgttcttcatagagttggaaggamcacgtgaaaatgatgtgaaaatac

SEQ ID NO: 38910 - DNA, 50 bp, homo sapien
ttagtttcttaatttcatcctataamtcctaattacttttacatatcatt

SEQ ID NO: 38911 - DNA, 50 bp, homo sapien
ttatcaatagcattttagtttcttakcttatgcatctgagaattaaagaa

SEQ ID NO: 38912 - DNA, 50 bp, homo sapien
aagaaagcaaaatactcctagtctamcaatagccaattggattgcagccc

SEQ ID NO: 38913 - DNA, 50 bp, homo sapien
gcaaagtgttttatactcaaccttayacctctcatttcaagtacctcaga

SEQ ID NO: 38914 - DNA, 50 bp, homo sapien
taattgaatattttgtcatatgtaayaccatttttatccctgaaaacttt

SEQ ID NO: 38915 - DNA, 50 bp, homo sapien
tttgtggatattggcaaattgattckgaagtttctatggagagacataag

SEQ ID NO: 38916 - DNA, 50 bp, homo sapien
agtgcattcagacaagaacatgtgasagtcctctgtatcttttaaatcca

SEQ ID NO: 38917 - DNA, 50 bp, homo sapien
ttatgggtgctttggtgcgattaggrcaaagaagtagaggagaattagaa

SEQ ID NO: 38918 - DNA, 50 bp, homo sapien
tcacagaggctcacctggaccaacaytgtactcttgcttttagcatatcc

SEQ ID NO: 38919 - DNA, 50 bp, homo sapien
acagaaacacaattttacttgtaccyaaatcatgtcatttagcaaaggaa

SEQ ID NO: 38920 - DNA, 50 bp, homo sapien
acctctgatgatgacattgaggacaygctggctatgccatggctggattg

SEQ ID NO: 38921 - DNA, 50 bp, homo sapien
ttaacctcttagctgctttgtggackgatgcttattatctgcatttgtaa

SEQ ID NO: 38922 - DNA, 50 bp, homo sapien
cttccatccattttatttatactgayggagaggaaaacattggccagcca

SEQ ID NO: 38923 - DNA, 50 bp, homo sapien
agtttcatgcagctttctggttgtgracaagacttaccctgagagtggag

SEQ ID NO: 38924 - DNA, 50 bp, homo sapien
cccatttatagaaaccaataataaargtgatacccacaccctaaaaatac

SEQ ID NO: 38925 - DNA, 50 bp, homo sapien
taaaaaaatgaataagatttggaccsatggtaactacctggtctctgcca

SEQ ID NO: 38926 - DNA, 50 bp, homo sapien
acagcctcattttacactttctactraatctcagactctcattctacttg

SEQ ID NO: 38927 - DNA, 50 bp, homo sapien
actggagtgtctgtggtccaggcacygatggaggatggaggcatcccaag

SEQ ID NO: 38928 - DNA, 50 bp, homo sapien
caagaacttaagtaatcatctatgcractacaaacagattaatatattgg

SEQ ID NO: 38929 - DNA, 50 bp, homo sapien
ggtagtataaccagaagtattatccrgaagacgtaacaaccttagggatg

SEQ ID NO: 38930 - DNA, 50 bp, homo sapien
gaaatctgaggtttgatcctatctcraagttattaactgattgttttatg

SEQ ID NO: 38931 - DNA, 50 bp, homo sapien
aataagagtaatcagttttaggcaaragaaaattgcttgctgtaatacag

SEQ ID NO: 38932 - DNA, 50 bp, homo sapien
cagttgaagaagatacatacgtctaytacaaataagtaaataatccatgg

SEQ ID NO: 38933 - DNA, 50 bp, homo sapien
tttttcgtccttatgcaaacacaaaygattcactttcaaagctcagaagc

SEQ ID NO: 38934 - DNA, 50 bp, homo sapien
aagatcttaatattgaagaattcaayggaagaggtactaacttacacaga

SEQ ID NO: 38935 - DNA, 50 bp, homo sapien
ggaactatttggatactggctaccarggtttttatcactttctctagttt

SEQ ID NO: 38936 - DNA, 50 bp, homo sapien
atcatctgataggaacgcttccaacygaaaataacaggaaacactatata

SEQ ID NO: 38937 - DNA, 50 bp, homo sapien
tatttctttctctgacacacaagaamaaactaatactaaaaattggtact

SEQ ID NO: 38938 - DNA, 50 bp, homo sapien
agtttttgtttctatattctttccaktgaaaaagtatctggcagagtgtg

SEQ ID NO: 38939 - DNA, 50 bp, homo sapien
ggaacatccctgccacagagaaatawcagctagaggagtggctacttaga

SEQ ID NO: 38940 - DNA, 50 bp, homo sapien
cttttctcttgtgctaagatatcatraaaatggtaacttcaaaatcatgt

SEQ ID NO: 38941 - DNA, 50 bp, homo sapien
gtattcaaggtatgtaagtgtatgaygatttatagtaacattttccacag

SEQ ID NO: 38942 - DNA, 50 bp, homo sapien
aagcttttatattatctggattcaartctgaattacctctcttattcctc

SEQ ID NO: 38943 - DNA, 50 bp, homo sapien
agtataggataaatgtaccatgtaaygtatagtgtaaacataatttttat

SEQ ID NO: 38944 - DNA, 50 bp, homo sapien
actaccacacatttaataaactacartataggataaatgtaccatgtaac

SEQ ID NO: 38945 - DNA, 50 bp, homo sapien
tggtccccactgatggttctataaargctccatattatatgaaaaaccag

SEQ ID NO: 38946 - DNA, 50 bp, homo sapien
ggcaaatattattctcgtagccatarcagcactgagggtaattatattac

SEQ ID NO: 38947 - DNA, 50 bp, homo sapien
cacctgtaaattaggtgttttgaacsactgtgataaagcaaacataactt

SEQ ID NO: 38948 - DNA, 50 bp, homo sapien
attttattgtggaatcaactttagasatttttgtaagaggctttaaagca

SEQ ID NO: 38949 - DNA, 50 bp, homo sapien
tgtttatcaaaagacaccattaatcragggaacaactaacgccagaaagc

SEQ ID NO: 38950 - DNA, 50 bp, homo sapien
gtggatatttatatgtcactagtgaraatgttacctgttacatccttttt

SEQ ID NO: 38951 - DNA, 50 bp, homo sapien
actcagtgcaccacactattcaaaayaccccagtgctctcttctctcaac

SEQ ID NO: 38952 - DNA, 50 bp, homo sapien
agaacatccattataaggaatccagsaaataagttagattcaagtaacct

SEQ ID NO: 38953 - DNA, 50 bp, homo sapien
atttcccatttgtacacatgcaatawgattaaaatagatctctaaagaag

SEQ ID NO: 38954 - DNA, 50 bp, homo sapien
tatgctgaagtttttactattttgaratttttgctgatggttttataaca

SEQ ID NO: 38955 - DNA, 50 bp, homo sapien
atcaagtaaagagtaaacaaatacakattattgagagcaacatcttaatg

SEQ ID NO: 38956 - DNA, 50 bp, homo sapien
tctgaagtactttcaattaaccatartaacaaaatcctatttattgcctt

SEQ ID NO: 38957 - DNA, 50 bp, homo sapien
cagacacatgaaattctggtacaatrattctacaggttgaggaacatctt

SEQ ID NO: 38958 - DNA, 50 bp, homo sapien
aactatgctctgtgtttactattaaygtgactctgagatttctctgtcat

SEQ ID NO: 38959 - DNA, 50 bp, homo sapien
actttcgctttattgataatgcaccrccttcatttttctaactgtttgaa

SEQ ID NO: 38960 - DNA, 50 bp, homo sapien
tgagtgatgccatgtcctgaaagcarggggctaaacagatattatgactg

SEQ ID NO: 38961 - DNA, 50 bp, homo sapien
attggtttaagaacatcaacatggargcaattgatgaacccatggggcat

SEQ ID NO: 38962 - DNA, 50 bp, homo sapien
acattaatttggttcttaaaaggaaygcctagaatggaagttcattggtt

SEQ ID NO: 38963 - DNA, 50 bp, homo sapien
ttatttgccaattagtatattacagrctgctattctttttatacctctct

SEQ ID NO: 38964 - DNA, 50 bp, homo sapien
ccctgtcaactaatcagcattgttasaatcaggacaatgtgggtctatcc

SEQ ID NO: 38965 - DNA, 50 bp, homo sapien
gttaaaagttggtttttaaaggatakacaaacaatgctatatttggtcca

SEQ ID NO: 38966 - DNA, 50 bp, homo sapien
ttgtgcttacccaataccttaattaygcagaacaaattcattgcatgtca

SEQ ID NO: 38967 - DNA, 50 bp, homo sapien
tggaaaacagtaaaaacaactgtacygaccaggttcaggacccttggagg

SEQ ID NO: 38968 - DNA, 50 bp, homo sapien
cctgagagacatttaatctctttaargtgactcgacattacttctccatt

SEQ ID NO: 38969 - DNA, 50 bp, homo sapien
ttctttgagtctgcccatagcactasctttttgatctggaaatgctgcag

SEQ ID NO: 38970 - DNA, 50 bp, homo sapien
tgaaatgattgatacagtctattccrcagataaagaccttgttatgctac

SEQ ID NO: 38971 - DNA, 50 bp, homo sapien
ttattatttcttttaatctaccaaayggattcagatgttaaactctattt

SEQ ID NO: 38972 - DNA, 50 bp, homo sapien
ctttgggaaacacactttatatccaygtccatctgagaattcatccctca

SEQ ID NO: 38973 - DNA, 50 bp, homo sapien
atgcttatatattgtaggctttgaaytaaatttgttaagtaaattctcat

SEQ ID NO: 38974 - DNA, 50 bp, homo sapien
caaactttgctcatgtcatgtctatyaagatcaagaaaatggagcccata

SEQ ID NO: 38975 - DNA, 50 bp, homo sapien
acttcactccagccagggctacagascaagatcctgcttaaaataaataa

SEQ ID NO: 38976 - DNA, 50 bp, homo sapien
atgcctatgatttaaatgtggaagasgaaaataattctgccaatccaatc

SEQ ID NO: 38977 - DNA, 50 bp, homo sapien
ccttcattaaatgtgaccttcatcawtatacccatgcactcacagaattc

SEQ ID NO: 38978 - DNA, 50 bp, homo sapien
attttgttatagtagtccaagctaaracaagccagaaccaccaagacaag

SEQ ID NO: 38979 - DNA, 50 bp, homo sapien
actacaatcatgagctaaatcaatcyctttcctttacgcagtctcagata

SEQ ID NO: 38980 - DNA, 50 bp, homo sapien
aagatagcaatagtttctctcactcyatgtgctttccaagaactttgcca

SEQ ID NO: 38981 - DNA, 50 bp, homo sapien
aatttgggccaatgggaatattaaamttagaatgagaaaagcacttaaaa

SEQ ID NO: 38982 - DNA, 50 bp, homo sapien
cacacaaaaactcaatccaaaggtcrccattctcaaagatcaaaagtaga

SEQ ID NO: 38983 - DNA, 50 bp, homo sapien
atggagaaaaatattgaaatagagcrgagattgagacaactcttgacctc

SEQ ID NO: 38984 - DNA, 50 bp, homo sapien
ttggatcaactccaaatgctctaacrcggcctctaaggggaactgacctg

SEQ ID NO: 38985 - DNA, 50 bp, homo sapien
aaggcctaaagtcatagataaattamggtgatcggatgtgtggttcactc

SEQ ID NO: 38986 - DNA, 50 bp, homo sapien
acaggtataaaatgagtatgacaaaygcagcgctaacgcgagccacaagg

SEQ ID NO: 38987 - DNA, 50 bp, homo sapien
ctactggacaataaggctgaatagartaagctgcactttaaaaacatacc

SEQ ID NO: 38988 - DNA, 50 bp, homo sapien
cttattaggctagcacattgctcaayaggtttaaaataatgggtttctca

SEQ ID NO: 38989 - DNA, 50 bp, homo sapien
tagcatttgaatggagaggtgatagwagtaatgttcacatatgtgtaaag

SEQ ID NO: 38990 - DNA, 50 bp, homo sapien
attagtgagaaatagattggacaaaragggaccttaaactcaaaataccc

SEQ ID NO: 38991 - DNA, 50 bp, homo sapien
tattaaaaacaactttatcattctgmaaggcaagttatttcaagcctgag

SEQ ID NO: 38992 - DNA, 50 bp, homo sapien
tcagaggagcttcatactgcttctaygtcatacacctgtgttcatccatg

SEQ ID NO: 38993 - DNA, 50 bp, homo sapien
tgtggaggggcattcgtggattaaaytgagaacctacccacaattagtaa

SEQ ID NO: 38994 - DNA, 50 bp, homo sapien
gtgtagacttttaacacacagagtargataatgcatgtattgtgtaaatg

SEQ ID NO: 38995 - DNA, 50 bp, homo sapien
ttctttgggagcagttacgcttgaartccatgtgctgaagtttcatcaca

SEQ ID NO: 38996 - DNA, 50 bp, homo sapien
aaagaaagcttggaaaataaaataayggatccaagcccatcaggtgaagg

SEQ ID NO: 38997 - DNA, 50 bp, homo sapien
ttttgccaacagctcaaagaatatayggtaatattgtgggaactgagtga

SEQ ID NO: 38998 - DNA, 50 bp, homo sapien
cgtagatttcttgcatgtttccgaaratgatgagttctttgtttacaatg

SEQ ID NO: 38999 - DNA, 50 bp, homo sapien
tgcaatagagcagttcaataggcgayaggagcactgagtaagaggggcat

SEQ ID NO: 39000 - DNA, 50 bp, homo sapien
gtgcaaagaccttggaaagagaacaygatggacgtttctaaataaaacat

SEQ ID NO: 39001 - DNA, 50 bp, homo sapien
tcaaaataaaaattagcaacttagcycaagaaggatagctgggaaattgt

SEQ ID NO: 39002 - DNA, 50 bp, homo sapien
acagaaatgtaaagaccctagcctaragcaatgtatgtgcaaataggaga

SEQ ID NO: 39003 - DNA, 50 bp, homo sapien
acaatgaaatagaaggtatattgcayggaatttaggaaatatatctgaat

SEQ ID NO: 39004 - DNA, 50 bp, homo sapien
ccacatacattatcaaaatgattacmaagatggaattattcttatgacta

SEQ ID NO: 39005 - DNA, 50 bp, homo sapien
ctgaatgaagaagacaagacatatcrctagattgagcagagataaagtgt

SEQ ID NO: 39006 - DNA, 50 bp, homo sapien
atcagggaaaatacggtgcattggakaacctaaggctttgtgcctggggc

SEQ ID NO: 39007 - DNA, 50 bp, homo sapien
caatgcagtgagaataatttcaagakggtcatttcaatctagcacattta

SEQ ID NO: 39008 - DNA, 50 bp, homo sapien
aagaagatagaatggagctattaatraagtcaaagttcttacagaataga

SEQ ID NO: 39009 - DNA, 50 bp, homo sapien
gatgacttttactcatgtcagacacragaagagatgaggattctggatta

SEQ ID NO: 39010 - DNA, 50 bp, homo sapien
accagggttatctgagcctacactaygaaatctaaaatgttgtcaagggt

SEQ ID NO: 39011 - DNA, 50 bp, homo sapien
aaagactgtggataattattaaacaytctcttcccactatcatcagcatg

SEQ ID NO: 39012 - DNA, 50 bp, homo sapien
cagttccagaagggaaacctggtaaratgattgtttgcattccacggcca

SEQ ID NO: 39013 - DNA, 50 bp, homo sapien
tatcttctattccagctcaattatayatcctttgctgtagtaacatctga

SEQ ID NO: 39014 - DNA, 50 bp, homo sapien
tcctctccagaataatttgacaggasaagttcgagtttccaatatgtcag

SEQ ID NO: 39015 - DNA, 50 bp, homo sapien
agaggtaagcttgaggtaagatggcracttgaacaaagtatatcacctcc

SEQ ID NO: 39016 - DNA, 50 bp, homo sapien
gacagaataaaagcaagcatacttayaaagtgatctagtggatgaggtga

SEQ ID NO: 39017 - DNA, 50 bp, homo sapien
ttatatgtaaagataaagatagttgmatgaaggtagtaaaaaaaactcaa

SEQ ID NO: 39018 - DNA, 50 bp, homo sapien
gtaagacataaacttgctttaaaagragttaaatggtgaaaagacaaatc

SEQ ID NO: 39019 - DNA, 50 bp, homo sapien
ctaagatattgaactgaattatttakcttgcattgtcaaaaacaaatatg

SEQ ID NO: 39020 - DNA, 50 bp, homo sapien
gtgcttgggcaaactaaatggataaktgatggcttttaggcttttaagag

SEQ ID NO: 39021 - DNA, 50 bp, homo sapien
ggttgacttgctgagaatgtggagaytaaagccataaatattgatatttt

SEQ ID NO: 39022 - DNA, 50 bp, homo sapien
ccacacgcgcaaaatgctcagtcaaytccaataaaaaacatgaagaagat

SEQ ID NO: 39023 - DNA, 50 bp, homo sapien
cacttaaatttgtctcacagtttaaygatgctttattaaatttttaaaaa

SEQ ID NO: 39024 - DNA, 50 bp, homo sapien
acacacatacttaccagtgagttacrattgcctgcagtgtttagtagagt

SEQ ID NO: 39025 - DNA, 50 bp, homo sapien
ctcctttgatattctaaatgcatagyctaaaccataactttaactaaaag

SEQ ID NO: 39026 - DNA, 50 bp, homo sapien
gcagaatcaattcttatgtcaaaacrcattcatttttcaatccttttaaa

SEQ ID NO: 39027 - DNA, 50 bp, homo sapien
tcatgtacatattttgacatatttasacattatgaagcaagagttatgta

SEQ ID NO: 39028 - DNA, 50 bp, homo sapien
tcctctggggaagccgtatgccttaracgagtcacttgaaattgttctac

SEQ ID NO: 39029 - DNA, 50 bp, homo sapien
tagttacatgtttgtattcttgagayggatacaagaactctttttaggac

SEQ ID NO: 39030 - DNA, 50 bp, homo sapien
atagtacatttgtgatgagcatggaraatgtatataggatattagtaaat

SEQ ID NO: 39031 - DNA, 50 bp, homo sapien
agaatgtaagacatcgattgggccaygtgattctggagtgcaaggcctta

SEQ ID NO: 39032 - DNA, 50 bp, homo sapien
tggtaatgagacagaatatggagcartaacagtttctgttggcaaatcga

SEQ ID NO: 39033 - DNA, 50 bp, homo sapien
tacttagttaataatgtttaatcacmagataatctctcctatttatatta

SEQ ID NO: 39034 - DNA, 50 bp, homo sapien
ttccttacgataaacaatggaagtamatatctatctatcagcttggcttt

SEQ ID NO: 39035 - DNA, 50 bp, homo sapien
gtagaaatgtggaatattggctagcrcaacctgagaaagactcctaattt

SEQ ID NO: 39036 - DNA, 50 bp, homo sapien
tgtaagtaacttataagttgagtacratgcaaagaaatgtacagataatg

SEQ ID NO: 39037 - DNA, 50 bp, homo sapien
agggtttaccatgccccactagatasctctgactacaatttgctcaccat

SEQ ID NO: 39038 - DNA, 50 bp, homo sapien
aattagttaaaactatgcaattttayggcaaaatcaacatgatcgttaac

SEQ ID NO: 39039 - DNA, 50 bp, homo sapien
acagaaagttcagttatctatacacmgaagttatatgaaaaatagaagaa

SEQ ID NO: 39040 - DNA, 50 bp, homo sapien
agaaaacagagactgatgtgattcaragatggtactaaaaaattgagtta

SEQ ID NO: 39041 - DNA, 50 bp, homo sapien
aaactaaattagaggtaagacgtaarcaggaggagataagtgaaatttcg

SEQ ID NO: 39042 - DNA, 50 bp, homo sapien
tgtgccaggtattaatgttatattaytaaagcagcaataacaaattaaat

SEQ ID NO: 39043 - DNA, 50 bp, homo sapien
aaagagatactttaaataaccaagartagtcatacatagcaccagctaaa

SEQ ID NO: 39044 - DNA, 50 bp, homo sapien
gtcaagtaataattccttccaattartaatactacagatgcggttttaat

SEQ ID NO: 39045 - DNA, 50 bp, homo sapien
tcctctaagatcagaaaaaatggcamgtctggatgcagtggctcacgcct

SEQ ID NO: 39046 - DNA, 50 bp, homo sapien
ttccacttcaaattcaaagatctccrcttgaaaagacattgtaaaatcag

SEQ ID NO: 39047 - DNA, 50 bp, homo sapien
ctttccttcttataaataatgcgacwctgttaagttcatttccctcgttg

SEQ ID NO: 39048 - DNA, 50 bp, homo sapien
accacaaaacaatacaaacttattcycgtacagatttataggtcagaggt

SEQ ID NO: 39049 - DNA, 50 bp, homo sapien
gttctgttccatcatatacttgtaartctaaatccctttgagagtaactc

SEQ ID NO: 39050 - DNA, 50 bp, homo sapien
agctttaagagttgggagcattataycttttaatgtaaaaagctacctaa

SEQ ID NO: 39051 - DNA, 50 bp, homo sapien
ctccaaaaaatatttattgatctgaygtaaaaatatctttgagaaatgac

SEQ ID NO: 39052 - DNA, 50 bp, homo sapien
gtatcagagtatcactagttctatgkaatatgaatggattggccagtctc

SEQ ID NO: 39053 - DNA, 50 bp, homo sapien
catgcttttcacactctgagaaagawaaagttctccaatttgatcccatt

SEQ ID NO: 39054 - DNA, 50 bp, homo sapien
aaggcatatactctgattcagctaaygttaccagatcaactcattccatt

SEQ ID NO: 39055 - DNA, 50 bp, homo sapien
aaatgaccatctgattaaacataacmctatcatttaatcctagatatttc

SEQ ID NO: 39056 - DNA, 50 bp, homo sapien
ggtcaataaaatacaaaatgcacatsatgatttatatatctttattgttg

SEQ ID NO: 39057 - DNA, 50 bp, homo sapien
atttattcagaaaaaagaagaactcratatttatagtacaaaattccaca

SEQ ID NO: 39058 - DNA, 50 bp, homo sapien
tggacttctgcagtgggtgctaacayggcatccaacaggactttgtaata

SEQ ID NO: 39059 - DNA, 50 bp, homo sapien
aaccttttaaaagccttttattctaygttgcagagagctattatatacac

SEQ ID NO: 39060 - DNA, 50 bp, homo sapien
gtggaatattatggaacagttaaaawcaatatgggtagaaattaaggaca

SEQ ID NO: 39061 - DNA, 50 bp, homo sapien
ctgagtcctctgaggtcacttgttayacctgataccttttaaaaagtcaa

SEQ ID NO: 39062 - DNA, 50 bp, homo sapien
tggctatacatttgattgcataagckctatgtattacagatcccattcca

SEQ ID NO: 39063 - DNA, 50 bp, homo sapien
aagcttctctctatcctgtgactccraacttcatgatataataaagtgag

SEQ ID NO: 39064 - DNA, 50 bp, homo sapien
gtgagtgattgtgtgtacttttacckgaaatgactcatctgtattcttaa

SEQ ID NO: 39065 - DNA, 50 bp, homo sapien
ggtagcagagcacgtggcggatctayggtggccatggcagttgtggagct

SEQ ID NO: 39066 - DNA, 50 bp, homo sapien
tctgtagtaatgaatactagcaaaarttaagcacaaagcaatgaactgac

SEQ ID NO: 39067 - DNA, 50 bp, homo sapien
ttaaataatctgctgtatcttcaacygtctcttaggtctcttctaggtag

SEQ ID NO: 39068 - DNA, 50 bp, homo sapien
acagtcagacggacccgagttagttyaacagtgtgtgacatctgggtgac

SEQ ID NO: 39069 - DNA, 50 bp, homo sapien
tttatttcagaatgatggtgccaagrataggtatcagtcaggcctgatgc

SEQ ID NO: 39070 - DNA, 50 bp, homo sapien
tattgattataaagttagagtcacaraaatggaaatattctataactcct

SEQ ID NO: 39071 - DNA, 50 bp, homo sapien
tttttttttttacagttcttgatacyacctttggcaaatttaaataaggt

SEQ ID NO: 39072 - DNA, 50 bp, homo sapien
taacaccgctaactcgctgagagtaytaaacccaataagattttctttaa

SEQ ID NO: 39073 - DNA, 50 bp, homo sapien
aaaagaactacctactgatgtggtawctttagaatatcctatatgatgac

SEQ ID NO: 39074 - DNA, 50 bp, homo sapien
tagcatgtcgcaatcctgagtatccrctgtctttctcagccagctcttgc

SEQ ID NO: 39075 - DNA, 50 bp, homo sapien
gaatgtaagctgcagaaaactgtaaragaaattgcatatcctgctgaagt

SEQ ID NO: 39076 - DNA, 50 bp, homo sapien
tctttctgatatctcagcacctctgsaacataggaatgtaagctgcagaa

SEQ ID NO: 39077 - DNA, 50 bp, homo sapien
taaagaatatgtatttccattttgaygaacagttgtctcccttccaattt

SEQ ID NO: 39078 - DNA, 50 bp, homo sapien
caaaagattatctgaactatgattaygcttaaatttcaaaaatagccaaa

SEQ ID NO: 39079 - DNA, 50 bp, homo sapien
gttgctagcatatactcttaatcatsaaaaaaaaatatattggggaaatc

SEQ ID NO: 39080 - DNA, 50 bp, homo sapien
aattgtaagttttaatggctccatartaatttgttaaaatatgagctata

SEQ ID NO: 39081 - DNA, 50 bp, homo sapien
tagattactgtgtctattgctatcayagaatatttagtggagagggcatc

SEQ ID NO: 39082 - DNA, 50 bp, homo sapien
tgccaaagttgagggtacatctggawaaaagaaagaaaagtcacagtaag

SEQ ID NO: 39083 - DNA, 50 bp, homo sapien
tacaaaatattaattattttcatgcygcagatagtacttttaggtggaaa

SEQ ID NO: 39084 - DNA, 50 bp, homo sapien
tccagtttaaaaacaatctacaactyacaaatgcttccactatttatgaa

SEQ ID NO: 39085 - DNA, 50 bp, homo sapien
tgcttttaggggttatgcaataaacrgagcagagtaaaacattcaaatga

SEQ ID NO: 39086 - DNA, 50 bp, homo sapien
aaagtgaggcttgtaccagcgatgakaataactgctagagaataagattt

SEQ ID NO: 39087 - DNA, 50 bp, homo sapien
ctgattttaaaatagtgacataaaamattggaactaaataaaataactat

SEQ ID NO: 39088 - DNA, 50 bp, homo sapien
ccatgctaacagtttcaaaaaactcrgagaaataatgctacttaacaaaa

SEQ ID NO: 39089 - DNA, 50 bp, homo sapien
ccaaatcttaatatatagtctccacratcaaatgtagctcataaattcct

SEQ ID NO: 39090 - DNA, 50 bp, homo sapien
ttttaagattcattggaaaaataackccttggaagcattaactgttttaa

SEQ ID NO: 39091 - DNA, 50 bp, homo sapien
attttatgtgtatttcgtgtatttaycttatcttccaaaattttctaaac

SEQ ID NO: 39092 - DNA, 50 bp, homo sapien
agtagggaatttctataaaaatatckgaagacgtggaagtatctttggta

SEQ ID NO: 39093 - DNA, 50 bp, homo sapien
ctatgtgctgggtaatcaacctaccmacagcagaaatcaaaggtaagctt

SEQ ID NO: 39094 - DNA, 50 bp, homo sapien
agaaaaatgtacacaaatgtcaacayataaagaatattatactcacaagg

SEQ ID NO: 39095 - DNA, 50 bp, homo sapien
aaaaaaaagttaataaaaatgtacamagtctttaagaagtatgggattct

SEQ ID NO: 39096 - DNA, 50 bp, homo sapien
gtaggaaatggtgagagaaacctccyagatatcaaacttgtctgtacttg

SEQ ID NO: 39097 - DNA, 50 bp, homo sapien
tgatagagatgtgattagaagataaytgagaacatggataaaaactcgtg

SEQ ID NO: 39098 - DNA, 50 bp, homo sapien
atcagcatatattgtaagcagataartaaatgtataaaatttcggttatg

SEQ ID NO: 39099 - DNA, 50 bp, homo sapien
accttagttccctcctttataaacargctgattggcctaaatcacagtaa

SEQ ID NO: 39100 - DNA, 50 bp, homo sapien
ggtagttccatgaacttctgaaataygccatttaatgggcctcttgtgct

SEQ ID NO: 39101 - DNA, 50 bp, homo sapien
gttaaccatagtaaacacgataataygtaaatgtagttctgtaatttcag

SEQ ID NO: 39102 - DNA, 50 bp, homo sapien
tggttttataaggcaaggattttcargaacatctcaaaacagatatcttg

SEQ ID NO: 39103 - DNA, 50 bp, homo sapien
tattccaagtccttagtcttttccawctctcaatgtcccaaaaatgaagt

SEQ ID NO: 39104 - DNA, 50 bp, homo sapien
tgtttggaattgccactctatgaatyaaagagagaagtcactgtgggttt

SEQ ID NO: 39105 - DNA, 50 bp, homo sapien
agatgttgtgtctctgatgaactctsaacaaattcaaaatataggatgtt

SEQ ID NO: 39106 - DNA, 50 bp, homo sapien
atttagaagtcaaagatatatacttwaaaaattgcttattatgaagaaat

SEQ ID NO: 39107 - DNA, 50 bp, homo sapien
tctaatatcttacttccttctaagtwaaattgagcccaataacaaaatga

SEQ ID NO: 39108 - DNA, 50 bp, homo sapien
tttcatctgagacgtgtcattgaccratgttctccaggtccaggtccagt

SEQ ID NO: 39109 - DNA, 50 bp, homo sapien
tagaatcaccatgaagtgtctactaygcagttgttctagctatagctcca

SEQ ID NO: 39110 - DNA, 50 bp, homo sapien
aaggcatagcgcaaaagttattttasatgtggagttgtgcaaacccttca

SEQ ID NO: 39111 - DNA, 50 bp, homo sapien
ttgattataataaacatttcatctcmaaaacatcatagataagaatgaca

SEQ ID NO: 39112 - DNA, 50 bp, homo sapien
tattattttcttacatgacttattcrcagattattccaactatggctata

SEQ ID NO: 39113 - DNA, 50 bp, homo sapien
gaactgaaaaatgcagtagggtcgcraacgatggctcactttgagctaat

SEQ ID NO: 39114 - DNA, 50 bp, homo sapien
tgaaaaaggaaacacttcagagcacrctgaaaaatgttgtgtgtgctgaa

SEQ ID NO: 39115 - DNA, 50 bp, homo sapien
ctaggctggcacagaatggttcacargttggttgaatgcagtacagttcc

SEQ ID NO: 39116 - DNA, 50 bp, homo sapien
atgtacatccagcattttgttgtcayattaaaatccaagaataaacacaa

SEQ ID NO: 39117 - DNA, 50 bp, homo sapien
ttgttctcacctggagtcaataaaaygaaaagtaatgaagcttacagcaa

SEQ ID NO: 39118 - DNA, 50 bp, homo sapien
tttttttttctgcctattgtaatacrctaagacatctccgtgagtggaaa

SEQ ID NO: 39119 - DNA, 50 bp, homo sapien
acattaaatacatggaggaattagamgctcggcatttaatgatgcagtta

SEQ ID NO: 39120 - DNA, 50 bp, homo sapien
ttacaagcttgagccaccatgaccgrccctgtctgaaatttttaaccacc

SEQ ID NO: 39121 - DNA, 50 bp, homo sapien
acattatataaaataataaggatcaygcaagtaccttgaaagttttctgt

SEQ ID NO: 39122 - DNA, 50 bp, homo sapien
aatccctgagctgaaacctgaagaamtggctatctgctctccattctagc

SEQ ID NO: 39123 - DNA, 50 bp, homo sapien
agaaataactaatccaataactatarcaacttaaattatacaattacttt

SEQ ID NO: 39124 - DNA, 50 bp, homo sapien
tataaactagttaatattaaactgayccgtctctttttgccttcactgcc

SEQ ID NO: 39125 - DNA, 50 bp, homo sapien
ttttttctgccacgttatggtatcaygttcattctgaagttgtaatatgt

SEQ ID NO: 39126 - DNA, 50 bp, homo sapien
gtccccgggactaatgaaaggagtayaggtaacaatgatatgagttcagt

SEQ ID NO: 39127 - DNA, 50 bp, homo sapien
aagcagagaaatgctaagggccccaytagttgtttggaatggtgggagaa

SEQ ID NO: 39128 - DNA, 50 bp, homo sapien
cttctttccatgtacttcatgaaccratcttgctaaattcaaacttttct

SEQ ID NO: 39129 - DNA, 50 bp, homo sapien
ttctacaaaactaatagtaaaggaaygcttatcatctcattgttgtgagg

SEQ ID NO: 39130 - DNA, 50 bp, homo sapien
caacatcctctaagatattattctcrcaattatgccctttcttctatatc

SEQ ID NO: 39131 - DNA, 50 bp, homo sapien
tgacattttctctgacttataccacrcagtgtttcaaacctgtccctgaa

SEQ ID NO: 39132 - DNA, 50 bp, homo sapien
tggtcagagaaacattggtgtctgcragataatatcgaccaaacacacat

SEQ ID NO: 39133 - DNA, 50 bp, homo sapien
tgtattttaccatacctctctcttckcagaagccatcttctgatcttttt

SEQ ID NO: 39134 - DNA, 50 bp, homo sapien
ccttattgacgtaataatacagtaaraagatcatgtagtgaagtactggg

SEQ ID NO: 39135 - DNA, 50 bp, homo sapien
taaactgaaaatctttatagtggaartacattgcatagaagtaggattat

SEQ ID NO: 39136 - DNA, 50 bp, homo sapien
cagtagcccattcaaggtatacaaarttaaaggaatttgtagagggtttt

SEQ ID NO: 39137 - DNA, 50 bp, homo sapien
tatttgagagtgcttatgtttactgmaatatcacaacaatgttcaaggca

SEQ ID NO: 39138 - DNA, 50 bp, homo sapien
atataaaggtgatgaaacatgcttgsaaccaatattttgattttcagatc

SEQ ID NO: 39139 - DNA, 50 bp, homo sapien
ttatatgaatatttatattaagtaaragaaattcaggttttgattcttaa

SEQ ID NO: 39140 - DNA, 50 bp, homo sapien
aggatatttggtagaatagtaaccartatgggcaaaatgaagcattgctt

SEQ ID NO: 39141 - DNA, 50 bp, homo sapien
taaaaaaaaagaaccttttcataaawcagagaatgttataacagaaatga

SEQ ID NO: 39142 - DNA, 50 bp, homo sapien
tggtataccaaagtgagtaatacaarccatcaagtaatcagtaaaatgat

SEQ ID NO: 39143 - DNA, 50 bp, homo sapien
tgaaatatcaaagacctcagatataygatgcaaagaacaaaactctcatc

SEQ ID NO: 39144 - DNA, 50 bp, homo sapien
gaaaatcaacacaaatttctaaatcrattcaggaaatgaaaagaagagat

SEQ ID NO: 39145 - DNA, 50 bp, homo sapien
gtaacaatgcaaattctggtagtaasaacaacagccaaagtgtggaactt

SEQ ID NO: 39146 - DNA, 50 bp, homo sapien
aagtatgtgtcacgaaaattactaaraaactcaatcataagtgagattaa

SEQ ID NO: 39147 - DNA, 50 bp, homo sapien
gaataccatcataaacgctgtaaatkaacttacctacaacagacatttcg

SEQ ID NO: 39148 - DNA, 50 bp, homo sapien
agcctataaagggttgttatcagtcragttatcactaagcatttggagcc

SEQ ID NO: 39149 - DNA, 50 bp, homo sapien
aaaaatatttaagggattatggtaaygacatttgaaatagcatggagaaa

SEQ ID NO: 39150 - DNA, 50 bp, homo sapien
actgagctagagaatttctacttgaygggacatttactcccttgctacag

SEQ ID NO: 39151 - DNA, 50 bp, homo sapien
cttttattgattcataaagaaaggasgtgcatgaaaacctttgaggaaac

SEQ ID NO: 39152 - DNA, 50 bp, homo sapien
atcaacaatgagaactgattttatawaacgtactgcagagatactggccc

SEQ ID NO: 39153 - DNA, 50 bp, homo sapien
ccattcagctggtgagtgagttagargaattaacagtggagaaaatatta

SEQ ID NO: 39154 - DNA, 50 bp, homo sapien
ttgttgattccaacaatcacctttakctctcctgattcatttagaaattg

SEQ ID NO: 39155 - DNA, 50 bp, homo sapien
atatacttctattatcagaaataaakgattggccataatctattctgtaa

SEQ ID NO: 39156 - DNA, 50 bp, homo sapien
ggacattacatcaacttctactttckcttcttatgttattcttccttaac

SEQ ID NO: 39157 - DNA, 50 bp, homo sapien
ctcactgagctaaaccaaacatcaargtagcagggaaatatattctatca

SEQ ID NO: 39158 - DNA, 50 bp, homo sapien
tgtgcaaatgtatctcctgcattaayatctctgcctgttgcttaagatca

SEQ ID NO: 39159 - DNA, 50 bp, homo sapien
tgatagtttgttgacctcatggaggraaatctaaatgaaatcagtatctt

SEQ ID NO: 39160 - DNA, 50 bp, homo sapien
gaatagcattgtgtcaattactcccyataaacaaagtaagcagactgaaa

SEQ ID NO: 39161 - DNA, 50 bp, homo sapien
tgagaatacatgtaatttccttaaargatagactgtaggcttgataagta

SEQ ID NO: 39162 - DNA, 50 bp, homo sapien
gacaaagtgaggccagggtctgaaayaagtccttctaggctaacagttgc

SEQ ID NO: 39163 - DNA, 50 bp, homo sapien
tcttaatgctttctactacttatgartacaaatcagaaaagaagcacaaa

SEQ ID NO: 39164 - DNA, 50 bp, homo sapien
aaaacctgagattgttgattgcaacsattcacaaaaatatcagctataga

SEQ ID NO: 39165 - DNA, 50 bp, homo sapien
agctttctatttggttctcagtgtcsaattctataatatacatgaacaaa

SEQ ID NO: 39166 - DNA, 50 bp, homo sapien
gcaacacgacacatgtttctaccatragtcttttccaatggttttgcaga

SEQ ID NO: 39167 - DNA, 50 bp, homo sapien
aagatacagatttctcctcaatggaygaccactgactcaatagattggta

SEQ ID NO: 39168 - DNA, 50 bp, homo sapien
atcagttcccacaatctttaaataamgtccaggataaagtccaaataaag

SEQ ID NO: 39169 - DNA, 50 bp, homo sapien
tttcaatatttgcttaggtaaatgascctcttcaagaaggattacatata

SEQ ID NO: 39170 - DNA, 50 bp, homo sapien
atttcttccaagctgtatttttatcrcataatatttatttcaataatttc

SEQ ID NO: 39171 - DNA, 50 bp, homo sapien
tacacctcagttatttatttcttgckgagacatattgttgaaatctcatt

SEQ ID NO: 39172 - DNA, 50 bp, homo sapien
ccagaatagcctgatgtaaatggaarccagcggctgggagagctctacac

SEQ ID NO: 39173 - DNA, 50 bp, homo sapien
aggggtaccaggaccatactattcaragactctaggctatttttagatat

SEQ ID NO: 39174 - DNA, 50 bp, homo sapien
cattcagggtactcactctaaagcaygatctgaaggtggagctgaggtta

SEQ ID NO: 39175 - DNA, 50 bp, homo sapien
catattgtaacatcgctatgctgcaygataatctcgaacaatacttgctt

SEQ ID NO: 39176 - DNA, 50 bp, homo sapien
gttgaaattaatatgaaaagttttaygtttctattaagatatggaactaa

SEQ ID NO: 39177 - DNA, 50 bp, homo sapien
ataccaaatggtggattgatttctayaatttccgcacttccacacgtcat

SEQ ID NO: 39178 - DNA, 50 bp, homo sapien
tatacaattacactttatagaattaygcacatataacacacaacatatat

SEQ ID NO: 39179 - DNA, 50 bp, homo sapien
ttcatctaaataaaataattccaaakttcaagctctcatggctacttaca

SEQ ID NO: 39180 - DNA, 50 bp, homo sapien
tttatatcattctctaattaataacyaacaacatacttaattttaataca

SEQ ID NO: 39181 - DNA, 50 bp, homo sapien
gaaaagtatgtacagttgtattatcycaagttagaaatgaaaagaagtcc

SEQ ID NO: 39182 - DNA, 50 bp, homo sapien
ttatattcacagaacgctttggtagmaattagcaggaccagcagatctgc

SEQ ID NO: 39183 - DNA, 50 bp, homo sapien
gcttttggaagcacagttagaggacycgaaagtcatggtctgtgacaaac

SEQ ID NO: 39184 - DNA, 50 bp, homo sapien
gaaggcaatgtagtacatgccagaaycaaaagagtgaaggaatgtgaatt

SEQ ID NO: 39185 - DNA, 50 bp, homo sapien
agtcatgtgacccatgcttaaacaartgatggccctggaatgaagaactg

SEQ ID NO: 39186 - DNA, 50 bp, homo sapien
catgtaatatatcaattagcactgtmaaaattattgagtttcaaatactt

SEQ ID NO: 39187 - DNA, 50 bp, homo sapien
gatgtcaggctgaaatgtttaatcayactaattgttcctaccagtcctaa

SEQ ID NO: 39188 - DNA, 50 bp, homo sapien
aaactgtaaggattctaaggaaataygcgataaaaggttgagccttgaac

SEQ ID NO: 39189 - DNA, 50 bp, homo sapien
ctaagacaggccatgtgactaacagmacaagcaagaagtcatgatacgtc

SEQ ID NO: 39190 - DNA, 50 bp, homo sapien
atgatatcattgtggaacagcatgawtataactgtagtgccatgggttga

SEQ ID NO: 39191 - DNA, 50 bp, homo sapien
ggttttgtgtatttctcaggctgcartaatgccattgagacagtggggat

SEQ ID NO: 39192 - DNA, 50 bp, homo sapien
tagagcacctgtcacaacaatattascattcgcacaaggaattaaatcgg

SEQ ID NO: 39193 - DNA, 50 bp, homo sapien
acagcagaagccagttacataattgraaatgatacattcaggaataggcc

SEQ ID NO: 39194 - DNA, 50 bp, homo sapien
ctttcaatcaagttacctgcatgtcmataatgaaagcagatcttttaaac

SEQ ID NO: 39195 - DNA, 50 bp, homo sapien
tttatgtgttgaagacccatcagaawttatctctttggacaaacagagaa

SEQ ID NO: 39196 - DNA, 50 bp, homo sapien
gcaatatctcagagcacttctttgcragggtctcattcttgatttaattc

SEQ ID NO: 39197 - DNA, 50 bp, homo sapien
tcttttgtctgattctgacctgaaamtatctgcaagtgtggagtttgctg

SEQ ID NO: 39198 - DNA, 50 bp, homo sapien
tacaaaaacactaaagctctactcayggtgatattgatcattcctttcac

SEQ ID NO: 39199 - DNA, 50 bp, homo sapien
gcataaaacaactctgagaacaatcraaataggaggataaaatgtgctat

SEQ ID NO: 39200 - DNA, 50 bp, homo sapien
aaatgcataagcaaaacactttacaytaaacaattgatttttagaatcct

SEQ ID NO: 39201 - DNA, 50 bp, homo sapien
tggctggcttctgtaaaattatcaargagaagatagacctcaaacttaaa

SEQ ID NO: 39202 - DNA, 50 bp, homo sapien
ggtggctggtgcttcacaatttaaaygaggcctgtcttaggaaccccagg

SEQ ID NO: 39203 - DNA, 50 bp, homo sapien
tgaaataggtagtagctggcacttayggtgagatgggatttactagagta

SEQ ID NO: 39204 - DNA, 50 bp, homo sapien
tttaaaactgctaaaatgccctggasaactaataagaaaataaaaaatca

SEQ ID NO: 39205 - DNA, 50 bp, homo sapien
agggacatgatttctaacataaacckgaaggaataaagctaggcagtaaa

SEQ ID NO: 39206 - DNA, 50 bp, homo sapien
ttataatgagatgtcactacatacawtcctatcagatggactaaaataaa

SEQ ID NO: 39207 - DNA, 50 bp, homo sapien
tgagttccttccaaagagtatggtayggagaaggaaaagaaagagtaaat

SEQ ID NO: 39208 - DNA, 50 bp, homo sapien
acaatgtgagcaacacagacatgcayaaaacgtcaagcatggagacactt

SEQ ID NO: 39209 - DNA, 50 bp, homo sapien
agcaaataggtagaacctgttcatayagtacaaatgaggaaactgaagca

SEQ ID NO: 39210 - DNA, 50 bp, homo sapien
gctctactcatattgcaatatactgraaaacggaggattcctctaaagct

SEQ ID NO: 39211 - DNA, 50 bp, homo sapien
tagttcaatttctatatcacagttaycttccagagtatacttcaatattg

SEQ ID NO: 39212 - DNA, 50 bp, homo sapien
aaaaagcggtacctggggtaagatcygactgatgaagtggagttaattat

SEQ ID NO: 39213 - DNA, 50 bp, homo sapien
agtagatcccagaaagaactcaataygttatttattctagaaagctttct

SEQ ID NO: 39214 - DNA, 50 bp, homo sapien
aacaacctactggggagcctaaaagraagatcgctggacaatgagacttc

SEQ ID NO: 39215 - DNA, 50 bp, homo sapien
ctttattccttgaaaaactcatcaayctagtcccttcttcccccaaaagc

SEQ ID NO: 39216 - DNA, 50 bp, homo sapien
tcaacagtcatttgatagaataatasctgctgaggtcaactgcaagtcta

SEQ ID NO: 39217 - DNA, 50 bp, homo sapien
cttaacattgtgtgaactattacaaygaatataaaaatttaaaaacctag

SEQ ID NO: 39218 - DNA, 50 bp, homo sapien
tctgattgagaattatgtaaattcartacaatgtcagtttttaaaagtca

SEQ ID NO: 39219 - DNA, 50 bp, homo sapien
tagatgggtgggtgatggatagatgkagaaatagatgatgtgtgagtgga

SEQ ID NO: 39220 - DNA, 50 bp, homo sapien
cactgacctggaggtagatttagackaggattagcagctgtcccttctcc

SEQ ID NO: 39221 - DNA, 50 bp, homo sapien
tgagtgaaagcagtctccggagtccrgatcttggattacaagcttggctg

SEQ ID NO: 39222 - DNA, 50 bp, homo sapien
gcaggctcaagatccaagaagtgccyatttttcagtcaagtttgaaggca

SEQ ID NO: 39223 - DNA, 50 bp, homo sapien
agtgtcagcattttatgatcgctaaraaagaaaagtcatcattaataaga

SEQ ID NO: 39224 - DNA, 50 bp, homo sapien
tctgtggcacccaatgcttggtcaayaacaagccctttggggaatccttt

SEQ ID NO: 39225 - DNA, 50 bp, homo sapien
agctgggatggatcatttacaaagayacgctccatctccatacaggtagc

SEQ ID NO: 39226 - DNA, 50 bp, homo sapien
gctaatggaaatatttgggactcaakgtagttatttgctaagcagaaagg

SEQ ID NO: 39227 - DNA, 50 bp, homo sapien
ctaactgacagtttttcctgctgcawgaatagagaactacgttggggcaa

SEQ ID NO: 39228 - DNA, 50 bp, homo sapien
catgtgtcctctcacatactaaatcmatgttttaagcatgtgtctgaagg

SEQ ID NO: 39229 - DNA, 50 bp, homo sapien
caatggcaaataaaatgtatgtcacsatgagatctatgggaaataatagt

SEQ ID NO: 39230 - DNA, 50 bp, homo sapien
tccagctctagaggcacttgcatackcccctcacctacaccatccttgga

SEQ ID NO: 39231 - DNA, 50 bp, homo sapien
tttctctcacattgggtgactaggayggtgacattcttagggtgtttccc

SEQ ID NO: 39232 - DNA, 50 bp, homo sapien
cacctgtaaaatgtggacaatagaaktacaaagtgttagagttgtaagga

SEQ ID NO: 39233 - DNA, 50 bp, homo sapien
atctcctcttctattgtagagctcaracttacttgatttcaggacaagaa

SEQ ID NO: 39234 - DNA, 50 bp, homo sapien
actttcccacacgcttcccttactcwcatgatattgtttatatattagaa

SEQ ID NO: 39235 - DNA, 50 bp, homo sapien
ctaaaaaacaattagccactcattargccaagactttaattctatgatca

SEQ ID NO: 39236 - DNA, 50 bp, homo sapien
caactaaattaaaatcttctatttaygcaaagtaactctatgatgcaaat

SEQ ID NO: 39237 - DNA, 50 bp, homo sapien
cttttttaaaggatcagcggcatgaygaatttgtaagtatgctttttatt

SEQ ID NO: 39238 - DNA, 50 bp, homo sapien
gctatttgacaacatataaagggccrgctaattctacttgggaaattact

SEQ ID NO: 39239 - DNA, 50 bp, homo sapien
aacttgttttaactctttcaattcaytagggtgttatttagtaagttcac

SEQ ID NO: 39240 - DNA, 50 bp, homo sapien
aacgaaatgaacaaattttcggttayagatcagctctcaaacactaaagt

SEQ ID NO: 39241 - DNA, 50 bp, homo sapien
agaaaaacgtggtttaatgtgtttcyctggttattagaaatatgttattt

SEQ ID NO: 39242 - DNA, 50 bp, homo sapien
tgaggtcctaccctagggattaacckgaggatgaagacaataaaacccaa

SEQ ID NO: 39243 - DNA, 50 bp, homo sapien
tctggggtttcagaagtgattacaaygaagttctctaattgcttgtgtgt

SEQ ID NO: 39244 - DNA, 50 bp, homo sapien
cttatggattttggattatctgtagyatggtttcaggttattcagttccc

SEQ ID NO: 39245 - DNA, 50 bp, homo sapien
cctatgtattttcttatctcttttcraagtttagattctagggctctgta

SEQ ID NO: 39246 - DNA, 50 bp, homo sapien
agataatccaaaatccataagaaaasttagaaatgactcaccattttgag

SEQ ID NO: 39247 - DNA, 50 bp, homo sapien
catcctgtattgaattatacaggtcratgtctactctgatgactccagga

SEQ ID NO: 39248 - DNA, 50 bp, homo sapien
tggatttttccaaaatcagaccacaragatgaagacttgggtgccaggaa

SEQ ID NO: 39249 - DNA, 50 bp, homo sapien
cataccagtgagatttgttatcagcwcttcacttttagcatccacattcc

SEQ ID NO: 39250 - DNA, 50 bp, homo sapien
agaaacatgaaggatgaggaactcartaaaaaataaccaaagttaagtac

SEQ ID NO: 39251 - DNA, 50 bp, homo sapien
cttatacactgtatgtcctccaaagwaaggtataatggatcgtgaataga

SEQ ID NO: 39252 - DNA, 50 bp, homo sapien
aaaagatttgaacagatttttctcargactaaaggattatccaataagct

SEQ ID NO: 39253 - DNA, 50 bp, homo sapien
ttaggttacttgaactcttccattgyattgcaaagtcatgtttttataat

SEQ ID NO: 39254 - DNA, 50 bp, homo sapien
aggggatgatagtattagggtccaaycaaggagatggtataacatttaat

SEQ ID NO: 39255 - DNA, 50 bp, homo sapien
agataaatctttacacaacctaagakattccctttctagcaatggagtac

SEQ ID NO: 39256 - DNA, 50 bp, homo sapien
aaaaaaatagccagacgtaagtaaarattatgtatggttatttacatgag

SEQ ID NO: 39257 - DNA, 50 bp, homo sapien
ttcacagatacacactacagtatcayaggattttaatgttgagtagtatc

SEQ ID NO: 39258 - DNA, 50 bp, homo sapien
gttctgagtacatctgatttgcataygtcttagaaatatagtcattgtac

SEQ ID NO: 39259 - DNA, 50 bp, homo sapien
catttactcatcattatcagacaaayttcacgtttccaaactgcatttaa

SEQ ID NO: 39260 - DNA, 50 bp, homo sapien
ctaattagcatatttaaattagccargagatatagtaatcatctttatta

SEQ ID NO: 39261 - DNA, 50 bp, homo sapien
gcaaatgcactgaacttaggtcacgraagtgctacatttcttcttatcag

SEQ ID NO: 39262 - DNA, 50 bp, homo sapien
atacaaactccaacccatgagagaarctgcaagggctgaaccctggaaag

SEQ ID NO: 39263 - DNA, 50 bp, homo sapien
ctctccagttcatttcagttctttayctcagcaactgcaccaaattgcat

SEQ ID NO: 39264 - DNA, 50 bp, homo sapien
ttgctctgaggaccattgttgactcyctcttgttgaatataacccatata

SEQ ID NO: 39265 - DNA, 50 bp, homo sapien
ccacattctcaaccttgtgacattcmaatgtctgctaactgctttcttca

SEQ ID NO: 39266 - DNA, 50 bp, homo sapien
aatactggtgaacagtggtcaagaastagttttatattcctttaaaaaat

SEQ ID NO: 39267 - DNA, 50 bp, homo sapien
tgtggtaagaatatgtgaatgtcaayatcgaggagtttgttgaagtcaaa

SEQ ID NO: 39268 - DNA, 50 bp, homo sapien
catcacccttcttaaatggatacaaygacagaaattatttttcaaaaaag

SEQ ID NO: 39269 - DNA, 50 bp, homo sapien
gatagatttactgatatcagacaggwagaaggttttcgttttttgttttt

SEQ ID NO: 39270 - DNA, 50 bp, homo sapien
taataataggttatttcagtaaaaaktatgtcaaattaaatgttagaagt

SEQ ID NO: 39271 - DNA, 50 bp, homo sapien
gtttaggccatggagaggaaagtcastaattgtgttcagatttatagtga

SEQ ID NO: 39272 - DNA, 50 bp, homo sapien
ttcctcagagaagcctttttcatcaygtagcctaaatgaaacacctttgc

SEQ ID NO: 39273 - DNA, 50 bp, homo sapien
cctgcaaagatggtcccttcttttayacacatcgcattacttgaaatatc

SEQ ID NO: 39274 - DNA, 50 bp, homo sapien
gtataaagtgaaatgctagttgtaaygttttggccaagtcaaaaagtggg

SEQ ID NO: 39275 - DNA, 50 bp, homo sapien
cgggctgaatcaccatctagtcatayatttgttttacaaaattactaccc

SEQ ID NO: 39276 - DNA, 50 bp, homo sapien
actatgccctatcaagagatatgctyaagagagtttgaaaccaaaaagag

SEQ ID NO: 39277 - DNA, 50 bp, homo sapien
aatacttcttgggtgttaccgataasgcagtgccagaagttcttccctct

SEQ ID NO: 39278 - DNA, 50 bp, homo sapien
ttacatataagatttaaggtctgtayagaatccatgattttcctatcaaa

SEQ ID NO: 39279 - DNA, 50 bp, homo sapien
ctgcattgattcctaagagtgagatkaaaaagacgtcgaaagcctaggcc

SEQ ID NO: 39280 - DNA, 50 bp, homo sapien
atcacttctgttcacattttcttgcycaaaggaagactatggctgcattt

SEQ ID NO: 39281 - DNA, 50 bp, homo sapien
agcttctgacacaaagcctattttayaatgaagtgtcaaatatctcatgt

SEQ ID NO: 39282 - DNA, 50 bp, homo sapien
aatagccactcacattagtcaagcargctcttcataggcggatgctgaag

SEQ ID NO: 39283 - DNA, 50 bp, homo sapien
agtttagaaagagtcaaagcaagcayattggttactcaagtgtaataaga

SEQ ID NO: 39284 - DNA, 50 bp, homo sapien
ggataccgtgattcacaagaggcaayctctcacggaccagagccacaggt

SEQ ID NO: 39285 - DNA, 50 bp, homo sapien
tccttcattctgttaatattgggtcraatttgttcttcttttttagatcc

SEQ ID NO: 39286 - DNA, 50 bp, homo sapien
ttcctaagacctcaaagaagagaaarcagattgtctgaaaacaaaacaaa

SEQ ID NO: 39287 - DNA, 50 bp, homo sapien
aacagaatagctcttcatctaattgyaataatatgtgtgtagtcccgctt

SEQ ID NO: 39288 - DNA, 50 bp, homo sapien
cactcacccagagcatggccgcccawatttttacctgtggctctggtccg

SEQ ID NO: 39289 - DNA, 50 bp, homo sapien
ggtgaaaagcagctccaggctagacrcttgcggtggattcatgataatgc

SEQ ID NO: 39290 - DNA, 50 bp, homo sapien
cagttcagaaaactgggttcatgtcwacagattaacatcctaaaatgata

SEQ ID NO: 39291 - DNA, 50 bp, homo sapien
gtatattggactctatttgtgcatasgtactaaagattttatcatgtgtc

SEQ ID NO: 39292 - DNA, 50 bp, homo sapien
gggtttctcttgcactctgcttgatsagttatatgtcaagtgttctagac

SEQ ID NO: 39293 - DNA, 50 bp, homo sapien
tttcctataaaccatgcctctaagcmctttacagagcttctgtaagtaat

SEQ ID NO: 39294 - DNA, 50 bp, homo sapien
agaggatggattcaaacacactgtaratatgtattgagctactactactc

SEQ ID NO: 39295 - DNA, 50 bp, homo sapien
tttaattcagggactaatgtaatcargtttaccatgaaagcatttgagtt

SEQ ID NO: 39296 - DNA, 50 bp, homo sapien
aaagctggtaagaatttcttgctaawcctttgaaaataacatgacttcaa

SEQ ID NO: 39297 - DNA, 50 bp, homo sapien
catcatagaccttctggcccatgaarcctaaatttcctactctctggcct

SEQ ID NO: 39298 - DNA, 50 bp, homo sapien
aagatggaattcaatttggagaacarcatcgcttttgcataataaatgcc

SEQ ID NO: 39299 - DNA, 50 bp, homo sapien
gctaccttcaagagttagcctttccraataggtgttctgacttcccagga

SEQ ID NO: 39300 - DNA, 50 bp, homo sapien
atagtgcctttttaggctaaccagaygacagctaatgattttcatccaat

SEQ ID NO: 39301 - DNA, 50 bp, homo sapien
tctgttgtttatttacctatccaaaktattttgttattgcagcaggagca

SEQ ID NO: 39302 - DNA, 50 bp, homo sapien
gaaaaaaatattatcgcctgataacrcagctgacaacaaagatacaggca

SEQ ID NO: 39303 - DNA, 50 bp, homo sapien
agagctgatcacagtggtgaagacargaaaaccgtaaaatgcagactaaa

SEQ ID NO: 39304 - DNA, 50 bp, homo sapien
ggaaattaaactctaagttatccccyctgcttacgtgagacaaatgcata

SEQ ID NO: 39305 - DNA, 50 bp, homo sapien
gagcttctgtaagtaatacaattaargaatcatagaaacaggggagaaag

SEQ ID NO: 39306 - DNA, 50 bp, homo sapien
ctttgtcaattgcaattcagtgtccmggaattattacctgatataaaaat

SEQ ID NO: 39307 - DNA, 50 bp, homo sapien
actacgtacagccatgttgcctagamcgggtactctagaacataaactct

SEQ ID NO: 39308 - DNA, 50 bp, homo sapien
atggcccatgggactgtattgtaggmcaaacctgggagcttattagaaac

SEQ ID NO: 39309 - DNA, 50 bp, homo sapien
actgatcctttgaatcatatttgaarttaaatgcataccttaaatatgca

SEQ ID NO: 39310 - DNA, 50 bp, homo sapien
agccaggatagattatttgctattcyatagacctcctcttcactttccca

SEQ ID NO: 39311 - DNA, 50 bp, homo sapien
gggaagactattctggtagagagtayggttgaagcaaaatgaaggcggag

SEQ ID NO: 39312 - DNA, 50 bp, homo sapien
agagtacggttgaagcaaaatgaagrcggagaacacatcatagaaatagc

SEQ ID NO: 39313 - DNA, 50 bp, homo sapien
aaaaggaaatcactcaagaagaatayatagagagaaatcagtgaagcaat

SEQ ID NO: 39314 - DNA, 50 bp, homo sapien
agaaattttgatattctaactgcaamtgatgtctttcaaggtagggagcc

SEQ ID NO: 39315 - DNA, 50 bp, homo sapien
cttgacaatatgaacaaaagacctayatattcgtacagaccatcttatta

SEQ ID NO: 39316 - DNA, 50 bp, homo sapien
cagcactaagttcagtgatactaaasacatccaatccaaaacttattatc

SEQ ID NO: 39317 - DNA, 50 bp, homo sapien
tattctgctttctttattttctaccrcaactgaattctgagttcctaatc

SEQ ID NO: 39318 - DNA, 50 bp, homo sapien
gacctcaggtctcccaggcttgatayctttggtctttgaaactctgtcat

SEQ ID NO: 39319 - DNA, 50 bp, homo sapien
ttcaggtagagtcatataaactacaycaatattcccacctcttccttata

SEQ ID NO: 39320 - DNA, 50 bp, homo sapien
cccaggattctctggagaaacgttgsaggtagtgccgagagagtctgctg

SEQ ID NO: 39321 - DNA, 50 bp, homo sapien
attgaggtcataattgctttataatragggacaattaactgtttatagca

SEQ ID NO: 39322 - DNA, 50 bp, homo sapien
tttccacattgaccatagctgtgccsataatcagaaacaattattggtgc

SEQ ID NO: 39323 - DNA, 50 bp, homo sapien
ctgtaaaagacgaatgagacaaagargagcagaaaagtgagagtatgagg

SEQ ID NO: 39324 - DNA, 50 bp, homo sapien
tgatgagtctagtgagaaaccagaarcccagggaatccttgctgcaatgg

SEQ ID NO: 39325 - DNA, 50 bp, homo sapien
tttttcctttcttctcttcctactasgtcttaagtcctctaggcatacaa

SEQ ID NO: 39326 - DNA, 50 bp, homo sapien
aaagtttttcctttattctgaagtcrcaatctccaaagttatcagaatct

SEQ ID NO: 39327 - DNA, 50 bp, homo sapien
ctaaaacttaggttagtgaaaaagartattaactttgaagtcagaagaca

SEQ ID NO: 39328 - DNA, 50 bp, homo sapien
ttgtaatttagccttaaccttactakatttaaatcctggagcaaagaaca

SEQ ID NO: 39329 - DNA, 50 bp, homo sapien
attgatggtataatggtaagcaaaartcacaaatgtcaaggaagcaaaaa

SEQ ID NO: 39330 - DNA, 50 bp, homo sapien
atttgatagtttaataaaatttagargcaatctcaaacttacagcaaagt

SEQ ID NO: 39331 - DNA, 50 bp, homo sapien
atcttttttctacacttctagatacrctacaatgggtctctgatgataaa

SEQ ID NO: 39332 - DNA, 50 bp, homo sapien
tttacatggaaaaatactataatgarctaaactaccacccaaggcattct

SEQ ID NO: 39333 - DNA, 50 bp, homo sapien
tattatcaagtattatggtattatgyactgtatagaaatgtatgtgctct

SEQ ID NO: 39334 - DNA, 50 bp, homo sapien
cctcaactttgcttctgcttaatgaraaaaggtaacaaatccccttggtg

SEQ ID NO: 39335 - DNA, 50 bp, homo sapien
taaccaacaaggtcctttcaacatcraaaattttttaagttctctatcta

SEQ ID NO: 39336 - DNA, 50 bp, homo sapien
agggcctgaatgtgcctaacttaggraaaggagcaggaagtatgtattat

SEQ ID NO: 39337 - DNA, 50 bp, homo sapien
caagatggaggagataaatagttacsatgctgttgaaagttcgtgtatgt

SEQ ID NO: 39338 - DNA, 50 bp, homo sapien
tatctctttaaaataatttagaacamgtaatggctgcagaaccttaaagg

SEQ ID NO: 39339 - DNA, 50 bp, homo sapien
actgtgccagtcccagagaatctgckaagaaagttcttgaaaagtagaga

SEQ ID NO: 39340 - DNA, 50 bp, homo sapien
ctgagcttgggcggtgggaaggtcckcagacatctggtacaagaagggct

SEQ ID NO: 39341 - DNA, 50 bp, homo sapien
cagcttcttgatttctgggataagartacataaattactacaacaaagtt

SEQ ID NO: 39342 - DNA, 50 bp, homo sapien
agaaagacaatgggaaatgacaatcratgaacccattctcatagaaatcc

SEQ ID NO: 39343 - DNA, 50 bp, homo sapien
acctggccacctgggcacctctcctsaacatctgggtgaaggacaaaggg

SEQ ID NO: 39344 - DNA, 50 bp, homo sapien
ccctagtgtgatgacactcaacaaaygggtaccgactgaaattgaaatga

SEQ ID NO: 39345 - DNA, 50 bp, homo sapien
aagcaactgcaggatgagactggccraaaagagttggttagcctgagact

SEQ ID NO: 39346 - DNA, 50 bp, homo sapien
tcctttgtgaagcgtttcttttgccrccaggtagagttagctcacttctc

SEQ ID NO: 39347 - DNA, 50 bp, homo sapien
gcctaatgaaatatgatttggtaaamtatgaagcataaaatataaaattt

SEQ ID NO: 39348 - DNA, 50 bp, homo sapien
atagtggtggttaggattataaaaaygctttagctgatttccctggtact

SEQ ID NO: 39349 - DNA, 50 bp, homo sapien
atgggaccggcataggcaagagaccmgatttgctaaaccagctatagtac

SEQ ID NO: 39350 - DNA, 50 bp, homo sapien
ctttaaggagcttatggtagagttaragaaaagaatgcacaactgaattc

SEQ ID NO: 39351 - DNA, 50 bp, homo sapien
tcagtcctgctaccctggccaaaaaratgactgaaccaggatctatgcct

SEQ ID NO: 39352 - DNA, 50 bp, homo sapien
ccctggaggagtctaagtagagtgaygaactataggaagaaagactgagt

SEQ ID NO: 39353 - DNA, 50 bp, homo sapien
aagaaggcgcttatcagatgggaccrgcataggcaagagaccagatttgc

SEQ ID NO: 39354 - DNA, 50 bp, homo sapien
agaggacgtttgtaggactgcccagyagagtttattagtttatagaaatt

SEQ ID NO: 39355 - DNA, 50 bp, homo sapien
tgaagaaccttatagtttaattggasagatgtgatagtgtgtttgacaaa

SEQ ID NO: 39356 - DNA, 50 bp, homo sapien
gcaacatttactattcgtgaagtcgyccctccataatttttaagtctttc

SEQ ID NO: 39357 - DNA, 50 bp, homo sapien
tagagtaattcagttattgatttgtkaaattctgaagaacataactggaa

SEQ ID NO: 39358 - DNA, 50 bp, homo sapien
agtttagctgagctatgaattagagraggaatttggtaaatctagcttta

SEQ ID NO: 39359 - DNA, 50 bp, homo sapien
aaaccagtaagtagctatgactttasagtgatagggcctgaacattttca

SEQ ID NO: 39360 - DNA, 50 bp, homo sapien
gcacagagttttggttctaatagacrcaacaaaggtgcaggaaaaggcac

SEQ ID NO: 39361 - DNA, 50 bp, homo sapien
tgagcctattgtattcagtgtattayatgcaggcctgggtgtggatggga

SEQ ID NO: 39362 - DNA, 50 bp, homo sapien
tttattgaactagagagagtatcaaratcaaagactctgaagggaaaata

SEQ ID NO: 39363 - DNA, 50 bp, homo sapien
gacttgcagttttaattctctgacawctgatcactgcagtcttttaaatc

SEQ ID NO: 39364 - DNA, 50 bp, homo sapien
acaaaagtaattcctctttcagtgaygctttactagctgttcataggtac

SEQ ID NO: 39365 - DNA, 50 bp, homo sapien
taaatctaaaaacacagattagagcyatattcattaggaccttgagtgag

SEQ ID NO: 39366 - DNA, 50 bp, homo sapien
acttcaagtgttttaaatatattaargagtacttatgctatgtgtgtaga

SEQ ID NO: 39367 - DNA, 50 bp, homo sapien
tcaacaaacaccataatataagtccrctaatcatgagggacatgtatgat

SEQ ID NO: 39368 - DNA, 50 bp, homo sapien
gtatttaaactaggactttatttcamgtggtggctcaactattacactaa

SEQ ID NO: 39369 - DNA, 50 bp, homo sapien
gtgaagaaacagatttctagttaaaygctcccgggttgcatgcttttcta

SEQ ID NO: 39370 - DNA, 50 bp, homo sapien
gctattgaaagagtaagagtaaagargaaagtctgtgaatgctgaaaatg

SEQ ID NO: 39371 - DNA, 50 bp, homo sapien
cttctatgtgctcaaaggctcaagayaaagaggaattagtttaaagaaat

SEQ ID NO: 39372 - DNA, 50 bp, homo sapien
caactgaagctaagcattccagtccygctgaactgagctgctcccaccct

SEQ ID NO: 39373 - DNA, 50 bp, homo sapien
tagtaactggtgctatgtcctgtacraactataaacacttactgattgtc

SEQ ID NO: 39374 - DNA, 50 bp, homo sapien
cgtgaaccaccgtgcctggccttgamtattttgtaataatacttggctta

SEQ ID NO: 39375 - DNA, 50 bp, homo sapien
caatctaagggtaatgtttcttctayagcatgacagcatctctcacaaac

SEQ ID NO: 39376 - DNA, 50 bp, homo sapien
accagaataccagtcttgagatttaycctgattaaactatttaggttaca

SEQ ID NO: 39377 - DNA, 50 bp, homo sapien
tatttgtagacaatgacactgaggcrcaaacatgttaagtgcctttctaa

SEQ ID NO: 39378 - DNA, 50 bp, homo sapien
caaattctcaaatatgtagctagcaygtcagaaagaatactaactggaga

SEQ ID NO: 39379 - DNA, 50 bp, homo sapien
gtaccactctgcacatatgctaaaarccaccagattgttgtacacattaa

SEQ ID NO: 39380 - DNA, 50 bp, homo sapien
gtctagttgggtttcagtcattagaycacagtgccaacttcagccttgtg

SEQ ID NO: 39381 - DNA, 50 bp, homo sapien
tctcaggggcatcatagagataggcrctgtttgaattcatgtctgtccca

SEQ ID NO: 39382 - DNA, 50 bp, homo sapien
caaatatattttcatggagtttcaasaaagatgagaaattctatgcatat

SEQ ID NO: 39383 - DNA, 50 bp, homo sapien
atacatttgcttttaatgattgttgsacttttagtctattagttgaacat

SEQ ID NO: 39384 - DNA, 50 bp, homo sapien
gataatgtattattaatatctttaayctctcactcaaggtcctaatgaat

SEQ ID NO: 39385 - DNA, 50 bp, homo sapien
gagaagagtgggtcttgtcttatacyacccaggaatggaaacattagtag

SEQ ID NO: 39386 - DNA, 50 bp, homo sapien
ctattatgtattatgttaaatgtcakggaagatacagagatgaaccaaaa

SEQ ID NO: 39387 - DNA, 50 bp, homo sapien
gttagggttttggcatcttttctcargaaagtcaaagaaactctcttcct

SEQ ID NO: 39388 - DNA, 50 bp, homo sapien
attttggtgtgcatggtctgttaaartagtgggtctatagctttcagcag

SEQ ID NO: 39389 - DNA, 50 bp, homo sapien
ttcaaaacttcagccacaggagtacyatgaacaggcgtggatctactgct

SEQ ID NO: 39390 - DNA, 50 bp, homo sapien
gaaaacctgctttggaatattattgwaatcctagtccgtgtcacacccaa

SEQ ID NO: 39391 - DNA, 50 bp, homo sapien
gattttccaagctgggtaagtagtaygtaactgtatggtgtaaaaacatg

SEQ ID NO: 39392 - DNA, 50 bp, homo sapien
accctctggaaacaaaatctgctaayaacctaatggtcaagggtcactgc

SEQ ID NO: 39393 - DNA, 50 bp, homo sapien
tttggatttctaacttgatcaaaggmaaacccatgcaagaatggccagag

SEQ ID NO: 39394 - DNA, 50 bp, homo sapien
aaaggtcactctccaatgcacagaaycgatgggtagaggcttttgctatt

SEQ ID NO: 39395 - DNA, 50 bp, homo sapien
tcaaggacagttattcagtaagtcartaagggttatacctaaacttcaag

SEQ ID NO: 39396 - DNA, 50 bp, homo sapien
tacagaatatgggtaaccatgtacaycatcaattaatagctaagttaaac

SEQ ID NO: 39397 - DNA, 50 bp, homo sapien
gggccttagaataatatgagtatgasaaaaacaaacaaaatttttaaaaa

SEQ ID NO: 39398 - DNA, 50 bp, homo sapien
ctatgcacatttaaagactatgaagyaatggttaacacttaagagctgaa

SEQ ID NO: 39399 - DNA, 50 bp, homo sapien
gtcttaggtttgtgctttgggataaktcaagtcaagctattttataggac

SEQ ID NO: 39400 - DNA, 50 bp, homo sapien
tctctagtcattgatcttccagaagwacaatagctataaataagtcacca

SEQ ID NO: 39401 - DNA, 50 bp, homo sapien
tatatagtaaaacaattgaagagtcycttggattttgctgtaagggactt

SEQ ID NO: 39402 - DNA, 50 bp, homo sapien
aatgggaatatataatctaaccttaygaaatgagttagaagaataatgca

SEQ ID NO: 39403 - DNA, 50 bp, homo sapien
aagttgtttattcacagaagcactamaaccaaagaaaagtatgtgtttta

SEQ ID NO: 39404 - DNA, 50 bp, homo sapien
atttcattggtaataggaatggacawaatttaccctgggaaacttggctt

SEQ ID NO: 39405 - DNA, 50 bp, homo sapien
agttatagaagaagtacatcttacawaactgtgtgaacaattaagttgca

SEQ ID NO: 39406 - DNA, 32 bp, homo sapien
tgctccatattattccmaagatacatttatat

SEQ ID NO: 39407 - DNA, 50 bp, homo sapien
aaattaatgtttttatatagggagaractcataagcacattaaaagttca

SEQ ID NO: 39408 - DNA, 50 bp, homo sapien
ttaacaataaggtaggagtgagatakaaatcttttttcgttttgagccac

SEQ ID NO: 39409 - DNA, 50 bp, homo sapien
actctagttactgacagacccaaaamgttcttgacagtgtattttgagta

SEQ ID NO: 39410 - DNA, 50 bp, homo sapien
ccttttgagggtaacgtttgggaaaygagcattctgagaatttggggtgg

SEQ ID NO: 39411 - DNA, 50 bp, homo sapien
cctcatgattttctaaaaatccaccracagtgaggtcattcgttcctaaa

SEQ ID NO: 39412 - DNA, 50 bp, homo sapien
tcccagctggcaccctttctgttaaygatctcttcccacagttgtagaac

SEQ ID NO: 39413 - DNA, 50 bp, homo sapien
tgtgatgctcctgaaaactagactartagaaatctccatgatagatatca

SEQ ID NO: 39414 - DNA, 50 bp, homo sapien
tttagatattatagattccaaaaaayttaacagagagtttgtggtggtgt

SEQ ID NO: 39415 - DNA, 50 bp, homo sapien
caagtaagataactttccttagaaamaggtctgcaaatctgccgtgaatt

SEQ ID NO: 39416 - DNA, 50 bp, homo sapien
ttttataaaaattcaatttgtctagsatctagtttttgcaggggctgata

SEQ ID NO: 39417 - DNA, 50 bp, homo sapien
tcaaagtggggaaggtagagaaaaaragattatggagtagtgaagagagc

SEQ ID NO: 39418 - DNA, 50 bp, homo sapien
ctgtttagtaatagctttccttattraaaccattgtgttccattttataa

SEQ ID NO: 39419 - DNA, 50 bp, homo sapien
tgcaacctataggtactctatattcrcgcttcttttggtataaattctca

SEQ ID NO: 39420 - DNA, 50 bp, homo sapien
cacctgtccaggacacaaagtaaccratatttccatagactctattgaca

SEQ ID NO: 39421 - DNA, 50 bp, homo sapien
tcatgcttttttcaaggatttggaaygatagagcagtttctggtggtaaa

SEQ ID NO: 39422 - DNA, 50 bp, homo sapien
gtttctctatatgtcaaaggagcaarggtgacaactctccaaagctttcc

SEQ ID NO: 39423 - DNA, 50 bp, homo sapien
tatttcaacttagtccaggtatccaygaaggctttcttttacagcttgtg

SEQ ID NO: 39424 - DNA, 50 bp, homo sapien
tggatacctggactaagttgaaataygttactccgtaagacacaaaagga

SEQ ID NO: 39425 - DNA, 50 bp, homo sapien
tctacaggctctccaatctagagaaytcttgtgcagcaccaaataacaga

SEQ ID NO: 39426 - DNA, 50 bp, homo sapien
aactttcaaactacagcatggacatraacatttgatacctaggaatctct

SEQ ID NO: 39427 - DNA, 50 bp, homo sapien
ctgggcagttagattctcactttatyaagttttgtggattttcataatta

SEQ ID NO: 39428 - DNA, 50 bp, homo sapien
ccagttttcactgattgcaaaagtcyataatgtctctatgaaatgctaaa

SEQ ID NO: 39429 - DNA, 50 bp, homo sapien
actggaacatctctcagatccttaamagtgattccaaacaatgtaagaaa

SEQ ID NO: 39430 - DNA, 50 bp, homo sapien
tggaaattgactaatccaatagtatragtcactacagctaatgctgaatg

SEQ ID NO: 39431 - DNA, 50 bp, homo sapien
tataagctttatgtcaggaatgggasacaaagactaaataggtatttttt

SEQ ID NO: 39432 - DNA, 50 bp, homo sapien
ttgactcagtacaagtgtgctttaamtagtctctccagaactggttcacc

SEQ ID NO: 39433 - DNA, 50 bp, homo sapien
attctgtgtaaccgtgggaaaagaartaatggtgttgggaaaattcagtg

SEQ ID NO: 39434 - DNA, 50 bp, homo sapien
ctgtctgatctgtgccagagctaagragaatggaatctggcagaccctag

SEQ ID NO: 39435 - DNA, 50 bp, homo sapien
caaaacttttgacacactacccaccratttttatgcgttaactgtggttt

SEQ ID NO: 39436 - DNA, 50 bp, homo sapien
ttcaaacccctttagttttataaagsctaatttacaacactaggtaagga

SEQ ID NO: 39437 - DNA, 50 bp, homo sapien
atatccaactcagttgaaactgctamataaaaggacaacccaaaaggtca

SEQ ID NO: 39438 - DNA, 50 bp, homo sapien
aatattaaagtccacactcactttgmaacttatgtgtgacttggccaaaa

SEQ ID NO: 39439 - DNA, 50 bp, homo sapien
taaagttgaatcagtaaaaatgacawggtcacaagacagatgttcttaat

SEQ ID NO: 39440 - DNA, 50 bp, homo sapien
tcttgtttctatagctcaggattcaytccctttctctaattcttctcagc

SEQ ID NO: 39441 - DNA, 50 bp, homo sapien
ggctacagaaagttatcaaaatggawgagaaatgataaaaagaagaaata

SEQ ID NO: 39442 - DNA, 50 bp, homo sapien
acagtgaaaaaggtaagtcctcaggkaacataataacctcagtctatgaa

SEQ ID NO: 39443 - DNA, 50 bp, homo sapien
ctactctttgttcagacagtagagayggcccttcttagaacagcagagat

SEQ ID NO: 39444 - DNA, 50 bp, homo sapien
agcctgtaatcatattttttcatcarcttcaattgtagtttgcaagactg

SEQ ID NO: 39445 - DNA, 50 bp, homo sapien
attttctactcaatcagctttggtaygtattcagtgttttccctcaaggt

SEQ ID NO: 39446 - DNA, 50 bp, homo sapien
actttttaaattctctcccatggacrcatttataccttaaaactttgcct

SEQ ID NO: 39447 - DNA, 50 bp, homo sapien
taatttttttcccattaaaaaagacwacattgaatgctgagaataaaatg

SEQ ID NO: 39448 - DNA, 50 bp, homo sapien
ggcagaaaaccaacagaatgttataygttactcattttcaacttagtgtg

SEQ ID NO: 39449 - DNA, 50 bp, homo sapien
ttagacatgaaagaaagtaaggtgaragctcagagatttctgcctttggc

SEQ ID NO: 39450 - DNA, 50 bp, homo sapien
taataaggtttttaagactttatcayggtgcctaccaagaatgcaataga

SEQ ID NO: 39451 - DNA, 50 bp, homo sapien
atttcttcttcctggactacgcagcrctataataaactacatggttggtt

SEQ ID NO: 39452 - DNA, 50 bp, homo sapien
cttagaagtccagacatttaacttayagtgtaatatttaagcgtagaagt

SEQ ID NO: 39453 - DNA, 50 bp, homo sapien
gctgaggaactattctgattgaaagycattatatgcattaaattatttag

SEQ ID NO: 39454 - DNA, 50 bp, homo sapien
tgcaaatgacactaggatgttcttayaacttttatgtgctcatctataat

SEQ ID NO: 39455 - DNA, 50 bp, homo sapien
ggagttgctgtatcccagtaaaatarcaagcagtaaaaagcgaaataaaa

SEQ ID NO: 39456 - DNA, 50 bp, homo sapien
attgattaataaaggcacagaactaygaatatccaaaggaaaaataacat

SEQ ID NO: 39457 - DNA, 50 bp, homo sapien
taggcccggctgcttcctgattggcraagagtgaaaaacctttctgtatc

SEQ ID NO: 39458 - DNA, 50 bp, homo sapien
acctctggttcttttcagatttaaasaaagcaattataaaaaagaaagac

SEQ ID NO: 39459 - DNA, 50 bp, homo sapien
gctataactgttctgaggcaatatgragcctgatataaattaagatggta

SEQ ID NO: 39460 - DNA, 50 bp, homo sapien
gaagagactgagccactcatggtaaygttaaagtaaaaagctttggcggg

SEQ ID NO: 39461 - DNA, 50 bp, homo sapien
atccatttagtgtgcttatgtaaaayggcttcttccacctctgaaataac

SEQ ID NO: 39462 - DNA, 50 bp, homo sapien
gcagtttagaggtccttaatgaatcsacaaacagtcctacaaacttaaaa

SEQ ID NO: 39463 - DNA, 50 bp, homo sapien
aagtctgcaataacaacatgcttcayccttctgctaaagtgtatcctctc

SEQ ID NO: 39464 - DNA, 50 bp, homo sapien
tcctgagaataaagtacagttaatcraattttacagctgatatttataaa

SEQ ID NO: 39465 - DNA, 50 bp, homo sapien
tgaatatttattgatattattcaatmagtgcatagaactatgtatttact

SEQ ID NO: 39466 - DNA, 50 bp, homo sapien
atgggctttcagaatattaacagaaytggctggatagcgaggctggcctc

SEQ ID NO: 39467 - DNA, 50 bp, homo sapien
tcattatttccacattgaaagaccaytcatttttgtatgttgatattgta

SEQ ID NO: 39468 - DNA, 50 bp, homo sapien
ttgtttatattttcaggtaacatgakaattagactgatagaactcttcta

SEQ ID NO: 39469 - DNA, 50 bp, homo sapien
caatctcacttcccaaaggacagaarataagaaacaggttgtcagattaa

SEQ ID NO: 39470 - DNA, 50 bp, homo sapien
aaaaacagtagggaagataatctcaygctgttaacgttttggtatatctt

SEQ ID NO: 39471 - DNA, 50 bp, homo sapien
gcctcctattacctcattggagttaygtttcagagttccgacagggaaga

SEQ ID NO: 39472 - DNA, 50 bp, homo sapien
agaaaagtatatagagaggaataaaytagggcataaaaatatcttttatt

SEQ ID NO: 39473 - DNA, 50 bp, homo sapien
ggggagatacatttgttagaatttarccttttcataataaatgtttcttt

SEQ ID NO: 39474 - DNA, 50 bp, homo sapien
attaaaaaataaaaatattatccaayaaagtgttcataaaggtaatagtg

SEQ ID NO: 39475 - DNA, 50 bp, homo sapien
tcatttcatctctcagatttatttaycatacctgaatgatgaggctagat

SEQ ID NO: 39476 - DNA, 50 bp, homo sapien
tagtgaaactgagacagaaaaattargcgaatggcatttaactttttaaa

SEQ ID NO: 39477 - DNA, 50 bp, homo sapien
gacatatggaatgtaccaatattaamaaattctgattcttatttaggaca

SEQ ID NO: 39478 - DNA, 50 bp, homo sapien
cttgaatgtttcaaataaagttaaaragtgcatctatgtatagcttgatt

SEQ ID NO: 39479 - DNA, 50 bp, homo sapien
gctagagttaagtcaagcaatttcckcattaacaattattttgggcatgc

SEQ ID NO: 39480 - DNA, 50 bp, homo sapien
aaaataatcaaggaaataccattccraacattggctctggcaaggatttc

SEQ ID NO: 39481 - DNA, 50 bp, homo sapien
attaagtatctaaaagtatagaatayatgaaattaaataactgaacttta

SEQ ID NO: 39482 - DNA, 50 bp, homo sapien
cagacttccccatgcactacagtaasaactcaattttctgcataatgtgt

SEQ ID NO: 39483 - DNA, 50 bp, homo sapien
caattatctagtatagcagttttaargctatgtatcactgaatgccatcc

SEQ ID NO: 39484 - DNA, 50 bp, homo sapien
cgatgatgatgaccaacactatgtayaaggcattgttctcaccatgccac

SEQ ID NO: 39485 - DNA, 50 bp, homo sapien
tcataaatgtcaacccttaaaagtaycttagcaattatctagtatagcag

SEQ ID NO: 39486 - DNA, 50 bp, homo sapien
ttgaacggcctatatggtaggactawatacgttacattccaacaagatac

SEQ ID NO: 39487 - DNA, 50 bp, homo sapien
acacaattttgttaaataattgaacrgcctatatggtaggactaaatacg

SEQ ID NO: 39488 - DNA, 50 bp, homo sapien
ctctctgactctgaatttcctcatargtaagaatgggggtagtggaaaac

SEQ ID NO: 39489 - DNA, 50 bp, homo sapien
caacttatgcgtatctcaagttgtayaagtttgctgcacagataatttta

SEQ ID NO: 39490 - DNA, 50 bp, homo sapien
aatttgagctagcgtaacaaattaayttaaaaagtgtcctcctccctacc

SEQ ID NO: 39491 - DNA, 50 bp, homo sapien
atgattgtcaaaacctccttgtgtgraaggtgcagtcagaccactcaaag

SEQ ID NO: 39492 - DNA, 50 bp, homo sapien
acctatcacactctgccaattttgaygggaaaccaaagtacaaacactga

SEQ ID NO: 39493 - DNA, 50 bp, homo sapien
ggtagtatcactcaaaaattagttaycatctgcatgagttcttcttcatg

SEQ ID NO: 39494 - DNA, 50 bp, homo sapien
cagaaaagaaaactcagtcttgaccrggaggagatgtctttgtaagaggc

SEQ ID NO: 39495 - DNA, 50 bp, homo sapien
gtcattgattagatcaagacaaatayggaactgtccattgcagttgtgtg

SEQ ID NO: 39496 - DNA, 50 bp, homo sapien
tgggatagataagaagttcttaagaraaagaatggtttatgaatggtgga

SEQ ID NO: 39497 - DNA, 50 bp, homo sapien
ggatgaactaatgtgcaaaggattcyctcgcacatagatgccttaacacc

SEQ ID NO: 39498 - DNA, 50 bp, homo sapien
acaataattaaatgtttatatggtckaagctcttgttgttagagtattct

SEQ ID NO: 39499 - DNA, 50 bp, homo sapien
agtcattattgcacattgtaggggarataatctgtgacttttcctttcct

SEQ ID NO: 39500 - DNA, 50 bp, homo sapien
cagagaggagtcgagttctcaacaaytaagatttatcctttagtaaattt

SEQ ID NO: 39501 - DNA, 50 bp, homo sapien
tttaaggagtagcatcaattggaaaygtgagcaagaaagagaaagaagtc

SEQ ID NO: 39502 - DNA, 50 bp, homo sapien
aacattatgtaagaaaaataataaaygagctcttcaggtagtgatgatcc

SEQ ID NO: 39503 - DNA, 50 bp, homo sapien
ggagagaggataccagagaacagcgycagtttccctctgagtcagacact

SEQ ID NO: 39504 - DNA, 50 bp, homo sapien
ttgatgtgtttaagcacacacagtawcggaaaactcaactaacagtacac

SEQ ID NO: 39505 - DNA, 50 bp, homo sapien
taaaacaaagaaagatatacatgacygaattggatatctttgtttgtttg

SEQ ID NO: 39506 - DNA, 50 bp, homo sapien
ttcctagaaagttcccttttatctcrccagaggaaggcttgttcctagat

SEQ ID NO: 39507 - DNA, 50 bp, homo sapien
gcctacaattttcaccttaatcctaycaggtcctgaagaaatttttccag

SEQ ID NO: 39508 - DNA, 50 bp, homo sapien
tgtagtacaatttgtgaatgtctaakctcaatcatgctgtgacatgtgga

SEQ ID NO: 39509 - DNA, 50 bp, homo sapien
attgagctgctgggattggacaaaargatggataagctggtcccaaagat

SEQ ID NO: 39510 - DNA, 50 bp, homo sapien
ggaaaatactccctagctgaaatacracatacatatacccatacaatcat

SEQ ID NO: 39511 - DNA, 50 bp, homo sapien
ggagggaaatatgattcaccagttaycaattccaggtgaaggctcatacc

SEQ ID NO: 39512 - DNA, 50 bp, homo sapien
gaaaaaaacatttctacaacatttamctctgagtagaaagcaggggcctt

SEQ ID NO: 39513 - DNA, 50 bp, homo sapien
gatggggaaagaatattcctataaawgttactacagcagtgctacttgct

SEQ ID NO: 39514 - DNA, 50 bp, homo sapien
ccctgggtcatagatatgtgagttamatgatttactttgagtaaggctca

SEQ ID NO: 39515 - DNA, 50 bp, homo sapien
tctggcttcattgctatataatccastagttcggtctgcataatatttat

SEQ ID NO: 39516 - DNA, 50 bp, homo sapien
tgtaggggtcttcatagttgcattckctaagtcctgtgagaagctaagaa

SEQ ID NO: 39517 - DNA, 50 bp, homo sapien
atcctgagcttctcatgtactacaayctatttggataaaaaaatgtatat

SEQ ID NO: 39518 - DNA, 50 bp, homo sapien
tataccagcgatactgatgctattaygcttatccataggcaagcaagttt

SEQ ID NO: 39519 - DNA, 50 bp, homo sapien
ataaaatgttatccatgattgtaacrcgaaataaagatttgctcaaggga

SEQ ID NO: 39520 - DNA, 50 bp, homo sapien
gcaaagcttctaacatccaggatcayataatgtatcaaaaaattaaaata

SEQ ID NO: 39521 - DNA, 50 bp, homo sapien
atttctttcattttgtctaatcgaamaaatttatgcaaagaattggggac

SEQ ID NO: 39522 - DNA, 50 bp, homo sapien
atagacattgttgtatctgcgtttamatcacaagtctatatcaattagtt

SEQ ID NO: 39523 - DNA, 50 bp, homo sapien
cacagagaccagttcttgaaaaacawgattccttctccatgttaagacta

SEQ ID NO: 39524 - DNA, 50 bp, homo sapien
ccaaaagtgttatctgactcatctcmagtatgctgggtagctcttatgca

SEQ ID NO: 39525 - DNA, 50 bp, homo sapien
gtggcccagacacgtgactacaaagmcctacaaagacaatttctcttcat

SEQ ID NO: 39526 - DNA, 50 bp, homo sapien
gacatcaaggactaaaaaattatgcyaaggtaaagatgaaattatctcta

SEQ ID NO: 39527 - DNA, 50 bp, homo sapien
ttctgttaactttacagggaattacmaagttgggaaaagcagtcagcatt

SEQ ID NO: 39528 - DNA, 50 bp, homo sapien
tccctagcagaaagtagtactgtaaytattaaaatgtccaccatgggtta

SEQ ID NO: 39529 - DNA, 50 bp, homo sapien
tgaaaaacaaattatcgattcagtaraccaataagatgttaaatttcaga

SEQ ID NO: 39530 - DNA, 50 bp, homo sapien
gtggttaattttgaatccttcactcraatggttaagaactcaaaaccctg

SEQ ID NO: 39531 - DNA, 50 bp, homo sapien
gttaaaaaactagcccaagttcatcragttactgcatgatagagtttgag

SEQ ID NO: 39532 - DNA, 50 bp, homo sapien
tgattattagtttcttctgttctacrctttaacccaaatgaaaagggggg

SEQ ID NO: 39533 - DNA, 50 bp, homo sapien
taaattggaaagaatgtttattgcargattataattcccagtatacatcc

SEQ ID NO: 39534 - DNA, 50 bp, homo sapien
tttatatgtgacaatgtttcctttaygatttttgtactaaataaaccaaa

SEQ ID NO: 39535 - DNA, 50 bp, homo sapien
ctatgtgtcacatgaaaagtgtagcmcaattaggtagcaagagctgccga

SEQ ID NO: 39536 - DNA, 50 bp, homo sapien
agaagtcataatcatttttctagatwaggacaatgttaaaagttatccag

SEQ ID NO: 39537 - DNA, 50 bp, homo sapien
ttcttatagtataaattcctgaaaayggttctcattgttaatattcacac

SEQ ID NO: 39538 - DNA, 50 bp, homo sapien
gctcgggtataggacaacgaagagaygtatcacgtgacattagggacaac

SEQ ID NO: 39539 - DNA, 50 bp, homo sapien
atgccttaagccgcaaatggcagctractgtggaaaagtactaaataaac

SEQ ID NO: 39540 - DNA, 50 bp, homo sapien
ctgtaacctaacacaaaagtcatcastaagtaatacataagaatgtgtaa

SEQ ID NO: 39541 - DNA, 50 bp, homo sapien
ctgttccatttagtctgaactatccrctcttggaaaacaaaaatgaacac

SEQ ID NO: 39542 - DNA, 50 bp, homo sapien
ttaaatcctccacacacagtctcaaygtctgtttatattatgcttttcca

SEQ ID NO: 39543 - DNA, 50 bp, homo sapien
tgtcctcaaacaacacatgtttgaaytgtgaaggtccacctgtacacaaa

SEQ ID NO: 39544 - DNA, 50 bp, homo sapien
tcatcagaaagatgactttttatccmatctattcattgtgatgcttagtt

SEQ ID NO: 39545 - DNA, 50 bp, homo sapien
cagtttcttgcatgtatcttgtgacygtactccatacccaggaaactacg

SEQ ID NO: 39546 - DNA, 50 bp, homo sapien
acaccatgtcacgctagcatgtagayggaaattcttttgtattgatgtac

SEQ ID NO: 39547 - DNA, 50 bp, homo sapien
tgaaaatcaagttacaatgccagtcygacccgtgtgcctgacatacgttg

SEQ ID NO: 39548 - DNA, 50 bp, homo sapien
tcctttggtaactgcttgtaccaggyatcacggtaaacactgactgggga

SEQ ID NO: 39549 - DNA, 50 bp, homo sapien
atttcatgtttattaattcctcaacracaggaaaaatacttgatactttt

SEQ ID NO: 39550 - DNA, 50 bp, homo sapien
gtgttgtatagaatagttaacatacyaagatgcctcctaaaaactcagaa

SEQ ID NO: 39551 - DNA, 50 bp, homo sapien
aatgtggctgcgctcaagaaatatayagattaaaggagagttaaactatg

SEQ ID NO: 39552 - DNA, 50 bp, homo sapien
gatctatataggacaggttcagtaaragtatcaagtatttttcctgttgt

SEQ ID NO: 39553 - DNA, 50 bp, homo sapien
aagttatctttataaaacaccttgayaattgtttcctttttgcatatata

SEQ ID NO: 39554 - DNA, 50 bp, homo sapien
ttattatgaaatatgcttactgataygcttggatatattcctactatcac

SEQ ID NO: 39555 - DNA, 50 bp, homo sapien
tttttatgtcatagcgtggcagtccmaaactttttcagcaggtcatggct

SEQ ID NO: 39556 - DNA, 50 bp, homo sapien
gtcaaatttttaaaaaccaagattaygttatgaaacttttcaggcataaa

SEQ ID NO: 39557 - DNA, 50 bp, homo sapien
gcacatatggcagtcggataaattaygcacatctggattacttttggcaa

SEQ ID NO: 39558 - DNA, 50 bp, homo sapien
ttattttaagttttaacaacttctcmaaaagtaatgcataaccaatttgg

SEQ ID NO: 39559 - DNA, 50 bp, homo sapien
tatggattgtctactattaaagaaamggaaatgcatccacgtacactcat

SEQ ID NO: 39560 - DNA, 50 bp, homo sapien
agtcaaactctacacataggttttasaggatagtttttatctcacttcaa

SEQ ID NO: 39561 - DNA, 50 bp, homo sapien
gtgcttaagcatactttggtcactasgtagcagaatcataatgaaataat

SEQ ID NO: 39562 - DNA, 50 bp, homo sapien
acttacgagcaaaaggaagttgaaaraatgagtatgtctattgctgaagt

SEQ ID NO: 39563 - DNA, 50 bp, homo sapien
gatgggaaaggagatatatagccacyaattccaattctcactgggcacag

SEQ ID NO: 39564 - DNA, 50 bp, homo sapien
atttgggttggtcatcaataccttgsagaatttctgagcctacaatttca

SEQ ID NO: 39565 - DNA, 50 bp, homo sapien
ttgtttctgtcaccactcgttccacrgagaatttaaggaaaattacaaca

SEQ ID NO: 39566 - DNA, 50 bp, homo sapien
cttccaacagctaagtcaggtatccrgatgtattcctttaaggatatgtt

SEQ ID NO: 39567 - DNA, 50 bp, homo sapien
gtggagctgggatcaagagaatataygcggtctagtcgatctagcatctc

SEQ ID NO: 39568 - DNA, 50 bp, homo sapien
taaggacaatgctatgtggttatgaygatagaggtcacactgaggtggct

SEQ ID NO: 39569 - DNA, 50 bp, homo sapien
tttgcctcttgaatctgtgcaaacarctggcagttccactcatttaattg

SEQ ID NO: 39570 - DNA, 50 bp, homo sapien
aacttttactggcctactgtaatgcracctatgagtcagatttaaagtga

SEQ ID NO: 39571 - DNA, 50 bp, homo sapien
acttgtaagaattacagtttgacacrcctcaatgtagaaaggctttagga

SEQ ID NO: 39572 - DNA, 50 bp, homo sapien
taaagctcttgttaatgtattatgakgaaaggaaacataaaacacatttg

SEQ ID NO: 39573 - DNA, 50 bp, homo sapien
atctcacagggatgcgtactaatacyacatttaggtcatctttgtcctcc

SEQ ID NO: 39574 - DNA, 50 bp, homo sapien
attttccctcatggtcagatttcaaygttacttcccggaaagaccatggt

SEQ ID NO: 39575 - DNA, 50 bp, homo sapien
gaagaactcatgaaactcatgaaagkacatcatactcatgttcactgcat

SEQ ID NO: 39576 - DNA, 50 bp, homo sapien
cctttctgatagtgctaaatgggttwaaaagccatctcatcagatcagtg

SEQ ID NO: 39577 - DNA, 50 bp, homo sapien
tttcttgtacaatgcagctatatgaygattttttgtagtataaatgatac

SEQ ID NO: 39578 - DNA, 50 bp, homo sapien
aactttgtaactgctgacagatatayaggaggatgggaagaggttaggaa

SEQ ID NO: 39579 - DNA, 50 bp, homo sapien
attattattatttggaaagtgcctastaagacaggggcaggtgacatgtt

SEQ ID NO: 39580 - DNA, 50 bp, homo sapien
gcattcaaataaaatagtgggtaagwatatagagaacaatgtagtgatat

SEQ ID NO: 39581 - DNA, 50 bp, homo sapien
ctacaagaaataactttgaagggaaraaagtcattagcttagaatatgaa

SEQ ID NO: 39582 - DNA, 50 bp, homo sapien
tgtagttctattttacgtaaacatayagttagaaaagagtaattaattgc

SEQ ID NO: 39583 - DNA, 50 bp, homo sapien
agaatatgtttaaatctacctattaygtagaagtgcccccaaagttgttt

SEQ ID NO: 39584 - DNA, 50 bp, homo sapien
atagagatatcaattcttgctgcaayggtgtcttagttcattcaggctgc

SEQ ID NO: 39585 - DNA, 50 bp, homo sapien
agcatgcttttaaaatcctttaaaarcacatagaaaggaaaatagcataa

SEQ ID NO: 39586 - DNA, 50 bp, homo sapien
tttgcagtgtatattccatctgctamcatgaactacatgtctttcgtgcc

SEQ ID NO: 39587 - DNA, 50 bp, homo sapien
aagaaaatctggcaagaaagctaaargttaacaggagaggttaacagaaa

SEQ ID NO: 39588 - DNA, 50 bp, homo sapien
aggcaaccatgatgctaacagcgtamgtttcttagaaaacccatgtatct

SEQ ID NO: 39589 - DNA, 50 bp, homo sapien
cagtgctgaagaggtacttagactayatggagagagagagaggcccatct

SEQ ID NO: 39590 - DNA, 50 bp, homo sapien
agaacgttgggtctcaaaggcaattkaagggtaatgaaagaaaagaagtg

SEQ ID NO: 39591 - DNA, 50 bp, homo sapien
ttcttgaaaggttattctgctatcaragtgaaactatgtatatactgcca

SEQ ID NO: 39592 - DNA, 50 bp, homo sapien
tgataaatgactcctgaatatagaaygaatgaagacaatggaaagtataa

SEQ ID NO: 39593 - DNA, 50 bp, homo sapien
aggtgaagaagtgctgcccatagagraaagacttggttaatcactttagt

SEQ ID NO: 39594 - DNA, 50 bp, homo sapien
ggtcctgccttgaagtcctcagaagrcctgtttttataagtaaatgttat

SEQ ID NO: 39595 - DNA, 50 bp, homo sapien
tgcattgggtatcagaagagggagamgttttattctagctatgtgtgaaa

SEQ ID NO: 39596 - DNA, 50 bp, homo sapien
tctttctccatgaaaactttctagamcttttgattgaaaacaaaacaaca

SEQ ID NO: 39597 - DNA, 50 bp, homo sapien
tgtcctgatgatttgttataggagasactctggaacgccatgtgagaagc

SEQ ID NO: 39598 - DNA, 50 bp, homo sapien
ttctctttcttacttgctgcaatgawatttaaaatatatgttgccctggt

SEQ ID NO: 39599 - DNA, 50 bp, homo sapien
actgttctagatgtgcttttctgaargtcctctttggtaggagaatggaa

SEQ ID NO: 39600 - DNA, 50 bp, homo sapien
tatataatgaagtgtggggaaacgcratgctttcagtgatctggtaacgc

SEQ ID NO: 39601 - DNA, 50 bp, homo sapien
ttgaacttcagctgtgtctatgtgaygccaaccaatgaagacagcaaaaa

SEQ ID NO: 39602 - DNA, 50 bp, homo sapien
tgaacttttatataattgaaatatamctgttatttgcctatcaatattca

SEQ ID NO: 39603 - DNA, 50 bp, homo sapien
agttcaagcatatccattccatacawctgtgagtacatttgtagttctag

SEQ ID NO: 39604 - DNA, 50 bp, homo sapien
ggatacaaattccttattagaggtayagcttgtaaatattttctcctaat

SEQ ID NO: 39605 - DNA, 50 bp, homo sapien
cagtataattaaagtttcattaatcwctaaatagtcttaatattctcctt

SEQ ID NO: 39606 - DNA, 50 bp, homo sapien
aggtgccttggttttttgaaaagackacgtggtattcctccaaacagcca

SEQ ID NO: 39607 - DNA, 50 bp, homo sapien
gttacaaaataggttccttggctgcmagtctgatacttgtgctaaaacca

SEQ ID NO: 39608 - DNA, 50 bp, homo sapien
gtggggtgcctgtcacttcaaaatayctgtaccttgtgactggaagtaat

SEQ ID NO: 39609 - DNA, 50 bp, homo sapien
cttgctttgttaatgtggcattgacracttttacctcctttgtccttaac

SEQ ID NO: 39610 - DNA, 50 bp, homo sapien
gactgatatggattgcggtatttaarcatccaccctagatcacacaattg

SEQ ID NO: 39611 - DNA, 50 bp, homo sapien
gataaattcattccattactgctaamacattctcagaacagggttcctaa

SEQ ID NO: 39612 - DNA, 50 bp, homo sapien
acataaacagatacaatgttctccaragtccagagcagggtctaaaccta

SEQ ID NO: 39613 - DNA, 50 bp, homo sapien
taagtccataccagtgatacaaataygatttttactatacttgccaaata

SEQ ID NO: 39614 - DNA, 50 bp, homo sapien
cctataaaatttgccagggtaaccamctactagaggactaataatggggg

SEQ ID NO: 39615 - DNA, 50 bp, homo sapien
agttttgtttttcttttagtactccraatacatcattccactccctcctg

SEQ ID NO: 39616 - DNA, 50 bp, homo sapien
atttgtctgacaacaggcttctcaaygaaaaccataaaggccaggagaga

SEQ ID NO: 39617 - DNA, 50 bp, homo sapien
ctttttttggtaaagaacccgctcaragtaccttctacatatgtttactt

SEQ ID NO: 39618 - DNA, 50 bp, homo sapien
tataaagtgtgttctgaattctgagycatagctaaccccatccctggcac

SEQ ID NO: 39619 - DNA, 50 bp, homo sapien
ggcttgcacagacttggcatttgacraacagtaactaatattagatgtca

SEQ ID NO: 39620 - DNA, 50 bp, homo sapien
aggaaatgacatcacttttagactgracaagagacttagtgtttcagcaa

SEQ ID NO: 39621 - DNA, 50 bp, homo sapien
aggaagatagagtttaagtaacaatyagcttcttggcatcaaacactggt

SEQ ID NO: 39622 - DNA, 50 bp, homo sapien
tcaagacaagggatgatttaattacractttcagaatttgtcactatata

SEQ ID NO: 39623 - DNA, 50 bp, homo sapien
ctcaaggcagaggatgagatgatgaygaatctttcttaggatggctactt

SEQ ID NO: 39624 - DNA, 50 bp, homo sapien
ataaaatatctaatttcatccaatastacaataaaagagtcacgtaaggc

SEQ ID NO: 39625 - DNA, 50 bp, homo sapien
gttactttcttcaaagcaaattaaargtagtatgccatttccatctgact

SEQ ID NO: 39626 - DNA, 50 bp, homo sapien
agactcatagtaaaacgccatagcgyccaattgtctttgccttggctgat

SEQ ID NO: 39627 - DNA, 50 bp, homo sapien
taagaaattttcaaatatggttaagyaagcataaatcctacacgttttca

SEQ ID NO: 39628 - DNA, 50 bp, homo sapien
tttactgggaggttgagtgatagaaraactgtcatcagaagtttaattaa

SEQ ID NO: 39629 - DNA, 50 bp, homo sapien
tcactgtccaggggacccagctgccrctattctacaggcctttttccaag

SEQ ID NO: 39630 - DNA, 50 bp, homo sapien
tcagtaacaatcaattaaatttccartgaaagcaaatctattttggatac

SEQ ID NO: 39631 - DNA, 50 bp, homo sapien
caaatctattttggatacatctaatyaggataaatgaaagaataagtgtg

SEQ ID NO: 39632 - DNA, 50 bp, homo sapien
actaaaaggctagtatcaaagctaaygtcagaaatgcccttctcatacag

SEQ ID NO: 39633 - DNA, 50 bp, homo sapien
atcatccaagcacagttaacagatawgttttagagaagacactatttgaa

SEQ ID NO: 39634 - DNA, 50 bp, homo sapien
catttcaatgagcaagggtgtttcartacagctattatctgaaaagcata

SEQ ID NO: 39635 - DNA, 50 bp, homo sapien
agatatatgttaggtgtgagtataayagaaacctcagcagactaagaacc

SEQ ID NO: 39636 - DNA, 50 bp, homo sapien
aaaataattgataaatataactccaygagaataaaaaaaattaaggatga

SEQ ID NO: 39637 - DNA, 50 bp, homo sapien
aaggatgaccaaaacatgccataaasaaaatgcaaagaattagaaaagct

SEQ ID NO: 39638 - DNA, 50 bp, homo sapien
tacaactctacatgaaaacacaatamcttgattctaagaaaatgaaaaat

SEQ ID NO: 39639 - DNA, 50 bp, homo sapien
tgcctattttagggcaatagtaaaartcccattcaaaagcctgttatcct

SEQ ID NO: 39640 - DNA, 50 bp, homo sapien
gttaccagctgcatggtgacaggtcraggtctagctctgagctctgctaa

SEQ ID NO: 39641 - DNA, 50 bp, homo sapien
tctctgaccaggtctcaaatttctayggtccttctccctgttacctccag

SEQ ID NO: 39642 - DNA, 50 bp, homo sapien
ttcttttttctgaaaattttggaaaktctggaatccacacctattccctt

SEQ ID NO: 39643 - DNA, 50 bp, homo sapien
cttggttaccatccaatccaactgamaaatgagtaaactgagacttcaaa

SEQ ID NO: 39644 - DNA, 50 bp, homo sapien
tgagcttagaatggcattagtcaccratacttagcagctgttacatgttt

SEQ ID NO: 39645 - DNA, 50 bp, homo sapien
gtttagaaaattcaaaggagcaaaawtatttctcatgtaataaaataaag

SEQ ID NO: 39646 - DNA, 50 bp, homo sapien
tcacattccccagtgaataaactctsaagactctggcaaatccctatttt

SEQ ID NO: 39647 - DNA, 50 bp, homo sapien
aacaatttgggtttattccctcaaamgacagagaaagtacaccttccctc

SEQ ID NO: 39648 - DNA, 50 bp, homo sapien
tcaaaagtgactcagtttggagaacraatggtatggttatccaatccatg

SEQ ID NO: 39649 - DNA, 50 bp, homo sapien
cccttcttgaatttttccaatttgakagggtccaactgtttcctactgga

SEQ ID NO: 39650 - DNA, 50 bp, homo sapien
ctttctttttggctaagtattcccargaggtataaactaaaccaacattg

SEQ ID NO: 39651 - DNA, 50 bp, homo sapien
gtggagctgctcttttcaaggccacyaaggacctccatgttactaaatcc

SEQ ID NO: 39652 - DNA, 50 bp, homo sapien
aagaaaacaaaacaagcaagctacaragcaactacttaaaagaacatttt

SEQ ID NO: 39653 - DNA, 50 bp, homo sapien
gctattgattcttcttctcactccaytgaaattattacattttatgttta

SEQ ID NO: 39654 - DNA, 50 bp, homo sapien
tataacctaacttcttcactattcarcctaatattcagaaagaggactag

SEQ ID NO: 39655 - DNA, 50 bp, homo sapien
agacaaatgccctattttgagtacayggtgatatagttggtcaccttcag

SEQ ID NO: 39656 - DNA, 50 bp, homo sapien
cagtattgaactaagtataatttacmatagcaaatacttaacagctcagg

SEQ ID NO: 39657 - DNA, 50 bp, homo sapien
aaaagccaacaacttgggtaacagcycttaaattgacattgtttaggcat

SEQ ID NO: 39658 - DNA, 50 bp, homo sapien
tatgctacaaggatataaacaattawacaacgaaccagaactatgctggc

SEQ ID NO: 39659 - DNA, 50 bp, homo sapien
ttgatatttttttccagttataaatkaaagttgattttacatagaaaatt

SEQ ID NO: 39660 - DNA, 50 bp, homo sapien
aaaacttgtctcctttattaactackgagatgtatatctttttacttatt

SEQ ID NO: 39661 - DNA, 50 bp, homo sapien
tttgcacaggtttatgtgctttaagyatttacaataattgtgatttccct

SEQ ID NO: 39662 - DNA, 50 bp, homo sapien
cggtgtggtctgagagctggtacccraagccatatttgttagagtaatca

SEQ ID NO: 39663 - DNA, 50 bp, homo sapien
gaagacgttcctgtgagatcaatggycagttatacttgctaccaagtaga

SEQ ID NO: 39664 - DNA, 50 bp, homo sapien
agatgttactctgaaatgtgttaccrcccactggcatgtgaatagaagac

SEQ ID NO: 39665 - DNA, 50 bp, homo sapien
acctgtgttgtttgggacaattcacygtcttgtaattttaatcattgtaa

SEQ ID NO: 39666 - DNA, 50 bp, homo sapien
tacaattacatagaaattgaataaastactcctgaaagacatttgggtaa

SEQ ID NO: 39667 - DNA, 50 bp, homo sapien
tcctttttcaaactcaggactggaarcaatactactcttatacttagcag

SEQ ID NO: 39668 - DNA, 50 bp, homo sapien
aaagaagacctagaaaactgctataytaagcctatcaaaaattctaaaat

SEQ ID NO: 39669 - DNA, 50 bp, homo sapien
aataatgtttgctttggcctcatcaktaaggataaaacaaattaatttta

SEQ ID NO: 39670 - DNA, 50 bp, homo sapien
tttagaggatgtgaaactacagtaamctcatgtgacaaaaaatcctccga

SEQ ID NO: 39671 - DNA, 50 bp, homo sapien
ggatgcagtgaaaaggaaacacttasactactggtgggaatgtaaactag

SEQ ID NO: 39672 - DNA, 50 bp, homo sapien
caatcctgcttggtttacactggaaygtctcttctgggacttctctggtg

SEQ ID NO: 39673 - DNA, 50 bp, homo sapien
gtaggagaaaggacttgcatgcaggragaatgattagtattgtattggtg

SEQ ID NO: 39674 - DNA, 50 bp, homo sapien
tagggtgacacgcctcagacagtccrcattaatttcacatcctggaatag

SEQ ID NO: 39675 - DNA, 50 bp, homo sapien
ctgtatccgtaagatgaggtagactragactaaattcatgagtttaccat

SEQ ID NO: 39676 - DNA, 50 bp, homo sapien
acaggagggatataaaggtaaagaawccatggcatgaatctttagggaga

SEQ ID NO: 39677 - DNA, 50 bp, homo sapien
gtatggtgatggtgactgattggagrcactacctaactacactggggaaa

SEQ ID NO: 39678 - DNA, 50 bp, homo sapien
actgctctctggtatgggtcttgaasctgtaatgacaatacctgaatcac

SEQ ID NO: 39679 - DNA, 50 bp, homo sapien
gagtcagcttggtctaaagggtaackccaatttgtacatttttcctttct

SEQ ID NO: 39680 - DNA, 50 bp, homo sapien
tcatttccctacttttgaaccttcartaacttcctagcacctattcctag

SEQ ID NO: 39681 - DNA, 50 bp, homo sapien
ggaaaacaaaacatatgctacttcaygggttcagttactgtcataactac

SEQ ID NO: 39682 - DNA, 50 bp, homo sapien
ttggtttttagagtgatgaaaataastaaacaagctgtccatgactggtt

SEQ ID NO: 39683 - DNA, 50 bp, homo sapien
ccttcagcctttaacaagaaacagaygaataggtcaatcccaagaaggtt

SEQ ID NO: 39684 - DNA, 50 bp, homo sapien
agacctcgatttcctcctgtaataakttaatatagccatttttgctaaat

SEQ ID NO: 39685 - DNA, 50 bp, homo sapien
ccaaactttgtatcttccttccatawataccattggccacatcctttcca

SEQ ID NO: 39686 - DNA, 50 bp, homo sapien
atattggtaagactctctcttaccartaaaagtgaatgaattacttatta

SEQ ID NO: 39687 - DNA, 50 bp, homo sapien
atcaaccaaagtattgccagagataragattgattattgcaagaaaaaaa

SEQ ID NO: 39688 - DNA, 50 bp, homo sapien
tgagagatgatgttacctacaaggckgacatacagtatacatacacatac

SEQ ID NO: 39689 - DNA, 50 bp, homo sapien
tgaagcacattcatcaaaaagatcamaggattgcttggtagcagacagga

SEQ ID NO: 39690 - DNA, 50 bp, homo sapien
caaaatgtaaaccattgagtggcaayatcctaggctttgtagactgtgcc

SEQ ID NO: 39691 - DNA, 50 bp, homo sapien
gaacaaaatgttaggacgctggtacragcaccactgaaatatccctatat

SEQ ID NO: 39692 - DNA, 50 bp, homo sapien
aggaaacaaatctatactgagtacawtcagaaacagagatcctatcagac

SEQ ID NO: 39693 - DNA, 50 bp, homo sapien
ggcaggagagtcagagaagaggtgamaacaaaagaaaaggtgagaaagag

SEQ ID NO: 39694 - DNA, 50 bp, homo sapien
atggaggaagggggcagtttacttarctactgggaaatcacttgaggctc

SEQ ID NO: 39695 - DNA, 50 bp, homo sapien
agtgcaggggagaggagccacagaamgccgaacctcagaggggactccca

SEQ ID NO: 39696 - DNA, 50 bp, homo sapien
gtgccctgcctcttctaaatgactgmaatgactgcataaagaacatggct

SEQ ID NO: 39697 - DNA, 50 bp, homo sapien
tgccagagaatagacatctgcttgamgtacagcgagttttagagtgggtt

SEQ ID NO: 39698 - DNA, 50 bp, homo sapien
tctttgcatttaggcttgttaaatayagttttgtaagtacctccttcaac

SEQ ID NO: 39699 - DNA, 50 bp, homo sapien
cacccagatagttaaatacagttcartaatagctttgtgagggagggagc

SEQ ID NO: 39700 - DNA, 50 bp, homo sapien
gaaaatgcagtctccataacttaaaytgcttgaatggattttcataaacc

SEQ ID NO: 39701 - DNA, 50 bp, homo sapien
aaaaaaagaaattaaaagtcaatackaagttaaataaacaaaccaattaa

SEQ ID NO: 39702 - DNA, 50 bp, homo sapien
aatgtttatgagtctaccactacatyagattggtgcagtgattacaggag

SEQ ID NO: 39703 - DNA, 50 bp, homo sapien
gcattattttattatgattttataaragattgacacaacataattcaaaa

SEQ ID NO: 39704 - DNA, 50 bp, homo sapien
tcaatgatctctctgacagtaacaasttctaattttcttaccatgccctt

SEQ ID NO: 39705 - DNA, 50 bp, homo sapien
gtctataatattgttagaatgaccamgtctgctcttaaaaatagcagtac

SEQ ID NO: 39706 - DNA, 50 bp, homo sapien
tgtaggtacttgtattgagggaaaarccttatatgtccaggtaggctaca

SEQ ID NO: 39707 - DNA, 50 bp, homo sapien
atttggaaagtgacaaattgatcatragaaagctaaaatgacaaattcaa

SEQ ID NO: 39708 - DNA, 50 bp, homo sapien
atacatagaatatacctaggttctcmatattataggtatttttacggtga

SEQ ID NO: 39709 - DNA, 50 bp, homo sapien
gagttcagtgtcttattctcattaaygttagagtacaatagagaatagca

SEQ ID NO: 39710 - DNA, 50 bp, homo sapien
tgccattgtcattgtgtaatgattcycaagtttctactaacctataataa

SEQ ID NO: 39711 - DNA, 50 bp, homo sapien
tggtgattaggacttctgggatttcyacctagacgtgggcttctttaagt

SEQ ID NO: 39712 - DNA, 50 bp, homo sapien
agtaggagaattaatgagattagcamaatactggataaatattattcata

SEQ ID NO: 39713 - DNA, 50 bp, homo sapien
attctgtcactaccttaaatattagragtagaagcaaaacttaaatttaa

SEQ ID NO: 39714 - DNA, 50 bp, homo sapien
gaatttggctaaagttttagttttcmatatcgctgcaggcacagtcaaat

SEQ ID NO: 39715 - DNA, 50 bp, homo sapien
acctccatctctatcttttgtcagcragtttcctcagagttccctctctg

SEQ ID NO: 39716 - DNA, 50 bp, homo sapien
ttcctattctcagtttagctcatgargagtccagcagaattccaaataac

SEQ ID NO: 39717 - DNA, 50 bp, homo sapien
cctccctggactcagcctttcaatcrgaataatgagatgatcactgtagc

SEQ ID NO: 39718 - DNA, 50 bp, homo sapien
gcttagattctatgtataaataaaawcccaggcacatggaaaaaacgtag

SEQ ID NO: 39719 - DNA, 50 bp, homo sapien
ccttcttggagttcgattaattggcygaaaggattcacagaactcaagga

SEQ ID NO: 39720 - DNA, 50 bp, homo sapien
aacacattcagacctgccagtactayattaatgacaaaaatatatccaaa

SEQ ID NO: 39721 - DNA, 50 bp, homo sapien
cctgggctttgttttcttgattcaastagtgttcacattattataattat

SEQ ID NO: 39722 - DNA, 50 bp, homo sapien
accctaattataggcatgatcactcraacttattaagactaaataacttt

SEQ ID NO: 39723 - DNA, 50 bp, homo sapien
ttatagtctttcactgagggtctcamgaagagttatctgaattcaaaagg

SEQ ID NO: 39724 - DNA, 50 bp, homo sapien
cctattaaatatatgctgggtcaccrctatggactgtattgcgtccctca

SEQ ID NO: 39725 - DNA, 50 bp, homo sapien
tttttgtgtatgtaatttcttattaygagattaaggaagttcccttctat

SEQ ID NO: 39726 - DNA, 50 bp, homo sapien
aatctgttttcagcactattattcarcgtattactggaagttctagtcat

SEQ ID NO: 39727 - DNA, 50 bp, homo sapien
actgtggaatgatgaactcaaactargtagcatatccatcacctcatata

SEQ ID NO: 39728 - DNA, 50 bp, homo sapien
caaatgcaatcctcacgtcatccacragacccaggaaagttaaataacca

SEQ ID NO: 39729 - DNA, 50 bp, homo sapien
attcacttaaaagcacgatatttccrcttcattttaatgtgtttagttga

SEQ ID NO: 39730 - DNA, 50 bp, homo sapien
ctgtggcacagtgggagcccatatawgtagttctgttcatctggagtata

SEQ ID NO: 39731 - DNA, 50 bp, homo sapien
atttctacctagttaaggcttacaartaaatgataaaactgttatatagc

SEQ ID NO: 39732 - DNA, 50 bp, homo sapien
atcacgcatgtgcatgaagaagccaygttgaatgtccaaccagtaaagct

SEQ ID NO: 39733 - DNA, 50 bp, homo sapien
tccctctttggttgacctgtctccaygtaagattacctaaattgcatttt

SEQ ID NO: 39734 - DNA, 50 bp, homo sapien
ctcaatagcattgagacagtaggcaygaaacagaaaacatctgtcaccct

SEQ ID NO: 39735 - DNA, 50 bp, homo sapien
gcaagggcggtcaacagagaaaacaygtggatgggatgtgtgaatggaat

SEQ ID NO: 39736 - DNA, 50 bp, homo sapien
ctcttaatagagtctttgggtcttgmaatatgcttacagttaggggtttc

SEQ ID NO: 39737 - DNA, 50 bp, homo sapien
ttgaaacctgtgacatgccatttaamgaacagacaccagagaatacaatg

SEQ ID NO: 39738 - DNA, 50 bp, homo sapien
aattatctataactaaatgtgccaaratgttatagtgctatatgaactgc

SEQ ID NO: 39739 - DNA, 50 bp, homo sapien
aagcatttcttcaaagaactgcacayggctttaccagtatgatccagaag

SEQ ID NO: 39740 - DNA, 50 bp, homo sapien
gcagggcacctaaattcccagctgayggaaacgtgaatgtgctcagtagc

SEQ ID NO: 39741 - DNA, 50 bp, homo sapien
agaagatgtagttcaaattgtgcaaygagtctcatagagatcaaggaatc

SEQ ID NO: 39742 - DNA, 50 bp, homo sapien
cagatggagaggagttcatgggaacratgatttacccctgctcacttacc

SEQ ID NO: 39743 - DNA, 50 bp, homo sapien
aaacaaacaaaggactgatatagaaygatgaattaaggccaggagcagtg

SEQ ID NO: 39744 - DNA, 50 bp, homo sapien
actcttctcagatgggtgttacagargtgccaggaattcttctagaagta

SEQ ID NO: 39745 - DNA, 50 bp, homo sapien
caaagaatatttttctaaaaatgagwcctaggcaacaaggaaagagcttg

SEQ ID NO: 39746 - DNA, 50 bp, homo sapien
atgaggcccaaactttgtcttctcaytcttcaagttttggaatccactca

SEQ ID NO: 39747 - DNA, 50 bp, homo sapien
agataacctatagtatattcataccsaaacttatctttttctaatacttt

SEQ ID NO: 39748 - DNA, 50 bp, homo sapien
gtatcaagaattgggccatagaaagragttatagaagcaaaaattgaata

SEQ ID NO: 39749 - DNA, 50 bp, homo sapien
actagaactcaaagggatagagacartatgaaatgaaaaaaggccttggt

SEQ ID NO: 39750 - DNA, 50 bp, homo sapien
ttgatgacaaaatcagggttttgatkatagggtttgtgttgaaggaggta

SEQ ID NO: 39751 - DNA, 50 bp, homo sapien
acttcatatccatctggaagaaatamtagctcccagtctcattcttttta

SEQ ID NO: 39752 - DNA, 50 bp, homo sapien
gtggttgacagtttttgtctttaggragtctgaaaataggaccccaatct

SEQ ID NO: 39753 - DNA, 50 bp, homo sapien
tgaaacccagtacttattttgcctaygcttacatctcaatttggacacta

SEQ ID NO: 39754 - DNA, 50 bp, homo sapien
aggccacatttcccagtctctcttamagttacatgtgactaagtttgtaa

SEQ ID NO: 39755 - DNA, 50 bp, homo sapien
agggcactagagaataaagtatcacmgccatggattaacagcagctcgag

SEQ ID NO: 39756 - DNA, 50 bp, homo sapien
gccctttcgaagttaggtgtaaccaygtgacttgcattggcataagaatt

SEQ ID NO: 39757 - DNA, 50 bp, homo sapien
tcaagaagtcagtacatttattgcargtttattttatgcttagcatagca

SEQ ID NO: 39758 - DNA, 50 bp, homo sapien
agaattgggtgttgctttctctccgkagtacatgagatctaagaagaggc

SEQ ID NO: 39759 - DNA, 50 bp, homo sapien
aaaatcttttgttgaataacagtgartattatcagcaccaaaaaagcaga

SEQ ID NO: 39760 - DNA, 50 bp, homo sapien
aggatgctttccaatcattcaatcaygctcaagtctacctgttcttgtgt

SEQ ID NO: 39761 - DNA, 50 bp, homo sapien
gccatgcagaaacaacatgagaggasgacgtaaatagacttgcaaagatg

SEQ ID NO: 39762 - DNA, 50 bp, homo sapien
accatattagatgattgcctaagccyatgatattttagcagtgcattatg

SEQ ID NO: 39763 - DNA, 50 bp, homo sapien
tacactacgcctcatccttcattcartctacagttcctagcctagtgctt

SEQ ID NO: 39764 - DNA, 50 bp, homo sapien
attaaggaatgtcacatgtagattaygagttactgggcatctggtataaa

SEQ ID NO: 39765 - DNA, 50 bp, homo sapien
gggagcaagagtacaataccagaaartgatcatgtaaggtaagcactaaa

SEQ ID NO: 39766 - DNA, 50 bp, homo sapien
tgcaaaccagcaagaatcttacctcrgaaaaatatctctgtgatctgtgg

SEQ ID NO: 39767 - DNA, 50 bp, homo sapien
atgctcaaataaaagacacatataaraaggtaaaagagtaaaaagaattt

SEQ ID NO: 39768 - DNA, 50 bp, homo sapien
atcagaaaagtcgagtttaaagagasaaagagtagccatcgtggctatat

SEQ ID NO: 39769 - DNA, 50 bp, homo sapien
atgtaaaattaagaaggaagataatyatattggagtaagcatcttatttt

SEQ ID NO: 39770 - DNA, 50 bp, homo sapien
tcagcaaatcttactaagagtgcaakggataaatctcacaaaaatacaaa

SEQ ID NO: 39771 - DNA, 50 bp, homo sapien
caaacaccagctacccacttaaacaraatcagcatgtctacgatttgcca

SEQ ID NO: 39772 - DNA, 50 bp, homo sapien
aagatgtgatgttataagcattccargtgccaagtgccaacaaaaatatt

SEQ ID NO: 39773 - DNA, 50 bp, homo sapien
tctaatgaggctaagaacttcaagaktatgaacacaggttatagtaagta

SEQ ID NO: 39774 - DNA, 50 bp, homo sapien
gacagatgcttagatgccatgttaarggtgtgaactttatcctacagggc

SEQ ID NO: 39775 - DNA, 50 bp, homo sapien
tcttttacctataatgttcttatatsagtcccttccactctgtctttatt

SEQ ID NO: 39776 - DNA, 50 bp, homo sapien
caaagcactaaaaatagctgatatcraaccaaaggtccttcatgatcctt

SEQ ID NO: 39777 - DNA, 50 bp, homo sapien
aatagtgtcagattttgagtcaacamgataaaactttcaacagtatgcta

SEQ ID NO: 39778 - DNA, 50 bp, homo sapien
taagtaaacgagggggaaaaggagaytacatgaggttttgagtggtgaag

SEQ ID NO: 39779 - DNA, 50 bp, homo sapien
taattcctagatttcaggtccagtaygctgacttcacatctttgccccat

SEQ ID NO: 39780 - DNA, 50 bp, homo sapien
actgttcagcaaacttaaggaggccyatttattgttaatgaacaatcttg

SEQ ID NO: 39781 - DNA, 50 bp, homo sapien
tgtttatggactaaatactagactgsagatagtaaatataaatttaatga

SEQ ID NO: 39782 - DNA, 50 bp, homo sapien
attccacatggagaagaaagggtgarcaatttttctgtgcataggtcttt

SEQ ID NO: 39783 - DNA, 50 bp, homo sapien
agccattttgaaaggggtcatttacyacttttgtattcaacaacataaag

SEQ ID NO: 39784 - DNA, 50 bp, homo sapien
ctctttcattctaaacacgtgcccawgggtgaaacaaagcaagtctgcac

SEQ ID NO: 39785 - DNA, 50 bp, homo sapien
actaaatatttgcctggatggaagaycgttcatccaatcaaacaaatata

SEQ ID NO: 39786 - DNA, 50 bp, homo sapien
aaaaaattaattattctgtgggaaaytgtatattcaaattaagaggaagt

SEQ ID NO: 39787 - DNA, 50 bp, homo sapien
actagaacctccaaacagtgaaagcrgcacatataaaaaaattaattatt

SEQ ID NO: 39788 - DNA, 50 bp, homo sapien
ttttgatatattaattagctcatacyataagcctggacttttgctaggca

SEQ ID NO: 39789 - DNA, 50 bp, homo sapien
ctacatcttacataaaataaggtgarcataatgaatctcatctggactgt

SEQ ID NO: 39790 - DNA, 50 bp, homo sapien
gcataaagtatgaagagattgcgcaygatataaacatttgtttgtggttc

SEQ ID NO: 39791 - DNA, 50 bp, homo sapien
gagctacttcatgtccaagtaattcrcgtatcacagtataattaaagttt

SEQ ID NO: 39792 - DNA, 50 bp, homo sapien
aaaaggtgatttatagaagcagttayagtcctctgaagagaaggcaaaac

SEQ ID NO: 39793 - DNA, 50 bp, homo sapien
agcaagtattttcaactagtcttcamactcatctgtaggccatagttttg

SEQ ID NO: 39794 - DNA, 50 bp, homo sapien
cctcctccttaacgctgacctttccmgatgctccggagtttctttttgac

SEQ ID NO: 39795 - DNA, 50 bp, homo sapien
tactataattgagggaggtagattayggtgcaggattacttctcgatcaa

SEQ ID NO: 39796 - DNA, 50 bp, homo sapien
aatacaaatgggctctgcattaaaayggttcccacagctgaggtttctgc

SEQ ID NO: 39797 - DNA, 50 bp, homo sapien
cctggtaaatattaataggctccaaycatcggaagtgaggaagtgttggg

SEQ ID NO: 39798 - DNA, 50 bp, homo sapien
atggttatacatattacatctataartgttacaaatccagcaatacatta

SEQ ID NO: 39799 - DNA, 50 bp, homo sapien
tgtgtaggtagagcaagtagccgctraagagtaatgttcatgaaacttaa

SEQ ID NO: 39800 - DNA, 50 bp, homo sapien
agcacttcatgcagcaccaaggtctyaaaatggaagtgtgactgatgtgc

SEQ ID NO: 39801 - DNA, 50 bp, homo sapien
aagagtgaaattaactaggactagarcatttctgcttcctttcattctct

SEQ ID NO: 39802 - DNA, 50 bp, homo sapien
tgctgtcttccaggcctttgaatgaktaacaccccatgcactcaggctta

SEQ ID NO: 39803 - DNA, 50 bp, homo sapien
tagtggtgagatttagggacagttamgtaatttctctaatcctcaatttt

SEQ ID NO: 39804 - DNA, 50 bp, homo sapien
aacagatgctgtgtcatcaaccaagyctgtgaatgcaggggttggagtga

SEQ ID NO: 39805 - DNA, 50 bp, homo sapien
aagtcaagatcacacctattcagatmatcataaccatctagcagcttcag

SEQ ID NO: 39806 - DNA, 50 bp, homo sapien
tccagcccttagttaatgccaagtcratttccgatggtgagaaccagaaa

SEQ ID NO: 39807 - DNA, 50 bp, homo sapien
taagacatgattataacactgttcaycaatggatcaactctgtaccttgt

SEQ ID NO: 39808 - DNA, 50 bp, homo sapien
atattggaaaagaagaaagatgtaarataaataatctaagcttctacatt

SEQ ID NO: 39809 - DNA, 50 bp, homo sapien
tgtctctaccattgagtgtagaatarggagctgtttaagagtttccgagg

SEQ ID NO: 39810 - DNA, 50 bp, homo sapien
gattatcatacagtctgactttcaastagtatatatttgcttctttttct

SEQ ID NO: 39811 - DNA, 50 bp, homo sapien
atataattttaaaagtatggataaarttactcttcaggtttaaactactt

SEQ ID NO: 39812 - DNA, 50 bp, homo sapien
cacttataaacaattatatgagtaaycacagagtttcagggtttaaaaac

SEQ ID NO: 39813 - DNA, 50 bp, homo sapien
tttgtgtgtatctggtacctaataartattcagtaaatgttttctaagcg

SEQ ID NO: 39814 - DNA, 50 bp, homo sapien
tatcatgtcagaggctgcagcttcayggtcctaaaaaaaaaaaaaaaaaa

SEQ ID NO: 39815 - DNA, 50 bp, homo sapien
aatgatttatgaaggctcttgataartatgcgtatcagccctgccactta

SEQ ID NO: 39816 - DNA, 50 bp, homo sapien
gacggctcagctttcttgtcactaaygaggtgggatgtggttgtgcattc

SEQ ID NO: 39817 - DNA, 50 bp, homo sapien
agaagctgcttctcttgtcaactaargcaagactgggtaaggacagtggg

SEQ ID NO: 39818 - DNA, 50 bp, homo sapien
gtgcagaagagaagtttccaaatgaygttatagacagggaagaagagctt

SEQ ID NO: 39819 - DNA, 50 bp, homo sapien
cacattagtcaagatgacaaactatraagactagaactgagtcagtggtg

SEQ ID NO: 39820 - DNA, 50 bp, homo sapien
caatggacaaaacattactaacaaawccatactgcaataagtcatgaact

SEQ ID NO: 39821 - DNA, 50 bp, homo sapien
aatgttaattaaggtttgactttgcragagatacggtagttgaagagtta

SEQ ID NO: 39822 - DNA, 50 bp, homo sapien
tgtggagcattaatgtgtaagcgggyaaatgccaaatcgaggagttctag

SEQ ID NO: 39823 - DNA, 50 bp, homo sapien
ttttctgacacttttatgaagtgtcratgttaattaaggtttgactttgc

SEQ ID NO: 39824 - DNA, 50 bp, homo sapien
aaatcagaacctccaagctgcccacrgtctgaagtaggttggtcttcgtg

SEQ ID NO: 39825 - DNA, 50 bp, homo sapien
tttccttcaaagttcattctgcaggkatttatatagcttctcccttttct

SEQ ID NO: 39826 - DNA, 50 bp, homo sapien
cacctgagaaggtatttaactgcaaraaatagcagaatagccaacaataa

SEQ ID NO: 39827 - DNA, 50 bp, homo sapien
atttagtattgaactcgaagagatakggatgaactttttcctttgtaatt

SEQ ID NO: 39828 - DNA, 50 bp, homo sapien
gcttagcaaaattgctctaagtgaargaactgtcatctgctggtgaccag

SEQ ID NO: 39829 - DNA, 50 bp, homo sapien
cataatcctgcctttcacagtaagawccagttgtatttccctgtggcttc

SEQ ID NO: 39830 - DNA, 50 bp, homo sapien
aaatggcatgactagcaattttttaygcagattgtacttgcctagatgtg

SEQ ID NO: 39831 - DNA, 50 bp, homo sapien
tgacctatcctctgtctccgatcccrgacaattgatgtacaaggttcatt

SEQ ID NO: 39832 - DNA, 50 bp, homo sapien
atcacagtcgcacatcttagtccacrgtaattgataaagcaaataaaacg

SEQ ID NO: 39833 - DNA, 50 bp, homo sapien
tagcctattactcctaggctacaaaygtgtatagcatgcaactgcaccta

SEQ ID NO: 39834 - DNA, 50 bp, homo sapien
tacaagtacctgggcttcacgccgakcaattccacttgaattggtctgca

SEQ ID NO: 39835 - DNA, 50 bp, homo sapien
ctttcattgctatttaaaatgacgcmaaagctgaagtccaatactcatcc

SEQ ID NO: 39836 - DNA, 50 bp, homo sapien
tcctgtgtccgtatcaaccaggcaarctataatactgcgctagcagcagg

SEQ ID NO: 39837 - DNA, 50 bp, homo sapien
ccactggagcaggcttgtggtatcayctagatattgtttctagttccact

SEQ ID NO: 39838 - DNA, 50 bp, homo sapien
tctatggaccactccttaagaatcaytgagatagtgcatgcagactactt

SEQ ID NO: 39839 - DNA, 50 bp, homo sapien
aaatgaagtagcagcatgatatcacygatctgcttaagaaccccatgatt

SEQ ID NO: 39840 - DNA, 50 bp, homo sapien
gggatctgtactaactcctttcctcrgactctccttccctcaagcctgaa

SEQ ID NO: 39841 - DNA, 50 bp, homo sapien
tgaattcattgttttgccatcctgaraatagtagccatgaaggctttcat

SEQ ID NO: 39842 - DNA, 50 bp, homo sapien
caaaaaactatactccgaccaatagrcaagtttggtgaattcattgtttt

SEQ ID NO: 39843 - DNA, 50 bp, homo sapien
atgactaagacaagaaactctcacgraagtcttatttcttttgttgaatg

SEQ ID NO: 39844 - DNA, 50 bp, homo sapien
tactagtagtttcaagcctgaagaaytaccaagtatgtagaaagtaaagt

SEQ ID NO: 39845 - DNA, 50 bp, homo sapien
taaaggacattgtgttagttatctayggctgggtaacaaattatcccaaa

SEQ ID NO: 39846 - DNA, 50 bp, homo sapien
ctgagagatgtagtttatgcccaggwcactttgcttatggtcttctagct

SEQ ID NO: 39847 - DNA, 50 bp, homo sapien
caggtagttcttaatataaactgtcraaaattcaacggtctgatgttctc

SEQ ID NO: 39848 - DNA, 50 bp, homo sapien
tttagaaaacagaaagttctttactracatgaaaggatttctaagacata

SEQ ID NO: 39849 - DNA, 50 bp, homo sapien
gtaatgtatcctgttagagaacaaaytggaatcaccatgatcttctctga

SEQ ID NO: 39850 - DNA, 50 bp, homo sapien
atactcaaaagtctgagaataagaargagttttgggaagttaaaaaatgt

SEQ ID NO: 39851 - DNA, 50 bp, homo sapien
ttacgcccgagatgctcttaatttgratgcttcacccaaacattccacca

SEQ ID NO: 39852 - DNA, 50 bp, homo sapien
aagtacagcagatcctgaaagtaacwcagaatgactgaagtgaagaagac

SEQ ID NO: 39853 - DNA, 50 bp, homo sapien
aagagcaagaaacaagtaccaaagakctcatatgtcatgtggtgatagat

SEQ ID NO: 39854 - DNA, 50 bp, homo sapien
agttctaaaataactgattatgtccyaataagatgattttggaataagac

SEQ ID NO: 39855 - DNA, 50 bp, homo sapien
tttctattcgaatgagatagaggtasgcgtcaaacagcttacaataggta

SEQ ID NO: 39856 - DNA, 50 bp, homo sapien
ccatagtggtaagtccaagggcccargtgcctatttctctggcttaagct

SEQ ID NO: 39857 - DNA, 50 bp, homo sapien
cagtagctatgttgtttgatagctaragtctgttgattgatatttgggtt

SEQ ID NO: 39858 - DNA, 50 bp, homo sapien
tagaaagcttgagagatcagggagascatttatcagtctgggaacatcct

SEQ ID NO: 39859 - DNA, 50 bp, homo sapien
taaagatgtgagagctgacagataayaaggaatagtttgagaaacctaaa

SEQ ID NO: 39860 - DNA, 50 bp, homo sapien
tttttacatagtctgacaccataaakgactaattatcgatggctaaaatc

SEQ ID NO: 39861 - DNA, 50 bp, homo sapien
ccaaggaatttaagttgtgtttttaraggattatatctatggagatgaat

SEQ ID NO: 39862 - DNA, 50 bp, homo sapien
ctgtaatcatttcctaatttgaatamgaagttaaaaacatattcccataa

SEQ ID NO: 39863 - DNA, 50 bp, homo sapien
atttcaagaatatttgatgcctgaamcttttgtgcttttctatacaaatc

SEQ ID NO: 39864 - DNA, 50 bp, homo sapien
aaactgaactctctctcggttactayggcatcccctgaaaaaatgtcagt

SEQ ID NO: 39865 - DNA, 50 bp, homo sapien
atgatccatttcatgacttttctaayttaccagatcaatctagtcattaa

SEQ ID NO: 39866 - DNA, 50 bp, homo sapien
aagaatgtgcctagcacatagtagaygctgtataaatgttggtctcctct

SEQ ID NO: 39867 - DNA, 50 bp, homo sapien
tgctccatcattactgtagctaatcrgatccttaccactgaagtgcatac

SEQ ID NO: 39868 - DNA, 50 bp, homo sapien
attttagaccctcattatctcttgcsgagaccactatactgactttctaa

SEQ ID NO: 39869 - DNA, 50 bp, homo sapien
tttatggtccctgtagggtttggacyagacctgagttgctgcctgatcct

SEQ ID NO: 39870 - DNA, 50 bp, homo sapien
ctcaaactgaaattattgaagagaamcatcatgctgctcatgactggaat

SEQ ID NO: 39871 - DNA, 50 bp, homo sapien
attgtgccattttaggcatggtaaartcccagaaatcatcaagaccaacc

SEQ ID NO: 39872 - DNA, 50 bp, homo sapien
accaaatctaagttccctgagcacaygagaagcattgttacactgtccat

SEQ ID NO: 39873 - DNA, 50 bp, homo sapien
tctctttctcatctctctgccagcgwaagtgtaataacttcttaacctta

SEQ ID NO: 39874 - DNA, 50 bp, homo sapien
cttgtggtggttttaattgcacaaarcaacgagacatcctagaaagcttg

SEQ ID NO: 39875 - DNA, 50 bp, homo sapien
ttaactctaccatctagagagagacrgcttgatacaagaatatcagggct

SEQ ID NO: 39876 - DNA, 50 bp, homo sapien
atgcttaactttgattacctgtactyaagatagagtaaaacagcaatgcc

SEQ ID NO: 39877 - DNA, 50 bp, homo sapien
aagaatatcagggcttcgtctcgcargtcaaagcctttattatttagttt

SEQ ID NO: 39878 - DNA, 50 bp, homo sapien
ttctcactccttaggtatggattacrcatggtgacttcctttcaaagtgt

SEQ ID NO: 39879 - DNA, 50 bp, homo sapien
gtctacacatgctggtgtctttcaayggatgtctctgttaacaaaaataa

SEQ ID NO: 39880 - DNA, 50 bp, homo sapien
tttttgcactgatttgacactgatayacataatcaaaccttgcaacaacc

SEQ ID NO: 39881 - DNA, 50 bp, homo sapien
ccaagcttgtaaagtctcccgtggayatcttaattcttatattttccttt

SEQ ID NO: 39882 - DNA, 50 bp, homo sapien
tagtaataataatgctagcagcatargactagcattattattatgatcct

SEQ ID NO: 39883 - DNA, 50 bp, homo sapien
aatgattaactcatctactttaccarggttacataatcaagtattagtta

SEQ ID NO: 39884 - DNA, 50 bp, homo sapien
cagcctattactgtctaaagacaaarctccttgtgatgatttgtagtaat

SEQ ID NO: 39885 - DNA, 50 bp, homo sapien
atgctttaacccaactcatgcagcckatttctggggtcttaggtttttaa

SEQ ID NO: 39886 - DNA, 50 bp, homo sapien
tatttaagcttttccctaattccagkactctaatattcagtactaatttt

SEQ ID NO: 39887 - DNA, 50 bp, homo sapien
tgggtccttttcaagatgttaactasaagtattaaattaccctcctgacg

SEQ ID NO: 39888 - DNA, 50 bp, homo sapien
gcaccaagtcagataatagatattargaacttggtacatactgttattgg

SEQ ID NO: 39889 - DNA, 50 bp, homo sapien
tttaaaaaatcaaatacagcttgtcraaatgacctccgtaaaacacttct

SEQ ID NO: 39890 - DNA, 50 bp, homo sapien
gtttatggatagtggtttaattagartaatgacaaaaactggaacacaat

SEQ ID NO: 39891 - DNA, 50 bp, homo sapien
aatacataaataataaggattatgaratatgataagtgctacaaagtaaa

SEQ ID NO: 39892 - DNA, 50 bp, homo sapien
cacaaagacaagaaaataggggaacygtcaaagaagtgataaagactgag

SEQ ID NO: 39893 - DNA, 50 bp, homo sapien
tactcctgaaagagttcttcggttamaactatatcctgatactttttatt

SEQ ID NO: 39894 - DNA, 50 bp, homo sapien
gggaattgtggaaataggaccaatcygaggctttcgtgagagagtgtatc

SEQ ID NO: 39895 - DNA, 50 bp, homo sapien
gtctctgccgtcagtggtaacatggkactctttactgggtgattctataa

SEQ ID NO: 39896 - DNA, 50 bp, homo sapien
tactaagtttacagagtatcctaaartctccaaacaaaagtgaccagaat

SEQ ID NO: 39897 - DNA, 50 bp, homo sapien
catttatatcttactaacatattaayacctctcacgttgagggcctatac

SEQ ID NO: 39898 - DNA, 50 bp, homo sapien
gcaggccttaattccaacacacccayaaagtgatccaaggctgatgtgac

SEQ ID NO: 39899 - DNA, 50 bp, homo sapien
tgccagattgcacttttattgttaaygagcattttcctcttttacttgtc

SEQ ID NO: 39900 - DNA, 50 bp, homo sapien
aagtatcctgggcttggggccagagmatttagttatttgtgacttttaca

SEQ ID NO: 39901 - DNA, 50 bp, homo sapien
aagagtccactcctctctatacttcragctaaacgggaagctcagagata

SEQ ID NO: 39902 - DNA, 50 bp, homo sapien
gagctgggtctccatggctggtcaartaggagagattacataatgtttaa

SEQ ID NO: 39903 - DNA, 50 bp, homo sapien
agagcctataagtcattttgattagkatatgaccacagggttttggcacc

SEQ ID NO: 39904 - DNA, 50 bp, homo sapien
agccagggttccaaagtcaagttaamaatcactcgaggtagacaagtgat

SEQ ID NO: 39905 - DNA, 50 bp, homo sapien
agttcagaaacaaggtagtgtgcaartaaatcacaggtggcaccagagat

SEQ ID NO: 39906 - DNA, 50 bp, homo sapien
aaaaatcatggttcattaccctgaarcaaatggtcaggccatgagagaga

SEQ ID NO: 39907 - DNA, 50 bp, homo sapien
gggagtgtgagtcgtataagataacrcagtggtatgtctgcaggtatgct

SEQ ID NO: 39908 - DNA, 50 bp, homo sapien
agactcatgtttttactagccacaakaaagtattaaactatttctatgaa

SEQ ID NO: 39909 - DNA, 50 bp, homo sapien
actactattaagaatgaatctcaaastttaatgggcaacgaatcatctag

SEQ ID NO: 39910 - DNA, 50 bp, homo sapien
ttatggaaaacaatggaatgagtacwgaatagttgttcttcttgatcatt

SEQ ID NO: 39911 - DNA, 50 bp, homo sapien
tttgtgaactgtttgtaacactgaaygtaaacttagaataagcagatgac

SEQ ID NO: 39912 - DNA, 50 bp, homo sapien
ataatgaaaacatttgccttcttgargcaggaaactggaaattttaatct

SEQ ID NO: 39913 - DNA, 50 bp, homo sapien
gtaggttattgggaaacagagagaamcttggagtccaaagataggagagg

SEQ ID NO: 39914 - DNA, 50 bp, homo sapien
ttttcatcttgcaaaattgaagctayacccactaaactacatcccattct

SEQ ID NO: 39915 - DNA, 50 bp, homo sapien
catcttcaacagaatatctactctawctggttgttgtgatagttgaacat

SEQ ID NO: 39916 - DNA, 50 bp, homo sapien
ccattcttcactcacaagattggcaragattaagaaaaccaacaatgcca

SEQ ID NO: 39917 - DNA, 50 bp, homo sapien
ttgcaactctataaagtttctgttayatagctatcagttgattatgataa

SEQ ID NO: 39918 - DNA, 50 bp, homo sapien
acagatcagttactggatgtcaaagycttgtcttttgcgttaggctgttg

SEQ ID NO: 39919 - DNA, 50 bp, homo sapien
aaaacagcaaaaataaccagtacaaraagtccattcaaacaacccacacc

SEQ ID NO: 39920 - DNA, 50 bp, homo sapien
cctgctgcctgctctcttctataaayataccagatgaatctttccagcat

SEQ ID NO: 39921 - DNA, 50 bp, homo sapien
aaggcatattttaattgtatattaastcatctatcatttaggatgcttag

SEQ ID NO: 39922 - DNA, 50 bp, homo sapien
gaaccaccctatcaactcagtataartgtattgaatataagttaatgtca

SEQ ID NO: 39923 - DNA, 50 bp, homo sapien
gcaaatcaaatttttaaattctctcrctgttgctttaatatgctatatct

SEQ ID NO: 39924 - DNA, 50 bp, homo sapien
aaatgaacgatatgagctgttgagasaatgacaatgttaataacttcatc

SEQ ID NO: 39925 - DNA, 50 bp, homo sapien
aaacatctctgactttcatttgaaaytgtggaaagactatacccaaaaag

SEQ ID NO: 39926 - DNA, 50 bp, homo sapien
aaaggaaagcattaaatcgaagacaytatttgaacaacaactcataaagc

SEQ ID NO: 39927 - DNA, 50 bp, homo sapien
taccctatgactctacttatatataygacttcaagttctaatagcaacct

SEQ ID NO: 39928 - DNA, 50 bp, homo sapien
cacatcacagatgcttatcatcatcraatttaacatgccactctaattaa

SEQ ID NO: 39929 - DNA, 50 bp, homo sapien
ttcagcttaaaaaatgttcaccgtgkataaacctgtaatgagagctttca

SEQ ID NO: 39930 - DNA, 50 bp, homo sapien
taaaagtaaattaaatcagaaccacraaaaataggattaaaagacaaatc

SEQ ID NO: 39931 - DNA, 50 bp, homo sapien
tcctgttctaaaaattctcctgaaaygaaacctcaagacttccttgatta

SEQ ID NO: 39932 - DNA, 50 bp, homo sapien
tcccagggaaaatgtcactgtattamgaaaaatatcaacaagcctactgc

SEQ ID NO: 39933 - DNA, 50 bp, homo sapien
tttgttttgcaagacctactcattayggcaaaaagacgttaattattgca

SEQ ID NO: 39934 - DNA, 50 bp, homo sapien
ataatttgttattctaaaaatggcasaatagttcttattaggaaatcaaa

SEQ ID NO: 39935 - DNA, 50 bp, homo sapien
aaaacttgatctctgggtttctgaayacagcgttgagaaaaaaagtctga

SEQ ID NO: 39936 - DNA, 50 bp, homo sapien
ataaaatgtcaagactgatattaaawctgggtggttgaaacaacagacat

SEQ ID NO: 39937 - DNA, 50 bp, homo sapien
accctagcatagtgcttgacatatartaagttcttagtagatattctttt

SEQ ID NO: 39938 - DNA, 50 bp, homo sapien
atattccctttttgcttaaatgggarcaacaaatgctgttgtttaaatga

SEQ ID NO: 39939 - DNA, 50 bp, homo sapien
aggcaccttttaccaaattttgcttwaaaatccttaatgcttttgcattt

SEQ ID NO: 39940 - DNA, 50 bp, homo sapien
tgaagatgcctagaaagaaagggtcractgatttacatgagaaagacaat

SEQ ID NO: 39941 - DNA, 50 bp, homo sapien
ttaaggtcaagtatcaagccaataakgtcaataattacatccccctgatc

SEQ ID NO: 39942 - DNA, 50 bp, homo sapien
tgagtcaccttattatttagtagaawatctacacatcccactcatcctgc

SEQ ID NO: 39943 - DNA, 50 bp, homo sapien
tgaaagtagaacttatttcatctgaygaccagttcaagacattttctgct

SEQ ID NO: 39944 - DNA, 50 bp, homo sapien
tctggatagtgttactcgtcagtcaytcatttttgctaaattgcagaaac

SEQ ID NO: 39945 - DNA, 50 bp, homo sapien
gaatccttccacgaaacttcaaataygtgggttaaattccggaaagcctc

SEQ ID NO: 39946 - DNA, 50 bp, homo sapien
gcaagcttgagaaaaaacctggatayggaagactggatggaccaggagaa

SEQ ID NO: 39947 - DNA, 50 bp, homo sapien
ccagagaaagtagcctcttgctctaygctaatggatttcttcaataggag

SEQ ID NO: 39948 - DNA, 50 bp, homo sapien
attatttaagttggtatggtcagatragtaaaacagtattttaactaagc

SEQ ID NO: 39949 - DNA, 50 bp, homo sapien
gagttcatgtgtcacctaaagtatcycatgggtattataaacacagcact

SEQ ID NO: 39950 - DNA, 50 bp, homo sapien
atttgaaaaatgcatcataacaatartatcatcatcaacatcatactgtg

SEQ ID NO: 39951 - DNA, 50 bp, homo sapien
ctccaaaatgggaaaatccagcccayggtggactgcactagatcttatag

SEQ ID NO: 39952 - DNA, 50 bp, homo sapien
tattaggtgttataagtaccctagayacgatttaaatgcagtagtgtctg

SEQ ID NO: 39953 - DNA, 50 bp, homo sapien
ttccctcttggaactgtgactaatgyatcaagagtcagagcagagatcct

SEQ ID NO: 39954 - DNA, 50 bp, homo sapien
ctttcatatctcatttatcttattcrcgcttcatgatgtaatcctctctt

SEQ ID NO: 39955 - DNA, 50 bp, homo sapien
cataacttgtctgttttcacagatayatagctggcgaggaattctgcctc

SEQ ID NO: 39956 - DNA, 50 bp, homo sapien
ataacattatccataattatttaccrcagcaatataacttattattatct

SEQ ID NO: 39957 - DNA, 50 bp, homo sapien
acccttaagtgaggagactatacccragttccacctagcttgcaaattct

SEQ ID NO: 39958 - DNA, 50 bp, homo sapien
aacccaataataatgcatgtaagcaygtgagcaatagaggaaaaggaagg

SEQ ID NO: 39959 - DNA, 50 bp, homo sapien
tagctcaggagaaacttcattaaaayggcaaatggagaaaatataagtat

SEQ ID NO: 39960 - DNA, 50 bp, homo sapien
tgaacaactcaaaatgtctccctcayagtgcttgaaattccctcttctga

SEQ ID NO: 39961 - DNA, 50 bp, homo sapien
tcccacaaatttaaaaatttcttccraagtccaattaaagattcatttct

SEQ ID NO: 39962 - DNA, 50 bp, homo sapien
tggaggtatgaataactaccagatcraatacatgggaataacctttttta

SEQ ID NO: 39963 - DNA, 50 bp, homo sapien
gttttcacattccagcccttttactyaggtatcaatttctccagttcttt

SEQ ID NO: 39964 - DNA, 50 bp, homo sapien
agcacaaacaattacttttgtctaayagccttaacatatacttaagataa

SEQ ID NO: 39965 - DNA, 50 bp, homo sapien
ttccctctatatttctaaagttcaastaaaaaatccagatattttcctct

SEQ ID NO: 39966 - DNA, 50 bp, homo sapien
atagatgatcagtcagttcttcaaasagataacacacataaaattaccag

SEQ ID NO: 39967 - DNA, 50 bp, homo sapien
ttgaataaaaaatcaataatgtatamaggaggttcaaagttattacccaa

SEQ ID NO: 39968 - DNA, 50 bp, homo sapien
agactaaatgcaaattaaatttacastcagtaggctatgtttgctctttc

SEQ ID NO: 39969 - DNA, 50 bp, homo sapien
tgtaaaaataatgtgtttattgcagraagtttagaaattacagggaaaat

SEQ ID NO: 39970 - DNA, 50 bp, homo sapien
cttagtatcaaaaaaccagtattaargacatatggaatttatccatatga

SEQ ID NO: 39971 - DNA, 50 bp, homo sapien
agctaaacaatttaaactacagctarcgacttagattgttgtcatgtgta

SEQ ID NO: 39972 - DNA, 50 bp, homo sapien
ccaaaattctgggagggaccttagcratgtgtttacatggtcaatttttt

SEQ ID NO: 39973 - DNA, 50 bp, homo sapien
caataccttgttcatctatgcaatamgtaagtaagatgttagtaataaag

SEQ ID NO: 39974 - DNA, 50 bp, homo sapien
actacctgctgaagaatgaaatccaygtggaggagagtccagctgtccct

SEQ ID NO: 39975 - DNA, 50 bp, homo sapien
gcagagttcaggttagttaccatgcyaagaaaatataaatggttgaaatt

SEQ ID NO: 39976 - DNA, 50 bp, homo sapien
agttcttatacatcatttggagttargtttactgtctcctagtttctttg

SEQ ID NO: 39977 - DNA, 50 bp, homo sapien
acaatattcaaataaattaagatacrcaaacaccgaagaacttttaaaca

SEQ ID NO: 39978 - DNA, 50 bp, homo sapien
gatgcttgtattctctataacattargaaatattaaaatgttgctataca

SEQ ID NO: 39979 - DNA, 50 bp, homo sapien
ccctattattgcttgtctttgcagartctcaggctgtattataaaacttg

SEQ ID NO: 39980 - DNA, 50 bp, homo sapien
gacctccttggagagatggattttayagttcctcctgtctcctcactcac

SEQ ID NO: 39981 - DNA, 50 bp, homo sapien
cctcttaaattactctgtatactttmcttgcctttattttctctgtttcc

SEQ ID NO: 39982 - DNA, 50 bp, homo sapien
ccaattcaaaacatcatttaattagmacttcaagctccatcttgtcagac

SEQ ID NO: 39983 - DNA, 50 bp, homo sapien
tacatggtaggtaagagaagattgcycaaatagggagagcaaggataatt

SEQ ID NO: 39984 - DNA, 50 bp, homo sapien
aaaaggatttttccccagggaagtcsagtttttagttgtcttttattgtc

SEQ ID NO: 39985 - DNA, 50 bp, homo sapien
aattcagacgaccattgctgaaaacraactggtatcttctctctcaccat

SEQ ID NO: 39986 - DNA, 50 bp, homo sapien
cgcacgtgtttagagaatctctgaaygcttcttttctaactaagggtaaa

SEQ ID NO: 39987 - DNA, 50 bp, homo sapien
ggaggattgtgctatacacttttaaytgacctgttgctatacccagcagc

SEQ ID NO: 39988 - DNA, 50 bp, homo sapien
aactgggaaatactaggacaattaamgttggcttctcttggatgtattgt

SEQ ID NO: 39989 - DNA, 50 bp, homo sapien
catttaaaaagtaatattatgactayagcaattgaggacctggtctgtac

SEQ ID NO: 39990 - DNA, 50 bp, homo sapien
tagaattagtccatgaagctggaccragactatgttctactctgctctta

SEQ ID NO: 39991 - DNA, 50 bp, homo sapien
cacagtgaggagaagctaagttctargttaaatgcactgttgcctagcca

SEQ ID NO: 39992 - DNA, 50 bp, homo sapien
ctaaggaactaacatcattctttcaygttaacgaaactcccaacagactg

SEQ ID NO: 39993 - DNA, 50 bp, homo sapien
atgaattgttttttccatctttttaraacagaattctgtggtctcaaata

SEQ ID NO: 39994 - DNA, 50 bp, homo sapien
gtttgtttcatctaacctctgtatcyataccatgtttccactgacctata

SEQ ID NO: 39995 - DNA, 50 bp, homo sapien
gtgctgtaaacatttggcataggaarattaagtgggacagaggattaagt

SEQ ID NO: 39996 - DNA, 50 bp, homo sapien
gtttcttactgccttggttgcaggamctctagctaaacacattggggcat

SEQ ID NO: 39997 - DNA, 50 bp, homo sapien
ctccactgaacctgtttcctgtgaarggtagtaataatccgatggccgta

SEQ ID NO: 39998 - DNA, 50 bp, homo sapien
tcaagtactttgtgatcgtctactaygcatcaggcttattctgctacctg

SEQ ID NO: 39999 - DNA, 50 bp, homo sapien
tttgagaaaactgagtcaagatattraagacatggttggattaaaaggtc

SEQ ID NO: 40000 - DNA, 50 bp, homo sapien
tattttggctgtaataaaacattagkattcaacagtttgattttactctt

SEQ ID NO: 40001 - DNA, 50 bp, homo sapien
aggagaggcaggagcgaagaagagargtgaaaacaatgtatatggtgacc

SEQ ID NO: 40002 - DNA, 50 bp, homo sapien
caataaggacagatgtcccaagaacyataatgcgtttgtgtaaaacaaat

SEQ ID NO: 40003 - DNA, 50 bp, homo sapien
agtcaacggtttaaattatgaaacaytgaactaacgattactagagttaa

SEQ ID NO: 40004 - DNA, 50 bp, homo sapien
ttagaatgaaccctgtgtattgttgsattggaattggatattgatgtgaa

SEQ ID NO: 40005 - DNA, 50 bp, homo sapien
atacaatgggtaacaacgtgagctawaactgagaagcctgcacccatagc

SEQ ID NO: 40006 - DNA, 50 bp, homo sapien
aaatgtttgacgtctcattagcctcragatgatttttaacatggccaggg

SEQ ID NO: 40007 - DNA, 50 bp, homo sapien
tgtccacggggctgctattgcacaastctcctcctcctacacacacacac

SEQ ID NO: 40008 - DNA, 50 bp, homo sapien
aaaaattaatccatccagactcatamcttaagagaatattttataaaagg

SEQ ID NO: 40009 - DNA, 50 bp, homo sapien
aactgaaaaggactccataaaggaargggttacagagagaagtttaagac

SEQ ID NO: 40010 - DNA, 50 bp, homo sapien
tctgggtttctctttctatctgagaytatgtatcactcacctctatttta

SEQ ID NO: 40011 - DNA, 50 bp, homo sapien
tgcatttttaacagatagttctgacrcagatgatgggaagactgcaaatt

SEQ ID NO: 40012 - DNA, 50 bp, homo sapien
atgaaatccaatgaggagaaagaacygctaccacagaaattggatttaaa

SEQ ID NO: 40013 - DNA, 50 bp, homo sapien
tatatatgagaagaaatcagaaaccragaaaatggagactattgtgatgc

SEQ ID NO: 40014 - DNA, 50 bp, homo sapien
tcttaaatcttgtgctatgaagaaaygctattaatccttcctattaatgt

SEQ ID NO: 40015 - DNA, 50 bp, homo sapien
gagaacagaaacaatacactcctaaytatgcaatagggcatgactcccct

SEQ ID NO: 40016 - DNA, 50 bp, homo sapien
ggaggtgatcaaaacagaagaaaaayagttaaagaggaaaggatgaagga

SEQ ID NO: 40017 - DNA, 50 bp, homo sapien
ctgacactggacagatggtatgaackgtggtttattggtacatatgtctg

SEQ ID NO: 40018 - DNA, 50 bp, homo sapien
acaaaacaaaggatgtgcacatatamgttctctttttgtctttcaagatt

SEQ ID NO: 40019 - DNA, 50 bp, homo sapien
ctgaatttgtggtgttcacagaccayggtgagatcaaataagaaacatta

SEQ ID NO: 40020 - DNA, 50 bp, homo sapien
attgcccaggccagccttttcccaartacagcagagttcctgttattatt

SEQ ID NO: 40021 - DNA, 50 bp, homo sapien
gcaggaactattcagtcattgagatwacctttgatgagaggagaaagctc

SEQ ID NO: 40022 - DNA, 50 bp, homo sapien
ctctatctaatacaagtacattggaraaaagaattaacgaagaaacattt

SEQ ID NO: 40023 - DNA, 50 bp, homo sapien
aagcttctggtccagtggataattayagaaggaagcccttttctcatgta

SEQ ID NO: 40024 - DNA, 50 bp, homo sapien
ccagtgcaagtttttgagactggcasgcttgtgttggagctgagctccac

SEQ ID NO: 40025 - DNA, 50 bp, homo sapien
cccctggactgtcgacaggccaccayggtagagttggtaggtgttatggt

SEQ ID NO: 40026 - DNA, 50 bp, homo sapien
gtggaactgccttgccttttggtgcrgagaacaggaagctcctacattcc

SEQ ID NO: 40027 - DNA, 50 bp, homo sapien
ctctggagtagcattgcatagggtcrcattgttactggccaggtttcagt

SEQ ID NO: 40028 - DNA, 50 bp, homo sapien
aataaatcatactggttatgtatacraatggaaggagacattgacatgaa

SEQ ID NO: 40029 - DNA, 50 bp, homo sapien
ttttgtaatgaactgttaattcctaygtaatggcttttcctgcagataag

SEQ ID NO: 40030 - DNA, 50 bp, homo sapien
tcacacggagaactgttacgccatayctgaaacaatgaagggacacacaa

SEQ ID NO: 40031 - DNA, 50 bp, homo sapien
gatcacatgaactacttttacctagmcaactggaagagtccaagttcgtt

SEQ ID NO: 40032 - DNA, 50 bp, homo sapien
gagtatgaagacttggtgtagtacayggcattcgtctgattcttccagcc

SEQ ID NO: 40033 - DNA, 50 bp, homo sapien
ctttgacgaggctccatataagaacracagcaaaaggccaccatgctgag

SEQ ID NO: 40034 - DNA, 50 bp, homo sapien
ggatagtacaattggaatattaataraagaacaagtgcatgaagcatgac

SEQ ID NO: 40035 - DNA, 50 bp, homo sapien
gtttaaagaaagatatggcgatacartagaaatcaacttattgaaattac

SEQ ID NO: 40036 - DNA, 50 bp, homo sapien
agaaaccaaggcaatcattgagggartaagaatagtcatatggattgatt

SEQ ID NO: 40037 - DNA, 50 bp, homo sapien
tgctactttcctttaagaagagagcrcttaaaagagtaaggttctacctc

SEQ ID NO: 40038 - DNA, 50 bp, homo sapien
acatcacttaattctcacagtagaarataatacagaacgaaaagccatgt

SEQ ID NO: 40039 - DNA, 50 bp, homo sapien
agttctctctaggttcaggaggttawgattccagttctacttctggccca

SEQ ID NO: 40040 - DNA, 50 bp, homo sapien
actcaccaccagtggtctgattctcrcttcccttgtcttccccctagttg

SEQ ID NO: 40041 - DNA, 50 bp, homo sapien
aaggttggaaattaacatattttaaraagcatatttcataaattttgact

SEQ ID NO: 40042 - DNA, 50 bp, homo sapien
tgcaaggcactggtccttaaaaagartccacagatctcaactccttgctg

SEQ ID NO: 40043 - DNA, 50 bp, homo sapien
gtaagtcacttatctagctcaagcasaaggtctcagggtcgaggtaactt

SEQ ID NO: 40044 - DNA, 50 bp, homo sapien
tctgtgagacagatgaaataatccawcctacttttggctgagtggccagg

SEQ ID NO: 40045 - DNA, 50 bp, homo sapien
ctttatttttctcttaaattagaaawcctaaccaggacaagctcgaccta

SEQ ID NO: 40046 - DNA, 50 bp, homo sapien
gatgctcaactggtaagcgtaatgcragtattaaaaaaaataaaatcgca

SEQ ID NO: 40047 - DNA, 50 bp, homo sapien
cccacatcttatggacaggaaaagarctaggtgctactcactgacagcca

SEQ ID NO: 40048 - DNA, 50 bp, homo sapien
ccaaaagtagttgtatcaaccattgyataattatgttgtactttgatatt

SEQ ID NO: 40049 - DNA, 50 bp, homo sapien
agaaataatatagatcgcacagataygcagttcatgaaacaaaaagcaga

SEQ ID NO: 40050 - DNA, 50 bp, homo sapien
taacagaagctgaaattgctaacaaygaaccaaaatatctctgcttcaat

SEQ ID NO: 40051 - DNA, 50 bp, homo sapien
ggggtaacatatgtgaggttcatagwaaattcattcgtggacactggaac

SEQ ID NO: 40052 - DNA, 50 bp, homo sapien
ttccatggttagctgatgactaaagmaggactagaattcaggcctcctat

SEQ ID NO: 40053 - DNA, 50 bp, homo sapien
gcaatggaaggatatggtaaagctaygtgacaggctgaatgaattttaat

SEQ ID NO: 40054 - DNA, 50 bp, homo sapien
tagtttctgtcatattctcctgtcaygaagacctgacatcatgaaatgat

SEQ ID NO: 40055 - DNA, 50 bp, homo sapien
gtcacatagctttaccatatccttcyattgccccattttaaatacatttg

SEQ ID NO: 40056 - DNA, 50 bp, homo sapien
agctcccaaacaagatgaaatgtgaragagaaaatctgtgtttacttttg

SEQ ID NO: 40057 - DNA, 50 bp, homo sapien
gagacctagacctgcacagaagatastacagggcattctgaacaagagaa

SEQ ID NO: 40058 - DNA, 50 bp, homo sapien
tggtgtgaattagtgtcctggagaaytgtgggctctttgaagtatatttg

SEQ ID NO: 40059 - DNA, 50 bp, homo sapien
cctagggcctagggatgcctttggcrccaggagttcataatttctctttt

SEQ ID NO: 40060 - DNA, 50 bp, homo sapien
gtacagtgatttcccatgggaataasttaataatcattagatgtcatgag

SEQ ID NO: 40061 - DNA, 50 bp, homo sapien
gaaagtaatatcctttaagacaaaayccatggcctataatatagctatta

SEQ ID NO: 40062 - DNA, 50 bp, homo sapien
aatgttccataccagatttcctggargagcgatatatatttatttctgag

SEQ ID NO: 40063 - DNA, 50 bp, homo sapien
atgtgcacaaaacttgaactttccayacataaactcagggcaatggcagt

SEQ ID NO: 40064 - DNA, 50 bp, homo sapien
taaattcctaagagatatagtcgctraacactaggtcatatatagtaggt

SEQ ID NO: 40065 - DNA, 50 bp, homo sapien
cttcacaatgtagtacatcttctaarcctttgtatatgcaatgtatagta

SEQ ID NO: 40066 - DNA, 50 bp, homo sapien
gttaaagaggcagctacaaagtttaycactatatataagcaagaaccagc

SEQ ID NO: 40067 - DNA, 50 bp, homo sapien
tcaaggaaaatgctaaattgagagtyaaaataccagttaccaatttagca

SEQ ID NO: 40068 - DNA, 50 bp, homo sapien
ttccatgcatcaccaataattcaacrgctctcttgatgaatgtctacttc

SEQ ID NO: 40069 - DNA, 50 bp, homo sapien
tctcactcaatcccttcaattgctayatgatattgtaaattgagaacctg

SEQ ID NO: 40070 - DNA, 50 bp, homo sapien
caatatacggtcttttatgactggayacttttagcataatgttttcaagt

SEQ ID NO: 40071 - DNA, 50 bp, homo sapien
aagtattctgagttaatataaaataycggaatatccagactccaatttgt

SEQ ID NO: 40072 - DNA, 50 bp, homo sapien
ttaaaaataaaatggtaagagtagayactgatcataaatgaacaatgatt

SEQ ID NO: 40073 - DNA, 50 bp, homo sapien
atgaaaatatggagctctccttagakgcgcaaaatttggcaattgcagga

SEQ ID NO: 40074 - DNA, 50 bp, homo sapien
atttttaaaaaacaaatatgaagcasaatagatacaactgaagaatggac

SEQ ID NO: 40075 - DNA, 50 bp, homo sapien
taggaaagaaaactgtaataaagcartcctgaaattaaattcaacactaa

SEQ ID NO: 40076 - DNA, 50 bp, homo sapien
ccctttcaagggaaggcgccataatragcagttgcaaaagcttctttgag

SEQ ID NO: 40077 - DNA, 50 bp, homo sapien
tagaatgaaaggattcaagggaacgracactaagatacaagctctgtttt

SEQ ID NO: 40078 - DNA, 50 bp, homo sapien
acatataaatactatgtaatctgcaygaaacattaatccttggctggaaa

SEQ ID NO: 40079 - DNA, 50 bp, homo sapien
caccctaactgactttaaaatatacracaaaacagtactaggcaaaacag

SEQ ID NO: 40080 - DNA, 50 bp, homo sapien
ctgggaatacagatttgattagatgmaggctttattttttgacatgaaaa

SEQ ID NO: 40081 - DNA, 50 bp, homo sapien
tggaaaaactgcatattgaaacttarctcgcattatacacttcaatacac

SEQ ID NO: 40082 - DNA, 50 bp, homo sapien
tctattcagcaccccttatttcaaastattgtgctaatacagtttttata

SEQ ID NO: 40083 - DNA, 50 bp, homo sapien
ccattcagcaaatattttgtggttaygtactatgtgctatttagctatgt

SEQ ID NO: 40084 - DNA, 50 bp, homo sapien
gtggacaatatcaataggtctaataygtatgtaactggagtctgagaagg

SEQ ID NO: 40085 - DNA, 50 bp, homo sapien
atatttaaaaggtgctttaatgaaakacaatgaccaatgattgtatttca

SEQ ID NO: 40086 - DNA, 50 bp, homo sapien
aacagaagagtgttcccaaagaccartgaaatacaatcattggtcattgt

SEQ ID NO: 40087 - DNA, 50 bp, homo sapien
tgaaatatgcacccaaaagttgttayattgctgggctggcaaatgctcca

SEQ ID NO: 40088 - DNA, 50 bp, homo sapien
gtcctggccaacactttgctgcctaygaacaattctgttagaggtcccaa

SEQ ID NO: 40089 - DNA, 50 bp, homo sapien
agctttgactcagcagcagttagcaracaaacatcttgatataatactga

SEQ ID NO: 40090 - DNA, 50 bp, homo sapien
atgtaatatgccttctaaaaataaartctgcatttccatgttcatttgcc

SEQ ID NO: 40091 - DNA, 50 bp, homo sapien
gagaagtggtgggcaggaaagtataraatggtgtaagagctcttttcctt

SEQ ID NO: 40092 - DNA, 50 bp, homo sapien
agattttgtttttgtgttttccatcsaacaataagcagatctatctttgt

SEQ ID NO: 40093 - DNA, 50 bp, homo sapien
cacggtgggctgtgacgataattcayggatgtctttgttggccagcgctc

SEQ ID NO: 40094 - DNA, 50 bp, homo sapien
aaagtttgaataaattctaaggacamaatgagcataatattacgtggttg

SEQ ID NO: 40095 - DNA, 50 bp, homo sapien
gtgctctgtcttctacaccgttgtcrgaattaaatttctaaatgttttca

SEQ ID NO: 40096 - DNA, 50 bp, homo sapien
tttcttacatgtatatattgcatacyggcagaatctgggcttttggtgta

SEQ ID NO: 40097 - DNA, 50 bp, homo sapien
acgtattagctgagcaacattaaacrgttatttaatcagagtttagttgc

SEQ ID NO: 40098 - DNA, 50 bp, homo sapien
ctttgaaggtaaagcgacgtatccaracttccttgtcttgacatcctgac

SEQ ID NO: 40099 - DNA, 50 bp, homo sapien
cttgcagtatacttttaaggtctaasaacaagccaccatttatttcctta

SEQ ID NO: 40100 - DNA, 50 bp, homo sapien
tatatccccacataaagttaaacaaygcttcatcaacatagctttacctg

SEQ ID NO: 40101 - DNA, 50 bp, homo sapien
tcaattattagtatgttccttactartacattcttctaaatatgaacaag

SEQ ID NO: 40102 - DNA, 50 bp, homo sapien
gcaggagggaattaaaagagttgccracagatttaaactagaagtttgca

SEQ ID NO: 40103 - DNA, 50 bp, homo sapien
cataggatgcatcctacatgtgatakattattaccacaagtatatctcat

SEQ ID NO: 40104 - DNA, 50 bp, homo sapien
gcttaagaattaggcacaataaggayacagaatggagaaatcaaagaaac

SEQ ID NO: 40105 - DNA, 50 bp, homo sapien
gtgaatatgataagctaagtcagaartagaatactttaaggcaataaagg

SEQ ID NO: 40106 - DNA, 50 bp, homo sapien
gctcacactaaaatacaggctataaytcagagactgaaaaatataatggg

SEQ ID NO: 40107 - DNA, 50 bp, homo sapien
gagaaacagagagctaccttatcccrgagtgacagacaatattttgcaga

SEQ ID NO: 40108 - DNA, 50 bp, homo sapien
cattgtcgtgtttgccctcacaccaktcttttcaacacaagacagaatac

SEQ ID NO: 40109 - DNA, 50 bp, homo sapien
cctagattttcccctgtgagtgccayacaagttgtacactaggggtcaca

SEQ ID NO: 40110 - DNA, 50 bp, homo sapien
caattctatctaacttgtctacaaaytagagggtttccatagtgcctcta

SEQ ID NO: 40111 - DNA, 50 bp, homo sapien
cttcaataggaggctcttagttagaygatgattgacctagtttctcagta

SEQ ID NO: 40112 - DNA, 50 bp, homo sapien
gggtggcataggagctatttagaaaygtcagggtttgctgggcaaattga

SEQ ID NO: 40113 - DNA, 50 bp, homo sapien
agacgatgattgacctagtttctcartacaaagtccttagatgggatcat

SEQ ID NO: 40114 - DNA, 50 bp, homo sapien
aacacttaaggttgaggaacatagargttagttagtgtcaaagagttgga

SEQ ID NO: 40115 - DNA, 50 bp, homo sapien
ttgatagctcctcattgaatgatcartatttcttccacaatctatttcat

SEQ ID NO: 40116 - DNA, 50 bp, homo sapien
aacatgtctctgtaaatatgtcctcygaccagcactctaccaagaagctt

SEQ ID NO: 40117 - DNA, 50 bp, homo sapien
cctgtaggaaaagcaatgctttcccrcttagacctgcttgctcacctggc

SEQ ID NO: 40118 - DNA, 50 bp, homo sapien
gcaactctgctctgtcttgctccacrgacctacgggtacttagggaagtc

SEQ ID NO: 40119 - DNA, 50 bp, homo sapien
cctccttcactagttgccttagcacmagtcattacacaagacactggtgc

SEQ ID NO: 40120 - DNA, 50 bp, homo sapien
tgggatgagataaaagtgagaggagsctagtcctgtgggattattcttaa

SEQ ID NO: 40121 - DNA, 50 bp, homo sapien
tagacagctgccccagtcaacttaaygtctaccacttaatccccacccta

SEQ ID NO: 40122 - DNA, 50 bp, homo sapien
tcttcaatggcctggggcttggctayacaagaaaatgcttgttataactt

SEQ ID NO: 40123 - DNA, 50 bp, homo sapien
aaggcttctggcagaaatttagtcasgacctgggaaggattatttcaaat

SEQ ID NO: 40124 - DNA, 50 bp, homo sapien
atggtttggattgagtagtcatagayatttacactgagatttaaataaca

SEQ ID NO: 40125 - DNA, 50 bp, homo sapien
caagccaattcattcatatatttaamactgttgagcatttactactgcca

SEQ ID NO: 40126 - DNA, 50 bp, homo sapien
aaatcatgaaagaccttttagatgayaataaggagtttggtttttactct

SEQ ID NO: 40127 - DNA, 50 bp, homo sapien
tacaagcaaagtggaaaagtaagacwctatcgtacagggaggaatctctc

SEQ ID NO: 40128 - DNA, 50 bp, homo sapien
cagatagcagtatgttgtaagtagawcttgctggcactggtttcttggct

SEQ ID NO: 40129 - DNA, 50 bp, homo sapien
aggaagtgaaaataacaggccgtaayggtctcatgaagaataaagcaccc

SEQ ID NO: 40130 - DNA, 50 bp, homo sapien
cacgtggcatttgttttgtttgcaastgatgaagccaaagaggaaaggaa

SEQ ID NO: 40131 - DNA, 50 bp, homo sapien
ttgtttttaaaaaaccatcctatacygagcagaataatagtagagaagaa

SEQ ID NO: 40132 - DNA, 50 bp, homo sapien
ctgtaagtattttcagttatcagagwccatagttgttgtaaactgacagg

SEQ ID NO: 40133 - DNA, 50 bp, homo sapien
gaaaaatacttatatattgacggaamacttctagaatgatacccaaactc

SEQ ID NO: 40134 - DNA, 50 bp, homo sapien
aatctaatttatgactggtcaagtamatttaaatagattaatgccttaat

SEQ ID NO: 40135 - DNA, 50 bp, homo sapien
gttccagcttcctcatctgtaaaaawcgagcaagttaagactgggtgagt

SEQ ID NO: 40136 - DNA, 50 bp, homo sapien
gaacttaaagtcaaatcctggctaaytgagtgataatagcaaacaggcca

SEQ ID NO: 40137 - DNA, 50 bp, homo sapien
cccattatatacttactcttagaaartatgtacagataatgggtgcagtt

SEQ ID NO: 40138 - DNA, 50 bp, homo sapien
ctttagccaaaagactaggaattagrcagccttgtaagacagaagacttt

SEQ ID NO: 40139 - DNA, 50 bp, homo sapien
taaagccactttggtcctacaagccmaatgcgtatgttctgtagggttgc

SEQ ID NO: 40140 - DNA, 50 bp, homo sapien
catttgtcacccgatttcctgcaaartgaatgttctttatattttatctt

SEQ ID NO: 40141 - DNA, 50 bp, homo sapien
aaataagaactaggcaaacttaccayaggataacagaaaacccaaaataa

SEQ ID NO: 40142 - DNA, 50 bp, homo sapien
ttgaacttcaccttgacaatgtaaaygaacagcttaccttcacaggtaca

SEQ ID NO: 40143 - DNA, 50 bp, homo sapien
tccagaaaattgttagaagtactaayggagtctaaaatcataattttttt

SEQ ID NO: 40144 - DNA, 50 bp, homo sapien
taaaaacaagcattctggccctttgyaagagcattataaatcatggtttc

SEQ ID NO: 40145 - DNA, 50 bp, homo sapien
tttaatgaaacctttatgttgtttcycatgtcttttataaaacaagaaac

SEQ ID NO: 40146 - DNA, 50 bp, homo sapien
agcagagttgtgagcatatagggcayccagattttaaaattaagtcttga

SEQ ID NO: 40147 - DNA, 50 bp, homo sapien
tttaaatgtgtaataatacaaacatraataacacagagtatgaacattct

SEQ ID NO: 40148 - DNA, 50 bp, homo sapien
tacacaaagtgactagagcattaaaytgtaatgaaaatacctgaaagtgc

SEQ ID NO: 40149 - DNA, 50 bp, homo sapien
aataaacaggtggtaggagcacagawgaacccaaaagatttcatttttca

SEQ ID NO: 40150 - DNA, 50 bp, homo sapien
gccacgccacccaacctcttcaatgraactgttaaacccaatttagcttt

SEQ ID NO: 40151 - DNA, 50 bp, homo sapien
cctacttatgtttctgagagtcaacraattcctgaatgctatgctttctt

SEQ ID NO: 40152 - DNA, 50 bp, homo sapien
gaaaacaaaaaggatgaattttccartactctgagttcaccagaaaattc

SEQ ID NO: 40153 - DNA, 50 bp, homo sapien
tccttcgtcatctattcctttcttayctctccagcttcatcactcatctc

SEQ ID NO: 40154 - DNA, 50 bp, homo sapien
tggataagattggttgctaggtcacrggttgaattttaactatcaggtaa

SEQ ID NO: 40155 - DNA, 50 bp, homo sapien
agaagaggactcaactcaaaatgggycaattaaatacagaggggaagatt

SEQ ID NO: 40156 - DNA, 50 bp, homo sapien
ttttagaagccaagttgcagagtatsaagaagaagccagaaagcttgtgg

SEQ ID NO: 40157 - DNA, 50 bp, homo sapien
agtgttggccacatttagttagcacyaggaaaggttaaatggggtcagag

SEQ ID NO: 40158 - DNA, 50 bp, homo sapien
aatgattcaaaatagatgaacagaaygcttcccaactttccaaaaatatg

SEQ ID NO: 40159 - DNA, 50 bp, homo sapien
cactctgtaagccctgccatttttaygttgaaatagtagttgaatatgct

SEQ ID NO: 40160 - DNA, 50 bp, homo sapien
caattccttaaaaataacaaactacsaatactctgcctagattacattga

SEQ ID NO: 40161 - DNA, 50 bp, homo sapien
tataaactatgaactttagttaatartagcgtattgatattggttcatca

SEQ ID NO: 40162 - DNA, 50 bp, homo sapien
aggtggcaatagtgtttcagtgacargcatatttggagccatcttcaatc

SEQ ID NO: 40163 - DNA, 50 bp, homo sapien
ctagttcattttcaagataattacayagcagtagaactacaccatagata

SEQ ID NO: 40164 - DNA, 50 bp, homo sapien
cattcacatgacactgtatcactcayggactgttttaaagcgcaatccac

SEQ ID NO: 40165 - DNA, 50 bp, homo sapien
cagacctttcctttgtcgattgagayagcttagtatttcttgtaacaatt

SEQ ID NO: 40166 - DNA, 50 bp, homo sapien
aggctacaattaaggtgttagcctasggtctctcacaagactacaatcac

SEQ ID NO: 40167 - DNA, 50 bp, homo sapien
aagtaagacacataataaaatataaracaaacgtgacaggtttctttgaa

SEQ ID NO: 40168 - DNA, 50 bp, homo sapien
acaatatctgtggatcagctagctaygggaaatgaggaaaagaggaattt

SEQ ID NO: 40169 - DNA, 50 bp, homo sapien
aagtcagatatctacaaaccaggaartaacctctcgccagacactggatc

SEQ ID NO: 40170 - DNA, 50 bp, homo sapien
gtgattagctaaaattctatttctgracgaggcagtagaaataagaaaaa

SEQ ID NO: 40171 - DNA, 50 bp, homo sapien
caccattactatccctccaacaacaraggctgaaaaaaattacactccag

SEQ ID NO: 40172 - DNA, 50 bp, homo sapien
atggtatgtgaaatcatatctcatcrcaaacaatttttcaggagttctcg

SEQ ID NO: 40173 - DNA, 50 bp, homo sapien
ttatattaatctagagagttagttaygaattttattaatattatgacctc

SEQ ID NO: 40174 - DNA, 50 bp, homo sapien
ccgatttccctatttctataaccaamtcttatggataatagcagttaagg

SEQ ID NO: 40175 - DNA, 50 bp, homo sapien
aggtttacaagaattttggggaaacrctaagcaattaagcagaaaaacct

SEQ ID NO: 40176 - DNA, 50 bp, homo sapien
ataattgtataaagtatacagtttargtcaaggatcactttttgaaaaag

SEQ ID NO: 40177 - DNA, 50 bp, homo sapien
aagtggcttacctgttgtatattgarcaaatagcattagtaagttaggga

SEQ ID NO: 40178 - DNA, 50 bp, homo sapien
tggggggagttctgccaggggaggaygctagattctcttccgtcagtgaa

SEQ ID NO: 40179 - DNA, 50 bp, homo sapien
cttatagcagacctggtgaatatccrcaagaatgttttattttaaggtat

SEQ ID NO: 40180 - DNA, 50 bp, homo sapien
ctgattaaatgcaggcatactggaaraggaaggaagatgtaagaaataaa

SEQ ID NO: 40181 - DNA, 50 bp, homo sapien
cagggagcaaactggcttgatggtasagtttgtggaggaggagttgtgta

SEQ ID NO: 40182 - DNA, 50 bp, homo sapien
atgaaacaagatttgaatttctaaaycatggcctacgaactacatttcct

SEQ ID NO: 40183 - DNA, 50 bp, homo sapien
acttctacaactttaggcactatcartaaaaaaacatacatgcacataac

SEQ ID NO: 40184 - DNA, 50 bp, homo sapien
tgagattttgctgtctagtgcatggmaacttggtacaaagaatgtggcag

SEQ ID NO: 40185 - DNA, 50 bp, homo sapien
tccctagtacctaggacagttctcamaacacacgaggtatttcatatcca

SEQ ID NO: 40186 - DNA, 50 bp, homo sapien
atcgctgagtcagaagaatgaaatcrgagctggaccagacacaaatgggt

SEQ ID NO: 40187 - DNA, 50 bp, homo sapien
aatctagggcaggttacagttttcaytcattttgactcattaacctttct

SEQ ID NO: 40188 - DNA, 50 bp, homo sapien
tttcttgggagagccgattgtaaacsatttaccagcacaccactagattt

SEQ ID NO: 40189 - DNA, 50 bp, homo sapien
tagtttaatagtgaatgaagaactaygtaattttaactgttcacatttac

SEQ ID NO: 40190 - DNA, 50 bp, homo sapien
aagcacatagacatcaaagacactcrcttcggaaatgtccctgactgctg

SEQ ID NO: 40191 - DNA, 50 bp, homo sapien
tgtctctgtgtctgataaatatcgaygatccctgtgtttctctcaaatta

SEQ ID NO: 40192 - DNA, 50 bp, homo sapien
aatggctgcttggtggcttattagargagagaatatattaagcaagacag

SEQ ID NO: 40193 - DNA, 50 bp, homo sapien
cagctacgcgcgccactatggccacsgtctgagtctggtttcttttccca

SEQ ID NO: 40194 - DNA, 50 bp, homo sapien
atcaatatgatttatgaaagaccctragcatacaaaattcatggaggata

SEQ ID NO: 40195 - DNA, 50 bp, homo sapien
caacattgcttcagggacttccgagsagatttgagccgtggtagaagggg

SEQ ID NO: 40196 - DNA, 50 bp, homo sapien
tagaaatgagttggactgtgctaccygcggttacttatgcccaaaagcca

SEQ ID NO: 40197 - DNA, 50 bp, homo sapien
gtggttttagggacaagaactgttaygatctgataatctgaaagaacttg

SEQ ID NO: 40198 - DNA, 50 bp, homo sapien
ttttgcttaataaggcattttgaaarattaatacattaataaacccaggt

SEQ ID NO: 40199 - DNA, 50 bp, homo sapien
aacctgctacccactctagtaaggcrgacaagtaaccaaaatttaaaaac

SEQ ID NO: 40200 - DNA, 50 bp, homo sapien
tggatgccctttctgctaccaagackgtcagtagttacacaaaattatat

SEQ ID NO: 40201 - DNA, 50 bp, homo sapien
ttccaagggtttttcattttaacaaygtacaatgccttaatctagatgaa

SEQ ID NO: 40202 - DNA, 50 bp, homo sapien
tcctcaaatgtattttggaggaccargaaaaagttgttaaatgagagaat

SEQ ID NO: 40203 - DNA, 50 bp, homo sapien
gaatcagacatttctcagacattctkaatctagaccatgttaggggtttt

SEQ ID NO: 40204 - DNA, 50 bp, homo sapien
tacaaaacccaggcatagaagaagawgctatttattgaactccctcaaaa

SEQ ID NO: 40205 - DNA, 50 bp, homo sapien
ggtgtcttgtaactgagatgctggartacagagaggagagaggggacagc

SEQ ID NO: 40206 - DNA, 50 bp, homo sapien
actcaaaggttaaaggctggccgcayagagagagtaaatgttttcagtaa

SEQ ID NO: 40207 - DNA, 50 bp, homo sapien
tgtgactccaggttggattcaagtayggttttctatttttcttctgattg

SEQ ID NO: 40208 - DNA, 50 bp, homo sapien
tcattcatcactcttatgggaacacrgaaacattcgggctgtgcaattca

SEQ ID NO: 40209 - DNA, 50 bp, homo sapien
cacttaagtttctaggttagttcatraaagcctgttctacccagaatata

SEQ ID NO: 40210 - DNA, 50 bp, homo sapien
gcaaaataagatcagttagataacartggttgtttgaattggtaaattaa

SEQ ID NO: 40211 - DNA, 50 bp, homo sapien
acagtgtggattttatgaaggctaaygctttgctttattcataatttcaa

SEQ ID NO: 40212 - DNA, 50 bp, homo sapien
aatagtcagtgaccaaattgacttayacggtgtgatttatggaatgccag

SEQ ID NO: 40213 - DNA, 50 bp, homo sapien
tattacaagaaagctacatatctcarcctcaatcatctgtcatccgaact

SEQ ID NO: 40214 - DNA, 50 bp, homo sapien
aatcataatcatggtacagaatccamaaaagttccctcattatatcctct

SEQ ID NO: 40215 - DNA, 50 bp, homo sapien
attaagttgctcttcaaatctctgaragcctatcataaaaatctggacag

SEQ ID NO: 40216 - DNA, 50 bp, homo sapien
tctcagcctcaatcatctgtcatccsaactatgtatgtaactattatctg

SEQ ID NO: 40217 - DNA, 50 bp, homo sapien
tattgtacaacttctagcttcttgaytaccattctggatctaaccatcta

SEQ ID NO: 40218 - DNA, 50 bp, homo sapien
gtaaatggcatcctatatgatttcaygtgttgatattaatgttgtggcgt

SEQ ID NO: 40219 - DNA, 50 bp, homo sapien
gcagtgtgaaagatacaaatacctaragctagttttgtcctcaattaaaa

SEQ ID NO: 40220 - DNA, 50 bp, homo sapien
tgtcaatctaaaactcctggaagaawatcatgacttttagaaagatcttc

SEQ ID NO: 40221 - DNA, 50 bp, homo sapien
gaaaaatgaaaatgccatgtcctaasagcatgaatgtttacatttcagtt

SEQ ID NO: 40222 - DNA, 50 bp, homo sapien
cagctaatatctcctgcttaaaatawctaaaattggagaaagagagagag

SEQ ID NO: 40223 - DNA, 50 bp, homo sapien
aagtacatgtctctgtaatattctgkatgatgaatgtgatgaaatgggag

SEQ ID NO: 40224 - DNA, 50 bp, homo sapien
catttcatggaaaattacttgtggarattctttgaggcttagtatgaaga

SEQ ID NO: 40225 - DNA, 50 bp, homo sapien
ctactgtgagcactgataaaattaaygagtttcatagtaattctaatatg

SEQ ID NO: 40226 - DNA, 50 bp, homo sapien
atgaaccatccatgaaggtccaatawcttttgtgttctagtcaaggctgg

SEQ ID NO: 40227 - DNA, 50 bp, homo sapien
ctgtgtgaaatggactacacagccasgttaggtgattgcagagagagata

SEQ ID NO: 40228 - DNA, 50 bp, homo sapien
aagccttagatttatttcactctgcraagttgtcacaacagcagattttc

SEQ ID NO: 40229 - DNA, 50 bp, homo sapien
aaaattacaagtttatacagacagaragtataaaggcaaatggggtaaaa

SEQ ID NO: 40230 - DNA, 50 bp, homo sapien
ttttatgaatttcacataattggcayaatctgtacccaggacatcaccca

SEQ ID NO: 40231 - DNA, 50 bp, homo sapien
actctctgaaatactggttagaatasaactcagaattgtcctagtgggtg

SEQ ID NO: 40232 - DNA, 50 bp, homo sapien
ttggattttaagctacttaaatgcamataaatgattttaaaagtatgagt

SEQ ID NO: 40233 - DNA, 50 bp, homo sapien
ttagcatttttttttctgttcagtaktaattgttttaagccaccagcctg

SEQ ID NO: 40234 - DNA, 50 bp, homo sapien
tgaaatattgcttacttttatactcraatcttttaaattcatgttttctt

SEQ ID NO: 40235 - DNA, 50 bp, homo sapien
agaaaagggttgccacgacaaatgasacaaggaagaccagagaaggactc

SEQ ID NO: 40236 - DNA, 50 bp, homo sapien
atgagagagcagaaataaagggaagrcaaattcaggaaataataaatgct

SEQ ID NO: 40237 - DNA, 50 bp, homo sapien
attatacttcctttcacatgcaaaawtatttaagccattctttaggttat

SEQ ID NO: 40238 - DNA, 50 bp, homo sapien
taagcatctactttgtgtaaagtacygagaaccaatgaaatgtaattaat

SEQ ID NO: 40239 - DNA, 50 bp, homo sapien
catgaaaaataatggtatctgcagartatctgtatgtagtagctctacag

SEQ ID NO: 40240 - DNA, 50 bp, homo sapien
tcaatctttttagtgctttgttctaraatcttctttggaacaaacaagat

SEQ ID NO: 40241 - DNA, 50 bp, homo sapien
ccaaagacccagaatcaaggcttgcratgaaatcacttttcctcatgact

SEQ ID NO: 40242 - DNA, 50 bp, homo sapien
gaaaagggttcaacctcctgcttcayagaatttagtttctatgaaatgaa

SEQ ID NO: 40243 - DNA, 50 bp, homo sapien
cccttcacaaaaaaatcaaatagacsattgtaaaatgcaaactacaaaat

SEQ ID NO: 40244 - DNA, 50 bp, homo sapien
tatgttgtggtattccattattttawcttgcatttcttggatgacacgtg

SEQ ID NO: 40245 - DNA, 50 bp, homo sapien
tgtctggaagttttagttttggatcrgaattatcaacacttgcttgaatt

SEQ ID NO: 40246 - DNA, 50 bp, homo sapien
gtatgaagtaaattcatgaaatttcrcacctaaatcacgtgatttctctc

SEQ ID NO: 40247 - DNA, 50 bp, homo sapien
aaaagacacaaatattcactcgttcsagaatgtataaataagataaatga

SEQ ID NO: 40248 - DNA, 50 bp, homo sapien
ctgcagctatttctcaagggttaaaygttggaaagtcagtcctacttccc

SEQ ID NO: 40249 - DNA, 50 bp, homo sapien
aggtctataataacctatgctttcawcttagtaaactagagaaagaagag

SEQ ID NO: 40250 - DNA, 50 bp, homo sapien
agaatttcttctctcctcaatatacygcgaacttaactaaaagtcagcaa

SEQ ID NO: 40251 - DNA, 50 bp, homo sapien
aaaggggataggctacctcttaaatracctataggaaacaggcaaacaag

SEQ ID NO: 40252 - DNA, 50 bp, homo sapien
tatattagtgcttgaaaggcagctcmgaagtttggattctatactttatg

SEQ ID NO: 40253 - DNA, 50 bp, homo sapien
tgagagaaatttcaaccaattatggratatttatgctcgaaataccctga

SEQ ID NO: 40254 - DNA, 50 bp, homo sapien
tgaatgtacacatatgtctttgagamactgccttcaatattttgggtaca

SEQ ID NO: 40255 - DNA, 50 bp, homo sapien
tcattttctagccaataataaccaayttagttgctaaactaataatttaa

SEQ ID NO: 40256 - DNA, 50 bp, homo sapien
atttaacattttgctatcaaggagaygttgaaattgtggttattgttaac

SEQ ID NO: 40257 - DNA, 50 bp, homo sapien
agaaagtggttaagagattccaaaawtgagatctagtccagagattctca

SEQ ID NO: 40258 - DNA, 50 bp, homo sapien
ttttcccacataccctataacttcarggttatgcgattacaaagctttta

SEQ ID NO: 40259 - DNA, 50 bp, homo sapien
cactccctttgtaagagcagctgaaygacctgttagttaagttttagtag

SEQ ID NO: 40260 - DNA, 50 bp, homo sapien
cagatatccaggtcaacattttctgraaacatattaaatggagtggcaca

SEQ ID NO: 40261 - DNA, 50 bp, homo sapien
ttgtttttcaagaaattttcaccaargttaccagatttgtggacatagag

SEQ ID NO: 40262 - DNA, 50 bp, homo sapien
cctattacatcctaatcttactcaamgctattgcacctgcaagtgtgtgc

SEQ ID NO: 40263 - DNA, 50 bp, homo sapien
attctgccatgttggaactgcctcamatctcattttaacattctattgtt

SEQ ID NO: 40264 - DNA, 50 bp, homo sapien
ctaatgtgagacccattatctaataraagtcatgaaatctagcttattca

SEQ ID NO: 40265 - DNA, 50 bp, homo sapien
agacattttgatcttatagaagtgastagatgaaacattagagtaataaa

SEQ ID NO: 40266 - DNA, 50 bp, homo sapien
tagaaaaatgactagtatcagcgaasaggtagggagataagctttgttca

SEQ ID NO: 40267 - DNA, 50 bp, homo sapien
acattttcctttaaagcaaatgatayggcagtcgcacacttcaattctgt

SEQ ID NO: 40268 - DNA, 50 bp, homo sapien
tgtcacaggaagaatctaagcactgsaaagaaagtgtgattagttgatcc

SEQ ID NO: 40269 - DNA, 50 bp, homo sapien
gagggggtatgaaatacagataagaktacaactttgaaattaacaacatt

SEQ ID NO: 40270 - DNA, 50 bp, homo sapien
gtctgttagctctagcaacataattraagtgcaaggaaagagggaaagca

SEQ ID NO: 40271 - DNA, 50 bp, homo sapien
gccacatttatatatttttggtttayggttggagacgtatttgaagtgtc

SEQ ID NO: 40272 - DNA, 50 bp, homo sapien
aaatgccatcttgctgtgataaagayctcaaaagggctaatgaaattatc

SEQ ID NO: 40273 - DNA, 50 bp, homo sapien
ataaacacatatatagggtagagtcycatcagctaatcagtgaatgcatg

SEQ ID NO: 40274 - DNA, 50 bp, homo sapien
gacaaaaagtctgcagctaaagtagracaaacacaacttagaattatgag

SEQ ID NO: 40275 - DNA, 50 bp, homo sapien
atacaaacaagtaaggtgaatttaartagcatgacaatacatgtggagaa

SEQ ID NO: 40276 - DNA, 50 bp, homo sapien
ctagtcacttaaaagagcaacattakaacacttatatcccaacctcaatt

SEQ ID NO: 40277 - DNA, 50 bp, homo sapien
ttgagttattattttatgaattttcycagtcagaggcttcttccccatcc

SEQ ID NO: 40278 - DNA, 50 bp, homo sapien
atcatattgaattttgagtgagtcaratgttttaatgtttgttaacatta

SEQ ID NO: 40279 - DNA, 50 bp, homo sapien
gtttttatgtgccaatgccaatatayataatttatcaacacaacctacag

SEQ ID NO: 40280 - DNA, 50 bp, homo sapien
ccagatccagctgaaagatacagctraaagagacagcctgcagcatcatc

SEQ ID NO: 40281 - DNA, 50 bp, homo sapien
tggctctgagttctgtttctttacckaccttaactgaaattctctgggtt

SEQ ID NO: 40282 - DNA, 50 bp, homo sapien
gtatctatgatccagaagtatataaygaaaatagacatctgcaatactgt

SEQ ID NO: 40283 - DNA, 50 bp, homo sapien
gtactttaaacagaggagaaagcaartgataaaacagtttctcagtagaa

SEQ ID NO: 40284 - DNA, 50 bp, homo sapien
cctaattttattatcattcaaagaamgcatgagagttatgataaatcata

SEQ ID NO: 40285 - DNA, 50 bp, homo sapien
gaaaatctgaccaaaatacaaggcastgaaatctggtgcatttagatgag

SEQ ID NO: 40286 - DNA, 50 bp, homo sapien
caattaaatgactaagcaaaacttayattcatgaaaaacaagttcaacaa

SEQ ID NO: 40287 - DNA, 50 bp, homo sapien
ttcactgaagaattatattaagagcraggtgaagaagaagaaatattttt

SEQ ID NO: 40288 - DNA, 50 bp, homo sapien
gctgagatggggaacttgccaaggamgtatggcagcgggtcaggatagag

SEQ ID NO: 40289 - DNA, 50 bp, homo sapien
gtatagctagttttttgttatccatsataataggatgggtaattgtaatt

SEQ ID NO: 40290 - DNA, 50 bp, homo sapien
gatcttcttacttccgtatcaaatarcactgtgattactgtctttcaatc

SEQ ID NO: 40291 - DNA, 50 bp, homo sapien
aaggagattaccaggcagaatatctraagtgtcagctgtttcttttagcc

SEQ ID NO: 40292 - DNA, 50 bp, homo sapien
gccacaaattgataaattgttgtgamaaaaagagaaactggcacacatga

SEQ ID NO: 40293 - DNA, 50 bp, homo sapien
ataaagcccttaagattattagaagmccttttgtttaacagagaggaact

SEQ ID NO: 40294 - DNA, 50 bp, homo sapien
tgtagttttactcatcatatccatgraagttgttaaatggaaagtattaa

SEQ ID NO: 40295 - DNA, 50 bp, homo sapien
aagtctcggtaagagtaattgaaacygttagcttttagtttttccaatgt

SEQ ID NO: 40296 - DNA, 50 bp, homo sapien
ttttccaaaatattcttgagaagtamgcatatatgcaaagccatacatgg

SEQ ID NO: 40297 - DNA, 50 bp, homo sapien
attgcataacaattttcctatacctragaatgcctttgcttttaattttg

SEQ ID NO: 40298 - DNA, 50 bp, homo sapien
attcagagtgatcagaatatatttcraaacctattgagagttatggcatt

SEQ ID NO: 40299 - DNA, 50 bp, homo sapien
acttctcactcccgccaccctgtgamggtctttgcttcctctttgccttc

SEQ ID NO: 40300 - DNA, 50 bp, homo sapien
gagatcatgtgacagccgcacagcgmatcaggtcgcgggtccatttcaca

SEQ ID NO: 40301 - DNA, 50 bp, homo sapien
tctatgtataaagcaataatgtataygctcttctgagaccttggagtaaa

SEQ ID NO: 40302 - DNA, 50 bp, homo sapien
tgacataactttccctggatgagtaraacagcttagtgatctagccattt

SEQ ID NO: 40303 - DNA, 50 bp, homo sapien
ctatgcttaataaccactatacttasgtgaactgcttctaagtattaaaa

SEQ ID NO: 40304 - DNA, 50 bp, homo sapien
ataatcgctctcttaaaatgaagcaygaggataagtaataactttttatg

SEQ ID NO: 40305 - DNA, 50 bp, homo sapien
tttataatacatttacctgaatcaamtcccctctgaaaacttgcttcttg

SEQ ID NO: 40306 - DNA, 50 bp, homo sapien
caaaagcaggttattgccacagatayggaccttgtctgatactgtctaga

SEQ ID NO: 40307 - DNA, 50 bp, homo sapien
ctaaagcttaaaaccccaaattccaygtccctgagtaggaaagagatatt

SEQ ID NO: 40308 - DNA, 50 bp, homo sapien
tgcacaaatgtaacgttgagagaacraagccaggctcaaaagaataatct

SEQ ID NO: 40309 - DNA, 50 bp, homo sapien
ctaaagcccctattctttcccatacrcagccggtttactcacattttgca

SEQ ID NO: 40310 - DNA, 50 bp, homo sapien
tgcagagacggtcaagtataaaatayatcagatcaggactttaatagtgc

SEQ ID NO: 40311 - DNA, 50 bp, homo sapien
gaggagagaggttggataaggaacayggtgcaagcctgactccacatgaa

SEQ ID NO: 40312 - DNA, 50 bp, homo sapien
gaagcctaagtaatatttacccgccraataaggcacatcctacttctgtc

SEQ ID NO: 40313 - DNA, 50 bp, homo sapien
agtgcagcagctgggctcctggtcartgaagttcctccatcttggaggtc

SEQ ID NO: 40314 - DNA, 50 bp, homo sapien
ataaagtagaaacagaaagtaataamggtgaacatgtcttctcccaagtt

SEQ ID NO: 40315 - DNA, 50 bp, homo sapien
aagatgtagcttctaatatagaacaygttggtggatgcaaattcctagtg

SEQ ID NO: 40316 - DNA, 50 bp, homo sapien
cccactgatttcccagcgctgtaacmatacagaaatatgacgcaaagcaa

SEQ ID NO: 40317 - DNA, 50 bp, homo sapien
agcttttttgtttttttaatcatcayatattaaaggtgcaataaaaacat

SEQ ID NO: 40318 - DNA, 50 bp, homo sapien
caagcgacaagtttaggctggtgaaktagtagctaaaaggcttttaaagc

SEQ ID NO: 40319 - DNA, 50 bp, homo sapien
actgtctgagatgtgaaccagtaccygaattcctgtgtatagggtcctct

SEQ ID NO: 40320 - DNA, 50 bp, homo sapien
tttggcgccgatgctatgagaaacaygagttaatgaaagggtttagctcc

SEQ ID NO: 40321 - DNA, 50 bp, homo sapien
aactactaaattatctgttcttttawgtatgatgtctaaacctgccttta

SEQ ID NO: 40322 - DNA, 50 bp, homo sapien
caaaatatgtagctgattaataccarcattgtgaacgctgtacaaccttg

SEQ ID NO: 40323 - DNA, 50 bp, homo sapien
tcatttacaattatctcttcctttcyaagcgttgagcttcttgagaatgt

SEQ ID NO: 40324 - DNA, 50 bp, homo sapien
tactgctatagcatgtttcagacacrataggaaaatgaccatcctctcat

SEQ ID NO: 40325 - DNA, 50 bp, homo sapien
aaagaaaaaagtttgtggtctccacyaatggtataaaataataattaatg

SEQ ID NO: 40326 - DNA, 50 bp, homo sapien
gcaaccaagatactcttcaaatgccraatttataaacaaactatggtaca

SEQ ID NO: 40327 - DNA, 50 bp, homo sapien
ctggagagggagacttcctgagggcygatcaactgtctaatcactattta

SEQ ID NO: 40328 - DNA, 50 bp, homo sapien
ctaatgttttcttcagcacagaataygacacaaggaagagacatacttgg

SEQ ID NO: 40329 - DNA, 50 bp, homo sapien
ttaaatccattcttttatttaaacartgttaagcagttttcttaggggca

SEQ ID NO: 40330 - DNA, 50 bp, homo sapien
tatatcagtaagtcacaatcaacaayggcaaatgaggactctgaggagcc

SEQ ID NO: 40331 - DNA, 50 bp, homo sapien
aattaaataattctaaggagtttacmacatacggtatatacaaagattga

SEQ ID NO: 40332 - DNA, 50 bp, homo sapien
tatacatatatatgttagggttgaakaacaagaaaatatgtaatagataa

SEQ ID NO: 40333 - DNA, 50 bp, homo sapien
gccattagtcttctaagtggtaacaytggattaaattttcagaaagcttg

SEQ ID NO: 40334 - DNA, 50 bp, homo sapien
catgtggaatggtatagccattatgyaaattgtgtggatttttctaaaca

SEQ ID NO: 40335 - DNA, 50 bp, homo sapien
tccagactaagcaggaaatctttaargccacaagtacttaataccaacta

SEQ ID NO: 40336 - DNA, 50 bp, homo sapien
tcagccccaaaacacacacagttgcraagtccttttgagttgatttctgg

SEQ ID NO: 40337 - DNA, 50 bp, homo sapien
agcaatgtgtttttatatacttgtakgtgagtagaatattgctttcatgg

SEQ ID NO: 40338 - DNA, 50 bp, homo sapien
ggcaatttatcctagggacctttcaratattcagaacatatttgcaaacc

SEQ ID NO: 40339 - DNA, 50 bp, homo sapien
tattggtcttaatgctctactgctaraaattgccaccttgccaggactcg

SEQ ID NO: 40340 - DNA, 50 bp, homo sapien
tgagcctgggagctagacagaatgaygtattgattagaaaggacagatat

SEQ ID NO: 40341 - DNA, 50 bp, homo sapien
caggcagacagatgatcctggagcaygttcagggaggagggcaggagcca

SEQ ID NO: 40342 - DNA, 50 bp, homo sapien
ggtggaaaagaggatttatatacaartggttcaagatcttttttatcctc

SEQ ID NO: 40343 - DNA, 50 bp, homo sapien
agtaagatcaattaacattctcttcyatattgaacataattagaatggca

SEQ ID NO: 40344 - DNA, 50 bp, homo sapien
ttgactggatgttttggcattaagamattttgctaaattcaaaaagatgg

SEQ ID NO: 40345 - DNA, 50 bp, homo sapien
aaaacctaccttgtgcatctgaatamtaaggcatgagttagggattttga

SEQ ID NO: 40346 - DNA, 50 bp, homo sapien
ctagaattaaagagtggcaataacaygaggaagagttcgaaaggagttta

SEQ ID NO: 40347 - DNA, 50 bp, homo sapien
ataacagggaggtgtcctaatagcaygatagatggtgaaaagaagacgtg

SEQ ID NO: 40348 - DNA, 50 bp, homo sapien
tgctctctcccctcttttgtgaagamagcgggtccaaatgtgattcaaac

SEQ ID NO: 40349 - DNA, 50 bp, homo sapien
gggggcaggagcaacttgtaataatkaaaatgtaaacgtgaaaaaaagga

SEQ ID NO: 40350 - DNA, 50 bp, homo sapien
tggtgaaaatggagccaagatgaaaygatctgtcaaaaatttgattgatt

SEQ ID NO: 40351 - DNA, 50 bp, homo sapien
acagacactacagcaactatgggaayctcaactttgaaatagtatgggac

SEQ ID NO: 40352 - DNA, 50 bp, homo sapien
taaaaataattacttttatacttaaygatagtgctaaggtactaggggaa

SEQ ID NO: 40353 - DNA, 50 bp, homo sapien
aacataatcagagttaaataaataaytcacctcttcataagataacaaat

SEQ ID NO: 40354 - DNA, 50 bp, homo sapien
gggactgtgaattacattttagtaarctgtgaagcccatgaacacatagt

SEQ ID NO: 40355 - DNA, 50 bp, homo sapien
tggcctctgatatcagttgtgtttcyagctgtaaaagcacaatagcatct

SEQ ID NO: 40356 - DNA, 50 bp, homo sapien
gcatccgcactgggttcttggaggamgattatgtcaagcaaagctgtcag

SEQ ID NO: 40357 - DNA, 50 bp, homo sapien
aatcccagactgtttctacaggatasagtgctaccagttctggcacatat

SEQ ID NO: 40358 - DNA, 50 bp, homo sapien
ggagttcaaaattacaattaaaatgraaacttcactagtggagctcaaca

SEQ ID NO: 40359 - DNA, 50 bp, homo sapien
agaggagcagaaattcattagatgcractttggtcatttcccctgtaatt

SEQ ID NO: 40360 - DNA, 50 bp, homo sapien
ggagaaggtgccagtcaacaaaccartgaaattaatgataatatcaagta

SEQ ID NO: 40361 - DNA, 50 bp, homo sapien
cttttgcctttctccccaaaacttayattgtgtggcttgctttctcactt

SEQ ID NO: 40362 - DNA, 50 bp, homo sapien
ctttttgacaggagtcttttagtcckgctatacagctgcaccttgtacat

SEQ ID NO: 40363 - DNA, 50 bp, homo sapien
aacacagtgaagtgttgtgtagccargataggcatgtgcacaagttacag

SEQ ID NO: 40364 - DNA, 50 bp, homo sapien
aatataaactaggataaatcttcacygtaagagaactattatcatatcca

SEQ ID NO: 40365 - DNA, 50 bp, homo sapien
caaatcaccctaaaatttgagacttmaaacaacaaacacttattatctca

SEQ ID NO: 40366 - DNA, 50 bp, homo sapien
tagtctcccttaccgcaacagtatayccagttctactaaacaatttacac

SEQ ID NO: 40367 - DNA, 50 bp, homo sapien
ttctcattaaaaaaagagcttcacartctataatatttcaaacaaaacaa

SEQ ID NO: 40368 - DNA, 50 bp, homo sapien
ctactcacatgaaggatgatgtgtayggcaaaatcctacttctgaacccg

SEQ ID NO: 40369 - DNA, 50 bp, homo sapien
gaattgtgtcttttaaagggagcacractgaaatatttctggatagaaaa

SEQ ID NO: 40370 - DNA, 50 bp, homo sapien
ttttcactctctcgtccaggagcaartgtcaaccgtagttttattcaaaa

SEQ ID NO: 40371 - DNA, 50 bp, homo sapien
tcaccaccaccaaccttgtttcgtargcaaactgggcccgagggtaaaat

SEQ ID NO: 40372 - DNA, 50 bp, homo sapien
agacgcctattagaaagaatactaaygggtacttattctgttttcctatg

SEQ ID NO: 40373 - DNA, 50 bp, homo sapien
taattctgcgcatacaccaatgaacrcattatacccatttgtttcagaaa

SEQ ID NO: 40374 - DNA, 50 bp, homo sapien
tgcagatttttggagatttaaaaccygacagcataattgacaacattttt

SEQ ID NO: 40375 - DNA, 50 bp, homo sapien
agtactaaaaagctgattagatagayaatgcttcctttaaatgtttccgt

SEQ ID NO: 40376 - DNA, 50 bp, homo sapien
tgcaagcccagcaatttgtattcacrgaaagtagagtagagaatttacaa

SEQ ID NO: 40377 - DNA, 50 bp, homo sapien
gtcagaggtaggatacagactggtaytacaaggtaaagataacttagcct

SEQ ID NO: 40378 - DNA, 50 bp, homo sapien
taatattcatcagagtcgtaaaaacyattatccagcataatatcttttaa

SEQ ID NO: 40379 - DNA, 50 bp, homo sapien
gtaaatactacagttcattaaaccayctgcttacttcatacaagctagca

SEQ ID NO: 40380 - DNA, 50 bp, homo sapien
ttcaaatgcacttcacgaaccgacaygtaataacatttgaaaaccaaatt

SEQ ID NO: 40381 - DNA, 50 bp, homo sapien
gctctgaaagataacaaacaggcaamatcttttacttcttgctcacaagt

SEQ ID NO: 40382 - DNA, 50 bp, homo sapien
aaagatatgcatggcatacaaagaayagggcttactatatttttgccact

SEQ ID NO: 40383 - DNA, 50 bp, homo sapien
taaaaatgcttccacaaactttgaawcttccttgtctacagggtatgtgt

SEQ ID NO: 40384 - DNA, 50 bp, homo sapien
ttaatttaaaatgaataatttatatsaaaggtatgcatcagcttaatgaa

SEQ ID NO: 40385 - DNA, 50 bp, homo sapien
gcagctttgcccttccttcctcactragagccctatagcccaggacggtc

SEQ ID NO: 40386 - DNA, 50 bp, homo sapien
agaccaggagactgagatgtttaatractaaccaactgaacatatgaata

SEQ ID NO: 40387 - DNA, 50 bp, homo sapien
tgaatttaattttcaaatcaagctayatatgtatgacattcagctttccc

SEQ ID NO: 40388 - DNA, 50 bp, homo sapien
agtgtcattcctgaatagcccttaaragagtcagggtttagatgcttcca

SEQ ID NO: 40389 - DNA, 50 bp, homo sapien
ttgaatcattattgaaatggaaaagraagtgtaatacgaagcattcatgg

SEQ ID NO: 40390 - DNA, 50 bp, homo sapien
atgagtgaagtacaactaagaataartaaaatagaaataatattaagcag

SEQ ID NO: 40391 - DNA, 50 bp, homo sapien
aagaagaatgaagatttgtgatccaygcttgagattgtggatcacctttg

SEQ ID NO: 40392 - DNA, 50 bp, homo sapien
tggatcaattgccagagatgagtcasaacataacctggctaggaaagtgc

SEQ ID NO: 40393 - DNA, 50 bp, homo sapien
gtccccaaaacccaggccagctaagkaaagcaatacatttggtggaaaag

SEQ ID NO: 40394 - DNA, 50 bp, homo sapien
aaatcaacagttcctattcagttgayaatacatatggcaagtcataaaat

SEQ ID NO: 40395 - DNA, 50 bp, homo sapien
gcagattaaaacagagtaaggcacaragagtttcaatgacctgttcaagt

SEQ ID NO: 40396 - DNA, 50 bp, homo sapien
aacgttttacttctgggagttaaaayaagactccatggcatatcaatgcc

SEQ ID NO: 40397 - DNA, 50 bp, homo sapien
aaacattataattatacctgacagckaaaaatattagtttgcatcttcct

SEQ ID NO: 40398 - DNA, 50 bp, homo sapien
gaagcttcccctcccgcaaacatacygcaaaggaaaatctttcgaagagc

SEQ ID NO: 40399 - DNA, 50 bp, homo sapien
tatcgaacacatcagcaaagaccaaygttatactgaaatgagtattatca

SEQ ID NO: 40400 - DNA, 50 bp, homo sapien
agaattttatagaaagttgaagttayactgtgtgatattggaaagacact

SEQ ID NO: 40401 - DNA, 50 bp, homo sapien
gcctatacagcactttgcactccatraaagaagcacctgagtacttacct

SEQ ID NO: 40402 - DNA, 50 bp, homo sapien
tgttaacttgattcagctaaaataayaggagttcccaaataatagatctg

SEQ ID NO: 40403 - DNA, 50 bp, homo sapien
ttaattggatcaaactaccaagcaakttatattccaggacattatcaaaa

SEQ ID NO: 40404 - DNA, 50 bp, homo sapien
gtgccctagacatgtagccactgtcrccatgattatacattttgataaat

SEQ ID NO: 40405 - DNA, 50 bp, homo sapien
ttcattaaattaaaaggaagtcctarctgatcgatcacatagaaaaatat

SEQ ID NO: 40406 - DNA, 50 bp, homo sapien
tgtttttgctgcatagcgacttcccrattttatagccttccttgggctta

SEQ ID NO: 40407 - DNA, 50 bp, homo sapien
tgaaacttttttttagctgtgaaacyattttgtcaagtgaattgctcctc

SEQ ID NO: 40408 - DNA, 50 bp, homo sapien
agtggtctggaataggaggaggataygcaaaatatggtatagggacattt

SEQ ID NO: 40409 - DNA, 50 bp, homo sapien
ttcatgatgtattaatttacgatggratttatgcttggctgaagaaatgg

SEQ ID NO: 40410 - DNA, 50 bp, homo sapien
gtgatctgcatatgtaccagtaaaaygcaaaccattatttaaattttttc

SEQ ID NO: 40411 - DNA, 50 bp, homo sapien
cgttcaatttattaagctaatctacyctgtacaaaaaaaatataaaaatt

SEQ ID NO: 40412 - DNA, 50 bp, homo sapien
agcttcctgaatgtgatcaggtaaayatcagttcaaattttcaaatctca

SEQ ID NO: 40413 - DNA, 50 bp, homo sapien
tgattctctacatattccgtcatgawctaaaatgaatagcttataaaaac

SEQ ID NO: 40414 - DNA, 50 bp, homo sapien
acactaggcaatgagtagtcaaatayggaaaggcattgatttggtgagga

SEQ ID NO: 40415 - DNA, 50 bp, homo sapien
tttcttaacatagaaatattgggagmaggtttatgtttatgtatcaggcc

SEQ ID NO: 40416 - DNA, 50 bp, homo sapien
atgtgtttgtgtttctccatggataygtttttcaacttttccatcacatt

SEQ ID NO: 40417 - DNA, 50 bp, homo sapien
atggcttaccacacagtaaattgcawctgctaatgataatgctgcagatt

SEQ ID NO: 40418 - DNA, 50 bp, homo sapien
gaaaaataaattgctgcatggttaarttaaactagaggagaagaaaggca

SEQ ID NO: 40419 - DNA, 50 bp, homo sapien
cttttccaagggagaacaatatggamgttgctagcttttctctctttcct

SEQ ID NO: 40420 - DNA, 50 bp, homo sapien
tagggttggaacacagaggttaaacrcatagcacctgtcttcaagtggct

SEQ ID NO: 40421 - DNA, 50 bp, homo sapien
agtaataatttttctagacatcctgraatgtaaaatgttggaaagatcag

SEQ ID NO: 40422 - DNA, 50 bp, homo sapien
gcctctttgtgttaaatctaatcgcyctggttagtattttaattttaaac

SEQ ID NO: 40423 - DNA, 50 bp, homo sapien
aacccaggtcttctcattttaattcrcattctttttatgtctctgtcctt

SEQ ID NO: 40424 - DNA, 50 bp, homo sapien
gtaataaaaagcaggttgctaaaacyactttatatactcagttgtgatat

SEQ ID NO: 40425 - DNA, 50 bp, homo sapien
gttgctgatatcacttctctactcaygttactatttcacacactataata

SEQ ID NO: 40426 - DNA, 50 bp, homo sapien
gcaacctcagtattttgtcctcttgmaatagtcataaacttgtaaagtac

SEQ ID NO: 40427 - DNA, 50 bp, homo sapien
cgaaaatattagaagttacagatacrcctcacagtatatttttattaaac

SEQ ID NO: 40428 - DNA, 50 bp, homo sapien
gaaatctttaaagactttttcatcakatggaataacaattagacaacaag

SEQ ID NO: 40429 - DNA, 50 bp, homo sapien
tatgtgtataggagatatttcaaacmaagtcatttatctttttttggtgt

SEQ ID NO: 40430 - DNA, 50 bp, homo sapien
tttgtgtgacattatttggtccatgrcatatacatatccaaacaacagtg

SEQ ID NO: 40431 - DNA, 50 bp, homo sapien
gaagggatagtcttacttctggatawctaccatgaggataaagtataaag

SEQ ID NO: 40432 - DNA, 50 bp, homo sapien
aacatgcttttatacttttattacayagttacgtaccaacaaattgttat

SEQ ID NO: 40433 - DNA, 50 bp, homo sapien
ttggtgattgaactttgcttcaccartcttacacttgaaagtatttggca

SEQ ID NO: 40434 - DNA, 50 bp, homo sapien
tgtcttgtctgtggagtgctttgagkcattctacaaatacatatttttag

SEQ ID NO: 40435 - DNA, 50 bp, homo sapien
atgtgtgatgtgtgtgcaatttgacragtcattacatcagagttctgatg

SEQ ID NO: 40436 - DNA, 50 bp, homo sapien
tcagtgatgacaccagaaaaatgaayaatgatcagatccagcatgctatc

SEQ ID NO: 40437 - DNA, 50 bp, homo sapien
tctgaacaacctgttatatgaatgaraaatatgcccagtgtctcatctag

SEQ ID NO: 40438 - DNA, 50 bp, homo sapien
acaacgaacccccatgtgcccattayataacttcagtaatgatgaactca

SEQ ID NO: 40439 - DNA, 50 bp, homo sapien
actaagtagcctataactttatagcrctactgataatactttaaaatatt

SEQ ID NO: 40440 - DNA, 50 bp, homo sapien
tcatgtgctgcttgtgaacagatcartataaaaagatgtggagaatgtat

SEQ ID NO: 40441 - DNA, 50 bp, homo sapien
tgcttcttggtacctctgatgtctcyctttcttcagggctctgtaggttt

SEQ ID NO: 40442 - DNA, 50 bp, homo sapien
tctttcttctaattatctcctattcyacagtaatattcttaaagtttacc

SEQ ID NO: 40443 - DNA, 50 bp, homo sapien
atatttcaacaagaattgggagaaartctatggttaggatggccatgtaa

SEQ ID NO: 40444 - DNA, 50 bp, homo sapien
ttggcccttacaacagaatataatamgaaaagaacgagaccgagcaaaat

SEQ ID NO: 40445 - DNA, 50 bp, homo sapien
gttcaagaagtaagattaactcataraaaatgatgacacatttcaaaaat

SEQ ID NO: 40446 - DNA, 50 bp, homo sapien
atagaggcaggtgagtaatcctagargttgtgtaaaatgctcctgattct

SEQ ID NO: 40447 - DNA, 50 bp, homo sapien
tttagggatggcactattgcccttgwaaagtctgttaaactcctcttttt

SEQ ID NO: 40448 - DNA, 50 bp, homo sapien
tctgccaacagaattcaagagtgaaracagaaaatgtcatcaatttagtg

SEQ ID NO: 40449 - DNA, 50 bp, homo sapien
aatgtcccacactcaaatcatcctamaatttcaaggcctatcctctgagt

SEQ ID NO: 40450 - DNA, 50 bp, homo sapien
tgtcaccctgagctaacgcccagtayagaattgagtgattattgagataa

SEQ ID NO: 40451 - DNA, 50 bp, homo sapien
tcacttatacaacaaatatatactaygtgtctggtgcattctagatccta

SEQ ID NO: 40452 - DNA, 50 bp, homo sapien
attatatcatttaaagttttattaasaccaatatttaactcttcctattg

SEQ ID NO: 40453 - DNA, 50 bp, homo sapien
agcaaccaaagcacagtaatgacaayattggacaggagagtgaagatcta

SEQ ID NO: 40454 - DNA, 50 bp, homo sapien
tctgttcactgtacatacatcttacrcattagtggtcaagcctatggcag

SEQ ID NO: 40455 - DNA, 50 bp, homo sapien
aaatacctgcatattcaaacaataamcaacatccgtattcagtatttttg

SEQ ID NO: 40456 - DNA, 50 bp, homo sapien
ctaaatacaggttgacatctaccaamaatttaactatctaaaaagaaatg

SEQ ID NO: 40457 - DNA, 50 bp, homo sapien
tacattccatgcagctaggtatggcragtttcagcccttgatatatgact

SEQ ID NO: 40458 - DNA, 50 bp, homo sapien
ctgttcaaattataccactacaggamaaactaactcgatgaaaaaatttt

SEQ ID NO: 40459 - DNA, 50 bp, homo sapien
tatttgataagcgctgtaacaaaaartgcatgtgggtgcagggcactgtg

SEQ ID NO: 40460 - DNA, 50 bp, homo sapien
aatccacaacctggaatttttttaasatactctcactaatccgttttcat

SEQ ID NO: 40461 - DNA, 50 bp, homo sapien
tgacatgaaagaatagagacttttcycaaaacatcaatgtgcaactgaaa

SEQ ID NO: 40462 - DNA, 50 bp, homo sapien
actttcatttccaccatataaacccraggacttttagcctggaatttgag

SEQ ID NO: 40463 - DNA, 50 bp, homo sapien
catcggtcaatctctacgtcccatargcagagtaataataggtaatgagg

SEQ ID NO: 40464 - DNA, 50 bp, homo sapien
caatttaagtggaccaaggtggacartgtaccctagataaatgattaact

SEQ ID NO: 40465 - DNA, 50 bp, homo sapien
ttttacaatatttatgtcctcaacaygctgacaatgagaaagtactttcc

SEQ ID NO: 40466 - DNA, 50 bp, homo sapien
tgcctgcaggtaacagaaaacacaawtccaaatggcctcaataataaaga

SEQ ID NO: 40467 - DNA, 50 bp, homo sapien
taaaaaactgaaaattacagagagaygataaattccaaatgacatagtga

SEQ ID NO: 40468 - DNA, 50 bp, homo sapien
aagagacttgtaaggtatattaatcraagggtgctgatggttagagtaga

SEQ ID NO: 40469 - DNA, 50 bp, homo sapien
acatgtttcatttgtgttgttttaayatcattattcctcttgtaattcga

SEQ ID NO: 40470 - DNA, 50 bp, homo sapien
ctcttctctgtgtcctggctacccarcaatccacagtgccctgcacccac

SEQ ID NO: 40471 - DNA, 50 bp, homo sapien
gactcaaaatgctggctggctgtcaygcccatctgaggagcttatcaaat

SEQ ID NO: 40472 - DNA, 50 bp, homo sapien
caggttaaatgtttggacgtcaaccrcgataatctgccatcacggcagcc

SEQ ID NO: 40473 - DNA, 50 bp, homo sapien
atgtcttgaaacctgaaattctctaratgtttggtgatctaaatattaaa

SEQ ID NO: 40474 - DNA, 50 bp, homo sapien
gtttattctattatttaggaaccacrattaatatttctaaaatgtacttt

SEQ ID NO: 40475 - DNA, 50 bp, homo sapien
aaaaaagaattgtagcacctctaagraagataaataaataagaaatttta

SEQ ID NO: 40476 - DNA, 50 bp, homo sapien
gtatatgagaaaagattcgctcatarcaaaagtgtaaataacttgctgat

SEQ ID NO: 40477 - DNA, 50 bp, homo sapien
cctccctccagcatctctcaaaccaygttactctcacctgctcttctctc

SEQ ID NO: 40478 - DNA, 50 bp, homo sapien
tcccccaaccaattaccaaagctagyagtagtcagcacaggaaaactcag

SEQ ID NO: 40479 - DNA, 50 bp, homo sapien
atacagtaccttctagaatctatacmggagtaagcagatcattgtggtct

SEQ ID NO: 40480 - DNA, 50 bp, homo sapien
ttcttaaagttttaatctatcacaartcatcaaaaattaaggtgtgtttt

SEQ ID NO: 40481 - DNA, 50 bp, homo sapien
ataccgtggtaggcattacaaactayaaaggtaacagactaatttctaat

SEQ ID NO: 40482 - DNA, 50 bp, homo sapien
ggaatggagacttggaacataacctwaaaacctgataaagaatataactt

SEQ ID NO: 40483 - DNA, 50 bp, homo sapien
catcctaaccatgcttttaataacasaagcagagattattttgcttcatg

SEQ ID NO: 40484 - DNA, 50 bp, homo sapien
caatttattatcttatggtttctggkaatcaggaaatcaggagtggctta

SEQ ID NO: 40485 - DNA, 50 bp, homo sapien
aaaacctttagtgatgaaaaaattaygaagagttttactgatgtaatatc

SEQ ID NO: 40486 - DNA, 50 bp, homo sapien
cattttaggtagttggttaaaattamagatcaggaaactaattatttaga

SEQ ID NO: 40487 - DNA, 50 bp, homo sapien
atactaaagtgctctcttatgataayacctcagaaaatagcactgataaa

SEQ ID NO: 40488 - DNA, 50 bp, homo sapien
acagtcacaatttctaaagagaccaycaaatcactcatgggagagaagcc

SEQ ID NO: 40489 - DNA, 50 bp, homo sapien
gaaactgctaattgtgtaaaaagcayggattttcaaagaaactaaatgtt

SEQ ID NO: 40490 - DNA, 50 bp, homo sapien
ctagtcaatacaagcattatattcayctacaaaatttataaatactatta

SEQ ID NO: 40491 - DNA, 50 bp, homo sapien
agtacatgtttgttaaaatgagaacygtgcattcagatttagattttact

SEQ ID NO: 40492 - DNA, 50 bp, homo sapien
aaatcttattaaaaaaataacgttgscaaagtctatgcacatgatgaaga

SEQ ID NO: 40493 - DNA, 50 bp, homo sapien
tgcttctaaaaatactgacctaagcrcctctatgagttgttataagtaaa

SEQ ID NO: 40494 - DNA, 50 bp, homo sapien
gctctgaacctgagctcaaattgccrtgtctttgaaaagtctggtagttt

SEQ ID NO: 40495 - DNA, 50 bp, homo sapien
ttaattgattatcattaataagatasagaattgaaggtagaatgattttt

SEQ ID NO: 40496 - DNA, 50 bp, homo sapien
ttgacctttggtattttttctgcacrgtatattttctgcatgcttatgta

SEQ ID NO: 40497 - DNA, 50 bp, homo sapien
ccaaaggttgttacattaaaaactawgagagttcaatatttcttttatca

SEQ ID NO: 40498 - DNA, 50 bp, homo sapien
ctttcaagtttgtcagaatcttcaamtcattattgttcttgttttagaat

SEQ ID NO: 40499 - DNA, 50 bp, homo sapien
tagggatttaaggagagaatgagaayataggcatagaaacagttgtccta

SEQ ID NO: 40500 - DNA, 50 bp, homo sapien
caaggttctggcacaatgaaatgtamcttggattttccagatggggcttt

SEQ ID NO: 40501 - DNA, 50 bp, homo sapien
agccttggatcattcatctatatacycttccatgagagaaataaacttca

SEQ ID NO: 40502 - DNA, 50 bp, homo sapien
ttaaaactattcacctcactcaatgwaactttaaaatagagtagagcaac

SEQ ID NO: 40503 - DNA, 50 bp, homo sapien
agtttacttacaaacctagtatatcrccaagaagctggcaatataagagg

SEQ ID NO: 40504 - DNA, 50 bp, homo sapien
actgaagttgtcagagtttgaataawgtgtccatagtctaaattgagggt

SEQ ID NO: 40505 - DNA, 50 bp, homo sapien
tgaactttataatattgttgagaacsattatttgtcagggagtgataaaa

SEQ ID NO: 40506 - DNA, 50 bp, homo sapien
cagtatccaaccaagcctttgtaaaytaattatgagtgattattttgagg

SEQ ID NO: 40507 - DNA, 50 bp, homo sapien
tattaatattttcatgaccttgaccrgatcaatatattgcacaaatatta

SEQ ID NO: 40508 - DNA, 50 bp, homo sapien
attatcactgaatcaaaacatgaagmaagttcccagaagtcggggttgtt

SEQ ID NO: 40509 - DNA, 50 bp, homo sapien
gttgaactctagatattgtggactayaatcaaaagtatttatctacaaaa

SEQ ID NO: 40510 - DNA, 50 bp, homo sapien
taaagaggtcttggggtaatttgaasgaatgaaggctgtttgttcatttg

SEQ ID NO: 40511 - DNA, 50 bp, homo sapien
tggaattattggttgaagcgaacgargctattggttcagtaaatattctc

SEQ ID NO: 40512 - DNA, 50 bp, homo sapien
caggaattaatgaatatatttttcamatgctaatgtttcagtgaaatgaa

SEQ ID NO: 40513 - DNA, 50 bp, homo sapien
gccctgtctgaatttatgacccaccraatcaggaatacaataaaatggtt

SEQ ID NO: 40514 - DNA, 50 bp, homo sapien
aaaagggtgagccaattaccacagarcggtactcaaaattttctgtgagt

SEQ ID NO: 40515 - DNA, 50 bp, homo sapien
gtgagccactgcaccaacctagttasacagcaaggactaatttctggttc

SEQ ID NO: 40516 - DNA, 50 bp, homo sapien
ttcagggaaccaatttcatgataaargtgctagaaagggacatgaagaat

SEQ ID NO: 40517 - DNA, 50 bp, homo sapien
attgctgggtgaccttttagtcataygaacaagagcaaaacaaaaaagta

SEQ ID NO: 40518 - DNA, 50 bp, homo sapien
accagctctacaaaactaatacaccyataaatattgctaaagataaatat

SEQ ID NO: 40519 - DNA, 50 bp, homo sapien
tgcataaaaagttaaggcagtcaatraaaaggctatcaataaatttgcat

SEQ ID NO: 40520 - DNA, 50 bp, homo sapien
atttagatagcaacactgtccttgaygtcttttagatttgtaatgctata

SEQ ID NO: 40521 - DNA, 50 bp, homo sapien
cactaatatatatgctgaagaattcrctataataatggtcattatatttc

SEQ ID NO: 40522 - DNA, 50 bp, homo sapien
tatagcgaattcttcagcatatatawtagtgaaaattgacaataacatct

SEQ ID NO: 40523 - DNA, 50 bp, homo sapien
ataccaagcatgaagaggccttacasagatgacatacttaaggaaaatgc

SEQ ID NO: 40524 - DNA, 50 bp, homo sapien
cttcccagtatcaattctctgtatawgttcattcttgcattgctataaag

SEQ ID NO: 40525 - DNA, 50 bp, homo sapien
cagctttggccttggttaagagatayccagatacatctcaagcttctgct

SEQ ID NO: 40526 - DNA, 50 bp, homo sapien
tagttaaattctgaagccatccctartaaatttggcatatttgcctttca

SEQ ID NO: 40527 - DNA, 50 bp, homo sapien
atctataatttagctggtgatccatkaacactctattctattaatccttt

SEQ ID NO: 40528 - DNA, 50 bp, homo sapien
ttgagatcataaggaagataatgcasactttattctcaaatacagctccc

SEQ ID NO: 40529 - DNA, 50 bp, homo sapien
taagctttatgaaacttctgtgcctkacaaacaagattaaatatttgcaa

SEQ ID NO: 40530 - DNA, 50 bp, homo sapien
tattctcaaatacagctcccaggaaygtacttagcttatgaataaacaga

SEQ ID NO: 40531 - DNA, 50 bp, homo sapien
aaatcagtcttcagtatctcataagkcatgtgatttctataccaacatcc

SEQ ID NO: 40532 - DNA, 50 bp, homo sapien
gtataaaaatcaatgacctttgtggrcatagaggttaaataacagatata

SEQ ID NO: 40533 - DNA, 50 bp, homo sapien
cgcttaccaatacctgtctctattayctaaaaactatccatcagagggta

SEQ ID NO: 40534 - DNA, 50 bp, homo sapien
ttggccagccgagtgaggaagaaaastatcgacaggcaaaaagaaaagat

SEQ ID NO: 40535 - DNA, 50 bp, homo sapien
gtcagctgaaagagaagcagtcccgmatgttaggattgaagttgatgggt

SEQ ID NO: 40536 - DNA, 50 bp, homo sapien
aatattatttattcttaaccattcayatttatctgtacatcaaacaaaca

SEQ ID NO: 40537 - DNA, 50 bp, homo sapien
aaattgttttaaagttatatttaagyccatttcagcacaaaaatatcaac

SEQ ID NO: 40538 - DNA, 50 bp, homo sapien
gtcaatgggatcataaaatgtatgaytataatggtactgcagaggaaagt

SEQ ID NO: 40539 - DNA, 50 bp, homo sapien
tggtggcaaagggtgagcgttagcartcagctgcatgtttgccaacatta

SEQ ID NO: 40540 - DNA, 50 bp, homo sapien
agttacatttcaatgtgtacatataygatagtttctccatatccttacca

SEQ ID NO: 40541 - DNA, 50 bp, homo sapien
gtaaaataattattgtttggtgatcraaactatgaagacatataatcaaa

SEQ ID NO: 40542 - DNA, 50 bp, homo sapien
ctctgttttaggaagtaaattataargaacactatatatagttgtggaag

SEQ ID NO: 40543 - DNA, 50 bp, homo sapien
taaaaatcactgtaaatccaaattaygtcgccacagaaattatatctata

SEQ ID NO: 40544 - DNA, 50 bp, homo sapien
tcttagaaaaggcattatatgaatcyatgacactaccaataatacatttt

SEQ ID NO: 40545 - DNA, 50 bp, homo sapien
tcacaacctttcggagatgatgaagwcaccacagttttcgaggagcccat

SEQ ID NO: 40546 - DNA, 50 bp, homo sapien
cacaataacaattctaatcataacaytactcagcttaaaactttttagta

SEQ ID NO: 40547 - DNA, 50 bp, homo sapien
ggatccaggaattcagaggtttaacraggaccagtataggaagcagaaaa

SEQ ID NO: 40548 - DNA, 50 bp, homo sapien
tccatctctattaccaatgccctgarccaaaagaaatcccaaagtagatt

SEQ ID NO: 40549 - DNA, 50 bp, homo sapien
aaatagtcagcctgccttttctgcaytaccctcctttccttttgcgccac

SEQ ID NO: 40550 - DNA, 50 bp, homo sapien
agccaattcgatcaactgaaagaaakggtatcagtcatggaagatgaaat

SEQ ID NO: 40551 - DNA, 50 bp, homo sapien
ggagctaatagtctagtcctataaawgttaatttgaatactttaactaaa

SEQ ID NO: 40552 - DNA, 50 bp, homo sapien
gagtctcaggaatcagccatgaagayagtaagaccaaggtcagtgtccaa

SEQ ID NO: 40553 - DNA, 50 bp, homo sapien
aagcttatcactgactctaacacaaytgtagttttcttagcaagaaagac

SEQ ID NO: 40554 - DNA, 50 bp, homo sapien
agtcaaacaaaacatttggagtaaayaccttccagttgtctcatttttct

SEQ ID NO: 40555 - DNA, 50 bp, homo sapien
ttaacttttaaactattactaccgaygtacataataacatatgaaacttt

SEQ ID NO: 40556 - DNA, 50 bp, homo sapien
tttactgaaaagaaaattgtggtacragaaacttctaagtgtcaatactt

SEQ ID NO: 40557 - DNA, 50 bp, homo sapien
agacaaatgtcttatatagtctcaaytgaaaaaccacttatgcccaaact

SEQ ID NO: 40558 - DNA, 50 bp, homo sapien
ttttcgcccaatttatctcaactccrgagaagaaatttttttcaaacatt

SEQ ID NO: 40559 - DNA, 50 bp, homo sapien
atttttttaatccatcattggtatgyatttagagtggactttcctgcttg

SEQ ID NO: 40560 - DNA, 50 bp, homo sapien
atgctgatctgctaagcaagaggaamattctgacagcagtttaatatcaa

SEQ ID NO: 40561 - DNA, 50 bp, homo sapien
ataaagacaaaaccgtcaataaaaasaatgaattcataaaatatacacag

SEQ ID NO: 40562 - DNA, 50 bp, homo sapien
gcttgatacaggaaccacagctcackattaaacaattgctgatgagtata

SEQ ID NO: 40563 - DNA, 50 bp, homo sapien
gtcagtaaaactaatcttgtaaaaayggagtaatgcagaaagtattgttg

SEQ ID NO: 40564 - DNA, 50 bp, homo sapien
caaaggttgttaaccactttaacaaracaggtggagaggtgggagtagat

SEQ ID NO: 40565 - DNA, 50 bp, homo sapien
ttggacaattcctgacttgccaatayctcaagagttcctcaagttagttt

SEQ ID NO: 40566 - DNA, 50 bp, homo sapien
tgagtcgcgtctaacacactcttcayagcatttacatttggttttattat

SEQ ID NO: 40567 - DNA, 50 bp, homo sapien
acaatatatcttttcctatacattartaaggtcactcttttaaactaata

SEQ ID NO: 40568 - DNA, 50 bp, homo sapien
aattatagcattctactactttccaygttacaggacaaaggcggaagagc

SEQ ID NO: 40569 - DNA, 50 bp, homo sapien
tatgtagctacggaattaaccactgractacacaatttttatacaattat

SEQ ID NO: 40570 - DNA, 50 bp, homo sapien
gattatttctttatcactggctaagyaatttgaccaaggtgtgtcttggt

SEQ ID NO: 40571 - DNA, 50 bp, homo sapien
gtttattagacaactcttttctccartcaaggtaagtaatagaaaagcaa

SEQ ID NO: 40572 - DNA, 50 bp, homo sapien
accaaccagaaggatgtagaaaggayaatgtgcctcattcttcggcctcc

SEQ ID NO: 40573 - DNA, 50 bp, homo sapien
aagtccaataaaaacaacagattaayggattcatatctactattcaagtg

SEQ ID NO: 40574 - DNA, 50 bp, homo sapien
cagcattttaattgacatattcaccragtcaaagaggcttcagaaggcag

SEQ ID NO: 40575 - DNA, 50 bp, homo sapien
ggaagttcagaattgggcactttgcrctgggacaaggtgcttctactgaa

SEQ ID NO: 40576 - DNA, 50 bp, homo sapien
aacagagcctataaatgaatattaartggatttcaggagttattcagtaa

SEQ ID NO: 40577 - DNA, 50 bp, homo sapien
taattttatctacaacaagtcataartatcaactagggtaaagctatctg

SEQ ID NO: 40578 - DNA, 50 bp, homo sapien
ccttatccctgtgtacgtgtgaaatratgcaaaacaatagagtgttcgtg

SEQ ID NO: 40579 - DNA, 50 bp, homo sapien
ttgaatcaggcaaagatcactccaamtgttgaactattgggtaagtggag

SEQ ID NO: 40580 - DNA, 50 bp, homo sapien
gctaattttcttattgcgttattcaytatccatacgcttcctaaaactat

SEQ ID NO: 40581 - DNA, 50 bp, homo sapien
aaatttatatttttaaatacaactgraaaccctccaaagagtcaatatga

SEQ ID NO: 40582 - DNA, 50 bp, homo sapien
catggcttgagaacaggtttaaagaracatagaaataagccccatgaact

SEQ ID NO: 40583 - DNA, 50 bp, homo sapien
ataactgaaccactgtgtatacagayagatcataaagcggtgaactgggc

SEQ ID NO: 40584 - DNA, 50 bp, homo sapien
gtgtctgagattgatttgtaataaartgaggtggttcgctggaatgacca

SEQ ID NO: 40585 - DNA, 50 bp, homo sapien
taaataaataaatgctaaattttatsaggagaactcaaagcacacacaat

SEQ ID NO: 40586 - DNA, 50 bp, homo sapien
tcctgacccattatcaggaagacaaytcttttgggtttctttttccggga

SEQ ID NO: 40587 - DNA, 50 bp, homo sapien
tatctgttgccctctagggactccartatgaaaagaaacatatgatatgg

SEQ ID NO: 40588 - DNA, 50 bp, homo sapien
ttcttaaacctgaacttctaaaagasacagtgttgcatggagagatttgt

SEQ ID NO: 40589 - DNA, 50 bp, homo sapien
cattcccagtgataatctactacacycaacaattggaagtgttctatttg

SEQ ID NO: 40590 - DNA, 50 bp, homo sapien
taaaatccaagtaccccatagataawtaaagtaggcactcaaatattttt

SEQ ID NO: 40591 - DNA, 50 bp, homo sapien
cctgtaaaattcagtttaaattagakagaatgtgtaagacactgtctgac

SEQ ID NO: 40592 - DNA, 50 bp, homo sapien
tgttccaaaggctgataatttgtcayaaaagaagtgtgttgtgataaact

SEQ ID NO: 40593 - DNA, 50 bp, homo sapien
tctaaacatttaaaaattaaatatgycacatttgtggtagatcacatttg

SEQ ID NO: 40594 - DNA, 50 bp, homo sapien
gaagagagccaggattcttgacctcrcatagttcatagtctcaagtttta

SEQ ID NO: 40595 - DNA, 50 bp, homo sapien
caagcccttgggattcaggagcaagsctataccatcagcagtaaagaaat

SEQ ID NO: 40596 - DNA, 50 bp, homo sapien
tagaagcctttccatctaaaaaatayagtggcttttgctttgtatttcct

SEQ ID NO: 40597 - DNA, 50 bp, homo sapien
atatattatattattcatgtcctacrcaactttataaacttgtttctgat

SEQ ID NO: 40598 - DNA, 50 bp, homo sapien
ggatacaaatgaatagtagcaagaarataattgaagttgaacacagatgt

SEQ ID NO: 40599 - DNA, 50 bp, homo sapien
tgtcttttaggtaagtctagataaawgctcaaatgatgccatcttacaga

SEQ ID NO: 40600 - DNA, 50 bp, homo sapien
tctaaaaccagttatactcataaaarcatcttgcagctgatataagatta

SEQ ID NO: 40601 - DNA, 50 bp, homo sapien
accaaggcagaagcacctgtggacawtacgcccataggagtcaacttggg

SEQ ID NO: 40602 - DNA, 50 bp, homo sapien
attcagaagagcctggttatagttamagaacagaaaattataagtctgta

SEQ ID NO: 40603 - DNA, 50 bp, homo sapien
catgtgtacttttatggctcacttcycagagtaaggatttggacatttgt

SEQ ID NO: 40604 - DNA, 50 bp, homo sapien
aattggtattcatatacaaaagtaaygtaaatgaaagttgtttttttttt

SEQ ID NO: 40605 - DNA, 50 bp, homo sapien
aacagtaaaatctctatacagaacasctgaaaatcagcaatggcgcaggg

SEQ ID NO: 40606 - DNA, 50 bp, homo sapien
tttttattctctctgtaaagacaagmaactttcaatatttgtaatctctg

SEQ ID NO: 40607 - DNA, 50 bp, homo sapien
cccacttccttggaaacccgtgtgayacaacagaggcagccatgatcccc

SEQ ID NO: 40608 - DNA, 50 bp, homo sapien
aaaggctatcacccattacccttgayccccaaatggcttgcatcaccctg

SEQ ID NO: 40609 - DNA, 50 bp, homo sapien
agaaaagaaatgttagcaatgaatargtgatgaaacagttatgaatcact

SEQ ID NO: 40610 - DNA, 50 bp, homo sapien
aatcctcttcatttattgtcctggarcaagcctctctggagtgtgaaggt

SEQ ID NO: 40611 - DNA, 50 bp, homo sapien
aatacagtaaagcaggtgctaagatmaatgtctttgccagggacagaggg

SEQ ID NO: 40612 - DNA, 50 bp, homo sapien
aatatttacctttgaattggactcaytgaaaatagctagaaggaatgtaa

SEQ ID NO: 40613 - DNA, 50 bp, homo sapien
aaaacccagggacagtctagtctaayacgtcaacttcctcagaggcagat

SEQ ID NO: 40614 - DNA, 50 bp, homo sapien
aagtaaaaatggccagctggtaaacyaaaggagagaatgtccatgcatga

SEQ ID NO: 40615 - DNA, 50 bp, homo sapien
cctcaatttgtagaaaaagattgatyaggaaggtccctgtccctgtaggt

SEQ ID NO: 40616 - DNA, 50 bp, homo sapien
ggatttttaagctttggtttccagaraacattgtcactgaggggattgag

SEQ ID NO: 40617 - DNA, 50 bp, homo sapien
cactatctatatgcatgtactattayatctattacatacaaatagataaa

SEQ ID NO: 40618 - DNA, 50 bp, homo sapien
atccaaagctttctcaagcaagataygtactgtcagtagaaagagtaaag

SEQ ID NO: 40619 - DNA, 50 bp, homo sapien
agtgcatttgagtgcttttacacacygtgcttagtgcttaatgtagatta

SEQ ID NO: 40620 - DNA, 50 bp, homo sapien
ttgagaatgtctgccctagggtatcrccaacccaaagataaaatcacttg

SEQ ID NO: 40621 - DNA, 50 bp, homo sapien
ttctggaagatgctatgactgataaytcttccccatatctagtacctcat

SEQ ID NO: 40622 - DNA, 50 bp, homo sapien
actactgtgatgacagtgacaaagamtactgctagttctataattactat

SEQ ID NO: 40623 - DNA, 50 bp, homo sapien
atagtacattcagtttttatactgasattagtgaaaaaatatgcaattca

SEQ ID NO: 40624 - DNA, 50 bp, homo sapien
tgaaaaaaaatattaaaacaataccyggcttataagcaatgaataaacat

SEQ ID NO: 40625 - DNA, 50 bp, homo sapien
ggtagtatgaaaaattcaatgactayaaaagaaagtaacaaattgttcaa

SEQ ID NO: 40626 - DNA, 50 bp, homo sapien
atgcatcaaacagatctcaagatttsaaaagtggaataagaggtagttag

SEQ ID NO: 40627 - DNA, 50 bp, homo sapien
gtactgaaacgtatttttctcctctkaataacagcattgtgtgaagttag

SEQ ID NO: 40628 - DNA, 50 bp, homo sapien
gtactgttagactgaaaaaccattasagcttattaaagaaattttgaaac

SEQ ID NO: 40629 - DNA, 50 bp, homo sapien
tgcttatattgctattttggacttaycaattttagagagcatatttgcct

SEQ ID NO: 40630 - DNA, 50 bp, homo sapien
gagatggctgttttggctccaactgragatacttttttcccttcaactca

SEQ ID NO: 40631 - DNA, 50 bp, homo sapien
aaaattgctgcaggtatcttaggatyacttaatggttgtgtgttggggta

SEQ ID NO: 40632 - DNA, 50 bp, homo sapien
catggagaacatggcatcctagaatragaaatccacatctggtactgtca

SEQ ID NO: 40633 - DNA, 50 bp, homo sapien
gaactaagagcagttaacagaacaayaaaaaagtaatttatactattaac

SEQ ID NO: 40634 - DNA, 50 bp, homo sapien
tattcagatctggtttcagtattcaraaaataatgtcttttctagccatt

SEQ ID NO: 40635 - DNA, 50 bp, homo sapien
gacaaaggaacatttaatcaataacyctgcagtattacgtacatttaatt

SEQ ID NO: 40636 - DNA, 50 bp, homo sapien
actttttaatattatatagatcaacmaatactctagtaaattgcccatct

SEQ ID NO: 40637 - DNA, 50 bp, homo sapien
attttagcaagaattgcatcataaasaaatccatctaagggaagtcattt

SEQ ID NO: 40638 - DNA, 50 bp, homo sapien
gcttactaatatggtaaagaaattayaatgtgatacaacttttcttttta

SEQ ID NO: 40639 - DNA, 50 bp, homo sapien
ccagaccctcactgttaacatgcaaytcttgtccttttgtgttaagcatg

SEQ ID NO: 40640 - DNA, 50 bp, homo sapien
acttaaagacatatggaccactttcrcttagtttaaatcaataagaccaa

SEQ ID NO: 40641 - DNA, 50 bp, homo sapien
actccatgatctaaaggctcaagaaytaagaaccacagattttctgccat

SEQ ID NO: 40642 - DNA, 50 bp, homo sapien
ttgcaggcaatgatcattaaccttcyaataaacatagtgaaagtctttac

SEQ ID NO: 40643 - DNA, 50 bp, homo sapien
tgagtgaaatatctcccaaaaccackgcaaactctttgctcctatttcat

SEQ ID NO: 40644 - DNA, 50 bp, homo sapien
catcaaaaccagttagaaaaactgastaataattgtgttgtaaaaaaaat

SEQ ID NO: 40645 - DNA, 50 bp, homo sapien
aatgactccaatttatggaagatagraaagggcataaggagaaacatagg

SEQ ID NO: 40646 - DNA, 50 bp, homo sapien
tcagccttgactgacaatgctaataragactagatcaagagagaaatagt

SEQ ID NO: 40647 - DNA, 50 bp, homo sapien
tctgagccccatgataggcaaaggcygagacctccagtttgattgttaat

SEQ ID NO: 40648 - DNA, 50 bp, homo sapien
tccaggtgttcattgttcagtagtcractattcagagtctttcgaggaga

SEQ ID NO: 40649 - DNA, 50 bp, homo sapien
ccaagaatggagaaaatagccatcartcagttgcttcctcaagaaaccta

SEQ ID NO: 40650 - DNA, 50 bp, homo sapien
tttcagcttgatattaacttagtcayaggagttatagcaaattttgatgt

SEQ ID NO: 40651 - DNA, 50 bp, homo sapien
gtataacatagtataccatcttttgraaagaaactttacagcacatgaca

SEQ ID NO: 40652 - DNA, 50 bp, homo sapien
gggacagaatttttgcctaggataakgaagagaaacttttgggaggtaaa

SEQ ID NO: 40653 - DNA, 50 bp, homo sapien
taaacttaagttccataaagccagaygctatacagtgcaaaggctaatgt

SEQ ID NO: 40654 - DNA, 50 bp, homo sapien
tctggaatactagtcatacaacttamgttagagtcagagaaagaaaaaaa

SEQ ID NO: 40655 - DNA, 50 bp, homo sapien
gaattaaaaacatctgttgagatacragaaatcactggattaaattatta

SEQ ID NO: 40656 - DNA, 50 bp, homo sapien
gatcctgaccctgtgaaggactagaytaatgtgaatttttgtgtcttact

SEQ ID NO: 40657 - DNA, 50 bp, homo sapien
aagcattcatctagagttagaaatartaacagtgcaaggacaaaaaaaac

SEQ ID NO: 40658 - DNA, 50 bp, homo sapien
tgaatgcttatgcagctttggaatayctaaaaacaaattgactctctttt

SEQ ID NO: 40659 - DNA, 50 bp, homo sapien
tgcaatttcagatttccaaggagccrctttaacaacaacatcacaacaaa

SEQ ID NO: 40660 - DNA, 50 bp, homo sapien
attgtaatagatggagctttgcttayatgtctccgcagatagattcatta

SEQ ID NO: 40661 - DNA, 50 bp, homo sapien
agtcatgaagcttcttttgagaagasaatgtatacgtacctatatatatg

SEQ ID NO: 40662 - DNA, 50 bp, homo sapien
tccttcttcacctctctgagaggcamgcatttaagaaaaaaggggtgaga

SEQ ID NO: 40663 - DNA, 50 bp, homo sapien
acagggtggttacagacatggaaaakctgagaataatcacctctgataaa

SEQ ID NO: 40664 - DNA, 50 bp, homo sapien
tgtagcataggatcttactattaccrgattagaaagttatgagcattctc

SEQ ID NO: 40665 - DNA, 50 bp, homo sapien
tttgttcctgtatcaaagaccatttkactctatttgtatgtgtctatttc

SEQ ID NO: 40666 - DNA, 50 bp, homo sapien
aaatttctatagccagaagagttaarataaaaggtgcacaagaggaacat

SEQ ID NO: 40667 - DNA, 50 bp, homo sapien
catgtttaagccaccccaattgagaygttcataattaaataaagctcaca

SEQ ID NO: 40668 - DNA, 50 bp, homo sapien
gtgcaagctgctgctccttgaccttsaacaacattcagaacatattcatt

SEQ ID NO: 40669 - DNA, 50 bp, homo sapien
gaccctacagtatagcaggaaaggcraatagaggtacatggataatgaca

SEQ ID NO: 40670 - DNA, 50 bp, homo sapien
aggagacataaatatgttaaaataaygaagacagaagggaaaatgttgaa

SEQ ID NO: 40671 - DNA, 50 bp, homo sapien
atttgcagatttggaagaggaaaccragaggcagactaagcttttgatag

SEQ ID NO: 40672 - DNA, 50 bp, homo sapien
atgaatggagtctgtcttaagatcaktacagaatatcgcacatattatat

SEQ ID NO: 40673 - DNA, 50 bp, homo sapien
ttgtagatatacacatataaacaaakagactaacacatatcaatgtctag

SEQ ID NO: 40674 - DNA, 50 bp, homo sapien
ttaatacagagtatacactagcaacsattttatttattctgcaatgtacc

SEQ ID NO: 40675 - DNA, 50 bp, homo sapien
gggtcaagctctctttcataaaaccyggtatgtgtgaacacctggatgaa

SEQ ID NO: 40676 - DNA, 50 bp, homo sapien
tgcttttttggcatagtagaatttgyattttgttccacaataccttcatc

SEQ ID NO: 40677 - DNA, 50 bp, homo sapien
gttttgaacaggaaaacatttctgayaaaagtgagtagttgtaagacaag

SEQ ID NO: 40678 - DNA, 50 bp, homo sapien
tattttccttgttcctaaaactttgyaattgtctcatcttttcacaaaat

SEQ ID NO: 40679 - DNA, 50 bp, homo sapien
acaattgacataaacctggtgactaygactcctcctgacagtgagatctt

SEQ ID NO: 40680 - DNA, 50 bp, homo sapien
aagaattagaatagagcactaataartatttcagaaatggcaagcaaagg

SEQ ID NO: 40681 - DNA, 50 bp, homo sapien
ttcttctgtcctcctgaggtgattarggaagcctcatgtttccatagcag

SEQ ID NO: 40682 - DNA, 50 bp, homo sapien
aaaaactggattatgcagagaaataygacttgagaaatgacaggcagaat

SEQ ID NO: 40683 - DNA, 50 bp, homo sapien
tttggtgatgcttccatcattgatawgattcctagcaagtgcatgtgtgt

SEQ ID NO: 40684 - DNA, 50 bp, homo sapien
ttctaacagctctcccagattgtacraactcaagttcaagaactaggttt

SEQ ID NO: 40685 - DNA, 50 bp, homo sapien
ctgcaatcagatttttaataaagtakctgtgtcttgggtcatcaatgata

SEQ ID NO: 40686 - DNA, 50 bp, homo sapien
cctgccctgtgttgcttgcaaactaygataggagatgttagattattttg

SEQ ID NO: 40687 - DNA, 50 bp, homo sapien
gcaagatttatgcttgaattcttaaycggaatattgttttgtgatgatta

SEQ ID NO: 40688 - DNA, 50 bp, homo sapien
ttccagtaactcatcaaatgtgacayagttctttatttgggatgaccaat

SEQ ID NO: 40689 - DNA, 50 bp, homo sapien
tcagatccactttaattctagctatraacacagaacatgcaaaactgttt

SEQ ID NO: 40690 - DNA, 50 bp, homo sapien
cttatgagcaaattaacatcccatasgacaatcttttttcaagagggaag

SEQ ID NO: 40691 - DNA, 50 bp, homo sapien
atgcttctctatttattcccagatartactgcattctataatatagtaaa

SEQ ID NO: 40692 - DNA, 50 bp, homo sapien
taatcagccaaagaccaggaggaaasagcttatagtctgacaaaatattt

SEQ ID NO: 40693 - DNA, 50 bp, homo sapien
aaggaaaacccatgtttggaatagaygtcattttaatatagttaagactc

SEQ ID NO: 40694 - DNA, 50 bp, homo sapien
gggattgctccactctactgctacaratacatccacagaaggagctctag

SEQ ID NO: 40695 - DNA, 50 bp, homo sapien
tcacagacacttgggactaagtcttsaaagaaattaggccatggctaaaa

SEQ ID NO: 40696 - DNA, 50 bp, homo sapien
gatgcaaacccaaacaagagtggcgwcatttccaagagaaaaggggatga

SEQ ID NO: 40697 - DNA, 50 bp, homo sapien
actttttattgaaaactacactgaaygctaaatgtccacctttacaataa

SEQ ID NO: 40698 - DNA, 50 bp, homo sapien
tgagatataggaaagggtaacagagratggatggaaaacagcatccctga

SEQ ID NO: 40699 - DNA, 50 bp, homo sapien
gcatataactctcatattctctcgawggactatgactgtgactgagacta

SEQ ID NO: 40700 - DNA, 50 bp, homo sapien
accttttaactattagcattattcayagaggaaataaagacactttttta

SEQ ID NO: 40701 - DNA, 50 bp, homo sapien
tctgtgctgaggatagataatcagamataataggagctggaaacagactg

SEQ ID NO: 40702 - DNA, 50 bp, homo sapien
ttgactactttccggttggtgttacygatattaaattatataacctacag

SEQ ID NO: 40703 - DNA, 50 bp, homo sapien
ttgcctttaagaagtaggttttacartgacacttctctgatcacatttcc

SEQ ID NO: 40704 - DNA, 50 bp, homo sapien
cctttacccatgtgatctaagagacrgagacagtcagtaaccttggagtt

SEQ ID NO: 40705 - DNA, 50 bp, homo sapien
tcagcaaggcaacattaaattatcayggctctcgagaaaaacagaggagc

SEQ ID NO: 40706 - DNA, 50 bp, homo sapien
cttaaatattggactatatttactaygtttgatattgctgaccattttat

SEQ ID NO: 40707 - DNA, 50 bp, homo sapien
tgaaaaagcactgcttatttggaagwctaggaaggatattttgctaaaat

SEQ ID NO: 40708 - DNA, 50 bp, homo sapien
tgcatccgcctatacaatctttaccrataaagactcgaggcacctaaaaa

SEQ ID NO: 40709 - DNA, 50 bp, homo sapien
aaggcagtgaccacatttgtgcaggyaaaacaggagagtggagtatcaga

SEQ ID NO: 40710 - DNA, 50 bp, homo sapien
gtagctattgcagtgtataaggatastaattatggtttacatttttggtt

SEQ ID NO: 40711 - DNA, 50 bp, homo sapien
actcatcagtgcacatactctcaaakaatctggttaaacttgtcttatct

SEQ ID NO: 40712 - DNA, 50 bp, homo sapien
tctcttactctcctactttttaatcyactcactacattcaattgtttgga

SEQ ID NO: 40713 - DNA, 50 bp, homo sapien
agcataataccttccaggtagaaagyataatgaatggatagtgatgcata

SEQ ID NO: 40714 - DNA, 50 bp, homo sapien
aaagttaaaataatttcagacgtagyagataagaccaactccatggaaga

SEQ ID NO: 40715 - DNA, 50 bp, homo sapien
attaaaaatgccttaaactttagacwatataccaattcaatgcttttaat

SEQ ID NO: 40716 - DNA, 50 bp, homo sapien
gtgctagaccttcaggtcacacccaratagtcaaaattgtaaatattaaa

SEQ ID NO: 40717 - DNA, 50 bp, homo sapien
cacagtattctagtattttgtgagtraagtcattatttcttaggacatca

SEQ ID NO: 40718 - DNA, 50 bp, homo sapien
aatagagttgcaattaccatacttargaaaatgtgaaaaagaaatggaag

SEQ ID NO: 40719 - DNA, 50 bp, homo sapien
ttatggtaataatcaccagttaatcracgttccttccacaaacatttatt

SEQ ID NO: 40720 - DNA, 50 bp, homo sapien
tctttcacaaaaggaagagtcagtcrataagacaaacttcgttgttgtct

SEQ ID NO: 40721 - DNA, 50 bp, homo sapien
ttaactaaaatatcacgtcataataraaatccaattgactttagaagtat

SEQ ID NO: 40722 - DNA, 50 bp, homo sapien
agtgatggtctcttaatcaggctaamctattgcacctggaaatcatatct

SEQ ID NO: 40723 - DNA, 50 bp, homo sapien
aattgactttagaagtatgagaagayatagaaagttcttacccttccatc

SEQ ID NO: 40724 - DNA, 50 bp, homo sapien
aaagtaagatcctaaggtagcaataratataaaaaataaaaacttaatgg

SEQ ID NO: 40725 - DNA, 50 bp, homo sapien
acgaatctcccttgctagagcttaartgacccttgactaaacaaggtaac

SEQ ID NO: 40726 - DNA, 50 bp, homo sapien
ctccagagatgtcttttttcatgcasaggattttttacttttaacaggat

SEQ ID NO: 40727 - DNA, 50 bp, homo sapien
catgaaaaaagacatctctggagccygaacaatccatttacttctttgta

SEQ ID NO: 40728 - DNA, 50 bp, homo sapien
ggaaaaacatctctttacaacagcargtggctaagtatgttccatgtaga

SEQ ID NO: 40729 - DNA, 50 bp, homo sapien
tagatatggattcctagaaaatggayagttgaatatagcctatacatctt

SEQ ID NO: 40730 - DNA, 50 bp, homo sapien
tataactttatatgcacttggaaacraaagttcttgtgacttgcattatt

SEQ ID NO: 40731 - DNA, 50 bp, homo sapien
ataatttttcctacgttgcactatawctttgtttctcttttccatctcct

SEQ ID NO: 40732 - DNA, 50 bp, homo sapien
tacaggacaagttatctgatgtctartagaaaagcaagtccttgcaaggg

SEQ ID NO: 40733 - DNA, 50 bp, homo sapien
gagaatgttctcctaaaagacttgcrgaatcactctgtccttggaagttt

SEQ ID NO: 40734 - DNA, 50 bp, homo sapien
cgtacccagattaggtgccttaccaracatttctgattgttacctcattt

SEQ ID NO: 40735 - DNA, 50 bp, homo sapien
gccaagtgttgaaaacgaaatctgartaactttcgaagctgagtgtgata

SEQ ID NO: 40736 - DNA, 50 bp, homo sapien
tgaaacaggattatgactgtcaccartgaaaaaatttcatattgatgtct

SEQ ID NO: 40737 - DNA, 50 bp, homo sapien
tttgttatagggaattctagatttasgtctctgctaacagtcatttctat

SEQ ID NO: 40738 - DNA, 50 bp, homo sapien
aatatattgcccatgtttaatgttaygagctatactagtatgtacaggaa

SEQ ID NO: 40739 - DNA, 50 bp, homo sapien
catgagtctatgagcctcacggataygtaatcaatactgaggtaactggc

SEQ ID NO: 40740 - DNA, 50 bp, homo sapien
ccttaaagccttgtgccctgatgccsagttgtctgtattagagggcatga

SEQ ID NO: 40741 - DNA, 50 bp, homo sapien
tttttgtttcttttggattatttctmacgatttgctgaaagctatgaaag

SEQ ID NO: 40742 - DNA, 50 bp, homo sapien
ggcttaagatagggatcccaataaaygtctgtgcaaaagtctacaagtaa

SEQ ID NO: 40743 - DNA, 50 bp, homo sapien
gcttgttgaattagatatgttttccrctttaatccctttatcaactttca

SEQ ID NO: 40744 - DNA, 50 bp, homo sapien
gttggaaatggaaaagtcagtcaagsctgttatttgtatcatattcacat

SEQ ID NO: 40745 - DNA, 50 bp, homo sapien
tctaaaatatttgagaatactgtcaytaaaatgtaaatgtttatcctata

SEQ ID NO: 40746 - DNA, 50 bp, homo sapien
tttctgatccagtttgcctacaatawctgttttagcatagtatacttgac

SEQ ID NO: 40747 - DNA, 50 bp, homo sapien
ataactgtaataagagattcagttgratatacagaacttcagcatagaat

SEQ ID NO: 40748 - DNA, 50 bp, homo sapien
ttctgaaaagactggagtttgaacaytaaatctgagcactccgcatgctt

SEQ ID NO: 40749 - DNA, 50 bp, homo sapien
agttccagtgatctcttctctgaatsacacggaactgtctcctatcagag

SEQ ID NO: 40750 - DNA, 50 bp, homo sapien
ttctaagcctatttctctaacacacycttaatggacatgacttagctact

SEQ ID NO: 40751 - DNA, 50 bp, homo sapien
catagctttaaaaatcaacatgacckacccgcttttccctaatatatact

SEQ ID NO: 40752 - DNA, 50 bp, homo sapien
ctcaacaagaaaggcaagtgccttamcatgaaagagccaagtacagtgtc

SEQ ID NO: 40753 - DNA, 50 bp, homo sapien
gttctgaaaagcccaactttgctcakgtcaggaaagaaacatgataactc

SEQ ID NO: 40754 - DNA, 50 bp, homo sapien
ttttaaaatatgatgattagattgawgaggattgtaaagactttctttta

SEQ ID NO: 40755 - DNA, 50 bp, homo sapien
acccaactggaacatgcctaggacaytgaaaccggtctgtgggattgcca

SEQ ID NO: 40756 - DNA, 50 bp, homo sapien
gtcaccttatcaaacaaaacaataartagcaaatacagaatttctggtct

SEQ ID NO: 40757 - DNA, 50 bp, homo sapien
ggctggattctaagtggttatgtaartcattaaaagaagtaaggcagcag

SEQ ID NO: 40758 - DNA, 50 bp, homo sapien
ctcacccctgctgtgggaattgtgaycctgcttctgccactgcacttagt

SEQ ID NO: 40759 - DNA, 50 bp, homo sapien
attattttattgatgattcctttgaygttgtatttaaaatctaaacctaa

SEQ ID NO: 40760 - DNA, 50 bp, homo sapien
atgtggcacctctttttcaatcaacrcagaccataaggaaagatctactt

SEQ ID NO: 40761 - DNA, 50 bp, homo sapien
aatcttccctgtaagtcttgaatccrctaaactgaggtaaaacacaaaag

SEQ ID NO: 40762 - DNA, 50 bp, homo sapien
ttgtgcaaaaacaatttagattaagkctggaaactctaggtttatgagag

SEQ ID NO: 40763 - DNA, 50 bp, homo sapien
acatgccgaagcttagctgaattggmatgtagatattttttggtcacttg

SEQ ID NO: 40764 - DNA, 50 bp, homo sapien
tcctttaaagcagtgcctaatacaaragcatggttgtgggtcatttattt

SEQ ID NO: 40765 - DNA, 50 bp, homo sapien
ggccaagtcagcacattgctttcaaytgagttatatagcaaagctgcttt

SEQ ID NO: 40766 - DNA, 50 bp, homo sapien
tttattagattagatttgagaagtaycctgcctattagcaattactagtt

SEQ ID NO: 40767 - DNA, 50 bp, homo sapien
tttataatgtgaaaaacttgaaatayctgtacattattattgaattttat

SEQ ID NO: 40768 - DNA, 50 bp, homo sapien
tttttcttttgtttaaaaataatacwcaatgcatattaaaagacaaagta

SEQ ID NO: 40769 - DNA, 50 bp, homo sapien
taaagaccagagtcttgttctaatayatacaccttggctggcataactat

SEQ ID NO: 40770 - DNA, 50 bp, homo sapien
ggattggagaggtggtcagtaatcaygcctgctaaactaggtatagtaac

SEQ ID NO: 40771 - DNA, 50 bp, homo sapien
atgtgggaagagagggaaagaatacrgacagatatttcaggagctgctgg

SEQ ID NO: 40772 - DNA, 50 bp, homo sapien
ttcatgggtttgcgtagaccatagcracaggtgatgatccaaaggactcc

SEQ ID NO: 40773 - DNA, 50 bp, homo sapien
aatcaagtcttccaaaagagaatggkagtcctttggatcatcacctgtcg

SEQ ID NO: 40774 - DNA, 50 bp, homo sapien
gaggaaaatgtaacatctggtatagraatgttacaacgattttattttaa

SEQ ID NO: 40775 - DNA, 50 bp, homo sapien
catgtataactaatataaatgcttayaacgtattgtcctgcatatacatt

SEQ ID NO: 40776 - DNA, 50 bp, homo sapien
tgtttttgtagatggttggcatttasgtgaatataattttgtaataaata

SEQ ID NO: 40777 - DNA, 50 bp, homo sapien
aaaggagagaagaatgctcttaatamgtttggaagcatttatttatttgt

SEQ ID NO: 40778 - DNA, 50 bp, homo sapien
ttcccttctcttaaaatttttgcccrccttccattgctcaataaccttta

SEQ ID NO: 40779 - DNA, 50 bp, homo sapien
tggcatatatgataatgaggaaaaawtctgattccattctcttcccttgt

SEQ ID NO: 40780 - DNA, 50 bp, homo sapien
ttttcaactagaacttccctttcaaygtcacctatcacttgaaatagcaa

SEQ ID NO: 40781 - DNA, 50 bp, homo sapien
ggtagcttttgacagttaaataagakgtatggagactagtacaatctcta

SEQ ID NO: 40782 - DNA, 50 bp, homo sapien
ttgtttggacttaccacactccagargaattcagctatatgcctcagagc

SEQ ID NO: 40783 - DNA, 50 bp, homo sapien
acctgaagatttaaaaaggtgcaagmagcctctgttacttaaaactcttc

SEQ ID NO: 40784 - DNA, 50 bp, homo sapien
cctttatcaaacagaattagagacartaacattaaatcaacaaattcatc

SEQ ID NO: 40785 - DNA, 50 bp, homo sapien
cctgtctaagaacaattattctgacrcttgttaaaaacagtaaggaagac

SEQ ID NO: 40786 - DNA, 50 bp, homo sapien
tcatatggtctcagtttagaatacartagtgaggagagttcccactgtca

SEQ ID NO: 40787 - DNA, 50 bp, homo sapien
tttaagttcatcaccattttgaagayacaatacttatttaaatccatcag

SEQ ID NO: 40788 - DNA, 50 bp, homo sapien
tatctataactgacaattcaagaaamctactgccgggagtgccaatcttt

SEQ ID NO: 40789 - DNA, 50 bp, homo sapien
ggaaggataaatataacttcctgaaygtgccttgtttcttgtacctctgt

SEQ ID NO: 40790 - DNA, 50 bp, homo sapien
atttctttagaactttcagggataamtgtgttgcactataatggcttcca

SEQ ID NO: 40791 - DNA, 50 bp, homo sapien
gctacagggattgccttttcaggtcygaactgaaccagtaagtaagtttt

SEQ ID NO: 40792 - DNA, 50 bp, homo sapien
gcaaatatttatgtggtaattatacrgagaaatgtttaggtgcaatattt

SEQ ID NO: 40793 - DNA, 50 bp, homo sapien
ccacaaattgaaaattggagaaagamcaaattagagtatattttcttctg

SEQ ID NO: 40794 - DNA, 50 bp, homo sapien
gctagtgagtattgcaggcaaaaacmaggtggattgattcataaagcttt

SEQ ID NO: 40795 - DNA, 50 bp, homo sapien
ggtttcagtatttcaacagtgggtcratgccagatattcttgacctgtca

SEQ ID NO: 40796 - DNA, 50 bp, homo sapien
ttctataagtaattgtgtagaaaaargtctcagagacgttttaatagttg

SEQ ID NO: 40797 - DNA, 50 bp, homo sapien
tccacttttttcttaatatgcatcakccaacattcctttcaaagcttccc

SEQ ID NO: 40798 - DNA, 50 bp, homo sapien
ccccaaacatagcatgctgttctcaygccttcatatatttccaggtgtgt

SEQ ID NO: 40799 - DNA, 50 bp, homo sapien
aagattaaagctcaaattgaaaaccwatgtttataattaaaaatataaat

SEQ ID NO: 40800 - DNA, 50 bp, homo sapien
agaactcacaggctactacgaagtayagagcaataactatatgcattaca

SEQ ID NO: 40801 - DNA, 50 bp, homo sapien
tcacagaaaatatgtaattaaagtayagcttattgccacaggtcacatta

SEQ ID NO: 40802 - DNA, 50 bp, homo sapien
ctgaaactcagatgggctgttttgaraaatgatttaaaggattagtatca

SEQ ID NO: 40803 - DNA, 50 bp, homo sapien
cttcaaatgaagagtatttcaaagasgatgttggactaataatataactc

SEQ ID NO: 40804 - DNA, 50 bp, homo sapien
gacatcagcaattcacaagaagctcrcagactagtacatagttggccatt

SEQ ID NO: 40805 - DNA, 50 bp, homo sapien
attgttgtagttctcaactgtgattsaaatacgtgatagttactagagca

SEQ ID NO: 40806 - DNA, 50 bp, homo sapien
tgggaatataattgcttctctgaatkacaaattttgtggtttttttcctc

SEQ ID NO: 40807 - DNA, 50 bp, homo sapien
aaaagttctcattctttgagtctgaygctaacaagctgataattaagata

SEQ ID NO: 40808 - DNA, 50 bp, homo sapien
aattagcaagaacatatcaatgaacrcaaagaacctgatcattatcactc

SEQ ID NO: 40809 - DNA, 50 bp, homo sapien
tgaattggtctgagatcataattacrgaattgaaagatttaatgtttcaa

SEQ ID NO: 40810 - DNA, 50 bp, homo sapien
tactttctctgagagtaatacctcaygtgctaataagtattgcatattaa

SEQ ID NO: 40811 - DNA, 50 bp, homo sapien
atccttttatacaaatcaagctgtaragataaagaaaatttgaagactct

SEQ ID NO: 40812 - DNA, 50 bp, homo sapien
cagatgaaccttgacttggctgataytagtgtgtacgtgaatgacccaga

SEQ ID NO: 40813 - DNA, 50 bp, homo sapien
aaataaggagttatgattgaatcacragtttatttaattagagatttttg

SEQ ID NO: 40814 - DNA, 50 bp, homo sapien
agtccagtaggagaaatggacataaratgtagtgccaaaatgaaaatata

SEQ ID NO: 40815 - DNA, 50 bp, homo sapien
aaaaaacaaagaagaaatacatataracactgagcatatagaagtatgtt

SEQ ID NO: 40816 - DNA, 50 bp, homo sapien
agcagcatttctgaagactgaaccasaaatatatggaacacacaaattct

SEQ ID NO: 40817 - DNA, 50 bp, homo sapien
agctttgacccattctgaaagaaacraacactgctgtaggttttatgccc

SEQ ID NO: 40818 - DNA, 50 bp, homo sapien
aaagtttataaatgaatagtaaaaakaatttcaaatgtaatattcaaact

SEQ ID NO: 40819 - DNA, 50 bp, homo sapien
ctggaagagccaactcattgtcgaargagaagaatgaagtgggagaagtg

SEQ ID NO: 40820 - DNA, 50 bp, homo sapien
acatagctatgcactgtgttttgatkaagcaatgtactatacagggcaat

SEQ ID NO: 40821 - DNA, 50 bp, homo sapien
catcaacaatatctggatgcctactyacaatgattatgtcaccttaaatc

SEQ ID NO: 40822 - DNA, 50 bp, homo sapien
aagaaaagcctctgaaatgtgaaaasggaaaaattgtgctgagtgtattt

SEQ ID NO: 40823 - DNA, 50 bp, homo sapien
gtagaacaaagtggttggctatttcwatactaagagaggtgtgaggttta

SEQ ID NO: 40824 - DNA, 50 bp, homo sapien
tgaggaccctcagtgtcttactcagratactatgaatgttctgcatgatc

SEQ ID NO: 40825 - DNA, 50 bp, homo sapien
atattattcaggggctacaaaatctsaccttcttggcttaactcattaat

SEQ ID NO: 40826 - DNA, 50 bp, homo sapien
aaattacttcaacttctacaaggcaratttactgatctttatgtcccctt

SEQ ID NO: 40827 - DNA, 50 bp, homo sapien
tctatttacatatgagatttctttgratgcaagtattttttctgtttaat

SEQ ID NO: 40828 - DNA, 50 bp, homo sapien
ctaaaatcacatggctaattaatcgsataccaataattaagctttgttat

SEQ ID NO: 40829 - DNA, 50 bp, homo sapien
acaggcctcagcaaaaaaatcataasacaatcagcagtggggtttatctt

SEQ ID NO: 40830 - DNA, 50 bp, homo sapien
gctggagttgtatatagattcctatsacctagctattatgcaggtgcaaa

SEQ ID NO: 40831 - DNA, 50 bp, homo sapien
agagtatacaccaaatcctaaactgyattctgtaccgtcatgatcgtgtt

SEQ ID NO: 40832 - DNA, 50 bp, homo sapien
tagaattatggtgcttctgttattayggattcattattggctggagttgt

SEQ ID NO: 40833 - DNA, 50 bp, homo sapien
tcttagccaggaaatgctttctctamtagacaccaatatccattgaaatc

SEQ ID NO: 40834 - DNA, 50 bp, homo sapien
tttgtgttaatcttataatcgatggraagtcattaaccacttaagaggag

SEQ ID NO: 40835 - DNA, 50 bp, homo sapien
aactggcatcagtttcttgaattcaytattgaagttactccagttttaaa

SEQ ID NO: 40836 - DNA, 50 bp, homo sapien
taggcactggccaacacatgactatwagaagaccaaactggcatcagttt

SEQ ID NO: 40837 - DNA, 50 bp, homo sapien
atatggaaatatttaagcctaaggamaacaagtctgttaataacacccct

SEQ ID NO: 40838 - DNA, 50 bp, homo sapien
atgatagtgattgcttttatattaaytgttgaggctagcctagtatatga

SEQ ID NO: 40839 - DNA, 50 bp, homo sapien
atgacaaatttgattacattttatakacatggttgaaaggaatgttggtg

SEQ ID NO: 40840 - DNA, 50 bp, homo sapien
gagtcgggcagagggggcaagggtaratcttcatacagaggacatattgt

SEQ ID NO: 40841 - DNA, 50 bp, homo sapien
gacattgtagtgttattaattggctkaaaatcaacattgtgtgtttcaag

SEQ ID NO: 40842 - DNA, 50 bp, homo sapien
agtgctagggcaaagtactgttgtawcatgaaagaagttccctgctgaga

SEQ ID NO: 40843 - DNA, 50 bp, homo sapien
tattgcatactttgggtcacttatamcttctcacaccaatacaaaaacat

SEQ ID NO: 40844 - DNA, 50 bp, homo sapien
agagtggctatttaagaagagaccamtaatggaaaagcacttggaaaaaa

SEQ ID NO: 40845 - DNA, 50 bp, homo sapien
tggaggattttgaacaggagtgtacyatgttctaatttagttttgaaatg

SEQ ID NO: 40846 - DNA, 50 bp, homo sapien
actgtcggtcatatttgcagtgaaaytgagtatttttctaaaagtagaag

SEQ ID NO: 40847 - DNA, 50 bp, homo sapien
tgacttgtataaatgtccaggagtayatcttcaatcaaatttcgaagaag

SEQ ID NO: 40848 - DNA, 50 bp, homo sapien
ctcctagctgaaagaacaattcttgsatatttctgatgttactagactca

SEQ ID NO: 40849 - DNA, 50 bp, homo sapien
ggattttccagaagttccatattgayataatactctgagtcacaggtaat

SEQ ID NO: 40850 - DNA, 50 bp, homo sapien
tttaacaacttaatcaattcaaggarcatgagccgcaatgctttgcctgg

SEQ ID NO: 40851 - DNA, 50 bp, homo sapien
acaaaatactgaaagttaatttatcrgaatgccaatagcaattatctatg

SEQ ID NO: 40852 - DNA, 50 bp, homo sapien
tctagcaaaacagaagctatgttagycaaaggtctttatttcctttatta

SEQ ID NO: 40853 - DNA, 50 bp, homo sapien
tgcaaatgtaaatagctttaagcaaygttaagatctcctttttctgaggt

SEQ ID NO: 40854 - DNA, 50 bp, homo sapien
ttaagggcttacatgattcctaaaaktatcatatgcatttttgttgatta

SEQ ID NO: 40855 - DNA, 50 bp, homo sapien
tctcaggtgacaccaccacagatcastaataactaccttcctgcatgtac

SEQ ID NO: 40856 - DNA, 50 bp, homo sapien
tattatgtgaatacatgagtgaatakctaactcacagtatactctcagag

SEQ ID NO: 40857 - DNA, 50 bp, homo sapien
acattgggcatatgcgttacactagkagctatgccttcaactatctcact

SEQ ID NO: 40858 - DNA, 50 bp, homo sapien
ttaaaatcacaaaactataaatgcamcctaacagcagaacacacagtaaa

SEQ ID NO: 40859 - DNA, 50 bp, homo sapien
aactgttggtgaaataaaaatataartgtcttcagaattgtcagcataca

SEQ ID NO: 40860 - DNA, 50 bp, homo sapien
taatggtgaggcaaacatcaataaarcaggataatttgtcagttggggta

SEQ ID NO: 40861 - DNA, 50 bp, homo sapien
gctctaagcactttcctagagataarataaaacagaaactaactgaaatt

SEQ ID NO: 40862 - DNA, 50 bp, homo sapien
aagcctgtctgggcacagtgtaataygctggtctgatacccatgaactcc

SEQ ID NO: 40863 - DNA, 50 bp, homo sapien
tgggaactttttatttgagcaggaakaatggaggcattttacagtgtgct

SEQ ID NO: 40864 - DNA, 50 bp, homo sapien
ttgcctggaagtggattccagaacarcctatcaggaagaggtagtttctg

SEQ ID NO: 40865 - DNA, 50 bp, homo sapien
aacataagcttggtggattatcgaamgacctcaaatgggtcaggagttcg

SEQ ID NO: 40866 - DNA, 50 bp, homo sapien
taagtcagtactgtttttagacagcscaaatgtgtcacaaggcacacagc

SEQ ID NO: 40867 - DNA, 50 bp, homo sapien
tttgtcacagtgtccttttcaatacygaccatcagataaggattaggagt

SEQ ID NO: 40868 - DNA, 50 bp, homo sapien
actttacaaaaagttgttcataaggycctgaagattttccttgccaatta

SEQ ID NO: 40869 - DNA, 50 bp, homo sapien
atgaagaaaaaggtatggtaaaatgycaggctctaaatagtggaatcatt

SEQ ID NO: 40870 - DNA, 50 bp, homo sapien
taaaaccacattcaactacaaacacwgactctgaggaaagagtttccata

SEQ ID NO: 40871 - DNA, 50 bp, homo sapien
tattgcatgcttcagagaaatctcaygtgaaagaaagagccaatccatgc

SEQ ID NO: 40872 - DNA, 50 bp, homo sapien
ctcaaatgtttcactattacaccacrattgaattaaacaagcaaataaat

SEQ ID NO: 40873 - DNA, 50 bp, homo sapien
cacatcctcgaaaacttgctaattayagtttgaaggccagctcttctcgt

SEQ ID NO: 40874 - DNA, 50 bp, homo sapien
gatacctaaatgctactacagatggyatgtctgttatgttactggaaaag

SEQ ID NO: 40875 - DNA, 50 bp, homo sapien
ttaacctctcctcaccaggtatgacrgaccagtttgcgattacgtgaatg

SEQ ID NO: 40876 - DNA, 50 bp, homo sapien
caaaatacatttgcagccttgacaaractaggaattatttcatatgaagt

SEQ ID NO: 40877 - DNA, 50 bp, homo sapien
tatatttctaccacctactaatcaamtattctgtgtggtttgataagtca

SEQ ID NO: 40878 - DNA, 50 bp, homo sapien
accacagtatgtaagtccaattcaaygattttctaagtatgtaaaaaatg

SEQ ID NO: 40879 - DNA, 50 bp, homo sapien
tacttttaggttgacaagtgtaatayagactaaaaaattgagcctgagac

SEQ ID NO: 40880 - DNA, 50 bp, homo sapien
aaatttcagaatctccatagccggascagtgtgcctgacccaggtgggca

SEQ ID NO: 40881 - DNA, 50 bp, homo sapien
aaagcagaaattgtggctgtttctayggaaattggcacgtgcaaggtaat

SEQ ID NO: 40882 - DNA, 50 bp, homo sapien
ctttgaacttggttgagattaagaawaaagtatgacatgagaaaaagata

SEQ ID NO: 40883 - DNA, 50 bp, homo sapien
agtgagttttaaaatgtatccgttgyatatagcattattgagcttattac

SEQ ID NO: 40884 - DNA, 50 bp, homo sapien
cattttacttaatactactttgttasaggaaaattcaattttcttgtatt

SEQ ID NO: 40885 - DNA, 50 bp, homo sapien
ttcttactctcttagaagacacaccrgattactcactggatgctaaaagc

SEQ ID NO: 40886 - DNA, 50 bp, homo sapien
aagtattctatgccagtctccgttcractttgaagatgctgaccagggga

SEQ ID NO: 40887 - DNA, 50 bp, homo sapien
ctaaggcatcaagcaggtaactatartaggcaaaggaagcaagatgacaa

SEQ ID NO: 40888 - DNA, 50 bp, homo sapien
ttttttttttttttccattcttgccygatctttgttggcttctgtattag

SEQ ID NO: 40889 - DNA, 50 bp, homo sapien
gagtttgtgggaagagtaccatggayggaagatctgttgaaaaattcatt

SEQ ID NO: 40890 - DNA, 50 bp, homo sapien
caatgatgctatctcacagtattcaycatgcaaattatggtttctgttct

SEQ ID NO: 40891 - DNA, 50 bp, homo sapien
ttagtaagtgtagactggaatcccarcttgaccattgtccgacttcaggg

SEQ ID NO: 40892 - DNA, 50 bp, homo sapien
tgacaattacacttctttctttgaaytctaagtcaatataattaccttac

SEQ ID NO: 40893 - DNA, 50 bp, homo sapien
tccataccagcccctgctcctatcamatgtttactggatgtcttaatgga

SEQ ID NO: 40894 - DNA, 50 bp, homo sapien
cagggttagagcctttttgctacggyaagtaattcatgcacccaacctca

SEQ ID NO: 40895 - DNA, 50 bp, homo sapien
cactcaggatattttgtgtggtttcyctttgatgtgcctcttcctacaaa

SEQ ID NO: 40896 - DNA, 50 bp, homo sapien
tgtctctcaagagccaggtaaagtayagtaagtgagggtcatatgcagtt

SEQ ID NO: 40897 - DNA, 50 bp, homo sapien
agacttgcaacctatgatacaaagakagtttatatacggtgccagtggtg

SEQ ID NO: 40898 - DNA, 50 bp, homo sapien
cattagaaataatacagacttttaaycaaatgaggtattatactcatgga

SEQ ID NO: 40899 - DNA, 50 bp, homo sapien
tagacacaaagctacacttagcaatyaaggacttgagagaatccctccag

SEQ ID NO: 40900 - DNA, 50 bp, homo sapien
attcagattaatcaagaacaggaatsatagggacagaaatccggagaact

SEQ ID NO: 40901 - DNA, 50 bp, homo sapien
attagtttgatcctgggagggattaragaccaaataactacagtcagcca

SEQ ID NO: 40902 - DNA, 50 bp, homo sapien
aggaagtagcttaacacaaattgtcsaaattaaccaacatttttgaatgc

SEQ ID NO: 40903 - DNA, 50 bp, homo sapien
tgagaaaataacaggttaagttatasacagtttagatgtttcaagtactc

SEQ ID NO: 40904 - DNA, 50 bp, homo sapien
tatgtcttatgcatatgtctgttaamggtaaagtttggtctgagaaataa

SEQ ID NO: 40905 - DNA, 50 bp, homo sapien
ttgcatgtgctgcttcaagtcaggaraagtataattgtactgtgtgtaaa

SEQ ID NO: 40906 - DNA, 50 bp, homo sapien
tgcctcataaataatacatctactakgtacccataaaatttaaaaatact

SEQ ID NO: 40907 - DNA, 50 bp, homo sapien
aggtgcagataaaaatatggttttcraagagcctttctgattaccatgct

SEQ ID NO: 40908 - DNA, 50 bp, homo sapien
tttttactagtgttagtatgggcaasaccttatctctctttttaaaaaat

SEQ ID NO: 40909 - DNA, 50 bp, homo sapien
aagtatggtcaaggttctgtggaaaytagtgaagaattgaagatcaggtg

SEQ ID NO: 40910 - DNA, 50 bp, homo sapien
atcaactgatgttgacaagaactgaygtccacaagagcaaaatggaaaga

SEQ ID NO: 40911 - DNA, 50 bp, homo sapien
cctgctacatagaaatcaggactgartaccacagaatttttaaatgtcac

SEQ ID NO: 40912 - DNA, 50 bp, homo sapien
actcataatcataagggaaataatcrcgctgttcacctgtattacatggc

SEQ ID NO: 40913 - DNA, 50 bp, homo sapien
tgtctctgactccaaggtcgtctgakgtcatacctttccaactgtaagtt

SEQ ID NO: 40914 - DNA, 50 bp, homo sapien
cagaagctagaatcaaaagttctgaraagacccggagaggattcagtctc

SEQ ID NO: 40915 - DNA, 50 bp, homo sapien
tttcttaatcctgagcattgatcaartattgaccgtaggccagatgctat

SEQ ID NO: 40916 - DNA, 50 bp, homo sapien
cagtgtgaatatttcttggcttcacsaatacttcttgttttcaacttttc

SEQ ID NO: 40917 - DNA, 50 bp, homo sapien
tgtaaaattttggaagaaaatgtccragaaaacgattaaaatgcttatcc

SEQ ID NO: 40918 - DNA, 50 bp, homo sapien
acccctaagcacatatgcagtaaaakttaggctgtgtggtgagatttgag

SEQ ID NO: 40919 - DNA, 50 bp, homo sapien
atttaagtttgcctcaagacgggaayagcttgtgcctagtgggaaattgc

SEQ ID NO: 40920 - DNA, 50 bp, homo sapien
aaatttgctgcaagtcattgtcttaygtagtctttttaagggctttgaga

SEQ ID NO: 40921 - DNA, 50 bp, homo sapien
ttttattccttcaggaataagtcacwctcttaagaacctgtgctctaaac

SEQ ID NO: 40922 - DNA, 50 bp, homo sapien
aagtgttaccggaggagttattagtyaaagcatgagtaaacctttagcaa

SEQ ID NO: 40923 - DNA, 50 bp, homo sapien
ttcacggatttgtaatctaggtcaarttacttaaaatctgaaaaattagc

SEQ ID NO: 40924 - DNA, 50 bp, homo sapien
aggcctaaaaagattgccttaccagyctagatcaaacagtaagttaatgc

SEQ ID NO: 40925 - DNA, 50 bp, homo sapien
ttgagctatatactacattaactacyattaagtggcatgtatattagttg

SEQ ID NO: 40926 - DNA, 50 bp, homo sapien
gcagtcatactaactgcaagatcaaygattaataccaaagtgttcacata

SEQ ID NO: 40927 - DNA, 50 bp, homo sapien
ctctaaggctgcctactaagcagaaytagcccagccatggtaaaggaggt

SEQ ID NO: 40928 - DNA, 50 bp, homo sapien
aaagaaaacacaaaggaaatcatcargagaataaattcaaaaattaaaaa

SEQ ID NO: 40929 - DNA, 50 bp, homo sapien
aaatagtatgacatggtgcagttttwaaaaaatattactgtacctctggt

SEQ ID NO: 40930 - DNA, 50 bp, homo sapien
tgaatttgaggactagtagctggaastgctgaaccacctcagtgggttgt

SEQ ID NO: 40931 - DNA, 50 bp, homo sapien
acagatattctccatatgtgagttaygtatctcaaaaaagtattcaaagt

SEQ ID NO: 40932 - DNA, 50 bp, homo sapien
gtgtgagctagccgcaggtgagcaayttcttgtttccaaacaaatagaaa

SEQ ID NO: 40933 - DNA, 50 bp, homo sapien
ttctcttgtggttgctattaggaacsagatctcagggttatacaaaaggc

SEQ ID NO: 40934 - DNA, 50 bp, homo sapien
atatgagaaacaatcaacatcattcrcatacaataatacttaatatcata

SEQ ID NO: 40935 - DNA, 50 bp, homo sapien
taaaatatatatagctgatatgtgcscattttatgcacatgtattgcaag

SEQ ID NO: 40936 - DNA, 50 bp, homo sapien
acatggcagaacaccaaggtttcacygctttactccaaagacgccacgta

SEQ ID NO: 40937 - DNA, 50 bp, homo sapien
agactaaaggtagttccttgaataarttaagatttgatatcattttaacc

SEQ ID NO: 40938 - DNA, 50 bp, homo sapien
ccgaggacaaaatatcgatcaaaaargtcatgttgttccaggtcccaaga

SEQ ID NO: 40939 - DNA, 50 bp, homo sapien
ttttaaggaaaaaacaatcccatagsctatgactaggtaagaaaggagaa

SEQ ID NO: 40940 - DNA, 50 bp, homo sapien
caggccactctctataaaataacaaygttccccacttcctccttatctta

SEQ ID NO: 40941 - DNA, 50 bp, homo sapien
tagtaaaataattaaaaacctaagaygaagaagatacgatacaaactgtc

SEQ ID NO: 40942 - DNA, 50 bp, homo sapien
gggctagataagagaaaactgatgaygtaaatttttttttttttttaagg

SEQ ID NO: 40943 - DNA, 50 bp, homo sapien
ctttaaaagtaaatgaggcaaaataygtaaaagcacttaaattataaaga

SEQ ID NO: 40944 - DNA, 50 bp, homo sapien
cagtttattcattcttcggtagaaayacatgtagttagttactttgaata

SEQ ID NO: 40945 - DNA, 50 bp, homo sapien
agatgtacaccgggcattgcctacgraagttagttaattacaccaacctg

SEQ ID NO: 40946 - DNA, 50 bp, homo sapien
ttacagcttgattgcaacttatttaraagtcctgggccagaactgcccag

SEQ ID NO: 40947 - DNA, 50 bp, homo sapien
tgcctttattaggaaatgatcaatamcttcctacttagcaatattttagg

SEQ ID NO: 40948 - DNA, 50 bp, homo sapien
tagaattggcttaacaaagagctatsaaactatacatgcactatatagat

SEQ ID NO: 40949 - DNA, 50 bp, homo sapien
attctgccttaggttggtatagctargtgaaaaatgcacaatttagaatc

SEQ ID NO: 40950 - DNA, 50 bp, homo sapien
gtcatttcgaagctgatggaaatcamgaagagcttaaaagcttcagaacc

SEQ ID NO: 40951 - DNA, 50 bp, homo sapien
tagagggttagggtaccaatgacagyagaaaggattatgaccaactgtga

SEQ ID NO: 40952 - DNA, 50 bp, homo sapien
ctaccttgttttgcttaaagtcacakattctaagaagctcgtataaagtt

SEQ ID NO: 40953 - DNA, 50 bp, homo sapien
tgcactgctccttctctaaggtgaayagtttcatttcctgcctgagcttt

SEQ ID NO: 40954 - DNA, 50 bp, homo sapien
gaggtgatgctgctgcttcaaaatcrattgttgtgtacatcctcggggag

SEQ ID NO: 40955 - DNA, 50 bp, homo sapien
attatagtactaacagagatgcatayatactgatcatacattctgacatg

SEQ ID NO: 40956 - DNA, 50 bp, homo sapien
ctcatttaaactcatgaaagttggayataaaagtgaagaaaagaagaggt

SEQ ID NO: 40957 - DNA, 50 bp, homo sapien
agtaatctttttatattgtgtgacayaggggtaatttcatttgagtttct

SEQ ID NO: 40958 - DNA, 50 bp, homo sapien
gtaggtaaaatagtcttacctgtgamtcacaatatagaagcaataaaaga

SEQ ID NO: 40959 - DNA, 50 bp, homo sapien
aaaatttttctggtactgaattctarggaaagttttcttcatggtgctca

SEQ ID NO: 40960 - DNA, 50 bp, homo sapien
ttatttctgcctagtggttacaacayagtcaatttgggcctaaatatcac

SEQ ID NO: 40961 - DNA, 50 bp, homo sapien
actcacacctgtctatagcctcaaaygggtgcttgcctaaacctgcaaaa

SEQ ID NO: 40962 - DNA, 50 bp, homo sapien
gtaaagtaactcagtaatctcatgcsgattttggtattttactgccagct

SEQ ID NO: 40963 - DNA, 50 bp, homo sapien
agtattgtacagcagatttctaaaaygcactcgtcttgccttaacttaaa

SEQ ID NO: 40964 - DNA, 50 bp, homo sapien
aaatgttaaaacttaaaagctctaamaactgattgagtatattacaattt

SEQ ID NO: 40965 - DNA, 50 bp, homo sapien
gaggttagggaggcacccactatagyagagatataggaagagttattttt

SEQ ID NO: 40966 - DNA, 50 bp, homo sapien
aaccatactatcattgttaaacaccrctctgatcgtcaaaattaactgag

SEQ ID NO: 40967 - DNA, 50 bp, homo sapien
gaatctcaacataattttgaagttaycctaaaggagaccataaataaatt

SEQ ID NO: 40968 - DNA, 50 bp, homo sapien
gtccccaagggacatggcaaaatgaygacatctgaggtttgaagcctgtc

SEQ ID NO: 40969 - DNA, 50 bp, homo sapien
agtattttggtaagagcattgacacraggttgtccagaaatcccttaaaa

SEQ ID NO: 40970 - DNA, 50 bp, homo sapien
agccttccgatccagtttagttaccracagttgcataacattagctatcg

SEQ ID NO: 40971 - DNA, 50 bp, homo sapien
gctgaggaagtcaggtgatgatgcamgaactttaaggagtgcttacctgt

SEQ ID NO: 40972 - DNA, 50 bp, homo sapien
tatgcaaatgacttgggactaaaacyaatcatgaaatatattactttcct

SEQ ID NO: 40973 - DNA, 50 bp, homo sapien
ctatgttgtaaccactaggcagaaayaagtgattaaaagaaaatcccgta

SEQ ID NO: 40974 - DNA, 50 bp, homo sapien
ctgtttgggttttatagacagtgtayatcacaaaaagaaacattacaaaa

SEQ ID NO: 40975 - DNA, 50 bp, homo sapien
taacgggacaaaatcaactttatgcwcattctaaatctctcaactgctat

SEQ ID NO: 40976 - DNA, 50 bp, homo sapien
ctgctgcctctgctgctgttgtaaaygccttcatggagacaggcacccca

SEQ ID NO: 40977 - DNA, 50 bp, homo sapien
cgtgagccaccgtgcccagcctgtarggataaacattcaagtcttgctct

SEQ ID NO: 40978 - DNA, 50 bp, homo sapien
tagagtcaaggaatagactacttacygcagaatctaacctctcattggga

SEQ ID NO: 40979 - DNA, 50 bp, homo sapien
ttcagtggaacaagtgagtgttctgraaagtacaacaggatcaagttttg

SEQ ID NO: 40980 - DNA, 50 bp, homo sapien
tgagtcactcatgtctttagattctraacagagaaaatgtcaaggttgcc

SEQ ID NO: 40981 - DNA, 50 bp, homo sapien
aaaaggaagtagatttaacacggagkatgcaatccaaatgcatgtcctca

SEQ ID NO: 40982 - DNA, 50 bp, homo sapien
ccttttgtaatttgttagccttgaartattggaaaaaaataaaatgtctc

SEQ ID NO: 40983 - DNA, 50 bp, homo sapien
acgtgctaacagtttgttagttcccrcagcagtaattatgatagattgtg

SEQ ID NO: 40984 - DNA, 50 bp, homo sapien
gaactgttatgatcagtatgattttwaaaacagtgctaacaaattatagg

SEQ ID NO: 40985 - DNA, 50 bp, homo sapien
caattgatggcaagtttcacgtgtcrcaattaaagttttatgtacgtatt

SEQ ID NO: 40986 - DNA, 50 bp, homo sapien
gatagagatagagaagatgtgatgamgagaagaaaacaagtacagcctaa

SEQ ID NO: 40987 - DNA, 50 bp, homo sapien
tttagcctgatatttacatcttctcratatctcactgaattctgttcttt

SEQ ID NO: 40988 - DNA, 50 bp, homo sapien
ggtttgcataactctgctaacgccakaattttttaagtcactttttatag

SEQ ID NO: 40989 - DNA, 50 bp, homo sapien
ttcaattactgtttcctcttcaacamgtgattgtttatgtcttttggggc

SEQ ID NO: 40990 - DNA, 50 bp, homo sapien
gacagcctaagatcactgtcctcaakaatttaccttgggtagtaagatga

SEQ ID NO: 40991 - DNA, 50 bp, homo sapien
taattttcctggagcacctacttgcrgactgtagctctttctccaaactt

SEQ ID NO: 40992 - DNA, 50 bp, homo sapien
tcagtcttatttgattaaaattggargactaaacagagaagctgatagaa

SEQ ID NO: 40993 - DNA, 50 bp, homo sapien
tacagacttgcccatcctacattcawaagaaaatagatcctcaaatgccc

SEQ ID NO: 40994 - DNA, 50 bp, homo sapien
attacagcaatagcatatttctcaascaccatatagttgcaaatccttta

SEQ ID NO: 40995 - DNA, 50 bp, homo sapien
catcttgcagcaaaaccaccatgatkaccagcgtttgactcttgcatacc

SEQ ID NO: 40996 - DNA, 50 bp, homo sapien
catgggccaagtcacaggttctaackctattgctgggacaaaagataatt

SEQ ID NO: 40997 - DNA, 50 bp, homo sapien
gcaataacagaacatgtcattactasaaaaggttattgtgagaattgaat

SEQ ID NO: 40998 - DNA, 50 bp, homo sapien
gggattacaaaataacagatttaaasgtataaagtgtgtaaacatcatta

SEQ ID NO: 40999 - DNA, 50 bp, homo sapien
gggaagaggaggtctatttccagccrgactaggcctttctatggattctc

SEQ ID NO: 41000 - DNA, 50 bp, homo sapien
gcaagaaagacaaggtgggtagaaaytaggaaatcctcctgaaccaaaaa

SEQ ID NO: 41001 - DNA, 50 bp, homo sapien
tgatgcgcatattgcctttgaaaaamttgtagtagaaagtcatattcaat

SEQ ID NO: 41002 - DNA, 50 bp, homo sapien
tcttcacatggcctttttctctgtaygttttcaatctccgtctccctctg

SEQ ID NO: 41003 - DNA, 50 bp, homo sapien
atcaaatctctttgtatctgttacascaattagaccaacaaaattttcac

SEQ ID NO: 41004 - DNA, 50 bp, homo sapien
tactacataattatcattttcacctraatttcagctgatctctgttgcta

SEQ ID NO: 41005 - DNA, 50 bp, homo sapien
agagaacagcgcctgtgatttaaaaygagcaggagggtctaccttcaaag

SEQ ID NO: 41006 - DNA, 50 bp, homo sapien
cttctcagcattcattttctctctgkaagcataaagctgtttttccttca

SEQ ID NO: 41007 - DNA, 50 bp, homo sapien
ctaataaccatgtattccaaatgtargtacagacctctcccttgactccc

SEQ ID NO: 41008 - DNA, 50 bp, homo sapien
ggaaagcaaagaagcattaaaaaaargtgatgagagcaaaagatgattgg

SEQ ID NO: 41009 - DNA, 50 bp, homo sapien
cattggacgagacactataccaacaytcacaagccttgcattctagtgga

SEQ ID NO: 41010 - DNA, 50 bp, homo sapien
taggaagtgggtagagtaaatattascttcccacaagcagatagggacat

SEQ ID NO: 41011 - DNA, 50 bp, homo sapien
atggctatattttaatacaatgaaakgatatatacaaaaatcagcaaaag

SEQ ID NO: 41012 - DNA, 50 bp, homo sapien
aggtgctacctttttaagctaactasagaataaatacttagagtgtaatt

SEQ ID NO: 41013 - DNA, 50 bp, homo sapien
tagcttcctcccttaagacttataakagcaattctcaaactttctcgtct

SEQ ID NO: 41014 - DNA, 50 bp, homo sapien
ttggaggcttatctatccggtattayactcattacctcggtgacgggatc

SEQ ID NO: 41015 - DNA, 50 bp, homo sapien
tatttatcaaaagaaacattggacartcagaatgggctgcagagctgtgt

SEQ ID NO: 41016 - DNA, 50 bp, homo sapien
cagtctctttctgaaaggtgattaaraaaagaggataataaagcaacatc

SEQ ID NO: 41017 - DNA, 50 bp, homo sapien
ttattcctgaagacaaatgaaggaasatagggagcaagattgactgtcat

SEQ ID NO: 41018 - DNA, 50 bp, homo sapien
aagcatctttgcccaaagataaaaayggataaaagactgtacttactgtg

SEQ ID NO: 41019 - DNA, 50 bp, homo sapien
gggtcttagagctaggccgaagttayccaaaactgaggagtctgtccagc

SEQ ID NO: 41020 - DNA, 50 bp, homo sapien
ttaattacgtggctttattcccagaycaagattgtgcccattaaccccaa

SEQ ID NO: 41021 - DNA, 50 bp, homo sapien
tttcgcagttcatagcaatttgaaartcactacgctaattaaattttaaa

SEQ ID NO: 41022 - DNA, 50 bp, homo sapien
attatctccctattactttggttagrcctctgattatttgtagtttaaca

SEQ ID NO: 41023 - DNA, 50 bp, homo sapien
aagacctgagggtttactattgtaarggtcatgataaacaatgggatgat

SEQ ID NO: 41024 - DNA, 50 bp, homo sapien
atgccaaagcttcaggtatatcagamccttttccacaccaccccacatca

SEQ ID NO: 41025 - DNA, 50 bp, homo sapien
tagaacatacttatttgataaaacartcatagaatgcaaatgcaaattta

SEQ ID NO: 41026 - DNA, 50 bp, homo sapien
agaagaaatatttagctgctaaaggycatgaagttatggctctgaagagc

SEQ ID NO: 41027 - DNA, 50 bp, homo sapien
aaaataatggcctaaattagaacccrgaagtctggactctgaatcttctg

SEQ ID NO: 41028 - DNA, 50 bp, homo sapien
aggagtcccagtttctgtcctaaaartgtatatattagaaccattagata

SEQ ID NO: 41029 - DNA, 50 bp, homo sapien
tgggatcccagaaatctctgggttaycaagaaataaatggacatcaaact

SEQ ID NO: 41030 - DNA, 50 bp, homo sapien
ctgacatggcatcggagataaatagraattagtggatcctctaaaaaatg

SEQ ID NO: 41031 - DNA, 50 bp, homo sapien
tcctgcattcaaatatattttagtasctattcaccaaggaaatgtgctaa

SEQ ID NO: 41032 - DNA, 50 bp, homo sapien
cttcggttgaattaacagtacgaaayagtaaccctctgtgcccgtgatgt

SEQ ID NO: 41033 - DNA, 50 bp, homo sapien
tgtaaactgatgcaacttttgtggastatctgtagaaatttcatatccac

SEQ ID NO: 41034 - DNA, 50 bp, homo sapien
caccataaggaaagagtgtacaagayggtaagatatcaaataattttcaa

SEQ ID NO: 41035 - DNA, 50 bp, homo sapien
accggggatctgacttcatgcaccaytgaaagggtctctaggccctccag

SEQ ID NO: 41036 - DNA, 50 bp, homo sapien
gtgcttttcagagaggctaccgttgyacttcagtatgcagcagatacaga

SEQ ID NO: 41037 - DNA, 50 bp, homo sapien
cttttgtttatgtgggctgcatctaycttaacatggatgcatgttttcta

SEQ ID NO: 41038 - DNA, 50 bp, homo sapien
tggtccaagccattcaataagtcccwagataattccaaactttcccacat

SEQ ID NO: 41039 - DNA, 50 bp, homo sapien
aattatgcagagttcaaaacaagaaytggaaaagaattgactgaagacaa

SEQ ID NO: 41040 - DNA, 50 bp, homo sapien
caattactttagtccagggatgagayagtcgagacagttgctctcaacta

SEQ ID NO: 41041 - DNA, 50 bp, homo sapien
agaaaccaagtaaattagggagataycattcatgcctttttaaaaatctt

SEQ ID NO: 41042 - DNA, 50 bp, homo sapien
ggaggctaaagtgtatctcttcttawacatacatgagaaataatagatta

SEQ ID NO: 41043 - DNA, 50 bp, homo sapien
catctcaccttgaataattgaagcastagttttcagaaaagctcttgttc

SEQ ID NO: 41044 - DNA, 50 bp, homo sapien
cagcattttctgttcattgaactacsacaactgacttatgatcttggttc

SEQ ID NO: 41045 - DNA, 50 bp, homo sapien
aaccttttatcttttctttagagtakaccttcatgctccattaaaactag

SEQ ID NO: 41046 - DNA, 50 bp, homo sapien
tattttctttgttagatatatcatasggcaataatttggctcatactaca

SEQ ID NO: 41047 - DNA, 50 bp, homo sapien
gctgtaaagatacacctgagactgcraaatttatgaggaaaacaggttta

SEQ ID NO: 41048 - DNA, 50 bp, homo sapien
tttacttctctcctgtgcatctagartactattatctagaatagtactac

SEQ ID NO: 41049 - DNA, 50 bp, homo sapien
gctgctgcaaagcctttaatgtggartacggacatcttgtagtaaggtta

SEQ ID NO: 41050 - DNA, 50 bp, homo sapien
caaaaaaaaaatcttattagtttccraagaatctatgcataggtatagtt

SEQ ID NO: 41051 - DNA, 50 bp, homo sapien
gttgttttcatgcacaagaaggaaargtattcaaattaagtctaccagaa

SEQ ID NO: 41052 - DNA, 50 bp, homo sapien
atctgaacccaccagccaaataagcracctgtgtacaagccaagttaaaa

SEQ ID NO: 41053 - DNA, 50 bp, homo sapien
cagaatagggaaagattgtccaatayagtcctaaagagtcaagatcaacc

SEQ ID NO: 41054 - DNA, 50 bp, homo sapien
ggtttcccccacctcagaagtctgaktatgaaaaggcttagaagcaacag

SEQ ID NO: 41055 - DNA, 50 bp, homo sapien
tctgctatcacattacctcaataaayggcatggtcctgcctttcattttc

SEQ ID NO: 41056 - DNA, 50 bp, homo sapien
cttataataactaaaatggttattawcaatatcttgcaaaacttgccaaa

SEQ ID NO: 41057 - DNA, 50 bp, homo sapien
tcactcatggttagtgccatctttawcttcttttgaaagcagttgggtat

SEQ ID NO: 41058 - DNA, 50 bp, homo sapien
aataaaaaatataaatttagacaaaygagaatcttgaaagcattaagaaa

SEQ ID NO: 41059 - DNA, 50 bp, homo sapien
agggaggaagaagagaattctgttaycgggtgaataattaaaagctgcat

SEQ ID NO: 41060 - DNA, 50 bp, homo sapien
ctataagcagtatcagctaaccacaraagtgggctacaataaccaatgga

SEQ ID NO: 41061 - DNA, 50 bp, homo sapien
tttcatagggtttccaattaatgtcratttattctacttgtctacattta

SEQ ID NO: 41062 - DNA, 50 bp, homo sapien
attcaatcacttaatcacttatttarcttttagtctatctgtgagtgtca

SEQ ID NO: 41063 - DNA, 50 bp, homo sapien
gaatggcctcagagtaaatgctcaayaaaggaaagctaaaataattagag

SEQ ID NO: 41064 - DNA, 50 bp, homo sapien
cacccattactcaccatgttacttaygcacaaaggtcccagtttagtgac

SEQ ID NO: 41065 - DNA, 50 bp, homo sapien
aggagaatgaaaagtgtaggagataratagaaaggagaaagggaagaaga

SEQ ID NO: 41066 - DNA, 50 bp, homo sapien
caggagttagtagagagtcctgacamgcaaactggaagattatgttatct

SEQ ID NO: 41067 - DNA, 50 bp, homo sapien
aagaagaaataaattcaaactaaaamaagatcggcaaagattaatttaga

SEQ ID NO: 41068 - DNA, 50 bp, homo sapien
acactatacctactactcttagagcygcagaagtcatgaaagatatgctc

SEQ ID NO: 41069 - DNA, 50 bp, homo sapien
ctaactcctggactccttaaaatcaratgaagccaagttgtctgaagcaa

SEQ ID NO: 41070 - DNA, 50 bp, homo sapien
tgcttcatattcaagtatctttacaygtgcttcatatctttatacacaaa

SEQ ID NO: 41071 - DNA, 50 bp, homo sapien
tgatggcagacttgtgcgatcccatkagaatactgaaagcagtgtattac

SEQ ID NO: 41072 - DNA, 50 bp, homo sapien
cagtgaaaacataatcaactagctgracagttaagactctgtgactccaa

SEQ ID NO: 41073 - DNA, 50 bp, homo sapien
gttctgttatagccaattattgccarctttggtttcctgttcatatgttc

SEQ ID NO: 41074 - DNA, 50 bp, homo sapien
gaacacatatgtatttacttacataraaatggaacctttgtctgctaaag

SEQ ID NO: 41075 - DNA, 50 bp, homo sapien
cataaaagtgattgttttctttatcmagtaggttatttgtgtataaaaat

SEQ ID NO: 41076 - DNA, 50 bp, homo sapien
tgcccctctctgagcccgaacatcarcatttaggacatggcaggaattaa

SEQ ID NO: 41077 - DNA, 50 bp, homo sapien
gaaaacaaagctatttttaaaaccaygaatctctgacaagaacaaagtca

SEQ ID NO: 41078 - DNA, 50 bp, homo sapien
ttttgcagaatgtcctgctgatgggyacggaaaagctaatggaaaaatca

SEQ ID NO: 41079 - DNA, 50 bp, homo sapien
cttcgattaatttcctgtcagcagargaactttaatttcatcttcaacaa

SEQ ID NO: 41080 - DNA, 50 bp, homo sapien
tctccttcaacaattcctgataatgrcaacttaaattaggataactttac

SEQ ID NO: 41081 - DNA, 50 bp, homo sapien
tagatgctggggtccctgtttctcayggtgttctgataacttgggtatca

SEQ ID NO: 41082 - DNA, 50 bp, homo sapien
acaaaccctgacaaacttcagcaaargaggggtgaattggtaaaaaggga

SEQ ID NO: 41083 - DNA, 50 bp, homo sapien
attttctgacaataagatttgctaartattggaaagtgttcctgagagag

SEQ ID NO: 41084 - DNA, 50 bp, homo sapien
gttgtactggccccttggtggatcayatcccagctccagataactcatgg

SEQ ID NO: 41085 - DNA, 50 bp, homo sapien
tggtaggcatgtgtcaaagaaaacargacaaggttgcaagaacagaatgg

SEQ ID NO: 41086 - DNA, 50 bp, homo sapien
tagaatttcatagaggtaggtaatgyatactgagttcattgtttttctct

SEQ ID NO: 41087 - DNA, 50 bp, homo sapien
aaagctccaaaccttactcctttacyattgcaagtatacgtgagctggag

SEQ ID NO: 41088 - DNA, 50 bp, homo sapien
tattaatcaaggtagcagttacatcmatcaaagtgacagtatatatactt

SEQ ID NO: 41089 - DNA, 50 bp, homo sapien
aatgcaacctcatttatctgacaacygaatttgtaatgggtatccgggtg

SEQ ID NO: 41090 - DNA, 50 bp, homo sapien
tggcatgcttttagtttttaaagtamatctgtagtttgacttgaataccc

SEQ ID NO: 41091 - DNA, 50 bp, homo sapien
cttttctcacatcaaaatatagtgaygctgggttccatttattcaaggtc

SEQ ID NO: 41092 - DNA, 50 bp, homo sapien
agcagaagacactctctctcacagarcctaaccaggaagagttctacaaa

SEQ ID NO: 41093 - DNA, 50 bp, homo sapien
tcttcagttattagcctaataagaayggaaacagcttgcaaaagtaagac

SEQ ID NO: 41094 - DNA, 50 bp, homo sapien
ttttgaaatattgattgatagatgawacctcagcaaaagaagaagagcac

SEQ ID NO: 41095 - DNA, 50 bp, homo sapien
gaatgttaccatacgaatgtgtgcayaagatgaaagaaaaattaaactgg

SEQ ID NO: 41096 - DNA, 50 bp, homo sapien
tttaattctccatgtctttacaaaakccttctcaccttgaaattggaaaa

SEQ ID NO: 41097 - DNA, 50 bp, homo sapien
ccattatctccctccactatttccaygaggccaaatttattttctttttt

SEQ ID NO: 41098 - DNA, 50 bp, homo sapien
attcctgggctgtagaatagttacayagattaagaagagagggttgtaag

SEQ ID NO: 41099 - DNA, 50 bp, homo sapien
ccaaatagttaatatagtaagtaacrattgctctgtgtgcaggaatacat

SEQ ID NO: 41100 - DNA, 50 bp, homo sapien
aaggatgtagataggggcaagaacaratgaggagagactatcctttttaa

SEQ ID NO: 41101 - DNA, 50 bp, homo sapien
tgtagcactgctgaaaaaaagatcartatagaaacagttctaaccacaca

SEQ ID NO: 41102 - DNA, 50 bp, homo sapien
cagaagcagaatatttactttagaawtatgcatggaatggactctatatg

SEQ ID NO: 41103 - DNA, 50 bp, homo sapien
ttaaatgtcaagaaatacagaatcaygtcttgaagttatttagaatttca

SEQ ID NO: 41104 - DNA, 50 bp, homo sapien
tagagaaggtgctatcaaggatgagraaacacaataatgagctatagtag

SEQ ID NO: 41105 - DNA, 50 bp, homo sapien
caccttgcatcaatgctcaggaaatyagttaaaactagctattactgaag

SEQ ID NO: 41106 - DNA, 50 bp, homo sapien
attactcccttcagcctgcataagcratagattagaagttctagaattcc

SEQ ID NO: 41107 - DNA, 50 bp, homo sapien
tcaaagatttgagaattgcccaattkaagttcattcaaaactcttgcctt

SEQ ID NO: 41108 - DNA, 50 bp, homo sapien
tttttgccatcaaccattaactgtcraatatttcccatctcaacaatatt

SEQ ID NO: 41109 - DNA, 50 bp, homo sapien
gtttaagtaccgaaatgattttctaycctactatgtgatccaaaataaaa

SEQ ID NO: 41110 - DNA, 50 bp, homo sapien
tctctgatctgtactaatatcatcarctcctactgagaattagaataaca

SEQ ID NO: 41111 - DNA, 50 bp, homo sapien
ctaccacttgatgacttgactccttmaacaggtgacttcagggtcaccgc

SEQ ID NO: 41112 - DNA, 50 bp, homo sapien
atgggattgctaaagagtggaataayggtagtacaacatggaagtcatgt

SEQ ID NO: 41113 - DNA, 50 bp, homo sapien
tacccaagtgcttgtaggtgacttayaattcccagccttcgctcagatct

SEQ ID NO: 41114 - DNA, 50 bp, homo sapien
agcatcaatatcatgcttggttatgragcagatcctgaaatgatattatg

SEQ ID NO: 41115 - DNA, 50 bp, homo sapien
caccttcctttaaaagccataccacygtagattttgtgtatcacttcatg

SEQ ID NO: 41116 - DNA, 50 bp, homo sapien
cccaaattgcactggattatctgccrctaattagagattaggaattggtg

SEQ ID NO: 41117 - DNA, 50 bp, homo sapien
gtttctgcagtgctatttgtgacaawctggcattctagaaatgacttttc

SEQ ID NO: 41118 - DNA, 50 bp, homo sapien
gacccaaaatggagaattaaatgacygtatttttcactggcattagcttt

SEQ ID NO: 41119 - DNA, 50 bp, homo sapien
aggaagtgggaatgatgcatattcawcgacgcctacaaaaattacttcag

SEQ ID NO: 41120 - DNA, 50 bp, homo sapien
ggaagagggaacctcaaactgtaaamtgaggtcctaaaataatgcaggag

SEQ ID NO: 41121 - DNA, 50 bp, homo sapien
aaaaagcacaatccattctacatcayggtctatggctggagataacagtc

SEQ ID NO: 41122 - DNA, 50 bp, homo sapien
gtgttgtgtatgaataactggaatayggaaacattgttgtctctatcttc

SEQ ID NO: 41123 - DNA, 50 bp, homo sapien
catcaggaagaacttgaacttttaaygggagaagtcctcagccacctcca

SEQ ID NO: 41124 - DNA, 50 bp, homo sapien
acatggcatgcaatcctgagccaacygggagagggataagtcaggaaata

SEQ ID NO: 41125 - DNA, 50 bp, homo sapien
cctgctcatgtgaaatatttcctaaragtacttcagcttaaaaatcttgc

SEQ ID NO: 41126 - DNA, 50 bp, homo sapien
ctattttttggttgtaattattgacsctggagatacctatcattatgaag

SEQ ID NO: 41127 - DNA, 50 bp, homo sapien
acttcagtagcgaagtgtggagattwaaaagactcaaggcagggaaacca

SEQ ID NO: 41128 - DNA, 50 bp, homo sapien
ttcatgcagatttttgagtttccaayagtgtcttcacactccgtcaacat

SEQ ID NO: 41129 - DNA, 50 bp, homo sapien
aaaatctgcactctgatcaagattayggagatagattttctctctcagta

SEQ ID NO: 41130 - DNA, 50 bp, homo sapien
gagtctttgcttagcatgctgataakacttctatgattctggagaaaagg

SEQ ID NO: 41131 - DNA, 50 bp, homo sapien
agaaggatgagttgaagttaggtgasgtattagagagctggaaagaaaga

SEQ ID NO: 41132 - DNA, 50 bp, homo sapien
agaaagatgtacaaggaaggctaacrgtggtgcagccaagacctcagatc

SEQ ID NO: 41133 - DNA, 50 bp, homo sapien
tttcttaccaaatacctatgattgayctcccttattttcagaatttacat

SEQ ID NO: 41134 - DNA, 50 bp, homo sapien
gcaactctctatattgaacaacttasagtcccatgttattccacattttt

SEQ ID NO: 41135 - DNA, 50 bp, homo sapien
caaaacacaccctaaatgcatctaartctccactccagtccagataggac

SEQ ID NO: 41136 - DNA, 50 bp, homo sapien
tctgtggactggtcagatagatatayggttttagtgtgggaaagctttta

SEQ ID NO: 41137 - DNA, 50 bp, homo sapien
ttcccacaaagctcttaaatcctcargcaaatcagcagattctggggtgt

SEQ ID NO: 41138 - DNA, 50 bp, homo sapien
gactcactgttttcttgtgctggaartggatcatggactcactgctttct

SEQ ID NO: 41139 - DNA, 50 bp, homo sapien
ccctaagtacttggaaataaggttckatgtactcagagttctactagcaa

SEQ ID NO: 41140 - DNA, 50 bp, homo sapien
gggcaggggcaggatctgttcctaaygtagcatgggtgacatttggagga

SEQ ID NO: 41141 - DNA, 50 bp, homo sapien
tatttgcattattttctccggtgaartaggagcacttactgcaaatatca

SEQ ID NO: 41142 - DNA, 50 bp, homo sapien
ttacctacaaagtgtgttaccggaaraccactgaacaggcctgctttacg

SEQ ID NO: 41143 - DNA, 50 bp, homo sapien
catctgtgcttgaatatgcgcagtayctaaggctaggactgaggaaagag

SEQ ID NO: 41144 - DNA, 50 bp, homo sapien
tgggagcagaaggtatgtactacccrggaagatagtttagacatgggcat

SEQ ID NO: 41145 - DNA, 50 bp, homo sapien
aactataaagaggaacaggaaacagwctcctagatagaagtctcatgtag

SEQ ID NO: 41146 - DNA, 50 bp, homo sapien
agccacagtttggaacctcttgttgsactgtaattggactttctccacat

SEQ ID NO: 41147 - DNA, 50 bp, homo sapien
tgaatatgttcactcatcactgccasgactatgtacatatttagggtaaa

SEQ ID NO: 41148 - DNA, 50 bp, homo sapien
gtttatttcatcctactttgcattayggttagcctacaaattttctcctc

SEQ ID NO: 41149 - DNA, 50 bp, homo sapien
ccctctgaggtaagaaaaggcatacrgtaagaaccatttgtacaatcgtc

SEQ ID NO: 41150 - DNA, 50 bp, homo sapien
gcaccacatcacctctgttaaatgcmctctcaggagttcagactttgttc

SEQ ID NO: 41151 - DNA, 50 bp, homo sapien
aaacaactgggactatatagaagaakgtatccctaaactgtgaaggagct

SEQ ID NO: 41152 - DNA, 50 bp, homo sapien
tttctgaaacaaatagagtaaacatragtgggtcagatttacctaagctt

SEQ ID NO: 41153 - DNA, 50 bp, homo sapien
aaattacaatagaagcatctgtactwaatgaaaaaggaaacctagggttt

SEQ ID NO: 41154 - DNA, 50 bp, homo sapien
attttgactgacttctcgtgtcctcrctacttcacatttccatccccagg

SEQ ID NO: 41155 - DNA, 50 bp, homo sapien
tacccagcattctattgctcccaggraaaagaccaggaaggatgctctgg

SEQ ID NO: 41156 - DNA, 50 bp, homo sapien
attcctaggaatttttaaaattacartagaagcatctgtacttaatgaaa

SEQ ID NO: 41157 - DNA, 50 bp, homo sapien
ggattcaaaagttgcaagtacagtayatgaaggatggctattaatggtga

SEQ ID NO: 41158 - DNA, 50 bp, homo sapien
aagacgtatactaatctctaaattaycaccctctaaacattgtcctctgc

SEQ ID NO: 41159 - DNA, 50 bp, homo sapien
ggagagggtaacttgagaatggaggycaggataatgtctttaaatattta

SEQ ID NO: 41160 - DNA, 50 bp, homo sapien
tgtcactcatgtgtctaagctaagaygagtacgtttactttagagcactt

SEQ ID NO: 41161 - DNA, 50 bp, homo sapien
aactgtagttctagtaagaaagacaracctatttattttgtttaagtaag

SEQ ID NO: 41162 - DNA, 50 bp, homo sapien
tggttagactcaatgattcctagctsaatagaattagatgatgacctgca

SEQ ID NO: 41163 - DNA, 50 bp, homo sapien
accatagtctctcaagggtggcccayactaatcattctccatttttcatc

SEQ ID NO: 41164 - DNA, 50 bp, homo sapien
cttagaagcattataggatcaataawgtttcctgagttcctaaaacccag

SEQ ID NO: 41165 - DNA, 50 bp, homo sapien
aaaagaaatattaatcgaataattaktaaaactcattaaatttctccact

SEQ ID NO: 41166 - DNA, 50 bp, homo sapien
ttataaaatacatattcattaaaagrcatatttccaaaatacataaagag

SEQ ID NO: 41167 - DNA, 50 bp, homo sapien
agtttaacatcagattagtaatttckagagcctcaatcaccctttaggca

SEQ ID NO: 41168 - DNA, 50 bp, homo sapien
caattatttacttataaagctctacmagtacatttgaatacttaaacaaa

SEQ ID NO: 41169 - DNA, 50 bp, homo sapien
ctgttttaaaattatttaactcccasaacacttatagtcttaatacttta

SEQ ID NO: 41170 - DNA, 50 bp, homo sapien
aaaccataccaaacggacaatgtaawgaatgataaaagagacatcacacg

SEQ ID NO: 41171 - DNA, 50 bp, homo sapien
gaaaaccaataaaaagttccattccrattataacaatataagccaaaagg

SEQ ID NO: 41172 - DNA, 50 bp, homo sapien
tccacagtcaatcacttcctacacartaaattctttggccaatgtttgac

SEQ ID NO: 41173 - DNA, 50 bp, homo sapien
gcaaagaggcaaggagaaaatacaayaggatgagttgcaaagatgctaaa

SEQ ID NO: 41174 - DNA, 50 bp, homo sapien
caggctttgagatagtgggtcattayatggcaagagcgcccaggacaaga

SEQ ID NO: 41175 - DNA, 50 bp, homo sapien
tgtgcaagctgttacattcttttccygaggctaggcagcgtctcctccaa

SEQ ID NO: 41176 - DNA, 50 bp, homo sapien
gtaagtgatctcctcttggtctgtaygtacatatttaacacatgtcaata

SEQ ID NO: 41177 - DNA, 50 bp, homo sapien
attatcagtgtgcatcagatgataayccgctattttaccttgaaaataat

SEQ ID NO: 41178 - DNA, 50 bp, homo sapien
tgagcaccttcctatgcctacatgaytagatacaggtattagccctgttt

SEQ ID NO: 41179 - DNA, 50 bp, homo sapien
aaataaatatttatttcgaatgagaraagaagcaacaaataatttattta

SEQ ID NO: 41180 - DNA, 50 bp, homo sapien
caattcacctaaaaaattctgtttamctatctgtgtctagatataatctg

SEQ ID NO: 41181 - DNA, 50 bp, homo sapien
taaatacaggttagtaatcttaaacygatagcaggctaaattaagagttg

SEQ ID NO: 41182 - DNA, 50 bp, homo sapien
tttcctgctctagttgacgtactcaytcaattttctagaaacacccgtaa

SEQ ID NO: 41183 - DNA, 50 bp, homo sapien
gaatacatttacccatagtatttctsaagagcagatgacaatgtctaaaa

SEQ ID NO: 41184 - DNA, 50 bp, homo sapien
gaaacatagaaaacagccataaaatkaaactagggaatgagtattaacaa

SEQ ID NO: 41185 - DNA, 50 bp, homo sapien
cctgcagtgaagttttaattgctatmacactggataacactgtttgactg

SEQ ID NO: 41186 - DNA, 50 bp, homo sapien
ggaagggcaaaacctttcatttatgkatttctagctgctaaactgttgat

SEQ ID NO: 41187 - DNA, 50 bp, homo sapien
agctacggatgggattctagcacaaygaataaaagctggcaaaatgtaaa

SEQ ID NO: 41188 - DNA, 50 bp, homo sapien
tcttctttttcacttctaacatacamatgaaaaatgcagcctgcagtgaa

SEQ ID NO: 41189 - DNA, 50 bp, homo sapien
aagttttcagtacaacagctcaaaastaaatacaaccaaaataatccctc

SEQ ID NO: 41190 - DNA, 50 bp, homo sapien
cctgaacgacataaaaatagacttgmacagattagaaaacacctctttta

SEQ ID NO: 41191 - DNA, 50 bp, homo sapien
cttgtttagccattgtatgggcagcstataaaagctggtgtttaatgtcc

SEQ ID NO: 41192 - DNA, 50 bp, homo sapien
acagaggtagcagttttgatggcaaygattatttcattatggacttaatc

SEQ ID NO: 41193 - DNA, 50 bp, homo sapien
cgagtgaggtttgggatttggtagayagataactcagctttcccacccct

SEQ ID NO: 41194 - DNA, 50 bp, homo sapien
aattttgtcaaggcatatgtatcatkaacttagtctactggttgactgtt

SEQ ID NO: 41195 - DNA, 50 bp, homo sapien
aagatggaaggaacctgggtccctgratatacttatagaacacagctgtc

SEQ ID NO: 41196 - DNA, 50 bp, homo sapien
tctggccatgtaaataagctccttaycaggtctaacctagcttcagtggc

SEQ ID NO: 41197 - DNA, 50 bp, homo sapien
agtcattctttgtcacattcctgackggtcaaaataaatctaattaggag

SEQ ID NO: 41198 - DNA, 50 bp, homo sapien
aaacctgtggacaggccatgaggtasactgaaaaagaacaccctaaaaat

SEQ ID NO: 41199 - DNA, 50 bp, homo sapien
ttttaatgaaaaacaacttgcaggarccctttgaaaagcactgtatggat

SEQ ID NO: 41200 - DNA, 50 bp, homo sapien
ctagattatctgtatgaggactgaawgctgttgcaaatgtccttttgagt

SEQ ID NO: 41201 - DNA, 50 bp, homo sapien
tgctgtgagccattatgtttcacaaytatcaatttattttccatgagact

SEQ ID NO: 41202 - DNA, 50 bp, homo sapien
tcagggcctgaaattgtgacaggaawttatcaaacacatgctagatcatg

SEQ ID NO: 41203 - DNA, 50 bp, homo sapien
cttatttgctctcctgtgaatagcawgaaattttatctactgtgccttcc

SEQ ID NO: 41204 - DNA, 50 bp, homo sapien
gattgttataagaatctcgtatctaycacagttctaccttcctcttttta

SEQ ID NO: 41205 - DNA, 50 bp, homo sapien
gtgcctacaatacttgctaagccacyaaatctaacagtttgaaacagctg

SEQ ID NO: 41206 - DNA, 50 bp, homo sapien
gcctaacaaactgtaggcacttatamaaaggcggcttttgttattacctg

SEQ ID NO: 41207 - DNA, 50 bp, homo sapien
taaatgtaggatatgatgaacatgcygaagagaaactgctgttgatgtgg

SEQ ID NO: 41208 - DNA, 50 bp, homo sapien
actgttttccagaatttaaaatgcartaatccatagagataaactgttcc

SEQ ID NO: 41209 - DNA, 50 bp, homo sapien
ggagcatgttctaacacaatgtaagsaagctaagaatctcgataaaaggt

SEQ ID NO: 41210 - DNA, 50 bp, homo sapien
ttcaacaccttttaattgcaaggaaratctttccagttttaccagattca

SEQ ID NO: 41211 - DNA, 50 bp, homo sapien
tttgttcttaaaatgcatcatgcttwaactttctttaggaatttatttta

SEQ ID NO: 41212 - DNA, 50 bp, homo sapien
tctggaaaattagttttagaaattamgagggaatcaagagtttaagatat

SEQ ID NO: 41213 - DNA, 50 bp, homo sapien
ttgcaataaaagactttctgttggasaaaacaggtatgaaatagttgggg

SEQ ID NO: 41214 - DNA, 50 bp, homo sapien
gtgaactcataaacaggtctacaaayatgtaatgtctacacacacacata

SEQ ID NO: 41215 - DNA, 50 bp, homo sapien
gtccagatctaggaaataataactgmaagtctgacaaccttaatggtctg

SEQ ID NO: 41216 - DNA, 50 bp, homo sapien
actgagccagagataggtttatttayggtgaataatacagttatggtcac

SEQ ID NO: 41217 - DNA, 50 bp, homo sapien
tattttgaattttttgtttgctcacyattcttaggaaattaagtctttgt

SEQ ID NO: 41218 - DNA, 50 bp, homo sapien
aaagtgccatttaaaaaaatcagackctccaaagcaggcaaagacagact

SEQ ID NO: 41219 - DNA, 50 bp, homo sapien
gattctgacttaacagtcaggttcasaggaatagtcccagatgagcccta

SEQ ID NO: 41220 - DNA, 50 bp, homo sapien
tacaccaaatgaaactttgaacttayccaatgtgctgtattttagggctc

SEQ ID NO: 41221 - DNA, 50 bp, homo sapien
ccttacttcttctaggcatgttggcmatacgtataattaaaaagcaagca

SEQ ID NO: 41222 - DNA, 50 bp, homo sapien
atttggcagccaagtctttaaagtartaagagcaaaacatatttggaata

SEQ ID NO: 41223 - DNA, 50 bp, homo sapien
ttatacatctggcccaacatatcaasctgtgcagggcatttggcggttgt

SEQ ID NO: 41224 - DNA, 50 bp, homo sapien
tggaggattactatggtccaaataarccaaatctaaattgaattctatcc

SEQ ID NO: 41225 - DNA, 50 bp, homo sapien
ttggctaccacatgtaatacgcacaratgcagtgtgtttatttaataaag

SEQ ID NO: 41226 - DNA, 50 bp, homo sapien
ccattccattaagtgccacccgccaracatttactgaacattttcttttc

SEQ ID NO: 41227 - DNA, 50 bp, homo sapien
agaaaataaaagaaaaaaaagaatcyctttgtcaaccgataaggttggat

SEQ ID NO: 41228 - DNA, 50 bp, homo sapien
tcttaacccctactccacctctaaakagagcatcttacagcctgtatcct

SEQ ID NO: 41229 - DNA, 50 bp, homo sapien
gctgaagggaatctcagcaatcatgsaccggactctcttaacccctactc

SEQ ID NO: 41230 - DNA, 50 bp, homo sapien
agaccaagtaaatacatcacataaaygaggcgctgcttgtcttggaaaca

SEQ ID NO: 41231 - DNA, 50 bp, homo sapien
ataactacctggcaagtaattcaaaytcaaaataattattttaaggaaac

SEQ ID NO: 41232 - DNA, 50 bp, homo sapien
attcatgcagtcctcttgtcaataasggtatcactctccaccccaacctc

SEQ ID NO: 41233 - DNA, 50 bp, homo sapien
gcttactttttcttcttctttctcarggatggctactagtcaaaggtcac

SEQ ID NO: 41234 - DNA, 50 bp, homo sapien
actttcttcaacagactagaaaaaasaagcagaaagtaagtagaatggtg

SEQ ID NO: 41235 - DNA, 50 bp, homo sapien
cagagaatatctgtgagatactacaygaagcaaacgttaccaaggcatat

SEQ ID NO: 41236 - DNA, 50 bp, homo sapien
gttgacagaagatacagggcacataytatactgcatcccaagaaagaact

SEQ ID NO: 41237 - DNA, 50 bp, homo sapien
ggaggagatgtgttttgaggaaagamactacttaatctctggacctattt

SEQ ID NO: 41238 - DNA, 50 bp, homo sapien
atcatcacagtcctaaatttctgtartaagtcatgatatttatttggcta

SEQ ID NO: 41239 - DNA, 32 bp, homo sapien
ccaggttggcattggcrgattctgtcagtgct

SEQ ID NO: 41240 - DNA, 50 bp, homo sapien
ctcctcgccacatcattgactgttamattagaactttgcttgagtggatt

SEQ ID NO: 41241 - DNA, 50 bp, homo sapien
ctgtgtgaactgctgtcttctctgastcaaggcagctttcaatgagctgt

SEQ ID NO: 41242 - DNA, 50 bp, homo sapien
catatcaaggccaaacatttattcaytcattgttcagatgtgtaaggaac

SEQ ID NO: 41243 - DNA, 50 bp, homo sapien
atgatagtgttctttatggaaatcasagaaattactttgagttcatcatt

SEQ ID NO: 41244 - DNA, 50 bp, homo sapien
gagttcctgttttcataggagaaaawctcagtgttggccatgagtatgca

SEQ ID NO: 41245 - DNA, 50 bp, homo sapien
tactgtttgatttttaaaaaaacatsaatctttctgttaacatttttatt

SEQ ID NO: 41246 - DNA, 50 bp, homo sapien
ctaatttgattctactcctttcaaayggtggcacttaattctcctcccct

SEQ ID NO: 41247 - DNA, 50 bp, homo sapien
cgaaaaacctggcactgtttaatgcrctttgctgtcttatgtgttatatt

SEQ ID NO: 41248 - DNA, 50 bp, homo sapien
accaaacttgagagtatctcaaagarcatctattccaactcgttgaatat

SEQ ID NO: 41249 - DNA, 50 bp, homo sapien
gcagaatttcctgtcaaattgtatayatcacaaggactttgcccagttcc

SEQ ID NO: 41250 - DNA, 50 bp, homo sapien
tttggttttttttaatcgtgagggarcaataatttactaagtttgtgatc

SEQ ID NO: 41251 - DNA, 50 bp, homo sapien
taggaaggccatgccttcagcctgayatgtgcaagtacaaatagtccatt

SEQ ID NO: 41252 - DNA, 50 bp, homo sapien
ggtctgtgttcatcaggcattcttgrattactaagaagagacattctcag

SEQ ID NO: 41253 - DNA, 50 bp, homo sapien
gtgttggcagtttttgtctttcagtsaattaatccattttatataagtta

SEQ ID NO: 41254 - DNA, 50 bp, homo sapien
gggccagtagaatccacatatcttcyatacggatttatctaatgtcaata

SEQ ID NO: 41255 - DNA, 50 bp, homo sapien
gagttccttggaagaacagggcgtarcgattaatgaagaagcttagttct

SEQ ID NO: 41256 - DNA, 50 bp, homo sapien
ctctctcattttctctcattccaaamatttaatttcaggtggctccaccc

SEQ ID NO: 41257 - DNA, 50 bp, homo sapien
ggtgctaacacccgaagtttttccaygtctcaggcacttcccccaactcc

SEQ ID NO: 41258 - DNA, 50 bp, homo sapien
ttccagtgggatcagatatctatcaytaacagaaactacaaaccctgatt

SEQ ID NO: 41259 - DNA, 50 bp, homo sapien
ttgtacactgaagtgcctctcatacyacctggagttctagaaataggtgt

SEQ ID NO: 41260 - DNA, 50 bp, homo sapien
tcatcacttcctatatttcacattcracaactgcttatttggggagtata

SEQ ID NO: 41261 - DNA, 50 bp, homo sapien
tttgaaagaactaaagagatttttcragagatgagaaaatgtgcaaagaa

SEQ ID NO: 41262 - DNA, 50 bp, homo sapien
tttacagttacttcagaaaaatataygactattatgtacctataataaat

SEQ ID NO: 41263 - DNA, 50 bp, homo sapien
gacctaagagaaagtacaaagcatarggaaaaattttcaagatgtttaaa

SEQ ID NO: 41264 - DNA, 50 bp, homo sapien
agagcctgtttcccagagtaacaagraaaacgacttgattgaaaatgtta

SEQ ID NO: 41265 - DNA, 50 bp, homo sapien
ttgtctagtgctcagatgtttacaamgtgcgttcatctgcagaattcatt

SEQ ID NO: 41266 - DNA, 50 bp, homo sapien
agcaggaatcacagagcaaattggayggtttcaaaggaccatgctgcagc

SEQ ID NO: 41267 - DNA, 50 bp, homo sapien
caagagggagtcttgacaagaacacwaataccataaccaaggcagaatgt

SEQ ID NO: 41268 - DNA, 50 bp, homo sapien
tgatatgaatgtagcaaatatatggmaactcatgtgattaagaataaatc

SEQ ID NO: 41269 - DNA, 50 bp, homo sapien
catttcaaagcttattaggaactaargaatcaaatgatggtcaaaaatca

SEQ ID NO: 41270 - DNA, 50 bp, homo sapien
ttgtttgacaagaaccaatgccaacrcctaattaaggataagccacagag

SEQ ID NO: 41271 - DNA, 50 bp, homo sapien
caggtctctggattcaggaatgatamctttctgacacaaattttgtcctg

SEQ ID NO: 41272 - DNA, 50 bp, homo sapien
ggacccaggttggctaagtacataasggaagtttgcaggctggactgagg

SEQ ID NO: 41273 - DNA, 50 bp, homo sapien
taagcaaaaacaagtaattataaaarctccctcaatttaatctccctctc

SEQ ID NO: 41274 - DNA, 50 bp, homo sapien
taattcagcattagaatgttggaaaygcaatcacactatacagatgattc

SEQ ID NO: 41275 - DNA, 50 bp, homo sapien
agatttcatgttaatgactgactacsgagacatgctatttggctctatgt

SEQ ID NO: 41276 - DNA, 50 bp, homo sapien
acttctctattctaatatccttaagwaacacaactttctgagtatttacc

SEQ ID NO: 41277 - DNA, 50 bp, homo sapien
gaaacaacgagcagggtctgatcaamtatgctcacagaaaaccagagccc

SEQ ID NO: 41278 - DNA, 50 bp, homo sapien
tttcataacactcaagtgtaagacaygtcatattgctttatttttctaag

SEQ ID NO: 41279 - DNA, 50 bp, homo sapien
ttagtttgaactcttacatttaggaktacgcttcatgtagaatataattt

SEQ ID NO: 41280 - DNA, 50 bp, homo sapien
accctccatctcctgccagtaccaaygaggaagccagagggtaagggaac

SEQ ID NO: 41281 - DNA, 50 bp, homo sapien
tgaaatatctctctcatcaccttacygaattagtgaaaatattaaaagta

SEQ ID NO: 41282 - DNA, 50 bp, homo sapien
tatatgtgcatgtgcatgtgtgcacmacctaaaggaaatataattaaaaa

SEQ ID NO: 41283 - DNA, 50 bp, homo sapien
ctcccacttcgaatgtgagagttaaytggactcatttgcaactattgagt

SEQ ID NO: 41284 - DNA, 50 bp, homo sapien
gggtccccagcactctaacccacacrgtgtactatatacccagaaatggg

SEQ ID NO: 41285 - DNA, 50 bp, homo sapien
agacagcatagattctatattaagtsactacatactcgtttgaaataaaa

SEQ ID NO: 41286 - DNA, 50 bp, homo sapien
agtgacagatgtctttatacattaaytcaggtaatcatcagaacagcctc

SEQ ID NO: 41287 - DNA, 50 bp, homo sapien
caaagtaatcatttatttttgaaacmctaaatctgcttctgacttggttg

SEQ ID NO: 41288 - DNA, 50 bp, homo sapien
catgtagtatgacatgttaaaatgtraattctagccaggcgcggtggctc

SEQ ID NO: 41289 - DNA, 50 bp, homo sapien
ctttcaagatgtaatagatttgaaaygttgggcattttgagatagctaat

SEQ ID NO: 41290 - DNA, 50 bp, homo sapien
ggctatagatctgctaatatcagaamtatcaaaagaagagactacatccc

SEQ ID NO: 41291 - DNA, 50 bp, homo sapien
aattgcctctaggctctagcataagkctccctgcatagtatttcaaggaa

SEQ ID NO: 41292 - DNA, 50 bp, homo sapien
aaataataacatgagaaaatgaggawcttgtccaacataagttagggccc

SEQ ID NO: 41293 - DNA, 50 bp, homo sapien
aaatatgaatgataagcccttgaagwaaagtcatatgccctcttactttt

SEQ ID NO: 41294 - DNA, 50 bp, homo sapien
atggcacatactgcagaattgttcaygagaagaaaatctcatggtcaaaa

SEQ ID NO: 41295 - DNA, 50 bp, homo sapien
gattcagactaaatttaatacatcartaaagataggtataaacttactat

SEQ ID NO: 41296 - DNA, 50 bp, homo sapien
gacaaagatgtgttgggattagataygaattgttataaatgacttttgaa

SEQ ID NO: 41297 - DNA, 50 bp, homo sapien
aatagacttaatacacatttatagartattttatccgacagctgcagaat

SEQ ID NO: 41298 - DNA, 50 bp, homo sapien
accaggaccctcttgattttctgacmaagtgttggtggtgtcttaaggta

SEQ ID NO: 41299 - DNA, 50 bp, homo sapien
ttgaggaagagctcccttctctctcracttattttgggtggcaatggcat

SEQ ID NO: 41300 - DNA, 50 bp, homo sapien
attaggcaagaaaaagaaataaagcyatcctaattggaatggaagaagta

SEQ ID NO: 41301 - DNA, 50 bp, homo sapien
tacagtgaaaactggaaaaaaataaytaatcctgcaatgtgacgctatag

SEQ ID NO: 41302 - DNA, 50 bp, homo sapien
gtaagtataagtcaattttcatttgmactaacatgcttactctatacctg

SEQ ID NO: 41303 - DNA, 50 bp, homo sapien
aatgtaatctttaacaaggtaccaaygtctgtgaaatgtcactccaacaa

SEQ ID NO: 41304 - DNA, 50 bp, homo sapien
catatgcacagatatattctgtcaamataaagagagaagaaacatgaaag

SEQ ID NO: 41305 - DNA, 50 bp, homo sapien
tacttatcttcctgtcagtcattcartaccatttataaattctagagggc

SEQ ID NO: 41306 - DNA, 50 bp, homo sapien
ttcctttttagtggtggtagtttgayggcaaatgacttaaattatcctat

SEQ ID NO: 41307 - DNA, 50 bp, homo sapien
aacctttcttaaacagttaacatcayagtgatacttagttgtttcttgtg

SEQ ID NO: 41308 - DNA, 50 bp, homo sapien
tgaatggtaaaattcatctgaagtasaaaggttgagatccttgtgtcctt

SEQ ID NO: 41309 - DNA, 50 bp, homo sapien
tatttctcaaaaatgactgtgagggycaagtgttaaaagaaaaattcttt

SEQ ID NO: 41310 - DNA, 50 bp, homo sapien
agtttgggaatatatctaagtgtggyattttagtaatgaaaaatcactaa

SEQ ID NO: 41311 - DNA, 50 bp, homo sapien
cctatagattgaagtcaggtcctccraaacctagtagaatgcattgaaaa

SEQ ID NO: 41312 - DNA, 50 bp, homo sapien
cagtaattcaattggttctattatgwatggtagacaagactggggattgg

SEQ ID NO: 41313 - DNA, 50 bp, homo sapien
acggcatcctctggtgaaaacgaaartatttttatagttatgatcctatg

SEQ ID NO: 41314 - DNA, 50 bp, homo sapien
agaaatagaagttagtgctctaaaasataatacatagttggtatttgaat

SEQ ID NO: 41315 - DNA, 50 bp, homo sapien
attgcatccaatatactcagaagaayggaatattgattgatatttataag

SEQ ID NO: 41316 - DNA, 50 bp, homo sapien
gtcttctcagtcataattctaataayaatggaagatgagacatccttacc

SEQ ID NO: 41317 - DNA, 50 bp, homo sapien
aaggtgagagtgagacttaattctckctttaaatggaatcagattttgtg

SEQ ID NO: 41318 - DNA, 50 bp, homo sapien
aaacgttggttaatgtgtaatacaargttacagttggaaaggaagaataa

SEQ ID NO: 41319 - DNA, 50 bp, homo sapien
tggactggagtttagcggctgacgarcaagcatggaaaggacaagatata

SEQ ID NO: 41320 - DNA, 50 bp, homo sapien
atctggttaattccatcttctaaccrcatagtaaatagtgtctctatttc

SEQ ID NO: 41321 - DNA, 50 bp, homo sapien
taaccacgtaaaccagagtaaacccrcatgttattacacattaaatatga

SEQ ID NO: 41322 - DNA, 50 bp, homo sapien
aaaacaacctattatgttttacacaratgacattctagatccacatattt

SEQ ID NO: 41323 - DNA, 50 bp, homo sapien
ccaaagtgagacattcagtttatcayatccaagagaaataaggtcagtat

SEQ ID NO: 41324 - DNA, 50 bp, homo sapien
agagaaaatatgcagcataaaaacamgtagtgggtatttgtgaacaattc

SEQ ID NO: 41325 - DNA, 50 bp, homo sapien
gagtgagggatttagacttaaataasacggattactgaggtggatttcag

SEQ ID NO: 41326 - DNA, 50 bp, homo sapien
tgtgttaggaatctttatatgatagscattgagtgatgaaataaaccatt

SEQ ID NO: 41327 - DNA, 50 bp, homo sapien
tttacatatggcactgcatttttaargtgactgcattcactatttatacc

SEQ ID NO: 41328 - DNA, 50 bp, homo sapien
tattcactcccagtctgactcaaaayttgtcctgaaactgagagaagcat

SEQ ID NO: 41329 - DNA, 50 bp, homo sapien
agtgagctagactgcccatgtgggtyacagaaattcgattcaggaacatt

SEQ ID NO: 41330 - DNA, 50 bp, homo sapien
aatgaaaccatggagatgaaaaaaayatgatgattcaagtaaaaaatgca

SEQ ID NO: 41331 - DNA, 50 bp, homo sapien
aatggctacctcttctgctccaactracttaccacaagatggtgttttct

SEQ ID NO: 41332 - DNA, 50 bp, homo sapien
atgcattctcctctatttattcagckcagaaaaggcttaggttaaaaagt

SEQ ID NO: 41333 - DNA, 50 bp, homo sapien
tgatcagttttgttctacatacatascataccaatactctttaatcactc

SEQ ID NO: 41334 - DNA, 50 bp, homo sapien
ataatatattctgtgagcaggacggwatattctgatagtgtccattccca

SEQ ID NO: 41335 - DNA, 50 bp, homo sapien
atgaagtcttagtagggcattttagraggaaagcccattcttaacaagtg

SEQ ID NO: 41336 - DNA, 50 bp, homo sapien
aagaatgttttaatcatcatttccartaattttccttaaaaacttctgat

SEQ ID NO: 41337 - DNA, 50 bp, homo sapien
acaggaggcctgccatagaatcagaygaccagaaggtggcactagtagta

SEQ ID NO: 41338 - DNA, 50 bp, homo sapien
ttcattgtaagtaacactcctaacayggcaagaaagtaggctgtgacggt

SEQ ID NO: 41339 - DNA, 50 bp, homo sapien
gaggtatttcaatttggttcataatkaccctcgagaaagaagatcaaata

SEQ ID NO: 41340 - DNA, 50 bp, homo sapien
aggtttgcatttggtgtatgttctaygtattgattcatctgtggtgtttg

SEQ ID NO: 41341 - DNA, 50 bp, homo sapien
tttctgaacctgggaaactgagaacrggccagaattttccttaggagggg

SEQ ID NO: 41342 - DNA, 50 bp, homo sapien
tcaagggtttagtaatctagtggtgraaataagaattgttcagagaaaaa

SEQ ID NO: 41343 - DNA, 50 bp, homo sapien
aactggctaatccagaaaattggtcrcagagaagtagcgcattgctgtaa

SEQ ID NO: 41344 - DNA, 50 bp, homo sapien
gagaaatgcacaccacataactaaaygaattgttgtctaccttgattatg

SEQ ID NO: 41345 - DNA, 50 bp, homo sapien
atgcccacctaaggtgtaagaaaaaygtcttataaaagagtcagcaattt

SEQ ID NO: 41346 - DNA, 50 bp, homo sapien
atgtatagcaaaagccagaggcaaawttattctccttagcagttctaagt

SEQ ID NO: 41347 - DNA, 50 bp, homo sapien
agtttctggattttgtttatcctccrattccaaatggcataattgctagt

SEQ ID NO: 41348 - DNA, 50 bp, homo sapien
tcacatatttgtctcagaagttggtwacagtatttactgatacagataat

SEQ ID NO: 41349 - DNA, 50 bp, homo sapien
tgatatactttcttcaaatgagttaygtagaatcttataaaattttcttt

SEQ ID NO: 41350 - DNA, 50 bp, homo sapien
aggcaaagtcaggaagcagagttcasagagaaagagtttggaaggcactg

SEQ ID NO: 41351 - DNA, 50 bp, homo sapien
catgggataaggaatgaccagcaatkaacaagatgaggaagttctcacag

SEQ ID NO: 41352 - DNA, 50 bp, homo sapien
gggatagagttatgattacaattcargtcttgtctgttagcctgctgctg

SEQ ID NO: 41353 - DNA, 50 bp, homo sapien
agaataatctaacatcttcttatagwatgaggaaatcctgattaaaactt

SEQ ID NO: 41354 - DNA, 50 bp, homo sapien
atgagacaaggaaggtggtaggataygaagtgaaaggacactagagactt

SEQ ID NO: 41355 - DNA, 50 bp, homo sapien
tattaatatttcctatcgttagcatyaaaaaaggcagatagtgttatgtc

SEQ ID NO: 41356 - DNA, 50 bp, homo sapien
gtgacctataggagtaggctcagaasagtagcaggagaataactcagatt

SEQ ID NO: 41357 - DNA, 50 bp, homo sapien
tgattctctgctcctcctgcccaatsaagtgactcaaatccaaattcaaa

SEQ ID NO: 41358 - DNA, 50 bp, homo sapien
tttagtaaatggttaaattctaacaycattttatctttattccataaata

SEQ ID NO: 41359 - DNA, 50 bp, homo sapien
tgagcacacatctcacagaaatccckgagtggcctcccaggagactgaaa

SEQ ID NO: 41360 - DNA, 50 bp, homo sapien
gaaaaaaaaaatgtgaacttctacartgctactatttctctctcatgttg

SEQ ID NO: 41361 - DNA, 50 bp, homo sapien
ttatggttatttatcccaaaaggagwagtttaattctgtttaatatttgg

SEQ ID NO: 41362 - DNA, 50 bp, homo sapien
acacttgcctatgttgtaatgaaatsaaaatccagaacgattcatctcag

SEQ ID NO: 41363 - DNA, 50 bp, homo sapien
acttcatgagattgactagataatayggcacagaagtatttccttaaagc

SEQ ID NO: 41364 - DNA, 50 bp, homo sapien
aataggcattctttttcttgataaarttatgtccattagtagtttatgaa

SEQ ID NO: 41365 - DNA, 50 bp, homo sapien
caactttcaaagtgactgtagttgaycagtgccttctgtgcatttatgtg

SEQ ID NO: 41366 - DNA, 50 bp, homo sapien
cccaaagtaactctatagtcagagarccaactgttagcagaggcagaata

SEQ ID NO: 41367 - DNA, 50 bp, homo sapien
tttgtttgttttaaattttgccttaycttacaatgttggccctagcactt

SEQ ID NO: 41368 - DNA, 50 bp, homo sapien
aatacagaagtaaaatagtataaaaktaaaagcactagaaaataaggata

SEQ ID NO: 41369 - DNA, 50 bp, homo sapien
gtttactcaaaacaatcatattaaaragaaatgtacagcaaaagacatga

SEQ ID NO: 41370 - DNA, 50 bp, homo sapien
gattttttatggacttgctagaggasaaaacaacctgaagggatgggtag

SEQ ID NO: 41371 - DNA, 50 bp, homo sapien
catccaaaggtgatggagggatccasagttggctaaaatcatcatcaggt

SEQ ID NO: 41372 - DNA, 50 bp, homo sapien
gagcaataaaaagcagaaaccatagraaagtgataaataggacttcatca

SEQ ID NO: 41373 - DNA, 50 bp, homo sapien
ccccctttttattggacagttctatwaattttgacaaatgcatacactaa

SEQ ID NO: 41374 - DNA, 50 bp, homo sapien
tttctattgtcattgtcagcctcggycaaacacactctaagcttgcccaa

SEQ ID NO: 41375 - DNA, 50 bp, homo sapien
tgacccaaaacagaccaatggactaygatatggttcagaacaaggggtct

SEQ ID NO: 41376 - DNA, 50 bp, homo sapien
gtccccctttcttgcctttcttgtamctggttctagcaagattttcctat

SEQ ID NO: 41377 - DNA, 50 bp, homo sapien
tatcacattgtaagctcctccaaaawcggaactgcgcccattagcacttt

SEQ ID NO: 41378 - DNA, 50 bp, homo sapien
atgcctccttccaagctcaaagccartaaaggacttaggcctcttgataa

SEQ ID NO: 41379 - DNA, 50 bp, homo sapien
acatacagtttaaagaacttctacawtcactacaaacctctgcatttcct

SEQ ID NO: 41380 - DNA, 50 bp, homo sapien
gaaaaaatgtacagaactgtaatggracatcaaatttgttcatgacagta

SEQ ID NO: 41381 - DNA, 50 bp, homo sapien
tggccaaggcagtggcttctacttcygaaaactctgtttagtggcctggc

SEQ ID NO: 41382 - DNA, 50 bp, homo sapien
cagctgacttcatcacccgtctacamggtcatgcttaatgagtcacatca

SEQ ID NO: 41383 - DNA, 50 bp, homo sapien
tattggtctttcatacactagttaartgcctgtgctactggaaaacaggc

SEQ ID NO: 41384 - DNA, 50 bp, homo sapien
aagaaggtgtggtttctcaaaaagamaatcaggctactggcaccagacca

SEQ ID NO: 41385 - DNA, 50 bp, homo sapien
ctctacttttcctaatcctcaacaayggatagctttatcatatttacttg

SEQ ID NO: 41386 - DNA, 50 bp, homo sapien
cccatcagcctacatcttcctcaggkaatcattgtaagccctctacagcc

SEQ ID NO: 41387 - DNA, 50 bp, homo sapien
ataaaatggagaagtaaaattataamatggtgttgctgaacatagaatga

SEQ ID NO: 41388 - DNA, 50 bp, homo sapien
ttagaagctaagatttacacttgaaygaagttattgggagacttagaagt

SEQ ID NO: 41389 - DNA, 50 bp, homo sapien
cagatctgctgtgtatgcatcagccraattatcctgtctcactaacctaa

SEQ ID NO: 41390 - DNA, 50 bp, homo sapien
ttcatttccatgtatttcttaacaartgctagaggaaaccttcttttcta

SEQ ID NO: 41391 - DNA, 50 bp, homo sapien
tgttagatcaatcaatcgttcattcrataggtagagagagagagatgtag

SEQ ID NO: 41392 - DNA, 50 bp, homo sapien
aactgacgctgcagatcagtcaactragtatgatgcctacttttttaaaa

SEQ ID NO: 41393 - DNA, 50 bp, homo sapien
actaacttggcaatatctgattttgracccagatgagcagtactaccaac

SEQ ID NO: 41394 - DNA, 50 bp, homo sapien
ccaataacctgtcatagtaacaaaargaaagatgtgttaataatagattt

SEQ ID NO: 41395 - DNA, 50 bp, homo sapien
tatttttattgttcccaccaactgcrctaaacagaaattaccccacttac

SEQ ID NO: 41396 - DNA, 50 bp, homo sapien
tttacttttcaggctactgtagtgayagttttattttgtagattttagag

SEQ ID NO: 41397 - DNA, 50 bp, homo sapien
attcctgtgatttattacaagtcacraaaggaaatatgcaaaaccataag

SEQ ID NO: 41398 - DNA, 50 bp, homo sapien
tttccactacagctcccagattctaytacatggttctacttctttttcaa

SEQ ID NO: 41399 - DNA, 50 bp, homo sapien
gaacataaatactgtttttcaagaascaggcactgccatggatattttac

SEQ ID NO: 41400 - DNA, 50 bp, homo sapien
cactaggttcatgttgggactcaagkcttataatttctcacaagctccca

SEQ ID NO: 41401 - DNA, 50 bp, homo sapien
acatttcctcttttcaaattctatakacctgcttagctaaatccctgcac

SEQ ID NO: 41402 - DNA, 50 bp, homo sapien
tttttgtgttcccttattgcttcagraaggaggaggagaggtaagcatat

SEQ ID NO: 41403 - DNA, 50 bp, homo sapien
tccttccatgtgggacaccattaaamccagtgttgtgtcaaccagcaaag

SEQ ID NO: 41404 - DNA, 50 bp, homo sapien
tcatttaactaatagttcctaaataygtaaaaagatcttgtcactatgca

SEQ ID NO: 41405 - DNA, 50 bp, homo sapien
cactgtgggcgaataatcgcatggarcatttggctaaggattctgtgttg

SEQ ID NO: 41406 - DNA, 50 bp, homo sapien
catgattttattgagtaaatatatawgggtccaaaaaatctgaaaaacac

SEQ ID NO: 41407 - DNA, 50 bp, homo sapien
aaactctactcagagaaaaaggaccrcatggagatactgcaaagagaggt

SEQ ID NO: 41408 - DNA, 50 bp, homo sapien
gaggcctcactgaccaccaaagagaragaaaatatcctgagtatcctgga

SEQ ID NO: 41409 - DNA, 50 bp, homo sapien
taggtagaaaaagagaagtctactamggaggtttgggtgttaccagaatt

SEQ ID NO: 41410 - DNA, 50 bp, homo sapien
ggtttaaagaaacaaatagcatggartaagtcaaccattaagaactctaa

SEQ ID NO: 41411 - DNA, 50 bp, homo sapien
agactgcaaattaggtagcaagttaraaagtagcaaacatgttaaaaata

SEQ ID NO: 41412 - DNA, 50 bp, homo sapien
agtgagttgttgttttatgtgaccayaattgattgctaataataactgtt

SEQ ID NO: 41413 - DNA, 50 bp, homo sapien
tgcatcagggtgactggaaaatgtgraatcaaatattaaagagcaaatat

SEQ ID NO: 41414 - DNA, 50 bp, homo sapien
aaatatctcatgttcttgtggtagcyaaagtggattcatggaggtagaga

SEQ ID NO: 41415 - DNA, 50 bp, homo sapien
tatcacatggctcttttgtttcaagratcctttctcagaagtgtagcctg

SEQ ID NO: 41416 - DNA, 50 bp, homo sapien
tgcgtgcagaatatgctgtcacttaygaaggagataaatgctaatttctt

SEQ ID NO: 41417 - DNA, 50 bp, homo sapien
ggctttagtcgtcaggttctttcaamtagagtctcagatcctcaaagaca

SEQ ID NO: 41418 - DNA, 50 bp, homo sapien
tggaaaggctttctgtaataaatgasacttgactgaattttaaaggatag

SEQ ID NO: 41419 - DNA, 50 bp, homo sapien
actctttttcactagatggaatacaragttgtttcttttcactgggccct

SEQ ID NO: 41420 - DNA, 50 bp, homo sapien
ttggagaaatgaagctgaatgagaasagaagggttttggtaattaagtcc

SEQ ID NO: 41421 - DNA, 50 bp, homo sapien
agccatgggtagtgccttaatagcarcataggcaatagctatcactggat

SEQ ID NO: 41422 - DNA, 50 bp, homo sapien
gtcatatactttggaggaccttatgraatgtatcaatattcaattgaaag

SEQ ID NO: 41423 - DNA, 50 bp, homo sapien
cacaaaagaatgtgctaggtgttacragacaggattgcacacattgctgg

SEQ ID NO: 41424 - DNA, 50 bp, homo sapien
ggttttcttgagaaaaaaatttaaaygatgggactatgagagactacgaa

SEQ ID NO: 41425 - DNA, 50 bp, homo sapien
tggcagggtccttaggtcctagttascagctttttctacttcaagggaag

SEQ ID NO: 41426 - DNA, 50 bp, homo sapien
gctcacaaattggatttttcttccaytgaatattctgggtgactcctcag

SEQ ID NO: 41427 - DNA, 50 bp, homo sapien
gcaagcagcatctgttaatcacagckaaatcaaactataaattaataatt

SEQ ID NO: 41428 - DNA, 50 bp, homo sapien
tacttatgccatccaagtatgctagycgccattttttcctctagtgtcat

SEQ ID NO: 41429 - DNA, 50 bp, homo sapien
ctctcttctactggaaagtggctgamagttgtttctagggaagaacttgt

SEQ ID NO: 41430 - DNA, 50 bp, homo sapien
acatccagctttgagattgccttccraaaactagccaaggattagtgcta

SEQ ID NO: 41431 - DNA, 50 bp, homo sapien
ataatccgtaaaagtcagcaatcaayttcatgtacctttattgcttaaat

SEQ ID NO: 41432 - DNA, 50 bp, homo sapien
atctctaccctcagtgagcttataaytgaactggaaagacaggcataact

SEQ ID NO: 41433 - DNA, 50 bp, homo sapien
gcattccactgacagtcacataaatsatattatagccacatgggcagctg

SEQ ID NO: 41434 - DNA, 50 bp, homo sapien
ccatgatcccatattccctgaataamtctttctatccattttccattcct

SEQ ID NO: 41435 - DNA, 50 bp, homo sapien
agtccaaggctcttaccaaataattkaaggaatttacaaagcttattttt

SEQ ID NO: 41436 - DNA, 50 bp, homo sapien
aaagtaaaccaaaggcaaataatagraaaactcttgtatggagtcttctc

SEQ ID NO: 41437 - DNA, 50 bp, homo sapien
aatccctttttcaaactactgtcacraaaccgtgtagaatttgaacactg

SEQ ID NO: 41438 - DNA, 50 bp, homo sapien
actctgattgatgatgatgatataastggaaaagagtgctataaattgat

SEQ ID NO: 41439 - DNA, 50 bp, homo sapien
aagaaaaactaaacatattaagaaayctccatgcattgaaacaactggct

SEQ ID NO: 41440 - DNA, 50 bp, homo sapien
tccctacatattataaaattgctgcraatacaaagagtcatgtcttttct

SEQ ID NO: 41441 - DNA, 50 bp, homo sapien
caatctacagaaacagagagcactamgtataagagctagatttgaggtaa

SEQ ID NO: 41442 - DNA, 50 bp, homo sapien
tcaaaacaatgttttatagaatacartggaaaggtaaggttattatcgcc

SEQ ID NO: 41443 - DNA, 50 bp, homo sapien
acaagatgtatttcagttatacagaytcaggagaaaggtgttgaattctt

SEQ ID NO: 41444 - DNA, 50 bp, homo sapien
tattgagagatttcttggaacaaggrataataggctgaagtacccaatta

SEQ ID NO: 41445 - DNA, 50 bp, homo sapien
gctgagcatttgacaagttctaaaaygttcatatccattaagtatgtggg

SEQ ID NO: 41446 - DNA, 50 bp, homo sapien
aaagaattaatatgactaccagatcyctaggtgacataatttatgcctag

SEQ ID NO: 41447 - DNA, 50 bp, homo sapien
tatccatatcgtttagctctagtcasatttataattttatgttcacttgt

SEQ ID NO: 41448 - DNA, 50 bp, homo sapien
tacttgtagaaaaaaactccgtatcrccttcaggaatattaccaattaat

SEQ ID NO: 41449 - DNA, 50 bp, homo sapien
caatttacattcatactttagaagayggtgactaattttcttttctgaag

SEQ ID NO: 41450 - DNA, 50 bp, homo sapien
tgtataaaactaagctgtagcctgaytaccatgggtacacgttctcagaa

SEQ ID NO: 41451 - DNA, 50 bp, homo sapien
tctatttgagcttctcatttactaarctatttctctaatcattttgagag

SEQ ID NO: 41452 - DNA, 50 bp, homo sapien
ctagtctacaaggatgtgactggaaraataattaacagagccttatctgg

SEQ ID NO: 41453 - DNA, 50 bp, homo sapien
tgtagttcttcctaataagtcaaacwagctcacatttatggtgctgaata

SEQ ID NO: 41454 - DNA, 50 bp, homo sapien
gagccattcgtacttagtactttaargcagcacttttcaaatgtattcca

SEQ ID NO: 41455 - DNA, 50 bp, homo sapien
ctgtcccaagatttttcattgattaygtcttccatggtgagatttcaggc

SEQ ID NO: 41456 - DNA, 50 bp, homo sapien
tgaagtagacaaatatgtggtgtgarctaactcagcatgtactttttaca

SEQ ID NO: 41457 - DNA, 50 bp, homo sapien
taatcacagaactgattacctaatarcgatgtttgctttttatagttcaa

SEQ ID NO: 41458 - DNA, 50 bp, homo sapien
tgagaagtgacatccaacaagttacrgagagaaaccataccagctgaaaa

SEQ ID NO: 41459 - DNA, 50 bp, homo sapien
ggtctgtcaccccaaaaggttaacartcattgtaattgtatttttcctac

SEQ ID NO: 41460 - DNA, 50 bp, homo sapien
ttagatactgtgagtcaatatctagragaccaactgtttctggatgcctt

SEQ ID NO: 41461 - DNA, 50 bp, homo sapien
gttgctaccttcctatctcttaaatyacatatgtcagaaagtgctattta

SEQ ID NO: 41462 - DNA, 50 bp, homo sapien
ctgaggatttgggagtcagcaacacmgtgataaccattcatgccaaggct

SEQ ID NO: 41463 - DNA, 50 bp, homo sapien
gcagagattattatctgtggttcagwaagtagatattaatattattcaaa

SEQ ID NO: 41464 - DNA, 50 bp, homo sapien
gaagaagcccacatggcctggaaaastgagaggttcattagttatttcaa

SEQ ID NO: 41465 - DNA, 50 bp, homo sapien
cttttttttttttttagtttcttaaygtgaagacgtaggtcattgatttg

SEQ ID NO: 41466 - DNA, 50 bp, homo sapien
ttcatttctgtccatttttcaaatcsatatgtttttaaaataaaactcca

SEQ ID NO: 41467 - DNA, 50 bp, homo sapien
acgcatgtctgaatatgtttagacawgaatatcgacatccaaatatttta

SEQ ID NO: 41468 - DNA, 50 bp, homo sapien
ccagcacctttgcagctttgttatamatccctcatcttgaactacacagg

SEQ ID NO: 41469 - DNA, 50 bp, homo sapien
aataaagacatacttcatgcattaaygttaaagttccacaagtttatgct

SEQ ID NO: 41470 - DNA, 50 bp, homo sapien
cacattcctctagggagatagaccamagaaacaagtacaatgcagtgtga

SEQ ID NO: 41471 - DNA, 50 bp, homo sapien
tgttttgccaaatacagcctaagcartgagagatgtattgagttcctcac

SEQ ID NO: 41472 - DNA, 50 bp, homo sapien
ccaacttcagcattaatgtagataayaacctatgagctatcataaactgg

SEQ ID NO: 41473 - DNA, 50 bp, homo sapien
tgagtggatgtctgagccaaaaataygccattttctatagacacaggttt

SEQ ID NO: 41474 - DNA, 50 bp, homo sapien
taggtctaagttcttgagagtgtacyaaagacatttgatgaaagatagcc

SEQ ID NO: 41475 - DNA, 50 bp, homo sapien
tatggatgttaaccactaagtgtcaygtagtcatagaagcaaaagttaga

SEQ ID NO: 41476 - DNA, 50 bp, homo sapien
acgtttatttaactgttctcatttayggatgttaaccactaagtgtcatg

SEQ ID NO: 41477 - DNA, 50 bp, homo sapien
acagaatagcatgctaaaagtggacragagccttaaaaggcaaaaactga

SEQ ID NO: 41478 - DNA, 50 bp, homo sapien
tatagactgatgagtttgattgataygtgttgcaaaatcatcacaaatgg

SEQ ID NO: 41479 - DNA, 50 bp, homo sapien
caggacatctcttgacataaattctsacgtataaatttacattcatactc

SEQ ID NO: 41480 - DNA, 50 bp, homo sapien
aatacattggatcctcatctgcaagmattatactatgttacccatacaga

SEQ ID NO: 41481 - DNA, 50 bp, homo sapien
cttatggtgaaatacttgaagaaaayatgaaattaggtggagttttattt

SEQ ID NO: 41482 - DNA, 50 bp, homo sapien
caagcctttaatgtacttggtactcraatgtttactcatagacaagcctc

SEQ ID NO: 41483 - DNA, 50 bp, homo sapien
aacaatcagtgaagtaaatagacaaygaacaaagtgggagaaaacatttg

SEQ ID NO: 41484 - DNA, 50 bp, homo sapien
acatcacactctgaaattaaacttaygttctaaggactattaaaaataac

SEQ ID NO: 41485 - DNA, 50 bp, homo sapien
tcacaatagccaagatttggaagcarcatatgcccatcaacagatacatg

SEQ ID NO: 41486 - DNA, 50 bp, homo sapien
atgctcaaattgccttggctttcacrctatttacaacaaaaattggtctg

SEQ ID NO: 41487 - DNA, 50 bp, homo sapien
tgaatttattgactaagaaattctaygtcttaaaatccatcattgtcttt

SEQ ID NO: 41488 - DNA, 50 bp, homo sapien
tgtgtaaaggattttaagatgaaaargtataattacggtaattatgattt

SEQ ID NO: 41489 - DNA, 50 bp, homo sapien
cacagttgttctgaatactgagatcygaaagaagtgtctcctatgtactt

SEQ ID NO: 41490 - DNA, 50 bp, homo sapien
tttagataagttctctaatcacaccrctatcattgtatccctaagaacat

SEQ ID NO: 41491 - DNA, 50 bp, homo sapien
atggtgcaatgtaatgaattgagtamccaggtcacctgcctgtctcctga

SEQ ID NO: 41492 - DNA, 50 bp, homo sapien
tcccaaagcttagttctggaaaacartgtgctcatatcagtgattttgga

SEQ ID NO: 41493 - DNA, 50 bp, homo sapien
gaaaaaatcattataaaatggagtcrataacaggttacagcatcacaagt

SEQ ID NO: 41494 - DNA, 50 bp, homo sapien
acatagcgaaattgttctaagaaaartatgtgtaaaatttattttaaaaa

SEQ ID NO: 41495 - DNA, 50 bp, homo sapien
aataaatagatttccagacctctcgmaaaggaaggacctaaataagtagt

SEQ ID NO: 41496 - DNA, 50 bp, homo sapien
taagcttgtaggatttgtggtgttarcttgactaggttgaagttaaaatg

SEQ ID NO: 41497 - DNA, 50 bp, homo sapien
acattccactatagaattatcatatraatgagcattagcctctgtgtttt

SEQ ID NO: 41498 - DNA, 50 bp, homo sapien
aagcttatggatgcatcatgagccarggatttacctgctagttttgatgc

SEQ ID NO: 41499 - DNA, 50 bp, homo sapien
tgaaggtagacctaggggactgttargataaacataatggaaaaagctta

SEQ ID NO: 41500 - DNA, 50 bp, homo sapien
tctattctgcagtcacaaaggatagkaatcactgagcgcataacacttga

SEQ ID NO: 41501 - DNA, 50 bp, homo sapien
agcagtgttattctgagcatcaagaraaatgatctggaagcatcaatatt

SEQ ID NO: 41502 - DNA, 50 bp, homo sapien
aatgagaagtggttggccataaaacygtaggatattttaacaacagaaga

SEQ ID NO: 41503 - DNA, 50 bp, homo sapien
gaggctggctgtatgggtaagctaastgttcttattgtatgacaagtatt

SEQ ID NO: 41504 - DNA, 50 bp, homo sapien
gagtaagactgcctgttgtgacggtyaagtgttagtggaaggaaagagga

SEQ ID NO: 41505 - DNA, 50 bp, homo sapien
agaaatttagttaaattcagcaacaytgcagtaaatataagctcagttca

SEQ ID NO: 41506 - DNA, 50 bp, homo sapien
tagctaagatcactgataaagataartacactaaacaacagattttcagt

SEQ ID NO: 41507 - DNA, 50 bp, homo sapien
tcaaataattctaatttgctgaaaastctacagtctaactgatatgttgg

SEQ ID NO: 41508 - DNA, 50 bp, homo sapien
agactaagcacaatctattaaaacaytgtcatgcaactttacatacaggc

SEQ ID NO: 41509 - DNA, 50 bp, homo sapien
taaagcagtgagttggaagaacagayggagaagctctcttagaggtcagc

SEQ ID NO: 41510 - DNA, 50 bp, homo sapien
ctaaataattccaatagataaagcgyaaatagttaaccaaaattaactta

SEQ ID NO: 41511 - DNA, 50 bp, homo sapien
actcagtgcaatccctaacaaaataygaacaacgtgcttcacagaaatag

SEQ ID NO: 41512 - DNA, 50 bp, homo sapien
aaaagagaacaaggaagcaatattgraatgtcatggaatgacagttaaca

SEQ ID NO: 41513 - DNA, 50 bp, homo sapien
tcatatgggtcattcaacagatacaytcaactgcctttatttgaaaggat

SEQ ID NO: 41514 - DNA, 50 bp, homo sapien
aatttaaattgaaagactcccttaaygttgggcaaaatctaaaatttcag

SEQ ID NO: 41515 - DNA, 50 bp, homo sapien
atattcattgattttctagatcctcrctaacttgcccagtagtcatatgg

SEQ ID NO: 41516 - DNA, 50 bp, homo sapien
gtctgagaagtaatcacaatataccragcccttttaaactgtattcagta

SEQ ID NO: 41517 - DNA, 50 bp, homo sapien
tccataaaatgaagtattggccaaascagcatttcaaactattttttggg

SEQ ID NO: 41518 - DNA, 50 bp, homo sapien
ttttgcagaatgacctttatagatcwgaatcatggagggcaacaaccagg

SEQ ID NO: 41519 - DNA, 50 bp, homo sapien
accaccctcatgtaattcagaaaacygatatgttgaaaacccatatagca

SEQ ID NO: 41520 - DNA, 50 bp, homo sapien
caaccaacatttcctgtaaatcttayactaaacggaatataatgaataat

SEQ ID NO: 41521 - DNA, 50 bp, homo sapien
gagttgcctgtgtggcattcattacyggagatgtccagcaaactttcagc

SEQ ID NO: 41522 - DNA, 50 bp, homo sapien
ggttgggtctagagatttaggtatayaggtttagaagttttccatagata

SEQ ID NO: 41523 - DNA, 50 bp, homo sapien
gtcttataagaacacatgatatctayggaaaacttctaaacctgtatacc

SEQ ID NO: 41524 - DNA, 50 bp, homo sapien
tctgaaggtgctcaaataaatatgcmaacctatcttccgactagttcctc

SEQ ID NO: 41525 - DNA, 50 bp, homo sapien
accattgttttttagttctttttcaygggatttattactatcagaaaata

SEQ ID NO: 41526 - DNA, 50 bp, homo sapien
agttaaaaatctaatggcgttacatraattcaagggaagaaagtcagcaa

SEQ ID NO: 41527 - DNA, 50 bp, homo sapien
tatatgataaccacagttcaaaacaraggtcctcaagcactttaagattc

SEQ ID NO: 41528 - DNA, 50 bp, homo sapien
taataaaatgagttagctttagtgayatggctgtaacaagcatttttcgt

SEQ ID NO: 41529 - DNA, 50 bp, homo sapien
aacatttttatatagcatcaggaagyataagcaaatcaaattctctaaaa

SEQ ID NO: 41530 - DNA, 50 bp, homo sapien
gatttggtgttggcataaagactgasaagtaaatacatcaaagaaactgc

SEQ ID NO: 41531 - DNA, 50 bp, homo sapien
ttttctcaaaaccatcaatttttacrcttcctcacccatgttattctgtg

SEQ ID NO: 41532 - DNA, 50 bp, homo sapien
gacacatagtttgaaattccatgaaragtatgaatttcagttactatata

SEQ ID NO: 41533 - DNA, 50 bp, homo sapien
cttcaccggattgttcatatcaaacycaaacaagtagctacgacaaccct

SEQ ID NO: 41534 - DNA, 50 bp, homo sapien
agaaaaataaacataattgcataccraaatataataaaaatctatatact

SEQ ID NO: 41535 - DNA, 50 bp, homo sapien
gcaaagagtgtctgtttacctaataygtgacaagtatatatttcagccca

SEQ ID NO: 41536 - DNA, 50 bp, homo sapien
tgaagtaagttgcaacatttggagaygtaatagaaatctcttatttcatg

SEQ ID NO: 41537 - DNA, 50 bp, homo sapien
aacaaaaattatccaagtctctctarctatttctaaacaccgtggtatgc

SEQ ID NO: 41538 - DNA, 50 bp, homo sapien
aaggacagggatcaaaaccacaaacsgctaaatatggcttttaggaactg

SEQ ID NO: 41539 - DNA, 50 bp, homo sapien
aattaaacattgctgcccactgtaayagatgcttaaatatgtgtatctcc

SEQ ID NO: 41540 - DNA, 50 bp, homo sapien
aaggaagagatttagcagttagattsaacagaacatggtggcaaattaga

SEQ ID NO: 41541 - DNA, 50 bp, homo sapien
agaaaatctgcatggtagttcaacaratgacaactcctacatatcagaga

SEQ ID NO: 41542 - DNA, 50 bp, homo sapien
ccatgcctttagcgttatcacttgayggaccataaggaagaactatgtaa

SEQ ID NO: 41543 - DNA, 50 bp, homo sapien
ttagaccagcacaggttagaacaagmctgtccctgtgcttattgtgcctc

SEQ ID NO: 41544 - DNA, 50 bp, homo sapien
atattatgaattttgcatcattgtcrcctcctaaatatgttatagaagaa

SEQ ID NO: 41545 - DNA, 50 bp, homo sapien
aattatattatattgaccatattatraattttgcatcattgtcgcctcct

SEQ ID NO: 41546 - DNA, 50 bp, homo sapien
taatttttactactcctgttgtatakaagaagcatccataaatggggcaa

SEQ ID NO: 41547 - DNA, 50 bp, homo sapien
ctagccatgttgatctgttcacttayggtgtttctaatgcccaggacata

SEQ ID NO: 41548 - DNA, 50 bp, homo sapien
atggtgaatatcaattgtatatgtgraagtacttatataggtagacctcc

SEQ ID NO: 41549 - DNA, 50 bp, homo sapien
aggccatacttcaagtaacaaagtcycatttcattatttcagtagttttt

SEQ ID NO: 41550 - DNA, 50 bp, homo sapien
ttttctgacagctcatctggtatgtraagattattatgaccttctaagtt

SEQ ID NO: 41551 - DNA, 50 bp, homo sapien
aaattttaactttcacagactctcakagctcaaacaaaaaaagtaaaata

SEQ ID NO: 41552 - DNA, 50 bp, homo sapien
gagaagcttgagaagcatataaaacratactgattatagggaattgatga

SEQ ID NO: 41553 - DNA, 50 bp, homo sapien
acctcaagtttacagattcagttatkaaacaaacacatattcaacaccta

SEQ ID NO: 41554 - DNA, 50 bp, homo sapien
taatgaaaaaagtagatgtatgcaawaaaagataaataatttaagtgaaa

SEQ ID NO: 41555 - DNA, 50 bp, homo sapien
ttctttcttagaattttcatctttcrcttaaattatttatctttttttgc

SEQ ID NO: 41556 - DNA, 50 bp, homo sapien
agtgatgggagacagtaggcagtacmaatagtacctgttttttggttgcc

SEQ ID NO: 41557 - DNA, 50 bp, homo sapien
cactcaacaaactcatgtatatgtcrcttgaacaattctcaggtacttga

SEQ ID NO: 41558 - DNA, 50 bp, homo sapien
ggccatacattcattcaagaataccragaacatgtagagatgaacagtgt

SEQ ID NO: 41559 - DNA, 50 bp, homo sapien
aattcactaaacacttaccacacatsaggctttataaatattatttcatt

SEQ ID NO: 41560 - DNA, 50 bp, homo sapien
tgtgtggtaagtgtttagtgaattgraatgtctcttttctttctctgcgg

SEQ ID NO: 41561 - DNA, 50 bp, homo sapien
aatacattcatttccttcttataaakacagtttccataaactatattact

SEQ ID NO: 41562 - DNA, 50 bp, homo sapien
ctagaaactgcatagaaatctctaayggaaccaactctccacatccttca

SEQ ID NO: 41563 - DNA, 50 bp, homo sapien
tgctatattgactcaaaagatattarctagtacagagagtcaataaatat

SEQ ID NO: 41564 - DNA, 50 bp, homo sapien
tacattttgaaatttcatgatgtgaytactaatttaaaattacattagat

SEQ ID NO: 41565 - DNA, 50 bp, homo sapien
cattaccattcatactaaatctatayctttgctcaggtcattcccctcgt

SEQ ID NO: 41566 - DNA, 50 bp, homo sapien
ataaattatgtggtgaaaaaagtacrggactggaaagcaacagatctggg

SEQ ID NO: 41567 - DNA, 50 bp, homo sapien
tccatgccgacttaaccatacataayctttgggaataaaacacagtatgg

SEQ ID NO: 41568 - DNA, 50 bp, homo sapien
actaaatctgaggaagatggtgaaaygtcagaacagcaagtaaaattctt

SEQ ID NO: 41569 - DNA, 50 bp, homo sapien
atagtgactattaaatattctttacycaacacattatattgtaaaaatat

SEQ ID NO: 41570 - DNA, 50 bp, homo sapien
ctgaaggtataaccatccatcttcasgaagtaagaatagtgaatagtaag

SEQ ID NO: 41571 - DNA, 50 bp, homo sapien
agaaactactttgggtccattcagcrcaatcttcctcattctgctcagga

SEQ ID NO: 41572 - DNA, 50 bp, homo sapien
tgttagaaggatttaagtacattgcygaaggtataaccatccatcttcag

SEQ ID NO: 41573 - DNA, 50 bp, homo sapien
ttagctccaagaaaaactgctcttayggaatagtgtagatcagaaatttt

SEQ ID NO: 41574 - DNA, 50 bp, homo sapien
gtgacctaaagaatagtgctgacccrcatttaactaaaaatcagagaaaa

SEQ ID NO: 41575 - DNA, 50 bp, homo sapien
caaaacaaaatgtaagtaatatctayggtttcactgactcctactaacta

SEQ ID NO: 41576 - DNA, 50 bp, homo sapien
ttctgacttcttttagttatctggaraatcttaacagcttcaatgacatg

SEQ ID NO: 41577 - DNA, 50 bp, homo sapien
ttgattatgatattaattcaaagtasagtcattccatataagtagaaaag

SEQ ID NO: 41578 - DNA, 50 bp, homo sapien
ttttggcaacctatggaaatcctaaytgagtatctgttaatgctctgttt

SEQ ID NO: 41579 - DNA, 50 bp, homo sapien
ttgtggaacttacattctggtgataygtcaactcttcttttataaaagtg

SEQ ID NO: 41580 - DNA, 50 bp, homo sapien
tccataggttgccaaaatatgtcctyaagatgtggtttaacattctgtgt

SEQ ID NO: 41581 - DNA, 50 bp, homo sapien
aaatcttcatttgtagaaaaatagaytccctacctttgtggaacttacat

SEQ ID NO: 41582 - DNA, 50 bp, homo sapien
gccaccacgcctggcaatttgctaakaatttgaagacttgactccacgat

SEQ ID NO: 41583 - DNA, 50 bp, homo sapien
ataaggttttccgggaaacactaaaytgcgttaacattctgctgaagtta

SEQ ID NO: 41584 - DNA, 50 bp, homo sapien
ctgaataccaatatgaaagaggcttsaagaacttggatagtaagccccag

SEQ ID NO: 41585 - DNA, 50 bp, homo sapien
actttatccgacagggagcattaaasgcagaattaagctaccaaaggcaa

SEQ ID NO: 41586 - DNA, 50 bp, homo sapien
ataatgtagaactggtggatcataargtcacagagctgagaggatcttta

SEQ ID NO: 41587 - DNA, 50 bp, homo sapien
aaataatgtttatttggcaattatcragtataggaactgcaaagacaaaa

SEQ ID NO: 41588 - DNA, 50 bp, homo sapien
ttgctaaaaggactcacaaaactcarcttattacagctaaaggatctaga

SEQ ID NO: 41589 - DNA, 50 bp, homo sapien
cacaggaaatcattctgttgcctaamtcctatgactggcagtcttttcta

SEQ ID NO: 41590 - DNA, 50 bp, homo sapien
atttcaatactgtatggagatagaartagtctaatttgcttatcactgcc

SEQ ID NO: 41591 - DNA, 50 bp, homo sapien
aaataaaagtgctgttgaagactctkaaattcgctgcatattagagaaca

SEQ ID NO: 41592 - DNA, 50 bp, homo sapien
ggaagagacatgatgaggctgtggartcaaagaacaatgtacttcagcaa

SEQ ID NO: 41593 - DNA, 50 bp, homo sapien
agatgctcaatagatatttgttgaayactaattgttgaaagccagcaggc

SEQ ID NO: 41594 - DNA, 50 bp, homo sapien
ttctacacaaggaaaataggacttaygtgtcattcaaattacattattcc

SEQ ID NO: 41595 - DNA, 50 bp, homo sapien
ttttaggttcacttctacctagaccrctgctttttattagaaatggaagt

SEQ ID NO: 41596 - DNA, 50 bp, homo sapien
ccaaaagaaaatacatcatccgtagracttttttcagaaacaaaatatgt

SEQ ID NO: 41597 - DNA, 50 bp, homo sapien
ccagcaggtcttcctccatcatacamaagacaaatacatgcaaagcagtt

SEQ ID NO: 41598 - DNA, 50 bp, homo sapien
actcctagacccacaaaccagaaaamaataatctcaggtcagagacttag

SEQ ID NO: 41599 - DNA, 50 bp, homo sapien
atgataaatgcttcaatctggggaasagtaaatattacaagagttgactc

SEQ ID NO: 41600 - DNA, 50 bp, homo sapien
acgccttgggtgtcttcagctgctcraggcatatattaatagcccagcaa

SEQ ID NO: 41601 - DNA, 50 bp, homo sapien
ttaatgttatcaccacagaagaagasaagggtagatactgggagatgact

SEQ ID NO: 41602 - DNA, 50 bp, homo sapien
agcctcaaaactatccctggctcccrctctcatgtcccactttcaaatca

SEQ ID NO: 41603 - DNA, 50 bp, homo sapien
ctcaactctactcatggatgccgaaygatgtctgtgtcttgcactttgct

SEQ ID NO: 41604 - DNA, 50 bp, homo sapien
gggccaatgattaacagcagatacamtaggaaataccatagacatcccag

SEQ ID NO: 41605 - DNA, 50 bp, homo sapien
tgccatggctggaaggagccttagcratgatttagaccaggggccctcca

SEQ ID NO: 41606 - DNA, 50 bp, homo sapien
caatccgaaaactagtgcaagagagraccatccttagtttaagttaactt

SEQ ID NO: 41607 - DNA, 50 bp, homo sapien
aggagcagtccctcaccatgcttacratgtcgtctctgtcttttggcctt

SEQ ID NO: 41608 - DNA, 50 bp, homo sapien
acatgactaatgggcacgtaaattaratgttactaagcaagagactattc

SEQ ID NO: 41609 - DNA, 50 bp, homo sapien
tcttggtttgttgctttgaaaggaaraattttagtataaagactctagta

SEQ ID NO: 41610 - DNA, 50 bp, homo sapien
ctgcttttagccacaggctagaagayagaacaattgagtcttttaaaaag

SEQ ID NO: 41611 - DNA, 50 bp, homo sapien
aatccctgccttcgtggagtttatawcctagcaaacctaaattctggatc

SEQ ID NO: 41612 - DNA, 50 bp, homo sapien
aggcatcaatacaactcagcagtaascaattcacccatctttggaggtaa

SEQ ID NO: 41613 - DNA, 50 bp, homo sapien
gcagcatcatacagcaaaatattaartgttagttcttacaagggcttaca

SEQ ID NO: 41614 - DNA, 50 bp, homo sapien
gattaagaagcaactcagatgtaacrcggtgggaaggagtctctcttcct

SEQ ID NO: 41615 - DNA, 50 bp, homo sapien
aacagctgacctacccaggtctcctraacagttatcggtaaagtctcaaa

SEQ ID NO: 41616 - DNA, 50 bp, homo sapien
agaaataaaaataagtcatcacttcracttcatgtgctaacatcactgag

SEQ ID NO: 41617 - DNA, 50 bp, homo sapien
ttgtagcagatgatggtcacctttaygggattacaggacttgccaaatct

SEQ ID NO: 41618 - DNA, 50 bp, homo sapien
aactatattagcagcacctttctacrcttatgccaacaggaattcttaat

SEQ ID NO: 41619 - DNA, 50 bp, homo sapien
tctctgacacaaagtaagcatgcagmaaatggtggcggagtgacagcgtg

SEQ ID NO: 41620 - DNA, 50 bp, homo sapien
gtccaggttcagacaagacttctcakgtgaggttcctaggattcagctcc

SEQ ID NO: 41621 - DNA, 50 bp, homo sapien
gttccttctctcccgcaaagcaatcrgaggaatcttttttttttcctcct

SEQ ID NO: 41622 - DNA, 50 bp, homo sapien
tttatgcttagcaacctgtgagatayggctagtgtcactcacttttggta

SEQ ID NO: 41623 - DNA, 50 bp, homo sapien
ttcattcactcattcaatatccaacmaatatttatagattgattattcca

SEQ ID NO: 41624 - DNA, 50 bp, homo sapien
tggcacttgggaggcattatataaaygtttgtggctaccacagagaccaa

SEQ ID NO: 41625 - DNA, 50 bp, homo sapien
aactaatttaaacagaagtttcaaasaggcaggattggagtatatgcaga

SEQ ID NO: 41626 - DNA, 50 bp, homo sapien
ttgaagccaggccaaggctcctatcyaacaatctcctaagcacagaagaa

SEQ ID NO: 41627 - DNA, 50 bp, homo sapien
agaaaaaaaattccacaaattgctaygtaatatttgaaaacaacttaaac

SEQ ID NO: 41628 - DNA, 50 bp, homo sapien
ctagccatatctcacaggttgctaarcataaactatggcaaatgttaaac

SEQ ID NO: 41629 - DNA, 50 bp, homo sapien
atcatctattttcagttaatgataartgttgtgaaggaaataagtcaaga

SEQ ID NO: 41630 - DNA, 50 bp, homo sapien
gacagtaaatagttaacaaaattacyattacttactgctatgaaccagac

SEQ ID NO: 41631 - DNA, 50 bp, homo sapien
taatggcttgacatgcagtctatccygagcactggatgccaaagaactgt

SEQ ID NO: 41632 - DNA, 50 bp, homo sapien
tgaggcttcaagccaggatttatackaaagcatgtgccagaccatgtgct

SEQ ID NO: 41633 - DNA, 50 bp, homo sapien
cagtgtccatcagcaaccagccaatragtaggcgcagcttgtcagtgctg

SEQ ID NO: 41634 - DNA, 50 bp, homo sapien
gctgtgtgccaacacaggagcccacragagggaaacagtaatgactatag

SEQ ID NO: 41635 - DNA, 50 bp, homo sapien
tagagctgatggattaatgtttagasagtaccttgctatctttacttata

SEQ ID NO: 41636 - DNA, 50 bp, homo sapien
tgaatgagaggaatgggacactcctyaaagccagcatggtaattgcagga

SEQ ID NO: 41637 - DNA, 50 bp, homo sapien
atttctaggtcataactttttagaaktagccaagtaactattcctgcttt

SEQ ID NO: 41638 - DNA, 50 bp, homo sapien
cagctaagttctaaactgataaacayggtcatctgaaaaatgaataaact

SEQ ID NO: 41639 - DNA, 50 bp, homo sapien
atttgcccaatgcaggtgaccttgarctctgattgttacgacctcaagag

SEQ ID NO: 41640 - DNA, 50 bp, homo sapien
caagtttttgttgtagatagccttaygtttctttttgtttatcctatttg

SEQ ID NO: 41641 - DNA, 50 bp, homo sapien
ggtgtctacaggacgttttgaaagcraagcctctttggactgtacgagaa

SEQ ID NO: 41642 - DNA, 50 bp, homo sapien
cctataggggtcaaacagaatgagcsacagttgaaagcatgactccaaaa

SEQ ID NO: 41643 - DNA, 50 bp, homo sapien
gcccagaagggaaaaatctgattacrgaacttcctctccctagttgaggt

SEQ ID NO: 41644 - DNA, 50 bp, homo sapien
ccacgaaactaaaggaagttctttaycctgcagtcacatactccaggagg

SEQ ID NO: 41645 - DNA, 50 bp, homo sapien
tcttcctcaccacaatctccttgaargcagaaactagatttgcttcattt

SEQ ID NO: 41646 - DNA, 50 bp, homo sapien
ttttcttggcagcactgatgacatcygatgtatttttgagtggtccttta

SEQ ID NO: 41647 - DNA, 50 bp, homo sapien
ccctgacccccagcaatcttcacacrcatggaatctagacctgacaagct

SEQ ID NO: 41648 - DNA, 50 bp, homo sapien
agtggttgggtgaacatgttagtgakgaaggaaaacaagtcagagtggtc

SEQ ID NO: 41649 - DNA, 50 bp, homo sapien
gtatgtctttgacaaaagtgacctargagatgttttatctgttctttcaa

SEQ ID NO: 41650 - DNA, 50 bp, homo sapien
ttaagcttggataatttccatagagmattttgatgcatgtagcattttag

SEQ ID NO: 41651 - DNA, 50 bp, homo sapien
acaacacaggaaacatgatcatggasacaatggtttacattactacagtt

SEQ ID NO: 41652 - DNA, 50 bp, homo sapien
aataaatttgtattatcttttaatayggtgaccagcatcttgcaataaat

SEQ ID NO: 41653 - DNA, 50 bp, homo sapien
tcctctcatatatggttttgtttccrctggaatccttcttccaaatgaca

SEQ ID NO: 41654 - DNA, 50 bp, homo sapien
atctaataagggtttggtatctagartataaagaactgttataactcaac

SEQ ID NO: 41655 - DNA, 50 bp, homo sapien
taaaagggaactagcaggaggatccmaacttgttcatgcccttaaaggcc

SEQ ID NO: 41656 - DNA, 50 bp, homo sapien
acatcattcagaagttcatgggaccrctgattagatctaattcaatattt

SEQ ID NO: 41657 - DNA, 50 bp, homo sapien
agattctaaatagacctttgtgaaayagataaaaagataaaaatagctaa

SEQ ID NO: 41658 - DNA, 50 bp, homo sapien
gacaatattgttaactagactatacwcgttgttcaaactccatcagtttt

SEQ ID NO: 41659 - DNA, 50 bp, homo sapien
tcaccctggaacacctttgccagtayaggccctccttaaagtcacatggg

SEQ ID NO: 41660 - DNA, 50 bp, homo sapien
acttaacttatggatttccgggaaawgtttccagctaggaatgctctaaa

SEQ ID NO: 41661 - DNA, 50 bp, homo sapien
ttttaaatatccaatgaaaagaaaaytctggtaggaaggatcaaagcttt

SEQ ID NO: 41662 - DNA, 50 bp, homo sapien
gccaagcctccacaattgcaagagayaattccttaaaataaacacatttt

SEQ ID NO: 41663 - DNA, 50 bp, homo sapien
actagggcttacaacttaaataatayaaaagctgaactgaaagcagctct

SEQ ID NO: 41664 - DNA, 50 bp, homo sapien
ttttaagcgatttaatacacataacratcagatgctatccctgtattgga

SEQ ID NO: 41665 - DNA, 50 bp, homo sapien
tagaaaaacaatcagcactttcatcsagattacctgtctacgcaagtccc

SEQ ID NO: 41666 - DNA, 50 bp, homo sapien
ccaaggactcctagaggtcactcagrctatactaaaacctggaagaagtc

SEQ ID NO: 41667 - DNA, 50 bp, homo sapien
cttcttagataaaaagtgccctacaytgaaagatccacataacctcttcc

SEQ ID NO: 41668 - DNA, 50 bp, homo sapien
tgcttgctaactggcccaggcatcckgacgggcttggaggaaatgccccc

SEQ ID NO: 41669 - DNA, 50 bp, homo sapien
tttggcagtgatgttcctctctgtaygccaagtgggcacctggtcaatgg

SEQ ID NO: 41670 - DNA, 50 bp, homo sapien
cctttgacctcttggcctcatcagaytcattcataaaaactttgcccagg

SEQ ID NO: 41671 - DNA, 50 bp, homo sapien
catctagttaaaaatgcaaacaggarattattttctcaccgaatggcctt

SEQ ID NO: 41672 - DNA, 50 bp, homo sapien
aaaggtagtagaaaagggcatggaaratggtaaaaaactacaaaaagaaa

SEQ ID NO: 41673 - DNA, 50 bp, homo sapien
ttcatgttatttggaggcaaggaacrcttcagtgctaagaccattagaca

SEQ ID NO: 41674 - DNA, 50 bp, homo sapien
cgagaagggaggagtccatgcctagwagggtcattctgctatcctcagcc

SEQ ID NO: 41675 - DNA, 50 bp, homo sapien
cagtatctgtgcagcgatcctgttayggttggcagtcccttactttgaag

SEQ ID NO: 41676 - DNA, 50 bp, homo sapien
cctcacaggatcttacattttgtggratgataatagatgtaatattccca

SEQ ID NO: 41677 - DNA, 50 bp, homo sapien
taattttgctttcaaaaacaaattcsagaaactgtcagcttatagtattt

SEQ ID NO: 41678 - DNA, 50 bp, homo sapien
attgcagtggggagaagaaagtataragtgctagatgatggtaagtgctg

SEQ ID NO: 41679 - DNA, 50 bp, homo sapien
aaggattgcaagtttatagttgttaraatagacctcacatgaggtgactt

SEQ ID NO: 41680 - DNA, 50 bp, homo sapien
tcctgagcttaaccagaccattgtcrctgtaaacatataattgcagtgca

SEQ ID NO: 41681 - DNA, 50 bp, homo sapien
tcttgccttatctttatccacttaayacctgcaatgctgccagggatgga

SEQ ID NO: 41682 - DNA, 50 bp, homo sapien
taatgtttagacagtacctttgctakctttacttataaattattcacaca

SEQ ID NO: 41683 - DNA, 50 bp, homo sapien
aatatttcatgcactgtcatctgtgsattatttaataaagcaattgaagg

SEQ ID NO: 41684 - DNA, 50 bp, homo sapien
cctgcaagctggtttatatgaaaacrccagtactttcctgagcccctcca

SEQ ID NO: 41685 - DNA, 50 bp, homo sapien
catgttttgaagaaaaagattgccasctactgaaaggaatttgacttgta

SEQ ID NO: 41686 - DNA, 50 bp, homo sapien
gtgtgggttctaaaccaaaaatcagraacacagactccctggcttgcagg

SEQ ID NO: 41687 - DNA, 50 bp, homo sapien
gagcctaattttctgtgctgttaaamatttgtgtcccttttttgtgtgtt

SEQ ID NO: 41688 - DNA, 50 bp, homo sapien
ttgtggcttacttgtcacctgcctcragaccatcatcattcagaaatgag

SEQ ID NO: 41689 - DNA, 50 bp, homo sapien
ccagatgaaaacctacctaatccatsaaacagtgtctactctaaacacga

SEQ ID NO: 41690 - DNA, 50 bp, homo sapien
gggagactttgtttaatgtctccacraattctagatagactgttcctgca

SEQ ID NO: 41691 - DNA, 50 bp, homo sapien
gagcagaaggattaatcttaccagckataaccagagtcttttgggggcac

SEQ ID NO: 41692 - DNA, 50 bp, homo sapien
tccaggcagcctgatttactgatccraatgcagaaacacagatgggcgcc

SEQ ID NO: 41693 - DNA, 50 bp, homo sapien
attttactgaaacgttgaatgtgtawgagtgagaaaagtttagtatggca

SEQ ID NO: 41694 - DNA, 50 bp, homo sapien
tctatccctagacctgcaggtttaartaaattccaggcagcctgatttac

SEQ ID NO: 41695 - DNA, 50 bp, homo sapien
tggcttcttgcctttatggagcagayggagaggaaagccctgaaattcgg

SEQ ID NO: 41696 - DNA, 50 bp, homo sapien
ataaaatgagctttgaaagggaaaawttttagataacattatctcatcaa

SEQ ID NO: 41697 - DNA, 50 bp, homo sapien
ctcagagtggggagtagggaaataamtcagtcaataattgtggtgggatc

SEQ ID NO: 41698 - DNA, 50 bp, homo sapien
tctgtgctctggtaggagaatccgcygaattcttgctgctttgagtaatc

SEQ ID NO: 41699 - DNA, 50 bp, homo sapien
aacttttcaggaaagagactcaaaaygttcagaggtattgcaggttcact

SEQ ID NO: 41700 - DNA, 50 bp, homo sapien
caaagcaaaaatgttcaatatataartgttggaagatccagggaagcaca

SEQ ID NO: 41701 - DNA, 50 bp, homo sapien
cttcttcctagcttaaaaagttatasactggtttcaaatccagataattg

SEQ ID NO: 41702 - DNA, 50 bp, homo sapien
ttggcttccttatctctgttcctatyaaagtgcattctctgtcacacaga

SEQ ID NO: 41703 - DNA, 50 bp, homo sapien
ggacacctaagcaggattggctgaaygttatcctttctgctgaggcatca

SEQ ID NO: 41704 - DNA, 50 bp, homo sapien
acaatttcatttccaagactagacargaatatatttgcagacttgagcaa

SEQ ID NO: 41705 - DNA, 50 bp, homo sapien
cgtggtatgcgggcctgtaactgcayctagtcaggaagctgaggcagtta

SEQ ID NO: 41706 - DNA, 50 bp, homo sapien
tgacaactcactgtggtaaattatgyattgttgatgaggtaacacataag

SEQ ID NO: 41707 - DNA, 50 bp, homo sapien
ggcacccagtgtgtataggatggacyacaattctttaaaaaaaaaatcta

SEQ ID NO: 41708 - DNA, 50 bp, homo sapien
agtaaccttattcactctctgggaaygttgactttttgaggtaattttta

SEQ ID NO: 41709 - DNA, 50 bp, homo sapien
gaatggcttagagtggtacctggcaygtggtatgtttcttttttagacat

SEQ ID NO: 41710 - DNA, 50 bp, homo sapien
ataggaaaaagaacagtatcattccrcattaacaattgaaagatgactgc

SEQ ID NO: 41711 - DNA, 50 bp, homo sapien
attcagacttgcttgtgttcacaaayagataatgccagaggtggtggtct

SEQ ID NO: 41712 - DNA, 50 bp, homo sapien
aatcacaatcatgtcattgttactamattctggcagtgccaagatctgac

SEQ ID NO: 41713 - DNA, 50 bp, homo sapien
tcatatggacatggtaagcattatawaatcaagtactactagctctttct

SEQ ID NO: 41714 - DNA, 50 bp, homo sapien
atctctccacaaatggcctacaagayagctgtgattagacccactctaca

SEQ ID NO: 41715 - DNA, 50 bp, homo sapien
ctgttgagtcaataattatggtcaartcctgttgagagatgagtccaggg

SEQ ID NO: 41716 - DNA, 50 bp, homo sapien
gcatggcagcgtaaccaatgttcacrgtccatattggtaattgcctgcag

SEQ ID NO: 41717 - DNA, 50 bp, homo sapien
cgctggtgaaagggattgagtctgarcatctctccagggtctaataattt

SEQ ID NO: 41718 - DNA, 50 bp, homo sapien
tttggaagcactgtaatgagaatgcrcaataggaaaagtgccaactggct

SEQ ID NO: 41719 - DNA, 50 bp, homo sapien
tgtacagtttaaagggtaataaccaratgaacacctgtgcccagcaacag

SEQ ID NO: 41720 - DNA, 50 bp, homo sapien
tgtccctgtcctagctcatcatgatyagtgtcagcggttggcttatccag

SEQ ID NO: 41721 - DNA, 50 bp, homo sapien
tgtttcacagtttaagaaagttgtgwagtaattgttaagaacttagaacc

SEQ ID NO: 41722 - DNA, 50 bp, homo sapien
tgttgaaattgttcccttgatgtagyaatagaaaattttagattaggctt

SEQ ID NO: 41723 - DNA, 50 bp, homo sapien
agaagccttatgaaaattatactgasaacctgatctcgtttactccatgt

SEQ ID NO: 41724 - DNA, 50 bp, homo sapien
agattttctctcccaggaaattaaayactgagagagctgaagcagagaca

SEQ ID NO: 41725 - DNA, 50 bp, homo sapien
aaattttaaacaattaaccttgaacygtctgatcatgcagtggttactca

SEQ ID NO: 41726 - DNA, 50 bp, homo sapien
ctgggctctcctctggcatgtcgtayctcattttaatgagtcgtgtctct

SEQ ID NO: 41727 - DNA, 50 bp, homo sapien
ataaaatctaggcccagtgccacaastaaatccctgtaggaactctcaag

SEQ ID NO: 41728 - DNA, 50 bp, homo sapien
gaaagtcacaggttaaatttcataasgacaaatataagatagcatctagg

SEQ ID NO: 41729 - DNA, 50 bp, homo sapien
atactaaaagccactgaattacatamcctttaaaacagtgtattttatga

SEQ ID NO: 41730 - DNA, 50 bp, homo sapien
acattcactatcttttagggcataargcacatgtgggtaagaaatattat

SEQ ID NO: 41731 - DNA, 50 bp, homo sapien
aggctctgttgtgtgaacctagtgcycaaaacttaggagaggaagaggat

SEQ ID NO: 41732 - DNA, 50 bp, homo sapien
agccactcggtcttccaggaaaaacragcaatcctatagcaaattagccc

SEQ ID NO: 41733 - DNA, 50 bp, homo sapien
tccaatctcaaaatggtaaactctayaagaagaaacattaaagcttttca

SEQ ID NO: 41734 - DNA, 50 bp, homo sapien
cggtgagtcagcaaaatggatctgarcgcaaggctagagccacagccgtg

SEQ ID NO: 41735 - DNA, 50 bp, homo sapien
ttactgaaaatattaacaggtaactmaattactccctctgtcagtccaaa

SEQ ID NO: 41736 - DNA, 50 bp, homo sapien
aatagccaatatatagcatttattakgagtaagacactccttcaagcatt

SEQ ID NO: 41737 - DNA, 50 bp, homo sapien
gtaagcgtgtgtctttccttcttatraaaagagctggaaaagcagtaaga

SEQ ID NO: 41738 - DNA, 50 bp, homo sapien
caccctaatctcattcttgctctcaracttttccctcctcttcttcataa

SEQ ID NO: 41739 - DNA, 50 bp, homo sapien
ccaaagcactcctccaaggataaaarggatggaaagtggagccttgaact

SEQ ID NO: 41740 - DNA, 50 bp, homo sapien
cccaacacccctatgatttttcttcrattcactgagattaggacttgctg

SEQ ID NO: 41741 - DNA, 50 bp, homo sapien
ttaggactcggtgggaaataattgcsgaagatgaaacaaaggaggcagaa

SEQ ID NO: 41742 - DNA, 50 bp, homo sapien
ccccatttaccctactgtttctacasgttatgacgtatcatttttacaca

SEQ ID NO: 41743 - DNA, 50 bp, homo sapien
tgaagcaggaataacataacttatcrgaaagaacacacagccaaagatga

SEQ ID NO: 41744 - DNA, 50 bp, homo sapien
ccctgcattcttgtctgtttcctggratctataatgcccatgccctgtat

SEQ ID NO: 41745 - DNA, 50 bp, homo sapien
aagcactatttgggcaatagtatgtmacaggataaacagaaatagggtaa

SEQ ID NO: 41746 - DNA, 50 bp, homo sapien
acagaaacatcacagtgcatactctkacaaagcaaattgtgaagtacttt

SEQ ID NO: 41747 - DNA, 50 bp, homo sapien
gacagcaacttctgtgtttctgggcmataaactagtgctatgagatgaaa

SEQ ID NO: 41748 - DNA, 50 bp, homo sapien
gattggggcttcatccagctgtcaaygggaggtgtgggtgtgtgcgtgca

SEQ ID NO: 41749 - DNA, 50 bp, homo sapien
taggacaccccaagcaggacatacaktagtcaggcaataaggttaagaag

SEQ ID NO: 41750 - DNA, 50 bp, homo sapien
gtctgtttgttgggagatgaatctcmatgacctctactactacttaacaa

SEQ ID NO: 41751 - DNA, 50 bp, homo sapien
aagccgagaatttacatttctcaggracactgaaatatgcacattaaatc

SEQ ID NO: 41752 - DNA, 50 bp, homo sapien
tggtgattttggattgctgtctgaayaaatcattggtttgggctcccaca

SEQ ID NO: 41753 - DNA, 50 bp, homo sapien
cttactaacacctatgatgttacctkaaatcaatctcccatatgtatgct

SEQ ID NO: 41754 - DNA, 50 bp, homo sapien
aaacgtgctcagattgggtattgaartagagacctactccagtgccagcc

SEQ ID NO: 41755 - DNA, 50 bp, homo sapien
acaaacaaaggaaatgtagagaatayctcatgctaagaagtgccacggtg

SEQ ID NO: 41756 - DNA, 50 bp, homo sapien
tcccttaagagtacatacataacaaytgaaccaaaagacattcttagatg

SEQ ID NO: 41757 - DNA, 50 bp, homo sapien
gccagggcagaaggcagaatcaacayattgagagcctagctctgtggcgt

SEQ ID NO: 41758 - DNA, 50 bp, homo sapien
agtcagaagattaaagaggtcaacartgtacacaatataggatttaatgt

SEQ ID NO: 41759 - DNA, 50 bp, homo sapien
cgttgatcctctgtgaaacctcaaarggtagcaatcagctaattgaagaa

SEQ ID NO: 41760 - DNA, 50 bp, homo sapien
ccagatgctgcatgcctgagaaataygcaggttcccacaactagaaggaa

SEQ ID NO: 41761 - DNA, 50 bp, homo sapien
ataaagtcagaagcaagaagtaccaygagaagaagagaaatagcaagact

SEQ ID NO: 41762 - DNA, 50 bp, homo sapien
gaaaaccacagccatttgttcttaaytcatctcaggaaggggtgaacaat

SEQ ID NO: 41763 - DNA, 50 bp, homo sapien
gtagtatgtaaagaacagaaagcaayagagtagcccagaagtaagcacat

SEQ ID NO: 41764 - DNA, 50 bp, homo sapien
ctgtccagctttaaggaggattttcycttatcaccaaatttccaggcaac

SEQ ID NO: 41765 - DNA, 50 bp, homo sapien
tcaaagccccagcatgtcacccaacygttaacaccaatccacataaagaa

SEQ ID NO: 41766 - DNA, 50 bp, homo sapien
ctgggggaggagagaggacagcaagracaagtggctcttgagaggaaagg

SEQ ID NO: 41767 - DNA, 50 bp, homo sapien
ttttctgggcttgctttaaggtgaartaaggcactcacaactctagatag

SEQ ID NO: 41768 - DNA, 50 bp, homo sapien
accatttccctactattaagcagaakttatctcttgagggcaaatacagt

SEQ ID NO: 41769 - DNA, 50 bp, homo sapien
tcggtaggcctgcggtggatcctagsaatctgcattaacaatctccaaag

SEQ ID NO: 41770 - DNA, 50 bp, homo sapien
caaactgttttttggtagctgagaawctgtaatcggcttttggattatga

SEQ ID NO: 41771 - DNA, 50 bp, homo sapien
gccacaggatattgtaaagataaagraaatgacgtaaatcaataggatct

SEQ ID NO: 41772 - DNA, 50 bp, homo sapien
agaaagtgcctcaacatctattgtakaaagcaaggagtaggccagtctta

SEQ ID NO: 41773 - DNA, 50 bp, homo sapien
gagtttttttcctctttcctggacaracattttagattttttagaatcag

SEQ ID NO: 41774 - DNA, 50 bp, homo sapien
cctgaaatcctggggttccaagaaaktgcctcaacatctattgtagaaag

SEQ ID NO: 41775 - DNA, 50 bp, homo sapien
attgttgacatgcctttgcatataaygttctttccaattggcatcatttg

SEQ ID NO: 41776 - DNA, 50 bp, homo sapien
atggttcttgcctacagatcacttamaattgtgtggccttagatgagggg

SEQ ID NO: 41777 - DNA, 50 bp, homo sapien
gtcttaatgaggaccctgacaaagcrgcatgcaacatgggcactgaaacc

SEQ ID NO: 41778 - DNA, 50 bp, homo sapien
atagagctcatattcattatgaatcrgataatgaggaagctactttgagc

SEQ ID NO: 41779 - DNA, 50 bp, homo sapien
cttaaaagggaattccccaccaaaaktctgatgcaggcacttagccgacg

SEQ ID NO: 41780 - DNA, 50 bp, homo sapien
tttctgggtcgcatgtccaccttgakaattattcctcggttacaggaaaa

SEQ ID NO: 41781 - DNA, 50 bp, homo sapien
ataatagaaacacttatcagacttaytaagatgacattctaagccctagt

SEQ ID NO: 41782 - DNA, 50 bp, homo sapien
agactgacttgagtaagtgttcaacrgtagtaatgcgatccaggttaaat

SEQ ID NO: 41783 - DNA, 50 bp, homo sapien
ccatttgcctttttctcaatttggakatcacttatttcagaagagtgaaa

SEQ ID NO: 41784 - DNA, 50 bp, homo sapien
gtgtgtgcaatctaatgataaaggarccaaagtcttctagcaggactctc

SEQ ID NO: 41785 - DNA, 50 bp, homo sapien
aggatgcttaatggcaatactcctcraagcatggaccctgaaatcctggg

SEQ ID NO: 41786 - DNA, 50 bp, homo sapien
acaggtttttttccagatagatttakaactgttcctactaagcttgcagt

SEQ ID NO: 41787 - DNA, 50 bp, homo sapien
gtaaacacaggatcagaagcacgaaytggatgttaagaaaataccaaggg

SEQ ID NO: 41788 - DNA, 50 bp, homo sapien
agaaatagtccagaatctatcatccrcaagaggaagtaaatcaaactgtc

SEQ ID NO: 41789 - DNA, 50 bp, homo sapien
acacctgataattagaacatcaagargataattcagtctctgataagctt

SEQ ID NO: 41790 - DNA, 50 bp, homo sapien
ctcagaagtgttaacttgagggtgcratgaaccacttccccttttccaaa

SEQ ID NO: 41791 - DNA, 50 bp, homo sapien
tgtcctgtgcatgcactgcaaaaagrcacctagcaaagggagctaggaag

SEQ ID NO: 41792 - DNA, 50 bp, homo sapien
ttttccaaatcaagcatattaaggawcaaagggctgaatatgagcaccag

SEQ ID NO: 41793 - DNA, 50 bp, homo sapien
tcttgcagcctgtgttgggaggattraataggatgccacacacagggcca

SEQ ID NO: 41794 - DNA, 50 bp, homo sapien
atgtttgtgcttacttttacttctaycttcttctggattatttggtttgg

SEQ ID NO: 41795 - DNA, 50 bp, homo sapien
gatcactactttagaaaaatggagaygtgtacttaagttggtctttaccc

SEQ ID NO: 41796 - DNA, 50 bp, homo sapien
atttataaattcaacttgtgtgaacratgaacaattcaatctgtgtaaaa

SEQ ID NO: 41797 - DNA, 50 bp, homo sapien
attagatatgatctctttcgtgtagragctctctgtacagaggtactgat

SEQ ID NO: 41798 - DNA, 50 bp, homo sapien
aggggtccccaggtggtagaaaaackgttacagccaactcctccatgtgt

SEQ ID NO: 41799 - DNA, 50 bp, homo sapien
ctaccaataattgcacagtgcaatasaataatgctcaaatacattaacat

SEQ ID NO: 41800 - DNA, 50 bp, homo sapien
tccgagcccaggaggacttcttcacsgtcttcagcttggcgggacttgca

SEQ ID NO: 41801 - DNA, 50 bp, homo sapien
ctctcagctcagttttcacagttgtwaaataagattaaacataccatttt

SEQ ID NO: 41802 - DNA, 50 bp, homo sapien
tatattctaccatttatcctaaaaaytatgatctacccaaatattactga

SEQ ID NO: 41803 - DNA, 50 bp, homo sapien
tacagtggaatatcatgcagatatcrgaaaataaaatttagatctgacag

SEQ ID NO: 41804 - DNA, 50 bp, homo sapien
tagcaattattataatcagaaactckattttttgcctatctgctaacttt

SEQ ID NO: 41805 - DNA, 50 bp, homo sapien
atttcatgaagtctccacctcttaaytgcaacactggcagcacctgaact

SEQ ID NO: 41806 - DNA, 50 bp, homo sapien
aaagtagaagaaattcttatttaaartgcaaaagaacacttgacaaaaat

SEQ ID NO: 41807 - DNA, 50 bp, homo sapien
cttggtttataaaatagtataaagaycaaaccaagtaaatgtatccagct

SEQ ID NO: 41808 - DNA, 50 bp, homo sapien
cctagcccctgcgcctgactaccgarggacttatttagataaccaggaag

SEQ ID NO: 41809 - DNA, 50 bp, homo sapien
cttgagcttttactctgttgtctaamtggatcatggagaacaggaggcaa

SEQ ID NO: 41810 - DNA, 50 bp, homo sapien
agtgcatgttaaaagagtcgtaaaakaaattcataacaatttttagattc

SEQ ID NO: 41811 - DNA, 50 bp, homo sapien
tgacctcccagtagaagctctcgaasatattgcagccatcatggggatac

SEQ ID NO: 41812 - DNA, 50 bp, homo sapien
ttcagactgtcatcttacttgactayctttctttgtgcattacttagttt

SEQ ID NO: 41813 - DNA, 50 bp, homo sapien
tttaatgaacaaaatttccatattcrattaactagccacagcacagttaa

SEQ ID NO: 41814 - DNA, 50 bp, homo sapien
cagaagaaaagcaaagttgattttayaccaagacgaaacgagttataaat

SEQ ID NO: 41815 - DNA, 50 bp, homo sapien
aagaggtatagagtgctaagggtgawcctaatctgatctgccggaatcag

SEQ ID NO: 41816 - DNA, 50 bp, homo sapien
tgctgagtcagagggagttagctgamattatagaaaggcaaatgggcagc

SEQ ID NO: 41817 - DNA, 50 bp, homo sapien
ttccttttctcattcagtcagctaaktattcttcatcagtgccttagggg

SEQ ID NO: 41818 - DNA, 50 bp, homo sapien
ttgacagtgtgttagctaacgtttcwcccatttttactgtaatgacgtat

SEQ ID NO: 41819 - DNA, 50 bp, homo sapien
tacacgttactgtttgttcctaaaaygtataaagctctcactctaagcag

SEQ ID NO: 41820 - DNA, 50 bp, homo sapien
tgtagcttcctagacagcttttctayatattacgcccagggaatcttctg

SEQ ID NO: 41821 - DNA, 50 bp, homo sapien
agatttgttatttatttccttaataycctgagtcttcagttatttttata

SEQ ID NO: 41822 - DNA, 50 bp, homo sapien
taaaagacgattgaagctcttagccyaatgatggaagccccagcttgtgg

SEQ ID NO: 41823 - DNA, 50 bp, homo sapien
ggagcgataaactcagataataatcrcattgctaatatgacttatgtaaa

SEQ ID NO: 41824 - DNA, 50 bp, homo sapien
ttgatgtcagggtttgactgctatargtcacacatgtcctggaggctagc

SEQ ID NO: 41825 - DNA, 50 bp, homo sapien
tgctggatggacaagagctgcagccygataaggactaaaaggatgccagc

SEQ ID NO: 41826 - DNA, 50 bp, homo sapien
ttgtcaaccaaagaaacttatctgarcctcgtatttagagtttttattag

SEQ ID NO: 41827 - DNA, 50 bp, homo sapien
aaaaccagctaagactgttcagagaygaaaatagggacataatgagtaat

SEQ ID NO: 41828 - DNA, 50 bp, homo sapien
aaatccttacactgggatttcccgaygtgtgttttatgtgaaaagagtct

SEQ ID NO: 41829 - DNA, 50 bp, homo sapien
atattttaaggttttgactgtcaaayctataataatctaagtcaaaagta

SEQ ID NO: 41830 - DNA, 50 bp, homo sapien
gaaccagtcatgcatgcaaatccackgataatggctgctctgtaacatgc

SEQ ID NO: 41831 - DNA, 50 bp, homo sapien
tattatccatggtttggagattcccrgaagtcttatagtagcagagtaga

SEQ ID NO: 41832 - DNA, 50 bp, homo sapien
actttggtgactgcattttccagaaycagaatttttatgtgctctaagat

SEQ ID NO: 41833 - DNA, 50 bp, homo sapien
caactatataagaattgtatttcatsaagagacttttaaaataatctttc

SEQ ID NO: 41834 - DNA, 50 bp, homo sapien
atcctcaattttttctccttgaatargaaagcagaagtccttggcttagg

SEQ ID NO: 41835 - DNA, 50 bp, homo sapien
gaagcagagagaagaggccaaataayacgttggttcagctcaatccatgc

SEQ ID NO: 41836 - DNA, 50 bp, homo sapien
gtatgtcatttctatgcctttgttayattcttgtgtaatttaaataagat

SEQ ID NO: 41837 - DNA, 50 bp, homo sapien
taaactaaatacatttttgtgctaayatctatattctgtagatttcaaat

SEQ ID NO: 41838 - DNA, 50 bp, homo sapien
taagctttcccataaatgcctggtaraacatggaaattggcttctgcttt

SEQ ID NO: 41839 - DNA, 50 bp, homo sapien
tcagggaacacgtgcattccttaaamctgtatgaaacaattgtacagttt

SEQ ID NO: 41840 - DNA, 50 bp, homo sapien
ttgaaaatggaattgcataaagacayggatcagtagcatggctagttccc

SEQ ID NO: 41841 - DNA, 50 bp, homo sapien
taaaatggcaatataaatagataaartttaaaacagtgttctgagttcaa

SEQ ID NO: 41842 - DNA, 50 bp, homo sapien
aaggacagagcttggtatgtaataarcactaaattgaaatcaggcctatt

SEQ ID NO: 41843 - DNA, 50 bp, homo sapien
ataagtaaaaatcatagaatcgccayattagaagtgatctcaaatataat

SEQ ID NO: 41844 - DNA, 50 bp, homo sapien
tgaccataaaaacactgtgaaagcamctcaagtattgatttgggggattt

SEQ ID NO: 41845 - DNA, 50 bp, homo sapien
gttgtatttcagtgtattggctgatraagaggtcatgcctaagctttgct

SEQ ID NO: 41846 - DNA, 50 bp, homo sapien
agaggcaaaacataggtacataagasagagctaataactaaaggcaatag

SEQ ID NO: 41847 - DNA, 50 bp, homo sapien
aatgaccacttactgaggaccgttcrattctaggcattgtcctatggaca

SEQ ID NO: 41848 - DNA, 50 bp, homo sapien
cagcagagtgtatcttctgggctcartcttcacttttccatcattgtcac

SEQ ID NO: 41849 - DNA, 50 bp, homo sapien
taaagcattatggaaatataatatcyctgtaaaactgtacttatcataag

SEQ ID NO: 41850 - DNA, 50 bp, homo sapien
aggaatgaggtacagtgaaaagttamatggtgttgatttctaacaataga

SEQ ID NO: 41851 - DNA, 50 bp, homo sapien
tatttcttcttctcttcttttaacayggactatatggagccaaaaaagta

SEQ ID NO: 41852 - DNA, 50 bp, homo sapien
ttgaagctgggaatacagtgtgtaaraggaggaaatacctgaggatattt

SEQ ID NO: 41853 - DNA, 50 bp, homo sapien
ctgaagggacagggctcggaagacaygacggagtgaggaaaaacaccttt

SEQ ID NO: 41854 - DNA, 50 bp, homo sapien
taccatggaattccaaggatgatatmagtacagactttacaggcagatta

SEQ ID NO: 41855 - DNA, 50 bp, homo sapien
ccttggaattccatggtaaatcatcsatctttgaaatccgcaaactgtta

SEQ ID NO: 41856 - DNA, 50 bp, homo sapien
ctaatactcagtattatgattatagrcgattttagctttttaagtatttt

SEQ ID NO: 41857 - DNA, 50 bp, homo sapien
ggagaagagagagattaggtaaccayaggtgcaggctgttgctgggtgtg

SEQ ID NO: 41858 - DNA, 50 bp, homo sapien
aaaacttgcttgcaccagagagaacratcctatccagggcccagatggga

SEQ ID NO: 41859 - DNA, 50 bp, homo sapien
atataattaagttgctgaattaaacygtgaactaagccaaaacgttaatt

SEQ ID NO: 41860 - DNA, 50 bp, homo sapien
tgttatatgaaacacatacaagaaayttgaacagaaaaagcacaaatgaa

SEQ ID NO: 41861 - DNA, 50 bp, homo sapien
aatttgtcaggtgcaaagctatcacragaagttattacattctttcagta

SEQ ID NO: 41862 - DNA, 50 bp, homo sapien
agcaggggaccactaggttgcctaaygtgcggtgaaccagcccagtctgg

SEQ ID NO: 41863 - DNA, 50 bp, homo sapien
tgaactgtggtgagatctcacaatgrattattaggcgacagtgaaaatga

SEQ ID NO: 41864 - DNA, 50 bp, homo sapien
tctcataccacttcagtctaagcagracagttagaaatggaacatggaga

SEQ ID NO: 41865 - DNA, 50 bp, homo sapien
gatgttttaagttctaaattgagatkaactggccagttttttgtttataa

SEQ ID NO: 41866 - DNA, 50 bp, homo sapien
gcttctatttacagagtagagcatamatccagacggtatgactttaaaat

SEQ ID NO: 41867 - DNA, 50 bp, homo sapien
ggaagcttttcagatgacttaggaayatccaaagggaggcaccccagggg

SEQ ID NO: 41868 - DNA, 50 bp, homo sapien
gccacacccttttgatctttagaacmaatccatagtccatcttgggaaat

SEQ ID NO: 41869 - DNA, 50 bp, homo sapien
tctctaacccttacgtttatggcaayttcttctacatttcccatgcaagc

SEQ ID NO: 41870 - DNA, 50 bp, homo sapien
gatgagcctggatctccagaagataytaggaatatagagtcagctggtag

SEQ ID NO: 41871 - DNA, 50 bp, homo sapien
acctttctgaattttagtattcttarcaagagcaggtttctgggttattt

SEQ ID NO: 41872 - DNA, 50 bp, homo sapien
ctttagtttgaatatttcttcgatcyatcttctattaattactaactctt

SEQ ID NO: 41873 - DNA, 50 bp, homo sapien
tgagttacaactcttgtctgagataytaaagctcaaatctttagcctgtg

SEQ ID NO: 41874 - DNA, 50 bp, homo sapien
tcatctgcagttgtcatatttgtgamctcgcggcaagtgagatattgcta

SEQ ID NO: 41875 - DNA, 50 bp, homo sapien
catgattgctctcttaggcctgatartaaatagctttgtttttcattgta

SEQ ID NO: 41876 - DNA, 50 bp, homo sapien
ggcattttgctagcccgtgctttacygacaaggtcaaaatcaagataggg

SEQ ID NO: 41877 - DNA, 50 bp, homo sapien
ttataaacaaaactaattggaagaayggtaaagacgctataaaaattcag

SEQ ID NO: 41878 - DNA, 50 bp, homo sapien
tttgatctggaaagcctacttggcaktaatctgaactgttcaggctggaa

SEQ ID NO: 41879 - DNA, 50 bp, homo sapien
gtagttcattaactgaattctagtcracctcatttatcacattccctcaa

SEQ ID NO: 41880 - DNA, 50 bp, homo sapien
ggacgatattaggcactcaattctaratggtgcagttctgtaaaattggt

SEQ ID NO: 41881 - DNA, 50 bp, homo sapien
tgcagtgatctcaggagacttcaggragagtaagaaaaacaacagatggg

SEQ ID NO: 41882 - DNA, 50 bp, homo sapien
aattctattccactcctctccgctarccattttccattagccatttttgc

SEQ ID NO: 41883 - DNA, 50 bp, homo sapien
tggggtcatttgctatcccagtaccrcttagcctaaactgactcattcac

SEQ ID NO: 41884 - DNA, 50 bp, homo sapien
atcaacagtgacaatagcgcaagaawattataaaatcataaaccttgaac

SEQ ID NO: 41885 - DNA, 50 bp, homo sapien
agtaaggcatggaaatatggaagcaygagtgtttaggtaatgtcatcaga

SEQ ID NO: 41886 - DNA, 50 bp, homo sapien
tgagggtgttatcctgaccatacgaygttagctccctgccttccctcaag

SEQ ID NO: 41887 - DNA, 50 bp, homo sapien
gacatctcagttggttcaacttatayaattctgactgaaaaattaatgtt

SEQ ID NO: 41888 - DNA, 50 bp, homo sapien
ctagaagtctacatatttctcacaargattgtaagtttcaattaatgagt

SEQ ID NO: 41889 - DNA, 50 bp, homo sapien
agtcttcacttttccatcattgtcayacactccatcaaagtttaactcct

SEQ ID NO: 41890 - DNA, 50 bp, homo sapien
atacaaagggaaattgagttattgaraaaaatcttgcactctctcaaatt

SEQ ID NO: 41891 - DNA, 50 bp, homo sapien
ccttgggaatgactttgaaaaccacraaattgtcctgtcaaggcagatgc

SEQ ID NO: 41892 - DNA, 50 bp, homo sapien
gtcactttttgactcaaagccatggrcacatctccaaataggatcgagag

SEQ ID NO: 41893 - DNA, 50 bp, homo sapien
tgactccaaacagagaatgagctgamgtgatattaatcagactataattt

SEQ ID NO: 41894 - DNA, 50 bp, homo sapien
cttattttaccttcagtgttactagraatataacaataacctagaaaaag

SEQ ID NO: 41895 - DNA, 50 bp, homo sapien
ttttcctggaaatctatattcctcayctgtgaaatccttgagaagaggac

SEQ ID NO: 41896 - DNA, 50 bp, homo sapien
ccaccaattcccgttggttccgaaarttggaataggtgccaaggatctgg

SEQ ID NO: 41897 - DNA, 50 bp, homo sapien
tccctttggattcttctccttaagcragatcttaggctcctgaagcgagg

SEQ ID NO: 41898 - DNA, 50 bp, homo sapien
tattcttctagttggatttttgttarctactatatgttctgtaccatatt

SEQ ID NO: 41899 - DNA, 50 bp, homo sapien
ctcatactcaactgagacaatccaarcgctttacttattctcaatttaaa

SEQ ID NO: 41900 - DNA, 50 bp, homo sapien
ctgtcgacatatatacccagcggagmaacgagttattatacaacattggt

SEQ ID NO: 41901 - DNA, 50 bp, homo sapien
tttgttgaatgaatgaacaaataaaygtgtaaggaagtcaggcacagcac

SEQ ID NO: 41902 - DNA, 50 bp, homo sapien
ctctaatttcagcaaactgaaaatayggtccactaaccagcagcatcagc

SEQ ID NO: 41903 - DNA, 50 bp, homo sapien
tatattagtaatagagtaacatataraatacaataaagcatacatatgaa

SEQ ID NO: 41904 - DNA, 50 bp, homo sapien
tttgatttagtatgtgtaccagagayatttgctattcactaaacaggcaa

SEQ ID NO: 41905 - DNA, 50 bp, homo sapien
agtgtaaaaacctatgggagtattargttcactgatacaagtatatagtc

SEQ ID NO: 41906 - DNA, 50 bp, homo sapien
cgagataggacacacagcagccataycttacagggacaagttgctccacg

SEQ ID NO: 41907 - DNA, 50 bp, homo sapien
gaggaagaggaatagcaatttaggcrcaagatacgtggagcaacttgtcc

SEQ ID NO: 41908 - DNA, 50 bp, homo sapien
actatcctgttaaattaaactccacrgagctattctccagcattctcaga

SEQ ID NO: 41909 - DNA, 50 bp, homo sapien
acaataatatattacatgacacacartataaatagatgtaaattgtgaca

SEQ ID NO: 41910 - DNA, 50 bp, homo sapien
aataatgatcaatttgggtcttgatkacatctttttttcagtatctaatg

SEQ ID NO: 41911 - DNA, 50 bp, homo sapien
ttctgcagaagaaaattccagaactsagctttatgagaccagggtataaa

SEQ ID NO: 41912 - DNA, 50 bp, homo sapien
atcagttgtcctgaaatgactaaaamtgaatgactaagttatttaaggca

SEQ ID NO: 41913 - DNA, 50 bp, homo sapien
taagtcttatagaaagtatatagacractcatgataatcctggaataaag

SEQ ID NO: 41914 - DNA, 50 bp, homo sapien
ctaagaattctaaaatctcactacaktatttattgatccttcatataatc

SEQ ID NO: 41915 - DNA, 50 bp, homo sapien
atgttagctatctttattaatagcaycgttaccactgtcatcagttattc

SEQ ID NO: 41916 - DNA, 50 bp, homo sapien
agggccacggaatgaaaggagtccaygtccctgaatctccatgtggaaga

SEQ ID NO: 41917 - DNA, 50 bp, homo sapien
attcactgtaatctcctgggattgcyatgaaaaaattggtcaggggcttt

SEQ ID NO: 41918 - DNA, 50 bp, homo sapien
atcttcttaaagcatcggtcagcccrcattattcacctccttaaaaacca

SEQ ID NO: 41919 - DNA, 50 bp, homo sapien
ctaattaatatccacagcatcctgartaatcactgctagtacacctcact

SEQ ID NO: 41920 - DNA, 50 bp, homo sapien
gaaagaagatagtaactttgtgggayagatgtataaattagcttgtatga

SEQ ID NO: 41921 - DNA, 50 bp, homo sapien
gcccagatagctaaatgttctgcacygaagacaggatgttcaccaacatg

SEQ ID NO: 41922 - DNA, 50 bp, homo sapien
tgcccgcctccggtggagagagagayggccaaccgatttcccgttcggtt

SEQ ID NO: 41923 - DNA, 50 bp, homo sapien
aaagagaaccaggcaattttaatccrctaggtcagaactcacatgggtaa

SEQ ID NO: 41924 - DNA, 50 bp, homo sapien
aaagaaattagagatgatacacacayaaaaaaggaaaaacatgccatgat

SEQ ID NO: 41925 - DNA, 50 bp, homo sapien
tattttcataaacattaagttatccrcaatttttatattcaatgtttcat

SEQ ID NO: 41926 - DNA, 50 bp, homo sapien
ttaacaatattcactctttttataartgatcatggcatgtttttcctttt

SEQ ID NO: 41927 - DNA, 50 bp, homo sapien
tgggctttataatcataaaaaaagamgaattggggcttcaaattgagtat

SEQ ID NO: 41928 - DNA, 50 bp, homo sapien
acagttatccaagactcagtgtagawtaaaaaaatatataaaacgtatat

SEQ ID NO: 41929 - DNA, 50 bp, homo sapien
agcaacacccacaatagtgatacacrgatgttaaaaataacgtttaattt

SEQ ID NO: 41930 - DNA, 50 bp, homo sapien
ttttttaaagctttagtaaacaatamaacacctaagaaacaaaagagaat

SEQ ID NO: 41931 - DNA, 50 bp, homo sapien
ggcttatcacacagggtgttgtaaargagtgccgttcttccatttctgag

SEQ ID NO: 41932 - DNA, 50 bp, homo sapien
aaattacaatttaaatgatgctctayctttatttcagtatgcaagttaat

SEQ ID NO: 41933 - DNA, 50 bp, homo sapien
atttgaaaatcttagtcaagcaatastagataaggccatattaaaaacgt

SEQ ID NO: 41934 - DNA, 50 bp, homo sapien
ggaggacctggtctaattcaccctgkatgatcatggaagagaggtctcta

SEQ ID NO: 41935 - DNA, 50 bp, homo sapien
tggcaaggggaagtcattgattcaasaatagctagaaagtggaagaactt

SEQ ID NO: 41936 - DNA, 50 bp, homo sapien
aagaacaaactgacaagaccttccaygacatggttccaagatgcttttca

SEQ ID NO: 41937 - DNA, 50 bp, homo sapien
tccacactatgagatgctttgatggyaagatccatgttttgtgaagacca

SEQ ID NO: 41938 - DNA, 50 bp, homo sapien
aagtgccaccattttctgttcacttyaaaaaactcatatggaaattctgg

SEQ ID NO: 41939 - DNA, 50 bp, homo sapien
agttgtgttgaaaactacgagataawggtagtcaagaaggtatttttatg

SEQ ID NO: 41940 - DNA, 50 bp, homo sapien
atcctgaaggtacacaatttgtcaakttctgagcttttgggaaaaataga

SEQ ID NO: 41941 - DNA, 50 bp, homo sapien
gctttgtatctgaagtgggaagcgtraaaaattggagctgtcagccacca

SEQ ID NO: 41942 - DNA, 50 bp, homo sapien
ctccaaaatagctttaaaatgctaaygagtacaatgattttatataaaat

SEQ ID NO: 41943 - DNA, 50 bp, homo sapien
aacgccaccacagccagcgcctttamcttaagcaccaggtatgttcacag

SEQ ID NO: 41944 - DNA, 50 bp, homo sapien
gtgagagggaaaaatgaggggaatayggaaatgtgtatatacttctaaaa

SEQ ID NO: 41945 - DNA, 50 bp, homo sapien
cagaagagtcagtaatccatccggcraatatttattgagtgacaagtcac

SEQ ID NO: 41946 - DNA, 50 bp, homo sapien
tcagtaaataagctgcttgggcctarcaagtaactggtagtaggactggt

SEQ ID NO: 41947 - DNA, 50 bp, homo sapien
gctgtccagcctgaagatgacaaaartttctcaatgcagccactcagctg

SEQ ID NO: 41948 - DNA, 50 bp, homo sapien
ctccaggccatttgacagactgcaamgtagtaagtacatagcagaatatt

SEQ ID NO: 41949 - DNA, 50 bp, homo sapien
ctgcaacgtagtaagtacatagcagratatttgtaccagttgagcaaagt

SEQ ID NO: 41950 - DNA, 50 bp, homo sapien
gacccccacatctttgaagtgtaaaytaagagctacattttcccttttac

SEQ ID NO: 41951 - DNA, 50 bp, homo sapien
atctgcctactcccttaacgttgaaktagagcagtttcacctgctacaag

SEQ ID NO: 41952 - DNA, 50 bp, homo sapien
tcaccacttcatttggctagttatgrcacaatctctcagaagcttttgtg

SEQ ID NO: 41953 - DNA, 50 bp, homo sapien
gtaggaaggcacgctggatcgtctakctgattccaaagctgtcctttgcc

SEQ ID NO: 41954 - DNA, 50 bp, homo sapien
atttctttccccttctaaatatccayatgtgctaattaattacttttaag

SEQ ID NO: 41955 - DNA, 50 bp, homo sapien
tgttaaagcttcaattgggtcttgaragataggagacatttaaatgagat

SEQ ID NO: 41956 - DNA, 50 bp, homo sapien
attcctttatgtattcagcagattayatccagctagcaagggggctatga

SEQ ID NO: 41957 - DNA, 50 bp, homo sapien
ttcttgagactttgggggccacatarataactgctcattttccccctctg

SEQ ID NO: 41958 - DNA, 50 bp, homo sapien
aggaatgaacaaatttactttcaggsattgcaaagacattacatttggca

SEQ ID NO: 41959 - DNA, 50 bp, homo sapien
tttcttctaagcaattcaagtcgacyctaagatatttcttgagactttgg

SEQ ID NO: 41960 - DNA, 50 bp, homo sapien
attgcaaagacattacatttggcaayttaaaaacaaaagacactttctga

SEQ ID NO: 41961 - DNA, 50 bp, homo sapien
ggaattgtggagacagtcacattccraggaaaaagtcctcaaccaagaag

SEQ ID NO: 41962 - DNA, 50 bp, homo sapien
ttaggagtgcacatttgggtgataayactataaaaacgacaatgaagtca

SEQ ID NO: 41963 - DNA, 50 bp, homo sapien
ataaaggaaatataaggaaaggttaytaaatcctacaacaaatattcact

SEQ ID NO: 41964 - DNA, 50 bp, homo sapien
ccgcaatgctatctctggagaaaacrattacacacacacacatacacaca

SEQ ID NO: 41965 - DNA, 50 bp, homo sapien
aagcttgttcacagcattttcttacscatttacaattgagaactcatttc

SEQ ID NO: 41966 - DNA, 50 bp, homo sapien
acctacttcctccaagttcttaaagmaggttatcgcaaaagactcagcat

SEQ ID NO: 41967 - DNA, 50 bp, homo sapien
tgttgtgaacaggcagctgatctggyagccctcgaatgggaaacaagtgc

SEQ ID NO: 41968 - DNA, 50 bp, homo sapien
tgcctgttcacaacagcacagataartgaagtttgaaattttaatatcag

SEQ ID NO: 41969 - DNA, 50 bp, homo sapien
gtgttatacaaggcatccatggtaargttctaagaagactgttggaggat

SEQ ID NO: 41970 - DNA, 50 bp, homo sapien
aaagctgtatggctgaccagggaacmatgaatagtcaaatgtgatgataa

SEQ ID NO: 41971 - DNA, 50 bp, homo sapien
aacttcttatcttgccttgagggcakaattcggaccacccagcaaaggtt

SEQ ID NO: 41972 - DNA, 50 bp, homo sapien
taacaattaaggaagtcaattcaatsatgaaagaaataatatggattttt

SEQ ID NO: 41973 - DNA, 50 bp, homo sapien
accaagctgtgcagcagagctggtckaacaagaaaactactaccacagtt

SEQ ID NO: 41974 - DNA, 50 bp, homo sapien
attcaatgacaattactcatcaagargcctaaaaacatcttaagctgcaa

SEQ ID NO: 41975 - DNA, 50 bp, homo sapien
ttaaggttgtctctggaaacatacayggagagcttcttgtgccagtcact

SEQ ID NO: 41976 - DNA, 50 bp, homo sapien
ttgctgtggtcaaaatcttgtaacayctagtctaggaaggaaaaaaagac

SEQ ID NO: 41977 - DNA, 50 bp, homo sapien
aatagagataatttctgagtttgtamgattgttgtaagtgctccaacatg

SEQ ID NO: 41978 - DNA, 50 bp, homo sapien
cttttttttgtgtgtagtaactaacratctgagtctaaaattatttgaaa

SEQ ID NO: 41979 - DNA, 50 bp, homo sapien
cagaaagctcttatctgtcctcaccrcgaggctgaatataatttactccc

SEQ ID NO: 41980 - DNA, 50 bp, homo sapien
attcagttgccatgataccatgacawtattgggaatgacagctttgaatg

SEQ ID NO: 41981 - DNA, 50 bp, homo sapien
catccattccctctgtctagtgtcayctgtatttccacactgataattaa

SEQ ID NO: 41982 - DNA, 50 bp, homo sapien
ctaggaataattaaatatcctgcccracataataaagggtggcagagaca

SEQ ID NO: 41983 - DNA, 50 bp, homo sapien
aagacctgggaattttacttgatgayatgatatggacgattacaaaggga

SEQ ID NO: 41984 - DNA, 50 bp, homo sapien
atgcaaagaattgattgaatagacaytagaagagctaaaagtcaagtagg

SEQ ID NO: 41985 - DNA, 50 bp, homo sapien
ttcataaaatgttgtatgcagacacrgtatatttgtcttttttatcatac

SEQ ID NO: 41986 - DNA, 50 bp, homo sapien
catgctgtacaatttgtgtagttaaygcaagggttctgagatgatataca

SEQ ID NO: 41987 - DNA, 50 bp, homo sapien
ttccttctcctttccttatctctaakttaaacatctctatttttcccaaa

SEQ ID NO: 41988 - DNA, 50 bp, homo sapien
ttcaaccacagtatattactgtaggkagtagattgacttgaactgcaagt

SEQ ID NO: 41989 - DNA, 50 bp, homo sapien
tatgttttaggtgtccactagatatraactaggtgttacatatcatcacc

SEQ ID NO: 41990 - DNA, 50 bp, homo sapien
acaaaggcagtagtgaagaatgatgycaagatgtgtcggcttatatgact

SEQ ID NO: 41991 - DNA, 50 bp, homo sapien
cagtttctaagcacaataatagagayaaggagaattcagagatgtcatgt

SEQ ID NO: 41992 - DNA, 50 bp, homo sapien
agaactggagtagggagacagcttaycagaaggaaccatttttcttctgg

SEQ ID NO: 41993 - DNA, 50 bp, homo sapien
gctcattaaataagagcgccgattcyaacgccctgactggtttccagccc

SEQ ID NO: 41994 - DNA, 50 bp, homo sapien
actaagacagtggcttaacccatctraattattatccataaaatgatcat

SEQ ID NO: 41995 - DNA, 50 bp, homo sapien
tttgaagccagataatctgtactcawagatcagtaataccattatttgta

SEQ ID NO: 41996 - DNA, 50 bp, homo sapien
tctaacagtttcattcatgtctaaayctacattcaatagcttcatttgtg

SEQ ID NO: 41997 - DNA, 50 bp, homo sapien
acaccagtgggctctaggaatgaacratcatttatagcagcatcagctct

SEQ ID NO: 41998 - DNA, 50 bp, homo sapien
catgcccaagaaagcaattagcaaartagaattagcttagtacatcactg

SEQ ID NO: 41999 - DNA, 50 bp, homo sapien
gcatcatctcgatgaaggattgtcargattcttaaagctgaacatgtgct

SEQ ID NO: 42000 - DNA, 50 bp, homo sapien
tgaaacatgcgaattacatgtaagckgctctaaattttgttgtccttcta

SEQ ID NO: 42001 - DNA, 50 bp, homo sapien
ggcaatgttttaagacactgattccygataaaaccaccaggacttatgtg

SEQ ID NO: 42002 - DNA, 50 bp, homo sapien
tcctctgattgccttttagcaagacratgactgtgcataggagataacac

SEQ ID NO: 42003 - DNA, 50 bp, homo sapien
catggagaaagtcatattttgaaaargtaacccagccatgatattttagt

SEQ ID NO: 42004 - DNA, 50 bp, homo sapien
gtttttctatatttttgatgttttckaagtgaaatatatattacctaggt

SEQ ID NO: 42005 - DNA, 50 bp, homo sapien
gttttatagatgtatacatatgccasaacgtatcacactgtacactctat

SEQ ID NO: 42006 - DNA, 50 bp, homo sapien
cccaaaattgggtcaaatgtaattayggtaaaaagaggtccaaaaagtta

SEQ ID NO: 42007 - DNA, 50 bp, homo sapien
aagcgttaccacaatactcaatttakaaccacacttcagtaagggcccat

SEQ ID NO: 42008 - DNA, 50 bp, homo sapien
tcataattggctactttctaatgtcscaaacggattatgttattgagaaa

SEQ ID NO: 42009 - DNA, 50 bp, homo sapien
tgttgtaagcatccaagtagagataygagtaggcaattgggtatatgagt

SEQ ID NO: 42010 - DNA, 50 bp, homo sapien
gtaaagccctgatgtgtatatagaawttccctaaagtatttggtgataga

SEQ ID NO: 42011 - DNA, 50 bp, homo sapien
ggttgtcattggcatccgtaacctcratgtagacttcagttacagaagag

SEQ ID NO: 42012 - DNA, 50 bp, homo sapien
ttgctgtcacaagggatcatttacaragcaactcaaaacactttcaggca

SEQ ID NO: 42013 - DNA, 50 bp, homo sapien
ctttattctctttgtatttacaatarctctcctatagtcttctgcgtacc

SEQ ID NO: 42014 - DNA, 50 bp, homo sapien
tatcatcccattttatttttcttgasgtttctaatctaaagcatgcttct

SEQ ID NO: 42015 - DNA, 50 bp, homo sapien
tgtgtttctgagttaagatgtttaargtatattcatccttgttggacgat

SEQ ID NO: 42016 - DNA, 50 bp, homo sapien
tcaggtcatctactcaactggataartgattgtggccaagtaatagtgca

SEQ ID NO: 42017 - DNA, 50 bp, homo sapien
aaacagtcagaaccatggattattaygaaaacatactagtgaggaatcag

SEQ ID NO: 42018 - DNA, 50 bp, homo sapien
taaatataaaagctacttttaaacartcagaaccatggattattacgaaa

SEQ ID NO: 42019 - DNA, 50 bp, homo sapien
gccccataggctgaaccgattttcartcctgatcaaagctagagatttca

SEQ ID NO: 42020 - DNA, 50 bp, homo sapien
atcagcataatgtcatcaatgtaacrgaccagtttgatatcttggggaag

SEQ ID NO: 42021 - DNA, 50 bp, homo sapien
cccttaagagaattttgttgctcaayctgcctaaagtttaataccattct

SEQ ID NO: 42022 - DNA, 50 bp, homo sapien
cctggattccacggttctaacactaygtgattctaatgttttacagcatg

SEQ ID NO: 42023 - DNA, 50 bp, homo sapien
tgatctaaggtctttacctagaatgragttttgcctctctaatggagaaa

SEQ ID NO: 42024 - DNA, 50 bp, homo sapien
accatgttaagtgttccttatgcatkacttcacaacatcccagtagtaat

SEQ ID NO: 42025 - DNA, 50 bp, homo sapien
tagtccatttttctcattttgtcaaygcaaatctaagattcggaaagagt

SEQ ID NO: 42026 - DNA, 50 bp, homo sapien
gaggttcaatcaggcaatcagacagwcctaacaacgtggctcaagagaga

SEQ ID NO: 42027 - DNA, 50 bp, homo sapien
gtggtcaagtaaagtggaaatgctayatgtaactttggagacagacttgg

SEQ ID NO: 42028 - DNA, 50 bp, homo sapien
tccatttcatctgggttatccaataygttggcaaataattgttcacaata

SEQ ID NO: 42029 - DNA, 32 bp, homo sapien
ccttcacagctgcccartagacatcctgatca

SEQ ID NO: 42030 - DNA, 50 bp, homo sapien
gacaaggcgtggccctgtagataagkatgaatttcggtaaagcccatgcc

SEQ ID NO: 42031 - DNA, 50 bp, homo sapien
agtttttccatgggaaatttatcctyagactagtttggggccatagtggg

SEQ ID NO: 42032 - DNA, 50 bp, homo sapien
agaaatacttctaacagtggcttaaygcaaaggcctcagaggcagtgaga

SEQ ID NO: 42033 - DNA, 50 bp, homo sapien
aaatcacctgagttgcaaaaacatcrcttgtataaaagagttgcaccata

SEQ ID NO: 42034 - DNA, 50 bp, homo sapien
gtccgctaacctcctctgggacaccwcctctagtcattggaatgcatccc

SEQ ID NO: 42035 - DNA, 50 bp, homo sapien
aaactgaagctgagaattattgacawgatattggcccattaaagtttttc

SEQ ID NO: 42036 - DNA, 50 bp, homo sapien
cagggaaaaatattaccagttactayccatattagagacagaatgatgat

SEQ ID NO: 42037 - DNA, 50 bp, homo sapien
gttttcctctttttgtattagtgaaktgatggcttttaaatatattaata

SEQ ID NO: 42038 - DNA, 50 bp, homo sapien
ttgctagccattgctgacaatagaaygaaggaacaatcagggtctcaaaa

SEQ ID NO: 42039 - DNA, 50 bp, homo sapien
ttcaagcttggacaagaaagtgtacygccctcagtcttattttactcatc

SEQ ID NO: 42040 - DNA, 50 bp, homo sapien
tcctccctttactgaaaattacagaraattaaagacctactgtaggcaaa

SEQ ID NO: 42041 - DNA, 50 bp, homo sapien
ctgaaaactgaatgacaagaaggaaytattcatgtgagaatcttaaggga

SEQ ID NO: 42042 - DNA, 50 bp, homo sapien
acatatcatctctaaatcattcagawccctgagaacagtgagtcctcgac

SEQ ID NO: 42043 - DNA, 50 bp, homo sapien
tgatgctactcgactgcaggttccaytgaagcatatgaattcagatgagt

SEQ ID NO: 42044 - DNA, 50 bp, homo sapien
ctattagaatggcccagatccagaasgctgacagcaccaagtgctggtga

SEQ ID NO: 42045 - DNA, 50 bp, homo sapien
aaattgatgggcagttggtaaaatargtgtgaatgagagaaagctttgtt

SEQ ID NO: 42046 - DNA, 50 bp, homo sapien
ttaaattttttagtattttaataacrgcattttcctcccagcccagtttt

SEQ ID NO: 42047 - DNA, 50 bp, homo sapien
gtatgagaaacagtcttcacacctcygagactcaacataggcacccaatc

SEQ ID NO: 42048 - DNA, 50 bp, homo sapien
tacatgtgtcacatctgatcatgackcaatctgtcaaaacataaatttta

SEQ ID NO: 42049 - DNA, 50 bp, homo sapien
caataaatttaatatgttccagatayagtgtgctgactgtactattgagt

SEQ ID NO: 42050 - DNA, 50 bp, homo sapien
taagaagatccaagacagtaaaagayataaattgccaacttctaaactga

SEQ ID NO: 42051 - DNA, 50 bp, homo sapien
tgcctttctaatgatgccacatcacmatgtcttaattaacaaacatacag

SEQ ID NO: 42052 - DNA, 50 bp, homo sapien
gaacagagcttttcagattagaacayagtgagtctagggttgaatcctat

SEQ ID NO: 42053 - DNA, 50 bp, homo sapien
cggagacctgtatataaatctgtcaygcaatgctgtaattgtttttaatc

SEQ ID NO: 42054 - DNA, 50 bp, homo sapien
tgtcatcaccaagcaatcagtccaartgggatctggatcaataattagag

SEQ ID NO: 42055 - DNA, 50 bp, homo sapien
acatcaactagcaagaaaagagggaygagaacccaggccagattggtttc

SEQ ID NO: 42056 - DNA, 50 bp, homo sapien
gtgtgaagattctctatgaatttaarggtttctagttgaacaaagctgaa

SEQ ID NO: 42057 - DNA, 50 bp, homo sapien
aatggagtgacactctcacttaatasaaaatgaggtaaatcacctaaagg

SEQ ID NO: 42058 - DNA, 50 bp, homo sapien
tttcttacattctttcatttaaaacyacagtgaccttttgaggtaggtgt

SEQ ID NO: 42059 - DNA, 50 bp, homo sapien
tgagattttagtggtattaaatgccmgaaaggtcttcctgctttttaacc

SEQ ID NO: 42060 - DNA, 50 bp, homo sapien
ctcaaagcaggtacccatcaaatcaygttaaaatatttcacagtgaagaa

SEQ ID NO: 42061 - DNA, 50 bp, homo sapien
aggagcagccaggggagtaggagaasgcaaaggcctcagtcaagaaagga

SEQ ID NO: 42062 - DNA, 50 bp, homo sapien
tattataattcttgtaggcaaatgayaccggaataaggggcaacttcttg

SEQ ID NO: 42063 - DNA, 50 bp, homo sapien
gattatttttctggcaagttaatcayagcataatggtcaagagcacaaaa

SEQ ID NO: 42064 - DNA, 50 bp, homo sapien
ttaaagccatagattttattccagawaggagaaagtacatggcattaata

SEQ ID NO: 42065 - DNA, 50 bp, homo sapien
gataccaaaatagcttttaggaagaygacagcttaatagtctcttaaatt

SEQ ID NO: 42066 - DNA, 50 bp, homo sapien
gatggatgatcaaattacaagttacmatgcaaatagtagctccctcattc

SEQ ID NO: 42067 - DNA, 50 bp, homo sapien
tagattagtataaagactgtttctaygtaatcttctttggggcaggagtc

SEQ ID NO: 42068 - DNA, 50 bp, homo sapien
aacctcacttacagaatgtgaaatasatcaatggaatttgggtttaagta

SEQ ID NO: 42069 - DNA, 50 bp, homo sapien
gggaaggattaatgtatgaccatcayagggcactgaatgcattgcccagc

SEQ ID NO: 42070 - DNA, 50 bp, homo sapien
attctctgcttccacactgagtcccrcgtgtctttgccagctactgaagc

SEQ ID NO: 42071 - DNA, 50 bp, homo sapien
acacgtaaaactaaccattataataycacaggatgacagccatcaaagag

SEQ ID NO: 42072 - DNA, 50 bp, homo sapien
ccaaacacttgggaccttgtaataaygactttgtgttaatttgacatttt

SEQ ID NO: 42073 - DNA, 50 bp, homo sapien
aaaggttgcaaaattgagggagaacracagttatgatagttcagtataac

SEQ ID NO: 42074 - DNA, 50 bp, homo sapien
tttatagctgaaaatcaagttctccrgaaatgctttacaagcttccacct

SEQ ID NO: 42075 - DNA, 50 bp, homo sapien
tttcacagagctggaattttacatamgccaattgagacacacttctatca

SEQ ID NO: 42076 - DNA, 50 bp, homo sapien
atgcagaaataagaactgagtcattraagatgatagcatggatagtttta

SEQ ID NO: 42077 - DNA, 50 bp, homo sapien
gctgtaatgcaactttgctgactagraattggtttactctttcatgtctg

SEQ ID NO: 42078 - DNA, 50 bp, homo sapien
atcacaatcttctttgtagttttacrgagacttttccagaaaatctgctt

SEQ ID NO: 42079 - DNA, 50 bp, homo sapien
aggcggaaaacataaatgaacaaatragccggtgagagaacacctttccc

SEQ ID NO: 42080 - DNA, 50 bp, homo sapien
aaagcaaagctctgataaatacagamgatgtttctccaggtgccagaaga

SEQ ID NO: 42081 - DNA, 50 bp, homo sapien
gccagtgaatatcaagtgctcacctraacctgagagtctcagaattaaat

SEQ ID NO: 42082 - DNA, 50 bp, homo sapien
ttgtgtactaaaaccaaatttgatcycttgagtaagtggtgctgtaaact

SEQ ID NO: 42083 - DNA, 50 bp, homo sapien
agtgtaaatttcacagtctcaacaamaggaagacttaagatgaaatgtga

SEQ ID NO: 42084 - DNA, 50 bp, homo sapien
ctacctaccagaacttctgtaagaaygggctgatggaacacatgagacca

SEQ ID NO: 42085 - DNA, 50 bp, homo sapien
aaaaatcagtgagaactcactattargacagttgcttacctacgtcctcc

SEQ ID NO: 42086 - DNA, 50 bp, homo sapien
cattggttatcatatacacattacasaatgcgaaactgacactagtcttt

SEQ ID NO: 42087 - DNA, 50 bp, homo sapien
gaaagaaaaacccagtggaatcgccratgtttagatggcctttcccagga

SEQ ID NO: 42088 - DNA, 50 bp, homo sapien
tggcttcaaatatcgtttctaactasgtatgtgagatcgagcaagtttaa

SEQ ID NO: 42089 - DNA, 50 bp, homo sapien
ctctataactagtgttcagatacaargaaggcactaaatagatgcttatt

SEQ ID NO: 42090 - DNA, 50 bp, homo sapien
gcatttgagattctggaaataattcrccatagctggaatctatagcgcag

SEQ ID NO: 42091 - DNA, 50 bp, homo sapien
aacttggcaaaccctatcagacgacyatgcctgggaattcagtctaaacc

SEQ ID NO: 42092 - DNA, 50 bp, homo sapien
ggaaaatccactggataattcaggargactaccagaaaccaaatcacccg

SEQ ID NO: 42093 - DNA, 50 bp, homo sapien
tggtctacactagagttgatgtcacygagagttaggaaaccgtagaaagg

SEQ ID NO: 42094 - DNA, 50 bp, homo sapien
tgttgaatatgtaatttgagattatraaatcataccacattctaccaaaa

SEQ ID NO: 42095 - DNA, 50 bp, homo sapien
tgttaaggacaacaccataaggtggmaagtttgtaaaaatgagctttggg

SEQ ID NO: 42096 - DNA, 50 bp, homo sapien
gtatttcttcatagcagtatgagaasggactaacacagtacattggtacc

SEQ ID NO: 42097 - DNA, 50 bp, homo sapien
gtgctattacataaaacagtagttcratagagaaaaactgagaaactgac

SEQ ID NO: 42098 - DNA, 50 bp, homo sapien
ctcatgggggttccagtctagtgggyaaggccaattttctacaagtattg

SEQ ID NO: 42099 - DNA, 50 bp, homo sapien
agtcaggataaatcagtcctgatatsaacctactgactcattgtttcatc

SEQ ID NO: 42100 - DNA, 50 bp, homo sapien
ctcttacaagactcactgcaatttaraaaggaattcttggtgggtacaat

SEQ ID NO: 42101 - DNA, 50 bp, homo sapien
ctataggtactcctcgttcattaaakgtagtgaggtatggaaggaaccat

SEQ ID NO: 42102 - DNA, 50 bp, homo sapien
actagtcagaacaaacttagaaaacratatgtggacaacccacaagatat

SEQ ID NO: 42103 - DNA, 50 bp, homo sapien
taaatttcactggattaacacgtccratcaattctcattaatcacaacag

SEQ ID NO: 42104 - DNA, 50 bp, homo sapien
attctttctttggaacatgtctagayggaggatcacaaacgatgacccat

SEQ ID NO: 42105 - DNA, 50 bp, homo sapien
caaagaacacacatagtccactctayacaataaaatattcaataataaca

SEQ ID NO: 42106 - DNA, 50 bp, homo sapien
tttttgtgtgtatttttaaaaattawgtattcacaaaatccaatagaaga

SEQ ID NO: 42107 - DNA, 50 bp, homo sapien
taagtaaaagctttacaatatgataygtattttttcgatatgtgaagtac

SEQ ID NO: 42108 - DNA, 50 bp, homo sapien
ataaacaggtgctgataatgagaagsaattgaagaaaaataacagtagga

SEQ ID NO: 42109 - DNA, 50 bp, homo sapien
aaatcttttgacgaaattgatcaagractgcaatgggtcatcaccacact

SEQ ID NO: 42110 - DNA, 50 bp, homo sapien
ctggcatgaaaactctgccctaacartgagctaaggcaagtaggtcccca

SEQ ID NO: 42111 - DNA, 50 bp, homo sapien
atgtaaataactggtgaatcttggamaaggatcttcaaaagtttctttta

SEQ ID NO: 42112 - DNA, 50 bp, homo sapien
gtacagaaaaagaagaagtcgaaaaygtaattggattggtaagtgttccc

SEQ ID NO: 42113 - DNA, 50 bp, homo sapien
ctacaattagtcaataatgtcacaaraaggtaaggcctggtgctttcatt

SEQ ID NO: 42114 - DNA, 50 bp, homo sapien
gggattttgaatttttgggatttcartattcaagattgcggagttcagga

SEQ ID NO: 42115 - DNA, 50 bp, homo sapien
ttcagaaagagacagaattctggacrgcaagagacataattcaaattcca

SEQ ID NO: 42116 - DNA, 50 bp, homo sapien
agctcttaactcttaggctctaatarcagcaagcactgggtaggaacctt

SEQ ID NO: 42117 - DNA, 50 bp, homo sapien
aaagctctatgtcaacaatttattasggtaccaagttctaaaactttcta

SEQ ID NO: 42118 - DNA, 50 bp, homo sapien
caaaagccatagagtagcaagaaccwggtgcaggagtctcaacatcgaga

SEQ ID NO: 42119 - DNA, 50 bp, homo sapien
gagaagtggaatcgagagatgtttawgtctaaggctccctgagaagaacc

SEQ ID NO: 42120 - DNA, 50 bp, homo sapien
acattggtgtgtgatattctgaaaamaaatctctgacaaaaccatcacag

SEQ ID NO: 42121 - DNA, 50 bp, homo sapien
aagtacagagacttaagaattgaaaycctgatctgcttggtgtcaaaagc

SEQ ID NO: 42122 - DNA, 50 bp, homo sapien
ttcgtgatagaagaaagccctgagawaagtatcaatggattggtagtttg

SEQ ID NO: 42123 - DNA, 50 bp, homo sapien
gactttggagatgtcagattgccaaragaggagagggaactgctttttac

SEQ ID NO: 42124 - DNA, 50 bp, homo sapien
ttatttaaagggcatgagatttatgyaggaccaatggaaaatattcactc

SEQ ID NO: 42125 - DNA, 50 bp, homo sapien
agcaaactaagaaaataatcacccamacaagaaagtaagaaaccctaaat

SEQ ID NO: 42126 - DNA, 50 bp, homo sapien
cacctgaagagaaatgccaggtgagraacccttgactcatttcaaagttc

SEQ ID NO: 42127 - DNA, 50 bp, homo sapien
gagcaattaagcttgagggaaaatgsaaactatacatacaaccacagtga

SEQ ID NO: 42128 - DNA, 50 bp, homo sapien
aaattggaacaaaaaagggacagtcrctcagtcatctctaattaattctt

SEQ ID NO: 42129 - DNA, 50 bp, homo sapien
tgatcctgttataaaaattgtaaaarcatgataacaggcagatgtattga

SEQ ID NO: 42130 - DNA, 50 bp, homo sapien
ggagaaatagattgcaatacaacaayagtagaggacttcaataccccaat

SEQ ID NO: 42131 - DNA, 50 bp, homo sapien
tgcttttcgctttgcagcatttgtcrctacctatggtacatagtttatca

SEQ ID NO: 42132 - DNA, 50 bp, homo sapien
tatgataagcttaactatctgaaccyggggtaaaaggctaataaccagca

SEQ ID NO: 42133 - DNA, 50 bp, homo sapien
atacccctctccatttcctctactckaaagacatttagttactcaggcag

SEQ ID NO: 42134 - DNA, 50 bp, homo sapien
gagaaaatacattacaataacatacrcttagatgaaactaccacaaatac

SEQ ID NO: 42135 - DNA, 50 bp, homo sapien
atagcattacaaacatgttaaagggrataaatgtgtactgatcttccttg

SEQ ID NO: 42136 - DNA, 50 bp, homo sapien
gagtgaggcttatgctgggagttgckatggtctgtaaatgtgaggataag

SEQ ID NO: 42137 - DNA, 50 bp, homo sapien
ggtagctgcctgaaagtttgttagcygagttttgaagatcaagctgtagc

SEQ ID NO: 42138 - DNA, 50 bp, homo sapien
aaatctaattttcaggatatgctcaygcaaaactgattgaaataacaaaa

SEQ ID NO: 42139 - DNA, 50 bp, homo sapien
tctttaattcccacaagttgttgaartatgtatggttttatccttatttt

SEQ ID NO: 42140 - DNA, 50 bp, homo sapien
tgatcagaaaaacaccctgtgagcakattttaatcaaagccctaaatatg

SEQ ID NO: 42141 - DNA, 50 bp, homo sapien
ttaaataccaaaacaccgtctagtcyataggctggcaaagtacacctgtt

SEQ ID NO: 42142 - DNA, 50 bp, homo sapien
gtttttattctctagctggcaactarccctttgctcttggttgaattcag

SEQ ID NO: 42143 - DNA, 50 bp, homo sapien
agcattaaagaagaaagattactccrgacttataactatataagagcact

SEQ ID NO: 42144 - DNA, 50 bp, homo sapien
acagactcagggaaagctatctaagkagtcatatctgatttgaaccttaa

SEQ ID NO: 42145 - DNA, 50 bp, homo sapien
gtagtgggatattaaatgtgcttgastattgatttgagggaactcttgtc

SEQ ID NO: 42146 - DNA, 50 bp, homo sapien
taaacatatctttttcccttcaaagrctaccctgggctaccatatagtta

SEQ ID NO: 42147 - DNA, 50 bp, homo sapien
aaatattacatcacctccaagtcgcrctattcataccataaagctataaa

SEQ ID NO: 42148 - DNA, 50 bp, homo sapien
gagctttttgttatgtagtaagaatratactccaaaatgatggttatggt

SEQ ID NO: 42149 - DNA, 50 bp, homo sapien
aaggaggaaatcaaatcatgctacartgaaaattaggtcgctttcaagag

SEQ ID NO: 42150 - DNA, 50 bp, homo sapien
gcggtggatgactaacaatagtcacragaagtagcataggttaccactca

SEQ ID NO: 42151 - DNA, 50 bp, homo sapien
tcttccaaacaactataatatggtcygacaaatgcttttccagaagtaca

SEQ ID NO: 42152 - DNA, 50 bp, homo sapien
gctaacaatgaaggtggtactgacayataattaaacagttgtcaaagggg

SEQ ID NO: 42153 - DNA, 50 bp, homo sapien
aggccttgattccggtcattgaacayactttattcatttctgtgtctggc

SEQ ID NO: 42154 - DNA, 50 bp, homo sapien
atgaaatgaaattggctggaaacccraacaccttatcacatatttccaca

SEQ ID NO: 42155 - DNA, 50 bp, homo sapien
gacatcaaaacctagtctttaaaaawtcaccttccatatctttgggaata

SEQ ID NO: 42156 - DNA, 50 bp, homo sapien
ttagaagagaaagtgtgtgataatgyactccaaacagaagaaggagagtc

SEQ ID NO: 42157 - DNA, 50 bp, homo sapien
gctaggtttatccttggactctttgratacgtaagccattaagtagtctt

SEQ ID NO: 42158 - DNA, 50 bp, homo sapien
gaaaaactagatcaatactggaaaaygttagaatatacaagtaaagtctc

SEQ ID NO: 42159 - DNA, 50 bp, homo sapien
ttagcctcttatttgctagctgaaartcttttaggagaattagactagaa

SEQ ID NO: 42160 - DNA, 50 bp, homo sapien
atctctttacttcagtgacaaattayctttcctctgaaagtctaaagctt

SEQ ID NO: 42161 - DNA, 50 bp, homo sapien
gtagaaaaggtggaattgagcctacrcttgttattatctaacttgattct

SEQ ID NO: 42162 - DNA, 50 bp, homo sapien
cctaagtaggagccaatgaagaagcracacacatgtacttgagtctccac

SEQ ID NO: 42163 - DNA, 50 bp, homo sapien
ttgagaacaggtctaagataccggayaaagggtattgtggcaaaagtaac

SEQ ID NO: 42164 - DNA, 50 bp, homo sapien
aggaatcatcaaaagaagacccataycaattttagaagcgttaagtataa

SEQ ID NO: 42165 - DNA, 50 bp, homo sapien
gatcaagagtgatacactattatgcrctacttcctgttacctcctatgtg

SEQ ID NO: 42166 - DNA, 50 bp, homo sapien
acacacacacacacaaagaatgtcaygtgaaggtgaaggctgagtgtggg

SEQ ID NO: 42167 - DNA, 50 bp, homo sapien
taaacttttttcttcagaagccaaaytaacttgcagaataatagagccac

SEQ ID NO: 42168 - DNA, 50 bp, homo sapien
tattcttttaaggatctgagactctmaaaggtgccacagcgtttgacctt

SEQ ID NO: 42169 - DNA, 50 bp, homo sapien
catttttaaggttctcatacctttcrccaaactgctattcagagatgtgg

SEQ ID NO: 42170 - DNA, 50 bp, homo sapien
aataaaaataatgccggacattgaaygggtattttttatttgccagggga

SEQ ID NO: 42171 - DNA, 50 bp, homo sapien
ctcttttccctccattttgctaccamtgaagaatggaccacttttgcttc

SEQ ID NO: 42172 - DNA, 50 bp, homo sapien
caatttacacaatatccaaggtcaayagcaatcaatagcatggagtaata

SEQ ID NO: 42173 - DNA, 50 bp, homo sapien
aaatttcaaaaggatgaaggaggtarattatgacattctaggtccctgac

SEQ ID NO: 42174 - DNA, 50 bp, homo sapien
gaggtgacgtcttatggttatcagcmctgtacttctgggttgcacatgtg

SEQ ID NO: 42175 - DNA, 50 bp, homo sapien
ctggtacatggtagtcatcccacaartggtttaaaatatttaaaaataga

SEQ ID NO: 42176 - DNA, 50 bp, homo sapien
aagaaatctaaggaaatttcagagawtcagagtttcaaaaggttaggtag

SEQ ID NO: 42177 - DNA, 50 bp, homo sapien
ttcacagaggatcctggtatgagtcycaattgtgtcaactaaatgctcta

SEQ ID NO: 42178 - DNA, 50 bp, homo sapien
aatcataggggatttctacctgagargaaagttgattgttgggtccctca

SEQ ID NO: 42179 - DNA, 50 bp, homo sapien
attgtttggaacctctaggatgaaartaaagtttgagaatagcctttagt

SEQ ID NO: 42180 - DNA, 50 bp, homo sapien
actgaaggctttggtgatgcagtgaygggaacaggaggagtgtttgagaa

SEQ ID NO: 42181 - DNA, 50 bp, homo sapien
ggatcagaagacagtaaaatgagccrcttatagggataggcaatcaaaag

SEQ ID NO: 42182 - DNA, 50 bp, homo sapien
ttcaaacctgccttgagaaatttcarggactcccttatgaagaaagcttt

SEQ ID NO: 42183 - DNA, 50 bp, homo sapien
ccaatttgaatattagaccaattcaytattcatagaaatcccagaagata

SEQ ID NO: 42184 - DNA, 50 bp, homo sapien
ctggcccagcagcttaggattgtaargagtagagattctcttgactttcc

SEQ ID NO: 42185 - DNA, 50 bp, homo sapien
taaggtatttgggttctccagagacrgatactgaacttatcagtgatctc

SEQ ID NO: 42186 - DNA, 50 bp, homo sapien
tcttaggggatgactccatctctgarcaagtttggatagaacttggtgga

SEQ ID NO: 42187 - DNA, 50 bp, homo sapien
actagacagatgtgtgttaagaaaargtagagataaatgtatcagcttgc

SEQ ID NO: 42188 - DNA, 50 bp, homo sapien
agtatgaccagtccacaagttccaamaatgtagcagtgcaacaaaaccta

SEQ ID NO: 42189 - DNA, 50 bp, homo sapien
ttctggagaatatcactgatctgcartatttttattatatggtttaaagt

SEQ ID NO: 42190 - DNA, 50 bp, homo sapien
atcttgaactggaaataagggaacaytaaagattggcaagagattactga

SEQ ID NO: 42191 - DNA, 50 bp, homo sapien
agtagatgcctgtttggataattaaygacactttcagtttgggcaaatca

SEQ ID NO: 42192 - DNA, 50 bp, homo sapien
aagcctgggtttagggctcatttgascaagagaatgaataagtagtgcat

SEQ ID NO: 42193 - DNA, 50 bp, homo sapien
acacatcagagattatctcattaatkaagtaaccggaaggacgatcaagc

SEQ ID NO: 42194 - DNA, 50 bp, homo sapien
tgcactgtttcatgtgggaaaaataygtacctatgttgaagcttccataa

SEQ ID NO: 42195 - DNA, 50 bp, homo sapien
agtcaaaccaagtattcattaccaayagcagagaacaatagtactttcat

SEQ ID NO: 42196 - DNA, 50 bp, homo sapien
gacaaaggagcagggattttttttargttgattcctgtatttatgtaact

SEQ ID NO: 42197 - DNA, 50 bp, homo sapien
ccctattgcaggcccattagaaaagmatttgcactaagaaactgtggtct

SEQ ID NO: 42198 - DNA, 50 bp, homo sapien
tttagattgagatggggtcagaaaargtcttttgagtctctgaaatctta

SEQ ID NO: 42199 - DNA, 50 bp, homo sapien
aaaggaaggaagagaagaagagggamtaagccagccagccaggtagccaa

SEQ ID NO: 42200 - DNA, 50 bp, homo sapien
gggggctcatgccctctgagtagaaygtggtgacctccaggagcggtggg

SEQ ID NO: 42201 - DNA, 50 bp, homo sapien
agaacagcagaaatacgacaagagasaagtgcagtagagtgtgcctaatt

SEQ ID NO: 42202 - DNA, 50 bp, homo sapien
aaacaacttttatctgtaagatacargtaatccatgctcaaaagaactct

SEQ ID NO: 42203 - DNA, 50 bp, homo sapien
taagactaaagtattatcttcatccrcatgatcttggataaatagcatat

SEQ ID NO: 42204 - DNA, 50 bp, homo sapien
gactccctcaattagacaaataaacraaagatgtcaagaatcttaaagga

SEQ ID NO: 42205 - DNA, 50 bp, homo sapien
gtttaaggccaaagcagtaagattcraaggactgggttgatgcatccaag

SEQ ID NO: 42206 - DNA, 50 bp, homo sapien
aacattgagaaactatggttaattamattatctgattagctaaatattaa

SEQ ID NO: 42207 - DNA, 50 bp, homo sapien
aagtgcttttcgctttagaagtaatsagttgtcatgtgagaacaagtgaa

SEQ ID NO: 42208 - DNA, 50 bp, homo sapien
ctgaaaacagccttgaaatattggcyaagagggtacataatctttcatct

SEQ ID NO: 42209 - DNA, 50 bp, homo sapien
cttatcataaaagttaattgaatccyaagactaacagtggcacaatatgc

SEQ ID NO: 42210 - DNA, 50 bp, homo sapien
tgcacactgactcaaaattacaccgracaactaaaacagatttattgttc

SEQ ID NO: 42211 - DNA, 50 bp, homo sapien
ttaactgaattttataagcatccacygtaatatcagatatttcacatgtg

SEQ ID NO: 42212 - DNA, 50 bp, homo sapien
tgttttttgttgttgtcattgttaastgaaaaatgataaaacaagcccaa

SEQ ID NO: 42213 - DNA, 50 bp, homo sapien
cctcagctattctgatattatcaacyacagactactcacaactgcccatt

SEQ ID NO: 42214 - DNA, 50 bp, homo sapien
acattctaatattgcatagccatgaragctgggaaaatgctgctgtttta

SEQ ID NO: 42215 - DNA, 50 bp, homo sapien
tttgttttagctctttctcctgcaaygttttatgaactctaataaaagta

SEQ ID NO: 42216 - DNA, 50 bp, homo sapien
ttgatgtttattgctgtcatgtcaaycaatcattttttgcagaaaattaa

SEQ ID NO: 42217 - DNA, 50 bp, homo sapien
tcctgtgccccagttgcttcctctcractatgccttctgatcaattatgt

SEQ ID NO: 42218 - DNA, 50 bp, homo sapien
tataacagcagttgccgagatctacraaatataattagaagagcccccaa

SEQ ID NO: 42219 - DNA, 50 bp, homo sapien
agccaaagaaaatatgggttagtgasagtggaagtcttattagctgatta

SEQ ID NO: 42220 - DNA, 50 bp, homo sapien
tagttcattctattaaaaaggactcycaaattcattgtcccaagcattgc

SEQ ID NO: 42221 - DNA, 50 bp, homo sapien
aaccattcctcatatcaataacccayactcttattccattcttctatgca

SEQ ID NO: 42222 - DNA, 50 bp, homo sapien
taaatttatattagaagatttctcarataattggtggttaaagttggata

SEQ ID NO: 42223 - DNA, 50 bp, homo sapien
cagcaaaagaatgttcaagtttctargtaagtaatatacccagcgtattt

SEQ ID NO: 42224 - DNA, 50 bp, homo sapien
ccagccttaaattcataatgtttagwataacccagagtatttttttccaa

SEQ ID NO: 42225 - DNA, 50 bp, homo sapien
aaataggcacatgctacaaacagcawccctacaataaactcccattgtgg

SEQ ID NO: 42226 - DNA, 50 bp, homo sapien
aagatacacaaatggctaataagcayataaaaaaattcccaacatcacta

SEQ ID NO: 42227 - DNA, 50 bp, homo sapien
aggaaggattaacagaagttagccartgatggaaatgttgaagacatatg

SEQ ID NO: 42228 - DNA, 50 bp, homo sapien
tcaatgagcagtaatgttgtgaaagraatcatttttctaagcaataggtc

SEQ ID NO: 42229 - DNA, 50 bp, homo sapien
aataaaaaaaggcaaagctaatttaygatgatgtaagtgagaaagtagtt

SEQ ID NO: 42230 - DNA, 50 bp, homo sapien
agggaggcaatgagataagtactaasagaaggttgaagtctcagtaaaca

SEQ ID NO: 42231 - DNA, 50 bp, homo sapien
aacttccttaccgtaaagagagaacrgacctcaacctcaggcatggcgcc

SEQ ID NO: 42232 - DNA, 50 bp, homo sapien
aagatttaactaagctgaaatctgaytagtccaggaaggtttgcctatga

SEQ ID NO: 42233 - DNA, 50 bp, homo sapien
tctccagttgatttcaaagatacatraatagaattgtgtctagttacatg

SEQ ID NO: 42234 - DNA, 50 bp, homo sapien
agattaaaaaattagaataaaggagratgaacttgacataatactatagc

SEQ ID NO: 42235 - DNA, 50 bp, homo sapien
gcaggcataagatatttttcctttakaagaagattcagaaaatctggata

SEQ ID NO: 42236 - DNA, 50 bp, homo sapien
ctgagagaggacgaaggcttcacgarcgtgtttgaaaccaagacttgata

SEQ ID NO: 42237 - DNA, 50 bp, homo sapien
tcaagaattctgagtgttttttgaayttaaggtatctactgaatattttt

SEQ ID NO: 42238 - DNA, 50 bp, homo sapien
aatgattgatatttttctaatgacarcattcacttggtacttattaagcc

SEQ ID NO: 42239 - DNA, 50 bp, homo sapien
acattcacatactctatggcatccaraatcttgaaggacacatagcaggt

SEQ ID NO: 42240 - DNA, 50 bp, homo sapien
ttgagtcagaaaattcaataaaccaytcactgagcacataagcaaagagc

SEQ ID NO: 42241 - DNA, 50 bp, homo sapien
aaaacgaacaaacagaaaaacacctraggatgacagtgagttcagtttgg

SEQ ID NO: 42242 - DNA, 50 bp, homo sapien
tgaaattctactagctgcaaaagacygagttttcctgagatttggggctt

SEQ ID NO: 42243 - DNA, 50 bp, homo sapien
ttggtgagtgtctcaactggtacaaygtcttgggaagaatcaaccagaat

SEQ ID NO: 42244 - DNA, 50 bp, homo sapien
gagccagtggtttgtcagaaaaacaygtgactaaaatccctctttattgg

SEQ ID NO: 42245 - DNA, 50 bp, homo sapien
aattctctggagcactgattgctatyacttcttgttggataatctgtgag

SEQ ID NO: 42246 - DNA, 50 bp, homo sapien
gttttctatttccattttcaagaagraggtaaccaaggctcagaaagttt

SEQ ID NO: 42247 - DNA, 50 bp, homo sapien
ggatatctgatttcatattcaccaastcatacaaatcagaggacacgcag

SEQ ID NO: 42248 - DNA, 50 bp, homo sapien
tatatgtaactgtagtcacagggtakaaaatgtaagtcaaataagaatgt

SEQ ID NO: 42249 - DNA, 50 bp, homo sapien
cattgaatctctctattcaaaaagcygatccttaatagtgctgaggaaaa

SEQ ID NO: 42250 - DNA, 50 bp, homo sapien
aaatttgaacaatgaattaattaccrcactgtagcttcttgagagaaaga

SEQ ID NO: 42251 - DNA, 50 bp, homo sapien
cctggtaagatcttgcttgtttttcrcttctgcctaactggaatctttgt

SEQ ID NO: 42252 - DNA, 50 bp, homo sapien
tactagagatattctagaaggcagaygattccattcttggacaaatcata

SEQ ID NO: 42253 - DNA, 50 bp, homo sapien
aagtactaacatgaatgctgcattamagataattagcatgaagtttaggg

SEQ ID NO: 42254 - DNA, 50 bp, homo sapien
atagagaaatgtagattattgtaacmaatgccaagatactcatcttgatt

SEQ ID NO: 42255 - DNA, 50 bp, homo sapien
aggcggtaaaatctgaccatttaaarggttacaaagcatccatttttaat

SEQ ID NO: 42256 - DNA, 50 bp, homo sapien
ttgttttaaagctgaaaatctgcatyagaaaaataccggatagtcaccag

SEQ ID NO: 42257 - DNA, 50 bp, homo sapien
tgaactacatatcccttgacggcagragccatgtttcattacctttgtat

SEQ ID NO: 42258 - DNA, 50 bp, homo sapien
tgaggagatacgacaggcagtggaartatttgttacctacaatggcacat

SEQ ID NO: 42259 - DNA, 50 bp, homo sapien
tctctaatatccagtcttataatcaytattgaacaacaacatgaaagaac

SEQ ID NO: 42260 - DNA, 50 bp, homo sapien
caggtaaaaatccagcttcttcacargtagtaaaaaggaggtaataatgt

SEQ ID NO: 42261 - DNA, 50 bp, homo sapien
cttcttgatggactcaatgaagaatyaccagatgcctcctacacccaagt

SEQ ID NO: 42262 - DNA, 50 bp, homo sapien
cactgaattcttagaaattctaaaaytatttgacatagaatctgtatcac

SEQ ID NO: 42263 - DNA, 50 bp, homo sapien
ttggtagactctgtgttggaatataygtagccactgtattaaaaaaaaaa

SEQ ID NO: 42264 - DNA, 50 bp, homo sapien
tttaatattgacatgcctatagagayggtaagacaagactaaagagcatt

SEQ ID NO: 42265 - DNA, 50 bp, homo sapien
tttgtgtacagtacagttaaaattayaccattacacttgaagctaacatt

SEQ ID NO: 42266 - DNA, 50 bp, homo sapien
gcaatttctcaggaccggagtgaaaygcttccttttgacagagaggcaga

SEQ ID NO: 42267 - DNA, 50 bp, homo sapien
caatatgataaatgtttggtagtgcycttgtgggattctcaccactgcgt

SEQ ID NO: 42268 - DNA, 50 bp, homo sapien
tggcaggagacttggcggtacagcayaagggaacagccccacagccaaac

SEQ ID NO: 42269 - DNA, 50 bp, homo sapien
gtacagtatgtatgagagacatttarcaggagaccttaggaggaagtgga

SEQ ID NO: 42270 - DNA, 50 bp, homo sapien
gcctcagctgcctcctctgcacaatragggcaagagtcaggctctggagc

SEQ ID NO: 42271 - DNA, 50 bp, homo sapien
ctcttttttccttaataaactacccrattctcaggtattctttatagcag

SEQ ID NO: 42272 - DNA, 50 bp, homo sapien
agattgatttttctcacatatgggawcaccaaatacccaaaacctgaaca

SEQ ID NO: 42273 - DNA, 50 bp, homo sapien
tcaattgaaagatatctgaatgaaaygactgatcgaaacaatttgccatc

SEQ ID NO: 42274 - DNA, 50 bp, homo sapien
agagagaatcttctttagaacttaaygatgataatggtaacttgtcttta

SEQ ID NO: 42275 - DNA, 50 bp, homo sapien
ctctgaattgagtggatgaaaggacygtcaaggtttgccacgtcctcatt

SEQ ID NO: 42276 - DNA, 32 bp, homo sapien
gagaagagctgctaacygctgtataaacatca

SEQ ID NO: 42277 - DNA, 50 bp, homo sapien
ctgcctttactatacagaccttcaawgatttacacctcaagtttgtgacc

SEQ ID NO: 42278 - DNA, 50 bp, homo sapien
aaaggtgaagatatcaagttttatarcacaagcaagactgaagaggtaaa

SEQ ID NO: 42279 - DNA, 50 bp, homo sapien
caagagagtttataatgaaaggttaycatatcatcagtttggtttagaga

SEQ ID NO: 42280 - DNA, 50 bp, homo sapien
agacatacagatggccactagaaacygaaaaggacaagaaaacaagttct

SEQ ID NO: 42281 - DNA, 50 bp, homo sapien
caccttgctacacaaagcatacagasaggagaataagagaacagcagaag

SEQ ID NO: 42282 - DNA, 50 bp, homo sapien
gaatgtaggattctcaagggtgaaayggcatttttgctgtatccatggtg

SEQ ID NO: 42283 - DNA, 50 bp, homo sapien
tggaaactctgtctttcagtgtgcawcaaatggtatacatggggcactga

SEQ ID NO: 42284 - DNA, 50 bp, homo sapien
attgaggcagggcatggacctatcasagtctgggagatattacagaaaaa

SEQ ID NO: 42285 - DNA, 50 bp, homo sapien
gtaatattgtgtaggaaaacatgaaktcggtaggggtaaggaggcaaaat

SEQ ID NO: 42286 - DNA, 50 bp, homo sapien
gagtgagcagctttggaagccaaaaytgttaaatatctaggtaaataccc

SEQ ID NO: 42287 - DNA, 50 bp, homo sapien
ataatcttaaaacattcatatgagayaagtaccagtttaatcttcatttt

SEQ ID NO: 42288 - DNA, 50 bp, homo sapien
caatgaaacactatacagcccttaamaaaagaataagtgaagtcctggaa

SEQ ID NO: 42289 - DNA, 50 bp, homo sapien
taactagctaatgcagactccaatcragtagcctaacacagtatttgtgg

SEQ ID NO: 42290 - DNA, 50 bp, homo sapien
tccctcacctgtaatctgggtatatyagtaatggttaccttatatgctgt

SEQ ID NO: 42291 - DNA, 50 bp, homo sapien
ctcattttcaagtacacggcataaamgattagaaactgagagagagagtg

SEQ ID NO: 42292 - DNA, 50 bp, homo sapien
tatcaaagggagacattaagactcasggtcaaaacaacttaaaaaaaatc

SEQ ID NO: 42293 - DNA, 50 bp, homo sapien
ttcttaaaatccagtttttcaacacrcagtgagagggtgatttttcccct

SEQ ID NO: 42294 - DNA, 50 bp, homo sapien
tttatgagaggcatgaaacttggagwataaatgaaacttagatgccagag

SEQ ID NO: 42295 - DNA, 50 bp, homo sapien
ccattaacacctgttccactgaatcyacaggtgatcttaatggtgactta

SEQ ID NO: 42296 - DNA, 50 bp, homo sapien
ttcttctattaaaatgaatctctgcyctatcatgtagattaacccaaggg

SEQ ID NO: 42297 - DNA, 50 bp, homo sapien
tctgttttgttcatcattatattccraatccactgcataatgttgggtac

SEQ ID NO: 42298 - DNA, 50 bp, homo sapien
tactgccagggaagaaggatttaatyaggtcctgcagccaaggacatggg

SEQ ID NO: 42299 - DNA, 50 bp, homo sapien
tttaaattttatttgacataagtgaraagctaagtaagtaaaagcacttt

SEQ ID NO: 42300 - DNA, 50 bp, homo sapien
cttctagggaatacgccacgatgagkaaagcagtgtttggcattagtggg

SEQ ID NO: 42301 - DNA, 50 bp, homo sapien
caatgtatgactattttacctttagyagctatgatggttatagtaaaaat

SEQ ID NO: 42302 - DNA, 50 bp, homo sapien
ttgctctgttggcatctgttcaaaamagctaacaaaagtcggttggttct

SEQ ID NO: 42303 - DNA, 50 bp, homo sapien
acatccacatcatagaggctgggaarctaaaaattgcattgcccaggctc

SEQ ID NO: 42304 - DNA, 50 bp, homo sapien
taaacttagagttaaataattgaaayaccatgtaatgcatgtcctaataa

SEQ ID NO: 42305 - DNA, 50 bp, homo sapien
cttcttttgtctcccttgaggatgamcataaaacctctaatgagtggcac

SEQ ID NO: 42306 - DNA, 50 bp, homo sapien
tgcctaaccaatgaatggtagccacratatttgtcctttattcaatatca

SEQ ID NO: 42307 - DNA, 50 bp, homo sapien
ataagctccccagattcccatggaastctacagaaggacataatgagaaa

SEQ ID NO: 42308 - DNA, 50 bp, homo sapien
ttactgtatttggggtcaccaatgaygactcagatgtcttggttccctga

SEQ ID NO: 42309 - DNA, 50 bp, homo sapien
ctctgtagaacaaagtttatgtgacygagtgcaaacccattttctctttg

SEQ ID NO: 42310 - DNA, 50 bp, homo sapien
caatgtaatcagaaaggctgtactaygaaaatcaaagtgaagattacaga

SEQ ID NO: 42311 - DNA, 50 bp, homo sapien
agcagaccgtacagggcctaatctgkacttaagaccatttgttcaaatga

SEQ ID NO: 42312 - DNA, 50 bp, homo sapien
tttaaaataaaaggtagtagcattawgtctctgatgtcaagatctaaaat

SEQ ID NO: 42313 - DNA, 50 bp, homo sapien
gaacacaaatttaaacaatgaaagayattaaaattcaaccccaatggcat

SEQ ID NO: 42314 - DNA, 50 bp, homo sapien
aatactatgagttagttatgctgttyaacacccatttgcaaatgagaaat

SEQ ID NO: 42315 - DNA, 50 bp, homo sapien
ttgaacacatactatttgctgcattkaaacgtgcatttatgaagaagagt

SEQ ID NO: 42316 - DNA, 50 bp, homo sapien
gcattgctgttcttacactaggttgyacattgaagtcacagaagacaaac

SEQ ID NO: 42317 - DNA, 50 bp, homo sapien
aacagtaatcattttaaaaacactcrcatcttttgcctgcatgtttagct

SEQ ID NO: 42318 - DNA, 50 bp, homo sapien
tccaaaagcacattgaatgtcaagcrccatagtatctctggcagacatgc

SEQ ID NO: 42319 - DNA, 50 bp, homo sapien
aactctataaaagactctaaatggaytactggttaggaagtatgggaagt

SEQ ID NO: 42320 - DNA, 50 bp, homo sapien
taggttgtaagctaacgcggctataycaacgtaagacatactaacttacg

SEQ ID NO: 42321 - DNA, 50 bp, homo sapien
aatgacttcaggtcacaagggaaccraactaagtgaataggaagtctctt

SEQ ID NO: 42322 - DNA, 50 bp, homo sapien
ataaatatgttaccccagctgaatayaaacgaactaggagtccgtcatta

SEQ ID NO: 42323 - DNA, 50 bp, homo sapien
gtaaatggaatattccagatgtccaragtgtccgtgtataaatgttgagc

SEQ ID NO: 42324 - DNA, 50 bp, homo sapien
ctggtcaagggatactaatgaaagaraagatcttgaagaacatggtttat

SEQ ID NO: 42325 - DNA, 50 bp, homo sapien
aaagtttacaaatttaggcataagayatttgactctagctttgtagtgaa

SEQ ID NO: 42326 - DNA, 50 bp, homo sapien
ataaatgtcaaagtcatcagcatcaytcagacaaatcacattaatttgtg

SEQ ID NO: 42327 - DNA, 50 bp, homo sapien
aactagttgattatacctttcaataycttagatttttatacctaccaaat

SEQ ID NO: 42328 - DNA, 50 bp, homo sapien
tgcattcaggatgtgatttaattgckccatataagacataaaatatctac

SEQ ID NO: 42329 - DNA, 50 bp, homo sapien
gcgccttcctgactgcctctgaggcyaactgcgatgtcttggcaacaatt

SEQ ID NO: 42330 - DNA, 50 bp, homo sapien
tgtgatcattatctagaaatatgagycgtaccagctgactatgttctcag

SEQ ID NO: 42331 - DNA, 50 bp, homo sapien
acaactgactgcagctgagcctgaaygtgcaaataggtcagtgtcactgc

SEQ ID NO: 42332 - DNA, 50 bp, homo sapien
taaacagtagctactaacattatcawcactaaacgaaatgtttgctgttc

SEQ ID NO: 42333 - DNA, 50 bp, homo sapien
taattttaaacatgcagtaaaatgcwaaggatcttcttatacaagtcttt

SEQ ID NO: 42334 - DNA, 50 bp, homo sapien
aaaaactagatcaatcaacccaaagratatgtctcaatccctgaagggtc

SEQ ID NO: 42335 - DNA, 50 bp, homo sapien
taactttagaatcagacttgatacarattgtttccttacctagtaaatat

SEQ ID NO: 42336 - DNA, 50 bp, homo sapien
gtttccagactttattgtgtctaagyatcacaggaaatgtattaaccatg

SEQ ID NO: 42337 - DNA, 50 bp, homo sapien
gaccaccttagttccaaaggatgccyattagaaatgaaagaaaaggaggc

SEQ ID NO: 42338 - DNA, 50 bp, homo sapien
gtgggaagagggtgtcataagatttraaaaagaccacaaattattctaat

SEQ ID NO: 42339 - DNA, 50 bp, homo sapien
gaaatttaccaactggtctagcaggraatttgacaagtagtaaccttctt

SEQ ID NO: 42340 - DNA, 50 bp, homo sapien
tgaatagtccacttataatcattcaycttgaaaaaatttaattcctcctc

SEQ ID NO: 42341 - DNA, 50 bp, homo sapien
acctatctcatgaacaagactcatcrctcttcaaggtccaggttgagtta

SEQ ID NO: 42342 - DNA, 50 bp, homo sapien
tgtcctctctgccagggtaaataatsacaatctccctcggcttctctctc

SEQ ID NO: 42343 - DNA, 50 bp, homo sapien
tctgcacctcagctgatgagacatakgtttgctctgggtaggaggccttg

SEQ ID NO: 42344 - DNA, 50 bp, homo sapien
ctcatcagctgaggtgcagatctacyacctccttatgctgtgactttgtg

SEQ ID NO: 42345 - DNA, 50 bp, homo sapien
agtaaacctcatcctatagtttttamaatgaaagatgtctccagacaatg

SEQ ID NO: 42346 - DNA, 50 bp, homo sapien
catgatgctgacacaaaggacagcaycgcataatcaggagcaatgtggac

SEQ ID NO: 42347 - DNA, 50 bp, homo sapien
gcaaaagtcttaataatgcttctagmacaaactacatacttaaagaatgt

SEQ ID NO: 42348 - DNA, 50 bp, homo sapien
ccttctcaattatatctttagtgtaygctttaacattctttaagtatgta

SEQ ID NO: 42349 - DNA, 50 bp, homo sapien
gaaatcataagaaaaattaaagaacygaatgaaatcgtgaaaagcacgtg

SEQ ID NO: 42350 - DNA, 50 bp, homo sapien
tatgggtatattgtgggagataaacracctttctctctctctttgtgttc

SEQ ID NO: 42351 - DNA, 50 bp, homo sapien
tttattctttgtggccttctgaaaakttctacttcctcccttgcatttta

SEQ ID NO: 42352 - DNA, 50 bp, homo sapien
taaaccagaataatttattgtctccwcgttgcgtatttcattcctgttta

SEQ ID NO: 42353 - DNA, 50 bp, homo sapien
atgtgggtagctcaagggcaaaataygttgaagattgatttcccagattc

SEQ ID NO: 42354 - DNA, 50 bp, homo sapien
ttggtagatagcagatctggggttcmatctcaagctgtctgtagctaatc

SEQ ID NO: 42355 - DNA, 50 bp, homo sapien
catccagaccgtgctaaattctccastaggggctctctgctcctcccgtt

SEQ ID NO: 42356 - DNA, 50 bp, homo sapien
gtgtccattacagagcatatccacawtacctactgaagaagctttggcgt

SEQ ID NO: 42357 - DNA, 50 bp, homo sapien
tggagaacctctaattcagtcatgtmtttccacagatggggagatagaag

SEQ ID NO: 42358 - DNA, 50 bp, homo sapien
taaaaatagacatcgcttaaaataawcatatgaatgaaataactaatttt

SEQ ID NO: 42359 - DNA, 50 bp, homo sapien
ggatacagagccacaccatatcaaakgtcttcttcatatattttaaaatc

SEQ ID NO: 42360 - DNA, 50 bp, homo sapien
ataaagaaattctttgaaggcaaaaygtaagagagctttgttcatagaaa

SEQ ID NO: 42361 - DNA, 50 bp, homo sapien
aatgagaaggaaaaaatatagaaagscaaattgttttcacaaagttcaga

SEQ ID NO: 42362 - DNA, 50 bp, homo sapien
ttaatgtgcaagtaaactgcaaaagycgttatgtctaagaaaagggtaat

SEQ ID NO: 42363 - DNA, 50 bp, homo sapien
tggttcttattctctggtaaaactaygtcataagcagcacatggagagcc

SEQ ID NO: 42364 - DNA, 50 bp, homo sapien
gggtctccacctgtgtcctatatagycctgtgtcttaatgacatctattc

SEQ ID NO: 42365 - DNA, 50 bp, homo sapien
acaggcagaatccaggtatacagaaragaaagcgtagaaggaggaagaaa

SEQ ID NO: 42366 - DNA, 50 bp, homo sapien
agaaagcgtagaaggaggaagaaaayagtcattgtacacaacaatctcag

SEQ ID NO: 42367 - DNA, 50 bp, homo sapien
gagatgaagatttagaaatatggacmctttttttatagactaagttctaa

SEQ ID NO: 42368 - DNA, 50 bp, homo sapien
gtacaaggtaataagtgaccgatgaratatcaacaaaagccttgggaatt

SEQ ID NO: 42369 - DNA, 50 bp, homo sapien
cctcattcatttcctctgtcagtaasgaaatactgtgttcagacaataag

SEQ ID NO: 42370 - DNA, 50 bp, homo sapien
tttcaaggagagttacctacttggcragaatgtgtggtgtatggatagtc

SEQ ID NO: 42371 - DNA, 50 bp, homo sapien
tgagtaatcagctgggtgaatagaamcctgttaggcctaagaggcagcca

SEQ ID NO: 42372 - DNA, 50 bp, homo sapien
aggctatccgtttgaaccttacatcwcaaagaagtcacatgagctacgta

SEQ ID NO: 42373 - DNA, 50 bp, homo sapien
ataaggtagatgttaccactacagargattttcttatctaatgcatttgt

SEQ ID NO: 42374 - DNA, 50 bp, homo sapien
agattcagtattctgtgaggcaacckaagattatcagtttttaacatttt

SEQ ID NO: 42375 - DNA, 50 bp, homo sapien
gattacatgcatgaaccgtcacaccrgagtagaaatacagttgttgacag

SEQ ID NO: 42376 - DNA, 50 bp, homo sapien
ttttgagagcgcaggaaggaccttcrcctgattagttttgcctccattgc

SEQ ID NO: 42377 - DNA, 50 bp, homo sapien
agggacagttttagccaaagtggtamgaatcacaatccaggtatgcaaac

SEQ ID NO: 42378 - DNA, 50 bp, homo sapien
cttcaaggctgcacctggcttcaaaraggaaaaatgaactacaggcatct

SEQ ID NO: 42379 - DNA, 50 bp, homo sapien
agaaaaccattattatgaattaacayctgaggattagctcatcatattag

SEQ ID NO: 42380 - DNA, 50 bp, homo sapien
gtaagaggaaaagcctaggagagcaytgaggtgtgggaagctttggcctc

SEQ ID NO: 42381 - DNA, 50 bp, homo sapien
gagagaaggtggaggaagtattgccrgaaggattgagtcagaatgtgtgt

SEQ ID NO: 42382 - DNA, 50 bp, homo sapien
gaattttcaatttgttttgacatacrgacattttattttatggtttatga

SEQ ID NO: 42383 - DNA, 50 bp, homo sapien
attatcaacaaacatctcaaggaaayctagtccatttattttacttgttt

SEQ ID NO: 42384 - DNA, 50 bp, homo sapien
taggtcagctaagatgcctgcaatayagttcaggagatttaagaaggcat

SEQ ID NO: 42385 - DNA, 50 bp, homo sapien
tttgttactgcatgctaatctaaaamtggttaattgcaaatactggtaat

SEQ ID NO: 42386 - DNA, 50 bp, homo sapien
ctacaaatatgtttgttctttaatcyacattgagacttttgtgaaagcga

SEQ ID NO: 42387 - DNA, 50 bp, homo sapien
gtcctagatacagctggttagaaaaygtcttagtaatcttcagttggttg

SEQ ID NO: 42388 - DNA, 50 bp, homo sapien
atcaggacagtctcccttgcaaagayatagcacctgataattgatcttca

SEQ ID NO: 42389 - DNA, 50 bp, homo sapien
caattgtgatgatcatcatgaagatsaattatcaggtgctatgtctttgc

SEQ ID NO: 42390 - DNA, 50 bp, homo sapien
gctacttcttgctcactgaatccaaycagtatagtgtcatcaatgtaatg

SEQ ID NO: 42391 - DNA, 50 bp, homo sapien
caattttaagaaaaagctgtgtcatwaagaatagtcacagttatccagga

SEQ ID NO: 42392 - DNA, 50 bp, homo sapien
gcctcaaataggacaatagaataaaragagaatggaagtagttggaatga

SEQ ID NO: 42393 - DNA, 50 bp, homo sapien
tgacactatgtgggtaaccaaaatamatgacgatatatggaatcataaaa

SEQ ID NO: 42394 - DNA, 50 bp, homo sapien
atgtagagcctgaatttcagcttcayagattacaggacaggtgacctgag

SEQ ID NO: 42395 - DNA, 50 bp, homo sapien
aaacgtctaatattgagctctaaaawtgtgggagcaaagctattttacta

SEQ ID NO: 42396 - DNA, 50 bp, homo sapien
tgttttgaaaaaccctcatctgctayacatcaaacccatatttgtgacat

SEQ ID NO: 42397 - DNA, 50 bp, homo sapien
aaagaattgcctttagagcataaggraatatatcaataaattttaaacta

SEQ ID NO: 42398 - DNA, 50 bp, homo sapien
catttattaaatggcaaaaagaataytatggtaacttatgggcttgactt

SEQ ID NO: 42399 - DNA, 50 bp, homo sapien
tgtagcaaggactagaactggggcaygaacccaagcatttggatcctaga

SEQ ID NO: 42400 - DNA, 50 bp, homo sapien
tggggacaaaagtacaaaatgtgggracacacaagtaatatttgggtagc

SEQ ID NO: 42401 - DNA, 50 bp, homo sapien
tacacagcaatggataaccaatacamcagcctatgatgataactatgtac

SEQ ID NO: 42402 - DNA, 50 bp, homo sapien
aatatctttaaaaagtcatggcaagscctaaattaaagaaaatatgacag

SEQ ID NO: 42403 - DNA, 50 bp, homo sapien
tgaagagttctctaagtcactaaatratagtctgctgccttataacaacg

SEQ ID NO: 42404 - DNA, 50 bp, homo sapien
tagttctcccagcagccctaagagayagtaagtcataacaatgacttcca

SEQ ID NO: 42405 - DNA, 50 bp, homo sapien
gacttctcccagagggagtgtccctraatacttggcagaagccgcacggc

SEQ ID NO: 42406 - DNA, 50 bp, homo sapien
attccattcactatgcattgaatgarcatccattaaatacataccatgac

SEQ ID NO: 42407 - DNA, 50 bp, homo sapien
cagtactggacagtgcaattcaccarattttttaggtcagagtacatcta

SEQ ID NO: 42408 - DNA, 50 bp, homo sapien
ttatccaagtttcatttacctcatayctagtgtttcatctcatccttagc

SEQ ID NO: 42409 - DNA, 50 bp, homo sapien
tttatactaactttaagaattctccrcactcacacacacaaaaattagag

SEQ ID NO: 42410 - DNA, 50 bp, homo sapien
gaagatgcactgatttccatagatasaaaaacattccaaagacataaaca

SEQ ID NO: 42411 - DNA, 50 bp, homo sapien
cccttccattagcagtaggtctgaawtaactttaatatgcaagttatcat

SEQ ID NO: 42412 - DNA, 50 bp, homo sapien
ctagctttgcacatgctattccttaygctttgaatgcttatttcttgcac

SEQ ID NO: 42413 - DNA, 50 bp, homo sapien
ctggcactttagttagtaacttctcmaaagtacagtacaggaatcacggt

SEQ ID NO: 42414 - DNA, 50 bp, homo sapien
catcagacaataactccactggaaawttgggtagtatggtttttgttttc

SEQ ID NO: 42415 - DNA, 50 bp, homo sapien
gttaatgttttcctttccacgacacraggatgctgaattgaggtcataga

SEQ ID NO: 42416 - DNA, 50 bp, homo sapien
tatgaaaaatgctttagatgggtaaygttctgagtacatgggattggtca

SEQ ID NO: 42417 - DNA, 50 bp, homo sapien
atccataacaaaagatggaggcgccmaactgctgttttattacacccatg

SEQ ID NO: 42418 - DNA, 50 bp, homo sapien
tatcttctattccttctaccaagaaygctcttagcctccttatccactta

SEQ ID NO: 42419 - DNA, 50 bp, homo sapien
tggattaactattttgaaaaataaartatgttgccaaccttgaaagcaat

SEQ ID NO: 42420 - DNA, 50 bp, homo sapien
ctctgaaaccatactgtaattaatamaaagaacagatgcatttggttttt

SEQ ID NO: 42421 - DNA, 50 bp, homo sapien
attaaatactggacttcattccacartgacttccaattagggcagaatga

SEQ ID NO: 42422 - DNA, 50 bp, homo sapien
gacaatttgggcaaatgatgctgtcycatagttgctttaatgtattaaat

SEQ ID NO: 42423 - DNA, 50 bp, homo sapien
caaatccttgacttcctctcaacacygaacaaaacaacatacacacctac

SEQ ID NO: 42424 - DNA, 50 bp, homo sapien
attattacctctaaggtttgcaaatsaaggccgaattctactacaggtgt

SEQ ID NO: 42425 - DNA, 50 bp, homo sapien
ctatggaagctttagtgtaagtgctragagcgctgtaaatgtaatggaca

SEQ ID NO: 42426 - DNA, 50 bp, homo sapien
aatgattttggaggaaacacccaaasagagtgtgaaagtaatccatgttc

SEQ ID NO: 42427 - DNA, 50 bp, homo sapien
gaccattagatttaatcaagttttakgcttttgcaaagcaggttgtaaaa

SEQ ID NO: 42428 - DNA, 50 bp, homo sapien
aatgtacacctataacattagtcaakgcctctcatcaagtcaggagggtt

SEQ ID NO: 42429 - DNA, 50 bp, homo sapien
aaaaaatgagggcaaggagaaaaacygggtgagagcttcctggctttcga

SEQ ID NO: 42430 - DNA, 50 bp, homo sapien
aatgcatttgggaaacgcacatctaracatttgggaagctgatgttcaca

SEQ ID NO: 42431 - DNA, 50 bp, homo sapien
tgattgaggaggatttgaatcttgarggttagataacatagctagtgttt

SEQ ID NO: 42432 - DNA, 50 bp, homo sapien
ctctgcctgcagttagagaaattgayggagagattacagtgatagatctg

SEQ ID NO: 42433 - DNA, 50 bp, homo sapien
agaatatactgcattgctgagaataktaggagcttgaagcatggagttaa

SEQ ID NO: 42434 - DNA, 50 bp, homo sapien
attggaaagaaaaccagatatccaawgtattaatgcaagaaattttctga

SEQ ID NO: 42435 - DNA, 50 bp, homo sapien
aaaaccatgaatgggaaacatttaaytccatgcttcaagctcctaatatt

SEQ ID NO: 42436 - DNA, 50 bp, homo sapien
ctgatttttatcttttattttgctaycagttaagatgtttattacgtttt

SEQ ID NO: 42437 - DNA, 50 bp, homo sapien
cataagtagcacttggaaatgctaaraaataatatgggctctcaatgtgt

SEQ ID NO: 42438 - DNA, 50 bp, homo sapien
gcatctgttgagggacgctgttagamtccttcaggtgtaatgaaagaagt

SEQ ID NO: 42439 - DNA, 50 bp, homo sapien
caatatgagctgggctgtgaccaaaytaacattgaatgtggcctgagttg

SEQ ID NO: 42440 - DNA, 50 bp, homo sapien
acctctgcaaatgatgattgatgcaytaatgtgagactgataaactctga

SEQ ID NO: 42441 - DNA, 50 bp, homo sapien
aaaatgcatgcagatgatttagtaayggtgataacagaaataaacaacaa

SEQ ID NO: 42442 - DNA, 50 bp, homo sapien
gggaccccacacactctcaggaggtraaaccgagatacccgaggaaggtc

SEQ ID NO: 42443 - DNA, 50 bp, homo sapien
taaaagagagtcaatgagaaattaastaatagtataggtggtatacagaa

SEQ ID NO: 42444 - DNA, 50 bp, homo sapien
acactggctccatttcaaacataaaygcaagataaatgattggtcagtgg

SEQ ID NO: 42445 - DNA, 50 bp, homo sapien
atactgaattgcaaacaagtattacycttaagatttggaaatcattttta

SEQ ID NO: 42446 - DNA, 50 bp, homo sapien
cagacacctggacctgtttactgccragccctacataattctccttcact

SEQ ID NO: 42447 - DNA, 50 bp, homo sapien
ggaaaggtatatgaaaccgattgagmaattaaattggcttagtcttattg

SEQ ID NO: 42448 - DNA, 50 bp, homo sapien
cagtctcaccgagctaagtaaatccraaaacatctggggggcccacagag

SEQ ID NO: 42449 - DNA, 50 bp, homo sapien
tgtttttcccttggagagattgtccragatgagggatggtggagggacaa

SEQ ID NO: 42450 - DNA, 50 bp, homo sapien
cactaggcttttggcaacactgataygtgttagccaaactttgaccttag

SEQ ID NO: 42451 - DNA, 50 bp, homo sapien
aatgaggaaagtgaaactcagagaartaatctgacggccccaagatcaca

SEQ ID NO: 42452 - DNA, 50 bp, homo sapien
atgggcataatcacccttctgtcgtraagttctgggcctatcatctaaga

SEQ ID NO: 42453 - DNA, 50 bp, homo sapien
ataaaggtgcatgctgattcattccratattccctccccatttactcaac

SEQ ID NO: 42454 - DNA, 50 bp, homo sapien
tatttcccgtgtcttcgattattgcrccatggtctccctgtaagtttcac

SEQ ID NO: 42455 - DNA, 50 bp, homo sapien
gggcagttagagtggaaagtatgcargactaaaggtccagtttggaaaat

SEQ ID NO: 42456 - DNA, 50 bp, homo sapien
aattcctctgggtgtaatcttagccyatactttaatttcaactttaagaa

SEQ ID NO: 42457 - DNA, 50 bp, homo sapien
gacagcatggacaagacttagaagartaagcatggtagaaaataaaaagc

SEQ ID NO: 42458 - DNA, 50 bp, homo sapien
caggaggtcagggaattacagttcayggaggttacaccgaagctagattt

SEQ ID NO: 42459 - DNA, 50 bp, homo sapien
catcccagctctgccattatgaaggmaaattgttccaccactcagagctt

SEQ ID NO: 42460 - DNA, 50 bp, homo sapien
tggtgtgcggggatatggagcgtgaygtatttattttaatctgtgccttc

SEQ ID NO: 42461 - DNA, 50 bp, homo sapien
tgattctgcagctaactcagcaggargtaaaatgaggcagtggttagaaa

SEQ ID NO: 42462 - DNA, 50 bp, homo sapien
ggaatctaggacagttgtaaaagccraggtgaatggagacgtgaggacgg

SEQ ID NO: 42463 - DNA, 50 bp, homo sapien
ggctggggactggagctctcccgacraaattagctgccatctctggatcc

SEQ ID NO: 42464 - DNA, 50 bp, homo sapien
aggcaatcatgataataataattccmatcataactaccttttatcaagtg

SEQ ID NO: 42465 - DNA, 50 bp, homo sapien
ttctgcatcagtaacatgataagccraactcaaagggaaactaggctaag

SEQ ID NO: 42466 - DNA, 50 bp, homo sapien
ttccattgatctcttacccttgatcrgaaccgacgggaatttgtttgcat

SEQ ID NO: 42467 - DNA, 50 bp, homo sapien
tggctgctgcctcacataaaagataraaggaagttagccttggaaaagtt

SEQ ID NO: 42468 - DNA, 50 bp, homo sapien
gaaaaaaaggtattactctaagtccrgctttattaccatcacaatcaata

SEQ ID NO: 42469 - DNA, 50 bp, homo sapien
gatgttgttatcttccgggtagttgrcaaactttcatggatgcatttaaa

SEQ ID NO: 42470 - DNA, 50 bp, homo sapien
tttcaattttttcttaatctgatgartcaaaccagtttttattacaactt

SEQ ID NO: 42471 - DNA, 50 bp, homo sapien
gttatgattgtctctacatctccaayatctaacacaaggcctggatgctc

SEQ ID NO: 42472 - DNA, 50 bp, homo sapien
ttagcaggaaaaaccagtaccaactragtcaaacaggaaagactgcctca

SEQ ID NO: 42473 - DNA, 50 bp, homo sapien
tttgcatgtaaattgactttataaawtagataccataagctggtaataga

SEQ ID NO: 42474 - DNA, 50 bp, homo sapien
tttattcagcaccttctgtggttggyactctgcaaagtgttgaggcaaca

SEQ ID NO: 42475 - DNA, 50 bp, homo sapien
cacttactagttacagttcacctatratacacggaatattgagattactt

SEQ ID NO: 42476 - DNA, 50 bp, homo sapien
tgttattgtttgcaaattattgtacygccagtgaaggtaactattaaaga

SEQ ID NO: 42477 - DNA, 50 bp, homo sapien
tttattgcagaaagaatgatctcccwataatacaaacttaattatgttgt

SEQ ID NO: 42478 - DNA, 50 bp, homo sapien
gagatggaagaacaccaattcagaargaatcactgtgtaaataattcaca

SEQ ID NO: 42479 - DNA, 50 bp, homo sapien
gatttatttactcattctttcattcraacattcattcaacagatatgcct

SEQ ID NO: 42480 - DNA, 50 bp, homo sapien
tgtttttttcttaccctgtttatacyaatttggcaaatcgctgatctata

SEQ ID NO: 42481 - DNA, 50 bp, homo sapien
gcctatgactttgcttctccagcctraattgtggaaatcccagtcttttc

SEQ ID NO: 42482 - DNA, 50 bp, homo sapien
cattattttaaccaaagctctatacygctttcagatttgtggtcacttgc

SEQ ID NO: 42483 - DNA, 50 bp, homo sapien
aatgttacctcttcctctcaaattaktaagttgcatatcagtgcctagaa

SEQ ID NO: 42484 - DNA, 50 bp, homo sapien
aatataaaatgaacatatgtactacrgctactacttaataaccattagac

SEQ ID NO: 42485 - DNA, 50 bp, homo sapien
ttgtaactggatcagtgtgtgtagcscgttgcagagatccctaggctata

SEQ ID NO: 42486 - DNA, 50 bp, homo sapien
tgttttatgctaacaaggtctttgawaaggagagatcctttggtcccttg

SEQ ID NO: 42487 - DNA, 50 bp, homo sapien
catacagtgatttctctcaaagtccraatataatttcagcctcagaaaga

SEQ ID NO: 42488 - DNA, 50 bp, homo sapien
ccatttgtctgaccaaattcttcacyagacggttggcttcacaccttcct

SEQ ID NO: 42489 - DNA, 50 bp, homo sapien
ataaaagtaatcagttttatgtgaargacattaaggcaagggctgtttct

SEQ ID NO: 42490 - DNA, 50 bp, homo sapien
aagagacttataaatcaagaaaaccraggttaccatagcaatctctggca

SEQ ID NO: 42491 - DNA, 50 bp, homo sapien
aaatctatcttctttaataagtgtgmaaatacaacactttactggaaccc

SEQ ID NO: 42492 - DNA, 50 bp, homo sapien
atataaagcagtgaacaaagcatacygagtaaaaacaacctcagaggcaa

SEQ ID NO: 42493 - DNA, 50 bp, homo sapien
tagcttttaagttgtcattgaccaaragaccgttcaagggtgattatagt

SEQ ID NO: 42494 - DNA, 50 bp, homo sapien
catttctcagaaatagtagagcacaraaaagtacatcaaagcaattataa

SEQ ID NO: 42495 - DNA, 50 bp, homo sapien
ggagtagcacaatgcccttgaatcaytcctcagtaatataagaacagaat

SEQ ID NO: 42496 - DNA, 50 bp, homo sapien
tggtaaatgctcccataaatagaaamaggtgctgcagaccagcaaggtga

SEQ ID NO: 42497 - DNA, 50 bp, homo sapien
tcttttttttaaagggaataccgtamcttatatataaaggcatcaaagta

SEQ ID NO: 42498 - DNA, 50 bp, homo sapien
agtacaacaggaacgtgtcacacaaygtaaaaatgatcatgccataacca

SEQ ID NO: 42499 - DNA, 50 bp, homo sapien
tcctggtagaataaggactttattargagatctgtatgcgcccagtgtct

SEQ ID NO: 42500 - DNA, 50 bp, homo sapien
aatcccaaaggattaaaattccaaaygttgaaagcctgaaatccaaattc

SEQ ID NO: 42501 - DNA, 50 bp, homo sapien
taaaaaagaaaaatagggagctcaartatgttgaataatcaatggctgta

SEQ ID NO: 42502 - DNA, 32 bp, homo sapien
actctttactttgttawcctaatctatgtgtc

SEQ ID NO: 42503 - DNA, 50 bp, homo sapien
cactggacaatagatacaagctgaaygcctagcccttcgctggccctggg

SEQ ID NO: 42504 - DNA, 50 bp, homo sapien
caatggaaccatgtccatgaatgccrgatatgacagacccactggctctc

SEQ ID NO: 42505 - DNA, 50 bp, homo sapien
atatcacaatccattcaggtttccayagtagattagaacactcgtgggtg

SEQ ID NO: 42506 - DNA, 50 bp, homo sapien
caagaaaataaagtagttgggaaatraagtccgctgttcacattcatgaa

SEQ ID NO: 42507 - DNA, 50 bp, homo sapien
cttcctgaaacaggcacaaacatcayctctgaagagcaaatgagcactaa

SEQ ID NO: 42508 - DNA, 50 bp, homo sapien
gtccatatctatattagagtgtctcrgacccaaagatatcttaaatggca

SEQ ID NO: 42509 - DNA, 50 bp, homo sapien
cactctgagaccacaataggctaatraggaatgccatttaagatatcttt

SEQ ID NO: 42510 - DNA, 50 bp, homo sapien
tctgagtcttacccatgtgagatgawcttgttggtgtcaatggggaaagg

SEQ ID NO: 42511 - DNA, 50 bp, homo sapien
atcagggatcctattatataaatgayggcttatccacacaatagaatagg

SEQ ID NO: 42512 - DNA, 50 bp, homo sapien
tcctctggggtagaccatatgctaarctacacaaccagtcttaatacatg

SEQ ID NO: 42513 - DNA, 50 bp, homo sapien
gagagacatcccagatctcccacacrgaactccggcgcgctttgaagtgt

SEQ ID NO: 42514 - DNA, 50 bp, homo sapien
agtcaagctataaatttcaaattagwcatggcaagcctaatataggggac

SEQ ID NO: 42515 - DNA, 50 bp, homo sapien
aattttgaaaatcaaactgatgtcartattagcatggattcagtcaagct

SEQ ID NO: 42516 - DNA, 50 bp, homo sapien
ctccacagatatttattacatgtcamctccgtaaaagaaattgccttacc

SEQ ID NO: 42517 - DNA, 50 bp, homo sapien
ccagaatgttgatggattagtaacarggagaaaaaaagacagcaccatta

SEQ ID NO: 42518 - DNA, 50 bp, homo sapien
gcatcatttaataaagcagggtcccrgatttacagacctttgtttgagtt

SEQ ID NO: 42519 - DNA, 50 bp, homo sapien
gaccaggacacatgtttttctcaccrgataataggggcacagaagaccaa

SEQ ID NO: 42520 - DNA, 50 bp, homo sapien
tgcactttctgcattcgtgagcctayctgcaagcacagagggtttgatct

SEQ ID NO: 42521 - DNA, 50 bp, homo sapien
ctttctcttctataatcacttttacwatggtaataattatggacacattt

SEQ ID NO: 42522 - DNA, 50 bp, homo sapien
catctctgccttatagatgaggatayggagtcttagagaagttaagggat

SEQ ID NO: 42523 - DNA, 50 bp, homo sapien
agcagctacaaagttgtctcaaagcygatcttgatagattactgtataca

SEQ ID NO: 42524 - DNA, 50 bp, homo sapien
acagggttaatgtcatgatcataccrggaaatgaatataaagcgcctagc

SEQ ID NO: 42525 - DNA, 50 bp, homo sapien
actgacacagatattagaattagcayacaatgacgttaaaacatttattg

SEQ ID NO: 42526 - DNA, 50 bp, homo sapien
atcacacattgtcttcatacgcctaycctagtttatcacctttatacaca

SEQ ID NO: 42527 - DNA, 50 bp, homo sapien
aactgaatccaaactcactattttcrcagtggttgttatcggtcctgccc

SEQ ID NO: 42528 - DNA, 50 bp, homo sapien
aaggctttaaacagccataattaccygaatgacattttatgtgaaaaata

SEQ ID NO: 42529 - DNA, 50 bp, homo sapien
atttgtcttacagggttgataattaygatgaaactagttatattaattag

SEQ ID NO: 42530 - DNA, 50 bp, homo sapien
aatgggtttagtatttctttacagcrccatttggtaaactctgatgacca

SEQ ID NO: 42531 - DNA, 50 bp, homo sapien
atttatcatctcaagaagttgtaacrgtgggcctttcactttagaggaaa

SEQ ID NO: 42532 - DNA, 50 bp, homo sapien
aataatactgatgatagtataaacartcactatttccatggttttttcta

SEQ ID NO: 42533 - DNA, 50 bp, homo sapien
aggcaatggaatctggtctcttcaartgagtgacctacatataacggaca

SEQ ID NO: 42534 - DNA, 50 bp, homo sapien
ctatctctcaggcctggattaagaawgaaatcaaacaaggtaacttatta

SEQ ID NO: 42535 - DNA, 50 bp, homo sapien
acaaatttctacaccctcatgttggratggtgaataacattgactttgca

SEQ ID NO: 42536 - DNA, 50 bp, homo sapien
acttagtttcctcaactatgaattamgaatgatagaaccacaagagcaaa

SEQ ID NO: 42537 - DNA, 50 bp, homo sapien
aatgaatcaaaatcctgaaccctggratacttagctttccttccagacag

SEQ ID NO: 42538 - DNA, 50 bp, homo sapien
agttatcttgttaagcacaaaagcartacagaatgttagatgcagaatat

SEQ ID NO: 42539 - DNA, 50 bp, homo sapien
catctctccctgcccagagtaaagaytatggagatgaggacgtgacctat

SEQ ID NO: 42540 - DNA, 50 bp, homo sapien
tcttacaactggtttgtggtggagcyaagtttgggcccctgaacttttat

SEQ ID NO: 42541 - DNA, 50 bp, homo sapien
tgctgctagcttgttgctgaacccaratatgaagccacggacttgggctg

SEQ ID NO: 42542 - DNA, 50 bp, homo sapien
cttttaatcaacctgctttacataaygtatgtttttcatcaaaggcgatt

SEQ ID NO: 42543 - DNA, 50 bp, homo sapien
agttccaagctcctagagggctaaaytacatccccgatcctttctgaagt

SEQ ID NO: 42544 - DNA, 50 bp, homo sapien
cccaccagacatgacgtacaggagcratgaggagtttcctggagagaata

SEQ ID NO: 42545 - DNA, 50 bp, homo sapien
ctattaaataaaatcaagtttattcmaggaatgaccaggagttttcatca

SEQ ID NO: 42546 - DNA, 50 bp, homo sapien
aaacatagcaaggcatcatcagaacrgccattgaatagaacacattaagt

SEQ ID NO: 42547 - DNA, 50 bp, homo sapien
tctagaatccctctttaccttttcaygtacactatcctgattagctcagg

SEQ ID NO: 42548 - DNA, 50 bp, homo sapien
ctcagaaaagttgttgtgtttggtcmaatgaaggcactggggccaaagaa

SEQ ID NO: 42549 - DNA, 50 bp, homo sapien
gttaaggaaacacaatttaactgacrgcagaactaagggcatgtgttgga

SEQ ID NO: 42550 - DNA, 50 bp, homo sapien
tgcctcgtaacacatttagatttacwcaatttcctagaaatgcagacaca

SEQ ID NO: 42551 - DNA, 50 bp, homo sapien
tctcccctggccctttgtacctaacrccctgatgatgtaccctttttttg

SEQ ID NO: 42552 - DNA, 50 bp, homo sapien
tatgatgatttgtctactcaaaagamaaccttatagacacaaagtctgtt

SEQ ID NO: 42553 - DNA, 50 bp, homo sapien
ggtctcaggcccatctgtctaaccaygcagccgttctgccacgggtctgg

SEQ ID NO: 42554 - DNA, 50 bp, homo sapien
cgaacttatcatgacctttggttaayttaacatactcctgtagtctttca

SEQ ID NO: 42555 - DNA, 50 bp, homo sapien
gagacatgtttgaaaggctattctayctatgcattagtggaatcccaaaa

SEQ ID NO: 42556 - DNA, 50 bp, homo sapien
atcagactccttcccagaatccaaaygcttccaaaggatgttcagtgtgg

SEQ ID NO: 42557 - DNA, 50 bp, homo sapien
gcttggatttaaatcacaataacacygagggaagatgaatgacagtgcta

SEQ ID NO: 42558 - DNA, 50 bp, homo sapien
aaattgttgcaactgtagttgtaagraaaatactacctcaaggcccgatc

SEQ ID NO: 42559 - DNA, 50 bp, homo sapien
ttgtctccagcagtgcctcctttggyagtgaatttcaggtgtgttattcc

SEQ ID NO: 42560 - DNA, 50 bp, homo sapien
gccaatatcaaacagaacacttttcratttgatgtaaaaattaaggatta

SEQ ID NO: 42561 - DNA, 50 bp, homo sapien
aactcactgtatgtgagagaaatacsaagttctatgccaaatccatctca

SEQ ID NO: 42562 - DNA, 50 bp, homo sapien
aggtgaaggtggcattctcctctgaygtggtggcattttcccattccaat

SEQ ID NO: 42563 - DNA, 50 bp, homo sapien
taattaattctaagactatctggtcracaagtatttttaaaacagacatt

SEQ ID NO: 42564 - DNA, 50 bp, homo sapien
ttatgatgatcatcagtctacagagraagaaacttgctttatttctttac

SEQ ID NO: 42565 - DNA, 50 bp, homo sapien
aacacaaggaactgtacatgaggaaytgcagaagcaacagagagaagaaa

SEQ ID NO: 42566 - DNA, 50 bp, homo sapien
ctactaatttgctgttggtgtgtccyatctataattgtaagatacatatt

SEQ ID NO: 42567 - DNA, 50 bp, homo sapien
catggtaatgatacaggagttaagargaaactaattagtcagatagtgag

SEQ ID NO: 42568 - DNA, 50 bp, homo sapien
acctatcaagtaaaggcctcgttcarctttatttttgcagtcagaattgt

SEQ ID NO: 42569 - DNA, 50 bp, homo sapien
tacatacaatagataactaatacacyctcttctctttttgggattccact

SEQ ID NO: 42570 - DNA, 50 bp, homo sapien
atatttgtttctatatgctaagtttraaaaccaaccatagcctaggtcct

SEQ ID NO: 42571 - DNA, 50 bp, homo sapien
ggactgataattgctcagatcagaayttaactgcatgtagtaaatgaata

SEQ ID NO: 42572 - DNA, 50 bp, homo sapien
tgagtttggttaagtgtttagatatractttacataaaaggcatctgata

SEQ ID NO: 42573 - DNA, 50 bp, homo sapien
aaacaacataatcatgatatctactracatttaggtatcatttattctat

SEQ ID NO: 42574 - DNA, 50 bp, homo sapien
gctcacattttattcattaaaggacrcacatagacacaattgttacagaa

SEQ ID NO: 42575 - DNA, 50 bp, homo sapien
ttgttattaactacagcatgtaacasactcattcattgaattgtgttcag

SEQ ID NO: 42576 - DNA, 50 bp, homo sapien
cgggcactgtgccaagtgctttcacrgaattttatattttatctttgcaa

SEQ ID NO: 42577 - DNA, 50 bp, homo sapien
atagagagcttctgtagtcaagcaasacaggtttgaatggactagaagca

SEQ ID NO: 42578 - DNA, 50 bp, homo sapien
actgcttacactatttatggtatgaygttatataagatccaataaaagtg

SEQ ID NO: 42579 - DNA, 50 bp, homo sapien
cacagcaaaagcctttctgataagcrgagatcaataccaggagaatatct

SEQ ID NO: 42580 - DNA, 50 bp, homo sapien
aacttctgcttgttgtattcatagcyaatattttttccaaatagtgtttt

SEQ ID NO: 42581 - DNA, 50 bp, homo sapien
aggacataaatagtgtgttctgaaargtacttgcacccttagttacccca

SEQ ID NO: 42582 - DNA, 50 bp, homo sapien
taagcttgtaagtcatctagaaggcmacttcattctttccaaggaaattg

SEQ ID NO: 42583 - DNA, 50 bp, homo sapien
ggtctgaggattcgatggtagcgacrcgctcacgttgctttcctgatgct

SEQ ID NO: 42584 - DNA, 50 bp, homo sapien
agcctgaaaaataactgtcttcatcraaaacttagttccccagttgtttg

SEQ ID NO: 42585 - DNA, 50 bp, homo sapien
gtgttaatcaggcacacacagcagcratagaaggcatctgagtttcattt

SEQ ID NO: 42586 - DNA, 50 bp, homo sapien
aacagaaaccctttcttagcctgaawgtcatgtgaaacaaacaaataaac

SEQ ID NO: 42587 - DNA, 50 bp, homo sapien
tgagccatcctgggacagaatgagcrgagtttcatgagcaggtggttcct

SEQ ID NO: 42588 - DNA, 50 bp, homo sapien
attgataaaacactacagtttaaaarctcacatttatcattttagagaga

SEQ ID NO: 42589 - DNA, 50 bp, homo sapien
aaggttactttaatgcaacatggacyatgccatttatattggtctgtgac

SEQ ID NO: 42590 - DNA, 50 bp, homo sapien
agatcaacctgaggccatttgggtaygttgtgcaaaaatcaatcctttaa

SEQ ID NO: 42591 - DNA, 50 bp, homo sapien
atagctgaaaaagatgcaaaaaatcmaccctacttcatgctgggaagagt

SEQ ID NO: 42592 - DNA, 50 bp, homo sapien
tgtctggaatagaagggtacttagawcataagagcgttcagctgaaagag

SEQ ID NO: 42593 - DNA, 50 bp, homo sapien
ataactccttttcttcaaatacccasagcatattagataccaagaagcct

SEQ ID NO: 42594 - DNA, 50 bp, homo sapien
ggaagaagacaaagagaaaggcaaaygtattgtgtatctaaaaagcatgt

SEQ ID NO: 42595 - DNA, 50 bp, homo sapien
atctgactctacggattgtactcaakggaatatcctctacagagtttact

SEQ ID NO: 42596 - DNA, 50 bp, homo sapien
caccctaccactaacttgcttcttayctgaaaagattttggagaagagct

SEQ ID NO: 42597 - DNA, 50 bp, homo sapien
tacacaagactaaatagtgttaggaygttcagttattcagttagatcaag

SEQ ID NO: 42598 - DNA, 50 bp, homo sapien
gacaaatcttggtgttgccaatcacwcaaggtttccatgagaatcacatg

SEQ ID NO: 42599 - DNA, 50 bp, homo sapien
tcactttctctttttcttaatgccawgtctgctttcttctctagattgta

SEQ ID NO: 42600 - DNA, 50 bp, homo sapien
agcctctgccctcaagcaaattacartctagagaagaaagcagacatggc

SEQ ID NO: 42601 - DNA, 50 bp, homo sapien
tgttctactcctatgggcaagacacrgaaagtgggtcaaccaaagtcaat

SEQ ID NO: 42602 - DNA, 50 bp, homo sapien
atgatcacgtttgaattttctcaaaygctcaacagatccattcatgtaag

SEQ ID NO: 42603 - DNA, 50 bp, homo sapien
gttaatcaaacttccttctctttgakactcaagcaagcatcaaatacaca

SEQ ID NO: 42604 - DNA, 50 bp, homo sapien
tgtttagctcagtttaatgggtatgyatcaaacttagtacctacaaagaa

SEQ ID NO: 42605 - DNA, 50 bp, homo sapien
gagacatttaaatttcaaaaacacgrccttgtggagttcaaagataacaa

SEQ ID NO: 42606 - DNA, 50 bp, homo sapien
cttggtgatttcataatctccttaaygcagagaaaggtagcaagtggatg

SEQ ID NO: 42607 - DNA, 50 bp, homo sapien
ttgaatgataagagctggagcctaaytcagaccagtgcaaggaggaccac

SEQ ID NO: 42608 - DNA, 50 bp, homo sapien
atgcccagaaagatggaaaattttaycagactgttgatggatctcacact

SEQ ID NO: 42609 - DNA, 50 bp, homo sapien
ccagtaggagagaactagatgaactraatgaaaagatgctccacctacag

SEQ ID NO: 42610 - DNA, 50 bp, homo sapien
tcaacaacatagtttctaggaacatwagcacctaagaatgaaaaaatgtt

SEQ ID NO: 42611 - DNA, 50 bp, homo sapien
cacacttacgaacttgaccttccatkaatttaaatttgtgacctgtttcc

SEQ ID NO: 42612 - DNA, 50 bp, homo sapien
cctctctgtttggaggtatgtaaacrcagcttaaaatgaaacagaacctt

SEQ ID NO: 42613 - DNA, 50 bp, homo sapien
cagcaggacgatgacaaagcctaaarccaaaccatggataggtgtgacta

SEQ ID NO: 42614 - DNA, 50 bp, homo sapien
atggaccaaagtgcacttactgatckcatttgcagttgggaaacagatgc

SEQ ID NO: 42615 - DNA, 50 bp, homo sapien
ccactgagaacagcagccctgtaccrcacaaagaaactaacagtccatga

SEQ ID NO: 42616 - DNA, 50 bp, homo sapien
tatcatatcatatttgtattcatcarcagcttcatcacaaatattctgta

SEQ ID NO: 42617 - DNA, 50 bp, homo sapien
tttatctctttatgtcaatccttacratattcttagggagactaaccacc

SEQ ID NO: 42618 - DNA, 50 bp, homo sapien
attctttaaatagcagttacatgaaytcataataaataggtattaggtgt

SEQ ID NO: 42619 - DNA, 50 bp, homo sapien
tgtggagtgaatttgcctttgttccrgcctggagtggaagcaagaataca

SEQ ID NO: 42620 - DNA, 50 bp, homo sapien
tcagcagagtcaatgccacaacaaarattaaggtttgtgtataataagca

SEQ ID NO: 42621 - DNA, 50 bp, homo sapien
atgtacctagcctggagcttgacaartagtagatgtataagaaatgtttg

SEQ ID NO: 42622 - DNA, 50 bp, homo sapien
agtttgtttaacaagactggtcatartaccttcaaggcaagagcaaattg

SEQ ID NO: 42623 - DNA, 50 bp, homo sapien
ccagaaacagctcacataggactgaygatatgcactgctaatttaaccac

SEQ ID NO: 42624 - DNA, 50 bp, homo sapien
accacagagaataaaatttcagtgcratgactttcagcaatgtttttcaa

SEQ ID NO: 42625 - DNA, 50 bp, homo sapien
ttaggggccagaaattaaggagtgcsaggattttgctccacagtgaaaga

SEQ ID NO: 42626 - DNA, 50 bp, homo sapien
gagcaaggccttgccatctgcaacasaggattaggcagccttgagaaatg

SEQ ID NO: 42627 - DNA, 50 bp, homo sapien
agaaccagggaaaagcaaatgtcgasaaagatttcagaggcagacgccgg

SEQ ID NO: 42628 - DNA, 50 bp, homo sapien
tcatcatgagtattaatcctaaaaamcaattgaaggtgcaggtgccatta

SEQ ID NO: 42629 - DNA, 50 bp, homo sapien
taacttttcttagtcctctttctaaygagaatcttatagtttaaggcttt

SEQ ID NO: 42630 - DNA, 50 bp, homo sapien
tttagattcatgtgggaatactgaaygctgaaatgaacgagcagaaatat

SEQ ID NO: 42631 - DNA, 50 bp, homo sapien
ctccaccagcattgtctgcactaacmacgaggcttagagatttgtccagt

SEQ ID NO: 42632 - DNA, 50 bp, homo sapien
gtgtgcaagagagacttgactttgcwcttctgcagaactaccttggtgac

SEQ ID NO: 42633 - DNA, 50 bp, homo sapien
gcagctgccaaacagtagggcaacartatttccaaagccaagcaaggcca

SEQ ID NO: 42634 - DNA, 50 bp, homo sapien
ttaataggagtcttggtggtgttcayggaaaattatccaagctctctcta

SEQ ID NO: 42635 - DNA, 50 bp, homo sapien
gagatcagctactctgagtttttcayagaaagtaaacactaatttgggaa

SEQ ID NO: 42636 - DNA, 50 bp, homo sapien
tgtggagataccctgcaagtagaccraatgtgagaaagccacaggagtac

SEQ ID NO: 42637 - DNA, 50 bp, homo sapien
aattgtgtcttttgttcaccaataamtaaaatgtctgtgggattgttttt

SEQ ID NO: 42638 - DNA, 50 bp, homo sapien
agaaaccttgtgaaggtactaaataygacaacatcttcagtaacagagga

SEQ ID NO: 42639 - DNA, 50 bp, homo sapien
ctccaggactgcccctgttttccaarttagcataatctactctggaagtt

SEQ ID NO: 42640 - DNA, 50 bp, homo sapien
tactttacgtactttaagatgatgascaaaatccttactgtctccctgca

SEQ ID NO: 42641 - DNA, 50 bp, homo sapien
ttcactggaacatataattcatacarataattcaagggcaacaaatggga

SEQ ID NO: 42642 - DNA, 50 bp, homo sapien
atgcttgaatttacactcatgagtcmatttcaagtaagaagagggagtaa

SEQ ID NO: 42643 - DNA, 50 bp, homo sapien
tttggtgcattcctttgacccatgckgagaattctatcagaagcagcagg

SEQ ID NO: 42644 - DNA, 50 bp, homo sapien
tagaagtgaacagcgtgtcttgaaaraaccaattccaaactttaagcata

SEQ ID NO: 42645 - DNA, 50 bp, homo sapien
ctataccttgacgttatctactacayattgatttgtcagcctataagtat

SEQ ID NO: 42646 - DNA, 50 bp, homo sapien
catatggtcactctatttgataacartaatctgtgatgactatgttaatc

SEQ ID NO: 42647 - DNA, 50 bp, homo sapien
gaacacaattgttctgaaatcatagyaaaaattgcaaagggctttcaaaa

SEQ ID NO: 42648 - DNA, 50 bp, homo sapien
tgcctgaatcatttcctctttctgakgcgtctagagaacagccaggtgta

SEQ ID NO: 42649 - DNA, 50 bp, homo sapien
tggtcacataacgctaggagatttgyacctctgatatatgccagtcttcg

SEQ ID NO: 42650 - DNA, 50 bp, homo sapien
gttttcaaaaatggcacatcattcckccatatacaacaacaaactcagtc

SEQ ID NO: 42651 - DNA, 50 bp, homo sapien
atatgtcaaatccagtgatacttccyaattgcatagagcccaatttagcc

SEQ ID NO: 42652 - DNA, 50 bp, homo sapien
ggttccccacagtcaggaactaaccrgaaggcgggagacttgagaccttg

SEQ ID NO: 42653 - DNA, 50 bp, homo sapien
aggaatctgttttctttttgagccaytggaactctttaatatattaccag

SEQ ID NO: 42654 - DNA, 50 bp, homo sapien
aatgtaaaatgaactaagatacttamcatctaagaaactcctgaatcatt

SEQ ID NO: 42655 - DNA, 50 bp, homo sapien
ctaacaatacccactaagagactacrctaccgagtgctcagattttggca

SEQ ID NO: 42656 - DNA, 50 bp, homo sapien
tctgtccaagtccttggctttcatcrgactctcaaaggagcctcagaaag

SEQ ID NO: 42657 - DNA, 50 bp, homo sapien
gattccaggatacatttgtcaggaamaagtaatcaaaattcactctttga

SEQ ID NO: 42658 - DNA, 50 bp, homo sapien
ttgggtattaaaaaattattctaaarttcaccagaagaataaagatggaa

SEQ ID NO: 42659 - DNA, 50 bp, homo sapien
tggatacccatagtaagcaataagasagcgaaaagaaaagatcaatgctt

SEQ ID NO: 42660 - DNA, 50 bp, homo sapien
atttatatgcacaaggatgtatatakagctgtcaacagggattggaaagc

SEQ ID NO: 42661 - DNA, 50 bp, homo sapien
gatgtcagacctcactagaaaactcygaggtggatgggttttgttctctc

SEQ ID NO: 42662 - DNA, 50 bp, homo sapien
tggcctttacacaaaggatcggttasaaagctcctcatactgtggttaga

SEQ ID NO: 42663 - DNA, 50 bp, homo sapien
gttatttgtttttgctggttgcgaakcactgggatattttctttcttttt

SEQ ID NO: 42664 - DNA, 50 bp, homo sapien
gtctgcaagcataaagctaaataacrcatcccattaatcaataaaatgct

SEQ ID NO: 42665 - DNA, 50 bp, homo sapien
ctaggatgataacatttttgaaccckgatactgtatttaagggtataaga

SEQ ID NO: 42666 - DNA, 50 bp, homo sapien
atggaatagtggttctagactagaargagctaatgttctcagacaagagc

SEQ ID NO: 42667 - DNA, 50 bp, homo sapien
tgctccttcagtagatatattgtgaygagtataaaatatgtttcttatgt

SEQ ID NO: 42668 - DNA, 50 bp, homo sapien
gaattgctaagactggttaaggaaaygtctactccagagtttagctctcc

SEQ ID NO: 42669 - DNA, 50 bp, homo sapien
aaaccaaggacattttattccatcaytaaacgtatgtgcaggtactgcaa

SEQ ID NO: 42670 - DNA, 50 bp, homo sapien
aaaatacaaagcagtacctatcttayctctgatgtaattaaagtgtccat

SEQ ID NO: 42671 - DNA, 50 bp, homo sapien
tggcatagaccttggtctgtactgcsgatgagagccgtagatgctcaggg

SEQ ID NO: 42672 - DNA, 50 bp, homo sapien
ataaagacatatgatgccgagaatayagggactttctattatatcaaaaa

SEQ ID NO: 42673 - DNA, 50 bp, homo sapien
aaaaataaatatataaataataaatmatgctgacagtttaaatttcaaca

SEQ ID NO: 42674 - DNA, 50 bp, homo sapien
aaattaaatctttatacttgtcccartgatgaggtagccagatgagagca

SEQ ID NO: 42675 - DNA, 50 bp, homo sapien
ctgtgacaaattggagggttgcctayggggcctctaggttgcagggacag

SEQ ID NO: 42676 - DNA, 50 bp, homo sapien
tgggtttgttaatttctaattggacygaacacttgttgtggcagttttgg

SEQ ID NO: 42677 - DNA, 50 bp, homo sapien
tatttgttaatgattattttatttaygatgctttgagaaaatactgagca

SEQ ID NO: 42678 - DNA, 50 bp, homo sapien
cccataggcttttgagaagaagaacragtggatataaagaaatgtggcat

SEQ ID NO: 42679 - DNA, 50 bp, homo sapien
agttattgtctgtaaatcccagttargtactcaaagatttaaagtgtaat

SEQ ID NO: 42680 - DNA, 50 bp, homo sapien
ttggacagattctgttgtcctcgacrcgtctctttataaagtggtaaaag

SEQ ID NO: 42681 - DNA, 50 bp, homo sapien
tgtcttaaaccattggaagcaaaacsgttttcccatgacattctggcctt

SEQ ID NO: 42682 - DNA, 50 bp, homo sapien
gaacgactatagcataatatcgaaamtgaaaaattgaaattggtggtggc

SEQ ID NO: 42683 - DNA, 50 bp, homo sapien
ctgacagtgatgagtatgtttttccsgacagagtgcaggctgccttctaa

SEQ ID NO: 42684 - DNA, 50 bp, homo sapien
cacagcacaacgtttgtgcagaaaaygacctcaactgagtgggcacgtgg

SEQ ID NO: 42685 - DNA, 50 bp, homo sapien
gctaaatactctgctgtgacttttawactgctgatttgaataaaatctta

SEQ ID NO: 42686 - DNA, 50 bp, homo sapien
acctcattagaacttatgaaaacatyatctataagtactgaaaggcaata

SEQ ID NO: 42687 - DNA, 50 bp, homo sapien
ttacagcatgtcacccccttgtcacrattcctccaaaagtagaacttgtc

SEQ ID NO: 42688 - DNA, 50 bp, homo sapien
gcttccatcccttcctttcaaattcratcacctcaccatgttaccagccc

SEQ ID NO: 42689 - DNA, 50 bp, homo sapien
ttgaagtgaatacttgtcaagtcatwacaaggagaaatgtctctaattaa

SEQ ID NO: 42690 - DNA, 50 bp, homo sapien
gttctgaaagtgatttgaggttagcrgccagagtgaaagcatgagtctct

SEQ ID NO: 42691 - DNA, 50 bp, homo sapien
tgtttgccatggaattatagaagcckagggaagtatagaagacttcattt

SEQ ID NO: 42692 - DNA, 50 bp, homo sapien
atcaagtgggtaaaatactggatacyggcagtcttcaggaatatcccgga

SEQ ID NO: 42693 - DNA, 50 bp, homo sapien
gctctttaatcagtacctggttctaygacttcatcaacatccagttagag

SEQ ID NO: 42694 - DNA, 50 bp, homo sapien
agaccaacaatatacattgggtttcyattgcatcttcaggatcctgttcc

SEQ ID NO: 42695 - DNA, 50 bp, homo sapien
gaaaacaaaggacttctaggaaagakaatatgctagttttgtgacagtgt

SEQ ID NO: 42696 - DNA, 50 bp, homo sapien
attgtttttttctaatacatactgarcattgtcactacaaatccatctga

SEQ ID NO: 42697 - DNA, 50 bp, homo sapien
ctggcatcctatcaggcaccaggaasacttacatgtggtagttcgtgtgg

SEQ ID NO: 42698 - DNA, 50 bp, homo sapien
acatacatatatgcagaagtagttayccagtacatctctgaaaatttttt

SEQ ID NO: 42699 - DNA, 50 bp, homo sapien
tttgttccagaaagagccaaagttaygatgttttactcatccatatgtaa

SEQ ID NO: 42700 - DNA, 50 bp, homo sapien
taaatgcacgtaagggaaacatactragtaaccaagatgtgtcttggacc

SEQ ID NO: 42701 - DNA, 50 bp, homo sapien
gctttaccagatgccgaatacccatkactgtttaggtctatttctagact

SEQ ID NO: 42702 - DNA, 50 bp, homo sapien
cggaaaacatcttggcagtttaaccrctattgtaatactcatgtattgat

SEQ ID NO: 42703 - DNA, 50 bp, homo sapien
gagtggagcacattgtgactgttcayatcccattggctagaattcagtca

SEQ ID NO: 42704 - DNA, 50 bp, homo sapien
tttacaataagaaatggagttggcaygggcactaggaactgcatccttat

SEQ ID NO: 42705 - DNA, 50 bp, homo sapien
atgtgtttgttcgcagacttactcaygaatcgttgactgcccttgaaatt

SEQ ID NO: 42706 - DNA, 50 bp, homo sapien
gcactatctgttttcctgcaaaggayctcaaacatacctactttttctca

SEQ ID NO: 42707 - DNA, 50 bp, homo sapien
ttttttttcctaaaatttctgatgartaatttggctgttttttgaatcct

SEQ ID NO: 42708 - DNA, 50 bp, homo sapien
atttattttaggaataagttctttgraggagaagtggatgatggacacaa

SEQ ID NO: 42709 - DNA, 50 bp, homo sapien
tttggtagacttgatgatttaagtayatattgttcactggatgattctac

SEQ ID NO: 42710 - DNA, 50 bp, homo sapien
tagaattaattagaggaaaatctaawgtcagcataaatagcttcaaactg

SEQ ID NO: 42711 - DNA, 50 bp, homo sapien
actcccaatttaattgcttgtgtaaytagagttaattgcagagtagaggt

SEQ ID NO: 42712 - DNA, 50 bp, homo sapien
aggactcagtctgccgctctgtgaartggagaagttgtgtaaggcctctc

SEQ ID NO: 42713 - DNA, 50 bp, homo sapien
ctttctgcttctgggagctaatgccrccagtgcagtgatacatggaagtg

SEQ ID NO: 42714 - DNA, 50 bp, homo sapien
taaatgaaggcactgaccaaacatascaatgacgaaaacaaccaccacca

SEQ ID NO: 42715 - DNA, 50 bp, homo sapien
aagatggtacctgcgaggtctgtaayaaacagatgcagggtttagtcact

SEQ ID NO: 42716 - DNA, 50 bp, homo sapien
aaatttgccaaattaaaatttatcarcagcaataatggaaaaaatctatt

SEQ ID NO: 42717 - DNA, 50 bp, homo sapien
cataaaggaaaatctaagtatcatargcacaaaactttggtattttaacc

SEQ ID NO: 42718 - DNA, 50 bp, homo sapien
atgtcttggactttttagcaactgaycataaaagtctgaaggatggattt

SEQ ID NO: 42719 - DNA, 50 bp, homo sapien
tcttaaaacctacaaattagtgcacragtactacaactgatgtgccttac

SEQ ID NO: 42720 - DNA, 50 bp, homo sapien
gaaagcacagttgtcttacaggttayattcgcgagaaaatctccaaggtg

SEQ ID NO: 42721 - DNA, 50 bp, homo sapien
tatccataaccttctggtctcccatsactatcaatgacttaaagttggat

SEQ ID NO: 42722 - DNA, 32 bp, homo sapien
ttgatttttcagaccaygtgtactgatccaaa

SEQ ID NO: 42723 - DNA, 50 bp, homo sapien
atctgtcattcagcttcttcctaccragtgtgaggtgccacactcttcag

SEQ ID NO: 42724 - DNA, 50 bp, homo sapien
tctttctgcagctctaattagtgccrcagggaaccatggatgaaaatggc

SEQ ID NO: 42725 - DNA, 50 bp, homo sapien
acccagaaggaaaactctcagaggtyaatggactatattctttacctggg

SEQ ID NO: 42726 - DNA, 50 bp, homo sapien
cagaaaaaggaattgaaaataatcgycacccagaagatccagaaaactga

SEQ ID NO: 42727 - DNA, 50 bp, homo sapien
tccctttctggtgtcgagctactggraacatcgctgttgaactgtgtatc

SEQ ID NO: 42728 - DNA, 50 bp, homo sapien
ataaggcctttgtcattgttagtcamcttagatgtgaatatcagtagggc

SEQ ID NO: 42729 - DNA, 50 bp, homo sapien
taacaatcggtttgttagaatccaartaaaggatccaacgctggtttttt

SEQ ID NO: 42730 - DNA, 50 bp, homo sapien
cttagaatttatggttcttttaaaayttaacaagtcagtgctcttcatag

SEQ ID NO: 42731 - DNA, 50 bp, homo sapien
ggttctgagatacactgttgagtgargagaagtgtgctgcggacaataca

SEQ ID NO: 42732 - DNA, 50 bp, homo sapien
acctcataggctttatctcctttaaraaatctctgatactgggtaagtga

SEQ ID NO: 42733 - DNA, 50 bp, homo sapien
ggcagactttttaccaaataatgccragaaaactggatattcatatgccg

SEQ ID NO: 42734 - DNA, 50 bp, homo sapien
ccagtgctctggagagaaataatgarcatgaattttttaaacaccagctg

SEQ ID NO: 42735 - DNA, 50 bp, homo sapien
ttataaggctcgagagagagatgtaygctttcccacattcttcacatttg

SEQ ID NO: 42736 - DNA, 50 bp, homo sapien
cctttatctaccaattttctccatcyagaaccttgggaacccttcttcaa

SEQ ID NO: 42737 - DNA, 50 bp, homo sapien
acatttctgagcatgtacatcatgcyagaccctgcagcagaaaaaaataa

SEQ ID NO: 42738 - DNA, 50 bp, homo sapien
attaaagaaacccaagtatactgaarcaatgtatcaaagtatttaaaata

SEQ ID NO: 42739 - DNA, 50 bp, homo sapien
aagaataatttggatggccaattagmaatgctcttttgagctggggcatt

SEQ ID NO: 42740 - DNA, 50 bp, homo sapien
ttctgttactaaatataaaagctatsaagccttctgatgcatcatcaggt

SEQ ID NO: 42741 - DNA, 50 bp, homo sapien
cctttgactatggcagtgtttcccaragtaaactgatcataggaaaaaaa

SEQ ID NO: 42742 - DNA, 50 bp, homo sapien
aagcaattgtttggcttttattcacyggggttttctatgtcagtgctgat

SEQ ID NO: 42743 - DNA, 50 bp, homo sapien
gttattatatttaacaaaatgtgaaygaaaccacaaattattgtaaaagc

SEQ ID NO: 42744 - DNA, 50 bp, homo sapien
aagcctgaatcgtatttaatgctccrcttgagctgttaagaatagtaaga

SEQ ID NO: 42745 - DNA, 50 bp, homo sapien
gctctttgtacttagtgacagaaacracattgcgatgtgaaggttactct

SEQ ID NO: 42746 - DNA, 50 bp, homo sapien
gaaattcaaaattggagattgtagargcatagcagaattactcagtagta

SEQ ID NO: 42747 - DNA, 50 bp, homo sapien
taatctatttacttgggcatgtcccrcaaaattatacatcccttgaggga

SEQ ID NO: 42748 - DNA, 50 bp, homo sapien
agcttcttgagatgtctgcctctagraacagtattcttccttttaatagg

SEQ ID NO: 42749 - DNA, 50 bp, homo sapien
gggactttattttgtgtgggagagarcagaatatggatagatttgctgaa

SEQ ID NO: 42750 - DNA, 50 bp, homo sapien
cagggaagttacagtcaattgcttaraggttatttagtaaataaatggca

SEQ ID NO: 42751 - DNA, 50 bp, homo sapien
agtgagatgtatgagagaccattcargtataggaaacatctctgatttga

SEQ ID NO: 42752 - DNA, 50 bp, homo sapien
gagaatttgaaaccctcaaacgatamtactagaaatgtaaaatagagcag

SEQ ID NO: 42753 - DNA, 50 bp, homo sapien
gggtaagtgaaaagatgcttgtgtaygtatgaatgatgaatgagaaacaa

SEQ ID NO: 42754 - DNA, 50 bp, homo sapien
cctgaacctccaccaagtctttcccratgagatgtaatctttccctcatt

SEQ ID NO: 42755 - DNA, 50 bp, homo sapien
agagctgtaaaatgtgcttattctaygagacctgcaccgaaattaccttt

SEQ ID NO: 42756 - DNA, 50 bp, homo sapien
ctctcagtccgttttccagtcaaacsatttgttacttgattcagttccaa

SEQ ID NO: 42757 - DNA, 50 bp, homo sapien
tgacctttcacttactgtcttcttcrccctgcttgggtcacgtgatgctt

SEQ ID NO: 42758 - DNA, 50 bp, homo sapien
ccataaagagatacataagtcatggyacttgttcctctgggcctcagaag

SEQ ID NO: 42759 - DNA, 50 bp, homo sapien
gtagaagatttttattgctgtgaacrgtaggaacagctcctattagagcc

SEQ ID NO: 42760 - DNA, 50 bp, homo sapien
tcacccgtcagctgacttcttagcaracctttccacctctctgagtctca

SEQ ID NO: 42761 - DNA, 50 bp, homo sapien
taactcaagtgacatttaaaacttayggaaacatcaaatgtatcaacacg

SEQ ID NO: 42762 - DNA, 50 bp, homo sapien
agcttataattattcatctctaaagscttctatgaaattattccttctgc

SEQ ID NO: 42763 - DNA, 50 bp, homo sapien
cttggttggactggagcatggctacraagaaaactattggggccaatccc

SEQ ID NO: 42764 - DNA, 50 bp, homo sapien
gcacaaacaaaaaagacttgaagaaygagggaattgaatacacagcgttc

SEQ ID NO: 42765 - DNA, 50 bp, homo sapien
tgtgcaatacagtatttagattttaygggaaaacacaccctacactgaac

SEQ ID NO: 42766 - DNA, 50 bp, homo sapien
cagacctctggtccggacaatgaacwacccatagaacaagatctgatttg

SEQ ID NO: 42767 - DNA, 50 bp, homo sapien
aaataacaggcaagtctagataccaygagagctagcaacctgaagaagtc

SEQ ID NO: 42768 - DNA, 50 bp, homo sapien
agcttgcgagagagaaggcgttgtcygaacagctagagtattatgactgg

SEQ ID NO: 42769 - DNA, 50 bp, homo sapien
accaggaggaggaagtgctccagccraagtaaaagcagaccagtcagagc

SEQ ID NO: 42770 - DNA, 50 bp, homo sapien
gcatgcctgtttaccatagttattayatttgtcagcggtgatattggttt

SEQ ID NO: 42771 - DNA, 50 bp, homo sapien
aatactgataaatgatggttatagtyaagtaatcatgtgtggaaatgaac

SEQ ID NO: 42772 - DNA, 50 bp, homo sapien
agactccaactcctgcttctcttggratctctgcccagagtccaatctcc

SEQ ID NO: 42773 - DNA, 50 bp, homo sapien
ctcgacacatccaaatgtgaacacakcttctccacaaagtgccccttcac

SEQ ID NO: 42774 - DNA, 50 bp, homo sapien
ccagcagctacattctaggggtgccyggacgtcctggtctcttgagatga

SEQ ID NO: 42775 - DNA, 50 bp, homo sapien
taaaaagtgaagctggtccaggttayagactactcttagtgtattttcag

SEQ ID NO: 42776 - DNA, 50 bp, homo sapien
aatacagaacaattctttaatctcaygtggcagcagcaaaatatgtgtgc

SEQ ID NO: 42777 - DNA, 50 bp, homo sapien
ggggaatcagatgcaaaatgatgaawgaggagaaatagttcttttttttt

SEQ ID NO: 42778 - DNA, 50 bp, homo sapien
gacaagtactttagcttttacctccragatactttgctttgcacagaact

SEQ ID NO: 42779 - DNA, 50 bp, homo sapien
agagattagtctaaagataccttccraatcagagttcctctttgcaagat

SEQ ID NO: 42780 - DNA, 50 bp, homo sapien
gagatcagtgaactaaccggaaccargagggctctagttacagtcattaa

SEQ ID NO: 42781 - DNA, 50 bp, homo sapien
aagggaacgtcttgacttctgcttaygtaaaatgagactgttccatccct

SEQ ID NO: 42782 - DNA, 50 bp, homo sapien
tcagtatttggagggtcagtaagaaygaaccaagcaaagcagaaggggaa

SEQ ID NO: 42783 - DNA, 50 bp, homo sapien
tgtccacatctcttccaggacttgcraagttttcagctattattttatta

SEQ ID NO: 42784 - DNA, 50 bp, homo sapien
ctgaactgataaatgtatttcacaawtagggcacctgttcctgaattaac

SEQ ID NO: 42785 - DNA, 50 bp, homo sapien
aaacctcagagattaaaaacaggtaycaagaattaatcaggccaaatatt

SEQ ID NO: 42786 - DNA, 50 bp, homo sapien
cctgactagcactcctcaaagccatsaaggttatcaaaaataagaaaagt

SEQ ID NO: 42787 - DNA, 50 bp, homo sapien
tacgggaagtcgtacaccttgacccraatctagcaacctcaaggctcttc

SEQ ID NO: 42788 - DNA, 50 bp, homo sapien
ctcccttggctaacttgaagtctgaycctttataccagaactgtaagaca

SEQ ID NO: 42789 - DNA, 50 bp, homo sapien
aggttttgtagcttatgtgaaaagcrctggatgccaatggattatttatt

SEQ ID NO: 42790 - DNA, 50 bp, homo sapien
taaaaaagtaagaatgtggcacatartaggaaaaaaaaaaaaaaaaagaa

SEQ ID NO: 42791 - DNA, 50 bp, homo sapien
cacgatagctcacatggaaggatgartaagaaccggcagtgtttagacag

SEQ ID NO: 42792 - DNA, 50 bp, homo sapien
taaaccccatcagcgtcctacatacyacgtgcagatcatcagggcctacc

SEQ ID NO: 42793 - DNA, 50 bp, homo sapien
atcaaagttttaatatacgaggataragaaaactgacgactattaatttt

SEQ ID NO: 42794 - DNA, 50 bp, homo sapien
ccaggacatgttactgaatgagaaayggctaccgtatccagaagtgccaa

SEQ ID NO: 42795 - DNA, 50 bp, homo sapien
caagcctggtggtgttccacctatakctccctcagtgaatgtgctggtgc

SEQ ID NO: 42796 - DNA, 50 bp, homo sapien
ctaccttagcttggactataaccacmatcttcatgccttagtttgacaat

SEQ ID NO: 42797 - DNA, 50 bp, homo sapien
aaagttttcaaattgagtagacaacrgtaatgtgaattccacaaagagat

SEQ ID NO: 42798 - DNA, 50 bp, homo sapien
ttcaaatacatgtaacttgactctcraatattattataaattcctgtaag

SEQ ID NO: 42799 - DNA, 50 bp, homo sapien
tggctccagcttagcagtgtccaacrgtaaaaatagaaaagcccctgagt

SEQ ID NO: 42800 - DNA, 50 bp, homo sapien
ttaaaccataaatcatgtgttattaytaagtttcatatctcctctgaaac

SEQ ID NO: 42801 - DNA, 50 bp, homo sapien
tcatttctttctcttgtttgctgaarataagacacaaaagttaattgcac

SEQ ID NO: 42802 - DNA, 50 bp, homo sapien
actgaacatggcttaacttaactaarctgaaatcccaattatactattat

SEQ ID NO: 42803 - DNA, 50 bp, homo sapien
tgcttgtcagtattagactaacaaasagatcaaaagcaataggcaaaaca

SEQ ID NO: 42804 - DNA, 50 bp, homo sapien
tggttgattttgctactgaatgagakacatcaattttcttgagattcaac

SEQ ID NO: 42805 - DNA, 50 bp, homo sapien
gaggaaacaagtttgcttcaaaatcygattctttatctaaataaactcac

SEQ ID NO: 42806 - DNA, 50 bp, homo sapien
aaaatgccctttttttggtcacagargaaacaagtttgcttcaaaatctg

SEQ ID NO: 42807 - DNA, 50 bp, homo sapien
aaagggcattttaagcctgcaaataraacttaaaatgctttatttctata

SEQ ID NO: 42808 - DNA, 50 bp, homo sapien
aagaaatcaagctatgatccacagayggcaataaatcctgttattctatt

SEQ ID NO: 42809 - DNA, 50 bp, homo sapien
gtgcctccgggatatgatgtgaaaastataagtcagaaatcatttttgct

SEQ ID NO: 42810 - DNA, 50 bp, homo sapien
tacccttatcttgaggcacactaacscttggtgcttaatttttaaaacat

SEQ ID NO: 42811 - DNA, 50 bp, homo sapien
actcaatagtcatattagcaatttawgaacttgattatacctttgaaatg

SEQ ID NO: 42812 - DNA, 50 bp, homo sapien
tgttactgagttattgttcatttcamaggtataatcaagttcttaaattg

SEQ ID NO: 42813 - DNA, 50 bp, homo sapien
aatagaactttcaaacagaattttcratccctaacacaaagaatggtatt

SEQ ID NO: 42814 - DNA, 50 bp, homo sapien
atgggtaccagtagttgattgacaayataaggactatgctaccatgcttg

SEQ ID NO: 42815 - DNA, 50 bp, homo sapien
tactctccacaagctacagtttcacractccctagaaaggactagagtta

SEQ ID NO: 42816 - DNA, 50 bp, homo sapien
gcaaaacctggactttatttgaacaygaggtatacactgcaattttttgc

SEQ ID NO: 42817 - DNA, 50 bp, homo sapien
taaagcttataatttagtattctcastaagatatcacgttaaaatatttt

SEQ ID NO: 42818 - DNA, 50 bp, homo sapien
tttttataatataatttactgccaamaatctgaaaagtgaggatttgatg

SEQ ID NO: 42819 - DNA, 50 bp, homo sapien
gaagtatctttgtgaacaagttaagragcaggaacaagacttctaatctc

SEQ ID NO: 42820 - DNA, 50 bp, homo sapien
ccaagagggcaaggctgactgcataraagtttgaattcccccacgtcatg

SEQ ID NO: 42821 - DNA, 50 bp, homo sapien
accttcacgtgtctcagtccgcttasgctgctataaaaaataacaaagac

SEQ ID NO: 42822 - DNA, 50 bp, homo sapien
agaaaacactcacatgaaggaaaacrcatactaccaggaagaaaaccttc

SEQ ID NO: 42823 - DNA, 50 bp, homo sapien
gcaatttcagtgtgcagcatttagarcttgggtcagaaaagcaggtccac

SEQ ID NO: 42824 - DNA, 50 bp, homo sapien
tcaaggagtatgtttcaaatcagacrctcgaaacaactagaactggagcc

SEQ ID NO: 42825 - DNA, 50 bp, homo sapien
gaaaaagactacaagatgacgaatamaaaatcaggagccaaaatgaatat

SEQ ID NO: 42826 - DNA, 50 bp, homo sapien
tagtaaaaagctttcactctgctcasaattcctaccttcacaccagcccc

SEQ ID NO: 42827 - DNA, 50 bp, homo sapien
ctttctcaagacatgagatttccatsaagtgttagttaacattgatctct

SEQ ID NO: 42828 - DNA, 50 bp, homo sapien
gtataaggaaggcttcccttaaagartatcttgccgctgtcttgggattt

SEQ ID NO: 42829 - DNA, 50 bp, homo sapien
ggattgtgatactaatggcggattaygtaataaactcaactatattggct

SEQ ID NO: 42830 - DNA, 50 bp, homo sapien
gtatactctaatcttcactagtgatsaagtgcggagtttgtcacctgtta

SEQ ID NO: 42831 - DNA, 50 bp, homo sapien
tactctcaacagcttttgccagctawtaagagattcagataggattaaag

SEQ ID NO: 42832 - DNA, 50 bp, homo sapien
attctttataactttaattcctctcyataacattctcttctaccctgtgc

SEQ ID NO: 42833 - DNA, 50 bp, homo sapien
gtttactcaaatttctgccattctaygaaatacagtgaattgttgccaat

SEQ ID NO: 42834 - DNA, 50 bp, homo sapien
tgatcgtgtctaaactaagatttaayaggctaagcctcagagggatttaa

SEQ ID NO: 42835 - DNA, 50 bp, homo sapien
gaacaaatgtcttagcaaaggctacycaaagtctaatgtttatttcttta

SEQ ID NO: 42836 - DNA, 50 bp, homo sapien
ttgctgtgttcaagtgatagcttctraagactcattttggtcatgtgtgg

SEQ ID NO: 42837 - DNA, 50 bp, homo sapien
ttgcagaaaactttagctatgggaayaaatgtcttagcaaaggctaccca

SEQ ID NO: 42838 - DNA, 50 bp, homo sapien
caagaggaaccaactcaaaaaattcracattccagatcttcagatgcaag

SEQ ID NO: 42839 - DNA, 50 bp, homo sapien
aaattttctaaaatcaacactgttayagctaaatgtatgtaatatgtcac

SEQ ID NO: 42840 - DNA, 50 bp, homo sapien
gcaaatccatgcattactgcctaacrctctatttatggctatatgcatga

SEQ ID NO: 42841 - DNA, 50 bp, homo sapien
agtacaccctatcctatagccatcawccgttgaaagacaattggtgttgc

SEQ ID NO: 42842 - DNA, 50 bp, homo sapien
actggtacagtagctgaggtaccacragagggtgaataattggtggaagc

SEQ ID NO: 42843 - DNA, 50 bp, homo sapien
tacccttaaccattgggttacgtgcyaattacaggagatgaaaaaaggag

SEQ ID NO: 42844 - DNA, 50 bp, homo sapien
attgaaaaatattttcttcataaackattcccaaagaactgtttctacaa

SEQ ID NO: 42845 - DNA, 50 bp, homo sapien
gttctgtccaagtacttccatccaaraggtgattgactgtaccaccatga

SEQ ID NO: 42846 - DNA, 50 bp, homo sapien
cttagatgcctgctttccagtattcrataagagaatgatgtatacagctg

SEQ ID NO: 42847 - DNA, 50 bp, homo sapien
caaaggttactaaaggttcatggacrctactatttgataactgtgtggta

SEQ ID NO: 42848 - DNA, 50 bp, homo sapien
agtatcgaaatcttcaaccacacacwgaatagggagagtagtgtagtaag

SEQ ID NO: 42849 - DNA, 50 bp, homo sapien
cagcctttggagactaaccatccaastgaatatagagttacatagctctc

SEQ ID NO: 42850 - DNA, 50 bp, homo sapien
cataatgctcttgtacatggacccarggagtgcctacagagctggagaag

SEQ ID NO: 42851 - DNA, 50 bp, homo sapien
cctattccaatgatgctattatataygttttgtacctatctgatatttat

SEQ ID NO: 42852 - DNA, 50 bp, homo sapien
aacttcaagacactagtgaaaaagasaactgggtaaaacacaaagttaaa

SEQ ID NO: 42853 - DNA, 50 bp, homo sapien
ctgccagggcccacaaggagccataygcacatctatccacctctgcctgg

SEQ ID NO: 42854 - DNA, 50 bp, homo sapien
gcctgaagcccaagggccatctagcmaattaaataaaacatcaccatagc

SEQ ID NO: 42855 - DNA, 50 bp, homo sapien
gagcatatgtatgaagtcctggtaartagcaagtgtttgatgattgtctg

SEQ ID NO: 42856 - DNA, 50 bp, homo sapien
ttactttaccttttaaaatattagcygaaggatagggaaaagacgttgga

SEQ ID NO: 42857 - DNA, 50 bp, homo sapien
aagggctacagatctaatcagcatamatcagctcaaggcattcggaattg

SEQ ID NO: 42858 - DNA, 50 bp, homo sapien
agaagagttctttcctctagcaggakatgccgtgccaaggaattatgagt

SEQ ID NO: 42859 - DNA, 50 bp, homo sapien
gagaggagcatacttagggctttccratatcccctactgcaaatggacca

SEQ ID NO: 42860 - DNA, 50 bp, homo sapien
aggagactagagaggcagagaggtckagggtaccctcaatcattcagcca

SEQ ID NO: 42861 - DNA, 50 bp, homo sapien
attatcagcacataaacaaaacacastaatctaaaacactttgctttcat

SEQ ID NO: 42862 - DNA, 50 bp, homo sapien
tcatttgtttagtcctacagatgacyaaaatgtaatccctagattctaac

SEQ ID NO: 42863 - DNA, 50 bp, homo sapien
gttgaataacttgtccaaagataackgttaagtggaacggatgggagtca

SEQ ID NO: 42864 - DNA, 50 bp, homo sapien
ttttgtcataagtcatgtttgttcascataccatttgcaaatacaactgt

SEQ ID NO: 42865 - DNA, 50 bp, homo sapien
ggggcatacaaactttcagttacaarttaataagttctggagacctaaca

SEQ ID NO: 42866 - DNA, 50 bp, homo sapien
agttttcctatttctcctaatgataygattttctgtgcatatttttttaa

SEQ ID NO: 42867 - DNA, 50 bp, homo sapien
aatgcaaaggtgactttagcactaayggactgtccagttaaggggtggct

SEQ ID NO: 42868 - DNA, 50 bp, homo sapien
tttttgccattctaaccaccaccaasttagtccaggccctgaaagtctac

SEQ ID NO: 42869 - DNA, 50 bp, homo sapien
tgcattttgaaacaaagggctccaaygcaacagatttgaaagcattgatt

SEQ ID NO: 42870 - DNA, 50 bp, homo sapien
gttctttaaatattgctatcatttgyaaaactggttaaaaatgtctgctg

SEQ ID NO: 42871 - DNA, 50 bp, homo sapien
tagtattgctagttgaagatatcackgaagcctattgtttttcatcagag

SEQ ID NO: 42872 - DNA, 50 bp, homo sapien
gtaagatagaagacacactttataayagggcaagctgcaatgaaaaattc

SEQ ID NO: 42873 - DNA, 50 bp, homo sapien
gataaatgtttaaatcgatggtacayactaaaacaaactttggagggagc

SEQ ID NO: 42874 - DNA, 50 bp, homo sapien
aaagtgctaagtaaacataatatgaygatgatgctgtttaattctttaga

SEQ ID NO: 42875 - DNA, 50 bp, homo sapien
tggagaatgagttctgaggctttacmagtttttaaataactggtgcaaaa

SEQ ID NO: 42876 - DNA, 50 bp, homo sapien
gaaatatacttctctgtgaagccacwaccttttaggattttctgtcactt

SEQ ID NO: 42877 - DNA, 50 bp, homo sapien
gctatcctacccacagcacgggccaygcagaacagggctgaaggattatg

SEQ ID NO: 42878 - DNA, 50 bp, homo sapien
tgaatgtgggcgtatctattcccaasttatctgcttccaccttttaaaag

SEQ ID NO: 42879 - DNA, 50 bp, homo sapien
agctcctactaattgatatgcgttayaattggaaaggttgcaaggaacac

SEQ ID NO: 42880 - DNA, 50 bp, homo sapien
ctaatgtattcaaagtaaacaatacyataaggtcaccttattcaccaggg

SEQ ID NO: 42881 - DNA, 50 bp, homo sapien
aatttgctctctcctaatacaagagrccacaaagattattttcatagtgt

SEQ ID NO: 42882 - DNA, 50 bp, homo sapien
ataaaaaacagcaatgcaacgaaaamaatacaaatgtgaaaataatatag

SEQ ID NO: 42883 - DNA, 50 bp, homo sapien
gttaagggggtagatatcctttcaaktagattgcttgggacacgtgctgg

SEQ ID NO: 42884 - DNA, 50 bp, homo sapien
aattgtacaagacaaaggaactagartagcctaaacaatcttgaaaaagc

SEQ ID NO: 42885 - DNA, 50 bp, homo sapien
acccctaaggtacaagcctagaatarcctcaatattaaactgagccaagg

SEQ ID NO: 42886 - DNA, 50 bp, homo sapien
gctgcttattagatgcaaaggaaaastagtaatttacaccatggggaaat

SEQ ID NO: 42887 - DNA, 50 bp, homo sapien
tctgttattgagaaaggggatcccgragcaacctcttcttccaatcttga

SEQ ID NO: 42888 - DNA, 50 bp, homo sapien
ttcgatacttggtttgtgcctagtcratgcaccgaatgataactcattag

SEQ ID NO: 42889 - DNA, 50 bp, homo sapien
atatccacacaatttgcatgcgaaayggtgcttcctaccaaaagaaaaag

SEQ ID NO: 42890 - DNA, 50 bp, homo sapien
ttacaaaataaaaagagagtctttawggcccaacaatcaggagaccctca

SEQ ID NO: 42891 - DNA, 50 bp, homo sapien
atgtatttgaaacctactgggttagyacctgcagaacaaaagtaaaataa

SEQ ID NO: 42892 - DNA, 50 bp, homo sapien
ttccagccttcatttaaaaactacgrcgactccagccagtcaagcggcag

SEQ ID NO: 42893 - DNA, 50 bp, homo sapien
cactgcattccttggaggtctataargcaaattgtgttattctccatgtt

SEQ ID NO: 42894 - DNA, 50 bp, homo sapien
aagcaagatgcactggctcagagaamggccaaggattatcttaggaacaa

SEQ ID NO: 42895 - DNA, 50 bp, homo sapien
ttggggagaaggagctgttgaaaagwacccctctcccaggcaaaattttc

SEQ ID NO: 42896 - DNA, 50 bp, homo sapien
aagcttatctgagaagatagacatayataagtaccaaaatatcaaataaa

SEQ ID NO: 42897 - DNA, 50 bp, homo sapien
tgaacattttacaaaccatcctagtkaagtctcttcatgtctgtttcctc

SEQ ID NO: 42898 - DNA, 50 bp, homo sapien
tttgcaattagcattagctgtacaayctatttctgatcagtgatgattca

SEQ ID NO: 42899 - DNA, 50 bp, homo sapien
gtggatttgatctgtatgtattcaaycctgaacttcagcaatataaatga

SEQ ID NO: 42900 - DNA, 50 bp, homo sapien
tataatttagggctatttaccttcayccttcttaatatctgtagtctacc

SEQ ID NO: 42901 - DNA, 50 bp, homo sapien
atagatataatgatacctcctttaayataacatgccaatcggaaattaat

SEQ ID NO: 42902 - DNA, 50 bp, homo sapien
cggctgtgcaacttgggaaactcaayttatttgttgtcttgagttccttt

SEQ ID NO: 42903 - DNA, 50 bp, homo sapien
aatctttacctcaaaaaaattccagratcagctggcttagtagtgaatcc

SEQ ID NO: 42904 - DNA, 50 bp, homo sapien
ggatcagctggcttagtagtgaatcycacaaatataagaaagtaatagca

SEQ ID NO: 42905 - DNA, 50 bp, homo sapien
tacctgtcatgcaagactaatcaaasaacaagcaccagtagaacaaaaat

SEQ ID NO: 42906 - DNA, 50 bp, homo sapien
aagggaagctgaagattaagtttagycacatgaacaatgatttaatcagt

SEQ ID NO: 42907 - DNA, 50 bp, homo sapien
tcacattgcaattcttggaatgtagyatgttgcttataactatttaaatg

SEQ ID NO: 42908 - DNA, 50 bp, homo sapien
cctgagacgatggcaggtttaatcartaaatgtttggtgtgttctgactg

SEQ ID NO: 42909 - DNA, 50 bp, homo sapien
gtttttaacaataaggtaatagaaartggaaatgtacaagagagactagg

SEQ ID NO: 42910 - DNA, 50 bp, homo sapien
aagaaatgagctcagtgtgttcagaraatgacggtgaggctgaactaaaa

SEQ ID NO: 42911 - DNA, 50 bp, homo sapien
attacctagacaccaaatttgactawatggtagcataatgattacagtta

SEQ ID NO: 42912 - DNA, 50 bp, homo sapien
ttcaactaattgttggtttaattcargctgagacttctgccactaagatt

SEQ ID NO: 42913 - DNA, 50 bp, homo sapien
aataggatgttttttaaggaagattmaatcagttatagaagtttaatgta

SEQ ID NO: 42914 - DNA, 50 bp, homo sapien
aaccaaaacagacatattgcctatcragaaaaagcatttttactccaata

SEQ ID NO: 42915 - DNA, 50 bp, homo sapien
tttctgttcattttttaggtgtccaygaattatagaataaacaacagatg

SEQ ID NO: 42916 - DNA, 50 bp, homo sapien
aataaacaaaaaacaaacctagtcaygtagcctctttcaaaggtagaaaa

SEQ ID NO: 42917 - DNA, 50 bp, homo sapien
ttatttttcaaattatgcctttaagratgtgataaacataaatgtagcca

SEQ ID NO: 42918 - DNA, 50 bp, homo sapien
ataacctggtgttgaaagcacaatgratttgaaataacacctaagtcaga

SEQ ID NO: 42919 - DNA, 50 bp, homo sapien
tgattatccaacttgaaatatcaatwaagttgtcaaacaaatgcatcagt

SEQ ID NO: 42920 - DNA, 50 bp, homo sapien
atagcataaccttctgtatcttatcsaaccaggttttattgtgagtggat

SEQ ID NO: 42921 - DNA, 50 bp, homo sapien
tcacaagctgtccacgttgataggckccatatgtaatctgttgagtcaac

SEQ ID NO: 42922 - DNA, 50 bp, homo sapien
atgtcagaggccagaaaatacttatraaaggccagaagaagagactcatg

SEQ ID NO: 42923 - DNA, 50 bp, homo sapien
tgttctttagcccagtcatctcacartggaattcccagggagagggagga

SEQ ID NO: 42924 - DNA, 50 bp, homo sapien
cacaccctgttgtatcattgaaaaaygcgcagacttcagctggatgaggt

SEQ ID NO: 42925 - DNA, 50 bp, homo sapien
tagtaacagttaaatatgctgagtamcttctatatgccagatattgatct

SEQ ID NO: 42926 - DNA, 50 bp, homo sapien
tttaataaatactgcatcgaatttayagatcaacttggagtcttttacca

SEQ ID NO: 42927 - DNA, 50 bp, homo sapien
gcaatttgctaccttcatttattaawcctaatagctttccatgaaatttt

SEQ ID NO: 42928 - DNA, 50 bp, homo sapien
accttccaaggctgttcgtttgatcygagataaaagctgccacaagacaa

SEQ ID NO: 42929 - DNA, 50 bp, homo sapien
tcccatatttttccagagatcatagwattccttaagtgacacaatccctt

SEQ ID NO: 42930 - DNA, 50 bp, homo sapien
tctctttcattaagagccatgaatargtatctcattacctttgtaaatat

SEQ ID NO: 42931 - DNA, 50 bp, homo sapien
gcctctgtaatctacaaccggatgcrctcttacacccaagccttgatggg

SEQ ID NO: 42932 - DNA, 50 bp, homo sapien
tatataattttcagatttcattttarctctcaaatcttcaacagcctaga

SEQ ID NO: 42933 - DNA, 50 bp, homo sapien
agttacataagattcatctctcaacyatattggaaatgtcagggttacca

SEQ ID NO: 42934 - DNA, 50 bp, homo sapien
gtatcaagaatgatacccaggctgaygacttaagccactggatagggaca

SEQ ID NO: 42935 - DNA, 50 bp, homo sapien
atacacaataaacagccagctgaaartatttcagaacacttactccaatt

SEQ ID NO: 42936 - DNA, 50 bp, homo sapien
gaaaaatgtggcacccttctttaaayatccaatcagaatgccagtagaaa

SEQ ID NO: 42937 - DNA, 50 bp, homo sapien
gaataaaatgaattaatatatgcgargagattagaatttgcctggcatgt

SEQ ID NO: 42938 - DNA, 50 bp, homo sapien
ttattgaataatatctaggtgtcaayttacttgttccttgtaacatcatc

SEQ ID NO: 42939 - DNA, 50 bp, homo sapien
tagaatgaaatgatatctttacgggmatcagaagacctaatctgtagtat

SEQ ID NO: 42940 - DNA, 50 bp, homo sapien
ggggtttacttttaagagtatttatragtttagcacaggcttccccagtg

SEQ ID NO: 42941 - DNA, 50 bp, homo sapien
ggtgttcaataagtgcttgttgaaakaattgcctcatgagaatcaatgtc

SEQ ID NO: 42942 - DNA, 50 bp, homo sapien
aaagtaaaatcctattgagcttaaarcctaaaagatacacaatctagatc

SEQ ID NO: 42943 - DNA, 50 bp, homo sapien
tgctaaacagcactccagcgttgaaytctccttaaggggccagtaaatgg

SEQ ID NO: 42944 - DNA, 50 bp, homo sapien
aagcccctagggattagtggttgcgmatcactccattaaagggcttttct

SEQ ID NO: 42945 - DNA, 50 bp, homo sapien
cattagtgcttcctctttcaaacatratgataaggacctgtggctcacac

SEQ ID NO: 42946 - DNA, 50 bp, homo sapien
gataaatatcctttaagtaaccatgkatcacttagtcactttggaatctt

SEQ ID NO: 42947 - DNA, 50 bp, homo sapien
ccttcagattattttgagtcattcaytatacttaataattgcattcattg

SEQ ID NO: 42948 - DNA, 50 bp, homo sapien
atcaaagaaatactaaagataggaasaaaaatcaataaactgaaaaacag

SEQ ID NO: 42949 - DNA, 50 bp, homo sapien
tgagctaacattctctagctgtgcakaataggtaacaatgaatatttgct

SEQ ID NO: 42950 - DNA, 50 bp, homo sapien
ttaatatgatctattttaataatctyactcagtttcccttaattttgctg

SEQ ID NO: 42951 - DNA, 50 bp, homo sapien
tgaaagagagctgcatcatcactacyactgtggagcagaagtgtagacag

SEQ ID NO: 42952 - DNA, 50 bp, homo sapien
atgaattcatactgcgttcagcttgyaaaaaagacttgctatgtacaaag

SEQ ID NO: 42953 - DNA, 50 bp, homo sapien
ttcactgatattgagttcataataayaaccttgggcatcagagagaaatt

SEQ ID NO: 42954 - DNA, 50 bp, homo sapien
agtgattctggaatgtagacctcaamctctgcagtgtgtagtggaaggtt

SEQ ID NO: 42955 - DNA, 50 bp, homo sapien
gatcacgctaacatctctgttgtacrggaaagcgaaatcatttcgagtta

SEQ ID NO: 42956 - DNA, 50 bp, homo sapien
tgtgcctaatatgaggatgagtaccyggaaccaactaaaaatagttactg

SEQ ID NO: 42957 - DNA, 50 bp, homo sapien
gggcgtgttcttttttggagaatatrataaaatcaccatgtacttgtata

SEQ ID NO: 42958 - DNA, 50 bp, homo sapien
gatggggagagaagacagcagagaasgaaaatttatacgaaatggtattt

SEQ ID NO: 42959 - DNA, 50 bp, homo sapien
aacaagtgtggttattattgaatcamcttatctaactggacaaataatat

SEQ ID NO: 42960 - DNA, 50 bp, homo sapien
ggcctcactttcctttctcgttaacyatgaagcagaaactatattcatca

SEQ ID NO: 42961 - DNA, 50 bp, homo sapien
ctgacatcaaataaacactatgctaygtatctataatttctaagttttgt

SEQ ID NO: 42962 - DNA, 50 bp, homo sapien
gactagagagagaatagtaaagaaaygtaggaggattcccttcttagcaa

SEQ ID NO: 42963 - DNA, 50 bp, homo sapien
gaagtttgactcacctagaactataytaccatccagcttgtaattcttca

SEQ ID NO: 42964 - DNA, 50 bp, homo sapien
gaacatccaaatggaatatcccaagrcatgataagtaataccttcctcaa

SEQ ID NO: 42965 - DNA, 50 bp, homo sapien
cttatgatgacctctttcacttacamgaattcataaacgtggctcatttg

SEQ ID NO: 42966 - DNA, 50 bp, homo sapien
acatagttgcaatattgaaaataagsctggtaattgggtcatcttattag

SEQ ID NO: 42967 - DNA, 50 bp, homo sapien
tcattaactcccaaatctgtatttayagcacaaattactcattgattcca

SEQ ID NO: 42968 - DNA, 50 bp, homo sapien
ttttcacagcccttgacaccatcaaygtactttcttcatcctgttcctca

SEQ ID NO: 42969 - DNA, 50 bp, homo sapien
gcatcaagtggtcacgagtacaacastagtaaacgcactgtgcatgctcc

SEQ ID NO: 42970 - DNA, 50 bp, homo sapien
aggaccatatgctctctcttttaaamatgtacctgtctgaagcttgaact

SEQ ID NO: 42971 - DNA, 50 bp, homo sapien
gggatcgaggggaagcaaactattcraagtagcaggtgagaaatctctac

SEQ ID NO: 42972 - DNA, 50 bp, homo sapien
ggcttccttcctagcacccatcacarcttcaagtgtttttcttcccaggt

SEQ ID NO: 42973 - DNA, 50 bp, homo sapien
aatcctagcgctcatttaactcacaractgtaatacaacagtggcagcaa

SEQ ID NO: 42974 - DNA, 50 bp, homo sapien
tttttaaaaaatccaaaggtacaaartaagagtgtggctaagtaaactat

SEQ ID NO: 42975 - DNA, 50 bp, homo sapien
cactgggaagatgttttattgctaamgtgggttactaaggtccccactat

SEQ ID NO: 42976 - DNA, 50 bp, homo sapien
tcttacagtaaagtaaactcaaggamaaaaggataagaaaatcataagag

SEQ ID NO: 42977 - DNA, 50 bp, homo sapien
cactgttttaagtgagatacagccaygaaccaaacagtcattccctctaa

SEQ ID NO: 42978 - DNA, 50 bp, homo sapien
ggtttccacactgtgttcctcgtgaycagtagtcccaggaagaggctggc

SEQ ID NO: 42979 - DNA, 50 bp, homo sapien
cacttaaagcctcttttggagtaaaygtaaggcgtaattttgtgggatat

SEQ ID NO: 42980 - DNA, 50 bp, homo sapien
ctctgtgttgaaggatataccattaragttaaatcaacttagggaacatc

SEQ ID NO: 42981 - DNA, 50 bp, homo sapien
ccaaaaaagaaacaatcaaaaaggcrcagaaatcatggatgatagcaact

SEQ ID NO: 42982 - DNA, 50 bp, homo sapien
agctgcacatttgcaaccacttcctsaaggagattctgtaatagtcccat

SEQ ID NO: 42983 - DNA, 50 bp, homo sapien
tgagaccaagtgggaataagtcaccraataactcttagaaataccaggtt

SEQ ID NO: 42984 - DNA, 50 bp, homo sapien
aaagcagagttcatttagctacaaasgaccattgaatggcactagagata

SEQ ID NO: 42985 - DNA, 50 bp, homo sapien
aacaatctcaagcgtccatacttgargaaaggctcagaataagtcatacg

SEQ ID NO: 42986 - DNA, 50 bp, homo sapien
aaggcattggggaaaaaatcaggaaycaatcattttctattttactacag

SEQ ID NO: 42987 - DNA, 50 bp, homo sapien
gaagtagaagataatatcagttcgcrcataccaatggaccattccactgt

SEQ ID NO: 42988 - DNA, 50 bp, homo sapien
tttatgacttgttgccaaaaaatgasatagatttgttgcacgttgctttg

SEQ ID NO: 42989 - DNA, 50 bp, homo sapien
aaccaacacaggaaagtaaagttaaytgcacataggaagtttctttttgt

SEQ ID NO: 42990 - DNA, 50 bp, homo sapien
ctaaaatatagggagtggctataccrgataaatgaaggtcatctttagct

SEQ ID NO: 42991 - DNA, 50 bp, homo sapien
attttgcaaactcatagattcaaaaygtgctattatatgaaataagtaag

SEQ ID NO: 42992 - DNA, 50 bp, homo sapien
gattctctaatcgatactaacagaaktaatttgctccaatgagttgctta

SEQ ID NO: 42993 - DNA, 50 bp, homo sapien
tttatgctcctcatcacagtgtaagwccatgaaaaattaacgcccctgtt

SEQ ID NO: 42994 - DNA, 50 bp, homo sapien
cttcagtcagatagatgattcctaaratatattacacctaatttgtcaaa

SEQ ID NO: 42995 - DNA, 50 bp, homo sapien
agaagtccttctccggtttacacagmaaatggagactgttattgatattt

SEQ ID NO: 42996 - DNA, 50 bp, homo sapien
cttaaatcttgccaacagtctataaratttgacaaattaggtgtaatata

SEQ ID NO: 42997 - DNA, 50 bp, homo sapien
ctacatagtaaaattagaagacaagratgttaaaatagatattataagta

SEQ ID NO: 42998 - DNA, 50 bp, homo sapien
tggccatgtgaacctctgattctccwcctgttaaataagggaatcttaaa

SEQ ID NO: 42999 - DNA, 50 bp, homo sapien
tttatgcttatagtacttggcccacractgatgcacaatggatcacgagg

SEQ ID NO: 43000 - DNA, 50 bp, homo sapien
aaggagcagtgtgtggagaagcaaarttcaaacaggtgttataacaagga

SEQ ID NO: 43001 - DNA, 50 bp, homo sapien
cagttcctgcgctcaaggggcttacmaattagttgtggagaaaagactat

SEQ ID NO: 43002 - DNA, 50 bp, homo sapien
tgcaaagatgtggaagtatatctaarctctttttatgttttaacacaata

SEQ ID NO: 43003 - DNA, 50 bp, homo sapien
gggcttctttctgaactcttcagaayatatatgaaaaatgaagcttgagc

SEQ ID NO: 43004 - DNA, 50 bp, homo sapien
gattttttttttcccacgtggtagaygaatcttagtaagaaaatacagac

SEQ ID NO: 43005 - DNA, 50 bp, homo sapien
tcttatcttttcattagttaatatakgtgtaccttcaaatggcaataaca

SEQ ID NO: 43006 - DNA, 50 bp, homo sapien
agtgattctcatgctttaatgcaccraaggatcccctaggatgttgataa

SEQ ID NO: 43007 - DNA, 50 bp, homo sapien
ttactcctccaagaccacatttagaktccgcatgatccaaggacagcagc

SEQ ID NO: 43008 - DNA, 50 bp, homo sapien
aagagcttctctatccaggactgccragagtacatttcattataaccata

SEQ ID NO: 43009 - DNA, 50 bp, homo sapien
caaataaaataccccttgggaaatcyattaatgttagaatactgtgttct

SEQ ID NO: 43010 - DNA, 50 bp, homo sapien
ggctttttttttcatttctcctttarcaacacaatgactgtcaaagagct

SEQ ID NO: 43011 - DNA, 50 bp, homo sapien
taaaagttgcatataaatcccaacckaacatacaagtcaagacacggtgt

SEQ ID NO: 43012 - DNA, 50 bp, homo sapien
aaagctaattcaggtattttgcttaygggactaattttcatgcttagcag

SEQ ID NO: 43013 - DNA, 50 bp, homo sapien
tgcctggctgacttgtggttcttaayagtgtggctcttaaaatagcaaac

SEQ ID NO: 43014 - DNA, 50 bp, homo sapien
aaaaatggtagctgttattatcataycactttcatggaatttcgttagtt

SEQ ID NO: 43015 - DNA, 50 bp, homo sapien
taaacaaaacaaaagacgtgtctacmactccagggaagtgaaaaagcaga

SEQ ID NO: 43016 - DNA, 50 bp, homo sapien
tgtaacaggacaacctgaaatttaartccaattacatatgagaatttaat

SEQ ID NO: 43017 - DNA, 50 bp, homo sapien
taaaagatctgaacacttaggaaaakaggactgaataagcaattaagtat

SEQ ID NO: 43018 - DNA, 50 bp, homo sapien
tgtggcatagtctatcagtgtgaatraataaattgtaataatttggactt

SEQ ID NO: 43019 - DNA, 50 bp, homo sapien
gtgtgtgtcttttcctgacatgacaygagaaaaaaaatgttcatgaatga

SEQ ID NO: 43020 - DNA, 50 bp, homo sapien
tgatatctacagaccacacattttaygaaagaaggatcaagtccaaatta

SEQ ID NO: 43021 - DNA, 50 bp, homo sapien
ggacaagcattttgtttttcaaaccrcatacagggaaaataattatttaa

SEQ ID NO: 43022 - DNA, 50 bp, homo sapien
atgaggtgaccctaaatcaaaataayagcctttggatttaaagattttgc

SEQ ID NO: 43023 - DNA, 50 bp, homo sapien
gaattgactatgaaaataatgagaaytgtggcagaatgcatttaatcaat

SEQ ID NO: 43024 - DNA, 50 bp, homo sapien
cggaccctctgcagctcttgtcaccrcgtcaacaccctctgctttgccac

SEQ ID NO: 43025 - DNA, 50 bp, homo sapien
aggatattagaatcctaattgggaaygaacatacaatatattctatgaaa

SEQ ID NO: 43026 - DNA, 50 bp, homo sapien
aattaacatctctgaatcaattttayggagctattatcttaattttgtgg

SEQ ID NO: 43027 - DNA, 50 bp, homo sapien
ttctggcctgtaacaccaagcagtawaacgatgagattgaagtgtgacca

SEQ ID NO: 43028 - DNA, 50 bp, homo sapien
ttgtagttgattggaatcatcaccayaggttatataacaaaatattcagt

SEQ ID NO: 43029 - DNA, 50 bp, homo sapien
agccagttatacagtgtctttcaggragttttacatgcatatgttaataa

SEQ ID NO: 43030 - DNA, 50 bp, homo sapien
tgatttctcttattcagagcaaatgmatgatggcctctctccatgtagct

SEQ ID NO: 43031 - DNA, 50 bp, homo sapien
atacctaagagtgattctccttaccygaggcacttgagaaatggggctca

SEQ ID NO: 43032 - DNA, 50 bp, homo sapien
ccaacacaattaagacaggattacaytgcaacttatgagtttctcaagga

SEQ ID NO: 43033 - DNA, 50 bp, homo sapien
ctcgtagtgacttctttccaaagacracagttacagaaaggcagaaaaaa

SEQ ID NO: 43034 - DNA, 50 bp, homo sapien
aggaacagttaccctgctttgcctcraaagtgtcatcaatttgtaatttt

SEQ ID NO: 43035 - DNA, 50 bp, homo sapien
gtgttccaccaacactgcaattcaaygaatcaaaagtcaaatccatgctt

SEQ ID NO: 43036 - DNA, 50 bp, homo sapien
cttgcgcctcgttttctagagataargaaatggagatggagtgaggttat

SEQ ID NO: 43037 - DNA, 50 bp, homo sapien
ctcctgtgaactgtccatgatacaayttctgacctgcagttgcttgggat

SEQ ID NO: 43038 - DNA, 50 bp, homo sapien
gaactgttagcattattagtcactgkactcttagcataacacagattata

SEQ ID NO: 43039 - DNA, 50 bp, homo sapien
ggctgcagagttgacaaaagtctcaragtgttatctcttagggaagcttc

SEQ ID NO: 43040 - DNA, 50 bp, homo sapien
tataaaaatgcccttcttggagctcraaatttgattctttgtttgtttta

SEQ ID NO: 43041 - DNA, 50 bp, homo sapien
tggagagcccttgtaacaatttaaayctaagtgtctacatttagcttctg

SEQ ID NO: 43042 - DNA, 50 bp, homo sapien
gaggtggtcatgagggatcccaaacrgtttcacactgacacaccccacat

SEQ ID NO: 43043 - DNA, 50 bp, homo sapien
cagtttaagtcttcagctggtaaaaytttctctgtttagcccatttggaa

SEQ ID NO: 43044 - DNA, 50 bp, homo sapien
aagacttacacagaatatgtgtttaygatgcacagccaactataagacat

SEQ ID NO: 43045 - DNA, 50 bp, homo sapien
taagaagtactttattaaaaggctayaggtaaataaatacattcaaatta

SEQ ID NO: 43046 - DNA, 50 bp, homo sapien
aaactcgcctctaaatgagctgaaartatataaaaataaacagacctcaa

SEQ ID NO: 43047 - DNA, 50 bp, homo sapien
tatttgtttattagaatacgattgtraattggttgggtcaagagtaattg

SEQ ID NO: 43048 - DNA, 50 bp, homo sapien
actacatcaaacacatctccaaggcyagtgtagagtgctcctcataggca

SEQ ID NO: 43049 - DNA, 50 bp, homo sapien
cactactctagttatttgacatagaygactgtattacagtcccctcattt

SEQ ID NO: 43050 - DNA, 50 bp, homo sapien
ggaaatcactgtattaaattgctaaygtataaatggttcaaggtaaatag

SEQ ID NO: 43051 - DNA, 50 bp, homo sapien
aaacattttgtaattttccctgagayggtagctgacagaggtgaactgag

SEQ ID NO: 43052 - DNA, 50 bp, homo sapien
aatgattctcactgccgtccagttayaccccagtcttagtgctgggcact

SEQ ID NO: 43053 - DNA, 50 bp, homo sapien
tgtttgtttttgcatggtatagatayagggttttacttttaagcggttag

SEQ ID NO: 43054 - DNA, 50 bp, homo sapien
aggaatgagagactttcacctgtacraaggatgtctctggaaaacggaat

SEQ ID NO: 43055 - DNA, 50 bp, homo sapien
tgataaaaatggttttatcttaaaastctgatgaaacctctctctcacac

SEQ ID NO: 43056 - DNA, 50 bp, homo sapien
gtctcacccagggtgattctcaaaastataaactcttatccaatgtaaaa

SEQ ID NO: 43057 - DNA, 50 bp, homo sapien
tagagcaatgaaagtaagagcattayagaagacaggaagcctagaacagg

SEQ ID NO: 43058 - DNA, 50 bp, homo sapien
ccataaaagggtcatattgtccaacraactggggaggaacggtgaaactg

SEQ ID NO: 43059 - DNA, 50 bp, homo sapien
aatgttaataacttaaatttgcctcmagttgctctgtcatttggtttcaa

SEQ ID NO: 43060 - DNA, 50 bp, homo sapien
cgccttttcaattctcttcttctaayctagtctgtgtaagaaatcccgtc

SEQ ID NO: 43061 - DNA, 50 bp, homo sapien
aacatgcaaggtcagtcatttctacygatacctaaggtcacagaaccagg

SEQ ID NO: 43062 - DNA, 50 bp, homo sapien
cctggtttgctcattagcaccctgakgatcatgagtccaaggctgccttc

SEQ ID NO: 43063 - DNA, 50 bp, homo sapien
acttccctcagggtcttgaacgacargcctaagttgactttctccatgta

SEQ ID NO: 43064 - DNA, 50 bp, homo sapien
ctaatgagcaaaccaggcaattctgractgtatgcattagcagccgttgc

SEQ ID NO: 43065 - DNA, 50 bp, homo sapien
caagaagtcatctattaataatgcayctcttcatgacactataaagaaac

SEQ ID NO: 43066 - DNA, 50 bp, homo sapien
aaacagcagatgaggtctgggcaccragtttatttgctctaagacagagg

SEQ ID NO: 43067 - DNA, 50 bp, homo sapien
gagcagtgtagccaggaaggaaatgrcatttatgatttgtgtcaagaaac

SEQ ID NO: 43068 - DNA, 50 bp, homo sapien
gtatgaagagcttctctgtctttagscattgcgatatatattgagggagg

SEQ ID NO: 43069 - DNA, 50 bp, homo sapien
gtttatttgaagagttggtaggcccragactttttctgaaatgtttattg

SEQ ID NO: 43070 - DNA, 50 bp, homo sapien
tcaccaaaaaagcccagagtgcccayggtggaaatatgctgtttttgcca

SEQ ID NO: 43071 - DNA, 50 bp, homo sapien
gaaaatttatgttacaacttacagaytccattttctatctctctgcacca

SEQ ID NO: 43072 - DNA, 50 bp, homo sapien
ccatttaaagaataacacttaagaastagaatattgccagtatttcagaa

SEQ ID NO: 43073 - DNA, 50 bp, homo sapien
actggtaataatggacagaaaattaragagagctgtcacctctgtcaagg

SEQ ID NO: 43074 - DNA, 50 bp, homo sapien
aagctcattttggcatctggaatggmagtactagagcaggaagactagag

SEQ ID NO: 43075 - DNA, 50 bp, homo sapien
tttgaaacacaaaagactgatgaaasattaaattttgttcctacaaacaa

SEQ ID NO: 43076 - DNA, 50 bp, homo sapien
acttatgcatgttattggccatcagrcaaagtgaggaacagcccctgtgg

SEQ ID NO: 43077 - DNA, 50 bp, homo sapien
tagtgagaagcacattgaagctgaartaggtacggcaaaaaaaaggaata

SEQ ID NO: 43078 - DNA, 50 bp, homo sapien
ctcggaagacatcctaaagtctaaastagccactaccaagtgtaaattag

SEQ ID NO: 43079 - DNA, 50 bp, homo sapien
gataaatgtatatctgcaagttctayctattgtaaaaacctgaagaaaca

SEQ ID NO: 43080 - DNA, 50 bp, homo sapien
agaaggtgttctggtaactgtaaccrggtatatgcagcacttaggcaggt

SEQ ID NO: 43081 - DNA, 50 bp, homo sapien
catctcacctttgggaaccataaaakaagtgttttgcttgaagtgtagtc

SEQ ID NO: 43082 - DNA, 50 bp, homo sapien
gtacctggttgttcggaaataaaggycactaacagatccttgggactcgt

SEQ ID NO: 43083 - DNA, 50 bp, homo sapien
aaataacggataaatgttaactggaracaactctatttccaaattaagtg

SEQ ID NO: 43084 - DNA, 50 bp, homo sapien
atatcatctctgctcagatatctcayagttttaacatatatttattcagt

SEQ ID NO: 43085 - DNA, 50 bp, homo sapien
atggtagaaaaaaatgaaaatgtaaygagatgggatccgggtcaaagtca

SEQ ID NO: 43086 - DNA, 50 bp, homo sapien
atataaaaaaaatgcaatcattggargacatagttcaaccaagggtctca

SEQ ID NO: 43087 - DNA, 50 bp, homo sapien
ttctttcatagtctcaggatagaccrgattactctattaaaagatagggt

SEQ ID NO: 43088 - DNA, 50 bp, homo sapien
gaaggagtcattatgataccaaagaraatggaaagaagtggtatccagat

SEQ ID NO: 43089 - DNA, 50 bp, homo sapien
ttcataggcccagtgggaggagccartaaaagaagagtgaaaatacaaga

SEQ ID NO: 43090 - DNA, 50 bp, homo sapien
ggcagctgaatagttttgtctcacaygttaagccaactcttgaagtgaac

SEQ ID NO: 43091 - DNA, 50 bp, homo sapien
catgaacacatcttagcatgaaaacmgttgcatgggattcaaacaacagg

SEQ ID NO: 43092 - DNA, 50 bp, homo sapien
agataacagaggacagaaaacggtamatagatgaattaattcaaatagtt

SEQ ID NO: 43093 - DNA, 50 bp, homo sapien
cttattatgaatttacagaataccaygacagtcagttctgaattcctgca

SEQ ID NO: 43094 - DNA, 50 bp, homo sapien
ctgccaggcttgtgtagatctcaaartaaaggtatcccgtcatctcagtg

SEQ ID NO: 43095 - DNA, 50 bp, homo sapien
aataaatcagttggcaaatcttgaakatgtagagccttactaacaaaatg

SEQ ID NO: 43096 - DNA, 50 bp, homo sapien
gtttcatttttctactgtattacaaygcactgaggataagggatatcttt

SEQ ID NO: 43097 - DNA, 50 bp, homo sapien
acagacctcagtgccaattggataaygcctttagtggaattggggtctga

SEQ ID NO: 43098 - DNA, 50 bp, homo sapien
gtattgtatcccatgcatactctgayacaatgttcttcaagaccaggtca

SEQ ID NO: 43099 - DNA, 50 bp, homo sapien
cctgaggaagttaactgctagaagayggcagcagatgacactcctcaatg

SEQ ID NO: 43100 - DNA, 50 bp, homo sapien
gtgatccatatatgcttatagactayacagagaagaaactagtggggagg

SEQ ID NO: 43101 - DNA, 50 bp, homo sapien
gctctatttttggtagagctttaackgatattctttgataatccctgttt

SEQ ID NO: 43102 - DNA, 50 bp, homo sapien
gaatctcagttcattcgtatgcagamagtctaatgccaacagcctaaagt

SEQ ID NO: 43103 - DNA, 50 bp, homo sapien
gccaactctcttgccagcattctgaycacaaggttaggagatagaaacat

SEQ ID NO: 43104 - DNA, 50 bp, homo sapien
taccaaatgatgacctgagccttagycaggaacgaagcaactgtcagaat

SEQ ID NO: 43105 - DNA, 50 bp, homo sapien
aggctaatttccaggaggcaaatgcyatttaactgtatatctttcagatc

SEQ ID NO: 43106 - DNA, 50 bp, homo sapien
caacgttttcgaattcccttctagayaccaaatgatgacctgagccttag

SEQ ID NO: 43107 - DNA, 50 bp, homo sapien
actggcgatttatagaacagttaaargaccagggatctggtcttggcagg

SEQ ID NO: 43108 - DNA, 50 bp, homo sapien
gaaaagccttggaatgcagtttgatmacaattttgtggaaatgatatctg

SEQ ID NO: 43109 - DNA, 50 bp, homo sapien
aatttttaaaaatataatagattctyaccttccatgctgactttagaaac

SEQ ID NO: 43110 - DNA, 50 bp, homo sapien
tcaatatttacctcttcaagagtgaytagtttgataacagatactccttt

SEQ ID NO: 43111 - DNA, 50 bp, homo sapien
agtgtgccttcattactgctctactraaaataattcacttaagataattc

SEQ ID NO: 43112 - DNA, 50 bp, homo sapien
agaagtctctgaggtgggtcatgatracatagtgaaagaaaaaaaatagc

SEQ ID NO: 43113 - DNA, 50 bp, homo sapien
caattgagagtactattagttctatyaagagttacttgagggaacatctt

SEQ ID NO: 43114 - DNA, 50 bp, homo sapien
aatttgtgataaaagtttaatttggrcagaacattggcaatactaagcat

SEQ ID NO: 43115 - DNA, 50 bp, homo sapien
tgtaatcttaggaaagatacttcaayggatgttcatatgcctattaagtg

SEQ ID NO: 43116 - DNA, 50 bp, homo sapien
ctgaagcagtatgttacagtgtaccrgaattaattcggatcatcctgacc

SEQ ID NO: 43117 - DNA, 50 bp, homo sapien
tggggaagtctgaggaagttggtgargtcttacgttaataaaaacaagtg

SEQ ID NO: 43118 - DNA, 50 bp, homo sapien
ttcgtgtctatgtcttccctcctgcrctaggttacaatttatgtaaagtg

SEQ ID NO: 43119 - DNA, 50 bp, homo sapien
aagtacgctgtcatcattgtgcttcyacacatttgctaatttattgtcgc

SEQ ID NO: 43120 - DNA, 50 bp, homo sapien
cgtattgtcatccatatacttcaacrcatcgacttttgttataagtacgc

SEQ ID NO: 43121 - DNA, 50 bp, homo sapien
aaatgaaatgcatgcgatgaacagaygggactaatagctcagacacatac

SEQ ID NO: 43122 - DNA, 50 bp, homo sapien
caaaaggtacctttggctgtatgaargtgttattatcctatttgtaatat

SEQ ID NO: 43123 - DNA, 50 bp, homo sapien
gaaaaacccaaagatatggtacaaarcaatttataaagacagaaacttat

SEQ ID NO: 43124 - DNA, 50 bp, homo sapien
gagaaccactggttttctgtctgtayaacccttttgaatggactctttaa

SEQ ID NO: 43125 - DNA, 50 bp, homo sapien
acgtatcttttcttgagacacaattyaatctacaacaactaccttttcca

SEQ ID NO: 43126 - DNA, 50 bp, homo sapien
actaaaggaatgagtctgaaatgacsgcaatctaacatgtggtgatgagc

SEQ ID NO: 43127 - DNA, 50 bp, homo sapien
gcaccagatcctctttacctaaatamccagtctttaacatgagctagtcc

SEQ ID NO: 43128 - DNA, 50 bp, homo sapien
tcagttttctccagaattgtcctgartaaccttgtgagtctagattctta

SEQ ID NO: 43129 - DNA, 50 bp, homo sapien
agccaaagtttatttttgttgttggkattattttgttacattcagacaga

SEQ ID NO: 43130 - DNA, 50 bp, homo sapien
tattaaaagatgcatatcaaaataakccataactaaaaaacagccaaagg

SEQ ID NO: 43131 - DNA, 50 bp, homo sapien
tgagcacctacttgccttagagaatsagagtcttcaaatgaaggactatg

SEQ ID NO: 43132 - DNA, 50 bp, homo sapien
atattgtaaatcaaaacttgggaacrcagttaagccagtccttagaaagt

SEQ ID NO: 43133 - DNA, 50 bp, homo sapien
gaattaaagggcagcgaataaaagcraatcatttaaaatcatttttggct

SEQ ID NO: 43134 - DNA, 50 bp, homo sapien
gaaggaccaaaatgattgagctaagyatcagacttaagaagtaagagaaa

SEQ ID NO: 43135 - DNA, 50 bp, homo sapien
tgacagataatatgcagctggttccraatcgtgcctctagttatgttatg

SEQ ID NO: 43136 - DNA, 50 bp, homo sapien
ccgggagaagggagggcagaggtacyagtagatagaggaaggtatgagaa

SEQ ID NO: 43137 - DNA, 50 bp, homo sapien
atagcaactggaactggactccctcrgagctgaaaggaatttgagatatc

SEQ ID NO: 43138 - DNA, 50 bp, homo sapien
aattgttctaagccagggaagaataycacttggctggaaaagttcagtca

SEQ ID NO: 43139 - DNA, 50 bp, homo sapien
tgaaatcagagcaatatttgagctayggccttttttccctctaaaatgct

SEQ ID NO: 43140 - DNA, 50 bp, homo sapien
aagaagtgtttcaggtgcaaaggaamtgtgggtgctccatgactctctga

SEQ ID NO: 43141 - DNA, 50 bp, homo sapien
gatcagctgggatctctgaatagatkaggagtcagggtgaagacagaaac

SEQ ID NO: 43142 - DNA, 50 bp, homo sapien
atgtttttagagttttgggatcacaytccaaaacagtacctggatgcctt

SEQ ID NO: 43143 - DNA, 50 bp, homo sapien
cttggggtcttgtccgttggtataartgttacagtttcaagtttgttgac

SEQ ID NO: 43144 - DNA, 50 bp, homo sapien
ttgtgggacttaactgagtagcagarcctggaaacacctcattgcatctg

SEQ ID NO: 43145 - DNA, 50 bp, homo sapien
accaactaaataacttcccagtggakgtatggatatctaatattccacag

SEQ ID NO: 43146 - DNA, 50 bp, homo sapien
aatgttttgtgtaattcagtaaacaygcaatttttaaaaattgcagccat

SEQ ID NO: 43147 - DNA, 50 bp, homo sapien
ggggcctgaatcagactgtggagaartgtatgatgcatgattttatggaa

SEQ ID NO: 43148 - DNA, 50 bp, homo sapien
accagcatcccttgtcagctttatcrcaagtaaaacctccgttgcagagt

SEQ ID NO: 43149 - DNA, 50 bp, homo sapien
ggacacaaattacacacagtaataawcatcaacagagcttagttatattt

SEQ ID NO: 43150 - DNA, 50 bp, homo sapien
ctgttcttccagtcttataggattayctggaggatcatgtgatgcgaagg

SEQ ID NO: 43151 - DNA, 50 bp, homo sapien
gtctatctgagctgcttgaagcaaaygaaacttatggattggactagcct

SEQ ID NO: 43152 - DNA, 50 bp, homo sapien
agaaatgcttaccataagatacaaawgtaagtaattttttattttaaaaa

SEQ ID NO: 43153 - DNA, 50 bp, homo sapien
ggggaacaaagtattctttttaatayggaagcacatcaccctgacaatct

SEQ ID NO: 43154 - DNA, 50 bp, homo sapien
aacatagaaagataatgcattacacygggacattaccagagctaccacat

SEQ ID NO: 43155 - DNA, 50 bp, homo sapien
acttatattcagaagcatcttgttayctcatgggggaactcaggctctgt

SEQ ID NO: 43156 - DNA, 50 bp, homo sapien
ttaataagagaaaaactgtaacctaygaattatcttggatttttccatat

SEQ ID NO: 43157 - DNA, 50 bp, homo sapien
tctttgggtacagaattccaaaaaamtgtaggtaatgaaaatggtgtctc

SEQ ID NO: 43158 - DNA, 50 bp, homo sapien
tttgcctggaacatactgtacaaccrggcttacctacctccaggcagaag

SEQ ID NO: 43159 - DNA, 50 bp, homo sapien
tccattttaacatcctctatttacawgtgtactcatatttctatcaacta

SEQ ID NO: 43160 - DNA, 50 bp, homo sapien
actattgacagatccagtctactgaygagggagcgaacgcagatgagtag

SEQ ID NO: 43161 - DNA, 50 bp, homo sapien
tccacggtggatgcaaatatctcackgatgtttctatttagtctgaatac

SEQ ID NO: 43162 - DNA, 50 bp, homo sapien
aacaagggaaagaacagcaaagtagyccttcaggttttgccaggaaaaca

SEQ ID NO: 43163 - DNA, 50 bp, homo sapien
ccctgcctgagacagaaagaatacasctgatgatcatgaactactattgc

SEQ ID NO: 43164 - DNA, 50 bp, homo sapien
tgaggacagctgcattaaactgttayatattcctatctactttgatactt

SEQ ID NO: 43165 - DNA, 50 bp, homo sapien
tgtgattaaagtggtaaataataggwcattttttaggcagaacaaccaag

SEQ ID NO: 43166 - DNA, 50 bp, homo sapien
ttcctccaagttctccagtccctaarcatactaaatgttctttctccagt

SEQ ID NO: 43167 - DNA, 50 bp, homo sapien
accataattataagttcctgaaacgyaggagccttctcatactggtcaat

SEQ ID NO: 43168 - DNA, 50 bp, homo sapien
cacaatagtgatttccaaatgttacrgcagaaaatagcatagcaactgaa

SEQ ID NO: 43169 - DNA, 50 bp, homo sapien
gggggctggactaggaggtactggawgtttaatagttcctggagctctgg

SEQ ID NO: 43170 - DNA, 50 bp, homo sapien
gacaggagaggcggctctgcccagcratttatgtacagagatgttttgcc

SEQ ID NO: 43171 - DNA, 50 bp, homo sapien
tttataaagacagctttgaatcacasatcacatccttacagtacacccag

SEQ ID NO: 43172 - DNA, 50 bp, homo sapien
ttttaagtgcaactacttggacacasaggttatgtgatgggcctaaggtt

SEQ ID NO: 43173 - DNA, 50 bp, homo sapien
tggatgaaagaggacctcatgtctasgtcagaagaaataattataagact

SEQ ID NO: 43174 - DNA, 50 bp, homo sapien
tatcatcattcttcacatgactgtcragaagtaagtggaaaattctacaa

SEQ ID NO: 43175 - DNA, 50 bp, homo sapien
tggatttaaatcaatcatgggattakgtgttgaattttttcagagcagac

SEQ ID NO: 43176 - DNA, 50 bp, homo sapien
acaagaccacactgctactcatcacrgtcggtaatttgcctgggatgcaa

SEQ ID NO: 43177 - DNA, 50 bp, homo sapien
taacacttactacctgtgtgatactragccagttactgaatatctcagtc

SEQ ID NO: 43178 - DNA, 50 bp, homo sapien
gatccagagaactctgtgatatgacygaccatcacattagtcttactgat

SEQ ID NO: 43179 - DNA, 50 bp, homo sapien
cacactgcaataatcctggtataaakttgggtaagaccggaaggttagta

SEQ ID NO: 43180 - DNA, 50 bp, homo sapien
agatggccttaataaatctctctaaygttataaatatacagtttctggtt

SEQ ID NO: 43181 - DNA, 50 bp, homo sapien
tcctctgctaaaagcagctttcaatyagttaatcaacggaagaaatgcat

SEQ ID NO: 43182 - DNA, 50 bp, homo sapien
gcatacgagcatatcctctttcttayaacttggtcacttgatccaatctt

SEQ ID NO: 43183 - DNA, 50 bp, homo sapien
taaatctccaaaggtcccacggtgawcatcaaagattggatcaagtgacc

SEQ ID NO: 43184 - DNA, 50 bp, homo sapien
atggtggccacatcatacttgtaacyctaaactccataaatctccaaagg

SEQ ID NO: 43185 - DNA, 50 bp, homo sapien
aaaatggaaaatgttctctctcttaygctttatcttttttgttccatctt

SEQ ID NO: 43186 - DNA, 50 bp, homo sapien
cctgctgccttctgtctagattccartatgaggctattgctgagatacca

SEQ ID NO: 43187 - DNA, 50 bp, homo sapien
taagtaatatggttaaggccacatarctggcggttcactaggcttcacac

SEQ ID NO: 43188 - DNA, 50 bp, homo sapien
aaaaaaaaaaaaaaaatctctgtatkaaactatccaccagaggcaggaca

SEQ ID NO: 43189 - DNA, 50 bp, homo sapien
agcacgggtggcctgagagatgtaaygcaaaaccctgactacacacagtg

SEQ ID NO: 43190 - DNA, 50 bp, homo sapien
ctcattcaggaggaacaaggtcagaragacaagatgggaccagatgactt

SEQ ID NO: 43191 - DNA, 50 bp, homo sapien
cccaatgtaatattccagataaataraatttccaggcttttaagtatcct

SEQ ID NO: 43192 - DNA, 50 bp, homo sapien
aaattaaagttgtatccttagttcayctcactgtgcaaaagtattgccaa

SEQ ID NO: 43193 - DNA, 50 bp, homo sapien
ttggaaatttctaaaccacatcctamaccttgaaaatctcctctagttga

SEQ ID NO: 43194 - DNA, 50 bp, homo sapien
gaagaaggatagagaacaatggacaygggaggccaaattccagagtaggt

SEQ ID NO: 43195 - DNA, 50 bp, homo sapien
actcaaccctacataggagaccaacygagatccgttttactgatcctacc

SEQ ID NO: 43196 - DNA, 50 bp, homo sapien
catttacctcattgggttatataagyattaaatgagttaataaccaaaag

SEQ ID NO: 43197 - DNA, 50 bp, homo sapien
ctggacacattgtacacggtctacaratacttgctgattaactgaattgg

SEQ ID NO: 43198 - DNA, 50 bp, homo sapien
taacctctcatttgctcaactaaacrctggaagtcaaatgaattccttcc

SEQ ID NO: 43199 - DNA, 50 bp, homo sapien
tttatcaattgatttctgtgactgamcatttttactaagttattcattgg

SEQ ID NO: 43200 - DNA, 50 bp, homo sapien
ttctaaggaaatggtgcctttaaccwctcatttgctcaactaaacactgg

SEQ ID NO: 43201 - DNA, 50 bp, homo sapien
gtgtgtcctaagtagcttctattagyattgtcctgtccgtttccttggca

SEQ ID NO: 43202 - DNA, 50 bp, homo sapien
agaaacttttctgacatgttacccartaagaaatatagtattatcgtgca

SEQ ID NO: 43203 - DNA, 50 bp, homo sapien
agcagtaggatcataatgagggatgrcatagcttaaaagacaaagcaaag

SEQ ID NO: 43204 - DNA, 50 bp, homo sapien
tctgtgcttttaaaacactttcaaartaattctgatatgcagctaaattt

SEQ ID NO: 43205 - DNA, 50 bp, homo sapien
ctgccattttagaagctgtctttcayggtacataaggagaaaaagtggat

SEQ ID NO: 43206 - DNA, 50 bp, homo sapien
atttagacatatgtaagaccagtacrctgaaagctacaacaaaatacact

SEQ ID NO: 43207 - DNA, 50 bp, homo sapien
aaactgtctatatcgcttgatatcaytatctacttatgcctgaaatctag

SEQ ID NO: 43208 - DNA, 50 bp, homo sapien
aaaacaaaaggtgtgataaaaccaartgaagttgaactttctacctaaaa

SEQ ID NO: 43209 - DNA, 50 bp, homo sapien
ccactgaagcaaaaggatttgtacaytgatagagctagaaatcagaacct

SEQ ID NO: 43210 - DNA, 50 bp, homo sapien
aatttattatacttaaaagtgctacyggtataagacaaatcttaacattt

SEQ ID NO: 43211 - DNA, 50 bp, homo sapien
tataatataaaaatctgttaagcaaygaaatgaccaatgtaagaagcaaa

SEQ ID NO: 43212 - DNA, 50 bp, homo sapien
ttatgtattatatataacatgtttakgattaaatctggcccatattctaa

SEQ ID NO: 43213 - DNA, 50 bp, homo sapien
tcttgagggccacacccatgataacrctggaattttcatttaattcctaa

SEQ ID NO: 43214 - DNA, 50 bp, homo sapien
ccaggctattttcagtacaagtaaaygcaaccagatgacagagcccactt

SEQ ID NO: 43215 - DNA, 50 bp, homo sapien
aaggtaacatttttgtcagtctatakgtaagcattatgtaaaaaaaaaag

SEQ ID NO: 43216 - DNA, 50 bp, homo sapien
caaaagcaacatctattcttgaactyagcttagaagatttttttgtttgt

SEQ ID NO: 43217 - DNA, 50 bp, homo sapien
tctggcacaaggtacaggtataaccraatgtaagtgccttggttctggac

SEQ ID NO: 43218 - DNA, 50 bp, homo sapien
agacgtggagtgggggaagtaaatasaatctcgtgaaagagaaggactga

SEQ ID NO: 43219 - DNA, 50 bp, homo sapien
atgtggtacagggccagcggttgacmatctacttaaactgccaggaaaat

SEQ ID NO: 43220 - DNA, 50 bp, homo sapien
cttttcagagccacccacttattccmacgaaagtagctgtgataattttt

SEQ ID NO: 43221 - DNA, 50 bp, homo sapien
ggattcttccagcccagctttgagcrgcgtagaacggtcggatggaggtg

SEQ ID NO: 43222 - DNA, 50 bp, homo sapien
aacaaatgctaatcatagcaagctaraggcctgaatgatagtggacttac

SEQ ID NO: 43223 - DNA, 50 bp, homo sapien
acctaatttctcccttcagtcttcargatctcctgataatcatttattcc

SEQ ID NO: 43224 - DNA, 50 bp, homo sapien
gtgcttatattgaaagtatgctctcrgaaaatatattttagcatttccaa

SEQ ID NO: 43225 - DNA, 50 bp, homo sapien
tgttctatagcttatgacccaaaacrctaaaagtagaacattctaatatt

SEQ ID NO: 43226 - DNA, 50 bp, homo sapien
catcagcataagttctcagtttaaayggctgcctccttgaaacagtgccg

SEQ ID NO: 43227 - DNA, 50 bp, homo sapien
acattctatgcaatatatctaaatcraatcatggtaccagataaaattat

SEQ ID NO: 43228 - DNA, 50 bp, homo sapien
aggtgctttctttcctcaggatccgmaattaaattaatgcttctggccag

SEQ ID NO: 43229 - DNA, 50 bp, homo sapien
cctttggggaccatgactccatggayaggactgtcattcagaaataccac

SEQ ID NO: 43230 - DNA, 50 bp, homo sapien
tactgcataaaatgtggaggtcaacrcttaactaaaatgattttttaaag

SEQ ID NO: 43231 - DNA, 50 bp, homo sapien
cttctattgaaatcaatttctcttcyataaaatgatcacctaagagattg

SEQ ID NO: 43232 - DNA, 50 bp, homo sapien
aggatatcagtaagtgagccagttarctccataaaactccagaaaagttc

SEQ ID NO: 43233 - DNA, 50 bp, homo sapien
ccatgacgggttgaacgcataagtayctttagtttttccaaaatgtctct

SEQ ID NO: 43234 - DNA, 50 bp, homo sapien
aagtaagcagatctatgtaatggcaraaagataataataaatgaattaaa

SEQ ID NO: 43235 - DNA, 50 bp, homo sapien
tgtgcatgttatttaattattactamcattgctctgaattaattaagcaa

SEQ ID NO: 43236 - DNA, 50 bp, homo sapien
cagattctttgaagcactagaagcaracacttgaccacaatgtattctca

SEQ ID NO: 43237 - DNA, 50 bp, homo sapien
taagtaaaatagcaggagtgctcggwcagaaaaggacatttaactaaatc

SEQ ID NO: 43238 - DNA, 50 bp, homo sapien
aataaataagagtcactaagtaaaartgctgaaaattcccagtagacaat

SEQ ID NO: 43239 - DNA, 50 bp, homo sapien
ataccaaacattgttctactgctcartatattatttaatcttctaccaac

SEQ ID NO: 43240 - DNA, 50 bp, homo sapien
ccttgctgctatagtgataaggtcamctgtgattccatttctgtctttga

SEQ ID NO: 43241 - DNA, 50 bp, homo sapien
aggatcattctatcattttgctaccrgatactatgcttccttcctggtta

SEQ ID NO: 43242 - DNA, 50 bp, homo sapien
atgacaatccatgagaaaaacgagcsaaaaacaaaatgagccccaaatta

SEQ ID NO: 43243 - DNA, 50 bp, homo sapien
tgcttggatccttaaggagtttacgraatctgctgttttatcaaagtgaa

SEQ ID NO: 43244 - DNA, 50 bp, homo sapien
gcgcagtgtctttctcacagtattcrctccataaatgtttgttaagtatt

SEQ ID NO: 43245 - DNA, 50 bp, homo sapien
atttcatttcttcatcataagttaaycagcataaagctagaaggagttac

SEQ ID NO: 43246 - DNA, 50 bp, homo sapien
aaagagacccagctgaaagaagctayaattattcttgacattttagaacg

SEQ ID NO: 43247 - DNA, 50 bp, homo sapien
atattgttatgtatgcatgttaaaaygtatagggtaaccattgttttaaa

SEQ ID NO: 43248 - DNA, 50 bp, homo sapien
acggaaacttacttgtataagctgayggtcggttcaactgccaacatcac

SEQ ID NO: 43249 - DNA, 50 bp, homo sapien
ataccaacaggtagatagagaacggrcagtaaatattgatgaagttaaat

SEQ ID NO: 43250 - DNA, 50 bp, homo sapien
tagctacagaaatatttaaaatcatwagttgggtttttatcacaacttaa

SEQ ID NO: 43251 - DNA, 50 bp, homo sapien
gtgctttacatacaaattagccataygtttattaaagaatgttaataaaa

SEQ ID NO: 43252 - DNA, 50 bp, homo sapien
aaaatttgagtgattcttacaggcaygatactgttctgattccatatttt

SEQ ID NO: 43253 - DNA, 50 bp, homo sapien
atagagcctggtgatccctttgacaractgaaaaattggtatgtatcaaa

SEQ ID NO: 43254 - DNA, 50 bp, homo sapien
tgggagagtggattaaacaggttgcmcaggcctgagtagctcattcatta

SEQ ID NO: 43255 - DNA, 50 bp, homo sapien
taggaagtttgcaaagaattggaaartgggaaattaagaagcatgctttc

SEQ ID NO: 43256 - DNA, 50 bp, homo sapien
cacactttctaggtgggataccagcraggtactgtttaaggaatccaatt

SEQ ID NO: 43257 - DNA, 50 bp, homo sapien
agatgggagagctgtattcaagtctkaaagtcaatggaaaggattcattt

SEQ ID NO: 43258 - DNA, 50 bp, homo sapien
atttctctggcttcatgcccagataygggtacagttccttgtttaaaaaa

SEQ ID NO: 43259 - DNA, 50 bp, homo sapien
acctcactaagcagaagaataagaayatatcaccagtgagccattgagga

SEQ ID NO: 43260 - DNA, 50 bp, homo sapien
tatgacttcaactcccatccataatracttctaatccatcttcactctgg

SEQ ID NO: 43261 - DNA, 50 bp, homo sapien
ttacatgaaaaattgtctccaatccrctttatgtatactcatgttatctt

SEQ ID NO: 43262 - DNA, 50 bp, homo sapien
ttttgtatttttccttggctttgatkaattgacagatgtcaccaacgctg

SEQ ID NO: 43263 - DNA, 50 bp, homo sapien
ttattcctcagggcatgatactgacyaacagatttggaggaccataaaga

SEQ ID NO: 43264 - DNA, 50 bp, homo sapien
catattcaacctgacgagataatatsataaaattgtcaacatcagccctg

SEQ ID NO: 43265 - DNA, 50 bp, homo sapien
cagtcacatatggcagaagtgataayagtagagtttaatcaatttcacac

SEQ ID NO: 43266 - DNA, 50 bp, homo sapien
gagttgcaggcttcctgtgggccacmaataacagagtctgacagtatcac

SEQ ID NO: 43267 - DNA, 50 bp, homo sapien
tcctgtgcaattctgtctgcaattawcttttctgtgtcctagcatgacac

SEQ ID NO: 43268 - DNA, 50 bp, homo sapien
taaatggttgctttttaataaaatawcacctattctaaagatttactcac

SEQ ID NO: 43269 - DNA, 50 bp, homo sapien
gaaagtatctatgctacttgattaaytggaggaaatgttgaacatttatt

SEQ ID NO: 43270 - DNA, 50 bp, homo sapien
tctgggatgcaccaagcagatgtgaygttctatctataatctaattggta

SEQ ID NO: 43271 - DNA, 50 bp, homo sapien
agataaacaaataactgttgaagagraaataattttacgttaatttttgc

SEQ ID NO: 43272 - DNA, 50 bp, homo sapien
tagttatatgcctttggattaaaagycctcatctcaggtaaagccttttc

SEQ ID NO: 43273 - DNA, 50 bp, homo sapien
ttgtgccttggaacagggtgagaaayggtcagatttagaatgtaatttaa

SEQ ID NO: 43274 - DNA, 50 bp, homo sapien
tctcattatctaacctagatacttaygaagttctcagaatcaaaatgagt

SEQ ID NO: 43275 - DNA, 50 bp, homo sapien
cagaattatagttgaactgacctcargaatcaaaatactaatgacaaagt

SEQ ID NO: 43276 - DNA, 50 bp, homo sapien
gataaataggatatgcctttcttaaygtttttcaattgcatattcaatac

SEQ ID NO: 43277 - DNA, 50 bp, homo sapien
aaacttccaatcattctgtgtcattyaatagcctgtcacttatggaaagt

SEQ ID NO: 43278 - DNA, 50 bp, homo sapien
tttgttcactactgtcttctagcacraaataaatgtttgctatatatatg

SEQ ID NO: 43279 - DNA, 50 bp, homo sapien
tgcagcagtgtcaaagtgtgagagawtccaattgaatataaaacattaca

SEQ ID NO: 43280 - DNA, 50 bp, homo sapien
tatgacaataaaaactgtggttagcwcttacatagcacttaatcagggta

SEQ ID NO: 43281 - DNA, 50 bp, homo sapien
cagaagttctagttgagaaaactgaygaagagggttacactaaacagtgt

SEQ ID NO: 43282 - DNA, 50 bp, homo sapien
aacatcatcagtcatgaaaactcacraatagagaaatcagcaagtatatt

SEQ ID NO: 43283 - DNA, 50 bp, homo sapien
cccaccctctaaaatattatactccratgaatgagaaaagcagtcatgcc

SEQ ID NO: 43284 - DNA, 50 bp, homo sapien
gttgtaaatgagactataactgcaayggtaaaaaggcaggatttgtaacc

SEQ ID NO: 43285 - DNA, 50 bp, homo sapien
attgcagttatagtctcatttacaayattagtgtgctaaatagggactgc

SEQ ID NO: 43286 - DNA, 50 bp, homo sapien
ctcgttgggatcatagcagaggttaygatgattgtgcttcctgggcatta

SEQ ID NO: 43287 - DNA, 50 bp, homo sapien
cccagtaacatacattatcttcgttraaagcaagcagtgactttcatagg

SEQ ID NO: 43288 - DNA, 50 bp, homo sapien
ttgtcacggcacactaaacaatatgmaagtaggtaaagggtgaggggagg

SEQ ID NO: 43289 - DNA, 50 bp, homo sapien
tgaactctcgtaataatccaatctayggctcctaattcactgtattttgg

SEQ ID NO: 43290 - DNA, 50 bp, homo sapien
atttataaagcatatgcaagggtgckacgtagttcaggatgctattgtga

SEQ ID NO: 43291 - DNA, 50 bp, homo sapien
taatattacccttagctgctatttayaagtccatttcatcagcataataa

SEQ ID NO: 43292 - DNA, 50 bp, homo sapien
aaaaaaagcacaaaataaaagtttasatttggcataactttagtagtctc

SEQ ID NO: 43293 - DNA, 50 bp, homo sapien
attatagctattgctatgtggttaaygagttaatatattcaaagcacata

SEQ ID NO: 43294 - DNA, 50 bp, homo sapien
cctattatgaagcaagccggctgackcactactgttctaatgatagtctg

SEQ ID NO: 43295 - DNA, 50 bp, homo sapien
tgtatttctgtgagatctacataacwgaagttcctcttaaaaataattaa

SEQ ID NO: 43296 - DNA, 50 bp, homo sapien
ctctgttataagactggctgatataraatgataaaacagatatataaaag

SEQ ID NO: 43297 - DNA, 50 bp, homo sapien
gatcatttctaatttaatagtgacasaaaacctttggaactcatacacta

SEQ ID NO: 43298 - DNA, 50 bp, homo sapien
atctgttaattgactatatctaacayggtgaacaattccaacaattattc

SEQ ID NO: 43299 - DNA, 50 bp, homo sapien
taagaactaccaaaacatccataccyatactgttgcaaacaaggtacaca

SEQ ID NO: 43300 - DNA, 50 bp, homo sapien
ctctgggacttaagaccgtgttatayaccactgaaatacaaatgtggttt

SEQ ID NO: 43301 - DNA, 50 bp, homo sapien
gtttcccgtcacataactaacttcawgttgctcacaagtctccattctcc

SEQ ID NO: 43302 - DNA, 50 bp, homo sapien
acaactggatggctttcctgataaarccttttagataaatgcaaaggtcc

SEQ ID NO: 43303 - DNA, 50 bp, homo sapien
aagttttactattattctttcagtaracacttatttggaggtgactggga

SEQ ID NO: 43304 - DNA, 50 bp, homo sapien
cactccaatgttggtgaggacggtcyatccattctgcatatgtctgcgtc

SEQ ID NO: 43305 - DNA, 50 bp, homo sapien
aaggcaaactgtagactaattcaccraaaataagtacacatacttttcaa

SEQ ID NO: 43306 - DNA, 50 bp, homo sapien
aaaatctacgccctgcagtgctccarcgtaagccacagaaatctaggctg

SEQ ID NO: 43307 - DNA, 50 bp, homo sapien
cacacacatgcacaattatgagactraacactcccttcttctttggattg

SEQ ID NO: 43308 - DNA, 50 bp, homo sapien
agttatattttaaagacctgacccayatattgagagaaactttcaaagct

SEQ ID NO: 43309 - DNA, 50 bp, homo sapien
ccatttttggatgacagcactgagayatattggttatgatttgccctcca

SEQ ID NO: 43310 - DNA, 50 bp, homo sapien
cttggagccagagaaaaattgtatargtcagttcactaggaataggtcca

SEQ ID NO: 43311 - DNA, 50 bp, homo sapien
ttacaagtcaatgttctagcagagtraagtcattactggccttaattttc

SEQ ID NO: 43312 - DNA, 50 bp, homo sapien
ctgcttctcttcctcttttggataaytgacattttgtcaaatggcaaaaa

SEQ ID NO: 43313 - DNA, 50 bp, homo sapien
tctcatccctttactggctgagcaamttctaaacagaattcttcagtaag

SEQ ID NO: 43314 - DNA, 50 bp, homo sapien
tcaagagcttggtgagcaaaggtacyctggtgcagaccaaaggtaccggt

SEQ ID NO: 43315 - DNA, 50 bp, homo sapien
tcatttatgtgaggcagctaggtaartgtccgttttgaggaggagggttg

SEQ ID NO: 43316 - DNA, 50 bp, homo sapien
tagacagatgaccttgaccaccagaktaagaaaagtaagaatatctggca

SEQ ID NO: 43317 - DNA, 50 bp, homo sapien
tcccagcctctgagcttgtttatgaygaatgacaatgaataacttccaat

SEQ ID NO: 43318 - DNA, 50 bp, homo sapien
tgaagttaaattagcttcttcaacartgagctctgtggaatagatgcacc

SEQ ID NO: 43319 - DNA, 50 bp, homo sapien
acttgtagctctgtgtccattgtccrctgttaattcacaagagccttgat

SEQ ID NO: 43320 - DNA, 50 bp, homo sapien
tgcgtgagcactgattagtcttctartactcagatgagcacacagaagac

SEQ ID NO: 43321 - DNA, 50 bp, homo sapien
catctgatgttatcagtaggaagcarcatattggtctttagataaataaa

SEQ ID NO: 43322 - DNA, 50 bp, homo sapien
tagcattcaatagttgctttaaaaayagttgttcatttatgtgactttac

SEQ ID NO: 43323 - DNA, 50 bp, homo sapien
gatgtgtgactcattttatttttggwcaacacacgtaagtcacaataata

SEQ ID NO: 43324 - DNA, 50 bp, homo sapien
agaaactgacttttggtttaaataaygattactttgaaaaacacaatata

SEQ ID NO: 43325 - DNA, 50 bp, homo sapien
ccaagacagctttatctctcatgaamataacttcagtggcctccttcctg

SEQ ID NO: 43326 - DNA, 50 bp, homo sapien
atcttggtctagagccatttcaaccygatttcttttcatgtcagtggcat

SEQ ID NO: 43327 - DNA, 50 bp, homo sapien
tgtttagtcggctagttatgtctgayggatagaagtgaggacactcctaa

SEQ ID NO: 43328 - DNA, 50 bp, homo sapien
agaaggcttggctctaagcccaaaayagccgacctgctttgctcacctct

SEQ ID NO: 43329 - DNA, 50 bp, homo sapien
aagtggactttattcccttattccastaatgcaaggcttaatccatattt

SEQ ID NO: 43330 - DNA, 50 bp, homo sapien
ttgtacttttctgttaatcaaaagcrcatctaatctgttttatctgaaaa

SEQ ID NO: 43331 - DNA, 50 bp, homo sapien
ggaatacgttgtatgcctatccttgmaatttattactatatacatttttc

SEQ ID NO: 43332 - DNA, 50 bp, homo sapien
aaatggtgacttacccaagcaaagakaagagtatgtggaaagacatatag

SEQ ID NO: 43333 - DNA, 50 bp, homo sapien
acatattagatattttacctgataaytgataaagaatacatcgcactgcc

SEQ ID NO: 43334 - DNA, 50 bp, homo sapien
tagaagtaagaattttgtgtgattayagggctattactacaccatctaac

SEQ ID NO: 43335 - DNA, 50 bp, homo sapien
ccttacattttatttatatacaatargacacattttggatgcaccattac

SEQ ID NO: 43336 - DNA, 50 bp, homo sapien
tttgggcccattttcaggtagtgacraaatcagttacagggactagtttg

SEQ ID NO: 43337 - DNA, 50 bp, homo sapien
tagaaactcagggctaagagcaatcraagagatcattttactttagttat

SEQ ID NO: 43338 - DNA, 50 bp, homo sapien
ttttttgtgtggtacaaaccatgtamaaagtcaccataaaactagagtat

SEQ ID NO: 43339 - DNA, 50 bp, homo sapien
caatggggagacactcctttggtcastaactcaaataaatctgtagaacc

SEQ ID NO: 43340 - DNA, 50 bp, homo sapien
gtcccaactgtaaaggttgttaaacrgcaggaatgatttattcaaaggag

SEQ ID NO: 43341 - DNA, 50 bp, homo sapien
agagagacttattcgtgttaaaatgraatactctgtccctgagcgcttaa

SEQ ID NO: 43342 - DNA, 50 bp, homo sapien
tcctgtgctcctgatcactgagcaamcatgaaattgactacaaacaataa

SEQ ID NO: 43343 - DNA, 32 bp, homo sapien
ttaaaggaagattgtcrctaatagataaaaag

SEQ ID NO: 43344 - DNA, 50 bp, homo sapien
tctacagcactgcttagattgcgtcrctccttgcctactgagtacagatg

SEQ ID NO: 43345 - DNA, 50 bp, homo sapien
taggaaagcatgcttgattttagaastcagagaccgtgaaaggagaactg

SEQ ID NO: 43346 - DNA, 50 bp, homo sapien
acttacatgtgaatggaatgatcacrattcaactaatttgccagattaat

SEQ ID NO: 43347 - DNA, 50 bp, homo sapien
caaattggcacaaacaagaaagacartatcaaactatggtagattaaaca

SEQ ID NO: 43348 - DNA, 50 bp, homo sapien
ttaaaaggcagagtatccgctatatkataagaactccatagatattagtt

SEQ ID NO: 43349 - DNA, 50 bp, homo sapien
catcccagctgtctgatataggaatmaaaaacgcagtattaaagaaaaca

SEQ ID NO: 43350 - DNA, 50 bp, homo sapien
attaatatgatattaagtttacaaarttacctagcctccctccccaaaat

SEQ ID NO: 43351 - DNA, 50 bp, homo sapien
atagccctgtggagcaaccaaaggarcattgctttatattcactgcagaa

SEQ ID NO: 43352 - DNA, 50 bp, homo sapien
ttaatatcatattaataagaatgatraaacacaatactattccatgaaaa

SEQ ID NO: 43353 - DNA, 50 bp, homo sapien
actggtgtgtatgtcatttaaattaragaaatgctgtcctaactaagcat

SEQ ID NO: 43354 - DNA, 50 bp, homo sapien
tgtaggaattctttgtatatctcccrccttttaaaatatgtaatcagttt

SEQ ID NO: 43355 - DNA, 50 bp, homo sapien
ttgtaatgaaactatatctatctgaraaacaaccataacaaacaaagaaa

SEQ ID NO: 43356 - DNA, 50 bp, homo sapien
gaatgaatgtaaggatgtgaaggaaraggacgctaagacatatgaaaata

SEQ ID NO: 43357 - DNA, 50 bp, homo sapien
cggtttttgccacgtacttgatttaycatctttagatgatttatttccat

SEQ ID NO: 43358 - DNA, 50 bp, homo sapien
gtttattctcatgtttgctacacacratgtggacacttgcttggactgac

SEQ ID NO: 43359 - DNA, 50 bp, homo sapien
cctgccaccaggaaaggtaaagccaytgctcttgtttgcaggctatgtta

SEQ ID NO: 43360 - DNA, 50 bp, homo sapien
ttacacatctctgcatcacactgacycttcgtaaagatactcccagtgta

SEQ ID NO: 43361 - DNA, 50 bp, homo sapien
atggtctgttccgtctatcactccaytctttatctagtctctgagacaag

SEQ ID NO: 43362 - DNA, 50 bp, homo sapien
tgcaagggggcactgtattgagaagyaagccgatttcactaatgttacat

SEQ ID NO: 43363 - DNA, 50 bp, homo sapien
aatacaaacttttgagacagtttcaktccatttgatagtcattcaaccaa

SEQ ID NO: 43364 - DNA, 50 bp, homo sapien
acattttagataataaattttagcayagggattactctgtgtgtcagtac

SEQ ID NO: 43365 - DNA, 50 bp, homo sapien
gatctattgtataacacagtgactayagtataaaacaatgtattatattc

SEQ ID NO: 43366 - DNA, 50 bp, homo sapien
cccacactctctacataaggcataamatggaaccatttggatggaaaaat

SEQ ID NO: 43367 - DNA, 50 bp, homo sapien
ttaatgttgctactaattgctttacrgagaagtaaaagattcttataact

SEQ ID NO: 43368 - DNA, 50 bp, homo sapien
atatggcttctattcctgtagattaygtggtccctattttagtgagcctt

SEQ ID NO: 43369 - DNA, 50 bp, homo sapien
atcagaagcttggacctaacagatargacgagtcgagtgtttctaaaggc

SEQ ID NO: 43370 - DNA, 50 bp, homo sapien
acaaaagtagtttgtagtaggtaaaytctaacctgccttgagtttgcatt

SEQ ID NO: 43371 - DNA, 50 bp, homo sapien
tatgatcatgggtctaatgatcccaygatttagttttgcttttatttggg

SEQ ID NO: 43372 - DNA, 50 bp, homo sapien
tagaaaagtatactattttgccaaaraaaccggaagcaagcattgacaca

SEQ ID NO: 43373 - DNA, 50 bp, homo sapien
acactttgtctcacccatccagaatkaacagagtagtatgaccacagaaa

SEQ ID NO: 43374 - DNA, 50 bp, homo sapien
aatggagaaattcaagaaaccaaaamtgtttatgtcacagataaaaaact

SEQ ID NO: 43375 - DNA, 50 bp, homo sapien
agtatgtccttgttgatcttcactakctccttgttttatcccgtggctca

SEQ ID NO: 43376 - DNA, 50 bp, homo sapien
atctaaagccaatttcttccacaccragttatttgtcatcttttccaaag

SEQ ID NO: 43377 - DNA, 50 bp, homo sapien
tcttttccaaaggctacattgataarcacaacttgtttggcttctaaaat

SEQ ID NO: 43378 - DNA, 50 bp, homo sapien
ttgtatagagccagtccaatcatacrgcataatttagaacttggcttatg

SEQ ID NO: 43379 - DNA, 50 bp, homo sapien
gcagtgcctaagaagttgaaaattayatgatgaatcactgctctgacctt

SEQ ID NO: 43380 - DNA, 50 bp, homo sapien
gtttaattcaatcctgactcctacartaatagcaagacataacaacttct

SEQ ID NO: 43381 - DNA, 50 bp, homo sapien
tcgttacctgttatttatttagctaycaattttaactattgataaatgta

SEQ ID NO: 43382 - DNA, 50 bp, homo sapien
tctatttccaaaggtaagtgttttaygaacgtcactcaatgctggtgctt

SEQ ID NO: 43383 - DNA, 50 bp, homo sapien
tcatttaatcttcttgacaactctcratgtgctactgagaaaactcgcac

SEQ ID NO: 43384 - DNA, 50 bp, homo sapien
ctggtaattagtcatccagcttatakgaaggtactatagtttttcattaa

SEQ ID NO: 43385 - DNA, 50 bp, homo sapien
agcacagaagcatctgaggaggaacrccgtgattcacttccagctgtcag

SEQ ID NO: 43386 - DNA, 50 bp, homo sapien
ttcatatctgttgcagaattcacccrccaacttattgtcattaatgaaaa

SEQ ID NO: 43387 - DNA, 50 bp, homo sapien
gtaaagaaaggaacgtagaactgtaygaagaggtcatttgagcccacctt

SEQ ID NO: 43388 - DNA, 50 bp, homo sapien
atttaaaatggttatctatatagagsatttaccatgaatggagcttgcag

SEQ ID NO: 43389 - DNA, 50 bp, homo sapien
ttaaacagattagtcaaggaaaatayacatggtgattccaggcaaaacga

SEQ ID NO: 43390 - DNA, 50 bp, homo sapien
ttacattttctgtctttgtctttatmaccataacttcaataccatgtgcc

SEQ ID NO: 43391 - DNA, 50 bp, homo sapien
agtttaatctaggaaattatccttcyacctggcatgctcatactacctgt

SEQ ID NO: 43392 - DNA, 50 bp, homo sapien
atggacccccaaaatatttgtccaastgctaactcctagtaccaaactct

SEQ ID NO: 43393 - DNA, 50 bp, homo sapien
aaaaagaaatggcgagctcattatgraaacatctattagaaaatagggat

SEQ ID NO: 43394 - DNA, 50 bp, homo sapien
gattggctggattatagttaacataygtaccacgtggtcatggtaagact

SEQ ID NO: 43395 - DNA, 50 bp, homo sapien
acgtaccacgtggtcatggtaagacygtcaattgccggaaacggtggctc

SEQ ID NO: 43396 - DNA, 50 bp, homo sapien
taagagtaccctttcagtcatttagwcattcaggccaataactattcaat

SEQ ID NO: 43397 - DNA, 50 bp, homo sapien
aaaagaaaaaaattcaattaatagasgagcacaagataatattaaagaaa

SEQ ID NO: 43398 - DNA, 50 bp, homo sapien
ccattaaaaaatacattaatactaayatcgggacaaactaaaggaagttg

SEQ ID NO: 43399 - DNA, 50 bp, homo sapien
caactgccaagcgcccgcacttgtcmaggagcattttgctgtcaggacta

SEQ ID NO: 43400 - DNA, 50 bp, homo sapien
agcatttatattcatggctcgataaygcaagacagattaaaaaaaaaaaa

SEQ ID NO: 43401 - DNA, 50 bp, homo sapien
gtgaagagggcagtcggaccgattcracattgacctctgctcttagatca

SEQ ID NO: 43402 - DNA, 50 bp, homo sapien
ggccagcagctgcgaaacccgtccamgcgaaattgagttcttggctgggc

SEQ ID NO: 43403 - DNA, 50 bp, homo sapien
caggaacattactaaaattttggaargcattggaatgtagtagaaaggtc

SEQ ID NO: 43404 - DNA, 50 bp, homo sapien
atgcaataaaactcatcttgtgctargtactggagatacatggagggagc

SEQ ID NO: 43405 - DNA, 50 bp, homo sapien
aacatactctccaaatctgagacaaytcatccaagcagtgtgtttccttt

SEQ ID NO: 43406 - DNA, 50 bp, homo sapien
taaaaaagaaattcaatctaattacygagttaccaaagcagaatatagag

SEQ ID NO: 43407 - DNA, 50 bp, homo sapien
attttgttgtgacctaaacgcaaaaragcgctaagtgaaaacaattcaga

SEQ ID NO: 43408 - DNA, 50 bp, homo sapien
catgcctagtacctgactcgtggacyggcatgtggtatgagctcaatgat

SEQ ID NO: 43409 - DNA, 50 bp, homo sapien
cacacattctctgcctatcttgaagyatctcttactctggtcttgaaaca

SEQ ID NO: 43410 - DNA, 50 bp, homo sapien
ccacatccttactcctcgccggtacrgaaacctaagtccacatgccgaga

SEQ ID NO: 43411 - DNA, 50 bp, homo sapien
atagcctttaccataagagtgttgaygtgaccttttgagaatgtgtgatc

SEQ ID NO: 43412 - DNA, 50 bp, homo sapien
tgaagcttgctatggtttgtgacaascgtattttattgtattctaatttt

SEQ ID NO: 43413 - DNA, 50 bp, homo sapien
tcttgtgagattactaaatttgggasacttgagaaatgactttcagttcc

SEQ ID NO: 43414 - DNA, 50 bp, homo sapien
cccaaatctcataatactgagtttcmctggagaaatgtattccacgttca

SEQ ID NO: 43415 - DNA, 50 bp, homo sapien
agtttccctggagaaatgtattccaygttcagaaacctggggcagagcaa

SEQ ID NO: 43416 - DNA, 50 bp, homo sapien
ctcagtttgtcagattcccaaactcyatttatctctactgcaccgacttg

SEQ ID NO: 43417 - DNA, 50 bp, homo sapien
gtgaagaaaatagatgataagactaygtgctagactaaagcaagagcttg

SEQ ID NO: 43418 - DNA, 50 bp, homo sapien
tcagactttgggtaacaaggccctaratcattcttcaagatttcaagtta

SEQ ID NO: 43419 - DNA, 50 bp, homo sapien
tgcagcatagaaaaaataatagaacrgtgtggtgacactaaagtcgtgac

SEQ ID NO: 43420 - DNA, 50 bp, homo sapien
gagtgtgagctcctccaggacatgamctatttttttcttcttcttttatc

SEQ ID NO: 43421 - DNA, 50 bp, homo sapien
aatgaaaattatacctgctaaatgakcccagttttcaagtctgctcatca

SEQ ID NO: 43422 - DNA, 50 bp, homo sapien
accactgaaaatgcaacattgtacayatcactggttgttgggagggactt

SEQ ID NO: 43423 - DNA, 50 bp, homo sapien
ctagttcatgctttagaaacccagtraaatacatcagaacctcagctcca

SEQ ID NO: 43424 - DNA, 50 bp, homo sapien
aatgtagttcattggtaaattaaacmaaaggtcagaaatcattaaacaaa

SEQ ID NO: 43425 - DNA, 50 bp, homo sapien
cccaaatttcaaggaggtattcaaayggagcacatagctacatattaata

SEQ ID NO: 43426 - DNA, 50 bp, homo sapien
aaaaagagaagttcttactaacccayctgttcacctacttgcatctgtgc

SEQ ID NO: 43427 - DNA, 50 bp, homo sapien
tctctcttcacctctacctgaaaccygatgctttaaagaccagagttatc

SEQ ID NO: 43428 - DNA, 50 bp, homo sapien
atgttgaattagtgctgtgggaataygggtcctatcaggcagatttgcag

SEQ ID NO: 43429 - DNA, 50 bp, homo sapien
ccctcatccatttatgtctcagaccrctattcttaactattcaatggtga

SEQ ID NO: 43430 - DNA, 50 bp, homo sapien
acgtttataaacagctagcctatggmatgtctttccctttcattttcctg

SEQ ID NO: 43431 - DNA, 50 bp, homo sapien
acgcccggctgaacatggagattctraataacaataataatagctaacac

SEQ ID NO: 43432 - DNA, 50 bp, homo sapien
gcaggaggggagaataggaactgacrgctaatgagtataagctttctctt

SEQ ID NO: 43433 - DNA, 50 bp, homo sapien
aagaggtttaaacggtccactacgarataaatagagaaggaaaagttatc

SEQ ID NO: 43434 - DNA, 50 bp, homo sapien
aaagataccatggtataacggttaayactctggactccaaatacagaaat

SEQ ID NO: 43435 - DNA, 50 bp, homo sapien
tctgggtgaatagttcgagctcactragactacctgggaattgagaagat

SEQ ID NO: 43436 - DNA, 50 bp, homo sapien
ggccaccacactgttaaacactgtaragacctcagggcagaataagccct

SEQ ID NO: 43437 - DNA, 50 bp, homo sapien
gatgaaaagtttacagacggaattayggaaagtctcagaacagtgagatc

SEQ ID NO: 43438 - DNA, 50 bp, homo sapien
gctttacttggaacatcatccaggckcagagaacacaaatatttcatttc

SEQ ID NO: 43439 - DNA, 50 bp, homo sapien
acaaatccttaaaatgtattaagaaytggccctgaaaaaaaaaggaattg

SEQ ID NO: 43440 - DNA, 50 bp, homo sapien
tggtgggatggaaatgtttctctaaytatctgaggtggtttcaatggctg

SEQ ID NO: 43441 - DNA, 50 bp, homo sapien
ctaatctgatttcactctcccattasatgaaagagaaggaagtaccgtcc

SEQ ID NO: 43442 - DNA, 50 bp, homo sapien
gcagcatctgcaatgcaatgtacaartatctgtctctctaggtcccctga

SEQ ID NO: 43443 - DNA, 50 bp, homo sapien
tgggaacggcctcgccctgagtaacrggaagaaaggcgttggctggcctc

SEQ ID NO: 43444 - DNA, 50 bp, homo sapien
ctattttgatttataaatggacaggratatatcagtaagacactaccaga

SEQ ID NO: 43445 - DNA, 50 bp, homo sapien
ctttgccacacatattgcactggtayggcttctccccagtatgaattttg

SEQ ID NO: 43446 - DNA, 50 bp, homo sapien
acaaggcacaaagaagagtaaaagamctcatggatctgaccaatttgtga

SEQ ID NO: 43447 - DNA, 50 bp, homo sapien
caatacattttgaattcaaacattcrccttataggtcatgtttttcaggc

SEQ ID NO: 43448 - DNA, 50 bp, homo sapien
ctgagcatctcctttaaacaagtcartagcaatttctacatcttcatttt

SEQ ID NO: 43449 - DNA, 50 bp, homo sapien
aataagtgtgcctctcaccttgtatmacttgtataacacacgaggatttt

SEQ ID NO: 43450 - DNA, 50 bp, homo sapien
ccaggaaactgtgaaccaggactcartagttcccatggaccacatattca

SEQ ID NO: 43451 - DNA, 50 bp, homo sapien
cttagcatcatgtcctgtgtagttcyatcccggaatcaatcctcaacagc

SEQ ID NO: 43452 - DNA, 50 bp, homo sapien
aaccttttcaaaaactagaaatttasaaatggttggttactaaacttaaa

SEQ ID NO: 43453 - DNA, 50 bp, homo sapien
tccagttcgagaggtggatttcataraaaggtaggaaggacatctcctca

SEQ ID NO: 43454 - DNA, 50 bp, homo sapien
tggtgtttattataacataacattaraaataactcaggtgaccgcgaaca

SEQ ID NO: 43455 - DNA, 50 bp, homo sapien
ggcatgctcttgacaaatttactaawgttaagtgaggcaagaagctgcca

SEQ ID NO: 43456 - DNA, 50 bp, homo sapien
aaagtagtcctggaaagtagtcatcscgaaaaatttctgtcatagcaact

SEQ ID NO: 43457 - DNA, 50 bp, homo sapien
actgaatggtggccataaagattcayattgtggagtaaatctatttggaa

SEQ ID NO: 43458 - DNA, 50 bp, homo sapien
gtatcctttcattgttgtatttactyagatttcttacttggtttctggca

SEQ ID NO: 43459 - DNA, 50 bp, homo sapien
ttattcctggagatggcataatctgsataagacagaggtaccctgcacac

SEQ ID NO: 43460 - DNA, 50 bp, homo sapien
tatatgagggatacaagagatagacragatatatgactggcttttcactg

SEQ ID NO: 43461 - DNA, 50 bp, homo sapien
aatccagcttcttgccactataccayattgcctcttaggactcaaaacac

SEQ ID NO: 43462 - DNA, 50 bp, homo sapien
acacaaaacagatccagtttggagamggaaaaaggtgggctacttgggcc

SEQ ID NO: 43463 - DNA, 50 bp, homo sapien
tggaaaggtgtgaaaggagatttgargataggaatggatctgcctaagtt

SEQ ID NO: 43464 - DNA, 50 bp, homo sapien
tttgtgggctatgattttcagatagsaatattaaggagtaagtggggaaa

SEQ ID NO: 43465 - DNA, 50 bp, homo sapien
caaattagagttggaaccatcgtatraggcttgccacttatccagagata

SEQ ID NO: 43466 - DNA, 50 bp, homo sapien
ttgtacacattgacgaaaagtttcakccctacctctcaaagtgtttgcag

SEQ ID NO: 43467 - DNA, 50 bp, homo sapien
aagagcagtgtttaaattcctagcaragtgccgtaagaaacagaaactat

SEQ ID NO: 43468 - DNA, 50 bp, homo sapien
ttagcttcttttattgttattatacraggcttaaaatggttttttgccct

SEQ ID NO: 43469 - DNA, 50 bp, homo sapien
caactacctttttatttttaggcaaygtacgtattacaatttaagaataa

SEQ ID NO: 43470 - DNA, 50 bp, homo sapien
aattcaagaaagcaagataaacaagraagtaagataagataaataaaaca

SEQ ID NO: 43471 - DNA, 50 bp, homo sapien
acaattgggaaaaaagtgatataccrattaaagaaaaaataaaggagcac

SEQ ID NO: 43472 - DNA, 50 bp, homo sapien
atatgtaaacacagagagctgcaaayactttgagaggtagggctgaaact

SEQ ID NO: 43473 - DNA, 50 bp, homo sapien
aaagacagctgaatgtgaagaaacaytgattgtacacgtaacacacacat

SEQ ID NO: 43474 - DNA, 50 bp, homo sapien
accagaagtctctaaaaataaacacragtgtaataaaatgccaaattgga

SEQ ID NO: 43475 - DNA, 50 bp, homo sapien
gtgattgtttaaaagtgagtacagayaagctgattttctttagttttaag

SEQ ID NO: 43476 - DNA, 50 bp, homo sapien
acagggttccttttagatattggggsagtaacctggatgggcctgattct

SEQ ID NO: 43477 - DNA, 50 bp, homo sapien
cagtgttaaaatacatatgaaaagtmaagcatagagtctaatgaatattc

SEQ ID NO: 43478 - DNA, 50 bp, homo sapien
gaaaatattagcatcaaatggaacartgaaaatctgtcagtttaaaacat

SEQ ID NO: 43479 - DNA, 50 bp, homo sapien
cacgaacagccatgtatccatatacrgcaatcaaataaggaacttatgac

SEQ ID NO: 43480 - DNA, 50 bp, homo sapien
ataaataatcaccttccagaattaargaccagtattgctgtgtttttaaa

SEQ ID NO: 43481 - DNA, 50 bp, homo sapien
ttcttagaaagacaatgattaaaagraattcaagaaagcaagataaacaa

SEQ ID NO: 43482 - DNA, 50 bp, homo sapien
cactttgtatttctgctgccaagtaycaggactggagagctgagagaagc

SEQ ID NO: 43483 - DNA, 50 bp, homo sapien
tttaactaagtgttaactactaatgmactacaggtgtgaattataggtga

SEQ ID NO: 43484 - DNA, 50 bp, homo sapien
gtgttttacacccacatccatctaayctcctgcttctcataggccatgat

SEQ ID NO: 43485 - DNA, 50 bp, homo sapien
aggccttcatgcagtagtaatattgyaaagactggtaccagactcagcat

SEQ ID NO: 43486 - DNA, 50 bp, homo sapien
agtagcaatgatatttatttatttarctccaaaaatggcttattttatta

SEQ ID NO: 43487 - DNA, 50 bp, homo sapien
atgttttatcattctcatctctccayggaaattaatgaaagttaccacct

SEQ ID NO: 43488 - DNA, 50 bp, homo sapien
taacaatattgattcttcctattaayaagcatggaatgtttttccattta

SEQ ID NO: 43489 - DNA, 50 bp, homo sapien
gagtctgaaattatgtgaaatctgcyaggcttaaactaatttttaaaata

SEQ ID NO: 43490 - DNA, 50 bp, homo sapien
tgaacagaggcacacataaatttacsagactttgacaaagcaatacattt

SEQ ID NO: 43491 - DNA, 50 bp, homo sapien
ctgtaggaataattatctgctggtaycaatgtccattttattcctaggta

SEQ ID NO: 43492 - DNA, 50 bp, homo sapien
ccaaaggatagcctagccattgaaaytgatatgaactggaatatgaaaat

SEQ ID NO: 43493 - DNA, 50 bp, homo sapien
ctttaaaaaataaacgtagcttaaasgcacttatgttttaaatgttttgt

SEQ ID NO: 43494 - DNA, 50 bp, homo sapien
atctgcagctcagacaactgaaaaasgactaatctgcttatagatggaga

SEQ ID NO: 43495 - DNA, 50 bp, homo sapien
cctatgttctctactctcaaaagtgmaaatgacattaataactgaattta

SEQ ID NO: 43496 - DNA, 50 bp, homo sapien
cattgactgactgtgaggtacagaaycttaattgagatgatggaagctac

SEQ ID NO: 43497 - DNA, 50 bp, homo sapien
gctgaatatgcttctctctcttaaasgtcccagcagaattctgccactga

SEQ ID NO: 43498 - DNA, 50 bp, homo sapien
ttcccctcttttctgcactcagcaaygttaacctatgtccctctctggat

SEQ ID NO: 43499 - DNA, 50 bp, homo sapien
tgtcaacaagttgataatgtagcccratctctacccatgataggagagta

SEQ ID NO: 43500 - DNA, 50 bp, homo sapien
aatatattccccgtgacacctagatragcaaatttattgggagctaaaat

SEQ ID NO: 43501 - DNA, 50 bp, homo sapien
ctgaggtagagactctgaagggcgcragattctgattgtgcctgtcctca

SEQ ID NO: 43502 - DNA, 50 bp, homo sapien
aagctaccaggcatcaattcagatargtgagaaggtccttacacccgtga

SEQ ID NO: 43503 - DNA, 50 bp, homo sapien
gggatcagctgcaaagttaatgaacrgcttttatttactgaagaaatcac

SEQ ID NO: 43504 - DNA, 50 bp, homo sapien
gcctggcctcaatccactcttgtaakaaatacattcaatccctaatctaa

SEQ ID NO: 43505 - DNA, 50 bp, homo sapien
tctatccccaaaggctgccacttgaratagttcttgctttgggggagtca

SEQ ID NO: 43506 - DNA, 50 bp, homo sapien
ttacagcttgctagaggtggaccacrattttgattggaaactttccacca

SEQ ID NO: 43507 - DNA, 50 bp, homo sapien
ggcagtgcttgaagagacttctgggyacagtctggggacttgctttgatg

SEQ ID NO: 43508 - DNA, 50 bp, homo sapien
tgacctgaaatctattttctgtatgracaagaagactacagactgagaat

SEQ ID NO: 43509 - DNA, 50 bp, homo sapien
ttcaagatagctgattcctgtataarggtattaaaatgtctagtaaagaa

SEQ ID NO: 43510 - DNA, 50 bp, homo sapien
ggtcatgcttgagaatcagtgttcckactaaaggcagtgggggacccaaa

SEQ ID NO: 43511 - DNA, 50 bp, homo sapien
gctgccttttcctatgtaactaacayctctaccctcaacctgaatggtac

SEQ ID NO: 43512 - DNA, 50 bp, homo sapien
caatagagtgaaacatttgatccgartaaaaataattatgtataattgct

SEQ ID NO: 43513 - DNA, 50 bp, homo sapien
aggagaaaaagctttaactagcaaawgaacgtattaaacaagatttggag

SEQ ID NO: 43514 - DNA, 50 bp, homo sapien
tagaagggatcaaattccaaaagacsagtagaaagggaaatgtggattct

SEQ ID NO: 43515 - DNA, 50 bp, homo sapien
gtaagaagcatgtataatgcaaataycttctttatttcgtcacagccagt

SEQ ID NO: 43516 - DNA, 50 bp, homo sapien
taacaaatgctgttcgagttaaaacmattgaatcatggagccctggtgcc

SEQ ID NO: 43517 - DNA, 50 bp, homo sapien
aaacccattagtctctcattaactasaaataaaattaagtctgtactgga

SEQ ID NO: 43518 - DNA, 50 bp, homo sapien
tctgtgctctaaaccactattggtaygctatttctgtgtggctggtctgg

SEQ ID NO: 43519 - DNA, 50 bp, homo sapien
ataggtcttctgttttagtacgtgarataattcctcaatcgatcttattg

SEQ ID NO: 43520 - DNA, 50 bp, homo sapien
tccaacaatataataccagcttacartcttctgtagatttaaattaaaca

SEQ ID NO: 43521 - DNA, 50 bp, homo sapien
ctgcatgcaaacatttaaaactttcragagaatacagtgcaccaggtaga

SEQ ID NO: 43522 - DNA, 50 bp, homo sapien
aagtgcaatgtcaagagacaaatgaygaaataccattggaagaagaaaaa

SEQ ID NO: 43523 - DNA, 50 bp, homo sapien
atatccagttatgcctgttgaaagakattgttaaaccacgtagtattaaa

SEQ ID NO: 43524 - DNA, 50 bp, homo sapien
taattgccaaattaatgcggtaggcyattgtgtttgagctcagagaaaca

SEQ ID NO: 43525 - DNA, 50 bp, homo sapien
ttgaaatgggacatggaggaacacayggctttggatatggagtgggccat

SEQ ID NO: 43526 - DNA, 50 bp, homo sapien
caggcttttaagctgcttataacaaygaagctcgcaaggtgcaagcttgt

SEQ ID NO: 43527 - DNA, 50 bp, homo sapien
gccattctctcctacattcagcccayaggagttagtagatctgaatgcac

SEQ ID NO: 43528 - DNA, 50 bp, homo sapien
aaaggcaagagatatccaaggaaaaygtaggcaatttttgcccaaatggt

SEQ ID NO: 43529 - DNA, 50 bp, homo sapien
ttaaaccagggtctactttagatgayggcttgtgcattttcttttatttt

SEQ ID NO: 43530 - DNA, 50 bp, homo sapien
ctaggtgaatttagcttctgaaaaaygcttagatactggacacaaatggg

SEQ ID NO: 43531 - DNA, 50 bp, homo sapien
catgtttgatctgttgctattcagaygatgagctgaaaatatgagatgtc

SEQ ID NO: 43532 - DNA, 50 bp, homo sapien
ataggtgaatacaactgaaatggaaygattgcctgttttttagtactttg

SEQ ID NO: 43533 - DNA, 50 bp, homo sapien
ctgcaatatcttagagtcctttctaraattatacagaagtcaaaataacc

SEQ ID NO: 43534 - DNA, 50 bp, homo sapien
aacacaacctggaagcatttccgtgyacaatttggaacagccaggaatgc

SEQ ID NO: 43535 - DNA, 50 bp, homo sapien
tcacgaaattagttacaatttatgaragcaaatgaatagattttatattt

SEQ ID NO: 43536 - DNA, 50 bp, homo sapien
tcgccactgcttttgtggtgatgccraggccaagaagtaatagcagctta

SEQ ID NO: 43537 - DNA, 50 bp, homo sapien
tccgggctggtgaaggcaagtgccaygaaattcagccagtagcatccctt

SEQ ID NO: 43538 - DNA, 50 bp, homo sapien
tttcaatttttcaatcaatgttataygtttaactgtagtcgtaaatataa

SEQ ID NO: 43539 - DNA, 50 bp, homo sapien
gcactccatcacagtgggagaggccrcccttggagatcctgtgaaccaag

SEQ ID NO: 43540 - DNA, 50 bp, homo sapien
atatggatggaaaaggctttgcatartagcttctcacctgacattgaaat

SEQ ID NO: 43541 - DNA, 50 bp, homo sapien
tctaggatatatctctgctgaataawtctacttgttctctgctcttagaa

SEQ ID NO: 43542 - DNA, 50 bp, homo sapien
gggaccgtttctgagcacataagcgyattcagtgggtgctaacaagcgcc

SEQ ID NO: 43543 - DNA, 50 bp, homo sapien
ccactgaatcacctgtagggcagcamtcttgaccatactgttcatagcag

SEQ ID NO: 43544 - DNA, 50 bp, homo sapien
actgtggcttgtgtttccctaatcaygtagctgaaagtcccacaacccaa

SEQ ID NO: 43545 - DNA, 50 bp, homo sapien
atagtgttctcttttcctagattcartagttccacagaccagtaacagtg

SEQ ID NO: 43546 - DNA, 50 bp, homo sapien
gccttatctacaatataataatttcycacaaatgcaaagaatataggttt

SEQ ID NO: 43547 - DNA, 50 bp, homo sapien
aatcaaataaacatcctaactgaaaraaatcagagtagaattaaggactg

SEQ ID NO: 43548 - DNA, 50 bp, homo sapien
tattctagtgataaacaattcagcayctagaataattctccatgtcagct

SEQ ID NO: 43549 - DNA, 50 bp, homo sapien
tagagttgagttgtattgtctaatamagtagccactaaaattcagtaaaa

SEQ ID NO: 43550 - DNA, 50 bp, homo sapien
atcgcagatcttctagtgttggtctmaatattctagtgataaacaattca

SEQ ID NO: 43551 - DNA, 50 bp, homo sapien
ggcccaggacagctttagaatgtgaygatttttttgcttatctgtagtgg

SEQ ID NO: 43552 - DNA, 50 bp, homo sapien
gtcctgggccacatgcatcccgagakctgcaggttggacaagcttgcatc

SEQ ID NO: 43553 - DNA, 50 bp, homo sapien
catgtgtgaaacactgggtcttgatyactcagatctctcagggtcctttc

SEQ ID NO: 43554 - DNA, 50 bp, homo sapien
gattggctccagatattctgccctcrcactctacaagatctcatttctga

SEQ ID NO: 43555 - DNA, 50 bp, homo sapien
tagattcagatggaagaagaaaacargtcccaaatgaaaacctatgtgtg

SEQ ID NO: 43556 - DNA, 50 bp, homo sapien
gactagatacacttcactatgagcawcatatacacaaccaactcataccc

SEQ ID NO: 43557 - DNA, 50 bp, homo sapien
aaatcaaaaaaatactgtgttaataygctagcagggaaaaaatgatcaca

SEQ ID NO: 43558 - DNA, 50 bp, homo sapien
agagtgaaagctgtgaggtgaaaagragtaaacctcatggaaacattgat

SEQ ID NO: 43559 - DNA, 50 bp, homo sapien
aaatccagaaaaatgaaataacttayctaagactgtaggactgggactgg

SEQ ID NO: 43560 - DNA, 50 bp, homo sapien
atttatagctcttcgcatcatatggwcaatttaaggcacatggtcagtgt

SEQ ID NO: 43561 - DNA, 50 bp, homo sapien
ctggccgcagactctgcactattaaygacttcactttactgctttatgtg

SEQ ID NO: 43562 - DNA, 50 bp, homo sapien
gcttccttcaggtcttgaatttgacrggaatttgaccaggaggttctacc

SEQ ID NO: 43563 - DNA, 50 bp, homo sapien
aatgagtctttgcttcgtaaaagccrctcactaatacaacatacaaattg

SEQ ID NO: 43564 - DNA, 50 bp, homo sapien
ctggtctaagaggagtgaaaagcacsaaagttaggacccaggataccagg

SEQ ID NO: 43565 - DNA, 50 bp, homo sapien
gataggattaatgattatgcctctamaatctataaccagatgtacccttg

SEQ ID NO: 43566 - DNA, 50 bp, homo sapien
gtgcttcactttcaactggttctgaygtttgagagctcaaggctactggc

SEQ ID NO: 43567 - DNA, 50 bp, homo sapien
tccatcctatttccaagaacaccagraaaggctttgtcaaatgccttcct

SEQ ID NO: 43568 - DNA, 50 bp, homo sapien
tactatttcaaagtcattataaataygttttctacctaaattctaaaaaa

SEQ ID NO: 43569 - DNA, 50 bp, homo sapien
gagtggagccatgtatcagtttaagyagtggtgacaatgtaggtgatact

SEQ ID NO: 43570 - DNA, 50 bp, homo sapien
gctgctcttctgcatacagagaactyaggctgtctgctgcctgtgctgct

SEQ ID NO: 43571 - DNA, 50 bp, homo sapien
taaaatagggaaaatatgcttagatyagtgtccaccttacaaagtgttag

SEQ ID NO: 43572 - DNA, 50 bp, homo sapien
tatgtcattttcaggttttaatttcyaatataagcatacaagactatata

SEQ ID NO: 43573 - DNA, 50 bp, homo sapien
tgtgtgaggccagcaggtttatttayggtttctgattttatttattgccc

SEQ ID NO: 43574 - DNA, 50 bp, homo sapien
ttcacctccagtttcaaatctactcygacactgacttccctaactctggt

SEQ ID NO: 43575 - DNA, 50 bp, homo sapien
ttaaaaattatttgtggaattgaaaytgtgaagcagacgttttgaaatga

SEQ ID NO: 43576 - DNA, 50 bp, homo sapien
cagtggtggcagggcctagctggtamaaagaagacatgttttagacaaat

SEQ ID NO: 43577 - DNA, 50 bp, homo sapien
tttcagaacacatcatcaacatcaartattacacatttattttaaaagtt

SEQ ID NO: 43578 - DNA, 50 bp, homo sapien
tatcaactacaaattgaaaattgcakgttgactatgtcattgaaacgaag

SEQ ID NO: 43579 - DNA, 50 bp, homo sapien
ttcagatgtggaaattggcacctaamgtacattttcatggccaatatgaa

SEQ ID NO: 43580 - DNA, 50 bp, homo sapien
taatattcttaggaaatagtctaatsaaactgttacaatctggtaaacat

SEQ ID NO: 43581 - DNA, 50 bp, homo sapien
ttcgattttactattatataagccaratttctaaatactggaccaagaga

SEQ ID NO: 43582 - DNA, 50 bp, homo sapien
ttaaagttttaagtccatgtctccargaaaaatttgttttaatcctaaaa

SEQ ID NO: 43583 - DNA, 50 bp, homo sapien
tgacatattgtcctgttagtctccaygattgcattatgaattgatttatt

SEQ ID NO: 43584 - DNA, 50 bp, homo sapien
gccaggaattaacatcttttagcatmaaatacttttgtttgtgtgtgtgt

SEQ ID NO: 43585 - DNA, 50 bp, homo sapien
gtaaaccataaagggaaagactgacsaatgtaaacgttaaaaatcaaatt

SEQ ID NO: 43586 - DNA, 50 bp, homo sapien
taaataatagctcctgcgttgttggsaaactaatatttatctattttttg

SEQ ID NO: 43587 - DNA, 50 bp, homo sapien
gaaatatcctctagagtaaatactaraaaagtgtaaagaataagaatact

SEQ ID NO: 43588 - DNA, 50 bp, homo sapien
cctttaggtactagaaaatctaagaygactagggactggaataaaccccc

SEQ ID NO: 43589 - DNA, 50 bp, homo sapien
caagttatgaaaagagataatatgargatgaccttaatttacactttccc

SEQ ID NO: 43590 - DNA, 50 bp, homo sapien
gtctgactttcctcaagtcaaaggasagacaaaataacattgagcgaatg

SEQ ID NO: 43591 - DNA, 50 bp, homo sapien
ttggtactagctgaatgggatcactwacaaaaggtcaaagtaacacagtt

SEQ ID NO: 43592 - DNA, 50 bp, homo sapien
cagtcttgagtttaacttcaaggtcracattatcagtcagaataccagtt

SEQ ID NO: 43593 - DNA, 50 bp, homo sapien
aatatcaagggaacagtgactaaaarcaaagacattgagttatctgtcat

SEQ ID NO: 43594 - DNA, 50 bp, homo sapien
gggctataagagaaggttactaaaaytgtctaggagtgaggtagtaagta

SEQ ID NO: 43595 - DNA, 50 bp, homo sapien
attatgtgattttaagagaggcataygtattgaggagttgttcctctttg

SEQ ID NO: 43596 - DNA, 50 bp, homo sapien
gaagttagagcatatctttaggtagsaatcccaatagataatttttcagg

SEQ ID NO: 43597 - DNA, 50 bp, homo sapien
tcttaatagtgaccttgcttaatatsagctagtcaactgggaaagaggta

SEQ ID NO: 43598 - DNA, 50 bp, homo sapien
caagaaaaataaggcaccttaaacaytgaagctacagaaagattgagctg

SEQ ID NO: 43599 - DNA, 50 bp, homo sapien
cgttttgtccattactgagatatttmaaaagctctttctagtagcttgaa

SEQ ID NO: 43600 - DNA, 50 bp, homo sapien
ggggcaggtgtggtctcagatcaaaygtgacaatagatttcaggctgcga

SEQ ID NO: 43601 - DNA, 50 bp, homo sapien
actagaaattgtataagagaacagaytctgtgactgacagacttgggtta

SEQ ID NO: 43602 - DNA, 50 bp, homo sapien
tctctatcttctttggtctctaagamaataggacatgtgagtgaggtaaa

SEQ ID NO: 43603 - DNA, 50 bp, homo sapien
ttaatgcactgcatgaataataacarcagactataaatcctactggaaat

SEQ ID NO: 43604 - DNA, 50 bp, homo sapien
tcctggctctagtgtgctcagaaacraatacaaactaatgcaaaacagaa

SEQ ID NO: 43605 - DNA, 50 bp, homo sapien
ggatctgtgtcttgaagttatcttayatgtttcatggacattgtattacc

SEQ ID NO: 43606 - DNA, 50 bp, homo sapien
agacatcagaattcttttccctcaawgttctcgaggtgattctaatgttc

SEQ ID NO: 43607 - DNA, 50 bp, homo sapien
aaacaagctttgagacccttcccgcracatctctgggggagcccaggaac

SEQ ID NO: 43608 - DNA, 50 bp, homo sapien
caccttttcaccaaaaataagatacrgacaacaaatatctaaatgtttct

SEQ ID NO: 43609 - DNA, 50 bp, homo sapien
tataacagcacaaatggacttaagayaatacaaaggtgccaaggatacac

SEQ ID NO: 43610 - DNA, 50 bp, homo sapien
catttggtttcaagctggacctaaawtatgttttggcattgttactaact

SEQ ID NO: 43611 - DNA, 50 bp, homo sapien
tcagagagctcctagtatgatgaagragacccccaaagaactatggccaa

SEQ ID NO: 43612 - DNA, 50 bp, homo sapien
aaaaaaggataagattactaaatgayagagtatttaaacacatttttttc

SEQ ID NO: 43613 - DNA, 50 bp, homo sapien
caccaccactacaattatttgtgaartcatcatgtccgacaggtggggca

SEQ ID NO: 43614 - DNA, 50 bp, homo sapien
ttagttatatattagtttcattatayagtggttcttgacatctaggaaag

SEQ ID NO: 43615 - DNA, 50 bp, homo sapien
tgtccaaaaccaaccataatggtcartcatttctggatttactcaaactt

SEQ ID NO: 43616 - DNA, 50 bp, homo sapien
tgagtctacactgggttgactctgaraggtttatatcttattgggtatta

SEQ ID NO: 43617 - DNA, 50 bp, homo sapien
ctgcttccaggagtacacaaaggaasgctatgtcctaaaagaccgtttca

SEQ ID NO: 43618 - DNA, 50 bp, homo sapien
aagcctaggctaagtacaactggackcatgggacacactgtggggctatg

SEQ ID NO: 43619 - DNA, 50 bp, homo sapien
ctggttctcttgctgaaaatattcargcatcctacttttcaaagtatcag

SEQ ID NO: 43620 - DNA, 50 bp, homo sapien
agtgcagtgatggaactagacttcargaaggagattactgccaaacgtga

SEQ ID NO: 43621 - DNA, 50 bp, homo sapien
aagtccccattaagcctatgtccagycggcctatggccagtgtgtccaca

SEQ ID NO: 43622 - DNA, 50 bp, homo sapien
tatctgaattaaacctattgagcaaraagtttctctttctttgttcttcc

SEQ ID NO: 43623 - DNA, 50 bp, homo sapien
gaaaactgtatgtacatgaatcaagyaatgtaggtgtatacaaaacatgc

SEQ ID NO: 43624 - DNA, 50 bp, homo sapien
aagcagggcttttagcttgtttacaytgaaggttagtactgatatgtgct

SEQ ID NO: 43625 - DNA, 50 bp, homo sapien
gcagtgtagtcatttttaacatctcrgagaggaggaaatgcacatcacat

SEQ ID NO: 43626 - DNA, 50 bp, homo sapien
ctccaaaacaacttagtttcagcaamttagattttaccaatagcaatgct

SEQ ID NO: 43627 - DNA, 50 bp, homo sapien
aacacctgaaactataaaacttctgracaaaactctaggaaaaactcttc

SEQ ID NO: 43628 - DNA, 50 bp, homo sapien
aaactcctcccaatatccttcattcrcctaccaccaaatcttcaaacctt

SEQ ID NO: 43629 - DNA, 50 bp, homo sapien
ggtgctggtccaggattgcatttgaygctggttgaacgagaaaatacgat

SEQ ID NO: 43630 - DNA, 50 bp, homo sapien
ttgacgctggttgaacgagaaaatasgatgcattcgcaagggacattttt

SEQ ID NO: 43631 - DNA, 50 bp, homo sapien
ccttctttcccaaactcaaaaacacrgtaatgatcttgcttttaagacat

SEQ ID NO: 43632 - DNA, 50 bp, homo sapien
cagcacacccaggttgctaggcctgmagaaagggcaggatttccgtgcta

SEQ ID NO: 43633 - DNA, 50 bp, homo sapien
cccaactgttaatgaaaactgacctracagtccatcccacctgggtatct

SEQ ID NO: 43634 - DNA, 50 bp, homo sapien
accctcaaggtggtggaaattgagayggtgataataattataacagaagc

SEQ ID NO: 43635 - DNA, 50 bp, homo sapien
cccaggcagatacagggcagcatgartaccttagggtcaggtcactgtga

SEQ ID NO: 43636 - DNA, 50 bp, homo sapien
gtctaaacttgttttatttgttggaygaaattttgtgtttcatggggaaa

SEQ ID NO: 43637 - DNA, 50 bp, homo sapien
cccaaactcacatgacctttctgaarctcagtaaaataaagggagactgc

SEQ ID NO: 43638 - DNA, 50 bp, homo sapien
aatatgtggtcaaatgatttttgacmaagatactaagaccattccatggg

SEQ ID NO: 43639 - DNA, 50 bp, homo sapien
ctgtgtttaaatctgtgagttacaasaactgtggaggacctgatggcttt

SEQ ID NO: 43640 - DNA, 50 bp, homo sapien
accccaaaactgtagataatgatcakggttatatagtcccctctagttct

SEQ ID NO: 43641 - DNA, 50 bp, homo sapien
tgttgaattaatctgtatcaacaaawctcagtgggtctatggatctagag

SEQ ID NO: 43642 - DNA, 50 bp, homo sapien
attttgtgacatataccaatctagarctattttgttatatcttcctggag

SEQ ID NO: 43643 - DNA, 50 bp, homo sapien
tttgtggtctgtaccttttgacatawactatgctgaacacatggcctttc

SEQ ID NO: 43644 - DNA, 50 bp, homo sapien
acagattaaaaatggggtaagtctaygcaaactaacttagaaaagtattc

SEQ ID NO: 43645 - DNA, 50 bp, homo sapien
catcctattcctgtctctctctttcyctgtaaccttatctgtgactttgt

SEQ ID NO: 43646 - DNA, 50 bp, homo sapien
tcaaagaaaattaggtcagtctatayaaatgccttcaaggttaaattttt

SEQ ID NO: 43647 - DNA, 50 bp, homo sapien
atgctgataaattcagcaacttaaarggaatgtacccattccttaaaaat

SEQ ID NO: 43648 - DNA, 50 bp, homo sapien
agtctaggagcttctatatccaagaygttcttacctgccagaaggtcctg

SEQ ID NO: 43649 - DNA, 50 bp, homo sapien
ttatacatgtcctcatgccagctccratcttgtgagactcaacctctata

SEQ ID NO: 43650 - DNA, 50 bp, homo sapien
gttatcttggaggaaaacacattaawctatccagacttaggctacacatg

SEQ ID NO: 43651 - DNA, 50 bp, homo sapien
tggtatatgaggtgtcttcacaaagkctaagtatttaattgtaagttcct

SEQ ID NO: 43652 - DNA, 50 bp, homo sapien
ctcttaatgctatcaataatcctacygaatccgcttccttgacttaatct

SEQ ID NO: 43653 - DNA, 50 bp, homo sapien
aatgttaatatgttaatagatagaaratcttttgtctagaagagatagtc

SEQ ID NO: 43654 - DNA, 50 bp, homo sapien
gagcagctcttttagagggaatgagmctaggaaaggtggatggactcaga

SEQ ID NO: 43655 - DNA, 50 bp, homo sapien
atttttaaaccttataacaatcctgmaaagtagaaatggttattcttgat

SEQ ID NO: 43656 - DNA, 50 bp, homo sapien
tctgctcagcctgatattttttccartaaaacattcttaaatcatacctc

SEQ ID NO: 43657 - DNA, 50 bp, homo sapien
gaaaacttccacagatttccattacyattctaccataatctgcccttaca

SEQ ID NO: 43658 - DNA, 50 bp, homo sapien
ttacacttgtaaagatcaattattcraaaattatggaagcaaagagccag

SEQ ID NO: 43659 - DNA, 50 bp, homo sapien
cagaattcactctttcacttattaarcattgactgtgtactagacccagt

SEQ ID NO: 43660 - DNA, 50 bp, homo sapien
atcgtgatagttagctaactcttacrcatttatttttctctagcaccaga

SEQ ID NO: 43661 - DNA, 50 bp, homo sapien
cacaacaggatgggctaccatgttargtttaagccaatgcataactctcc

SEQ ID NO: 43662 - DNA, 50 bp, homo sapien
tgtccaattactctttcctactaaawgccaataacctaggaagaatttta

SEQ ID NO: 43663 - DNA, 50 bp, homo sapien
attgtagaatgagtggaatttaaacrggtaatgataagagtggcatgttc

SEQ ID NO: 43664 - DNA, 50 bp, homo sapien
aaacaattccattaattatcaaaagrcaatttcactttcaactttgtaat

SEQ ID NO: 43665 - DNA, 50 bp, homo sapien
aataaattttagtaataatcataaartaagacaaataataactttgctct

SEQ ID NO: 43666 - DNA, 50 bp, homo sapien
tcatttccttgattgattattctaayactaatactaataacatctgccaa

SEQ ID NO: 43667 - DNA, 50 bp, homo sapien
tgggacctaaaggctgtcctagaacygaaacagaaaaagaatgtgagcgc

SEQ ID NO: 43668 - DNA, 50 bp, homo sapien
ctggaattgaccaagaatcaaatacrgcacatttcagaccagtacctatg

SEQ ID NO: 43669 - DNA, 50 bp, homo sapien
ctttctttggtgtaaaacattattayaacagtagatatgtaactagagag

SEQ ID NO: 43670 - DNA, 50 bp, homo sapien
tacctactgaactggagcacacccasaaacttcaatttctctctctagtt

SEQ ID NO: 43671 - DNA, 50 bp, homo sapien
gttcaactgacaggagagaagatgawgggtaacaaactgggagaaactga

SEQ ID NO: 43672 - DNA, 50 bp, homo sapien
gaagtgtgcccaagaaatgatgtgcrgacattcatcacactggtatgtga

SEQ ID NO: 43673 - DNA, 50 bp, homo sapien
ggtgaacattatactaaggatttacrcattgttgtacaaagttgatttct

SEQ ID NO: 43674 - DNA, 50 bp, homo sapien
gtttttatgtgaaaacataggctaastatcctcttttatatctctgttgt

SEQ ID NO: 43675 - DNA, 50 bp, homo sapien
taatcacatttaataataggataccsagaaacaaatacctcacatactgt

SEQ ID NO: 43676 - DNA, 50 bp, homo sapien
ggggctagaggtcagatactgacaakgaacagttttctatgtatgatgct

SEQ ID NO: 43677 - DNA, 50 bp, homo sapien
tattctattctcacagagcttcctcyacaataaaggcaatataaacataa

SEQ ID NO: 43678 - DNA, 50 bp, homo sapien
aatcacaatcagaattccagtatacrctttttatcaaaattgacaacatt

SEQ ID NO: 43679 - DNA, 50 bp, homo sapien
ttatgagcatgagttatggagtcagratacctggttgaattcaatctctt

SEQ ID NO: 43680 - DNA, 50 bp, homo sapien
aagttcacccatagtctttgctttayaaaatgagattaaaatcattttag

SEQ ID NO: 43681 - DNA, 50 bp, homo sapien
cggacaggtagaatgattgcttagaktaatgctgagggaaagaccgaagt

SEQ ID NO: 43682 - DNA, 50 bp, homo sapien
acctagaaaatcctaaaggctctgcsaaaaagctaccagagctgataaat

SEQ ID NO: 43683 - DNA, 50 bp, homo sapien
agaattattgaaagaattaagtcacracatgagtctctaatgcacaaatt

SEQ ID NO: 43684 - DNA, 50 bp, homo sapien
gagcgtccttgccttccagattctawgttccatgactttcatttcagtca

SEQ ID NO: 43685 - DNA, 50 bp, homo sapien
aacctatctaccactcattgctctcmaggactatctatgggctcgtagtc

SEQ ID NO: 43686 - DNA, 50 bp, homo sapien
gctacagaagtaaaatttctcagaakgagtgactttgcacctgacaccac

SEQ ID NO: 43687 - DNA, 50 bp, homo sapien
atcaatatgattaccaaatagttatyaagtgcttattaagtactaacatg

SEQ ID NO: 43688 - DNA, 50 bp, homo sapien
actctaccctaaagtcaaatatcaayagctgcaggtactcaaggatcttt

SEQ ID NO: 43689 - DNA, 50 bp, homo sapien
tattttcatttgctaaatatggtaaytctagccagagagtaaatattttc

SEQ ID NO: 43690 - DNA, 50 bp, homo sapien
ttttgtgcatctactaagcatcagcratagaactatgaacaagacagaga

SEQ ID NO: 43691 - DNA, 50 bp, homo sapien
aaatacgtgccagcttaagcagttayagacatcatagaatatcttaaact

SEQ ID NO: 43692 - DNA, 50 bp, homo sapien
actgagctgaccgcaatatgaagggmaatgaaatggttttgtgtagtcat

SEQ ID NO: 43693 - DNA, 50 bp, homo sapien
ttatgagaatttaatgagataatgcrcaagatgtgtctgatgaatagtaa

SEQ ID NO: 43694 - DNA, 50 bp, homo sapien
atgaaaaaagtcttaaataattacartggaaatatgaaggacaatgaagc

SEQ ID NO: 43695 - DNA, 50 bp, homo sapien
ggtagaagcccagggtcatcatttaycccttgtcttaacataagattctc

SEQ ID NO: 43696 - DNA, 50 bp, homo sapien
ggttgtaatgaagattaaatgaatcratacacgtaaagagtcgagaacag

SEQ ID NO: 43697 - DNA, 50 bp, homo sapien
aattggtcacaaaaaggttagtgaaytgactattaaaatataatatgagc

SEQ ID NO: 43698 - DNA, 50 bp, homo sapien
aatactggtccttaggtgaaagataygacacaattagtaagtgctgtcta

SEQ ID NO: 43699 - DNA, 50 bp, homo sapien
atgagttgtgtgtttcttttgtgaasaagcctaatccttgcattttgttc

SEQ ID NO: 43700 - DNA, 50 bp, homo sapien
acatcttatggtttacatggtgctawtacctaagtgtaatgaatggagaa

SEQ ID NO: 43701 - DNA, 50 bp, homo sapien
atgtgtagcacctttcttccaataartggtgttctttcagcttgcccacc

SEQ ID NO: 43702 - DNA, 50 bp, homo sapien
agagacgaggtcagacagctatttcraagatgggttaaaaaaaaaaaaaa

SEQ ID NO: 43703 - DNA, 50 bp, homo sapien
aatgaaataaacctctataaacctamcacctaacaggattaagtcattgt

SEQ ID NO: 43704 - DNA, 50 bp, homo sapien
tttctaaggctaaattggcagagtakatcatctaaagccaaacactgaag

SEQ ID NO: 43705 - DNA, 50 bp, homo sapien
gttaaggagacaataaatgtccttayagttgaggccatatttatttgggt

SEQ ID NO: 43706 - DNA, 50 bp, homo sapien
tttagaacttgaaagtgaggaaggtsaaagattatccatggagatttagg

SEQ ID NO: 43707 - DNA, 50 bp, homo sapien
tttgagcttctagtaatcattctccracaaataaagatgacttctaaagt

SEQ ID NO: 43708 - DNA, 50 bp, homo sapien
ttataaaagaataagggttagaagargacataaatgctaaagatgtaaac

SEQ ID NO: 43709 - DNA, 50 bp, homo sapien
agctggtatactattgtccacagtayatttttgatttatgttccaaaatc

SEQ ID NO: 43710 - DNA, 50 bp, homo sapien
tatattaggtaactgcatgtaaaacragtccagaacttgaatggagttgt

SEQ ID NO: 43711 - DNA, 50 bp, homo sapien
tgctcgaaaaatggttccagcctcasaatggaaaccaaagtgaaaagtaa

SEQ ID NO: 43712 - DNA, 50 bp, homo sapien
gacgtcagcccttgtggtagaggaawtagttgaagcccaaagggaaaaag

SEQ ID NO: 43713 - DNA, 50 bp, homo sapien
ttgctatagcctgttttcagcaaaargtataattctgtatcaatgatgaa

SEQ ID NO: 43714 - DNA, 50 bp, homo sapien
tgggtgtttctttgttaacttcctgracatttcctggccttcgatgtttg

SEQ ID NO: 43715 - DNA, 50 bp, homo sapien
gtatccgtattccattttttttttcsaaccaagctgatgagcctttttct

SEQ ID NO: 43716 - DNA, 50 bp, homo sapien
ctggcataaatgaagtgttaagtggwataagtgacttgtgaccgttccca

SEQ ID NO: 43717 - DNA, 50 bp, homo sapien
gtaattttgttgtataaaagtggcayaattctcttgggaaatgaaagtca

SEQ ID NO: 43718 - DNA, 32 bp, homo sapien
gtaccttaaaaggaaayggagagtaggaactg

SEQ ID NO: 43719 - DNA, 50 bp, homo sapien
tcaatctcaagagcttgtctctttcyctaaacaactgaccgtgcccatat

SEQ ID NO: 43720 - DNA, 50 bp, homo sapien
tgtggctctcttcttgagtttagacsgaaggaactcttggtttgtgcatt

SEQ ID NO: 43721 - DNA, 50 bp, homo sapien
tcactaggtgatgtcacttcagattkaaactgtctttattctaaagcaat

SEQ ID NO: 43722 - DNA, 50 bp, homo sapien
tctactttagagaaagtgagattaargttctaaacaaagatacaaggcca

SEQ ID NO: 43723 - DNA, 50 bp, homo sapien
gtgtaatcgctagtgggttaaaatgyaaaatattctgcatacacaatgta

SEQ ID NO: 43724 - DNA, 50 bp, homo sapien
gtagtataatatatatcaggcatcartcttgtggaacttgttatcctata

SEQ ID NO: 43725 - DNA, 50 bp, homo sapien
accccaaaataaggccatacacttayacctatctgatctttgacaaagct

SEQ ID NO: 43726 - DNA, 50 bp, homo sapien
ctctaaagagtactcaggctggaaastgctccatctattctactagttgg

SEQ ID NO: 43727 - DNA, 50 bp, homo sapien
ttcaacaggtgcttacactggataamaacaacaaatggaagctgcagaaa

SEQ ID NO: 43728 - DNA, 50 bp, homo sapien
tggaaagacactggtgaatataagakaagacaactggcctttgtgcagct

SEQ ID NO: 43729 - DNA, 50 bp, homo sapien
attatcagtacctggccatgtaaagrcttgtaaaggctatttattgaaaa

SEQ ID NO: 43730 - DNA, 50 bp, homo sapien
ttggatccaggatggttccaaacacwaggatgaagaaaccctgggaaaca

SEQ ID NO: 43731 - DNA, 50 bp, homo sapien
attgaaataggaattggtaataactragagtatgttttaacatcatgatt

SEQ ID NO: 43732 - DNA, 50 bp, homo sapien
ctggaagaagtttgctggtgtgtgarcattttatccatttccccacacag

SEQ ID NO: 43733 - DNA, 50 bp, homo sapien
tatttaatgtcattaattttttgagratgtaaacacttgacttttctcta

SEQ ID NO: 43734 - DNA, 50 bp, homo sapien
ataaagttaaattttaacaaaaaatkaatcagttctactcttacttgctt

SEQ ID NO: 43735 - DNA, 50 bp, homo sapien
tgtcaaataggagagatatttaggasgtaacatcatcaggattagctaca

SEQ ID NO: 43736 - DNA, 50 bp, homo sapien
tttctatgctctgttgctctgtcctsaaaaattacaaaagcacaaattga

SEQ ID NO: 43737 - DNA, 50 bp, homo sapien
aactttatacatgtgaatatcaatargctactaaatatgaatttctactg

SEQ ID NO: 43738 - DNA, 50 bp, homo sapien
aattgccttccctgggtatcagtaamaaccacctcttctagaatggactt

SEQ ID NO: 43739 - DNA, 50 bp, homo sapien
ggacctttatgctaatattttaaatsagtgagctgcagatatataggata

SEQ ID NO: 43740 - DNA, 50 bp, homo sapien
aacaccacctcttgtgctcctaagtwaaacgtgatggtggattaatcttg

SEQ ID NO: 43741 - DNA, 50 bp, homo sapien
atatgttaatatcattataggaaatraactctttgatataaatgaggttt

SEQ ID NO: 43742 - DNA, 50 bp, homo sapien
tatagatatgattctgaagacaagayacaatccaagcaatggctactgag

SEQ ID NO: 43743 - DNA, 50 bp, homo sapien
atcattctatttatctcaatgttacyaactctaaaggaacaatccaataa

SEQ ID NO: 43744 - DNA, 50 bp, homo sapien
tacaatttatgtccatatttgcttgkaaccttagcgcaatatttgagcca

SEQ ID NO: 43745 - DNA, 50 bp, homo sapien
agaccccataaaattccatgaaataycctggcttatcagttgaagaccca

SEQ ID NO: 43746 - DNA, 50 bp, homo sapien
ggcattcaaaatgtgatagacaggarcattcattagacaaaaatttctcc

SEQ ID NO: 43747 - DNA, 50 bp, homo sapien
gcatgtcagttaaaaaacttgaaaargaactgtgtgggtgtgtattttga

SEQ ID NO: 43748 - DNA, 50 bp, homo sapien
ctcacctcccttttcagatgcaccayggacggagtaactgcaaatttagg

SEQ ID NO: 43749 - DNA, 50 bp, homo sapien
atttcattgcatggaagtgtcacccraggggttcgcaaattatatctgaa

SEQ ID NO: 43750 - DNA, 50 bp, homo sapien
gtggaacagggaatgagttcaatctmaagacaagtttcagagatcttcta

SEQ ID NO: 43751 - DNA, 50 bp, homo sapien
aaaggaccaggacactgcatagttawatcatttccttcatccaatgggat

SEQ ID NO: 43752 - DNA, 50 bp, homo sapien
cagggttgagcacaatttagtctgcratatttggaagaccttagacagat

SEQ ID NO: 43753 - DNA, 50 bp, homo sapien
ctgtttcctagacttttctccttacsatctgcatacagcaagctcaacta

SEQ ID NO: 43754 - DNA, 50 bp, homo sapien
tttagcataatctcatgcatacttgratgttttataaaaaaattgatgac

SEQ ID NO: 43755 - DNA, 50 bp, homo sapien
ttggtcattatggagatagggtaacrcaacaagggaatttccatgtgatt

SEQ ID NO: 43756 - DNA, 50 bp, homo sapien
caaatctgaagcagcgataacagttsaacattttcttaagggttttcttt

SEQ ID NO: 43757 - DNA, 50 bp, homo sapien
ctgacttgaagaacgaagccatggaygctcgtggtaagtgttacagttct

SEQ ID NO: 43758 - DNA, 50 bp, homo sapien
tgggaggagaattcccatttactaamacctgctatttgctaatcatacag

SEQ ID NO: 43759 - DNA, 50 bp, homo sapien
tactaacaataaagaatgaagaaaartctggcgaatttaagaataaccta

SEQ ID NO: 43760 - DNA, 50 bp, homo sapien
gtttttgaagctaactgtattgttawccagtccgtgtatttaataataat

SEQ ID NO: 43761 - DNA, 50 bp, homo sapien
ggcttgatggtgttagtgctttccaragatagcccctaccctggaaatat

SEQ ID NO: 43762 - DNA, 50 bp, homo sapien
gagatctaacaaggagtgcaatttasagctaccagctacctaccttgtcc

SEQ ID NO: 43763 - DNA, 50 bp, homo sapien
ctgtgacattaagttaaatgaccaakgtatctctagaaaattagttcaaa

SEQ ID NO: 43764 - DNA, 50 bp, homo sapien
taattcactaatatagagtccacaartgatgaagatttactgtatctgga

SEQ ID NO: 43765 - DNA, 50 bp, homo sapien
gttttttgacatacaaatatgttaayagggtatgacaaggttaagtaatt

SEQ ID NO: 43766 - DNA, 50 bp, homo sapien
cttctggaataaattgaccctcctcraattttcttttctctctactttgt

SEQ ID NO: 43767 - DNA, 50 bp, homo sapien
atttacctgtcaaatttaataccaasatatgagacctggccactacgtac

SEQ ID NO: 43768 - DNA, 50 bp, homo sapien
gctttcttgttctaatatccaagackatctctcataaattagtgtatggc

SEQ ID NO: 43769 - DNA, 50 bp, homo sapien
agtgttagggcttaaaaaccctttargatggtatatagaaaagctaggat

SEQ ID NO: 43770 - DNA, 50 bp, homo sapien
tattgaataagtccaaacatttccakgaaagacataaaggcatccttgtt

SEQ ID NO: 43771 - DNA, 50 bp, homo sapien
taagtaactagcacagccatttagtraataacacggtttgaattggactt

SEQ ID NO: 43772 - DNA, 50 bp, homo sapien
actttaagaattagtgctttaacacratttttactggctatctaaaaaat

SEQ ID NO: 43773 - DNA, 50 bp, homo sapien
ttgaagcctgtgtttctttaagtcaraggtatatatttcacaatcttgga

SEQ ID NO: 43774 - DNA, 50 bp, homo sapien
gtgactttattaacaaattgaatcaygtgcctcctcttctttagaatact

SEQ ID NO: 43775 - DNA, 50 bp, homo sapien
agccgggaaaaaggtggcgccctaayacggtgcccctcgaatgcattgtg

SEQ ID NO: 43776 - DNA, 50 bp, homo sapien
gttctctttaccaaaacctttcagawtatcttgagatccacaaatgctgg

SEQ ID NO: 43777 - DNA, 50 bp, homo sapien
aatttttctacttaatctcagaaaayctgctgccattttataataaatac

SEQ ID NO: 43778 - DNA, 50 bp, homo sapien
agctttcattccctttataaagagaragtcttagattcaatgtgatgttt

SEQ ID NO: 43779 - DNA, 50 bp, homo sapien
gaagtgtacatttatataaggcacawtaagtttgaggggcctaaaactga

SEQ ID NO: 43780 - DNA, 50 bp, homo sapien
tggattcatgaggaatcaatgatcartcctggacagtaataatcaaacaa

SEQ ID NO: 43781 - DNA, 50 bp, homo sapien
tctgagaagtcgtgcttgatatcaaytatccatttttcccttctctttgt

SEQ ID NO: 43782 - DNA, 50 bp, homo sapien
tagaaaatactgtagataattgtagrattcaggactagaaagcccagata

SEQ ID NO: 43783 - DNA, 50 bp, homo sapien
ttcataggacctcttgatgtgtactyactcaaattcttcaaccttatata

SEQ ID NO: 43784 - DNA, 50 bp, homo sapien
tgagagaagaaggcttcaggtgatcmaatttctctgagctaagtttgaac

SEQ ID NO: 43785 - DNA, 50 bp, homo sapien
acgtggcctactattagtagattggwatacatttggataataggtatttt

SEQ ID NO: 43786 - DNA, 50 bp, homo sapien
ataattaaatgacgtaagaatagtargacaagaaaaataaagatgtgagt

SEQ ID NO: 43787 - DNA, 50 bp, homo sapien
gtttttacatggcttgattagaaaaraggtggttcctatgcactaaagtt

SEQ ID NO: 43788 - DNA, 50 bp, homo sapien
tatatttattgttatatctattgcaygaagtaaatctatttattccctta

SEQ ID NO: 43789 - DNA, 50 bp, homo sapien
attatagatgcttattacatatgctractcttctaaataaagtccaggtt

SEQ ID NO: 43790 - DNA, 50 bp, homo sapien
atcttccattgatattcattgcaackccgggaaatcaaaggaaacgggct

SEQ ID NO: 43791 - DNA, 50 bp, homo sapien
tcttcacagaagttctaggtgctgawctctttacctgaccaccttgtggc

SEQ ID NO: 43792 - DNA, 50 bp, homo sapien
tgtatttgggtcataaatttttctgyagcatttggatacctcaggttaca

SEQ ID NO: 43793 - DNA, 50 bp, homo sapien
taactctctcatgtttgttgtaaccygaggtatccaaatgctgcagaaaa

SEQ ID NO: 43794 - DNA, 50 bp, homo sapien
aaatatgttcaatacatttagcatayaaaaggaacacaactagaatatat

SEQ ID NO: 43795 - DNA, 50 bp, homo sapien
caaaataactgctcaataaacagcaytacattatgatcttatacctggtc

SEQ ID NO: 43796 - DNA, 50 bp, homo sapien
tttgaattttatcctattattagtgmaaagtcattggagggttctgagta

SEQ ID NO: 43797 - DNA, 50 bp, homo sapien
agttttcaaatgcccggaaggtaaawtgtagcattctataaattttcttt

SEQ ID NO: 43798 - DNA, 50 bp, homo sapien
gtacttctataattgtatgctactartaaatcaagttagaaatttattat

SEQ ID NO: 43799 - DNA, 50 bp, homo sapien
cattagctggggactagacccaagaycacaaagattcatcagaaatctga

SEQ ID NO: 43800 - DNA, 50 bp, homo sapien
gatgcatttcttccttgagggcaaaytaactatacagaagagactgtatg

SEQ ID NO: 43801 - DNA, 50 bp, homo sapien
gactttagagttcaggttcaaattaygctctgctacctgctaacagtgag

SEQ ID NO: 43802 - DNA, 50 bp, homo sapien
ttccttctcatcagaatttggaaatraagactaaatgtttgggtcagttg

SEQ ID NO: 43803 - DNA, 50 bp, homo sapien
aaaattgacattataataaatagtayctatgttacaaagttttttgtgtg

SEQ ID NO: 43804 - DNA, 50 bp, homo sapien
aaggctgtcagttggaggtcattaaygggtaattaagtgaaaatgctaca

SEQ ID NO: 43805 - DNA, 50 bp, homo sapien
cccaggccctctcattgaacctagamctgagcgtcatacactattttaat

SEQ ID NO: 43806 - DNA, 50 bp, homo sapien
aaggaatcaaatatccacagtaaaayctattcaagttcattgttccccta

SEQ ID NO: 43807 - DNA, 50 bp, homo sapien
acatgagttttttttaaattccaaarttgtgtctagcaatgaattaaaga

SEQ ID NO: 43808 - DNA, 50 bp, homo sapien
accatgccaccagtcctcaatatcaygttcagcaaaataagtggacaagg

SEQ ID NO: 43809 - DNA, 50 bp, homo sapien
ctggatttatcagaaatacattcaayatatccaagagagaaacacttcaa

SEQ ID NO: 43810 - DNA, 50 bp, homo sapien
atttcataattcttaggaatctattsaaaggagaagacatttttttccac

SEQ ID NO: 43811 - DNA, 50 bp, homo sapien
aagcttgccaatccctgaaacagccyggatacagaccaaattgctatatg

SEQ ID NO: 43812 - DNA, 50 bp, homo sapien
aaaaactgtgagaaactcctggagasactaaaggccatcataaactttgg

SEQ ID NO: 43813 - DNA, 50 bp, homo sapien
tgttccttatggttttaagattaagragttgagtcccagagagtccctta

SEQ ID NO: 43814 - DNA, 50 bp, homo sapien
aaagtcacattttatgccatcttgaycgaatatttatattattggcactt

SEQ ID NO: 43815 - DNA, 50 bp, homo sapien
attaaataactcatcaccacaagaaraagttgtgtcataagaaagatata

SEQ ID NO: 43816 - DNA, 50 bp, homo sapien
tacctagtcgatgctcaattaatacraggatcaggtatttctattatttc

SEQ ID NO: 43817 - DNA, 50 bp, homo sapien
ccttacttccatttctctgattccayctatgtacaacttacgaaaacttg

SEQ ID NO: 43818 - DNA, 50 bp, homo sapien
gcttattcaaaaacatcactgtatastagactaccaatttctcccctgga

SEQ ID NO: 43819 - DNA, 50 bp, homo sapien
tgggacctcaaagtaagtggctgagragaacagaaggaatgtgactttag

SEQ ID NO: 43820 - DNA, 50 bp, homo sapien
agctttttagagtatttacatttcaraggagcagagaaggaatttacaat

SEQ ID NO: 43821 - DNA, 50 bp, homo sapien
catataaagatgacatggttacaaaktttcccatttgagatatcaatagc

SEQ ID NO: 43822 - DNA, 50 bp, homo sapien
ttttattctacaaaaggaagaaataygattgctgaatattaatagccctc

SEQ ID NO: 43823 - DNA, 50 bp, homo sapien
aataagaaacaagattcttgagagcrgatcaaagaattaggtgagttaga

SEQ ID NO: 43824 - DNA, 50 bp, homo sapien
tgaggtaattgctactgtttctctawccaaatcaataaaccgtcctccac

SEQ ID NO: 43825 - DNA, 50 bp, homo sapien
aagaacagaaatatactccgggaagyccaagatcagggtgccagcaggtt

SEQ ID NO: 43826 - DNA, 50 bp, homo sapien
tctaaactgtggatgtccttcatacraataacctaaatgtgagaaaatat

SEQ ID NO: 43827 - DNA, 50 bp, homo sapien
gacaagaatatctgtactgtactcargaatttactgtttatatcttcctt

SEQ ID NO: 43828 - DNA, 50 bp, homo sapien
acaatggggttatgtcttgataaacycattggaagttaaaaaatatttta

SEQ ID NO: 43829 - DNA, 50 bp, homo sapien
cccggcgcttaggtgtcgctctcaargaactcggtcttcctgggcagagc

SEQ ID NO: 43830 - DNA, 50 bp, homo sapien
cctgatattacagctattatcacaayggtaggtgcacatatccccccact

SEQ ID NO: 43831 - DNA, 50 bp, homo sapien
aattaggcattatagtaacttttccsgaaatcagaggtatgggtattatt

SEQ ID NO: 43832 - DNA, 50 bp, homo sapien
aggggttaggaaacaccaaagataawtaggtcaattttgtcattttcctg

SEQ ID NO: 43833 - DNA, 50 bp, homo sapien
ttaatggaagcagaggcacttggaamctaattcaaacttttgtatttttg

SEQ ID NO: 43834 - DNA, 50 bp, homo sapien
cacagccgtaccagtgacttgaatargatagaggaccatcaagctgaggg

SEQ ID NO: 43835 - DNA, 50 bp, homo sapien
gtgagtaataacagctttttcttccraacaaattgtaaactctttttcat

SEQ ID NO: 43836 - DNA, 50 bp, homo sapien
ttctttcctcagagctgcgtcaagaratacaataataagtaatgccatta

SEQ ID NO: 43837 - DNA, 50 bp, homo sapien
tacactttgtagtaaagaaaggccayctatatcctctatgcatgtaactt

SEQ ID NO: 43838 - DNA, 50 bp, homo sapien
tgtaggttaggaaaatattgttaagrcagagtatatgtgtgtgtgtgtat

SEQ ID NO: 43839 - DNA, 50 bp, homo sapien
aagctttgctgtttctggcagtgacrctctaaccatgttaattaaactgg

SEQ ID NO: 43840 - DNA, 50 bp, homo sapien
tgataaagattcaagtaagttaccasaaagagtatagcattattttcctg

SEQ ID NO: 43841 - DNA, 50 bp, homo sapien
gacaagctgttcagagcttgggtaaytgaactactgaataataaatataa

SEQ ID NO: 43842 - DNA, 50 bp, homo sapien
agtactaatggtagaatttagaaaawgctgtattacttgtattgtgaact

SEQ ID NO: 43843 - DNA, 50 bp, homo sapien
gagaggtgacctcctcatattctcaygttcaggtccctccacttccagag

SEQ ID NO: 43844 - DNA, 50 bp, homo sapien
agagtgaatttgattcaatatcataraaaaatcacctttggctgagatca

SEQ ID NO: 43845 - DNA, 50 bp, homo sapien
aaagtaaaactcacggatagaaaaarggttaccaatctttgagcctgttt

SEQ ID NO: 43846 - DNA, 50 bp, homo sapien
aatgtacctcacccaaggagaatgaycaaattggaggagattgtggcatg

SEQ ID NO: 43847 - DNA, 50 bp, homo sapien
aggccaagcaaagggccaagaaaaartaactgagaagatgcagcaagtga

SEQ ID NO: 43848 - DNA, 50 bp, homo sapien
cagaatatctaaattgaaacaatggraaactcaattaaaaatatgtttag

SEQ ID NO: 43849 - DNA, 50 bp, homo sapien
aattgtatatacatctgttagaaaasttttataagaaattaaagcgtttt

SEQ ID NO: 43850 - DNA, 50 bp, homo sapien
tgctgctcaccaaactgaaaagtcaytaattcatgtcccatgttctccca

SEQ ID NO: 43851 - DNA, 50 bp, homo sapien
gaggggggcttgcccaaatttgtgayagaaatctgccatgagctgaggag

SEQ ID NO: 43852 - DNA, 50 bp, homo sapien
tgagctgaggagtgtaatcaagtcamccttttacactggagatccaaaaa

SEQ ID NO: 43853 - DNA, 50 bp, homo sapien
acatgtctctgatagaacaatgtgayggaataacaccaatggaggaactg

SEQ ID NO: 43854 - DNA, 50 bp, homo sapien
ttaatcattgcattaaggatatttgmaagtagagctttacaagtgttagg

SEQ ID NO: 43855 - DNA, 50 bp, homo sapien
tctaatctatgctctaaaggaataarcagatgaaaaccaatctggacaag

SEQ ID NO: 43856 - DNA, 50 bp, homo sapien
tatctccaggagctgcctgtggaaamacttttatctgatatggtagttta

SEQ ID NO: 43857 - DNA, 50 bp, homo sapien
atgtgttaattgtgcttctaaaacarctttggtgatcttaataaaataaa

SEQ ID NO: 43858 - DNA, 50 bp, homo sapien
aaaaaaattggtcataaaataataakaagaagattgaaattatttaccat

SEQ ID NO: 43859 - DNA, 50 bp, homo sapien
aacattgctatgatatcagattccaygctgtgaggcctcatttggttaat

SEQ ID NO: 43860 - DNA, 50 bp, homo sapien
aaattcttgaggttattttgagtaayaaaaaagtattatgaatcattaat

SEQ ID NO: 43861 - DNA, 50 bp, homo sapien
tccacatcaagacatggatatcatamaagggaatttttctcttgcaattg

SEQ ID NO: 43862 - DNA, 50 bp, homo sapien
aaagcaaacagaatctctaacctaaytgtgttttagcaggatatttaaaa

SEQ ID NO: 43863 - DNA, 50 bp, homo sapien
taaaataactattcagtctttgaaamggtttagtcaacataatcaatata

SEQ ID NO: 43864 - DNA, 50 bp, homo sapien
agtttttagaacataaatcttcagayccgtattatttctccacagataaa

SEQ ID NO: 43865 - DNA, 50 bp, homo sapien
ggacaattgctctgctatctttaaamatacagcttggtgtcaatgtgaga

SEQ ID NO: 43866 - DNA, 50 bp, homo sapien
tctctataaatctggtttaaaaaatkatctgaatgtaaaatactaaattt

SEQ ID NO: 43867 - DNA, 50 bp, homo sapien
gcaagaaagagcttagtaccttgacmgcataacttcaaccagcaaatatt

SEQ ID NO: 43868 - DNA, 50 bp, homo sapien
gtttcaacattaaagaatcaaataarggaaacaatgaaatttttaataag

SEQ ID NO: 43869 - DNA, 50 bp, homo sapien
ataactgtagtaactgacataatggkatgatgtgaagcatgtatcaaaat

SEQ ID NO: 43870 - DNA, 50 bp, homo sapien
cgtgtgatttggttactgtcctaaawactttttaatgcgtcatattttat

SEQ ID NO: 43871 - DNA, 50 bp, homo sapien
tatcacctttcctctcatttgtaccyattatcagtaaaacaaaagattca

SEQ ID NO: 43872 - DNA, 50 bp, homo sapien
ctgatttagtattatgtcttggaaawtgtgctatagcaatacatagacat

SEQ ID NO: 43873 - DNA, 50 bp, homo sapien
acttaagtgcaatatataaacattcmattactttaggcctctaactttta

SEQ ID NO: 43874 - DNA, 50 bp, homo sapien
tttgaattgaaagaaatcctattaaytgagccatgactatgtgaccttaa

SEQ ID NO: 43875 - DNA, 50 bp, homo sapien
taataatgctcactttatgagactamtaatgagattaaatagaatgttct

SEQ ID NO: 43876 - DNA, 50 bp, homo sapien
atatcaaaatccaaatagatgaagastcgccttacactttaccacactat

SEQ ID NO: 43877 - DNA, 50 bp, homo sapien
aagctatacatatctgataaaatggyaatggctaagtaaaagtagatata

SEQ ID NO: 43878 - DNA, 50 bp, homo sapien
taatttttttctctacttttatttcragtgaagtaactacacaaagtgaa

SEQ ID NO: 43879 - DNA, 50 bp, homo sapien
gactacaggattacttgagagttatyagggctgcctaacagaccaggaga

SEQ ID NO: 43880 - DNA, 50 bp, homo sapien
aatatttgtggtaattctcacctctraaccatcaacggtatcaataatga

SEQ ID NO: 43881 - DNA, 50 bp, homo sapien
tcttcttcaccaacccacaagattaragagagaagtattccttttgctca

SEQ ID NO: 43882 - DNA, 50 bp, homo sapien
caatgctcccctcaagggcaagtcawtcccatttaagtagatatgcataa

SEQ ID NO: 43883 - DNA, 50 bp, homo sapien
gaaccattttaacacttaaatgaacyacacttaaatctgggtgtgtgaag

SEQ ID NO: 43884 - DNA, 50 bp, homo sapien
ttattcctggtatataatttttcaayacttattcagtgaaaagccaggcc

SEQ ID NO: 43885 - DNA, 50 bp, homo sapien
tctaaatacatagttgatttgtatgyaaacagttattgctgtggtcaaat

SEQ ID NO: 43886 - DNA, 50 bp, homo sapien
cctccagtaggatagctttctcactsactatttcttgatgtaagtgatgt

SEQ ID NO: 43887 - DNA, 50 bp, homo sapien
gacacttcttcaacaatgtcttcgcygaaccatccaagtaaatgagatgc

SEQ ID NO: 43888 - DNA, 50 bp, homo sapien
aactctgaacccacaaaaagacccaygaagatctcaccagaactgatcca

SEQ ID NO: 43889 - DNA, 50 bp, homo sapien
aatgatgaaattatattgtctgttaygaactctcaatccaaactattccc

SEQ ID NO: 43890 - DNA, 50 bp, homo sapien
tctagctgagagattattggaaaacrgtaaacaccatcccatctttagac

SEQ ID NO: 43891 - DNA, 50 bp, homo sapien
tgtcttataatggaagaaatcttcayggacttgcattatggcttgaactg

SEQ ID NO: 43892 - DNA, 50 bp, homo sapien
ccttttaaactcccagttaagtagcrcagtggcttttcacctctccgcct

SEQ ID NO: 43893 - DNA, 50 bp, homo sapien
gatatcaggcatctccataattacargtggctatagaaatcaggaactgc

SEQ ID NO: 43894 - DNA, 50 bp, homo sapien
catttactgaggtatagtgttaagcycattaggtgacatttatgagaaat

SEQ ID NO: 43895 - DNA, 50 bp, homo sapien
tatgtaacaaactcaaatgttaaacsaataatcttctactaaaaacaata

SEQ ID NO: 43896 - DNA, 50 bp, homo sapien
tattttctgcttgaaaaggcttaccratcttagtggttctgaatgcgtgt

SEQ ID NO: 43897 - DNA, 50 bp, homo sapien
atcacaaaagtcctcggctctcctcratgggcattctgaagagtcaaaag

SEQ ID NO: 43898 - DNA, 50 bp, homo sapien
gttatgcatcagaaaggcctgatatracatgaggaaggtagacaataaag

SEQ ID NO: 43899 - DNA, 50 bp, homo sapien
attagacctaataatgatctcggtawcaacctcctaatgtccatccgcct

SEQ ID NO: 43900 - DNA, 50 bp, homo sapien
agaaaaaggagaacaaactaagctcsaaaattagtcaaaggaaggaaata

SEQ ID NO: 43901 - DNA, 50 bp, homo sapien
tagttaatgccttctagtgaaaccartgaagagaggtaagtcaagcatta

SEQ ID NO: 43902 - DNA, 50 bp, homo sapien
tctcaggaatattttcgtcttaaagrattatcgaggtccattccaagatg

SEQ ID NO: 43903 - DNA, 50 bp, homo sapien
tctatttgtatttcgctctagtttayacttgtttatgtgtgtcatctggt

SEQ ID NO: 43904 - DNA, 50 bp, homo sapien
tgtaagtttcatgatacaaccaggasagtaaaggtatagcataatgaggg

SEQ ID NO: 43905 - DNA, 50 bp, homo sapien
atttctcttattctgtttttacaaartatgttctacatttctgtctagta

SEQ ID NO: 43906 - DNA, 50 bp, homo sapien
ctttctaagttataacttccaggackaatagctttggatatgttttacta

SEQ ID NO: 43907 - DNA, 50 bp, homo sapien
agtggtttttgaccaaaaaaatgaargatgttaagagctatcaccaaagt

SEQ ID NO: 43908 - DNA, 50 bp, homo sapien
catggaacattacagggtttggcgayaatgctatgggaatttgacagttg

SEQ ID NO: 43909 - DNA, 50 bp, homo sapien
ttcttgacatttataggtagtataaratatgtgacttccaaataaacata

SEQ ID NO: 43910 - DNA, 50 bp, homo sapien
tataaactgcctgaaaaaacctgcaycacagaccataagaatatttacat

SEQ ID NO: 43911 - DNA, 50 bp, homo sapien
atgccagttaaatgatgcatttgtawaaataattagaagatttttctgag

SEQ ID NO: 43912 - DNA, 50 bp, homo sapien
ctttcccttccttttgttcaaagcaraaattgacatcaccataccttgtt

SEQ ID NO: 43913 - DNA, 50 bp, homo sapien
aaattattttaatcaaatgaaactaygtagatcaaatttaactcttcacc

SEQ ID NO: 43914 - DNA, 50 bp, homo sapien
ccacaaacacactcttagacaatttsaaaaatatcgttaatattatgatg

SEQ ID NO: 43915 - DNA, 50 bp, homo sapien
tattggcctttctctaaaaatgagcrgatgtttagtagacatattatttt

SEQ ID NO: 43916 - DNA, 50 bp, homo sapien
cacccgcaagtcttattcacaacaargttttactgattacaacagtgaaa

SEQ ID NO: 43917 - DNA, 50 bp, homo sapien
cacgtgcagatttttcatggttacayaggaattaaagagaacagcaagga

SEQ ID NO: 43918 - DNA, 50 bp, homo sapien
cttcatagaaactgataaacaacggycaccaaagttgagaagccagtctg

SEQ ID NO: 43919 - DNA, 50 bp, homo sapien
attgttgctttcgttggtaatagcartagaaactattgatggcagaacac

SEQ ID NO: 43920 - DNA, 50 bp, homo sapien
attttttaaatgtaatatggtatacraaattttaggaattattattgcca

SEQ ID NO: 43921 - DNA, 50 bp, homo sapien
tatgctttatttctatcagcaaacartcagaggaaagatgtccccagaat

SEQ ID NO: 43922 - DNA, 50 bp, homo sapien
tgtaataaagaaataagaaggttaasagtattacttagttactatatata

SEQ ID NO: 43923 - DNA, 50 bp, homo sapien
agtcaattaacagagccttggaagaygagactaccccaaagacatgcaac

SEQ ID NO: 43924 - DNA, 50 bp, homo sapien
taatagaaatacttgtccatagaacrcagctttgcagcatattcatccca

SEQ ID NO: 43925 - DNA, 50 bp, homo sapien
tacatacagtgtttcagtggaaagawtatccctttggaaccatatcagag

SEQ ID NO: 43926 - DNA, 50 bp, homo sapien
attgtctccctaatattacatcagaratattaagcagtattaatagacaa

SEQ ID NO: 43927 - DNA, 50 bp, homo sapien
agacaataattattttttcttggaargttttagagcaacagaagctgttt

SEQ ID NO: 43928 - DNA, 50 bp, homo sapien
taagagaaggaaatacatgctattgyaacataaaaatgaaatgcttcttg

SEQ ID NO: 43929 - DNA, 50 bp, homo sapien
tacaaagaaggcaaaggtgacctaasagaaggaaatacatgctattgcaa

SEQ ID NO: 43930 - DNA, 50 bp, homo sapien
tacgcctactctgcttaacaaaggarccttcctataaccacagcaccaaa

SEQ ID NO: 43931 - DNA, 50 bp, homo sapien
gattctttctaacgttttcaggatasagcagcaactggagtgagggtggg

SEQ ID NO: 43932 - DNA, 50 bp, homo sapien
cattcataacggatatgtttttccamaataataaagctatgtgatcgagt

SEQ ID NO: 43933 - DNA, 50 bp, homo sapien
ttgtagtattcataaacctaagtaaycttgtgaaattatattagaagaca

SEQ ID NO: 43934 - DNA, 50 bp, homo sapien
aaaggaccaacagtgttgataacccrcttcagaaatggttttctttaggc

SEQ ID NO: 43935 - DNA, 50 bp, homo sapien
actgtcaagtggaaacatgaacctamaatggtgataaaattgtatagaac

SEQ ID NO: 43936 - DNA, 50 bp, homo sapien
tccacagaacagagacttatttgtawgaagtcaaatgatcaaaatacatt

SEQ ID NO: 43937 - DNA, 50 bp, homo sapien
gcgaggcggtgatttgagccagaaasatgtacagaaagtggataaaaggg

SEQ ID NO: 43938 - DNA, 50 bp, homo sapien
gtccttaccacattaacttgcctcaraaccctgctattctcccaaggtca

SEQ ID NO: 43939 - DNA, 50 bp, homo sapien
ctccaaaaagctgcagagaaggagcsaaaaataacacatattcctaatct

SEQ ID NO: 43940 - DNA, 50 bp, homo sapien
aactcatcgtgaagtcaaacattcamattggaagaaagagctatagaaaa

SEQ ID NO: 43941 - DNA, 50 bp, homo sapien
gtacatctttctggctcaaatcaccrcctcgcagaaatcttctcagagaa

SEQ ID NO: 43942 - DNA, 50 bp, homo sapien
aggtccagaaatctccaaacccaggkcactaacagatgtgttttgggtct

SEQ ID NO: 43943 - DNA, 50 bp, homo sapien
tagtttgtaaaatggcctaacaacaygtaggtatgaaaccagtgttctca

SEQ ID NO: 43944 - DNA, 50 bp, homo sapien
aaactgcctccaactacagtgacaaygaatttctttttgtgggaattctt

SEQ ID NO: 43945 - DNA, 50 bp, homo sapien
ttcctgaaccgtatattttccaaaamactagttgcatgttggcaagtagc

SEQ ID NO: 43946 - DNA, 50 bp, homo sapien
atctagaccaaaggtccaagagtaamtatttctagacaatggatttttgg

SEQ ID NO: 43947 - DNA, 50 bp, homo sapien
ctaccaatgtattagtccactttccyaaatgtgtaagtgaacataatttt

SEQ ID NO: 43948 - DNA, 50 bp, homo sapien
ccaaatttcctttttacgtgtcctcraaggcagaaaactcagaatctttg

SEQ ID NO: 43949 - DNA, 50 bp, homo sapien
tttttctaattaaaatttcacacatragaatgaatatctctaactttcat

SEQ ID NO: 43950 - DNA, 50 bp, homo sapien
tgtagtcttaagtaccaggaaagccraaataaggttacatcttttccaat

SEQ ID NO: 43951 - DNA, 50 bp, homo sapien
aaaggttccatgtattatcttttcartattcatgttatactgtacaagca

SEQ ID NO: 43952 - DNA, 50 bp, homo sapien
aaagttattaaagtcagttgtttgaraagtaactggtgggaaggtaatcc

SEQ ID NO: 43953 - DNA, 50 bp, homo sapien
aactttctgacttcagacaagtgaayttaatacgggcttaatactggttg

SEQ ID NO: 43954 - DNA, 50 bp, homo sapien
gagccatctcttttaaatgcaaacaycaagggtgataacaccactatctc

SEQ ID NO: 43955 - DNA, 50 bp, homo sapien
taatttgaaaatccactaatgaagayggtaatagtgggaagtaagcacca

SEQ ID NO: 43956 - DNA, 50 bp, homo sapien
taaattacatgttgaactagaaatayaggtggttggaaattgtgaagctg

SEQ ID NO: 43957 - DNA, 50 bp, homo sapien
ctaggtagatctcacctgtatagcaycactataaggcaacttggcttggc

SEQ ID NO: 43958 - DNA, 50 bp, homo sapien
tcttccttaattaaataccagatcawcttaatattttcctggatgtgtga

SEQ ID NO: 43959 - DNA, 50 bp, homo sapien
caaataggtcactataatattctgaraagtttcatgtgaaagtgagatta

SEQ ID NO: 43960 - DNA, 50 bp, homo sapien
aaatattataattaattcacatctaygtacctaaggttggagaaagagtc

SEQ ID NO: 43961 - DNA, 50 bp, homo sapien
tgaaaaaatgacatagcctgtgtcartctctagcatttggtaagtactca

SEQ ID NO: 43962 - DNA, 50 bp, homo sapien
agactcatgccattggcttgcaaatkattaggtttaatttatgtttcctt

SEQ ID NO: 43963 - DNA, 50 bp, homo sapien
atttcaaagtgctagcatgccacaaracacttactttagttttatgtaag

SEQ ID NO: 43964 - DNA, 50 bp, homo sapien
acaggctatgtcattttttcaatacmaagccctgtgaaatgggtactatc

SEQ ID NO: 43965 - DNA, 50 bp, homo sapien
ctaacagtggacaagatcactttgamatgtaagaatatatgagttgcttt

SEQ ID NO: 43966 - DNA, 50 bp, homo sapien
ttcagaggatatgttttaggaggtgkattgttccattttatatatatatg

SEQ ID NO: 43967 - DNA, 50 bp, homo sapien
ggctatacgatcactatctcccaaaygctcttttaattagttttcttatc

SEQ ID NO: 43968 - DNA, 50 bp, homo sapien
ctgtggcacagccctgctcatgccayaaaatagtattaatattagttcta

SEQ ID NO: 43969 - DNA, 50 bp, homo sapien
ccaaaagtccatttatttccatttastaaaccctagatgtagttttattt

SEQ ID NO: 43970 - DNA, 50 bp, homo sapien
ggagcagatgtctggcttctcaggaytccgctgtctgtaatgatccatct

SEQ ID NO: 43971 - DNA, 50 bp, homo sapien
ccccttccctcaacattgctccacaygatcagaagtcccatggcagcagt

SEQ ID NO: 43972 - DNA, 50 bp, homo sapien
atatcaagtcaaggaaacaagttaasaaggagagaaatcccttatatttt

SEQ ID NO: 43973 - DNA, 50 bp, homo sapien
aaagaagtttactttaaattgtatcraacataaaaggagagtcatatcaa

SEQ ID NO: 43974 - DNA, 50 bp, homo sapien
tgaggtcacatttatttgggagaaaygcctttatattagctcatacaaaa

SEQ ID NO: 43975 - DNA, 50 bp, homo sapien
tttatatctgcatgttactcctcaaytaacttacaatttatgttgatgga

SEQ ID NO: 43976 - DNA, 50 bp, homo sapien
aaatatgacaggttagaattatttcraagaaaggctagcattataaaaag

SEQ ID NO: 43977 - DNA, 50 bp, homo sapien
aacttccaatgctaagtcactcatckagatctatagagaaaagcagtgtt

SEQ ID NO: 43978 - DNA, 50 bp, homo sapien
atccttagaaaggtaagagaaaatakagcattcattaaaaaaagcataaa

SEQ ID NO: 43979 - DNA, 50 bp, homo sapien
gtagaacttatttcctgtatattccrcaatgcataaaattttgagcttca

SEQ ID NO: 43980 - DNA, 50 bp, homo sapien
atgtacttgggtacttaactgcaaamatcaactaaattctgaccaatata

SEQ ID NO: 43981 - DNA, 50 bp, homo sapien
aagcctagggataagaaagacaccakgtttgagaaatcgaatgcattaat

SEQ ID NO: 43982 - DNA, 50 bp, homo sapien
ttggcaaggaagcctatgatataagmcattctgcagtgggctgctattca

SEQ ID NO: 43983 - DNA, 50 bp, homo sapien
tgctgacctgattttacattagacayctttgtgataaaaaaggtaatagc

SEQ ID NO: 43984 - DNA, 50 bp, homo sapien
agataaacatggaataatctacataygactttcacagaaggagaatgttg

SEQ ID NO: 43985 - DNA, 50 bp, homo sapien
gacttctttatggaattattttagcyactagtgtgaaaacaagaaacaat

SEQ ID NO: 43986 - DNA, 50 bp, homo sapien
gctcttaggagtccattagcgcttakgttagttcaactgggctcagtttt

SEQ ID NO: 43987 - DNA, 50 bp, homo sapien
aagataatgcacagaaaaactatgayaggaaattgaagagtacatacagg

SEQ ID NO: 43988 - DNA, 50 bp, homo sapien
ccgagaactctaatagtagaaacagscctacattcacatgcacaaactta

SEQ ID NO: 43989 - DNA, 32 bp, homo sapien
cctgatatcagaaacaygaggaacacttagtt

SEQ ID NO: 43990 - DNA, 50 bp, homo sapien
attttattttataaccatcgaggaascattgatatttctaaatagacaat

SEQ ID NO: 43991 - DNA, 50 bp, homo sapien
ggatgagcatgagccgaggcaaaaawtgggaagtcaagtggaggaatgat

SEQ ID NO: 43992 - DNA, 50 bp, homo sapien
catcgtaagttgaggagcatctgtayagtctttctacacaactcaatcat

SEQ ID NO: 43993 - DNA, 50 bp, homo sapien
caaagccaaaagagagagaataagcrgaagcaagctgaaaaacatattgg

SEQ ID NO: 43994 - DNA, 50 bp, homo sapien
tgaagtaatctaagcaatcagtaaamgcatataaaccacttgactaatag

SEQ ID NO: 43995 - DNA, 50 bp, homo sapien
gtggaaatgaaagcatccttaaatawctgctgtggatctgaatgagacat

SEQ ID NO: 43996 - DNA, 50 bp, homo sapien
taagaaataattttcatgcaaaataraagaatgtcacgatcacatggcta

SEQ ID NO: 43997 - DNA, 50 bp, homo sapien
ctgcactgattcaatagcctcatcastctctccatgtggaatattgtaac

SEQ ID NO: 43998 - DNA, 50 bp, homo sapien
gagtcaatggttacattaattacaamgtttatgtgacacttaatttggtt

SEQ ID NO: 43999 - DNA, 50 bp, homo sapien
tttttttaaagcatctttacgatgakattataggaagtatatgagaacaa

SEQ ID NO: 44000 - DNA, 50 bp, homo sapien
ccagacatcgagttcctgcctccaastgggcttcttgccaggacatatca

SEQ ID NO: 44001 - DNA, 50 bp, homo sapien
gttataaaatgaactttcattagacmactgacattagacaagcttcacta

SEQ ID NO: 44002 - DNA, 50 bp, homo sapien
tccatgaataatgattcaaatattaygaaaaaaggcattccaaaggcaaa

SEQ ID NO: 44003 - DNA, 50 bp, homo sapien
gtttcttgtttctctcttttctctcwaagcatttaactttcatcattgaa

SEQ ID NO: 44004 - DNA, 50 bp, homo sapien
atacagactaagactgtcaatatgakgatataggcttactgacttttgac

SEQ ID NO: 44005 - DNA, 50 bp, homo sapien
tctattggcattattgatcgatgacsaattctaaggtttctttttttcta

SEQ ID NO: 44006 - DNA, 50 bp, homo sapien
ccaagtgtttaggagttggagttcaycttagctattaattctagtttaat

SEQ ID NO: 44007 - DNA, 50 bp, homo sapien
ctcaatcttccttttccaaaaacgaytcatacctgattaatatctggctg

SEQ ID NO: 44008 - DNA, 50 bp, homo sapien
tattgctgatttggagaaagtttgartagtttgggtagacgatcaaacca

SEQ ID NO: 44009 - DNA, 50 bp, homo sapien
tggaaattattagaaatgcattaaamagtgaaaaagcgatgtaagcttta

SEQ ID NO: 44010 - DNA, 50 bp, homo sapien
cagtttcttacactcgattatcttawctctaaggatttttcattgcatat

SEQ ID NO: 44011 - DNA, 50 bp, homo sapien
tttttatttgcctactggttatctaractttttaagtgcatgcattttat

SEQ ID NO: 44012 - DNA, 50 bp, homo sapien
aatatgtagggaagaaaataaaagasaactagtgtttgtgctcaaagcaa

SEQ ID NO: 44013 - DNA, 50 bp, homo sapien
ggcaaccattgatattgtcttcctcragtacatgctgttctgtgcctgga

SEQ ID NO: 44014 - DNA, 50 bp, homo sapien
tgaaaggagaggcaataagaaaataygaacatagatatgtagtacctata

SEQ ID NO: 44015 - DNA, 50 bp, homo sapien
tctggcagcataaaatacatatcacrgattgatgtttatatctaataaaa

SEQ ID NO: 44016 - DNA, 50 bp, homo sapien
cgcattgaggtccctagtgaaaaggmatatatcgcaggataaaaactaga

SEQ ID NO: 44017 - DNA, 50 bp, homo sapien
atgaaaccccttttgaagttggtggraaccataaataaataagacatggg

SEQ ID NO: 44018 - DNA, 50 bp, homo sapien
tgtgcatattttatgtaggtcgtaarctgtcaaaaatatgaaaacggggg

SEQ ID NO: 44019 - DNA, 50 bp, homo sapien
gtgtttgtctgctcatcaaaatgggyacattaaaattacatttttttcct

SEQ ID NO: 44020 - DNA, 50 bp, homo sapien
tgtatgcttttgtttttacaagctcraacaagactgagtattctggctca

SEQ ID NO: 44021 - DNA, 50 bp, homo sapien
ctttagtgtggtagcatttacatcayccttgactagccagtgaaaaacct

SEQ ID NO: 44022 - DNA, 50 bp, homo sapien
atcccttcagtttttcacattaaaasctgtcattatggaatacaagtgaa

SEQ ID NO: 44023 - DNA, 50 bp, homo sapien
gcttaaataattacttcttaactcckatatgacagtgagccataattgct

SEQ ID NO: 44024 - DNA, 50 bp, homo sapien
atcttagatacagatctgatctctayaatgaactggtattcagaattttt

SEQ ID NO: 44025 - DNA, 50 bp, homo sapien
tccagtatgagccaagttggcagtcyacacacggtggccatattcatctt

SEQ ID NO: 44026 - DNA, 50 bp, homo sapien
taagcactctgtaggtgtcattgggwacaattattagaaggcatggcatt

SEQ ID NO: 44027 - DNA, 50 bp, homo sapien
tcacaaggtcccatagaaactaaacwccaagtctttttacttctaaattg

SEQ ID NO: 44028 - DNA, 50 bp, homo sapien
accttctcagagaggtctgtctcacyaccacctgttaactaggaaatctc

SEQ ID NO: 44029 - DNA, 50 bp, homo sapien
cttttatgatttattgtgctgttgamattattctaccgttagctaatagg

SEQ ID NO: 44030 - DNA, 50 bp, homo sapien
gttacttaacaatggataaaaggtawatgtattagttaattctttgctcc

SEQ ID NO: 44031 - DNA, 50 bp, homo sapien
tgcatatacttatgtcctgatgccaygtaatattccaggtttcatcttgc

SEQ ID NO: 44032 - DNA, 50 bp, homo sapien
tggattgcagagttatttttttaacrcccactgtatatccatacttttta

SEQ ID NO: 44033 - DNA, 50 bp, homo sapien
aaagctatattgtactctcatttcamatttattacaagtctgaagaacca

SEQ ID NO: 44034 - DNA, 50 bp, homo sapien
tataaacatataaaatatgattcaakaataaggagattgagtagaatgat

SEQ ID NO: 44035 - DNA, 50 bp, homo sapien
cagttttagataaaataggtacagawgaggagaagaaggaaaagtcttct

SEQ ID NO: 44036 - DNA, 50 bp, homo sapien
aaaattaagacacctgactaaggaargtatgttgatctcacctaattcct

SEQ ID NO: 44037 - DNA, 50 bp, homo sapien
tcttgaccctccattactcgttatcsaaataataatgcttacctcataca

SEQ ID NO: 44038 - DNA, 50 bp, homo sapien
aatgcaaaattgtacaaatgaatacwatgagactctagagtttaatacac

SEQ ID NO: 44039 - DNA, 50 bp, homo sapien
accaaaataggattgccatttagaayaggttgattctgctattgctttta

SEQ ID NO: 44040 - DNA, 50 bp, homo sapien
gagtcacatgaactatcttttggaamgttttaatgtgaaaagaaactgca

SEQ ID NO: 44041 - DNA, 50 bp, homo sapien
atttcattcagctccgtaaatctcaygaataggaatatgttcttaccacc

SEQ ID NO: 44042 - DNA, 50 bp, homo sapien
gtctgggacccagagagaacacatcrgagtgagagaacaaaaggtgtcat

SEQ ID NO: 44043 - DNA, 50 bp, homo sapien
taaaaaatgattattccaaatactgrcaaaattatggtaaaatcattgca

SEQ ID NO: 44044 - DNA, 50 bp, homo sapien
tgaatcagtgatatccaataaaataygagaatttatcaccagcagcttac

SEQ ID NO: 44045 - DNA, 50 bp, homo sapien
agttttagtgatatagtacttacaakgatgcttttaaaatgtctttccac

SEQ ID NO: 44046 - DNA, 50 bp, homo sapien
actgtaagaggtatattaagcataaytcaaagcagtcgaatgctgcaaat

SEQ ID NO: 44047 - DNA, 50 bp, homo sapien
aactaaataccaatgtagagtgagaracagtatgtaggataataaagacc

SEQ ID NO: 44048 - DNA, 50 bp, homo sapien
ctccaaaatattcattcgctgaatcracaataacagcttttccaaactcc

SEQ ID NO: 44049 - DNA, 50 bp, homo sapien
atatattggacctaattcaatcatcragataaaatattttcgggaataat

SEQ ID NO: 44050 - DNA, 50 bp, homo sapien
tgaaaaaatagattaatgaaacagamaagatttaagcatttttaaaataa

SEQ ID NO: 44051 - DNA, 50 bp, homo sapien
tgcttcttcattctgtaaaaaagtayattgcaatggaagtaaggtgcaca

SEQ ID NO: 44052 - DNA, 50 bp, homo sapien
aattctatcataaaaactggctgaamtgcgtcacaagaatatactaaata

SEQ ID NO: 44053 - DNA, 50 bp, homo sapien
ttggtaaagtggatttagggttttcratgaatgcagcctcttcttggaga

SEQ ID NO: 44054 - DNA, 50 bp, homo sapien
gccatctggtggtactttgaaacgasattgatttaatttttggacactgt

SEQ ID NO: 44055 - DNA, 50 bp, homo sapien
ttgcaattataaagttaaatatatakgccatttagagaagcctgaattca

SEQ ID NO: 44056 - DNA, 50 bp, homo sapien
ttttccacctgtccagatatgtgaaratcatgtctcctaaattccctctt

SEQ ID NO: 44057 - DNA, 50 bp, homo sapien
atttgagtatcaatgttccatctacratattatctaaatcactcaagaga

SEQ ID NO: 44058 - DNA, 50 bp, homo sapien
agtttcacagcgacctcaggtactayggtaatattaactttggcccatca

SEQ ID NO: 44059 - DNA, 50 bp, homo sapien
gaaataggtgatttagactttgtaartatggccaaatcaattaaacagag

SEQ ID NO: 44060 - DNA, 50 bp, homo sapien
gaaaatcaagcaaacattactaaaawgaaatactggtctacacatttctc

SEQ ID NO: 44061 - DNA, 50 bp, homo sapien
tttagagtagtattcattatttcacrcgttatactctcataacatagaaa

SEQ ID NO: 44062 - DNA, 50 bp, homo sapien
taaggaacaattgttatatggtggakaatataaaacaaatgacaatactt

SEQ ID NO: 44063 - DNA, 50 bp, homo sapien
tctaaatttccatcatccaccctaartaagttgagttacatcacccaggt

SEQ ID NO: 44064 - DNA, 50 bp, homo sapien
taaatgcatttcttctttgctgaccrgatgaatgtaatacttcactagtt

SEQ ID NO: 44065 - DNA, 50 bp, homo sapien
ctactgggaaaagctggttaagggcyacatagaatcactctgtaatatct

SEQ ID NO: 44066 - DNA, 50 bp, homo sapien
attagcaataccttttaggattagawgttaacatttacaacaagaagaag

SEQ ID NO: 44067 - DNA, 50 bp, homo sapien
gaaaaaaaaaaaaaatgagctgtgaygcaaattttagcgggtccaaataa

SEQ ID NO: 44068 - DNA, 50 bp, homo sapien
aataaaaaaaaattgcaagtatctayaccatacgtttccaagtataatat

SEQ ID NO: 44069 - DNA, 50 bp, homo sapien
accacaagcacatataaattttaaamggtaactatgtcaacagatcaaaa

SEQ ID NO: 44070 - DNA, 50 bp, homo sapien
aagggcatttttaccttgacctcacrgctggcctccaaattaatgtctgt

SEQ ID NO: 44071 - DNA, 50 bp, homo sapien
atgttccaattttagggcaaagtagwatcctgcactttcaacagatgttg

SEQ ID NO: 44072 - DNA, 50 bp, homo sapien
atctaggaagaatagcaaatgagaastattgataatctttgagtgtatta

SEQ ID NO: 44073 - DNA, 50 bp, homo sapien
gccaggggtccaccagcatttctgtwaagtctagatagatattttagact

SEQ ID NO: 44074 - DNA, 50 bp, homo sapien
gatatatcaaactggtcattagacarcttactttacctcctcccccttat

SEQ ID NO: 44075 - DNA, 50 bp, homo sapien
cacattagctaattaagttcatcaartgttactttaaaataattcaaaaa

SEQ ID NO: 44076 - DNA, 50 bp, homo sapien
taattagcaataattatttttctgtsaactaatactgatagattgtgcat

SEQ ID NO: 44077 - DNA, 50 bp, homo sapien
ttatgtaaatgtattataatagctargagacaaccatttgcataataata

SEQ ID NO: 44078 - DNA, 50 bp, homo sapien
taagagagatattagctttagatgartagtttttggaaataatataccag

SEQ ID NO: 44079 - DNA, 50 bp, homo sapien
gtcagaagtaactgcaggagataccracaaagaattataaaaatcagatg

SEQ ID NO: 44080 - DNA, 50 bp, homo sapien
tgtaattattgatataaatgggatarctattgagtttattaatagtgcaa

SEQ ID NO: 44081 - DNA, 50 bp, homo sapien
aattcagcttttggattaaatcaagyattgaatggataatttatccccaa

SEQ ID NO: 44082 - DNA, 50 bp, homo sapien
taattactaactttaaaggataatcrgaactctattctgtttgcacttac

SEQ ID NO: 44083 - DNA, 50 bp, homo sapien
ataataatccattcctaattgcttaygtggaatctatgaatccttccttg

SEQ ID NO: 44084 - DNA, 50 bp, homo sapien
aagctggcaatcacaggccttatccrgattccacacaaactgaagggcca

SEQ ID NO: 44085 - DNA, 50 bp, homo sapien
gcttgtgtgcttgtcagcttttaacycgactctaccaattcctaccagtc

SEQ ID NO: 44086 - DNA, 50 bp, homo sapien
gaaatggcaagtttgtcaagcctgcygaaaagtatacactcattaattct

SEQ ID NO: 44087 - DNA, 50 bp, homo sapien
cagtcccaaacctgctgctattaccrattctcattattcttcttatgttc

SEQ ID NO: 44088 - DNA, 50 bp, homo sapien
gtatttctcttggctattttatccartcactttttggtggcatttacaat

SEQ ID NO: 44089 - DNA, 50 bp, homo sapien
tttaggtcaataaatccactagtgamaatggatcagagattgttactata

SEQ ID NO: 44090 - DNA, 50 bp, homo sapien
ttattacatgtattaggccttcctcmaactatactttcaaagcttcctat

SEQ ID NO: 44091 - DNA, 50 bp, homo sapien
ctattctagaccatttttagcatgayactactaaatacaagcaaatttta

SEQ ID NO: 44092 - DNA, 50 bp, homo sapien
attttaatatgtttgtaatctgtacrctgtatttcaagaaatcaaacact

SEQ ID NO: 44093 - DNA, 50 bp, homo sapien
gatgatgagtgcatgtacctaattaragaatttccagcaatgtggagaaa

SEQ ID NO: 44094 - DNA, 50 bp, homo sapien
atgcatatcaaatgacttttggatamctgagtgaatgagttaatgatatg

SEQ ID NO: 44095 - DNA, 50 bp, homo sapien
acatcttcttgaagcagtacacaaamctttgtatcataagcttttcttta

SEQ ID NO: 44096 - DNA, 50 bp, homo sapien
atgaggacctattttcctacactgakagtctttaggatactgattagaaa

SEQ ID NO: 44097 - DNA, 50 bp, homo sapien
gggcgaaattgtcctggactcagacraatctaatgtttcagaacttcttt

SEQ ID NO: 44098 - DNA, 50 bp, homo sapien
aatagaaaagagaaccaaatgatcgyatccttttttcaggtataatgact

SEQ ID NO: 44099 - DNA, 50 bp, homo sapien
tgtatatgacttataaaatatctcartcttatgcattacatcagaacact

SEQ ID NO: 44100 - DNA, 50 bp, homo sapien
gccaaaacaacctagattattcttgractggagtcaatttgtttcatctc

SEQ ID NO: 44101 - DNA, 50 bp, homo sapien
taaatcttgaataatttactttatgratcattttactgaaaaaaaatctc

SEQ ID NO: 44102 - DNA, 50 bp, homo sapien
atttattatgtaccattcactaggarcgtcacctttcagaggaaaaaaac

SEQ ID NO: 44103 - DNA, 50 bp, homo sapien
tgagtcattatcagatgttcaagcaytgatggtcatcattcacccagata

SEQ ID NO: 44104 - DNA, 50 bp, homo sapien
gaaatgggttttgaggatgctaaaasaagaaaatcaaaatatattttaga

SEQ ID NO: 44105 - DNA, 50 bp, homo sapien
tgtgaattaggtgcagtgggtactayagtgttacatgctcaataaggtta

SEQ ID NO: 44106 - DNA, 50 bp, homo sapien
agtcatttctctaggtgttagaaagrattaataagtgaagtatgagtgtt

SEQ ID NO: 44107 - DNA, 50 bp, homo sapien
ggtagaattatgttgtaaatcctgaraatcagaaatagagaactttttca

SEQ ID NO: 44108 - DNA, 50 bp, homo sapien
tttgtaatggtctttgagagtcaaaygtttattacctacaagaattaaga

SEQ ID NO: 44109 - DNA, 50 bp, homo sapien
ttcttaatgaaactgatgagatctayggatatgactattttgaggatgcc

SEQ ID NO: 44110 - DNA, 50 bp, homo sapien
ttttgttgctgatcaagctcaaacaytctaggaccattttacaaaataac

SEQ ID NO: 44111 - DNA, 50 bp, homo sapien
aataattctaccacttattgatttasatttatatgatgaccaaataaatt

SEQ ID NO: 44112 - DNA, 50 bp, homo sapien
tgttatgtgtcaacttgctaacttaygccctattgttgtcataacaggaa

SEQ ID NO: 44113 - DNA, 50 bp, homo sapien
cctatgtcctgcacttttcccaagakgtactgcctcactgtgtcagataa

SEQ ID NO: 44114 - DNA, 50 bp, homo sapien
catattattatttctgagagtataartaggctaagtaaaatagaaaaaaa

SEQ ID NO: 44115 - DNA, 50 bp, homo sapien
aatagttaggcttccttcataaatartaacgttttaatggaagcttatgg

SEQ ID NO: 44116 - DNA, 50 bp, homo sapien
ttggcccatcaatcttatttagaacmaaagagattaaaaattagttagtt

SEQ ID NO: 44117 - DNA, 50 bp, homo sapien
aacaggtcttccttcctacgcattawctcttttcttagtttcatttattt

SEQ ID NO: 44118 - DNA, 50 bp, homo sapien
tgggtgaacaatctataacggcataygagagagagcagaaggaccagtcc

SEQ ID NO: 44119 - DNA, 50 bp, homo sapien
ttcaaggaagtagtggctgaattaartctaaatatcaaatatgtctttgt

SEQ ID NO: 44120 - DNA, 50 bp, homo sapien
gataggaaagaaaactagccaggaakgtaaatgaagctgcttttaaataa

SEQ ID NO: 44121 - DNA, 50 bp, homo sapien
ctggagcaagatgctggctattgaasgtgacaaggaactgcttatggctc

SEQ ID NO: 44122 - DNA, 50 bp, homo sapien
tgaagcttttctataaaattatgagragataaatggcagcaccagctcct

SEQ ID NO: 44123 - DNA, 50 bp, homo sapien
aaaagaaatcacagaactaataaacycattcacaagggccaatcattttg

SEQ ID NO: 44124 - DNA, 50 bp, homo sapien
ataaagaataaggtccaaacttctcmacatgatatgtaatatgcaatggc

SEQ ID NO: 44125 - DNA, 50 bp, homo sapien
tgaagaaataaacctaatcaaagaargaatagacttaactccaatgaaat

SEQ ID NO: 44126 - DNA, 50 bp, homo sapien
gaattccagtgttcttgcgtggaaaycagaaattaatttattcaattctt

SEQ ID NO: 44127 - DNA, 50 bp, homo sapien
gaggacacaaataaaactgcttaacygatgcatgggataaaggggagaag

SEQ ID NO: 44128 - DNA, 50 bp, homo sapien
aatgaatacacaatataataaggaasaaattctgactgtaagaacacatt

SEQ ID NO: 44129 - DNA, 50 bp, homo sapien
taatagcattatatgatggtaagacsacgtgaaaatgaagaaataaggaa

SEQ ID NO: 44130 - DNA, 50 bp, homo sapien
cctatgagacttatgataacagctaygcgacccaaacacaaaggtaaggc

SEQ ID NO: 44131 - DNA, 50 bp, homo sapien
ccaactgtaatgagaagagtatataycatttaaactacttacacattttt

SEQ ID NO: 44132 - DNA, 50 bp, homo sapien
aactgttacattgtgccgaagtccaygatagatgcattttattggccata

SEQ ID NO: 44133 - DNA, 50 bp, homo sapien
tcttcctcacactctcttcaaactcraatatctttttcagagatgtctag

SEQ ID NO: 44134 - DNA, 50 bp, homo sapien
atgtgacactatggatttttagcaaytgaattgaagataagtactaaata

SEQ ID NO: 44135 - DNA, 50 bp, homo sapien
gctgtagatgtttgaccaagatgaaraaatagaaaatataagcaacatcg

SEQ ID NO: 44136 - DNA, 50 bp, homo sapien
atggtacttcagagctttttacaaakaatcccacttgtgaacattacttt

SEQ ID NO: 44137 - DNA, 50 bp, homo sapien
aacaattatttctgaatgtgtaaaawtttcatagtcttttcttttatttt

SEQ ID NO: 44138 - DNA, 50 bp, homo sapien
aaaagtaggctaaaatacaggtcatraagtaaaatgagcaaagcagtgtt

SEQ ID NO: 44139 - DNA, 50 bp, homo sapien
ttgattttagtttgcattgatatagyatgcacattaacttattatttcat

SEQ ID NO: 44140 - DNA, 50 bp, homo sapien
gctgataggaatatatttttccttcyctgatgtattaaataaataaccaa

SEQ ID NO: 44141 - DNA, 50 bp, homo sapien
gcctctgactttgtagggttcccacygaagcatccatggctggctgaatg

SEQ ID NO: 44142 - DNA, 50 bp, homo sapien
tgtgatacacatcttaagtaactaaygtagtgagcccaatgcagaagaat

SEQ ID NO: 44143 - DNA, 50 bp, homo sapien
tcataataaaacaccattctacactyacgtaattcacaaaaactcacatt

SEQ ID NO: 44144 - DNA, 50 bp, homo sapien
tactgaaagactacctgcacaaataraatgcaagatgaaacctcaaatgg

SEQ ID NO: 44145 - DNA, 50 bp, homo sapien
taaaaatacgtggaaatgtaaataasgttcagagaagagtggtagtgatt

SEQ ID NO: 44146 - DNA, 50 bp, homo sapien
tagtattgatagtgttaatcatgacyggattcggagactactactcattt

SEQ ID NO: 44147 - DNA, 50 bp, homo sapien
tttcacaaagaaaagattgaccaaamtagaaagagaaacaaaagaaggaa

SEQ ID NO: 44148 - DNA, 50 bp, homo sapien
ttgtttctgaggagagagatgcaagyagaattacggaagactgttagggc

SEQ ID NO: 44149 - DNA, 50 bp, homo sapien
acagaaaatatgttcgaagcagagastactatagagcttacctatttgaa

SEQ ID NO: 44150 - DNA, 50 bp, homo sapien
tatatatgcatttaagcctaaaaagrattctgccacaccatgtccccata

SEQ ID NO: 44151 - DNA, 50 bp, homo sapien
agaaaatcacttgtagcatgaagaaygtagataattttataatatattta

SEQ ID NO: 44152 - DNA, 50 bp, homo sapien
tctgaatgacttcactgaatttttaygctacattcatatatggcagtcag

SEQ ID NO: 44153 - DNA, 50 bp, homo sapien
aaactgagaactgtcagtccacagamctattatatcaccatatggaagtg

SEQ ID NO: 44154 - DNA, 50 bp, homo sapien
tcctatgcctgtgtttatgtcttcaygttttggacatttcatgtttggta

SEQ ID NO: 44155 - DNA, 50 bp, homo sapien
tggtgatccctgaccatagtatgtayaatgctccctccagtaaccctcag

SEQ ID NO: 44156 - DNA, 50 bp, homo sapien
catagggctaggttgtattcccttaragaagattggaaaagtcagggctt

SEQ ID NO: 44157 - DNA, 50 bp, homo sapien
aaacctcacccttatgcaatacattyaagtcacaaacctgctcacgtgca

SEQ ID NO: 44158 - DNA, 50 bp, homo sapien
gcaccatcatatcataaattaaatargggaagcacctcagaattttagct

SEQ ID NO: 44159 - DNA, 50 bp, homo sapien
ctttgaagaatagatggtaggtgtcragtatggagatgcataagtataaa

SEQ ID NO: 44160 - DNA, 50 bp, homo sapien
ggaacttcagcatttcacaatgagaygaaacaggcgattgacagtagaga

SEQ ID NO: 44161 - DNA, 50 bp, homo sapien
taaatgcaagacagaatgagaagtayatcaaacagaatacaaaataacct

SEQ ID NO: 44162 - DNA, 50 bp, homo sapien
taactgaaagatgtggtaaaacatcrgagagcggtctttaattaatctct

SEQ ID NO: 44163 - DNA, 50 bp, homo sapien
tcattaaaaccatactgaatcttcayattttagctgttaaaacgactgac

SEQ ID NO: 44164 - DNA, 50 bp, homo sapien
ttctaagtaatatagtgttctaagaygctagtaacatgcttggcctataa

SEQ ID NO: 44165 - DNA, 50 bp, homo sapien
atacattgtcttttcttaatcctaawgggttctctaacatttccctgttc

SEQ ID NO: 44166 - DNA, 50 bp, homo sapien
ttgctgaatgaaaagaaagttttaaygcagcgagataaatgcacacatct

SEQ ID NO: 44167 - DNA, 50 bp, homo sapien
tacaacacatcttcaaggacatttayggaattagggctctgaggaaagga

SEQ ID NO: 44168 - DNA, 50 bp, homo sapien
tttgatggaactttcaaacaagtcartcaaggtcctgaagcattgttttg

SEQ ID NO: 44169 - DNA, 50 bp, homo sapien
tagctgagttcgtaaaaagcctctgmaaaattgtaatctatgtctatgtg

SEQ ID NO: 44170 - DNA, 50 bp, homo sapien
attgtagcaatttatttcctctcctragctaaatttcagtacactactgt

SEQ ID NO: 44171 - DNA, 50 bp, homo sapien
gagatttggaaggcaccaggaataamatgatatggcttagatctgtgtcc

SEQ ID NO: 44172 - DNA, 50 bp, homo sapien
tgctaagttggaacctaccatttacragtaaaaattacactttatttata

SEQ ID NO: 44173 - DNA, 50 bp, homo sapien
gccaactgtctagaatcattagtacsacttccaatcagagctgactacag

SEQ ID NO: 44174 - DNA, 50 bp, homo sapien
agagctgactacagtgactcactccracccttaactgacttctcaggaaa

SEQ ID NO: 44175 - DNA, 50 bp, homo sapien
tcttgctgtttgctaatacttcaaawtttattctttctagaattagatga

SEQ ID NO: 44176 - DNA, 50 bp, homo sapien
ggcagcctgaaaatagcattaatgarcaattcttggaagacttgtatttt

SEQ ID NO: 44177 - DNA, 50 bp, homo sapien
agtgtatatatttaacctaatttcaycatgtctactgtttaagtagagat

SEQ ID NO: 44178 - DNA, 50 bp, homo sapien
acaataatagaatctgtaaagagaayggaaaggaattagtaatgaactag

SEQ ID NO: 44179 - DNA, 50 bp, homo sapien
tccagttcagcgcaatctccaaatawgggtttttctctgtacatcaccta

SEQ ID NO: 44180 - DNA, 50 bp, homo sapien
agcaatatatataatgtcttattggwataaaaaaatctagtctcagatta

SEQ ID NO: 44181 - DNA, 50 bp, homo sapien
ctgattgaaccttcctgtgaagttasgtagaggagttgtgtgccaattca

SEQ ID NO: 44182 - DNA, 50 bp, homo sapien
tggagcccacacaaaaatgtgtaagrcagaaacaaggttaaagtatataa

SEQ ID NO: 44183 - DNA, 50 bp, homo sapien
tatttatcctagttactttcccatayatttactgttgacttttccatgcc

SEQ ID NO: 44184 - DNA, 50 bp, homo sapien
ggatatgaagtcattagggatactargtctttatgttttcttatttggcc

SEQ ID NO: 44185 - DNA, 50 bp, homo sapien
atacactttaaatcaacaccaatgarccaatgtattattaccactctgag

SEQ ID NO: 44186 - DNA, 50 bp, homo sapien
atcaggcttggagctgggaataagayaattagaagagaatgctgagtaca

SEQ ID NO: 44187 - DNA, 50 bp, homo sapien
atttattatctgatgctcatctgaayatctccctaactagatctcatatt

SEQ ID NO: 44188 - DNA, 50 bp, homo sapien
catccaatttgatagctgtttctgargaaattaaccttaggaactcagat

SEQ ID NO: 44189 - DNA, 50 bp, homo sapien
attgtacaacagcaactgagaaacawtaagtgtgaatagaaatatcagca

SEQ ID NO: 44190 - DNA, 50 bp, homo sapien
tttttctcaatatgttgatgaattgraccattgaccactgtcttttccat

SEQ ID NO: 44191 - DNA, 50 bp, homo sapien
ggttaaatatataacaagtatattamattagcttactcagtaggatacaa

SEQ ID NO: 44192 - DNA, 50 bp, homo sapien
tcattattacatacaggtagctaaartatgtcaaaatgtcagggccataa

SEQ ID NO: 44193 - DNA, 50 bp, homo sapien
atatctagtagcagaggaactatacrcctgtttcgcatgggttaacattt

SEQ ID NO: 44194 - DNA, 50 bp, homo sapien
tgcaaaaatatctggaagtataaaaytcactgttaaaagtatgtacacag

SEQ ID NO: 44195 - DNA, 50 bp, homo sapien
taagacctctaggtcagtggaaagascatttaatcatggaacatctttca

SEQ ID NO: 44196 - DNA, 50 bp, homo sapien
aattgaggtagacaccctcttactcraaatatcttcctacattttataac

SEQ ID NO: 44197 - DNA, 50 bp, homo sapien
cgaagctggataattgaaattccagraaaaaacatttctcctgattttag

SEQ ID NO: 44198 - DNA, 50 bp, homo sapien
agaaaatgacacaatagagcaagaamttaggaaagacccacttttagagg

SEQ ID NO: 44199 - DNA, 50 bp, homo sapien
gtttttctcaaacccagtagtttcasagatcagaattttccacttccctt

SEQ ID NO: 44200 - DNA, 50 bp, homo sapien
ttctgacccagtagactactaataastgaaaagtgttcctcagctataag

SEQ ID NO: 44201 - DNA, 50 bp, homo sapien
tcagagtactattttaggaactctcrgacctgcaggcttcccatccttcc

SEQ ID NO: 44202 - DNA, 50 bp, homo sapien
attgaaaggaaaggatagacctctawgaatgattaatcaaaaaatgtaaa

SEQ ID NO: 44203 - DNA, 50 bp, homo sapien
cttgtaatcaatatcagcaacttcaratgaaaataatgtgagcctttttc

SEQ ID NO: 44204 - DNA, 50 bp, homo sapien
aaaaatacatctctactttatggaakaatacaacagacatgaattactta

SEQ ID NO: 44205 - DNA, 50 bp, homo sapien
tctttggagagcagaaaaatatcctmaaaacatgcttactaactataact

SEQ ID NO: 44206 - DNA, 50 bp, homo sapien
aagggaggatgggcaaggcataaagyaaacagagcaagcctggtgcctga

SEQ ID NO: 44207 - DNA, 50 bp, homo sapien
gtttgtagaacataggatactctggmaatttgagttaccagagttcttgt

SEQ ID NO: 44208 - DNA, 50 bp, homo sapien
ttcaaataattcaccattatcttgawtattttacagtgcaataaaatttt

SEQ ID NO: 44209 - DNA, 50 bp, homo sapien
gagacaaagagacataaaagcagtaraccacaagggacagatggtagagg

SEQ ID NO: 44210 - DNA, 50 bp, homo sapien
gaccaataacaaataaagagattgamgtagaaattaaaaatctctcaaca

SEQ ID NO: 44211 - DNA, 50 bp, homo sapien
gttgtaagtttatctacgaattccaraaagtaggtgtgttctttaataag

SEQ ID NO: 44212 - DNA, 50 bp, homo sapien
gccagtcaacattaagtctaaactcratcctaaagttagttatcttcacc

SEQ ID NO: 44213 - DNA, 50 bp, homo sapien
tcccctcttgcttggcatatgcgtakcttcctctgtgttgctgtatctgc

SEQ ID NO: 44214 - DNA, 50 bp, homo sapien
tgaagaatcatataacagaaggctasatatattattgcatgccccagaaa

SEQ ID NO: 44215 - DNA, 50 bp, homo sapien
cagacttcttattctataaaaccacygaatcgagaaatcattgtagtctc

SEQ ID NO: 44216 - DNA, 50 bp, homo sapien
aaaaatggaaataaaaatgcatctargagccttgaaaattagtgatattt

SEQ ID NO: 44217 - DNA, 50 bp, homo sapien
tctgagaagcttatggaactatcctyaagaataacgcaatgacattttaa

SEQ ID NO: 44218 - DNA, 50 bp, homo sapien
caaattataagacattggtcctgatragtcagtatatagcaagaaacaca

SEQ ID NO: 44219 - DNA, 50 bp, homo sapien
cttttgtgcaagtgttgttaattggycatcttatccctagggcctaacac

SEQ ID NO: 44220 - DNA, 50 bp, homo sapien
tatctctaaaatcaatcctggataaygagggatacagaacacagtgaagg

SEQ ID NO: 44221 - DNA, 50 bp, homo sapien
gagatgagatcagcctggtttgttamatttcatggccttttcttttcctc

SEQ ID NO: 44222 - DNA, 50 bp, homo sapien
ttttgttcctgtcacatggttttccraaaatagcattaaagttatatttt

SEQ ID NO: 44223 - DNA, 50 bp, homo sapien
tgagtaaagcatgctagttaataatsagctatcaactgttgggaaaatat

SEQ ID NO: 44224 - DNA, 50 bp, homo sapien
atctctaagtcattaacataataaaytaggtgttactcatatctattact

SEQ ID NO: 44225 - DNA, 50 bp, homo sapien
atcaccattgaatcttacccagaaayatcagcttttggtcctttgcctat

SEQ ID NO: 44226 - DNA, 50 bp, homo sapien
gctgagaggtttaaggcacatcaacrgaaaagggaaatggaaagaaaaat

SEQ ID NO: 44227 - DNA, 50 bp, homo sapien
aatgattttcctatttctttagaagwagtagtcatccattcaatagcagt

SEQ ID NO: 44228 - DNA, 50 bp, homo sapien
atcagattctttttaaaactctgacrctgtcaaatacatcagcttgtggt

SEQ ID NO: 44229 - DNA, 50 bp, homo sapien
attttgagcattatattttgtgagcrattttaaaatttttatactatccc

SEQ ID NO: 44230 - DNA, 50 bp, homo sapien
ttatccctggaaaatcagaatgcctsagatctttcattagtccattttga

SEQ ID NO: 44231 - DNA, 50 bp, homo sapien
tagtatgtagaacaaaaaatgtataygagagaattaatttcttatatatt

SEQ ID NO: 44232 - DNA, 50 bp, homo sapien
tgacatatatcctcaaaacaatctargaaaatatcctaaaaataaacctg

SEQ ID NO: 44233 - DNA, 50 bp, homo sapien
aaacatgaaatattggtcatcactgratctattcaagtacataatatatc

SEQ ID NO: 44234 - DNA, 50 bp, homo sapien
taatttaattctgtctccttaatgaygtagaagttgcttataggctttag

SEQ ID NO: 44235 - DNA, 50 bp, homo sapien
agagtagtgcagcttagtaagtatayattctggtcctatttagttgggtt

SEQ ID NO: 44236 - DNA, 50 bp, homo sapien
ttcaggaaattgcacctggaagcaartacacccatcttcttttcttatga

SEQ ID NO: 44237 - DNA, 50 bp, homo sapien
aatgaaagcctaattggttacaagasaggaagggactcatttccactggc

SEQ ID NO: 44238 - DNA, 50 bp, homo sapien
tttaattttatggcctattttcttakaattctcaccagtttggttgaaat

SEQ ID NO: 44239 - DNA, 50 bp, homo sapien
catccattggattatgttaacaggawtaccagttgttgcacagatgcttt

SEQ ID NO: 44240 - DNA, 50 bp, homo sapien
ttttatttttcattagaattttgtakatggagactgaagggctctcttga

SEQ ID NO: 44241 - DNA, 50 bp, homo sapien
caatttggcctattaacctaatctaktaccagtattcactgttttaatta

SEQ ID NO: 44242 - DNA, 50 bp, homo sapien
aataaaggactcattccatagtgcayatttcaaaccaaccatttaatttt

SEQ ID NO: 44243 - DNA, 50 bp, homo sapien
agatttctgctttctttaggtaacarctatatctcaaggtaaacaagctt

SEQ ID NO: 44244 - DNA, 50 bp, homo sapien
agtaatctgccaacgcacagaataaygacgtattaactaattattcttat

SEQ ID NO: 44245 - DNA, 50 bp, homo sapien
cacagtctgtttgtgaattttgacaktcatttccaataatttttggcgtt

SEQ ID NO: 44246 - DNA, 50 bp, homo sapien
atatggcaatccatatggttcttacygcaaatgccagcattgcccactgg

SEQ ID NO: 44247 - DNA, 50 bp, homo sapien
agagagacaacacacaaaattttcaytaacaacctcagcgcaggtagtcc

SEQ ID NO: 44248 - DNA, 50 bp, homo sapien
aaaatttactattcttgggtcatagmaaataatgtagaccgattttaggt

SEQ ID NO: 44249 - DNA, 50 bp, homo sapien
tcatcaatgaagggatcatataacamgcgcatatatgtgcatgcacatat

SEQ ID NO: 44250 - DNA, 50 bp, homo sapien
ccatgaaagacacaaaaatgtctacyatataaggcagtatctaagcagaa

SEQ ID NO: 44251 - DNA, 50 bp, homo sapien
aggaataaacctctcatttttgaagkataaataactgactattttatcct

SEQ ID NO: 44252 - DNA, 50 bp, homo sapien
ttgatgaccatcaccctaatctacartaacagcttatctatttagaccag

SEQ ID NO: 44253 - DNA, 50 bp, homo sapien
gaagatggaattaaagtatttgaaaktcattggatagacaatatagagag

SEQ ID NO: 44254 - DNA, 50 bp, homo sapien
catactacaacatggatgaatcttawgttgagttaaataaaataggccag

SEQ ID NO: 44255 - DNA, 50 bp, homo sapien
gcaacttaccaagcacttggaataaycagctaataacagtagctaacatt

SEQ ID NO: 44256 - DNA, 50 bp, homo sapien
atacttcacctaagatgaataatcascttaataattaccatcagagcatc

SEQ ID NO: 44257 - DNA, 50 bp, homo sapien
gttccatcacgtgggctacagaatasagaatgggattgataatactgtaa

SEQ ID NO: 44258 - DNA, 50 bp, homo sapien
gtggtgagcaggaaattggacatgargaaatatgaaggtatgaagagaag

SEQ ID NO: 44259 - DNA, 50 bp, homo sapien
ttaaacgtattggtataatatctgarcaataacttaaattacacagactg

SEQ ID NO: 44260 - DNA, 50 bp, homo sapien
tatgtggtaaagatgtgtaaataaargttgctaatattatagcagctaac

SEQ ID NO: 44261 - DNA, 50 bp, homo sapien
catcaaaccacacttctttgagaagractagcaattgtgtatggtaagag

SEQ ID NO: 44262 - DNA, 50 bp, homo sapien
tgtcatcagctctgtcttacaaatgyagttgtgaattggatggaacattt

SEQ ID NO: 44263 - DNA, 50 bp, homo sapien
aaggagaaatatgaattcgttattayagttggagactttagtaattcttt

SEQ ID NO: 44264 - DNA, 50 bp, homo sapien
gcgttgcataaatcctagagtccaarggtcctagaaccaggatgtccaag

SEQ ID NO: 44265 - DNA, 50 bp, homo sapien
caagggtaaaaaatagaaaatagtaycacatacgatcaaaattaatcaaa

SEQ ID NO: 44266 - DNA, 50 bp, homo sapien
atatgaaatcaaaacatggaaagtargacttgtgatctgatagtttaaag

SEQ ID NO: 44267 - DNA, 50 bp, homo sapien
ataattggtaaatttgcaatgaaaaygtcataaaaaggatcgtaaaaagg

SEQ ID NO: 44268 - DNA, 50 bp, homo sapien
gcagtaaacttggagttagtagaccrgagacatgctcatttatttattca

SEQ ID NO: 44269 - DNA, 50 bp, homo sapien
cttttttcctgtgaattgaaactccragtctgatcaattagctaataatt

SEQ ID NO: 44270 - DNA, 50 bp, homo sapien
atatgagccatgctgaggtgagaatraaattcacttttaaatgaacatac

SEQ ID NO: 44271 - DNA, 50 bp, homo sapien
tgatagaattatatgagtatgtaaawtcacacattctgaattcaaggagg

SEQ ID NO: 44272 - DNA, 50 bp, homo sapien
ttttttggcaaaaatgatggtcaacratgatgaatatttgagtagacaca

SEQ ID NO: 44273 - DNA, 50 bp, homo sapien
acagtcttaagtctgacagtttacarcgcttttaaattgcctcggtagaa

SEQ ID NO: 44274 - DNA, 50 bp, homo sapien
ctttaaaaggagaatgggattatgarccaagacacatatttctgcgctgt

SEQ ID NO: 44275 - DNA, 50 bp, homo sapien
aggcaaggtgaagggtgatagatgawccattctactctgtttctgacatg

SEQ ID NO: 44276 - DNA, 50 bp, homo sapien
catagtagagttgatcattaaataawgtaataacaacctagttggtgacc

SEQ ID NO: 44277 - DNA, 50 bp, homo sapien
tctggttttcgctttagtttctgtayagtatcatataatacccattaata

SEQ ID NO: 44278 - DNA, 50 bp, homo sapien
tataattaattattacccattggcawtaaatcacatatcttttttgttgt

SEQ ID NO: 44279 - DNA, 50 bp, homo sapien
agtttaagtagataataaggcctgayaagtatgtgttgagtgagtgaaag

SEQ ID NO: 44280 - DNA, 50 bp, homo sapien
tttggctacatttatattcaagtgarctaacggcactggtccaaaatttc

SEQ ID NO: 44281 - DNA, 50 bp, homo sapien
agtaaaagcttttgctcctcaaccarcttatttcaattaccatcactggt

SEQ ID NO: 44282 - DNA, 50 bp, homo sapien
gactttctttttctttctttttaacragggcaattgactatcaagagggg

SEQ ID NO: 44283 - DNA, 50 bp, homo sapien
aggttgaagccattgttataataaayagcttccaatgtttctcttaaaag

SEQ ID NO: 44284 - DNA, 50 bp, homo sapien
tggaaatgcatataatataaacatasggtcattgaaatatagccctggaa

SEQ ID NO: 44285 - DNA, 50 bp, homo sapien
atgtgaattactcaaacaccatcttkaaagggtcatgtctaaactatgtc

SEQ ID NO: 44286 - DNA, 50 bp, homo sapien
cttattttgtggtagagggataaagragacattcatagaactgttgccat

SEQ ID NO: 44287 - DNA, 50 bp, homo sapien
gcatttccatatttatactgaattcrcccacaagaatgctgtgtacactc

SEQ ID NO: 44288 - DNA, 50 bp, homo sapien
taatttatttataaccataacaaaartgaagtttactacagcaaaggttt

SEQ ID NO: 44289 - DNA, 50 bp, homo sapien
cataacttctataaatactaacaccyggcagtaaactaatgcatccatag

SEQ ID NO: 44290 - DNA, 50 bp, homo sapien
tgttctttttctaacgagtttgacawtgaatcttatgctaatgacacctg

SEQ ID NO: 44291 - DNA, 50 bp, homo sapien
tgtttctctattcttgtcatatttcmaggtttctcagtcttcaaaagaca

SEQ ID NO: 44292 - DNA, 50 bp, homo sapien
tagaagggactacaaatatgaaaaayggtaaaatatataaagctaaataa

SEQ ID NO: 44293 - DNA, 50 bp, homo sapien
tagaaaaccaggtcctttcagtaccratctaaggaagacatgaattgggg

SEQ ID NO: 44294 - DNA, 50 bp, homo sapien
taatttgtaagttttttttcattccyatgctatttgtagctaagtcaaga

SEQ ID NO: 44295 - DNA, 50 bp, homo sapien
caactgcccaggtagcaaaattctgwataaagtcaaaaatggatgctcat

SEQ ID NO: 44296 - DNA, 50 bp, homo sapien
aatacaaaacacagtaacaagtctayagaagtctgctggaattcttgctg

SEQ ID NO: 44297 - DNA, 50 bp, homo sapien
tgcagggaaacaccaatttgaatgaytaaaaatagtacataatctaaggg

SEQ ID NO: 44298 - DNA, 50 bp, homo sapien
ttaccaaatttgcaaaaatgtgagasatcttaacagaaaatagggagata

SEQ ID NO: 44299 - DNA, 50 bp, homo sapien
cttttgataatgtgtaattcagaacygtaacttttcttcttctctcttga

SEQ ID NO: 44300 - DNA, 50 bp, homo sapien
acagatatggcaagcctcagagctayggttttaatctagttatcatccaa

SEQ ID NO: 44301 - DNA, 50 bp, homo sapien
agaagaacctattaaattttgtcaawtaagaaacttgaggtttatcttaa

SEQ ID NO: 44302 - DNA, 50 bp, homo sapien
aatttggtatacaacaactctttaawcatttatcagatctatactatttt

SEQ ID NO: 44303 - DNA, 50 bp, homo sapien
aaatttttaagcctcatgtccatagmaattgagcgaaattaaactcatga

SEQ ID NO: 44304 - DNA, 50 bp, homo sapien
actgctcatggttacagaaagtgtcrcgtaaaaatagatggaaattatct

SEQ ID NO: 44305 - DNA, 50 bp, homo sapien
cccaaattagtatggtaacaaagcckgagcattttgcattacacaaggct

SEQ ID NO: 44306 - DNA, 50 bp, homo sapien
acagagtatttatgaggatgacaaarggatttgttttaagtcactaaagc

SEQ ID NO: 44307 - DNA, 50 bp, homo sapien
caattggcttctattttttttcttcyctaatgactcagccaatctgttta

SEQ ID NO: 44308 - DNA, 50 bp, homo sapien
taactcccataatctttaatgaagayccttgactttgctacttgtgggaa

SEQ ID NO: 44309 - DNA, 50 bp, homo sapien
tatatatttaaatttcctcttaagcygcaggaaaaatcagaatcagaaag

SEQ ID NO: 44310 - DNA, 50 bp, homo sapien
catattagcatgaaaaaattcttagsatcaaggaggcttttgttttaatt

SEQ ID NO: 44311 - DNA, 50 bp, homo sapien
ctgcaggaaaaatcagaatcagaaartagcaagttacagtgaatgactta

SEQ ID NO: 44312 - DNA, 50 bp, homo sapien
ttggaaaaaagccttagcaacctackctcaagtctcaagtacacatctaa

SEQ ID NO: 44313 - DNA, 50 bp, homo sapien
taagaattttgttcatcgaaagataycagtaacatagagaagtaaagcaa

SEQ ID NO: 44314 - DNA, 50 bp, homo sapien
tattgtcccagaatacccttccagamtaaattaacatttacaaacaaatg

SEQ ID NO: 44315 - DNA, 50 bp, homo sapien
attttatataataatgcttttgggargtagagttattggtgtatgttcgt

SEQ ID NO: 44316 - DNA, 50 bp, homo sapien
aagttactatgcatgtaggtttttcyctatagctgaaaatatcttttaaa

SEQ ID NO: 44317 - DNA, 50 bp, homo sapien
aaaaatttatctttactaggtttacmgaatctttacataggcaaatcttt

SEQ ID NO: 44318 - DNA, 50 bp, homo sapien
gtttattttatgcattgtttattggyaatttcctgttaatcacgcttttt

SEQ ID NO: 44319 - DNA, 50 bp, homo sapien
aaaaaaggtgctgatagattagaagsataggtactgtaaaatataatcca

SEQ ID NO: 44320 - DNA, 50 bp, homo sapien
taatattagtttagtatatatatgaktatgaaccacttagtttaaggtga

SEQ ID NO: 44321 - DNA, 50 bp, homo sapien
tgctctgtgaatatcttgaaacacastaaggaggatgatcatttctggtc

SEQ ID NO: 44322 - DNA, 50 bp, homo sapien
tgtgagagaaggcaaagagtttttaygtagtcactgaagctcacaaggca

SEQ ID NO: 44323 - DNA, 50 bp, homo sapien
acaatccccttgagacattgcatgakaatattgcagttttccatttggca

SEQ ID NO: 44324 - DNA, 50 bp, homo sapien
caaagagaagttctgtcatgcgtcayggaaaattaaagcacagtaataaa

SEQ ID NO: 44325 - DNA, 50 bp, homo sapien
tttccttaaatacacttagaaaagayggaaaactgtgttataagggagga

SEQ ID NO: 44326 - DNA, 50 bp, homo sapien
atcccagagaagcagaaggactttcyctaatgttgtctaaattttctgct

SEQ ID NO: 44327 - DNA, 50 bp, homo sapien
ttatataactcatgtttccctagacmatatgtagtaaatatacacattaa

SEQ ID NO: 44328 - DNA, 50 bp, homo sapien
ctatgatgtgataacacatttagaarttacgataaccattgtgaattatt

SEQ ID NO: 44329 - DNA, 50 bp, homo sapien
ccctattttctttggttaacaggaartctccttggggcagagcttaactt

SEQ ID NO: 44330 - DNA, 50 bp, homo sapien
ctttaaaaaatgaaagctaagctagracagtctaaagctgcctttgtcag

SEQ ID NO: 44331 - DNA, 50 bp, homo sapien
cttaaaaccactgatatctggatccsattctcagagattctgattttatt

SEQ ID NO: 44332 - DNA, 50 bp, homo sapien
aaatccattgtgatcaagagtaaggycaattttattagagtccatttaga

SEQ ID NO: 44333 - DNA, 50 bp, homo sapien
tggtggtttttcttgcaagctgtccyatggtgaattggatcaatccctca

SEQ ID NO: 44334 - DNA, 50 bp, homo sapien
ttaagctctttttcctgactatagcyaataccatttatttgacatcaaca

SEQ ID NO: 44335 - DNA, 50 bp, homo sapien
ctctcagctatctagtagtgggagarattcatacccctgacggtcagtat

SEQ ID NO: 44336 - DNA, 50 bp, homo sapien
aagaattcactagcttacttgaaaarcagttacagtagatcctttgttca

SEQ ID NO: 44337 - DNA, 50 bp, homo sapien
tgagcttcatttatatggctgcatasgactatagagtcaaaagacaaagc

SEQ ID NO: 44338 - DNA, 50 bp, homo sapien
agaaaagggcccactataccttggaragctcagtaataagaatcaacttt

SEQ ID NO: 44339 - DNA, 50 bp, homo sapien
ctagaatgatgatacaaattgtacaraaaggaatgagacaaaaaagtttt

SEQ ID NO: 44340 - DNA, 50 bp, homo sapien
gtctcaaatgactttagcctctgcartaagttaatgttactttaaattgt

SEQ ID NO: 44341 - DNA, 50 bp, homo sapien
taaaatacagaagtatcacacccaayctagggaatcatatttaaaggcag

SEQ ID NO: 44342 - DNA, 50 bp, homo sapien
cttagcaatatcatctcagcaaataygaagaatttcaaaaagttcatgga

SEQ ID NO: 44343 - DNA, 50 bp, homo sapien
agaattcaccagaatgtccctaagtmaaggtctccagaaaaaagtttcct

SEQ ID NO: 44344 - DNA, 50 bp, homo sapien
ttatctacttctatgctataccctayctttatctttcaagtttttttctt

SEQ ID NO: 44345 - DNA, 50 bp, homo sapien
aacaaattcctaggggacagtaacaraattgaaatatgtagaagaaagac

SEQ ID NO: 44346 - DNA, 50 bp, homo sapien
taaaaggtcacagactgcctcagagwattggagacttgcagagctaaaac

SEQ ID NO: 44347 - DNA, 50 bp, homo sapien
acccataatttcaggattaaattackctctgctcctctctagaggctgaa

SEQ ID NO: 44348 - DNA, 50 bp, homo sapien
ttcaactctgtccttggttgtgaaakaaatcatagactatgggtaaatga

SEQ ID NO: 44349 - DNA, 50 bp, homo sapien
gtgaactaacctgctctgaggcaaasagaccttatggttcacttacaatg

SEQ ID NO: 44350 - DNA, 50 bp, homo sapien
caacattctaattccgtttcttatamcctactgtcatgaggaaacagatc

SEQ ID NO: 44351 - DNA, 50 bp, homo sapien
tcaacttctaaatctgctgcaaatcrcatataagagaaataccaaaagct

SEQ ID NO: 44352 - DNA, 50 bp, homo sapien
aatctttaaagaaagaatcatgaacsacatatctttgtgtggagtttcac

SEQ ID NO: 44353 - DNA, 50 bp, homo sapien
gctttttttttctttagttgacataygcattgacactctggctgcttgtg

SEQ ID NO: 44354 - DNA, 50 bp, homo sapien
ctctatgagtatctgagactttaacwctgcattattgaatagttaaaact

SEQ ID NO: 44355 - DNA, 50 bp, homo sapien
agttagcaacattgagcaatgaccarcctaactgtgtaactaaaaggata

SEQ ID NO: 44356 - DNA, 50 bp, homo sapien
tgaaaatcacattggcattgctcggwaacatatattagtgaatggtaaat

SEQ ID NO: 44357 - DNA, 50 bp, homo sapien
taactgctgtaatgtacagtctggcrcaagaaatacgtagtgaacattta

SEQ ID NO: 44358 - DNA, 32 bp, homo sapien
gaaattaatttgtttamaaggttgaatagctt

SEQ ID NO: 44359 - DNA, 50 bp, homo sapien
tcatgaaaagtgttgagtagtacaargagttggactttgaggaaggaaat

SEQ ID NO: 44360 - DNA, 50 bp, homo sapien
gagtctttggtatgattagctaataygatactgcaggtctcttaaatatt

SEQ ID NO: 44361 - DNA, 50 bp, homo sapien
taaaacagaccacaggtgtacacaasaaaccaaactcataatacaatata

SEQ ID NO: 44362 - DNA, 50 bp, homo sapien
agcaaaaaaaatacacaattgtgcargatttttcatagatagtatgtgta

SEQ ID NO: 44363 - DNA, 50 bp, homo sapien
atacagcttgaagagtaaacagtgaratcactaaagggatgtgaaaagat

SEQ ID NO: 44364 - DNA, 50 bp, homo sapien
cttggtggcggaaagattttaaagcyctagaatacaggaattggagtcgt

SEQ ID NO: 44365 - DNA, 50 bp, homo sapien
acaaattctgcagtgtcttcctgtamgaatctgtaaaaatcctcatcagc

SEQ ID NO: 44366 - DNA, 50 bp, homo sapien
ttcccctcctttttgtccaggatgargaccccgattttgagagaaggtga

SEQ ID NO: 44367 - DNA, 50 bp, homo sapien
tactctttctcttaactgtgtaaaaygtgtagttcatagtgggcaatcag

SEQ ID NO: 44368 - DNA, 50 bp, homo sapien
accatcactcatccttgcatggctaygaaatgtttaatcctgattctaat

SEQ ID NO: 44369 - DNA, 50 bp, homo sapien
aaatcacagcaccgaaagtatcaaamtaggactcttaaaaagtaataaag

SEQ ID NO: 44370 - DNA, 50 bp, homo sapien
ctcagtgaaacatttgatcacttgtwaaaataccctcagaataccttgaa

SEQ ID NO: 44371 - DNA, 50 bp, homo sapien
gaataacttttggatctcttcatgaygtatctagaataagtgtgacatat

SEQ ID NO: 44372 - DNA, 50 bp, homo sapien
gacatctccatgaagatgctaagtargcctctaggtgtataagtctagag

SEQ ID NO: 44373 - DNA, 50 bp, homo sapien
tttgattagagataaaagtgacctawcagatgaaaagatggtgtctttac

SEQ ID NO: 44374 - DNA, 50 bp, homo sapien
agcagtacattcagattgaggagtcrcttagcatgtaggtgatgatataa

SEQ ID NO: 44375 - DNA, 50 bp, homo sapien
tcaatttcactaggtcataaattaartatcctacccagtgtcagttaatg

SEQ ID NO: 44376 - DNA, 50 bp, homo sapien
gaaactactgtagtattccacatcaragctattaacacatgtttttgggt

SEQ ID NO: 44377 - DNA, 50 bp, homo sapien
tcagaaccttttttgcacaaagagarcgatgaaacataaagaggttagtg

SEQ ID NO: 44378 - DNA, 50 bp, homo sapien
aatattgagagcttttaagaaacaaygatatgacttcttaccaactccaa

SEQ ID NO: 44379 - DNA, 50 bp, homo sapien
ggtgaggcactagaatatctacaggrccgtaactacagctgagggagaga

SEQ ID NO: 44380 - DNA, 50 bp, homo sapien
tctttcacagtccttatgtgtcttawatatcattatggtatttattttgt

SEQ ID NO: 44381 - DNA, 50 bp, homo sapien
cctaaagaaagcttattcctactatracttacaactagggtagcttctcc

SEQ ID NO: 44382 - DNA, 50 bp, homo sapien
attcaggttcaaatactgattaaccrcaggctctgggcaaagcaaataga

SEQ ID NO: 44383 - DNA, 50 bp, homo sapien
ctaaagatgaagaagacaaaggaaayggtggacacaggacagggaaccac

SEQ ID NO: 44384 - DNA, 50 bp, homo sapien
ggcaatgtgtgcttttctgcataaayaaagagggttttctatggcttaga

SEQ ID NO: 44385 - DNA, 50 bp, homo sapien
aatacaataagctttagaaattcaamacactaaagtagaagggctgtata

SEQ ID NO: 44386 - DNA, 50 bp, homo sapien
cccattgttcctatactaggtactaytaacatcactggaagaaatcagtg

SEQ ID NO: 44387 - DNA, 50 bp, homo sapien
aatctccaacctttcatcttaaaacmgttctcatcatgaagaaatgggca

SEQ ID NO: 44388 - DNA, 50 bp, homo sapien
cattgcacttgagaataattaaaatsaatggaaagtatgagtctggattt

SEQ ID NO: 44389 - DNA, 50 bp, homo sapien
tagcttaaatattcttcataaataayccttagtaacaatttccaaaacaa

SEQ ID NO: 44390 - DNA, 50 bp, homo sapien
tgtagctagcacttcacttttgttaygaaatggtttaaatcagtggtccc

SEQ ID NO: 44391 - DNA, 50 bp, homo sapien
tttgtgaaaatatctggaatatcacyaacttggaaaaattctaaagaatt

SEQ ID NO: 44392 - DNA, 50 bp, homo sapien
tgtttctaccaacttgtttcttcctyagaatttttccatgtgttgtcctg

SEQ ID NO: 44393 - DNA, 50 bp, homo sapien
ttcatttatatcaaggaggacctaasagttttgttctctcggagatcaaa

SEQ ID NO: 44394 - DNA, 50 bp, homo sapien
accaatggaaatgttagttcagacayccaaaagtatataaaatatctgat

SEQ ID NO: 44395 - DNA, 50 bp, homo sapien
ggagatcagaatttttggcaggagayaccaattgataaactctgtaatag

SEQ ID NO: 44396 - DNA, 50 bp, homo sapien
tcactaacttctctataaaacattgracttaaccatactttcagtaccta

SEQ ID NO: 44397 - DNA, 50 bp, homo sapien
gaatccaccttgcaactatctgctaygtctttgtggtggaagcttagttt

SEQ ID NO: 44398 - DNA, 50 bp, homo sapien
aggcatgagctaccacatccggcctraaataattactgtaaaccacagtg

SEQ ID NO: 44399 - DNA, 50 bp, homo sapien
actaaaagtctcaggcaataggacaratgagtgtcatcatttttattgtg

SEQ ID NO: 44400 - DNA, 50 bp, homo sapien
cctatccctcatctgcaagacataamcttcttatgagagagctgcttggt

SEQ ID NO: 44401 - DNA, 50 bp, homo sapien
agtatccaactttataacttgagtcraaattactcagcccaactatgatg

SEQ ID NO: 44402 - DNA, 50 bp, homo sapien
tttggccaaatttttcaacaagcaaracgagctagtataaatcagaggtg

SEQ ID NO: 44403 - DNA, 50 bp, homo sapien
gcaaaaacagcctaatagacctacarctgggcaggttacactttatctag

SEQ ID NO: 44404 - DNA, 50 bp, homo sapien
agtggccagactttgatgccaacgarggaaagaacaagataaaagcttcc

SEQ ID NO: 44405 - DNA, 50 bp, homo sapien
ggtattttaaatagtactgagtttcrattgagatatattttaaaacttga

SEQ ID NO: 44406 - DNA, 50 bp, homo sapien
ccacggccagttatcaatgtcgaaayttgattaaaacttagcaggcaagt

SEQ ID NO: 44407 - DNA, 50 bp, homo sapien
aatttgatttagaaaaattgctatayagtcctaactccattatcactaat

SEQ ID NO: 44408 - DNA, 50 bp, homo sapien
ggtgctgtgcagtttcgattttctayatattagcatctctgtggaacatt

SEQ ID NO: 44409 - DNA, 50 bp, homo sapien
gacaaagacagagacacagagagaawtactattttatgaagagttatcta

SEQ ID NO: 44410 - DNA, 50 bp, homo sapien
acttctatatgcctcagaatcactcrcagggcttgttagaatatgttagc

SEQ ID NO: 44411 - DNA, 50 bp, homo sapien
ttaaaaatcagtggcaataaaagagracctataactaccagtagatattc

SEQ ID NO: 44412 - DNA, 50 bp, homo sapien
ttctaatctatttatattttggtaamatgctggttgtgactcaccaaact

SEQ ID NO: 44413 - DNA, 50 bp, homo sapien
accaactgtaacaactgcaatattaycaaatgtaaagtttctctgaaaat

SEQ ID NO: 44414 - DNA, 50 bp, homo sapien
aaggtaacaagtatttcagggtaacratggatgatgaagaagtaggaaag

SEQ ID NO: 44415 - DNA, 50 bp, homo sapien
tctgcaaaattctatccacatccaargtgtctctgagaagtcgaggccct

SEQ ID NO: 44416 - DNA, 50 bp, homo sapien
attattttcttcaacttgaaatagamacatgtgaggacataaagtagaaa

SEQ ID NO: 44417 - DNA, 50 bp, homo sapien
actggtttaattcatctgcctggaartcctctttaatagcagctctacat

SEQ ID NO: 44418 - DNA, 50 bp, homo sapien
caggctcgcagggtctattatattcraagttgggaagttcttatgtttta

SEQ ID NO: 44419 - DNA, 50 bp, homo sapien
acaggttttttatggatttatgaaayttaatggacacacacacatcaata

SEQ ID NO: 44420 - DNA, 50 bp, homo sapien
caccaaattccacctttatatgaaayacttgatagtgaccactcaaagtt

SEQ ID NO: 44421 - DNA, 50 bp, homo sapien
cagtgaggtttccatagtattaaaaktaacatgttagaaaagaaaaaaaa

SEQ ID NO: 44422 - DNA, 50 bp, homo sapien
ttagactgaatgctcctttagcaaayaagacttttagttcttttaggtcg

SEQ ID NO: 44423 - DNA, 50 bp, homo sapien
ccaatttatttttctattttaaaacyctctaagtacatgatttctagcat

SEQ ID NO: 44424 - DNA, 50 bp, homo sapien
aaagtgaaagccttatccaagtcacrggaattttaaaacaaaagtagagt

SEQ ID NO: 44425 - DNA, 50 bp, homo sapien
tgactacactaatgtactatgcacaracataaactttcaaaaggaggagc

SEQ ID NO: 44426 - DNA, 50 bp, homo sapien
catttagggcttttcatttagctaasagtaaaagccaatgttcttccaaa

SEQ ID NO: 44427 - DNA, 50 bp, homo sapien
ttgtttgctttaattaaagatgcagrcattaatcaaacatttccatatga

SEQ ID NO: 44428 - DNA, 50 bp, homo sapien
gcccccaggtcacagatctggataaraggaccaaaagtaaaacaagacag

SEQ ID NO: 44429 - DNA, 50 bp, homo sapien
gatgaggattgaaaactgccctttgratttagtgatatggaagtcgatgg

SEQ ID NO: 44430 - DNA, 50 bp, homo sapien
tgaaaaatcattaaatatactaaacrgttactcaagtgaaaaattcttta

SEQ ID NO: 44431 - DNA, 50 bp, homo sapien
atacgatcctgatctgaaccaaataratgtgagaaatgttcatcaaaaca

SEQ ID NO: 44432 - DNA, 50 bp, homo sapien
ggttttatgtatgacaatgtattcaygaagcagtagaaaatccatcttgg

SEQ ID NO: 44433 - DNA, 50 bp, homo sapien
aataatgcatagaatttcatgtggtraaacaaactatttatttgctgttt

SEQ ID NO: 44434 - DNA, 50 bp, homo sapien
cactctcatgtttaaagttaacccayattggttgtactctggagtttctc

SEQ ID NO: 44435 - DNA, 50 bp, homo sapien
ttcattttgttggctagaagtgttasaagggaaatttggttccagttgtt

SEQ ID NO: 44436 - DNA, 50 bp, homo sapien
agttggagtgtaaagttgtcctaagwattggggagcctgctttctaaaag

SEQ ID NO: 44437 - DNA, 50 bp, homo sapien
agatcaaagagtcatgaaaaaagaargagttggagtgtaaagttgtccta

SEQ ID NO: 44438 - DNA, 50 bp, homo sapien
ctctgctttacttctatatctctcakgtagttttagtctcataagtttaa

SEQ ID NO: 44439 - DNA, 50 bp, homo sapien
aaggatcctagacaatatttcacctmaacagagacttgcattaagtaaag

SEQ ID NO: 44440 - DNA, 50 bp, homo sapien
tgcctcaatgctctgcatcccaggarctgttaaactctctcttacttcca

SEQ ID NO: 44441 - DNA, 50 bp, homo sapien
tttcctgatgattagatatagaatcragaagttcatttggatgtaaaaga

SEQ ID NO: 44442 - DNA, 50 bp, homo sapien
agattagagaccactctctgatttgraagggcctattttccaagagatta

SEQ ID NO: 44443 - DNA, 50 bp, homo sapien
cttcaccaaagaaataatggctgcaygaagctgaaatgagaaaaaaataa

SEQ ID NO: 44444 - DNA, 50 bp, homo sapien
gcctttttctttgctaaagattttayacgctaatttgcataaagtgcagc

SEQ ID NO: 44445 - DNA, 50 bp, homo sapien
gtgctggagaaaatgtttagagctayggaggattagtacggatatctttc

SEQ ID NO: 44446 - DNA, 50 bp, homo sapien
atttaacagagaacagttcatagtaycacacatagaataggccactatta

SEQ ID NO: 44447 - DNA, 50 bp, homo sapien
ttttctatgtggctgatatccttcargaagaaagatctttcttactatgt

SEQ ID NO: 44448 - DNA, 50 bp, homo sapien
atgtttgttatgtttctctctcacawccttagatatctccatttgaaaag

SEQ ID NO: 44449 - DNA, 50 bp, homo sapien
accatgtagtaatgaaaaaatatgakgaaattgattaaaattatgttgat

SEQ ID NO: 44450 - DNA, 50 bp, homo sapien
tgtctgagatactgcaggaattaaakaactggtttttctattatgacaat

SEQ ID NO: 44451 - DNA, 50 bp, homo sapien
ttctattatgacaattagaagaaagrcattaagtttgcatttagaagtac

SEQ ID NO: 44452 - DNA, 50 bp, homo sapien
gcctctacccctgcacaaaagagtakgagaattttgaactcaaacataaa

SEQ ID NO: 44453 - DNA, 50 bp, homo sapien
ccaatagcacaagagaagatcacgaygtttccaagtcaatgggcatatca

SEQ ID NO: 44454 - DNA, 50 bp, homo sapien
tgacgtgctggtgctgacaggttccmatgtaaactggacagacgaaattt

SEQ ID NO: 44455 - DNA, 50 bp, homo sapien
tgtacaggaagcaccattctcccgaktattcagtacttaactttattgct

SEQ ID NO: 44456 - DNA, 50 bp, homo sapien
acccctgcctccttctaaacactaayggtaattcatacaacacagagaac

SEQ ID NO: 44457 - DNA, 50 bp, homo sapien
agtgttgtgccaaactggttagtaaytattttgaatatcatacatggttg

SEQ ID NO: 44458 - DNA, 50 bp, homo sapien
tgcaacaaaaatgcagagaggaaaastgacatggcatacaaaagagacag

SEQ ID NO: 44459 - DNA, 50 bp, homo sapien
caattcctatctttccttcaagaacsaggtaaaattaatctgctccaaat

SEQ ID NO: 44460 - DNA, 50 bp, homo sapien
gcctattgctatgcattttgtcaatsagcatagtactgaaatagcctaat

SEQ ID NO: 44461 - DNA, 50 bp, homo sapien
catcaataagtaatttttacttactragagatggggaaagactaattcag

SEQ ID NO: 44462 - DNA, 50 bp, homo sapien
ttagttgagtctaatggtaggtacamaagactggaatggcaagatacaag

SEQ ID NO: 44463 - DNA, 50 bp, homo sapien
ttttttaacactatggttaatatcascttcttttctgagagcaggtgttg

SEQ ID NO: 44464 - DNA, 50 bp, homo sapien
ggctccatacacacaggttactcaamtattagatcctaattcatttcaac

SEQ ID NO: 44465 - DNA, 50 bp, homo sapien
tttgttcttcaaatgccttttaacaytcaaatattgttcttacctaattt

SEQ ID NO: 44466 - DNA, 50 bp, homo sapien
tatctggattaggaaaaagaataaartaagcaaagaaatgaactctggat

SEQ ID NO: 44467 - DNA, 50 bp, homo sapien
atctacttacagaatattttcattaycctaaaaagaaagctcagacacat

SEQ ID NO: 44468 - DNA, 50 bp, homo sapien
tagccaattaaagtgtatgctcttgyaaatatcatggttttggtttttgc

SEQ ID NO: 44469 - DNA, 50 bp, homo sapien
aaaacttttgaagcatatcatgcaayggttgttagtattcacagacttgt

SEQ ID NO: 44470 - DNA, 50 bp, homo sapien
tgaatttttaccatgttttctctatragtgtggtttgcagaattcctgtt

SEQ ID NO: 44471 - DNA, 50 bp, homo sapien
agtgaaagacttgtactgaaaactamgaaacatgatgaaagaaattttaa

SEQ ID NO: 44472 - DNA, 50 bp, homo sapien
tctccttagtaacaaatttggtaaaragtctataaagtgcttctgatgta

SEQ ID NO: 44473 - DNA, 50 bp, homo sapien
gaaaactcccctcaaaaatagcttayggtactatgacttaaaatttcagg

SEQ ID NO: 44474 - DNA, 50 bp, homo sapien
atgtgtatacgtacacttggaaagawctgtgctataactacagcatgagg

SEQ ID NO: 44475 - DNA, 50 bp, homo sapien
ccattatgttaggcaaatgggataaygaaaaatgttaatatactatctat

SEQ ID NO: 44476 - DNA, 50 bp, homo sapien
ataagagaactggcattaagtgctargaagtatgagtcagaaacaatcat

SEQ ID NO: 44477 - DNA, 50 bp, homo sapien
attctcttttctgctgaatatgtgayccttagtgttcatagaagttgctg

SEQ ID NO: 44478 - DNA, 50 bp, homo sapien
ataaactccatgtgcaaacttacaayagagaattaaaggtctcctcaaag

SEQ ID NO: 44479 - DNA, 50 bp, homo sapien
gatttgtactttgtataaagcagagrcaatgcagcattcgcttatcccta

SEQ ID NO: 44480 - DNA, 50 bp, homo sapien
gtgtgatcagcttcacaagagaaaartacatgagtaagggtctcatatac

SEQ ID NO: 44481 - DNA, 50 bp, homo sapien
taataaataaaaacaatacaatgagratggtgacactaagattatcgtaa

SEQ ID NO: 44482 - DNA, 50 bp, homo sapien
acttagtgcacagctgataccaaaayttccttggaccagtacctccagcg

SEQ ID NO: 44483 - DNA, 50 bp, homo sapien
ttaagagaaatttgattgatctcagwaatataatactttttttgtttaat

SEQ ID NO: 44484 - DNA, 50 bp, homo sapien
acactcatctgttctatgccctccaytctcaagcccatgttctgtatcta

SEQ ID NO: 44485 - DNA, 50 bp, homo sapien
ctacaggtgagcaaacatccagtcartatatgaagtatctactcttttgc

SEQ ID NO: 44486 - DNA, 50 bp, homo sapien
aaggaatggtacaaactagaaatagragaatacagtggtatgttgaagca

SEQ ID NO: 44487 - DNA, 50 bp, homo sapien
cttagatgtcccgctccctcaagtcratgtcaaacccagtgaaacaacag

SEQ ID NO: 44488 - DNA, 50 bp, homo sapien
ccaaagcttgttaaccagcaatgggyatagcactgatttttaagtgaaat

SEQ ID NO: 44489 - DNA, 50 bp, homo sapien
ggagattaactctttaatttattccrcaaagctgtattaaatagctatta

SEQ ID NO: 44490 - DNA, 50 bp, homo sapien
ccaagtatctttgggcaatagcagasagttttgaatgactgaactcaacc

SEQ ID NO: 44491 - DNA, 50 bp, homo sapien
caaagagtagagtacgacaatgagcsaaaaatacaactttatagcaatga

SEQ ID NO: 44492 - DNA, 50 bp, homo sapien
gacacaattgacacacaatcaactgyagatatttgaagtgtacaatttga

SEQ ID NO: 44493 - DNA, 50 bp, homo sapien
ataaatcaataatacactagtaccartaagaaaaatataagtccattgta

SEQ ID NO: 44494 - DNA, 50 bp, homo sapien
agtagtttacacctttatatacaccratttattatagtttgcagatttgg

SEQ ID NO: 44495 - DNA, 50 bp, homo sapien
gaggtaaaaattcagaaaaaaagcartatgtaaactaattaggagtctga

SEQ ID NO: 44496 - DNA, 50 bp, homo sapien
ttgtagacagtatagtcatgaaacaragacaaactttcgtatttaatggc

SEQ ID NO: 44497 - DNA, 32 bp, homo sapien
ctattgggtctttgtawggacaaatgtggtcc

SEQ ID NO: 44498 - DNA, 50 bp, homo sapien
attagatagcaactctctggcttaartgatgaaaatactgagatatacat

SEQ ID NO: 44499 - DNA, 50 bp, homo sapien
tggaggcctgcccagggtgcataackgttaatgctttctagagtagtgcg

SEQ ID NO: 44500 - DNA, 50 bp, homo sapien
caccactggtagaagatggagcacaygcccggtccaaggtagcagtccaa

SEQ ID NO: 44501 - DNA, 50 bp, homo sapien
gttgaactggaattaggattagaatmaaaaattaagcatatacaaaatgc

SEQ ID NO: 44502 - DNA, 50 bp, homo sapien
ccttccttttgcctaaagaaaagtaygaagaactcaagtttgaataaagc

SEQ ID NO: 44503 - DNA, 50 bp, homo sapien
tacctgccaacaagaggctctgtaasaacaatgtcagggtagccaggcct

SEQ ID NO: 44504 - DNA, 50 bp, homo sapien
tcccattctaatcttaaactcagtcrcttgcttcaccaggaccaaggcag

SEQ ID NO: 44505 - DNA, 50 bp, homo sapien
catccagggaggaagcaatgataagrctctaggaggtggcattcacctct

SEQ ID NO: 44506 - DNA, 50 bp, homo sapien
ctgtaaccctataatactgtaaccckgacactagttgggctgcctattct

SEQ ID NO: 44507 - DNA, 50 bp, homo sapien
tagtaaattttcccacataacaagasaaaaaagcctgtaaatggcaaaaa

SEQ ID NO: 44508 - DNA, 50 bp, homo sapien
caatggctggcctctagtcactaagraaagtctaagtatcttctgttcat

SEQ ID NO: 44509 - DNA, 50 bp, homo sapien
atagctttagctctactaatagttaycttaatccaatcaactttggcagg

SEQ ID NO: 44510 - DNA, 50 bp, homo sapien
tatgcatattgttagataaaacataraagtaagttacagccagcagtcag

SEQ ID NO: 44511 - DNA, 50 bp, homo sapien
agtcgtatggaatacttattgtgcgwcaattgctgtaaaaagtgcttgta

SEQ ID NO: 44512 - DNA, 50 bp, homo sapien
aaaagatcatcaaatatttgaagaaragcaactaaatgaaaggaggacca

SEQ ID NO: 44513 - DNA, 50 bp, homo sapien
gaaaaagattcatttgctattcttamacttagaaacttctgggtcaagag

SEQ ID NO: 44514 - DNA, 50 bp, homo sapien
cttctttctaaagactgctgccagamtctatgaaactcaaagtgagaaat

SEQ ID NO: 44515 - DNA, 50 bp, homo sapien
tgttatttgaatattaattctaagayggttactttaatcaaaaacagcag

SEQ ID NO: 44516 - DNA, 50 bp, homo sapien
ttcaattgatagaggaattgggaacygatcctatgtaaatatacaaaata

SEQ ID NO: 44517 - DNA, 50 bp, homo sapien
tacgtaatttaagcaaacaaacagartaagatgggttttcttcatagtca

SEQ ID NO: 44518 - DNA, 50 bp, homo sapien
agcagctggaaaagaaaccataaaaygagtgattacaatcagcaaagtgt

SEQ ID NO: 44519 - DNA, 50 bp, homo sapien
attgttgattaactcatttctaaaawctatggcaatctttattttatgat

SEQ ID NO: 44520 - DNA, 50 bp, homo sapien
gagaatagtatccattctcaaatacractgtccaattatcactcaaatgt

SEQ ID NO: 44521 - DNA, 50 bp, homo sapien
agtaagtcacgttagagtaaaaataygttcactgcaaaataaaatatatg

SEQ ID NO: 44522 - DNA, 50 bp, homo sapien
aactaatggatgtaagaaaaagtggyatttgaactgttaaggaagagatg

SEQ ID NO: 44523 - DNA, 50 bp, homo sapien
agctttgtgcaaaagctcaaaattgwacctcctaatttgtttgcataccc

SEQ ID NO: 44524 - DNA, 50 bp, homo sapien
ctttcttgaaaacaatcaccaatgaracaagtcctaattttaatatgaca

SEQ ID NO: 44525 - DNA, 50 bp, homo sapien
aacccagattccagcaggacgggcckcaaagtctcgttacaagatgaagt

SEQ ID NO: 44526 - DNA, 50 bp, homo sapien
ttgctgaatgattctaaacatattarcaatttacatcacattctgactca

SEQ ID NO: 44527 - DNA, 50 bp, homo sapien
gttaggggagaaaatatctaacatcscaatttgttcatttcttaaagttt

SEQ ID NO: 44528 - DNA, 50 bp, homo sapien
gggagaggtttggctctagatggaasgattttcattgactagaacaagat

SEQ ID NO: 44529 - DNA, 50 bp, homo sapien
gacattgtcgaggccctttttatagwctaattaacatgccagaaatttca

SEQ ID NO: 44530 - DNA, 50 bp, homo sapien
caattaattagcacaattctatggaytattgcttgctccttttttatcct

SEQ ID NO: 44531 - DNA, 50 bp, homo sapien
tattcttattagcttatcttttaaakaatgactggtaatgttttcttctc

SEQ ID NO: 44532 - DNA, 50 bp, homo sapien
gaactcccttttcacttttcacaaaygctgagtgacctcaaccacttcta

SEQ ID NO: 44533 - DNA, 50 bp, homo sapien
aatattatcctgttaaatcttattasctagacctgagttatttcacacaa

SEQ ID NO: 44534 - DNA, 50 bp, homo sapien
gatttcagtaggatgtcagtgagatmaaaaaacattctcatgtctcctcc

SEQ ID NO: 44535 - DNA, 50 bp, homo sapien
ttcctaatattcttcatcaacacatragttcttccactgcatctctctcc

SEQ ID NO: 44536 - DNA, 50 bp, homo sapien
aaaaacacgcatgagattgtcatacrgagcttgagggactccaacttatt

SEQ ID NO: 44537 - DNA, 50 bp, homo sapien
cacagctttcttacaattactttacracgtttctagaatactgatttctt

SEQ ID NO: 44538 - DNA, 50 bp, homo sapien
aagaatattaggaaagcaagttgaamacttcaggaagaagaatgaaaatc

SEQ ID NO: 44539 - DNA, 50 bp, homo sapien
ggctcacacagctttttcctcatccrattttagctgatctcacttcatag

SEQ ID NO: 44540 - DNA, 50 bp, homo sapien
aatgaatttttctctatgccaaatawcttgggaaattgattctcctactt

SEQ ID NO: 44541 - DNA, 50 bp, homo sapien
tcacaggctaagacttcaaacttccrcaccaagttttaatcccgttggta

SEQ ID NO: 44542 - DNA, 50 bp, homo sapien
tggaatttcttggctaagaataaaakactctaggcaatttcagtgccaac

SEQ ID NO: 44543 - DNA, 50 bp, homo sapien
tgttagaggagtgtcttcagttacartctatactctgtgcatgcagttta

SEQ ID NO: 44544 - DNA, 50 bp, homo sapien
ggaatttgccataccctggtatttgmagatagctaaaatttttctgagac

SEQ ID NO: 44545 - DNA, 50 bp, homo sapien
gtccttctaaggagtattcttctaaragaggctgacaaataaggaagtgc

SEQ ID NO: 44546 - DNA, 50 bp, homo sapien
agcgaaataagtaactaatcttctamctttaatatgctttttatgctcat

SEQ ID NO: 44547 - DNA, 50 bp, homo sapien
tttgtttctacttgaaggagaactargaaatacctcagttatgactattt

SEQ ID NO: 44548 - DNA, 50 bp, homo sapien
ttgctaataagcttaatgaacactcrctgagttggctgtacaatgaggtg

SEQ ID NO: 44549 - DNA, 50 bp, homo sapien
agataattgagaagaaaacattttarccagttattcaggtttcttggcag

SEQ ID NO: 44550 - DNA, 50 bp, homo sapien
tgctgtaaattttttaccaaaatgcragagtcattattcagcatcacaat

SEQ ID NO: 44551 - DNA, 50 bp, homo sapien
agaagtgacaacaaacaccttaatcrattattctgcattataatttcaaa

SEQ ID NO: 44552 - DNA, 50 bp, homo sapien
aatagcaagttatttaacttgggtakgatgtttgtgacaattcagaaacc

SEQ ID NO: 44553 - DNA, 50 bp, homo sapien
acctgtcccacttcttgaagcactakactcaagcaaaagaataatcatct

SEQ ID NO: 44554 - DNA, 50 bp, homo sapien
gtttggagagcatttgctttctagastacgatgttctgaaatgtatacac

SEQ ID NO: 44555 - DNA, 50 bp, homo sapien
ttctctacttaacctgaaagccaatmattaggcatgtctgactggtgctg

SEQ ID NO: 44556 - DNA, 50 bp, homo sapien
ctaacccatccacataacttcaatayctggaatttcacaaatgaaaacct

SEQ ID NO: 44557 - DNA, 50 bp, homo sapien
tcaatacagaggttatgtagggttcraattttcacttattgctggattgt

SEQ ID NO: 44558 - DNA, 50 bp, homo sapien
aaggggcagagctgtgtttgtgactsagactccttggcttcagctgagta

SEQ ID NO: 44559 - DNA, 50 bp, homo sapien
tgatggattggaaattctagtagagwcaaaggaactaatcatcaagatac

SEQ ID NO: 44560 - DNA, 50 bp, homo sapien
gtaagaaaaaattgcttgaaattgcyctattatttatatgcagatgattt

SEQ ID NO: 44561 - DNA, 50 bp, homo sapien
gataccaagtgcttatataaacttcrctgctttattattattgttaatgc

SEQ ID NO: 44562 - DNA, 50 bp, homo sapien
agatttcttcttgtttcaatcccaaycaatttccaatctctatgagagtt

SEQ ID NO: 44563 - DNA, 50 bp, homo sapien
taagatcaacactgatatttgcatcrcttcctgctctacctgttgtcaca

SEQ ID NO: 44564 - DNA, 50 bp, homo sapien
tgcctggcagaggaaatgttaagaaygtaaaactgcactgtattttattc

SEQ ID NO: 44565 - DNA, 50 bp, homo sapien
tccagccctggatggctacaattgcyctttaatgaattttagtctttttt

SEQ ID NO: 44566 - DNA, 50 bp, homo sapien
aaaaaccttacccaggactctcataygtttactatctatctaagtgattt

SEQ ID NO: 44567 - DNA, 50 bp, homo sapien
tttactttacaattttaaaacatacrcttacaaccctgagaaagtatttt

SEQ ID NO: 44568 - DNA, 50 bp, homo sapien
atactgtaaaaaagtattactgtaargtggactggagacctgcagggtcc

SEQ ID NO: 44569 - DNA, 50 bp, homo sapien
atatgtatgagattaacttttccacracacatggattaacaccacagtga

SEQ ID NO: 44570 - DNA, 50 bp, homo sapien
agaaaaagatccagaaggatacatastaagacactaaaagtggtgacatc

SEQ ID NO: 44571 - DNA, 50 bp, homo sapien
agtgctattattgtacctatgaaaargagactagtagaattatctgcatg

SEQ ID NO: 44572 - DNA, 50 bp, homo sapien
ggtcacaagttccacttgaaacatayaaattggtgagggggtagggggca

SEQ ID NO: 44573 - DNA, 50 bp, homo sapien
gcctgtatgagtctgtacaaaattcragtataaatattaaatatgtgact

SEQ ID NO: 44574 - DNA, 50 bp, homo sapien
tttagtgacagatcgataacctgcckaaggatattgaaagagtatactac

SEQ ID NO: 44575 - DNA, 50 bp, homo sapien
cttctattatatttttggtagtcaawtaaagaggattaaaatgtgaagcc

SEQ ID NO: 44576 - DNA, 50 bp, homo sapien
atgttggatttatataaagaaaccartaacttccatggaaacttgatttg

SEQ ID NO: 44577 - DNA, 50 bp, homo sapien
attaatttcctcaaagtcttttttakgaattttatcagtggctgctattt

SEQ ID NO: 44578 - DNA, 50 bp, homo sapien
tttgtaagagataaatggatgaataygttggatttatataaagaaaccaa

SEQ ID NO: 44579 - DNA, 50 bp, homo sapien
tagaataagccaagtctgataggccrcttttattattattttttaaaatt

SEQ ID NO: 44580 - DNA, 50 bp, homo sapien
agttaggtaggtaactgaccttagaygccaggacatttcccccaaaaaag

SEQ ID NO: 44581 - DNA, 50 bp, homo sapien
gtgtctgaagtatctaacatctttakcctctgtaattggaacattgcctg

SEQ ID NO: 44582 - DNA, 50 bp, homo sapien
ggagtggaagtggtgttagggcttcraaggatgaaagattctctgaggct

SEQ ID NO: 44583 - DNA, 50 bp, homo sapien
atgttgaaaataagagagttgttaargaggtgtcctgagtgtgtgagaga

SEQ ID NO: 44584 - DNA, 50 bp, homo sapien
tataaactgttcatgtagttcactargatgcttaatttcatcttctctca

SEQ ID NO: 44585 - DNA, 50 bp, homo sapien
cgtggttaaagttcaccttgcaacgyatttgaaataggtgctttgtgttg

SEQ ID NO: 44586 - DNA, 50 bp, homo sapien
ctttatttaacaaccagattttatcycagtgttagaaaacatttgcattg

SEQ ID NO: 44587 - DNA, 50 bp, homo sapien
cagggtaagcacacaataattgtcarctcttactatcaaagttattattg

SEQ ID NO: 44588 - DNA, 50 bp, homo sapien
ttaacaagaaggaaattctttaagaygcaataatatgcatgaaccttgag

SEQ ID NO: 44589 - DNA, 50 bp, homo sapien
ttttttttttttttttgggtgaatargtagctccattatggctgtgacaa

SEQ ID NO: 44590 - DNA, 50 bp, homo sapien
taaaaatgtcttaagcatgcactaamtgttttatggtgtgctagttcttt

SEQ ID NO: 44591 - DNA, 50 bp, homo sapien
tgggcattttatgtgaatttgtccaygtgtatgaatgtcttaatttttcc

SEQ ID NO: 44592 - DNA, 50 bp, homo sapien
tatttgtggccctcttatggcttccyagtgtatagaaacctcacaaattg

SEQ ID NO: 44593 - DNA, 50 bp, homo sapien
tcattataatgatgttctcaataaamacctttagacacaaatgagcccag

SEQ ID NO: 44594 - DNA, 50 bp, homo sapien
cttatatatgtgacaaaatcctctakgcctatgatagtgtgtatagtgat

SEQ ID NO: 44595 - DNA, 50 bp, homo sapien
taaatatgcctaaattattatatcawgcacattttaaatttttcttatta

SEQ ID NO: 44596 - DNA, 50 bp, homo sapien
tgctttttttattctcattcctggcycattcagttctcttgggtttttct

SEQ ID NO: 44597 - DNA, 50 bp, homo sapien
taggtatcatcttgatacaaatacasaaaagtgcaaacagtaagttcttt

SEQ ID NO: 44598 - DNA, 50 bp, homo sapien
agtggccctaggagtaatatttgaartgtcataggaatagccaactcact

SEQ ID NO: 44599 - DNA, 50 bp, homo sapien
agccattaaagttggcttatagaagwagtactcctgaagtgaagatgaag

SEQ ID NO: 44600 - DNA, 50 bp, homo sapien
aggttaataaaacttacctatcatgwatttggtaaggttatttatcatga

SEQ ID NO: 44601 - DNA, 50 bp, homo sapien
tgcaatatacgttaaatcatttccarattacttataatacctaacacaat

SEQ ID NO: 44602 - DNA, 50 bp, homo sapien
ttggctagatctcatcatagggccasatccaatgcaagggaggctgcaaa

SEQ ID NO: 44603 - DNA, 50 bp, homo sapien
cccttaagaggttataatacttttgragaggagtaaaactttgagactac

SEQ ID NO: 44604 - DNA, 50 bp, homo sapien
agtgaaggcatatgcatagaagacaractatctaaattacatcttatctg

SEQ ID NO: 44605 - DNA, 50 bp, homo sapien
acctcatattcacctaaagataatayggcgtagtgcacagggcatgcata

SEQ ID NO: 44606 - DNA, 50 bp, homo sapien
ggaaagtatcatgctagatactgtayagaacaaaaagttcaagaaagctt

SEQ ID NO: 44607 - DNA, 50 bp, homo sapien
aattctggtgtgactaggaaataaawgttattgtgtgaagcctccaggaa

SEQ ID NO: 44608 - DNA, 50 bp, homo sapien
gtggtgtatttaatttaaccttaaamattatgtcatcctccagaagctat

SEQ ID NO: 44609 - DNA, 50 bp, homo sapien
ttacttgacatgggagaaagagtccygaatattttaaatatgattaaaat

SEQ ID NO: 44610 - DNA, 50 bp, homo sapien
aaagacagagcaatcatctggaaaaygggagctaaaaacacaagcttttg

SEQ ID NO: 44611 - DNA, 50 bp, homo sapien
agctgccttgcctttagcgattccaraaacagcaaggctagctctggatt

SEQ ID NO: 44612 - DNA, 50 bp, homo sapien
cctctataattttcatctatgacacmagctcctacatcaataaaatgttt

SEQ ID NO: 44613 - DNA, 50 bp, homo sapien
tcaacattattaaaaacactgcataygtaaaataaaatctatcttcaagc

SEQ ID NO: 44614 - DNA, 50 bp, homo sapien
cttatattgccaataaggaaatatcratgatgtggaaaagcatttgcacc

SEQ ID NO: 44615 - DNA, 50 bp, homo sapien
tgacttgtccaggtttaaatagtaastcagtcctcaggctggaaaaacaa

SEQ ID NO: 44616 - DNA, 50 bp, homo sapien
caaagggagggacattttgtaccagycatagcccgtagaaagatccttct

SEQ ID NO: 44617 - DNA, 50 bp, homo sapien
atccaagtagcaaatgagaagggaaygccttaagtcttgagaagaagctt

SEQ ID NO: 44618 - DNA, 50 bp, homo sapien
atgcttattcctgtttgggatgttgsagtaaatatttttagcaagaaagt

SEQ ID NO: 44619 - DNA, 50 bp, homo sapien
tatttcttatctcttttccatcatasagattaagtttcccaattcaaata

SEQ ID NO: 44620 - DNA, 50 bp, homo sapien
attgaaagtgagttatgtttctgaawtctcattgggaccctcacgcctgg

SEQ ID NO: 44621 - DNA, 50 bp, homo sapien
ttatattctttgagataattagagayattccagatgcagaaattgggtag

SEQ ID NO: 44622 - DNA, 50 bp, homo sapien
ggggaacaatgcctccctggcctaastgaaggagaacagagtccttcctt

SEQ ID NO: 44623 - DNA, 50 bp, homo sapien
tgtctctctccccagtagttcaggtmaatgtaattcccagctctatatat

SEQ ID NO: 44624 - DNA, 50 bp, homo sapien
tggctgccaccaataactgggattayatttttgctctttcacatttgaag

SEQ ID NO: 44625 - DNA, 50 bp, homo sapien
ctgtgaacttgctgcctccatgaaakagattaaagcatgtcctctatgtc

SEQ ID NO: 44626 - DNA, 50 bp, homo sapien
ttctactcagtatttcatggattccyagtgtcgaagtgttttttatatta

SEQ ID NO: 44627 - DNA, 50 bp, homo sapien
gcctgctagtagtttgattggagacragtggtagacgacaaacaagccat

SEQ ID NO: 44628 - DNA, 50 bp, homo sapien
gtgtaacatttagctctttaagtackgatgactatgtagttcaaaacttc

SEQ ID NO: 44629 - DNA, 50 bp, homo sapien
ctacatgttttctcagtctagatcargtttttagccctgtgaggacttat

SEQ ID NO: 44630 - DNA, 50 bp, homo sapien
gttatgcgatactaacaaaaagtaakgagctatttcatgtaaggaatgtg

SEQ ID NO: 44631 - DNA, 50 bp, homo sapien
ctatgattatataaaccacagattaycttagagaacaaagtcctgacctg

SEQ ID NO: 44632 - DNA, 50 bp, homo sapien
aagttgggaagattgctccaagctasaagttcgtgaccagctgggcaaca

SEQ ID NO: 44633 - DNA, 50 bp, homo sapien
ttccttcctggtcctgaaatgagtaygtttagtgagagacctgcagatca

SEQ ID NO: 44634 - DNA, 50 bp, homo sapien
ctaaaaacaaaagaagaagaatccarcatttggcaatggcccagtcaact

SEQ ID NO: 44635 - DNA, 50 bp, homo sapien
tattgtttctcttcagagtaatttayccaagaagaaaccagcaatctgcc

SEQ ID NO: 44636 - DNA, 50 bp, homo sapien
acttgccgccaaggaacctgaagaakttacttaacatcactgagatgtct

SEQ ID NO: 44637 - DNA, 50 bp, homo sapien
catacatatttaagaactgtgaatgyagtagtaaggaaattaggctgtgt

SEQ ID NO: 44638 - DNA, 50 bp, homo sapien
attttcctttgacttatacaggcagyctattctcttttatgcttacaagg

SEQ ID NO: 44639 - DNA, 50 bp, homo sapien
atataagtaggcattcaaatagtacygaatgacaaaaaatatatatatag

SEQ ID NO: 44640 - DNA, 50 bp, homo sapien
ataatagtgataaggaaagcaaaaaygacaaaggagatcattgatggggg

SEQ ID NO: 44641 - DNA, 50 bp, homo sapien
agaatgtgaaggataaaaacttcatratattttcccatagccacatagaa

SEQ ID NO: 44642 - DNA, 50 bp, homo sapien
atttccccaactctcatcacttctakgtcacttactgtcaacacccattt

SEQ ID NO: 44643 - DNA, 50 bp, homo sapien
atcagaggtatatatgtgggctagcrctgttagattgaaatctaacttga

SEQ ID NO: 44644 - DNA, 50 bp, homo sapien
gccatgttttttaaataaaggttcgycatggtttcgccaccttgcccagg

SEQ ID NO: 44645 - DNA, 50 bp, homo sapien
gagtgatgttaccagcatggttgtawacattaatatataaatcaaaaatt

SEQ ID NO: 44646 - DNA, 50 bp, homo sapien
aggaggagtgaaagcaaggaactaargaaaggaacggataacctactggc

SEQ ID NO: 44647 - DNA, 50 bp, homo sapien
atcagttgaccagttgactgtattawgccaagactcacagggtgtcatat

SEQ ID NO: 44648 - DNA, 50 bp, homo sapien
tctctagaaacttaaaatccagtacragaaaattttacaagtcacagatg

SEQ ID NO: 44649 - DNA, 50 bp, homo sapien
tttcatagatagatggatggacaaaygatgttattgagggatgtggtggg

SEQ ID NO: 44650 - DNA, 50 bp, homo sapien
catttacccaaatgaaacttggatcracacgaaagatatatttgttacaa

SEQ ID NO: 44651 - DNA, 50 bp, homo sapien
aaggtagtaacaggatttgaatgtawattttgccaaatggtgacatggtc

SEQ ID NO: 44652 - DNA, 50 bp, homo sapien
agttgaagttggtaatttgtgctgcygacttgacacggtgttcgtcattg

SEQ ID NO: 44653 - DNA, 50 bp, homo sapien
gggaaggacctggatctgtttcacaycataaacgcctaaattgccagagc

SEQ ID NO: 44654 - DNA, 50 bp, homo sapien
gggcctgaggaatcaattcctcttcyacaaaggtatgaacacaccagccc

SEQ ID NO: 44655 - DNA, 50 bp, homo sapien
aatagactagttctgcagtttgagtkaacgagttcctggattagtacttt

SEQ ID NO: 44656 - DNA, 50 bp, homo sapien
taacactgagaatgactggataaccrggaaaaaactgacctcaaggtggg

SEQ ID NO: 44657 - DNA, 50 bp, homo sapien
tcttcagatatgagatcatcaaaaayaaagacagtatctaattcatttta

SEQ ID NO: 44658 - DNA, 50 bp, homo sapien
cacttggcccattttgcactatccaygagcttctgttgcttagaagaata

SEQ ID NO: 44659 - DNA, 50 bp, homo sapien
acacacatcagctgactgggagagartatctttgtagcttctgatcattc

SEQ ID NO: 44660 - DNA, 50 bp, homo sapien
tggttttctggccttaggataccagracttacatcaatggtcctcaccat

SEQ ID NO: 44661 - DNA, 50 bp, homo sapien
tacagttttgtttggttttattatgyatggaaaaagtagaagggacatcc

SEQ ID NO: 44662 - DNA, 50 bp, homo sapien
ctaatctatgtaacctgaaatattcrcatacagtttgattcttaatttgc

SEQ ID NO: 44663 - DNA, 50 bp, homo sapien
gtaaacagtacattttctttacaatyatagattcaggtcatactcagttt

SEQ ID NO: 44664 - DNA, 50 bp, homo sapien
gagttttatagaaggatgatgtgggyaccgcatatttaaattccttgcac

SEQ ID NO: 44665 - DNA, 50 bp, homo sapien
agggaccatgttaggcaaggtgtacrgaaataggcttctgacctttccac

SEQ ID NO: 44666 - DNA, 50 bp, homo sapien
ggctagttatttagtagttctatgakaatattgcagcctctcatgcaatg

SEQ ID NO: 44667 - DNA, 50 bp, homo sapien
tacttcagtcttctctatttttctcwattagtctagctaaagatttgtca

SEQ ID NO: 44668 - DNA, 50 bp, homo sapien
cttctacaaatacttttgcattcatraagtcataagtagaaagcaaggag

SEQ ID NO: 44669 - DNA, 50 bp, homo sapien
cagtagttataagtttaatgccagamtataggcacacattgctggcagtc

SEQ ID NO: 44670 - DNA, 50 bp, homo sapien
agcttcctaattttttaaatacctaygtgttgtatgaatcacaatgaaat

SEQ ID NO: 44671 - DNA, 50 bp, homo sapien
gcaaactataacaaattgctaatttwaaaaattccacctacaattatatc

SEQ ID NO: 44672 - DNA, 50 bp, homo sapien
ctaacaaaaagtcactgaattagaamtgaaacttcccatttatggagttc

SEQ ID NO: 44673 - DNA, 50 bp, homo sapien
gctttggtgggtagggtattcttgawggcaactttttttttccttcagca

SEQ ID NO: 44674 - DNA, 50 bp, homo sapien
tgggaaacaatggacaggaatggaartgagacactaaataaactatgttt

SEQ ID NO: 44675 - DNA, 50 bp, homo sapien
ttaatgaaaattgcaacctacaaatratttataactgtaaacatagttta

SEQ ID NO: 44676 - DNA, 50 bp, homo sapien
aaaaaaaaacttgcaagagtagtatwaagaaccctcaaataatctttggc

SEQ ID NO: 44677 - DNA, 50 bp, homo sapien
ttcataactttgtggaagttttagaygagtatttcagctgagtaagtgaa

SEQ ID NO: 44678 - DNA, 50 bp, homo sapien
tgaatcttcagcagtatcatctgacyaggaattgactatggacaatatca

SEQ ID NO: 44679 - DNA, 50 bp, homo sapien
aaagggcaccaagtcaaagttgataygtaaaaattactgtcccattagca

SEQ ID NO: 44680 - DNA, 50 bp, homo sapien
attaagcttggcatgtttgagaatgsaagagtgtcagtgtggctggacta

SEQ ID NO: 44681 - DNA, 50 bp, homo sapien
agcactagaaatttgcctttacacargaaataataggatgctgaaaaaaa

SEQ ID NO: 44682 - DNA, 50 bp, homo sapien
tccattaatggctctcctcaatttaygtcagttgatcacatgaagacatt

SEQ ID NO: 44683 - DNA, 50 bp, homo sapien
ctctccagagtaactccactataacyggcctggcaaggagaccgctctaa

SEQ ID NO: 44684 - DNA, 50 bp, homo sapien
atttggattcactaaatgttaaaaartcagagtaattattacactgaggt

SEQ ID NO: 44685 - DNA, 50 bp, homo sapien
agactccagcctttgaacttcattgyaaacaccatggaatttggcctttc

SEQ ID NO: 44686 - DNA, 50 bp, homo sapien
cattcatttcttgctttgcttgcaaygtgtgactttcatttatgcactcc

SEQ ID NO: 44687 - DNA, 50 bp, homo sapien
gtgtcaataatcatattgctaaaagycctttattctaggaatcatctatc

SEQ ID NO: 44688 - DNA, 50 bp, homo sapien
acgttgttctcaagctaacctggaasatttatcaagatagaatacattct

SEQ ID NO: 44689 - DNA, 50 bp, homo sapien
gacactgaaaagaaaatgacaacccrgaaacatattgtaaaataagttac

SEQ ID NO: 44690 - DNA, 50 bp, homo sapien
tctgtattgagaagtaatagaaaatkatgcatcgctggttcatctctact

SEQ ID NO: 44691 - DNA, 50 bp, homo sapien
ttcaactcagttttccctgctctcamgttgtgcattaatcactgatactc

SEQ ID NO: 44692 - DNA, 50 bp, homo sapien
atcgatgtgacatattagtctatgayataaaacattcagtgaatgcactt

SEQ ID NO: 44693 - DNA, 50 bp, homo sapien
atccttataaaaccataacagcaaarttaaatggccaatataaattccca

SEQ ID NO: 44694 - DNA, 50 bp, homo sapien
aatgctgaagccaagacaaataagaygaaaacatgcaaaggctgcaagct

SEQ ID NO: 44695 - DNA, 50 bp, homo sapien
caagcatggctatcattttgggaaasataccgagtgaaagtgttgaaaat

SEQ ID NO: 44696 - DNA, 50 bp, homo sapien
tattttcaatctaaacttatgtagcwatgtgagtgatcaaaatttatcta

SEQ ID NO: 44697 - DNA, 50 bp, homo sapien
caatccatcaaatgtaaagtcaaaaraagaccaatgcaaataaggcagta

SEQ ID NO: 44698 - DNA, 50 bp, homo sapien
gaagcatgaagtgtccccctttttasagaagactgagtaaaggagtggga

SEQ ID NO: 44699 - DNA, 50 bp, homo sapien
ctaagaaaggacattacaaaagtagrcataaaaaggtgtaggtgtccaag

SEQ ID NO: 44700 - DNA, 50 bp, homo sapien
tggtagttgaagcaatgagtcttatraggtccctcaagatgagcgggaag

SEQ ID NO: 44701 - DNA, 50 bp, homo sapien
ctcgctttatatgaaataatcaccaktcttttaacttcaccactcttgag

SEQ ID NO: 44702 - DNA, 50 bp, homo sapien
ttcaccttatatcccagggtaggaaragacacaagactgcaagatgcaag

SEQ ID NO: 44703 - DNA, 50 bp, homo sapien
ctgacaaagcagtaattaagagtgaraaattaagtaaaatagtcacacaa

SEQ ID NO: 44704 - DNA, 50 bp, homo sapien
agtgcatgagtcctgcttgaactaasagtaggaacaagaacagcccctta

SEQ ID NO: 44705 - DNA, 50 bp, homo sapien
tagatattatttttttccagctaaarttgatgagcttggaaatgcatatc

SEQ ID NO: 44706 - DNA, 50 bp, homo sapien
acaagcatgccattttcaggtattayagtagaattctatttgaaaaagtg

SEQ ID NO: 44707 - DNA, 50 bp, homo sapien
caaagtgacttgttcaaagctagcartaaggggctgttcttgttcctact

SEQ ID NO: 44708 - DNA, 50 bp, homo sapien
tacaaagaactggcactataaggaasagcactaatagattccttgtcaga

SEQ ID NO: 44709 - DNA, 50 bp, homo sapien
aacttcatcttaaaatacgcatggarattataaaatactgtcccatagaa

SEQ ID NO: 44710 - DNA, 50 bp, homo sapien
agaaaccagaggtattcatgcaaaakttttaaatgctgtggtattacatc

SEQ ID NO: 44711 - DNA, 50 bp, homo sapien
gcctcactcctaatttcagctcttarccttcaatgcccattggtgcctga

SEQ ID NO: 44712 - DNA, 50 bp, homo sapien
ttgatttcctgggactcaagtctcayaggaaactgattaccataactcat

SEQ ID NO: 44713 - DNA, 50 bp, homo sapien
gatgttagaaacagataactgcatgkatagagataaaaggatttgttttc

SEQ ID NO: 44714 - DNA, 50 bp, homo sapien
gccatgtgaccttgaagaaataaaasaaagacaataacacaaacatatca

SEQ ID NO: 44715 - DNA, 50 bp, homo sapien
tctgagttccctcttttgcactctckctagtgatatttgtgtacatttct

SEQ ID NO: 44716 - DNA, 50 bp, homo sapien
ttgtgttaactttttcccttgcttayatgaaaaaccctgaggaaaggaag

SEQ ID NO: 44717 - DNA, 50 bp, homo sapien
ccttattatcttctattgtgtttcaragacttcttacatgtcttcgcaaa

SEQ ID NO: 44718 - DNA, 50 bp, homo sapien
tgtgcttttggatttgcatagaaggyaagatttgatggttaagatttcac

SEQ ID NO: 44719 - DNA, 50 bp, homo sapien
acaggcataagccaccgcgcccagawgaaagatatatgttttaatgtctc

SEQ ID NO: 44720 - DNA, 50 bp, homo sapien
tgtctaacagcaacattatatactgmaggcacaaaatgagatttttatag

SEQ ID NO: 44721 - DNA, 50 bp, homo sapien
atcagagagatgaggcaggaaggaasgtaagagaaactcaaagcctaaca

SEQ ID NO: 44722 - DNA, 50 bp, homo sapien
atgcaactgctacctattgtgggcayctcgagtcacccttgtggctccct

SEQ ID NO: 44723 - DNA, 50 bp, homo sapien
tgattcagatttgcatagtattaagyagaaagatgacatctattactggc

SEQ ID NO: 44724 - DNA, 50 bp, homo sapien
cagtggacaaagaactaaaaattatsaaattgtgttattatctagtgaaa

SEQ ID NO: 44725 - DNA, 50 bp, homo sapien
gagaaaggcgttgtttggtaataggmactcagaaccaaagtcatattcag

SEQ ID NO: 44726 - DNA, 50 bp, homo sapien
ctccatgacagcctgctggtgcaaastacgaatcaactttctcaggggag

SEQ ID NO: 44727 - DNA, 50 bp, homo sapien
agatgacccattcaggagttttgagkcagtgcttattcatatgtatatat

SEQ ID NO: 44728 - DNA, 50 bp, homo sapien
gatcagatctgatttaatgggtagarattgcttatagttatcatcagtta

SEQ ID NO: 44729 - DNA, 50 bp, homo sapien
gcgttaacatttccccatcttgttaygcagttttacaatacctttatttg

SEQ ID NO: 44730 - DNA, 50 bp, homo sapien
ttcaatctttaatgcaaaaatgaacyaagtattaaacatgaaagggaata

SEQ ID NO: 44731 - DNA, 50 bp, homo sapien
aggttggagagaatgatcaggaaggragtcaagtaggcccattagaagca

SEQ ID NO: 44732 - DNA, 50 bp, homo sapien
tagataaatagaaacgaattaaagcsaatgttattttgcagtaaaatcag

SEQ ID NO: 44733 - DNA, 50 bp, homo sapien
gagcatctctctctgaatttacctartacaatgtttattcctccgttatt

SEQ ID NO: 44734 - DNA, 50 bp, homo sapien
ttgttttgatgactacatgagatcarcatacatataagcataggggtcag

SEQ ID NO: 44735 - DNA, 50 bp, homo sapien
aatccctcaatctggtttgtggcaartggttgcttaaataacttcttaat

SEQ ID NO: 44736 - DNA, 50 bp, homo sapien
tcagagttcaatatgtagataacaartccatcagcatataaacatgttca

SEQ ID NO: 44737 - DNA, 50 bp, homo sapien
attttgggggaaaattttgcccttgragactagagaacatggtgacacac

SEQ ID NO: 44738 - DNA, 50 bp, homo sapien
gtcacatttaaaagggatataagatraagtccttcctagtctcagcacat

SEQ ID NO: 44739 - DNA, 50 bp, homo sapien
tcaggaaatggtagatcccgaggtayagcccattgtctgagggctgcaga

SEQ ID NO: 44740 - DNA, 50 bp, homo sapien
taagctttgaagggtcttttagaaasagagacacataaactcaaacctcc

SEQ ID NO: 44741 - DNA, 50 bp, homo sapien
ttaagttagtaagctggattgtaaamggaaattcaggaaatggtagatcc

SEQ ID NO: 44742 - DNA, 50 bp, homo sapien
catcttctctagctgtcaagaccccrctatttccttaaaattattcagca

SEQ ID NO: 44743 - DNA, 50 bp, homo sapien
ggggggagtgagtgcacagcaaggtsaactggtaaactttgtagctgact

SEQ ID NO: 44744 - DNA, 50 bp, homo sapien
taagatacagcaaatgctccttcacragtggtagcctgggagtcattcat

SEQ ID NO: 44745 - DNA, 50 bp, homo sapien
gctaattatgtatgtttctgttatascattaattgtatggtcatatgtag

SEQ ID NO: 44746 - DNA, 50 bp, homo sapien
gatcctaatgatgaactttagagaaygtttagatttaggttaaattaatg

SEQ ID NO: 44747 - DNA, 50 bp, homo sapien
ggttccgtatttccgtaatataccaycaatcactctaaatttataatacc

SEQ ID NO: 44748 - DNA, 50 bp, homo sapien
aagcaaaaatggagaaacgggatcayatcaacttacaaagcttctacaca

SEQ ID NO: 44749 - DNA, 50 bp, homo sapien
gttgcatgcctttttccaggtctackaggccgagctgtgtgtattacttc

SEQ ID NO: 44750 - DNA, 50 bp, homo sapien
gattccaagctttctagacaatgagraacttactgtactttgggtaaagc

SEQ ID NO: 44751 - DNA, 50 bp, homo sapien
ttcttccaattacatgttttattgcrctaaacaattgtcagagaggcagc

SEQ ID NO: 44752 - DNA, 50 bp, homo sapien
ttggcttctaccttgttctcttggaygttccatctcaggtactcctgttt

SEQ ID NO: 44753 - DNA, 50 bp, homo sapien
catatttacagtcaattgatcttccrcaaaggtgctaagaacacataatg

SEQ ID NO: 44754 - DNA, 50 bp, homo sapien
agccttcacaagcaaagaactgttayctattcctactccattccccactg

SEQ ID NO: 44755 - DNA, 50 bp, homo sapien
caggctgatgaagccaagataataaytgtcatataccataataattaatg

SEQ ID NO: 44756 - DNA, 50 bp, homo sapien
cagtttcacaatggtaatttgaaaaycttttagtcaaccattaccacaga

SEQ ID NO: 44757 - DNA, 50 bp, homo sapien
tttcaaaaaagaaaggcccaaaacawtgtctagatggaattttggaatct

SEQ ID NO: 44758 - DNA, 50 bp, homo sapien
attgtcatactgttgatgtacctaaytgatagaccagtaaccattcattt

SEQ ID NO: 44759 - DNA, 50 bp, homo sapien
cctatgtaaagtgtaagaatccaacrgcagggaagtatcacttgtctcca

SEQ ID NO: 44760 - DNA, 50 bp, homo sapien
tattttttgtaattttcaaaataaascaagaagattaaagaaacttaagg

SEQ ID NO: 44761 - DNA, 50 bp, homo sapien
gaaattctgcaacacaggctgttacmaggcatttttcacatttgttgcct

SEQ ID NO: 44762 - DNA, 50 bp, homo sapien
ttgatgtgttttattgctcttctaawtgtaatttctgctgaagaaaggat

SEQ ID NO: 44763 - DNA, 50 bp, homo sapien
tgatatcctcctgggctccagccaarttcaaatgaaagtttgggttatta

SEQ ID NO: 44764 - DNA, 50 bp, homo sapien
tttgagatacttaaacaaatgttgayggttatggttggcttaataagctg

SEQ ID NO: 44765 - DNA, 50 bp, homo sapien
tctggattgaatctgtgataaacggraaagcaagatgtgcctgggaggca

SEQ ID NO: 44766 - DNA, 50 bp, homo sapien
ttcagtatcttttgtcctatatctcrcttatggcttccataaatatacgt

SEQ ID NO: 44767 - DNA, 50 bp, homo sapien
gaatatattaatcccatcttaaataygcccaccacttcccgaagaactta

SEQ ID NO: 44768 - DNA, 50 bp, homo sapien
aaagagggacttctagaatgaccctsagctttctggaactggagtccttt

SEQ ID NO: 44769 - DNA, 50 bp, homo sapien
ttcaacactacttcaaaattccaacsaagatcacaagatgatttggaggg

SEQ ID NO: 44770 - DNA, 50 bp, homo sapien
tttttagaattaattttgttaaaagmagtacctgacacataagtgctata

SEQ ID NO: 44771 - DNA, 50 bp, homo sapien
gtcatagattaaaaacatatgattcraaataaacatacctttagaaaaag

SEQ ID NO: 44772 - DNA, 50 bp, homo sapien
tgctaacaaagattgcttgagaatamatgtgagataagaaaatgtgctgg

SEQ ID NO: 44773 - DNA, 50 bp, homo sapien
ctcagtttttggcagcatcttctaaycatgtgatatgtttgaggctacca

SEQ ID NO: 44774 - DNA, 50 bp, homo sapien
acggctgatgtgatttcagagcctayaatttggaatttgtaagaactctg

SEQ ID NO: 44775 - DNA, 50 bp, homo sapien
tgcttttggtggagagcacctgatckcgactttacagccaatgtatttac

SEQ ID NO: 44776 - DNA, 50 bp, homo sapien
tcttctataagaaataatttctgcamgttaagctcatcaatgtctttctc

SEQ ID NO: 44777 - DNA, 50 bp, homo sapien
atagggaaaaaataaactacggaaartccatagtagcaattgatcctttg

SEQ ID NO: 44778 - DNA, 50 bp, homo sapien
cagaataatatcttctctctaggaaygatctttgtgttacccaacagcca

SEQ ID NO: 44779 - DNA, 50 bp, homo sapien
tcttctccttatctccctattccaakagattcaaagagaggtgcagatag

SEQ ID NO: 44780 - DNA, 50 bp, homo sapien
tataaatgattacaggaattatctasgagcaagacaagatagtaagttga

SEQ ID NO: 44781 - DNA, 50 bp, homo sapien
caatattctagaattcaaatataaaraagagatagttcccagaaccatgg

SEQ ID NO: 44782 - DNA, 50 bp, homo sapien
ctcaggaggaatacatagttatggaygatacattctgagcaaatgagagt

SEQ ID NO: 44783 - DNA, 50 bp, homo sapien
agagtaaggtaccatggaatagacakgccaagtttaagatattctaaaat

SEQ ID NO: 44784 - DNA, 50 bp, homo sapien
agactgaattctgtaatacatcttgmattatgagatttataaggctaaaa

SEQ ID NO: 44785 - DNA, 50 bp, homo sapien
atcataaataataagaaggaaaacaygatggtgaccatagattctaaact

SEQ ID NO: 44786 - DNA, 50 bp, homo sapien
tttctctgaagaagcctgattaatayaggaaacaagctatttgagtctca

SEQ ID NO: 44787 - DNA, 50 bp, homo sapien
aaagctacatctcgttttctttctaratccagaccaatgtttctcaaact

SEQ ID NO: 44788 - DNA, 50 bp, homo sapien
atcaactattttgactgaatttaccyatgacttgagaaaatcggttactt

SEQ ID NO: 44789 - DNA, 50 bp, homo sapien
tagccagacttcaaaaaggatggcamcttccaattttgaaaacacatatt

SEQ ID NO: 44790 - DNA, 50 bp, homo sapien
ggaagttaatatcagaactccaacakgtgattgataaatgtaaagtctgc

SEQ ID NO: 44791 - DNA, 50 bp, homo sapien
gcccttagtttatgtttccagtctasccaaataatcttttcacacaaaca

SEQ ID NO: 44792 - DNA, 50 bp, homo sapien
atttcgatgaaataatggagttgtarcaaaatagctcagtgatggtatcc

SEQ ID NO: 44793 - DNA, 50 bp, homo sapien
acagccaccctctgatatccatgaasatgcttttctattaaaagtatttc

SEQ ID NO: 44794 - DNA, 50 bp, homo sapien
tttaaaactttagcataccaacttaygttaatgactgcatgtaactttaa

SEQ ID NO: 44795 - DNA, 50 bp, homo sapien
atgtaatgcagagaaaaataagtaaygctgtgcatgcaaaggtcataaaa

SEQ ID NO: 44796 - DNA, 50 bp, homo sapien
gaacccaaggggactacgaaaaaaayactggccttccttgtgtccactta

SEQ ID NO: 44797 - DNA, 50 bp, homo sapien
atacaaatttcctgtgcttattaacwacaaaggatctttgagaataagcc

SEQ ID NO: 44798 - DNA, 50 bp, homo sapien
agaagaggagggaaggaagaggaaayagacttgtgggatcccccgaaaag

SEQ ID NO: 44799 - DNA, 50 bp, homo sapien
ataccacctatagagaaagcactcaygaaaatagacattcaggtagctct

SEQ ID NO: 44800 - DNA, 50 bp, homo sapien
caattactctctagtctcatagttcmctcagcagtcatttaaaatgagga

SEQ ID NO: 44801 - DNA, 50 bp, homo sapien
gttatgcaaagtgaatactgaataaygacaaggcacttcagcatgagcaa

SEQ ID NO: 44802 - DNA, 50 bp, homo sapien
taaacccctaattttagtcacttgcrgagacagatttgagattgatctcc

SEQ ID NO: 44803 - DNA, 50 bp, homo sapien
aatgtggaaaattccacttacctcasagggttcttctaaatataattgca

SEQ ID NO: 44804 - DNA, 50 bp, homo sapien
aggccaatatgatattagtcctaaawtgacattatccttgttatgcttat

SEQ ID NO: 44805 - DNA, 50 bp, homo sapien
aaatatctaacattataacttctgcmattcttttttttcttggtatattt

SEQ ID NO: 44806 - DNA, 50 bp, homo sapien
caccaagcttagagccagccgaccayggaggagttgaggacaagctgagc

SEQ ID NO: 44807 - DNA, 50 bp, homo sapien
agataggtatctgtattttaacttgmaaatgaaatgctcataagacttct

SEQ ID NO: 44808 - DNA, 50 bp, homo sapien
cattcagacagcattttgtgaactcyaatcctacaattaaaatattaaat

SEQ ID NO: 44809 - DNA, 50 bp, homo sapien
agacatgatgaccatcagaaaggcaraaaagatttaggtagtgaggaggg

SEQ ID NO: 44810 - DNA, 50 bp, homo sapien
cccacaagggtatactcagcaatcaygcttatgacaaaaattaaaatatg

SEQ ID NO: 44811 - DNA, 50 bp, homo sapien
cttcattggctttcaacacaagaacsattgcactatgaggctaattgacc

SEQ ID NO: 44812 - DNA, 50 bp, homo sapien
ttatatcactaaaatggaaagctacrgagacttagaaaaatgacattgta

SEQ ID NO: 44813 - DNA, 50 bp, homo sapien
agaaaagcatccgtataaagggaaargtgtatctattaataaaatctcaa

SEQ ID NO: 44814 - DNA, 50 bp, homo sapien
atgccagcaagcagaaaaacatacasactgtgggagtttcagaaggagaa

SEQ ID NO: 44815 - DNA, 50 bp, homo sapien
gatgttcttatggtgcacaatttccsaagtttaataataagcttctctgg

SEQ ID NO: 44816 - DNA, 50 bp, homo sapien
ttcaataaatacttattgaataaacraatagcagtcttacaggtacacct

SEQ ID NO: 44817 - DNA, 50 bp, homo sapien
atatacatatatataaaaatataacrcttctaaacaatggactagttacc

SEQ ID NO: 44818 - DNA, 50 bp, homo sapien
acaacctaatgttcaataaaatggartacttaaccaactatgatatacta

SEQ ID NO: 44819 - DNA, 50 bp, homo sapien
ctagaacagaggttggcaataatcartcttttagtcttgtggccaattag

SEQ ID NO: 44820 - DNA, 50 bp, homo sapien
aactatctcccttggtaattttatgyaactatctcactggataattatat

SEQ ID NO: 44821 - DNA, 50 bp, homo sapien
aaagcatttttatgtcgtgaggatayggacaggtagagaggcaggttaat

SEQ ID NO: 44822 - DNA, 50 bp, homo sapien
ttaaaaatctcattcaactagttcargttctctctcttttcctgcccctc

SEQ ID NO: 44823 - DNA, 50 bp, homo sapien
ccacatagctgaaggacagtacatamcatctgaacatgtattttctttgg

SEQ ID NO: 44824 - DNA, 50 bp, homo sapien
tgtgtttgaagcccagtgtcaggaamttaaaactttcatagcaaggtaga

SEQ ID NO: 44825 - DNA, 50 bp, homo sapien
ctgatgatatgaaagtcatagtgtgyatatgaacctcaatgatacttttt

SEQ ID NO: 44826 - DNA, 50 bp, homo sapien
gcctgtattcatgctgttggtatccyagatttgcttacctaataagaaat

SEQ ID NO: 44827 - DNA, 50 bp, homo sapien
tataaataaatcaccatttctattayagcccactgaaaagacaaagaaaa

SEQ ID NO: 44828 - DNA, 50 bp, homo sapien
aatttttaggattataacacaccctmagaaacagtctgaatacatatact

SEQ ID NO: 44829 - DNA, 50 bp, homo sapien
attttaatatagccaaaataacctasagctaatctgtttatttccaccta

SEQ ID NO: 44830 - DNA, 50 bp, homo sapien
agaagtgcttactgtaagggaaatasaattgagcttaaaatttactgggt

SEQ ID NO: 44831 - DNA, 50 bp, homo sapien
atttagtgagttggtctccaaacgayaaatgtctgtaaaagagaatttca

SEQ ID NO: 44832 - DNA, 50 bp, homo sapien
gacaatcctgcataaaattaaagtcycaaattatcaagaaaatgaacaat

SEQ ID NO: 44833 - DNA, 50 bp, homo sapien
aacaaaactaacaacctgaagctaastagaccaattaattcctaaaacaa

SEQ ID NO: 44834 - DNA, 50 bp, homo sapien
tccaaatcatgccaagagtatcaaayacatttaacaagtgactgcctcct

SEQ ID NO: 44835 - DNA, 50 bp, homo sapien
attcttaaacatctttaaaatggagsccataggaattaccctgtaatgaa

SEQ ID NO: 44836 - DNA, 50 bp, homo sapien
ttataggtgactagatatttttctcrctgatttatttattttttcttcat

SEQ ID NO: 44837 - DNA, 50 bp, homo sapien
tacttaatctgagcttcagaaagtcycttgcgatgctatctaggtactgg

SEQ ID NO: 44838 - DNA, 50 bp, homo sapien
ttattagctacatatgtggtacagamctttttacctcaataaatatcaat

SEQ ID NO: 44839 - DNA, 50 bp, homo sapien
atcaagcctcttctcttctacttccrgacatgacatgcactctactgtgt

SEQ ID NO: 44840 - DNA, 50 bp, homo sapien
atgaatgattgtgaccctattcataygcaaaaaagtgggatccattcact

SEQ ID NO: 44841 - DNA, 50 bp, homo sapien
aaaatgtgaggaacctagaattccayaggatgacttttaagttgcgtgct

SEQ ID NO: 44842 - DNA, 50 bp, homo sapien
ctttctaaaaattttacctttaatargtatgagttttcattgaagtcaaa

SEQ ID NO: 44843 - DNA, 50 bp, homo sapien
tatggtatggaagaactataattaamtaggtgttacaaacataaactcca

SEQ ID NO: 44844 - DNA, 50 bp, homo sapien
ctaggagtcacaatttagtaacatcmaattcttccgttcattaccaacac

SEQ ID NO: 44845 - DNA, 50 bp, homo sapien
ccctcaagcttgagatactaggagarataaacagcagagcaaatgtgctc

SEQ ID NO: 44846 - DNA, 50 bp, homo sapien
agagaattcacatctttctgttctarctggtattcctgcattattttctc

SEQ ID NO: 44847 - DNA, 50 bp, homo sapien
aaacttgcagagagtgctacatcaayctaaaatggcttcctttccatgtt

SEQ ID NO: 44848 - DNA, 50 bp, homo sapien
tggaaagtaaaactcagttgagggawtcaggacatttcccaaggggtaat

SEQ ID NO: 44849 - DNA, 50 bp, homo sapien
tggggtgttgtaggaacaaatttaamacacttcttcttacaactactggc

SEQ ID NO: 44850 - DNA, 50 bp, homo sapien
attagtagtgaacaggggacattcasattaaaatattgtctacattatat

SEQ ID NO: 44851 - DNA, 50 bp, homo sapien
caaattgacatgcaaagattagaaartaagaggccatcagatgtgatttg

SEQ ID NO: 44852 - DNA, 50 bp, homo sapien
tgacttccacagtgaatcttgggtckccttgttttctatatgttagattt

SEQ ID NO: 44853 - DNA, 50 bp, homo sapien
ataagaaaataaatgagttcacatayagaagattaaaattctaatgccat

SEQ ID NO: 44854 - DNA, 50 bp, homo sapien
ccagcaaaaaggagacacttgtgaaygtaagtaatgtgtcctattaaaac

SEQ ID NO: 44855 - DNA, 50 bp, homo sapien
ttgtcccaacaaccatatagcacaargtatttttaatttacattttacag

SEQ ID NO: 44856 - DNA, 50 bp, homo sapien
ctgtgttacagtttcttcaataataragacactgaaactcaataattcat

SEQ ID NO: 44857 - DNA, 50 bp, homo sapien
aaatgtttgcaaagggtcttgtacarctcaattttgatatctaatttgca

SEQ ID NO: 44858 - DNA, 50 bp, homo sapien
taagaattagtaacttgaaagagaawttacattgtaagaaacatttagat

SEQ ID NO: 44859 - DNA, 50 bp, homo sapien
aataagtgtggttagtctattactgycagccaattattgtttgtctttct

SEQ ID NO: 44860 - DNA, 50 bp, homo sapien
aaaaagaagttatagtggcaagatgyaaaatcaaagttaaaagtagtcag

SEQ ID NO: 44861 - DNA, 50 bp, homo sapien
aacattagccaacaagttccactccrctgaatttatatagtacttttttt

SEQ ID NO: 44862 - DNA, 50 bp, homo sapien
gggagaatgtttccaatgataaaaayttcagatacattttagatttaata

SEQ ID NO: 44863 - DNA, 50 bp, homo sapien
ttttatttcccacagattaattccaytcaaagtgtccttcagctatctag

SEQ ID NO: 44864 - DNA, 50 bp, homo sapien
cagaagtgtaggaagtataacaaaaygactgcagcattaagaggctttat

SEQ ID NO: 44865 - DNA, 50 bp, homo sapien
aagactatatttagatatagttgcaragaactagattcaatttattatgt

SEQ ID NO: 44866 - DNA, 50 bp, homo sapien
ctcaacctcttggttttaattgcaastaactgaatccgactgtttccatt

SEQ ID NO: 44867 - DNA, 50 bp, homo sapien
aatgtttgcagattttttagaagaaygaaagttggaaatttatttggaaa

SEQ ID NO: 44868 - DNA, 50 bp, homo sapien
cagaaaaaatactgttttcttcgtasagattatttcatagtggtcttcaa

SEQ ID NO: 44869 - DNA, 50 bp, homo sapien
ttttcttttctattcaaacagatcamaattcgttataatttcaaattcct

SEQ ID NO: 44870 - DNA, 32 bp, homo sapien
taatccacaagccatasaaataacttaatgtg

SEQ ID NO: 44871 - DNA, 50 bp, homo sapien
tgacttttcttatatggctttaaggrattatctttatgtctcatatcttt

SEQ ID NO: 44872 - DNA, 50 bp, homo sapien
cagtaaaatttggctgctgtatttgsaacgatacattcttggctttctca

SEQ ID NO: 44873 - DNA, 50 bp, homo sapien
gtactggtaataagtggatattttawggtacattttcaaagtttatgtta

SEQ ID NO: 44874 - DNA, 50 bp, homo sapien
ttggtaaatgagaagtttaaatgccrcattataattgttcagccaaactt

SEQ ID NO: 44875 - DNA, 50 bp, homo sapien
taaataacacagaagcaaatactgayggagtaagattctctattgaacca

SEQ ID NO: 44876 - DNA, 50 bp, homo sapien
acttcactataagggcttttacacawcagattagcaacctcctctctgct

SEQ ID NO: 44877 - DNA, 50 bp, homo sapien
tatatctgttttcccatgagagctawcagttatattctctgcttaaattg

SEQ ID NO: 44878 - DNA, 50 bp, homo sapien
ttaaccaaaacagaaatgaactggcraatgtctcactatagaagagaaga

SEQ ID NO: 44879 - DNA, 50 bp, homo sapien
aaattaatctctagtaaaatatcaayaaaagtctgagcactgcactagtt

SEQ ID NO: 44880 - DNA, 50 bp, homo sapien
tagtgacaatatttacttcacattgmaaatttaggctaaaacaaagcaca

SEQ ID NO: 44881 - DNA, 50 bp, homo sapien
tttttcttttacaattgtaacttacyatttgtttgctaagacatagtttt

SEQ ID NO: 44882 - DNA, 50 bp, homo sapien
tctctttctatactataatattggaytattggcttttacatctactgtta

SEQ ID NO: 44883 - DNA, 50 bp, homo sapien
tggaattatggtactttcctgaaaakaaggagagttaattaaacccaatt

SEQ ID NO: 44884 - DNA, 50 bp, homo sapien
gtgactaaaaaagaaagttagaatayaagcaacagtgtgaacaaaatatt

SEQ ID NO: 44885 - DNA, 50 bp, homo sapien
tttaatagcaagtgtgtgggtacaasgtaatgaacgaaagtaaaagaggg

SEQ ID NO: 44886 - DNA, 50 bp, homo sapien
tttcatgatgtgtctccttaaagtgycaagatgccatgcttagaatttaa

SEQ ID NO: 44887 - DNA, 50 bp, homo sapien
ttattagatgagagcataagataacrcttaagcattggcaaaatgtatag

SEQ ID NO: 44888 - DNA, 50 bp, homo sapien
tttgcttacctattctgtttccaagwagtacattgttcttatattcaatg

SEQ ID NO: 44889 - DNA, 50 bp, homo sapien
taagttgtagagctcattatacttcratatccatcttctaagaataagat

SEQ ID NO: 44890 - DNA, 50 bp, homo sapien
tggcaagattagagtgtaaaagcaaycctgatagacggcttctcaaagca

SEQ ID NO: 44891 - DNA, 50 bp, homo sapien
ataaaagcagccaaatgaacaatgcwagaaatgtctctaaatttaaaccc

SEQ ID NO: 44892 - DNA, 50 bp, homo sapien
agaagcaatgctcatgatgactaaamtgttctaagaagccattttccccc

SEQ ID NO: 44893 - DNA, 50 bp, homo sapien
ttatctgatattaaagaaaaatgtgmatcagctaaaatttcatacaaaaa

SEQ ID NO: 44894 - DNA, 50 bp, homo sapien
tattcatgaagtccaagttttatgamgattaaatcatcacactaaaggag

SEQ ID NO: 44895 - DNA, 50 bp, homo sapien
gatttcatgcttcataatcaaatcarcctcaacacttttaatagttactc

SEQ ID NO: 44896 - DNA, 50 bp, homo sapien
acaatgcagtcttatgaacttatctkagagaaatgtcactaacagattgt

SEQ ID NO: 44897 - DNA, 50 bp, homo sapien
ccttctttatccttgaagttattgayattcaacagagtgtgtttaaatac

SEQ ID NO: 44898 - DNA, 50 bp, homo sapien
ctgctggagccattttctgtttcatragttgatacctgtgtatgctgttc

SEQ ID NO: 44899 - DNA, 50 bp, homo sapien
atttttagtcatactttaattcaaawtctagttgttacatttaaaaaggg

SEQ ID NO: 44900 - DNA, 50 bp, homo sapien
ctactcacctgacagattctacagaytccctattgcatggagaaactaga

SEQ ID NO: 44901 - DNA, 50 bp, homo sapien
gaaaatccacttgttttgtgtttccsagtggaaggcaggatcaatcccca

SEQ ID NO: 44902 - DNA, 50 bp, homo sapien
aaaatgtggctaacacaaaaattgawcatcaagatttctaagtggttacc

SEQ ID NO: 44903 - DNA, 50 bp, homo sapien
tgtctacttctttattttatatctamcattaggaagtgctaaagtgtgga

SEQ ID NO: 44904 - DNA, 50 bp, homo sapien
accattttctccagaaacaactctgmatcacaagaagttaaggaaaatgc

SEQ ID NO: 44905 - DNA, 50 bp, homo sapien
atcagctcattgtatctggctattargaaaggcaaaacacagatccaatt

SEQ ID NO: 44906 - DNA, 50 bp, homo sapien
gcatagcttaggcagtaggtttaatraattctctgtaccacatctagcac

SEQ ID NO: 44907 - DNA, 50 bp, homo sapien
ccaatgcacagataaatatgggaacyactgcaatttcctctctcccttaa

SEQ ID NO: 44908 - DNA, 50 bp, homo sapien
agtggcctctcacaaaccatgggaasagccaacagtatagtcagacacct

SEQ ID NO: 44909 - DNA, 50 bp, homo sapien
tagaggtagggtaatgtgaaatccaractaaatacacattgaatttttgc

SEQ ID NO: 44910 - DNA, 50 bp, homo sapien
tgaggtgcagaatatctgtactcaamtgaagatcaaagtataattttcaa

SEQ ID NO: 44911 - DNA, 50 bp, homo sapien
taacagaaatccagatatttttaaastaaatgagcagtcacatcctaacc

SEQ ID NO: 44912 - DNA, 50 bp, homo sapien
caatagtctggaacaaaggatattasaataattgctgttgctgctaccta

SEQ ID NO: 44913 - DNA, 50 bp, homo sapien
ataacaaagaaaaagaaccaaattayatcacgtcaaaagaaaaaaaaaaa

SEQ ID NO: 44914 - DNA, 50 bp, homo sapien
aaacttaacacttgtgtgccaaaacrattgcacagatcagctgcagacaa

SEQ ID NO: 44915 - DNA, 50 bp, homo sapien
caacagacacatgttaaatgaaagarccaatactttattgcgcgctgctg

SEQ ID NO: 44916 - DNA, 50 bp, homo sapien
tcttgagatgacttatatatcatcasaggtttagatccttgaccagaata

SEQ ID NO: 44917 - DNA, 50 bp, homo sapien
atgactacagttccttaggtcaccaycttatcttcaatatgactttctca

SEQ ID NO: 44918 - DNA, 50 bp, homo sapien
cccaataaaagcagaatcctaatacyaatatatctgaggttgaattgcta

SEQ ID NO: 44919 - DNA, 50 bp, homo sapien
gtagtacgtgaccacactctcacaargccacctagattaaccatgacatg

SEQ ID NO: 44920 - DNA, 50 bp, homo sapien
ataaatgagaagtctaatagcttccygaatagaacagttctgcttcatat

SEQ ID NO: 44921 - DNA, 50 bp, homo sapien
attgaattctaacctctttgactcckaagatgaatgaagtgtataactgt

SEQ ID NO: 44922 - DNA, 50 bp, homo sapien
atctcattttctaatttcaaatatastaaccagtcaggtgtggtggcatg

SEQ ID NO: 44923 - DNA, 50 bp, homo sapien
tgattcaatccattcatccaaaacartagaacagacgttcaacaagcagt

SEQ ID NO: 44924 - DNA, 50 bp, homo sapien
tattgcttgactcacagctgtcaaasaaaagtgatgaataaaatgcaaga

SEQ ID NO: 44925 - DNA, 50 bp, homo sapien
aatattacgaactgaattcttataawcgtaaattgaaaggcttatgcacc

SEQ ID NO: 44926 - DNA, 50 bp, homo sapien
aaaatgaaagctttaaatacatttcraagatgcataatcaatactttatg

SEQ ID NO: 44927 - DNA, 50 bp, homo sapien
ttttcatataaagaaataatacagawgtctttgaacccccctattccatt

SEQ ID NO: 44928 - DNA, 50 bp, homo sapien
gcactatgactagtcaccacaattaratcaggtgtataaacatctttgca

SEQ ID NO: 44929 - DNA, 50 bp, homo sapien
tctgagattgatgaacctttcactargatagaaaataagaaggaagcttt

SEQ ID NO: 44930 - DNA, 50 bp, homo sapien
ctgattcctctctgtccctgtaccaygacctcgcttatttacacagaaac

SEQ ID NO: 44931 - DNA, 50 bp, homo sapien
gataagattgagtacccatggaaackgtttattagtagtagaatagaaag

SEQ ID NO: 44932 - DNA, 50 bp, homo sapien
atcaaaggatatacacactcatccargaatgttgaaaaatttcaggaaga

SEQ ID NO: 44933 - DNA, 50 bp, homo sapien
tacctatttttgttatttagcttgcratgacctccttgattcctcctcat

SEQ ID NO: 44934 - DNA, 50 bp, homo sapien
cttgaggagagtaatatttatgcagracacttatgttttatggcttcaga

SEQ ID NO: 44935 - DNA, 50 bp, homo sapien
accctttaaattcttacttatcttaycaggtcatggaagatacactttag

SEQ ID NO: 44936 - DNA, 50 bp, homo sapien
aaaattgattaatagtcatgaagcartaacagtctctcaattttaacaaa

SEQ ID NO: 44937 - DNA, 50 bp, homo sapien
ctctaaaacatcacagctcttaacaraagggatcattcttgcaaaggcca

SEQ ID NO: 44938 - DNA, 50 bp, homo sapien
gggacatgggggagatacaaataacratacctgagtacaatccttgctat

SEQ ID NO: 44939 - DNA, 50 bp, homo sapien
atttccaaattgaaagaactcaaaamgtaccagcacatttaattttttaa

SEQ ID NO: 44940 - DNA, 50 bp, homo sapien
gactttaaaaattattcagttcttcracctcctaaaataatggcatattt

SEQ ID NO: 44941 - DNA, 50 bp, homo sapien
ataaaattggttcagtttctactacsgtaaccctcattaaatctaagtaa

SEQ ID NO: 44942 - DNA, 50 bp, homo sapien
atatgttggagttgttgttaagagaratgcatactcctcattttacgcac

SEQ ID NO: 44943 - DNA, 50 bp, homo sapien
ggtggttctctcagtcaggtcattargtaaatgttgaaccaaatattttc

SEQ ID NO: 44944 - DNA, 50 bp, homo sapien
gacttttactgattgaataaatacakgactgactgaaaactctatcgtga

SEQ ID NO: 44945 - DNA, 50 bp, homo sapien
gctacataattatcattctaaattcraagtactgcatgtcacctaccaac

SEQ ID NO: 44946 - DNA, 50 bp, homo sapien
aacaagaaataaaggtttcgtaagtsacagtaagaacttaccttcaggaa

SEQ ID NO: 44947 - DNA, 50 bp, homo sapien
gttgagaaatttgttctaacattacrgcagaaattttcaagaaggcacaa

SEQ ID NO: 44948 - DNA, 50 bp, homo sapien
tatggaaaaggacaacggtgagtcgyccagtttaaatctcacatcagact

SEQ ID NO: 44949 - DNA, 50 bp, homo sapien
aattactaaatattttagttggcagratcataaaccctatcggaccacat

SEQ ID NO: 44950 - DNA, 50 bp, homo sapien
tttttctgccaactaccaaccaagaycaattctacttccataaacttttc

SEQ ID NO: 44951 - DNA, 50 bp, homo sapien
ccaatatggcatcagtgttccatgcygcaagtaaacttgtccataaagtt

SEQ ID NO: 44952 - DNA, 50 bp, homo sapien
aagagtttcatgtgaaccagcatgartaacatcagaggctattcattttc

SEQ ID NO: 44953 - DNA, 50 bp, homo sapien
tacactcattttacaaatcagcaaasagaagtcaaataattcaacaaagt

SEQ ID NO: 44954 - DNA, 50 bp, homo sapien
caagaagagaggcctcattataaacyaacttttctggcaaccctgccaga

SEQ ID NO: 44955 - DNA, 50 bp, homo sapien
ggcagacagagaaaagagatatttgraagatagaagttagaaaaattcta

SEQ ID NO: 44956 - DNA, 50 bp, homo sapien
tttatctcttgtctagccaagttcaygttaaattctactaggttagcact

SEQ ID NO: 44957 - DNA, 50 bp, homo sapien
tgaatctcttatgcacttcaaataaycttttcattgaggtaccattccta

SEQ ID NO: 44958 - DNA, 50 bp, homo sapien
ttaccaaatgcagtctaacattacaytgaaagtataaaacatgacattgg

SEQ ID NO: 44959 - DNA, 50 bp, homo sapien
tccaaaatgcaattcttagaataacyaataactctggctcactgaatatg

SEQ ID NO: 44960 - DNA, 50 bp, homo sapien
aattctcaggccagtcttgccttcaratatacacaagtggcctagtctca

SEQ ID NO: 44961 - DNA, 50 bp, homo sapien
ggtgatgatattcaaacgaggagatsatattggagaggagtatggtgccc

SEQ ID NO: 44962 - DNA, 50 bp, homo sapien
tgttttaaacaacctgataccctatyaacaacatatatccaaatcaggcc

SEQ ID NO: 44963 - DNA, 50 bp, homo sapien
aaagctgttaatattgtttttaatgrcatgcattttatttacatttgaaa

SEQ ID NO: 44964 - DNA, 50 bp, homo sapien
ttacaatttttgagaaacacctaaasaaggcacacttgaaattccaaaca

SEQ ID NO: 44965 - DNA, 50 bp, homo sapien
tttctttttacacactatgacattawcaaccaagtcaagattaaatattt

SEQ ID NO: 44966 - DNA, 50 bp, homo sapien
aaatacataggatagaaaatacagasgatagaaaatgagtaaatactcaa

SEQ ID NO: 44967 - DNA, 50 bp, homo sapien
atcgtgtgttgtcaatctcaaaatcygaatgcctatttgaatcaattgct

SEQ ID NO: 44968 - DNA, 50 bp, homo sapien
ttaagttagcttgcaaatttagaaamgaccagaatataacccaattttaa

SEQ ID NO: 44969 - DNA, 50 bp, homo sapien
caaacaaaaagcaatatgaacggaayattaacactgcaaaaagtaaatac

SEQ ID NO: 44970 - DNA, 50 bp, homo sapien
tagccattttgtctcttaaaactcaygctcaagctcactcacccagttcc

SEQ ID NO: 44971 - DNA, 50 bp, homo sapien
gcatatagactagctcttttaaagayacactcaagaaaagaagtgatttg

SEQ ID NO: 44972 - DNA, 50 bp, homo sapien
caaaaatttaattacttctttatcakgttattagcctacaagagtaaata

SEQ ID NO: 44973 - DNA, 50 bp, homo sapien
atcatgaactatgataaggtctggawacaggacatcaaaaaaaaaacctc

SEQ ID NO: 44974 - DNA, 50 bp, homo sapien
gcatgtaaaattttatttatgggacragaaatgacagtggtagaaatttt

SEQ ID NO: 44975 - DNA, 50 bp, homo sapien
atacatatattaccttgattaaatascttagactgatagtttgaatgcag

SEQ ID NO: 44976 - DNA, 50 bp, homo sapien
ggaaagtttatgatttctatccttcrcgtctccaaaagaaaccaagctcc

SEQ ID NO: 44977 - DNA, 50 bp, homo sapien
cttctaatagaagaatataattgccractgataagattataaatttgcag

SEQ ID NO: 44978 - DNA, 50 bp, homo sapien
atagttaccgcccttctctacaacarcatataggcacttctggaagaaat

SEQ ID NO: 44979 - DNA, 50 bp, homo sapien
tagtgctgaggtccaaataaagttgragaacatgaacttgaagtggcacc

SEQ ID NO: 44980 - DNA, 50 bp, homo sapien
ataagaatgagatacaattaaaggaraattagctactgctgaggatctgt

SEQ ID NO: 44981 - DNA, 50 bp, homo sapien
agcattttttttctgtctgaaatagyaggtttaggatacatggatgagga

SEQ ID NO: 44982 - DNA, 50 bp, homo sapien
atacaatccttcaggctaaatatgayaatgatcttggtgtaaacctaaga

SEQ ID NO: 44983 - DNA, 50 bp, homo sapien
aaaaattcattggagttaaacagcaraatggtggtcaaaataaagagtca

SEQ ID NO: 44984 - DNA, 50 bp, homo sapien
acattcccttcacataacactcttcrcttttagattaatctgctgaaatg

SEQ ID NO: 44985 - DNA, 50 bp, homo sapien
tggcataaagcttgaatattatctaygtttacctaacactgtagctctgt

SEQ ID NO: 44986 - DNA, 50 bp, homo sapien
ataataatgctagtagtatatgatargtaaaacaaatggctcttaaattt

SEQ ID NO: 44987 - DNA, 50 bp, homo sapien
gaagtgattctgatatttgttgaaawttaagagccatttgttttacttat

SEQ ID NO: 44988 - DNA, 50 bp, homo sapien
ctgcaagcaaatgtcctcttacataytatcctcctacctttctctaattc

SEQ ID NO: 44989 - DNA, 50 bp, homo sapien
ctccttctccttttcctttttcctcrgaatgctggattcatcacgctctg

SEQ ID NO: 44990 - DNA, 50 bp, homo sapien
ttccaaggagttctaatttggaaaayggcagtatagaataggcttaaagt

SEQ ID NO: 44991 - DNA, 50 bp, homo sapien
ttggcacacagaggaatgagctgtayccttagttggcacactaagtagat

SEQ ID NO: 44992 - DNA, 50 bp, homo sapien
tgaggtgaacccaggagtttgtacaygactttatgaaattgctctcttga

SEQ ID NO: 44993 - DNA, 50 bp, homo sapien
agggagaacaatagaggacaaagacrcacagttgtccagggagaatggaa

SEQ ID NO: 44994 - DNA, 50 bp, homo sapien
gtcctcagatagctgctttgtgcaayatatttaatgagaggacaggatgg

SEQ ID NO: 44995 - DNA, 50 bp, homo sapien
gtagtaacattgaaatatctgccagrataatctacacctgtctcttgaat

SEQ ID NO: 44996 - DNA, 50 bp, homo sapien
gagagctttacagtcattctttacastacattgttaacgacccctttcaa

SEQ ID NO: 44997 - DNA, 50 bp, homo sapien
gagcctctgcacccagctgaacacasatttcttgattctttttttttttt

SEQ ID NO: 44998 - DNA, 50 bp, homo sapien
tatggtgttatactggtgtgctataytaaatggtgtctgtttcaggtaaa

SEQ ID NO: 44999 - DNA, 50 bp, homo sapien
ccacatccattgtttgacatgacaamtggtgactgcctctgacatcagag

SEQ ID NO: 45000 - DNA, 50 bp, homo sapien
gattaagaagcagttatgaagtttaycatcggagggtacaggtctacaaa

SEQ ID NO: 45001 - DNA, 50 bp, homo sapien
tgggatgaaatttatgggaaaaatakataggatgaaaaatggattttgtc

SEQ ID NO: 45002 - DNA, 50 bp, homo sapien
atcaatatgaacttgatctattccaygattttcaagttactataaatgtc

SEQ ID NO: 45003 - DNA, 50 bp, homo sapien
cttttacagaatgcctcattgaccawcctttctcggaggagttataaaga

SEQ ID NO: 45004 - DNA, 50 bp, homo sapien
cttttgtttttcaagccaggttgtayactctttgtgacagctgtttttcc

SEQ ID NO: 45005 - DNA, 50 bp, homo sapien
cattatagccattgtttgtagttacmcatgaatttgtttcataccatttc

SEQ ID NO: 45006 - DNA, 50 bp, homo sapien
cctttcgaattagaatacggtcaggyagattatggaattaatgtcaatat

SEQ ID NO: 45007 - DNA, 50 bp, homo sapien
catgctgcagtcattgggcatatatsagagtataaaacaggcagaaattt

SEQ ID NO: 45008 - DNA, 50 bp, homo sapien
atccttttcattttgtcacaataaaygttctagctctatgaaatcatttt

SEQ ID NO: 45009 - DNA, 50 bp, homo sapien
ttaaacaatactcaatggtactgaartatatctcttgtggtgattgggtt

SEQ ID NO: 45010 - DNA, 50 bp, homo sapien
gtatactgaggtataattacaagaaygtggaagattaatatttatatatg

SEQ ID NO: 45011 - DNA, 50 bp, homo sapien
tactcttttttaagtgtaattttacsaccatctacctcattttttgtctt

SEQ ID NO: 45012 - DNA, 50 bp, homo sapien
gttgagagaccttcaactttaggcartatttattaatttgatccatataa

SEQ ID NO: 45013 - DNA, 50 bp, homo sapien
aaacctataaggaaacttgagaacaygtaggaaaaggcaaagtaaagaaa

SEQ ID NO: 45014 - DNA, 50 bp, homo sapien
gacagaagtgtactctgggagtcaaygaaaaagaacaggtgctttccatc

SEQ ID NO: 45015 - DNA, 50 bp, homo sapien
tgattctgtttacctaattgtgagayatgagcaaagtcacttaaattttc

SEQ ID NO: 45016 - DNA, 50 bp, homo sapien
ttagtgagagcatttttccttaaacmagcaggagcattagaacctgacac

SEQ ID NO: 45017 - DNA, 50 bp, homo sapien
aatcctatcaagcaaatcctcctaayactactttcaaattaaggtattat

SEQ ID NO: 45018 - DNA, 50 bp, homo sapien
agaggtgactctgtctcccttctgaratggagcctggaacagcagtgagc

SEQ ID NO: 45019 - DNA, 50 bp, homo sapien
tactctggactctatttgggaaaacmagaatgatatgttgaagagcaaat

SEQ ID NO: 45020 - DNA, 50 bp, homo sapien
cttttaatgagtattagtctaaatgsagaatttataaacaaaaacatcct

SEQ ID NO: 45021 - DNA, 50 bp, homo sapien
atcactaggaaccatagtccttctayaaaagctctaccatcattttgtgc

SEQ ID NO: 45022 - DNA, 50 bp, homo sapien
aatattgtttactttaacagtatcargtgtttcctttgtactgtaagaaa

SEQ ID NO: 45023 - DNA, 50 bp, homo sapien
taaatcctttcggaaggaatgattgyaataaggtgagtaaattcctagat

SEQ ID NO: 45024 - DNA, 50 bp, homo sapien
tggggagttgaactgataagcaccargattttcttacagatttagggacc

SEQ ID NO: 45025 - DNA, 50 bp, homo sapien
cactcagattggaatacggtttatayctcatcatcctataaagactgata

SEQ ID NO: 45026 - DNA, 50 bp, homo sapien
tctttgtggttaagaagaactctacsatgaattgcacttgagctgagact

SEQ ID NO: 45027 - DNA, 50 bp, homo sapien
cactgcgtcttttgggaaataaatargaagaaatgtcatggaagagaagg

SEQ ID NO: 45028 - DNA, 50 bp, homo sapien
tataagattggtatagttggaggaayaatcaatgtgggaaagtttggatt

SEQ ID NO: 45029 - DNA, 50 bp, homo sapien
attttgttcacaaaagtattatctayaactgccaaaacaagaagaaaacc

SEQ ID NO: 45030 - DNA, 50 bp, homo sapien
aatcataaatgtaagaaaatgaggamgtaacttacaagaaggatagatgt

SEQ ID NO: 45031 - DNA, 50 bp, homo sapien
accttcatttaaaagataagaactcmaaataaacagaagtacttggattt

SEQ ID NO: 45032 - DNA, 50 bp, homo sapien
gtcctcctagaagaaggatgcctgargatattcttgaataatgagtagag

SEQ ID NO: 45033 - DNA, 50 bp, homo sapien
taagagttccaactgagtgactcctractaatcaagagatgcatctacat

SEQ ID NO: 45034 - DNA, 50 bp, homo sapien
aaatagtattttttctgtttagatgmaactgtaagtaaagagaggaaagg

SEQ ID NO: 45035 - DNA, 50 bp, homo sapien
gcagttttcataggaagaagattaastccagtaaatatagaggttgacaa

SEQ ID NO: 45036 - DNA, 50 bp, homo sapien
ggtaaataaaaatttgtggtatgaaraaagaaagaatatatttgtgggat

SEQ ID NO: 45037 - DNA, 50 bp, homo sapien
caaatgcctcatcaacatacctgtasagattcaaatatatgagaagtctt

SEQ ID NO: 45038 - DNA, 50 bp, homo sapien
aggcaatttagtgtgttagaaagaasaaggattttggtaccgtgcagact

SEQ ID NO: 45039 - DNA, 50 bp, homo sapien
actatacagttcagagtccaataacyatattctgacacaactacatcccc

SEQ ID NO: 45040 - DNA, 50 bp, homo sapien
tcttttatcaattttcttccttagasgtaatgtatgtttctctattttca

SEQ ID NO: 45041 - DNA, 50 bp, homo sapien
gcataacctcagggagttacttctcracacttcaacttcctcagccaaaa

SEQ ID NO: 45042 - DNA, 50 bp, homo sapien
tctcatgataattcactgactttaawtgataaagatggaaagaaccagag

SEQ ID NO: 45043 - DNA, 50 bp, homo sapien
ttttgaattcatagaaaagttaggcyaaataccaaaggtgacatacagta

SEQ ID NO: 45044 - DNA, 50 bp, homo sapien
atctggtccttacagaatgctcacartacaatggactaggtagcatatga

SEQ ID NO: 45045 - DNA, 50 bp, homo sapien
atacacagtctttttcaaatttaccrccagacatcccaatgctttgtaaa

SEQ ID NO: 45046 - DNA, 50 bp, homo sapien
gtcctggatgattgttatgtaatgtmaatagtataattgctaagtattgt

SEQ ID NO: 45047 - DNA, 50 bp, homo sapien
gcttatcagggcaaggaatgtaagcmaccaaaaggagagttagagtagat

SEQ ID NO: 45048 - DNA, 50 bp, homo sapien
ttgggagggtgtagttgagaaacttyaaggagtcctcaaaagtgtttccc

SEQ ID NO: 45049 - DNA, 50 bp, homo sapien
gcttaataattgagatccctttatayactgattccctggtacatttaaaa

SEQ ID NO: 45050 - DNA, 50 bp, homo sapien
tatttatgttaacagatatcattagragatttttaagattcatatatgta

SEQ ID NO: 45051 - DNA, 50 bp, homo sapien
cactcagtcagtccttgagtatcagycagggtcacaggcccagagccaca

SEQ ID NO: 45052 - DNA, 50 bp, homo sapien
tccttgagttcatcttccaagcagasagagatacaggaatgataaaataa

SEQ ID NO: 45053 - DNA, 50 bp, homo sapien
ggtgcttagtgcagccaatacaaaamttagggacatattccctatccttc

SEQ ID NO: 45054 - DNA, 50 bp, homo sapien
tgtcatataagaagcatatattttarcagtgaatacaaccaaatgagtaa

SEQ ID NO: 45055 - DNA, 50 bp, homo sapien
ctatacaaattgcatttatcatcaasgcacaaggcccagctcccccaaag

SEQ ID NO: 45056 - DNA, 50 bp, homo sapien
gttgagacaaacagttttagatatamgtagaagctggaccagtatcatcc

SEQ ID NO: 45057 - DNA, 50 bp, homo sapien
gttcagccacacctgttctttcagcrgcaaaaatccattagatgttgagg

SEQ ID NO: 45058 - DNA, 50 bp, homo sapien
ggattcatttcatttgtttgaggcasccatagtaaaaactttcaaaactg

SEQ ID NO: 45059 - DNA, 50 bp, homo sapien
tcagttttacgaaaaggtgactcctyagctttaatcaagtaaaagtacac

SEQ ID NO: 45060 - DNA, 50 bp, homo sapien
ggtttcatcttctgttcaggccattraaactttctccctatcagcaatac

SEQ ID NO: 45061 - DNA, 50 bp, homo sapien
aggataatatgcttcaaaggaattayacatagactgtcttcctcaaactt

SEQ ID NO: 45062 - DNA, 50 bp, homo sapien
caggtctgcaggaattgactgtttayacaaagggacttcaaaaagttcat

SEQ ID NO: 45063 - DNA, 50 bp, homo sapien
gaaaggcagtaattgcttctcaagayacttagcataatctctgatttctc

SEQ ID NO: 45064 - DNA, 50 bp, homo sapien
gttcttgacttaaggtcactgaacarcagaataatttgaatgctgttcta

SEQ ID NO: 45065 - DNA, 50 bp, homo sapien
agcaaggagagttcttctaattgaayccaaggatacaggacagccaccgt

SEQ ID NO: 45066 - DNA, 50 bp, homo sapien
gaaaaggaaagaaaagaaaagaaaargtaagtatagtgcctggtgtccag

SEQ ID NO: 45067 - DNA, 50 bp, homo sapien
tccctttgccaaatctgttctttccsattcctgctgcaacaaatcaaatt

SEQ ID NO: 45068 - DNA, 50 bp, homo sapien
ctaaatagaattgagaatatcaaccrcatagctaggatgcagtgaaacct

SEQ ID NO: 45069 - DNA, 50 bp, homo sapien
aggttctctgacacaatggtcagaartattctccactgggtttccactta

SEQ ID NO: 45070 - DNA, 50 bp, homo sapien
taaaatatttctcaatccatctcaaygagaataccaaaaagcctttataa

SEQ ID NO: 45071 - DNA, 50 bp, homo sapien
caaatctagatcaggtttatatttcrctaccaatagttatcctttcactg

SEQ ID NO: 45072 - DNA, 50 bp, homo sapien
gttttttcaagctgttccttcacacyggctttgcaggttgttgtggcacc

SEQ ID NO: 45073 - DNA, 50 bp, homo sapien
gttgtttttgctatgattgtgattaygtaaactgctagttgttaaatagc

SEQ ID NO: 45074 - DNA, 50 bp, homo sapien
aaagttttagtattgtacattaagaygatcaggcccagcagggtggttca

SEQ ID NO: 45075 - DNA, 50 bp, homo sapien
tgaggatgggtaatttataaagaagycaaaatttattttggctcctagtt

SEQ ID NO: 45076 - DNA, 50 bp, homo sapien
taaccaagaaggttttataacagaawttcaaagttattttaacattagac

SEQ ID NO: 45077 - DNA, 50 bp, homo sapien
tctgatctgtatttatttgcattgtyaattggatgcaaactactgtaaat

SEQ ID NO: 45078 - DNA, 50 bp, homo sapien
agagaataactggaatcttactaaaytgaagacataatgaagtttagaag

SEQ ID NO: 45079 - DNA, 50 bp, homo sapien
aactacttctgaagcattttgtcatsaaataccttctatagaataatttt

SEQ ID NO: 45080 - DNA, 50 bp, homo sapien
aggtgaggaaaatgaagctaagaaasataacatgacttcccattgccact

SEQ ID NO: 45081 - DNA, 50 bp, homo sapien
agttgataagaaaaggcaatggtagratattaagaaaatcaaaagttaga

SEQ ID NO: 45082 - DNA, 50 bp, homo sapien
gaagggtattaacgttttacagagargagatggattggtctttttgaagt

SEQ ID NO: 45083 - DNA, 50 bp, homo sapien
ttctatagaacactattctggagacygaatgacacagtatgttcactcag

SEQ ID NO: 45084 - DNA, 50 bp, homo sapien
attttttcctttaacatcatttctakctaggttttcattttttcttttgg

SEQ ID NO: 45085 - DNA, 50 bp, homo sapien
taaaagttaacagttctcttcactayaaaaggcttgttaaaagaagaaaa

SEQ ID NO: 45086 - DNA, 50 bp, homo sapien
tgattttctccatcaaatgttatacyaatcttatttcctgtctaaacaat

SEQ ID NO: 45087 - DNA, 50 bp, homo sapien
agcaagaaactaactggtgggagtaragtgtgaagcacaaacgtgctaaa

SEQ ID NO: 45088 - DNA, 50 bp, homo sapien
caatgcagtgataagatttgatatcrctttgacgactaacattcaagtaa

SEQ ID NO: 45089 - DNA, 50 bp, homo sapien
atcaaccatgatttgagagaataagratacaaagttagtgtttaaaaaga

SEQ ID NO: 45090 - DNA, 50 bp, homo sapien
tatttactgcctcgaatttggacatrataaagtacatcaacatatctaga

SEQ ID NO: 45091 - DNA, 50 bp, homo sapien
gtacctgaaatggtagactcaaataygtgaatcgatccatgcacagattg

SEQ ID NO: 45092 - DNA, 50 bp, homo sapien
agacaaaggatattgcagtggatacyagaagaaccaaacatcatatgttc

SEQ ID NO: 45093 - DNA, 50 bp, homo sapien
tgtgtttgagaaacgtggcccactayatagctcttttaaagatttacagc

SEQ ID NO: 45094 - DNA, 50 bp, homo sapien
gtaagtgacaaaattaaaggtaccaratagcatgtcccagtgtattctat

SEQ ID NO: 45095 - DNA, 50 bp, homo sapien
cagtgtatactgtgctagttgttacrcagaataagtaagacaaggtaagt

SEQ ID NO: 45096 - DNA, 50 bp, homo sapien
atacattttattgaagactttggaayaacggtgaggtctcgttgatgaca

SEQ ID NO: 45097 - DNA, 50 bp, homo sapien
aatatttgaattttaaaagccagtcwcattagatttcattacaaagacac

SEQ ID NO: 45098 - DNA, 50 bp, homo sapien
caaataaaacatgctgtgatatatgmacttgtcaatgaaagaataaagta

SEQ ID NO: 45099 - DNA, 50 bp, homo sapien
actgccagacgtggcagcagagtaakgacagtaagtttagcattctgttg

SEQ ID NO: 45100 - DNA, 50 bp, homo sapien
tctataaagtgaagaaactgagttayctctttgctgaattccctgcacaa

SEQ ID NO: 45101 - DNA, 50 bp, homo sapien
agataagcagttagagtgatgaacamgggctttatggtttgtataaacag

SEQ ID NO: 45102 - DNA, 50 bp, homo sapien
cttgcatttattctactttttagtcrcatcaagtaactgcacatttaaaa

SEQ ID NO: 45103 - DNA, 50 bp, homo sapien
cttttacaagtcgagactgcaacaargagagcgagtgcccaaggtcacag

SEQ ID NO: 45104 - DNA, 50 bp, homo sapien
ataggtgctagcaaagcacagtatgsaacagggtaaggttgatggaacat

SEQ ID NO: 45105 - DNA, 50 bp, homo sapien
aaagtataatataataaagctaaagsacaaagagtgtcacctgaaatgta

SEQ ID NO: 45106 - DNA, 50 bp, homo sapien
caaccgataagcttataaattatacrgatgttttaatttaaagattaaat

SEQ ID NO: 45107 - DNA, 50 bp, homo sapien
gtatttgccttaaatttaacttacaygttggcttctcagatgaagtgttt

SEQ ID NO: 45108 - DNA, 50 bp, homo sapien
accaatcaagaacatgatcttcctcrcaatttctctatctatcccatagc

SEQ ID NO: 45109 - DNA, 50 bp, homo sapien
aaggtttttttaaatgataactttargaaggtgatatacaaaacttatca

SEQ ID NO: 45110 - DNA, 50 bp, homo sapien
acttatcaaatgaaagctataaaagkcaggtctacacaggaaacaatgga

SEQ ID NO: 45111 - DNA, 50 bp, homo sapien
tgataagtatgtatgcatctaaacayagaaaggatactataaaaatacag

SEQ ID NO: 45112 - DNA, 50 bp, homo sapien
caaaactttgttaacacattagttasgatattcatatattcttactgtta

SEQ ID NO: 45113 - DNA, 50 bp, homo sapien
ccaacatattagtcttaaacaaaacrcattccaataaatgctccatctta

SEQ ID NO: 45114 - DNA, 50 bp, homo sapien
aaaaagactggaaataagacagaagratctgttagcatttatgattaaaa

SEQ ID NO: 45115 - DNA, 50 bp, homo sapien
aaaaaagttactaagtgaactaccayagagtcaatgaatttataagagaa

SEQ ID NO: 45116 - DNA, 50 bp, homo sapien
ctatttaaataggaaatatagacaarctgtttagcaaagtacttcggaat

SEQ ID NO: 45117 - DNA, 50 bp, homo sapien
cagatacttccagactttaatatctsaacatgatcttgcagttttgttct

SEQ ID NO: 45118 - DNA, 50 bp, homo sapien
aaactccgcagtaaggaaacaaacartctatttgaaaataggcaaaaaga

SEQ ID NO: 45119 - DNA, 50 bp, homo sapien
gatttttaattccactaacctaaccrcagatacactgcttgtcagataca

SEQ ID NO: 45120 - DNA, 50 bp, homo sapien
ggaggaaatagttaattaaatttgcyctaacgctgtgtctgtgtacagca

SEQ ID NO: 45121 - DNA, 50 bp, homo sapien
gttttataactaatagtttcactcamagattgataccgggaaggagtttt

SEQ ID NO: 45122 - DNA, 50 bp, homo sapien
aaccaaaacactgactacataaaacyatacagaactaccactcaagccac

SEQ ID NO: 45123 - DNA, 50 bp, homo sapien
atagccttactttgtgtactatgaamattctgtaggtcaaaaagagagac

SEQ ID NO: 45124 - DNA, 50 bp, homo sapien
tttaaattaaaatatgttttgatgaygactgtaaatgacactggtaaaat

SEQ ID NO: 45125 - DNA, 50 bp, homo sapien
actgaattatgcgtcatttaataaakacgggtgtgactcaacctgccatg

SEQ ID NO: 45126 - DNA, 50 bp, homo sapien
ttatagtgccctcttttggacagaartctttcagtttgatgtagtggaag

SEQ ID NO: 45127 - DNA, 50 bp, homo sapien
caccagcagtacacattgttgccatyactgaatattctctcattctaatt

SEQ ID NO: 45128 - DNA, 50 bp, homo sapien
ttgtgaatagtgttgcagaaatgtaygcctcatatagctgatggtcagag

SEQ ID NO: 45129 - DNA, 50 bp, homo sapien
agaaaaaaacacaaaaagatgtctcwccaattctgattccctgtaattca

SEQ ID NO: 45130 - DNA, 50 bp, homo sapien
aagaagtttgtttcccaaatgcaaasttaactgacttattatgaatatta

SEQ ID NO: 45131 - DNA, 50 bp, homo sapien
catttatggtatacagcaccataaayttaatgtacgtatacattgtgcaa

SEQ ID NO: 45132 - DNA, 50 bp, homo sapien
tatataagactgtataattcactgaytagtcttcattcatgaagttatgt

SEQ ID NO: 45133 - DNA, 50 bp, homo sapien
gccagtgtctgctctctttaccaccraaatatcctgctacatgtacaatt

SEQ ID NO: 45134 - DNA, 50 bp, homo sapien
atagtagtaatagtgcctttaatcaygtggttctttatggttgaaataat

SEQ ID NO: 45135 - DNA, 50 bp, homo sapien
atgtatgcgtattttagtgctattamaaggtgtaaaatatgtgatttaag

SEQ ID NO: 45136 - DNA, 50 bp, homo sapien
ccgatcctgtcctttgaacaatccamcttgggaggtaccttggattaact

SEQ ID NO: 45137 - DNA, 50 bp, homo sapien
caaggaagagatataacttgatggamagaaagtaggctttgaaatggcaa

SEQ ID NO: 45138 - DNA, 50 bp, homo sapien
cttagtccaatggcgtgcttcgtgayatctgagtaccagacgccagagga

SEQ ID NO: 45139 - DNA, 50 bp, homo sapien
atacaaatgtttgatgctttattaasaatttcactataacgtatttttat

SEQ ID NO: 45140 - DNA, 50 bp, homo sapien
taccagtttactgtaacaaaagtcarcaggtcatgtttaggtcatcattt

SEQ ID NO: 45141 - DNA, 50 bp, homo sapien
ctaagctacctaacagccttcttacycacaagtgtaatcaatattttaaa

SEQ ID NO: 45142 - DNA, 50 bp, homo sapien
atcatgaatgtagacatggaaaattraaggatttctaaaattcgtaccag

SEQ ID NO: 45143 - DNA, 50 bp, homo sapien
ttgtaagtattaatgtgaccttatcraattcatagagatgaaggtgaaat

SEQ ID NO: 45144 - DNA, 50 bp, homo sapien
aggaatttttattgaaacggcagaamatgcaatataattacaaacatatt

SEQ ID NO: 45145 - DNA, 50 bp, homo sapien
aaaacagtatgggcttgtattaagayagaggctgttgagtgggatgaagt

SEQ ID NO: 45146 - DNA, 50 bp, homo sapien
tatgaaaggctggaatgattcaagcygattccagaaccaggttcctaatc

SEQ ID NO: 45147 - DNA, 50 bp, homo sapien
catgcctactagccctgtctctaaastttacaaggtcttcttgtaaacat

SEQ ID NO: 45148 - DNA, 50 bp, homo sapien
ccagttagtacttgtaactcttccaratacaaagagttagtaatcaccct

SEQ ID NO: 45149 - DNA, 50 bp, homo sapien
ttattttacgtttacaaaagcatcawaaacatcaaatacgtaggagtaaa

SEQ ID NO: 45150 - DNA, 50 bp, homo sapien
taaaactcatgatcgcaaatttctaygatataatgacaagtgaatgactc

SEQ ID NO: 45151 - DNA, 50 bp, homo sapien
atctataaagtcactgatctaatcarcttggctctctgatttactctgtg

SEQ ID NO: 45152 - DNA, 50 bp, homo sapien
tggagcttacattctagttcaagcaktcagataataataagcataataag

SEQ ID NO: 45153 - DNA, 50 bp, homo sapien
agttccagattggaggtaccatataratgtttattcctggatcaatttgg

SEQ ID NO: 45154 - DNA, 50 bp, homo sapien
gatcaattagaaacatgttagctgcrccattcgtgactatttatttaatt

SEQ ID NO: 45155 - DNA, 50 bp, homo sapien
tgggatgcaaatatatgtgaggtccrgcttctggtaatatcttctcagag

SEQ ID NO: 45156 - DNA, 50 bp, homo sapien
gcttaccctaagagctacaataaagrcactccagctgtagacttgtccca

SEQ ID NO: 45157 - DNA, 50 bp, homo sapien
ttccaatgaaatattaaactatgaayctttgtggaattttatacttcttt

SEQ ID NO: 45158 - DNA, 50 bp, homo sapien
tttcttttatttcttgtggccattamctttatttcacagagaggttaaat

SEQ ID NO: 45159 - DNA, 50 bp, homo sapien
ctccctctgtgtgtatgagtactatmaaatacattctgaatttcactagc

SEQ ID NO: 45160 - DNA, 50 bp, homo sapien
ggacaagtgaaattttaaatcttagracataaatatccaataaaaatgct

SEQ ID NO: 45161 - DNA, 50 bp, homo sapien
tagaagaacaaagggaaatttgacaytgagacagtagatattaaggattt

SEQ ID NO: 45162 - DNA, 50 bp, homo sapien
tgagcatgctacatgaatttcctcaytgaacctccacaaataccttatca

SEQ ID NO: 45163 - DNA, 50 bp, homo sapien
cttcttttctgttcctgtatactacyatgttctgtgaatgagatatcact

SEQ ID NO: 45164 - DNA, 50 bp, homo sapien
atatacagtggtcctgacctcatccratttcaaaaccaatcgatcagttt

SEQ ID NO: 45165 - DNA, 50 bp, homo sapien
tattgagccacttgaatttattggargaaaggagctatataaataacagg

SEQ ID NO: 45166 - DNA, 50 bp, homo sapien
ggggaaggcacagaaaaaacagtgcyatattcttaaattggtgagtgatt

SEQ ID NO: 45167 - DNA, 50 bp, homo sapien
atgtttgcagcaagatgtggctagtyaccctggaattaaatataccactg

SEQ ID NO: 45168 - DNA, 50 bp, homo sapien
agggaaatgcagtgtttaagaaaaaygcaccaattgagagtatgagatca

SEQ ID NO: 45169 - DNA, 50 bp, homo sapien
ttgagaaatgcttgttctgtcttcaygcctgaggtttcttcttgtcaact

SEQ ID NO: 45170 - DNA, 50 bp, homo sapien
gtagctatgaatgcttcttccaaccrctgaataccttccttttgtccatc

SEQ ID NO: 45171 - DNA, 50 bp, homo sapien
gttcttgtgagtttaagaaaaatacycggtctcattgattctaagaagca

SEQ ID NO: 45172 - DNA, 50 bp, homo sapien
aatatgagcagtattctatcaataaycttgattgttcttggaaataccat

SEQ ID NO: 45173 - DNA, 50 bp, homo sapien
ttaaaacaaataatgcaatgtccagycgtcaggtttctgatttagtagat

SEQ ID NO: 45174 - DNA, 50 bp, homo sapien
ggaacacttaggagattgcatatgaraaactgcaggaggaagttatctat

SEQ ID NO: 45175 - DNA, 50 bp, homo sapien
cttttgcaaactgaatttcctagaaragccacaaaaccttaaaatgcaat

SEQ ID NO: 45176 - DNA, 50 bp, homo sapien
atttacatttcataggaaattaccayctgcttttaatgagtattagtcta

SEQ ID NO: 45177 - DNA, 50 bp, homo sapien
tctttttcacacactttatatacaayagaagacctacataccacatgaat

SEQ ID NO: 45178 - DNA, 50 bp, homo sapien
tcttagtctaaacttccaataactcrccagtaagaaattagcagttatct

SEQ ID NO: 45179 - DNA, 50 bp, homo sapien
gcagaaaggtactataactgcacgamacagagctcaagtatccctcaaat

SEQ ID NO: 45180 - DNA, 50 bp, homo sapien
agtacctttctgctttcctacatacmatactgaaggaaagggggtatgat

SEQ ID NO: 45181 - DNA, 50 bp, homo sapien
tgaagggtcttattatcttatgagasagtcatattttttgtattgtgtgc

SEQ ID NO: 45182 - DNA, 50 bp, homo sapien
agttggtgatggctagagtcatcccrgcaatcaaagggaatcttcgcact

SEQ ID NO: 45183 - DNA, 50 bp, homo sapien
aagtcaccactgtggacaggtttgarcataaataaggtagtagaggaaaa

SEQ ID NO: 45184 - DNA, 50 bp, homo sapien
tatctgcatacccttgtttctcagcrctccacctttgcatcttgcatgct

SEQ ID NO: 45185 - DNA, 50 bp, homo sapien
agtaaaaataaacctcaataaagacrcaccttcaaagttttactatgcaa

SEQ ID NO: 45186 - DNA, 50 bp, homo sapien
gatttctagctcctaagggtatcagrccttccaaaaaatatctcccaggt

SEQ ID NO: 45187 - DNA, 50 bp, homo sapien
cttcttttagtccagagactactaayatgattttgctaatacaaatatct

SEQ ID NO: 45188 - DNA, 50 bp, homo sapien
tacacatggcaataaggcagaaaaamattctcataggaatcaaagaagag

SEQ ID NO: 45189 - DNA, 50 bp, homo sapien
gggcaacagtcatccaaatgagggartagaaatggcgagttcaacaagca

SEQ ID NO: 45190 - DNA, 50 bp, homo sapien
atttttatatgaacttatcagtagastagccaaaaaagaagcttcatata

SEQ ID NO: 45191 - DNA, 50 bp, homo sapien
cgataaatactttctgaatgactaartgaacacagaggcatacgggaatt

SEQ ID NO: 45192 - DNA, 50 bp, homo sapien
aaagccagttgtgatgggagacgtascattttcgattcaggtggggaaaa

SEQ ID NO: 45193 - DNA, 50 bp, homo sapien
cattcagtactatctctgaaaaataragttgttcaaatttgaggccttta

SEQ ID NO: 45194 - DNA, 50 bp, homo sapien
aaataatgaaataaataccaggcacrcttagaaatggtgttatgggaatg

SEQ ID NO: 45195 - DNA, 50 bp, homo sapien
gaatggaatcctgggatccttgaaascacgtatgtttaagccaatgatat

SEQ ID NO: 45196 - DNA, 50 bp, homo sapien
cactctaagcaatctaaaatctctcyagttaactccagcaatggcaagga

SEQ ID NO: 45197 - DNA, 50 bp, homo sapien
tttcccttcttcaagtgctaaaatcraaggcacaactttgcagagcagca

SEQ ID NO: 45198 - DNA, 50 bp, homo sapien
tcaggcttaaagtccaaaatccacayaatgtacaatcctcttcattaagt

SEQ ID NO: 45199 - DNA, 50 bp, homo sapien
ccagtgttccaggttctactgtcaayccaggctcaggctgtcccacatcc

SEQ ID NO: 45200 - DNA, 50 bp, homo sapien
tttataatttatctcattattgacaygtttttgaatcttagattttttaa

SEQ ID NO: 45201 - DNA, 50 bp, homo sapien
tctgtgcaagatgttgtggatacaaraaaacataaggtctcagttcttaa

SEQ ID NO: 45202 - DNA, 50 bp, homo sapien
aggatttctgtgaaggtttaaaaaaragatagcaaatctaccatgtctag

SEQ ID NO: 45203 - DNA, 50 bp, homo sapien
ctagtggttatttataatttccagascttaactaatcacagaaatggctt

SEQ ID NO: 45204 - DNA, 50 bp, homo sapien
aattactctgtaaatcactgttaccyggaaaataatgagttggcagatat

SEQ ID NO: 45205 - DNA, 50 bp, homo sapien
ggccaaattgataatatatacaatcyagtagctttgttagttattcaagc

SEQ ID NO: 45206 - DNA, 50 bp, homo sapien
ttattccataaactacattaatttcrataaagaccatgagagcataggtc

SEQ ID NO: 45207 - DNA, 50 bp, homo sapien
tttaaattgtacatttgttttcaacyaaaatcagatattcttctttttat

SEQ ID NO: 45208 - DNA, 50 bp, homo sapien
tgtaggaagtgattaagcccttgacmaatgaaataacttataataacctt

SEQ ID NO: 45209 - DNA, 50 bp, homo sapien
gagctaaacaccaggatgagcttgayaaacactgtgtctgaggcagagga

SEQ ID NO: 45210 - DNA, 50 bp, homo sapien
aactctttaaactttggttgctaaaytgtaatgatataccacagatgtga

SEQ ID NO: 45211 - DNA, 50 bp, homo sapien
catgctcccactctacatccacagaytcgactacaggctgagtatccctt

SEQ ID NO: 45212 - DNA, 50 bp, homo sapien
agactttgaaaaacgaattcaaagawgtattgtaactgggatgggggcta

SEQ ID NO: 45213 - DNA, 50 bp, homo sapien
gagctaaggagagggaaaagaagagragtgattgtacacttagaggcaag

SEQ ID NO: 45214 - DNA, 50 bp, homo sapien
ctcgcaaattttccaggatgcttaayatgttgtagacgtgtatcatatat

SEQ ID NO: 45215 - DNA, 50 bp, homo sapien
gaaatgctttgttcctcagatttccsagattgaaagggtatgtgtataaa

SEQ ID NO: 45216 - DNA, 50 bp, homo sapien
tactatctggctcgttaaataaaaaygttgtcatcttctgctttaaaacc

SEQ ID NO: 45217 - DNA, 50 bp, homo sapien
tctaattctgcccatgccatctagcmacaaaccatcaacactttgcacct

SEQ ID NO: 45218 - DNA, 50 bp, homo sapien
tgggtgttacatgttgaaataaatayatacctggataacagacaagcttt

SEQ ID NO: 45219 - DNA, 50 bp, homo sapien
aggtggagaattaggataccaaagaraaaagctacattgaaataatacct

SEQ ID NO: 45220 - DNA, 50 bp, homo sapien
atactttacagaaatagaaaaagaayggaggagtgaaagagtcaattatg

SEQ ID NO: 45221 - DNA, 50 bp, homo sapien
atcaaataaaataatgacataaaacrcctagcacaatagctggtattcag

SEQ ID NO: 45222 - DNA, 50 bp, homo sapien
gcaagggtgacccagctcatctttcrcagattcagaaatgagacacatag

SEQ ID NO: 45223 - DNA, 50 bp, homo sapien
tgagtaaagctttatagagcaggtamaaactgagctgaattttgagggat

SEQ ID NO: 45224 - DNA, 50 bp, homo sapien
ctaagttctggagactgattcagacyatctaaacattgacactaattcag

SEQ ID NO: 45225 - DNA, 50 bp, homo sapien
tagatggtctgaatcagtctccagarcttagtcacataaggctgagggtc

SEQ ID NO: 45226 - DNA, 50 bp, homo sapien
gaagaattcgagtccttgaatagacygataagccctgaaattgaggtagt

SEQ ID NO: 45227 - DNA, 50 bp, homo sapien
tttacagccttctttttgaatagacrcatgtcctctgctgaactgaatta

SEQ ID NO: 45228 - DNA, 50 bp, homo sapien
gctggtgagttctgactggcgagtgycaatagttattaggtaggacttgt

SEQ ID NO: 45229 - DNA, 50 bp, homo sapien
atggaaaaagtcctgggtcaaataasgtttacagtttgggattggtaaac

SEQ ID NO: 45230 - DNA, 50 bp, homo sapien
ttttcattgtaagtttttacttatgratggaaggttgtttttctttaatg

SEQ ID NO: 45231 - DNA, 50 bp, homo sapien
aattgttattgcttctaaatagacaygacatttgtgtggaaatgaagttg

SEQ ID NO: 45232 - DNA, 50 bp, homo sapien
atgatgtgttaaataaaatggcagasgcatgtgtaagtgttctgggaagt

SEQ ID NO: 45233 - DNA, 50 bp, homo sapien
tactgagattcactacccttgaagakatttctgttcagagtacacaaaat

SEQ ID NO: 45234 - DNA, 50 bp, homo sapien
tttttggatgtcaatcagttacaaayatagactgaagccatcattgtaat

SEQ ID NO: 45235 - DNA, 50 bp, homo sapien
ggagccgaatctagaagatgtacacwcctggtcagaaaaccaggcaaccc

SEQ ID NO: 45236 - DNA, 50 bp, homo sapien
ttcaaagttctctgtccctattacaytgcaagggctcatagataacctta

SEQ ID NO: 45237 - DNA, 50 bp, homo sapien
taacaactatttgagagcactgacartaagattaacactcggttgattta

SEQ ID NO: 45238 - DNA, 50 bp, homo sapien
ctttgctttgtgtcagcctacatcaycgacgagaacccagaagttatgat

SEQ ID NO: 45239 - DNA, 50 bp, homo sapien
ttcggaaacaaaattttaaaagtcartattcaatataccatagtatactg

SEQ ID NO: 45240 - DNA, 50 bp, homo sapien
tttttactggttgagtttaaccatayaagtaagttagcactcaaagtcta

SEQ ID NO: 45241 - DNA, 50 bp, homo sapien
tcaagttcaagttgaaaaaatttcaraggagagtaaggattgtcttgttt

SEQ ID NO: 45242 - DNA, 50 bp, homo sapien
tttgcctaatgtctgtcttgatgacygccatctttataaatcactttaca

SEQ ID NO: 45243 - DNA, 50 bp, homo sapien
tgcaggtcacatgtaactaactcaamttcacattaataaacaagtcatag

SEQ ID NO: 45244 - DNA, 50 bp, homo sapien
gaggaagtaaggacctattcacaagragaacttaaaacttttttcctgtg

SEQ ID NO: 45245 - DNA, 50 bp, homo sapien
gtcaatttagcaagccttctgtaacygaaaggatatttactatgtgtatg

SEQ ID NO: 45246 - DNA, 50 bp, homo sapien
tagtttttacactaacatattttggmattataccttaatgaacttgaagc

SEQ ID NO: 45247 - DNA, 50 bp, homo sapien
taatttagtaaacaacaatacagtayaatgagcattaaaatgagatgttc

SEQ ID NO: 45248 - DNA, 50 bp, homo sapien
aaaaactaaaacacaaacagttaccyaccttcatcatagggcaatggtaa

SEQ ID NO: 45249 - DNA, 50 bp, homo sapien
caagataagaataacaaagaacatamtaaggcctgttgaatgctgttaaa

SEQ ID NO: 45250 - DNA, 50 bp, homo sapien
aaagaatgaaaatatctgcttatgasgagagtgttttgagagagttaacc

SEQ ID NO: 45251 - DNA, 50 bp, homo sapien
acttttcccttcctatctctctccawctttaattccacttctagaggtaa

SEQ ID NO: 45252 - DNA, 50 bp, homo sapien
cactccattctcacagtattattccraatcactacccttaaagaggtaaa

SEQ ID NO: 45253 - DNA, 50 bp, homo sapien
tgtttgaccaaaacttatgagtaccrcttacaaaaattacactataaaaa

SEQ ID NO: 45254 - DNA, 50 bp, homo sapien
ttaccaccttggcctacatacttgcyacaaatcacattattttatggagc

SEQ ID NO: 45255 - DNA, 50 bp, homo sapien
ttttgtttcctggtagaaataataaragtgccaggatgtgcacacctgtt

SEQ ID NO: 45256 - DNA, 50 bp, homo sapien
atcaagtacatctggtggacattgaycggtatcagcaaagatgggcaatt

SEQ ID NO: 45257 - DNA, 50 bp, homo sapien
caagagagagacaagtggcttagagyagttaaagaggaattgtaccaatg

SEQ ID NO: 45258 - DNA, 50 bp, homo sapien
agttggattttgtttttgtctcaaaytaagagcttactattgtttttata

SEQ ID NO: 45259 - DNA, 50 bp, homo sapien
atttctgcccccttgtagctagagamaataaatgaaaacatattcaacct

SEQ ID NO: 45260 - DNA, 50 bp, homo sapien
gggccagaggctgcttcaccataaartgattaggcaattgcacacaatct

SEQ ID NO: 45261 - DNA, 50 bp, homo sapien
gaaagttgaataaaggctaataagascaaagaagaaattataagagagaa

SEQ ID NO: 45262 - DNA, 50 bp, homo sapien
caggcattatcactatatcaagaagycttcaataagtgaaatataacaca

SEQ ID NO: 45263 - DNA, 50 bp, homo sapien
cccaaacatgagtccctttcacatgsacgtggtatgaaaaatagtatatt

SEQ ID NO: 45264 - DNA, 50 bp, homo sapien
aaagttttcactttctagcctctaartctgccaaaaactcaactcagttt

SEQ ID NO: 45265 - DNA, 50 bp, homo sapien
cacagttaaaaggtccagattcttaycgttcatgtaaaatcaaactacaa

SEQ ID NO: 45266 - DNA, 50 bp, homo sapien
tttaattttatgaatcggatttgagractatgggcttcactcgccaaaat

SEQ ID NO: 45267 - DNA, 50 bp, homo sapien
gtattaggacattagctcaaaaagaratgtgactaaaaatttttgctttg

SEQ ID NO: 45268 - DNA, 50 bp, homo sapien
tcaaatttttgtaataactttcaaaygaagagataatcagatgtgtggag

SEQ ID NO: 45269 - DNA, 50 bp, homo sapien
acagaagaaaagattagttaatcaaygcatatcaatagaaactaagcaaa

SEQ ID NO: 45270 - DNA, 50 bp, homo sapien
atgggattccagttgcctaaatgaascagtgcaacctctctctggaagcc

SEQ ID NO: 45271 - DNA, 50 bp, homo sapien
ctgcagtaagttatcctgaagatcargctaatatcattgataaaggtggc

SEQ ID NO: 45272 - DNA, 50 bp, homo sapien
tatggaaatgacttgttttcttaaaytctgaaccatgagccaagctctgc

SEQ ID NO: 45273 - DNA, 50 bp, homo sapien
ccttcccagtcatctcatcacaaaayctaatagagtgttgaaggcactga

SEQ ID NO: 45274 - DNA, 50 bp, homo sapien
gcatgaaccaaatataataaatataygtctgctatttagctttgcaattt

SEQ ID NO: 45275 - DNA, 50 bp, homo sapien
ggtgattagtaagattaaaatcggaycttcagctatccaatgtcaatgtt

SEQ ID NO: 45276 - DNA, 50 bp, homo sapien
tttaaactctaaagcagtcctcatgsaaaaagagaaatcataaccagtta

SEQ ID NO: 45277 - DNA, 50 bp, homo sapien
agatcagaaaacttagaaacagtaayaatgatgacaattagaatactagc

SEQ ID NO: 45278 - DNA, 50 bp, homo sapien
tactgctctaccatagagaataacamagatgtcatcaggtactaccttgc

SEQ ID NO: 45279 - DNA, 50 bp, homo sapien
ttgaatctatggtggtaataaaaaartaaagaacagctgtgcggagaggt

SEQ ID NO: 45280 - DNA, 50 bp, homo sapien
tctcttgcttaatatctttcaatgaytacacggagctttcagattagaat

SEQ ID NO: 45281 - DNA, 50 bp, homo sapien
taggcaaaaatactgacttttagacyaaatgatgatgtgtataaaatcat

SEQ ID NO: 45282 - DNA, 50 bp, homo sapien
aagagcagggaaagagtttaggctayaaggaagtagttgtgtgtcccaac

SEQ ID NO: 45283 - DNA, 50 bp, homo sapien
aggaagttgtgaaagatatcatagakgcaaacctacaaatgcttgtatag

SEQ ID NO: 45284 - DNA, 50 bp, homo sapien
tgaaagcctctgaaatgaaggtgtcragtaaaaatgattagagcagttag

SEQ ID NO: 45285 - DNA, 50 bp, homo sapien
gagatagattgttttatatgtttgaraagttctagtgtctgacataataa

SEQ ID NO: 45286 - DNA, 50 bp, homo sapien
ttgtgcctagtatgcttgagaaaatkatgtcaacattagatatttaagaa

SEQ ID NO: 45287 - DNA, 50 bp, homo sapien
atcaaaggagtagttggatataatargctggagtttagggctgagatata

SEQ ID NO: 45288 - DNA, 50 bp, homo sapien
cagaattcatttaccatctgctttayaagaatctggacactctatgtttc

SEQ ID NO: 45289 - DNA, 50 bp, homo sapien
cgcaatggcattcatgtctcttatcrcctttattaaggtctaatgaagta

SEQ ID NO: 45290 - DNA, 50 bp, homo sapien
tctgccccacatacataactttcatraataacccaagtcaggagagaaag

SEQ ID NO: 45291 - DNA, 50 bp, homo sapien
cagttagatattgtactcagtaaaayatgcttgtgattattttattttat

SEQ ID NO: 45292 - DNA, 50 bp, homo sapien
gtaagggatttgaggtggtttgaaarattatatacaataaaaaagaaaaa

SEQ ID NO: 45293 - DNA, 50 bp, homo sapien
aatttataatttgcacatgaggataygctgtgaaaattatagcccagtgc

SEQ ID NO: 45294 - DNA, 50 bp, homo sapien
aacatgctaccacagctccatgacasgtgctctgcagccattcagttcac

SEQ ID NO: 45295 - DNA, 50 bp, homo sapien
ctaacccagctgttaccctcaacccrgaaattccttctatctctataggc

SEQ ID NO: 45296 - DNA, 50 bp, homo sapien
agtgtcacttctctgctattcttggycatgtagggagcaggacttctccc

SEQ ID NO: 45297 - DNA, 50 bp, homo sapien
gcttttctttatcttcagtcttcatyacgcatttgcaatacattataaag

SEQ ID NO: 45298 - DNA, 50 bp, homo sapien
agaatagggaaggttctgggacacaraataagaaggacaaaagtttatct

SEQ ID NO: 45299 - DNA, 50 bp, homo sapien
aacatttattgaacttgcgcatttarccagactctatgctaagcaacaga

SEQ ID NO: 45300 - DNA, 50 bp, homo sapien
taggggggcttaatgaacagtaaatrattaccttcacttatttggggaaa

SEQ ID NO: 45301 - DNA, 50 bp, homo sapien
aatatcttatgaatgtcctactaaamttgaaagcctcgtgtagagatagg

SEQ ID NO: 45302 - DNA, 50 bp, homo sapien
cttcactgggttgctttgaagattaraagacatatgtacattttttaaaa

SEQ ID NO: 45303 - DNA, 50 bp, homo sapien
ccagccacttaaggagtagtcaagayacttttattgaaggaagaaaggat

SEQ ID NO: 45304 - DNA, 50 bp, homo sapien
taagtaaggacagattgtgtttttayggattgtatagagatttagctctg

SEQ ID NO: 45305 - DNA, 50 bp, homo sapien
tggttgataagacatgaaaatcttasagaagggatatttggaaagcagat

SEQ ID NO: 45306 - DNA, 50 bp, homo sapien
aatcctgaaggcagcccataggaagragaaaaaagagaagaaaatgacac

SEQ ID NO: 45307 - DNA, 50 bp, homo sapien
tcatttgccatatttctcaaaatacygtaaccattctttgcattttattc

SEQ ID NO: 45308 - DNA, 50 bp, homo sapien
gaagctaacattaccaggacaagtasgatctagaagaatgagaatcccat

SEQ ID NO: 45309 - DNA, 50 bp, homo sapien
taattcatttaattgatattattctsaaagctctcaaagccataagtgac

SEQ ID NO: 45310 - DNA, 50 bp, homo sapien
caagttatttttttaagggactataytagccattcttgaaaggtggtttt

SEQ ID NO: 45311 - DNA, 50 bp, homo sapien
ttctagtaagagtcattacctggaartcacagttcagaagcaaggcatca

SEQ ID NO: 45312 - DNA, 50 bp, homo sapien
tcataagcgagttttccatcatgtakgtcatttatccctgtcatttctta

SEQ ID NO: 45313 - DNA, 50 bp, homo sapien
aactttaagggacatttactaaatayctgatgaaactcattactctttaa

SEQ ID NO: 45314 - DNA, 50 bp, homo sapien
ttaaaattagcaggctatgcatagamatacaggttttcaaattctccctt

SEQ ID NO: 45315 - DNA, 50 bp, homo sapien
tattcttttgtcttctgcataaaccrctgcaggctgaaggccactgtgaa

SEQ ID NO: 45316 - DNA, 50 bp, homo sapien
tgttaaagaagtctttgggaccctaygtgtcaatttaatgcctagggtgc

SEQ ID NO: 45317 - DNA, 50 bp, homo sapien
acatatttctgtggaaagatacaagrcctaaaatggagtaatatgttttc

SEQ ID NO: 45318 - DNA, 50 bp, homo sapien
aatccaataaaattagaatagcaagsattattgtttccattttttagaca

SEQ ID NO: 45319 - DNA, 50 bp, homo sapien
taaatttaaacctgaaatgattaatrataccctacaatgtatacatctac

SEQ ID NO: 45320 - DNA, 50 bp, homo sapien
atgagccactgtgtccagccactaarccttattataagattttttttata

SEQ ID NO: 45321 - DNA, 50 bp, homo sapien
ggagagatgatacctcagatatgtcrctatggaaaagtaaaagttggcca

SEQ ID NO: 45322 - DNA, 50 bp, homo sapien
atctcaccattgggacgtcttggatratatacgtaagagaaaagttttca

SEQ ID NO: 45323 - DNA, 50 bp, homo sapien
aatcagtgggatttcgatggacaaasaagaggagggagaaaaatctctgg

SEQ ID NO: 45324 - DNA, 50 bp, homo sapien
aagacagatcatacttttctaagcaytccgtatattggacataaagaaat

SEQ ID NO: 45325 - DNA, 50 bp, homo sapien
aaaaatctttcataaaagtgcctatyaaatttgagcaagtgtaacaatcc

SEQ ID NO: 45326 - DNA, 50 bp, homo sapien
tcatagtccacaaagacttactctamattgcaacctattgcagtggaaaa

SEQ ID NO: 45327 - DNA, 50 bp, homo sapien
acttttggctgttacatacccacaarctctagttacaagacagtccttag

SEQ ID NO: 45328 - DNA, 50 bp, homo sapien
ctgttattaagcccttgcatttgtayagcccttcagttcgcagagtgtat

SEQ ID NO: 45329 - DNA, 50 bp, homo sapien
atccctttaatctgaagtattctctraatgcatttccattttaacgaaca

SEQ ID NO: 45330 - DNA, 50 bp, homo sapien
agctcagctggtaggttttcccagcsatttccttggtctgagcatctctt

SEQ ID NO: 45331 - DNA, 50 bp, homo sapien
taaagttaggaatacatctacaatamactgttattcctactctgattact

SEQ ID NO: 45332 - DNA, 50 bp, homo sapien
tcaaatattaatatctacagttaccygaaaaggctattgaatttcttctc

SEQ ID NO: 45333 - DNA, 50 bp, homo sapien
cacatgaataagcagaaatactctasgcgcttgattaataacaggttgtg

SEQ ID NO: 45334 - DNA, 50 bp, homo sapien
ataataagccttagtctcctcatagyccttatctgttaactagattacat

SEQ ID NO: 45335 - DNA, 50 bp, homo sapien
attggaggagagcaaagtagaggctmagatagtcagtgccttagctaaag

SEQ ID NO: 45336 - DNA, 50 bp, homo sapien
atcttctttggtgttggttgttccaraattactcacattctgctttgctc

SEQ ID NO: 45337 - DNA, 50 bp, homo sapien
gcattcactctgtaccaggaactcckctaagtattgcatgccctcagttt

SEQ ID NO: 45338 - DNA, 50 bp, homo sapien
ttcaaatttttcataaaaatttcaawtattcatgaagttaataacagtgt

SEQ ID NO: 45339 - DNA, 50 bp, homo sapien
aatctaataacacagccatggtatcycaatcacataaagcataaagaaca

SEQ ID NO: 45340 - DNA, 32 bp, homo sapien
gctgagggaactacacygtactcagttcatta

SEQ ID NO: 45341 - DNA, 50 bp, homo sapien
tggatgcttccataccagccctcaawagtgtcttattttgcatatgtcct

SEQ ID NO: 45342 - DNA, 50 bp, homo sapien
attgtgatatgtggtcaagaaagcartacttctttgaaatagtgatatca

SEQ ID NO: 45343 - DNA, 50 bp, homo sapien
atgcttatctctcccaaagatatccwcatatatacacccagaaataatgt

SEQ ID NO: 45344 - DNA, 50 bp, homo sapien
aaatagccttctgtgaaaaagtgacygtactctctagggagattatgttt

SEQ ID NO: 45345 - DNA, 50 bp, homo sapien
ctgttttaaagtacttaagtatttayatgtggacaatccagtggatattt

SEQ ID NO: 45346 - DNA, 50 bp, homo sapien
gcaacgccgcagtgtttataatagcraagaccagacacaacccacatgtc

SEQ ID NO: 45347 - DNA, 50 bp, homo sapien
ctggaccatactaggtgcagtgagtyaccatcttccttcgtgcggtttgg

SEQ ID NO: 45348 - DNA, 50 bp, homo sapien
gaaatcttcacaacacttctggaaaycattaaatactttcaatcctcaac

SEQ ID NO: 45349 - DNA, 50 bp, homo sapien
acggtgggcttaaagtattcagtaawccatatttcaaacagatgtgctat

SEQ ID NO: 45350 - DNA, 50 bp, homo sapien
ggtctctccaggataaccttatatamctttctttcctcattaatatgctg

SEQ ID NO: 45351 - DNA, 50 bp, homo sapien
tgtcttttactccaaagttgtactayctgagtttccagaagactcttatc

SEQ ID NO: 45352 - DNA, 50 bp, homo sapien
ctcagggaaggaaccacagtttttaygtatttcctccatctcatggacct

SEQ ID NO: 45353 - DNA, 50 bp, homo sapien
acattcaatactcaatgaataaaacygattttcaaaattagatgcttttt

SEQ ID NO: 45354 - DNA, 50 bp, homo sapien
aagtctaaaaagatgctagggtagaygcatggagaatctgtgtgaacaat

SEQ ID NO: 45355 - DNA, 50 bp, homo sapien
aattgatgtttattgaatcttacctractcagtcccctctctcactaaga

SEQ ID NO: 45356 - DNA, 50 bp, homo sapien
aaacatcaattaattgcctgctacaygtgggcatttttcacatattattt

SEQ ID NO: 45357 - DNA, 50 bp, homo sapien
acagcagtgtgagaatggactagtayacattactaacggaggcactgatt

SEQ ID NO: 45358 - DNA, 50 bp, homo sapien
ttaaggtaaaatcctatctaagatayagagatccagttgtgttttagggt

SEQ ID NO: 45359 - DNA, 50 bp, homo sapien
caggaatcctgtctctgttaaggtaraatcctatctaagatatagagatc

SEQ ID NO: 45360 - DNA, 50 bp, homo sapien
cctcattacaaggacctgaggagtayatcctgggcttcaatttatcagat

SEQ ID NO: 45361 - DNA, 50 bp, homo sapien
ttctcaggttatctgaattcactgcygcaggaaggcaccctcagaatcta

SEQ ID NO: 45362 - DNA, 50 bp, homo sapien
aattatttgacttcaggatagaagaytcatggcagagggctcttgatcct

SEQ ID NO: 45363 - DNA, 50 bp, homo sapien
tcatgtaaacataccttgacccacgraactgtgaaactgaggaactccac

SEQ ID NO: 45364 - DNA, 50 bp, homo sapien
taaaatcctttgaaatgtatttatgmaaacaaccttcttagatatgtatt

SEQ ID NO: 45365 - DNA, 50 bp, homo sapien
gggacacacaacacaaatgtgcaaartgattggggatgattcatcctgga

SEQ ID NO: 45366 - DNA, 50 bp, homo sapien
tgtgtgccaggcactgttctggccaygcaagatgcagcagttaaaaaaaa

SEQ ID NO: 45367 - DNA, 50 bp, homo sapien
tctgagaggttcactacaaaaaagakgatgcataagagaaaaatagccct

SEQ ID NO: 45368 - DNA, 50 bp, homo sapien
aagaacagtatgacacaaaatacaargtaaaagtcaagacaaccagttct

SEQ ID NO: 45369 - DNA, 50 bp, homo sapien
gttaaaaacaagggtggagttcttaycaatcaatagtcagaataagggtc

SEQ ID NO: 45370 - DNA, 50 bp, homo sapien
aaaattaactacccaatatgataccygctctaaagtaaagagaaaccatt

SEQ ID NO: 45371 - DNA, 50 bp, homo sapien
acttttgtaagtgtgtttctcacccraatcttacttggaggctctacatc

SEQ ID NO: 45372 - DNA, 50 bp, homo sapien
agtaacaattcattgagctgaaaggkcctctggagataagtgcagagtgt

SEQ ID NO: 45373 - DNA, 50 bp, homo sapien
attctttatagatcttcacaatcacrcaagtttctcacatttaacaataa

SEQ ID NO: 45374 - DNA, 50 bp, homo sapien
caagcttaacattggcaacatgtacrgaagattcccttactaattataac

SEQ ID NO: 45375 - DNA, 50 bp, homo sapien
aaacttccagaataactacctcatayggtcataaaagcagcctggtaggc

SEQ ID NO: 45376 - DNA, 50 bp, homo sapien
tataaaaagcaattatatatgactcyagtttacagatgaaatcactgaga

SEQ ID NO: 45377 - DNA, 50 bp, homo sapien
ggagcacatccaagaatttagcatcrctttcatgacatatgacaagcaac

SEQ ID NO: 45378 - DNA, 50 bp, homo sapien
tatctgtgatattcctattgcaaaartatcctcctattctaaaggaaaat

SEQ ID NO: 45379 - DNA, 50 bp, homo sapien
tttgtattatttgtattacttagtargaaggaacattatgaagatgctga

SEQ ID NO: 45380 - DNA, 50 bp, homo sapien
tggatctttctctttgcccttcttcrctgggtttataattttagaagaac

SEQ ID NO: 45381 - DNA, 50 bp, homo sapien
gttttatacaaaaaaatcttactatsagcagtaaactcagtaattgaatt

SEQ ID NO: 45382 - DNA, 50 bp, homo sapien
tataaactttaattgtgttaatattmaatagagaagctaaatagcagaat

SEQ ID NO: 45383 - DNA, 50 bp, homo sapien
cagcccactttcttccatttacttayatgcaaccaaattcaattcttagc

SEQ ID NO: 45384 - DNA, 50 bp, homo sapien
gggtccaaacatgtcctgctaaagarcttagaatttatgctgtaagtata

SEQ ID NO: 45385 - DNA, 50 bp, homo sapien
aagaacctgctcaaccactttggaaygcccctgttaagctcaccttacag

SEQ ID NO: 45386 - DNA, 50 bp, homo sapien
gcacttcgggtacaaagtgataaccrgacgtcatttttcttggaaaaatc

SEQ ID NO: 45387 - DNA, 50 bp, homo sapien
gcagcaagaatgtaagtttcaaatgyataagcaattttcaggccgctgct

SEQ ID NO: 45388 - DNA, 50 bp, homo sapien
tcttgagccttatgaactttgctgaygtgaaagatgaagcaacctaaggc

SEQ ID NO: 45389 - DNA, 50 bp, homo sapien
aaaattctgtcatagttatttatcarcatttttataaaaagtcaaaaagg

SEQ ID NO: 45390 - DNA, 50 bp, homo sapien
cacctcaaatgttcaaattcccttgraagtctcacagccacaaagacata

SEQ ID NO: 45391 - DNA, 50 bp, homo sapien
aaattttctcttatctttcatgatasatttaatgatagttagttctcatt

SEQ ID NO: 45392 - DNA, 50 bp, homo sapien
gcattgatgttcctgtaactctgcartaagtacttgagcacagccagact

SEQ ID NO: 45393 - DNA, 50 bp, homo sapien
ttcaacaaattggataattaagatgraagggtaaaagtccaaattactac

SEQ ID NO: 45394 - DNA, 50 bp, homo sapien
ctccagtggcttggaaatgggaagtwaaggattctgatcttatgtgagac

SEQ ID NO: 45395 - DNA, 50 bp, homo sapien
attcaaatggaaacaattttgtggcrctctactttctcttcactttagtg

SEQ ID NO: 45396 - DNA, 50 bp, homo sapien
tcagtcatccatctcatctttgttaygccaggataccagacaaatgcaat

SEQ ID NO: 45397 - DNA, 50 bp, homo sapien
aaacaggtcaaggaagtataaatacrataaatcagcttctgggattgccc

SEQ ID NO: 45398 - DNA, 50 bp, homo sapien
ttcccattatagttgtaatgtaaaakcctttctctttgttcccctttcaa

SEQ ID NO: 45399 - DNA, 50 bp, homo sapien
gcaaatagaaactactatccccaaasagtatatattggccagtaatcaca

SEQ ID NO: 45400 - DNA, 50 bp, homo sapien
aggaagacataaggccttagctgcayggaattatgatgactgagaagtat

SEQ ID NO: 45401 - DNA, 50 bp, homo sapien
atctacttagtctcagtcttactctyacctgagcaatggtgatgggttag

SEQ ID NO: 45402 - DNA, 50 bp, homo sapien
aaaacaaaaatgtcaggcagattatmaacctaagatttttattcggaaaa

SEQ ID NO: 45403 - DNA, 50 bp, homo sapien
atcaaacgttttaaactctccttggwagtgtaagggctgggaatgagagg

SEQ ID NO: 45404 - DNA, 50 bp, homo sapien
attttaggctgatatgtttttaatarctctagcttcatagatatcttgca

SEQ ID NO: 45405 - DNA, 50 bp, homo sapien
tacactgcctactccactaagcagamaataactacaggactttataattg

SEQ ID NO: 45406 - DNA, 50 bp, homo sapien
ttgtgtaccaacagtagtttcaccamcgtgcaaagaatgcattccttaca

SEQ ID NO: 45407 - DNA, 50 bp, homo sapien
tgtgacatttagaaagatgattaacrcttgggaagagtacaagacagtgt

SEQ ID NO: 45408 - DNA, 50 bp, homo sapien
aaactgtggatcgccaacagaaaaayagtagggcgcaagctcccccagtg

SEQ ID NO: 45409 - DNA, 50 bp, homo sapien
ttagaaaaatataaggtaaagtgatraaggacaatttcatttgggtcagt

SEQ ID NO: 45410 - DNA, 50 bp, homo sapien
atatctaaatctcttgctcctctaartcaagtaatctgtcaagctcttac

SEQ ID NO: 45411 - DNA, 50 bp, homo sapien
tagacaagcttgagatagagtaagasgaaagaatggtaagatacatcata

SEQ ID NO: 45412 - DNA, 50 bp, homo sapien
gaagcagaggaacaaaatgctgagaytatgaaccagaggcgaggacagac

SEQ ID NO: 45413 - DNA, 50 bp, homo sapien
aaaattggttttggaaatagtggaarcataacttaaaagtcgctgtgcat

SEQ ID NO: 45414 - DNA, 50 bp, homo sapien
tagagattttagtttaatacagtcaratggcttgtttagtaagtttattg

SEQ ID NO: 45415 - DNA, 50 bp, homo sapien
ggaaataattcagcatttggaattcracaaggtcttaactgccagctatg

SEQ ID NO: 45416 - DNA, 50 bp, homo sapien
tatctgagaaataaccaaaagacaayctaatcttttacatagttctctat

SEQ ID NO: 45417 - DNA, 50 bp, homo sapien
ccgtgggaaaaactttggaaattctracctacatcttttctctttgcatt

SEQ ID NO: 45418 - DNA, 50 bp, homo sapien
catttacagtgctttctgaaaaaaaytatttcctatccattcttaagtac

SEQ ID NO: 45419 - DNA, 50 bp, homo sapien
tggatagtttattttagtgggtgacrcaacctacaacctacccacctggt

SEQ ID NO: 45420 - DNA, 50 bp, homo sapien
tttaccttgtgataaatgatgtaaartggtacctgtatacagtaattcac

SEQ ID NO: 45421 - DNA, 50 bp, homo sapien
actttgcctgctattggaataatgayggcaagggaagattccctctattc

SEQ ID NO: 45422 - DNA, 50 bp, homo sapien
ttttcccacggtctttgtaacttgcmgactaggagattccctttggtgcc

SEQ ID NO: 45423 - DNA, 50 bp, homo sapien
taaagaaaaatttaagggcagacaargatttcctatttccttgggtaacg

SEQ ID NO: 45424 - DNA, 50 bp, homo sapien
cactgcacaagcatccacatatttayacttatcatctttcaactgttttt

SEQ ID NO: 45425 - DNA, 50 bp, homo sapien
agttgtgctcaaggaatccgaaagayaatgactgtatttggcaggctaag

SEQ ID NO: 45426 - DNA, 50 bp, homo sapien
taatatttttaaaaatcatagatcayaatttatgcccttgacaagctttc

SEQ ID NO: 45427 - DNA, 50 bp, homo sapien
agcaaaattatgttgagttgaatagraaacaaaggcatgtcttgatcttt

SEQ ID NO: 45428 - DNA, 50 bp, homo sapien
actacaggttctttctacttcaacaytggatctgtgaatttaactttcct

SEQ ID NO: 45429 - DNA, 50 bp, homo sapien
accatactgggcactacaaattccaygatgaataagatccagttaatgat

SEQ ID NO: 45430 - DNA, 50 bp, homo sapien
ggcaagcgtttaataaatgcaatccraaggtgaacttgcggcagagacct

SEQ ID NO: 45431 - DNA, 50 bp, homo sapien
tcacaggcactgtttcactggatcayctcagctgctgtgaggttgatatt

SEQ ID NO: 45432 - DNA, 50 bp, homo sapien
atatgtaatattcaactctcaataamaaatttccaggtatatgaagaaac

SEQ ID NO: 45433 - DNA, 50 bp, homo sapien
ccctttactttgatttgtggccactractttactctaatattgttttaat

SEQ ID NO: 45434 - DNA, 50 bp, homo sapien
aattgcttttgcatcaaccagatacsatcagtgcaaatatcaacatagca

SEQ ID NO: 45435 - DNA, 50 bp, homo sapien
ttggagctgaaaatgaccagagaacsaagcggcctgctttatcgtcagat

SEQ ID NO: 45436 - DNA, 50 bp, homo sapien
agtgatagaaacttgctttataataktatcaaggatctgcctacataaag

SEQ ID NO: 45437 - DNA, 50 bp, homo sapien
aggtatttaaattttagccatttgartacaaggaattgtgtttccttcct

SEQ ID NO: 45438 - DNA, 50 bp, homo sapien
atttcattgtcatacatttaatccawgaatgagcatattggaaaacttcc

SEQ ID NO: 45439 - DNA, 50 bp, homo sapien
tatttaactttaagtagtacagtaawccaataattggggaaattaggatg

SEQ ID NO: 45440 - DNA, 50 bp, homo sapien
cctttatccaataggacttgagtctmaaattgctactcatggctacatat

SEQ ID NO: 45441 - DNA, 50 bp, homo sapien
gcaatagttaattatacaagactaaygattgaaggttgtcctagcttgtg

SEQ ID NO: 45442 - DNA, 50 bp, homo sapien
gcactgcaacaagctaaatgatcacygattaggtacacaggacataattt

SEQ ID NO: 45443 - DNA, 50 bp, homo sapien
tgaataaagctttgcttagtctgatragtcctagcaaaccactcaacttg

SEQ ID NO: 45444 - DNA, 50 bp, homo sapien
caaaattggatttttttcaaatccascgtgctaccagctaaatctataga

SEQ ID NO: 45445 - DNA, 50 bp, homo sapien
acttttggagcatccttacatgggaraccactttgaattaatggatttac

SEQ ID NO: 45446 - DNA, 50 bp, homo sapien
gcacagaacactatgtgggtacttayctgattatctgatggcccagatta

SEQ ID NO: 45447 - DNA, 50 bp, homo sapien
gagtcctttgacttgattaactgacsaatgccacaggattatttaattct

SEQ ID NO: 45448 - DNA, 50 bp, homo sapien
acagtttaagtactggagtaggtgcygactgttaatatacaaaagcaaaa

SEQ ID NO: 45449 - DNA, 50 bp, homo sapien
ctttgtagatcattcccttcttcaamattatcctgaaatttagtccttgg

SEQ ID NO: 45450 - DNA, 50 bp, homo sapien
caatttaggatctgcctcacagtcartaagaataaataagaaaaaaaaaa

SEQ ID NO: 45451 - DNA, 50 bp, homo sapien
ccattgatgggtgaacataagaggamgatgaaaacagtaaaaacacctca

SEQ ID NO: 45452 - DNA, 50 bp, homo sapien
acctactttggcatggagactatatraaggaataaaagacaccatcctat

SEQ ID NO: 45453 - DNA, 50 bp, homo sapien
ttttcttcaccctagaaaattttacrcttggtccatatgaaaaattcccc

SEQ ID NO: 45454 - DNA, 50 bp, homo sapien
gtaacaatttttacaaaagctgcatwaaatggctagaattaaaacccttg

SEQ ID NO: 45455 - DNA, 50 bp, homo sapien
tctggatgttcttccatgttaaaaartaggttgataaaatcatttttagc

SEQ ID NO: 45456 - DNA, 50 bp, homo sapien
gagagacatttctaacggacttacasctctcttttcttttgaatgaggat

SEQ ID NO: 45457 - DNA, 50 bp, homo sapien
ccaaagggtatgacaggagaaaaggratagagctgttccaaccagaagat

SEQ ID NO: 45458 - DNA, 50 bp, homo sapien
taggcatttgagtccaggtcaaaaayggcagcagctgctgagtcccaggt

SEQ ID NO: 45459 - DNA, 50 bp, homo sapien
acactcaatatcattaaaacctacasagaatttggcatttgttatttcaa

SEQ ID NO: 45460 - DNA, 50 bp, homo sapien
gagtggtgaagaaataaacattatargctgggaagttggagacatttcta

SEQ ID NO: 45461 - DNA, 50 bp, homo sapien
gcttctgagattttagtttccataayttagtgtgtatattaaaaataaat

SEQ ID NO: 45462 - DNA, 50 bp, homo sapien
ttgtcttgatttccggctagttaatragtgtgacatatctttaaggtttg

SEQ ID NO: 45463 - DNA, 50 bp, homo sapien
tttgttcaatatttccaacttaagayattcagctaatggttttcgggcaa

SEQ ID NO: 45464 - DNA, 50 bp, homo sapien
cacacatgttgatttgtaaatggaasagagtcattgaagagtaattcttc

SEQ ID NO: 45465 - DNA, 50 bp, homo sapien
agtataacaataacatacatatggtraaaaattgaaaagaaacaaaagat

SEQ ID NO: 45466 - DNA, 50 bp, homo sapien
tttaataaagaacataggcttctcartagtcaaatgatttacccatggtt

SEQ ID NO: 45467 - DNA, 50 bp, homo sapien
aggtgatgaactagtaactattaaartaaggcaaaggaagatgctgtaca

SEQ ID NO: 45468 - DNA, 50 bp, homo sapien
cagcataatgattaacaaagaattakcacattacagatctaatcctgggc

SEQ ID NO: 45469 - DNA, 50 bp, homo sapien
taaatacacagcgaatggtgaaataygcaatagaactgtcttttctgaaa

SEQ ID NO: 45470 - DNA, 50 bp, homo sapien
ttaacaaattttcagaagactgaaaktaggtgatgaactagtaactatta

SEQ ID NO: 45471 - DNA, 50 bp, homo sapien
ctatctatcacctcagttatccacayctttaggaaatcaaactccttact

SEQ ID NO: 45472 - DNA, 50 bp, homo sapien
gtgatgaataaggcacagggaagagwattcaaaattttggaacatttatc

SEQ ID NO: 45473 - DNA, 50 bp, homo sapien
tatctcaagtggaggcaaagctaacwactacgtttccttctctcaatctc

SEQ ID NO: 45474 - DNA, 50 bp, homo sapien
tatttaacagcagctgctattactaygttgaatgtctcaaaatctttctt

SEQ ID NO: 45475 - DNA, 50 bp, homo sapien
tgataggacttggtttgtgatacttwaaaacttacatatttataataaat

SEQ ID NO: 45476 - DNA, 50 bp, homo sapien
tttgtccgttatttcctgcagagtaytacgttgtcagattgtaacctttt

SEQ ID NO: 45477 - DNA, 50 bp, homo sapien
atatattattttccatagatggataygcaatgttaaatatatctactgga

SEQ ID NO: 45478 - DNA, 50 bp, homo sapien
tttcatagttaaatgcactgaacgaytataaaagttcagcatgtactgac

SEQ ID NO: 45479 - DNA, 50 bp, homo sapien
atggaaaaatatatgactcatactcyaaatattgacaatctccaagtatt

SEQ ID NO: 45480 - DNA, 50 bp, homo sapien
ggagagtagcttttcagatattgtcraactagagagtttcaagattgagt

SEQ ID NO: 45481 - DNA, 50 bp, homo sapien
acttttatttctcaaggagcagatastagatatacataccatgttgactc

SEQ ID NO: 45482 - DNA, 50 bp, homo sapien
tcagaatgaaaatcaataaaacagaratcaaaatacaagataaaatggat

SEQ ID NO: 45483 - DNA, 50 bp, homo sapien
ataagtgtttatattttcaatacacragttaataagttcactgtaaatac

SEQ ID NO: 45484 - DNA, 50 bp, homo sapien
aggaaagatgctatctccataacatraagcgtaaggtgaagaatcacacg

SEQ ID NO: 45485 - DNA, 50 bp, homo sapien
aacttatgcccccagaaatcttttamacctgttaggatacacattatcat

SEQ ID NO: 45486 - DNA, 50 bp, homo sapien
cctttggttttccataaatagctcarggtaaagagttgacagtctatctg

SEQ ID NO: 45487 - DNA, 50 bp, homo sapien
ttagaggcttcccattgctcctagargtcaagatcccaggcctgactctg

SEQ ID NO: 45488 - DNA, 50 bp, homo sapien
gaataaagatagacaggggtgaacasatttgagagttacttagagttaaa

SEQ ID NO: 45489 - DNA, 50 bp, homo sapien
aatatattatcacctttgtatatttraaagtaactcagcctctctacttg

SEQ ID NO: 45490 - DNA, 50 bp, homo sapien
tgattgatctgcatactaaaaggaasggtgcctgataagcccaggtttgc

SEQ ID NO: 45491 - DNA, 50 bp, homo sapien
ctgacttcaaggaagaactcttacamataaagatagaatgcactgacaaa

SEQ ID NO: 45492 - DNA, 50 bp, homo sapien
taaaagtggactataaatttgtagartagctgaatatttcaatgaatatc

SEQ ID NO: 45493 - DNA, 50 bp, homo sapien
aataatggctagctcgttccaaacaygttattaaatctgtcataaataaa

SEQ ID NO: 45494 - DNA, 50 bp, homo sapien
actaatattcagcaatagaggctaaratacagtggaccttgatgcattta

SEQ ID NO: 45495 - DNA, 50 bp, homo sapien
agcactgaactgtgtactttaaatamgtgagtttatggcaggtgaatata

SEQ ID NO: 45496 - DNA, 50 bp, homo sapien
ctttgggagcaatatatggtgaacastggcaatgcaggcatctgctgtga

SEQ ID NO: 45497 - DNA, 50 bp, homo sapien
agaggaaaatgaatggcgcacctcaytcccagagcttttctgccagagag

SEQ ID NO: 45498 - DNA, 50 bp, homo sapien
taaggatacctctcaaagaaagaaawgcattagtcacatttaacctgatc

SEQ ID NO: 45499 - DNA, 50 bp, homo sapien
ggatccctagagagcagagctaatasgatagacataaatatacctataga

SEQ ID NO: 45500 - DNA, 50 bp, homo sapien
agtatggaaaaacaatcatcctaacrctatgtatttgatagcctatccta

SEQ ID NO: 45501 - DNA, 50 bp, homo sapien
ctgtagctaagaagtaatggaggaartgaaaaacgtcacaaaggacattt

SEQ ID NO: 45502 - DNA, 50 bp, homo sapien
tttctataagattgaaatttttcatrataagaaagctacaaaaagaagaa

SEQ ID NO: 45503 - DNA, 50 bp, homo sapien
acagaatgccgggaaatgaacaagaraggttcttagctattatgagcttg

SEQ ID NO: 45504 - DNA, 50 bp, homo sapien
taccatccttgtttgtctctaaagcycactctatggaaattattctagga

SEQ ID NO: 45505 - DNA, 50 bp, homo sapien
taaccatgaattagatgttgactatyataagtaacatttattgagggcaa

SEQ ID NO: 45506 - DNA, 50 bp, homo sapien
aactggtacttctgtaaaaatatcasctaaaggaatgactataatttcaa

SEQ ID NO: 45507 - DNA, 50 bp, homo sapien
tgaggtatcatgaaggaatctgatcratgtatctttcacaaacgtcaatg

SEQ ID NO: 45508 - DNA, 50 bp, homo sapien
tttcagtattagcttcctggagggtsaaattaccctatcccatagaacta

SEQ ID NO: 45509 - DNA, 50 bp, homo sapien
acactacacatagctagctagactaratatagatagatggatggctgtta

SEQ ID NO: 45510 - DNA, 50 bp, homo sapien
cttgaaatctgttttctctgattctraaacgattgtcaaagtttcaatga

SEQ ID NO: 45511 - DNA, 50 bp, homo sapien
caagatgtttcttcataaagatgcaygtgtttacaaatggtctaatgtgg

SEQ ID NO: 45512 - DNA, 50 bp, homo sapien
agcttccaagtttatcaataatccawtaagggtgttccaacagaagttga

SEQ ID NO: 45513 - DNA, 50 bp, homo sapien
ttcttgcttcttttgcccaagactaygcttcttgcaacctggcattgttt

SEQ ID NO: 45514 - DNA, 50 bp, homo sapien
aatcagcgcataagggaattctcacygtcaaggaattgaggtgaaaatct

SEQ ID NO: 45515 - DNA, 50 bp, homo sapien
gagacaggcaaggcaaaattatacawgctccttaccctaacattctcctc

SEQ ID NO: 45516 - DNA, 50 bp, homo sapien
tgctaatgtagaggatatatgctgcraggtgtccagaagatctagctaag

SEQ ID NO: 45517 - DNA, 50 bp, homo sapien
tacagaaccttctctttagcatcacygtgagaagtgggatccgtagaaag

SEQ ID NO: 45518 - DNA, 50 bp, homo sapien
caatgtggggtaatctttagctatgsaggttcatacactagctttcataa

SEQ ID NO: 45519 - DNA, 50 bp, homo sapien
cacacttttttcttccttgcttgcartagtgatggaaaggagaagtgaat

SEQ ID NO: 45520 - DNA, 50 bp, homo sapien
aagtgtacctttcaatgtgctgggckctctagaaaaacaggagaaagtgg

SEQ ID NO: 45521 - DNA, 50 bp, homo sapien
ttgctaagctttacattatttctagwacttgtaagattttaaaagtctta

SEQ ID NO: 45522 - DNA, 50 bp, homo sapien
tgataatttaacataatcagggaacsatgtttttattaactcagatcaac

SEQ ID NO: 45523 - DNA, 50 bp, homo sapien
cagtccaggtatgtatttactcatamagttgccctaattcaccttggatc

SEQ ID NO: 45524 - DNA, 50 bp, homo sapien
aaagtcaagacatagactctaatacrcacaggaattttaaattatgttaa

SEQ ID NO: 45525 - DNA, 50 bp, homo sapien
gaccatttcctgtccagattcatcaytaaaatggcctttatagttagtaa

SEQ ID NO: 45526 - DNA, 50 bp, homo sapien
gtagactctgacaagaaatcagccasgaagataggcccagactcaaatgc

SEQ ID NO: 45527 - DNA, 50 bp, homo sapien
tattaaagaaatatggtaatgaagayattttaggcaaagataagcttttt

SEQ ID NO: 45528 - DNA, 50 bp, homo sapien
attagttcatatgagaaagaaaagayacatactcttgcagttcagaagtt

SEQ ID NO: 45529 - DNA, 50 bp, homo sapien
caaattactgtcattcagggacatasatagaaatattctaaacaatattt

SEQ ID NO: 45530 - DNA, 50 bp, homo sapien
gccttgctactatatccgtgagattsaacccacataatttgggagatttt

SEQ ID NO: 45531 - DNA, 50 bp, homo sapien
taaccattaactatattccacttcaygtagcctctttttcttttcatgac

SEQ ID NO: 45532 - DNA, 50 bp, homo sapien
aaatggactcatggagaattacctayacttttgcatccttgaatgcagaa

SEQ ID NO: 45533 - DNA, 50 bp, homo sapien
aatacaaaacacctgtgcaacctcartctcctatcttacttaatggcaac

SEQ ID NO: 45534 - DNA, 50 bp, homo sapien
aaggagattccctgtttccatgtaamaagggtattttgggttgccattaa

SEQ ID NO: 45535 - DNA, 50 bp, homo sapien
gattcatgttaaacctctcttgtaamgttctcaatgtctatgtgtatact

SEQ ID NO: 45536 - DNA, 50 bp, homo sapien
tacaaagaatctagacttgccaaaakaaatttgaaaaaaaaaaatgagtt

SEQ ID NO: 45537 - DNA, 50 bp, homo sapien
agaaaggtatctgatttgcatagagyatataattgtcgtatatagaaaga

SEQ ID NO: 45538 - DNA, 50 bp, homo sapien
tactttcttctttataaaagaataaracttgagtaagcagtaggtcatta

SEQ ID NO: 45539 - DNA, 50 bp, homo sapien
acattatctccaggactatcaacaargttttagcattcaacttcagtaga

SEQ ID NO: 45540 - DNA, 50 bp, homo sapien
tgagtcactggcgtcagaactgaacmaatgaaagactctatactgtgttg

SEQ ID NO: 45541 - DNA, 50 bp, homo sapien
aagataaaaaacagcatgacctagamcaatttctcaaggacaaatttcaa

SEQ ID NO: 45542 - DNA, 50 bp, homo sapien
gggtctcgtaggtggttataatcaaytggtggctgaggctggtgtctttt

SEQ ID NO: 45543 - DNA, 50 bp, homo sapien
attcagattttaaaaaataaacatcracatacacagcacatatatcacaa

SEQ ID NO: 45544 - DNA, 50 bp, homo sapien
tgtgttttgtcttacctcaaattaaygttagaaatgtattcctattgctt

SEQ ID NO: 45545 - DNA, 50 bp, homo sapien
ctgtgaagttttcccttcttctcaamaccaatttaggtgctcctcagtgt

SEQ ID NO: 45546 - DNA, 50 bp, homo sapien
gaattagctgtaatttgtagcagagwctatgagttattcccaaaatccat

SEQ ID NO: 45547 - DNA, 50 bp, homo sapien
agatatggtacactcactacttttaygtaattgtgtgtgatgtatctgca

SEQ ID NO: 45548 - DNA, 50 bp, homo sapien
ttcctccatcttttgctgatactgaragccgccttacaatttgtttatta

SEQ ID NO: 45549 - DNA, 50 bp, homo sapien
tatccctggggcccagcacagtccckgacatatatagcaaatgttccaaa

SEQ ID NO: 45550 - DNA, 50 bp, homo sapien
ctggttcaagttactgtaatgtctgyattctttccacttcacaaaaatgt

SEQ ID NO: 45551 - DNA, 50 bp, homo sapien
tacattttagctcttcctctggcatrataccaggccatgggtccaagact

SEQ ID NO: 45552 - DNA, 50 bp, homo sapien
atttttatatgattcattaatactaygtgaatgaaacattgtactactta

SEQ ID NO: 45553 - DNA, 50 bp, homo sapien
atctaatatccaatgcattgggtaartgtaacttcttctagcacccctac

SEQ ID NO: 45554 - DNA, 50 bp, homo sapien
agtcccatttagaaacttaagtacaygcatagtttagcttcaaaaccaga

SEQ ID NO: 45555 - DNA, 50 bp, homo sapien
cacatgtgaggtcactcctgtatcaygcctttttaaaaatagagcctcac

SEQ ID NO: 45556 - DNA, 50 bp, homo sapien
acaaaactagatagctactagatacratgcaattagaaaacaactcatct

SEQ ID NO: 45557 - DNA, 50 bp, homo sapien
ctttagcatcctcatttataaaataygaagtggtctctttggtcttgtcc

SEQ ID NO: 45558 - DNA, 50 bp, homo sapien
ttctacatttagtaacatcttttcarcctttatctgccttctctgacttt

SEQ ID NO: 45559 - DNA, 50 bp, homo sapien
actgtattaagtagtataagtaaacraggtgatttaaagtatatgggagg

SEQ ID NO: 45560 - DNA, 50 bp, homo sapien
cagacatcattctcctatttaccaaytgtgtatgagcaaatttgcaccat

SEQ ID NO: 45561 - DNA, 50 bp, homo sapien
agttcctatctcacatcattgttatmaagattgggtgcacgtttgcaaaa

SEQ ID NO: 45562 - DNA, 50 bp, homo sapien
ttggatttttttctaaattacttagragagtttattagttgtgtatcaca

SEQ ID NO: 45563 - DNA, 50 bp, homo sapien
gagcacattaaagcctacagtacaartgcaaagggctatggaaaaacata

SEQ ID NO: 45564 - DNA, 50 bp, homo sapien
tctctctcaacaatactgtactgccrctagtaactgcggttggtcaacca

SEQ ID NO: 45565 - DNA, 50 bp, homo sapien
gtatcttgcaaatgaagtttagtaasaggataggaatgataggatgatgt

SEQ ID NO: 45566 - DNA, 50 bp, homo sapien
tgataaaagagcatgaggtcattgtsaatattcctggaaaaccaacgttc

SEQ ID NO: 45567 - DNA, 50 bp, homo sapien
aagtttccttctaaatgaattgatasggtgtaatcttttaaagaatcatg

SEQ ID NO: 45568 - DNA, 50 bp, homo sapien
aaatagctaattatgttatgtttgcyaaccaaggcagctgactcactagc

SEQ ID NO: 45569 - DNA, 50 bp, homo sapien
tttcaaatcataccatgaatgataastgtctactcatattctaggctggt

SEQ ID NO: 45570 - DNA, 50 bp, homo sapien
ttgtatttattttaggatgtaatttwaaaatgtcaatatgttctcagaaa

SEQ ID NO: 45571 - DNA, 50 bp, homo sapien
ctttgaaaattaaggattgtgagaamtagagaattgttaggagtgatact

SEQ ID NO: 45572 - DNA, 50 bp, homo sapien
gctcctgatagatccaatgtacaacraaactgacatacacacaaagcgat

SEQ ID NO: 45573 - DNA, 50 bp, homo sapien
taacaccaaggttatgggtgtagtgyaattgaaaattcaaagtaaaaaaa

SEQ ID NO: 45574 - DNA, 50 bp, homo sapien
tcatatggtacataggcatatggaargaagggtaaccactcctgacatca

SEQ ID NO: 45575 - DNA, 50 bp, homo sapien
atatttttaataaattgatagattgrataattggtaaattactaaatcca

SEQ ID NO: 45576 - DNA, 50 bp, homo sapien
gtcgcagaccattcttctcacatctsaagctctagattcctgattatgcc

SEQ ID NO: 45577 - DNA, 50 bp, homo sapien
ccaccttatataattatgtgtattayattaaacttctagtagaacccatt

SEQ ID NO: 45578 - DNA, 50 bp, homo sapien
ttaaaatgaatgaacagagttagtamagcaaagaaggaattttggcttct

SEQ ID NO: 45579 - DNA, 50 bp, homo sapien
tcaagagggtccaagagtaattctaycagtaaaaacgtattcaggttttc

SEQ ID NO: 45580 - DNA, 50 bp, homo sapien
aatgaataagggttattttcctggasagtgcttacagtcaataacttaaa

SEQ ID NO: 45581 - DNA, 50 bp, homo sapien
actgacagaagtaggcttcacaagaygggtagaaaaaactatgatgagct

SEQ ID NO: 45582 - DNA, 50 bp, homo sapien
gaaaggctgcggaacagctgaagtgmatgtgagaaccaatctttataagc

SEQ ID NO: 45583 - DNA, 50 bp, homo sapien
aaacaacaaaatatattatgaagaaygtctttgggttaactgtataaagg

SEQ ID NO: 45584 - DNA, 50 bp, homo sapien
ggatatcagaaagagagaatagtcaragatccaagcaggcaggcagcatt

SEQ ID NO: 45585 - DNA, 50 bp, homo sapien
ttttatgcagtaactgacttctcacygtctgaatgtggccaacacatctt

SEQ ID NO: 45586 - DNA, 50 bp, homo sapien
gccttgttgtcctaagtgggtatcayggacagagaacaatatctttgttg

SEQ ID NO: 45587 - DNA, 50 bp, homo sapien
ttaaattacgggtgtcatgaacaaamtaaacagaaagaatgggaaagggg

SEQ ID NO: 45588 - DNA, 50 bp, homo sapien
ttagcaattacattacttgctatgcyatcaaatgtctgcatttattttaa

SEQ ID NO: 45589 - DNA, 50 bp, homo sapien
ttgctttgtatttgtgtaccctctaygagactgagcactgtgatggcagg

SEQ ID NO: 45590 - DNA, 50 bp, homo sapien
ggacaagatatgaagcacgtaacagkctcttcctttgacctatgtacatg

SEQ ID NO: 45591 - DNA, 50 bp, homo sapien
aaaaaaatagattaagtcctcctgayctaatctactcctcttaatagaga

SEQ ID NO: 45592 - DNA, 50 bp, homo sapien
gctgttagaatagtttgacaagaaaygttatcagatggttgaaatccagg

SEQ ID NO: 45593 - DNA, 50 bp, homo sapien
aagttttttatgcatcatcttaaccyacatgaaacttgtaaagaatttac

SEQ ID NO: 45594 - DNA, 50 bp, homo sapien
caatacctcacatggatgtccaataycaatgtttattaaataaaatacac

SEQ ID NO: 45595 - DNA, 50 bp, homo sapien
ttgaactactatatctttgataagcmatttccacctcctaatcaagggaa

SEQ ID NO: 45596 - DNA, 50 bp, homo sapien
tgctactatcctttcaacagattccrcttcatcttaagttaatgagaaga

SEQ ID NO: 45597 - DNA, 50 bp, homo sapien
ttacagctctagaggttagaagtctraaaccaacgtatcagcgggactgc

SEQ ID NO: 45598 - DNA, 50 bp, homo sapien
gaaagaaaaacaagtattatgcgaarcaagcagatgtgaatagtgtaagc

SEQ ID NO: 45599 - DNA, 50 bp, homo sapien
ttcagaaggatgagtcaattagcagraatagaaccagattctcccacata

SEQ ID NO: 45600 - DNA, 50 bp, homo sapien
ctcacagaatgtctctgcacagatargatgggttcccaacagcagtgaga

SEQ ID NO: 45601 - DNA, 50 bp, homo sapien
gtggctaaaaatattggaaaatacartctgtgttgctagataatcaaata

SEQ ID NO: 45602 - DNA, 50 bp, homo sapien
aatggaaagtttggaagtcctggaamataggccatccactatactagaca

SEQ ID NO: 45603 - DNA, 50 bp, homo sapien
tgaagctaaatcctcatattttactraggcaaatgacctttcaaggatct

SEQ ID NO: 45604 - DNA, 50 bp, homo sapien
tctgcatcttcatgtgcattaaatamataacatctgagggtgacatcagc

SEQ ID NO: 45605 - DNA, 50 bp, homo sapien
attttattagtgaaaaccccagatasaggtgagctaagctatgtctgtct

SEQ ID NO: 45606 - DNA, 50 bp, homo sapien
agatttcaacacagtatgaagagaaycaattttataaacatgggaaaata

SEQ ID NO: 45607 - DNA, 50 bp, homo sapien
gcattagtaaaaatgaagataaaacmatgtactcagattcatgcacatgt

SEQ ID NO: 45608 - DNA, 50 bp, homo sapien
gtcttcccacccagaccataatctcygaaataattattaggaattttctt

SEQ ID NO: 45609 - DNA, 50 bp, homo sapien
acttaatcttctggaaaacattttarggaccacaaatacatattgtaccc

SEQ ID NO: 45610 - DNA, 50 bp, homo sapien
aaccctaagcttgtttctttataaaygtagtcacctattttctaaacagc

SEQ ID NO: 45611 - DNA, 50 bp, homo sapien
tatgagaagtatgaatgagattacasggtcgataagacatttggaattga

SEQ ID NO: 45612 - DNA, 50 bp, homo sapien
atgtggctgagggtcagaagggaccrcctgtgcttaggaaggttgcatga

SEQ ID NO: 45613 - DNA, 50 bp, homo sapien
ctatttttgattagaaaaattataaygattctacctactatgattctaga

SEQ ID NO: 45614 - DNA, 50 bp, homo sapien
taggcacctgagagatgaatatggcyacctgatctcagtgcctacatttg

SEQ ID NO: 45615 - DNA, 50 bp, homo sapien
agtgcattcctctggaaaggcaggaygacatagtaggaagggcactggca

SEQ ID NO: 45616 - DNA, 50 bp, homo sapien
gcttgcaacaagaataggatattgastattttcacacagttcttccacca

SEQ ID NO: 45617 - DNA, 50 bp, homo sapien
gacacattaaccaacatcctctttaygacttaatccatatttcagtgctt

SEQ ID NO: 45618 - DNA, 50 bp, homo sapien
aaggaaggatttaaaacatattatgraagtagattaactgggacttgggg

SEQ ID NO: 45619 - DNA, 50 bp, homo sapien
ataaattggaaaggcagagtgttccrgagataaggagtcagactttggag

SEQ ID NO: 45620 - DNA, 50 bp, homo sapien
tcttgggacattaagcagacacaggracttggtactctaactccagggaa

SEQ ID NO: 45621 - DNA, 50 bp, homo sapien
agcaaaaaataatcacacctatttawaatgagcaaagttgcatctccact

SEQ ID NO: 45622 - DNA, 50 bp, homo sapien
gagtgtttataaaataatcaatttcrcaaactattatctgaattttgtgt

SEQ ID NO: 45623 - DNA, 50 bp, homo sapien
acccagatctggtattacagaataargaatagattgtagggaggccattg

SEQ ID NO: 45624 - DNA, 50 bp, homo sapien
aagagaatttttacagagcactaaartattacattgttgaagatgaacat

SEQ ID NO: 45625 - DNA, 50 bp, homo sapien
actgcttgaggcggtgactaccacastgtatgttatatatggtgtatgta

SEQ ID NO: 45626 - DNA, 50 bp, homo sapien
tgagtttccaattttatcgcaaagartaaagtcttgattataacatggtc

SEQ ID NO: 45627 - DNA, 50 bp, homo sapien
ttggggttacctagcttatttcaggkactgctcctatcttgaatgagttt

SEQ ID NO: 45628 - DNA, 50 bp, homo sapien
agagaatatgggcctactttatttgmaacacttctgaaaagtatttcttg

SEQ ID NO: 45629 - DNA, 50 bp, homo sapien
ggccagaaaatgttctctgggtaaargctcttttgtgtaaatgaaactat

SEQ ID NO: 45630 - DNA, 50 bp, homo sapien
attaaggaataaaaatacatgatgaygtgaggtctttgaattgtggtggt

SEQ ID NO: 45631 - DNA, 50 bp, homo sapien
ggagggaaacaatgaggatcttcaayttagactgagaaaagcacactaat

SEQ ID NO: 45632 - DNA, 50 bp, homo sapien
gtgtgacagtcagcaaataggaaackgcattggatgtttctcccctttac

SEQ ID NO: 45633 - DNA, 50 bp, homo sapien
tcaagttaatgttctggttaatttaygctgattcctctaaagtcacacat

SEQ ID NO: 45634 - DNA, 50 bp, homo sapien
aagcttcattttagtcagtatttcartcgtcttcttgacaaaccttttat

SEQ ID NO: 45635 - DNA, 50 bp, homo sapien
aataaaaaaaatatacttaaaaaacrctgttatctatactgttaattatt

SEQ ID NO: 45636 - DNA, 50 bp, homo sapien
gggctgagtagagtcaattagataaraaagaccaggccgacttttcagta

SEQ ID NO: 45637 - DNA, 50 bp, homo sapien
actgctattaagacagatttgttgayggtgcttagaagtttttctcatca

SEQ ID NO: 45638 - DNA, 50 bp, homo sapien
ctgtcaatcaaaagggagatacggargaagtatagagcagataacactgt

SEQ ID NO: 45639 - DNA, 50 bp, homo sapien
ccattgatctaagtgacttttttctsaccagtactatattgtcttgataa

SEQ ID NO: 45640 - DNA, 50 bp, homo sapien
tcatttccccatgtatgaagtgcccrcctgtaatatgctgtgttccactt

SEQ ID NO: 45641 - DNA, 50 bp, homo sapien
agcttttccagtgtactacccccacrgactggtgatgagtgtctgcagct

SEQ ID NO: 45642 - DNA, 50 bp, homo sapien
aggaatgtctattatctaaaaattaygttctgaaccttgaaccctggtca

SEQ ID NO: 45643 - DNA, 50 bp, homo sapien
caaaaaaaattatatgaaaatgttcrgaaacacttgattccaggaaagga

SEQ ID NO: 45644 - DNA, 50 bp, homo sapien
gagagagtatctcaagaatttaataygttaagtttgagatgcttacaaga

SEQ ID NO: 45645 - DNA, 50 bp, homo sapien
agctagatggatggaggtgccattawctggaatgggaaaactagaaaaac

SEQ ID NO: 45646 - DNA, 50 bp, homo sapien
tcatgtacttggagcccatgtgagakgctctgtagacatctctgggcata

SEQ ID NO: 45647 - DNA, 50 bp, homo sapien
gcagattagtaagactgacgattgaygaataaagttaaaatgaaaatcag

SEQ ID NO: 45648 - DNA, 50 bp, homo sapien
tctaagctaggttagagttatcttcycttagaaatcaaaataatgggaaa

SEQ ID NO: 45649 - DNA, 50 bp, homo sapien
ctatctttaagtaccaaatactccartagcagggtagcaacatttattta

SEQ ID NO: 45650 - DNA, 50 bp, homo sapien
atatgtacacatatgctcacatgtaycaaatataactatataatatttta

SEQ ID NO: 45651 - DNA, 50 bp, homo sapien
aacaaaatgttgtagtagtaaatacraacataaagcataattaaatcttg

SEQ ID NO: 45652 - DNA, 50 bp, homo sapien
gtggtgtgcaggggcaaagggattaygtatatgtagcctgtcaattagag

SEQ ID NO: 45653 - DNA, 50 bp, homo sapien
actctcttgtattgtttgacattgarctaagccatctgtgacagtggttg

SEQ ID NO: 45654 - DNA, 50 bp, homo sapien
taagagattgcccagataagtacagyagaaaccttcctgaccctgactga

SEQ ID NO: 45655 - DNA, 50 bp, homo sapien
tggtagttcagtatcctataaagtamaaccaatccatctgtccgaaagcc

SEQ ID NO: 45656 - DNA, 50 bp, homo sapien
ataaacacctctaaaaattgtagtgyaacctctattaacgtgatttaaac

SEQ ID NO: 45657 - DNA, 50 bp, homo sapien
caagtcagacgtattcttctctaackcattctgtaaagccagtatcatcc

SEQ ID NO: 45658 - DNA, 50 bp, homo sapien
ggaggtaggacccaaaagtgagtcawccaatcccagaggcactgcgcatt

SEQ ID NO: 45659 - DNA, 50 bp, homo sapien
gatctatcctttgaccaaatttttcrctcttcaagggcctcatactgctc

SEQ ID NO: 45660 - DNA, 50 bp, homo sapien
caggcactgaggcgcctcattattargctaagaccatgaggaagggatct

SEQ ID NO: 45661 - DNA, 50 bp, homo sapien
actctaaagaacagtatgctactaaytggtgactgttgtattaattcaga

SEQ ID NO: 45662 - DNA, 50 bp, homo sapien
attcattgtatcatcaaccctgtaayctatgccagaaaacctctaaatca

SEQ ID NO: 45663 - DNA, 50 bp, homo sapien
aaaaacagatctgtcaagattggagratagaacatatttacttctgttta

SEQ ID NO: 45664 - DNA, 50 bp, homo sapien
cctgaccacacaacatttatttagaygtctgaagtttcttaaacatacat

SEQ ID NO: 45665 - DNA, 50 bp, homo sapien
cattccagtccactgctattcattayggtaaatttcttggtaggctaatt

SEQ ID NO: 45666 - DNA, 50 bp, homo sapien
caagcctgtggttctcaaaattacastccatcagaaacctctggagacct

SEQ ID NO: 45667 - DNA, 50 bp, homo sapien
tttgttatcttttcttacagggttaygactcactgattaaaaagagggac

SEQ ID NO: 45668 - DNA, 50 bp, homo sapien
tgcaggaccttataactaacgatgaygacttaaaggaaaagacatgatca

SEQ ID NO: 45669 - DNA, 50 bp, homo sapien
aaatatcttcttcccaaatctgtcasaaatctaaagaattatatcacaaa

SEQ ID NO: 45670 - DNA, 50 bp, homo sapien
tttggaaactgatgtgtttctatacygaggagaaaacagtttaaattgtg

SEQ ID NO: 45671 - DNA, 50 bp, homo sapien
tgatctaattatcatgtcttttatcrcaggcaaaagtagaaataaaacat

SEQ ID NO: 45672 - DNA, 50 bp, homo sapien
ccataattgattagctaatatttacrctgagaatcttcacatattctgta

SEQ ID NO: 45673 - DNA, 50 bp, homo sapien
aagtatacagcataaaattactcaayagtggcatttaaatttttttccat

SEQ ID NO: 45674 - DNA, 50 bp, homo sapien
tatatttagagttcaaaatatacagyagaaggtgctaaatgacccatgaa

SEQ ID NO: 45675 - DNA, 50 bp, homo sapien
ctgcacttggaataagaatgaaaccyagaattgcacctacctcagtaaaa

SEQ ID NO: 45676 - DNA, 50 bp, homo sapien
ggtggctgagaaaaaaaatagagcamtgcaaatctagtaaacaacactga

SEQ ID NO: 45677 - DNA, 50 bp, homo sapien
ttgactagcttccaggtgatatctayacagacaatgcctaagcgatttcc

SEQ ID NO: 45678 - DNA, 50 bp, homo sapien
tttttagttatatgagaatatttccygataatagacgtgaaatgaacttg

SEQ ID NO: 45679 - DNA, 50 bp, homo sapien
ctatggtcgatctttctaactttaargagtacacaactgaactcaattac

SEQ ID NO: 45680 - DNA, 50 bp, homo sapien
ttctagatacttcattggaattttaygtaatctaaatgtagcaagagcaa

SEQ ID NO: 45681 - DNA, 50 bp, homo sapien
gaaaaacatgcagtgtgacggagaartgctcaaagataggtagacgcctg

SEQ ID NO: 45682 - DNA, 50 bp, homo sapien
actttcctcggcgcagaaaggcacartaataaaccctgagatccccggaa

SEQ ID NO: 45683 - DNA, 50 bp, homo sapien
aaaactgacacagaatttaatttgcrctagtcagctaaagacacaaaatg

SEQ ID NO: 45684 - DNA, 50 bp, homo sapien
aggaatagtgatgcttttaggaacasagttattgagaaggaagtggtaat

SEQ ID NO: 45685 - DNA, 50 bp, homo sapien
agagactggggatattttcatggtaraaataagacatgatcagtactttc

SEQ ID NO: 45686 - DNA, 50 bp, homo sapien
aatatttgaatgttgctcatcaaggrcattcttactgttcagctgaccct

SEQ ID NO: 45687 - DNA, 50 bp, homo sapien
ggaaaggcctggagatagcccaacartatcctagtttgcaaagtaaaaga

SEQ ID NO: 45688 - DNA, 50 bp, homo sapien
caataagagactgaccaataatttarcgtgacatgcagggatatgcttca

SEQ ID NO: 45689 - DNA, 50 bp, homo sapien
tccattttgagtatatgggttctgayacaatacacaaagaggagaatatt

SEQ ID NO: 45690 - DNA, 50 bp, homo sapien
ccttgggaactacataaggtacagaycagatcatttgaaattagtccagt

SEQ ID NO: 45691 - DNA, 50 bp, homo sapien
agtggaggtaaatagaatttatggaraagttggtactagaccacggtgga

SEQ ID NO: 45692 - DNA, 50 bp, homo sapien
ccaatattattgataacacaaacaayagttaatccattaatcctcttcct

SEQ ID NO: 45693 - DNA, 50 bp, homo sapien
aatttataaacaaaaaaaatcgtackatagctaactataagcaatactta

SEQ ID NO: 45694 - DNA, 50 bp, homo sapien
ttaatcctcttccttttgcttgggartcatattttaactgaaaggcttaa

SEQ ID NO: 45695 - DNA, 50 bp, homo sapien
cattggaataaaactggaaggaagakgttagattatcattattaataact

SEQ ID NO: 45696 - DNA, 50 bp, homo sapien
tagtttttgctgaaagttctcccaaygaatgtgcacggagatggaatgca

SEQ ID NO: 45697 - DNA, 50 bp, homo sapien
aatctatctgaacttttaatgatcargtaattccatacaatagacactta

SEQ ID NO: 45698 - DNA, 50 bp, homo sapien
tagtagctctaaggatacggacagamtatgatgaaaagatgaatatgtac

SEQ ID NO: 45699 - DNA, 50 bp, homo sapien
cgaatgctgattactttttgctataycagttttcatcatcagtaaataaa

SEQ ID NO: 45700 - DNA, 50 bp, homo sapien
ccatctgcactcactagagaccaaaygacaatgtggctaccacatcacag

SEQ ID NO: 45701 - DNA, 50 bp, homo sapien
ctttattctcacaaaaattccacatyacagacaaaagaatagaattgtgg

SEQ ID NO: 45702 - DNA, 50 bp, homo sapien
tcttatattctttatatctttagggycaggtgtaatacattgcaatagac

SEQ ID NO: 45703 - DNA, 50 bp, homo sapien
tctgagcaagattcttattcacgctyacctccatacctcatgtataaata

SEQ ID NO: 45704 - DNA, 50 bp, homo sapien
ttgcctaagaaatctaacatcctaartggaaaggcttcaaatatcaaata

SEQ ID NO: 45705 - DNA, 50 bp, homo sapien
tttataaatacaaccaacattggaayctccaaatgacaaatttatcaata

SEQ ID NO: 45706 - DNA, 50 bp, homo sapien
agtatggcatgtgcaaatgctgaaargtttaagaaaacatggattatttg

SEQ ID NO: 45707 - DNA, 50 bp, homo sapien
gttataaaatatgaaagtaccatgartatatgaaacagtaatgcacgggt

SEQ ID NO: 45708 - DNA, 50 bp, homo sapien
gtactgatgacacgtttacgctctcratgctctaaaggcttgaattgtat

SEQ ID NO: 45709 - DNA, 50 bp, homo sapien
tatttttgtcagcattgcttttcagkctagttaatacaaagacatttccc

SEQ ID NO: 45710 - DNA, 50 bp, homo sapien
ggccttatactaatacagtagtatamgatcatttctgtgtaagtaactga

SEQ ID NO: 45711 - DNA, 50 bp, homo sapien
aaatttttcaacctaatgtattccaytctcagggttcacaataaacccca

SEQ ID NO: 45712 - DNA, 50 bp, homo sapien
accttcactttaattgatttcttaamctctttatcttgctcattttttaa

SEQ ID NO: 45713 - DNA, 50 bp, homo sapien
cccctgccgccaaatcctgaacttgyaggtagatggtgtaaatatgtgtc

SEQ ID NO: 45714 - DNA, 50 bp, homo sapien
ggctcaaaaagatggcaattttctartaaaggaagcaacacagtaagttt

SEQ ID NO: 45715 - DNA, 50 bp, homo sapien
tcatcatgggttaaaaaaataatgawctattacaggaagtgaaacctaat

SEQ ID NO: 45716 - DNA, 50 bp, homo sapien
gatccaattagccattcatcttataragtggggagttctggagttccagg

SEQ ID NO: 45717 - DNA, 50 bp, homo sapien
tcacagactcttgcatacgttagaarcacgctatagtatcaagcaattga

SEQ ID NO: 45718 - DNA, 50 bp, homo sapien
gtttggggacttcatactagaataayggaagcaaagctgtgaagaccaga

SEQ ID NO: 45719 - DNA, 50 bp, homo sapien
taccctattatctctgatcaaaaatkatgttacttgtaccatttgctccc

SEQ ID NO: 45720 - DNA, 50 bp, homo sapien
ttaaatgcgacaacaagaaaaactcragagctgaatgaagagaggtggct

SEQ ID NO: 45721 - DNA, 50 bp, homo sapien
tcaaatgaagaacgtcctaattataygaaatctggcttccaaatgatcat

SEQ ID NO: 45722 - DNA, 50 bp, homo sapien
tgggagattctaaaagcgcaaatcartagcactttcctctatcctttttt

SEQ ID NO: 45723 - DNA, 50 bp, homo sapien
aactgatgttattgttgaattagtaragggacagacatcctgttgtgtga

SEQ ID NO: 45724 - DNA, 50 bp, homo sapien
agttgggagatcagcaaaaggtacamaaaataccagatttcaggaattaa

SEQ ID NO: 45725 - DNA, 50 bp, homo sapien
gaaattaaactggggctcctttggaygattactgcaattcaaatgactta

SEQ ID NO: 45726 - DNA, 50 bp, homo sapien
agctgagcccctttctgattattcakgttgatactaatagtcttctaaac

SEQ ID NO: 45727 - DNA, 50 bp, homo sapien
tcagttctgcttccatgatccttgayaagacgctcttgctattaatggac

SEQ ID NO: 45728 - DNA, 50 bp, homo sapien
ttaacagcaacaactcaaataccacyggattacgactccatctgtctatg

SEQ ID NO: 45729 - DNA, 50 bp, homo sapien
agtacaagataaagtaggagtgataytaaagagttaaaatttaatatata

SEQ ID NO: 45730 - DNA, 50 bp, homo sapien
ctggattacgactccatctgtctatraaaaatatcccgcatccccaccca

SEQ ID NO: 45731 - DNA, 50 bp, homo sapien
cttacaaagctgccaactcactaggraacaaaatgacactggatttcctt

SEQ ID NO: 45732 - DNA, 50 bp, homo sapien
ataaatttattttgtcataaacagartcaggaacagtaggaggaactagt

SEQ ID NO: 45733 - DNA, 50 bp, homo sapien
ttgaatcttcacactagaggttttamcattcaatcaattaggttctgaga

SEQ ID NO: 45734 - DNA, 50 bp, homo sapien
tgcctaaataaaagcaaattttaaargctgagaaaactatttttctgctc

SEQ ID NO: 45735 - DNA, 50 bp, homo sapien
aatgatgagagtactacacacaataygatttagttctaccagaagacaat

SEQ ID NO: 45736 - DNA, 50 bp, homo sapien
ctagaaatctctcaaaaaattcaaaygcccaagtaatgactattgaacac

SEQ ID NO: 45737 - DNA, 50 bp, homo sapien
aaagtgatattccagttgtcaccaayagataggcatggtcacagtagaat

SEQ ID NO: 45738 - DNA, 50 bp, homo sapien
aatcctagatccttattactagagayattaattcagtaggtctggaggga

SEQ ID NO: 45739 - DNA, 50 bp, homo sapien
atgttctctcccacacatttcctcaracatcattgctgcagtttaattcc

SEQ ID NO: 45740 - DNA, 50 bp, homo sapien
ttttcaagtttatgtcacgttaaaaraatgcatccaaataattaaaatta

SEQ ID NO: 45741 - DNA, 50 bp, homo sapien
gaaagaaaaaaatgcatatctcagamaagaggctttgtgactgtaagtag

SEQ ID NO: 45742 - DNA, 50 bp, homo sapien
tttgtatatagattctagaattcaayatgtagtaccaatataactattca

SEQ ID NO: 45743 - DNA, 50 bp, homo sapien
tcagatgttcctccaaactctctcaygcaaataatagataataaccacat

SEQ ID NO: 45744 - DNA, 50 bp, homo sapien
gtgagttcactaatccttcctctatsaatcacagttacttggataggact

SEQ ID NO: 45745 - DNA, 50 bp, homo sapien
gggtatgtaaaccaattttaactgaygaaaaggccaggaaagtttgtggc

SEQ ID NO: 45746 - DNA, 50 bp, homo sapien
attgggtcatggagtttaggagaagrcattccaggagacttaaatagcat

SEQ ID NO: 45747 - DNA, 50 bp, homo sapien
gctgttgatatatgcaacaacttgaygggtattatgctgcatgacaaaaa

SEQ ID NO: 45748 - DNA, 50 bp, homo sapien
actggatgaagggtacatgaaactcyctgtgctatttttttcaacaacta

SEQ ID NO: 45749 - DNA, 50 bp, homo sapien
catggaagcttatgggctgaatttayaagatgaatctagtgttcaaggtg

SEQ ID NO: 45750 - DNA, 50 bp, homo sapien
gataataagaactctgattcaaaaaygagacatatatcaagggaaaaact

SEQ ID NO: 45751 - DNA, 50 bp, homo sapien
ctttttaacaaattaatgtttggaarctcctcaaataagagattgaaata

SEQ ID NO: 45752 - DNA, 50 bp, homo sapien
agtatatggtagacagtcatacatayggataattattgtttacatacaga

SEQ ID NO: 45753 - DNA, 50 bp, homo sapien
tctcagaccagatcatgtctaactaygccaaagtgcaaactaaagaagtt

SEQ ID NO: 45754 - DNA, 50 bp, homo sapien
gatatcaggagttcaattttgcacayattaagggtaaaaatccattaaat

SEQ ID NO: 45755 - DNA, 50 bp, homo sapien
ggaagtggtgatataaaaggaattcrctactatcttgaactatgtgctaa

SEQ ID NO: 45756 - DNA, 50 bp, homo sapien
caaagttaaaaggaacgattcccacratgcaaccttcaatcccagtcagc

SEQ ID NO: 45757 - DNA, 50 bp, homo sapien
aacactgcattgctcatatttttgcrctctagagattagaaatttaatgt

SEQ ID NO: 45758 - DNA, 50 bp, homo sapien
gcagatgtgttttgtttgcttaataktaaatcccttttgtaaagtttata

SEQ ID NO: 45759 - DNA, 50 bp, homo sapien
accatatcttgggacttgattagtaygaagtcacatttaagtttggagta

SEQ ID NO: 45760 - DNA, 50 bp, homo sapien
ctgctattctgtcccactcctctacraaattctttcctcttttgaattcc

SEQ ID NO: 45761 - DNA, 50 bp, homo sapien
ggagaaccacagcttgattacatacyatccaatgggtttcaaagcttata

SEQ ID NO: 45762 - DNA, 50 bp, homo sapien
tttcctttaagactcaaatcttagcragagtagttcatactcactgtctt

SEQ ID NO: 45763 - DNA, 50 bp, homo sapien
ttgtcttcagagatgctggacttacratatcaaccaacctgctctctagc

SEQ ID NO: 45764 - DNA, 50 bp, homo sapien
aaaacacattctaacactgtctaagractgtctatgagtgagatttttat

SEQ ID NO: 45765 - DNA, 50 bp, homo sapien
catcattatacattatatgggagaawtatcttatagtgaaactgaaggaa

SEQ ID NO: 45766 - DNA, 50 bp, homo sapien
taggaggctgttttagccactggagractccaatgcttcttgaagttctc

SEQ ID NO: 45767 - DNA, 50 bp, homo sapien
taatgaatcaatgaacagtaaattaygatacgagctcttttcagggaggg

SEQ ID NO: 45768 - DNA, 50 bp, homo sapien
ttacagttctggagatcctaagtctraaatgggttcagtggatgaaaatc

SEQ ID NO: 45769 - DNA, 50 bp, homo sapien
cacaattacagctattaaaaggatcyagagtcagcatgaacttaaagaaa

SEQ ID NO: 45770 - DNA, 50 bp, homo sapien
acatgtttccagaaacagagaaccaytcacgactttccaataaagctatt

SEQ ID NO: 45771 - DNA, 50 bp, homo sapien
ataagctggcccattaacactattastaacctaaacacacatacgcatgc

SEQ ID NO: 45772 - DNA, 50 bp, homo sapien
atgagaaaaatttccaaacttattcwagtccacttttgtatctttcagga

SEQ ID NO: 45773 - DNA, 50 bp, homo sapien
cctagggctgtgtcatgaagtctackacatgggcgctgctaaggcattgg

SEQ ID NO: 45774 - DNA, 50 bp, homo sapien
aagaaaaaggagagatgactagcctyactagatatttttaaagcagcttt

SEQ ID NO: 45775 - DNA, 50 bp, homo sapien
atccgcatgagtgctccataactackaacttcacattcttgaatgaaaca

SEQ ID NO: 45776 - DNA, 50 bp, homo sapien
gtggggaatcttacctttggtcatcrgacatgtagttttctatcaaaata

SEQ ID NO: 45777 - DNA, 50 bp, homo sapien
ctcccggattaggttgtaaacattayggcactgctttgctgtcagtttga

SEQ ID NO: 45778 - DNA, 50 bp, homo sapien
ttctgctcttaacacctacaggcacycttcttacatcaggaaagctccca

SEQ ID NO: 45779 - DNA, 50 bp, homo sapien
ggaggcactcagtaagtatttattgratgaataagtcaatgaataagtga

SEQ ID NO: 45780 - DNA, 50 bp, homo sapien
agtatttattgagtgtgaaacaaatwagatgttccaagtaaaatgtaaag

SEQ ID NO: 45781 - DNA, 50 bp, homo sapien
atgacaaccaagcacacatttgatastacagtactaagaaagatttgggg

SEQ ID NO: 45782 - DNA, 50 bp, homo sapien
tattaaagcatacagctggactttayattatacccaagtttgtagtcgtg

SEQ ID NO: 45783 - DNA, 50 bp, homo sapien
agtatatcacaatagtagattgaacratgtgacagtgaaatttttgaaac

SEQ ID NO: 45784 - DNA, 50 bp, homo sapien
ctcatgcaccctaaagatgttataartgaaaacagtttactctgaatgag

SEQ ID NO: 45785 - DNA, 50 bp, homo sapien
tgtagtaattcttgaatagttgatayaatttttttcaaattatgatatta

SEQ ID NO: 45786 - DNA, 50 bp, homo sapien
ggctttaacttagagactgtttgcartagtagaaatctggaaatagagtt

SEQ ID NO: 45787 - DNA, 50 bp, homo sapien
aaaagttaataatcccttagtaataygtatctaagaacaatctacttata

SEQ ID NO: 45788 - DNA, 50 bp, homo sapien
aatttgggttcattctcacagagaaraggttattaaggctcagactggac

SEQ ID NO: 45789 - DNA, 50 bp, homo sapien
ttcaagataagcactagaaaaaatascaatttgtttggaagaaagtagct

SEQ ID NO: 45790 - DNA, 50 bp, homo sapien
tcgaataccattatgtgacaattacmctggatttacagcaggtatagttc

SEQ ID NO: 45791 - DNA, 50 bp, homo sapien
gaatatcaaacattaaaataatacaraaggagagtaattcagattctcaa

SEQ ID NO: 45792 - DNA, 50 bp, homo sapien
tctgacacattcattattattaagaygtagggagtccaatatatatctgg

SEQ ID NO: 45793 - DNA, 50 bp, homo sapien
cagaaacatcattaaactgattagayggaaatggttctcacatttatctg

SEQ ID NO: 45794 - DNA, 50 bp, homo sapien
attttgtgtagtgttgggtttataargttgaatactggctaggagctatt

SEQ ID NO: 45795 - DNA, 50 bp, homo sapien
aggtatcatctggcagacaaataaaycctgtccttgtgcactgcacacat

SEQ ID NO: 45796 - DNA, 50 bp, homo sapien
gctgacactactcatagtgagaattyaaccttttcctcagaataccttat

SEQ ID NO: 45797 - DNA, 50 bp, homo sapien
agagcatattggttactttgattaawggctgatgatattaaaacagcata

SEQ ID NO: 45798 - DNA, 50 bp, homo sapien
gacaggatgatccaagggtttataasgtatctctaaggagccagtcaaga

SEQ ID NO: 45799 - DNA, 50 bp, homo sapien
tcatgaagatttagtaaaaaagtaartgctagccaacaaaagtctcctta

SEQ ID NO: 45800 - DNA, 50 bp, homo sapien
aaagtaagccattctgaaatttaacsatttaccacattttaaacacagtt

SEQ ID NO: 45801 - DNA, 50 bp, homo sapien
ttgtttttatttttattttttcatgkcaaagatgtcatagcattttattt

SEQ ID NO: 45802 - DNA, 50 bp, homo sapien
aaccatgcccttaccatgtgtttaaraataatagggcaggtccaagagag

SEQ ID NO: 45803 - DNA, 50 bp, homo sapien
tgaatgaaacatagcattaacaagartaatttaaggcaacaacattcctg

SEQ ID NO: 45804 - DNA, 50 bp, homo sapien
tagtagaggagctaaattgtaaaagraaacacttggagtcaccattgaca

SEQ ID NO: 45805 - DNA, 50 bp, homo sapien
ctcaagactccaatagacactcttaragaaggattgctgatggattgata

SEQ ID NO: 45806 - DNA, 50 bp, homo sapien
ttcttatctttgaagtgatctgtgaygcttagcttagtattgcccttagg

SEQ ID NO: 45807 - DNA, 50 bp, homo sapien
acagttaacttaaatttactatggaycaaaagtagagattattagattat

SEQ ID NO: 45808 - DNA, 50 bp, homo sapien
tcttgttattcatattattaaaaaarcaactattgtgtactggtcttaaa

SEQ ID NO: 45809 - DNA, 50 bp, homo sapien
aaatatcccagctccagcatttacarcatataatctctctggagcttttt

SEQ ID NO: 45810 - DNA, 50 bp, homo sapien
tttctcaatttttctgatatttctargctacgtagttcatagcagctttt

SEQ ID NO: 45811 - DNA, 50 bp, homo sapien
ggaatttcctagggactggtttaccrcaactatggaaagtactgtcagat

SEQ ID NO: 45812 - DNA, 50 bp, homo sapien
ctctcaacaccaagtccatctagtarcactgagcaataccgagcagcatc

SEQ ID NO: 45813 - DNA, 50 bp, homo sapien
ctttctttatccttactattggaaayggatcctgtctcggaagacctaag

SEQ ID NO: 45814 - DNA, 50 bp, homo sapien
agaaaacctcccatgagaaatgtgaygaacaagattgactttgcagggac

SEQ ID NO: 45815 - DNA, 50 bp, homo sapien
tgtattcttggcttgaggaataatgmaacgtgatctcaagacaagatagg

SEQ ID NO: 45816 - DNA, 50 bp, homo sapien
taagcacttgacctatcactatgccyaaggctttggtgcacattaccata

SEQ ID NO: 45817 - DNA, 50 bp, homo sapien
ggcaaaggagaggttgccaaaacccrgacagttgtcagaacccagaaaag

SEQ ID NO: 45818 - DNA, 50 bp, homo sapien
aactaccccattttcgtatgctaackctttcctgccagaccgtgtttgat

SEQ ID NO: 45819 - DNA, 50 bp, homo sapien
cttctataggttttcgagtgtaaatkagggagaaatgcagaataatttaa

SEQ ID NO: 45820 - DNA, 50 bp, homo sapien
tctgtgagttagaagacaaaggagcrgaataacccacaaaacaatcctca

SEQ ID NO: 45821 - DNA, 50 bp, homo sapien
tatagaagactgaaataataagagasagatttcatacatttcattttcat

SEQ ID NO: 45822 - DNA, 50 bp, homo sapien
tggcctcctagaaataactggagtaygggaattaaaaaactcagtcctca

SEQ ID NO: 45823 - DNA, 50 bp, homo sapien
cacacacaaacccaacctttaacacracatttatcctgagaaacagtctt

SEQ ID NO: 45824 - DNA, 50 bp, homo sapien
tatgaaattgcccatggaattttaayatgaaattgcagataattatttgt

SEQ ID NO: 45825 - DNA, 50 bp, homo sapien
ttctccactggtgaccaattttggcwaagttacatctattctgtaaaatt

SEQ ID NO: 45826 - DNA, 50 bp, homo sapien
atgaattacatgaatgttaaatatasagtcttcttttgacattaattacc

SEQ ID NO: 45827 - DNA, 50 bp, homo sapien
ggtcatctttatatactaagttttcraagaagaagaagatgactctgtga

SEQ ID NO: 45828 - DNA, 32 bp, homo sapien
agctttaataggacaarcccaaactcaaatca

SEQ ID NO: 45829 - DNA, 50 bp, homo sapien
gtgagagccctagctccagctcacaygtaccttcaactaatatgcacaag

SEQ ID NO: 45830 - DNA, 50 bp, homo sapien
gaagattctataattattttaacagraagagatctcctgatgcttctact

SEQ ID NO: 45831 - DNA, 50 bp, homo sapien
atacaaattcctctccttcctatgcmaaagtgctcggccatccagcacgg

SEQ ID NO: 45832 - DNA, 50 bp, homo sapien
agcagagtcatagagccttgaaataraagtaaaaatgtaaaccacggaga

SEQ ID NO: 45833 - DNA, 50 bp, homo sapien
aaattgtggaagaaatcttgtaataratatggcacagcagtgaaaatgaa

SEQ ID NO: 45834 - DNA, 50 bp, homo sapien
ccggttgtcaaaaggtttgtttagayatagtgcaggaaagagggagaaga

SEQ ID NO: 45835 - DNA, 50 bp, homo sapien
gaaaagataggatagctcaaatgaaygtattttcagcaacagacagaagt

SEQ ID NO: 45836 - DNA, 50 bp, homo sapien
tcatcttactctaatcttactttaamgacttcctaaatcacaaatgaaac

SEQ ID NO: 45837 - DNA, 50 bp, homo sapien
ctttctctttttccaccagttacaaygaattaaagacatacagtgtatta

SEQ ID NO: 45838 - DNA, 50 bp, homo sapien
aacagcagtagaatgtgaactaaaaygtgatagttatgcaagatatagta

SEQ ID NO: 45839 - DNA, 50 bp, homo sapien
atagataaaaattcagtagtgtataraacagcagtagaatgtgaactaaa

SEQ ID NO: 45840 - DNA, 50 bp, homo sapien
ctagcatacatctggcttatagtaartgcacaataaacaatgtgtaactg

SEQ ID NO: 45841 - DNA, 50 bp, homo sapien
ttccattctcattttaatattaaccmaattgtctaaatatcttatttaaa

SEQ ID NO: 45842 - DNA, 50 bp, homo sapien
ttaatcatcaaaactctagaaattasagcaggtttatcatattagtcgtt

SEQ ID NO: 45843 - DNA, 50 bp, homo sapien
tatatatatattgtataggctgtcaracttcattcatatttttatttact

SEQ ID NO: 45844 - DNA, 50 bp, homo sapien
tagtgtagattttttgaagactacartagaatatctagacacagggacct

SEQ ID NO: 45845 - DNA, 50 bp, homo sapien
acataggaaatagaatatagaatacygagaatgatttttatgagatctgt

SEQ ID NO: 45846 - DNA, 50 bp, homo sapien
tcaccctgatcatttctgttcccaayattgcttcagtatcttcccacttt

SEQ ID NO: 45847 - DNA, 50 bp, homo sapien
tatctgacaacccaacctcacataamggtagatttttcccctcttgctta

SEQ ID NO: 45848 - DNA, 50 bp, homo sapien
tttataatgcagggccaggagaagargattagacaaatatacaaaaacct

SEQ ID NO: 45849 - DNA, 50 bp, homo sapien
tgttaggcagcaatagataattagcrccatattaaaagaggcatttagag

SEQ ID NO: 45850 - DNA, 50 bp, homo sapien
ctttgtaggttttgcctcctcagtaycaagagcgccgaaggagtagtctg

SEQ ID NO: 45851 - DNA, 50 bp, homo sapien
aaaaaaggcactatgttggtctccargaagaattaaataggatacaaagc

SEQ ID NO: 45852 - DNA, 50 bp, homo sapien
tagtgaccttaagaaagtactgggaycaggatagagatttcaaggacatg

SEQ ID NO: 45853 - DNA, 50 bp, homo sapien
ggttaaagtgatgaaaatataactayggttaaatcattcatctgttgcaa

SEQ ID NO: 45854 - DNA, 50 bp, homo sapien
aacacagtgagtatattctgatggaygtcaaccattttttatcaactagg

SEQ ID NO: 45855 - DNA, 50 bp, homo sapien
ttgggtacctcagaatgtaggctaayctcggcttggcaatgaggagtttc

SEQ ID NO: 45856 - DNA, 50 bp, homo sapien
aagatactttattggcttgctcacaratagaatagcttgacacctacttt

SEQ ID NO: 45857 - DNA, 50 bp, homo sapien
tctaattgagttttcagattttaaasaacttacggactggaaactcatat

SEQ ID NO: 45858 - DNA, 50 bp, homo sapien
caggattccaaagctgggagtcaaaycctacgtccaatcccttggctcag

SEQ ID NO: 45859 - DNA, 50 bp, homo sapien
atatacaaagtattatggttgctcaraatagagtgtcgaaatgaggaaag

SEQ ID NO: 45860 - DNA, 50 bp, homo sapien
ttctaacacaaaacatttgagactastaacttcctatgcatttagttatc

SEQ ID NO: 45861 - DNA, 50 bp, homo sapien
tgggaaccattatcaaattttgacarcattaattcattaattcaatttgt

SEQ ID NO: 45862 - DNA, 50 bp, homo sapien
gaatgagtgtgaatggacagaatgaygttattaatcgctttggtaactgg

SEQ ID NO: 45863 - DNA, 50 bp, homo sapien
aaaggaagatccagtgagtcattccrcagtcatggatcatgtcatgaaat

SEQ ID NO: 45864 - DNA, 50 bp, homo sapien
acatcttattactgtaatccagaaaracttataattagaaaatcgttttt

SEQ ID NO: 45865 - DNA, 50 bp, homo sapien
ctgaatctacatttccttcagagcayattatgtagtgcattttcgtgcta

SEQ ID NO: 45866 - DNA, 50 bp, homo sapien
ttatacccagtgtcttggcctaaatratagtaataccaccctcttttttt

SEQ ID NO: 45867 - DNA, 50 bp, homo sapien
gtataaactgggattgtcctagatamacttatgaccgtcttgtccctctc

SEQ ID NO: 45868 - DNA, 50 bp, homo sapien
aggcaaaagctttgtcttttctcccragaacctagcggaatgactgccag

SEQ ID NO: 45869 - DNA, 50 bp, homo sapien
ttgttacagagaaattatttgctccraagttgtaaaagtacatacgtatg

SEQ ID NO: 45870 - DNA, 50 bp, homo sapien
gttatacaacaatatcattcattcartagatgtttatcaaatgcctaaaa

SEQ ID NO: 45871 - DNA, 50 bp, homo sapien
atgacttatcctcgggattcagttamctcagcctgacaccttttgtcctt

SEQ ID NO: 45872 - DNA, 50 bp, homo sapien
cattccggtgtctcacatttgcccayggactttactataatcatcaggac

SEQ ID NO: 45873 - DNA, 50 bp, homo sapien
tcttttgttccatcttcctcatggartcaattaactgttctaccatgaca

SEQ ID NO: 45874 - DNA, 50 bp, homo sapien
acaaacaagtaagaggtacactaagmagtagtcatgtttgacacagtaaa

SEQ ID NO: 45875 - DNA, 50 bp, homo sapien
gttgatagaatacaaatttggtgaaratctgaatcataatgacataaata

SEQ ID NO: 45876 - DNA, 50 bp, homo sapien
gttgtagcatatgacagaagtgtgcyctaaaaaaccacatctcttaattc

SEQ ID NO: 45877 - DNA, 50 bp, homo sapien
ttgagttatatttcaagtaattgcawtagcaaaaaggtgttaggagatta

SEQ ID NO: 45878 - DNA, 50 bp, homo sapien
aaacatcattaacacctgaaatctaygacttgtggctggagatcagtggc

SEQ ID NO: 45879 - DNA, 50 bp, homo sapien
ggaggtagtacaaaatgcaaaattaratgactgaaaaatcctgaacaaac

SEQ ID NO: 45880 - DNA, 50 bp, homo sapien
tagggatagaattttccttctacaarttgagaaagaaatagatacattgg

SEQ ID NO: 45881 - DNA, 50 bp, homo sapien
tgttgccagttagctacacgtataamataaaagtagcagctgctaaccta

SEQ ID NO: 45882 - DNA, 50 bp, homo sapien
cctgggttttagaatttctaaatccragagagcagatccaggattaaatg

SEQ ID NO: 45883 - DNA, 50 bp, homo sapien
ggaactagatgtaattcttaaggtaygattagattataaaattcagtgga

SEQ ID NO: 45884 - DNA, 50 bp, homo sapien
tttattgtgcttcttgatcctcacaygatccttggctgatttttcccact

SEQ ID NO: 45885 - DNA, 50 bp, homo sapien
atacttacctgaaaatcaaatatgamcttcctgtcatgtttgtcctgtgt

SEQ ID NO: 45886 - DNA, 50 bp, homo sapien
agcctttcttacagattccacatcartataattcctagaatcaagaaaaa

SEQ ID NO: 45887 - DNA, 50 bp, homo sapien
tagcacttcttaccacagagatctayggggagaaaaattgattaaagata

SEQ ID NO: 45888 - DNA, 50 bp, homo sapien
tggattcacacctaattctcctaagsctgatacatactgatccataatga

SEQ ID NO: 45889 - DNA, 50 bp, homo sapien
ggactctttaccgctatcatccacargtagatccactagcacatgtggtt

SEQ ID NO: 45890 - DNA, 50 bp, homo sapien
ctcctgtagactattattagtaaccygctacttcacttatctgcatccaa

SEQ ID NO: 45891 - DNA, 50 bp, homo sapien
ttgctttgctatttgcttcggaatayacatcaatctgaaaagccactccc

SEQ ID NO: 45892 - DNA, 50 bp, homo sapien
aagcaaatagcaaagcaagcgtgacmatttattggaagtttttatttatg

SEQ ID NO: 45893 - DNA, 50 bp, homo sapien
aagataccctccagtaactgtaacckgcaatcatttaaaaggaaatccta

SEQ ID NO: 45894 - DNA, 50 bp, homo sapien
acagttaagatagataagagatttaygtaaacatgttggattcttacaac

SEQ ID NO: 45895 - DNA, 50 bp, homo sapien
taaatgtggcacatttatacaatacratattagataagccaaatgagtgg

SEQ ID NO: 45896 - DNA, 50 bp, homo sapien
tgttggtaggaattcaaagtgaggcmaaaatataatgcaaccgaagaaaa

SEQ ID NO: 45897 - DNA, 50 bp, homo sapien
tggtggaataaaggaatcaggtgaayaggaaaagtcattttaaggtgtgt

SEQ ID NO: 45898 - DNA, 50 bp, homo sapien
tatttatacatacagtaccaactcayataaggctttactctttaccatat

SEQ ID NO: 45899 - DNA, 50 bp, homo sapien
aatccaaaatcattttatgctctaaytgtgaggtacatttatatttaaat

SEQ ID NO: 45900 - DNA, 50 bp, homo sapien
aagattaatcagactacatggtaagmaaagtaattctcagaagatcaact

SEQ ID NO: 45901 - DNA, 50 bp, homo sapien
gacctatgccaatcaaaatagaagakgactgtcctataaattcatagcac

SEQ ID NO: 45902 - DNA, 50 bp, homo sapien
ggtttaataaatatgaatgccttgawcctaggcaggtaaattcaatcagg

SEQ ID NO: 45903 - DNA, 50 bp, homo sapien
ccacctcacaggctgttggtctgacyagtttagctgcctttgggttaggt

SEQ ID NO: 45904 - DNA, 50 bp, homo sapien
ggctcacaacaaggaatcacaaaacygtagcttcccatggagactagaac

SEQ ID NO: 45905 - DNA, 50 bp, homo sapien
ctgtgacactcctgagtttgttatgmaatgctaagtttcctaaggacaga

SEQ ID NO: 45906 - DNA, 50 bp, homo sapien
gggaaaagaaactagattagagataygatcaaagggaatttagctttact

SEQ ID NO: 45907 - DNA, 50 bp, homo sapien
aggtatttggcaagtatttgctgaaygagtaaatggataattgttgtata

SEQ ID NO: 45908 - DNA, 50 bp, homo sapien
tgaccactccaattctgtaatataaygtacaatgtttcaaaaatatgggg

SEQ ID NO: 45909 - DNA, 50 bp, homo sapien
ggagtggcagggtgagtgtttcaaarggataagtagaacaggaatcttgc

SEQ ID NO: 45910 - DNA, 50 bp, homo sapien
tggtagaaattcactaggtcaggacygtatcacaaaagagaaatgaggga

SEQ ID NO: 45911 - DNA, 50 bp, homo sapien
ctccccgctctgctcttggacctacrctgaaaattcctaactggattaaa

SEQ ID NO: 45912 - DNA, 50 bp, homo sapien
aatttctgtaatgctagtagcgatakggtagcaaggaaagagtgtcaatc

SEQ ID NO: 45913 - DNA, 50 bp, homo sapien
ccaaactaatgcgctcgtcactcaarccaaaggaacctacaaacaaagtg

SEQ ID NO: 45914 - DNA, 50 bp, homo sapien
aaaattcttattttttactgttttakataccattgatgcctgcttatttt

SEQ ID NO: 45915 - DNA, 50 bp, homo sapien
aaaccaaacctgtttctgagtagaaragctcctagattagaaaattttgc

SEQ ID NO: 45916 - DNA, 50 bp, homo sapien
aaaggctttttatgtcagtaacatayatctaccccattcattttaatggc

SEQ ID NO: 45917 - DNA, 50 bp, homo sapien
cagccagttcaacccagagtatcaayagttgtcatagctgcatgttctta

SEQ ID NO: 45918 - DNA, 50 bp, homo sapien
tctcatgcatccaaagctcctgttaygaacattcctggattgtgaatttg

SEQ ID NO: 45919 - DNA, 50 bp, homo sapien
ctggagggtgtcttgtatacattgcmaagcagagcctcaaagctttcctg

SEQ ID NO: 45920 - DNA, 50 bp, homo sapien
tgctgttgctaagagtaataaagtcratggtctttctcccaggaatgtca

SEQ ID NO: 45921 - DNA, 50 bp, homo sapien
aacctgccctcatggaaagactttaygttagtgtgaaaagaacaatagaa

SEQ ID NO: 45922 - DNA, 50 bp, homo sapien
gttcattgttaatcggtaagacaaarctaagaacataaataccaatgatg

SEQ ID NO: 45923 - DNA, 50 bp, homo sapien
cccagatacaatatttatatggctcrctagtttctcagacagaattggac

SEQ ID NO: 45924 - DNA, 50 bp, homo sapien
catgaagcccaaggcccctcagttcygaaattctacaaggtcaggaagac

SEQ ID NO: 45925 - DNA, 50 bp, homo sapien
aaccttaattatctatactaagaagwcctgatgaaattatatgttaaagc

SEQ ID NO: 45926 - DNA, 50 bp, homo sapien
aatatttataaatctgtataatccayagagatgttaaggaaaacaaatgc

SEQ ID NO: 45927 - DNA, 50 bp, homo sapien
gatatcagcaaatgtgacataagcaraggctgaatataagcttgtgcact

SEQ ID NO: 45928 - DNA, 50 bp, homo sapien
gccttcagggtctctcccttgcatamgtttccaggctcatcattctcctc

SEQ ID NO: 45929 - DNA, 50 bp, homo sapien
ccaaaccagaagattatcactgttayattttggtgtctagtttaactgga

SEQ ID NO: 45930 - DNA, 50 bp, homo sapien
acttagctattcaattgtactcatamctgtattcacatctatatttcctt

SEQ ID NO: 45931 - DNA, 50 bp, homo sapien
aggaacaaccatagcaagaaaaacgraattgaatggcgccaaattgaaaa

SEQ ID NO: 45932 - DNA, 50 bp, homo sapien
gaattagtttattgtacctcaaaaaytgcacttctcctatgttagtgata

SEQ ID NO: 45933 - DNA, 50 bp, homo sapien
cctagcctgggacatgcaagaagatraaattcattttgcaatggttatgt

SEQ ID NO: 45934 - DNA, 50 bp, homo sapien
tgcaaatgcaaaaagccagaaatacratgaatagtgtctttaacatttaa

SEQ ID NO: 45935 - DNA, 50 bp, homo sapien
tctggctttttgcatttgcaattcayggctcataatacaaaattttcaag

SEQ ID NO: 45936 - DNA, 50 bp, homo sapien
acactaagaaaagaagttccaaggcygaaaataatgctgttaacattaat

SEQ ID NO: 45937 - DNA, 50 bp, homo sapien
gtcacaactaagtaaagaaataatamgtgttggaaaatacaagtgtgcag

SEQ ID NO: 45938 - DNA, 50 bp, homo sapien
ctacaatgacagggtgtatcacgcartcttctctagaagcaaaagtgcaa

SEQ ID NO: 45939 - DNA, 50 bp, homo sapien
acagcaaccagagtcaccttttagaytaataggacagattttggcactct

SEQ ID NO: 45940 - DNA, 50 bp, homo sapien
tgttgtctttccatgtcaccttacayactttattggttgaatgggattat

SEQ ID NO: 45941 - DNA, 50 bp, homo sapien
ataacacacaaattacaatgtcttcratgtgtatactgcctcacaggttg

SEQ ID NO: 45942 - DNA, 50 bp, homo sapien
atcataaagaatgggttcagtcaaayaaccaatgtaaggggactgaagca

SEQ ID NO: 45943 - DNA, 50 bp, homo sapien
ctttctttccccttcctgtggtctgraaattgtctccacacagaaagctg

SEQ ID NO: 45944 - DNA, 50 bp, homo sapien
cacctctaacagtaaatcagtactcrcaaatacttagaatagatctattt

SEQ ID NO: 45945 - DNA, 50 bp, homo sapien
ctttaccatgaaatctggattaaacrgttcgttattacagaggttctagg

SEQ ID NO: 45946 - DNA, 50 bp, homo sapien
ctcactacgttccatgctcttgccartatgccacggaaccgcatggctat

SEQ ID NO: 45947 - DNA, 50 bp, homo sapien
gagatgatggctagaattcatttgcrgaagggtattccatatagtagtta

SEQ ID NO: 45948 - DNA, 50 bp, homo sapien
gataacgaacatgaaagtgctttcaraagttttaagtgcaaagtctgact

SEQ ID NO: 45949 - DNA, 50 bp, homo sapien
ctgttgttggatggtatttacttagmaaagtctggaatatttaacgatgg

SEQ ID NO: 45950 - DNA, 50 bp, homo sapien
taaaaaaaaattcttaaatgaaaaaraaaggacacctcaactgaagatga

SEQ ID NO: 45951 - DNA, 50 bp, homo sapien
ttaggattaaatgagataaaataacygccatatgaaagccactcaataaa

SEQ ID NO: 45952 - DNA, 50 bp, homo sapien
tcaataagatgaaaagggagcttccyaaatatcactattatgactgagtt

SEQ ID NO: 45953 - DNA, 50 bp, homo sapien
tgagccaaaagaaatatcagccttakgtagaggatagggtcaaattttaa

SEQ ID NO: 45954 - DNA, 50 bp, homo sapien
aaatatttcagaataacaaaataagwctaacgcatattaaagtttactac

SEQ ID NO: 45955 - DNA, 50 bp, homo sapien
cctcttgattctcgatgctctctacmgaactaactttataaaacagagtg

SEQ ID NO: 45956 - DNA, 50 bp, homo sapien
cgagttataaataagtaagaacaagyaatgctagtataaagtacctagaa

SEQ ID NO: 45957 - DNA, 50 bp, homo sapien
gtgatattatagcatggagtttcaasagagtgacatattaaatgcaaaaa

SEQ ID NO: 45958 - DNA, 50 bp, homo sapien
ttttaagtgaactagaaaatgggcasgaatttgcggaacaacaggggtcc

SEQ ID NO: 45959 - DNA, 50 bp, homo sapien
ctcacccctgtctcgcagaaagcaasgaaaatggaaaaagagctatttat

SEQ ID NO: 45960 - DNA, 50 bp, homo sapien
gaaagataaagctagaatctgtagayggatgatagactacacagaccggg

SEQ ID NO: 45961 - DNA, 50 bp, homo sapien
gcatatttacttattaaaaaaaagcyaaccgatgattttcataagtagta

SEQ ID NO: 45962 - DNA, 50 bp, homo sapien
atcctacaagaaataaaaaatcatgrcaggctccgtagaagcagtgaaat

SEQ ID NO: 45963 - DNA, 50 bp, homo sapien
tgcccagaggagaccctttgagcaakgtatcattaaaatgtgatcgaaga

SEQ ID NO: 45964 - DNA, 50 bp, homo sapien
gtgcctagcacacatgtaatccttayagcagttttgtgcagtaaatacct

SEQ ID NO: 45965 - DNA, 50 bp, homo sapien
tggggagctttaaagaaatttctacyatgataaagaaaacataaggacta

SEQ ID NO: 45966 - DNA, 50 bp, homo sapien
atgttgtaagacaaggaaatgactamaagtttgagattgtggttccccct

SEQ ID NO: 45967 - DNA, 50 bp, homo sapien
catcaccatttaaggagaccattacyaattccaatgtgatctctgtcctt

SEQ ID NO: 45968 - DNA, 50 bp, homo sapien
gtcatacattttcccttggaattcasaaacaagtatattaatggtcatat

SEQ ID NO: 45969 - DNA, 50 bp, homo sapien
ggactaatacagatgctaaaatgccraatgagagttacagtcactgaaaa

SEQ ID NO: 45970 - DNA, 50 bp, homo sapien
aaaatggaaaaagagctatttatcasaaattggactttaaaaacatactc

SEQ ID NO: 45971 - DNA, 50 bp, homo sapien
tgagaaactaattagaataagctgawacatgattgaagttcggttgtggg

SEQ ID NO: 45972 - DNA, 50 bp, homo sapien
tagaaagtgggagtatactccaacaygtagatgaccttcttgtatgtagt

SEQ ID NO: 45973 - DNA, 50 bp, homo sapien
taggaagagccttacaagttctacarctattactttttcaacacataaat

SEQ ID NO: 45974 - DNA, 50 bp, homo sapien
aacaccagcatggatgacttccacartgatatgactttcatgcctcccag

SEQ ID NO: 45975 - DNA, 50 bp, homo sapien
agaacatctacgatgaacagataaayataactaacttccttttgcagtac

SEQ ID NO: 45976 - DNA, 50 bp, homo sapien
ggcacaaacaaggcaagttggtctcratatttcaggcacagaagacaaga

SEQ ID NO: 45977 - DNA, 50 bp, homo sapien
cactgcaatcttaaaggcaacgaacycgctttttagtattttgaaaggtt

SEQ ID NO: 45978 - DNA, 50 bp, homo sapien
gtttgactgagatatatagattctcraatattggctacttttgacctgct

SEQ ID NO: 45979 - DNA, 50 bp, homo sapien
caaaatttctatccatccttattaasacagattttatctgcctgccagtt

SEQ ID NO: 45980 - DNA, 50 bp, homo sapien
ttttaagaagacacatttttctaggraattgtgattgattaaatacgagg

SEQ ID NO: 45981 - DNA, 50 bp, homo sapien
gttttttgtaaggggcaaggtagtawatgttttggaccatagagccatgg

SEQ ID NO: 45982 - DNA, 50 bp, homo sapien
cccagcctcaaaaactattttgataraggtggtgtaatcttctaaagcca

SEQ ID NO: 45983 - DNA, 50 bp, homo sapien
gtatctttcccagttctcacttctcyattaacttggcctgctcatgactg

SEQ ID NO: 45984 - DNA, 50 bp, homo sapien
cctgttggtgttgttgatgctcaccratgaaagcagtcaggaaacctcca

SEQ ID NO: 45985 - DNA, 50 bp, homo sapien
acatagctatgttgttgcctataaamcacatcaccagcagtagataattg

SEQ ID NO: 45986 - DNA, 50 bp, homo sapien
agacgagagagagttgaattccagasattttttctgcaggaggtttatgg

SEQ ID NO: 45987 - DNA, 50 bp, homo sapien
agtcattgaacatcctctgtatgacrattcctctgctaagcacttcacag

SEQ ID NO: 45988 - DNA, 50 bp, homo sapien
atttttattgaagtcgtgaactccartaacattaagatgtaacacagtga

SEQ ID NO: 45989 - DNA, 50 bp, homo sapien
ttgatccatttcttgcagatctctcwcccaaacttttaaaaatattcctt

SEQ ID NO: 45990 - DNA, 50 bp, homo sapien
cctgaagacaaaatgtctacaaagargctattttataagcagcagcaacc

SEQ ID NO: 45991 - DNA, 50 bp, homo sapien
gcatgttttaacctttctggatttamggcaagtctctaagaggacacaga

SEQ ID NO: 45992 - DNA, 50 bp, homo sapien
agaacccaaagagaaattcaactcgmaaaatctaaagtaggcagcaaaga

SEQ ID NO: 45993 - DNA, 50 bp, homo sapien
atttattgtggcagattctttgcaayaaattcttgagcttgcatcatcct

SEQ ID NO: 45994 - DNA, 50 bp, homo sapien
attattgctttgttttaacatatgcragcaggcagaatacccagaataat

SEQ ID NO: 45995 - DNA, 50 bp, homo sapien
atgagaacatattcttgtctggtgamtaccatgaataatcatgacatcat

SEQ ID NO: 45996 - DNA, 50 bp, homo sapien
ttttcccccaacatatatgaaaatamcttttactcagaaaatgaacttct

SEQ ID NO: 45997 - DNA, 50 bp, homo sapien
gtatgtggttagggaaaccaagaagrcacaaagagattaaataacttgtc

SEQ ID NO: 45998 - DNA, 50 bp, homo sapien
taaaggaattaaactttgatacagaygagatagacaagatgaagtactca

SEQ ID NO: 45999 - DNA, 50 bp, homo sapien
atatattggtgtttactttatgtcargaaactgttattctacctgctttg

SEQ ID NO: 46000 - DNA, 50 bp, homo sapien
ctcacaaaaacctcttgggagtgacygaacgcaagtaacctaaaactgga

SEQ ID NO: 46001 - DNA, 50 bp, homo sapien
agtgtgtttgtaaattatagttcacycttatctggatagagagattaata

SEQ ID NO: 46002 - DNA, 50 bp, homo sapien
aagataagagctctggagacttccaygggtcagttaagaaagtatgtgaa

SEQ ID NO: 46003 - DNA, 50 bp, homo sapien
tgatatctaccaaccaagtagttcaygatttgtaagagttcatttataac

SEQ ID NO: 46004 - DNA, 50 bp, homo sapien
actgaggttccatgagctatctcgayggttgaaaatgaatctttgctctg

SEQ ID NO: 46005 - DNA, 50 bp, homo sapien
ttaaagtgaaatgaataatacatgcygatttaaagtgaaatgtgtacctc

SEQ ID NO: 46006 - DNA, 50 bp, homo sapien
gggaatctagttccaccgaaattcargtacaagaatgaaagcaggtgtct

SEQ ID NO: 46007 - DNA, 50 bp, homo sapien
ctaaaaagaaaactgaacaaaggacratacagatgtgtggaatgaatgct

SEQ ID NO: 46008 - DNA, 50 bp, homo sapien
gttgtctcttcctggaataacctagracatcctccttctagatcaaaact

SEQ ID NO: 46009 - DNA, 50 bp, homo sapien
tcatttctacttttctattgtgatayactttagaaaaaagtccttcatta

SEQ ID NO: 46010 - DNA, 50 bp, homo sapien
aaaatacatgccatgataccaaaaaygtgtttgccatttacctagtcttg

SEQ ID NO: 46011 - DNA, 50 bp, homo sapien
ttttacttaggtgaaacattattaawctgtactaacaatacagaaacata

SEQ ID NO: 46012 - DNA, 50 bp, homo sapien
caaatcttattagaaaagttgaatcrcatgactacatttatacaggggaa

SEQ ID NO: 46013 - DNA, 50 bp, homo sapien
tgatcaaatccatcttattttagtcrcttatctctcttacctgccattcc

SEQ ID NO: 46014 - DNA, 50 bp, homo sapien
gacttgttctaatttaccaagagtaraatgtttcaccaaatgtaccttat

SEQ ID NO: 46015 - DNA, 50 bp, homo sapien
actaaaagcttgcccgaattgcaacraagtactatggtttgaatgtcccc

SEQ ID NO: 46016 - DNA, 50 bp, homo sapien
agatggttttgaaaattagagatgaygtatttaagtacacagcaaatggc

SEQ ID NO: 46017 - DNA, 50 bp, homo sapien
ttgttattataaacttagacatgaartagagaaaggaggttaagttctag

SEQ ID NO: 46018 - DNA, 50 bp, homo sapien
tccattgcaaacagctgctatcataragttcctatcaagtgccagttgct

SEQ ID NO: 46019 - DNA, 50 bp, homo sapien
gctgactaagacactattgttattcyattccattgacctggcctgttgca

SEQ ID NO: 46020 - DNA, 50 bp, homo sapien
atctaaatactgggaatagcacaacrggaaaaatgtatgtaatgcttata

SEQ ID NO: 46021 - DNA, 50 bp, homo sapien
tcttgaaactgctgcaggagaaaaastaactctatagtaaattcaccagc

SEQ ID NO: 46022 - DNA, 50 bp, homo sapien
tataaaatcaaatatatctccataartctgtttgaaaaaacaaaactaca

SEQ ID NO: 46023 - DNA, 50 bp, homo sapien
tgattttccatgctcacagtgacgcrcatagaatgggctctctcattctc

SEQ ID NO: 46024 - DNA, 50 bp, homo sapien
cttccaatgggagcacaaatgtttayaatgatggtgcgtctaggatgaga

SEQ ID NO: 46025 - DNA, 50 bp, homo sapien
atcactatgaaattctacatacagtkacaaagacagaactatgacagacc

SEQ ID NO: 46026 - DNA, 50 bp, homo sapien
ccaaattactgttcttttcactctgkaagaattaaggtattttctctgcc

SEQ ID NO: 46027 - DNA, 50 bp, homo sapien
catttattcaagtcacatagaacgcygcatcaggatatttgtgcatggtt

SEQ ID NO: 46028 - DNA, 50 bp, homo sapien
cagagtcatgtgtccagttaggctayaaaactacaggcttctaatatttc

SEQ ID NO: 46029 - DNA, 50 bp, homo sapien
tcacccatacagacaattgatagaaygaggtcctgaacaatgtgcggagt

SEQ ID NO: 46030 - DNA, 50 bp, homo sapien
gtttaaaaaataaacataaggtgacrgccttaaagacaaaactaatgttt

SEQ ID NO: 46031 - DNA, 50 bp, homo sapien
gagagtcaaacactggaatgttttcwattacttattctatgattggtttg

SEQ ID NO: 46032 - DNA, 50 bp, homo sapien
attatttggtcttgcatgtgtctaamcttctccctagataatcaccttaa

SEQ ID NO: 46033 - DNA, 50 bp, homo sapien
gcagtgactcttgctgcccagaatgsacagcgatggtaagagacaccgtg

SEQ ID NO: 46034 - DNA, 50 bp, homo sapien
cgaatgtgcgcttgagtttgtcctayctgagacttcggactccgggaaga

SEQ ID NO: 46035 - DNA, 50 bp, homo sapien
gttccatggtttctgggtgccatgargatagatacaactaggtagcaaaa

SEQ ID NO: 46036 - DNA, 50 bp, homo sapien
gaagttgagttactttaccagaggcsaacacagagctgaaaatcggtctc

SEQ ID NO: 46037 - DNA, 50 bp, homo sapien
cccatttgctgttgtgtgcccagcargtatctgtttaaaactgtataaat

SEQ ID NO: 46038 - DNA, 50 bp, homo sapien
aatttaaggcaaaaaggagaaataargaattatgtcctcaaatggcatga

SEQ ID NO: 46039 - DNA, 50 bp, homo sapien
aagtacagtctgtctttccaaaacarattaatggtaagatatacctatag

SEQ ID NO: 46040 - DNA, 50 bp, homo sapien
caaacagaatttaaggagaacctaayctggaagaagcgttaaggaaaagt

SEQ ID NO: 46041 - DNA, 50 bp, homo sapien
atctatttataacttcctgacttgaygacaattttttaagaataatttta

SEQ ID NO: 46042 - DNA, 50 bp, homo sapien
attattattaaacttttaaaaatagratgatagggaattaaaacattaga

SEQ ID NO: 46043 - DNA, 50 bp, homo sapien
tttcagctatccataatatttcagcratttttacctgaatacacaacttc

SEQ ID NO: 46044 - DNA, 50 bp, homo sapien
tacagtaaggtagctggaaaagcgaragagctccagagatctgcaaaggg

SEQ ID NO: 46045 - DNA, 50 bp, homo sapien
ttatttaatttttactcactctaccrctgtaattagagaagcttttggtt

SEQ ID NO: 46046 - DNA, 50 bp, homo sapien
tagatgaagaagcagaaaatgtgacmataacttgagaaaatagtcaatag

SEQ ID NO: 46047 - DNA, 50 bp, homo sapien
tttaagccagttttattggagtagaraatggaaattatgacaacatcatt

SEQ ID NO: 46048 - DNA, 50 bp, homo sapien
ccttgttttgtttatttgactacaargaatctaacagaagccaaatgcct

SEQ ID NO: 46049 - DNA, 50 bp, homo sapien
tattactgctacaaaagaaaggtaawgttttgcaagatcatagaatagtc

SEQ ID NO: 46050 - DNA, 50 bp, homo sapien
tggataatcttaatgctataatctayatgacagtattactttttgggttg

SEQ ID NO: 46051 - DNA, 50 bp, homo sapien
tatgagaagaccctatttgaaatacygaagttgagttactttaccagagg

SEQ ID NO: 46052 - DNA, 50 bp, homo sapien
aaaaacttaaatgaactcctgatgaraggaaaatatatgtatattttatc

SEQ ID NO: 46053 - DNA, 50 bp, homo sapien
ctggagtgagatcctggaaaactcaraagtataggaaaggtctcactaca

SEQ ID NO: 46054 - DNA, 50 bp, homo sapien
agaagtcctaaaccaggcttgacaayggtgccagggcactgaaggatgcc

SEQ ID NO: 46055 - DNA, 50 bp, homo sapien
gctgctgcactcaggtagccgtttayagcccttgttgagctttcacaata

SEQ ID NO: 46056 - DNA, 50 bp, homo sapien
ccatctcctttctttccttggacacrgagagaacctgtttcatatggcag

SEQ ID NO: 46057 - DNA, 50 bp, homo sapien
ttccatcaaaattgtttgaacttgaycattcctgaacattaattgcttat

SEQ ID NO: 46058 - DNA, 50 bp, homo sapien
aagcttctgctcatataattttaagraggaagcagacaaaaaatatgaat

SEQ ID NO: 46059 - DNA, 50 bp, homo sapien
aaaatatgaattcatcttgagggcaycttgtgacagccagattcaaaggt

SEQ ID NO: 46060 - DNA, 50 bp, homo sapien
cattatatggtaaaataggctcaacracattgtcaatcctgaaaatccaa

SEQ ID NO: 46061 - DNA, 50 bp, homo sapien
gatagctttgttctgtttgcaggatyatattatatagtaaatgatattct

SEQ ID NO: 46062 - DNA, 50 bp, homo sapien
gaggcccaagctacattgcagtggakacccttttgaaagagtctaccata

SEQ ID NO: 46063 - DNA, 50 bp, homo sapien
ctaacctttacagtacactttcccartggaatatacagtctgtgtaccaa

SEQ ID NO: 46064 - DNA, 50 bp, homo sapien
aaagacatcttagttaaagctagagraagaaaacttcaaataagcaaaga

SEQ ID NO: 46065 - DNA, 50 bp, homo sapien
aattttcccaactggctatgtatgaygattgtattgtgagtgagtcattg

SEQ ID NO: 46066 - DNA, 50 bp, homo sapien
tcccatgacctgactgatcttattamcttctcagagttcttatatagttg

SEQ ID NO: 46067 - DNA, 50 bp, homo sapien
aaaaaaagtaagtaatcaagcaatargactatagactctagtctatcatt

SEQ ID NO: 46068 - DNA, 50 bp, homo sapien
tcaacatataacaaatagatgaagawactaaaaggaataatgactatgtt

SEQ ID NO: 46069 - DNA, 50 bp, homo sapien
tttactatttctctccaaaaaaagcratactagtccaggcttcagaagac

SEQ ID NO: 46070 - DNA, 50 bp, homo sapien
aggaatatttccaaattcattctatraggcagcttaaccctgatgccaac

SEQ ID NO: 46071 - DNA, 50 bp, homo sapien
tgattgaggaacatacggagtttagsatctctgggccaatgtttctgttg

SEQ ID NO: 46072 - DNA, 50 bp, homo sapien
cttaaatcctttaggtcccgagaatkagtacatgttgacaccttagtata

SEQ ID NO: 46073 - DNA, 50 bp, homo sapien
taaggtcttatttttggcaaggtcarcaacggcctctagtttctaaatca

SEQ ID NO: 46074 - DNA, 50 bp, homo sapien
ttacaaaagatagttaacaaagtaamtcagtgatatcttgctttgtgtct

SEQ ID NO: 46075 - DNA, 50 bp, homo sapien
gagatggagatggtgaataaaatagracacagaattcagaaatggacatg

SEQ ID NO: 46076 - DNA, 50 bp, homo sapien
aattcataattttcaaatggaaatartaactctcaatgcagacaggtttg

SEQ ID NO: 46077 - DNA, 50 bp, homo sapien
tctctgtttgcaaagagaaatcacawtggaaatatttctaaagattaccc

SEQ ID NO: 46078 - DNA, 50 bp, homo sapien
atcttctctgtgactagaccataacygatatcattactaaattattttaa

SEQ ID NO: 46079 - DNA, 50 bp, homo sapien
acgagccagtttgtagtacctgccaygtaggattgccagataaaaccaaa

SEQ ID NO: 46080 - DNA, 50 bp, homo sapien
cagctataagactgtaacccacatayacctgtctgcttcctattttggga

SEQ ID NO: 46081 - DNA, 50 bp, homo sapien
tatactaattacatgatgaaaatgawcagctaatattcttttgtttgaga

SEQ ID NO: 46082 - DNA, 50 bp, homo sapien
tgggcatgtagaggattgaacaaggkagtattgactgtttcatttttata

SEQ ID NO: 46083 - DNA, 50 bp, homo sapien
taacatcaatcaagttaaaactccartgaggcaaggacatcacgaagtat

SEQ ID NO: 46084 - DNA, 50 bp, homo sapien
gccagcaaacattgatggaatgatayagaggtacaaactattgacccctt

SEQ ID NO: 46085 - DNA, 50 bp, homo sapien
aaaatgtttgggccattgaaagacawcaaaaatagatctggatatttcag

SEQ ID NO: 46086 - DNA, 50 bp, homo sapien
aagtaatgttacttaaagccaataakaacataaatataaacaaatgccct

SEQ ID NO: 46087 - DNA, 50 bp, homo sapien
tagagtgtcccatgagagtaataacrgaccatagcaaatgtgtaagtttg

SEQ ID NO: 46088 - DNA, 50 bp, homo sapien
aataaatgatagtctagccatacaaygaaatcttatgtagttattaaaaa

SEQ ID NO: 46089 - DNA, 50 bp, homo sapien
gtaatgtcttctcagggtggctagaygtgggaaaacaattatttgtcaac

SEQ ID NO: 46090 - DNA, 50 bp, homo sapien
tgttgacttgctgttggctatgttamgaaatcagatctacgttggaaaag

SEQ ID NO: 46091 - DNA, 50 bp, homo sapien
attgataaaatatttctgactgaaastagcctacattaaatttgcaccac

SEQ ID NO: 46092 - DNA, 50 bp, homo sapien
gtatgctttcataattcctttcagakagaacgaaatataaatacataaat

SEQ ID NO: 46093 - DNA, 50 bp, homo sapien
gtcatgcttttaggaatgaatcctakaaactgattgtcctctggaacaaa

SEQ ID NO: 46094 - DNA, 50 bp, homo sapien
ataacaaaatcatatgcaggcaccaygttaggttaggttcactacttgag

SEQ ID NO: 46095 - DNA, 50 bp, homo sapien
caacttctggtaaacaactagcccartacttcaataaggagcttccacaa

SEQ ID NO: 46096 - DNA, 50 bp, homo sapien
gatactaaggtcagcctttacataayagtagtcataccctgtgttctgaa

SEQ ID NO: 46097 - DNA, 50 bp, homo sapien
gttcactacttgagtcttgccaatgraagagaaggcaataaaaagaaccc

SEQ ID NO: 46098 - DNA, 50 bp, homo sapien
agagaataatagcacaactgaaaaaygaactgtgcacatggatgataagg

SEQ ID NO: 46099 - DNA, 50 bp, homo sapien
ggaatatctgcatttttatggaaacraaggccttagtcaaaggaaaaact

SEQ ID NO: 46100 - DNA, 50 bp, homo sapien
ttttagtcaatcttttatgttactaygttttagatgggatacttttaact

SEQ ID NO: 46101 - DNA, 50 bp, homo sapien
tcaaatattaacactttcttagtcartatcacagctgatgaattttcttc

SEQ ID NO: 46102 - DNA, 50 bp, homo sapien
caatctgattgtcatcattaagatamcctagaaaataagaagcaaaaaat

SEQ ID NO: 46103 - DNA, 50 bp, homo sapien
caaactggctgttgtacttcttaaamatccacttcccatgccccactcca

SEQ ID NO: 46104 - DNA, 50 bp, homo sapien
ttgaaaagcttttccaatcctggacrgtaatggagttgggcaagatggtg

SEQ ID NO: 46105 - DNA, 50 bp, homo sapien
tagcttccgttgtgactcaagaataraaaatgttaatggccaacagcata

SEQ ID NO: 46106 - DNA, 50 bp, homo sapien
ccttatacagaaaaaccacaaaatcrcattaattttccagttttattaca

SEQ ID NO: 46107 - DNA, 50 bp, homo sapien
gagtccagccagaatcatggcttaaygggagtactggttaatctgcttga

SEQ ID NO: 46108 - DNA, 50 bp, homo sapien
aggtgtctccatgaaaagtattatcrccagttgagtaaataaatgactca

SEQ ID NO: 46109 - DNA, 50 bp, homo sapien
cttttttggttccatatgaattttaygatagtacttctaattctgtgaaa

SEQ ID NO: 46110 - DNA, 50 bp, homo sapien
agacgtgattttattgtctataatargagtcaaaagatatcatctgacta

SEQ ID NO: 46111 - DNA, 50 bp, homo sapien
tccagtgtatgcattttataaattgragtacattcctattataacagaga

SEQ ID NO: 46112 - DNA, 50 bp, homo sapien
attcaaatggccgtgaagagaggtayatttagtaataatagattcaggtg

SEQ ID NO: 46113 - DNA, 50 bp, homo sapien
caacataatgaattgaaatctttggmaggactatttctgagctctatgag

SEQ ID NO: 46114 - DNA, 50 bp, homo sapien
tagcatagcacaatttctccagttgraaaacatgctttatggtcaagttc

SEQ ID NO: 46115 - DNA, 50 bp, homo sapien
cttaaaagcacttaggtacttgatayggtgctaggtagtcaagataaaat

SEQ ID NO: 46116 - DNA, 50 bp, homo sapien
ttcagtactcagaactgagaagatarcatggcacgcttatttaatagtct

SEQ ID NO: 46117 - DNA, 50 bp, homo sapien
tgttgtttggggacttttttgtgagratttagaacagtttagtcagtctg

SEQ ID NO: 46118 - DNA, 50 bp, homo sapien
gatcttctaggccatcttctccacartgatttttatcagcgacggccccc

SEQ ID NO: 46119 - DNA, 50 bp, homo sapien
aataagcttatattctaatggcaggraactaaattatcaaagaaactatt

SEQ ID NO: 46120 - DNA, 50 bp, homo sapien
aatagactcttttaaaaagattgtgwaaactgggtatatttgagttttat

SEQ ID NO: 46121 - DNA, 50 bp, homo sapien
aggtttaagcatgctaacaagttccwccataaacaggcactaaaaaggaa

SEQ ID NO: 46122 - DNA, 50 bp, homo sapien
gagatgaatttctgcacttttaaaamtagagaactggagtaattaatgtt

SEQ ID NO: 46123 - DNA, 50 bp, homo sapien
gatagcacccaagattagcatgattkaactgtttcaacgtttgaacacag

SEQ ID NO: 46124 - DNA, 50 bp, homo sapien
ggtctacttacatgtacaaagtcaaygttttatatggctattttagatca

SEQ ID NO: 46125 - DNA, 50 bp, homo sapien
tcatttgtggaccattctatgttgcmctgacgaataactagagtatattt

SEQ ID NO: 46126 - DNA, 50 bp, homo sapien
atattacttttagaatggacatatgsacatcaagcctgagggtgtttctt

SEQ ID NO: 46127 - DNA, 50 bp, homo sapien
tctataatttctttcagtgaactatsaatggtacagaccatgaaatttcc

SEQ ID NO: 46128 - DNA, 50 bp, homo sapien
gaggttccataaaacctgaataaaaygtttgaagataaaataagtttgtg

SEQ ID NO: 46129 - DNA, 50 bp, homo sapien
ggttctgcaagtactataactcagasgataagttttttgctatacctaaa

SEQ ID NO: 46130 - DNA, 50 bp, homo sapien
agcggatagagttttggtttgaacaygcgactaccctgattccacattca

SEQ ID NO: 46131 - DNA, 50 bp, homo sapien
cttgtccatgaggtgtgacggactgsaaagatggtcacagatcatggagc

SEQ ID NO: 46132 - DNA, 50 bp, homo sapien
actgagcattctactattgggttgargaattatgtcccataatttaatta

SEQ ID NO: 46133 - DNA, 50 bp, homo sapien
acttagttctgaggaccaactttgcmattagtattaggctaggtatatta

SEQ ID NO: 46134 - DNA, 50 bp, homo sapien
ctctgagtacgtcctatcagcatagyaaacagtcagaaagcttttataca

SEQ ID NO: 46135 - DNA, 50 bp, homo sapien
taaatcatctttatggggcctaaacygtagagtatcaaaagcaaatgcat

SEQ ID NO: 46136 - DNA, 50 bp, homo sapien
actgggcactgagtctacctcccacrctgatttctattttgcatcaattt

SEQ ID NO: 46137 - DNA, 50 bp, homo sapien
aatgtaaattttgaatctgaaagcartattaagtttcaaatcttctttaa

SEQ ID NO: 46138 - DNA, 50 bp, homo sapien
ttgctttttattgttcctcagcccartctatgccatttttaagtgcacat

SEQ ID NO: 46139 - DNA, 50 bp, homo sapien
ttagatcagctgtatagtcttgaaamattacttaccctttcagttttcag

SEQ ID NO: 46140 - DNA, 50 bp, homo sapien
aatttaacatcctagtctctaaaackgccttaaaatattttgtacagtaa

SEQ ID NO: 46141 - DNA, 32 bp, homo sapien
acactttgatagacaawtaaaggtaaagaata

SEQ ID NO: 46142 - DNA, 50 bp, homo sapien
agttttgtttcatgtacttaagatayggttgttaacacctgtatttgtgg

SEQ ID NO: 46143 - DNA, 50 bp, homo sapien
gatttctacctcgtgctaatgtcaarctacttggaaaaagggcacaagct

SEQ ID NO: 46144 - DNA, 50 bp, homo sapien
tgtgtcttacctctttatttgaaaaytgtgctttggggagggcttgaatt

SEQ ID NO: 46145 - DNA, 50 bp, homo sapien
tgttgaatggagtgattcaaggatayacagctattaaaggtcaggtcttc

SEQ ID NO: 46146 - DNA, 50 bp, homo sapien
gttagatgtttgttattagcatcccrggaagtaaggtgggcttagtctga

SEQ ID NO: 46147 - DNA, 50 bp, homo sapien
tctgtgccactgatgtgtgctcaaarcaggaaaggagagaacacttttcc

SEQ ID NO: 46148 - DNA, 50 bp, homo sapien
tctgaataatgcttgctcacctacarcaagatgaaaaatggtaggttcca

SEQ ID NO: 46149 - DNA, 50 bp, homo sapien
gttatttaggtataagctgaactaaraagtaatttcctttaagaatttaa

SEQ ID NO: 46150 - DNA, 50 bp, homo sapien
ttttatctccctgcacatcgaagtayaacttggcatttcccatacagaaa

SEQ ID NO: 46151 - DNA, 50 bp, homo sapien
gttaattcctccatatgatctcattsaagttttcacatcccaaactcttt

SEQ ID NO: 46152 - DNA, 50 bp, homo sapien
tagtgctagaacctaaaaatacttaygaagcagcttgtctggataattct

SEQ ID NO: 46153 - DNA, 50 bp, homo sapien
actggagccagcaaacagcaccatayagtcgaaggtctcaggtacatact

SEQ ID NO: 46154 - DNA, 50 bp, homo sapien
tataagaaaatgttcagttttattcscgctaactttagagccaagcaaag

SEQ ID NO: 46155 - DNA, 50 bp, homo sapien
atttataatctaaaatgtgttttagragagtttgagaggatcagggtgga

SEQ ID NO: 46156 - DNA, 50 bp, homo sapien
acacacgcttgaaatgtccaggccartatgaaaagtcttatgttcatctt

SEQ ID NO: 46157 - DNA, 50 bp, homo sapien
tttaaactttctggtgaaaatagcaygtttttccaagctctttaaaatgt

SEQ ID NO: 46158 - DNA, 50 bp, homo sapien
cagccgtaactgaatgtgaaggatargtaggattttactaggcagagcca

SEQ ID NO: 46159 - DNA, 50 bp, homo sapien
attccaatctattcttatttctccaygtattagtgttctatggacttttc

SEQ ID NO: 46160 - DNA, 50 bp, homo sapien
taggcatcatttattaatctttatamcccatattacttctctaccggtgt

SEQ ID NO: 46161 - DNA, 50 bp, homo sapien
ctttagatctgcaatccaagtctagyaccgaaaactaaagtctgttagaa

SEQ ID NO: 46162 - DNA, 50 bp, homo sapien
tttccttttattaccaatagaagcawtattggaagtgaaactaaacagca

SEQ ID NO: 46163 - DNA, 50 bp, homo sapien
tgacattgcaggatgctgatatctaygaataagtggattctactgagaaa

SEQ ID NO: 46164 - DNA, 50 bp, homo sapien
gttaatgtaactgtgttaattattaygatgcttactatatcgtggtcagt

SEQ ID NO: 46165 - DNA, 50 bp, homo sapien
gtttaaattgtgtttgtctgtgaatraggaagaagtagtgcctcataaag

SEQ ID NO: 46166 - DNA, 50 bp, homo sapien
ccggtggctcttcctcttcttgtaaygacagcagacctataggattaggg

SEQ ID NO: 46167 - DNA, 50 bp, homo sapien
ggaagacaagctgttatgctgaataygcaaagaggcaggaagaagcctct

SEQ ID NO: 46168 - DNA, 50 bp, homo sapien
ctacattaagtactaagaataccaamcatttggctgattgcagggaggga

SEQ ID NO: 46169 - DNA, 50 bp, homo sapien
ataaagctattgtttttccaaaacasaaatctacactgggtctcaatatc

SEQ ID NO: 46170 - DNA, 50 bp, homo sapien
gcttcccagagacaggatacacatcraatctgaatgcacttcattctgaa

SEQ ID NO: 46171 - DNA, 50 bp, homo sapien
tcctaggttcaatagtaatcagggaragacaaaattacacttttgacctc

SEQ ID NO: 46172 - DNA, 50 bp, homo sapien
ctcagaaacacactagaaacaataarttactagccatgtaagcatccctc

SEQ ID NO: 46173 - DNA, 50 bp, homo sapien
cctgcctatgttgggttccttttaastagtgtaggatggtggggaaaata

SEQ ID NO: 46174 - DNA, 50 bp, homo sapien
atgcccaagaagtctcagaaagatgrcacctacagataaacctaaattag

SEQ ID NO: 46175 - DNA, 50 bp, homo sapien
gtaccatacagagatgcagaatctayggcccactgaaaggaaataaccgc

SEQ ID NO: 46176 - DNA, 50 bp, homo sapien
caggaaaatgagacacttcctctgaycttagactaggctgggtttccagc

SEQ ID NO: 46177 - DNA, 50 bp, homo sapien
aagaaagtgaaataaaatgatcaaaraagtatgccaactgaatattgtaa

SEQ ID NO: 46178 - DNA, 50 bp, homo sapien
ctgttaagatattgcaggtaccccawtgaccattaccattcagtgatgat

SEQ ID NO: 46179 - DNA, 50 bp, homo sapien
gcaatgccaggacattcgatgccaasatatgtgagtagtttagtgacttc

SEQ ID NO: 46180 - DNA, 50 bp, homo sapien
ttggcatcgaatgtcctggcattgcrgagaaaccttaaactactaacagc

SEQ ID NO: 46181 - DNA, 50 bp, homo sapien
tgggtttaggccaacctttattctasaagcagtttagctttattagtaag

SEQ ID NO: 46182 - DNA, 50 bp, homo sapien
ggtctttgcctgaataacatgagcayactgtgagaatccacaagactagg

SEQ ID NO: 46183 - DNA, 50 bp, homo sapien
attattggattcctctttcagccatratggaataactgatatcagatttg

SEQ ID NO: 46184 - DNA, 50 bp, homo sapien
catgggcactgattaaaatctcacaraaatgtgtaaccatttgcctcacc

SEQ ID NO: 46185 - DNA, 50 bp, homo sapien
gttatatcccacctacatagaatacsaggttaaagaaatctgggccgggc

SEQ ID NO: 46186 - DNA, 50 bp, homo sapien
aggtctcagtttgaagctgacccaamtagggaaaaaacaaatacggctgt

SEQ ID NO: 46187 - DNA, 50 bp, homo sapien
atacaaggatttctttgcttttaaarttatgagtagatactttttcttcc

SEQ ID NO: 46188 - DNA, 50 bp, homo sapien
aactggttatacttttgcctcagacraatagccatgctgtcactggaaaa

SEQ ID NO: 46189 - DNA, 50 bp, homo sapien
gctctagggagaggctctaaagaaamaaatgaggctgagatctgaatttc

SEQ ID NO: 46190 - DNA, 50 bp, homo sapien
tagggttaattctccaccaccaccartgagtagacctgttaggttatatt

SEQ ID NO: 46191 - DNA, 50 bp, homo sapien
ggcttagcccaacacctggaatcatraaagtgctcaataaatctttcatg

SEQ ID NO: 46192 - DNA, 50 bp, homo sapien
gacagcaaccagaaggtaatccacasggtaagctcaaaatttgccaaaac

SEQ ID NO: 46193 - DNA, 50 bp, homo sapien
ttatcaggtaaataattctgaatacmatctagtcttaatggcccacacct

SEQ ID NO: 46194 - DNA, 50 bp, homo sapien
caagacagaataaaatgataactcaygaagcagggacagaaaggatagca

SEQ ID NO: 46195 - DNA, 50 bp, homo sapien
tgggtctcaggagattttcaggtacwctcagaataagactattggtatgg

SEQ ID NO: 46196 - DNA, 50 bp, homo sapien
acctcatctcctgttattaatgatcmaaattttcttttcttctctgtttt

SEQ ID NO: 46197 - DNA, 50 bp, homo sapien
ctccatattaataatattcaatagascatcatttttcaaccttgatataa

SEQ ID NO: 46198 - DNA, 50 bp, homo sapien
gtttggcactctctagattttgacayattagaagaaaaaataaagttata

SEQ ID NO: 46199 - DNA, 50 bp, homo sapien
tggtgattctcagtttctactattgwacttccctgagttatttccagcta

SEQ ID NO: 46200 - DNA, 50 bp, homo sapien
aacctgtctcaaaagattctcctcaytctagaagtttctgattctgtaat

SEQ ID NO: 46201 - DNA, 50 bp, homo sapien
taaaaattaagtctccataagaagcraatatactattgataactcttaca

SEQ ID NO: 46202 - DNA, 50 bp, homo sapien
agcgttgcttaagttcctttgactayggaattctctctagtggatcatgt

SEQ ID NO: 46203 - DNA, 50 bp, homo sapien
cagagtccaaatagcttaaaactacrgaaatgtattattctctcacagtt

SEQ ID NO: 46204 - DNA, 50 bp, homo sapien
acccctcaacacaaactttattagcmagacggtaatttttatcttttgga

SEQ ID NO: 46205 - DNA, 50 bp, homo sapien
aggtacagtaaacatctataaaacartaactatgaaccaatctacacact

SEQ ID NO: 46206 - DNA, 50 bp, homo sapien
aataattgagtctccttccaattaamtcatggaacatcagagccattata

SEQ ID NO: 46207 - DNA, 50 bp, homo sapien
tctattcttttgtaactaaacctacrattggcaaacatccatctagctcc

SEQ ID NO: 46208 - DNA, 50 bp, homo sapien
tgctctaatgcaataagaaaaaaacraatgcaattagaccacaaaatcat

SEQ ID NO: 46209 - DNA, 50 bp, homo sapien
attcttagcatcacctaatattcaartagcactaaattaaagcataaaaa

SEQ ID NO: 46210 - DNA, 50 bp, homo sapien
aaattttttaatatcatatttgtaayagccttagactctagaacatggta

SEQ ID NO: 46211 - DNA, 50 bp, homo sapien
ctgcattttaataagatcccctggcrattcgtgcacccatcacaattaga

SEQ ID NO: 46212 - DNA, 50 bp, homo sapien
gtataaatcacttttagctctagtayaacagttaaaatacaaaagtatta

SEQ ID NO: 46213 - DNA, 50 bp, homo sapien
gtgaaatatggacatccagatacatraggcccaaaggttcccaaacaggt

SEQ ID NO: 46214 - DNA, 50 bp, homo sapien
attggatagcttcagaaggcctgcaygttttaaaatttttggtatttttc

SEQ ID NO: 46215 - DNA, 50 bp, homo sapien
ccagtgggtgaacagtaaggtcaagyacactgcaggtatttcacactgcc

SEQ ID NO: 46216 - DNA, 50 bp, homo sapien
ggccttgaatgtacgtattttcaaaytatatgaggaagaagtcaagttca

SEQ ID NO: 46217 - DNA, 50 bp, homo sapien
ttttaaacattaaagtgcttcttacwctcacaaatcaaataaatgtgaaa

SEQ ID NO: 46218 - DNA, 50 bp, homo sapien
taagactataatgacagattgtgaayaccaagtttgctggctaattctat

SEQ ID NO: 46219 - DNA, 50 bp, homo sapien
caaatcaaataaatgtgaaattatayctcaaaacaggctattgtgaaccc

SEQ ID NO: 46220 - DNA, 50 bp, homo sapien
ataattcatcttaaagctcacctaawtaaaagtaagtgactaaaatgatc

SEQ ID NO: 46221 - DNA, 50 bp, homo sapien
ttatggcaaaaggtataaacttagcraagaatgatgcatttgaaacagag

SEQ ID NO: 46222 - DNA, 50 bp, homo sapien
tatctctgtgctctaaactcctagaygcagcgatcacgttctgctcactc

SEQ ID NO: 46223 - DNA, 50 bp, homo sapien
caccaagatgtctctagataaaaatragacttcagcactttttgcttttg

SEQ ID NO: 46224 - DNA, 50 bp, homo sapien
agaatgcagcacttttctatagttaytgaacattgaatatctgaataagc

SEQ ID NO: 46225 - DNA, 50 bp, homo sapien
cattgccatctatgtcttactaatcyagagaaaggtatctttttcaaaaa

SEQ ID NO: 46226 - DNA, 50 bp, homo sapien
ttgcatgaatgtattttagaccaccyattgttttcagaaacgtgaaaata

SEQ ID NO: 46227 - DNA, 50 bp, homo sapien
gcaggtatcccctgcaaatttcagcsatctacgtattagtggttttaaag

SEQ ID NO: 46228 - DNA, 50 bp, homo sapien
ttaaatggaaatacaacacatgatamgttacagcttcatgggaaaaataa

SEQ ID NO: 46229 - DNA, 50 bp, homo sapien
tgccattttcggttaatatggtcaaytcagatggttaaatgttccccgtt

SEQ ID NO: 46230 - DNA, 50 bp, homo sapien
cctgatttcctcaacctttaaaggcrccacagtacctcaagaaaataaat

SEQ ID NO: 46231 - DNA, 50 bp, homo sapien
aaaaatgatcagttatacttgattgraacagaagtataagcttttaaact

SEQ ID NO: 46232 - DNA, 50 bp, homo sapien
aacccctgatttgctacgttacagamgaaaaagtatgttgaagtcgaagg

SEQ ID NO: 46233 - DNA, 50 bp, homo sapien
taatggaagtttttttcttatatackgagtcatttaccttatttgatata

SEQ ID NO: 46234 - DNA, 50 bp, homo sapien
tagacaaactctgaggatgaaagtargagggttctcaaattagttctagt

SEQ ID NO: 46235 - DNA, 50 bp, homo sapien
tttcagtttagggcactttgtgatawaaggcgataaaagtaatctggaat

SEQ ID NO: 46236 - DNA, 50 bp, homo sapien
taatcttaacaagacatatcttgaasagttgtctaccaaagtcatttgat

SEQ ID NO: 46237 - DNA, 50 bp, homo sapien
ccaatcgaattgattaatactaaaartggaacaactgcaaactagaacta

SEQ ID NO: 46238 - DNA, 50 bp, homo sapien
catccagagaagatcattctaaatcsagtggttggcccatgccaacaata

SEQ ID NO: 46239 - DNA, 50 bp, homo sapien
ttttattctgcataggaggagtaaaracaatgcagtttcatttgtaacac

SEQ ID NO: 46240 - DNA, 50 bp, homo sapien
caaaggttagaacatggattaacgamtagaagcaatagaaagactcttta

SEQ ID NO: 46241 - DNA, 50 bp, homo sapien
ttaggaaggagaaatgacaataacaycttgcacgtatttaaatgctcttc

SEQ ID NO: 46242 - DNA, 50 bp, homo sapien
tcacaagaaaaactaagttactcgcrgagacctctacacattagagtgga

SEQ ID NO: 46243 - DNA, 50 bp, homo sapien
gatctgccatattttaatgtttccartgataataatgttggatctcaagc

SEQ ID NO: 46244 - DNA, 50 bp, homo sapien
tccagtgttagttagttaaaggagaraatcaggactaagacctaaaccct

SEQ ID NO: 46245 - DNA, 50 bp, homo sapien
taatcacgttgtattagcaatttgaygaatcagttatttcatgaacacat

SEQ ID NO: 46246 - DNA, 50 bp, homo sapien
atgagtaacaaagggctttgtggaartatctgaaggccaataattctttt

SEQ ID NO: 46247 - DNA, 50 bp, homo sapien
cttataagaagtctttcatttttgaygaggaaccttaaagttcttatagc

SEQ ID NO: 46248 - DNA, 50 bp, homo sapien
caccacctgagatgaagaatgactcraccatatgatgaaacagagaaagc

SEQ ID NO: 46249 - DNA, 50 bp, homo sapien
ctggccgccatttcacagtatgtacraagctgatgaatatatttgattat

SEQ ID NO: 46250 - DNA, 50 bp, homo sapien
acatgcagaattattttgtaaaaacrgtgattcaaaacaagaagtaccat

SEQ ID NO: 46251 - DNA, 50 bp, homo sapien
catgatgggctatgtggtggatttgyactctcggtggtacaggtgtcacc

SEQ ID NO: 46252 - DNA, 50 bp, homo sapien
agacagaaattaggctccaaagatasgctctttacccatacagcatccaa

SEQ ID NO: 46253 - DNA, 50 bp, homo sapien
cttaaattgtcgttactaaggatcaygaaaacttcttctgaggatagtaa

SEQ ID NO: 46254 - DNA, 50 bp, homo sapien
gctgcttaacactaattaacacaacratttcactaaaatgtgaaaccaag

SEQ ID NO: 46255 - DNA, 50 bp, homo sapien
ctaagcctgctactgtgctgattacscaaacaattcaggagaaattaagt

SEQ ID NO: 46256 - DNA, 50 bp, homo sapien
taggacaacaagagtattgtactgamatgtgcttctcacagtgcttagtg

SEQ ID NO: 46257 - DNA, 50 bp, homo sapien
gagctcatcagctccttggcatttgyagcctacctgtgcaatcataggag

SEQ ID NO: 46258 - DNA, 50 bp, homo sapien
gtacagacaagagagacagacatgtraagaaatggttattcttcagtgca

SEQ ID NO: 46259 - DNA, 50 bp, homo sapien
aatcctttccttgtatttttcgaaaycactgatgcagcttaagaaaacag

SEQ ID NO: 46260 - DNA, 50 bp, homo sapien
acagttaaaggtgcacgcgttagtgraacctcgcaacacatcagtgacca

SEQ ID NO: 46261 - DNA, 50 bp, homo sapien
ggaacaggtattgtgttagaattaaytaagcatttccctctctggagcca

SEQ ID NO: 46262 - DNA, 50 bp, homo sapien
gaagctcaggcagcagttcaaggctwacacatcacactcttctttttagg

SEQ ID NO: 46263 - DNA, 50 bp, homo sapien
ctggcacctaaaatagatggctggaraggtaattagatgcagttacttgc

SEQ ID NO: 46264 - DNA, 50 bp, homo sapien
cgcattgaaccttccagtggacacasgaaaaagagccaaaaggaggaaga

SEQ ID NO: 46265 - DNA, 50 bp, homo sapien
gtctcatcaagagtacagacttagartagatgcttttctccattacttcc

SEQ ID NO: 46266 - DNA, 50 bp, homo sapien
tccctcttattagactaaactttgayattataccattatttccttttgag

SEQ ID NO: 46267 - DNA, 50 bp, homo sapien
acagcagctaagtgagcctctaccarcgagtgttatagacccctttataa

SEQ ID NO: 46268 - DNA, 50 bp, homo sapien
aaaggcacaagaacttaactttgtcmaatgaagtctttcaggaggaggtg

SEQ ID NO: 46269 - DNA, 50 bp, homo sapien
aaatcaggatcccaaagaggtattarcatttgcaggttcattgccgcatt

SEQ ID NO: 46270 - DNA, 50 bp, homo sapien
ccacatgtgagagacatatagataawcaaaggacagataaataagcttag

SEQ ID NO: 46271 - DNA, 50 bp, homo sapien
tttgttctggtagcgcttggttttayatggacagtgagaaaatgttttca

SEQ ID NO: 46272 - DNA, 50 bp, homo sapien
ttcttacaacagactcgctctctctsaagtttatttttacttcaataaca

SEQ ID NO: 46273 - DNA, 50 bp, homo sapien
gtacccctctcttggaatacagaaaygttacctaaacagtaatttgagcc

SEQ ID NO: 46274 - DNA, 50 bp, homo sapien
acaaccagcgcctcatgagaaccaaytcagtctctagagaacagtgttaa

SEQ ID NO: 46275 - DNA, 50 bp, homo sapien
gaaaatgcatgtgaagtatttctcartaattaagtaccattctcttcagt

SEQ ID NO: 46276 - DNA, 50 bp, homo sapien
aatcatttcatccctgtcgttcttayaacatccttactctttcatcaatt

SEQ ID NO: 46277 - DNA, 50 bp, homo sapien
gtagttttgaacatcgttaaagcacraacacctctccaaggctaattaga

SEQ ID NO: 46278 - DNA, 50 bp, homo sapien
actctacagagacaatcactttcaastcctttagtatttacccccatatc

SEQ ID NO: 46279 - DNA, 50 bp, homo sapien
ttcgtgactctcattaatcttagatraaaaaactgttaaaattaggaaaa

SEQ ID NO: 46280 - DNA, 50 bp, homo sapien
tttcatctaagattaatgagagtcaygaatatctattacaaattgttgag

SEQ ID NO: 46281 - DNA, 50 bp, homo sapien
cagtcaaaattatgacaatactgaaragaagtgaaaatcagaaaaggaaa

SEQ ID NO: 46282 - DNA, 50 bp, homo sapien
tgctcctgaaatcgcttataaaggaygcagacagggtcatggcagatctt

SEQ ID NO: 46283 - DNA, 50 bp, homo sapien
caaattgacccagctctttcctcaayctactcattttctctttcttttct

SEQ ID NO: 46284 - DNA, 50 bp, homo sapien
gcttcacacaaatacaagttacaaawgctattttaaatgtcaatggcatt

SEQ ID NO: 46285 - DNA, 50 bp, homo sapien
aacagagagaagaaaagctaaaatckaagatactgatttaagggatctag

SEQ ID NO: 46286 - DNA, 50 bp, homo sapien
gtttatttacacattaaatgatagakataacggaatgccattgacattta

SEQ ID NO: 46287 - DNA, 50 bp, homo sapien
aattacagccctcacaagaaaaatayagataagtatcagttagggaagat

SEQ ID NO: 46288 - DNA, 50 bp, homo sapien
cacaatatggtaataaagattgagaygtccacaaactatgaatttctatg

SEQ ID NO: 46289 - DNA, 50 bp, homo sapien
aagtcataccgttgttaaaaattcasggacttctgagagttatcaataag

SEQ ID NO: 46290 - DNA, 50 bp, homo sapien
ggttaggagaacaattggcgtgttaycaaggaaaaggtgagagaagacgg

SEQ ID NO: 46291 - DNA, 50 bp, homo sapien
tgaacccacttattcataatcccatyacaatttgacttctgcaccaaata

SEQ ID NO: 46292 - DNA, 50 bp, homo sapien
gatatacacattttaaatggtcataygtatttccaaaattcttcttgagt

SEQ ID NO: 46293 - DNA, 50 bp, homo sapien
gttctgttgataagagaaagtgtacmagaaaaagttgagttttgagctgg

SEQ ID NO: 46294 - DNA, 50 bp, homo sapien
tcattgctacgccaagtaaaaattaygtttgagtgaaaaggtattttttt

SEQ ID NO: 46295 - DNA, 50 bp, homo sapien
accagcatgacagattgagcgttaargtagaactaaacaagaggcactca

SEQ ID NO: 46296 - DNA, 50 bp, homo sapien
acctggttgttcttatagatctgaargtatttgaaacacatttttattat

SEQ ID NO: 46297 - DNA, 50 bp, homo sapien
ggaataaaagactgaaaataagagaygtggtaataaaatagctactactc

SEQ ID NO: 46298 - DNA, 50 bp, homo sapien
aatgctgacaagccctgggagatgcrattcttgaccaggtgcttaatatc

SEQ ID NO: 46299 - DNA, 50 bp, homo sapien
atcctaatctaagagcacagcgaaamtgagcttcaaagaataatttgctt

SEQ ID NO: 46300 - DNA, 50 bp, homo sapien
gtaacacttaaacaagtaatttagaycatgctgtaggccctgaatagctt

SEQ ID NO: 46301 - DNA, 50 bp, homo sapien
cgtgaacattcatttcttcttttgayccatggaaactgaagacaaatttc

SEQ ID NO: 46302 - DNA, 50 bp, homo sapien
caagtcctgaagggcattttaaaagyacatgctgcactatcccttgagag

SEQ ID NO: 46303 - DNA, 50 bp, homo sapien
ttattttccatggtttttgaaactawgttatctgagaatattttgccatg

SEQ ID NO: 46304 - DNA, 50 bp, homo sapien
tccagatttagatgtcaaagcccagmatgaaaagagcatgtgtgatttgt

SEQ ID NO: 46305 - DNA, 50 bp, homo sapien
tacacagctagtccacataattctcyactgtatttgccacttaacctatt

SEQ ID NO: 46306 - DNA, 50 bp, homo sapien
tattacagatgcttagttgaatggamgggcaagttggttgcatattaaaa

SEQ ID NO: 46307 - DNA, 50 bp, homo sapien
actaacaaattactgctttgaacacrggtgaattaactatcattgtgatg

SEQ ID NO: 46308 - DNA, 50 bp, homo sapien
tattttaaagcagaagcattcagacygtcataggatttctgtgataaaga

SEQ ID NO: 46309 - DNA, 50 bp, homo sapien
caaaagggcaagatgagtatttaacygagctgaaggataaatgcacttaa

SEQ ID NO: 46310 - DNA, 50 bp, homo sapien
attttttaaagttcatctggatacartgtaagaaatgtattacagttggg

SEQ ID NO: 46311 - DNA, 50 bp, homo sapien
gatgaccatggtgaagcctagaagartcactgaattgctactaacatgtc

SEQ ID NO: 46312 - DNA, 50 bp, homo sapien
tgataacaataataataatagtgatsagaagaaattagatggcagtgtag

SEQ ID NO: 46313 - DNA, 50 bp, homo sapien
ctttacactgcttactttctctatcrcttttcccaaatacgtccccagta

SEQ ID NO: 46314 - DNA, 50 bp, homo sapien
tagctttactttctttactgccatcsaggacagagagctcttcctagtgt

SEQ ID NO: 46315 - DNA, 50 bp, homo sapien
gtgatattttttacaaatcttcaaargagtagcaacataagaaccacatt

SEQ ID NO: 46316 - DNA, 50 bp, homo sapien
atacagaaatgtaaagggtcaagaayagcagtcagtcttgagaatgaagc

SEQ ID NO: 46317 - DNA, 50 bp, homo sapien
gccaatgcctgggaggagaactccartaagaagaaatggcaagtgcaagg

SEQ ID NO: 46318 - DNA, 50 bp, homo sapien
caatatggggcatatatgaaactgawcttaataaataaaaaatataactc

SEQ ID NO: 46319 - DNA, 50 bp, homo sapien
agtcttctctctctttggacacaacrgtcttaggggttgatcattataat

SEQ ID NO: 46320 - DNA, 50 bp, homo sapien
ctcttcacaggaaagaatttcccacyagatccctgcagataattatttca

SEQ ID NO: 46321 - DNA, 50 bp, homo sapien
agtttataaacctacctcattgtacyattacctagatcataaacacagta

SEQ ID NO: 46322 - DNA, 50 bp, homo sapien
aatgtattttgaaagtacttagaaaraaagcaagtaacctctaagaggca

SEQ ID NO: 46323 - DNA, 50 bp, homo sapien
gctggagaaaatttcttatgaccaaytaaagtcagagaagtctgtgctgt

SEQ ID NO: 46324 - DNA, 50 bp, homo sapien
atgaaacacaaatcataatctctgargcaaataagaatggaaggactcct

SEQ ID NO: 46325 - DNA, 50 bp, homo sapien
acaagcagtagaagcgttcagaagcrataatgggcagacgacttaaacat

SEQ ID NO: 46326 - DNA, 50 bp, homo sapien
ttttaaacatgacctttaggaagccrgagacactgtggtcaatgtttttc

SEQ ID NO: 46327 - DNA, 50 bp, homo sapien
tactgggcttttcaatttggccttaygtagtcaccaagtttccctcaaaa

SEQ ID NO: 46328 - DNA, 50 bp, homo sapien
aggtaggtcctcagaacctaaagcgyaaggagattccacattactcttct

SEQ ID NO: 46329 - DNA, 50 bp, homo sapien
ctccatagccaattactcatgaaacrattgttgatcttattacatagaca

SEQ ID NO: 46330 - DNA, 50 bp, homo sapien
catcaaagcttttacgaaattaaatkaatgcaacagaactctgtggatta

SEQ ID NO: 46331 - DNA, 50 bp, homo sapien
ttaacattttatgtaactcattcatwaaggtctcaagtggatgctcaaag

SEQ ID NO: 46332 - DNA, 50 bp, homo sapien
taagcatggtctggtatcacagaaaktggtgtctgttgggatacttttga

SEQ ID NO: 46333 - DNA, 50 bp, homo sapien
attaaggtctcaagtggatgctcaamgctattacaattcagtacaagtca

SEQ ID NO: 46334 - DNA, 50 bp, homo sapien
ttatcctacagatatgcttcaaaaaygagatactagaacaacaagcaggc

SEQ ID NO: 46335 - DNA, 50 bp, homo sapien
ttctgtaagttgtgccataattaccrctggatagaagaaatgttttgtat

SEQ ID NO: 46336 - DNA, 50 bp, homo sapien
ttaagaaagaacgctcaaagccacaragattgtaaagggctgactgagaa

SEQ ID NO: 46337 - DNA, 50 bp, homo sapien
atttatgggaggtgaaacaatgttaygtatcaggaaaaaggaaggtttct

SEQ ID NO: 46338 - DNA, 50 bp, homo sapien
actatattattgggaagattcaagawaatttttaaaatgaaataaacact

SEQ ID NO: 46339 - DNA, 50 bp, homo sapien
aaagctttacagattgaccttcttamtaaccaccaactcacttctctcat

SEQ ID NO: 46340 - DNA, 50 bp, homo sapien
tgaaaagtaaggagggaaaataataygtaacgaattcctattgtctcact

SEQ ID NO: 46341 - DNA, 50 bp, homo sapien
gctatattacacaaatgccagtataytaagtacaaaagcaggtgtaaacc

SEQ ID NO: 46342 - DNA, 50 bp, homo sapien
gcaggaatcttgctaatgtaaaaccraggtgtgaagtcattttcacttca

SEQ ID NO: 46343 - DNA, 50 bp, homo sapien
tgaaattcttattcaatggtcatacrgcgtaatttgctaaatgagctgtg

SEQ ID NO: 46344 - DNA, 50 bp, homo sapien
tcctggtgggcagagttgctgaaacyggaagcagggggtttgaggggtgc

SEQ ID NO: 46345 - DNA, 50 bp, homo sapien
tcaggcaccataggaagcacctttaygtatgttatttctgatatttataa

SEQ ID NO: 46346 - DNA, 50 bp, homo sapien
aaagcatggaagtaaatgttagaccygcatgagctcctgttattggtggg

SEQ ID NO: 46347 - DNA, 50 bp, homo sapien
tccaaacatctgtatctattgctcasgtagactacagacaaagcttttat

SEQ ID NO: 46348 - DNA, 50 bp, homo sapien
tctgtggatctgaagccactggcaarttcctaggtcatccaaacatctgt

SEQ ID NO: 46349 - DNA, 50 bp, homo sapien
gaaaatgaactgagcttataagataygttttctagaaaataaagattcac

SEQ ID NO: 46350 - DNA, 50 bp, homo sapien
cgccaggaaagagggcttgcatttcragtcaaatccctttaacagaagtc

SEQ ID NO: 46351 - DNA, 50 bp, homo sapien
aaagacagagataataaagaaggacrcaaatatgcaagaatagaaaggaa

SEQ ID NO: 46352 - DNA, 50 bp, homo sapien
gggatggttttgggccaccaccagamaataaaagggcgtgtgtggagacc

SEQ ID NO: 46353 - DNA, 50 bp, homo sapien
gacagaggtgctgacagggatcaacragggctgacttgtgagtaaatgga

SEQ ID NO: 46354 - DNA, 50 bp, homo sapien
tagagtactatttctcagtggaagtyacgtgcattggagtcacatgggct

SEQ ID NO: 46355 - DNA, 50 bp, homo sapien
gttgggtttgttgtgacacatagatragattgcttgaggcttttattgtt

SEQ ID NO: 46356 - DNA, 50 bp, homo sapien
ctcattctgttctattcttactctawctacatatcagaatacaagtaatg

SEQ ID NO: 46357 - DNA, 50 bp, homo sapien
ctggcaaaaaaaaagtatgatgaccrgagttgttcactcttttaagcttt

SEQ ID NO: 46358 - DNA, 50 bp, homo sapien
gtcacaatggagtgtgtcttcaagayggtattgatacatttaggaatgga

SEQ ID NO: 46359 - DNA, 50 bp, homo sapien
ataattacagaagagcggtcaattaygagtttgtttcctgttcagtttgg

SEQ ID NO: 46360 - DNA, 50 bp, homo sapien
tggttgagaaagactctgcattagaygtcacccagcatagttcattatgc

SEQ ID NO: 46361 - DNA, 50 bp, homo sapien
ttgaaatgtgggaacgttaatgttaygacaaatctcatgggaactttctt

SEQ ID NO: 46362 - DNA, 50 bp, homo sapien
cctacacgtggtgtctttgatacaayctgttcttttcattacctataaat

SEQ ID NO: 46363 - DNA, 50 bp, homo sapien
tcaactatgagttgtgaaagctatawgaaatgtttctaaattatcaaaaa

SEQ ID NO: 46364 - DNA, 50 bp, homo sapien
taaactgaagtgccactgtttttaayacataatatgagtaagatgaatta

SEQ ID NO: 46365 - DNA, 50 bp, homo sapien
agacatgtgacattctttaaatgcargccaattcatacaaagacatgtaa

SEQ ID NO: 46366 - DNA, 50 bp, homo sapien
gtaaaacagaatgagcactttgatgwataaaatattttagcatctggaca

SEQ ID NO: 46367 - DNA, 50 bp, homo sapien
gaaaaggaatgagtggataatgcaasattaaaggtacagaaaaggaaata

SEQ ID NO: 46368 - DNA, 50 bp, homo sapien
tcctcccttaaaatctcagtgtcaayggtccttatatttgtaattcaagt

SEQ ID NO: 46369 - DNA, 50 bp, homo sapien
aaatcaaagtagactcagcaattttwaaaattatttatttatttattttt

SEQ ID NO: 46370 - DNA, 50 bp, homo sapien
atgtaatagataaaatttctctggaygcataataatgtgagaaagattgt

SEQ ID NO: 46371 - DNA, 50 bp, homo sapien
cacaggtatatatcctacagtgagcwctgaaatatcacttccagttcttg

SEQ ID NO: 46372 - DNA, 50 bp, homo sapien
ccatttacacgaggtgaggtacaaarcgttatctgtcctaacactgggaa

SEQ ID NO: 46373 - DNA, 50 bp, homo sapien
caatgaaggaaagatgctcagaggcratttgttcccacctgggcagatag

SEQ ID NO: 46374 - DNA, 50 bp, homo sapien
ttagatcatgcaggtctataaccaayggtgaatctagcaaaagttatttt

SEQ ID NO: 46375 - DNA, 50 bp, homo sapien
atgttgcattagtcattatggcatamaatttaagaatagttttattatgt

SEQ ID NO: 46376 - DNA, 50 bp, homo sapien
agatcattctaaggaggaaagcaacrggaaaactcaaaatgtgtaacagg

SEQ ID NO: 46377 - DNA, 50 bp, homo sapien
agggagaggagagggcgtctttggaraattccagcagttcagtgtgtctg

SEQ ID NO: 46378 - DNA, 50 bp, homo sapien
aacagtcaatggccatataattagaygtaagatgtttggaataaatatat

SEQ ID NO: 46379 - DNA, 50 bp, homo sapien
atgccttgttagcagaaagaatagakaagtcactagttgaaccgaaagaa

SEQ ID NO: 46380 - DNA, 50 bp, homo sapien
tgaacattttaagggctaagcatgcrccgttgagatgttcttataatcac

SEQ ID NO: 46381 - DNA, 50 bp, homo sapien
gtataaatacttttgaattaatggasatatgaattaatgaatcgttattg

SEQ ID NO: 46382 - DNA, 50 bp, homo sapien
ctaagggcctaaaagctgcaagccartatgtgtccataaagtgtaggcct

SEQ ID NO: 46383 - DNA, 50 bp, homo sapien
ttcctcgactccctttgggacattaycaagacatttgagacttatatgaa

SEQ ID NO: 46384 - DNA, 50 bp, homo sapien
tattaacaccatgaacatcctaaggycatagcttagaaataagggtcacg

SEQ ID NO: 46385 - DNA, 50 bp, homo sapien
ttgttgggtagatctcactctgggaygtgacccttatttctaagctatgg

SEQ ID NO: 46386 - DNA, 50 bp, homo sapien
ctaactattgccctttatctatgcaktatctgatagatgctcaataaatg

SEQ ID NO: 46387 - DNA, 50 bp, homo sapien
gttggtatcaattgagtaagaggaayataaaatgtctgaaatgctaacag

SEQ ID NO: 46388 - DNA, 50 bp, homo sapien
  misc_feature (7)..(7): n is a, c, g, or t
aaaaaangctttagaaaggtgacaayacatttaatagactccagaagttg

SEQ ID NO: 46389 - DNA, 50 bp, homo sapien
ccaacttgctgttgtctgtgctaaawttgtttcagagtgaccaaattaaa

SEQ ID NO: 46390 - DNA, 50 bp, homo sapien
gaaaaagtttgaaatgctgcaagaawtagcaaaatatagcatgaagtgag

SEQ ID NO: 46391 - DNA, 50 bp, homo sapien
gaaagagacggatgtagtgttgaaartagatgctcaggaggcaaaaactg

SEQ ID NO: 46392 - DNA, 50 bp, homo sapien
aaatggatgcagaacctcaggaagcygaacctgccaaggagctggtgaag

SEQ ID NO: 46393 - DNA, 50 bp, homo sapien
ctcctgcgttgctttgataactaaayaaaatggttctatctgaatagttc

SEQ ID NO: 46394 - DNA, 50 bp, homo sapien
ttacaggcatctagcaatgagttttwaaaaatatattatgtattcattat

SEQ ID NO: 46395 - DNA, 50 bp, homo sapien
ataccttctaggactgtaaaacataycggtagatcctcttttcatcacct

SEQ ID NO: 46396 - DNA, 50 bp, homo sapien
ataaaatatttgcaattatacaataygctaattcttagacgactacaaac

SEQ ID NO: 46397 - DNA, 32 bp, homo sapien
ctttgagtagtgtctgraaaatagaaaatact

SEQ ID NO: 46398 - DNA, 50 bp, homo sapien
caaagttttctaggtttgctctaacracaattgactacaactgggtggca

SEQ ID NO: 46399 - DNA, 50 bp, homo sapien
ttcagtatagtaagtctgttgttctyaagttatggttgagttaaatgttt

SEQ ID NO: 46400 - DNA, 50 bp, homo sapien
taaaagatattttcacaaaaccacartagagaggaaggagaagaaaatac

SEQ ID NO: 46401 - DNA, 50 bp, homo sapien
cctgcaattgcttttgagaagaaaargacttcatggcagcctctcttttc

SEQ ID NO: 46402 - DNA, 50 bp, homo sapien
ttaacttctttggaacagcagttcargtcccagtagatgatttcattaag

SEQ ID NO: 46403 - DNA, 50 bp, homo sapien
agtaaagattttaataaaaaccggcrattctgtgaccatctctaagaaac

SEQ ID NO: 46404 - DNA, 50 bp, homo sapien
gacctatcctgagacatttaattcamgtgtggatagagacttctatcaaa

SEQ ID NO: 46405 - DNA, 50 bp, homo sapien
ggttgcgtgcagcaaaccattttagraatttgtctcacgttgcccataag

SEQ ID NO: 46406 - DNA, 50 bp, homo sapien
agaacaatttgccagtatatattaamatttcaaatgtagcaatctgatac

SEQ ID NO: 46407 - DNA, 50 bp, homo sapien
gactctaattttggcttctgaatgcygaggactgcagtgccaacaggcgt

SEQ ID NO: 46408 - DNA, 50 bp, homo sapien
atatcaaacctttaatgcctgacaasagctggaagcaaggagtggggctt

SEQ ID NO: 46409 - DNA, 50 bp, homo sapien
ccaattgtacagtataatttttaaakgcttaatcatagagtttgaaaaga

SEQ ID NO: 46410 - DNA, 50 bp, homo sapien
aactgttcatttcaatgggattctgsaaatgtcgtagcttcaaggatgtt

SEQ ID NO: 46411 - DNA, 50 bp, homo sapien
cgcttttattaaatccctctctggtkaaaatacctagcctggtttctgtt

SEQ ID NO: 46412 - DNA, 50 bp, homo sapien
tatcctgaatattctttggactcatyaataatatatatagtttattagaa

SEQ ID NO: 46413 - DNA, 50 bp, homo sapien
ctcttttttcttggtctgaaaaagartatggtgttttacgagctgcctag

SEQ ID NO: 46414 - DNA, 50 bp, homo sapien
cggctgagaacggatactggaagtcyagaatgtacgcactgccatcaatc

SEQ ID NO: 46415 - DNA, 50 bp, homo sapien
ctatttttgtagtcctgtaattagarcttgccaaataaaacattctatat

SEQ ID NO: 46416 - DNA, 50 bp, homo sapien
gcagactatgttcatgtaggctcaastcattccctgaaacacataaggct

SEQ ID NO: 46417 - DNA, 50 bp, homo sapien
tcctatgtatctatcttagaaaaacmcaatagtatacacagaggcatttc

SEQ ID NO: 46418 - DNA, 50 bp, homo sapien
gtaaaagctcagcactcgttttgaayataggtgtaatttgctgcgttaac

SEQ ID NO: 46419 - DNA, 50 bp, homo sapien
gctaaagtttctgtttaataaagtgmattacaaaattgtaaaatgaggtg

SEQ ID NO: 46420 - DNA, 50 bp, homo sapien
agcaagggaggactaggtaaataaaygggcctgagatgaaagccatactt

SEQ ID NO: 46421 - DNA, 50 bp, homo sapien
caagtgcaacaaatgaacctaaccayggatctatatactagcacaactgt

SEQ ID NO: 46422 - DNA, 50 bp, homo sapien
ctgaagcaggctattgaaacattgaycatctacaggagaggacctaaaaa

SEQ ID NO: 46423 - DNA, 50 bp, homo sapien
tacattagtttttccttaggcaaacratattacatatgtgaatcttagca

SEQ ID NO: 46424 - DNA, 50 bp, homo sapien
ctatttcagcagacagagacagtgasagaccttgtgggtgggaggaggga

SEQ ID NO: 46425 - DNA, 50 bp, homo sapien
attgacttcatgtaattatcagtaartggatccaaaagtcctcaatgatc

SEQ ID NO: 46426 - DNA, 50 bp, homo sapien
gggatcgcattacctcacctatcaaygagacttcagttctggaaagaacg

SEQ ID NO: 46427 - DNA, 50 bp, homo sapien
aattaaccactgatccactgatcgaygatcaattaaccactgatccgctg

SEQ ID NO: 46428 - DNA, 50 bp, homo sapien
tcaaatgcacgcacgctctgttaaaytctcactgtgtacaaataggatat

SEQ ID NO: 46429 - DNA, 50 bp, homo sapien
agctgtagagtaaaaactagacttargcatttccaattaaggcaggctag

SEQ ID NO: 46430 - DNA, 50 bp, homo sapien
cgtgtggcagctagtccatgattagraaatgtgacactggctgacttctc

SEQ ID NO: 46431 - DNA, 50 bp, homo sapien
gggatcaggccctctttggaatgaaygaccgcttgcttggaggaaccaga

SEQ ID NO: 46432 - DNA, 50 bp, homo sapien
gtccacatttcattctcattcagtayaggtgcattggcccctctaaaagt

SEQ ID NO: 46433 - DNA, 50 bp, homo sapien
atgatgcctgtagtataaaagcaaaygttgcagaacttcatcatgtgatc

SEQ ID NO: 46434 - DNA, 50 bp, homo sapien
taaataacctgcccatagttaaatasctagtgagttattgaatagtatag

SEQ ID NO: 46435 - DNA, 50 bp, homo sapien
ttctattaccttacatcttttccaaytagcttataaattctctgaaggca

SEQ ID NO: 46436 - DNA, 50 bp, homo sapien
tagttagactaaaaggcttttcatarattttaatgcttcaaatgaggaca

SEQ ID NO: 46437 - DNA, 32 bp, homo sapien
gggctcactggtggtaygaatcggacgcgtcc

SEQ ID NO: 46438 - DNA, 50 bp, homo sapien
gcaataatgtcttgaaattgctggamgtaaccattattacgcttgcttgt

SEQ ID NO: 46439 - DNA, 50 bp, homo sapien
aatgcagcttcattctgttgcctatyacccgttgtcatccacaactcatt

SEQ ID NO: 46440 - DNA, 50 bp, homo sapien
ctcaaagagataccctaaaaaccaakaactgcacttgaagaatgcaattg

SEQ ID NO: 46441 - DNA, 50 bp, homo sapien
ctcctttaaataccaaggtattagcrgataaaccatgtggaaatgggtaa

SEQ ID NO: 46442 - DNA, 50 bp, homo sapien
agaccagggtaattttcatacctaaragacatataagagatttaccaaca

SEQ ID NO: 46443 - DNA, 50 bp, homo sapien
tgcacttgaagaatgcaattggggayaaagtcacaaataccctgcagtgc

SEQ ID NO: 46444 - DNA, 50 bp, homo sapien
gagaacaaaaaggattagttgccaaratgcaaggaaccctgaaagcagcc

SEQ ID NO: 46445 - DNA, 50 bp, homo sapien
ttacaaattagcaaatgttgttctcratcagttctactccaaaagagtaa

SEQ ID NO: 46446 - DNA, 50 bp, homo sapien
tgaattagtttataagagatcttaaraagtcacttagcaagaaatgaata

SEQ ID NO: 46447 - DNA, 50 bp, homo sapien
ttttgtgtccttcccactttgaagaktccctgagaagattggtatgtctg

SEQ ID NO: 46448 - DNA, 50 bp, homo sapien
ttgtcatgtcatcaaaatttaaggastcaatagataaattatattactca

SEQ ID NO: 46449 - DNA, 50 bp, homo sapien
cagtgcccatgttggtcctgtttatragcccaagtctatgtcataagtaa

SEQ ID NO: 46450 - DNA, 50 bp, homo sapien
ttaaatgatggccagtctactcttayctgggagctacagtatagacaaaa

SEQ ID NO: 46451 - DNA, 50 bp, homo sapien
aaaggctaaagagaagggtttagaaktctgtactggtcttgttagcttga

SEQ ID NO: 46452 - DNA, 50 bp, homo sapien
taaattgtttgctcataaagtcctaygaccaagtatcttaatcagagatg

SEQ ID NO: 46453 - DNA, 50 bp, homo sapien
gaggaagtattaagaacacactccaygaactggatatggacaaaagggtg

SEQ ID NO: 46454 - DNA, 50 bp, homo sapien
gaatatcttttcttgtactttttgamcatttatatatctttgcacttact

SEQ ID NO: 46455 - DNA, 50 bp, homo sapien
gagagggagacatcttagtgtgagcraatgaccagtcgtttagtagagcg

SEQ ID NO: 46456 - DNA, 50 bp, homo sapien
gcaaaaactgcaacaaaatctcaaaycctttctgcagcagcagatggcaa

SEQ ID NO: 46457 - DNA, 50 bp, homo sapien
gtaagcttagccttcctgtgttttasactagtgatctttcacatacagca

SEQ ID NO: 46458 - DNA, 50 bp, homo sapien
aaccttatgaatttagggttaacaayaatctcttctgtaaaaagaaataa

SEQ ID NO: 46459 - DNA, 50 bp, homo sapien
aagaagctcctacttgattacggaaygaatgccatattaggacttactca

SEQ ID NO: 46460 - DNA, 50 bp, homo sapien
caatagtgtaagcaaaccaagagaamatatgcaaaaagtaccaataaata

SEQ ID NO: 46461 - DNA, 50 bp, homo sapien
gccatctttctggtgctgttacaaaragtatggaaggtactgacccattc

SEQ ID NO: 46462 - DNA, 50 bp, homo sapien
ccaaacacatgtataaaaccgacaaygagacaggaaaaattgaaagcttt

SEQ ID NO: 46463 - DNA, 50 bp, homo sapien
accaaatttccacacttcagcaatakgtcattcattcttttaataaagct

SEQ ID NO: 46464 - DNA, 50 bp, homo sapien
tctgaaatagtgcttattgcatcgaycaaaaagaagtgaatgctggagtg

SEQ ID NO: 46465 - DNA, 50 bp, homo sapien
tgtaaggactctttattcaaggtaaygtttgaaccctgctgagccagtgg

SEQ ID NO: 46466 - DNA, 50 bp, homo sapien
catcacatttactacatttgttagcyaaaacgtagccctcttgtaatcac

SEQ ID NO: 46467 - DNA, 50 bp, homo sapien
tgactcatccatcctcagatcctgaygactgtgcctttgttatccctggc

SEQ ID NO: 46468 - DNA, 50 bp, homo sapien
ctgggtattggaaggccagataaaasataccaaatccaccaggaagcttc

SEQ ID NO: 46469 - DNA, 50 bp, homo sapien
ccacttcttgtgagcaaaaaactcarctgttacaattcaatatggtaaag

SEQ ID NO: 46470 - DNA, 50 bp, homo sapien
tttacaatctacttggctctaatacwaatagtcgaatgtacccaatttgt

SEQ ID NO: 46471 - DNA, 50 bp, homo sapien
ttttatgtgtctaacaggcaactagmcatatctaccaagatgactaggtg

SEQ ID NO: 46472 - DNA, 50 bp, homo sapien
gggaggataggtaaagatgagccgargtaaacagactcgtttatttctgt

SEQ ID NO: 46473 - DNA, 50 bp, homo sapien
atgttatgtaaaaaaataagacttcygaaatacttagacaaaccataaat

SEQ ID NO: 46474 - DNA, 50 bp, homo sapien
ttaacggtaataataagatgaatacractgtctgggaaggagggggaagt

SEQ ID NO: 46475 - DNA, 50 bp, homo sapien
ttcattctttgatgtactagaaggayggaatgcaaagtatttctctatac

SEQ ID NO: 46476 - DNA, 50 bp, homo sapien
taggaatataacagtgagatatagaygccatcggtttcctcacagagcac

SEQ ID NO: 46477 - DNA, 50 bp, homo sapien
agaataatttaacgagagaggaaaayacaatagagaaaaacaaaatcctg

SEQ ID NO: 46478 - DNA, 50 bp, homo sapien
catttgcagctaaaccagatttctckctttacagctgagccacttaacac

SEQ ID NO: 46479 - DNA, 50 bp, homo sapien
aacaacccacacattcacctttcttygtgtacctgctgagctagccactg

SEQ ID NO: 46480 - DNA, 50 bp, homo sapien
aggcacagagatttggcacttcttgsagaaataagtcactaaaaatttgg

SEQ ID NO: 46481 - DNA, 50 bp, homo sapien
ctcatatgaaagagtgttagggaaayctagaataagaagagaatttctaa

SEQ ID NO: 46482 - DNA, 50 bp, homo sapien
gcctagatgctctatctgctacaacygcttcacacatttcaaaaccgtcc

SEQ ID NO: 46483 - DNA, 50 bp, homo sapien
gcttctcctcacaaaataaagatgcragtctctgttcagatttaaacagt

SEQ ID NO: 46484 - DNA, 50 bp, homo sapien
tctgagcccataagtagcatatacaygtaggtgccagctgtggtggtagt

SEQ ID NO: 46485 - DNA, 50 bp, homo sapien
gtagaactttgctaatgttcaacaayggaggcaggactaatcatatttaa

SEQ ID NO: 46486 - DNA, 50 bp, homo sapien
ataaaagccaaactaaatgtcagacyggcttctctatgatcctcctttct

SEQ ID NO: 46487 - DNA, 50 bp, homo sapien
catgacagagcatatggctgagaaaycatatagaatgctctagaataaaa

SEQ ID NO: 46488 - DNA, 50 bp, homo sapien
aaacagctgagaaatgtattggaatkagactgaattgatagaacagtttc

SEQ ID NO: 46489 - DNA, 50 bp, homo sapien
acgatgttgaagcaattttcacaaayggtgttcacgaatctggatcgtgt

SEQ ID NO: 46490 - DNA, 50 bp, homo sapien
tgtgttatcccatatggattagaaargcagaaaggagaaatgagaggaag

SEQ ID NO: 46491 - DNA, 50 bp, homo sapien
gttaaaacaaggagacaattaagacmcttgcttctcttctaaattagata

SEQ ID NO: 46492 - DNA, 50 bp, homo sapien
aggtctatttctgagccctaaattcmaaataagcctgtttctatataaag

SEQ ID NO: 46493 - DNA, 50 bp, homo sapien
gttacagaacaatatcagaagcctaygtgccatctaaaattttcttttat

SEQ ID NO: 46494 - DNA, 50 bp, homo sapien
agtggtgtcgaagtgtatctgagcayggaaaccggttgaaactagttgcc

SEQ ID NO: 46495 - DNA, 50 bp, homo sapien
tatagggcttttacttttatgagaaygtacaagtctgttatttaaaaaag

SEQ ID NO: 46496 - DNA, 50 bp, homo sapien
aaccagcatgatgggggagaagcacygctgtattcgtcactacaaaactc

SEQ ID NO: 46497 - DNA, 50 bp, homo sapien
tgttggcactatgtctaatagcccaracccagtaaaggagaaaagcagtc

SEQ ID NO: 46498 - DNA, 50 bp, homo sapien
ttgtaaatgagtacaaatgaatacaycagttggagtacgtgtggaatagc

SEQ ID NO: 46499 - DNA, 50 bp, homo sapien
cctctggagccctcactcatcctaaygctttctgtccacacaataccccc

SEQ ID NO: 46500 - DNA, 50 bp, homo sapien
gacatcgctgagcctctgtaacttcmagtgtacaatggtcataatagtat

SEQ ID NO: 46501 - DNA, 50 bp, homo sapien
gtagcatgaaaacagtcatgcttaartgttgattatttcattcttcacat

SEQ ID NO: 46502 - DNA, 50 bp, homo sapien
aatatctttaaagtggaacgctaaaragcagtgaaaataaattaactaat

SEQ ID NO: 46503 - DNA, 50 bp, homo sapien
aacctttaactcacaggtgttcatayacttaacaaagaaaattattgact

SEQ ID NO: 46504 - DNA, 50 bp, homo sapien
atatacatagattattataccattaraaaaacaaaggaatgattaatgta

SEQ ID NO: 46505 - DNA, 50 bp, homo sapien
tttttttctctaaatttctgttaatmaaatgagatgtgaactggaacaac

SEQ ID NO: 46506 - DNA, 50 bp, homo sapien
gatctgtcaaaagaatattattttcraaatgttcagaacattaaataacc

SEQ ID NO: 46507 - DNA, 50 bp, homo sapien
aggaagcagcagaaaactgatgactraatacttttgagctttgtggagaa

SEQ ID NO: 46508 - DNA, 50 bp, homo sapien
aattaggaagtatataaaaatcaagyatgcaaaatgagaggcaattatca

SEQ ID NO: 46509 - DNA, 50 bp, homo sapien
ttgaaaagacctgattctccaggccrcgtttcaggaaagcaaagtgaagg

SEQ ID NO: 46510 - DNA, 50 bp, homo sapien
aatgttgagtctagttgtacactgaygtcaaaaaaaaaagagagtgaaga

SEQ ID NO: 46511 - DNA, 50 bp, homo sapien
gtgatttttgtctactgccaactgckaagaaaaccaaaattcaatgtgat

SEQ ID NO: 46512 - DNA, 50 bp, homo sapien
gggcaggacacaaaagtggttagacmgtagaccacttagagtttgccatc

SEQ ID NO: 46513 - DNA, 50 bp, homo sapien
tttattataatgggtagaataaaackcatatatatatattaaaccaccat

SEQ ID NO: 46514 - DNA, 50 bp, homo sapien
cagacccaataaatggtggagccaayatttgaacccatgcatacttaacc

SEQ ID NO: 46515 - DNA, 50 bp, homo sapien
tcaataccggtcagttgatattttaraaagtggcaccgtagggctaacct

SEQ ID NO: 46516 - DNA, 50 bp, homo sapien
ttccatggaagaatcaaagtattccraatagaaagctctaattctcatgc

SEQ ID NO: 46517 - DNA, 50 bp, homo sapien
agaggcaacttctgcaacaattaaawggaaatagtaatagtacatgcatc

SEQ ID NO: 46518 - DNA, 50 bp, homo sapien
ttcatcagatgatacctttggtgccraaaggaaacacgcaagtcacgaaa

SEQ ID NO: 46519 - DNA, 50 bp, homo sapien
tagcagtatggtatggtggcctacgraaacaactggtgggaagaaactga

SEQ ID NO: 46520 - DNA, 50 bp, homo sapien
agaagagaagcctggtaaccaagtakgtcagtgcactaatccaaacaagg

SEQ ID NO: 46521 - DNA, 50 bp, homo sapien
taacctttttgagcttctagacttcrctgacatggacaagtgcaagtgag

SEQ ID NO: 46522 - DNA, 50 bp, homo sapien
ttgcattttattgcattataattaaytgaaaagtagaaatttgtatattt

SEQ ID NO: 46523 - DNA, 50 bp, homo sapien
aaggataatggcttccagttccaccmatgtttctgcaaaggacatgattt

SEQ ID NO: 46524 - DNA, 50 bp, homo sapien
cacagaccatacagatattaaaacartaataagtgaataatgtggaattt

SEQ ID NO: 46525 - DNA, 50 bp, homo sapien
attttcaagtgtgtaaacagtcttgyattctcaggataaaccacacttgg

SEQ ID NO: 46526 - DNA, 50 bp, homo sapien
ctggtgttgtagtctgaagtttccargacagtatatgactatgagatgtt

SEQ ID NO: 46527 - DNA, 50 bp, homo sapien
gcacaataaaagtataaactcagtayagtgcatagtatctttttcatata

SEQ ID NO: 46528 - DNA, 50 bp, homo sapien
ctctaagggtgagtgtgggaggacartaggaggtacaaacacaagtaaat

SEQ ID NO: 46529 - DNA, 50 bp, homo sapien
atagactttgacccagagaactaaaragatagaaaatatagacaaaaagt

SEQ ID NO: 46530 - DNA, 50 bp, homo sapien
tctgttgacagatggacagatcgaaygctcatagacttaaggactcataa

SEQ ID NO: 46531 - DNA, 50 bp, homo sapien
gattatgtttttcagaaaggagtcamtagatactatcaagggttactaaa

SEQ ID NO: 46532 - DNA, 50 bp, homo sapien
ggtttcattgctgactgcattactaygatctcagagacctaacatctagg

SEQ ID NO: 46533 - DNA, 50 bp, homo sapien
tattcagtaagccagatgttagttargaaatgatactagaagccttttat

SEQ ID NO: 46534 - DNA, 50 bp, homo sapien
tcccggggatgtgaacaatgtgttgkaggtgttcatgacctcagtgtccc

SEQ ID NO: 46535 - DNA, 50 bp, homo sapien
tttagagtgttttgcctatatgtacmaacagtaagcatctagaatgaaag

SEQ ID NO: 46536 - DNA, 50 bp, homo sapien
gagataggatttcttccatggctaaygaatgaagttgaaaaaaccatgga

SEQ ID NO: 46537 - DNA, 50 bp, homo sapien
catgatggtgatgttggggataatgsaatatcgtggaaatggtcaatatc

SEQ ID NO: 46538 - DNA, 50 bp, homo sapien
acacgggagctgcttttagatggagrctacctacaaagaacaacatatga

SEQ ID NO: 46539 - DNA, 50 bp, homo sapien
acatagatgatgaaaggattcatgayatagaaaatagatctgaagaaata

SEQ ID NO: 46540 - DNA, 50 bp, homo sapien
ggtcaagtccaaacctactcactaaytctgtgctctgctgctgtattcac

SEQ ID NO: 46541 - DNA, 50 bp, homo sapien
gtgagactccctatctacaaaatatraaaaggaaattagctgggcatttt

SEQ ID NO: 46542 - DNA, 50 bp, homo sapien
ttctcagtgaccattctcagttccayctcacttttctactttcttttgat

SEQ ID NO: 46543 - DNA, 50 bp, homo sapien
cttgtaagtttgctcagtttttggartcaagatcctgataccttttttcc

SEQ ID NO: 46544 - DNA, 50 bp, homo sapien
gttaaagaagactgactattttacawccacaggtatgaaaatttaagttg

SEQ ID NO: 46545 - DNA, 50 bp, homo sapien
tgtggtaaatggctgttattcaaaarctgtatgctcagagaagttgtctt

SEQ ID NO: 46546 - DNA, 50 bp, homo sapien
tctaatgactgcaaatgttggcctcratctatatgctttgctggcattat

SEQ ID NO: 46547 - DNA, 50 bp, homo sapien
acctccacattgctagaaggatggtyacatcttggacctcaggtgcttca

SEQ ID NO: 46548 - DNA, 50 bp, homo sapien
agctttgaccttattaccctgagcartaagtctaaccctttctcctctgt

SEQ ID NO: 46549 - DNA, 50 bp, homo sapien
ggcatgttttatgagttacaatgatraagaaaaagtgttacaaatacccg

SEQ ID NO: 46550 - DNA, 50 bp, homo sapien
cacactattgctgacattcaatggtraagaatctcagtgaacccaaggag

SEQ ID NO: 46551 - DNA, 50 bp, homo sapien
gctagaacaagacaggatgacgactraaacacagtatgcaagcttagaaa

SEQ ID NO: 46552 - DNA, 50 bp, homo sapien
tatttccccatgactagtacaggacygaacaactgtagacattgaaaata

SEQ ID NO: 46553 - DNA, 50 bp, homo sapien
agtcaatgttttccttctatttctcycagaggtctaaacatctctaaact

SEQ ID NO: 46554 - DNA, 50 bp, homo sapien
gatagaacttttgaatccaaaaaggraatacacaaaattgaaatatggag

SEQ ID NO: 46555 - DNA, 50 bp, homo sapien
aaatgactggatattactgcacagtsaatctagtacgtgaacaagaagat

SEQ ID NO: 46556 - DNA, 50 bp, homo sapien
cctacattaagactttgcagagataygcggatgggtcagataaatcagag

SEQ ID NO: 46557 - DNA, 50 bp, homo sapien
cagtttgcatctctgttctgatggaktacatgtctgataatcaaccagaa

SEQ ID NO: 46558 - DNA, 50 bp, homo sapien
ctttataagggaatctacacgattaragagggtagaatagtgagagaggc

SEQ ID NO: 46559 - DNA, 50 bp, homo sapien
acacaggagtagagatttttaacaaytgagattcattcccatcagctggt

SEQ ID NO: 46560 - DNA, 50 bp, homo sapien
cataagatatcatcataacttgtacwcctcttggatcttgcagacagacc

SEQ ID NO: 46561 - DNA, 50 bp, homo sapien
ctggcagataaaagcggaacatccaycaaattctagtaagtgcattttat

SEQ ID NO: 46562 - DNA, 50 bp, homo sapien
tcaccccaactttcttcaagtgttcrctcaaatgatgcctcagggaggcc

SEQ ID NO: 46563 - DNA, 50 bp, homo sapien
aatgcaaaggctaatgccaaccggayggttttctgaaccaagttgatcat

SEQ ID NO: 46564 - DNA, 50 bp, homo sapien
aagcagcagatgacaagctattgaartaaaaattctgaataaaattaggg

SEQ ID NO: 46565 - DNA, 50 bp, homo sapien
gctttcatatctctgaaatttgccaractataaaaacctcagatctcagt

SEQ ID NO: 46566 - DNA, 50 bp, homo sapien
aaaaatgtaaatggtatctcaatcaygaaccaagtagaaagatgtgcaca

SEQ ID NO: 46567 - DNA, 50 bp, homo sapien
tcttttcagtgtggcatttgtaacaytgctcatctctatgaaatggaatg

SEQ ID NO: 46568 - DNA, 50 bp, homo sapien
ggaagcaggttcccaagttgatgatsagcattcagaataataaactttgc

SEQ ID NO: 46569 - DNA, 50 bp, homo sapien
tcttaccatccacctttgctatctargacaccctctccttcttcccttga

SEQ ID NO: 46570 - DNA, 50 bp, homo sapien
ttctaattttctttgtgtaactggawcttcagttaatcttagtgtcaaca

SEQ ID NO: 46571 - DNA, 50 bp, homo sapien
aagctttctccatctgtaatgcactsagggcccagaaatcactctggtca

SEQ ID NO: 46572 - DNA, 50 bp, homo sapien
tcttacccctaacttcctctttcaayttaccatgtaattcctagtttatc

SEQ ID NO: 46573 - DNA, 50 bp, homo sapien
aatttgcagaaatgggcaagaaaaaytacttaactcattggtgggaagca

SEQ ID NO: 46574 - DNA, 50 bp, homo sapien
agggagagatatgcaaatgttcatcractctgtaatgaaaaatcttctta

SEQ ID NO: 46575 - DNA, 50 bp, homo sapien
gaattgaaaagaccagtttcttggayggccagctagagatgagctgaatt

SEQ ID NO: 46576 - DNA, 50 bp, homo sapien
tttttctctttgtgagtaaataaaayccttaattgacattaccagatgct

SEQ ID NO: 46577 - DNA, 50 bp, homo sapien
tttttaaaagacattgggtagtatartaagagtcacacctgatgttcaag

SEQ ID NO: 46578 - DNA, 50 bp, homo sapien
tgcttgcagagcaactccggatagaygtagacgttgctcaagtccactgt

SEQ ID NO: 46579 - DNA, 50 bp, homo sapien
ttttagccttggcagactaaaaaaastgtcctacacaaatcagcctgccc

SEQ ID NO: 46580 - DNA, 50 bp, homo sapien
tgggccaactccagtttatctttaaycaaagctgtgctgacttaaatagt

SEQ ID NO: 46581 - DNA, 50 bp, homo sapien
ctccaatctctcatcttgtgtccaasgagacgcgtactatcctggcatca

SEQ ID NO: 46582 - DNA, 50 bp, homo sapien
ttttcagtgggtttggtgatttggayggattaaaattctagactgaaaag

SEQ ID NO: 46583 - DNA, 50 bp, homo sapien
atatctaaagaggttggcatgaaaasggtttgatctttctgagttaacta

SEQ ID NO: 46584 - DNA, 50 bp, homo sapien
ccaataaaatgaaaaggaggccaacrataccacaaatttcaatgatcaat

SEQ ID NO: 46585 - DNA, 50 bp, homo sapien
aaacatttagttacatgtaaagttaygcaaactgatgaaatattacaatc

SEQ ID NO: 46586 - DNA, 50 bp, homo sapien
gggaaagaaaataaaggtgctgtaartccacaaggcccatggtgttcaca

SEQ ID NO: 46587 - DNA, 50 bp, homo sapien
gagtgggctgcgctgctattactcaygggccgcctcgctcgcagcactga

SEQ ID NO: 46588 - DNA, 50 bp, homo sapien
ctgttgatcatacctcctccaataayatgtgaggttctaaagacctaacc

SEQ ID NO: 46589 - DNA, 50 bp, homo sapien
aagtcactaagaaaagtcaacataaygaatgaacttagaccatctgcaga

SEQ ID NO: 46590 - DNA, 50 bp, homo sapien
tatattctattcaactgaaaatagcragactcagtaaaaagacaaaactt

SEQ ID NO: 46591 - DNA, 50 bp, homo sapien
tattttgccaaagtgtatgggtatayctaattcaaccaggcctaactatc

SEQ ID NO: 46592 - DNA, 50 bp, homo sapien
caggaagacaggttaagaatgttgayctaacagaagatgataacacaggt

SEQ ID NO: 46593 - DNA, 50 bp, homo sapien
tctgtgttgcttattttagggggacratgtctaaattgaaatgtttatcc

SEQ ID NO: 46594 - DNA, 50 bp, homo sapien
gcaaccaggctaccataaagtgcaasggctctatgaagtcagagaagaac

SEQ ID NO: 46595 - DNA, 50 bp, homo sapien
acctgcactggaacaaaagattttamaagaatgggtgctctcaaagtggc

SEQ ID NO: 46596 - DNA, 50 bp, homo sapien
ccagaccagagatcattactatcccrccatttggatgtctaggcagaaag

SEQ ID NO: 46597 - DNA, 50 bp, homo sapien
gaagtgagagatttgatgaggtcccrgagaaaaagacccggcagccgggc

SEQ ID NO: 46598 - DNA, 50 bp, homo sapien
tcagaatgtagggactttaaagggamctcagaggtgatcaagtccaaccc

SEQ ID NO: 46599 - DNA, 50 bp, homo sapien
agcttcctgacaacacagaccataasagaaatccaatagtctacaaagat

SEQ ID NO: 46600 - DNA, 50 bp, homo sapien
agccagcatgacccaatcaattgtarcaactattaggtgacgtatatctc

SEQ ID NO: 46601 - DNA, 50 bp, homo sapien
ctggaggcttaacagtggccgccatyaaaaatgatatcctacaccttggc

SEQ ID NO: 46602 - DNA, 50 bp, homo sapien
taatataccataacattaacgtaaartgtacgattcaatggcttttaaca

SEQ ID NO: 46603 - DNA, 50 bp, homo sapien
ccagtattgtttccattagagattgractacagaatgttttaaggttcta

SEQ ID NO: 46604 - DNA, 50 bp, homo sapien
ctgagtcactttgtctgcaaggacamctttgtatgttggaagtcactttc

SEQ ID NO: 46605 - DNA, 50 bp, homo sapien
ttaacataatgagaatctttatggamgaatttgcgacagctcaagaacat

SEQ ID NO: 46606 - DNA, 50 bp, homo sapien
aactactcattgtgcttctgttgcasacaatgcataggagtgaatgagac

SEQ ID NO: 46607 - DNA, 50 bp, homo sapien
ttctgaagtactcgctttctgaaacyatgtagttgtggccattccacagg

SEQ ID NO: 46608 - DNA, 50 bp, homo sapien
gtgtttccccctcaaactctcttgcrgactggtaaatgtcctaaattacc

SEQ ID NO: 46609 - DNA, 50 bp, homo sapien
attgcaaagctgaagatgtttgttarataagattattcagagaaatggaa

SEQ ID NO: 46610 - DNA, 50 bp, homo sapien
tttccctttcaagactcaaaatgtaygttttagatatttttattttgtga

SEQ ID NO: 46611 - DNA, 50 bp, homo sapien
agtgcataaagtttctcacttaggcygaagacactatgtacaactgagct

SEQ ID NO: 46612 - DNA, 50 bp, homo sapien
attctatttaatgtatggcagtttayggtttattttatttgtcctatcta

SEQ ID NO: 46613 - DNA, 50 bp, homo sapien
gcctttgagagaggtagcgtttacartgcaaccacacaatctaagtcagc

SEQ ID NO: 46614 - DNA, 50 bp, homo sapien
tctcccaagtaactttcagtctaacrgtacagctacagaaaaacctactg

SEQ ID NO: 46615 - DNA, 50 bp, homo sapien
aggataccgagccaccaagtaacacrgaaaaatgtatcgtttctgctaaa

SEQ ID NO: 46616 - DNA, 50 bp, homo sapien
atagatgaaatgcaaatgggcccccrctgtttctggtactcatctctctt

SEQ ID NO: 46617 - DNA, 50 bp, homo sapien
acttacagtttccatttttaacatartatcaggaaatattaagtgctttt

SEQ ID NO: 46618 - DNA, 50 bp, homo sapien
caagtttttgtcttaaaaagttaagractaaagagctgagacatttagaa

SEQ ID NO: 46619 - DNA, 50 bp, homo sapien
ggtgtgcccctgctgtacagaatgaygccacgggactcttgagaaaatct

SEQ ID NO: 46620 - DNA, 50 bp, homo sapien
taatgtatgggtcaatgaagcccagmagacattcattaactattatcaat

SEQ ID NO: 46621 - DNA, 50 bp, homo sapien
ttgaaataatatgtggcaattcagaytcaaatatttcgactttaagaatg

SEQ ID NO: 46622 - DNA, 50 bp, homo sapien
gctgcaacagccaaattgttttaggrataatagtaatagtaggaagagag

SEQ ID NO: 46623 - DNA, 50 bp, homo sapien
tatgtacaaatgtacatttgttgtgmaatattgtgcaatataattgtaat

SEQ ID NO: 46624 - DNA, 50 bp, homo sapien
tccaagtggggttgaagtatcatccygactcatttctgaagacttgtagc

SEQ ID NO: 46625 - DNA, 50 bp, homo sapien
agcctaacattccttaagagataggkaagcaggctctttagcctcactgc

SEQ ID NO: 46626 - DNA, 50 bp, homo sapien
ccccgtcttgggtattctcttataamaatgcaagaacagcctaataaccc

SEQ ID NO: 46627 - DNA, 50 bp, homo sapien
tcgcgttcttgcctgctggtcaataragagaacttaatcaaaagcgtagg

SEQ ID NO: 46628 - DNA, 50 bp, homo sapien
ataacgttgtaatggagcagatgtasaaacctgttggatggcgcttgata

SEQ ID NO: 46629 - DNA, 50 bp, homo sapien
ctgtgaggccaacattctgtaagacrctccggtcagggccattcatttct

SEQ ID NO: 46630 - DNA, 50 bp, homo sapien
agaagattgtatggcaaaatacgtasaagaaactctgtcactacctcagc

SEQ ID NO: 46631 - DNA, 50 bp, homo sapien
tcatggagcaaaacatccttgtgacygtatataggaatgtcttcataatg

SEQ ID NO: 46632 - DNA, 50 bp, homo sapien
ctctgaggactaactgtgattagaartgaatggccctgaccggagcgtct

SEQ ID NO: 46633 - DNA, 50 bp, homo sapien
tgtggttttttttcttgataagccawaaaaattatacataatgtgtgtgt

SEQ ID NO: 46634 - DNA, 50 bp, homo sapien
gggtggggacttgctttccagaacawggtgggattctccaagcgctgtga

SEQ ID NO: 46635 - DNA, 50 bp, homo sapien
tcttttttcctagatactatgacaarcaaggtaaatctctttctgaaaat

SEQ ID NO: 46636 - DNA, 50 bp, homo sapien
atcctccatcccacagtgtaaggtcrcatctagctctgaagtttcattgt

SEQ ID NO: 46637 - DNA, 50 bp, homo sapien
ggtttcataggtgaactgggctataycatcatatggcaaacactaggtgg

SEQ ID NO: 46638 - DNA, 50 bp, homo sapien
atgtgtcataatctggtctgagataygcttttattacaatttggtaatga

SEQ ID NO: 46639 - DNA, 50 bp, homo sapien
taatggggtccaattcatgttctgawaatactttctccaatgcactgttt

SEQ ID NO: 46640 - DNA, 50 bp, homo sapien
tagaactcatatctaacagtgctcarataactaccttgcatgagagattc

SEQ ID NO: 46641 - DNA, 50 bp, homo sapien
cactggcatcctttcagcattctgasatttttctgtgtaggatttcagag

SEQ ID NO: 46642 - DNA, 50 bp, homo sapien
tgcatgataaagatgagtgatccaaygttagaaatcatctggacattaaa

SEQ ID NO: 46643 - DNA, 50 bp, homo sapien
gctggtaaagcactctgtactcccartcatggcatgaattcttctgagtg

SEQ ID NO: 46644 - DNA, 50 bp, homo sapien
ccttaaaatacataagaaatgaataycataggttagaaaaaaatacatta

SEQ ID NO: 46645 - DNA, 50 bp, homo sapien
ttattcattttccattcattcaacargttgtagagctcctactgaatggt

SEQ ID NO: 46646 - DNA, 50 bp, homo sapien
gtcattagagagaaaagatgttgtaygtgcttaatgccaacttctcccct

SEQ ID NO: 46647 - DNA, 50 bp, homo sapien
ttcaccctgagcccgatacatgaccyggaactgctgtgagcaaatccctc

SEQ ID NO: 46648 - DNA, 50 bp, homo sapien
tacataatagcaataatgctttaacygtataaatgagactgtggaaattc

SEQ ID NO: 46649 - DNA, 32 bp, homo sapien
caatgaattttagtacracagtttgaaaagat

SEQ ID NO: 46650 - DNA, 50 bp, homo sapien
ttttgcttgttttaaagaaatctagmagtggttatgagttttaattcata

SEQ ID NO: 46651 - DNA, 50 bp, homo sapien
gcatagattttatgcggtagacatamattcctgctgtagtgtcagttctt

SEQ ID NO: 46652 - DNA, 50 bp, homo sapien
gaaaagctatgtaactgctatcttgmatacaaatacaagattggtttcgc

SEQ ID NO: 46653 - DNA, 50 bp, homo sapien
aaagtccacagtggcctgtggacatraacataactctcagagacaacact

SEQ ID NO: 46654 - DNA, 50 bp, homo sapien
acaagcagtgtggcttttttctacarcctaaataggaggctgacattatg

SEQ ID NO: 46655 - DNA, 50 bp, homo sapien
agttctcagatccaggcttatttgaygactccccaaggtctggagatatc

SEQ ID NO: 46656 - DNA, 50 bp, homo sapien
aagcagtgttcaacatttttgaatakgatgaaaactttttaatgttccct

SEQ ID NO: 46657 - DNA, 50 bp, homo sapien
ggatccaggagtgaggacactggatkagcacttcccacttagcaagaaac

SEQ ID NO: 46658 - DNA, 50 bp, homo sapien
tgtgcagtcctgttggttgtgattartaacggaccagagtgaggacccct

SEQ ID NO: 46659 - DNA, 50 bp, homo sapien
gctatcctgaatttaaacaagtgaaytgcagaatatatattactcagttc

SEQ ID NO: 46660 - DNA, 50 bp, homo sapien
cctaatatgtttgggattattaagcraaggctggagctgaaacataaggt

SEQ ID NO: 46661 - DNA, 50 bp, homo sapien
tccgtcctggggtcggctcttgttcyagtccggcgggagctgcccgcgcc

SEQ ID NO: 46662 - DNA, 50 bp, homo sapien
ttttcttagttattattttctgctaygtctaataccaatattgccgcagg

SEQ ID NO: 46663 - DNA, 50 bp, homo sapien
attcctgggtggtttagaatctcagwcacctgcatgtcactgctgtctgc

SEQ ID NO: 46664 - DNA, 50 bp, homo sapien
attgatttcttccacaggtctagtayattaggttcctctgctttaccttg

SEQ ID NO: 46665 - DNA, 50 bp, homo sapien
gataaaggtaagaatggaattgtccrcttagagggtttgttatgggcctt

SEQ ID NO: 46666 - DNA, 50 bp, homo sapien
cagggccatggggacagttaaatgastcaacctagtaagacagttacaca

SEQ ID NO: 46667 - DNA, 50 bp, homo sapien
cagtagtggtggaatatgaaatcaarggaaatactatgtgctttctatgt

SEQ ID NO: 46668 - DNA, 50 bp, homo sapien
ctactgcaactttatctgtatgtccmaaacagttactagagctctgaata

SEQ ID NO: 46669 - DNA, 50 bp, homo sapien
aacagaaataactttgattatgaaasgaagctatttctcattgtgaaaga

SEQ ID NO: 46670 - DNA, 50 bp, homo sapien
aagaatgagaaaaatggatatgacarctgagagacactataaaggaaact

SEQ ID NO: 46671 - DNA, 50 bp, homo sapien
acgaggtccttgattttcaatttccygcaatcctggctaagagacacaat

SEQ ID NO: 46672 - DNA, 50 bp, homo sapien
gttgacgtcacttgctacagttcacracgtacacagaaacctttaggctg

SEQ ID NO: 46673 - DNA, 50 bp, homo sapien
tacggaatctgcactcaaggtgtcaygttgaccatatacccactcatttt

SEQ ID NO: 46674 - DNA, 50 bp, homo sapien
acatcttatttgtgctgttagtaaayaccactggagcaaaaccatttggg

SEQ ID NO: 46675 - DNA, 50 bp, homo sapien
tgctgacatcctcacaaaatctctckattctacaaccctttctagctgtc

SEQ ID NO: 46676 - DNA, 50 bp, homo sapien
aattatgaaaataaaccatgggaaaktgacggaaagtgatagggagtcat

SEQ ID NO: 46677 - DNA, 50 bp, homo sapien
ggaaggaaacataactacatagaccraaaacgagagcacagaaaagctgg

SEQ ID NO: 46678 - DNA, 50 bp, homo sapien
gaccctcatccacgggattccaggaygaggaaagagacaggatggagcac

SEQ ID NO: 46679 - DNA, 50 bp, homo sapien
gagtcaatattctttaaacacttcartcttttcaagcaatgtttggcata

SEQ ID NO: 46680 - DNA, 50 bp, homo sapien
catttcatccagtcatctcaacttayggccacagataactgctgctcccg

SEQ ID NO: 46681 - DNA, 50 bp, homo sapien
tggagaagcaacagcggatttcaacrcccaggacggaccaggtagggagg

SEQ ID NO: 46682 - DNA, 50 bp, homo sapien
tattatacattggccttaagtctacygaaataatgtagatagatagatag

SEQ ID NO: 46683 - DNA, 50 bp, homo sapien
gagattactttctgatagtcacatamctcattccaaaatgtaaatccacc

SEQ ID NO: 46684 - DNA, 50 bp, homo sapien
tgtctcatcttgattcctttttaggraaggcgagagcatcagtaggaagt

SEQ ID NO: 46685 - DNA, 50 bp, homo sapien
actttcaacagcagagtcgacgctasccagattcactttggtaagcaatc

SEQ ID NO: 46686 - DNA, 50 bp, homo sapien
caagacctctcggcaggtctaataartactgtaattttgaaagagagatg

SEQ ID NO: 46687 - DNA, 50 bp, homo sapien
aggggagagtgattattttcatacayggtttctggttttgtacttttaaa

SEQ ID NO: 46688 - DNA, 50 bp, homo sapien
acacggtatgctcatatttaaactargtaagggcaaccgctaataatttg

SEQ ID NO: 46689 - DNA, 50 bp, homo sapien
attaaattaatttagcgaaattcacyggatacaatatactaaaactaata

SEQ ID NO: 46690 - DNA, 50 bp, homo sapien
atattctacactaataatctaaataycttgtctgttttacttctttttct

SEQ ID NO: 46691 - DNA, 50 bp, homo sapien
aacaattgggtagactgcagtaacayctatatgattttggttagtgcccc

SEQ ID NO: 46692 - DNA, 50 bp, homo sapien
tttacttttctatgttatatatacaygggcggtatgagttcaacagtcac

SEQ ID NO: 46693 - DNA, 50 bp, homo sapien
tcatcatcatcatcataacttagaakgcttacttccaaaatgtgagcact

SEQ ID NO: 46694 - DNA, 32 bp, homo sapien
cctcacaagctatggamcggtactagtcatgc

SEQ ID NO: 46695 - DNA, 50 bp, homo sapien
aaaacagctactaaaacggcatatckaagggattttgaatatgcacctat

SEQ ID NO: 46696 - DNA, 50 bp, homo sapien
tatctgtctgactgaagttctaaggyattctgtggttacttagaaatgat

SEQ ID NO: 46697 - DNA, 50 bp, homo sapien
ttctgccccccaaataatgtgaggayaatggttagttcacctgaaggaat

SEQ ID NO: 46698 - DNA, 50 bp, homo sapien
caagggagattcaaactttacagcaygttcgttctatttcaaggggagtc

SEQ ID NO: 46699 - DNA, 50 bp, homo sapien
ttaatcacaaatttaccctgcctcamaaagatagtcgagaggagagtgga

SEQ ID NO: 46700 - DNA, 50 bp, homo sapien
cacttagaacactctggctacaaggraaataatcaataaatagagtttcc

SEQ ID NO: 46701 - DNA, 50 bp, homo sapien
tggacctaactacttaataaacagarccgtcaggcatttctgtggcctca

SEQ ID NO: 46702 - DNA, 50 bp, homo sapien
acattacattttctaacattttaaargcaattttcagccagttttgctta

SEQ ID NO: 46703 - DNA, 50 bp, homo sapien
cactaatggtttgtgattaacacatsatagagactacctattagcctact

SEQ ID NO: 46704 - DNA, 50 bp, homo sapien
gtttgttatggcagattgattgaackgtgtataatgtctgtagattttgg

SEQ ID NO: 46705 - DNA, 50 bp, homo sapien
agctcaaagtggatgggcgaattgtsaacctgtcttcagcacagacacag

SEQ ID NO: 46706 - DNA, 50 bp, homo sapien
ttctatcacagaatgcacattagtaktaaattatttaggatagatatatg

SEQ ID NO: 46707 - DNA, 50 bp, homo sapien
atgtgtatccttttgcacttcaccamggtggatggacttccatcattttt

SEQ ID NO: 46708 - DNA, 50 bp, homo sapien
acaaaaaaccaatcacttagaatgasattgtgtaaagttttaaatatctt

SEQ ID NO: 46709 - DNA, 50 bp, homo sapien
agagataatatactgttctgtgacayctaagagttgcaggtgtaaggaaa

SEQ ID NO: 46710 - DNA, 50 bp, homo sapien
gtgctaagtcaggtgcccagagagcrctgctgtccggagaaatagggatc

SEQ ID NO: 46711 - DNA, 50 bp, homo sapien
tggcagggatctgagagtgaaccacygaggcaactagaggctggagttct

SEQ ID NO: 46712 - DNA, 50 bp, homo sapien
catgaagcacagagcggcaggacgaygagaggataaatcatttggaaaga

SEQ ID NO: 46713 - DNA, 50 bp, homo sapien
aatcccagtagtcactactggaatayggtgaacctctctctttgaagcct

SEQ ID NO: 46714 - DNA, 50 bp, homo sapien
acaaaaaaacagcctgactaatcccrggctatgacagaatttctaagaat

SEQ ID NO: 46715 - DNA, 50 bp, homo sapien
gcacacggctcactagaactgttaaygccgtcaaagtatctctgacacgt

SEQ ID NO: 46716 - DNA, 50 bp, homo sapien
cagacaaaagtatttgactccagaawgatttccaggaattacagtatgag

SEQ ID NO: 46717 - DNA, 50 bp, homo sapien
gagccaggaattcaaaacaacaacamgttgacgccatggtgcacatccag

SEQ ID NO: 46718 - DNA, 50 bp, homo sapien
ttagttttactaaagtattaacaaamatattcacagctgtttgaaaaggc

SEQ ID NO: 46719 - DNA, 50 bp, homo sapien
cgtaaaaggtgtccagtgcaagccargtatatccagcacttaacgagaag

SEQ ID NO: 46720 - DNA, 50 bp, homo sapien
taaatcccacttggacaggatgaatratctttttaaagtattgctgaatt

SEQ ID NO: 46721 - DNA, 50 bp, homo sapien
atctgttttttttctaaacattaccraggatttctagcaagccacttaat

SEQ ID NO: 46722 - DNA, 50 bp, homo sapien
atatttcagagaattgtatctgcatraagtcatagaaatacacacaaaaa

SEQ ID NO: 46723 - DNA, 50 bp, homo sapien
catgcagaataataatgccactaagragcaaacaggtgattcctagatgg

SEQ ID NO: 46724 - DNA, 50 bp, homo sapien
agattacgattccacatttatccagmaggctgattactaaggtccaaata

SEQ ID NO: 46725 - DNA, 50 bp, homo sapien
tttggacatcacaattttttcttcastaatgccccaaggtttcccacaga

SEQ ID NO: 46726 - DNA, 50 bp, homo sapien
gaaagttctctcaagttgtttttacratagtctggaaaacacagtctcat

SEQ ID NO: 46727 - DNA, 50 bp, homo sapien
catgatttctccctggtgtgaactcycggatgttgaatgaagcctgaatt

SEQ ID NO: 46728 - DNA, 50 bp, homo sapien
tacctacacaagcatgactgtttcartaagaatttacattattggtgggt

SEQ ID NO: 46729 - DNA, 50 bp, homo sapien
catctgtggatagagcaagtaaacayagtacagcatggtgaacagtagtg

SEQ ID NO: 46730 - DNA, 50 bp, homo sapien
tatggggtctattacatttagacaarttaaggtggattatcttagggaaa

SEQ ID NO: 46731 - DNA, 50 bp, homo sapien
ttatattggaattgtcctaaatttakagaaaacttgaattgatatcttca

SEQ ID NO: 46732 - DNA, 50 bp, homo sapien
tccagaacacggcaagctggatggayagtgatctggacaaaaatttgctg

SEQ ID NO: 46733 - DNA, 50 bp, homo sapien
aattcacctctccgttatattctaargatggacaaaaattgtcttgatgt

SEQ ID NO: 46734 - DNA, 50 bp, homo sapien
ggggagacagacatgagccaaatatmaacataactatgaaactagtcaga

SEQ ID NO: 46735 - DNA, 50 bp, homo sapien
gagaagattggcaagatagtgtttgragtgatgaatactgtcatgtctcc

SEQ ID NO: 46736 - DNA, 50 bp, homo sapien
gtgaagtaattgatggtgcaaggtcycagaagaggagatatacatggggt

SEQ ID NO: 46737 - DNA, 50 bp, homo sapien
tgaagttgtggtgtcataaagacaasaacaaaggagctaatttataggta

SEQ ID NO: 46738 - DNA, 50 bp, homo sapien
gctcttaactgtcatgcctattttawaaaacataagaggcaaaaagtagt

SEQ ID NO: 46739 - DNA, 50 bp, homo sapien
cttggttttgtaattctttctccaaycatggccgcttatagtgctaccag

SEQ ID NO: 46740 - DNA, 50 bp, homo sapien
ctataggaaagtaaagagatggcgaygtatgtgaagttgtggtgtcataa

SEQ ID NO: 46741 - DNA, 50 bp, homo sapien
ccatttaataactctagagattaaaytgattaagtgattttcccagaagc

SEQ ID NO: 46742 - DNA, 50 bp, homo sapien
ttaaacaaatgaagagcaagaactakggaagacaaaataatgagtaaaga

SEQ ID NO: 46743 - DNA, 50 bp, homo sapien
caagctttatcaattaaacttttcaygagtttagcatatcagattctttt

SEQ ID NO: 46744 - DNA, 50 bp, homo sapien
aaagcagcttccacccaatattcaargcattactgaaggcaacaaaacag

SEQ ID NO: 46745 - DNA, 50 bp, homo sapien
cttctaagccaaccattctagtgacrgaaaaaagctagtttcattatttt

SEQ ID NO: 46746 - DNA, 50 bp, homo sapien
aagttcagggacatatcctaccagasattgtaaagctataggaataaaat

SEQ ID NO: 46747 - DNA, 50 bp, homo sapien
tccagtgtgactaacaagggatatcragttcttcagacctgtggtataca

SEQ ID NO: 46748 - DNA, 50 bp, homo sapien
gcaaacaattttgatcagtttctatyaaatgggtgctgagagaaatgata

SEQ ID NO: 46749 - DNA, 50 bp, homo sapien
aatgaagaaaaattggaattgacaaygattttctcaaactataaggaagc

SEQ ID NO: 46750 - DNA, 50 bp, homo sapien
atgtatgctttgccactgtttctacmattattatacaaaaacataaatat

SEQ ID NO: 46751 - DNA, 50 bp, homo sapien
aaatacttgtatttccaagtatatcyacatagggctgtgcttaaattgta

SEQ ID NO: 46752 - DNA, 50 bp, homo sapien
aagtaaggaaatgtgtcataccaaaytgagtacagaaattatgagggtag

SEQ ID NO: 46753 - DNA, 50 bp, homo sapien
tgtcatggccaacctcagcaactgcrgcagaaaatacagctttcaacaca

SEQ ID NO: 46754 - DNA, 50 bp, homo sapien
cccatagaatattccttctcatctaragactccagtctgtaaccatgtgc

SEQ ID NO: 46755 - DNA, 50 bp, homo sapien
gaagctaacctggcagtaaattctasctcaaccttacttgaggcacctcc

SEQ ID NO: 46756 - DNA, 50 bp, homo sapien
ccccaatgaagccctccttgctacakccataagtaaacactatcttgaaa

SEQ ID NO: 46757 - DNA, 50 bp, homo sapien
ctagtgaccctgccatgttactacakattttgaatatcatctcaacctgg

SEQ ID NO: 46758 - DNA, 50 bp, homo sapien
gtgaagttttcttgagtaggctaacraagtatgaaactccttaagctttc

SEQ ID NO: 46759 - DNA, 50 bp, homo sapien
actcattctagaatactcctggcaakgccgccggcttcgggtcacaagat

SEQ ID NO: 46760 - DNA, 50 bp, homo sapien
ggcagttcctgagccattttaatcakagagccattaggagatgagatggt

SEQ ID NO: 46761 - DNA, 50 bp, homo sapien
gtctgactcacaggttcctgattgcsaagatgtgttacaggaaaactgtg

SEQ ID NO: 46762 - DNA, 50 bp, homo sapien
attcatgaacttggtatgtgccttartaacattcacttggaataaacaac

SEQ ID NO: 46763 - DNA, 50 bp, homo sapien
gtggggacacagccaaaccatatcayggagtaagtgcaaaacaacaattc

SEQ ID NO: 46764 - DNA, 50 bp, homo sapien
ataatagtttagtaatgctatctatmacaattaaattggtgacttaaaaa

SEQ ID NO: 46765 - DNA, 50 bp, homo sapien
ctgccttgatttggtgctaaggtgcyatcagctatactcatcattgcttt

SEQ ID NO: 46766 - DNA, 50 bp, homo sapien
tactgcaattatacagataccacaayttcagatattgatcagcgtgttca

SEQ ID NO: 46767 - DNA, 50 bp, homo sapien
caggtggcacctcagggcagcaccartatcagctaaggtgtaaatgcctc

SEQ ID NO: 46768 - DNA, 50 bp, homo sapien
tgggaatttcgagtcatgttcttcasgctgcttgggacaccccacctgga

SEQ ID NO: 46769 - DNA, 50 bp, homo sapien
ccttgtcttgttttttaatcaagacragtatagatgactctctatttacg

SEQ ID NO: 46770 - DNA, 50 bp, homo sapien
atttgatgtgaacaactgtaccttasaaaaatgtacttaatttgaaatac

SEQ ID NO: 46771 - DNA, 50 bp, homo sapien
ctgacggacactgtgtctgttgggcraggcggattggccatttcttatag

SEQ ID NO: 46772 - DNA, 50 bp, homo sapien
tgtcagcagctggttgcaacatcctkaaaggcagtcattccttcttcaat

SEQ ID NO: 46773 - DNA, 50 bp, homo sapien
ggatctcccttctcacattcacaaaycttgcgttcacactgaatcaataa

SEQ ID NO: 46774 - DNA, 50 bp, homo sapien
cctctgaacaacaacagaaaatcatkaggagagaaaaatggaataatggg

SEQ ID NO: 46775 - DNA, 50 bp, homo sapien
accccgttattcaatagctagcagayatagttattggaatgggggtagag

SEQ ID NO: 46776 - DNA, 50 bp, homo sapien
gctcatacgacctctgctttacaaartgtattacaaaggggagagagggt

SEQ ID NO: 46777 - DNA, 50 bp, homo sapien
acacttcatcttctcctctaaacacratcattaccagctgcctgtcatct

SEQ ID NO: 46778 - DNA, 50 bp, homo sapien
tcttaatgcgtaaaagtcttcaaaaygacagaaataaagctctaatggtg

SEQ ID NO: 46779 - DNA, 50 bp, homo sapien
aaaggcctttcaaaaatgccagagaraactcgtgcccgagggagcacacg

SEQ ID NO: 46780 - DNA, 50 bp, homo sapien
aactgcaaagcccactaaggaagaargccgagcaaagggagaccctgtct

SEQ ID NO: 46781 - DNA, 50 bp, homo sapien
cgcaatagagattccaagatgtaggmcaagggaccactttatttttctct

SEQ ID NO: 46782 - DNA, 50 bp, homo sapien
aagttagttggaaatgtaagtataaygacaggtttcaggggagttaggga

SEQ ID NO: 46783 - DNA, 50 bp, homo sapien
gagccactacgcctggccagtgctaraggttttaaagtggtgggctagac

SEQ ID NO: 46784 - DNA, 50 bp, homo sapien
ctgggaaatgatgccagtaagaatamggcctccaggctatgtatttcctt

SEQ ID NO: 46785 - DNA, 50 bp, homo sapien
cccccctccttcatgacaaaataatmataactgcacctcacaggcaagtg

SEQ ID NO: 46786 - DNA, 50 bp, homo sapien
gaggtttaaagagagacaatagtacygtaaggcatagccaatagttattg

SEQ ID NO: 46787 - DNA, 50 bp, homo sapien
tgtgattgtgatctgtcaaattttasaatgacttattaaggtctaaaaga

SEQ ID NO: 46788 - DNA, 50 bp, homo sapien
tctatttcagacaaaccgcatgtcaraggaaattgcccagctacacctct

SEQ ID NO: 46789 - DNA, 50 bp, homo sapien
taagggctggaaacttttcaaacacyaaggagcattcggaatatgcattc

SEQ ID NO: 46790 - DNA, 50 bp, homo sapien
tgggtaaatgctgataataatgaaawctgtaaggtcagtctgtgaagata

SEQ ID NO: 46791 - DNA, 50 bp, homo sapien
gataagcttccatgagagaagacagratatttaagagcctgaagtcacca

SEQ ID NO: 46792 - DNA, 50 bp, homo sapien
agtaatttattttgagattccatcartaatcagatcttgctaaatttaca

SEQ ID NO: 46793 - DNA, 50 bp, homo sapien
aaatgtgcatgcaaaattcttgacaygaggaagttgtaggaacaggtgtt

SEQ ID NO: 46794 - DNA, 50 bp, homo sapien
tcggtgggcctgtaggcaggacttaygcatggtgctattattaccaggca

SEQ ID NO: 46795 - DNA, 50 bp, homo sapien
gccctttttccctacagttccgtcaygtatgcttggcaattttggtctct

SEQ ID NO: 46796 - DNA, 50 bp, homo sapien
ttccccaatacagataaagcctagayaaaaagtagggtgatacataggca

SEQ ID NO: 46797 - DNA, 50 bp, homo sapien
cccccgctttgctgccagtagatcaygctgcttccttctgttctttcctt

SEQ ID NO: 46798 - DNA, 50 bp, homo sapien
cagttctccagtaatgaaagtgagayggaatactagccagttcaattaat

SEQ ID NO: 46799 - DNA, 50 bp, homo sapien
gtccaaatgacagacaaagatgcaartatggagtaggagaaataatgcca

SEQ ID NO: 46800 - DNA, 50 bp, homo sapien
cagccctggctttctctttttaggaygctttcctgataataaatctccac

SEQ ID NO: 46801 - DNA, 50 bp, homo sapien
cacatcaggtgaattggcatgtctayggagtccctgtctgagtgagtgtg

SEQ ID NO: 46802 - DNA, 50 bp, homo sapien
tgcctgatctaaataaataatgcaarcaataagccaggcagcaatcaatg

SEQ ID NO: 46803 - DNA, 50 bp, homo sapien
tctcagaaggattctgagagtcatcmatgtttgaatcatatgcaaaaaat

SEQ ID NO: 46804 - DNA, 50 bp, homo sapien
ctgaatagtcatttattttcctactraagtctatttcatgtaagatgttt

SEQ ID NO: 46805 - DNA, 50 bp, homo sapien
tttgaaagagacataccaacaaattraaatagaatctaacttttcataaa

SEQ ID NO: 46806 - DNA, 50 bp, homo sapien
caaaatcagaaattttaaactaatgyattgacccatttttgaaacaaggc

SEQ ID NO: 46807 - DNA, 50 bp, homo sapien
aggaaatgaaaccaggcattcatatraagttctttcttgaaagagttatt

SEQ ID NO: 46808 - DNA, 50 bp, homo sapien
tctagagtctagcaggatcaactgasaaaaatcaaattataatcttatat

SEQ ID NO: 46809 - DNA, 50 bp, homo sapien
accaatttcacaaaaagaacctgtaygaggaagttcagtagccaaaccta

SEQ ID NO: 46810 - DNA, 50 bp, homo sapien
aattacatctattataatcaacagcratttatcaattacatcagggatgt

SEQ ID NO: 46811 - DNA, 50 bp, homo sapien
tacatttgtgggaaaatactacttamctccctctgtttgcttagtaaatg

SEQ ID NO: 46812 - DNA, 50 bp, homo sapien
cggtaactctggaagatatttgccarctctctaatgggcatatcagaagg

SEQ ID NO: 46813 - DNA, 50 bp, homo sapien
aagagtttagacaagagttgatagarccaaaggtgtggtcttgggtaact

SEQ ID NO: 46814 - DNA, 50 bp, homo sapien
aatatgtggtttcatggcttcatgaraagggtttatactaacatgaacaa

SEQ ID NO: 46815 - DNA, 50 bp, homo sapien
ggcaatagagtttaggaatcaaaaaygtattatactctttttagctctta

SEQ ID NO: 46816 - DNA, 50 bp, homo sapien
aattagattttagtaaattggactckcgattagtataatattattggata

SEQ ID NO: 46817 - DNA, 50 bp, homo sapien
atgaactgttcccaatgagaaagaaytcgatttggtcaggacattgttga

SEQ ID NO: 46818 - DNA, 50 bp, homo sapien
ccttaatcactggccatgttgagaaraaaagtgttttacaagcatcattg

SEQ ID NO: 46819 - DNA, 50 bp, homo sapien
cattatctgatggagttaatggttasagagctaaacagtgcacttcaaac

SEQ ID NO: 46820 - DNA, 50 bp, homo sapien
caataaatgggaagcattctataaastaataaactcacaagaaaaatgac

SEQ ID NO: 46821 - DNA, 50 bp, homo sapien
tcacgtatgagataaattccagagayattacagaggtagaatggataaag

SEQ ID NO: 46822 - DNA, 50 bp, homo sapien
gtgtacagtgaacatatttgaattawgttgagtaaattacattaagcaga

SEQ ID NO: 46823 - DNA, 50 bp, homo sapien
tctcaaagtgccatggtgacttgaamattactcataatgactgaagagac

SEQ ID NO: 46824 - DNA, 50 bp, homo sapien
aagccaagaagttttcaaaggcaacraatatgtctaatcaagagctccaa

SEQ ID NO: 46825 - DNA, 50 bp, homo sapien
ttataatcaatgacaatccttataaraaacagattcctgcctcattcagg

SEQ ID NO: 46826 - DNA, 50 bp, homo sapien
gagtttaagaaaggaagtctgatcaytcatcgtatacttccaacatcctt

SEQ ID NO: 46827 - DNA, 50 bp, homo sapien
acttcctttcttaaactcctctcctraaatgcattatgtgtgtgtgtgtg

SEQ ID NO: 46828 - DNA, 50 bp, homo sapien
cttccttctagactcaataatttagsaagagatagacacttgtgccaaac

SEQ ID NO: 46829 - DNA, 50 bp, homo sapien
gaatgaatgagtcacacactggaacyatcagaagagttaagttgagagac

SEQ ID NO: 46830 - DNA, 50 bp, homo sapien
gacatgttaacatccaataaaaataygggttgccacagtgctgttctatc

SEQ ID NO: 46831 - DNA, 50 bp, homo sapien
agagaggattccaccagacataagargctcatcttgacccttcgtgaaag

SEQ ID NO: 46832 - DNA, 50 bp, homo sapien
ctcgaacattgggaagacttggtaamattttgagagaccagaattgatct

SEQ ID NO: 46833 - DNA, 50 bp, homo sapien
tgttcgaggaaatgcaattcatgtayaatcttttgtattacatttgcaac

SEQ ID NO: 46834 - DNA, 50 bp, homo sapien
tgtgtgctatttgctatacaatatawgattgtctggagttttgagtcctg

SEQ ID NO: 46835 - DNA, 50 bp, homo sapien
gagcactctagagtctttaagtgcaraacattcatcatatccatcttcag

SEQ ID NO: 46836 - DNA, 50 bp, homo sapien
ggtatgaaaatagagacaaggagcasaaattggatggtagccagagatga

SEQ ID NO: 46837 - DNA, 50 bp, homo sapien
tccccaataagaggcaattttagtgsatttcaaacttagaatatgagctg

SEQ ID NO: 46838 - DNA, 50 bp, homo sapien
agggtcttaaaataaaaagcgataasttagtggaaagtaatgcaaggact

SEQ ID NO: 46839 - DNA, 50 bp, homo sapien
atagtttccattgattatgacatcaytgaggcaggaatggtaacagaccc

SEQ ID NO: 46840 - DNA, 50 bp, homo sapien
aaccaaggggtggaatattcacgaargttcctggaaaaaggtagaggtgt

SEQ ID NO: 46841 - DNA, 50 bp, homo sapien
taagtgaaacagtaattatattgtasatgggatattaaaaaaactttaaa

SEQ ID NO: 46842 - DNA, 50 bp, homo sapien
atttatagaagaaataaaatccaaamaaacgatcagagtgagaaggcagc

SEQ ID NO: 46843 - DNA, 50 bp, homo sapien
atttcaatttttattttttctttgaytactggctgttcaagattctgttg

SEQ ID NO: 46844 - DNA, 50 bp, homo sapien
aaacgtctatgggaatctaaatgccragatcagaatttcgatgacatcta

SEQ ID NO: 46845 - DNA, 50 bp, homo sapien
agatcagaatttcgatgacatctaayagagtttggaaattgaacagaaag

SEQ ID NO: 46846 - DNA, 50 bp, homo sapien
tatatggactccaaggtcaactagawggaagtaagtaaaagcgagtaaga

SEQ ID NO: 46847 - DNA, 50 bp, homo sapien
tggagagtatatcatctccgtgagamcaacttgaaaaataaacgaatggt

SEQ ID NO: 46848 - DNA, 50 bp, homo sapien
tttaagatgataggttttcatcaatraactttctcatttcaaatgataca

SEQ ID NO: 46849 - DNA, 50 bp, homo sapien
ttttgaaaataatctatgaatttctraaagacagaagaaagaatgttttt

SEQ ID NO: 46850 - DNA, 50 bp, homo sapien
gatgtcttcaatgattttgttcttamatgatgtgactttttttttttttt

SEQ ID NO: 46851 - DNA, 50 bp, homo sapien
ttgtcagttttcctatcttcataaaytgcaaaacagcattcatttccttg

SEQ ID NO: 46852 - DNA, 50 bp, homo sapien
aactgtattttcacagtacttctggrattcttaatgaactagaaacttaa

SEQ ID NO: 46853 - DNA, 50 bp, homo sapien
gtgaatttatatcaaccagctttagwaacatatccataaaaagccccaca

SEQ ID NO: 46854 - DNA, 50 bp, homo sapien
agacaataaagtgggacataatattmaaaatcacatcattgaatgcaagc

SEQ ID NO: 46855 - DNA, 50 bp, homo sapien
aattcttgatgtgttagcttccctayagagacagtcaattgtgattaact

SEQ ID NO: 46856 - DNA, 50 bp, homo sapien
cctagatttgtaagcagaaagcagamtatgaaggctcttgcatgttatag

SEQ ID NO: 46857 - DNA, 50 bp, homo sapien
aacatacaagttgcttacttagcccraagaggtcagtaagcttctagatt

SEQ ID NO: 46858 - DNA, 50 bp, homo sapien
tgtctattattatttagttttgcaaygcctttaaacgattaccttaccag

SEQ ID NO: 46859 - DNA, 50 bp, homo sapien
atactaataactaattagaaagcacratgaaaataaattataatcttcac

SEQ ID NO: 46860 - DNA, 50 bp, homo sapien
tgtattggtactctgattttatttarctctatattcaacactttcagagg

SEQ ID NO: 46861 - DNA, 50 bp, homo sapien
ctacatggtccatgccttagtactgraagagacttgtgaccccaggcaga

SEQ ID NO: 46862 - DNA, 50 bp, homo sapien
acagtttggaaacatatcgctagtgyaaaatatcagagatcttgtaagac

SEQ ID NO: 46863 - DNA, 50 bp, homo sapien
ttatgtactagtattacatgtcaaamaaggcagagagatctattatggta

SEQ ID NO: 46864 - DNA, 50 bp, homo sapien
atcatttagccaccattacctgctcyatgactttttgctctaagtccttc

SEQ ID NO: 46865 - DNA, 50 bp, homo sapien
taagggtgatggaaagagttaaggcragtcaggacattagaaccaatcaa

SEQ ID NO: 46866 - DNA, 50 bp, homo sapien
cctgagtcctcacagttgtcacacastaagcagtctgacaaggagctgct

SEQ ID NO: 46867 - DNA, 50 bp, homo sapien
atagaaaagtaacatgtctctgatayacagttcctttgattggttctaat

SEQ ID NO: 46868 - DNA, 50 bp, homo sapien
tagcctacaccaacttctctgcaggwatgagctaatacattcaaacctgt

SEQ ID NO: 46869 - DNA, 50 bp, homo sapien
ccaattaccaccgctggttacaggaragttaaacaggtagcaatactaga

SEQ ID NO: 46870 - DNA, 50 bp, homo sapien
tttgctctcttctgttgttagaaacycaaatattaagttacaaaaaggtt

SEQ ID NO: 46871 - DNA, 50 bp, homo sapien
ggggggtgtcccatagtatggagtcrcaattacctattagtgaagagaga

SEQ ID NO: 46872 - DNA, 50 bp, homo sapien
tttctttggcactatttctctgatawcttgagtcaatcactccagtaatc

SEQ ID NO: 46873 - DNA, 50 bp, homo sapien
taaaagcagttaaaatgttcaaatayctgttgttctggcattaagaaaga

SEQ ID NO: 46874 - DNA, 50 bp, homo sapien
acccatagagactgtacagataccaygacctttgcatcaaggtataaaat

SEQ ID NO: 46875 - DNA, 50 bp, homo sapien
caaatacctgttgttctggcattaakaaagaataataaataatataagct

SEQ ID NO: 46876 - DNA, 50 bp, homo sapien
tcccagatcccaggctcagagaaaaytatttcattgcttagacttcagag

SEQ ID NO: 46877 - DNA, 50 bp, homo sapien
tgctgatttcaactactcgtacaatyaaattatctttcagctcaagaact

SEQ ID NO: 46878 - DNA, 50 bp, homo sapien
ccactattcaatgaaagaactcatcrctacctgttaatagatttgcgtag

SEQ ID NO: 46879 - DNA, 50 bp, homo sapien
agaaatcctaggaaaagctaacttaygtaatttttgattgttaaatttta

SEQ ID NO: 46880 - DNA, 50 bp, homo sapien
tcaagaaagcagtagtgattataaaytagcagcacaatagcaggatggtt

SEQ ID NO: 46881 - DNA, 50 bp, homo sapien
tagatgtttatatagtaaatcataarggcattaattcaaaacaatatagt

SEQ ID NO: 46882 - DNA, 50 bp, homo sapien
gaacctcaagctattgcagctctcaragaaggctgggaaggggaggaatg

SEQ ID NO: 46883 - DNA, 50 bp, homo sapien
aaaaattgcatttttcaatagaaagrcattaaaaagacatctggtaatgc

SEQ ID NO: 46884 - DNA, 50 bp, homo sapien
cctgtgtctcttctgtgcaattcacyatgtacaactatgccagatgaatc

SEQ ID NO: 46885 - DNA, 50 bp, homo sapien
atgattatctaccttgaaaggcccaygttttactagaccaccacactcca

SEQ ID NO: 46886 - DNA, 50 bp, homo sapien
attattattcagttatcttaaaaggwcctaagtctatcttgcagtactga

SEQ ID NO: 46887 - DNA, 50 bp, homo sapien
cctaagtctatcttgcagtactgatyaaaagcaattttcaaatccaaaac

SEQ ID NO: 46888 - DNA, 50 bp, homo sapien
attccaaggtaatgacagaattttaygttcctcagaagctgatccttgta

SEQ ID NO: 46889 - DNA, 50 bp, homo sapien
cctctggcacttgttaggccacatakgaaaaactgtctccagtcgtggat

SEQ ID NO: 46890 - DNA, 50 bp, homo sapien
atgggttctatctccggaatgaagtsaaatgtgatattattgattacaac

SEQ ID NO: 46891 - DNA, 50 bp, homo sapien
atggcatcagtccatccaagccttaygctactcactgaagcccaaataat

SEQ ID NO: 46892 - DNA, 50 bp, homo sapien
tctaacagcctatgattcaatgcaaragcaaagaaattacttaaagttgg

SEQ ID NO: 46893 - DNA, 50 bp, homo sapien
catgaagaacagtgtttgcaaaatgkcagaggagtgaaaaagcagcatgt

SEQ ID NO: 46894 - DNA, 50 bp, homo sapien
aatgatagtaatgacagtaaaaataygatatatgcatgcaattggatctt

SEQ ID NO: 46895 - DNA, 50 bp, homo sapien
acaaaatagagaaaatacggtgcaayacatatcgcagaacaatgtttaac

SEQ ID NO: 46896 - DNA, 50 bp, homo sapien
atgctccaacctatactttcacttaycttaatcagaatgccaccattaaa

SEQ ID NO: 46897 - DNA, 50 bp, homo sapien
atgttttaatttcttgtaattactcrccttaactagtgatatcctgggag

SEQ ID NO: 46898 - DNA, 50 bp, homo sapien
accagaaaaaatgtgttctttaaaayataggtcagtggtccaatatgtat

SEQ ID NO: 46899 - DNA, 50 bp, homo sapien
cactaaagctgacattttgaattgayggagaaagaatgacgataattatg

SEQ ID NO: 46900 - DNA, 50 bp, homo sapien
gatataatattcagctgcatcactaygtctaattaaagataacctcagaa

SEQ ID NO: 46901 - DNA, 50 bp, homo sapien
tgcaaaactcaaagtaactctatcartaagaaaaataagtattacacgtg

SEQ ID NO: 46902 - DNA, 50 bp, homo sapien
tcaatatccctggggaacataaataygaaaactctcaacaaaatactagc

SEQ ID NO: 46903 - DNA, 50 bp, homo sapien
ataaacaccacttgatcataataagwaatccttttaatatgctgcataag

SEQ ID NO: 46904 - DNA, 50 bp, homo sapien
tcaaaggaatgtcatttaaaagacasgaaattagatgctgatatgcctaa

SEQ ID NO: 46905 - DNA, 50 bp, homo sapien
actgcactatttcacacatccaaaamgatggccagttgtagaatgtaagc

SEQ ID NO: 46906 - DNA, 50 bp, homo sapien
tcatttatttaattttcacctaccartattcctcagattaaataatgtca

SEQ ID NO: 46907 - DNA, 50 bp, homo sapien
ggagttatctgttctaaatttaatgsaagactgaattttgaccattgcac

SEQ ID NO: 46908 - DNA, 50 bp, homo sapien
ggaccctctaaaggttatgggcatamgaagaggaagggaaacatttgaaa

SEQ ID NO: 46909 - DNA, 50 bp, homo sapien
ggcatttgaacagaagccagaaagaytcgagagggtcaagagaaagacta

SEQ ID NO: 46910 - DNA, 50 bp, homo sapien
tttaattgtttactgttgccgattgyataaattttaaactccttatcagg

SEQ ID NO: 46911 - DNA, 50 bp, homo sapien
aaccctagtatgatgttatgtttccragatctttctaatcctttgcattt

SEQ ID NO: 46912 - DNA, 50 bp, homo sapien
tgcaagctaatgatgttaaggggtcyaatggagatttattgaagacaagg

SEQ ID NO: 46913 - DNA, 50 bp, homo sapien
agaggcaactttaaaaaggaggtaartagaatgagagaggagaatccttc

SEQ ID NO: 46914 - DNA, 50 bp, homo sapien
aagggacactcagagataaatttgaygggagatctcagagctacttccta

SEQ ID NO: 46915 - DNA, 50 bp, homo sapien
actcattaaagcttatctgaagccasagttatatgttatggtttattgcc

SEQ ID NO: 46916 - DNA, 50 bp, homo sapien
cagaaaaacattgacttagtatttascttctacttaccacaaagaatcat

SEQ ID NO: 46917 - DNA, 50 bp, homo sapien
tctcatttagactgcttagactgacyacataggaattgctttggtaacca

SEQ ID NO: 46918 - DNA, 50 bp, homo sapien
atctctgtccttctccatggcttaaytggatgactagtgcacccattcca

SEQ ID NO: 46919 - DNA, 50 bp, homo sapien
aaagaaagtgaaaaggaatttatgawaatagtgactttattgatgtaata

SEQ ID NO: 46920 - DNA, 50 bp, homo sapien
tggaaatattcaaactagctttcaawggatttatataattatggtttgac

SEQ ID NO: 46921 - DNA, 50 bp, homo sapien
atcaagtaagtgcatgagatatctaycagacatataagcagttgatgtgc

SEQ ID NO: 46922 - DNA, 50 bp, homo sapien
tttagatgctaatgagcagtgaaatracccaactatggacatgaataaag

SEQ ID NO: 46923 - DNA, 50 bp, homo sapien
ctatcctcattaagttgctcttgaargtggaataaacatatataaaaaat

SEQ ID NO: 46924 - DNA, 50 bp, homo sapien
catatttatcattcttaaaattatartaatcaagtgtttgtttatatatt

SEQ ID NO: 46925 - DNA, 50 bp, homo sapien
catttatgacataacaggtgaaaacmataaaaacagacttaatgttatcc

SEQ ID NO: 46926 - DNA, 50 bp, homo sapien
taaagcaattagactgagacaacaayacagtaagtacctgcaaagtactg

SEQ ID NO: 46927 - DNA, 50 bp, homo sapien
atctccctttcttcagtcaccataayttaaagcaaaactttttttttttt

SEQ ID NO: 46928 - DNA, 50 bp, homo sapien
agcaaggccaattgaaatattattgyagtacaaagcataaaagcataggg

SEQ ID NO: 46929 - DNA, 50 bp, homo sapien
ctaaccttaaaattttggtgaggtgraattaggaaacaatgaataacaaa

SEQ ID NO: 46930 - DNA, 50 bp, homo sapien
cccactggagttgtagaagatattayatgcaccaagaaacttaagctttg

SEQ ID NO: 46931 - DNA, 50 bp, homo sapien
atcaagaatgttttcatatcaagtcycagggatgcaacttgtgggcaaaa

SEQ ID NO: 46932 - DNA, 50 bp, homo sapien
acattctcaggaggctgttttcaagkctccttatcacacattccgttcct

SEQ ID NO: 46933 - DNA, 50 bp, homo sapien
gtgcttttatatgtagtaaacaaggycataggtgcctcatgatctgacca

SEQ ID NO: 46934 - DNA, 50 bp, homo sapien
gcaaacaaatggaagtctgtattaaytcacatcaggtcagattaggattc

SEQ ID NO: 46935 - DNA, 50 bp, homo sapien
atgacataggttatatttaactgtayaatatttcgatgagacaagcatgt

SEQ ID NO: 46936 - DNA, 50 bp, homo sapien
aggtgctagaactattagtgtataamaccatttggtatttggtgacatat

SEQ ID NO: 46937 - DNA, 50 bp, homo sapien
aatgatgatgatgatatatcataaaragaccaaacaaagaggcagtgttc

SEQ ID NO: 46938 - DNA, 50 bp, homo sapien
atttgtattaaagcataacctttacyactgctctaagaagatctatagga

SEQ ID NO: 46939 - DNA, 50 bp, homo sapien
gtgagcaaaattatctaactttctayactatgcatgagcagcaatagatg

SEQ ID NO: 46940 - DNA, 50 bp, homo sapien
cagattaatttctttatgaaggagtsaaatgtgctagctatattcctaga

SEQ ID NO: 46941 - DNA, 50 bp, homo sapien
aagatttgaagcaaactaacagtatwagggaccagagccaaaccagttag

SEQ ID NO: 46942 - DNA, 50 bp, homo sapien
tgcatcagtttcccttcaaaagtcargtgaatatcacaaaaacatacacc

SEQ ID NO: 46943 - DNA, 50 bp, homo sapien
cagagctgaaagtgttagacactccratagctagtcattcttgtagatgg

SEQ ID NO: 46944 - DNA, 50 bp, homo sapien
ctgagccctgataattctggaacaayaagaaaaattccactctgtcacct

SEQ ID NO: 46945 - DNA, 50 bp, homo sapien
acagaagattggttatttctaggtcraaaagctgtggatcataaccacag

SEQ ID NO: 46946 - DNA, 50 bp, homo sapien
agttttttatttgtttattggtgtgragattaatatgtgattccataaca

SEQ ID NO: 46947 - DNA, 50 bp, homo sapien
acatcctcctaaactgagatggttarcaataactgaagtctatatggaag

SEQ ID NO: 46948 - DNA, 50 bp, homo sapien
attgcaagagtgtggtaatgacaaargacaaataagtaaatcaaaggaac

SEQ ID NO: 46949 - DNA, 50 bp, homo sapien
gttattgctaaccatctcagtttagraggatgttcaagagtactcctact

SEQ ID NO: 46950 - DNA, 50 bp, homo sapien
tactcctacttcccaatttgctgacycatttcaagtgattacatgaaagt

SEQ ID NO: 46951 - DNA, 50 bp, homo sapien
acaaatagaaaatttttatttaaggkatactctgatgctataattttcta

SEQ ID NO: 46952 - DNA, 50 bp, homo sapien
gccttaaagtggacctcggtgggacyatgaggactgtaatgttcatttct

SEQ ID NO: 46953 - DNA, 50 bp, homo sapien
agaagctggggcagataatcaaggarcataataaatacagaaagacttcc

SEQ ID NO: 46954 - DNA, 50 bp, homo sapien
attctttttactgtcattttaataaycaagcactgttaaagaaaaaatta

SEQ ID NO: 46955 - DNA, 50 bp, homo sapien
agcagttgcttataacatcataatamaaaaagatatttttaactggcaaa

SEQ ID NO: 46956 - DNA, 50 bp, homo sapien
ggggttttaacatattgttagccaaygcaaaatatatgggaattggaata

SEQ ID NO: 46957 - DNA, 50 bp, homo sapien
acctggttttgaagatagacaaatawacaaggttatggaaagacagaaaa

SEQ ID NO: 46958 - DNA, 50 bp, homo sapien
aaaataattaccctaaagtacctagycacaaaatatatgaaaaagaggtt

SEQ ID NO: 46959 - DNA, 50 bp, homo sapien
tactctttgggataaaactttccctkaataatattcctcttcctttattt

SEQ ID NO: 46960 - DNA, 50 bp, homo sapien
tatggaaaattaaagcacaaaaaaakttcatgcttcagttttgagatctc

SEQ ID NO: 46961 - DNA, 50 bp, homo sapien
ttataatgtagaccgtactgaggcaratgatggtgtcattttgattttac

SEQ ID NO: 46962 - DNA, 50 bp, homo sapien
ttacagaataaaagtgtcctgacaamctaaatctccatgaaatttttagc

SEQ ID NO: 46963 - DNA, 50 bp, homo sapien
attttaattaaaattgaggcattagwattgaaacttgtgcaaagaaaaat

SEQ ID NO: 46964 - DNA, 50 bp, homo sapien
gtcgaaacacttgcagtgactccgarcgcccttggagaaaaaaaaggcac

SEQ ID NO: 46965 - DNA, 50 bp, homo sapien
gggagagccttgccaaatttttagaraagaatatgtatttctccccactt

SEQ ID NO: 46966 - DNA, 50 bp, homo sapien
ctttaggtaattttaaatatctcaaraaagaagaacaataattttttaaa

SEQ ID NO: 46967 - DNA, 50 bp, homo sapien
tataggttaagaaatactactgcaastgaaaaccaaatataattccatac

SEQ ID NO: 46968 - DNA, 50 bp, homo sapien
gctttttgacatattacaagtacaayttcagaaaaccctgtttcattctc

SEQ ID NO: 46969 - DNA, 50 bp, homo sapien
atgattgccctacgtatgtcatgaakgtaaaattttcttcaaaatcatga

SEQ ID NO: 46970 - DNA, 50 bp, homo sapien
ataaaggaataaaggaatcaaacaakttaatcatacttcctacgagtcat

SEQ ID NO: 46971 - DNA, 50 bp, homo sapien
aaaactcagtttgaaatgatgaaaaytgcaagatgttcaaatctgaaaaa

SEQ ID NO: 46972 - DNA, 50 bp, homo sapien
aaatcgcagacagaatgcaagtcacygatgacaagtcacaaagagcaaat

SEQ ID NO: 46973 - DNA, 50 bp, homo sapien
ccaactgaaaggcgaggacatgctaycaataccaaggtaaatggggcagt

SEQ ID NO: 46974 - DNA, 50 bp, homo sapien
aattctcaaacagcatttcattttaycaaaagtaaagcaaaacaaacaaa

SEQ ID NO: 46975 - DNA, 50 bp, homo sapien
agtctgatctgatataaattaagcaygtgttcatcatagactcagataac

SEQ ID NO: 46976 - DNA, 50 bp, homo sapien
caatccagtcaactataagcaacaastatacacacggcattgtgtttgat

SEQ ID NO: 46977 - DNA, 50 bp, homo sapien
tttggaaattaaatgtattaactccraggataagaatttttctgtccctt

SEQ ID NO: 46978 - DNA, 50 bp, homo sapien
agatctaagcttggtctttgtttaaygttgaagaaaatgacccttgtcta

SEQ ID NO: 46979 - DNA, 50 bp, homo sapien
acacaaatagcatactaaattgtgartattttactaaagaccttgtgagt

SEQ ID NO: 46980 - DNA, 50 bp, homo sapien
aataataaaatatagacactctccartattgatgagatatatttcttcct

SEQ ID NO: 46981 - DNA, 50 bp, homo sapien
caggcatagtgattcattgtggttayactcaatcatactctattactcca

SEQ ID NO: 46982 - DNA, 50 bp, homo sapien
attggagtagcagatgctattggtcrattaaccaaaaacccattcccaat

SEQ ID NO: 46983 - DNA, 50 bp, homo sapien
cattgtattttacatttctgaattgsagttcatctatttacattttaaga

SEQ ID NO: 46984 - DNA, 50 bp, homo sapien
catctatttacattttaagattaggmattttcatacttgaagtaatgcat

SEQ ID NO: 46985 - DNA, 50 bp, homo sapien
gcattttattgtacttatctttttayacgcctctgtctctatcaatttta

SEQ ID NO: 46986 - DNA, 50 bp, homo sapien
tgagccaaagctggaccttctgcaayagggaattagagagtagagagact

SEQ ID NO: 46987 - DNA, 50 bp, homo sapien
acttatgtattgtttaagtgttttcrataagcaatgtagaaaagtagatt

SEQ ID NO: 46988 - DNA, 50 bp, homo sapien
actttttcatctgatgtctttaatasagtaaaattcacttctttgaaatt

SEQ ID NO: 46989 - DNA, 50 bp, homo sapien
agggaaattaacattttaagtgcacsaattctaataagtaaaatgtaaac

SEQ ID NO: 46990 - DNA, 50 bp, homo sapien
atcgttatactagttaacaatctctsaccacctaggacacttgttcactt

SEQ ID NO: 46991 - DNA, 50 bp, homo sapien
cgaaaagactgattccatggtcatasgtttgaggttatttgttcttaaga

SEQ ID NO: 46992 - DNA, 50 bp, homo sapien
ttttttctgtttccttctggactaartgaagaaaagcaagggagtctttt

SEQ ID NO: 46993 - DNA, 50 bp, homo sapien
aaagaaggtatgcttttgacattccrgaagatccacatgtttgggcaaat

SEQ ID NO: 46994 - DNA, 50 bp, homo sapien
atctatttatgttaactcacactcaraacgattatagtaatgatacaatt

SEQ ID NO: 46995 - DNA, 50 bp, homo sapien
accagggacaatcttactactctccyagttaatgatcacttcaggggctg

SEQ ID NO: 46996 - DNA, 50 bp, homo sapien
catattagtagacttattgactaaaraaagataagttatataatattaag

SEQ ID NO: 46997 - DNA, 50 bp, homo sapien
ctccttcattcacaaatgggactcasaaaggatgtatgatatgtggctaa

SEQ ID NO: 46998 - DNA, 50 bp, homo sapien
gaaatctgcacagatgaagtgcaagrcataaaccatattgaatcgtctgt

SEQ ID NO: 46999 - DNA, 50 bp, homo sapien
gggaacttgtcaagcctttcttctayggaaatgatatagtagaaattctg

SEQ ID NO: 47000 - DNA, 50 bp, homo sapien
tgtcttcaaagggaatccttaaaaawgatatattggaaaccactgatttc

SEQ ID NO: 47001 - DNA, 50 bp, homo sapien
ggaagaaagagaacaattctgataawttaggtgattttgtaagaaattca

SEQ ID NO: 47002 - DNA, 50 bp, homo sapien
ccaccacactgggctacacgtggaayagtaggtgcaaagaggtcacttgg

SEQ ID NO: 47003 - DNA, 50 bp, homo sapien
gagtttaaaagaatgttgaacagtcraagtgcagtgtattggacaattct

SEQ ID NO: 47004 - DNA, 50 bp, homo sapien
gctaattcctgacatcctcatgccakattctcttgctactgtctttctct

SEQ ID NO: 47005 - DNA, 50 bp, homo sapien
ttgtgtgtaaattaagatgtcattgyattaacagttcaacttcttattta

SEQ ID NO: 47006 - DNA, 50 bp, homo sapien
acagaaagttaattcagaattatgayggaatattagacattattttatag

SEQ ID NO: 47007 - DNA, 50 bp, homo sapien
tttatcacatcattaaaaagtttcartagaagatgaggatcatagaaatt

SEQ ID NO: 47008 - DNA, 50 bp, homo sapien
ctgctgactttcaaagggtcctagawgggacaacataatggtgtgcaagg

SEQ ID NO: 47009 - DNA, 50 bp, homo sapien
atagctttcaatattatcactgattwaagagttgatgtattttgaaaagt

SEQ ID NO: 47010 - DNA, 50 bp, homo sapien
gtcaattttccatttacgtgaaaackactcgatacatgcttctaagctta

SEQ ID NO: 47011 - DNA, 50 bp, homo sapien
atgtgtttggagtctttacatgtacrctatttcctctgcttagaaaatac

SEQ ID NO: 47012 - DNA, 50 bp, homo sapien
ttagaaaaaagtaagaaaatttagayaaaagtactgacataaaacaggca

SEQ ID NO: 47013 - DNA, 50 bp, homo sapien
ttccatcatgtcaattgcatcattaygtttgattgttggcctactagtgt

SEQ ID NO: 47014 - DNA, 50 bp, homo sapien
atgaaaaattaactgagaacaatgastcatcaactatgttagtactcacc

SEQ ID NO: 47015 - DNA, 50 bp, homo sapien
catactgaacacaaacaattgagaaygtaaggatcacataattttgtctt

SEQ ID NO: 47016 - DNA, 50 bp, homo sapien
tgtgtgaaagaaaggatagaagaaamtatttaatatgagccaggaaagaa

SEQ ID NO: 47017 - DNA, 50 bp, homo sapien
cttttatattccccaaattcagacasatattaaatgcacttggtggccca

SEQ ID NO: 47018 - DNA, 50 bp, homo sapien
aagcagctacacttcagtctacttasaaggttaattgctgatggtagttt

SEQ ID NO: 47019 - DNA, 50 bp, homo sapien
aggaatactgcctactttccctacakattctgctgaaagcagcttcatct

SEQ ID NO: 47020 - DNA, 50 bp, homo sapien
atttagtgatgtcttacttttttggmatctcctaccagtgtatccttcac

SEQ ID NO: 47021 - DNA, 50 bp, homo sapien
actattatcattggatattttaacaygcttttatcagaaaaaaatccagc

SEQ ID NO: 47022 - DNA, 50 bp, homo sapien
ttgaggaataatgtgtctctgccaayaagagtgttagtgctgaagattgc

SEQ ID NO: 47023 - DNA, 50 bp, homo sapien
catttttctgcattctagccttctckctttggttttgaaatatagaagta

SEQ ID NO: 47024 - DNA, 50 bp, homo sapien
tacttgagcttgaaaaaatatttcarggatggaacaggaatagtggggac

SEQ ID NO: 47025 - DNA, 50 bp, homo sapien
taatcactgtaaaactttactgagamtatcatagagtagagctttacaaa

SEQ ID NO: 47026 - DNA, 50 bp, homo sapien
agttcactttgaagatagagtattgsaatccatttccttcccctcttttg

SEQ ID NO: 47027 - DNA, 50 bp, homo sapien
atgtaaagcacatagtacatgttcawtacctcttagctcttattattatc

SEQ ID NO: 47028 - DNA, 50 bp, homo sapien
tattcactttcccttatgtggctatsaacaagaaaacaataaaacagctg

SEQ ID NO: 47029 - DNA, 50 bp, homo sapien
taaaagttagcttttgagaccgtgasagaagaatccatcctatagtaacg

SEQ ID NO: 47030 - DNA, 50 bp, homo sapien
ttaaaattctattagaatttaacacrgtaattagaattagcacatacaca

SEQ ID NO: 47031 - DNA, 50 bp, homo sapien
aggacacctggagttttatcagtgarcactttaggaatgtctgtttctcc

SEQ ID NO: 47032 - DNA, 50 bp, homo sapien
cttgaacatcagaatggtacatatcygagaatgtgattagctgggtgcag

SEQ ID NO: 47033 - DNA, 50 bp, homo sapien
ataaataaacagataattttttacarggattatgctcataaatattgaga

SEQ ID NO: 47034 - DNA, 50 bp, homo sapien
caatgttgaatttggctcatacttcyagggtagctaagcagaaagaaatt

SEQ ID NO: 47035 - DNA, 50 bp, homo sapien
cctttaagatgtatggtgactaataygtttatcatcatttttctcttctt

SEQ ID NO: 47036 - DNA, 50 bp, homo sapien
aacaaattgtcccttctctacccaawttatgctttgtctgtgaaaacaga

SEQ ID NO: 47037 - DNA, 50 bp, homo sapien
caactgcttctatgttgtactctgcraaaaatcacacggccagaatgagg

SEQ ID NO: 47038 - DNA, 50 bp, homo sapien
atataaatcctaaacatttcaagtgyacatctacttccagggatcataaa

SEQ ID NO: 47039 - DNA, 50 bp, homo sapien
ttgcaggccctgaactcctttggtcrctatagagaggttgttgacaatat

SEQ ID NO: 47040 - DNA, 50 bp, homo sapien
cctgtcgctgctactcatatcacaasttagtgacctagccacccttaaag

SEQ ID NO: 47041 - DNA, 50 bp, homo sapien
ttattccaaaggtcctttgctcaaamctttaattgaccaactcaatctac

SEQ ID NO: 47042 - DNA, 50 bp, homo sapien
gcaagatggaagagcaattacaaacygtttccatgaccaaagcagataat

SEQ ID NO: 47043 - DNA, 50 bp, homo sapien
gtttcagaatatcaaaattattaaaraaggatatagcattttcataagat

SEQ ID NO: 47044 - DNA, 50 bp, homo sapien
gtaagtgtacacaggaataaaactamaaggttgaaatccaattttaccgt

SEQ ID NO: 47045 - DNA, 50 bp, homo sapien
agaaatattatatttctgtacacaawgtaacattataaatgaaagcttca

SEQ ID NO: 47046 - DNA, 50 bp, homo sapien
attcactggctagcattcttctttgyaaagttctcaagtaagaggcaaag

SEQ ID NO: 47047 - DNA, 50 bp, homo sapien
ttatagaaattacataaaattatgtsaacaaatggcaataacttgatata

SEQ ID NO: 47048 - DNA, 50 bp, homo sapien
caacaggaaagatttaactaccacasaggagtatgccattttctatggaa

SEQ ID NO: 47049 - DNA, 50 bp, homo sapien
agccgaaatatcaacgaagtgtcaasataaatttgagctatcttctgacc

SEQ ID NO: 47050 - DNA, 50 bp, homo sapien
cgtattcccaactaggtctacatgasgcaaggatatccaagctcatgact

SEQ ID NO: 47051 - DNA, 50 bp, homo sapien
cagagtctgcaatctcaaatcttaartggtataccaatctttctctgtgt

SEQ ID NO: 47052 - DNA, 50 bp, homo sapien
agggaaatgtgtgggctatattgagracctgaaagagggactaggcacta

SEQ ID NO: 47053 - DNA, 50 bp, homo sapien
ccatcccatatatctggattataacractgaagagtaggtacatgacttt

SEQ ID NO: 47054 - DNA, 50 bp, homo sapien
gtcgagaagacaatactttcaatgargcataaagtcatgtacctactctt

SEQ ID NO: 47055 - DNA, 50 bp, homo sapien
attattcctttttgtatcttaaatcrctcatctgggttcactttattata

SEQ ID NO: 47056 - DNA, 50 bp, homo sapien
aaaagggatgttaaaaacagggccaygagtatgggaagagaacgtacgtt

SEQ ID NO: 47057 - DNA, 50 bp, homo sapien
ctgatgaaggtatgatcagatcttaraacccaaaatgactcagctttcaa

SEQ ID NO: 47058 - DNA, 50 bp, homo sapien
ggaagctcagttaaaataataaaggragaaatatcctgcaattaattcgc

SEQ ID NO: 47059 - DNA, 50 bp, homo sapien
cttgaaacatgacaggctgtagaaaractattaaaatcgctttgctaaca

SEQ ID NO: 47060 - DNA, 50 bp, homo sapien
taagaagataaatattcttcccacaygttttgcacccagagctcctctgt

SEQ ID NO: 47061 - DNA, 50 bp, homo sapien
ctagatgcaacctcttcaacccttakagtgactagaaaagattctttttt

SEQ ID NO: 47062 - DNA, 50 bp, homo sapien
agagctcctctgttgaaataataagsagtgttgtaatacatgaatttgag

SEQ ID NO: 47063 - DNA, 50 bp, homo sapien
ttgactgaatcgcttaattgtagacragcattcattttaatgtaaatctt

SEQ ID NO: 47064 - DNA, 50 bp, homo sapien
aaaaatgtattctgaatgaagtaaaygttttcaatcagagtcttcatatc

SEQ ID NO: 47065 - DNA, 50 bp, homo sapien
aagccacatatgatcatggtaaaaakattccaggttcatatctcggttta

SEQ ID NO: 47066 - DNA, 50 bp, homo sapien
tttattgaatgtttactgcatgtgakaaaaaccctggtaaactaccaagg

SEQ ID NO: 47067 - DNA, 50 bp, homo sapien
ggttcttgacattcagactctagaaytgtcattttaaacatgtcttcttt

SEQ ID NO: 47068 - DNA, 50 bp, homo sapien
caatcaaaggataggattaaactccratgaagtcactttgtttcgttttt

SEQ ID NO: 47069 - DNA, 50 bp, homo sapien
tgcacttctgtaggggagatgtagawacttaaataaagagaaagaaacct

SEQ ID NO: 47070 - DNA, 50 bp, homo sapien
gaataggttgtgcttccctcagaaayggatgctctataagcttgaatatt

SEQ ID NO: 47071 - DNA, 50 bp, homo sapien
attatctctctgtgaaaaaataccartatgcttgtaaagagagaaaacaa

SEQ ID NO: 47072 - DNA, 50 bp, homo sapien
gtgcaaatggacttagtacattgaamaaattaatcctttcacattttatt

SEQ ID NO: 47073 - DNA, 50 bp, homo sapien
agaagacattcctctctcaattccgrcctatatataatgatttaataata

SEQ ID NO: 47074 - DNA, 50 bp, homo sapien
tgcatatttactgcaatgtatagtakgtatcatatgctttatgccaaagt

SEQ ID NO: 47075 - DNA, 50 bp, homo sapien
tttgctgtcttcccgtttgcattacyaaagattttccagaaaaacagtga

SEQ ID NO: 47076 - DNA, 50 bp, homo sapien
accatactgagattcaacaaatggastacgagttttatgaattttacttc

SEQ ID NO: 47077 - DNA, 50 bp, homo sapien
gattattccccaaaagtagcatagaygaagttaaagtaacaaaggaacag

SEQ ID NO: 47078 - DNA, 50 bp, homo sapien
aatttgcttttcctttatgcacttasaagagctcattaccaatatgacaa

SEQ ID NO: 47079 - DNA, 50 bp, homo sapien
gttcatagttaccaaagatttcatayggagattcaagtaggaatgaattt

SEQ ID NO: 47080 - DNA, 50 bp, homo sapien
gtgatctagtttctctacatcctcaytaagatttgtgttgtcactacttt

SEQ ID NO: 47081 - DNA, 50 bp, homo sapien
ataagtaatatgtgctattgttactyactatgtgtaatgtcatccacaat

SEQ ID NO: 47082 - DNA, 50 bp, homo sapien
cataatattgtttaagggaaaatgaygtagactagaaatattttcaaatc

SEQ ID NO: 47083 - DNA, 50 bp, homo sapien
ttgtttttgctgcaaatatatttacyataaatgactgcacataaattatg

SEQ ID NO: 47084 - DNA, 50 bp, homo sapien
tagatgtttgatttaactggtcttamatgatccttaaatgactctaattt

SEQ ID NO: 47085 - DNA, 50 bp, homo sapien
ccaaagttaaggcctactggtattgmattggtaatcagaaatgtttacca

SEQ ID NO: 47086 - DNA, 50 bp, homo sapien
tgtcacaatttacataattggtttcrcatgcaatttgtatttcatacatt

SEQ ID NO: 47087 - DNA, 50 bp, homo sapien
acattgaatgggtacagcgggaaaargctaatggctcagctgtccatgga

SEQ ID NO: 47088 - DNA, 50 bp, homo sapien
cacatctattcatttctaacagttaygtatcttcacctctgtgtcatcca

SEQ ID NO: 47089 - DNA, 50 bp, homo sapien
gaattatagacttaagaaacaaatckatggttgggttatgttgatttggt

SEQ ID NO: 47090 - DNA, 50 bp, homo sapien
actctatcaaatatccactaatgaarctaactgatattaatagactctag

SEQ ID NO: 47091 - DNA, 50 bp, homo sapien
agcctcaattttattatattttagaygatatgatctccatttatacaaat

SEQ ID NO: 47092 - DNA, 50 bp, homo sapien
gaaaaagaattatattactgtcttgkattactaaattgaattaatgttga

SEQ ID NO: 47093 - DNA, 50 bp, homo sapien
tatttaaggagttttgctgttaatgmaggactaaggacccctcactcatg

SEQ ID NO: 47094 - DNA, 50 bp, homo sapien
gaactgtacttcctttttatactccrgatgagtgaggtagagagaaagtg

SEQ ID NO: 47095 - DNA, 50 bp, homo sapien
agtaatgtttatgtgttatacacaamgtttgagccagtagtttcagagta

SEQ ID NO: 47096 - DNA, 50 bp, homo sapien
gacttgaattaaataaaataacttasgaatcttatactttctcttggctg

SEQ ID NO: 47097 - DNA, 50 bp, homo sapien
taactagacagcagaagggttcctaragacaatttcaagtacaaactacg

SEQ ID NO: 47098 - DNA, 50 bp, homo sapien
caggctgatattgcagcgacatcatraatttctcagacagctttgtgaat

SEQ ID NO: 47099 - DNA, 50 bp, homo sapien
tttttttttttttttttttactacartagaccatttttccatggacactt

SEQ ID NO: 47100 - DNA, 50 bp, homo sapien
accaacaggtgcaactgagaaacaaygtgtaaaatgtgattaagattaca

SEQ ID NO: 47101 - DNA, 50 bp, homo sapien
ccctataatctgagctcctccaggtkaaggaatgtaagttattcaagtgt

SEQ ID NO: 47102 - DNA, 50 bp, homo sapien
agctgatttagtttcatttacctaargagctgttctgaccctgttgcaga

SEQ ID NO: 47103 - DNA, 50 bp, homo sapien
ttttctttgaggatgtggaggtgtaygtaatcaatattgagccaaaagca

SEQ ID NO: 47104 - DNA, 50 bp, homo sapien
tctcaatcacaataatcatattcaaygacaggtttcttaatagtgagtct

SEQ ID NO: 47105 - DNA, 50 bp, homo sapien
atatttaatcatagaatacttctaawctccttctgacaaataaattgaac

SEQ ID NO: 47106 - DNA, 50 bp, homo sapien
ctccttttatttttctgatccctaawagttgagaaagacccagcttggtt

SEQ ID NO: 47107 - DNA, 50 bp, homo sapien
gtcaaggggttccttcaattgcatawtaaggattcagtaatttattttgt

SEQ ID NO: 47108 - DNA, 50 bp, homo sapien
ttacacataaagtaaatatgtttagraggaaaatccgtacaaaaagttga

SEQ ID NO: 47109 - DNA, 50 bp, homo sapien
tcctatttaaggtagatactggatamattttggttaaacgaataatgtag

SEQ ID NO: 47110 - DNA, 50 bp, homo sapien
gtcttgaagatcgctgtatttagggyaaagtgccgtataaatcatagaag

SEQ ID NO: 47111 - DNA, 50 bp, homo sapien
ctagatttagatgtagttttagatcsctgttagtgctttcctctgttcaa

SEQ ID NO: 47112 - DNA, 50 bp, homo sapien
ttatctggttaatatcatatcccacyatttattacagtgtctttctcaga

SEQ ID NO: 47113 - DNA, 50 bp, homo sapien
aggagtattctgagtttatacattasagcaaaaatgttaaaccttctctc

SEQ ID NO: 47114 - DNA, 50 bp, homo sapien
cacaggtgaaaaaaattcgagtaacragtaagacaaacagaattgcatta

SEQ ID NO: 47115 - DNA, 50 bp, homo sapien
caactgacttcaattatatgtagaascatccaaaagtctcctctcaggta

SEQ ID NO: 47116 - DNA, 50 bp, homo sapien
aacttggattattggtaaaaataagsaattgtgatgttcttccaacactc

SEQ ID NO: 47117 - DNA, 50 bp, homo sapien
gacaaaaccgaacgattctgcaagayaaagcattgaaaattttgaggtaa

SEQ ID NO: 47118 - DNA, 50 bp, homo sapien
acttggaaaaaataagtaatatcaastaatgccataatgtagctaaacag

SEQ ID NO: 47119 - DNA, 50 bp, homo sapien
gtcaatcattttaggttcttcaagtsaaagtgcttctgacaacaaactat

SEQ ID NO: 47120 - DNA, 50 bp, homo sapien
ggacatggaaaggaatgtattgatastatagggatttgtcatgggaaacc

SEQ ID NO: 47121 - DNA, 50 bp, homo sapien
gtccttttttgaagtaagggacaagragtaagtattttcttttttaagtt

SEQ ID NO: 47122 - DNA, 50 bp, homo sapien
aattttttatacttcttgtgatcccwacaatatattctatgtgtatttgt

SEQ ID NO: 47123 - DNA, 50 bp, homo sapien
atgcagtctaatttaagttctaaacsgtattccaaggcaagcttctatcg

SEQ ID NO: 47124 - DNA, 50 bp, homo sapien
aaggaatggcatcttgccaaagggartattacattaaaaaaaattgttct

SEQ ID NO: 47125 - DNA, 50 bp, homo sapien
ccaaaacagcaaatagtagagggcaraatttcactttaatatcatagtct

SEQ ID NO: 47126 - DNA, 50 bp, homo sapien
cctttagcaaactcctaatgtgtcaktaaaaattctcaaggatgaaatag

SEQ ID NO: 47127 - DNA, 50 bp, homo sapien
tatttttaaggaaacttacattggcrcagtattgggaaatggtccgtaag

SEQ ID NO: 47128 - DNA, 50 bp, homo sapien
ctgggaagcaaggctcagcggtaaaytctgtgaaacaatcattgcagtag

SEQ ID NO: 47129 - DNA, 50 bp, homo sapien
atggcctaattgttgacagtaacatratgtaatttgcttatttcaaaagg

SEQ ID NO: 47130 - DNA, 50 bp, homo sapien
caaaacccatacccacataccatccyattcagaaagacagaaatagctgg

SEQ ID NO: 47131 - DNA, 50 bp, homo sapien
gtttatttttatgtgtttatatatamctttatcactattctattcataaa

SEQ ID NO: 47132 - DNA, 50 bp, homo sapien
tcaatggtgaatccatttagagggamgctatagattttagtatctgtaga

SEQ ID NO: 47133 - DNA, 50 bp, homo sapien
taaatttatgacctttatgtcaggaytatatttgatttcagtatgaaaat

SEQ ID NO: 47134 - DNA, 50 bp, homo sapien
tattagacagatatcagggatggtargaacatgactaagctgtaacaatg

SEQ ID NO: 47135 - DNA, 50 bp, homo sapien
tttaaccaccaggaaacgtcaacaaygtaattcttggtactcttcaccaa

SEQ ID NO: 47136 - DNA, 50 bp, homo sapien
cctttttgatttcttttctcacccartgacttttcgagagtttattttat

SEQ ID NO: 47137 - DNA, 50 bp, homo sapien
atgtactttgaataaaatttagttcwctagttcctcaaaataggtaacag

SEQ ID NO: 47138 - DNA, 50 bp, homo sapien
gggctaggctactttaaattactcawatggttcagaaatcaacagtttgc

SEQ ID NO: 47139 - DNA, 50 bp, homo sapien
gaggaaagctagtatttattaagcayccatttagtaagactcttagctgt

SEQ ID NO: 47140 - DNA, 50 bp, homo sapien
gttaggtccttatactacatgtgaastagcatcatatcaattaaagttag

SEQ ID NO: 47141 - DNA, 50 bp, homo sapien
gaactcctagtctgttaatgaggaaygtaggatttaagaagtctctgcca

SEQ ID NO: 47142 - DNA, 50 bp, homo sapien
gtaatacttaacaacccaatgttctraatacagttaactggcacaagagc

SEQ ID NO: 47143 - DNA, 50 bp, homo sapien
aattatttgactactctgcataatasatataaattctctatactgtatat

SEQ ID NO: 47144 - DNA, 50 bp, homo sapien
tttatctaactgcaaagagatgccaygaacaatgatttaaatgaagaaac

SEQ ID NO: 47145 - DNA, 50 bp, homo sapien
agcttaattcaattattcatgcaaartatactactagaacttttttccct

SEQ ID NO: 47146 - DNA, 50 bp, homo sapien
tgaccttagtactatattcttggcaygtgtatctaaataaaaacacttct

SEQ ID NO: 47147 - DNA, 50 bp, homo sapien
atccacctgtaatgggtgaatccaaraagaataaccagtgtttaaaagac

SEQ ID NO: 47148 - DNA, 50 bp, homo sapien
atatatcaataattttcatgtcaccmactggttacttataatccctcaaa

SEQ ID NO: 47149 - DNA, 50 bp, homo sapien
gtagagaccaacacaacggcacttasaaaagtctggaaggagtgagacaa

SEQ ID NO: 47150 - DNA, 50 bp, homo sapien
caaaaatactaagcaagggaagaaartacaatctattaacttgggagctc

SEQ ID NO: 47151 - DNA, 50 bp, homo sapien
tgttaacaatttctaataattatcargttatcgaatgcttactgtgtgac

SEQ ID NO: 47152 - DNA, 50 bp, homo sapien
taaaccaatattgacacattattatraacaatagtagatatattgttcat

SEQ ID NO: 47153 - DNA, 50 bp, homo sapien
aagcaacaccaaatgaaagtattgartcaaaagtcaataaagcttcatgg

SEQ ID NO: 47154 - DNA, 50 bp, homo sapien
ttttataaatatgctaattttaggamaatcacaaaataatctttcagcct

SEQ ID NO: 47155 - DNA, 50 bp, homo sapien
aaacacaaaatttcaaaagttcagargactagtctccattgcaggtgact

SEQ ID NO: 47156 - DNA, 50 bp, homo sapien
attcattgcagaggtgattatactaycttagtgaaatatcttattccttt

SEQ ID NO: 47157 - DNA, 50 bp, homo sapien
tttaactagctctacttatcatttayaacctgttctcttatgtgctaaag

SEQ ID NO: 47158 - DNA, 50 bp, homo sapien
ccataagccagtctccattgtctaasattcccagttacaaattatgcatt

SEQ ID NO: 47159 - DNA, 50 bp, homo sapien
aaatgataagtagagctagttaaaayctctgtctaaactgtgctaaagtg

SEQ ID NO: 47160 - DNA, 50 bp, homo sapien
tcaaagcttgtttcactgtatccagycataaaacaaatttgtgacttata

SEQ ID NO: 47161 - DNA, 50 bp, homo sapien
ataatggattggtgtaaggaataacrgataaaataggagtttaaagcact

SEQ ID NO: 47162 - DNA, 50 bp, homo sapien
accataaagaatacaaccgaagacasagactcacagaacagggttgatgt

SEQ ID NO: 47163 - DNA, 50 bp, homo sapien
ttgtattctttttgggttctgctcartcacagaggaagttgtaataaaag

SEQ ID NO: 47164 - DNA, 50 bp, homo sapien
agcaggaggagcaattcaagaagacrcagtggtgaaggcccagtaagaca

SEQ ID NO: 47165 - DNA, 50 bp, homo sapien
tgttcttctaagcatttgactcccasgagagttggaaaggtgtgtatgta

SEQ ID NO: 47166 - DNA, 50 bp, homo sapien
tacatgaattctgaaaaacatatccraaaaaagtaacaagactctcaata

SEQ ID NO: 47167 - DNA, 50 bp, homo sapien
gtaacagcataatattcaataaaaaraaggtcatgataacatttcttgtt

SEQ ID NO: 47168 - DNA, 50 bp, homo sapien
caagcagtcaaagaagagatgctaastgactgttcaagagcacaattttt

SEQ ID NO: 47169 - DNA, 50 bp, homo sapien
ttaagtacttacaaggtctcggctcyatgccaaccactgttctatatcaa

SEQ ID NO: 47170 - DNA, 50 bp, homo sapien
aggaggggaaagagccaaaaaaacaygtgagtcaactgtgggtactgatg

SEQ ID NO: 47171 - DNA, 50 bp, homo sapien
gaatttggctttctccttcacgtaawcattgcacacataccagctctcct

SEQ ID NO: 47172 - DNA, 50 bp, homo sapien
gaaaagccccagtaattctaatgcgsaacaaagtttgaggggtcttgtta

SEQ ID NO: 47173 - DNA, 50 bp, homo sapien
gaacagcacaataggtgaataataargagacaaaaggaaatctctgccct

SEQ ID NO: 47174 - DNA, 50 bp, homo sapien
ttttaaagaaatagctcaaattagartaaagcagaaggtctattcctcta

SEQ ID NO: 47175 - DNA, 50 bp, homo sapien
taaagctttattgtctctgtaagaamaattaatatcaggtagattcagca

SEQ ID NO: 47176 - DNA, 50 bp, homo sapien
ctagggaatgatagataaaaactccratacagcacatttctgcctgtctt

SEQ ID NO: 47177 - DNA, 50 bp, homo sapien
aactttaaaacattttatggaaggamatacaatatcttaagaatctgcta

SEQ ID NO: 47178 - DNA, 50 bp, homo sapien
tagtatacaaaataaattatcactaytactgtttttctagatgaaaaagt

SEQ ID NO: 47179 - DNA, 50 bp, homo sapien
tcataaccaagcagacagtatacaayttccataccgagaatcaggttcct

SEQ ID NO: 47180 - DNA, 50 bp, homo sapien
aaagtttagcaaagaattgtaacaasttatttgtgtgccaagtaattgta

SEQ ID NO: 47181 - DNA, 50 bp, homo sapien
agccatttgtgacagactttttagcrgattcaaaataattttttctagat

SEQ ID NO: 47182 - DNA, 50 bp, homo sapien
taaaatcactacctagggaagaatgscaacctgcacatgcagcagattac

SEQ ID NO: 47183 - DNA, 50 bp, homo sapien
gtgttgtagttatataaaatatccartagatggtactgtaaaatgcctca

SEQ ID NO: 47184 - DNA, 50 bp, homo sapien
tggggacagaaggtggcattttacasaatatagaggatgagaagaataag

SEQ ID NO: 47185 - DNA, 50 bp, homo sapien
aaattctaaaaaaattttaggttaasaataaagcaaacctttgtgagaca

SEQ ID NO: 47186 - DNA, 50 bp, homo sapien
agtcttgtactgagaagaaataagaygtattaccttttgcttcaagggtc

SEQ ID NO: 47187 - DNA, 50 bp, homo sapien
ccagggctttaccttctgtaagttaycaaaatccacttggcagggtctag

SEQ ID NO: 47188 - DNA, 50 bp, homo sapien
tatttttgggttaagagggtggacaytgtagcttgtctcaatagtagctg

SEQ ID NO: 47189 - DNA, 50 bp, homo sapien
tctagtttgaaatattttatataaaraagctaaattggattaaaaaatgt

SEQ ID NO: 47190 - DNA, 50 bp, homo sapien
tgaatccgtctataaagcattctctwaagagttctagaagccttcctggg

SEQ ID NO: 47191 - DNA, 50 bp, homo sapien
cctagttctaaatcaattggatcackgataatttccacacaagattctta

SEQ ID NO: 47192 - DNA, 50 bp, homo sapien
ttgacacagggaaagaagatggtaartgctcatggtattgaatatgaaat

SEQ ID NO: 47193 - DNA, 50 bp, homo sapien
atccttactcaaagtacatctttaaytcatatactgcaacagtgctgcaa

SEQ ID NO: 47194 - DNA, 50 bp, homo sapien
gtgtatctagtaaatccaaagactarcctaagtaattcattaacaaagta

SEQ ID NO: 47195 - DNA, 50 bp, homo sapien
actgagttgaggaaatatatagtcaytaagtccttctgttaaattgcaat

SEQ ID NO: 47196 - DNA, 50 bp, homo sapien
ggaaaaccgtatccgtattttaaagratgttccatgttaccgtttcatct

SEQ ID NO: 47197 - DNA, 50 bp, homo sapien
attttcttacttgctgtactgtgtawcactctatttgtccatcatgttta

SEQ ID NO: 47198 - DNA, 50 bp, homo sapien
tctctagttaacatctatatgaaccragaaaagacactctactaatacat

SEQ ID NO: 47199 - DNA, 50 bp, homo sapien
aggactagagcactagagaagccaamattctggtagatgaaagagtcaac

SEQ ID NO: 47200 - DNA, 50 bp, homo sapien
gaatgaaattgagtaattcatttaaygtgaatcagatacatttctaatgc

SEQ ID NO: 47201 - DNA, 50 bp, homo sapien
gtgcaccagctgcggctcaaatggamccaggtatagctcaggccaccact

SEQ ID NO: 47202 - DNA, 50 bp, homo sapien
aatgcctcatgacgtaaatgactcamtcaaaatcacttcacccagcaaag

SEQ ID NO: 47203 - DNA, 50 bp, homo sapien
ctgtgaagacaagtgaaagtaaacaytgaaaatagacaggaagggaaagg

SEQ ID NO: 47204 - DNA, 50 bp, homo sapien
gactctaagaatcttatttatacttsaaggaaactttcattgtctctcct

SEQ ID NO: 47205 - DNA, 50 bp, homo sapien
taaagagggcgagattaatctaaagycgttttctaaatgctaaatacaat

SEQ ID NO: 47206 - DNA, 50 bp, homo sapien
tgatatatggctgctgtgaatgtaastgaactataaccaagagaaaagaa

SEQ ID NO: 47207 - DNA, 50 bp, homo sapien
atgattatgataaaatggcgataagkacctttcccttaaagggttgtcat

SEQ ID NO: 47208 - DNA, 50 bp, homo sapien
tcttgatttttaaaaaggatacaaaraatagcaacacctgatgatgtttt

SEQ ID NO: 47209 - DNA, 50 bp, homo sapien
attgagactatcatgatagctaaaaygacttattgacacagaattgacaa

SEQ ID NO: 47210 - DNA, 50 bp, homo sapien
ttctgtaagcagaactagtggaagakcaacatagtgtgtagagacatggt

SEQ ID NO: 47211 - DNA, 50 bp, homo sapien
catctgtttactaagagcctaaatgyatgctactgaagattttgaagaaa

SEQ ID NO: 47212 - DNA, 50 bp, homo sapien
aactgaaagaaagatgaacttaagartaaatttcggaagaaatcaccaga

SEQ ID NO: 47213 - DNA, 50 bp, homo sapien
ttttgaagatgtacgctatgctaaamttgcagaactgggagaggggaaag

SEQ ID NO: 47214 - DNA, 50 bp, homo sapien
tgtgtgcatagctctgccaacgtatsaacaaaatttcaaaatctaagtat

SEQ ID NO: 47215 - DNA, 50 bp, homo sapien
ggatcagcttttaaaaattaagtatragacattcaatgtattttgttctc

SEQ ID NO: 47216 - DNA, 50 bp, homo sapien
caaggccaagtttcaagtgtaaaaamgcaaaaatgttgcttcatctggga

SEQ ID NO: 47217 - DNA, 50 bp, homo sapien
gcctctggcagctgtgctcttttctsaaattctcacaagtaaaaagcaaa

SEQ ID NO: 47218 - DNA, 50 bp, homo sapien
aagcaaacccagaaatcaccatctaygtacttcctgcagctctcacattt

SEQ ID NO: 47219 - DNA, 50 bp, homo sapien
tggattatttctgcctgtagttatgragtctctaaaaaataattatgttg

SEQ ID NO: 47220 - DNA, 50 bp, homo sapien
aaacgaaaacatattacaaagcacasggaaaagtggactcctgcaaatga

SEQ ID NO: 47221 - DNA, 50 bp, homo sapien
ctcattaatagagctattactgccaycagtgaataatgttgatgataggc

SEQ ID NO: 47222 - DNA, 50 bp, homo sapien
tacgtgcccacgaagctagcccttawagatgcctttgcgtggttcctgag

SEQ ID NO: 47223 - DNA, 50 bp, homo sapien
tctgtgcacatggtaattagagtacmggacatcagcttgctagactcgat

SEQ ID NO: 47224 - DNA, 50 bp, homo sapien
tatagacaaagatggttctcaaatcmgagccacagtgctcccatcttgtt

SEQ ID NO: 47225 - DNA, 50 bp, homo sapien
ttgtagtattataagatgattctacrgagaataaaaaataacttatactc

SEQ ID NO: 47226 - DNA, 50 bp, homo sapien
tgagtttgctacgttttatttctcaycaacaccagttccatatcagatgc

SEQ ID NO: 47227 - DNA, 50 bp, homo sapien
ggtccccaatctcattccttttcacyggacaggacctcccaactggggtg

SEQ ID NO: 47228 - DNA, 50 bp, homo sapien
gtttaatatgttgaataaggaaatgycattcatgcttttagtttatatca

SEQ ID NO: 47229 - DNA, 50 bp, homo sapien
taaattgtatggaggtgttcagctaratttagattttaaaattcggacac

SEQ ID NO: 47230 - DNA, 50 bp, homo sapien
aacacagaatttttcgttactgtacyagaaattgggaagaaaaagtgtca

SEQ ID NO: 47231 - DNA, 50 bp, homo sapien
actgcaactagataccttcagaacamtaatgatcaaatcttatccctgca

SEQ ID NO: 47232 - DNA, 50 bp, homo sapien
ttaaattataaaaatattgatttaaygaatattgagagagtacagatgat

SEQ ID NO: 47233 - DNA, 50 bp, homo sapien
tatgtttgtgtaatgttaaggatgaygaagcaaatatttaacagctagga

SEQ ID NO: 47234 - DNA, 50 bp, homo sapien
tttcttaaattaagaaatatccatawattgagattagctgtaactaactc

SEQ ID NO: 47235 - DNA, 50 bp, homo sapien
tcttttgatcgaaactcagcttatartaactttaatcacataatatttaa

SEQ ID NO: 47236 - DNA, 50 bp, homo sapien
acaagttgcactccacgatgacaaayatagaggaacaaagtccacagagg

SEQ ID NO: 47237 - DNA, 50 bp, homo sapien
cgcataattgatatagaataaataartaacagtaggagctcaataactaa

SEQ ID NO: 47238 - DNA, 50 bp, homo sapien
ttatgtgtaaaacgaggaggctgtascaaaccatttctagggcacctaca

SEQ ID NO: 47239 - DNA, 50 bp, homo sapien
ctagaccacagttctcttagaggcaktgagtcccagagagcaagaagagc

SEQ ID NO: 47240 - DNA, 50 bp, homo sapien
acttgtgggttctgtgtcagtggaaygtttcagtactttttggcctggct

SEQ ID NO: 47241 - DNA, 50 bp, homo sapien
ttctattttagtattcctgtgaccaygaattatcagatatcagatagtta

SEQ ID NO: 47242 - DNA, 50 bp, homo sapien
cattttcattctagagaagattcccrcacaagattgttttatacttaaat

SEQ ID NO: 47243 - DNA, 50 bp, homo sapien
gttaaaacagtgcgtggatgaaataygctagataatcttttttttttttt

SEQ ID NO: 47244 - DNA, 50 bp, homo sapien
gaaataaagattgagctctacaaaaytgccgccaaaaatggctgagaatt

SEQ ID NO: 47245 - DNA, 50 bp, homo sapien
tattaacatacgcaattgatctataycacagtgtaagggctatgccacat

SEQ ID NO: 47246 - DNA, 50 bp, homo sapien
aataccattattgtatgtatcaatcygaaagacacataaacacatggtgc

SEQ ID NO: 47247 - DNA, 50 bp, homo sapien
taagaaaaaattaacttcacattaayagatagaatacatgtcacaatgtt

SEQ ID NO: 47248 - DNA, 50 bp, homo sapien
acacatacttttggtctctctccaartggtgctattcgtgctgctggtaa

SEQ ID NO: 47249 - DNA, 50 bp, homo sapien
attcggagtggaggagaacaagagayggcagaattagatagaatacaagg

SEQ ID NO: 47250 - DNA, 50 bp, homo sapien
catggtcacccaagacagtcaagagragaatgtaaaaatctctgtaaggc

SEQ ID NO: 47251 - DNA, 50 bp, homo sapien
tccattaaaattcccaattcacaaargacttagttctgtaacaaaaatag

SEQ ID NO: 47252 - DNA, 50 bp, homo sapien
ctgaacatggaatcagtgcctatgargttgtcattttcaagggcagtcct

SEQ ID NO: 47253 - DNA, 50 bp, homo sapien
acctgaatgattgaatctattaatamagctagacctatcttaccctagct

SEQ ID NO: 47254 - DNA, 50 bp, homo sapien
tttgttcctttattaacttcatacayagagtgctattttatgataagagt

SEQ ID NO: 47255 - DNA, 50 bp, homo sapien
aagaattttatgtagacatattaacrccaagcatttattagttttcaata

SEQ ID NO: 47256 - DNA, 50 bp, homo sapien
aaccacatgggctgaattggatgtasaagtggagccctgagaaatctatg

SEQ ID NO: 47257 - DNA, 50 bp, homo sapien
gctcatagcactgtgtaaataagacraggaacatgcacaagacagggagc

SEQ ID NO: 47258 - DNA, 50 bp, homo sapien
gagggaagagtgaaatatatagaaaytaaagtggtatgatacccagattt

SEQ ID NO: 47259 - DNA, 50 bp, homo sapien
tttttgattaagaaggatgaagttayaaaagttaggctgctagttctgtg

SEQ ID NO: 47260 - DNA, 50 bp, homo sapien
gaaccactgctgtagtgcagttaacraacattgaggatatctagtctaca

SEQ ID NO: 47261 - DNA, 50 bp, homo sapien
tgcttcattgtccccttctccaaaamtcttaacagcttccccaagcatct

SEQ ID NO: 47262 - DNA, 50 bp, homo sapien
cacattaaagttacttaattaaagcygactgagttgcctgagagtggctt

SEQ ID NO: 47263 - DNA, 50 bp, homo sapien
gagaggttagcattcttgtcccattkaaagatagtttaagtgccaaacta

SEQ ID NO: 47264 - DNA, 50 bp, homo sapien
aggaacaaactttgttttcagatatyactattctaataatgactaaactg

SEQ ID NO: 47265 - DNA, 50 bp, homo sapien
cccttaataatatctcgggcaggtaycgtaatctcctggtccccctttct

SEQ ID NO: 47266 - DNA, 50 bp, homo sapien
taatttcagtcatgcaaagaccagamtattaagccatcagaaaaaataat

SEQ ID NO: 47267 - DNA, 50 bp, homo sapien
gattacatttatcatcaatatgaaaygtaatgcaattctcatcctaaata

SEQ ID NO: 47268 - DNA, 50 bp, homo sapien
tcaccaataccatacctcaagatgakaagatgaagcattgctccaaaata

SEQ ID NO: 47269 - DNA, 50 bp, homo sapien
aatgcatccactcagactcacattamgtcaactctagaaatgttggaaac

SEQ ID NO: 47270 - DNA, 50 bp, homo sapien
gtagatctattagttaacataagaarggatctgaaggtgaagtgcttcca

SEQ ID NO: 47271 - DNA, 50 bp, homo sapien
aatgtttatttctgtactctcaaacrataatgtcaaacatctggaggttt

SEQ ID NO: 47272 - DNA, 50 bp, homo sapien
ttgtaaggtatagaggtaagtgaaartaatattaaaattccaggcaggga

SEQ ID NO: 47273 - DNA, 50 bp, homo sapien
aactcaagctaatatccatacctaawatatctcattcccccactttacta

SEQ ID NO: 47274 - DNA, 50 bp, homo sapien
agactcaggttatacagaaagcataygtgattcagagtattgagagtaaa

SEQ ID NO: 47275 - DNA, 50 bp, homo sapien
tttaacttaagtatcctttggaagawaattttataaacaaaccaaaagta

SEQ ID NO: 47276 - DNA, 50 bp, homo sapien
aaaattcatctgtatcaccctgaggyatgcttatcaccctggctgtttat

SEQ ID NO: 47277 - DNA, 50 bp, homo sapien
gttccctcagacttttgctaggttcrcttaatacctgagcttgacaatgc

SEQ ID NO: 47278 - DNA, 50 bp, homo sapien
cacagcctatggtatcttggaagtayaatttttccatctctgtttataag

SEQ ID NO: 47279 - DNA, 50 bp, homo sapien
aatttttacctagatgttcattggasaaattaactacattattataaaat

SEQ ID NO: 47280 - DNA, 50 bp, homo sapien
tcctggctacctttctgacggtataygtatgttcaatacacatctcgtct

SEQ ID NO: 47281 - DNA, 50 bp, homo sapien
aagtccaaccatctatccctgaaaaygtgcataaaagataatgggaagct

SEQ ID NO: 47282 - DNA, 50 bp, homo sapien
gactggaactcaatgagcgatgagamgagatgtgtattgaacatacatat

SEQ ID NO: 47283 - DNA, 50 bp, homo sapien
aaaatagtgttacctgaatagtacartcttatctttgacttgctttgctt

SEQ ID NO: 47284 - DNA, 50 bp, homo sapien
tatgctcatagagaagccatctatasagtaaggcaagactaaccagaact

SEQ ID NO: 47285 - DNA, 50 bp, homo sapien
ccagaattccaagttgctcttaatcwctctgtagttctgcctccaaatag

SEQ ID NO: 47286 - DNA, 50 bp, homo sapien
tagttgttttgacttctacaaagatraaatcctgaaaatacaagcacacc

SEQ ID NO: 47287 - DNA, 50 bp, homo sapien
aaattgttttactggccaatgaaacragaatttctgcccagagggttaaa

SEQ ID NO: 47288 - DNA, 50 bp, homo sapien
agcacaatcattacgtgaaatatatyaatttttcttgaggtcaaacagct

SEQ ID NO: 47289 - DNA, 50 bp, homo sapien
ttgccttagtcttgggacaaacttaygtaggtcttccttctagtaaaaca

SEQ ID NO: 47290 - DNA, 50 bp, homo sapien
caatttctggatttaaaaatctaaargtattcataagagtatcttttcca

SEQ ID NO: 47291 - DNA, 50 bp, homo sapien
gtgtggtactttgaactatggcatayaaaaacaagtgtcaatgccagaag

SEQ ID NO: 47292 - DNA, 50 bp, homo sapien
gaataaaaaaatcagactaatatgarctaatgtctaaggaaaagattatc

SEQ ID NO: 47293 - DNA, 50 bp, homo sapien
tgtttctggtataatgtgctttggasactagtttttatttaatttctctt

SEQ ID NO: 47294 - DNA, 50 bp, homo sapien
gggaacctcacagatgtttctattaygaattctaaaaactatgtggttat

SEQ ID NO: 47295 - DNA, 50 bp, homo sapien
gcagaacccgctttagtttctcaacrctgaacttgcaattgaactcccat

SEQ ID NO: 47296 - DNA, 50 bp, homo sapien
tttcaaataagttgctggactgttayggaaagatgctcaagggatattga

SEQ ID NO: 47297 - DNA, 50 bp, homo sapien
agctatgatttctgaagttttattayggtacttgtttattaaccatgata

SEQ ID NO: 47298 - DNA, 50 bp, homo sapien
acaatgcagtttgaaaagaatctaaygttaaagataatgataatgtagtt

SEQ ID NO: 47299 - DNA, 50 bp, homo sapien
ctccagaaggtgcagcaaattgtgtraaccatgtctccactacacgccta

SEQ ID NO: 47300 - DNA, 50 bp, homo sapien
ccatagagttagaacctaagaggaartctattgtgacatatattacttgt

SEQ ID NO: 47301 - DNA, 50 bp, homo sapien
gtagagcttaacggtgttttaagaaycatatcactttattctatttctta

SEQ ID NO: 47302 - DNA, 50 bp, homo sapien
tcagatgttaccaccatttccaaaasttattttagaagcaactattctag

SEQ ID NO: 47303 - DNA, 50 bp, homo sapien
gtgtacaccaaaaaaactcttgctarctaaatacaaaacaaataaatgag

SEQ ID NO: 47304 - DNA, 50 bp, homo sapien
gttttatatttacagaaaaatcgagsagatattgttgagttcccatattg

SEQ ID NO: 47305 - DNA, 50 bp, homo sapien
ccctgcagctcctgaaagggtcagastaagaaacccaaggacccagagaa

SEQ ID NO: 47306 - DNA, 50 bp, homo sapien
tcacttattcaaaggtacattgaaarctctcgtatgctgttgtctttgct

SEQ ID NO: 47307 - DNA, 50 bp, homo sapien
acgcatgtggttaatctgccattaaratcgtgggcattattttgcttaat

SEQ ID NO: 47308 - DNA, 50 bp, homo sapien
attcaaaattgttttgctaatctaamatttttctccacatagccctcttt

SEQ ID NO: 47309 - DNA, 50 bp, homo sapien
tatttgccacatgctgggtactacaytgaattcacacgaatgaaatgatg

SEQ ID NO: 47310 - DNA, 50 bp, homo sapien
aaaatattcagaaaagaaatattccrcagatttccaaaagaactaaactt

SEQ ID NO: 47311 - DNA, 50 bp, homo sapien
tttaataaaagagatgctcaatttayggtaattatgattatttcacctct

SEQ ID NO: 47312 - DNA, 50 bp, homo sapien
gattatgcaggaaggattattggacyaaaacttgacaaaggggtcctagt

SEQ ID NO: 47313 - DNA, 50 bp, homo sapien
gctatggccagaagatgcctgagcargtctatattcagctagaggtaagt

SEQ ID NO: 47314 - DNA, 50 bp, homo sapien
ctttttccacctggatagtagagtarcaataatagttaaatttcagattt

SEQ ID NO: 47315 - DNA, 50 bp, homo sapien
atttccagaaaaatgtaacaaaccarctgcttaacaaatcaagccctgct

SEQ ID NO: 47316 - DNA, 50 bp, homo sapien
aagacaagagacagacagcaatctamgtgactcagtaagtaaataggagg

SEQ ID NO: 47317 - DNA, 50 bp, homo sapien
aattattttcttcttgaaatactcaragtaggttttgtgacaaaatttgt

SEQ ID NO: 47318 - DNA, 50 bp, homo sapien
ttctctatcactgatgccaaggacayggtcttttctttatagaggatggc

SEQ ID NO: 47319 - DNA, 50 bp, homo sapien
tgatgttttctaaggaaacattttayaagggtgattgtggattcccgtgc

SEQ ID NO: 47320 - DNA, 50 bp, homo sapien
tttgtgctgagtgaattaagggaagmattatgtagatatgtggggaaaga

SEQ ID NO: 47321 - DNA, 50 bp, homo sapien
attctattttctgataatataaatcygatcttgccgatgtatattaaaca

SEQ ID NO: 47322 - DNA, 50 bp, homo sapien
acaagaggcaactccgtggaagcaayggacatttcttgagagtaagaatg

SEQ ID NO: 47323 - DNA, 50 bp, homo sapien
cttatcagaagccacatgttctataktactcatagctcttagttgaaggg

SEQ ID NO: 47324 - DNA, 50 bp, homo sapien
actgcattaacaagatgatggcttaygttcataataataatctggaagca

SEQ ID NO: 47325 - DNA, 50 bp, homo sapien
cacgataaacctatctaaacagttayagaatatcacaagagtgtgcattc

SEQ ID NO: 47326 - DNA, 50 bp, homo sapien
ggttttctattgtgtgtaaaaactaraagtgtccagtagctgttggcatg

SEQ ID NO: 47327 - DNA, 50 bp, homo sapien
gccaactcaatactgttcctccaaaratgtaaatataaatctagcaaagg

SEQ ID NO: 47328 - DNA, 50 bp, homo sapien
cctatgtttagaaagagagtaaaaawgttagatgaattcaacacttaatt

SEQ ID NO: 47329 - DNA, 50 bp, homo sapien
aataccttaaaggaatacctgtttaygaaaattagtctcatagatgatgg

SEQ ID NO: 47330 - DNA, 50 bp, homo sapien
taaactcattttgttgttaagaaaastacctttagctaagttacagataa

SEQ ID NO: 47331 - DNA, 50 bp, homo sapien
tagatagatcttagtattccaataarctggcacagtatccaccacatagt

SEQ ID NO: 47332 - DNA, 50 bp, homo sapien
acggtgaagcaagggactaacattcmcaacaatcccaggtaaaacacgaa

SEQ ID NO: 47333 - DNA, 50 bp, homo sapien
agttgtaatgaacgattgatgattasaatattttaattgaaatcatgcca

SEQ ID NO: 47334 - DNA, 50 bp, homo sapien
agatctagatataattgcaagtttayatactccaattctatcgttttaag

SEQ ID NO: 47335 - DNA, 50 bp, homo sapien
atttttgagtgattaaattgaattayagagaatcatgaaagtcttcaatg

SEQ ID NO: 47336 - DNA, 50 bp, homo sapien
agaagcttatatactatggaattctwaatctttaacaaacacatttagag

SEQ ID NO: 47337 - DNA, 50 bp, homo sapien
tatataagttggatattgggcttcamtcacaagtagaccatggcttaaga

SEQ ID NO: 47338 - DNA, 50 bp, homo sapien
caagagctgcacctcaaatagataawcaggctagataaaatagaaaaggt

SEQ ID NO: 47339 - DNA, 50 bp, homo sapien
ggtgaatatgtggaaagtgacaatayacaaggttatccactattggaagg

SEQ ID NO: 47340 - DNA, 50 bp, homo sapien
aatttaaaatatttccactttcttcycagtgaccaattaaaatataaatg

SEQ ID NO: 47341 - DNA, 50 bp, homo sapien
aaacaggttgtgatttgaacaaaacrctagaggccaaagtgaacagtttt

SEQ ID NO: 47342 - DNA, 50 bp, homo sapien
atgctgaggataaaatagcagatgaratatttgatcatgtatcttgcttt

SEQ ID NO: 47343 - DNA, 50 bp, homo sapien
atacttcttacacttcttatttgcaytaaggaattctgattggaaacata

SEQ ID NO: 47344 - DNA, 50 bp, homo sapien
ctttcctgtacccttcagtgcaaaaracgtgttctgggttgtacttttca

SEQ ID NO: 47345 - DNA, 50 bp, homo sapien
aaatcaacttttttaagtttaaaaawtactgcagaggaacaaaacactgt

SEQ ID NO: 47346 - DNA, 50 bp, homo sapien
atctagctctcatctttgcaccacasaatttagcataatacttggcacat

SEQ ID NO: 47347 - DNA, 50 bp, homo sapien
cttcatggtgcctatgtccaatgggkagtccaaatattaaacatgaagtg

SEQ ID NO: 47348 - DNA, 50 bp, homo sapien
agccttcagccttcctgcccaattayggcatcaggtatgtacgttttccc

SEQ ID NO: 47349 - DNA, 50 bp, homo sapien
catccataggtgtagaatgatttgaygcttaaagtaactaaaacactttg

SEQ ID NO: 47350 - DNA, 50 bp, homo sapien
ataaagagtgcggttagactcgtcamaattatctgtgtttaattaaaagc

SEQ ID NO: 47351 - DNA, 50 bp, homo sapien
acttttacagaccaatcctctaagaycatttattgcattttagcctcctc

SEQ ID NO: 47352 - DNA, 50 bp, homo sapien
cagaagacaataaggtcatttgatasaggtgaaagtactagtgacacaaa

SEQ ID NO: 47353 - DNA, 50 bp, homo sapien
cacaacatcctatctgtagcccataygtcagagaatcatttgattttcaa

SEQ ID NO: 47354 - DNA, 50 bp, homo sapien
ttacactaatccaactttacctaaaygtttatgcatctaggcaaattttg

SEQ ID NO: 47355 - DNA, 50 bp, homo sapien
aaatcaagaaagaccagttttaggaytatacttttcactgtgttcccaca

SEQ ID NO: 47356 - DNA, 50 bp, homo sapien
aagcagtctggtgtatgagaaagagsctccaaagtcagacaggcccaggt

SEQ ID NO: 47357 - DNA, 50 bp, homo sapien
ctttaattaaagcacatattacacakaaaatagtctgttgacagatgtac

SEQ ID NO: 47358 - DNA, 50 bp, homo sapien
tcccaaggggacataagggcaagcasacaagaactgaggcaggaccaggc

SEQ ID NO: 47359 - DNA, 50 bp, homo sapien
caaggatatataaactcaaggaaaakttcaataagagaaaaacagagcta

SEQ ID NO: 47360 - DNA, 50 bp, homo sapien
cattaagaatgacgaattttagaacrgtcctttcaacttgaaaaataaag

SEQ ID NO: 47361 - DNA, 50 bp, homo sapien
catcaagatgtaagagctcttagccrcgttaatcatttggtcttttcttc

SEQ ID NO: 47362 - DNA, 50 bp, homo sapien
taagcagcttgacccaatttatgccrccaaaaatatttaagaacagagct

SEQ ID NO: 47363 - DNA, 50 bp, homo sapien
ataaagatcccaaacctgtattttaygatgaacagtgtctcagttgagta

SEQ ID NO: 47364 - DNA, 50 bp, homo sapien
ccaagaaataaaccagttttcaaaakatgagttgcattgaagtacagaaa

SEQ ID NO: 47365 - DNA, 50 bp, homo sapien
aggaacaggaaaatccagagcaatayagtaaatggaatctttttgataaa

SEQ ID NO: 47366 - DNA, 50 bp, homo sapien
cagaaaaaattctgactacgggagakaatttttcagacaaactaagatga

SEQ ID NO: 47367 - DNA, 50 bp, homo sapien
tgaactcagtgaattgtttagtttayagattcttgatatttgttctttcc

SEQ ID NO: 47368 - DNA, 50 bp, homo sapien
tactcttattatgcactgtattctaygtccgactaattccctttggttgc

SEQ ID NO: 47369 - DNA, 50 bp, homo sapien
aagtagagtggtattaaaaagataarctatggcaattatacttctcaatt

SEQ ID NO: 47370 - DNA, 50 bp, homo sapien
tgttgaatatcttgatttatttcacmaaggtatatgaattgatgctacga

SEQ ID NO: 47371 - DNA, 50 bp, homo sapien
tcattatttcaattaggaataattaygtgttgacttcaaaaaccgaggcc

SEQ ID NO: 47372 - DNA, 50 bp, homo sapien
gctcctttttagtgaacaaccgaccraaaggataattctgtaataatttc

SEQ ID NO: 47373 - DNA, 50 bp, homo sapien
gaatggctaactagaacaaccaatgmagttttcttaactgtgctggttaa

SEQ ID NO: 47374 - DNA, 50 bp, homo sapien
aaaaaatgcatgaaatattattaaartcagggaattccttctaaattgca

SEQ ID NO: 47375 - DNA, 50 bp, homo sapien
ggaaaagatatagtcatgtgaattayaactgatgtatcagatttatagac

SEQ ID NO: 47376 - DNA, 50 bp, homo sapien
tctgaggcaacataatctttttacakaatttgcagcatgaaactaaattc

SEQ ID NO: 47377 - DNA, 50 bp, homo sapien
cattatcaaggcttttcctcaattaycaggatcagggtttgtcaacctca

SEQ ID NO: 47378 - DNA, 50 bp, homo sapien
aatttgcttgagcgagctcaaaacamgaatagcagaaagtccaaaaattg

SEQ ID NO: 47379 - DNA, 50 bp, homo sapien
acactttgaaatgataagatgctaamgaacgtcaccctgagctgcagtgt

SEQ ID NO: 47380 - DNA, 50 bp, homo sapien
gaaaagaacccaggtaaccttgctayaaatctagggccattttactaaag

SEQ ID NO: 47381 - DNA, 50 bp, homo sapien
tagcaccaaatgtattaaggaccaarcaaaagatttatggccattgacat

SEQ ID NO: 47382 - DNA, 50 bp, homo sapien
ctggcttttattttttttggtctatyactcgttctcccataattagcact

SEQ ID NO: 47383 - DNA, 50 bp, homo sapien
aaaggggctttaaaccatatgtagcraagtattaatatgtgtttaggtat

SEQ ID NO: 47384 - DNA, 50 bp, homo sapien
ctcatatagaaaagctagtacattcratatttcactgcaaacagagactg

SEQ ID NO: 47385 - DNA, 50 bp, homo sapien
acaatttctcgaaatcctggggttawaccagtctgtaggtaccaaatttt

SEQ ID NO: 47386 - DNA, 50 bp, homo sapien
caatatttagtaggaattgttttaaytgaaagcaaaattgcatgtagaaa

SEQ ID NO: 47387 - DNA, 50 bp, homo sapien
agtgttttcattaatagagggttgcycatggtgcattatctgcttgcaag

SEQ ID NO: 47388 - DNA, 50 bp, homo sapien
ctaagatcctggagctactaaaccargagtctagatttaaaccaagatgt

SEQ ID NO: 47389 - DNA, 50 bp, homo sapien
agaaagaataaatgtaatagtgttaygaacgtttgttaactcaggtagca

SEQ ID NO: 47390 - DNA, 50 bp, homo sapien
ggaagagaaggatgggaagaaattasggacaataaaccattagcatctgt

SEQ ID NO: 47391 - DNA, 50 bp, homo sapien
atgtgaaccatccctttttccagcayatccttgaacatatactaaccacc

SEQ ID NO: 47392 - DNA, 50 bp, homo sapien
gcccacacctttctcctgggccttawctcaaatccttaactgtttgaaat

SEQ ID NO: 47393 - DNA, 50 bp, homo sapien
aaggagaaatattcaagtataaggasaaagctgataagaaacccaagaat

SEQ ID NO: 47394 - DNA, 50 bp, homo sapien
acaccttaggggctgttggttaatayctggaatacaccaataagggctac

SEQ ID NO: 47395 - DNA, 50 bp, homo sapien
catttctcagctttgaaggcaaggargttctagaccaagattcccctctg

SEQ ID NO: 47396 - DNA, 50 bp, homo sapien
taagataaaatgttttcagcaagtaycttaattatattccctactggctc

SEQ ID NO: 47397 - DNA, 50 bp, homo sapien
tattttatgaaatatgatctgttgaygtttaaatgtaaattttattttcc

SEQ ID NO: 47398 - DNA, 50 bp, homo sapien
aattagaccacaggagagtattagasataggacaactgctgacttgtaaa

SEQ ID NO: 47399 - DNA, 50 bp, homo sapien
ctctgtgaatatactaacgaccactraattgtatgctttaaatggttgaa

SEQ ID NO: 47400 - DNA, 50 bp, homo sapien
ttaaattccaagtgttatttatgaargaagaaactattttatgaaatatg

SEQ ID NO: 47401 - DNA, 50 bp, homo sapien
tccacagcagaatttccaattcgaamctctttgttggcacgtggacctca

SEQ ID NO: 47402 - DNA, 50 bp, homo sapien
taaaaattttcttgtgagcatgccaktacacaggtagttctagggccttt

SEQ ID NO: 47403 - DNA, 50 bp, homo sapien
aggatctgagacatacctacctctcracaaagacaataacatcatatcta

SEQ ID NO: 47404 - DNA, 50 bp, homo sapien
ataatggaaaattcaaaatgttcgaygtaaatcaaataattagtaagaaa

SEQ ID NO: 47405 - DNA, 50 bp, homo sapien
gggattaatgaaaataaaggttagcycttcctgatctctgtgggggccat

SEQ ID NO: 47406 - DNA, 50 bp, homo sapien
ttggcctgaggtctcaaagctggtaraaattagtatgggacaggattgaa

SEQ ID NO: 47407 - DNA, 50 bp, homo sapien
acaaactcttacctttttctcctggragtctaaactggcacttttaaaaa

SEQ ID NO: 47408 - DNA, 50 bp, homo sapien
cctaattgggagtcatggaattgagsatgttctctgatgttctcacagtt

SEQ ID NO: 47409 - DNA, 50 bp, homo sapien
tcaaagaaacaggtggagtcaaataygtcagattccttcagctgccactc

SEQ ID NO: 47410 - DNA, 50 bp, homo sapien
gcagatactgttcttggtatgctgcraatagtaactcaaaacttctccaa

SEQ ID NO: 47411 - DNA, 50 bp, homo sapien
gtaaaaagtgaaaacattgttagaasaggatttttaaatattagagctgg

SEQ ID NO: 47412 - DNA, 50 bp, homo sapien
taagctcacactacataggaaaaggwccatcagcataaatatgaagttat

SEQ ID NO: 47413 - DNA, 50 bp, homo sapien
gatctaggatgtcctagattaatgcrctggagaacttgataaaggcactg

SEQ ID NO: 47414 - DNA, 50 bp, homo sapien
gaagtttaagacaggattgctttaartgcacaattttgttagaatttttc

SEQ ID NO: 47415 - DNA, 50 bp, homo sapien
tttttttttttttttggatgattaartaacactccttgagttctaatacc

SEQ ID NO: 47416 - DNA, 50 bp, homo sapien
tctggttttatcattcatatctaccrcatactgttcatcagctggtgcct

SEQ ID NO: 47417 - DNA, 50 bp, homo sapien
ttttctttcaagcatttacaaatatwagagataatcttcctttttattta

SEQ ID NO: 47418 - DNA, 50 bp, homo sapien
ctgagaatgttcctaaaagatgcagrcctttgtattcaagacgaacaggt

SEQ ID NO: 47419 - DNA, 50 bp, homo sapien
cccttttctaagaacccaggaatgtyaaactctctataagaatgagcttg

SEQ ID NO: 47420 - DNA, 50 bp, homo sapien
gttctttgcactcttgttttagcaartgataagcattcctgctcagatgg

SEQ ID NO: 47421 - DNA, 50 bp, homo sapien
tgagaatgacctgtacagagttccaraatttcatatgagctacttccaaa

SEQ ID NO: 47422 - DNA, 50 bp, homo sapien
attgcatatagcaatggtttccagcygactctgtgaagttctaggacctg

SEQ ID NO: 47423 - DNA, 50 bp, homo sapien
tagtcatagcttcatgggcctattaygtgtaaattagaaacacattattc

SEQ ID NO: 47424 - DNA, 50 bp, homo sapien
ttaataacatttgctgtaatttaaastactaagtcaaaaggaatgagaat

SEQ ID NO: 47425 - DNA, 50 bp, homo sapien
ctcatctcttcataagtgtagagtcraggacatgtagctaaattgcataa

SEQ ID NO: 47426 - DNA, 50 bp, homo sapien
ggatattaaagtaatgaggaaattcyagttatggacaccttctgtagaga

SEQ ID NO: 47427 - DNA, 50 bp, homo sapien
gaagtccttataactcatcaaataayctgtttggaaatatagtcacaaat

SEQ ID NO: 47428 - DNA, 50 bp, homo sapien
ccaataaaaattttgactaaaatctsactaagccacttgattaaggaaaa

SEQ ID NO: 47429 - DNA, 50 bp, homo sapien
tatatccaactatgctgattaatcaytaaactatatatttctttaggagc

SEQ ID NO: 47430 - DNA, 50 bp, homo sapien
gaataactaataatggcagcatgacragttaaaatttttccatttcttct

SEQ ID NO: 47431 - DNA, 50 bp, homo sapien
cccgtttgtttaccttttggtagccrctattggactataagcttctttct

SEQ ID NO: 47432 - DNA, 50 bp, homo sapien
ttaaaaagtttataaagtcaaaaaaytacagttagctaaagttaatttat

SEQ ID NO: 47433 - DNA, 50 bp, homo sapien
atggctcttggtattcaggttaacarattagcccaattagatggataaat

SEQ ID NO: 47434 - DNA, 50 bp, homo sapien
tacattcgatttacagtttagatacycagttgcatatgttgtagttgtaa

SEQ ID NO: 47435 - DNA, 50 bp, homo sapien
cctaggaagtctgtgaatgtaataasagagatcagttcaattttcagtat

SEQ ID NO: 47436 - DNA, 50 bp, homo sapien
taaatcaaatatttaaaagtttgcasacttatttcaagcatgtgggaaag

SEQ ID NO: 47437 - DNA, 50 bp, homo sapien
gtttgcaaaaacaggtggaaggctasatttgtgctgtgggccagtttgcc

SEQ ID NO: 47438 - DNA, 50 bp, homo sapien
tttctctgaaaaactagaggcaagaytataaagggaaaaataaaacatag

SEQ ID NO: 47439 - DNA, 50 bp, homo sapien
cacaatgaccctgtgttgtatgggartattgattcaaatggatgccttgg

SEQ ID NO: 47440 - DNA, 50 bp, homo sapien
tgtttggatttgttaaactttatcartaactcaaattacaggagaccatg

SEQ ID NO: 47441 - DNA, 50 bp, homo sapien
gtctgttgcagaggcttgatgtcaayttagcaggaagcccaccttacaac

SEQ ID NO: 47442 - DNA, 50 bp, homo sapien
actgaggcttccttgtggcttagatsaaggtttttcaacagggtagagac

SEQ ID NO: 47443 - DNA, 50 bp, homo sapien
accaataaaactggtgtttccactayggtagcagatcaagctttcttaga

SEQ ID NO: 47444 - DNA, 50 bp, homo sapien
gcttaaagatgagcaaagtgggtacmagcagaagtctcttgagtacctct

SEQ ID NO: 47445 - DNA, 50 bp, homo sapien
cccaatgctgtctattctaatttaayacatctgaagagagtgccagagca

SEQ ID NO: 47446 - DNA, 50 bp, homo sapien
gggtgatgagtagtacatagtaatasgctgttgttttctatactttccca

SEQ ID NO: 47447 - DNA, 50 bp, homo sapien
tagcaaaccaatggattatgagaacwatttagatgcaaaatgttactcca

SEQ ID NO: 47448 - DNA, 50 bp, homo sapien
ttgccctcccattttctcaactaacrattactggatacatatagttcaat

SEQ ID NO: 47449 - DNA, 50 bp, homo sapien
cccatctcaaataagatgactacagrcgtaatgtttcatccagttgtccc

SEQ ID NO: 47450 - DNA, 50 bp, homo sapien
agtaagccccaaaagacgtaaatccraaactgtaaagctgcaagagagaa

SEQ ID NO: 47451 - DNA, 50 bp, homo sapien
ctttgctgtctctgtgactttagcarattattcagtctttgagccttagc

SEQ ID NO: 47452 - DNA, 50 bp, homo sapien
taaatgctgataaatgttgtcaatawcacgaataaaattcaagcccccct

SEQ ID NO: 47453 - DNA, 50 bp, homo sapien
aactgtaaattaagagaaaagtaagycctctggatttcaaatatatcttt

SEQ ID NO: 47454 - DNA, 50 bp, homo sapien
aaatatttaaaaatgcttcatgtgaygttacttaggggtaagattaagtg

SEQ ID NO: 47455 - DNA, 50 bp, homo sapien
agatgtttagttaaaacaacacgtakcttttacacaaatataggtaatgg

SEQ ID NO: 47456 - DNA, 50 bp, homo sapien
ctatgtagtatttcactagcccaatragtctgtataacattaatttttta

SEQ ID NO: 47457 - DNA, 50 bp, homo sapien
tcttcattccagagcatattttaagyaagttaagtggattctgattcctt

SEQ ID NO: 47458 - DNA, 50 bp, homo sapien
ggggttcagaaatcagaagcaacatraagatcatagagtccctcttttgt

SEQ ID NO: 47459 - DNA, 50 bp, homo sapien
tttatttctgttactaggtggattargtattcaaatactagacaaaaact

SEQ ID NO: 47460 - DNA, 50 bp, homo sapien
cacacacacacaaaaaaccatttggragcacctcaggtaggattctactt

SEQ ID NO: 47461 - DNA, 50 bp, homo sapien
ggctgggctatgttataggaaactgyaggtatgaaaaacatagtttccaa

SEQ ID NO: 47462 - DNA, 50 bp, homo sapien
aaatccaatagagaattgcaacatamggccgctgcaggaccaggtgaatc

SEQ ID NO: 47463 - DNA, 50 bp, homo sapien
catcagcttgacttgatatagtaacrcagagggaggaaatggacacccgt

SEQ ID NO: 47464 - DNA, 50 bp, homo sapien
tctaaaatacttcttcacctggaackgcaggtggccatcttgcaccttga

SEQ ID NO: 47465 - DNA, 50 bp, homo sapien
ttcagaatacagtattttgagaagastaaatttggagtaacagctgtagt

SEQ ID NO: 47466 - DNA, 50 bp, homo sapien
gtccttttttgcgcatgtcaagtatragatacctattagccatgaagtag

SEQ ID NO: 47467 - DNA, 50 bp, homo sapien
gcagacacttcaaatacagtatgaaycattagttaagtatcactagcaaa

SEQ ID NO: 47468 - DNA, 50 bp, homo sapien
tctgtagatacttgatgatttcacgmatagtttaagcattatgatttatt

SEQ ID NO: 47469 - DNA, 50 bp, homo sapien
agtccttgaaaatctcatctgggcayatggatggcaggatggggcacaaa

SEQ ID NO: 47470 - DNA, 50 bp, homo sapien
actctggattcaagtgtgaggaaagsaaatctggcttaggtaaggaaagg

SEQ ID NO: 47471 - DNA, 50 bp, homo sapien
gaaaaattagattttataggtttcawattacaagcctgaatcgccatttt

SEQ ID NO: 47472 - DNA, 50 bp, homo sapien
gattctttaataatcctttgataatyacggtctacatttgtttatttttc

SEQ ID NO: 47473 - DNA, 50 bp, homo sapien
cagcacctgcatttggatttggcagyagtcaagcagcaacatttatgtcg

SEQ ID NO: 47474 - DNA, 50 bp, homo sapien
aattttgattctgtaggtgatgggaractattggatgattttagccaggg

SEQ ID NO: 47475 - DNA, 50 bp, homo sapien
tctggttacaatagtggctgtaacayctcctaaagttattgtgagacttt

SEQ ID NO: 47476 - DNA, 50 bp, homo sapien
atgaaaaactgctagccacacaacartctggagtaagggaagtcaacata

SEQ ID NO: 47477 - DNA, 50 bp, homo sapien
taaccagacatcttattttagaataygaagaatccagtaatctcttcaag

SEQ ID NO: 47478 - DNA, 50 bp, homo sapien
aattttctttgctgtgaagattggasatcactaattcatctgcacaaaaa

SEQ ID NO: 47479 - DNA, 50 bp, homo sapien
caagattcaaaatggaccaaccgaargcatatctatttatgatatttatt

SEQ ID NO: 47480 - DNA, 50 bp, homo sapien
atggtaaagactaaatctaattaaayattctctgtatttgagatggttcc

SEQ ID NO: 47481 - DNA, 50 bp, homo sapien
acctgtcactgtacagatttcacaayggtgattaagaaactacattacaa

SEQ ID NO: 47482 - DNA, 50 bp, homo sapien
ctttgccatcaaatgaagtccacaaraagcccaaaacctgtcactgtaca

SEQ ID NO: 47483 - DNA, 50 bp, homo sapien
ggacacataggtatacatatatacayacatagaacaacttatacatccct

SEQ ID NO: 47484 - DNA, 50 bp, homo sapien
gttaggagactctgtaggactaaagsaaataaacaagagaatccattcct

SEQ ID NO: 47485 - DNA, 50 bp, homo sapien
catgagccagtcactgtcagaggaaygggctatgcgaagtttgcttatgc

SEQ ID NO: 47486 - DNA, 50 bp, homo sapien
cagccatgaagtgataggatataagraatgttaaatgcacttggtaaaat

SEQ ID NO: 47487 - DNA, 50 bp, homo sapien
aagttgccaattactgccacatcaayttaagagaaagtgcaagtatgaaa

SEQ ID NO: 47488 - DNA, 50 bp, homo sapien
caactttgcacttattaaaaagatayctctgtgttgtctttgttgtatat

SEQ ID NO: 47489 - DNA, 50 bp, homo sapien
ttcattcaacaaataaatgattctgyaaaacttattggcaatgtgtgaga

SEQ ID NO: 47490 - DNA, 50 bp, homo sapien
attcctaataaattactgcaaaaacygtaaccatctagtaccaaataatt

SEQ ID NO: 47491 - DNA, 50 bp, homo sapien
cagtgttttcgtttttcctgtcctcrctttctttacagtagcagtcatct

SEQ ID NO: 47492 - DNA, 50 bp, homo sapien
taattatgaagagtaaaatttgatakgaacacaaactcaatcattgaatc

SEQ ID NO: 47493 - DNA, 50 bp, homo sapien
tatccaactaaaatcatatttgaaartggtccaggaatccccaaataact

SEQ ID NO: 47494 - DNA, 50 bp, homo sapien
gtatagcagtctattcctccctttasgtctattaatgtctgctttatata

SEQ ID NO: 47495 - DNA, 50 bp, homo sapien
actattcattgaattttattatcctwaccaaacacttacactttctctat

SEQ ID NO: 47496 - DNA, 50 bp, homo sapien
cacacacaatattccgcaacttcctraacacaagagattggatagaatac

SEQ ID NO: 47497 - DNA, 50 bp, homo sapien
ctctctcgaaagggtgctcgctcacyattccttagtctattgcccacaca

SEQ ID NO: 47498 - DNA, 50 bp, homo sapien
agaaaaaaatctacagtcaataataragtgttgtaaatgctgaagtgaga

SEQ ID NO: 47499 - DNA, 50 bp, homo sapien
aaatccgtttgtatttttcccagatmaggaattgttttgaagcctttggc

SEQ ID NO: 47500 - DNA, 50 bp, homo sapien
aactgacagccaaagtgtgcttttawatcaactgttgtatcagggtctga

SEQ ID NO: 47501 - DNA, 50 bp, homo sapien
tctctattctgctccattgaacttaygtctgcttttatactagtattaca

SEQ ID NO: 47502 - DNA, 50 bp, homo sapien
tatgttaggatagcaatatgcttgasaattttaaacaaaccagtgaggca

SEQ ID NO: 47503 - DNA, 50 bp, homo sapien
cactctagactggaggtgaaaacaakatggatttgcgggaaccatccttg

SEQ ID NO: 47504 - DNA, 50 bp, homo sapien
tttaaccacaaacatgagaatagaamgtaatggatatacaagagtcccac

SEQ ID NO: 47505 - DNA, 50 bp, homo sapien
aaatccagtaatatggccaagtaaaygactggaataaccagatgaaagaa

SEQ ID NO: 47506 - DNA, 50 bp, homo sapien
ttgttcaaagaaagaagtatatatartaaacatgaatagatctaagtgga

SEQ ID NO: 47507 - DNA, 50 bp, homo sapien
gtgtcatgtttccatacttccttccraataagaccatgatctgcagacct

SEQ ID NO: 47508 - DNA, 50 bp, homo sapien
taaatattctgtgtcatgtaagaacraggaggaatcgctgatcaattagg

SEQ ID NO: 47509 - DNA, 50 bp, homo sapien
ccagacgctatgggggaagcaggtayattttgcatgcagtgagccaccag

SEQ ID NO: 47510 - DNA, 50 bp, homo sapien
cattatttttatttatagcatctaayagtatctttgtttaataaaaagac

SEQ ID NO: 47511 - DNA, 50 bp, homo sapien
ctaactaggctgctacacctaaatcrctagggagcatctttaaatgcaag

SEQ ID NO: 47512 - DNA, 50 bp, homo sapien
caggcagatatgttcgctttaaatamaacttactgtgctgtatatttgcc

SEQ ID NO: 47513 - DNA, 50 bp, homo sapien
tctgtgctatgtgtaaagattcaacragtaaacatatttgctgaatcaaa

SEQ ID NO: 47514 - DNA, 50 bp, homo sapien
ggcagaaaatagtctctgccttagakaatttataattcaatcatcagtaa

SEQ ID NO: 47515 - DNA, 50 bp, homo sapien
aaagggagtgagaaatgaaacagaakaagtttgtggcataaccagcagat

SEQ ID NO: 47516 - DNA, 50 bp, homo sapien
cttttttactttttaatatcaccaayggcaagaaaaaagggcaagaaatg

SEQ ID NO: 47517 - DNA, 50 bp, homo sapien
caaccattttaacaaatccttgtaartgtcctctttgttcaggttccagg

SEQ ID NO: 47518 - DNA, 50 bp, homo sapien
gaaccaccccgcccggctggtccgawtatttctcaatcccttccaagcac

SEQ ID NO: 47519 - DNA, 50 bp, homo sapien
aagaagagtatcatatatttgtctargaaccagctagttaactatgatat

SEQ ID NO: 47520 - DNA, 50 bp, homo sapien
ctcagaaggttatgcattcctggtgyatagatgtttatggtgaaggtgtg

SEQ ID NO: 47521 - DNA, 50 bp, homo sapien
attcattcgattttactgtgctttawatctttatcctgaagagccacctt

SEQ ID NO: 47522 - DNA, 50 bp, homo sapien
aaacatactacagattacagactcaygatgtttagctatagcaggcgccg

SEQ ID NO: 47523 - DNA, 50 bp, homo sapien
tgttttcagtttatctcacaatgaayttatgtttcttcaattgggtgtta

SEQ ID NO: 47524 - DNA, 50 bp, homo sapien
aaaaatctatccttcttcttcaatgrcacagtgctactctatgtggggca

SEQ ID NO: 47525 - DNA, 50 bp, homo sapien
aaggttttatgtattaaaccctatcrcattcttggctatttggaaatatc

SEQ ID NO: 47526 - DNA, 50 bp, homo sapien
tatcttgcttggcattccataacatsactccttttgttctgtgtatgact

SEQ ID NO: 47527 - DNA, 50 bp, homo sapien
gatgtttgtatatggtatgaaataaragttcaatttcgttcttctgtaca

SEQ ID NO: 47528 - DNA, 50 bp, homo sapien
atgaatgagcagcagggccagtcacrctgatataaactcaaaccatggtg

SEQ ID NO: 47529 - DNA, 50 bp, homo sapien
gccacagcgtgtacaaatgcatggarccctgaaaataacccacacctgtg

SEQ ID NO: 47530 - DNA, 50 bp, homo sapien
ttgcagaggaggcgaggtttgaaccragcctaaaaggatgtttaaatgtc

SEQ ID NO: 47531 - DNA, 50 bp, homo sapien
agactctgaaataaaaagtgaataaygttccattctgaaccagaatttac

SEQ ID NO: 47532 - DNA, 50 bp, homo sapien
attttatctgtagccatagctaacayagttttacaccaaggatcaggata

SEQ ID NO: 47533 - DNA, 50 bp, homo sapien
taacttttttgcgaccctatacacaytaataacttctgtctccaaactgt

SEQ ID NO: 47534 - DNA, 50 bp, homo sapien
gtacaaaacagcagatatgtggggcraacaagtttagagatctgatgtac

SEQ ID NO: 47535 - DNA, 50 bp, homo sapien
gtttaacctcccaccctaattaatamcactatgctcagaggaactgtgca

SEQ ID NO: 47536 - DNA, 50 bp, homo sapien
aacccagtacaattctaactaaaagkatggtccgatgattccctctttga

SEQ ID NO: 47537 - DNA, 50 bp, homo sapien
agccctctgctgtggaccattcctgyatacgcaagtaatgggttttaaag

SEQ ID NO: 47538 - DNA, 50 bp, homo sapien
aacatctgcgtcctttccatacccargatttacacacagttcacagttta

SEQ ID NO: 47539 - DNA, 50 bp, homo sapien
ttcaggccacactcttctcattggaygaccacgagtaaaacacagctttg

SEQ ID NO: 47540 - DNA, 50 bp, homo sapien
tgcatggcaaataggtttgtaagtgsatttattaccatctccatatagta

SEQ ID NO: 47541 - DNA, 50 bp, homo sapien
gaagaaaagaccgggagaaggctaamtatttggttaagacaatatcatat

SEQ ID NO: 47542 - DNA, 50 bp, homo sapien
tagtcatctgctctgtagcaagtaamacattaaattctgaaaaataatag

SEQ ID NO: 47543 - DNA, 50 bp, homo sapien
tccattaggaaatcttatacctgagycaatagaactatccatttaaacct

SEQ ID NO: 47544 - DNA, 50 bp, homo sapien
actctagttgacaccaagcaatagamgtgcatgagaaaaaacctaacact

SEQ ID NO: 47545 - DNA, 50 bp, homo sapien
ctctctatctcagaaagttgcattcycggttattctgagaactacaagtt

SEQ ID NO: 47546 - DNA, 50 bp, homo sapien
acatgcttgctgactctaagtttaartatcccattacacagcaagttaaa

SEQ ID NO: 47547 - DNA, 50 bp, homo sapien
ttaatataagtttcatgaatatttgyatgtcataattaagaaaatatata

SEQ ID NO: 47548 - DNA, 50 bp, homo sapien
aatacagatctttaaaatgtgtaaaktaaacaatcaaaattaagaacttc

SEQ ID NO: 47549 - DNA, 50 bp, homo sapien
catttattaagttcccagatcaccaraaaaggccattctattaacgaagg

SEQ ID NO: 47550 - DNA, 50 bp, homo sapien
tctttgttttcactgctgacaaatawctcaataactgaccatgattaaca

SEQ ID NO: 47551 - DNA, 50 bp, homo sapien
acatttgaaatgtggctgtaggaaayggtgatggaaataatgggtacatt

SEQ ID NO: 47552 - DNA, 50 bp, homo sapien
tttgcgaatgcattaatgtctataaraaagataaataatatatagtgggc

SEQ ID NO: 47553 - DNA, 50 bp, homo sapien
agtgcctgacctaaaattcattctcyacaatcaacctttctattagcaca

SEQ ID NO: 47554 - DNA, 50 bp, homo sapien
aaacagaagctataaaagtgttagastaagctctggtgaaatgattatgg

SEQ ID NO: 47555 - DNA, 50 bp, homo sapien
aattcagataccattcaattggtctsactctaggaaatgtcctgtattgt

SEQ ID NO: 47556 - DNA, 50 bp, homo sapien
tatctcagatcacccagatactttcrctccacatccttcttagtcttcat

SEQ ID NO: 47557 - DNA, 50 bp, homo sapien
atatagtttattcaatcaacagggcratcagtttaaaggaaaaagaaata

SEQ ID NO: 47558 - DNA, 50 bp, homo sapien
tactatagatttcaaatgagccaagwcaagatataaagaaaaatgaacct

SEQ ID NO: 47559 - DNA, 50 bp, homo sapien
tagacttacattttatttttcttgcrctagattcctagtgctaagcatgc

SEQ ID NO: 47560 - DNA, 50 bp, homo sapien
gaggatactagctctatcctgaatamctcatgagattgtcgtataaaata

SEQ ID NO: 47561 - DNA, 50 bp, homo sapien
ctacgatgtagcatgtgtattataasaagtgtgaaatgtcatcaataatc

SEQ ID NO: 47562 - DNA, 50 bp, homo sapien
ttgggaagtgactgaatgagaaagaytacccagttacccaagaatatatt

SEQ ID NO: 47563 - DNA, 50 bp, homo sapien
tgttctataagtgacttactttactyaacaacataaaacagacagtatta

SEQ ID NO: 47564 - DNA, 50 bp, homo sapien
cgatgcggcgccgccgggtcaggtakcgattgaagtggaactccttctcc

SEQ ID NO: 47565 - DNA, 50 bp, homo sapien
cctagatgtctgttggcattgctgayactcctaaggtctggctgtggctc

SEQ ID NO: 47566 - DNA, 50 bp, homo sapien
accacccaaatcagcatgaacatatraaaattcattacaagacttaatga

SEQ ID NO: 47567 - DNA, 50 bp, homo sapien
tagaaaacacaaaagacaggaataamctataacaaaaactaattttcaat

SEQ ID NO: 47568 - DNA, 50 bp, homo sapien
acgaacgctgctacagtccttctcawacatacacaggaggctttgctctg

SEQ ID NO: 47569 - DNA, 50 bp, homo sapien
tgtagtagatatttgtttagccactkagagatttttaaaaaagagaaaat

SEQ ID NO: 47570 - DNA, 50 bp, homo sapien
aagacacccttcattagggaaagtaragatggaaattgtacctgttaact

SEQ ID NO: 47571 - DNA, 50 bp, homo sapien
tccttagtatttttcctcactacacratgaagttttggaagtcaacagat

SEQ ID NO: 47572 - DNA, 50 bp, homo sapien
ataatatcaatatggtctaccttatmacttttgcgaaccaataggcatcc

SEQ ID NO: 47573 - DNA, 50 bp, homo sapien
tgtgaggcttaaattgcaaatatgamctaatgccatgggtcattcaccat

SEQ ID NO: 47574 - DNA, 50 bp, homo sapien
tgagaaacaaaaatgaactttggaaktgttcaaaggaatcgtattctgct

SEQ ID NO: 47575 - DNA, 50 bp, homo sapien
ttgcttccactatccttccagttgakgtccactatcttagtgacattttt

SEQ ID NO: 47576 - DNA, 50 bp, homo sapien
ataaccttaagtgagctaatacttamaatagacctaacagtgcctgatat

SEQ ID NO: 47577 - DNA, 50 bp, homo sapien
gaagcttttaccagctgcctaagagracatgatgagtaagtttgaagctg

SEQ ID NO: 47578 - DNA, 50 bp, homo sapien
gaaacaccaaaacttacctatccaartcttaatagctagtattttattaa

SEQ ID NO: 47579 - DNA, 50 bp, homo sapien
ataactgttcttttttgtatcatccraataccagcttaagaggttattta

SEQ ID NO: 47580 - DNA, 50 bp, homo sapien
atataaggaagtatcaataaccaaasgagacataagaagatgcacttttg

SEQ ID NO: 47581 - DNA, 50 bp, homo sapien
tggttgtttaatctagactttatgcraaattacgactaggtttctgagct

SEQ ID NO: 47582 - DNA, 50 bp, homo sapien
tctcatttttcccatgtaggacataygactgtgcagcttccaaaatttag

SEQ ID NO: 47583 - DNA, 50 bp, homo sapien
ccaaccagagcattcgaattttgaayatgtggatcaatagaccttataaa

SEQ ID NO: 47584 - DNA, 50 bp, homo sapien
gtgctcagcaattgggaaataaaacyaggctggtggccaagaagcagctt

SEQ ID NO: 47585 - DNA, 50 bp, homo sapien
tatcatagtatctgggttgacgttakagtcgacagaactcttttttaatg

SEQ ID NO: 47586 - DNA, 50 bp, homo sapien
aaatgctgaactcctctgactgcaayctaatttgtacaagtgcttagaaa

SEQ ID NO: 47587 - DNA, 50 bp, homo sapien
ggtagattatacagtgagaaaagaayaaagtttgaatattaccaacatca

SEQ ID NO: 47588 - DNA, 50 bp, homo sapien
agattttgcatgtcaaacaaaaatgyattcctttcatggagtcactcata

SEQ ID NO: 47589 - DNA, 50 bp, homo sapien
tagcagcagtcccaacaatgtcagaygttttacctgagaataagcttcca

SEQ ID NO: 47590 - DNA, 50 bp, homo sapien
aggatatagaataattatcatcacartgaggaaataattataaactccaa

SEQ ID NO: 47591 - DNA, 50 bp, homo sapien
ggtgatgtcgaggtctttgtagtccyaaacttttgccttcaggcctctgg

SEQ ID NO: 47592 - DNA, 50 bp, homo sapien
gccaagttttagacaatatcaactasgtttattttactgactgattcgag

SEQ ID NO: 47593 - DNA, 50 bp, homo sapien
tgctgggtgggttaattgtcacaccyaagtagaaacataagagcaaattc

SEQ ID NO: 47594 - DNA, 50 bp, homo sapien
gggaacaggaaagaacaaagtgttaygtatgcatttgctggcatgtgaag

SEQ ID NO: 47595 - DNA, 50 bp, homo sapien
gaagcctttggtcaatatttacttcrcttcctggccaacacatctcccta

SEQ ID NO: 47596 - DNA, 50 bp, homo sapien
acacatctccctaagaacaacacatkagatttgtggagcatctgtgaaga

SEQ ID NO: 47597 - DNA, 50 bp, homo sapien
cctagtgtaccacactcaagatagcrgctaaatgggtaatatgggactca

SEQ ID NO: 47598 - DNA, 50 bp, homo sapien
taaacccatcataaatcttctccttraaagtctcttccagcttatcacct

SEQ ID NO: 47599 - DNA, 50 bp, homo sapien
tgattagaggcatgttttcctaggayggctgaagtcattgtgtcgagtga

SEQ ID NO: 47600 - DNA, 50 bp, homo sapien
aggccacataggctttccgtcttcaycttcctgctttggggtaagagact

SEQ ID NO: 47601 - DNA, 50 bp, homo sapien
cccggccacctatctgcctcagagasaaagaaaagtaaaacggaaagctt

SEQ ID NO: 47602 - DNA, 50 bp, homo sapien
tgactaccgccttattagagagtcartactttccgtacccagattcatgt

SEQ ID NO: 47603 - DNA, 50 bp, homo sapien
actttagtgactaaagttgcagtaayagtcgtgtggtcacaatgtgcttg

SEQ ID NO: 47604 - DNA, 50 bp, homo sapien
ttttaagtattatattgagtatggasgcattagaaatcctaacagtaacg

SEQ ID NO: 47605 - DNA, 50 bp, homo sapien
aattagaaactggaatttatagacaygttactgttaggatttctaatgcg

SEQ ID NO: 47606 - DNA, 50 bp, homo sapien
cctaacattttccccttacaaactaygtgatcgggtaaatgtttattctc

SEQ ID NO: 47607 - DNA, 50 bp, homo sapien
ctggacaatacttaaggttacttacygatcaatgcatgatgatttgatga

SEQ ID NO: 47608 - DNA, 50 bp, homo sapien
ctattttcaaagggagagtcttttayctcaatgcttagactgacaggcaa

SEQ ID NO: 47609 - DNA, 50 bp, homo sapien
tacatagaaaaattcaggaaggctayataagaaattgttgataatggttg

SEQ ID NO: 47610 - DNA, 50 bp, homo sapien
acaatgccaacatgatgactaccagyataaggcagagggtgtctaacgag

SEQ ID NO: 47611 - DNA, 50 bp, homo sapien
aaactgtgcaagagagaaagtgcccrcatgaaatggtaaaaacagagtag

SEQ ID NO: 47612 - DNA, 50 bp, homo sapien
cacacagctttctggttctatgaagrcatgaactcgggtcctggttttca

SEQ ID NO: 47613 - DNA, 50 bp, homo sapien
gggggcagagtttaaattgcaaagtyaactgagaaaagtgtatcactcaa

SEQ ID NO: 47614 - DNA, 50 bp, homo sapien
acacacccaggttgacattcaaaacraagtggatatgcaaccacggattg

SEQ ID NO: 47615 - DNA, 50 bp, homo sapien
atctgctctatcaagaatgctgttayccctatttgcctggctaacttcaa

SEQ ID NO: 47616 - DNA, 50 bp, homo sapien
tctgacccccaaaaggaatccaataygtgcattgtgaagccatgtctgtt

SEQ ID NO: 47617 - DNA, 50 bp, homo sapien
atagttacaatactacgtaaaataarctaagataacagaggataggtgaa

SEQ ID NO: 47618 - DNA, 50 bp, homo sapien
attcagactcctctattgtgaacagrccttattaaaatggaaatctattg

SEQ ID NO: 47619 - DNA, 50 bp, homo sapien
taggaagtagaaattataacacctaygtctagaggatatctttgtataag

SEQ ID NO: 47620 - DNA, 50 bp, homo sapien
atttttttctttttcttataaaccastgagtgaacgattttgtttcttcc

SEQ ID NO: 47621 - DNA, 50 bp, homo sapien
tcccagatgagccacatggtaatacyactaactcttggcatgcaggtaaa

SEQ ID NO: 47622 - DNA, 50 bp, homo sapien
ccaggcaaacccactatgagctaacyaaccacgattttccatttgccgtg

SEQ ID NO: 47623 - DNA, 50 bp, homo sapien
aattgctttcagttcatcaaccaatsataaaaatacacagcacccttatg

SEQ ID NO: 47624 - DNA, 50 bp, homo sapien
tgccgggcatcatcccatttaatccyaataaaactatcataggaaatttc

SEQ ID NO: 47625 - DNA, 50 bp, homo sapien
gaagtcatgaacctgctgggcttccrctctgttacctgtgaaataattga

SEQ ID NO: 47626 - DNA, 50 bp, homo sapien
acaaactataattatacattgagtcyatactttttgttggttgctgttgc

SEQ ID NO: 47627 - DNA, 50 bp, homo sapien
gttgttcaaaaggttccaactgttayaagttttcaaaaacagagagtgag

SEQ ID NO: 47628 - DNA, 50 bp, homo sapien
catcaagaaaaataaatgaaccaaaraagtccaattctgttttatgcaga

SEQ ID NO: 47629 - DNA, 50 bp, homo sapien
gcagacctgctgctatttcacaatgyaggggcaagagagtcacacactgg

SEQ ID NO: 47630 - DNA, 50 bp, homo sapien
ttaaaagggttaggagctaatcttaygcacacctagatagaccaaagtgg

SEQ ID NO: 47631 - DNA, 50 bp, homo sapien
gtctctaatgtttagcaattgattgyacagaagaaacctaagccctgttc

SEQ ID NO: 47632 - DNA, 50 bp, homo sapien
ctacttaagcttattgagaaatgtaygccaattcacccttaatgaacaca

SEQ ID NO: 47633 - DNA, 50 bp, homo sapien
tttccccctctttaggacagaaaggwaacctaatgtcatctgttccaagt

SEQ ID NO: 47634 - DNA, 50 bp, homo sapien
tgagaatatgatacccttgcaaccasctaactaaatatctgccattaact

SEQ ID NO: 47635 - DNA, 50 bp, homo sapien
cagaagctagacagtctgggtctgartattaaccttgtggccttgggtaa

SEQ ID NO: 47636 - DNA, 50 bp, homo sapien
ctaaaattattatctttattacaaarcattcttccatgtgagaaaatctg

SEQ ID NO: 47637 - DNA, 50 bp, homo sapien
tgaattgtaccttcttgttaaaacastcggcataaaaggttgaaacaggt

SEQ ID NO: 47638 - DNA, 50 bp, homo sapien
aggttagactgggaatggatctcacyaaggtagttctttcagtatttatt

SEQ ID NO: 47639 - DNA, 50 bp, homo sapien
tttttaagtgttttatattgtgaaamgattgctattagattgtcaggtaa

SEQ ID NO: 47640 - DNA, 50 bp, homo sapien
cttgttcctacccagaataatccacyatgatccctaggctggtttggaga

SEQ ID NO: 47641 - DNA, 50 bp, homo sapien
aatgagatgcaaaggagtgtaataayctactcagagtcccacagtaactg

SEQ ID NO: 47642 - DNA, 50 bp, homo sapien
tgaaagagatctgcaagaggttctaygaatcaggtggcagtgtgactctt

SEQ ID NO: 47643 - DNA, 50 bp, homo sapien
gagctattttaataaggctgtttcayagattagatgagatacccacatgt

SEQ ID NO: 47644 - DNA, 50 bp, homo sapien
cttgctgacgaatgaaacaccagccrgattattttaccaaagggcatgtg

SEQ ID NO: 47645 - DNA, 50 bp, homo sapien
tgggactttagggtgatttatcttcycagactttactggtacattgggag

SEQ ID NO: 47646 - DNA, 50 bp, homo sapien
aaaaacactcaacagtctgggtatayaagaaaagtccctcaacataataa

SEQ ID NO: 47647 - DNA, 50 bp, homo sapien
cacaagtgggtgtagccctcaatctracaacaaataaacactagattttg

SEQ ID NO: 47648 - DNA, 50 bp, homo sapien
ttaacataggtacgttaatcaaagtkacacatcacagactgaaagacaaa

SEQ ID NO: 47649 - DNA, 50 bp, homo sapien
agatgtcaactaacatttatgtactraaaggtaaaattacaaaaacgtgc

SEQ ID NO: 47650 - DNA, 50 bp, homo sapien
aaaggtaaaattacaaaaacgtgccygagaataacaacattgggatagtg

SEQ ID NO: 47651 - DNA, 50 bp, homo sapien
tcgtggtctgcactctcccattacastggtggatcattccagaagttagc

SEQ ID NO: 47652 - DNA, 50 bp, homo sapien
acacaaatagaagaacatttgagacrgtcattaattaacaaagacttctt

SEQ ID NO: 47653 - DNA, 50 bp, homo sapien
ttgacatcatagtccacagtttatgmaagaacttcacctgaccctgggtc

SEQ ID NO: 47654 - DNA, 50 bp, homo sapien
agtatggagtttgtttacatgtaacygaaattttatagcagtaatataat

SEQ ID NO: 47655 - DNA, 50 bp, homo sapien
actaatcactaccattctagatcacyattaaatgagcaaacacaaaataa

SEQ ID NO: 47656 - DNA, 50 bp, homo sapien
gaatcagaacgaaggggaaattaacyggctatacttatgaaatgcgaatg

SEQ ID NO: 47657 - DNA, 50 bp, homo sapien
tcaggtctgtgttggtttcagataayggatgctttaaatttaaggtagtg

SEQ ID NO: 47658 - DNA, 50 bp, homo sapien
ttgttacacagcaatagataacttgwataggttctatcagggaaagaaaa

SEQ ID NO: 47659 - DNA, 50 bp, homo sapien
acaatttggaaaccacagttctaagkattgaaaaggcagtagcaatgagt

SEQ ID NO: 47660 - DNA, 50 bp, homo sapien
acatggtagatgcttgctgcaggacrgatgggtatatgtagtatatctct

SEQ ID NO: 47661 - DNA, 50 bp, homo sapien
ttattgttctattaagatttgtgggyaagcattgaaatcttggacactaa

SEQ ID NO: 47662 - DNA, 50 bp, homo sapien
accagtccagcaagcagggactataragtgaggtagcaggaaataaggct

SEQ ID NO: 47663 - DNA, 50 bp, homo sapien
tctggtaaaagcacaaaagccgagamcctaaggagaaagagtgtctgtgg

SEQ ID NO: 47664 - DNA, 50 bp, homo sapien
attgtctgactggtttgttggttaaytggttggttcattggatggatgga

SEQ ID NO: 47665 - DNA, 50 bp, homo sapien
caagtgaaaaataagtcaaggaatamacaaaatactctcttattcctgga

SEQ ID NO: 47666 - DNA, 50 bp, homo sapien
ttctccattgctaatatctccacagmagtttttttattacagggtttaag

SEQ ID NO: 47667 - DNA, 50 bp, homo sapien
gcaagacagtcaccaccatgtagaayttagggtgaatagagccaaaagaa

SEQ ID NO: 47668 - DNA, 50 bp, homo sapien
gatcacaagtacttgctggcaccacratgtgtaaggaaacaataagtcaa

SEQ ID NO: 47669 - DNA, 50 bp, homo sapien
tattaaatatgaaaaattatatcgartatgaaaaattatagagaatctga

SEQ ID NO: 47670 - DNA, 50 bp, homo sapien
tcccatgagaggaggagactgctacyattcctgcaggctgcctgagtaag

SEQ ID NO: 47671 - DNA, 50 bp, homo sapien
cttcatgatgccactgccaagtcgtkaaaaatggatcaagggcataggct

SEQ ID NO: 47672 - DNA, 50 bp, homo sapien
tcaatactgtacataattctacttcratatttatatgcctctaacaccca

SEQ ID NO: 47673 - DNA, 50 bp, homo sapien
gtgggacataggaatctgcatttcartaaactttacacgtgattcttctg

SEQ ID NO: 47674 - DNA, 50 bp, homo sapien
tcaatgccaagttttgaaggtggtgycaaagttcactatctgtctgggta

SEQ ID NO: 47675 - DNA, 50 bp, homo sapien
tcaaaacttggcattgagattaaatkatgcaataaaagagaaactgtgat

SEQ ID NO: 47676 - DNA, 50 bp, homo sapien
taataagaagtacaagcctgtctacragaagactaacctaatctaaaggg

SEQ ID NO: 47677 - DNA, 50 bp, homo sapien
aggttgttctgtctgtgagcaacgaygggaatgtaatcacatgccccaca

SEQ ID NO: 47678 - DNA, 50 bp, homo sapien
tgcagagaatgagacttaatttttaygtaatatgtcttggatggcacttt

SEQ ID NO: 47679 - DNA, 50 bp, homo sapien
tgggctacctcgtgcaatggtatacygatggactctgaaatttttccata

SEQ ID NO: 47680 - DNA, 50 bp, homo sapien
gccaaactaggatttttctcttctgyaagccctattccttaccctctcat

SEQ ID NO: 47681 - DNA, 50 bp, homo sapien
aatggcactgctaagaactttacagractggaagtagtatcaaagtggct

SEQ ID NO: 47682 - DNA, 50 bp, homo sapien
ttgttcctttttagaaaccacttaaragaaagattaaatgttactctgat

SEQ ID NO: 47683 - DNA, 50 bp, homo sapien
taaaaatcctgtgggtacctaccaawtatgataaactaaggttgtaagag

SEQ ID NO: 47684 - DNA, 50 bp, homo sapien
aatggaagaagagaatagcagcataygagaacattcgccagctttgtgaa

SEQ ID NO: 47685 - DNA, 50 bp, homo sapien
tattctatttatctagcttagaaagwcatcaaaattttaaaaattgacaa

SEQ ID NO: 47686 - DNA, 50 bp, homo sapien
ttctggatggagataattgcaaagasgcataaaatagccaggtatctgcc

SEQ ID NO: 47687 - DNA, 50 bp, homo sapien
ttgcaggtgtgacattgctcagggaygagagacccaaagcaatcgtggaa

SEQ ID NO: 47688 - DNA, 50 bp, homo sapien
cttcaagcattctgagaagcaaggaractttctggtttgcatgtgaagct

SEQ ID NO: 47689 - DNA, 50 bp, homo sapien
ggtactataaatgtttatatgaatayggtttaaaatgtataaggagcaga

SEQ ID NO: 47690 - DNA, 50 bp, homo sapien
gagcagtctaaatattagaacagaaytattatttactgctgatatgattg

SEQ ID NO: 47691 - DNA, 50 bp, homo sapien
ggagaaagagttctatcatctcccartcctagtatcttcttttaatcagt

SEQ ID NO: 47692 - DNA, 50 bp, homo sapien
agatctgatggatactcttgttactsaatattactgaatgtctgttgata

SEQ ID NO: 47693 - DNA, 50 bp, homo sapien
ttttgttacttaatttgattccgccrcctacttttaaatattttgcaacc

SEQ ID NO: 47694 - DNA, 50 bp, homo sapien
gcttagtggcttgaggacaaacacarattgatggttctggaggtcagagg

SEQ ID NO: 47695 - DNA, 50 bp, homo sapien
aaattaatcgtagttgggtacatacratatataaagtatatattaacctt

SEQ ID NO: 47696 - DNA, 50 bp, homo sapien
ttccgcttttgcatcctcatagagtmaaaaaattgtaagttgaacctgac

SEQ ID NO: 47697 - DNA, 50 bp, homo sapien
tcttctacaaaaagcatgcctaccartattagaactctattctcaatatt

SEQ ID NO: 47698 - DNA, 50 bp, homo sapien
cagtttcagaaaagaccctatgttgsatgttacagagaacactacgaaac

SEQ ID NO: 47699 - DNA, 50 bp, homo sapien
gctgaaatgaaaagataattgtaaartacttagcctggaacagagcactc

SEQ ID NO: 47700 - DNA, 50 bp, homo sapien
caaatgagggaagttctccaatatartaaaacacctacactttaatgcct

SEQ ID NO: 47701 - DNA, 50 bp, homo sapien
aacaattaggactcttggaaaaatakgttagaatactggtacatgcaaag

SEQ ID NO: 47702 - DNA, 50 bp, homo sapien
cgctctaacatttcaaccacatgtawgagaaaataagggccatatggttc

SEQ ID NO: 47703 - DNA, 50 bp, homo sapien
gatgagtcttccccattgtcaatatragaattacagaaaacttaaatttt

SEQ ID NO: 47704 - DNA, 50 bp, homo sapien
tttctggagcttctgcgccctggagsatttgccaccttttttttctctat

SEQ ID NO: 47705 - DNA, 50 bp, homo sapien
tgtgaagtctccagtgaatcgccaawtaatatctgtcaagatgttgacca

SEQ ID NO: 47706 - DNA, 50 bp, homo sapien
gaataaacgaatgaaatgtcagctayataacaagaactgagattaacatt

SEQ ID NO: 47707 - DNA, 50 bp, homo sapien
ttgtgctattgcactccagcctagaygctaagaatgaaactccataaaac

SEQ ID NO: 47708 - DNA, 50 bp, homo sapien
gttttaaagctaaaatgcatataagmaaccatctaagactaaccagtttt

SEQ ID NO: 47709 - DNA, 50 bp, homo sapien
tcagtttagtttttaagtggttccaygtgggcacaggtattctttggcca

SEQ ID NO: 47710 - DNA, 50 bp, homo sapien
aaacacatccaacattaggtaaacaygaaattggtaagcagaggcaactg

SEQ ID NO: 47711 - DNA, 50 bp, homo sapien
ttatgagttcaccagtttggatactyacatttgtcttacatcaaccctgc

SEQ ID NO: 47712 - DNA, 50 bp, homo sapien
cactaaaagaactgctatcaaaataygtgtgacaactgtgaaagagcaga

SEQ ID NO: 47713 - DNA, 50 bp, homo sapien
cctgactgcctctctgtgctcttcasattgacctgcttcagttgtctcta

SEQ ID NO: 47714 - DNA, 50 bp, homo sapien
catggggaataatggttagctgcacraagccctttctggaacacaaagca

SEQ ID NO: 47715 - DNA, 50 bp, homo sapien
ttgtttttctctttcttttttaaatsatcaggaatgaagtgtattctgtc

SEQ ID NO: 47716 - DNA, 50 bp, homo sapien
ccattttctgtatggaaactccaacraagctatgtcaaggagatggcccg

SEQ ID NO: 47717 - DNA, 50 bp, homo sapien
ctttgaaacataatacaaccagtgargtgctaatatctttgcaaagctgc

SEQ ID NO: 47718 - DNA, 50 bp, homo sapien
ttaacatttaaattgctatttaagcwctagactcttgaaatatggaaaac

SEQ ID NO: 47719 - DNA, 50 bp, homo sapien
caagcactgagtatcttgccaggcaytatgaaaaaagataaaactataaa

SEQ ID NO: 47720 - DNA, 50 bp, homo sapien
tatatagtaattactttggttcctaygacattgtagagatttggacttaa

SEQ ID NO: 47721 - DNA, 50 bp, homo sapien
atttgccatattattggtactaaatkattatgaaagaaagagaggaaggg

SEQ ID NO: 47722 - DNA, 50 bp, homo sapien
gaacataaaacagcatgtcaggcaamgtctctcggaggatgtgacatttc

SEQ ID NO: 47723 - DNA, 50 bp, homo sapien
aatttcaatttaatttgtttttgacsaattaaatgttcataggaaaagat

SEQ ID NO: 47724 - DNA, 50 bp, homo sapien
cctccacctgtggaacaatattgccmgctataatggtagtataggcaaca

SEQ ID NO: 47725 - DNA, 50 bp, homo sapien
aagtagcaaagacttggtggattaasagcagatatttattttctcacaat

SEQ ID NO: 47726 - DNA, 50 bp, homo sapien
acctttatgatttaagggtcaggatragaaacataaagcataaactataa

SEQ ID NO: 47727 - DNA, 50 bp, homo sapien
acaatggcattacaatagaccttccrctagaagccttggctgacaggtaa

SEQ ID NO: 47728 - DNA, 50 bp, homo sapien
tgggaggtggtcagcctttttgttckagttaggccttcaactggttgaat

SEQ ID NO: 47729 - DNA, 50 bp, homo sapien
ggggaattcttttaattaatttttgmatgctgaattaatcttgcattcct

SEQ ID NO: 47730 - DNA, 50 bp, homo sapien
gtctttgaaacttgagtccctgtaamaaacaaataaatggattaacagtg

SEQ ID NO: 47731 - DNA, 50 bp, homo sapien
aacaccacaattaaggataaaaggaycttatattatcagaaatttcaatg

SEQ ID NO: 47732 - DNA, 50 bp, homo sapien
aagagaccactgtgatacattaagawtattgctataagggagcatgtgca

SEQ ID NO: 47733 - DNA, 50 bp, homo sapien
gcttcccagaaaacctggccagcaayggttctccaggaaggacgaaatct

SEQ ID NO: 47734 - DNA, 50 bp, homo sapien
aggcttcgttagcttatatgttaaawtgcctaggttaacttctaaatgaa

SEQ ID NO: 47735 - DNA, 50 bp, homo sapien
accgttgctggccaggttttctgggwagcagattccaaggccagtggcat

SEQ ID NO: 47736 - DNA, 50 bp, homo sapien
tttttgtatacctgactctgtttcarcatccgcttcccaaagaatgcagt

SEQ ID NO: 47737 - DNA, 50 bp, homo sapien
tgctgtaacaataatctctgtctcayctatcatcatattgccacccattt

SEQ ID NO: 47738 - DNA, 50 bp, homo sapien
actcatgtttttcaatgggcacttayagtacgtgtcatagtcttcttggt

SEQ ID NO: 47739 - DNA, 50 bp, homo sapien
aaaaaaatctcaacatgaataaaaakcagaatagaaaattatatatgcac

SEQ ID NO: 47740 - DNA, 50 bp, homo sapien
aataaaaccatcacaaacaaaaatawctaattacaaatcattttagatgt

SEQ ID NO: 47741 - DNA, 50 bp, homo sapien
ggttgatctttactgtagataaatgsaacccaattagaattgaataaaaa

SEQ ID NO: 47742 - DNA, 50 bp, homo sapien
ttaaagtatattcttatgtctctgaraagtaatcttataagtagatgctc

SEQ ID NO: 47743 - DNA, 50 bp, homo sapien
atactgaaataggtagctgaatataygacaatgaagagtttcatattaga

SEQ ID NO: 47744 - DNA, 50 bp, homo sapien
aagacaattaacgtttcatggtaagmatagatgtcccattcattgtttct

SEQ ID NO: 47745 - DNA, 50 bp, homo sapien
tgcagatttctgggagaataaggacratatcttccctgactctgaattcc

SEQ ID NO: 47746 - DNA, 50 bp, homo sapien
gccagggatactatccagcatggtayataaaaagaaaagtagtaataagt

SEQ ID NO: 47747 - DNA, 50 bp, homo sapien
cttggagttttggtctatttttgtaycatacacaggttgagtatttctca

SEQ ID NO: 47748 - DNA, 50 bp, homo sapien
cagttatttggttatagtagtacaamtgagctaagatagtactcaggtcc

SEQ ID NO: 47749 - DNA, 50 bp, homo sapien
tattcactcaataaatgttaaccgarcacttactatgtgtgctaggcact

SEQ ID NO: 47750 - DNA, 50 bp, homo sapien
ccactttccacacccccacttgcccrctgtctagtctctttacagagctc

SEQ ID NO: 47751 - DNA, 50 bp, homo sapien
cctggagagggcaggttagatttgargaacttataccttagtgttttttt

SEQ ID NO: 47752 - DNA, 50 bp, homo sapien
agagttctttatagagctctgattcratccttaccacaacctgtgaagga

SEQ ID NO: 47753 - DNA, 50 bp, homo sapien
tgcattttttagttaccaccatcgcmaagatagacttttggacaatatta

SEQ ID NO: 47754 - DNA, 50 bp, homo sapien
agtggcatgttagccccttattaacrcccatcattttgtatgctcctgtc

SEQ ID NO: 47755 - DNA, 50 bp, homo sapien
attgtgtaaatagcttcataagacamgtagaaatcaagagaaaaggaaag

SEQ ID NO: 47756 - DNA, 50 bp, homo sapien
taacagcctcttttgaaggcactgaraaaatatatatttgggaatagtgt

SEQ ID NO: 47757 - DNA, 50 bp, homo sapien
catataatgccatgataaaacctgartagtaggtatttgagtatttcctg

SEQ ID NO: 47758 - DNA, 50 bp, homo sapien
agcactgcagtctgttattggaccayaaaatatagaggtaagtccttccc

SEQ ID NO: 47759 - DNA, 50 bp, homo sapien
tcttttgaagtcaacattaagttccraagaacaaacatgcctgtcggggt

SEQ ID NO: 47760 - DNA, 50 bp, homo sapien
ctgcaatgacagtcaacatagaaaasaagggtacacttggctgtaaaaag

SEQ ID NO: 47761 - DNA, 50 bp, homo sapien
cccccaaatccatgagagctagcaaktacattatctgggtggcctttgtg

SEQ ID NO: 47762 - DNA, 50 bp, homo sapien
cagctgcatcaatcctggtcaacacrgagagagaaattctgaatgcagat

SEQ ID NO: 47763 - DNA, 50 bp, homo sapien
gagaagtccatgcaggaaatgctttsaaacaacagagtctgagatgcact

SEQ ID NO: 47764 - DNA, 50 bp, homo sapien
ttagcagacacttcctaacaaagaaygcaataagtcactttcgaaagaat

SEQ ID NO: 47765 - DNA, 50 bp, homo sapien
tcatttccagtctagctctagctgamgtaattgttctctctcttctccat

SEQ ID NO: 47766 - DNA, 50 bp, homo sapien
tgtaggccgaaaggaagtggattagyatggaagtggtttggccagaagtg

SEQ ID NO: 47767 - DNA, 50 bp, homo sapien
agtttggcagcaatggtccggaacascaataaattgaatacccaagagct

SEQ ID NO: 47768 - DNA, 50 bp, homo sapien
caatttctattctaccttgcatttgyaataatcaccattacaaccagcat

SEQ ID NO: 47769 - DNA, 50 bp, homo sapien
tatggcattcatatactgattcatamagtgagctaccaatctccacatag

SEQ ID NO: 47770 - DNA, 50 bp, homo sapien
aagaattgcagtaacgattcttagaygatcacaggttcaaaactgtgtgt

SEQ ID NO: 47771 - DNA, 50 bp, homo sapien
gtgctaactttctgcaaatatttagyacaatgataccatttattttcaaa

SEQ ID NO: 47772 - DNA, 50 bp, homo sapien
tgtagtcaggtatcggttctgagtcrctttcatacaaggagatgagttcc

SEQ ID NO: 47773 - DNA, 50 bp, homo sapien
cccaaatctctacctctattctgtawactagacattcctatcttaaacag

SEQ ID NO: 47774 - DNA, 50 bp, homo sapien
ggtatgcaatgtgtaataatcagatsaaggtaaataggacatccatcacc

SEQ ID NO: 47775 - DNA, 50 bp, homo sapien
aagagctaaagaagtatagatgcttyaagatttgagaggtgacctcagag

SEQ ID NO: 47776 - DNA, 50 bp, homo sapien
aatctaatcttactgcttgaatgtasagccataatgacagaaggggccag

SEQ ID NO: 47777 - DNA, 50 bp, homo sapien
atctgaatactgcataccctatagcmaataattttcagggaagcatagct

SEQ ID NO: 47778 - DNA, 50 bp, homo sapien
acaaatctattttcccttagaaacasgatgatgacacagggtagtgggta

SEQ ID NO: 47779 - DNA, 50 bp, homo sapien
tgcctcagtgtgagaccctttttcargctctatacattctcctatctcaa

SEQ ID NO: 47780 - DNA, 50 bp, homo sapien
acacttgatattataccacaaagccratagtgatcaagtaagttgctgtt

SEQ ID NO: 47781 - DNA, 50 bp, homo sapien
ttttcctgcttttccacagtttagaytattttttgaggcttctcctatga

SEQ ID NO: 47782 - DNA, 50 bp, homo sapien
atggtggtatcagagttcctgctgastaacttttcttcgagaggttggct

SEQ ID NO: 47783 - DNA, 50 bp, homo sapien
gcaagcgcatttctcataaagcattraacacttcaacaaatcaatgaaca

SEQ ID NO: 47784 - DNA, 50 bp, homo sapien
gttagtacaaagattgcgataatagratcaccagcctctctggcttcagg

SEQ ID NO: 47785 - DNA, 50 bp, homo sapien
tgtatagttcaagtagattataaaayagcatgatgacaatattagtaaaa

SEQ ID NO: 47786 - DNA, 50 bp, homo sapien
ttgaatatttaaaactgaataattcyacattgtttattagaaaaagtgtt

SEQ ID NO: 47787 - DNA, 50 bp, homo sapien
caccaagagagtttccctattggcawtctgaactaattcctttccatttt

SEQ ID NO: 47788 - DNA, 50 bp, homo sapien
tctacaagtaccagtctgaaacgaasatagcggtctttccagtttataaa

SEQ ID NO: 47789 - DNA, 50 bp, homo sapien
tagattacaggataaaacaatatatwaactcaacagatgcagaaaaaaat

SEQ ID NO: 47790 - DNA, 50 bp, homo sapien
cagtgagcaagtagtaggaaaacatsagcagttgagtaaagcaacaagtg

SEQ ID NO: 47791 - DNA, 50 bp, homo sapien
agctttgaattctctctgcaaagaaraggtccggtatcccggcgggagaa

SEQ ID NO: 47792 - DNA, 50 bp, homo sapien
cttgactttacagtcagaaaccagayggaaactatacactgtacctttcc

SEQ ID NO: 47793 - DNA, 50 bp, homo sapien
tttattaaagttacatgagtcttatsaaatagaatgaacatttgttggca

SEQ ID NO: 47794 - DNA, 50 bp, homo sapien
gtcaggattttcgaaccgcagcttaygttaggcggcagatttgaggcagc

SEQ ID NO: 47795 - DNA, 50 bp, homo sapien
gggaagaaggattttttcttgaaacygaatttattagcaaaatattttta

SEQ ID NO: 47796 - DNA, 50 bp, homo sapien
aaggaagcaagccaagttttaaacarcctgtctctaatgatctggtcagg

SEQ ID NO: 47797 - DNA, 50 bp, homo sapien
ggacaaacaggccatccaaaagagayatgatatttcaggttgctactaga

SEQ ID NO: 47798 - DNA, 50 bp, homo sapien
tatactgggcacatcagagatactaragaaacattattctgtgattgaaa

SEQ ID NO: 47799 - DNA, 50 bp, homo sapien
atgtaatccaatttggagggtttaaygacactttgcctcttcacaagcat

SEQ ID NO: 47800 - DNA, 50 bp, homo sapien
gagcacgtctgttttatctgtggacrctacctcgtgagattgatagtgcc

SEQ ID NO: 47801 - DNA, 50 bp, homo sapien
aaaaagaagcaaaaggcagaatacayaattcatcaaagaagataaacaaa

SEQ ID NO: 47802 - DNA, 50 bp, homo sapien
attgaagtagctagaaatctaataaycaatgtctaaagagatctatccaa

SEQ ID NO: 47803 - DNA, 50 bp, homo sapien
tttacagatcctgaaactgattgctyagagtgattaaataatttgcccag

SEQ ID NO: 47804 - DNA, 50 bp, homo sapien
aagtcaagatcaagagacagcattawtaacagaaacacacacttaagtca

SEQ ID NO: 47805 - DNA, 50 bp, homo sapien
tacacttgactgagagctcacaaaakgcttagatgttattccaaggtgca

SEQ ID NO: 47806 - DNA, 50 bp, homo sapien
ttcttttctttcttaaactttggacygagccactttctcagaagcacagc

SEQ ID NO: 47807 - DNA, 50 bp, homo sapien
cataaaacacagatatcatagtgaayatttcctgaggtaaaatctctaca

SEQ ID NO: 47808 - DNA, 50 bp, homo sapien
taaactctaaagcctaagaccattamaatgaatattctgccctgaagaag

SEQ ID NO: 47809 - DNA, 50 bp, homo sapien
tttataacatgaaatttagaatgaawtaatagtcatcgcacctaaaatat

SEQ ID NO: 47810 - DNA, 50 bp, homo sapien
actttgttaccaattcaaagataccractcagaatgtaaaagaaataaag

SEQ ID NO: 47811 - DNA, 50 bp, homo sapien
tgcagtccatttagcaggccgatgakagattttcctggatgcctctcctt

SEQ ID NO: 47812 - DNA, 50 bp, homo sapien
tcttccagagcaccaggcttggagargtgaccatgatttgcattcacagg

SEQ ID NO: 47813 - DNA, 50 bp, homo sapien
ccaggctcccgggaaattccccatamgttgaaacaaacagtaaggacaca

SEQ ID NO: 47814 - DNA, 50 bp, homo sapien
agagaaatgagtgtggatttaaaaaktaacaggctttgtatgcatataac

SEQ ID NO: 47815 - DNA, 50 bp, homo sapien
tttgtatgcatataactaagaatcarcttacttgccatgaagatgagtac

SEQ ID NO: 47816 - DNA, 50 bp, homo sapien
tctctctcagccatggaggctataaraggaagaatcactgcttttctcaa

SEQ ID NO: 47817 - DNA, 50 bp, homo sapien
gcctccagcttctctgcgtatttcaratcatcttgtcattcaatgcccag

SEQ ID NO: 47818 - DNA, 50 bp, homo sapien
tttggcattttcatataaacacgcargccgaagaagaatttctcctttct

SEQ ID NO: 47819 - DNA, 50 bp, homo sapien
tcgccagcctccgcaatgactgcaaraccacatagtgcatccctatgact

SEQ ID NO: 47820 - DNA, 50 bp, homo sapien
catttccccaacatctgaccatagawccctacattactgaatggttcttg

SEQ ID NO: 47821 - DNA, 50 bp, homo sapien
atccctcaagaagatagtcacattcraattaaattaaaataattatggaa

SEQ ID NO: 47822 - DNA, 50 bp, homo sapien
ttgtgcagtgattacactaacaaggyagccgggtataaaaacatagaaag

SEQ ID NO: 47823 - DNA, 50 bp, homo sapien
atagtcaggaggtgaacaaactgcawtctttatacttccaagtgttcata

SEQ ID NO: 47824 - DNA, 50 bp, homo sapien
acagatcagccgaagaacctcctctractacttaggattctcttcaagcg

SEQ ID NO: 47825 - DNA, 50 bp, homo sapien
aatatagggcatgtgaggaaatatcwagtcaaataagaaaagcaggtgga

SEQ ID NO: 47826 - DNA, 50 bp, homo sapien
tccaatggctacagaaacttgatgartagactgtattaagcgtctgatta

SEQ ID NO: 47827 - DNA, 50 bp, homo sapien
ctgaagtgctgttttcactctgtcaygtacagcttttattgctagcatct

SEQ ID NO: 47828 - DNA, 50 bp, homo sapien
tcaccacccacttggctacatcaaaytgagccagaaagagcctttccctg

SEQ ID NO: 47829 - DNA, 50 bp, homo sapien
cttatttttaacaatttggctgtagrataaagcactttcctaattcatga

SEQ ID NO: 47830 - DNA, 50 bp, homo sapien
ttataaggcttaaaacattcagaacratgcccagcacataacaccatcat

SEQ ID NO: 47831 - DNA, 50 bp, homo sapien
gaaggatatggctggtcagccagtasgtagatgtggttttctttccacca

SEQ ID NO: 47832 - DNA, 50 bp, homo sapien
aggggcgagatcagttgttggttcaygactgaggacatacctgaagcagt

SEQ ID NO: 47833 - DNA, 50 bp, homo sapien
tagttattgggaaagggcaatcaacrcgtgctttccttggctcatgattt

SEQ ID NO: 47834 - DNA, 50 bp, homo sapien
atgttgttcctatataaaaatcatcratcgggcaattttttaaatgacta

SEQ ID NO: 47835 - DNA, 50 bp, homo sapien
aagtttaacagtttatctgagtaaakaacaattcctgaatcaattagcac

SEQ ID NO: 47836 - DNA, 50 bp, homo sapien
catcatcataactttaaagaaacackgacatggagcatggctggcttttc

SEQ ID NO: 47837 - DNA, 50 bp, homo sapien
tttttgtctgggactgcagagtggamgctgttgtttctgggacagagtct

SEQ ID NO: 47838 - DNA, 50 bp, homo sapien
ttgccttcaatccttgactctgttasgccttagaattatgtctgggcgtg

SEQ ID NO: 47839 - DNA, 50 bp, homo sapien
ccagaatgaagttatccctttcttgkagttctagcttactaaccatctgt

SEQ ID NO: 47840 - DNA, 50 bp, homo sapien
ccttgccccacgccttctctgtggaycattcaggacctccagtgggggtg

SEQ ID NO: 47841 - DNA, 50 bp, homo sapien
attgtccactggcaactgctacttcyctaaaagacagattggtctatcgc

SEQ ID NO: 47842 - DNA, 50 bp, homo sapien
aggtaaatcttgtccgtgtttgatasaaatcaccagggtcccttctcagt

SEQ ID NO: 47843 - DNA, 50 bp, homo sapien
aaggaggaaagagatcaatgaagtcragagaaaactgaaactaaatgggt

SEQ ID NO: 47844 - DNA, 50 bp, homo sapien
gtctcttcttctctctggcaggtaartcttgtccgtgtttgatacaaatc

SEQ ID NO: 47845 - DNA, 50 bp, homo sapien
cttagaggagaatgaaataatcaaarttgatcatgggaagacatctttta

SEQ ID NO: 47846 - DNA, 50 bp, homo sapien
cgtcagtactcatgttggagataatyaactgtgctgcctttctaaggtgt

SEQ ID NO: 47847 - DNA, 50 bp, homo sapien
aaggacggcaccatagttaattaaaygtccactctgacggtaaaattcat

SEQ ID NO: 47848 - DNA, 50 bp, homo sapien
acttgccccttctcctgctaaacacrcaatctagttatctgttccttctg

SEQ ID NO: 47849 - DNA, 50 bp, homo sapien
ttatatgcctctggtcctttatttayaaggctgtcacctgtctgacaggt

SEQ ID NO: 47850 - DNA, 50 bp, homo sapien
acaaaatgtatcaaaacactaatagratccataaacacagacagctaaag

SEQ ID NO: 47851 - DNA, 50 bp, homo sapien
cctagagttccagaagcatataatcraccgtacacatggagtagtgttgg

SEQ ID NO: 47852 - DNA, 50 bp, homo sapien
gtcatgcttttgagcacctttcttamagtttcctaagtcttcctctggca

SEQ ID NO: 47853 - DNA, 50 bp, homo sapien
tcatgcagcatgaattcatatttccygagcttatggtatgcacaatacta

SEQ ID NO: 47854 - DNA, 50 bp, homo sapien
cctggtcccaggctataggtattaasgtccttgccacccatgatggatgt

SEQ ID NO: 47855 - DNA, 50 bp, homo sapien
ctgacattgaggagttcactgtctaragatcaaaagtagaggtggtggtg

SEQ ID NO: 47856 - DNA, 50 bp, homo sapien
attttatctaaagtacatgcaaaatratgtctgtatatttcatttgtcag

SEQ ID NO: 47857 - DNA, 50 bp, homo sapien
gggtatgagaggccctgattacaagmaaaggtgctgccacgcccaactct

SEQ ID NO: 47858 - DNA, 50 bp, homo sapien
accaaatctggactctgataaacacraatctacaaatctccctctagaaa

SEQ ID NO: 47859 - DNA, 50 bp, homo sapien
gtggtagagtaaaatttctccttgcyagttaaagctcacaaaaccttgca

SEQ ID NO: 47860 - DNA, 50 bp, homo sapien
gagtccatgccctttattcatttatwacaattgaggcagtcaagtgagaa

SEQ ID NO: 47861 - DNA, 50 bp, homo sapien
ctaaatattagaatatctctttctawaatgacacgtattagaaggtccat

SEQ ID NO: 47862 - DNA, 50 bp, homo sapien
attgagggtagaggggtgaatgtacsaggattggagtggaatggcacaga

SEQ ID NO: 47863 - DNA, 50 bp, homo sapien
attttattatacgtttaccagtgaartcgaagcagataggacaattctat

SEQ ID NO: 47864 - DNA, 50 bp, homo sapien
ctttcataaaattgaagagatgagartagttcataattcattgtatgagg

SEQ ID NO: 47865 - DNA, 50 bp, homo sapien
gtctctttacataatcctgtttgcaytattgccctggagttggtgttggc

SEQ ID NO: 47866 - DNA, 50 bp, homo sapien
cctattttcacatgacttgtctaccragaagatcccaaggaatcacccaa

SEQ ID NO: 47867 - DNA, 50 bp, homo sapien
agaggggacaggaaaatagtgaaaaragcatgctgtggaaattgcagcat

SEQ ID NO: 47868 - DNA, 50 bp, homo sapien
agaaaaacttactgagtgttttcaargcaaataaatgctctttacttctg

SEQ ID NO: 47869 - DNA, 50 bp, homo sapien
cttgtaatatcattataagcattacraacaatagtacttggcccatgata

SEQ ID NO: 47870 - DNA, 50 bp, homo sapien
caagtgaggcttcaggattaacgccmggattcgtaagtgcatcttccctc

SEQ ID NO: 47871 - DNA, 50 bp, homo sapien
gctggcataggcacaataatgcaaargattatggaaaatctaagaaatgt

SEQ ID NO: 47872 - DNA, 50 bp, homo sapien
gtgatctctaaaatcttgcctatgakgaggtccaacatttgcaattttgt

SEQ ID NO: 47873 - DNA, 50 bp, homo sapien
aatgggatcagaggctattttctacrgactagtttacattagtgatctca

SEQ ID NO: 47874 - DNA, 50 bp, homo sapien
cacaggtgccctttctgggcatataraactggcattgattaaggatgtat

SEQ ID NO: 47875 - DNA, 50 bp, homo sapien
agacttgggttgtcagtggtttgcaytcaagaataactcaggaagaagaa

SEQ ID NO: 47876 - DNA, 50 bp, homo sapien
aagcactgtatctacgcttaaactawgtaattataataataaaaagcata

SEQ ID NO: 47877 - DNA, 50 bp, homo sapien
gcaaaccattttcttccttcctgacrcgtggatatcagtggtccattcaa

SEQ ID NO: 47878 - DNA, 50 bp, homo sapien
ggctgcaaaaccttacctgaactgaygtgagactatttttggtctttatt

SEQ ID NO: 47879 - DNA, 50 bp, homo sapien
catacccagcctgcatcctaatttaygattcctattttgtgcctggtgaa

SEQ ID NO: 47880 - DNA, 50 bp, homo sapien
gcatcaagaaagaagtgaaatcttarctagagggaaaagtaactcagatg

SEQ ID NO: 47881 - DNA, 50 bp, homo sapien
gataaattttgatcaaataataatayccaaatgtttttgaagccaggatt

SEQ ID NO: 47882 - DNA, 50 bp, homo sapien
gaagatacttaatgctttgtgactayataaattgtaacagtggattgttt

SEQ ID NO: 47883 - DNA, 50 bp, homo sapien
tgttgcattctatctgcacaactcawatgggtaatgcttgtttgctctga

SEQ ID NO: 47884 - DNA, 50 bp, homo sapien
tcttaaatattttctagtttcagatraaagtgtttgatcactgagtattt

SEQ ID NO: 47885 - DNA, 50 bp, homo sapien
tttatagtgagaaagactacaagtamatgaggtacagagtaattaaagca

SEQ ID NO: 47886 - DNA, 50 bp, homo sapien
cgaactcatcccaatagtatttctcygaagggacactggtaagcttgtcc

SEQ ID NO: 47887 - DNA, 50 bp, homo sapien
caattaaccaaactttaagtagataygtctcataaaatgtcagtcagggt

SEQ ID NO: 47888 - DNA, 50 bp, homo sapien
aattcattttactttacacagggaaygactgactgtttacagattcatag

SEQ ID NO: 47889 - DNA, 50 bp, homo sapien
accgtttcattacaacttagcactawcagtgtgaaaatggattcgtgggc

SEQ ID NO: 47890 - DNA, 50 bp, homo sapien
actaacctagtgttgggtaaataacwctgaatttccttgatttaaaatcc

SEQ ID NO: 47891 - DNA, 50 bp, homo sapien
ggggaaaaataagaaaaccgtaacaygtagaggcaatacttcccagagca

SEQ ID NO: 47892 - DNA, 50 bp, homo sapien
aggtagataccatcttgttctcttarattttcatttcatttctcaggttt

SEQ ID NO: 47893 - DNA, 50 bp, homo sapien
tgtgctaaactcagtctctacccacragtggatttgtaactggttaatct

SEQ ID NO: 47894 - DNA, 50 bp, homo sapien
gacagaacatttcttcaagtggataytaggtcccaggcatatgaaaagtg

SEQ ID NO: 47895 - DNA, 50 bp, homo sapien
ggatcatatgctaatccttaaaaatracattgtaggaagaggaatctatt

SEQ ID NO: 47896 - DNA, 50 bp, homo sapien
tttaagctcaaatcttaacaatgccygacagaaggtcaaatctttatcaa

SEQ ID NO: 47897 - DNA, 50 bp, homo sapien
tcctcccttttaaactcacatttaargcattcagtgcacgttgaattaat

SEQ ID NO: 47898 - DNA, 50 bp, homo sapien
aaatactttgatcttgtgtttcccaygtctttatctttccttgtgtgtac

SEQ ID NO: 47899 - DNA, 50 bp, homo sapien
actggcctcgggtgctctatcgaaasggttcatatttctcctcgctctaa

SEQ ID NO: 47900 - DNA, 50 bp, homo sapien
catggaaagtcagatgcaagaaatakctgaaagtacacacaaaaaattag

SEQ ID NO: 47901 - DNA, 50 bp, homo sapien
tatagtaggtctttaataaatactasatgaatgaatcaacacataacaga

SEQ ID NO: 47902 - DNA, 50 bp, homo sapien
ctcttacatgatcaagtctttatcayggaacctgtcagcgttaacatcta

SEQ ID NO: 47903 - DNA, 50 bp, homo sapien
ctgagaggcactggaatttattctgyaggcaaaagagttaggagaacata

SEQ ID NO: 47904 - DNA, 50 bp, homo sapien
actaattccagcacaaacataacaartgtcctgatgacaggagtggctta

SEQ ID NO: 47905 - DNA, 50 bp, homo sapien
tttaatcaaggctcagaaatggaagractcgtgtacaactacattgaaga

SEQ ID NO: 47906 - DNA, 50 bp, homo sapien
gcaggcactaaatggctgaatgtccyatcagtggactccgtgaagacccc

SEQ ID NO: 47907 - DNA, 50 bp, homo sapien
attagtgtgccttctcacccaattcraccaaataggttctgataattatc

SEQ ID NO: 47908 - DNA, 50 bp, homo sapien
ctgaatgcagctcctttttaactcartattacctgtggttttctcatggt

SEQ ID NO: 47909 - DNA, 50 bp, homo sapien
catcatattgaagaaaaatgatttcragctcaatgtaaagaatatattaa

SEQ ID NO: 47910 - DNA, 50 bp, homo sapien
aagaggtggaaatgcccatgtcatarccttctcaggagctctagttcaca

SEQ ID NO: 47911 - DNA, 50 bp, homo sapien
tgtggtgtgggtctgactgtcttcaygtggcactgcagaaagggaggccc

SEQ ID NO: 47912 - DNA, 50 bp, homo sapien
tctggaagaaagaggatccaatagayaagagaccagataaacatgaaccc

SEQ ID NO: 47913 - DNA, 50 bp, homo sapien
tgtaagtgtaaattttttgccatacrcttaacagttcaaactgcttctgc

SEQ ID NO: 47914 - DNA, 50 bp, homo sapien
ctaatggtcatgttctcaatacccargtaaaagagtggctgaatttgtgt

SEQ ID NO: 47915 - DNA, 50 bp, homo sapien
ggtgtaactctgtccctttttattaygaagatcaactgagaaaacaacct

SEQ ID NO: 47916 - DNA, 50 bp, homo sapien
gaaagcactagatagatttatcagcrcaaaacagaggagaataaagtata

SEQ ID NO: 47917 - DNA, 50 bp, homo sapien
gtacagatgaaccacactgcaataaygtgatcccagggttctaggctaat

SEQ ID NO: 47918 - DNA, 50 bp, homo sapien
gggtaggatcatgactaactcaacargatgttaagagaatttgagaagca

SEQ ID NO: 47919 - DNA, 50 bp, homo sapien
agtaatgtttgaggcatattgaacaygtattagaatgaatttacataaac

SEQ ID NO: 47920 - DNA, 50 bp, homo sapien
tgaaatataaagagagttcaggatarctttaaaaatctaagagagggaaa

SEQ ID NO: 47921 - DNA, 50 bp, homo sapien
agaagtgctccttcacagtgggacayactaaccctctcctgcataggtgt

SEQ ID NO: 47922 - DNA, 50 bp, homo sapien
gatataagtttgtgggaggcacttamccttcatgctatgatatcactatg

SEQ ID NO: 47923 - DNA, 50 bp, homo sapien
catgtggaagcttcactatcacaaargtggccttgaactgggggttaagg

SEQ ID NO: 47924 - DNA, 50 bp, homo sapien
ataaataccattcaactgtgatttcraggtgtaataaaaacattccattg

SEQ ID NO: 47925 - DNA, 50 bp, homo sapien
aagttggagacaggcatcgagggcaygaactactgcacaacctgggccct

SEQ ID NO: 47926 - DNA, 50 bp, homo sapien
tttttagcatactaatgcatcataaytagcgtacaatgagcagcgaggat

SEQ ID NO: 47927 - DNA, 50 bp, homo sapien
ccaggaaggacacctgcaattaacayctatttaaaaagcgaaacaacact

SEQ ID NO: 47928 - DNA, 50 bp, homo sapien
tcctgtagtaatggtcacatacttaygcttttatgaaaaggttattaaat

SEQ ID NO: 47929 - DNA, 50 bp, homo sapien
ctatacccagtctaccaaatgataartcaaactaagtcacaaatggggaa

SEQ ID NO: 47930 - DNA, 50 bp, homo sapien
taaaggaattcagtttcactgttgaygtaagagctaagataacaaatgac

SEQ ID NO: 47931 - DNA, 50 bp, homo sapien
tgacatttttaaatggatgctttaaraggaaaataggcagtagaaattgt

SEQ ID NO: 47932 - DNA, 50 bp, homo sapien
gtcctgttgagcacagcagtcaatarctactccttggttacaccacctac

SEQ ID NO: 47933 - DNA, 50 bp, homo sapien
cccgtacaaatccatgctgtgaactragctctatgcagtttaccacacac

SEQ ID NO: 47934 - DNA, 50 bp, homo sapien
ctattgactgctgtgctcaacaggayggcataaacactcaggtacttttt

SEQ ID NO: 47935 - DNA, 50 bp, homo sapien
cattaccctgttcctggacagaagargacttaccagcttccaaagcggcc

SEQ ID NO: 47936 - DNA, 50 bp, homo sapien
tgcttaataaccttcctaacattcgrcattatttctactttctagccaga

SEQ ID NO: 47937 - DNA, 50 bp, homo sapien
tgagatgaagaagttcctcaagtgartatgttcaatgccaacagttcctg

SEQ ID NO: 47938 - DNA, 50 bp, homo sapien
tgttctttttgtcatctttgctaatmagtttgatatttttaatggaatac

SEQ ID NO: 47939 - DNA, 50 bp, homo sapien
ttgacaaatgcatacacctgtgtaaygcaaatccctgtcaagatatagaa

SEQ ID NO: 47940 - DNA, 50 bp, homo sapien
agaactgcatatgagtggactcatamaatgtgtactcggcatgtaaagct

SEQ ID NO: 47941 - DNA, 50 bp, homo sapien
gagaggctggcattcttcactctacraatacttagggcactgactatgtg

SEQ ID NO: 47942 - DNA, 50 bp, homo sapien
gtaatgtgcacgtgtaatgttttctkaaatcatcaacatcacaacaggga

SEQ ID NO: 47943 - DNA, 50 bp, homo sapien
ctgctaaacacatgcataaagttcckaatttcagctattctatttttcag

SEQ ID NO: 47944 - DNA, 50 bp, homo sapien
aaatacccaaagtgtccatattagcyatctagtcagttcatatggccaca

SEQ ID NO: 47945 - DNA, 50 bp, homo sapien
agagggacacaatggaatgatccacygtatgtaattggagttccagagaa

SEQ ID NO: 47946 - DNA, 50 bp, homo sapien
gttcttcccagtgatttcagggaagragactcggcttatagctcaatgtt

SEQ ID NO: 47947 - DNA, 50 bp, homo sapien
attatttcatatgcaggttgtttcaygtgcctagtgtttataaacgttaa

SEQ ID NO: 47948 - DNA, 50 bp, homo sapien
gagttcttcttcattaagaatactcrgaaaaccatttttaaaacacacaa

SEQ ID NO: 47949 - DNA, 50 bp, homo sapien
gtcagagaatgtttcctattgacttyaaatatgttcctctaaacatctta

SEQ ID NO: 47950 - DNA, 50 bp, homo sapien
catagaagaaggtaaatggaaactaygcttgtacctctgtgaataccagt

SEQ ID NO: 47951 - DNA, 50 bp, homo sapien
gacataatcaacctgtactaagagargccaggagagtatctatgggcctg

SEQ ID NO: 47952 - DNA, 50 bp, homo sapien
cccaagtgtcatgttactcagattaygtccttttcaagttttccagccag

SEQ ID NO: 47953 - DNA, 50 bp, homo sapien
aaaatggacattcatgtgagcataastgtaaatagtagccaactcttctt

SEQ ID NO: 47954 - DNA, 50 bp, homo sapien
agcttgaccttttcctaaattgttaycacagtgctggaggatatgcttct

SEQ ID NO: 47955 - DNA, 50 bp, homo sapien
acaagtatattcttgcacatctccawcgaagctcttgagtgaccaggcac

SEQ ID NO: 47956 - DNA, 50 bp, homo sapien
ttacagataaggaaactgatgttaaragaggttagcagactgaatcaaag

SEQ ID NO: 47957 - DNA, 50 bp, homo sapien
tactcccactttgtcagtgaaactamaaccctctgcttctcacatggctt

SEQ ID NO: 47958 - DNA, 50 bp, homo sapien
cttggtggtcttcaggtggattcccrgaagctcaagccttcctgagggac

SEQ ID NO: 47959 - DNA, 50 bp, homo sapien
tctaaagagagaatggttatttttcraagggaagaatatcatttccagtg

SEQ ID NO: 47960 - DNA, 50 bp, homo sapien
aagtataaggcaggcattttccttarcaagtgatacctcattaagatcca

SEQ ID NO: 47961 - DNA, 50 bp, homo sapien
aggaaagtagacacatataatctgakaataatttattcctaggctatagg

SEQ ID NO: 47962 - DNA, 50 bp, homo sapien
actgatcttcttttcagcaggatccrctaagaaaaaattctgtgttcctt

SEQ ID NO: 47963 - DNA, 50 bp, homo sapien
tttgaataccactcctgtatacttayctcagcttatttttcatttattat

SEQ ID NO: 47964 - DNA, 50 bp, homo sapien
agacgtgattgccagtttaagccaartaactatggtaaggccaacctcac

SEQ ID NO: 47965 - DNA, 50 bp, homo sapien
ataacttagaccttaagaatattccrctgttaacttgcctgaaaacaaga

SEQ ID NO: 47966 - DNA, 50 bp, homo sapien
tgggaacggagtcacacgaaaaccaycttccttctgttcccaaacacagg

SEQ ID NO: 47967 - DNA, 50 bp, homo sapien
aagaaagtttagaactaccctttaasaaaatagacacatatgaaacaatt

SEQ ID NO: 47968 - DNA, 50 bp, homo sapien
tggtcttttcattgaatcctaagagwactggcattcagaagtagtagtaa

SEQ ID NO: 47969 - DNA, 50 bp, homo sapien
atctgttttaaagtcttgctattagkagttacattaaaataagctgggat

SEQ ID NO: 47970 - DNA, 50 bp, homo sapien
tccctggagagtacagggaaaccaaytgttgtgcttagctcaagttaagt

SEQ ID NO: 47971 - DNA, 50 bp, homo sapien
ctatatttaccatacaatatgttcartctcttagctctatataagctgac

SEQ ID NO: 47972 - DNA, 50 bp, homo sapien
agcctgcttcataaaggcagaatgartagtgcaaataaattctgtaaaac

SEQ ID NO: 47973 - DNA, 50 bp, homo sapien
cccacctcataaaggagatgaaaacrcttgctacatgggctgcatgcgaa

SEQ ID NO: 47974 - DNA, 50 bp, homo sapien
aaacatgaataggaaacatctggaaygagaaagaatataactacaaatac

SEQ ID NO: 47975 - DNA, 50 bp, homo sapien
cattccccaagtctgtttgttcagayattaaagaaaagacaatgaaatca

SEQ ID NO: 47976 - DNA, 50 bp, homo sapien
aagataaattaatggaaattatccartataaatggcacagaggaaaaagc

SEQ ID NO: 47977 - DNA, 50 bp, homo sapien
gttcatcgccctcgtttttcaacctkaatggtaattacattccaaggact

SEQ ID NO: 47978 - DNA, 50 bp, homo sapien
gcctggcaccagtcaagtaagcaagwcttcccacagtgaggggacctgag

SEQ ID NO: 47979 - DNA, 50 bp, homo sapien
tcttaatcaaaaatggtggttgtatyagtgttctagggctggtgttccat

SEQ ID NO: 47980 - DNA, 50 bp, homo sapien
tatgaggaagtgttctgaggacagaraaacgggagaatggggaggagaag

SEQ ID NO: 47981 - DNA, 50 bp, homo sapien
tttaaaagtttctcacataatttgarcaaagagaaaagcaatctcaatag

SEQ ID NO: 47982 - DNA, 50 bp, homo sapien
cttttattttaaacattattgattaygcaaaaattcaaatatgattggag

SEQ ID NO: 47983 - DNA, 50 bp, homo sapien
taagtatgctttacagataagtgagycatagggaggttacctgaacccaa

SEQ ID NO: 47984 - DNA, 50 bp, homo sapien
gccaggcaaacacgggttctgtactyagatttaatgagaaactgacatgt

SEQ ID NO: 47985 - DNA, 50 bp, homo sapien
gtgcaatgttgaggataaagtgaatwaaagtcgatgtggatgctttcttt

SEQ ID NO: 47986 - DNA, 50 bp, homo sapien
tgctgatggagaagcaaatgttgtakgtataatgtcacatgtatcatgta

SEQ ID NO: 47987 - DNA, 50 bp, homo sapien
atattaattaggatttgatacaaaayttatgaatccaaattacacataat

SEQ ID NO: 47988 - DNA, 50 bp, homo sapien
taattcatgtctgactttgtaatcarccctattcataagaactggcttat

SEQ ID NO: 47989 - DNA, 50 bp, homo sapien
acaagaagtatacatgacaattttarggatgactatcacccaagccattt

SEQ ID NO: 47990 - DNA, 50 bp, homo sapien
gcattgattcttgggctatatccacrgagaacctaacaagcttccccaag

SEQ ID NO: 47991 - DNA, 50 bp, homo sapien
gcatataccctagtggcagcaacgaycctgtgtactcctccacccacgtg

SEQ ID NO: 47992 - DNA, 50 bp, homo sapien
ttccaagttttttttccaattccaaygtggcctgatttcaagttccccca

SEQ ID NO: 47993 - DNA, 50 bp, homo sapien
cagactgcacctgacatacagcaaawaagtttttcattaatggttaacct

SEQ ID NO: 47994 - DNA, 50 bp, homo sapien
atgaggaaagactgtaaggaaatgaraaggtaggcgtcttttaaaaggca

SEQ ID NO: 47995 - DNA, 50 bp, homo sapien
agctggtctgcagactgagagatgaygttaagattggtaaaaagcaaggc

SEQ ID NO: 47996 - DNA, 50 bp, homo sapien
atgattatagctaatataataaaagrctgaggtttttggcatctctttga

SEQ ID NO: 47997 - DNA, 50 bp, homo sapien
caaagaaatggtgctgaaaagaacamctttacctgtaataagcctgcctg

SEQ ID NO: 47998 - DNA, 50 bp, homo sapien
atgagacagaggctttccgtaaacayggctcattctcagagcacttcagg

SEQ ID NO: 47999 - DNA, 50 bp, homo sapien
ctgctcatttcaatgatggttttatyagaaaggcaattctgaacaacact

SEQ ID NO: 48000 - DNA, 50 bp, homo sapien
ctggggagaggaattaatgacttgarcagcactcacgggtcttaaactta

SEQ ID NO: 48001 - DNA, 50 bp, homo sapien
aaggaatttatatgttcatgattccmagatttattttgccaggttcaaac

SEQ ID NO: 48002 - DNA, 50 bp, homo sapien
aagtgtttttgttgttgtagagaacrcgccctgaacaaaactcctgattt

SEQ ID NO: 48003 - DNA, 50 bp, homo sapien
taaagagtaaactagttaatgcatgyaaagtcctttgagagttacctggc

SEQ ID NO: 48004 - DNA, 50 bp, homo sapien
ttaagaatgtcagaacactgatgacmacatacctgacttcttaatatagt

SEQ ID NO: 48005 - DNA, 50 bp, homo sapien
actggactttaaattttaaaaataaygtgagagctgctagaaaaattatg

SEQ ID NO: 48006 - DNA, 50 bp, homo sapien; identical to SEQ ID NO: 48005

SEQ ID NO: 48007 - DNA, 50 bp, homo sapien
gggcattcacactttttattgcacargagacactgatggatgagagcctg

SEQ ID NO: 48008 - DNA, 50 bp, homo sapien
aatgaaacaaatgaagaaaattaccyatatgttgagttcatacaattttt

SEQ ID NO: 48009 - DNA, 50 bp, homo sapien
attgaatcttctccttctatgattaycagctgcagggccttggaaatgtt

SEQ ID NO: 48010 - DNA, 50 bp, homo sapien
tccttgcttattcttgtagtccttaygctgaaaatgcacatatctcagtg

SEQ ID NO: 48011 - DNA, 50 bp, homo sapien
atagaggaaaacttcactgaaaccamgagaatagatagtgcatacaagat

SEQ ID NO: 48012 - DNA, 50 bp, homo sapien
gtttgaggaagactacaaatcaacayacgctgatgacaacgctgaacttc

SEQ ID NO: 48013 - DNA, 50 bp, homo sapien
agatccccaagtggcaaactcataartgtctttcattattagtgccaatt

SEQ ID NO: 48014 - DNA, 50 bp, homo sapien
ctagccttctgctctgctaagataawactgtctcaggaggaaagcttcct

SEQ ID NO: 48015 - DNA, 50 bp, homo sapien
tatagaagtatggtcaaaacttacckattatagccattttttcatctaaa

SEQ ID NO: 48016 - DNA, 50 bp, homo sapien
cctttatagggacgatcctaatgtcrgaagttacccatgaagagaacaca

SEQ ID NO: 48017 - DNA, 50 bp, homo sapien
caatcacatctgaactcagtctcacyatataaaagaggccttgttagagt

SEQ ID NO: 48018 - DNA, 50 bp, homo sapien
cctgccaaacctcctgtaaatagaartctcagaatatttctgcctatttc

SEQ ID NO: 48019 - DNA, 50 bp, homo sapien
tctggggtgcaatttgagatctacayaatgtgcagtgaaacaggttgttg

SEQ ID NO: 48020 - DNA, 50 bp, homo sapien
tagctattgtttgtgtaaaaacttaragatcctactgcttattggaaact

SEQ ID NO: 48021 - DNA, 50 bp, homo sapien
gctcttctcatccttcatcctctatraactctcccctaacttgggtagct

SEQ ID NO: 48022 - DNA, 50 bp, homo sapien
ggtagccaacactgcaattcctgtaracactgccaccgaatgcaccaggg

SEQ ID NO: 48023 - DNA, 50 bp, homo sapien
gagtattcaatgctcggaagcacaayataccttttgtaggcatcactttg

SEQ ID NO: 48024 - DNA, 50 bp, homo sapien
ataggacttcgccctttgtctaaagscattggaagtatccttgggagaag

SEQ ID NO: 48025 - DNA, 50 bp, homo sapien
aacctgatggagtggatgaatagacrgaaatgtgatagggcatatataga

SEQ ID NO: 48026 - DNA, 50 bp, homo sapien
atatgggagtaactcagacttattaygtattcagtttacatgctgcataa

SEQ ID NO: 48027 - DNA, 50 bp, homo sapien
tctgaacttggacctttttggtcacratgaattatttattcaattaagtg

SEQ ID NO: 48028 - DNA, 50 bp, homo sapien
taggtcaggatgattatttttgaaaygtataccaatcaatgtattggaat

SEQ ID NO: 48029 - DNA, 50 bp, homo sapien
aaccctactgctcatagcaataaaaraacctggtgaaatatgtgtgaatc

SEQ ID NO: 48030 - DNA, 50 bp, homo sapien
tttcatagaaaagcatccttttgaawgtatgttcctggcgcaactggcaa

SEQ ID NO: 48031 - DNA, 50 bp, homo sapien
tccaagaaatgtttggttcaccacartcttaagtaggtgcagtacccttt

SEQ ID NO: 48032 - DNA, 50 bp, homo sapien
agtgtggtagtgaagggatgccctasagccacgtttctaccaggcaaatg

SEQ ID NO: 48033 - DNA, 50 bp, homo sapien
ttttaaaatttgagaaagtccagagraatctttaaagttggactagttaa

SEQ ID NO: 48034 - DNA, 50 bp, homo sapien
acaaactagaataaaaaactttatartacataggtacatcaggtcagatc

SEQ ID NO: 48035 - DNA, 50 bp, homo sapien
tcagggagcagtttctgtgttttaamggaatagcctgctgtggttttgaa

SEQ ID NO: 48036 - DNA, 50 bp, homo sapien
aaaaactaatttttattaactgtgartattaatgctatggtcaaacttta

SEQ ID NO: 48037 - DNA, 50 bp, homo sapien
aattatcttttaaaactcttatcccyaaatgctcagacagactgatttga

SEQ ID NO: 48038 - DNA, 50 bp, homo sapien
aataatggaagacagcaacaaacgaygaaaattgctttgaagctccatga

SEQ ID NO: 48039 - DNA, 50 bp, homo sapien
ccaggctggttgtctcatcttaatayggtcataacaatccctgctctcca

SEQ ID NO: 48040 - DNA, 50 bp, homo sapien
tcctattgtttgtattttgataatcycacaagctcactacaaactttcac

SEQ ID NO: 48041 - DNA, 50 bp, homo sapien
agacttaaacaattgagacccatgcyatgtagtgaaacaaaaattggtaa

SEQ ID NO: 48042 - DNA, 50 bp, homo sapien
aacacaatgtcaataggctttaagayggatgtgttgaaaaaataagatga

SEQ ID NO: 48043 - DNA, 50 bp, homo sapien
gatcaaccaaccaaaggaattatctraaatagttgagaacttaacttgcc

SEQ ID NO: 48044 - DNA, 50 bp, homo sapien
actattataagatttttataacctcrcaggccatagccttttcaggggca

SEQ ID NO: 48045 - DNA, 50 bp, homo sapien
ccgatactccaatccctatgtagcaycattttattaagccaataaagtgc

SEQ ID NO: 48046 - DNA, 50 bp, homo sapien
ctgtgctatcttagtttctaggtcaygttaatctggaactaccttacaag

SEQ ID NO: 48047 - DNA, 50 bp, homo sapien
aagtcaaacttagggacatacattcrataaaaccaatacttagtcacagg

SEQ ID NO: 48048 - DNA, 50 bp, homo sapien
gctttcaaatactcctaaggctccayagtgaaagaaagagcggtctatcc

SEQ ID NO: 48049 - DNA, 50 bp, homo sapien
tccaaatgaaggcattctcattataracattttgcctatttttttgaaaa

SEQ ID NO: 48050 - DNA, 50 bp, homo sapien
ggtattgctttctcagtgcctatgasgctttatcagtgagactagcactg

SEQ ID NO: 48051 - DNA, 50 bp, homo sapien
ttaagaatgtgcttgatcaagctgamcttaataatggaagaacagatcta

SEQ ID NO: 48052 - DNA, 50 bp, homo sapien
gcaagcagcagcttaagcaagttgamgggctatttctcatctcaggtcag

SEQ ID NO: 48053 - DNA, 50 bp, homo sapien
gcactcagcctcactgggtggcaagmcttatggattatttacaggcacat

SEQ ID NO: 48054 - DNA, 50 bp, homo sapien
aaaaacaggctagaaacaaacttacygccaatactgggagaagacattat

SEQ ID NO: 48055 - DNA, 50 bp, homo sapien
tgccaacttcagatggatgagaacaygtaagctgccaaacaacatcaaga

SEQ ID NO: 48056 - DNA, 50 bp, homo sapien
aaaggaaaatacataataagcaaagrctgtttagaaaattgaattaaatc

SEQ ID NO: 48057 - DNA, 50 bp, homo sapien
cactagcaatccagttgattacttaycttatagcttatgaattgaaacca

SEQ ID NO: 48058 - DNA, 50 bp, homo sapien
aagcaaatatagataccaccatatamaggagtgaatggtagcaccacatg

SEQ ID NO: 48059 - DNA, 50 bp, homo sapien
tcattctttctcatattcaactttcscgtatcgacttacaattatgatca

SEQ ID NO: 48060 - DNA, 50 bp, homo sapien
ttgttgtgttgtgtttttaaagaaaygagaacatactgtacaaaatgttc

SEQ ID NO: 48061 - DNA, 50 bp, homo sapien
aaaaaaaaaggattgaatcattggargaaatatggaaataaaggaaaaag

SEQ ID NO: 48062 - DNA, 50 bp, homo sapien
caagaaaagacagaggcgaacgacaygtatcagcattcttgggatcatac

SEQ ID NO: 48063 - DNA, 50 bp, homo sapien
tctacctttggccttccaggacaaamtatcacatacataatttttaatag

SEQ ID NO: 48064 - DNA, 50 bp, homo sapien
aacactgactgtccagacgtttaacyacatgaggtagatacaagtctccc

SEQ ID NO: 48065 - DNA, 50 bp, homo sapien
gacatgcatcagctatttattttcasaagaagacaagttttctcacctgt

SEQ ID NO: 48066 - DNA, 50 bp, homo sapien
agccaaatgaaataaataaatgtgcragttatcacagtccctagggtttt

SEQ ID NO: 48067 - DNA, 50 bp, homo sapien
tttataatgtaactattttctctgayataattacagtaagttcaaatact

SEQ ID NO: 48068 - DNA, 50 bp, homo sapien
aatgatacattcacacattcgcataygaaacaccactaagattcagctct

SEQ ID NO: 48069 - DNA, 50 bp, homo sapien
aaatctggcattagcttccttctaawtgatgataattagacaaactattt

SEQ ID NO: 48070 - DNA, 50 bp, homo sapien
agagtaaccatctttaacaattacayggatgccactttctccatgaaata

SEQ ID NO: 48071 - DNA, 50 bp, homo sapien
atggatcagcctctctgaagattgaytatatttttcttctgcttgggtga

SEQ ID NO: 48072 - DNA, 50 bp, homo sapien
ggccttggctaagtggtgctaaaaarcaatttccatctaaacacctggtt

SEQ ID NO: 48073 - DNA, 50 bp, homo sapien
gcactgttagttcatctattccttargttagtatttactgagtgccttct

SEQ ID NO: 48074 - DNA, 50 bp, homo sapien
ttgaagatattgactctttacagaaygtattgaggtattttgttcaggtg

SEQ ID NO: 48075 - DNA, 50 bp, homo sapien
gtgagtgtctctccttgcggtggcarcattaggagcacatggcctggcaa

SEQ ID NO: 48076 - DNA, 50 bp, homo sapien
taataaccaatatgtcattgtagccraggaacttttagcttttctttatc

SEQ ID NO: 48077 - DNA, 50 bp, homo sapien
agaataatatctcacctaaaacaaargctactatgctaaacatccccacc

SEQ ID NO: 48078 - DNA, 50 bp, homo sapien
taaattttgttttggaataataaacracaaaagcaaacaaacaaatccta

SEQ ID NO: 48079 - DNA, 50 bp, homo sapien
aattttgataagtagtccctgggaakaataagttagttttatatatagta

SEQ ID NO: 48080 - DNA, 50 bp, homo sapien
tagcatctaacatgatgcttaaatcmaacaggagcaaaattacaagtggg

SEQ ID NO: 48081 - DNA, 50 bp, homo sapien
ctctggtgcacaataaattttaagasatgattattagagagagtgattcc

SEQ ID NO: 48082 - DNA, 50 bp, homo sapien
gtcatataaacaggattttacaacastcccaagagctgtgtgatttaaaa

SEQ ID NO: 48083 - DNA, 50 bp, homo sapien
gaaggacatgctattagtgcaacagraaagagtggcagtagcgtgggctt

SEQ ID NO: 48084 - DNA, 50 bp, homo sapien
tttcacataacaaatgttcaactcaygtttattcaataaatagataagtt

SEQ ID NO: 48085 - DNA, 50 bp, homo sapien
tgggtaccataccaatattcttgaargcaccagtagttgaacacattgag

SEQ ID NO: 48086 - DNA, 50 bp, homo sapien
tgtagtttttgaaattgtggacttaygtaatttcttggaattagaaatgt

SEQ ID NO: 48087 - DNA, 50 bp, homo sapien
ctctccccatcttctgactccggaayacataaaccgttctaactcaaagg

SEQ ID NO: 48088 - DNA, 50 bp, homo sapien
accccagagggagtgcatttcccacraataaaagcaaattggatcacaaa

SEQ ID NO: 48089 - DNA, 50 bp, homo sapien
accctaatagtgctacgtaggcatasagagctcatggccagtgtaaggaa

SEQ ID NO: 48090 - DNA, 50 bp, homo sapien
gacaaaagataaaagagcaaatgtayggatagaaggtatgtgacattgta

SEQ ID NO: 48091 - DNA, 50 bp, homo sapien
aaataataaatacataagattactaygtgtcagatattattctaacaatt

SEQ ID NO: 48092 - DNA, 50 bp, homo sapien
taattgagctgggcacttctcaaaawaattcttttaactcccttattatc

SEQ ID NO: 48093 - DNA, 50 bp, homo sapien
gacacagtttagcagtctgggatgaygaatctgcctcctttagaacaacg

SEQ ID NO: 48094 - DNA, 50 bp, homo sapien
tttgtgtatgctacattgacattcarcgatgaaacatatgcttctggctt

SEQ ID NO: 48095 - DNA, 50 bp, homo sapien
ggagggcaacagaaattctgagaaayggtgaaacagccataaaaatgaag

SEQ ID NO: 48096 - DNA, 50 bp, homo sapien
aggtttgcagcttagttagggtcaawccctgcttctgattttcatgtgac

SEQ ID NO: 48097 - DNA, 50 bp, homo sapien
ggtggaaattttgattttgaagtcayagcttgttaatgtgctgggctggc

SEQ ID NO: 48098 - DNA, 50 bp, homo sapien
tacaacccgaatgtgtattgtacgakattaaaggactttccactacaatt

SEQ ID NO: 48099 - DNA, 50 bp, homo sapien
tggaaaaaatgtttaagagccaagawagtaaaggtgattttaactgattg

SEQ ID NO: 48100 - DNA, 50 bp, homo sapien
aattgtggaatccactgcagaggtcracaataccattttcatatgcaaaa

SEQ ID NO: 48101 - DNA, 50 bp, homo sapien
acactggtctgtagaggaagagtcaracaccaacagaaatgtgtgtgtgt

SEQ ID NO: 48102 - DNA, 50 bp, homo sapien
gagggcatgtagttaccgatgctacrgcagattttgtgaaaatagaagta

SEQ ID NO: 48103 - DNA, 50 bp, homo sapien
actcattttacataaatcttcactcmaagtcttgggtgtcagcctagtgg

SEQ ID NO: 48104 - DNA, 50 bp, homo sapien
tggggcttaaacaagcacattccaarttaagaaccaatgacctaagggaa

SEQ ID NO: 48105 - DNA, 50 bp, homo sapien
aaactaataaagttccagtaactgaygccaagaaataaaggtctacaaat

SEQ ID NO: 48106 - DNA, 50 bp, homo sapien
gaaagaataatgtctgtaagacaagrcaagaaactatgaaacacaacaag

SEQ ID NO: 48107 - DNA, 50 bp, homo sapien
aatagtcaagagactccagctttcaragcaactgactcaaagactgtatt

SEQ ID NO: 48108 - DNA, 50 bp, homo sapien
caagtatatccaatctgtgactaagrcactaatgagctcccaaataaaaa

SEQ ID NO: 48109 - DNA, 50 bp, homo sapien
ggaagccctgagcagtccctagcaaygattgactttacaaccccaaattt

SEQ ID NO: 48110 - DNA, 50 bp, homo sapien
tgccccaatggccacaggtgcatacwcaggatggttgggcagggaagctc

SEQ ID NO: 48111 - DNA, 50 bp, homo sapien
actggcaactttagtttgtaataggkcccgatacttaggtaacatgaaga

SEQ ID NO: 48112 - DNA, 50 bp, homo sapien
agatagatagatctgtaaatataatmacttctttcaatgctagagacatt

SEQ ID NO: 48113 - DNA, 50 bp, homo sapien
ccattctcctgtgattaaaaagctcycatggctagaaacttctttatggt

SEQ ID NO: 48114 - DNA, 50 bp, homo sapien
atcattatatcattccctgtttgtastaacaacttaactaaattattacg

SEQ ID NO: 48115 - DNA, 50 bp, homo sapien
atattttaccagaaagtagctagcaygaatatcaaaatcggtcatgtata

SEQ ID NO: 48116 - DNA, 50 bp, homo sapien
cacaagattgttctgtgtctgtacckaaataataaatgtgaataatatta

SEQ ID NO: 48117 - DNA, 50 bp, homo sapien
caaactcatcagtaatcaaggacacrcataatgaatagcctgcatcatcg

SEQ ID NO: 48118 - DNA, 50 bp, homo sapien
tttgcatgcaggtatcctggttttgyacttgtaaagctgattttatggca

SEQ ID NO: 48119 - DNA, 50 bp, homo sapien
tacaagggcatttaagctacagaaartaacaataagggaaggtaataaaa

SEQ ID NO: 48120 - DNA, 50 bp, homo sapien
atgctcattgcacgttgttatatgcwcatcacaaggtttttctaaacata

SEQ ID NO: 48121 - DNA, 50 bp, homo sapien
acagtttgctcagtcgtacaaaatargcccagaacatgccaacagcccac

SEQ ID NO: 48122 - DNA, 50 bp, homo sapien
cccccccatgtacctaccgcttttckatagcaaatctggatgttttgctg

SEQ ID NO: 48123 - DNA, 50 bp, homo sapien
tgagtgccagatttcagggttttcaygacagagtttctcaggaagtagtg

SEQ ID NO: 48124 - DNA, 50 bp, homo sapien
gtccccagtcacaacagtttttgacwcctgtgttgactcaatgaagtcaa

SEQ ID NO: 48125 - DNA, 50 bp, homo sapien
ggaaatgtaagaaagaagaaagtacsatactgcacgtgatcaaagtctcc

SEQ ID NO: 48126 - DNA, 50 bp, homo sapien
caaaatttaatgtcacagaaactaaragaaatatttatagcccttggaaa

SEQ ID NO: 48127 - DNA, 50 bp, homo sapien
tagtttggagcttcaaatataaaaayctgctgcctttttctcctgccata

SEQ ID NO: 48128 - DNA, 50 bp, homo sapien
agaatacaatgagaaatgagcactaygtctaaatcttagcctgcctttat

SEQ ID NO: 48129 - DNA, 50 bp, homo sapien
ctcaaccacttctgttcttgtgtatsacttacagccttaattttctgtgt

SEQ ID NO: 48130 - DNA, 50 bp, homo sapien
actattatttatgccttctattctaygccaatagtgcagttaatgggaat

SEQ ID NO: 48131 - DNA, 50 bp, homo sapien
aagcagaacagttctaatgctcaacsacttctgttcttgtgtatcactta

SEQ ID NO: 48132 - DNA, 50 bp, homo sapien
ttgtgatcaagtgtaagactgtgatsaagagaaaccttcaaaggaaacta

SEQ ID NO: 48133 - DNA, 50 bp, homo sapien
ttcatagatatgatcagacccagaaratagttatatattttaatagataa

SEQ ID NO: 48134 - DNA, 50 bp, homo sapien
gaggtcatgataaaggtcactactawtaaggactcaaaactgagaaaagg

SEQ ID NO: 48135 - DNA, 50 bp, homo sapien
ggttggagaagcagttctcttctcartatttctctgggcttaaagatatt

SEQ ID NO: 48136 - DNA, 50 bp, homo sapien
atgcagtcaaagcaattgatgaaaarctccttccaatgtgtataacaaaa

SEQ ID NO: 48137 - DNA, 50 bp, homo sapien
aacattaatacagtgtttagttttaraaagtgtctgtttatacaccatgt

SEQ ID NO: 48138 - DNA, 50 bp, homo sapien
tgcatggggttcttggaccacattcrctttggttgactgtttctatattt

SEQ ID NO: 48139 - DNA, 50 bp, homo sapien
tttttgtaggtattttagtaacacgmatctgttgaggtcctggagaggat

SEQ ID NO: 48140 - DNA, 50 bp, homo sapien
taacaaaaaagggaaatatcgaaagraagagagaaatcatggaagaggta

SEQ ID NO: 48141 - DNA, 50 bp, homo sapien
actgaaagaaaacagagcagaatggmaatagcgtcatggtcatattttga

SEQ ID NO: 48142 - DNA, 50 bp, homo sapien
gtgaatattgtttcaatttcctttcragctacttattttctaatccagtg

SEQ ID NO: 48143 - DNA, 50 bp, homo sapien
agatgcatgtggcagtttaaaaagartaggccttctgcacaagtctaaag

SEQ ID NO: 48144 - DNA, 50 bp, homo sapien
atgctttgcaaatgcacagtttgtargcaaggacaggttgtaaaatgagg

SEQ ID NO: 48145 - DNA, 50 bp, homo sapien
atttggtgagccaattctcccgacasaaaggaagccaagggcaggggaaa

SEQ ID NO: 48146 - DNA, 50 bp, homo sapien
gagaaaatattttaatgcagcaagakaaaaataatttaccacatacaagg

SEQ ID NO: 48147 - DNA, 50 bp, homo sapien
ttatgagtgtatgtatgtatttaggwatgtatgtattttatctggcgcag

SEQ ID NO: 48148 - DNA, 50 bp, homo sapien
acaaggataagtatcatgcaaatatmagacagaatcagaaaacaggagtg

SEQ ID NO: 48149 - DNA, 50 bp, homo sapien
gtgtgaatgtgatatgacaagaagarcactcaacttctgtgattgtcttt

SEQ ID NO: 48150 - DNA, 50 bp, homo sapien
aattaagggacttgctcccagtcackcagctggtaaaggttcacagatct

SEQ ID NO: 48151 - DNA, 50 bp, homo sapien
aatcaacatataatgggttagaaacmaaaattaatgcttgtcttccaaat

SEQ ID NO: 48152 - DNA, 50 bp, homo sapien
tgtaattatacaatttccactattcratgttttgtataaaaccagttaca

SEQ ID NO: 48153 - DNA, 50 bp, homo sapien
tactaggtactgcaatacacagttamatgcaaggttaggcactgtcaggg

SEQ ID NO: 48154 - DNA, 50 bp, homo sapien
tgtgtattgcagtacctagtagtcartaaatccatgttgaatgaatgaat

SEQ ID NO: 48155 - DNA, 50 bp, homo sapien
tattaatacaacacgctttcaattaracaccaaagtattatcattttaca

SEQ ID NO: 48156 - DNA, 50 bp, homo sapien
agtaaatgtatgcagagtctccaaaycttttaaatgtggtcagagtatat

SEQ ID NO: 48157 - DNA, 50 bp, homo sapien
acttacctaggggctgagctgggaaracattaaaataacacacacagaaa

SEQ ID NO: 48158 - DNA, 50 bp, homo sapien
tcttcagcatcaacattagacaaaasaagaagttgagctgaaataaaatc

SEQ ID NO: 48159 - DNA, 50 bp, homo sapien
tctctagggaagccagtccttgaacygataatagtgggtttctctcagac

SEQ ID NO: 48160 - DNA, 50 bp, homo sapien
tgtggtttttgttaagatggaatackgatatttcactttatctttcctac

SEQ ID NO: 48161 - DNA, 50 bp, homo sapien
aaactgcaatgtctagaatatggaasagtggtgtggtttttgttaagatg

SEQ ID NO: 48162 - DNA, 50 bp, homo sapien
gagaattaagcaacaacacagtgaamctaggccaaatcaatcttacaaac

SEQ ID NO: 48163 - DNA, 50 bp, homo sapien
tacacacactttttaaaaatattagycattatgtagtgaatgagtagcga

SEQ ID NO: 48164 - DNA, 50 bp, homo sapien
ttttctaaatctgagatctggaataycaaccactacttagaaatgtggtg

SEQ ID NO: 48165 - DNA, 50 bp, homo sapien
tgagaatgggccaggagagttgagasgccaatagaaacttgaacagcttt

SEQ ID NO: 48166 - DNA, 50 bp, homo sapien
caactaatggccagggaatttgatayggaagattttatttacctattttg

SEQ ID NO: 48167 - DNA, 50 bp, homo sapien
ttggcaacacaaaaccttgccattaygcaggccgtgtttatttctagggt

SEQ ID NO: 48168 - DNA, 50 bp, homo sapien
tttagaagcagtgaggtgttctctawctatctttagtttatctgatatcc

SEQ ID NO: 48169 - DNA, 50 bp, homo sapien
tatcataccatatttgtatcaaatgrcacccaactcaacaaatatttgta

SEQ ID NO: 48170 - DNA, 50 bp, homo sapien
taaccacttttttcattgatacttargaaagcatccatctcaatttgttc

SEQ ID NO: 48171 - DNA, 50 bp, homo sapien
gagctcagttcattagcaccagcagratttttgaactgtctctgtagaac

SEQ ID NO: 48172 - DNA, 50 bp, homo sapien
ttgctagtaagagagttcttacttayggaatgttttcaaaggtatgtcct

SEQ ID NO: 48173 - DNA, 50 bp, homo sapien
gaggtagaccagctgacagaataaaygccatagggatgcttgtaagaact

SEQ ID NO: 48174 - DNA, 50 bp, homo sapien
atattttatttattctcaaaagatargttagctagttcctttactcattt

SEQ ID NO: 48175 - DNA, 50 bp, homo sapien
atattgagagtgtgtgaaattacacmaaggatcacgttgccaaattggat

SEQ ID NO: 48176 - DNA, 50 bp, homo sapien
atttgtgtgccaacattacagaatarggaagacaggagagatgaagtcca

SEQ ID NO: 48177 - DNA, 50 bp, homo sapien
gctttacctacaaaagctgaacgtaygcaagtcccatgaccctatcattc

SEQ ID NO: 48178 - DNA, 50 bp, homo sapien
cttcactatttctgttataaaaatamaataattgctagagtaacataact

SEQ ID NO: 48179 - DNA, 50 bp, homo sapien
agaaaattaaacaaacaactacaacycatacaagcaagaaacatacacac

SEQ ID NO: 48180 - DNA, 50 bp, homo sapien
agccctgcatgtggcccttctcccartcttaatctgcatgcaccaggttt

SEQ ID NO: 48181 - DNA, 50 bp, homo sapien
atgctgagaaaggaactgcctttacyatcaaagataatagcaaagagaat

SEQ ID NO: 48182 - DNA, 50 bp, homo sapien
cactgctgtgctagggcttgactatyacagtatcctagtgataacagagg

SEQ ID NO: 48183 - DNA, 50 bp, homo sapien
gataatcaggcaaacacatttacatractgacctatctgagaagtgctct

SEQ ID NO: 48184 - DNA, 50 bp, homo sapien
atattatatataattgaagccccaamataagtggagataatactgggaag

SEQ ID NO: 48185 - DNA, 50 bp, homo sapien
tctccttgttcttcttcattttcacrcatttggtctttttttgaaaatgt

SEQ ID NO: 48186 - DNA, 50 bp, homo sapien
atagttatttttagtcaatatattawgataacattccataagttccctgt

SEQ ID NO: 48187 - DNA, 50 bp, homo sapien
tagatacagtttgagcaaaaaaggaytaaaaagtagagaaaagaacatgg

SEQ ID NO: 48188 - DNA, 50 bp, homo sapien
atgcagccctcatctttgcaaataamgttttaaaatacggccttctgtag

SEQ ID NO: 48189 - DNA, 50 bp, homo sapien
cctggccgatccttgaacttgctgcraactttatggagattggtgattgc

SEQ ID NO: 48190 - DNA, 50 bp, homo sapien
gtttatttttcattcacattagataktataacacagtcacatgaaataaa

SEQ ID NO: 48191 - DNA, 50 bp, homo sapien
tgaggccaacacactaatacactaayacaaatttttgtttctgcagtctt

SEQ ID NO: 48192 - DNA, 50 bp, homo sapien
ttgttagaattaccttctctgtgcakataacaaactgatgcttggtacat

SEQ ID NO: 48193 - DNA, 50 bp, homo sapien
aaatagaaactatcttgactgctacraaaatctatacaagattgtttatt

SEQ ID NO: 48194 - DNA, 50 bp, homo sapien
aatcctttattaaaattaaatgacaytgccaaaatagaagaataattaaa

SEQ ID NO: 48195 - DNA, 50 bp, homo sapien
agtgatgtcttaccattgtggaatartaaccctggtctgctatgtgggtt

SEQ ID NO: 48196 - DNA, 50 bp, homo sapien
accatcttagctcttctaagggcacmaatttaagattaaattcaccaaag

SEQ ID NO: 48197 - DNA, 50 bp, homo sapien
tggaatcccaatgaggtttccaggtracaatactttaatatagcaagaga

SEQ ID NO: 48198 - DNA, 50 bp, homo sapien
aacagatatgcaagaacttaatatamgaaaatggtgacattcaaaatctc

SEQ ID NO: 48199 - DNA, 50 bp, homo sapien
ctagatattcagagttaagataaaakagttaagagttaagataatataaa

SEQ ID NO: 48200 - DNA, 50 bp, homo sapien
aaaaactttgttagctaactgtcacygaggagatgattatacagtattac

SEQ ID NO: 48201 - DNA, 50 bp, homo sapien
aagtgctgctacttttgaacataccrggtactgtagactgacttacacaa

SEQ ID NO: 48202 - DNA, 50 bp, homo sapien
gctccttacaagggtgtgatttggamagggaaaagtcaaaagttcatata

SEQ ID NO: 48203 - DNA, 50 bp, homo sapien
tgaagcccaccaactttggatccacygcactgggagacttgttaccctct

SEQ ID NO: 48204 - DNA, 50 bp, homo sapien
cctgtggacccattactctacatgaygggccaatgaacttagctttaggg

SEQ ID NO: 48205 - DNA, 50 bp, homo sapien
caggatctgctggggtggaaaattcrgaataagtcttttagagccttgtg

SEQ ID NO: 48206 - DNA, 50 bp, homo sapien
ttgattaaatatatagtttacaacartagagtcattttaaggtataggag

SEQ ID NO: 48207 - DNA, 50 bp, homo sapien
gaagaccaagaacctggaagagatcrcagggagtccagaaacgcctgtca

SEQ ID NO: 48208 - DNA, 50 bp, homo sapien
tttgtagcaatatagctgaggttcaytaaaagggaataagactgggcatg

SEQ ID NO: 48209 - DNA, 50 bp, homo sapien
cttggaaaactgatgtaggcatagawgataaagtcttgtttgttatgttt

SEQ ID NO: 48210 - DNA, 50 bp, homo sapien
actcaatatttcctcttaaagcctcyaatgggtaaaatgagtttctgcca

SEQ ID NO: 48211 - DNA, 50 bp, homo sapien
tgtggaaataagaaattaacaacaamatatgcacaaaatatctttgtggc

SEQ ID NO: 48212 - DNA, 50 bp, homo sapien
tctcttgttctatcatctcaaactcmatagcaagttgtattgatttggtt

SEQ ID NO: 48213 - DNA, 50 bp, homo sapien
agcttattacaactgtatacaatgaygtgtgggaaagattatggtatatt

SEQ ID NO: 48214 - DNA, 50 bp, homo sapien
tgccaagggcacgatagaaacattaygaagagaaccaaatcagtacaact

SEQ ID NO: 48215 - DNA, 50 bp, homo sapien
tatgtgtaattaatttatccaagaartgtgtattgagatcctagtatttg

SEQ ID NO: 48216 - DNA, 50 bp, homo sapien
gaagttccaaagtaaatctcataagsagtagagaaagcaacaacaaccac

SEQ ID NO: 48217 - DNA, 50 bp, homo sapien
ttttctccctgctacaactactgggwcattatgatagttacaataaagat

SEQ ID NO: 48218 - DNA, 50 bp, homo sapien
tttccaatgcttattcagagcttaamagtgccaggttattgcattaaatc

SEQ ID NO: 48219 - DNA, 50 bp, homo sapien
gcaagaaggggtgcaaataagaaacraatactcagaggatctcagctttt

SEQ ID NO: 48220 - DNA, 50 bp, homo sapien
taaatgcaactttaaaaagccttaargaacttgaagacaactttagtaag

SEQ ID NO: 48221 - DNA, 50 bp, homo sapien
tccctctctctgtaacgttcatttaygcattcttttagtcgttcacccag

SEQ ID NO: 48222 - DNA, 50 bp, homo sapien
tcatttgtagctcttcccagatgcaragtattttctgtattctaattctt

SEQ ID NO: 48223 - DNA, 50 bp, homo sapien
caggttgggtcacgctcccaggagasaagaccatggcaggctgagggggt

SEQ ID NO: 48224 - DNA, 50 bp, homo sapien
atggccacacgtgcccagctacccartccgcagaaacaggacaggcccta

SEQ ID NO: 48225 - DNA, 50 bp, homo sapien
gatctgccgtgctggagcatttaccygctcattctggttttgcactgtgg

SEQ ID NO: 48226 - DNA, 50 bp, homo sapien
ctgggactccttcaggtgctttatcyaaaataagtccaataactctttcc

SEQ ID NO: 48227 - DNA, 50 bp, homo sapien
atctgtgtatgttttctctgtgaatsaggcttgtactccttcccatgatg

SEQ ID NO: 48228 - DNA, 50 bp, homo sapien
agaaataaggaagatggaaagggagraaagtaatgttcaagacagaggca

SEQ ID NO: 48229 - DNA, 50 bp, homo sapien
acatttattatacattttgctgctawaaatgatgtatatcccacaataag

SEQ ID NO: 48230 - DNA, 50 bp, homo sapien
gtgaacaggtgcagagactgcatagragattgaattcctctgtcctcctt

SEQ ID NO: 48231 - DNA, 50 bp, homo sapien
tgcttctacaatcagccctggctgcraattaagacataaactgggggact

SEQ ID NO: 48232 - DNA, 50 bp, homo sapien
catattaatttttttttgtatagccraatatgtaggtgaagtgcacactg

SEQ ID NO: 48233 - DNA, 50 bp, homo sapien
cccaggctgcatctaagaaaactcaragggaatatgctatctatcttttc

SEQ ID NO: 48234 - DNA, 50 bp, homo sapien
attttttcacttgtatttgatagccsagaccaattgacttagaattccct

SEQ ID NO: 48235 - DNA, 50 bp, homo sapien
cataaatagaagtacattctttacartatcaggcagggaattctaagtca

SEQ ID NO: 48236 - DNA, 50 bp, homo sapien
ggactggattcatcttgccttgagaygggccagtagttatcagtgagtca

SEQ ID NO: 48237 - DNA, 50 bp, homo sapien
atattttacagaaggcgaattaataragaatgaaatatatacatatatga

SEQ ID NO: 48238 - DNA, 50 bp, homo sapien
cctacatctaaaccattacagattcyagttgagtctacttctttcttcaa

SEQ ID NO: 48239 - DNA, 50 bp, homo sapien
gtggtgtctctcttaatagaatttayggttgtggttattcagaaatatcc

SEQ ID NO: 48240 - DNA, 50 bp, homo sapien
gattacttagcagaaatgaagtgaaraggtggtccctgcccgctgactgg

SEQ ID NO: 48241 - DNA, 50 bp, homo sapien
ggtaactgaagggctggatttattayggatggagagaagagacggcagct

SEQ ID NO: 48242 - DNA, 50 bp, homo sapien
agattgcacactgtctcctaagttgmataaagcagagaacaacatgtctg

SEQ ID NO: 48243 - DNA, 50 bp, homo sapien
cactcatacttctgtggatgaactasattaaaataactaggtgctgtgag

SEQ ID NO: 48244 - DNA, 50 bp, homo sapien
tttgggttagatgttagatggatgamgaaaacagtgggtgatatgatttc

SEQ ID NO: 48245 - DNA, 50 bp, homo sapien
tccattctcacagtggacacaaacarcgttaccgaagtgctgaatatcaa

SEQ ID NO: 48246 - DNA, 50 bp, homo sapien
ctaagatcctgactgcagacaaagargcgatttaaggagcatctgttttg

SEQ ID NO: 48247 - DNA, 50 bp, homo sapien
tcattccctccatccctctcttaacmgcttgaagataatggaatcactca

SEQ ID NO: 48248 - DNA, 50 bp, homo sapien
aataagagagtcatcaaagagagtaygatcctgcttcatgtgggcatatt

SEQ ID NO: 48249 - DNA, 50 bp, homo sapien
catggtagcaagtaaaagatgagaasagtgctgtagatgagaataaatga

SEQ ID NO: 48250 - DNA, 50 bp, homo sapien
cagacagcaagctgaaaattatttakatgcacagagcacagaggtctgta

SEQ ID NO: 48251 - DNA, 50 bp, homo sapien
ctcagtcaactgagattgtgggttayaggcaaagagtaccttccttagca

SEQ ID NO: 48252 - DNA, 50 bp, homo sapien
cataagtgctttattattcatagtawgtagttccctttatctaataagac

SEQ ID NO: 48253 - DNA, 50 bp, homo sapien
agaaaaatcctagcatgacaaattcraggtggaactaactacctggccag

SEQ ID NO: 48254 - DNA, 50 bp, homo sapien
ggctgaggagcaaccacttgatacasagatttgcatgactaaaaaacaac

SEQ ID NO: 48255 - DNA, 50 bp, homo sapien
agcaatgactcagataatgaaagccraaaatctcatgatctttataataa

SEQ ID NO: 48256 - DNA, 50 bp, homo sapien
tgagtttggttcataactgtagtaayggttaagtgggtgcatgcacagat

SEQ ID NO: 48257 - DNA, 50 bp, homo sapien
gtaaccaagcaaaccaaactcgacartgaaaagagatgcctctgtgatgt

SEQ ID NO: 48258 - DNA, 50 bp, homo sapien
cgtttctgtggaacaaacaaaacgaytccaggcttatgcatttcctattt

SEQ ID NO: 48259 - DNA, 50 bp, homo sapien
ggaagacaggccttgtctattatcamcactggatatcaaagtcctctggg

SEQ ID NO: 48260 - DNA, 50 bp, homo sapien
caaacatttactgagtcttgctctaygccattcatcttcacatgtccagt

SEQ ID NO: 48261 - DNA, 50 bp, homo sapien
ttttcccattcatagtctcattttawcctcattccagacttttgaaaagg

SEQ ID NO: 48262 - DNA, 50 bp, homo sapien
tgttgagtgtagacaccttcagcaaygagtttagctagatcttctggaga

SEQ ID NO: 48263 - DNA, 50 bp, homo sapien
gatggaaattaattttataacagttsaacatcatctttgtcaatcagcag

SEQ ID NO: 48264 - DNA, 50 bp, homo sapien
gcagcagcggaggctgcgtggaggarcaactcactgtgctagaattacct

SEQ ID NO: 48265 - DNA, 50 bp, homo sapien
ttcattttttgccaaagaaccagagmaactcccatcctagtacaaaccaa

SEQ ID NO: 48266 - DNA, 50 bp, homo sapien; identical to SEQ ID NO: 47980

SEQ ID NO: 48267 - DNA, 50 bp, homo sapien
atattaacttaaattacaaaatacaktacagatagagtcaatgtccacat

SEQ ID NO: 48268 - DNA, 50 bp, homo sapien
ggagatgattcatccctaaaagacarctcaaggcctcttcaagaatcctc

SEQ ID NO: 48269 - DNA, 50 bp, homo sapien
atttactcttttaaacactaacttcraacaaatagccaatgtcatgctta

SEQ ID NO: 48270 - DNA, 50 bp, homo sapien
acagaagcctacgaggtggtttcccraagaactcagaggaacataacagc

SEQ ID NO: 48271 - DNA, 50 bp, homo sapien
cactaagtttgtgtaaaatacaaaaygtcaaatgtatgaatcagcctgat

SEQ ID NO: 48272 - DNA, 50 bp, homo sapien
aagacaagctgtcctgaagccaagtracacatgcttaggttgagaggtgg

SEQ ID NO: 48273 - DNA, 50 bp, homo sapien
ttaggccaggtatgttgacctaaaasgaagaagttgaggcaaagttaatc

SEQ ID NO: 48274 - DNA, 50 bp, homo sapien
gtagcaaacattcagacattgtaaasagtcagatattttcttttcttttt

SEQ ID NO: 48275 - DNA, 50 bp, homo sapien
cacccacatcgaaggatactataagrcccgactctataaaactcattatt

SEQ ID NO: 48276 - DNA, 50 bp, homo sapien
tttttgaaaatatttattaaattccraaactcaattctctaaaggtataa

SEQ ID NO: 48277 - DNA, 50 bp, homo sapien
gcttttgtagaaatacatggattcargattaattgtacattgagttctat

SEQ ID NO: 48278 - DNA, 50 bp, homo sapien
tcatatctctctacgtatttttgcaygaaacatagagtatatgaaataaa

SEQ ID NO: 48279 - DNA, 50 bp, homo sapien
gtttctggtagatacatggaagacawcaaatctacagccttctaccttcc

SEQ ID NO: 48280 - DNA, 50 bp, homo sapien
ccctaaacaagtacattaatgccacrcttcctctcattatagtcctcaag

SEQ ID NO: 48281 - DNA, 50 bp, homo sapien
gttgagaaatgaccacgtggccggtracacaaactctaaataggtgaagg

SEQ ID NO: 48282 - DNA, 50 bp, homo sapien
tgctggagcttcttatggaaataaayatgtgcatcccaatgtagggttaa

SEQ ID NO: 48283 - DNA, 50 bp, homo sapien
atccattaaccttttggatccttcaygatccctggcttggtgtggagtac

SEQ ID NO: 48284 - DNA, 50 bp, homo sapien
aggtttatcttgagaatgaaacgcartcctgtatgagaggtgctttggaa

SEQ ID NO: 48285 - DNA, 50 bp, homo sapien
caaactgaattcagtcactactaccraaaggattggccaccgccggagta

SEQ ID NO: 48286 - DNA, 50 bp, homo sapien
tcagcgggtaatgtgaaaaaccaagscttcctggtgatcccacaagagag

SEQ ID NO: 48287 - DNA, 50 bp, homo sapien
aataaaacatgccaccatttaagcawtaaggttttcaggtagttttgaat

SEQ ID NO: 48288 - DNA, 50 bp, homo sapien
agctttacacttactaaaaactgaawttcagctgaatatagctttatatt

SEQ ID NO: 48289 - DNA, 50 bp, homo sapien
ctggctgttcttggcgtaattcctayatttgctagaatactctggcttac

SEQ ID NO: 48290 - DNA, 50 bp, homo sapien
ttggctgttaaagaataaggcacgtracattttagtattattctgagaat

SEQ ID NO: 48291 - DNA, 50 bp, homo sapien
atttacaattgatatgcatttaccartataaactagacatgtctggagag

SEQ ID NO: 48292 - DNA, 50 bp, homo sapien
actctttgcaccatctgcggcggtakataatatgtgtaagacttgcaatg

SEQ ID NO: 48293 - DNA, 50 bp, homo sapien
atgagtaagatcatgggttcatatargcacaaatgttttggagtgcattg

SEQ ID NO: 48294 - DNA, 50 bp, homo sapien
tgctaaatgaaaagatgcttctgtaycttgaattctgtgaagtggtgagt

SEQ ID NO: 48295 - DNA, 50 bp, homo sapien
agtgacaaggtggttagaggcatgakatttggagttataccaatgtggat

SEQ ID NO: 48296 - DNA, 50 bp, homo sapien
atgacatgctctgtaccaccaaaggrcattatagaatatgcataagcttg

SEQ ID NO: 48297 - DNA, 50 bp, homo sapien
caaaccataacaagcagagtgacaargtggttagaggcatgatatttgga

SEQ ID NO: 48298 - DNA, 50 bp, homo sapien
attataaaataaaatggaaaagagaygtggagactataacaaacatgaaa

SEQ ID NO: 48299 - DNA, 50 bp, homo sapien
tctgggaatgatcgtgattcttaagyacctgatagcataaacctcggtca

SEQ ID NO: 48300 - DNA, 50 bp, homo sapien
gtagcctacctactgctggtgaatayctgagatcttgcttgggctacatt

SEQ ID NO: 48301 - DNA, 50 bp, homo sapien
atttcgatgatttccattacttttayagcttattggcttgtgaactctgg

SEQ ID NO: 48302 - DNA, 50 bp, homo sapien
gcaagctttaactagcaatctggacygaatgtttaatattaagacaagta

SEQ ID NO: 48303 - DNA, 50 bp, homo sapien
aggtatgtctcccaggagcataaaaycatcaagctgtaaattttatttaa

SEQ ID NO: 48304 - DNA, 50 bp, homo sapien
ggtgaatttacaaattttttctcaayaatcacaaatgtaaatgtgtatga

SEQ ID NO: 48305 - DNA, 50 bp, homo sapien
ctccatttatatccacttgaaataaytgacaaagctggatttgggattca

SEQ ID NO: 48306 - DNA, 50 bp, homo sapien
agcttttatgaggcctttcaagcaamgataaggggattggattttaaact

SEQ ID NO: 48307 - DNA, 50 bp, homo sapien
atatgttatgcagtaaatgacaataygggtcaataatattatcacaaagc

SEQ ID NO: 48308 - DNA, 50 bp, homo sapien
acaggtgctacactcagagcatctgsaaagacagttagtagaagatgaga

SEQ ID NO: 48309 - DNA, 50 bp, homo sapien
gcactccagcctggtgtctagggaaktatctaaaagctaaactacattgc

SEQ ID NO: 48310 - DNA, 50 bp, homo sapien
ggtttgctctacaaaaatggccagaygttgggtacctgatgaaccatctg

SEQ ID NO: 48311 - DNA, 50 bp, homo sapien
acaattatatttgtcactcttgagcratgaaggcaaactgttacccaaac

SEQ ID NO: 48312 - DNA, 50 bp, homo sapien
ttgtactgccatacagacagacattmaataaggtggatgaagaatgaagg

SEQ ID NO: 48313 - DNA, 50 bp, homo sapien
atgaacaaatctaaaactgtcaatcmatttccctaccaaattttttgtgt

SEQ ID NO: 48314 - DNA, 50 bp, homo sapien
ttactcctattgctttcaggcactcyctttaatcatagatttggtttctt

SEQ ID NO: 48315 - DNA, 50 bp, homo sapien
tcttacctataacacctgacaagaakaggcttaactcataaaaatagtgt

SEQ ID NO: 48316 - DNA, 50 bp, homo sapien
tagtctacattcttcactttatagaygaagaattttatagccatatttta

SEQ ID NO: 48317 - DNA, 50 bp, homo sapien
taatggcagagtgttcaatcctgaawatgaacgtgaataataataagaac

SEQ ID NO: 48318 - DNA, 50 bp, homo sapien
agttccggaacctgccaatgatgggyaacggaaagtgagggagttcaact

SEQ ID NO: 48319 - DNA, 50 bp, homo sapien
tggatagtacttttgcttggattagmacaccctataaatgtgactaatgg

SEQ ID NO: 48320 - DNA, 50 bp, homo sapien
tgtggtccgaagccagcacctctgakagattcttgacatgtgctgggcat

SEQ ID NO: 48321 - DNA, 50 bp, homo sapien
cctttttgttctaaacttggctgatwagtacaagaggcctacctttctgc

SEQ ID NO: 48322 - DNA, 50 bp, homo sapien
ggacccaaatgtacattcaggatggrcaataagtgctaaatccaacgaaa

SEQ ID NO: 48323 - DNA, 50 bp, homo sapien
gtcatccaaatttctgatttcacatmaacttgttaagatcacacaaaacc

SEQ ID NO: 48324 - DNA, 50 bp, homo sapien
gtgcccagcccctggtgattttatgragaacttactctgtgcccttggat

SEQ ID NO: 48325 - DNA, 50 bp, homo sapien
ggacccagacgcttcatgacccagasgagttaatgtgagtcagcaggagc

SEQ ID NO: 48326 - DNA, 50 bp, homo sapien
ttctgttagtgatcagataagggcarataattcagtagaaaagcttctgg

SEQ ID NO: 48327 - DNA, 50 bp, homo sapien
ggggcaagttaactcttctatacatsactcaaattcttcacctggataac

SEQ ID NO: 48328 - DNA, 50 bp, homo sapien
atccctgcacagattcttcaaaaacmgtgtctccatactgccaaatgaaa

SEQ ID NO: 48329 - DNA, 50 bp, homo sapien
gcaattgcatgaactaataaagtaasaattcactcattactacagggagg

SEQ ID NO: 48330 - DNA, 50 bp, homo sapien
atgtcaaatgggaagactatgcttawctgggtcttatgaacagaaaaata

SEQ ID NO: 48331 - DNA, 50 bp, homo sapien
ttcaccttcaatagctacgtgcgaaktctagagacacattcaagtttatg

SEQ ID NO: 48332 - DNA, 50 bp, homo sapien
ttggtttagtttggtttcacggaggwacaggatgatgagatttttcttta

SEQ ID NO: 48333 - DNA, 50 bp, homo sapien
tgtcaatcattccactgtagctgtgyaaacttccgctttttgaggggaca

SEQ ID NO: 48334 - DNA, 50 bp, homo sapien
ttaagaacactaaaaaatgaacatcyctgtgacaagtgcatcctcattat

SEQ ID NO: 48335 - DNA, 50 bp, homo sapien
catttcagtcaaagacaaactgtaayataaaagagaccaagatagaagct

SEQ ID NO: 48336 - DNA, 50 bp, homo sapien
tcccatttgggcacccctccttctcrcaaaagagaaagctgttttttttc

SEQ ID NO: 48337 - DNA, 50 bp, homo sapien
agtcagaatttgtggcaaacggtaaygaagagggtatgtgtttcctcccc

SEQ ID NO: 48338 - DNA, 50 bp, homo sapien
tccttttaagcctatcttctcaaatkagctaaactcttagtatattagtc

SEQ ID NO: 48339 - DNA, 50 bp, homo sapien
gttttttctgaaaaggcttaaaatasaatatagttcttggcatcaacttg

SEQ ID NO: 48340 - DNA, 50 bp, homo sapien
tccacagccttttccttcatcttccrgactctcaatgtgactgattaaac

SEQ ID NO: 48341 - DNA, 50 bp, homo sapien
agagatatatgagaactcactgaggyaaaaggcaaaaagagaatatccca

SEQ ID NO: 48342 - DNA, 50 bp, homo sapien
atggccttgaatgttaaccagatgaygttagggaaaccgcaagaggagtg

SEQ ID NO: 48343 - DNA, 50 bp, homo sapien
gtcaacacctcctgtgagtttggtaraagtacaggagtcacagtttcaac

SEQ ID NO: 48344 - DNA, 50 bp, homo sapien
actgatctagaataatttacttgcayaagagctagttttttaagatataa

SEQ ID NO: 48345 - DNA, 50 bp, homo sapien
tctttacacttataaagttttctccratataaattatcttacctacaagc

SEQ ID NO: 48346 - DNA, 50 bp, homo sapien
agagtcacatcacctgggtaaagtcycaagtagtatgtcaccaatcctat

SEQ ID NO: 48347 - DNA, 50 bp, homo sapien
aagatgggtgggcactgttttaaccrcacactttcagccatccatccctt

SEQ ID NO: 48348 - DNA, 50 bp, homo sapien
ttgaggccaatggcaaaaaacccaakttaccatgataaaaacttgaagaa

SEQ ID NO: 48349 - DNA, 50 bp, homo sapien
tttacaaataatctaacaacttatasatttttttatactcaacactctgt

SEQ ID NO: 48350 - DNA, 50 bp, homo sapien
ggagtggaacttaatctaatttatamgcagttccactagagatgtgcaag

SEQ ID NO: 48351 - DNA, 50 bp, homo sapien
tcccaggcccaagcatagcctggaaygaattaagaaggtcaccatattaa

SEQ ID NO: 48352 - DNA, 50 bp, homo sapien
tgagaaagcattagctaaaacataamaccatgagccaggcactgttgaag

SEQ ID NO: 48353 - DNA, 50 bp, homo sapien
acactcagaagcattttttaatacasggtcagtctccaggtatgcccaag

SEQ ID NO: 48354 - DNA, 50 bp, homo sapien
ttttagcttggaactctgaacactcmgaagcattttttaatacacggtca

SEQ ID NO: 48355 - DNA, 50 bp, homo sapien
aaacagataatccacaaaagacaaayacaaatattaaacatgtagaaaat

SEQ ID NO: 48356 - DNA, 50 bp, homo sapien
ttccctcctttacctggtccttaaaygttgatggtctgtggaactcaacc

SEQ ID NO: 48357 - DNA, 50 bp, homo sapien
gaccttctcagtagctccaggaacaycacttggagaaagccaaatgctta

SEQ ID NO: 48358 - DNA, 50 bp, homo sapien
ttgactcacggctaattaaataatayggaggcacccaaaagatgagtgtg

SEQ ID NO: 48359 - DNA, 50 bp, homo sapien
ttatttttcccaaattagtctgatcragaagaaacctacctaaagcaaaa

SEQ ID NO: 48360 - DNA, 50 bp, homo sapien
agagtacacaccaagatctacatgayggcaaatggttcatcctcctcctt

SEQ ID NO: 48361 - DNA, 50 bp, homo sapien
tccctcttgttgcagatccatgatcrattgtagcaacacgggcatataat

SEQ ID NO: 48362 - DNA, 50 bp, homo sapien
ctgcacctgtgctttgctcctggaaygctagagtgctttaaagaaaaata

SEQ ID NO: 48363 - DNA, 50 bp, homo sapien
acctctgaggtgcaaggatgtttaayggttgcacagagaagacaatccta

SEQ ID NO: 48364 - DNA, 50 bp, homo sapien
atcttcaacaagtttaaaaagagacraatctgtacacaaccttcagggat

SEQ ID NO: 48365 - DNA, 50 bp, homo sapien
ctcagcagcgttgggtgaagggtccratgatgggatcaggccctacagat

SEQ ID NO: 48366 - DNA, 50 bp, homo sapien
tgacctagccagtctcttaatgacamaacagatggtcctagaagttagct

SEQ ID NO: 48367 - DNA, 50 bp, homo sapien
gcagaaagttaagccaatcctaacaytcagcttgcaatcattctgacgta

SEQ ID NO: 48368 - DNA, 50 bp, homo sapien
atatgcgttgtttcacaagcatttcracatttaacatattgaatcagtat

SEQ ID NO: 48369 - DNA, 50 bp, homo sapien
cctccctccaaaattatcctgacatragctatttatactatataacagta

SEQ ID NO: 48370 - DNA, 50 bp, homo sapien
ggtaccactactgtacatctgaatayggccaaaatcttttttgtttgttt

SEQ ID NO: 48371 - DNA, 50 bp, homo sapien
caagaacataaagtattccgaagacrgcacaatttatgtcaattgctttt

SEQ ID NO: 48372 - DNA, 50 bp, homo sapien
tgggtagctggatacgcgaatgcagraatagttcatttttttctagtgcc

SEQ ID NO: 48373 - DNA, 50 bp, homo sapien
gcaaaatttcatattatgagatcaasgttagcatttcctcagctgtctgg

SEQ ID NO: 48374 - DNA, 50 bp, homo sapien
gatctggcaaagaaagataggcagarctattaaagtgttcaatttccttc

SEQ ID NO: 48375 - DNA, 50 bp, homo sapien
taaggcaaaccagttcaaaattatarctatcaggttttcttagatgctca

SEQ ID NO: 48376 - DNA, 50 bp, homo sapien
gtaccatgaccaccttagatcatatmaaacccactctcctctgcccactt

SEQ ID NO: 48377 - DNA, 50 bp, homo sapien
tacacacatatatgttccagctataytagtttgtcctttaatttggtaag

SEQ ID NO: 48378 - DNA, 50 bp, homo sapien
gaatgtgttcttagtctttgataatraaaatcttagcattttcacaaagt

SEQ ID NO: 48379 - DNA, 50 bp, homo sapien
cagcgtcactgtcttgtcacagaaarctgtcttcacatgtctttcagcca

SEQ ID NO: 48380 - DNA, 50 bp, homo sapien
ggaatggtcactgttacaggtattcyatcttcattatctgatttaatcct

SEQ ID NO: 48381 - DNA, 50 bp, homo sapien
aggaatgtactgagtgagaaacttawatctgctagaaagatccatgttgc

SEQ ID NO: 48382 - DNA, 50 bp, homo sapien
ttctccaaatctgatggtagtgaaartgtatcttatttttgttttaattt

SEQ ID NO: 48383 - DNA, 50 bp, homo sapien
gtcaaacatatatccacatttctccrcccggacagattcattctctctgc

SEQ ID NO: 48384 - DNA, 50 bp, homo sapien
atattctgagcatttggatgtcagtyaattcttctctaatcatgtggcct

SEQ ID NO: 48385 - DNA, 50 bp, homo sapien
caagggccctcagacctctgtattcyagaagtagtctgtttgacagtgaa

SEQ ID NO: 48386 - DNA, 50 bp, homo sapien
tgagagaaacatgtaacttttgtaayatatgacttaggagtgaagtgatt

SEQ ID NO: 48387 - DNA, 50 bp, homo sapien
tttctctcataggatacctgtatacyatatgtcaatcaacactatgagtg

SEQ ID NO: 48388 - DNA, 50 bp, homo sapien
gttatgtaatgtttatcataagagaraatcctaaaatattaaaattgctt

SEQ ID NO: 48389 - DNA, 50 bp, homo sapien
actaagaacacactcaattcttacartcacgtgtctgtgttggcatggtg

SEQ ID NO: 48390 - DNA, 50 bp, homo sapien
agtttaatctgtttatatggctcaakgaggacttttggaagtggtgggca

SEQ ID NO: 48391 - DNA, 50 bp, homo sapien
ttcagaaatgctaggttatcagtacmgaattccagaggcttctgagagtt

SEQ ID NO: 48392 - DNA, 50 bp, homo sapien
cgaccactgcagcctacgaagtcctraacaatcgggttcagcaggctgct

SEQ ID NO: 48393 - DNA, 50 bp, homo sapien
agctttaaaacttcaagtttggacarcctgatttctgtcaatatatttgc

SEQ ID NO: 48394 - DNA, 50 bp, homo sapien
gataagagttaataaattgatgtaaytcctatctttgtggtagttaacaa

SEQ ID NO: 48395 - DNA, 50 bp, homo sapien
ataaaataaaaagattactaaaacaygcctcttacatctaactatcttag

SEQ ID NO: 48396 - DNA, 50 bp, homo sapien
attgagcccaattccaaaaaagcgastatgccaggataaaaactagaagg

SEQ ID NO: 48397 - DNA, 50 bp, homo sapien
ggaaaccatagaatcatctttatacmagggcaggcatatcactatgcacc

SEQ ID NO: 48398 - DNA, 50 bp, homo sapien
tctaaactttgtgggcttatctaccrgcaactgtatttgtaatttctcat

SEQ ID NO: 48399 - DNA, 50 bp, homo sapien
ctgagatcaagtaatttttctgttaygctgctaatccatagatgctcaat

SEQ ID NO: 48400 - DNA, 50 bp, homo sapien
atccctcctcctgtactgccagggcrctgcttttcattttccatctttca

SEQ ID NO: 48401 - DNA, 50 bp, homo sapien
gtacgcaacactggcacagctgatamaatacagttgggggtatgcacatg

SEQ ID NO: 48402 - DNA, 50 bp, homo sapien
taccaggtgccaactaatccatgaarccatagaaattaaaatgatgtgac

SEQ ID NO: 48403 - DNA, 50 bp, homo sapien
aattcatccatttgtataacaatgarctgctattatgtatcagacagtat

SEQ ID NO: 48404 - DNA, 50 bp, homo sapien
ttagagaataatttgaaagagtttayatattttcaatgattggatcttcc

SEQ ID NO: 48405 - DNA, 50 bp, homo sapien
atgatactaaaataacagaaacaccratactctttgtcaggtcattccat

SEQ ID NO: 48406 - DNA, 50 bp, homo sapien
cgttctcttcatgcttatcctgtggrcagtttgatgaaaatggcttataa

SEQ ID NO: 48407 - DNA, 50 bp, homo sapien
aatcccatgatctaaatttctacaaygttctcttcatgcttatcctgtgg

SEQ ID NO: 48408 - DNA, 50 bp, homo sapien
gcattacagcttaatcctttcacacycatattgtccttgggcagataacc

SEQ ID NO: 48409 - DNA, 50 bp, homo sapien
tttatttactcttccaaagttcataygcagtttatgtttgtcaattatac

SEQ ID NO: 48410 - DNA, 50 bp, homo sapien
aaaagtttagatttagtccatgataytaaccaagtaaaattgattttatc

SEQ ID NO: 48411 - DNA, 50 bp, homo sapien
gaccacttgcagtaatttgtctctawccagtggtcacacatgctcagggg

SEQ ID NO: 48412 - DNA, 50 bp, homo sapien
tcctaattcgaattaagttgataaawttctaggtttgggttagcctttga

SEQ ID NO: 48413 - DNA, 50 bp, homo sapien
ccaattatgttttgggatgcattcaygacccttgcaattcttctacatgc

SEQ ID NO: 48414 - DNA, 50 bp, homo sapien
cagttgaataacaaatttaacaacaytctatctaacccttagcaaatacc

SEQ ID NO: 48415 - DNA, 50 bp, homo sapien
ataactaatactggcagactgaccarctagaattcactctgtcataagct

SEQ ID NO: 48416 - DNA, 50 bp, homo sapien
catgtgtatcattttattgttggtayacgacaaccattctaagtattaag

SEQ ID NO: 48417 - DNA, 50 bp, homo sapien
tctgaaactgaattcaatttatacartacgagatgctatcttactgcata

SEQ ID NO: 48418 - DNA, 50 bp, homo sapien
atttgtttatattacctttataatgyatgcttctagtatttccagatata

SEQ ID NO: 48419 - DNA, 50 bp, homo sapien
catttttaattttaaatatcaccaamgctgtattgccatttatcatatag

SEQ ID NO: 48420 - DNA, 50 bp, homo sapien
cttaagttttttttcctttctttccrgctcaaaatatcaagttaggttca

SEQ ID NO: 48421 - DNA, 50 bp, homo sapien
ggatgtgttttcgatatggtttaaakgaagataactaatggtgcttgaat

SEQ ID NO: 48422 - DNA, 50 bp, homo sapien
tagataaaattgtcttcaaatacaargctgttttctctacattgaaaatc

SEQ ID NO: 48423 - DNA, 50 bp, homo sapien
gatcctataacaaactgtgattaaayctagtcttggtctttcaaccactt

SEQ ID NO: 48424 - DNA, 50 bp, homo sapien
atcatcttgtccaacaaatactcaayccaagaactatcacctcttgctta

SEQ ID NO: 48425 - DNA, 50 bp, homo sapien
tctgggttatttcactcaaagggccrcaaaagctcaaatgccgagctaag

SEQ ID NO: 48426 - DNA, 50 bp, homo sapien
ggtcaagaaatgcctgaaatacatawagggtcagagaaaattactttaat

SEQ ID NO: 48427 - DNA, 50 bp, homo sapien
ggaaagatccttaaatctggagttayatagaaggtaaatttgagcacata

SEQ ID NO: 48428 - DNA, 50 bp, homo sapien
ttgatggcatgttactgaccatcaaygataacatctttaattatcccaat

SEQ ID NO: 48429 - DNA, 50 bp, homo sapien
tccttctcccattcttgaaaacaatkatccttctgtagcttgtaagaaat

SEQ ID NO: 48430 - DNA, 50 bp, homo sapien
aacctcacatcatttattcctggcasagtttaaggctgtcaccccaagag

SEQ ID NO: 48431 - DNA, 50 bp, homo sapien
ggcttctaacccacatgaatttttawaagttatatacagagatgtatatt

SEQ ID NO: 48432 - DNA, 50 bp, homo sapien
ttatgtatgaatcatgacctaaggarcaaatgaacacatcatcttgaact

SEQ ID NO: 48433 - DNA, 50 bp, homo sapien
cgtcttgccatatgactaagcagatsaacaaatacctatcactcacacac

SEQ ID NO: 48434 - DNA, 50 bp, homo sapien
ggataccagagacatcccttgaaaakaaagagcaaaaataaagtacaaat

SEQ ID NO: 48435 - DNA, 50 bp, homo sapien
gaagtcaacagtaccaaaacccatawgtttgtgaaatagcattactctaa

SEQ ID NO: 48436 - DNA, 50 bp, homo sapien
gataataatacaccttcatgagcaaygtttaatttaagactaagactgat

SEQ ID NO: 48437 - DNA, 50 bp, homo sapien
ttgtcttttttaaaggaagtttcacrgtaaatgtctaagataatgtttca

SEQ ID NO: 48438 - DNA, 50 bp, homo sapien
tgttattggttgtgctctctaagcamagcaaataaatctcattctaaact

SEQ ID NO: 48439 - DNA, 50 bp, homo sapien
caataacatgaatagttttgaattaycttaaagtctcctcactattttag

SEQ ID NO: 48440 - DNA, 50 bp, homo sapien
tccaagtcagcagtataatttcacamatcaagaagctagaagatacacag

SEQ ID NO: 48441 - DNA, 50 bp, homo sapien
aatttgaaagtaaatatgaaacaaaygaaatagtatgagtaaagtacatt

SEQ ID NO: 48442 - DNA, 50 bp, homo sapien
cagttttaaacaacagaattcaaccyggaaaacttaagtgatgaaagata

SEQ ID NO: 48443 - DNA, 50 bp, homo sapien
tgataatcattgcactgaattatacrgaagggcacttacacaaaaaagaa

SEQ ID NO: 48444 - DNA, 50 bp, homo sapien
gtttgttttcaggcatgatgaattakggccaaaggataacaacaggatga

SEQ ID NO: 48445 - DNA, 50 bp, homo sapien
cccctgtgacataaacattcagttgwcaaatacggtctctagaatccttc

SEQ ID NO: 48446 - DNA, 50 bp, homo sapien
ctataataatcaaacaaacatataawacaaagtaatatcattttaggtgc

SEQ ID NO: 48447 - DNA, 50 bp, homo sapien
cgtctcaggagttatggtgtcagaaytaaaatggtgtaagcaggagcctg

SEQ ID NO: 48448 - DNA, 50 bp, homo sapien
tctgaagtaatactatcttagagaakaattttcctctgtgtctttaatac

SEQ ID NO: 48449 - DNA, 50 bp, homo sapien
tgagagatagcattaatgttttctaygaagactcttggaagcctgaatat

SEQ ID NO: 48450 - DNA, 50 bp, homo sapien
attagctctctttctgtcttacataygctgttcactatttctctttccaa

SEQ ID NO: 48451 - DNA, 50 bp, homo sapien
tgaatctggccttactatatatgtarcttcacacttgctcaggaaatttc

SEQ ID NO: 48452 - DNA, 50 bp, homo sapien
taagtactagattggaaggaaaaggscactcttttttgtagcctcgaacc

SEQ ID NO: 48453 - DNA, 50 bp, homo sapien
tgactctaaatccagcccatctttamaattctgctcaaattccatctctt

SEQ ID NO: 48454 - DNA, 50 bp, homo sapien
tgctggaaaaccaccatcccatgtaygttattaaagtcatgtttaattgt

SEQ ID NO: 48455 - DNA, 50 bp, homo sapien
cagatttttaagtacttatgataaamtatacaaaacataaaaatacagat

SEQ ID NO: 48456 - DNA, 50 bp, homo sapien
aagaacagagtgcatagattaaagayagtaatgtttaaagaagttttgga

SEQ ID NO: 48457 - DNA, 50 bp, homo sapien
atagtagacagtgagatgatccaagracagagtgcatagattaaagacag

SEQ ID NO: 48458 - DNA, 50 bp, homo sapien
ttgggctaccaatcagtgtctgatayctattaagactttttaaaagggta

SEQ ID NO: 48459 - DNA, 50 bp, homo sapien
tactctatgccaaagatatacatacrccaatatcatttaaaaaatagtct

SEQ ID NO: 48460 - DNA, 50 bp, homo sapien
tttccctgtacatgtcttttctgtcmcggcagtgctcagcaaatgcctcg

SEQ ID NO: 48461 - DNA, 50 bp, homo sapien
aacaaggtcaacatggttgtgtaggmatctgagagcaaaaagaagcttag

SEQ ID NO: 48462 - DNA, 50 bp, homo sapien
cttgatacctatttcccacatccacyggtttggaacattttttaagaata

SEQ ID NO: 48463 - DNA, 50 bp, homo sapien
tttcaatgctaacgtgaattaatcartcttgtctattgtagtttcctttt

SEQ ID NO: 48464 - DNA, 50 bp, homo sapien
cagttcttgacatgatcactatcacrcttaaccaacaaccgatatgaaag

SEQ ID NO: 48465 - DNA, 50 bp, homo sapien
ggcaatagatcatatagactttcaaygtcaggcctatggattcctattat

SEQ ID NO: 48466 - DNA, 50 bp, homo sapien
gaaataaagtttgtaaagccttagcractttatgtaggttagataataag

SEQ ID NO: 48467 - DNA, 50 bp, homo sapien
tgttctgtgtcgtgatacttttaagrataaagccatttggagtgaaccat

SEQ ID NO: 48468 - DNA, 50 bp, homo sapien
agcaaacaaaaaaatggtagaatgtsaatgaacaaagacctgtgtttcat

SEQ ID NO: 48469 - DNA, 50 bp, homo sapien
atgcaatgacatgataatacttgcaygtagatgtttgttaaatgctggtt

SEQ ID NO: 48470 - DNA, 50 bp, homo sapien
ttggttctgatggaagaatataatamgcctgagttcatgtttcacaaata

SEQ ID NO: 48471 - DNA, 50 bp, homo sapien
tatttaatttgttataatcctagtayctagagttgtgtcatattagctct

SEQ ID NO: 48472 - DNA, 50 bp, homo sapien
tatttaccttggtggctcataaaccraagatgaaccacatcctatgtgag

SEQ ID NO: 48473 - DNA, 50 bp, homo sapien
gcttattccttcttttacccataaaytggaatgtatatcttctgttctct

SEQ ID NO: 48474 - DNA, 50 bp, homo sapien
gctgatatgactataagattaaaccratgggaacactatcttatttgaga

SEQ ID NO: 48475 - DNA, 50 bp, homo sapien
gcaacctttctgctgtagagtagtayacaaggccaggtttttcatctagg

SEQ ID NO: 48476 - DNA, 50 bp, homo sapien
gccaactcacctagccaatagggaargaagtcattctccaaatgtaagca

SEQ ID NO: 48477 - DNA, 50 bp, homo sapien
tgcttaactcaattattttgaattaygcagttttctcaaatatttgtttg

SEQ ID NO: 48478 - DNA, 50 bp, homo sapien
acttctcacagatatttttgaagatkaagtgaactagtatataggaaact

SEQ ID NO: 48479 - DNA, 50 bp, homo sapien
gcttgggaaccacttcactacttgamagattaaaaagccatcatatgctt

SEQ ID NO: 48480 - DNA, 50 bp, homo sapien
tcatagatattccaaccatgaaataytagctactcaatagcatagaaaaa

SEQ ID NO: 48481 - DNA, 50 bp, homo sapien
agcatctaagcacgtaaatgaaaagwagtcctagaattaaactcaagctt

SEQ ID NO: 48482 - DNA, 50 bp, homo sapien
ctaattcagaaaactttaagtctcawctatctttcttttggttcctcaaa

SEQ ID NO: 48483 - DNA, 50 bp, homo sapien
aaaagcaagaatactttttcttaacraagctaggtcttaaaattgaagct

SEQ ID NO: 48484 - DNA, 50 bp, homo sapien
aagatatattataataaaaaataccragacctatgagactctagaattga

SEQ ID NO: 48485 - DNA, 50 bp, homo sapien
tctcttaaggatctggtaaggctaawgcgtaatttgacaggaaaagcatg

SEQ ID NO: 48486 - DNA, 50 bp, homo sapien
tgtagtctgctttttattcttttggyatctggtcaaatggtatcttcttg

SEQ ID NO: 48487 - DNA, 50 bp, homo sapien
aaaaaatgtcctgatttatagagaaygtgatgatttacaaatagaggagg

SEQ ID NO: 48488 - DNA, 50 bp, homo sapien
ctttcaaaagtgatatataagatacygatgaagataatgggaaatggggt

SEQ ID NO: 48489 - DNA, 50 bp, homo sapien
tataaattgaaaaaatgtcatttgtsaatcttaataattataaattaaca

SEQ ID NO: 48490 - DNA, 50 bp, homo sapien
ttgaaattgtgaataaggaattgtakgcctgtgattgtatgacttcatga

SEQ ID NO: 48491 - DNA, 50 bp, homo sapien
tcttccttttcctttaatatgaatcrcatcaactagataagccaactata

SEQ ID NO: 48492 - DNA, 50 bp, homo sapien
atttatttgcaactaaattttgttaygaaagctccttattcttcattttc

SEQ ID NO: 48493 - DNA, 50 bp, homo sapien
actggtaccagacagggtagccaaayggagagctttagagggccccaggc

SEQ ID NO: 48494 - DNA, 50 bp, homo sapien
agtgagagatgacactactttactaratgggactactagcaaccagacac

SEQ ID NO: 48495 - DNA, 50 bp, homo sapien
tagcatttcattctttcttaaacaaktggatgtccctattttatgccatt

SEQ ID NO: 48496 - DNA, 50 bp, homo sapien
tggggggaaagataccaggctcaaarttataaaacatatgaaaggtgtgg

SEQ ID NO: 48497 - DNA, 50 bp, homo sapien
attcaggcacctgtctataacattasgtaaaagaagttgctcttgaatgt

SEQ ID NO: 48498 - DNA, 50 bp, homo sapien
gttctatttctctggagaatcttaaygaataacagtgactaaaagtattt

SEQ ID NO: 48499 - DNA, 50 bp, homo sapien
ggttgaaatctgagtaggaatatcaygaagggctatgtgttttcactgaa

SEQ ID NO: 48500 - DNA, 50 bp, homo sapien
cctaacgagtgctcacctttttgacyggtaacctaatgctgcagttatca

SEQ ID NO: 48501 - DNA, 32 bp, homo sapien
acaagcctatacaatgractatacaatgaact

SEQ ID NO: 48502 - DNA, 50 bp, homo sapien
ttcataggattgtgaagctaaattargtgcaaaggaaatgtaactgtgag

SEQ ID NO: 48503 - DNA, 50 bp, homo sapien
caattaatacttgcatcacagaatakagaaaagaagctgccttttaaatg

SEQ ID NO: 48504 - DNA, 50 bp, homo sapien
gcaacagcatttcaaagcaacggtaygaatcaagtgtttttaaacaatat

SEQ ID NO: 48505 - DNA, 50 bp, homo sapien
ccaaggtgggaaattgaaaagttacmatgaagagaggacaagcttagtaa

SEQ ID NO: 48506 - DNA, 50 bp, homo sapien
ttcagcagcaatagacaatgaatacrgcagcattagaaagaaagaataat

SEQ ID NO: 48507 - DNA, 50 bp, homo sapien
ccaaacaagaaaacaaggtggatatracataaaatcacttagtgctgagt

SEQ ID NO: 48508 - DNA, 50 bp, homo sapien
aagtgatgttatggtgaaactctccractagagtgaactatcaaggacta

SEQ ID NO: 48509 - DNA, 50 bp, homo sapien
gttgcccaagacatgtcagaatcaaygtctagagtcttaggtctaatacc

SEQ ID NO: 48510 - DNA, 50 bp, homo sapien
atgtaaagtatgcacaacttaccaamctcagagagaaatgagaataagcc

SEQ ID NO: 48511 - DNA, 50 bp, homo sapien
accaaaacatttgagaatggctatcrcttagtggtaaggagaaaatatta

SEQ ID NO: 48512 - DNA, 50 bp, homo sapien
aacaatcagagtaaagagaattacasaatcattatttgcttcttaagtca

SEQ ID NO: 48513 - DNA, 50 bp, homo sapien
tacttataacatttcacataaagtcrcatcatatagagttgcagtggttc

SEQ ID NO: 48514 - DNA, 50 bp, homo sapien
ggagaaattaaagaaaaacagccaartatgcctttgtgtgattcctgaac

SEQ ID NO: 48515 - DNA, 50 bp, homo sapien
gttgatcattagtgagattatatgaygttaatgaagtctttcagtttctc

SEQ ID NO: 48516 - DNA, 50 bp, homo sapien
ataaaatgaatggcttcttctaaaaygaaaatgaatacatacaacagagt

SEQ ID NO: 48517 - DNA, 50 bp, homo sapien
aggaagaaggtctagtgagtgatacmaagaagtagaaactgtaatagaac

SEQ ID NO: 48518 - DNA, 50 bp, homo sapien
gtaactaaacattctgtattccacarcttatctaatgtttttatattctt

SEQ ID NO: 48519 - DNA, 50 bp, homo sapien
atgaaaatctgtaagttatcaacaayttggataaaaagacttcaagtcat

SEQ ID NO: 48520 - DNA, 50 bp, homo sapien
ggcaattccacggtaccacttctccrcttcagaatgctttaagtacatat

SEQ ID NO: 48521 - DNA, 50 bp, homo sapien
ccaagaagtagaaactgtaatagaaygacgggagtggacactgtcagaga

SEQ ID NO: 48522 - DNA, 50 bp, homo sapien
tatatttgtgttacaaaccaaaggawctgcactaattttctacttaaaaa

SEQ ID NO: 48523 - DNA, 50 bp, homo sapien
tttatttcttaataatccaattataycttacttgaaaactgctctaaagg

SEQ ID NO: 48524 - DNA, 50 bp, homo sapien
gttttcaaaagaaataaaaaagacaytgcccttatgcagccaacattctg

SEQ ID NO: 48525 - DNA, 50 bp, homo sapien
ggtgatcaatttctgatttaaatgcrcctagccaaaagaacaatgacaaa

SEQ ID NO: 48526 - DNA, 50 bp, homo sapien
ttactggcactgctgacaaatagaawtgatatagaatgactggcctaaga

SEQ ID NO: 48527 - DNA, 50 bp, homo sapien
actggggaaaaggactaggacatcaytgagaggcattaggtgaaatgaat

SEQ ID NO: 48528 - DNA, 50 bp, homo sapien
aatccagaatctatctggagggtatraattatccaggcctttgagtctga

SEQ ID NO: 48529 - DNA, 50 bp, homo sapien
tgaaattgtccttgatatctgtcaaygttaaaattaaaaatatagattat

SEQ ID NO: 48530 - DNA, 50 bp, homo sapien
tctaattctggtccctaccacagtayctgtcatatagtaggtgttcaaca

SEQ ID NO: 48531 - DNA, 50 bp, homo sapien
ttaatatattacaggttataaatgarcaagaagtcgcaaatcagtatcta

SEQ ID NO: 48532 - DNA, 50 bp, homo sapien
cttattccagctggacaatgcaacaratattttttaggaactttgaatca

SEQ ID NO: 48533 - DNA, 50 bp, homo sapien
atgaagaaatttcctcagaatcttcmaatttagttatcatgtccactggc

SEQ ID NO: 48534 - DNA, 50 bp, homo sapien
ctgaagggtaacatacataaaataaygcctaatagcaaggaaaaattcta

SEQ ID NO: 48535 - DNA, 50 bp, homo sapien
tgtcaaaatgtattaaagtgacacamcgttaatactggttcaacctaaaa

SEQ ID NO: 48536 - DNA, 50 bp, homo sapien
cttcactgggtccttttcagatatargtaagtcagtagaaacagtgtcag

SEQ ID NO: 48537 - DNA, 50 bp, homo sapien
ttcaataaaattcaacttgacttcayggtaaaaatccttaacaaattata

SEQ ID NO: 48538 - DNA, 50 bp, homo sapien
tgagacccatggtggtgtgcaatagraatggtaatttgactctctgcagt

SEQ ID NO: 48539 - DNA, 50 bp, homo sapien
cttagtaatgttcccttaatacttamccatggatgtgtttgcttttgtga

SEQ ID NO: 48540 - DNA, 50 bp, homo sapien
tacgtcacattctgaatattcctgcsatggttttagttacattaagcctc

SEQ ID NO: 48541 - DNA, 50 bp, homo sapien
taatgttgtgttcaaatatgattaayagacaagacaacaaaagggtgatt

SEQ ID NO: 48542 - DNA, 50 bp, homo sapien
tagttcttgcattctcttaccatgayatatgtggaaacttagatataaat

SEQ ID NO: 48543 - DNA, 50 bp, homo sapien
cagccggtcattacttatagaaaacsgacatgtcttctagacactttaag

SEQ ID NO: 48544 - DNA, 50 bp, homo sapien
cccagtgactgttgactctagtcccragatagactaagtctctaaagttt

SEQ ID NO: 48545 - DNA, 50 bp, homo sapien
ttaggctaattgttgaagtaacataycttttaaaatgtatttaaatgata

SEQ ID NO: 48546 - DNA, 50 bp, homo sapien
aataaaatgccagtgactaagcctayagaaatggagatgcatgaaagcct

SEQ ID NO: 48547 - DNA, 50 bp, homo sapien
atattgctgtactgtatatccattawaaaggtgatttttcagctaagctg

SEQ ID NO: 48548 - DNA, 50 bp, homo sapien
aaaaatattgactgaggatgaagcaygttcaaagcaaattgaattaaatt

SEQ ID NO: 48549 - DNA, 50 bp, homo sapien
cgaagcctctccctctttgtaattayatctgtttttttctagttgttctc

SEQ ID NO: 48550 - DNA, 50 bp, homo sapien
aaaataatataagacagggaaatcartcttagaaatatgatcattaagta

SEQ ID NO: 48551 - DNA, 50 bp, homo sapien
taaacagaaaatattaatgcaagaaygcaaaagtaatgaggttcttccag

SEQ ID NO: 48552 - DNA, 50 bp, homo sapien
aaatattttaaaattattgggtagaygacatatatataagagaggcatta

SEQ ID NO: 48553 - DNA, 50 bp, homo sapien
aacttctgttctttaccttcagtacrgaacttcaatgatttatctttctc

SEQ ID NO: 48554 - DNA, 50 bp, homo sapien
tatcaaattatgtgataatacactcratggctttcaactaaccaactttt

SEQ ID NO: 48555 - DNA, 50 bp, homo sapien
atttattcattgttcttcatgtgtasaaatagaagcaaatccctcaacat

SEQ ID NO: 48556 - DNA, 50 bp, homo sapien
aaagtggtaatcctattaggaattayaaggtcattgataatgtcagcctc

SEQ ID NO: 48557 - DNA, 50 bp, homo sapien
attcgaaagtttctccatatgttgaygtggagctattaatgtggtattgc

SEQ ID NO: 48558 - DNA, 50 bp, homo sapien
taattatatacgtaaacttcaatgaygtgcaagtttaacacacatatatc

SEQ ID NO: 48559 - DNA, 50 bp, homo sapien
ctctgtgtcattttctgctcaataawaatcctactttgattgactaaata

SEQ ID NO: 48560 - DNA, 50 bp, homo sapien
ttggcaagtatgtcaggcatatggartcaataagagtgcagaggttgaga

SEQ ID NO: 48561 - DNA, 50 bp, homo sapien
tatataaatatgttacattgggtcckctttattttgacaagtagcattca

SEQ ID NO: 48562 - DNA, 50 bp, homo sapien
catgtaatatgcaaagcaccctgtgraggataatgtttgttaaagccatg

SEQ ID NO: 48563 - DNA, 50 bp, homo sapien
tgctattatatacaaattaaactccragaatatttgatctttctatcctt

SEQ ID NO: 48564 - DNA, 50 bp, homo sapien
agggaacatgtattaagactggaaamactgtgctctgggtcaatgaacat

SEQ ID NO: 48565 - DNA, 50 bp, homo sapien
aagcacatcataagatttaatgagaracaacaaatgataaagtcaataat

SEQ ID NO: 48566 - DNA, 50 bp, homo sapien
attttatgtatcaggttgttcttacrctgctctaaaaaaaatacctgaca

SEQ ID NO: 48567 - DNA, 50 bp, homo sapien
ctcaaatatgcatttcattaaggacyctaggtggttcagatccagagggt

SEQ ID NO: 48568 - DNA, 50 bp, homo sapien
ttctagagtgctatttgtgaaagtarcatgatttgggaagtcttaataag

SEQ ID NO: 48569 - DNA, 50 bp, homo sapien
atttatgtgtaggcttatgcgcacastgaaacatacacagacacccatac

SEQ ID NO: 48570 - DNA, 50 bp, homo sapien
cctcctaaaagtggatgcattctgaratccatttactaaagtgaaaggga

SEQ ID NO: 48571 - DNA, 50 bp, homo sapien
tttctaagctctgaaagctgcatgarggtagaagcaataccagagtcatt

SEQ ID NO: 48572 - DNA, 50 bp, homo sapien
aaacaaccaggctacaaccatatatyagccgaagagttactaaacccatc

SEQ ID NO: 48573 - DNA, 50 bp, homo sapien
tgtttcatgcttataagcataattgsaatgcctaaaataagatgaaattg

SEQ ID NO: 48574 - DNA, 50 bp, homo sapien
ggttcacagctacttccttcctaaaytctatcttcctaccagggcaaagc

SEQ ID NO: 48575 - DNA, 50 bp, homo sapien
gcagattcagctaatgagtgccttcraccactaaaatgagattcattgtt

SEQ ID NO: 48576 - DNA, 50 bp, homo sapien
tcttgttttgtgacatagacatttaraactatgtattttcctttaaggac

SEQ ID NO: 48577 - DNA, 50 bp, homo sapien
tgcttggtcaacctatatttaatcartcagttctatccctgtataaaaaa

SEQ ID NO: 48578 - DNA, 50 bp, homo sapien
acagtttgccacattaggatgccaastgcaattttgtcataagactgttt

SEQ ID NO: 48579 - DNA, 50 bp, homo sapien
tgcacctgtagttctgctttgcaagrcacagaaatggattttctccacaa

SEQ ID NO: 48580 - DNA, 50 bp, homo sapien
acgtaatatgaaagtgcaagaactcraacttagtagacattaacaggaca

SEQ ID NO: 48581 - DNA, 50 bp, homo sapien
gtacaaagttggattaggaattgtaygcagaaaattacatattcagaaag

SEQ ID NO: 48582 - DNA, 50 bp, homo sapien
ctctgagaagttctttaatgctaacraaaaaagctctgaatagttgtgga

SEQ ID NO: 48583 - DNA, 50 bp, homo sapien
cacttgccccagtactgagaccttamaaatggcaatctttggaacactgt

SEQ ID NO: 48584 - DNA, 50 bp, homo sapien
catgaccactacttctcaatagttcraaaattatattaactgaattacac

SEQ ID NO: 48585 - DNA, 50 bp, homo sapien
gggttttattacacttcaagaaatakagcattctttgattactttaaata

SEQ ID NO: 48586 - DNA, 50 bp, homo sapien
taataaaaccccagcaaatttgacaygtaccctttctaccatggctacgt

SEQ ID NO: 48587 - DNA, 50 bp, homo sapien
tatttcctatgtaataaggctaggasagataatcatgacatttatgagat

SEQ ID NO: 48588 - DNA, 50 bp, homo sapien
aagaagctctcttacgattctcaaayaggattgacaaaatagctctttta

SEQ ID NO: 48589 - DNA, 50 bp, homo sapien
aatggtttaagctctttctttcttayagtacaacttgtcaaactgtcact

SEQ ID NO: 48590 - DNA, 50 bp, homo sapien
attgacatgtaatttccttcacaaaytggccttttcacggtttgtcaaaa

SEQ ID NO: 48591 - DNA, 50 bp, homo sapien
aagagttgttgagtataacctcagastacttacatcagagaaggaagtga

SEQ ID NO: 48592 - DNA, 50 bp, homo sapien
tttaatggatatttatccgtcttgcyatatgactaagcagatgaacaaat

SEQ ID NO: 48593 - DNA, 50 bp, homo sapien
aaaaatttgtttttaaaggatttagycatgtttgggatctaactacattt

SEQ ID NO: 48594 - DNA, 50 bp, homo sapien
taaagtgaaaaaactttttgattaaygaaagagaagatagcataagaaag

SEQ ID NO: 48595 - DNA, 50 bp, homo sapien
ttcatatccagaactaagcacaatasaccacttttagaccaccctctttg

SEQ ID NO: 48596 - DNA, 50 bp, homo sapien
atcctactgctactttactttcaatkactttggcattccgtgttaaaatg

SEQ ID NO: 48597 - DNA, 50 bp, homo sapien
acaaactccaacatttatagaaacaytaagattgcagtaatgatttcagg

SEQ ID NO: 48598 - DNA, 50 bp, homo sapien
tcataacccttttataactagtaacmactcttactccttgagaatagcta

SEQ ID NO: 48599 - DNA, 50 bp, homo sapien
gtggttactagttataaaagggttaygatttctgtgtttaaaaaagtagt

SEQ ID NO: 48600 - DNA, 50 bp, homo sapien
ccatttcaccatatatgttatgatakctagtcattaaaacgtagctgtca

SEQ ID NO: 48601 - DNA, 50 bp, homo sapien
tattttagttttcttcctgttgtagraggtaatgactacatggtagcaaa

SEQ ID NO: 48602 - DNA, 50 bp, homo sapien
aaaaaacaaaaattgcaattcattayagtaactacatgtttatgctgctt

SEQ ID NO: 48603 - DNA, 50 bp, homo sapien
tgacatagtttagaaattccctgacyggatccaagttgaactaaggccag

SEQ ID NO: 48604 - DNA, 50 bp, homo sapien
aaatttaatttctgtagtagttagcyatgtctcatcatattatttaaaat

SEQ ID NO: 48605 - DNA, 50 bp, homo sapien
cagaggactgaagtctgttgtgaaawggtaaaagaaacaatgctcagtga

SEQ ID NO: 48606 - DNA, 50 bp, homo sapien
ggagctgactgagcaacaataaaagmcttagtatcccattaagagaagtt

SEQ ID NO: 48607 - DNA, 50 bp, homo sapien
ggtattgaagaatgtggtaagaaatsatgataaataaggatatgctgata

SEQ ID NO: 48608 - DNA, 50 bp, homo sapien
attgtatgtctatgattcactaacasctagaaaacgatattttttaatgt

SEQ ID NO: 48609 - DNA, 50 bp, homo sapien
aatccttgagcaccgtatctggcaartaatgaatgcttaatatatgtagc

SEQ ID NO: 48610 - DNA, 50 bp, homo sapien
ataaactttaacaatatttgaattaygacacataggtaaagaaagtttca

SEQ ID NO: 48611 - DNA, 50 bp, homo sapien
ttgccatttctattatgttaccaaaytattttccagcagatttacttgtt

SEQ ID NO: 48612 - DNA, 50 bp, homo sapien
ttttaaacaaaatcaccaataaaaaktacaaaaacatgaaaaatgtggca

SEQ ID NO: 48613 - DNA, 50 bp, homo sapien
tggcagctgcttatcaactttattayggcaccaagtataggagatttcca

SEQ ID NO: 48614 - DNA, 50 bp, homo sapien
tagaggtttattgatcactcaaggarcattacaaggaaagtacatctcat

SEQ ID NO: 48615 - DNA, 50 bp, homo sapien
ttattatgtcctccttgattcattckctaaaactataaaatgtagtcttc

SEQ ID NO: 48616 - DNA, 50 bp, homo sapien
tatacacgcctaattgtcttgtttgraaagatacataatcagtttgattg

SEQ ID NO: 48617 - DNA, 50 bp, homo sapien
tgctttattgaaaacactctttgcartcttagaaaggagagatcaaaatc

SEQ ID NO: 48618 - DNA, 50 bp, homo sapien
aacaatcaactttctccaaacatacrcatttctagtttagttctaggttt

SEQ ID NO: 48619 - DNA, 50 bp, homo sapien
ttttttaaactgaagtaaaacataawgtaactgaactaaaattaatgtga

SEQ ID NO: 48620 - DNA, 50 bp, homo sapien
cacacttgtgtgttgaagaaattccyaagtattaattcaatttgtaagca

SEQ ID NO: 48621 - DNA, 50 bp, homo sapien
atttgaaaactctaaaattgaagtartacatttttctattcacagacact

SEQ ID NO: 48622 - DNA, 50 bp, homo sapien
tgttgacagattcaggctatcaggcygacgtcttcatttcctcgctggct

SEQ ID NO: 48623 - DNA, 50 bp, homo sapien
gaaattacatatttataattgatcarctgcttatggttatcatgctttct

SEQ ID NO: 48624 - DNA, 50 bp, homo sapien
aaacaaacttctccgtctattctacwgtaaataatagtcgttcacacttg

SEQ ID NO: 48625 - DNA, 50 bp, homo sapien
tgctgaagatcttgatgctatagacmatatgttgctagtggttcacattt

SEQ ID NO: 48626 - DNA, 50 bp, homo sapien
aatttggatagaatagcaactggtartaataggcaaaattcagccaaaga

SEQ ID NO: 48627 - DNA, 50 bp, homo sapien
gagataaaatattcctcaggttacawgtttatctggggctgttttccttg

SEQ ID NO: 48628 - DNA, 50 bp, homo sapien
tcttgggaatattgatgacagatttwaaaatgtgtttaattaatataatt

SEQ ID NO: 48629 - DNA, 50 bp, homo sapien
ctattccagggtctaatttagactaygtagaatggtgttgaagaaaagag

SEQ ID NO: 48630 - DNA, 50 bp, homo sapien
tgccctacaattcattatagcacaayctttaacacaccacttaataactg

SEQ ID NO: 48631 - DNA, 50 bp, homo sapien
ccatgttgaaaaacattgacctgaartggtggttctaaagcttcggtgaa

SEQ ID NO: 48632 - DNA, 50 bp, homo sapien
acttacaatcaaatggagaaactgaygtaactatagtttctattccaagt

SEQ ID NO: 48633 - DNA, 50 bp, homo sapien
tgagcagctgcctggtcctctgaaayaggagataaaagatctcagctaat

SEQ ID NO: 48634 - DNA, 50 bp, homo sapien
caaaatgaaaaccatgccaagctaawtgaaaggaagacaataagctttct

SEQ ID NO: 48635 - DNA, 50 bp, homo sapien
gttcagcctgtcaactatggttttcwctgcaggataatctgttggccaga

SEQ ID NO: 48636 - DNA, 50 bp, homo sapien
ggttccactggcattgacatctttaygagtgactttccatcccttgaacc

SEQ ID NO: 48637 - DNA, 50 bp, homo sapien
aatcgaagataattaactgacaaaaygttagaattaataagacagccctg

SEQ ID NO: 48638 - DNA, 50 bp, homo sapien
gctgtgcagccttggacaagttactyaacaaaattgagcatctgtttcct

SEQ ID NO: 48639 - DNA, 50 bp, homo sapien
ttaatcttttaacaaactttccatawactgatccaaagtacaattggtac

SEQ ID NO: 48640 - DNA, 50 bp, homo sapien
aaaaaggtgatgtaacagtatgaaascatgaaataacgtctttgtgattt

SEQ ID NO: 48641 - DNA, 50 bp, homo sapien
gtttatttctaaacaaatgttaccakaattgatcacagtgtttttaagta

SEQ ID NO: 48642 - DNA, 50 bp, homo sapien
ttttgctccttattacacccaaagayattctgtaggctgatcagagacct

SEQ ID NO: 48643 - DNA, 50 bp, homo sapien
atcaggtgacctacagtatggaggamtcataatcttataaattacatcca

SEQ ID NO: 48644 - DNA, 50 bp, homo sapien
agagccatgtctctacatctagtaaygttatcagtagttgtaaaactcac

SEQ ID NO: 48645 - DNA, 50 bp, homo sapien
gattgaaaaataattagcaattggartataggcacctacaagtgtcatag

SEQ ID NO: 48646 - DNA, 50 bp, homo sapien
gataggtgggacaataattgataacwgaaaaaactaaaagggacttaaga

SEQ ID NO: 48647 - DNA, 50 bp, homo sapien
ccgtactagttcacaggatgcattaragaggtcctgtttgagagaaggaa

SEQ ID NO: 48648 - DNA, 50 bp, homo sapien
catagttgtgaataatttacagcgamtagatacaatatactttgccaaca

SEQ ID NO: 48649 - DNA, 50 bp, homo sapien
agcttgaaaatgagatcaaacttccrgaaagaaatatgctttatataaat

SEQ ID NO: 48650 - DNA, 50 bp, homo sapien
gtaacatagtcttttagaactaataygtggaatcatgaatatgtttatgg

SEQ ID NO: 48651 - DNA, 50 bp, homo sapien
ttcactccttcctctgagagcatcarattgcgccagatcaatatttgcaa

SEQ ID NO: 48652 - DNA, 50 bp, homo sapien
gtggaccttaatcaaatataactcaygtcctgacagaaagggaaaacttg

SEQ ID NO: 48653 - DNA, 50 bp, homo sapien
tttgccttgattcttaagtgttagayaaaatttgaagtatacactgttct

SEQ ID NO: 48654 - DNA, 50 bp, homo sapien
cttatgctccatgttagtgagcaggkatgatgcttttccctccctaaata

SEQ ID NO: 48655 - DNA, 50 bp, homo sapien
ttgtggaaaagccccttactgtttawattattgtcttatcaagaaatagc

SEQ ID NO: 48656 - DNA, 50 bp, homo sapien
taaaaaatattgccaattaactgacwactgaaaagcagagaaggagccat

SEQ ID NO: 48657 - DNA, 50 bp, homo sapien
gaatgttctatgtggatgcacattaygagacattttcattgcaaatttgt

SEQ ID NO: 48658 - DNA, 50 bp, homo sapien
cttcaggaagctaagggccttcaaartttctattgctttacattacctac

SEQ ID NO: 48659 - DNA, 50 bp, homo sapien
gcactttaggcaacccaaacatctaygtgaagaggatcacctttaaatta

SEQ ID NO: 48660 - DNA, 50 bp, homo sapien
agactagcttcaatctaagataagtsaaagcagtaaaaacttgttttaga

SEQ ID NO: 48661 - DNA, 50 bp, homo sapien
cttattgatagtaacaaactttaaamtaattcatacttgagtaataattg

SEQ ID NO: 48662 - DNA, 50 bp, homo sapien
aatccacttttattttccttctatawgataactaattggcccacaattaa

SEQ ID NO: 48663 - DNA, 50 bp, homo sapien
aagactatttctcaaaattaatagargtagtgcttaagtgagggagtaaa

SEQ ID NO: 48664 - DNA, 50 bp, homo sapien
atattgcatgattgagaagttacaarttaattcattagtcaggcaatggg

SEQ ID NO: 48665 - DNA, 50 bp, homo sapien
attcaccagaaatcaatgcagataargactacatcgtatacagttaatat

SEQ ID NO: 48666 - DNA, 50 bp, homo sapien
aatgtaaaagctttgatccaaactasgtattagtctacaaggaataggaa

SEQ ID NO: 48667 - DNA, 50 bp, homo sapien
caaaccatctccttctccttcaaaasttgtccttccctagtcctaaatgg

SEQ ID NO: 48668 - DNA, 50 bp, homo sapien
aagaaggaagcatcaatttagtcacygaggaacataacagatgagaaaaa

SEQ ID NO: 48669 - DNA, 50 bp, homo sapien
agtctcagatcaattctgagaaagayaaagagctgtattgatctaacaaa

SEQ ID NO: 48670 - DNA, 50 bp, homo sapien
acatgatttggcaaagatgtcataartaaatccaatccatttcttatcat

SEQ ID NO: 48671 - DNA, 50 bp, homo sapien
ttcaatagggatgaataactttaacygattttctattatctagactaatg

SEQ ID NO: 48672 - DNA, 50 bp, homo sapien
gaggcagtggacattttgtttataakggacattagatcgaagcatccagg

SEQ ID NO: 48673 - DNA, 50 bp, homo sapien
cttattaatttcatatcctttgtaaratagagataataatagtatctttc

SEQ ID NO: 48674 - DNA, 50 bp, homo sapien
acttctgtctagtggatcatttaaamctccatcactacagagtaaatatt

SEQ ID NO: 48675 - DNA, 50 bp, homo sapien
ttgcctgtatcccttgtctctataaygactgtgacacaatgcttaattgc

SEQ ID NO: 48676 - DNA, 50 bp, homo sapien
tccatgagcttcaaggtctaattaaygcctgtgaaaaatgaatatttcct

SEQ ID NO: 48677 - DNA, 50 bp, homo sapien
cgtagctagattttatttcatattgrcaaatgcttataatatttgtgcaa

SEQ ID NO: 48678 - DNA, 50 bp, homo sapien
tatgaatctcagcctcagaacgacaytgatttttgaaaaggttgcctatt

SEQ ID NO: 48679 - DNA, 50 bp, homo sapien
taatgcttttgcttgctgttctcacygtagagccagccttccattgcttt

SEQ ID NO: 48680 - DNA, 50 bp, homo sapien
ttaacatgatttacttgttaacaaakaatttgatcaattactaattgcac

SEQ ID NO: 48681 - DNA, 50 bp, homo sapien
ttcaatgtctcatagcttgtaagaakgagacttcatgaaattttcataaa

SEQ ID NO: 48682 - DNA, 50 bp, homo sapien
acgaaggggattacagcaattgaaasgctcctgttaatcctcttagtttg

SEQ ID NO: 48683 - DNA, 50 bp, homo sapien
aattatttaaattccaaataatatcmaagactagaaatggccgtggtcaa

SEQ ID NO: 48684 - DNA, 50 bp, homo sapien
ttactataaaaatcaggataaactcsaaatagatactttaaaattctaaa

SEQ ID NO: 48685 - DNA, 50 bp, homo sapien
acattatttatttttcattgtgagayactaaaaactgttaatcagactac

SEQ ID NO: 48686 - DNA, 50 bp, homo sapien
ttgcagtttttatgaaaaatgttaargtgactttgggagctcagccctca

SEQ ID NO: 48687 - DNA, 50 bp, homo sapien
atttgctctcccagaaattcttcagyccttagatgggtagacaggtagag

SEQ ID NO: 48688 - DNA, 50 bp, homo sapien
tcttttaacttccaggtaaaatagaractgctatggtatacaaccaaatt

SEQ ID NO: 48689 - DNA, 50 bp, homo sapien
tcaacacacaaacccacaccaaataragggcaattacattgattcagtta

SEQ ID NO: 48690 - DNA, 50 bp, homo sapien
ctttgcaagtagataataggaattayggagtttgtggacaaacaggagga

SEQ ID NO: 48691 - DNA, 50 bp, homo sapien
tattaagtgaacttgttttaatcacygatgggaacaagagaactgcatgg

SEQ ID NO: 48692 - DNA, 50 bp, homo sapien
aggttttctcaaaattcatatcatarggatcactgagaagcttcttaaaa

SEQ ID NO: 48693 - DNA, 50 bp, homo sapien
tttaaataatgtagtttaaaacagamgctcatatagaacaaagttatgta

SEQ ID NO: 48694 - DNA, 50 bp, homo sapien
tgtatgcaatgatgtacagtcttccrcagatttaccaccacaactatcca

SEQ ID NO: 48695 - DNA, 50 bp, homo sapien
tacacattccctagctcttaaatcastctggttattcagccctaggaaga

SEQ ID NO: 48696 - DNA, 50 bp, homo sapien
atggttcataaatatcatttgtatawagctatggtatgagaagagggtct

SEQ ID NO: 48697 - DNA, 50 bp, homo sapien
ttaaagaggaggtagagaaatatacrggtagaaagtttgttcaaagggat

SEQ ID NO: 48698 - DNA, 50 bp, homo sapien
atttgaaagaacttggatattgtgawctaaggtgtatttgctttggaggg

SEQ ID NO: 48699 - DNA, 50 bp, homo sapien
cttatttcttcaagtttgctacaaargaattagggatattaaagaaacat

SEQ ID NO: 48700 - DNA, 50 bp, homo sapien
caagtgttttaaaatcaactattaayctaccatggctcaatcaagaaagt

SEQ ID NO: 48701 - DNA, 50 bp, homo sapien
atattcttaaaccctcaatccatcayctaatagctataaaattcataatt

SEQ ID NO: 48702 - DNA, 50 bp, homo sapien
ttagcacaaagaagaaatcgttaacrgataaagaagcaagactaaacctc

SEQ ID NO: 48703 - DNA, 50 bp, homo sapien
tttaagtcactatttagcccatccartcagaaccaggattccaggtaccc

SEQ ID NO: 48704 - DNA, 50 bp, homo sapien
caaatattcattttggaatcaacaartaatagctaactttctgatttagc

SEQ ID NO: 48705 - DNA, 50 bp, homo sapien
ttttttcagcaaatatatttcgttcragtcaaggaaaccattaaatcatg

SEQ ID NO: 48706 - DNA, 50 bp, homo sapien
catatgtgtatttagcagcttaaatsattggaatgtacaaataacttagt

SEQ ID NO: 48707 - DNA, 50 bp, homo sapien
taaggaaaaatatagtacactttacrgatttgcaggttttgctatttata

SEQ ID NO: 48708 - DNA, 50 bp, homo sapien
aaaattacaatttatcttactgctaycatttgtgttttcaatcttcatct

SEQ ID NO: 48709 - DNA, 50 bp, homo sapien
attctcaggatttcactatagaagcmgcatatactgtgtaatttttaatt

SEQ ID NO: 48710 - DNA, 50 bp, homo sapien
acctaagtgtccatcaatggatgtakgaagataatgtggtgtatgtacat

SEQ ID NO: 48711 - DNA, 50 bp, homo sapien
atccacccaacaaagagttaattgcyagaaaatataaggaagtcaaacca

SEQ ID NO: 48712 - DNA, 50 bp, homo sapien
caagtcatcccatttttaatatatakctccaactaaagaagatacaaatc

SEQ ID NO: 48713 - DNA, 50 bp, homo sapien
ctatagaaagactgcaacatcattayaggttttaagagattttattgata

SEQ ID NO: 48714 - DNA, 50 bp, homo sapien
cactcagcaggtaacccatggtgaaygcctcttacctctgttgtttttcc

SEQ ID NO: 48715 - DNA, 50 bp, homo sapien
tcctgttaggaatcatcgagggaccygaaacagtaatgtaacatatattt

SEQ ID NO: 48716 - DNA, 50 bp, homo sapien
ctttgggcaaaatcatttattaaaamtctaatctgctaagtgattatttt

SEQ ID NO: 48717 - DNA, 50 bp, homo sapien
attttaatggcatgcttattttataragtgataatgtgaattaaattagt

SEQ ID NO: 48718 - DNA, 50 bp, homo sapien
gataaataagattcacacaagggatkaaatctgtttagtcctgctcaagg

SEQ ID NO: 48719 - DNA, 50 bp, homo sapien
aaagctatagaaaataggaaatagaygttcttatgaatgtaatactgtat

SEQ ID NO: 48720 - DNA, 50 bp, homo sapien
aattactggaaagtccacacctaacygtgaagaatagtcagagtcctatt

SEQ ID NO: 48721 - DNA, 50 bp, homo sapien
ggaatcgagtgaggtttgactgatasaaagtgcacatgtaagatttttgg

SEQ ID NO: 48722 - DNA, 50 bp, homo sapien
tggcccttgttcattctaccaaatcyattcccaatcgtctaacagttatg

SEQ ID NO: 48723 - DNA, 50 bp, homo sapien
gaaagtaacgatagttcagaaagatmagaataaatcagcagtttctgcag

SEQ ID NO: 48724 - DNA, 50 bp, homo sapien
atttcagtatctcctaaactcttgcyatgcaggaaaaattattttatgtg

SEQ ID NO: 48725 - DNA, 50 bp, homo sapien
aaactctagttggctttcctagttaygcacttctgctaaagtggctttgc

SEQ ID NO: 48726 - DNA, 50 bp, homo sapien
taaatattatgtgttgtggattaaayttgtgcgcttaaataaatttcagt

SEQ ID NO: 48727 - DNA, 50 bp, homo sapien
agttatttaatctcaattgtatcacygaatgtgaaagtcaggaagtcaaa

SEQ ID NO: 48728 - DNA, 50 bp, homo sapien
agtgatcatgggtcttaaatggtcasacaaaacgatatgcttttattgtt

SEQ ID NO: 48729 - DNA, 50 bp, homo sapien
ttcctaaagattacactggcttttamaaaataatttacaagcaaacttat

SEQ ID NO: 48730 - DNA, 50 bp, homo sapien
acagagccatgacattgtgagtaacracaactttgctacctctttctcct

SEQ ID NO: 48731 - DNA, 50 bp, homo sapien
accacctacattgcacatattttaawtaggcacttttaaccataatatac

SEQ ID NO: 48732 - DNA, 50 bp, homo sapien
aatgtcttctcttacttccaatcacrgtgatgttatctcctgcaggtctt

SEQ ID NO: 48733 - DNA, 50 bp, homo sapien
cttaagttaatttgatttttatatascactaagaatgtatgtagttgttt

SEQ ID NO: 48734 - DNA, 50 bp, homo sapien
tcaccactaaagaagtgacatatttraaaaatgatacggcagttctttga

SEQ ID NO: 48735 - DNA, 50 bp, homo sapien
tgctggagaaacatttgctaataatragtgaaaaccactggaatcctact

SEQ ID NO: 48736 - DNA, 50 bp, homo sapien
tacccaccttgataaccaataataartggaagatacagtaaaacaaaaaa

SEQ ID NO: 48737 - DNA, 50 bp, homo sapien
gaaaaaccatctaatttatctctgaygttactattcttgtctcatgtttc

SEQ ID NO: 48738 - DNA, 50 bp, homo sapien
acagtaactcatccaagcattcatawcataactaaatccctaccctaaac

SEQ ID NO: 48739 - DNA, 50 bp, homo sapien
cataacagttattaagatctatttaygcatttcaaaccattctttgagga

SEQ ID NO: 48740 - DNA, 50 bp, homo sapien
ttctatagaaatcaatttttaaaatyacttacttgtgctttgaccaattc

SEQ ID NO: 48741 - DNA, 50 bp, homo sapien
ttctgtttcactctctgattttctasagataaaagtactgtgtgtagaga

SEQ ID NO: 48742 - DNA, 50 bp, homo sapien
tcttagaaactagagcaacaaatacyatattatataccattaaatacttt

SEQ ID NO: 48743 - DNA, 50 bp, homo sapien
ttgcaaaaatttttcctcttaatcayccgtatttactacttcatagttgt

SEQ ID NO: 48744 - DNA, 50 bp, homo sapien
agaagtgggagagaatggggtgtaasagctagtggtttcctttagggaag

SEQ ID NO: 48745 - DNA, 50 bp, homo sapien
ccctaaagacttactaactaaaatayagaccctattgccatccaaatacc

SEQ ID NO: 48746 - DNA, 50 bp, homo sapien
tttgtaatgtatttcatatgtagaaygtattcagaaaagagtcctaaata

SEQ ID NO: 48747 - DNA, 50 bp, homo sapien
aagtggaataaaatagaaaaactgaraatggcatgctaacggggaagggc

SEQ ID NO: 48748 - DNA, 50 bp, homo sapien
aagtagcttctatgcacggaacaatkattaaaatatgtaagtcttcttgc

SEQ ID NO: 48749 - DNA, 50 bp, homo sapien
cttgggaatcttcagatgtggagccratagggagttttctgattatgaga

SEQ ID NO: 48750 - DNA, 50 bp, homo sapien
gacaccttgatgcaggcttctttaaygcagagtaggacacagatggctgg

SEQ ID NO: 48751 - DNA, 50 bp, homo sapien
aagaaaatgcaattggatactctgaygttttttatgtctccaaagatagt

SEQ ID NO: 48752 - DNA, 50 bp, homo sapien
tagaaagagtttttagggtccataakccaaatctcacgttaatatggaga

SEQ ID NO: 48753 - DNA, 50 bp, homo sapien
tgtccatcacaacatctgactcttasatactcaatattgttctctgccct

SEQ ID NO: 48754 - DNA, 50 bp, homo sapien
cagagaccaagattctgtgtttgcayatatcagcacgtatggccctaaaa

SEQ ID NO: 48755 - DNA, 50 bp, homo sapien
tataaaaagagctcaagttattcacrgtagggaaatataaattaaagcct

SEQ ID NO: 48756 - DNA, 50 bp, homo sapien
gttttccaaagcttaagaactaccakatatatagattgctagcattttaa

SEQ ID NO: 48757 - DNA, 50 bp, homo sapien
tacaataaacataggatctaattagwcagctctaaaaccttcttcagtaa

SEQ ID NO: 48758 - DNA, 50 bp, homo sapien
atctatcaaatggactttacatatargaatcttgaatttcatgagactcc

SEQ ID NO: 48759 - DNA, 50 bp, homo sapien
tcagcagtggccttgtgagcacctamgttcacctcagccctgagcgagct

SEQ ID NO: 48760 - DNA, 50 bp, homo sapien
acggttattagcagccgagcattacyggatactgacaaggaggacaggta

SEQ ID NO: 48761 - DNA, 50 bp, homo sapien
ttaataaaagctgtgagttttatatyaccgtgtgtttttacgatggtgaa

SEQ ID NO: 48762 - DNA, 50 bp, homo sapien
agagggaagagccagagccttagtayggtcctgtcagtctggctaggaca

SEQ ID NO: 48763 - DNA, 50 bp, homo sapien
gttcaaaatttcaactaccacctacrcattttataactctgaaatgttta

SEQ ID NO: 48764 - DNA, 50 bp, homo sapien
atttttaaaatgactttcaaagacarctaatgaacaagacaatatgtaag

SEQ ID NO: 48765 - DNA, 50 bp, homo sapien
ttaggatttttaaaatcaatttcaamatttgtgaagtattttctttttca

SEQ ID NO: 48766 - DNA, 50 bp, homo sapien
tttctagtttacgtttatcaatttaygaattttctgaagatgggaccatt

SEQ ID NO: 48767 - DNA, 50 bp, homo sapien
agtgcccttataaaatagacccatargaactcgttcacccctcccaccac

SEQ ID NO: 48768 - DNA, 50 bp, homo sapien
cgggacgaatgctaggattcagtaartagaaactgccctatggagtggaa

SEQ ID NO: 48769 - DNA, 50 bp, homo sapien
ctgctccttctccttaattctccaamgcaccattcatacaaagctgttgt

SEQ ID NO: 48770 - DNA, 50 bp, homo sapien
agtgaaaacattcagtatttgtcatyaaatcattttccattattgaaagt

SEQ ID NO: 48771 - DNA, 50 bp, homo sapien
ctccttttgatgcaggtatacctaaytacattcaactagagggattaaat

SEQ ID NO: 48772 - DNA, 50 bp, homo sapien
tacctataaagggtagagtgacttaycgcaagtgttcagcatttagaagt

SEQ ID NO: 48773 - DNA, 50 bp, homo sapien
tacttatagtttttattgctttgcaytaaccaataattatgtgtacaaaa

SEQ ID NO: 48774 - DNA, 50 bp, homo sapien
cacaagtaagttaataggcttaagcracttagaagcacagttcataactt

SEQ ID NO: 48775 - DNA, 50 bp, homo sapien
gttagttgatgttaatatgacattakcgttgtccagagtctggtgaggat

SEQ ID NO: 48776 - DNA, 50 bp, homo sapien
tcctatgtattttgtaggaaaatgarctctgaaaggaatcagtaatgagc

SEQ ID NO: 48777 - DNA, 50 bp, homo sapien
acctagaatgacttacatatttttarcaatgcgtaaacatactcatgctg

SEQ ID NO: 48778 - DNA, 50 bp, homo sapien
tagcaaggaaattatgtagaaaaagscttatagaaattaagcagaagaat

SEQ ID NO: 48779 - DNA, 50 bp, homo sapien
ttatgtcataaacaatggccaaaggwatttaaacttaaacatgtataatt

SEQ ID NO: 48780 - DNA, 50 bp, homo sapien
catttaatctccactggtaaataagraaatgcaaattacaaaaatcataa

SEQ ID NO: 48781 - DNA, 50 bp, homo sapien
ccctggggagggggcagtttcaagaytaaagagatagggaggccaaaaac

SEQ ID NO: 48782 - DNA, 50 bp, homo sapien
ataggcaaatgtgggcaagttcaagmcactattatctgaaagaatcatgt

SEQ ID NO: 48783 - DNA, 50 bp, homo sapien
agtcctgtaacttcttcctctataartctcataagtatttgctttctttt

SEQ ID NO: 48784 - DNA, 50 bp, homo sapien
ggggatacaaatggtcagtaaccaaygctaacatgactttcagcgccaag

SEQ ID NO: 48785 - DNA, 50 bp, homo sapien
ctttccctacatagttatagtagctsaagtcccttagtctctccacattc

SEQ ID NO: 48786 - DNA, 50 bp, homo sapien
agttgagaagttcacttctgaagtayggagaatctctaaatttctttcag

SEQ ID NO: 48787 - DNA, 50 bp, homo sapien
gtatttagaatatgccataataaaaygaactgaactttccacatcaatgc

SEQ ID NO: 48788 - DNA, 50 bp, homo sapien
aaccactgtttttgagtttcttttaygtttagttgaacttatattttaac

SEQ ID NO: 48789 - DNA, 50 bp, homo sapien
taagttatatcttccaattattttcraaattattaaaaaagctaatctct

SEQ ID NO: 48790 - DNA, 50 bp, homo sapien
ataatgatttacaaacttttgccaayggaagaaaataatgaggttgcttg

SEQ ID NO: 48791 - DNA, 50 bp, homo sapien
aaaggtgagtctttaaagaatttgcrccagttggatacagtctgaactaa

SEQ ID NO: 48792 - DNA, 50 bp, homo sapien
atcacaattgggtctctaaatagcayattaacttctctaaattattaata

SEQ ID NO: 48793 - DNA, 50 bp, homo sapien
caggtagtatctttataacagtgcgwaagtgaactagtaatatctttctt

SEQ ID NO: 48794 - DNA, 50 bp, homo sapien
agtctaacttgtattggataacagaygatactaaaaacagaagcttgaag

SEQ ID NO: 48795 - DNA, 50 bp, homo sapien
ctattaaagaagtagacgagattacyaagggagaaacttataagaggagc

SEQ ID NO: 48796 - DNA, 50 bp, homo sapien
aagaaagcagaaatgctataagttaygagggaaatggccactttgtgtca

SEQ ID NO: 48797 - DNA, 50 bp, homo sapien
aaactacattttctgccaggctctgraatatttaatcattgttgaaagga

SEQ ID NO: 48798 - DNA, 50 bp, homo sapien
gcattcaagtcttgccaaagtcttcsagtcttaggaaatcccatgaggga

SEQ ID NO: 48799 - DNA, 50 bp, homo sapien
tgaaatattaatgaattataacctamatgtccagagttgatgctccttag

SEQ ID NO: 48800 - DNA, 50 bp, homo sapien
tattttcttgagttgagaggttaaaratttactttcatatagtatggctt

SEQ ID NO: 48801 - DNA, 50 bp, homo sapien
agcaaaggcatcaaatacctaactcrcataaatgaccatgcctatatgtt

SEQ ID NO: 48802 - DNA, 50 bp, homo sapien
gacaatagttactaaagatgcctacyagaatattacaaggatatctactt

SEQ ID NO: 48803 - DNA, 50 bp, homo sapien
gttggttgtttattgatacattataraagcagcaatagagtatcttcaaa

SEQ ID NO: 48804 - DNA, 50 bp, homo sapien
ccttaatatgctttaattctaatcastctttcttccatcttcagtatttt

SEQ ID NO: 48805 - DNA, 50 bp, homo sapien
caacatacaaaagcgggaacaccatraaactgtctcttaaaaaacataaa

SEQ ID NO: 48806 - DNA, 50 bp, homo sapien
tgactagtaagtacatgaaaaggcastcaacattattagtcattggggaa

SEQ ID NO: 48807 - DNA, 50 bp, homo sapien
gggcattgctaatgtagtaaataaaygtcacaactttgaatctccaaaag

SEQ ID NO: 48808 - DNA, 50 bp, homo sapien
cacagtgtcagttctttcaataatamatgaaggtagaaattgggttccac

SEQ ID NO: 48809 - DNA, 50 bp, homo sapien
tgatatttgaaatatcctattaaaasaagaataattgcatactggatatt

SEQ ID NO: 48810 - DNA, 50 bp, homo sapien
cctcccacagccatacgttgacaacrcgtgccaaggcctggggcaacagg

SEQ ID NO: 48811 - DNA, 50 bp, homo sapien
ctattctgtcttagtgttctcagtaygattcttaaattggctgtttcaca

SEQ ID NO: 48812 - DNA, 50 bp, homo sapien
ggttgagaaatctaagatcaatatamaaaaccctggtatttccaaatgtt

SEQ ID NO: 48813 - DNA, 50 bp, homo sapien
aagtgtacctcaattttaaactacawgttatgttatgccctattacaaag

SEQ ID NO: 48814 - DNA, 50 bp, homo sapien
agctctcaatccttatcccacttgayctactggtaacatcccgcatgagt

SEQ ID NO: 48815 - DNA, 50 bp, homo sapien
ttctctttggtccaactaagtgaccyatctgtatgaaaatacacaagtgg

SEQ ID NO: 48816 - DNA, 50 bp, homo sapien
aggggacaaatactgcttgtttctaygtgcagaacagcaggaacataaca

SEQ ID NO: 48817 - DNA, 50 bp, homo sapien
atgggtcagaacagagtgagtcacayaaaccaccatgcagttcccaggtg

SEQ ID NO: 48818 - DNA, 50 bp, homo sapien
taggaagaaaataaataattgcgtakagtaaatctccaaggctatgagat

SEQ ID NO: 48819 - DNA, 50 bp, homo sapien
actataggaagtcttctatgaaccartatttctcccttctcaacccagat

SEQ ID NO: 48820 - DNA, 50 bp, homo sapien
acactgtctcttctactctcacatawcccttcaaaaacgccagtgcctac

SEQ ID NO: 48821 - DNA, 50 bp, homo sapien
cagtcacaatagtcctttctattcaygagaacaaccacttcctgggtgca

SEQ ID NO: 48822 - DNA, 50 bp, homo sapien
cagtggcagagttggaatggattccrgatgtctttgcgaacgattaagaa

SEQ ID NO: 48823 - DNA, 50 bp, homo sapien
atggtttaggctctgcagaccatacrattcctatcacaactcctcaactc

SEQ ID NO: 48824 - DNA, 50 bp, homo sapien
atttacaagtttctaatactgcaaamtaaatcaattatcaaataattcac

SEQ ID NO: 48825 - DNA, 50 bp, homo sapien
gtgaactgttggtaaccctttccaasatttgtcagaagtttgtaggagga

SEQ ID NO: 48826 - DNA, 50 bp, homo sapien
aagcagctgttacatacaaataattyaatgttttgcacagtaggcaaaat

SEQ ID NO: 48827 - DNA, 50 bp, homo sapien
tctttgaactcatttttagaaggtcracttcacaatctttcaaaacacaa

SEQ ID NO: 48828 - DNA, 50 bp, homo sapien
taaacatgaacactttgtgtaattgsatacaacttttattctttctggtc

SEQ ID NO: 48829 - DNA, 50 bp, homo sapien
ttaactagaaatgtctaggactcacraattgcataaatgcaccagtttac

SEQ ID NO: 48830 - DNA, 50 bp, homo sapien
tgaggagaaagtcaaaatataggaamaataccatgcagggtgagtacatg

SEQ ID NO: 48831 - DNA, 50 bp, homo sapien
tgtttaaacatgcaagaataagagcrgatgataatgaacatgtgaaagat

SEQ ID NO: 48832 - DNA, 50 bp, homo sapien
agggtaagtaaatatctccttttcamctcactcatgtttcatggggagga

SEQ ID NO: 48833 - DNA, 50 bp, homo sapien
cggaggcaatgtagttattgatgacragggaaatcatttgtaagctctgg

SEQ ID NO: 48834 - DNA, 50 bp, homo sapien
atgtgtttttccagttagaagttcayaggcactgatttttgcataatcaa

SEQ ID NO: 48835 - DNA, 50 bp, homo sapien
cctaaattcttatgttgatattgtakacctcagaatgtgacttatttgaa

SEQ ID NO: 48836 - DNA, 50 bp, homo sapien
tttctgccaatttgctttgaacagasacataatggaagcacaagaagagt

SEQ ID NO: 48837 - DNA, 50 bp, homo sapien
cttagcaaaacatggctctaaatagratttcaaaaccatacattgattac

SEQ ID NO: 48838 - DNA, 50 bp, homo sapien
aagatatctacttcgcatatcccatsagatggagagctacactccaccaa

SEQ ID NO: 48839 - DNA, 50 bp, homo sapien
tgcttagacaactgcctagttttccrctgaagacacccagtaatccttct

SEQ ID NO: 48840 - DNA, 50 bp, homo sapien
cacaacaggatgaagtcttgactcartatagcttgtaatccaagcacaga

SEQ ID NO: 48841 - DNA, 50 bp, homo sapien
cttacttcagggagatatagccttcrcttcatgttatggttggtgcagtc

SEQ ID NO: 48842 - DNA, 50 bp, homo sapien
ctattataagaaaaagtgttctgaawtccaaagtgttcaagaagtatttt

SEQ ID NO: 48843 - DNA, 50 bp, homo sapien
taagatagaatagaaacggaaggaasagaagatggtgtgaatacacaggg

SEQ ID NO: 48844 - DNA, 50 bp, homo sapien
aaagaataccttattttttaatagcraaagatctcttagaaggggttctt

SEQ ID NO: 48845 - DNA, 50 bp, homo sapien
caagagtcattttgtagcaaacaagratatagagaggactagaattattt

SEQ ID NO: 48846 - DNA, 50 bp, homo sapien
ctagatgtgtagcttctaactttgaraatttgattggagaactacaggaa

SEQ ID NO: 48847 - DNA, 50 bp, homo sapien
attagcctatgcacaactatcattaraatcccactgctaagtctaaaatc

SEQ ID NO: 48848 - DNA, 50 bp, homo sapien
actgtagatgattagtgtagctttcycagcatgcttttcacagccatcac

SEQ ID NO: 48849 - DNA, 50 bp, homo sapien
aaagattactgaatattaatatgaawgtttagttagatcttttttctcag

SEQ ID NO: 48850 - DNA, 50 bp, homo sapien
atatttattcaggaaccttacagaartctacaaaatagcttgttttggat

SEQ ID NO: 48851 - DNA, 50 bp, homo sapien
tattaacccctcctgcagaagtagcrgaatacagattcacagcttccctt

SEQ ID NO: 48852 - DNA, 50 bp, homo sapien
actgtggtggtggctgcttcgttcaytccttcattcttttcatatctttg

SEQ ID NO: 48853 - DNA, 50 bp, homo sapien
ttgccctttgtttgagttattgtctyactattgagttgttttagttccct

SEQ ID NO: 48854 - DNA, 50 bp, homo sapien
acattaaaagtggttatgattagaaygagtatcactgattaagcttccat

SEQ ID NO: 48855 - DNA, 50 bp, homo sapien
aaagccacagatagcccattgtgaawtgtaaagtgttaatgtcaaccggg

SEQ ID NO: 48856 - DNA, 50 bp, homo sapien
tggagactaataaaatgcagacaaaygaaattaactggaaacaaaaagtt

SEQ ID NO: 48857 - DNA, 50 bp, homo sapien
tttttacttatattgagtgctttaaraattaagaaacacttttaacagaa

SEQ ID NO: 48858 - DNA, 50 bp, homo sapien
atgttgattttgatgagccgtaaaayacattggtgtctggctcatcattc

SEQ ID NO: 48859 - DNA, 50 bp, homo sapien
gtaaaaaattctagagtaataaaaaygacagatagaatcaaagttctcca

SEQ ID NO: 48860 - DNA, 50 bp, homo sapien
attttgtttatcttgaaaaagaagayggttgctttgaaagaaaatatcat

SEQ ID NO: 48861 - DNA, 50 bp, homo sapien
gagaatgttgaacgcttgttaaataycttttgctagcctcttcatatgct

SEQ ID NO: 48862 - DNA, 50 bp, homo sapien
atatctgtgatatgtatgtatgatakgtttaggtagtcacttttttttct

SEQ ID NO: 48863 - DNA, 50 bp, homo sapien
atgtgtaagggaagtcttctggtackgcagatccccgttctccttcttcc

SEQ ID NO: 48864 - DNA, 50 bp, homo sapien
tagtatgaaataagctcaacctttgraatagagtcatataaaatttggtg

SEQ ID NO: 48865 - DNA, 50 bp, homo sapien
ataggtgaatactggcagccgtgccrataccaaagagatacctggaagcc

SEQ ID NO: 48866 - DNA, 50 bp, homo sapien
cactcggggatacagtcaggatgaakaaattattttacatttttagcaat

SEQ ID NO: 48867 - DNA, 50 bp, homo sapien
tttctaataaacagtatttcaagcartcttcctttaattagtgatgcttt

SEQ ID NO: 48868 - DNA, 50 bp, homo sapien
gagttttcaagacatttgtaaagaaraaggatagtggtaatagaaagtca

SEQ ID NO: 48869 - DNA, 50 bp, homo sapien
acatagctgggccggagctacttaasatcctagtgttcaaccgatagcat

SEQ ID NO: 48870 - DNA, 50 bp, homo sapien
tttgttctttccacgcacttaggaaygatacaatctctaattgcgtttac

SEQ ID NO: 48871 - DNA, 50 bp, homo sapien
aagaaacagatgggctataattcaartatttaagtgaacacacttttttt

SEQ ID NO: 48872 - DNA, 50 bp, homo sapien
aagaaatgcgctcaagaacttaaaaygtgtatttcatcagggagggttct

SEQ ID NO: 48873 - DNA, 50 bp, homo sapien
taagggttattggtgactgatgaaamtgtcaaacaaaagtggatgtaatg

SEQ ID NO: 48874 - DNA, 50 bp, homo sapien
gtgtatggaagatatccgttcacacsagtctggatgcgcccaggtcccca

SEQ ID NO: 48875 - DNA, 50 bp, homo sapien
gaaattcagaggcagagttacccaayagtagtaaaatagacctatagctc

SEQ ID NO: 48876 - DNA, 50 bp, homo sapien
ggaaaagtttcaaatgatggagctaygaaagatgtttgtcttgaatccca

SEQ ID NO: 48877 - DNA, 50 bp, homo sapien
atttcatattttaaatctcctcagargtatattatcccaagcaattttct

SEQ ID NO: 48878 - DNA, 50 bp, homo sapien
tatgtcaatactatgtttagtgctartaagatttctacttataatcacaa

SEQ ID NO: 48879 - DNA, 50 bp, homo sapien
ccagaaaggtgaatagtgttagacargcatacatttgccatcttttaaac

SEQ ID NO: 48880 - DNA, 50 bp, homo sapien
ttcctttctcttccagcatcagactyctatacctgcataatctacttcta

SEQ ID NO: 48881 - DNA, 50 bp, homo sapien
ggtcatttgtgatcctccctactgaygaagaatgtgatagtttctcacca

SEQ ID NO: 48882 - DNA, 50 bp, homo sapien
tgtcaaagcatatatctgtcaatcargagcaaagtgcacatttttcatgg

SEQ ID NO: 48883 - DNA, 50 bp, homo sapien
gtcttttgttttctgaccaatctaamaatacctgtgattaaatttaattt

SEQ ID NO: 48884 - DNA, 50 bp, homo sapien
gctgtgcccacgaggctgcactgacygggtcgtaaatgtatctgagatgt

SEQ ID NO: 48885 - DNA, 50 bp, homo sapien
attctgttatagctgttaaaattaascatcaactataaaatcaggtaata

SEQ ID NO: 48886 - DNA, 50 bp, homo sapien
agtaatcacagcctccatgaaatacrctacattttatgtaaatgaaattg

SEQ ID NO: 48887 - DNA, 50 bp, homo sapien
aaatagtctttacctggtaatctcartgaagagagaactaactaggttga

SEQ ID NO: 48888 - DNA, 50 bp, homo sapien
tttcaaaaatccaatataaacaaagycaaaagaaacactctactttttca

SEQ ID NO: 48889 - DNA, 50 bp, homo sapien
tagttagggtttctctcagtgggaasctcacgtgcaaaggcagtgaagca

SEQ ID NO: 48890 - DNA, 50 bp, homo sapien
acccgagggctgaggaagggatttamgaggaatagctggggccgggcgcg

SEQ ID NO: 48891 - DNA, 50 bp, homo sapien
caataagaatatgcaactacgtaatyagaccttgataccaggggagatag

SEQ ID NO: 48892 - DNA, 50 bp, homo sapien
acacagtcttccaagaatgttgtcartaatcttaacaggattgaactcag

SEQ ID NO: 48893 - DNA, 50 bp, homo sapien
acatatattactatttattttggtgmaaaactattaggctatttcaaagg

SEQ ID NO: 48894 - DNA, 50 bp, homo sapien
ttctgcaattgataaatgaaaattckgaatccaaactttaatgctagctc

SEQ ID NO: 48895 - DNA, 50 bp, homo sapien
ggtcttatatgcgtgaaaatgccctyaattagtgaaagaaggtgaatgac

SEQ ID NO: 48896 - DNA, 50 bp, homo sapien
atctaaaattctacttctatggcacrcaggtttttgtttagaaataaact

SEQ ID NO: 48897 - DNA, 50 bp, homo sapien
gcgtgtgctagctacttgtgattaamaatgtggatgtttgaaatgcatgc

SEQ ID NO: 48898 - DNA, 50 bp, homo sapien
aagagctaaggcaggagaaggatacraaaaaggtgaaggccaatcattct

SEQ ID NO: 48899 - DNA, 50 bp, homo sapien
ttgccctgccataccctatataaaakctatctaccctggctgggcaggcc

SEQ ID NO: 48900 - DNA, 50 bp, homo sapien
taagcaactgtagactttcgtgaacmcttttagccttaagtgcttaggat

SEQ ID NO: 48901 - DNA, 50 bp, homo sapien
tccaagctttaataagaactagtgarcctggaggatacagaggctggtat

SEQ ID NO: 48902 - DNA, 50 bp, homo sapien
attttgacaaaactgattaacactayggagatacttatgtagaagtagtc

SEQ ID NO: 48903 - DNA, 50 bp, homo sapien
tgtatgaaaagcaatttcttgctaamattacgtcatgtctccttagattt

SEQ ID NO: 48904 - DNA, 50 bp, homo sapien
gatagatgtgtagtgaagtaaacacygctcgataaagaacaaatgtacca

SEQ ID NO: 48905 - DNA, 50 bp, homo sapien
gcaagtcaggacctttcagaacaccrctatgatgttagaacccacgtgaa

SEQ ID NO: 48906 - DNA, 50 bp, homo sapien
gaaagagaacatcttaagctctctgwcaagaaagaatgtagtccatcagg

SEQ ID NO: 48907 - DNA, 50 bp, homo sapien
aacggttgtttccccactcatactawatggttctggaaggtactgataat

SEQ ID NO: 48908 - DNA, 50 bp, homo sapien
tgtaatcatctctctgtaagcaaatragtccactgagtttcagttctgtc

SEQ ID NO: 48909 - DNA, 50 bp, homo sapien
tttggattccaagtccagattcaccrgctagttccaatgggtttgagggg

SEQ ID NO: 48910 - DNA, 50 bp, homo sapien
accctttttattcacagtggaatacycttgaattttgcagatcatcaaac

SEQ ID NO: 48911 - DNA, 50 bp, homo sapien
tgtttgtaaagtacttacctcatgcyatctgtgtgagtgtcctaccaaac

SEQ ID NO: 48912 - DNA, 50 bp, homo sapien
atacctacatcataggaacatttgaygtaatagaggagagagtgagagaa

SEQ ID NO: 48913 - DNA, 50 bp, homo sapien
ctattgctaagtgcttagtttggaayagaggattaatgagcccggagaca

SEQ ID NO: 48914 - DNA, 50 bp, homo sapien
tgattctctttatattctaatgcatmataatggcggtgataagctaagta

SEQ ID NO: 48915 - DNA, 50 bp, homo sapien
agggccagaaatagacagcagtgaawctaatggtcagtaaacatggggaa

SEQ ID NO: 48916 - DNA, 50 bp, homo sapien
gcctttgatgacatggcttgaaagartaagtggatctttaatggacttct

SEQ ID NO: 48917 - DNA, 50 bp, homo sapien
taaatctgaaagagggtctatcaagraagaataaatggaatgtgaacata

SEQ ID NO: 48918 - DNA, 50 bp, homo sapien
ctaaatctatattgcatagttagtakcctcttataatagtaatcttgggt

SEQ ID NO: 48919 - DNA, 50 bp, homo sapien
tggaaggctttgaaatgacaaataaytaaatagttctaccttttaaaagt

SEQ ID NO: 48920 - DNA, 50 bp, homo sapien
taacatatttcatattctatgacacrgaacttaaaggtctcaattggaga

SEQ ID NO: 48921 - DNA, 50 bp, homo sapien
gagcgtgggctggacctcgttactcrcttctaatggatagaatatggcaa

SEQ ID NO: 48922 - DNA, 50 bp, homo sapien
tgaatttcagtgtgtcactgtctaayaacaggatctttccagctttaact

SEQ ID NO: 48923 - DNA, 50 bp, homo sapien
atgaagcgtagagcaaagtccacaakagatctgtaatgctctctgcctgc

SEQ ID NO: 48924 - DNA, 50 bp, homo sapien
aatgttgaaaattacctgtttatggmatttgttgaggaaggaatcaggga

SEQ ID NO: 48925 - DNA, 50 bp, homo sapien
cctaatggttctgggaggataattargttgtttatcacctttgatgctta

SEQ ID NO: 48926 - DNA, 50 bp, homo sapien
gttcaaatccctaccacaccacttgragaagatacttaatttatctgagc

SEQ ID NO: 48927 - DNA, 50 bp, homo sapien
ccagaatgaaatggcaaaaatggtcyacttagtgcaatcaacaagtttta

SEQ ID NO: 48928 - DNA, 50 bp, homo sapien
gaaaataattacaatagactacctgragccctagtatttccacaagttta

SEQ ID NO: 48929 - DNA, 50 bp, homo sapien
attcactatgtcatttaagatataaytgagatcattcatttcagggtcaa

SEQ ID NO: 48930 - DNA, 50 bp, homo sapien
caaagacttggacaaaagcctttaarcaacatattccattaaaaaaagaa

SEQ ID NO: 48931 - DNA, 50 bp, homo sapien
taaccataatacaaaaggatacagtraataatcaggaatgttctaatgag

SEQ ID NO: 48932 - DNA, 50 bp, homo sapien
aaagagtatgataaacataagaatgycaatatgtaccagcaattagttaa

SEQ ID NO: 48933 - DNA, 50 bp, homo sapien
tcctttctgtttaatagtactctcarctgaactctattctttttacattt

SEQ ID NO: 48934 - DNA, 50 bp, homo sapien
ctttgcttattgaaaggcagtgtgtraagtcttcaagaaagtgggctctg

SEQ ID NO: 48935 - DNA, 50 bp, homo sapien
ccacaacaaccctgtgaaaggaaaaycattattatcataccacttctaca

SEQ ID NO: 48936 - DNA, 50 bp, homo sapien
tctttaatgcattctctttgccatcygacaaaatcgtgcctcagtaattg

SEQ ID NO: 48937 - DNA, 50 bp, homo sapien
aaaggatcctggctgtctcagacacratagtttcctctggagacttgata

SEQ ID NO: 48938 - DNA, 50 bp, homo sapien
gaaaataaatctctagccactaagtraaattgccctaaagcttttcttat

SEQ ID NO: 48939 - DNA, 50 bp, homo sapien
atcacttactacaaagttgacaggarattgagggtagcagttaatgtata

SEQ ID NO: 48940 - DNA, 50 bp, homo sapien
aaatatatctaatactcaaattttawagaatgctctatcataccagatga

SEQ ID NO: 48941 - DNA, 50 bp, homo sapien
ctaaatatttggagatatgtctttgmataaaaatttatataaactacagc

SEQ ID NO: 48942 - DNA, 50 bp, homo sapien
caaaagcatgtgctacacaagctcawctgtcatattagctactaaacaca

SEQ ID NO: 48943 - DNA, 50 bp, homo sapien
aaatatatacatgtttctggaactayatatatgtctgtgtgtgtatacgt

SEQ ID NO: 48944 - DNA, 50 bp, homo sapien
ttttaacctttggaagaccacatccrcagaattgtacaaaaagtggttat

SEQ ID NO: 48945 - DNA, 50 bp, homo sapien
tgagttacttatcatttaagaaatawccaaactgctaacattgtaaaagc

SEQ ID NO: 48946 - DNA, 50 bp, homo sapien
tgaagagatgcagccctaatcttaayggcattgatctggaacagcttgga

SEQ ID NO: 48947 - DNA, 50 bp, homo sapien
ttgaataacgtgatcaaagtaaagaygtatgttctcaatttgggacaaat

SEQ ID NO: 48948 - DNA, 50 bp, homo sapien
gagcaaaagctcatacatctgaaggragatcaagttggtaaagcctttgg

SEQ ID NO: 48949 - DNA, 50 bp, homo sapien
tcactggttacttccatactggaaasacgaaggactgtccataaaactgt

SEQ ID NO: 48950 - DNA, 50 bp, homo sapien
actagtgaattcacaccttttcaaartttatcttcagagatgtatgtcaa

SEQ ID NO: 48951 - DNA, 50 bp, homo sapien
ctctaaaggccaacagcattctgagycctaatgttcaacaccaacaagat

SEQ ID NO: 48952 - DNA, 50 bp, homo sapien
aagctggatggagaatgacttcaacracttgacagaagtaggcttcagaa

SEQ ID NO: 48953 - DNA, 50 bp, homo sapien
tgaattctaaataagttcagagatayagtcatatttaaagttgtcctaca

SEQ ID NO: 48954 - DNA, 50 bp, homo sapien
gtttgagtaacacaaaataaatacartacaatgatgatttttaaggggaa

SEQ ID NO: 48955 - DNA, 50 bp, homo sapien
ttgttattcacatatcttttaccacygacaattggaaggcaaccttgcct

SEQ ID NO: 48956 - DNA, 50 bp, homo sapien
gcaatgagggatacataattaaatasatgctgttgccataggtgaccatt

SEQ ID NO: 48957 - DNA, 50 bp, homo sapien
attgcttggttctcattacaacgcayctttcccactataacatggagcct

SEQ ID NO: 48958 - DNA, 50 bp, homo sapien
cattcacccatcaacatgttgttatyactcattgtgtcctgaggatcagc

SEQ ID NO: 48959 - DNA, 50 bp, homo sapien
tcttcaaaatactttttgatcattayattgaagtggtcaatgaaggcagc

SEQ ID NO: 48960 - DNA, 50 bp, homo sapien
attttaattacatcattttatgccaratattcagtagagcttccagtaga

SEQ ID NO: 48961 - DNA, 50 bp, homo sapien
ggtgccatgagaccagaacctcatcyaccgcataacgctgttcagagcag

SEQ ID NO: 48962 - DNA, 50 bp, homo sapien
ctagtggttgatgctataagaattarataagataatgtatgtcaagtact

SEQ ID NO: 48963 - DNA, 50 bp, homo sapien
agtaaatttattctacatcctattargtaaaccacagatggtctctgcct

SEQ ID NO: 48964 - DNA, 50 bp, homo sapien
tataattatctaacagggtctacacrattctaggacaataggcaatgcac

SEQ ID NO: 48965 - DNA, 50 bp, homo sapien
acacatatatgtgagtatgaaaatcrgacgtacttttttctaaactgaag

SEQ ID NO: 48966 - DNA, 50 bp, homo sapien
cctgttgtatgttgtctcaggagtawggtattaataacgaggaagacata

SEQ ID NO: 48967 - DNA, 50 bp, homo sapien
cctgggcattttgtcaaaggatctamgaagtctctaggatgcataaaaga

SEQ ID NO: 48968 - DNA, 50 bp, homo sapien
atataatggtatgtagttcttgcatraatcaaataatccatctaattcac

SEQ ID NO: 48969 - DNA, 50 bp, homo sapien
ggtatgtgaggtcctaaagttttacyaggtgtttattattgcagtctcag

SEQ ID NO: 48970 - DNA, 50 bp, homo sapien
acctttaaaatgtcattttccagaaygttcataaaaacctctattccatt

SEQ ID NO: 48971 - DNA, 50 bp, homo sapien
tggttttagtattaaaggaggcctakgctacatgcttttctaaataagaa

SEQ ID NO: 48972 - DNA, 50 bp, homo sapien
gagttcaagaaaataccaaactataygacatgtcccattaaaaacttgac

SEQ ID NO: 48973 - DNA, 50 bp, homo sapien
aggcagaaaacaggtgctttttaacygattctacttctggacttacctca

SEQ ID NO: 48974 - DNA, 50 bp, homo sapien
tctacatttttaataagaaggacccrataatcactttcccagcttccctt

SEQ ID NO: 48975 - DNA, 50 bp, homo sapien
acacacatgctttcatcattattccyacattctaaaatctatcctggtga

SEQ ID NO: 48976 - DNA, 50 bp, homo sapien
aattttgtaaattgattaccacttayctatacatttaaagcagtcagttc

SEQ ID NO: 48977 - DNA, 50 bp, homo sapien
aaggctgatatcctctattctgacayagttgcgtcactcttaacccgcta

SEQ ID NO: 48978 - DNA, 50 bp, homo sapien
ttcctaaaggacatgtggtaaggatratacgagttctgaggatggccaaa

SEQ ID NO: 48979 - DNA, 50 bp, homo sapien
gagttggaggtgttactggtatcgargttaatcctagaatttcattttat

SEQ ID NO: 48980 - DNA, 50 bp, homo sapien
cagaagtggaactagctggatcatayggtaattgtatttttaattatttg

SEQ ID NO: 48981 - DNA, 50 bp, homo sapien
gtacattgatcaataaaattttttargccatcattgttcctcaaataatt

SEQ ID NO: 48982 - DNA, 50 bp, homo sapien
agcagaagagtcactctggttcttcyatggaatctggttctacttttcac

SEQ ID NO: 48983 - DNA, 50 bp, homo sapien
tattcattatgacactttatttaaakgttgaggcatgaaatgtatctgcc

SEQ ID NO: 48984 - DNA, 50 bp, homo sapien
tcagacgaaaatccagatttaccaaraagacaaattagtgagtgattggt

SEQ ID NO: 48985 - DNA, 50 bp, homo sapien
atcccctaagttatgcaacagatacmaaaaatgattgagaactagccaag

SEQ ID NO: 48986 - DNA, 50 bp, homo sapien
tttaccctccattgttccaggctacsacggaatgatgattacagctgagt

SEQ ID NO: 48987 - DNA, 50 bp, homo sapien
attttctatctactgttgttttaaargtcatcttgaattgattcagcccc

SEQ ID NO: 48988 - DNA, 50 bp, homo sapien
tttataggatcagaagaaatggaaayattaaacaacaaaaaaaggttcat

SEQ ID NO: 48989 - DNA, 50 bp, homo sapien
ccttggcatcagagatctcaggtaaktatgcctaaattaatagatttgcc

SEQ ID NO: 48990 - DNA, 50 bp, homo sapien
taactgccacatttaaaacagtgtaygtcagatttgtgtacccattgatt

SEQ ID NO: 48991 - DNA, 50 bp, homo sapien
tctaggacaaagagatcttcaaaaaycaaaaatgaggttcacatttacaa

SEQ ID NO: 48992 - DNA, 50 bp, homo sapien
ctgagatttagattaaaggctatgartacgccaaacagcaattatttcct

SEQ ID NO: 48993 - DNA, 50 bp, homo sapien
tgtatttttcatcaaaaactgactayggaaacttcaagtctttatatacc

SEQ ID NO: 48994 - DNA, 50 bp, homo sapien
caaaaatattcacatataccagatcrcttaggatttcatttgagctatga

SEQ ID NO: 48995 - DNA, 50 bp, homo sapien
acttcaaaacatgctcagatcatackgtagtcaaaaagcaaaagaaagcc

SEQ ID NO: 48996 - DNA, 50 bp, homo sapien
tgctctttccatatcagccaagtgaraacctagatccagaattcaactct

SEQ ID NO: 48997 - DNA, 50 bp, homo sapien
tctaaaaagtaatatttcggattaaktaggaacattgtcattaaaatttt

SEQ ID NO: 48998 - DNA, 50 bp, homo sapien
ctgactgatatcctaattttcatgaygtaagtttgcatattacagtaatt

SEQ ID NO: 48999 - DNA, 50 bp, homo sapien
tatgatttttccataatctctcttgragcaaaagcagaaccctagtattc

SEQ ID NO: 49000 - DNA, 50 bp, homo sapien
catgaaatcacttgggattcaagaartaggaagaatgagagttgaaagga

SEQ ID NO: 49001 - DNA, 50 bp, homo sapien
caatgtagatgtacatcgatatttgraatctattttgcaagctttctata

SEQ ID NO: 49002 - DNA, 50 bp, homo sapien
ttctgtatgcatatttctgtagtagkcacatttcaagccagtgaagaatt

SEQ ID NO: 49003 - DNA, 50 bp, homo sapien
gtccccgtggacccaagtctctgaargtaatctgataaattaatccatgt

SEQ ID NO: 49004 - DNA, 50 bp, homo sapien
ttaagagaacactttgaaatgtaagsaaatttttatgaataggtacgcac

SEQ ID NO: 49005 - DNA, 50 bp, homo sapien
cttaaaggatccatagcttccacatwagattttcagagagctttaagacc

SEQ ID NO: 49006 - DNA, 50 bp, homo sapien
tgggcagagggaaagacattaggcaycatggaaatacatattttttttac

SEQ ID NO: 49007 - DNA, 50 bp, homo sapien
taaacgatgcatctgtttagattagyccaaggagtaaggacaatgactcc

SEQ ID NO: 49008 - DNA, 50 bp, homo sapien
acacagaaattcatgctgcctgaatratatcacagtttacccagaatata

SEQ ID NO: 49009 - DNA, 50 bp, homo sapien
caaattttcctgaaaaagattcacgsatatgtggcataaaaatgggccaa

SEQ ID NO: 49010 - DNA, 50 bp, homo sapien
atatatttccaatattgaagagcgawccacttgcatgtatgggttttctt

SEQ ID NO: 49011 - DNA, 50 bp, homo sapien
gaaatagttaatcagaagagattatkaatcagaatgaaaataaacagata

SEQ ID NO: 49012 - DNA, 50 bp, homo sapien
ggaggtaaatttatgttttgtaacaytgtgataaggatgaatgatattaa

SEQ ID NO: 49013 - DNA, 50 bp, homo sapien
tcttgagggaactaatacagtgaaargtcatcccaagggagagcattagc

SEQ ID NO: 49014 - DNA, 50 bp, homo sapien
ccttcctctaagaattgacctgagaygacttatttctacacagctcatca

SEQ ID NO: 49015 - DNA, 50 bp, homo sapien
tggggacccctctcaaagcagagatsaaaagaccactcactccctgactg

SEQ ID NO: 49016 - DNA, 50 bp, homo sapien
ttttcaaccaaaaaaagtgaacttasatgcaagatcaatcagtatcccag

SEQ ID NO: 49017 - DNA, 50 bp, homo sapien
gtatcaaaataataaagagtgccatragtataaattccatcatcacatga

SEQ ID NO: 49018 - DNA, 50 bp, homo sapien
gaaatatgtatgatctgtcctccaayaatttgctcaataaacttaattaa

SEQ ID NO: 49019 - DNA, 50 bp, homo sapien
taagggtttaagctcttttcaatgcyatagtggaggaggtagaataaatt

SEQ ID NO: 49020 - DNA, 50 bp, homo sapien
ctgggagaggagtgcactgttcttasaagagctagaagggaccagaaacc

SEQ ID NO: 49021 - DNA, 50 bp, homo sapien
agtgacagaagaaacactaaattcaygatgataattgcctatggagagga

SEQ ID NO: 49022 - DNA, 50 bp, homo sapien
caaaagcatgagaaatgatacaggaragattgaattgaaagtagcatatc

SEQ ID NO: 49023 - DNA, 50 bp, homo sapien
tatatatttgctgagaaagctgaaaygtagggaccttaaggaacttgctc

SEQ ID NO: 49024 - DNA, 50 bp, homo sapien
taatattgggcactgttgacagtaayaatgtttcacatcctagtgttata

SEQ ID NO: 49025 - DNA, 50 bp, homo sapien
atgattaagttaaggaattatcgaaraccaatttgctcctcagtatgcag

SEQ ID NO: 49026 - DNA, 50 bp, homo sapien
aaaaaattgaaatttagtcccagatwactcccaggtctacattagtttaa

SEQ ID NO: 49027 - DNA, 50 bp, homo sapien
atgtaattctaaagtgataaggagaygcagatgaaaaactaactctgagg

SEQ ID NO: 49028 - DNA, 50 bp, homo sapien
gtgatgattacacatctcttttaaasgatgctcttgatttgtaaaattct

SEQ ID NO: 49029 - DNA, 50 bp, homo sapien
cacataggtgcttatacacatgttgracaaatgagttcatgacatctatg

SEQ ID NO: 49030 - DNA, 50 bp, homo sapien
atccagttaaaactctacctagaaamtacctcttatttaatagccaaatc

SEQ ID NO: 49031 - DNA, 50 bp, homo sapien
ctcaatttctctgtgaaaaacatacrcaaaatggtccttaaaagcaactg

SEQ ID NO: 49032 - DNA, 50 bp, homo sapien
atgtaatatgcaatgagtgaacacartgatgagtaaattaacaaaagaca

SEQ ID NO: 49033 - DNA, 50 bp, homo sapien
tggtagcttgcttttgcctctagatkaatgggaatcctatgtcagtgaag

SEQ ID NO: 49034 - DNA, 50 bp, homo sapien
gttaaagccagtagcatggaggttcmaataattagtaatacaatttttct

SEQ ID NO: 49035 - DNA, 50 bp, homo sapien
ttatttttgttgtttatattgaggcycatagagaagtcatgtgaaagacg

SEQ ID NO: 49036 - DNA, 50 bp, homo sapien
gctataagcaatgctagagaaaggaycaaatatgtctcccaaggtatata

SEQ ID NO: 49037 - DNA, 50 bp, homo sapien
atagtgacacttcctatctcatttayatctcgggaaaaagctttagtatg

SEQ ID NO: 49038 - DNA, 50 bp, homo sapien
catgttaatttcataatactcatttwaaaaggtctaaaaatatgtgctta

SEQ ID NO: 49039 - DNA, 50 bp, homo sapien
gacctcagaatgtatcaactgcttcwatatacttttattctatagatatt

SEQ ID NO: 49040 - DNA, 50 bp, homo sapien
gaaaaagaggtattcttgtgtctacyggtgaacagaggcaacctaggagc

SEQ ID NO: 49041 - DNA, 50 bp, homo sapien
cattaaattacatgtattgatatccyataagttaagaggatcggaggctc

SEQ ID NO: 49042 - DNA, 50 bp, homo sapien
gtggtacatgaactcctattgttacracataaataatcagctcatcccct

SEQ ID NO: 49043 - DNA, 50 bp, homo sapien
caatcagttaaattactgctataaayaaactatgtttcaaagacaacaaa

SEQ ID NO: 49044 - DNA, 50 bp, homo sapien
atcccctaaaatctgaacattactgwcaatagaatatatcttcatagggt

SEQ ID NO: 49045 - DNA, 50 bp, homo sapien
tgtgctgctctaacactctcaatgaygcttccaattggtagagtgagagg

SEQ ID NO: 49046 - DNA, 50 bp, homo sapien
atggcagttctgtggttattgccacrctacttatagagaaatgcagcata

SEQ ID NO: 49047 - DNA, 50 bp, homo sapien
gtatagtacatcagcttatgaatcayattttgtaccttatcctctagggt

SEQ ID NO: 49048 - DNA, 50 bp, homo sapien
tccccattggaatgaatgctttctcracagggtaacaaatgaaaattgga

SEQ ID NO: 49049 - DNA, 50 bp, homo sapien
tcacaaaataatgtcaaataaatgaygttcaggtactagcacagatagtt

SEQ ID NO: 49050 - DNA, 50 bp, homo sapien
taaaagtatatgacagcacctaacartggtctccaacctatactaagaat

SEQ ID NO: 49051 - DNA, 50 bp, homo sapien
cgctggctcatcatcttttagttatsagatgtccaaatggtaatccactt

SEQ ID NO: 49052 - DNA, 50 bp, homo sapien
gatctcttcttggagatggagacacygaaaaagaatcagacaatctctcc

SEQ ID NO: 49053 - DNA, 50 bp, homo sapien
gtaatctttataacatgatcagccargtataatttgagaagtcagttctg

SEQ ID NO: 49054 - DNA, 50 bp, homo sapien
tcttctaagtacttcccatagattarctcatcgaatcctcatgataaccc

SEQ ID NO: 49055 - DNA, 50 bp, homo sapien
aacattaacttttgcaatcaaataaraagacaagagtagaggaggtaaat

SEQ ID NO: 49056 - DNA, 50 bp, homo sapien
tcctgatgttggtaggtaaaaatatraacactttcaacatatagataatg

SEQ ID NO: 49057 - DNA, 50 bp, homo sapien
tacattttgctaattctccatattcsaaacttgttcattattagtatatc

SEQ ID NO: 49058 - DNA, 50 bp, homo sapien
actctcatgaaggttttatactaccrcatatgtatccacaaacaatacac

SEQ ID NO: 49059 - DNA, 50 bp, homo sapien
gggagtaactatttatttaaaacaasaatgaatgtaaagaagaataccta

SEQ ID NO: 49060 - DNA, 50 bp, homo sapien
tgaatccaataacttctgctctcaakaattgacagaaatcgctttccatt

SEQ ID NO: 49061 - DNA, 50 bp, homo sapien
tcactctaagaaagacacttcatacrgagagtttggatgcttataaaatt

SEQ ID NO: 49062 - DNA, 50 bp, homo sapien
agtacaaatggaattatgctcattakaaaagactcaggatctttaagatc

SEQ ID NO: 49063 - DNA, 50 bp, homo sapien
aaaaggttttaagagtctatatggargaacattttacatagtgtttaagg

SEQ ID NO: 49064 - DNA, 50 bp, homo sapien
aacatatgttgaacaaaaatctgaaygcctggaattctattgactctact

SEQ ID NO: 49065 - DNA, 50 bp, homo sapien
aatctctaaaggctataaagtatatkaaccaggattctttagttataggt

SEQ ID NO: 49066 - DNA, 50 bp, homo sapien
ttaaatttctacttgttatatggaamctgttatttttaagttaggaaaga

SEQ ID NO: 49067 - DNA, 50 bp, homo sapien
taatccaaaaatataagcagtaaaartaagcctccttcccacattagacc

SEQ ID NO: 49068 - DNA, 50 bp, homo sapien
gggattgctaattttctgcaattcgraaactcaagagctctgaaaccaag

SEQ ID NO: 49069 - DNA, 50 bp, homo sapien
tgaaagttttgagttcatatgtccaytaacatactagagaaagataagat

SEQ ID NO: 49070 - DNA, 50 bp, homo sapien
tgagaatcccccactcaaaaagataycaattgagcaacattataaatgta

SEQ ID NO: 49071 - DNA, 50 bp, homo sapien
ctatccagatgaacactatctttgayggagaagccatagatccaggtaat

SEQ ID NO: 49072 - DNA, 50 bp, homo sapien
tcactgctgggaagctggacaacacrcagggatctcatggtgcctcaagg

SEQ ID NO: 49073 - DNA, 50 bp, homo sapien
tcactcctaaagtccttcttgatgakataaaagtggcatatgcaattccc

SEQ ID NO: 49074 - DNA, 50 bp, homo sapien
cttacatattgctatgggtattcacraagaggaaaatgaagttgacttag

SEQ ID NO: 49075 - DNA, 50 bp, homo sapien
atgagacttgattcttgccagaaaaytgaccaccaactcagtctcagaga

SEQ ID NO: 49076 - DNA, 50 bp, homo sapien
gtcctgacacattactagacaagacyactggaagaaatagaaaacagaaa

SEQ ID NO: 49077 - DNA, 50 bp, homo sapien
taagacactgacaagttgaataacartgattctgatttttaaaaactaat

SEQ ID NO: 49078 - DNA, 50 bp, homo sapien
cttcattcaggatgtcagagtgtgargcatttagaaatacaagatatttg

SEQ ID NO: 49079 - DNA, 50 bp, homo sapien
tactaataaaagttgttaaaggctargatcaataataaatggagatttat

SEQ ID NO: 49080 - DNA, 50 bp, homo sapien
acacagcagtgttccaggtgtgttgmaaaagcacaggatgaataaggcat

SEQ ID NO: 49081 - DNA, 50 bp, homo sapien
tgtagtctggggtccccacatagcartgactcagacgggctctcaggatg

SEQ ID NO: 49082 - DNA, 50 bp, homo sapien
gctcaagaaaattttaaatctgtaaygttgttatattactagtaatttga

SEQ ID NO: 49083 - DNA, 50 bp, homo sapien
tgagtttaaagtttaaagcagataasgtatacagaaacatagaaaaggaa

SEQ ID NO: 49084 - DNA, 50 bp, homo sapien
acagcataaagcacttccaataagayacccagaataaattttttctaaga

SEQ ID NO: 49085 - DNA, 50 bp, homo sapien
actgggctgaagtacacgacaatcayattcagtacccctttggctatata

SEQ ID NO: 49086 - DNA, 50 bp, homo sapien
aattaagttctcagatgatactaaamggagagatgtttgttgcaaaaaac

SEQ ID NO: 49087 - DNA, 50 bp, homo sapien
cactcattgcaaatctccatctgaasgtctgtaaggaacatggctgtgct

SEQ ID NO: 49088 - DNA, 50 bp, homo sapien
tttcaaggaatgtttatcattttgayggtgaacatttattttgaaaattt

SEQ ID NO: 49089 - DNA, 50 bp, homo sapien
aagcccctttgcctatgccagaccaytgggttagttgccttctggtaggt

SEQ ID NO: 49090 - DNA, 50 bp, homo sapien
aaagcctatttatgaataccttttaygactggaatccttagggtgatcaa

SEQ ID NO: 49091 - DNA, 50 bp, homo sapien
tgagcaaattcaattttctacagcaratagtaaaacaagtgtcatagtct

SEQ ID NO: 49092 - DNA, 50 bp, homo sapien
acgcttgcattgttgtagctggtaawcattaaatttcagatttcagtgtt

SEQ ID NO: 49093 - DNA, 50 bp, homo sapien
aaatttttcataacaaatgtacaatragcaaattcaattttctacagcaa

SEQ ID NO: 49094 - DNA, 50 bp, homo sapien
aatttcagatgtgcaacaaatatacsaaagagcacttaagaaactacaga

SEQ ID NO: 49095 - DNA, 50 bp, homo sapien
ggttagttgtaatacgatcagataaktcaccaataatgggttaaattatg

SEQ ID NO: 49096 - DNA, 50 bp, homo sapien
cattttcattaagagttaccaaataygatataaacctgagtcactcttca

SEQ ID NO: 49097 - DNA, 50 bp, homo sapien
cagattgaaatgggcacttagcgaayacttgtggaccacaagacttgtct

SEQ ID NO: 49098 - DNA, 50 bp, homo sapien
ttaattgctgaagatgttgactaatsaaatacactgtcatttgtgtttaa

SEQ ID NO: 49099 - DNA, 50 bp, homo sapien
ttacaaagtttgtacaacagttgaartacattaacattcctcataggaag

SEQ ID NO: 49100 - DNA, 50 bp, homo sapien
ttggagtaagggttagggatggcackagctcatgaatgggatgaaagaca

SEQ ID NO: 49101 - DNA, 50 bp, homo sapien
tatcaggcaaacactgactagtttcycaagattggtctgaaggaataaag

SEQ ID NO: 49102 - DNA, 50 bp, homo sapien
attaataaccagaatacgtaagaaartcaacaacttataataaaacaaaa

SEQ ID NO: 49103 - DNA, 32 bp, homo sapien
caaagagtacgctttcraacagtaggctccaa

SEQ ID NO: 49104 - DNA, 50 bp, homo sapien
ataaagacatacctccaggatatcasaggttcaattccagaccacctcaa

SEQ ID NO: 49105 - DNA, 50 bp, homo sapien
ggaagcttattatacagtgagatcayggtccaattaacgttgcaaagtga

SEQ ID NO: 49106 - DNA, 50 bp, homo sapien
ctgcagggatgtatacacatccttcragtgcacatattcatcattttcac

SEQ ID NO: 49107 - DNA, 50 bp, homo sapien
aacaaagagaataagtgcatgcttaygataaggttttagtgggcttttat

SEQ ID NO: 49108 - DNA, 50 bp, homo sapien
ctgctttgctgttgtttaccctgcaygattcagcctttacttagaagctt

SEQ ID NO: 49109 - DNA, 50 bp, homo sapien
acgaaattgaggcaagttaaagcggyattttccatactgattagtatgct

SEQ ID NO: 49110 - DNA, 50 bp, homo sapien
gaaggtgggtaataacaaacttcackgagataaaggagcatgttgtaacc

SEQ ID NO: 49111 - DNA, 50 bp, homo sapien
tcataagaattacaacagttatacayaccactttgatctttgacttagct

SEQ ID NO: 49112 - DNA, 50 bp, homo sapien
ctgtaaaacatgagtcttaagaacakaagtgtaaaacctcggttgctttc

SEQ ID NO: 49113 - DNA, 50 bp, homo sapien
ccattcacctaatttcattttgcaaygccttgtggaggtaggaggcgaca

SEQ ID NO: 49114 - DNA, 50 bp, homo sapien
ctgtatccaatgggcctattttaaaygacttgtctgggcatctctgaatt

SEQ ID NO: 49115 - DNA, 50 bp, homo sapien
gcaatgccttgtggaggtaggaggcracaaggaattgaggagggtgacag

SEQ ID NO: 49116 - DNA, 50 bp, homo sapien
agaatgaaaggtttttcacataaaakaatgcttcaggtgataattctcaa

SEQ ID NO: 49117 - DNA, 50 bp, homo sapien
gagttggggatctgtattcttaacartctctctcggtaattctgctgggc

SEQ ID NO: 49118 - DNA, 50 bp, homo sapien
acttatacaagttatatgtaacttayacttggtagttatacaaggtagat

SEQ ID NO: 49119 - DNA, 50 bp, homo sapien
caatatgatgatgctgtatatttagkattttatctgtgagttctgtggaa

SEQ ID NO: 49120 - DNA, 50 bp, homo sapien
taaagaaaatcaatatactgaaatcygagtaagtaactcataatgtgttt

SEQ ID NO: 49121 - DNA, 50 bp, homo sapien
ttatttggtgtagccacgttcatcartattagctagatcttctggataac

SEQ ID NO: 49122 - DNA, 50 bp, homo sapien
atctactaccctttctagtgctttayctatgtcatcacaaagattccaga

SEQ ID NO: 49123 - DNA, 50 bp, homo sapien
aaatatcaagaaaacacaatgaagarattaagagtagagaggttaggagc

SEQ ID NO: 49124 - DNA, 50 bp, homo sapien
agtcacatggtatgtttgattacaakgttgatttaattagggcaccagac

SEQ ID NO: 49125 - DNA, 50 bp, homo sapien
ccaggtaggggaggtgttataaagakacaaagttggacagaactatctgg

SEQ ID NO: 49126 - DNA, 50 bp, homo sapien
attgaaaaaaacatcctttgggtagmattggtatgtttccaaacaaaaag

SEQ ID NO: 49127 - DNA, 50 bp, homo sapien
ataatgccaatcattttgcatttccrgacagaatgaagcacacgggcagt

SEQ ID NO: 49128 - DNA, 50 bp, homo sapien
cttggtcagcatcaaggcctttctaygtctgcctcacccctagcccaggg

SEQ ID NO: 49129 - DNA, 50 bp, homo sapien
tgccaattttatacttttcgaaggayatgtgtaccacttgtctcctctcc

SEQ ID NO: 49130 - DNA, 50 bp, homo sapien
gacatgatgaatagcctttattctarggtcagatatcatatactcaaagc

SEQ ID NO: 49131 - DNA, 50 bp, homo sapien
caaaaaaattacatatagggctgaartaaaatattagattcacctttatt

SEQ ID NO: 49132 - DNA, 50 bp, homo sapien
gagggaatttgatataacttatgacragggcttggtaacacacaacccct

SEQ ID NO: 49133 - DNA, 50 bp, homo sapien
gaaatcccatttttgtaggcactaarcagcattcatttacatagatgact

SEQ ID NO: 49134 - DNA, 50 bp, homo sapien
gaatctggggttcataggattataaytgaaaaagacagaaaaaaatcata

SEQ ID NO: 49135 - DNA, 50 bp, homo sapien
aatcaagattaagaatccaaacataytaaagtgagaattgggagttattt

SEQ ID NO: 49136 - DNA, 50 bp, homo sapien
accccctgtaggaacacagaccaagkaatttaacatatgcacaaaaggga

SEQ ID NO: 49137 - DNA, 50 bp, homo sapien
caagaaatgtctagactaatattcaycagttttacaaacataatgaaaat

SEQ ID NO: 49138 - DNA, 50 bp, homo sapien
tgatatggtaagtttcaatagattawctaatatcgaactatccttatatt

SEQ ID NO: 49139 - DNA, 50 bp, homo sapien
aactacaacatcaaacgatgtgtaayagtaacggtatcggaaggaaggaa

SEQ ID NO: 49140 - DNA, 50 bp, homo sapien
attttgaaaatgttatttccagatamagtgttcttcagtcctagaaaatt

SEQ ID NO: 49141 - DNA, 50 bp, homo sapien
tagaggtaatgagacagagagaaaawtgtgaatgtgatttatgaaaaaga

SEQ ID NO: 49142 - DNA, 50 bp, homo sapien
cccccaattcatgagagaacaatccrcaaaggatgactgacagagctctt

SEQ ID NO: 49143 - DNA, 50 bp, homo sapien
ctcttcattttcaggtaggtaaatakccaaaacatggggcacctagttct

SEQ ID NO: 49144 - DNA, 50 bp, homo sapien
tataaaccgaactgatgtaagtaaayggtctctcacttgttttatttaac

SEQ ID NO: 49145 - DNA, 50 bp, homo sapien
cattaacattgttccaagtaccaaawagaaaaataagcatgttaacttta

SEQ ID NO: 49146 - DNA, 50 bp, homo sapien
acaataagtagctttttgtcttacayattagtgcactgaaacaaaatact

SEQ ID NO: 49147 - DNA, 50 bp, homo sapien
attttctttctggagacatgattacyagaaacatataacactggggcagt

SEQ ID NO: 49148 - DNA, 50 bp, homo sapien
atgggaagggcaacatccaggtaacygtcatgcaggtggagacacagaac

SEQ ID NO: 49149 - DNA, 50 bp, homo sapien
tgcattcatgcaaattcctacttgaygatagccacatagatgatcagttg

SEQ ID NO: 49150 - DNA, 50 bp, homo sapien
ttcaaatgtttggaagatttttgatwaaacacaattgggtgaagtaagtg

SEQ ID NO: 49151 - DNA, 50 bp, homo sapien
aacacttcaatactaattgtctggaycatcgctcttgcattgaaatccac

SEQ ID NO: 49152 - DNA, 50 bp, homo sapien
caaactataaatagagaactaaaaawtcctaaatctgatattgggcatct

SEQ ID NO: 49153 - DNA, 50 bp, homo sapien
aaatactcaacatgataataagtatraagtccttagcacaatgcttggca

SEQ ID NO: 49154 - DNA, 50 bp, homo sapien
acaaaagcttcttagattgtcattayagactgtaaccaaatattgttgtg

SEQ ID NO: 49155 - DNA, 50 bp, homo sapien
aaataagagcacggcatattctatcrctatttacaacagggctttgctga

SEQ ID NO: 49156 - DNA, 50 bp, homo sapien
gagccctggactttcagttataagcygagacttttgctttcaagcttaaa

SEQ ID NO: 49157 - DNA, 50 bp, homo sapien
ggtgcctgtagcctggatgatcagcrcattccgaggtttagggatggggc

SEQ ID NO: 49158 - DNA, 50 bp, homo sapien
gtccccaggcactccatttccagctyacaccaactcagcttctgtgggta

SEQ ID NO: 49159 - DNA, 50 bp, homo sapien
acattataaattgtttctccataaaktatttcccaaaaaaggaaagtaga

SEQ ID NO: 49160 - DNA, 50 bp, homo sapien
gtgtatcttttttggcctccatttaygtttctatccatattttttcatct

SEQ ID NO: 49161 - DNA, 50 bp, homo sapien
tttacagaaatagaataaacacttgsaacattcatagaacagacagaaga

SEQ ID NO: 49162 - DNA, 50 bp, homo sapien
taacactattcatattgcctcgctasagatcattttttgtatcaggctga

SEQ ID NO: 49163 - DNA, 50 bp, homo sapien
gtgagaccatatttatttctatgtawgttacaaatcaaagtttatgcctg

SEQ ID NO: 49164 - DNA, 50 bp, homo sapien
caactcttagattgttttcctgatayaccttttctcattaattgtctaat

SEQ ID NO: 49165 - DNA, 50 bp, homo sapien
cccatataattattttattatagaarcatagttcaatccatttatcagaa

SEQ ID NO: 49166 - DNA, 50 bp, homo sapien
aaaatcatccattcattaatttaccraatcatttaccacagtttgtgggc

SEQ ID NO: 49167 - DNA, 50 bp, homo sapien
tcagaatcatacaatgatagcaactkaaaggatattagaaaacttctctt

SEQ ID NO: 49168 - DNA, 50 bp, homo sapien
attctaactcaactttacactctgtyaaggattacatataattttaagtc

SEQ ID NO: 49169 - DNA, 50 bp, homo sapien
cagcattattcagagtaattaattgsaacagacaaccctgaaatctcagg

SEQ ID NO: 49170 - DNA, 50 bp, homo sapien
ccagggtttctgggattcttttggasaaactaaaaatacactaattttat

SEQ ID NO: 49171 - DNA, 50 bp, homo sapien
ctggcttgtattgttatgaaggctcygaagggtgatgttaaatgcctaag

SEQ ID NO: 49172 - DNA, 50 bp, homo sapien
attagtggtgcatgcaatgtttgacrctacatcagtcccagaaagaatag

SEQ ID NO: 49173 - DNA, 50 bp, homo sapien
tcagcatttacaaatacctgaaacaygtgtctatatcctccccatcatct

SEQ ID NO: 49174 - DNA, 50 bp, homo sapien
cttctgactcttcatatgcaggaaarcaattaaaaactgatccattttaa

SEQ ID NO: 49175 - DNA, 50 bp, homo sapien
agttctcaaaggtctaggatttttaraagttgctacacagtaacaatttt

SEQ ID NO: 49176 - DNA, 50 bp, homo sapien
tatattagataatggatctggcccaygttcgtcttaacaaattatactgt

SEQ ID NO: 49177 - DNA, 50 bp, homo sapien
attatgttacagggactatatctccygaatcattttggaattcaaaggcc

SEQ ID NO: 49178 - DNA, 50 bp, homo sapien
acaaaaaactgtaaagccactgtaaygaaaccaagagagtattggcttag

SEQ ID NO: 49179 - DNA, 50 bp, homo sapien
tttaggaagtcataatagcacttacracgtgtcaatgatttgtttttaaa

SEQ ID NO: 49180 - DNA, 50 bp, homo sapien
aatagtgagggtgaatgattacgtgsaacagtcatgaaaagacccagttc

SEQ ID NO: 49181 - DNA, 50 bp, homo sapien
acctatgtacgatctgttccatctayctagaaataaacactaacagcagg

SEQ ID NO: 49182 - DNA, 50 bp, homo sapien
cctgattcatttactcctcacatcartcttccctatgagttccataaatt

SEQ ID NO: 49183 - DNA, 50 bp, homo sapien
atattttgaaagactatgtgataaawggatcaatttttagaaagtttcat

SEQ ID NO: 49184 - DNA, 50 bp, homo sapien
atcaaactcaaactaagcctgtgcayctattcaattaatattaacatgaa

SEQ ID NO: 49185 - DNA, 50 bp, homo sapien
ttgacaggtactattctagactgtgsaagtagaacagaccaggtccctgc

SEQ ID NO: 49186 - DNA, 50 bp, homo sapien
tctacttttctccatgaagtttgtcrccatcaactgttaaaactgtaaag

SEQ ID NO: 49187 - DNA, 50 bp, homo sapien
agaggatccctcaaggaactgacagratagaagaaaaagggaagttaaac

SEQ ID NO: 49188 - DNA, 50 bp, homo sapien
ctggtttgtatgttttttatcataakaatgaggttatagccgggtgcatt

SEQ ID NO: 49189 - DNA, 50 bp, homo sapien
tgtgttagtcactttacatttgttayctcaattgcagtaacagatctgtg

SEQ ID NO: 49190 - DNA, 50 bp, homo sapien
caatgggaagccactaaagaattctmaatgggaatatgagtcattaaagc

SEQ ID NO: 49191 - DNA, 50 bp, homo sapien
tctgaaagcttgttggttgtctttakaatgaaaagccagtgagtaattgt

SEQ ID NO: 49192 - DNA, 50 bp, homo sapien
ctgtttgtcttatggttgtttcttcmagatcacacacaaataggactatt

SEQ ID NO: 49193 - DNA, 50 bp, homo sapien
cttgatagaacatgatagaacttgayggagatgcaggtctgactcgacca

SEQ ID NO: 49194 - DNA, 50 bp, homo sapien
cttttttttatttagactgtaagaartagggctatgtcatttatatatac

SEQ ID NO: 49195 - DNA, 50 bp, homo sapien
ccttgacattgagtaaatcataaatsacttagtacccatgtgtgtaaagt

SEQ ID NO: 49196 - DNA, 50 bp, homo sapien
tttaaagtcctgttgattcataaaastaattgtaaaactcaaatcaaaat

SEQ ID NO: 49197 - DNA, 50 bp, homo sapien
gtggaaaagatggtgaacttcctacrggcttagaaaatttgtttagacta

SEQ ID NO: 49198 - DNA, 50 bp, homo sapien
actctataaatttagaggtttaccaytattgtatgtatcttaatagatga

SEQ ID NO: 49199 - DNA, 50 bp, homo sapien
tagaagcttattttaatcatttctcrataaatgaccatatcaatctagtt

SEQ ID NO: 49200 - DNA, 50 bp, homo sapien
acaaccataatctactacttcaaccyacagtactttgaatttttttttca

SEQ ID NO: 49201 - DNA, 50 bp, homo sapien
tttgttgttaaataatactttgaaaytggactcagcaactctatatttga

SEQ ID NO: 49202 - DNA, 50 bp, homo sapien
tttaataggggtttttcgttagtaayatgatgctcttttgggctgcagaa

SEQ ID NO: 49203 - DNA, 50 bp, homo sapien
cagaaggcatagttgttaccctcaaraagctactgttacctcagtaaagg

SEQ ID NO: 49204 - DNA, 50 bp, homo sapien
acagaactatgctagatagtgagcaygtttaaagatttatttagaatgac

SEQ ID NO: 49205 - DNA, 50 bp, homo sapien
cctgctatgctgagaaaggatatgayggcatttgcaaaaggataggctgt

SEQ ID NO: 49206 - DNA, 50 bp, homo sapien
atctgaagttttcactcatacattayagtagcccaaaaagggggatatat

SEQ ID NO: 49207 - DNA, 50 bp, homo sapien
acagtgtaacatgaaacaactctatraacatttttgatgcactcaacact

SEQ ID NO: 49208 - DNA, 50 bp, homo sapien
tattgctgtattattttgacattccsagataagtttatcttcagatgctg

SEQ ID NO: 49209 - DNA, 50 bp, homo sapien
agtgaggagaggtggtggaacctcaygtccatttcagtgaaaatgcttca

SEQ ID NO: 49210 - DNA, 50 bp, homo sapien
tttagtgtgggttaaatgaccaaaayaatcgtctgggaaacagaaagcca

SEQ ID NO: 49211 - DNA, 50 bp, homo sapien
caggttactaaccagttgcctttaaracaaggatataagctggatgggcc

SEQ ID NO: 49212 - DNA, 50 bp, homo sapien
agactaatctgaaaaaaccaacccamtagcttgctccaaaatttaagact

SEQ ID NO: 49213 - DNA, 50 bp, homo sapien
ggctaaagcatgttcgattcctgatkatagcaatctgcagtggcatcata

SEQ ID NO: 49214 - DNA, 50 bp, homo sapien
gtgatttgacactgtgccttaactaygttatcatcaattctaggtcatat

SEQ ID NO: 49215 - DNA, 50 bp, homo sapien
ctggaagtcaaaatgaagaaaaaaakatacagttattgacattactctca

SEQ ID NO: 49216 - DNA, 50 bp, homo sapien
tatataaacacacttattgaagtacygagaagcaaacagttaactgaata

SEQ ID NO: 49217 - DNA, 50 bp, homo sapien
agttttaatttcgatttcctaattayctagtgatgttgaacatctttgtg

SEQ ID NO: 49218 - DNA, 50 bp, homo sapien
gttagagaatatctaacatttaacaytgaacctatgtgagacattcccag

SEQ ID NO: 49219 - DNA, 50 bp, homo sapien
tatttgaactcgagatagcctacagwcattctcgaggatccgtctagcta

SEQ ID NO: 49220 - DNA, 50 bp, homo sapien
aaaaccatcaggaccttgtcaatgaytcacaatgatttcctagtattttc

SEQ ID NO: 49221 - DNA, 50 bp, homo sapien
aattattactactctggcttagagarcatatttataaatattcttttggg

SEQ ID NO: 49222 - DNA, 50 bp, homo sapien
tcatctcactcagagtttaaactctraaagtggcctacaaggctgtccac

SEQ ID NO: 49223 - DNA, 50 bp, homo sapien
tcagggttgagaacctgagtcaggcrcatataaagtagtttctaggtctc

SEQ ID NO: 49224 - DNA, 50 bp, homo sapien
ggttttagcttttttaagctcttcargtggccagtttggcatttcagttg

SEQ ID NO: 49225 - DNA, 50 bp, homo sapien
ggaaatccttactatccttagggtcragcacaagtcatccatttccatga

SEQ ID NO: 49226 - DNA, 50 bp, homo sapien
gtgaaaggcacagactctggagtcakacttagtttgcagagcttagcata

SEQ ID NO: 49227 - DNA, 50 bp, homo sapien
gacaattaactaaaaattatgacacmactttatgaataagaaaactgagg

SEQ ID NO: 49228 - DNA, 50 bp, homo sapien
actgctcctggccctagattttttaragactggaagagaatgttacttct

SEQ ID NO: 49229 - DNA, 50 bp, homo sapien
acagtaccaacaagagctcagattarccatagctgtgtgtgtggccaggt

SEQ ID NO: 49230 - DNA, 50 bp, homo sapien
gccagctgaaattgttataggtcacscgctgcacttctgggtcgatggca

SEQ ID NO: 49231 - DNA, 50 bp, homo sapien
ttatctaccaaaattgagtgatagaratgtacttaggaaagaaacccatt

SEQ ID NO: 49232 - DNA, 50 bp, homo sapien
ctttccttgacagataatatttgcasaacatgtaagcatttagtcagttt

SEQ ID NO: 49233 - DNA, 50 bp, homo sapien
tctgctatcaccaatctattaaaackgttatactcttgtggaatttatca

SEQ ID NO: 49234 - DNA, 50 bp, homo sapien
atatgacggtggcctctattttctcyatgtattgtgggagacaaggctat

SEQ ID NO: 49235 - DNA, 50 bp, homo sapien
tttgcatttctttcatagtagatccratcagttaattaaaaacaacaatt

SEQ ID NO: 49236 - DNA, 50 bp, homo sapien
tcatctaaagaaatatgtcctaagakgaaaatgttaccattacagcttga

SEQ ID NO: 49237 - DNA, 50 bp, homo sapien
aaaaataagagaaatgaaagtggaasgactaaacagaatgcaagtttggt

SEQ ID NO: 49238 - DNA, 50 bp, homo sapien
taatgacaacctcagaaatacacaayggagggtggccttctagctaacct

SEQ ID NO: 49239 - DNA, 50 bp, homo sapien
atgtcacatgaaaattatatgaagarctaaactatattgtgtgactctgg

SEQ ID NO: 49240 - DNA, 50 bp, homo sapien
aataatggaaaatatggtaataaaayttcaagaaactatgatctataaca

SEQ ID NO: 49241 - DNA, 50 bp, homo sapien
actaaaacttaaattatacagtcgarcttgtctgattgagatataactac

SEQ ID NO: 49242 - DNA, 50 bp, homo sapien
tgctaggaaaacatgccttgcttaaktattaaatcaaatatcctttagag

SEQ ID NO: 49243 - DNA, 50 bp, homo sapien
ataaaagtacttgatgctaagcaacsgtgtatacaaatcaagcctttctt

SEQ ID NO: 49244 - DNA, 50 bp, homo sapien
ttttcagattcaaatcagtcccatamatatactaaaaatttaactagtag

SEQ ID NO: 49245 - DNA, 50 bp, homo sapien
gactttccacaaaacaaaagatggcracgtactttgagtagcttccactc

SEQ ID NO: 49246 - DNA, 50 bp, homo sapien
tgagccatgtggtgaggttgaaatayagtaaatctaaaatggcagcatat

SEQ ID NO: 49247 - DNA, 50 bp, homo sapien
tctaagaggttggtggctggtgtaawggcttccttcctaaatgcctgcca

SEQ ID NO: 49248 - DNA, 50 bp, homo sapien
ttggcctggtttactagaattcttaygtgcactttacagtgatatccctc

SEQ ID NO: 49249 - DNA, 50 bp, homo sapien
atggactaaaatattcattttcctaygttcagatataatttaggcaagat

SEQ ID NO: 49250 - DNA, 50 bp, homo sapien
ggtgtgtctgctttgtctcatgaaayacctggatgatcactgatttctag

SEQ ID NO: 49251 - DNA, 50 bp, homo sapien
tcccctaattgaaatggtctttacaytgatctttacctgatcaaattgtc

SEQ ID NO: 49252 - DNA, 50 bp, homo sapien
agtggatattcttcctcccttgaaartgacggacatagttaattcatgca

SEQ ID NO: 49253 - DNA, 50 bp, homo sapien
gtcatatcataacacattgctgtacygagctaagttaatgactcctcaat

SEQ ID NO: 49254 - DNA, 50 bp, homo sapien
attattttaggtactaagttagatascaagattaatcagacacattatgc

SEQ ID NO: 49255 - DNA, 50 bp, homo sapien
attcaggtaagtaataatgtaagtcrctatatccaccaaattaacatata

SEQ ID NO: 49256 - DNA, 50 bp, homo sapien
ataatgaaagttccccagcgatgtaygaaaatttcactgtagagtaagcc

SEQ ID NO: 49257 - DNA, 50 bp, homo sapien
gagtctacagtaccactaatatatartaagcacacaatgagtttaaaaag

SEQ ID NO: 49258 - DNA, 50 bp, homo sapien
ccctaatttcttaacgaaggactcaycttttggattttcttctcaaaaat

SEQ ID NO: 49259 - DNA, 50 bp, homo sapien
ggtaagcttctttcctcatattttayctacattttctggatatgtcctgt

SEQ ID NO: 49260 - DNA, 50 bp, homo sapien
gaggcagatgaagggaaattgtatayggtaagttcttaaataaatactat

SEQ ID NO: 49261 - DNA, 50 bp, homo sapien
tagttttcatttacaggactgttatkagccctagtgtgtttttctgataa

SEQ ID NO: 49262 - DNA, 50 bp, homo sapien
aaaaaatgcaggtagcttacactaamagcagatagaactgtaactatcta

SEQ ID NO: 49263 - DNA, 50 bp, homo sapien
cacggttacaattcaaaaatctttcyatgatccttctaaggaatctccaa

SEQ ID NO: 49264 - DNA, 50 bp, homo sapien
ctaccaaggcacctctttactgtcartcgtcttaatggacaatgtacaca

SEQ ID NO: 49265 - DNA, 50 bp, homo sapien
tagttaattaaaattccacactaacrctcactttctcatttttaagagta

SEQ ID NO: 49266 - DNA, 50 bp, homo sapien
acaatgcatgtattttcttcttccakagctcttttttttaaacagacttc

SEQ ID NO: 49267 - DNA, 50 bp, homo sapien
atgagaattcaataccaagatcaaakgtacaatatgctgtcaaatgttta

SEQ ID NO: 49268 - DNA, 50 bp, homo sapien
agaggtcattcctgttatgccagatraatgcaaaatggcatggaagtgaa

SEQ ID NO: 49269 - DNA, 50 bp, homo sapien
taggctcataattactaagtgtaaayatatctatctccctgaagaaacta

SEQ ID NO: 49270 - DNA, 50 bp, homo sapien
tatagacaatgcctagaaagtccaaygtatgctgtcaggacttgactagc

SEQ ID NO: 49271 - DNA, 50 bp, homo sapien
aagttattgtcatgtttagttaaagmatttatatgttttttgtgtgtgtg

SEQ ID NO: 49272 - DNA, 50 bp, homo sapien
atgtaactttttacattcagaaaaartattctattgctgtttattgaaca

SEQ ID NO: 49273 - DNA, 50 bp, homo sapien
attttttgctttcggtttttgggaaytgtattgcttataaaagaccctgc

SEQ ID NO: 49274 - DNA, 50 bp, homo sapien
cccgccagactttgaacatgctatcycatatatcttgaaagttctgcttt

SEQ ID NO: 49275 - DNA, 50 bp, homo sapien
gaatctgtgaatacataagaaacaaygatacactctaaatggagcatgca

SEQ ID NO: 49276 - DNA, 50 bp, homo sapien
aatccacgctccaggaaatgtgctakgtaaactctttataggtcaaccta

SEQ ID NO: 49277 - DNA, 50 bp, homo sapien
ttctccttatgtgagaaattggactsaaatttagcaatcaatttaatttt

SEQ ID NO: 49278 - DNA, 50 bp, homo sapien
ggtcccgtaagactgtaatggaactraaaattcgtacagccaggtgacac

SEQ ID NO: 49279 - DNA, 50 bp, homo sapien
gttgttttgccatgtacctgacagaygataacacgaaaattgggagtttg

SEQ ID NO: 49280 - DNA, 50 bp, homo sapien
cagcacactgattaccgattgaggarattttgattcttgatttaggagta

SEQ ID NO: 49281 - DNA, 50 bp, homo sapien
agcataagcggttatataagaaacartgaattatattgcctatgtaatac

SEQ ID NO: 49282 - DNA, 50 bp, homo sapien
caagagggagctactgatgatctgayagttctttagtcttgactcatggt

SEQ ID NO: 49283 - DNA, 50 bp, homo sapien
ggggtcttattctgactctgccacaratagttatataagtctgaggaagt

SEQ ID NO: 49284 - DNA, 50 bp, homo sapien
gttagatcttaaataatttagataamcatagtggccatttagattattgc

SEQ ID NO: 49285 - DNA, 50 bp, homo sapien
cagaaaggcatatttcagaattatawctttcaatctaggcatgtatgctt

SEQ ID NO: 49286 - DNA, 50 bp, homo sapien
atacataacagggaattacaaatatsagttgcagaaagttactgctatgg

SEQ ID NO: 49287 - DNA, 50 bp, homo sapien
aggctagtatttcacggaactggaaytctaatctaagcagtctaattctt

SEQ ID NO: 49288 - DNA, 50 bp, homo sapien
ggcattggtcaaaaagctagtcacayagtatacagtaaagaatgtggtcc

SEQ ID NO: 49289 - DNA, 50 bp, homo sapien
ttaggggaggtttatagagtcaaaakttcctgagaatagatgaccctgat

SEQ ID NO: 49290 - DNA, 50 bp, homo sapien
tttagcacttaccatcttatgttccrggaaatcctttatctcgggcaaac

SEQ ID NO: 49291 - DNA, 50 bp, homo sapien
gggagtgaaagaactcttggatttargcattctaattactacccttgaat

SEQ ID NO: 49292 - DNA, 50 bp, homo sapien
atttttactaggatgatataatgacrataaaatagtgataccaagcagat

SEQ ID NO: 49293 - DNA, 50 bp, homo sapien
gcaagtacaacttaatattcataackcttagaattgcagaagcggaaagt

SEQ ID NO: 49294 - DNA, 50 bp, homo sapien
atgtgcaccgaataattacagatgawtacttatctaccagaagagaaacg

SEQ ID NO: 49295 - DNA, 50 bp, homo sapien
tgagatatagccatctaatatggaartgcttgaataatgatgttctacat

SEQ ID NO: 49296 - DNA, 50 bp, homo sapien
tcagattacctattttttctcatgcragttttagcagattgtctttcaag

SEQ ID NO: 49297 - DNA, 50 bp, homo sapien
actgagtctctgctgccagttaaaarcgatagatatagtctgctgatgca

SEQ ID NO: 49298 - DNA, 50 bp, homo sapien
gacttgcagggggatcctactataaygaatagctttagaatagtatccaa

SEQ ID NO: 49299 - DNA, 50 bp, homo sapien
aaaaagtttccgcttggctaaaccaygttgaagcacgttgcaggagttac

SEQ ID NO: 49300 - DNA, 50 bp, homo sapien
ggctattttactgaatggatagctarcatttctggaaagttttactgtgg

SEQ ID NO: 49301 - DNA, 50 bp, homo sapien
gttcatgcccatttaaatatagggaycataagtcgtgcaccagttaacgt

SEQ ID NO: 49302 - DNA, 50 bp, homo sapien
tattttctgttgtttgggtttcgtaygtttggcaataacattttaatgtt

SEQ ID NO: 49303 - DNA, 50 bp, homo sapien
agctaagcagactttatttaaagaaratgctcattcccttttgctggaca

SEQ ID NO: 49304 - DNA, 50 bp, homo sapien
accatttggcattatggtttttccayataatgacatactgttcatgaatt

SEQ ID NO: 49305 - DNA, 50 bp, homo sapien
ctgaatagtttttttaatgttatagmaattcaactgtttcatctatacca

SEQ ID NO: 49306 - DNA, 50 bp, homo sapien
tcattgtgaaatgaacctgagagtcrccacttaagatactgttctgggtc

SEQ ID NO: 49307 - DNA, 50 bp, homo sapien
ctgaacttttttcatattgatcttcrattttggatcatacagcaacagta

SEQ ID NO: 49308 - DNA, 50 bp, homo sapien
tgccctaagagataaagtgtattatyaagctgtgagtatttatgtgtggt

SEQ ID NO: 49309 - DNA, 50 bp, homo sapien
ggctgtgagatgttaaaacctgcacsaccttgactaaagtaaaaacattt

SEQ ID NO: 49310 - DNA, 50 bp, homo sapien
aaaataactagaaatgatattgaagsaacataacaaaatttagcataaac

SEQ ID NO: 49311 - DNA, 50 bp, homo sapien
gaaaacagaggtaatgatatagatakgccatgtaaccttcaactacagtc

SEQ ID NO: 49312 - DNA, 50 bp, homo sapien
aaagccaaagcttctccctaggtaaytctttgctcccagtccttccaggt

SEQ ID NO: 49313 - DNA, 50 bp, homo sapien
tagaaatgatttatttttgtaaacartatgcaagaatgatttccacttta

SEQ ID NO: 49314 - DNA, 50 bp, homo sapien
cggttccagtcctggctcctgtttcrattatatggctcagttcagtttcc

SEQ ID NO: 49315 - DNA, 50 bp, homo sapien
taattatcaatctgtgtattgtcaaygtaagggcttagctaaggttaaac

SEQ ID NO: 49316 - DNA, 50 bp, homo sapien
ttgccatacatttcaaatataatccrgcaatgtgaaaaatctctcaaatc

SEQ ID NO: 49317 - DNA, 50 bp, homo sapien
gagttttgataaaaatagaattaaayttagaccccattaacactccatat

SEQ ID NO: 49318 - DNA, 50 bp, homo sapien
aatattgttagctattgcctcagagratagtatacactcagaagtagtac

SEQ ID NO: 49319 - DNA, 50 bp, homo sapien
tagtctcctattaactcatcagtaaygctttgttcaaccaggctttcctt

SEQ ID NO: 49320 - DNA, 50 bp, homo sapien
tgcactgataatttaatagtatctaycctgggcaagagagtggaacagtg

SEQ ID NO: 49321 - DNA, 50 bp, homo sapien
gagttcagaaattgagcttggcatasatactgttctttgaggtggtgtcc

SEQ ID NO: 49322 - DNA, 50 bp, homo sapien
cttttataatatattggctgtaagcrctataaagataagttcttttaaaa

SEQ ID NO: 49323 - DNA, 50 bp, homo sapien
cctacttcacacactaaaagttaaayccataaatatattaaaagtcccag

SEQ ID NO: 49324 - DNA, 50 bp, homo sapien
gtaagtgttcagaattctaaagtacrctctatttacacccaaaagaaaaa

SEQ ID NO: 49325 - DNA, 50 bp, homo sapien
agaacaaggaaggccagatcagataygtgcaccgatccacaagttcagta

SEQ ID NO: 49326 - DNA, 50 bp, homo sapien
ctatttgtagatcacattgaataacyggtagctttgcctatctttagttt

SEQ ID NO: 49327 - DNA, 50 bp, homo sapien
ttgaaataataatttcattatttcawaccttcataggaaaataatagaat

SEQ ID NO: 49328 - DNA, 50 bp, homo sapien
tttttaaattaaaaaaattatttatsaaattaactgtcttcaaaaatcta

SEQ ID NO: 49329 - DNA, 50 bp, homo sapien
caaaaatgaaaggacatgttacttaygcttccatatgcagtcaaaagtca

SEQ ID NO: 49330 - DNA, 50 bp, homo sapien
attacagccctacctaactcaagacygaaaatatttactataaagcttga

SEQ ID NO: 49331 - DNA, 50 bp, homo sapien
aattcatttaaaagtcagctaaaaaytatataaagtattgcatttaccct

SEQ ID NO: 49332 - DNA, 50 bp, homo sapien
cactcaagagaagttatagtcatctsaacagttgtgcaacttcaactagt

SEQ ID NO: 49333 - DNA, 50 bp, homo sapien
tctcagcactcatcagcttgtagtcygaatcactcttatgcctccttgaa

SEQ ID NO: 49334 - DNA, 50 bp, homo sapien
ccttttaataataccattgagactcygagggttagttaattctcttttta

SEQ ID NO: 49335 - DNA, 50 bp, homo sapien
actgctgggaaagacacagcaaggargagctattatgggatgcctctctg

SEQ ID NO: 49336 - DNA, 50 bp, homo sapien
gctcaaatgtgaaacaccatgctacrggctctacaggcccaggaggctca

SEQ ID NO: 49337 - DNA, 50 bp, homo sapien
cccacttgacatagtgccagacatayagtagtcattaaattaaatatcaa

SEQ ID NO: 49338 - DNA, 50 bp, homo sapien
aataagaaatgctctataaaatctcrctcgaatgaagatgatctggatag

SEQ ID NO: 49339 - DNA, 50 bp, homo sapien
attgaatattggaaattctctcaaartacaagtaatcaaacttggggacg

SEQ ID NO: 49340 - DNA, 50 bp, homo sapien
gcccacttctcctcttatctacttcygaacatttctgtccagtttccttc

SEQ ID NO: 49341 - DNA, 50 bp, homo sapien
tttcctaagttcttggagcttaatakgagccatgaaatttttttatgaga

SEQ ID NO: 49342 - DNA, 50 bp, homo sapien
gagtataatgtattcatgaaagttamggatttttgacaaatggaataata

SEQ ID NO: 49343 - DNA, 50 bp, homo sapien
gtggcataatctgcctccaggtagartctacatttactaaatcaaagtaa

SEQ ID NO: 49344 - DNA, 50 bp, homo sapien
gtgggtcaaaccttaaaattaagcaygagcagcagtcttggctacctgat

SEQ ID NO: 49345 - DNA, 50 bp, homo sapien
aagtaccatgagttaagaagtaacartataaactaaagtcttaaattggg

SEQ ID NO: 49346 - DNA, 50 bp, homo sapien
ttaaaatattttcaatacatcaacayattgtgggaagttgtaaataaatg

SEQ ID NO: 49347 - DNA, 50 bp, homo sapien
aaaagtacaattcataattttttatragtatgattgtgaaggatggtctg

SEQ ID NO: 49348 - DNA, 50 bp, homo sapien
gaccatctgaaaagagcaactattamaaggagattgaaaggtgggaagag

SEQ ID NO: 49349 - DNA, 50 bp, homo sapien
agctgaaggaataccttcagatcaaraaatatgatgtaaatatgcaggac

SEQ ID NO: 49350 - DNA, 50 bp, homo sapien
taaagatattaaacagagttacatayacttacaacttcatacatatatat

SEQ ID NO: 49351 - DNA, 50 bp, homo sapien
caggaaaaggtgagcctggtaaagasagtttagaaggaggagggatgagg

SEQ ID NO: 49352 - DNA, 50 bp, homo sapien
aaggaatatgaattcattgtagaaasgtaacttgatgataagtagaaaaa

SEQ ID NO: 49353 - DNA, 50 bp, homo sapien
tgactctgagatactgaatgagcatragaaagtgacacttcatgactgaa

SEQ ID NO: 49354 - DNA, 50 bp, homo sapien
gttttgtagagtggtagagacttgaraagatgctagaacatcattttatg

SEQ ID NO: 49355 - DNA, 50 bp, homo sapien
gaaggaaatgacccaatgaagtctcratgagtagaatatggtttactgga

SEQ ID NO: 49356 - DNA, 50 bp, homo sapien
aatcacatcattgctgacctttctcraagcaatttccgcagagttgcggg

SEQ ID NO: 49357 - DNA, 50 bp, homo sapien
tcacatcaaaagaaaatgattcttamaaggccaaaattttaggagggaaa

SEQ ID NO: 49358 - DNA, 50 bp, homo sapien
gcaagtgagatttatacaggcattcrcatcatgtcctctactatcttcaa

SEQ ID NO: 49359 - DNA, 50 bp, homo sapien
gaagtctggctatttaatcacctgasacggaggagtttcatgctggagat

SEQ ID NO: 49360 - DNA, 50 bp, homo sapien
tttcttgtagttaagagattacccgraagcaaatgaaataaagtggttat

SEQ ID NO: 49361 - DNA, 50 bp, homo sapien
gagctattgagacttctagtaaccamattttatgttatttacaacaaagt

SEQ ID NO: 49362 - DNA, 50 bp, homo sapien
aagacccctctagttacaaatcccawacttatgaaagaagcacttaattc

SEQ ID NO: 49363 - DNA, 50 bp, homo sapien
tatcaataattttatggcatacttcyatttaaatcctacagccttctggg

SEQ ID NO: 49364 - DNA, 50 bp, homo sapien
tttggatatttttcaaatgttttagwaaattatcataggagtctatgcag

SEQ ID NO: 49365 - DNA, 50 bp, homo sapien
tctgcaggtctctccttttcctgaaytgtaaatatagcccaatagatcaa

SEQ ID NO: 49366 - DNA, 50 bp, homo sapien
gaattattaatatttgtgcatattayggctctgtattgactgtgtgtagt

SEQ ID NO: 49367 - DNA, 50 bp, homo sapien
ggtaattttcatatttaatttcttarcagccaaagactttctaccaaatc

SEQ ID NO: 49368 - DNA, 50 bp, homo sapien
agatgcacaaaaaatatgttgcctamaaatatagtcatgtagataataaa

SEQ ID NO: 49369 - DNA, 50 bp, homo sapien
aacatatcaccactactggtgaaaartaaatcagctcaaaaatcctctaa

SEQ ID NO: 49370 - DNA, 50 bp, homo sapien
caccatatctcagagccatgggaaaytattgatcagtccttgataaagca

SEQ ID NO: 49371 - DNA, 50 bp, homo sapien
aaaatgctacaaaccaaagatggaamgatgccaagtgagattgcaaaaag

SEQ ID NO: 49372 - DNA, 50 bp, homo sapien
gacatgaaacatctgattttcaggcwctaatggtggatttttaaactttt

SEQ ID NO: 49373 - DNA, 50 bp, homo sapien
atatggcctgaaataaacactgacaytatctgccgttacaggattaggga

SEQ ID NO: 49374 - DNA, 50 bp, homo sapien
gttgcattcctaaaacaaatgtataygcgtgaagtctggctatttaatca

SEQ ID NO: 49375 - DNA, 50 bp, homo sapien
tactccaagaagatcagcaatataartaaaagtggaatctgtcatgccta

SEQ ID NO: 49376 - DNA, 50 bp, homo sapien
gtttactgagaatgatgattcaatasaggaaaattacaattatataagaa

SEQ ID NO: 49377 - DNA, 50 bp, homo sapien
tccacttaatgcacactttttcttaratttcaaactaatgtacgtagcat

SEQ ID NO: 49378 - DNA, 50 bp, homo sapien
aaattatgtccatatataccaaagamagggaacaagggatgaaatgataa

SEQ ID NO: 49379 - DNA, 50 bp, homo sapien
accacccggttctgtttccttatgawagggctgtgtctccaatgttcgtt

SEQ ID NO: 49380 - DNA, 50 bp, homo sapien
tgctgattattctataattgtcctaygatttcactggttttgttacttcc

SEQ ID NO: 49381 - DNA, 50 bp, homo sapien
accttaagcttgattctttgtgtcaytcatataaaacatgtctcttcctt

SEQ ID NO: 49382 - DNA, 50 bp, homo sapien
ggcccaaacgtctaacactgattgaratataggttctgtggcaacatgtg

SEQ ID NO: 49383 - DNA, 50 bp, homo sapien
ataaattttaagaggtatcagacaawttggaaggcattcataagatagtg

SEQ ID NO: 49384 - DNA, 50 bp, homo sapien
tcaatatgaattttcatgttgacaargtggtataaaagataattataaag

SEQ ID NO: 49385 - DNA, 50 bp, homo sapien
atggtttaatgttttctcccagtgaytattatgtaccttatatcaattaa

SEQ ID NO: 49386 - DNA, 50 bp, homo sapien
ccctcctagacaaatatctgtgtccrctagaaacactcagatttttttgt

SEQ ID NO: 49387 - DNA, 50 bp, homo sapien
ttgagggatatatgtggtattttcamccatagagataactgatattgccc

SEQ ID NO: 49388 - DNA, 50 bp, homo sapien
tgcttagcagacagtgcacactgaawtaatattaggttaatgtttattta

SEQ ID NO: 49389 - DNA, 50 bp, homo sapien
ccaatattccctcattggactaaagrattaaagagcaaaataagtatgct

SEQ ID NO: 49390 - DNA, 50 bp, homo sapien
atgtgtcataactccaatatttcaayctaaaatccaaaaaagcagctgct

SEQ ID NO: 49391 - DNA, 50 bp, homo sapien
caactcatctatggtcctggggccayggttaactgagatctgccttcaaa

SEQ ID NO: 49392 - DNA, 50 bp, homo sapien
tatcaaagatattgcttttgaatcasaaacactatttggagtatactgtc

SEQ ID NO: 49393 - DNA, 50 bp, homo sapien
attattaaataaatatggtttatcasaggtaaatgtgtatttagaggcat

SEQ ID NO: 49394 - DNA, 50 bp, homo sapien
aagtaaacttaaattctgttagttcygaaaatacttacttgtaagtttaa

SEQ ID NO: 49395 - DNA, 50 bp, homo sapien
ctgcttaatgtccatcctgttcaccragttttattctgcattatagcagg

SEQ ID NO: 49396 - DNA, 50 bp, homo sapien
ctttatcagagaagtctaacatttasaagatgtatttttcatatgaattt

SEQ ID NO: 49397 - DNA, 50 bp, homo sapien
gaaataagtaggactagaggcataaragtctaataaagagattctagcaa

SEQ ID NO: 49398 - DNA, 50 bp, homo sapien
gacatccaggagaagaattgggcaartagctggataggagttcccatggt

SEQ ID NO: 49399 - DNA, 50 bp, homo sapien
gcaacatttgctgggacatttccaasagtagtttgaccaggagtgagctt

SEQ ID NO: 49400 - DNA, 50 bp, homo sapien
ttttcatttgaagcagttcaattaawtcttgttaagtatgacaataaatt

SEQ ID NO: 49401 - DNA, 50 bp, homo sapien
tgctcaaagagaaaaatttaccttcraaacattgatggactttctatcta

SEQ ID NO: 49402 - DNA, 50 bp, homo sapien
aaatgttaattaaatgatccataatracaaaatagtcaaatgggagtaat

SEQ ID NO: 49403 - DNA, 50 bp, homo sapien
gagagggaaaccaggattaacagacscaacagtcatgagggcctctcatt

SEQ ID NO: 49404 - DNA, 50 bp, homo sapien
cactggaaataatacatggataagtsaaacagtggatgaataaaataaaa

SEQ ID NO: 49405 - DNA, 50 bp, homo sapien
gtttgtagctttcatttctcagttaygtgttttcaggaaggtgcatttgt

SEQ ID NO: 49406 - DNA, 50 bp, homo sapien
ttactgcacttaattacataaatagrattttaagctatcaataatattag

SEQ ID NO: 49407 - DNA, 50 bp, homo sapien
gctaggtactaaaggaattctgagamgaaagcatgaacataaaggaacaa

SEQ ID NO: 49408 - DNA, 50 bp, homo sapien
ttagaagtagaaaattggctaggtaytaaaggaattctgagaagaaagca

SEQ ID NO: 49409 - DNA, 50 bp, homo sapien
aagctgtgttatgggtgagtatagayagagtaattgtgaggagcttttga

SEQ ID NO: 49410 - DNA, 50 bp, homo sapien
atttcttatttgggtcaatttatgcwcaaacctgtgatgtgctggaggaa

SEQ ID NO: 49411 - DNA, 50 bp, homo sapien
ggtagagagaagccaagacaaggtayggatttggttcagagtcatttcct

SEQ ID NO: 49412 - DNA, 50 bp, homo sapien
gtaaaagatcagctgtgttgaaagcmgcgggtaggtcaatcatgttgaag

SEQ ID NO: 49413 - DNA, 50 bp, homo sapien
agtgaataattcaaaaacctgaagaygtgcgagtactgagttaaagctct

SEQ ID NO: 49414 - DNA, 50 bp, homo sapien
gtgaacttctttaattttgctaagarctagtctgtttttaatgcagtaaa

SEQ ID NO: 49415 - DNA, 50 bp, homo sapien
tgccagtacctgttctcaaaataacrgatgattcttgcaagacatattaa

SEQ ID NO: 49416 - DNA, 50 bp, homo sapien
catttcctgatttgactaataagtaygcagtgtgataaatgttaaccagc

SEQ ID NO: 49417 - DNA, 50 bp, homo sapien
caaaatggtgaattgctttaacaaayggaaaatgagttcagaatgaagca

SEQ ID NO: 49418 - DNA, 50 bp, homo sapien
gcccagctgatgtactaccaatgagsatatacttaaaaagagtggtgggg

SEQ ID NO: 49419 - DNA, 50 bp, homo sapien
ctaataatgataaatattttacttgracatgctcactttgaattgctttc

SEQ ID NO: 49420 - DNA, 50 bp, homo sapien
aaaattgatggaaaactgaatacagraaagtgctactataggaaagggat

SEQ ID NO: 49421 - DNA, 50 bp, homo sapien
gtatttattgattatgtattttgggycagccctcttctaggtactagaga

SEQ ID NO: 49422 - DNA, 50 bp, homo sapien
cagatgctgtaaaatcaacaacttcratatggagaattcataaatattca

SEQ ID NO: 49423 - DNA, 50 bp, homo sapien
tgaattaatcccttaaagaacgatcratatgaaataaccacaacagaagt

SEQ ID NO: 49424 - DNA, 50 bp, homo sapien
gtggctcaggatggaattatctaaargtttcttcactcacacatctgatg

SEQ ID NO: 49425 - DNA, 50 bp, homo sapien
agctacatctgtggcttgggttacaygtgagatcttgtaggacagccata

SEQ ID NO: 49426 - DNA, 50 bp, homo sapien
gcatagttttttagaaacttctgaaytgatattacattgccatagcatcc

SEQ ID NO: 49427 - DNA, 50 bp, homo sapien
ggtagtttaatttgcttccataaaamcctgaaaatctgaaaattgctaga

SEQ ID NO: 49428 - DNA, 50 bp, homo sapien
taaaattggaaacaaatgataagtcwatttatgaaaacaataatcttatt

SEQ ID NO: 49429 - DNA, 50 bp, homo sapien
ccagagtttatgctataccaagtcaygaattaactgaatctgaaggaaca

SEQ ID NO: 49430 - DNA, 50 bp, homo sapien
acagtattttatgtcagtcacttggsatggacaacttattaatgaccctg

SEQ ID NO: 49431 - DNA, 50 bp, homo sapien
caactgcctaacaaatagaagataaytggtaaataaagtaatacaaattc

SEQ ID NO: 49432 - DNA, 50 bp, homo sapien
gcacaggaatatgatgccgtaacaaygactttcctttctatggtgggaag

SEQ ID NO: 49433 - DNA, 50 bp, homo sapien
ctgtgacacaaagatagcaaaatatsataaacgcttgatcctacagttgt

SEQ ID NO: 49434 - DNA, 50 bp, homo sapien
cagtgttttaactgtgatttcaaacygaacttattcaacttagtttttgt

SEQ ID NO: 49435 - DNA, 50 bp, homo sapien
tgcttattttttctaatttggtaagmcctcacatagaggatatattctgc

SEQ ID NO: 49436 - DNA, 50 bp, homo sapien
gaactcagtattaaattgtatgccaragtacatgtggctacaataagaat

SEQ ID NO: 49437 - DNA, 50 bp, homo sapien
aattttagatcactcatcattatgcwcttatattcacacccacacacact

SEQ ID NO: 49438 - DNA, 50 bp, homo sapien
atctaaaaataataataaaataatcmaccaaattctacataggcagatca

SEQ ID NO: 49439 - DNA, 50 bp, homo sapien
atatttgtatatgcagtgatgctcamatttcccaaacttcttaaacaggt

SEQ ID NO: 49440 - DNA, 50 bp, homo sapien
tattaaattccaaaaataaacatacrgtaacacttaaacagtatcaagct

SEQ ID NO: 49441 - DNA, 50 bp, homo sapien
taactaataagaattctagatgtcaraggtttctgagaagtgtttgatca

SEQ ID NO: 49442 - DNA, 50 bp, homo sapien
tggaagccttgtatttgtggactcaytcgggctataaagtgacggggaag

SEQ ID NO: 49443 - DNA, 50 bp, homo sapien
ttaattactgaccattgatgcataartatctacctacttttatttagaat

SEQ ID NO: 49444 - DNA, 50 bp, homo sapien
ccagatttgggattatatgggaaaarctcctaagtaccctaaacaattgt

SEQ ID NO: 49445 - DNA, 50 bp, homo sapien
cctattctaaaatatacaattctatmagtacgacgaatacttatcttgac

SEQ ID NO: 49446 - DNA, 50 bp, homo sapien
atatttcctattgaaatcagcccaaytatctttgttttttgttttgtgtt

SEQ ID NO: 49447 - DNA, 50 bp, homo sapien
tactgtacttttcttaccaaactaartagacagtgacttcgaaaatattt

SEQ ID NO: 49448 - DNA, 50 bp, homo sapien
tggaggaatccaatgacatttcttcyctaaacttttgtaacagcattcct

SEQ ID NO: 49449 - DNA, 50 bp, homo sapien
actctcctaagtttaatttatatccrcaccattttacagactaggataca

SEQ ID NO: 49450 - DNA, 50 bp, homo sapien
aggtccctaatgaccactatacttarcttgcaacatgttttatagatgtt

SEQ ID NO: 49451 - DNA, 50 bp, homo sapien
gaacaaacaccatagacattcattayggatactcaacttgctagctctag

SEQ ID NO: 49452 - DNA, 50 bp, homo sapien
aaccatgggcattaattaatccttaygtattgtaccagaaaagctttgaa

SEQ ID NO: 49453 - DNA, 50 bp, homo sapien
cacttggagttataatttgacatcawctgtactgtttccctttggcttct

SEQ ID NO: 49454 - DNA, 50 bp, homo sapien
tgaagtctaggaaatggtagtcataygtgaatcccaaattatctctgtaa

SEQ ID NO: 49455 - DNA, 50 bp, homo sapien
atcactaccaggcccttccatggccrctaaactgccctctacgcccttct

SEQ ID NO: 49456 - DNA, 50 bp, homo sapien
atatttggttttgaacaattcaatasgtttgatgttgtagattgaagctt

SEQ ID NO: 49457 - DNA, 50 bp, homo sapien
taaattctctctttgtatttgaagarcattatatctctacattgccatta

SEQ ID NO: 49458 - DNA, 50 bp, homo sapien
acattgggcctaataaggtcaagagycactaaatacaatgacaatggaag

SEQ ID NO: 49459 - DNA, 50 bp, homo sapien
aaatgtggtggtgcatcctaaaaatragagctatctacaactgatacata

SEQ ID NO: 49460 - DNA, 50 bp, homo sapien
gaggcatgaaaattgtcattaaataygcaaagagctatcatgcagaagag

SEQ ID NO: 49461 - DNA, 50 bp, homo sapien
atgattcagatagcattttgagtatyaagggcctggagatgttcattttg

SEQ ID NO: 49462 - DNA, 50 bp, homo sapien
gcccagagcccacaggtaaacatcarggaaaaaaggattcaaatccaagc

SEQ ID NO: 49463 - DNA, 50 bp, homo sapien
aagaagaacttacacgtattaaccartcttttactggagctgaaaggaaa

SEQ ID NO: 49464 - DNA, 50 bp, homo sapien
tgtatctggcaaaataatcgacaccragattcactggagaagtatacaat

SEQ ID NO: 49465 - DNA, 50 bp, homo sapien
tacttttattattactttgttttaaygtgctttctacagtgtatttgtct

SEQ ID NO: 49466 - DNA, 50 bp, homo sapien
gtttcccacagatgcacaaattcccrcagaaaactcttgggtctgttcaa

SEQ ID NO: 49467 - DNA, 50 bp, homo sapien
attccactatgtgatattagctatgmagccaaccattctcttgcagcaat

SEQ ID NO: 49468 - DNA, 50 bp, homo sapien
ggcttaaggtgtttttaactctgacrcaggaaaaatgtcaactttgctta

SEQ ID NO: 49469 - DNA, 50 bp, homo sapien
actgtgcccatattttctgaattccrctttctgccttcttagctgcatct

SEQ ID NO: 49470 - DNA, 50 bp, homo sapien
tagagccataggacaattgatcaaayatgagggtagaataaagctatttt

SEQ ID NO: 49471 - DNA, 50 bp, homo sapien
ttttgaggcaatgagaggcatatacrataaagttattaaatagaaaaatc

SEQ ID NO: 49472 - DNA, 50 bp, homo sapien
tctacagaacaaaaatgcaactgatraaagatctcgaggttagactgcat

SEQ ID NO: 49473 - DNA, 50 bp, homo sapien
agcaatgcaggagctgaaagacaaartagcctgtataaaaaagaatctaa

SEQ ID NO: 49474 - DNA, 50 bp, homo sapien
ctttttggggattctctcccttttayaatcagagctgtacctttggtgag

SEQ ID NO: 49475 - DNA, 50 bp, homo sapien
aataaatgaggtgatagtatagtagraaactgacattaaggaattgagta

SEQ ID NO: 49476 - DNA, 50 bp, homo sapien
ctgatgctcttaccacactctaaccrcagtagcctagtagtttcccctca

SEQ ID NO: 49477 - DNA, 50 bp, homo sapien
ctcctgaggaggcaatatacaaggaraagcaaaaacaatggaccacagat

SEQ ID NO: 49478 - DNA, 50 bp, homo sapien
ccttaggaaattagtagagtaaatamggaaaactgttcaagttgccactg

SEQ ID NO: 49479 - DNA, 50 bp, homo sapien
tctaaataatatagcattcaaatcartaaagaaaagtcagtgtcaaataa

SEQ ID NO: 49480 - DNA, 50 bp, homo sapien
tctgcaaaggtttaaactctttccayggtgagcgtatccaagtagctgca

SEQ ID NO: 49481 - DNA, 50 bp, homo sapien
ctacattctcctacaatttaaccaastgatgtgactcattgcccctccca

SEQ ID NO: 49482 - DNA, 50 bp, homo sapien
ttgggtctgaattccaatctcagtaygaatgttaggtttcacctcctgat

SEQ ID NO: 49483 - DNA, 50 bp, homo sapien
ataggttttgtcagcgttcaagtgakagactataatcaattaacatctcc

SEQ ID NO: 49484 - DNA, 50 bp, homo sapien
ttaggttgagaaaacagaattttgamatactagaactttctctcctatag

SEQ ID NO: 49485 - DNA, 50 bp, homo sapien
tgaagtgactgcattcatcaatcaarggtctatgccagagtctctcaaac

SEQ ID NO: 49486 - DNA, 50 bp, homo sapien
tgcaataatgggacttaatggaccakcatacacaggagcatctttcattg

SEQ ID NO: 49487 - DNA, 50 bp, homo sapien
tggtggtaaattttgcttttggaaasagttgcactaaattaggggtcaaa

SEQ ID NO: 49488 - DNA, 50 bp, homo sapien
ctatctaggtcagcttcttccattayatactttcctagcaccatgactat

SEQ ID NO: 49489 - DNA, 50 bp, homo sapien
cttcagataactcatcattctcaccrcacttctattttaactctgcaaga

SEQ ID NO: 49490 - DNA, 50 bp, homo sapien
ttgctccactgtcacctgaaatgtarcacaagaacaaagtcatcctccat

SEQ ID NO: 49491 - DNA, 50 bp, homo sapien
gggattaccagaggataatctgatgyataagccatgtggtgctcaaaaat

SEQ ID NO: 49492 - DNA, 50 bp, homo sapien
tataatcaattaacatctccttgtayatttttctgtaaatcgtggcttac

SEQ ID NO: 49493 - DNA, 50 bp, homo sapien
actttgagcatctgcatgttaaaaaygacagaacttacattaggctggat

SEQ ID NO: 49494 - DNA, 50 bp, homo sapien
taaaattaaaacaggaatataatacmagaaaccaatgaatcaaaaatata

SEQ ID NO: 49495 - DNA, 50 bp, homo sapien
gaatctacttagaggtttaaaatcartaatggcatttctaataagaatat

SEQ ID NO: 49496 - DNA, 50 bp, homo sapien
tcattcagcatttctgcatgttgtayaaagtttgttagaaaagctataat

SEQ ID NO: 49497 - DNA, 32 bp, homo sapien
ctttaaatctttggtaraatttcctgttaagc

SEQ ID NO: 49498 - DNA, 50 bp, homo sapien
agaaagtgactgaaaaaagtacatayaagtctctgcatttacctccttgt

SEQ ID NO: 49499 - DNA, 50 bp, homo sapien
tttgattatttgctctgcacaaaaayggtctgttcagcaggtaaactgga

SEQ ID NO: 49500 - DNA, 50 bp, homo sapien
tttttctttttaaaccaactgttgcraagtgaaaaaatcaattaagacat

SEQ ID NO: 49501 - DNA, 50 bp, homo sapien
tctcttcttatcttttaagaacataragagaattgacatggcagaaaatg

SEQ ID NO: 49502 - DNA, 50 bp, homo sapien
aattggtctagtagatacaactataygatttttagtacttcaggtggcat

SEQ ID NO: 49503 - DNA, 50 bp, homo sapien
acatattgctgctcccaaaattaacrgtgaagacatcttgttgcaattca

SEQ ID NO: 49504 - DNA, 50 bp, homo sapien
tcatgcaaagtagatatttgtagaayaattacagatgggaaagtatgccc

SEQ ID NO: 49505 - DNA, 50 bp, homo sapien
gggtaaggagagtgattatcagagamataattgcatatgttctccaacaa

SEQ ID NO: 49506 - DNA, 50 bp, homo sapien
tgaaaaataaaagaattccctaaatwacagtttgttcataaactacttca

SEQ ID NO: 49507 - DNA, 50 bp, homo sapien
agatctatattttgagtgaaaagtaygaggaatatttgaagtagtttatg

SEQ ID NO: 49508 - DNA, 50 bp, homo sapien
actttccctttagaatccttttcaaygtagggctgctcagcatcagtgaa

SEQ ID NO: 49509 - DNA, 50 bp, homo sapien
caatattttcaaactagtaggcataktaagatctatattttgagtgaaaa

SEQ ID NO: 49510 - DNA, 50 bp, homo sapien
tgcacacacacatacatcactcatawgatattctacttaaatgaactttt

SEQ ID NO: 49511 - DNA, 50 bp, homo sapien
aaagtataaatctcaagataaaactwaataatgacaagattctttttaaa

SEQ ID NO: 49512 - DNA, 50 bp, homo sapien
tgccgatttttaagaaatgagacaarccattgttctaatcttgtaaagtt

SEQ ID NO: 49513 - DNA, 50 bp, homo sapien
tatcaagtagattgttttttaattaygccaagtgacataaactttatagt

SEQ ID NO: 49514 - DNA, 50 bp, homo sapien
cagctaatatccctgtggatactaasatttcgtaattctcacatttgggt

SEQ ID NO: 49515 - DNA, 50 bp, homo sapien
ctgctgaaactgtgggatttaaagaygtcatgatcttccatttgagaata

SEQ ID NO: 49516 - DNA, 50 bp, homo sapien
gctgaatacaattcattattcgataycatgaaaatatattaatctggctt

SEQ ID NO: 49517 - DNA, 50 bp, homo sapien
agaaccctttaccaagtagatgatartaatgatgacgattatttttcaca

SEQ ID NO: 49518 - DNA, 50 bp, homo sapien
tttcagtacctcccaaatgctaggawtattctgaaaactttaatttatca

SEQ ID NO: 49519 - DNA, 50 bp, homo sapien
tcccacagaaacatattgcttgtacmctgaatgattcccatactaagcct

SEQ ID NO: 49520 - DNA, 50 bp, homo sapien
tagtaagaggaggtagaagcatccaytctgagtcagaaatctttctcagc

SEQ ID NO: 49521 - DNA, 50 bp, homo sapien
tatatattgggcatgtctggtgaacygatcttctagctctgccgttagaa

SEQ ID NO: 49522 - DNA, 50 bp, homo sapien
ataaaagggtctaactcataagaaasatttcgactataaacgttagatat

SEQ ID NO: 49523 - DNA, 50 bp, homo sapien
attctgtaattctatgcaataatgcycaaaagtgtaaatttctaacatat

SEQ ID NO: 49524 - DNA, 50 bp, homo sapien
tttcgactataaacgttagatataayaaaagccagtaaaattagttattg

SEQ ID NO: 49525 - DNA, 50 bp, homo sapien
tggtctgtttatgcactaatcccacwctattttatttatagagactttat

SEQ ID NO: 49526 - DNA, 50 bp, homo sapien
tgtgtataagtcatgagaaggattgrattgaaaaggagaggctaaatatt

SEQ ID NO: 49527 - DNA, 50 bp, homo sapien
gggaaggaaagacggatgtggatacygatatatttgcatgttttctaggg

SEQ ID NO: 49528 - DNA, 50 bp, homo sapien
gcagaattaactatgtgggccagggracttacaatatttaacaattaaca

SEQ ID NO: 49529 - DNA, 50 bp, homo sapien
agttaatcacagtctgagataaagayctgaaatcgagtcaatggcttttc

SEQ ID NO: 49530 - DNA, 50 bp, homo sapien
ataatgaaattttgaatattcacacyactacctaactgtttgaaggacag

SEQ ID NO: 49531 - DNA, 50 bp, homo sapien
aatagaacttgttaagatgcttaaaygagaaataaagagcataagggaga

SEQ ID NO: 49532 - DNA, 50 bp, homo sapien
taaatgttataagaaagagttaagcrattttatgagtgtgagagatacta

SEQ ID NO: 49533 - DNA, 50 bp, homo sapien
aggctgactacatattctgctaataygaaaaacataaacatccatattct

SEQ ID NO: 49534 - DNA, 50 bp, homo sapien
aaattactaatataatgccttagagmaaacaacgtgaaaatctcagggtt

SEQ ID NO: 49535 - DNA, 50 bp, homo sapien
tccattcctgcatataattttgaacragacaagttcttattatcaagaaa

SEQ ID NO: 49536 - DNA, 50 bp, homo sapien
gggaatatactgtggaaaataagaaygtgttgggatacatgagtgcagag

SEQ ID NO: 49537 - DNA, 50 bp, homo sapien
gatagagagggacttaaaatgattaygacatgatttaaacctatgccaag

SEQ ID NO: 49538 - DNA, 50 bp, homo sapien
cccggccaagtgagagatttatttcyaatggatgtttgtaaatgtacggt

SEQ ID NO: 49539 - DNA, 50 bp, homo sapien
ggaaagaaccttctcccagagactamactacagagaaaaacaagactgtc

SEQ ID NO: 49540 - DNA, 50 bp, homo sapien
aatccaatattctgtcactcaaccaygttctttcccattttatagcttta

SEQ ID NO: 49541 - DNA, 50 bp, homo sapien
ccaatggaagactttaagagaatcamgccttcagtacagaaattaactac

SEQ ID NO: 49542 - DNA, 50 bp, homo sapien
tttgcaaattgatccataatttggasatattattcattgatttaataact

SEQ ID NO: 49543 - DNA, 50 bp, homo sapien
agactagcttatagctcatagtaatyacaaatagctgaaactgactgaca

SEQ ID NO: 49544 - DNA, 50 bp, homo sapien
aaagtgatactctagccactactgayattaggagagaagttctcaatctc

SEQ ID NO: 49545 - DNA, 50 bp, homo sapien
tgtaatatttcagtacacaggtagartaggagacaggttttggtaattca

SEQ ID NO: 49546 - DNA, 50 bp, homo sapien
tatctgttaatgcaataaacatgtartaaacacctctaagtcaggcccta

SEQ ID NO: 49547 - DNA, 50 bp, homo sapien
ttttgtactcaaattaatcaatgcawctatttctccatgtttactaaatc

SEQ ID NO: 49548 - DNA, 50 bp, homo sapien
taattgagctggccagctgctgagayaaagaaatagccttggccatgcga

SEQ ID NO: 49549 - DNA, 50 bp, homo sapien
tgaccagccacttgaggtgaagagaycagatttatttagattttgtagcc

SEQ ID NO: 49550 - DNA, 50 bp, homo sapien
cacaaaacagactaagacagtgataygggagactgttctaatttagcttc

SEQ ID NO: 49551 - DNA, 50 bp, homo sapien
aattggaatattgtatagctgggtargagatatgtaaaatctgtaatctt

SEQ ID NO: 49552 - DNA, 50 bp, homo sapien
atttgttgccaccagaaaaaggaacrggtaatgattgttatataagggca

SEQ ID NO: 49553 - DNA, 50 bp, homo sapien
agtgagttaaacaattggacagatayggaattaacattaatagggaaata

SEQ ID NO: 49554 - DNA, 50 bp, homo sapien
aatggtctggcattcagcaagcctcraagtatttttgttttgttttgtat

SEQ ID NO: 49555 - DNA, 50 bp, homo sapien
ttgacttggataccgaaggatcgaaygttaccatgtcaagttgaaaatga

SEQ ID NO: 49556 - DNA, 50 bp, homo sapien
taaaagtcaggataatggtagctacyacatggcactgtttggaatgaatt

SEQ ID NO: 49557 - DNA, 50 bp, homo sapien
tgccatgtggtagctaccattatccygacttttactgaagataacaaaaa

SEQ ID NO: 49558 - DNA, 50 bp, homo sapien
cttccatcttccagctcaatgcttcratccactgtgtataacatagttat

SEQ ID NO: 49559 - DNA, 50 bp, homo sapien
atatcattttctaggtgtgccatgaygtaaaagaaattggtaagtattga

SEQ ID NO: 49560 - DNA, 50 bp, homo sapien
gggcattcgtgctgaggtaatgggawagtattagatagagggtgttagat

SEQ ID NO: 49561 - DNA, 50 bp, homo sapien
gcatttttgaaacaatgaggaggtasattagatgacagatatgaaagctt

SEQ ID NO: 49562 - DNA, 50 bp, homo sapien
ctacctaatatatgctggtgagtaasatgcaatacacaatctatatactc

SEQ ID NO: 49563 - DNA, 50 bp, homo sapien
agacttacactgacacagatatttcrcctgtcagcacagctaagggtctc

SEQ ID NO: 49564 - DNA, 50 bp, homo sapien
atttctttgaacctcaatataatagrcattcctgatcccaggactccctt

SEQ ID NO: 49565 - DNA, 50 bp, homo sapien
agtgttaatatgtatgtttaggataygaataaggaaaaccataaacgtcc

SEQ ID NO: 49566 - DNA, 50 bp, homo sapien
gaggttttgttcattgcatttcacawaagtcatgaaaaataacatttagt

SEQ ID NO: 49567 - DNA, 50 bp, homo sapien
taactcttacaaagtgtgcatacaarcaaggattgtctgagaagtatgaa

SEQ ID NO: 49568 - DNA, 50 bp, homo sapien
acgttatagatgatgaaattgagacmgagaaaactagcaatatgccaagt

SEQ ID NO: 49569 - DNA, 50 bp, homo sapien
tacctctttttaatgacttctgttaygtattccaaatgcttctgtttttc

SEQ ID NO: 49570 - DNA, 50 bp, homo sapien
tggtattatcctgccttcttgacaaytgtttaatgttaaagatttttcag

SEQ ID NO: 49571 - DNA, 50 bp, homo sapien
atcactaaatatgaatgtggtgtgcraataagctctacagactcatggaa

SEQ ID NO: 49572 - DNA, 50 bp, homo sapien
agaataaaacttcagttgctttttaratgatatccactgggtattccatt

SEQ ID NO: 49573 - DNA, 50 bp, homo sapien
ctttctggtactgtcatattagagaygaagggaagtagttataagggaat

SEQ ID NO: 49574 - DNA, 50 bp, homo sapien
aatccttattctttacctgtgtacartcaattctttatatagattatggt

SEQ ID NO: 49575 - DNA, 50 bp, homo sapien
tacacactgaaattaatagaaaaaaraaactccattgagatgaaggagct

SEQ ID NO: 49576 - DNA, 50 bp, homo sapien
ctctagaagagcattacgaattataragagtaatgtatgtagttatttct

SEQ ID NO: 49577 - DNA, 50 bp, homo sapien
tgccacatctacatcaactttattaraaaagcaaacaaatatccagtgtc

SEQ ID NO: 49578 - DNA, 50 bp, homo sapien
tatggtatattgattcatcagtaccwctttttttattactattgttttat

SEQ ID NO: 49579 - DNA, 50 bp, homo sapien
atcctatttctaaaataaagggccaktaaaagaagtctagaatgcctatt

SEQ ID NO: 49580 - DNA, 50 bp, homo sapien
cgtctctaaaacaataaaaaatttcrcttggcggtgatgtgcacctgtaa

SEQ ID NO: 49581 - DNA, 50 bp, homo sapien
ttcctggatacagaatgagtacaaascagtgctaaacacgttatcaactt

SEQ ID NO: 49582 - DNA, 50 bp, homo sapien
gttgtctgtgggagccaaccaatccrgatacatgggagtgatcatgaaga

SEQ ID NO: 49583 - DNA, 50 bp, homo sapien
ataaattgcattatgtcactgatcakgctgtataattacagatacacaga

SEQ ID NO: 49584 - DNA, 50 bp, homo sapien
tggctgaggccctagatgtagaggargtaaatgccttgcatcactcagat

SEQ ID NO: 49585 - DNA, 50 bp, homo sapien
tcctcctggaatatcacatgttgaamaaattttaaaattatccatttaat

SEQ ID NO: 49586 - DNA, 50 bp, homo sapien
ctaattgtcttgatatagcaaattcygaataaatagcctgtgttctcatt

SEQ ID NO: 49587 - DNA, 50 bp, homo sapien
tgctattaaaggatgtttaagcaackaagaggtagtccaggtgtatgatt

SEQ ID NO: 49588 - DNA, 50 bp, homo sapien
aaggataagagaaggaagaagttaasaatcagagacagtggcaaggttgc

SEQ ID NO: 49589 - DNA, 50 bp, homo sapien
actactctgtaatcaattccatagaygtgaggactgcaaaacaaatgatc

SEQ ID NO: 49590 - DNA, 50 bp, homo sapien
tgatacacacggaagtttctgcaagsaatccgaggtcacatccctgagca

SEQ ID NO: 49591 - DNA, 50 bp, homo sapien
ctggtcaagaggcttagaaacaactyagtcaacaggtgctcagtatttga

SEQ ID NO: 49592 - DNA, 50 bp, homo sapien
gaggaaagtaattacagtgctcagaygttaattaagagacactaaaaaac

SEQ ID NO: 49593 - DNA, 50 bp, homo sapien
ttccatttgtctattagtctcataastatttcagccatcttttattgaac

SEQ ID NO: 49594 - DNA, 50 bp, homo sapien
ggaatctaagcagtcatttagatcgsatgagagagtagaatcctagtcaa

SEQ ID NO: 49595 - DNA, 50 bp, homo sapien
aggaaaacctattttccttagaaacragagacagtgttttttgatgcttc

SEQ ID NO: 49596 - DNA, 50 bp, homo sapien
aagagtggttggaaatggttaaatgratgattctctaaattgaatgtttg

SEQ ID NO: 49597 - DNA, 50 bp, homo sapien
catagaagatgcatgaaaacagtgayagaacttacttattatacatttta

SEQ ID NO: 49598 - DNA, 50 bp, homo sapien
ttcaatgtgtctttttatataaaacraaatctggttacatgatgcctggc

SEQ ID NO: 49599 - DNA, 50 bp, homo sapien
attagcatttagtgttaaaagtcagmaatattaactagtgcatttctgta

SEQ ID NO: 49600 - DNA, 50 bp, homo sapien
cctgcttctgtgtttataagctctarccatatcatacaaaggaaagcaac

SEQ ID NO: 49601 - DNA, 50 bp, homo sapien
ggcagaggagagaacattatataaayagaacatcagttaattaattgcac

SEQ ID NO: 49602 - DNA, 50 bp, homo sapien
atgtagtatagacaacagaggacaasagagattctagaaatagacacata

SEQ ID NO: 49603 - DNA, 50 bp, homo sapien
atgcagggcaggtctggtcaagtacmggacacctgtggcctataaggtcc

SEQ ID NO: 49604 - DNA, 50 bp, homo sapien
ttttgccaacatccagaaaggaaccragtgctccagaaagagcccgggga

SEQ ID NO: 49605 - DNA, 50 bp, homo sapien
gtcttgcttattgattgacttagaaytgaaaaagagagaacggacatgtc

SEQ ID NO: 49606 - DNA, 50 bp, homo sapien
gctagatatttccttgcaaaattaasagacaggcttaaagagattagatg

SEQ ID NO: 49607 - DNA, 50 bp, homo sapien
ttaccaatagaacttcacttccacaytccacaggggtcctacagtcaggc

SEQ ID NO: 49608 - DNA, 50 bp, homo sapien
ggccactccttttccatgttctttamaaaattcatttatgatgctctttt

SEQ ID NO: 49609 - DNA, 50 bp, homo sapien
atttttatatccaataaacaaatccragtggtaagaatatgtattttcca

SEQ ID NO: 49610 - DNA, 50 bp, homo sapien
tgggtggcaagaagatccatctaaartagggtttctcaatctcagcacta

SEQ ID NO: 49611 - DNA, 50 bp, homo sapien
gaacaaaagttccttagataatagtwacaatatgtcttatcctcttatta

SEQ ID NO: 49612 - DNA, 50 bp, homo sapien
gactttttttcaacaacttatctgaratttaaagtaaagttagcaccacc

SEQ ID NO: 49613 - DNA, 50 bp, homo sapien
atatttggtgtagtatcatcctttgracctacttcataatcataatcttc

SEQ ID NO: 49614 - DNA, 50 bp, homo sapien
tagttttatagaaaaatatttcaaakttaggatacatggaagaaaataac

SEQ ID NO: 49615 - DNA, 50 bp, homo sapien
atctgtgaacaatgcagaaaataacsctgtggaatctacatgttagtagg

SEQ ID NO: 49616 - DNA, 50 bp, homo sapien
tgaactccagagtctgcaggctttargaagaaagtgtttgcctaaacata

SEQ ID NO: 49617 - DNA, 50 bp, homo sapien
aaagcccacaatgcctgtaaatccaraggaatgtaaaatacatggtccac

SEQ ID NO: 49618 - DNA, 50 bp, homo sapien
atgggtaacactggcctcacttccayaagggttctgtcccagagcactct

SEQ ID NO: 49619 - DNA, 50 bp, homo sapien
ttgtttaatagataaatctcagacartggcattataacatgatggtgata

SEQ ID NO: 49620 - DNA, 50 bp, homo sapien
caactggttaagtttaaaccagtaartcataatgaagcaaaagtaggttt

SEQ ID NO: 49621 - DNA, 50 bp, homo sapien
tgacacatttcaaatcataaataackcatggactttaacttgcatgacta

SEQ ID NO: 49622 - DNA, 50 bp, homo sapien
taatgccactgttattgcctgtaacrctaagctgtccattccctgggatt

SEQ ID NO: 49623 - DNA, 50 bp, homo sapien
atccacaacagaattttattcctgtraatgttttcaatctccaactttac

SEQ ID NO: 49624 - DNA, 50 bp, homo sapien
acaaaaggagagtattcaatgactaygctttgatagtgtagctatgaatc

SEQ ID NO: 49625 - DNA, 50 bp, homo sapien
taacggatggatctggaatcacaaamcttaaaagtagaacttaccctctt

SEQ ID NO: 49626 - DNA, 50 bp, homo sapien
aggatcctgagttcaaattagacacraagagcagagggcaaagatactgg

SEQ ID NO: 49627 - DNA, 50 bp, homo sapien
tcttccctgagctgacctgggtcctragagtattgaaaggaaatggtgct

SEQ ID NO: 49628 - DNA, 50 bp, homo sapien
ttaaacaactactagtatttaaacartatttcaaccacccatttgttaac

SEQ ID NO: 49629 - DNA, 50 bp, homo sapien
acggaagcagacaactcatttcttcrctaattcaaaatgagatagtaata

SEQ ID NO: 49630 - DNA, 50 bp, homo sapien
ttcagcaatttttctttctggagaaytggctctcagtgacttggcttgct

SEQ ID NO: 49631 - DNA, 50 bp, homo sapien
tcttcagtttgacctcctaagggaartaagtcctgcagaagtaaccagcc

SEQ ID NO: 49632 - DNA, 50 bp, homo sapien
ctaaataattcatgagttaatgaagmaagttaaatagctatcaaacaata

SEQ ID NO: 49633 - DNA, 50 bp, homo sapien
gtgagaataaaaatttgttcctagtraagagagcaacttgtaaaagccca

SEQ ID NO: 49634 - DNA, 50 bp, homo sapien
ttctggggaaagttatatagatgtargttccaataacttgagaaaacatt

SEQ ID NO: 49635 - DNA, 50 bp, homo sapien
cttacaactcaaagcacttcttttaygtgctcataggaaaatgatctttc

SEQ ID NO: 49636 - DNA, 50 bp, homo sapien
ctctctggtctggcagggaaaccctraaatactgccaaagcttattctgg

SEQ ID NO: 49637 - DNA, 50 bp, homo sapien
acaacatacttaattcacaaagataygttgttgacaaatcagcagttaag

SEQ ID NO: 49638 - DNA, 50 bp, homo sapien
ggacaaaaagtctgatgttattgaartaggatgttcacttgagagacttg

SEQ ID NO: 49639 - DNA, 50 bp, homo sapien
tgggttctagtcccagctctgccacraataggctatatgactttgggcaa

SEQ ID NO: 49640 - DNA, 50 bp, homo sapien
atttgtgccaatgtgtctggtaaagyccaactcttccaggacaaagctca

SEQ ID NO: 49641 - DNA, 50 bp, homo sapien
tttctcttccctgatgccataactaycttccaaaatgtaaacataatgat

SEQ ID NO: 49642 - DNA, 50 bp, homo sapien
ggcctgaagggaacattgtgtcttawattcatgggcttgtacagtgtgta

SEQ ID NO: 49643 - DNA, 50 bp, homo sapien
atccctgtaagggtaggtattagggycaagcaaattgaggcttggataga

SEQ ID NO: 49644 - DNA, 50 bp, homo sapien
tggactatttttactatttactttaygttgccatggagatggggagatca

SEQ ID NO: 49645 - DNA, 50 bp, homo sapien
tgtctcctgtggccccagattccaaygcttaacatctgtgatctccccat

SEQ ID NO: 49646 - DNA, 50 bp, homo sapien
catcctattttttttaacatagcaayaatgagatggctttgagaataata

SEQ ID NO: 49647 - DNA, 50 bp, homo sapien
gtggttctcacccatgctagcctcaygactactgtgtacactatagagta

SEQ ID NO: 49648 - DNA, 50 bp, homo sapien
gaataatgaaagagaggttatgaccraggaaggattagcctggcaggaag

SEQ ID NO: 49649 - DNA, 50 bp, homo sapien
gttctattggacagtgctgtttaagycatcaactctgtgcctcagtttcc

SEQ ID NO: 49650 - DNA, 50 bp, homo sapien
aatatcttctttctctatctttgtamatgtaaatactacctgccatcctt

SEQ ID NO: 49651 - DNA, 50 bp, homo sapien
gataatcaagcttgcgttggcacgamatgaaaaaaaagttgtgagaggtt

SEQ ID NO: 49652 - DNA, 50 bp, homo sapien
atagatttttttaaatgtaatttaayttaaagttctagaatacaagtgca

SEQ ID NO: 49653 - DNA, 50 bp, homo sapien
tagaagaaaaaaatgtttttctaaaktatagtgtagatgaagcatacagt

SEQ ID NO: 49654 - DNA, 50 bp, homo sapien
catggggctaatccagctgggcctcrcttgacggcagacagaggcacagg

SEQ ID NO: 49655 - DNA, 50 bp, homo sapien
gcaaagctcaaggcaaatcattcccraggagtttttactgctgccaagta

SEQ ID NO: 49656 - DNA, 50 bp, homo sapien
actgtgaggggttgtaaccatcacaraggatatacttaaactcatatttc

SEQ ID NO: 49657 - DNA, 50 bp, homo sapien
gaaatggaacatgtacatatctgcargtaaaaagacttgtggcctcattt

SEQ ID NO: 49658 - DNA, 50 bp, homo sapien
ccaagtgagtctatgtcagaaccagrattagaattttggaggcagaccaa

SEQ ID NO: 49659 - DNA, 50 bp, homo sapien
agattcaacctcaatattctgcatcraagggaaagtcctccaaatgagag

SEQ ID NO: 49660 - DNA, 50 bp, homo sapien
tgaatccagtggcataatgacagaarggtatagaatcacagttgtgaata

SEQ ID NO: 49661 - DNA, 50 bp, homo sapien
agtccaccaacccattgcctacaccrgaaatgatgctcataggaaagtaa

SEQ ID NO: 49662 - DNA, 50 bp, homo sapien
ccagaaggctggtcccaggctgtggmagattgtattatgagtcccaattc

SEQ ID NO: 49663 - DNA, 50 bp, homo sapien
tcatatattatgagagggaatgaaasatgagttagccattctggaaacca

SEQ ID NO: 49664 - DNA, 50 bp, homo sapien
cttggagccatcacagggagactccrcaaaacctttatgtggtccctggc

SEQ ID NO: 49665 - DNA, 50 bp, homo sapien
ccaatgtaggtaaagcatttactaamgttcatgtcatgtgctgagatcat

SEQ ID NO: 49666 - DNA, 50 bp, homo sapien
cctacctttctacttcgtatggctayaaagagtttctttctttttgagaa

SEQ ID NO: 49667 - DNA, 50 bp, homo sapien
tatacagtaatattgattatatagcrataagcagagacttcaagaattac

SEQ ID NO: 49668 - DNA, 50 bp, homo sapien
ttctctacatctactttcagtgccargagataatagagcaacatctagaa

SEQ ID NO: 49669 - DNA, 50 bp, homo sapien
cacaagcctaacatgataaattgtayagaagtaaatacacacacacgtac

SEQ ID NO: 49670 - DNA, 50 bp, homo sapien
aacagaatctcaacatatggacatasaccctcttgagctggttagaaagg

SEQ ID NO: 49671 - DNA, 50 bp, homo sapien
gttttgaaggtaacattgtgacttayggaatatctaaacgcatgcaatta

SEQ ID NO: 49672 - DNA, 50 bp, homo sapien
tgtcactgattttcagtgaacgaaasattaacatatacataggctgcctc

SEQ ID NO: 49673 - DNA, 50 bp, homo sapien
gctaatagggagtcaagtcaggatamatttagttagaatgtagtgggata

SEQ ID NO: 49674 - DNA, 50 bp, homo sapien
ccagccaaaggtctctccctttttcrcaggccctagagacctgatctgag

SEQ ID NO: 49675 - DNA, 50 bp, homo sapien
ggctttggaaaataagggagtttacrgaataatccactcaggtataaacg

SEQ ID NO: 49676 - DNA, 50 bp, homo sapien
tttttttttttgccatagaatcagcyaatctgcaaaatgggaataataag

SEQ ID NO: 49677 - DNA, 50 bp, homo sapien
gggggagggatttttaagattgaaasagtggaaaaatcacaggacttggg

SEQ ID NO: 49678 - DNA, 50 bp, homo sapien
atgagtctctttattatgacattggrcagattgtatcacacacgcagaaa

SEQ ID NO: 49679 - DNA, 50 bp, homo sapien
aatacaataactttaaagtatccacyagatttagcaacaaagagatattt

SEQ ID NO: 49680 - DNA, 50 bp, homo sapien
gatagtccttcatttctttttcaatyaggaaagcaatttggccaggtgtg

SEQ ID NO: 49681 - DNA, 50 bp, homo sapien
tctagaagatgaaattacctccaaaygaaattaaatactgaaagcctaac

SEQ ID NO: 49682 - DNA, 50 bp, homo sapien
ttggtaagttgaaaagtttattctaygatatgttcagtttgtcactctcc

SEQ ID NO: 49683 - DNA, 50 bp, homo sapien
aggaagacacatctttctctggaccrcggatgtatatatgggatgcagag

SEQ ID NO: 49684 - DNA, 50 bp, homo sapien
accaaattcttagaagttttctctartaaaattgatttgggagttgattt

SEQ ID NO: 49685 - DNA, 50 bp, homo sapien
aagaaagctgatagaaataggaaaakgtcaggctccgaacggtggctttg

SEQ ID NO: 49686 - DNA, 50 bp, homo sapien
ccttaagaagcctgacaaacagaatyacagaagcaaacttttaccaagtg

SEQ ID NO: 49687 - DNA, 50 bp, homo sapien
ggtcctcaagacaactcatattcaayaatttgctacaaagacttgcagaa

SEQ ID NO: 49688 - DNA, 50 bp, homo sapien
gtagcagtatcttgcaaatcattaawcaaataaggtttaggagccatcat

SEQ ID NO: 49689 - DNA, 50 bp, homo sapien
gatgaccagtacacagcctttggacsatggtgctaacctctcctgaagtc

SEQ ID NO: 49690 - DNA, 50 bp, homo sapien
aaacagtgattgataaatatcttcaraatgtagcagtatctgtcaatcca

SEQ ID NO: 49691 - DNA, 50 bp, homo sapien
tcgtctttaaaactattcacagacascaattataacattgactccaaatg

SEQ ID NO: 49692 - DNA, 50 bp, homo sapien
ctgtgtttgacaatgtggaaggtaaygtctgcacggctttcttctgggtc

SEQ ID NO: 49693 - DNA, 50 bp, homo sapien
ttcaatgctggtaccatgataaaaaygtgcataggttcaagagtagttta

SEQ ID NO: 49694 - DNA, 50 bp, homo sapien
tttgtagatacggattgtaacaaaakatgaatatgaaacataagaaatag

SEQ ID NO: 49695 - DNA, 50 bp, homo sapien
ttaaactatctcactcaggtatggawgaaataaaatacccttggagcagg

SEQ ID NO: 49696 - DNA, 50 bp, homo sapien
tcccagccccttatcaggacttcaakaaagatccagtcctcagccaacct

SEQ ID NO: 49697 - DNA, 50 bp, homo sapien
atttaagggtgggcaacttcataacraacccgagccaggaccacttagct

SEQ ID NO: 49698 - DNA, 50 bp, homo sapien
tccagcagacacccataacatccaartatctagtgagttctcaatgaata

SEQ ID NO: 49699 - DNA, 50 bp, homo sapien
gatacttagcttctgtaattctttgyaaatactgctctaaccccttgatt

SEQ ID NO: 49700 - DNA, 50 bp, homo sapien
tatactcacacaattatgctaaaggratggattaacaggttagtagcacg

SEQ ID NO: 49701 - DNA, 50 bp, homo sapien
tttctcagtaactagcaacatgactraactataagattcgaacgctcaga

SEQ ID NO: 49702 - DNA, 50 bp, homo sapien
attatccaaactttaattacatacaygagtacatttagattactaaaaca

SEQ ID NO: 49703 - DNA, 50 bp, homo sapien
accactatacagggattcctctagaygcaaggccactgggaaggtaaatg

SEQ ID NO: 49704 - DNA, 50 bp, homo sapien
ctccccactcccataacctgttttayaaggatcaagcccccatttttttc

SEQ ID NO: 49705 - DNA, 50 bp, homo sapien
tttgttacatgcataagatgtctaaygatcaaggcagagtatttaggata

SEQ ID NO: 49706 - DNA, 50 bp, homo sapien
cttttaaatatctattatgcagtaayatctctaaactactcttgaaccta

SEQ ID NO: 49707 - DNA, 50 bp, homo sapien
tgaacattttccctctctgaacacaygaagattttcctggcataaacaat

SEQ ID NO: 49708 - DNA, 50 bp, homo sapien
agcatttttcactggtaaggtgatayagatctttcaggattggttttgat

SEQ ID NO: 49709 - DNA, 50 bp, homo sapien
agcctgttagatgactggttgtgaaragccaaacattgggtatcatgtca

SEQ ID NO: 49710 - DNA, 50 bp, homo sapien
ggctcttcacaaccagtcatctaacrggctgaattctttacttttcacgc

SEQ ID NO: 49711 - DNA, 50 bp, homo sapien
tatcccacttaattttcacattagcratttgggtattatctctgtttaac

SEQ ID NO: 49712 - DNA, 50 bp, homo sapien
tttgtgtttaccagcatataaacaasaagcatttaaagaaacatgggttt

SEQ ID NO: 49713 - DNA, 50 bp, homo sapien
gttttgaataacatactttgagatayggtgatgtacttgccttctctatc

SEQ ID NO: 49714 - DNA, 50 bp, homo sapien
gaaggtatttttgaatgtagagttakaattcattactgaaagtacacact

SEQ ID NO: 49715 - DNA, 50 bp, homo sapien
tcgatcttttcatactggttcaatgrcattaccttcatataagtgacagt

SEQ ID NO: 49716 - DNA, 50 bp, homo sapien
ggcaacacttgcgggaagatttgtaragatccacaggagtaatttatcca

SEQ ID NO: 49717 - DNA, 50 bp, homo sapien
agaaccttgtgaaaaaccacagttaygtaaaagatccaggagcgcagttc

SEQ ID NO: 49718 - DNA, 50 bp, homo sapien
tatgcaagagtctattaaaaggactmaccaaagagcaaaatcaccaaagc

SEQ ID NO: 49719 - DNA, 50 bp, homo sapien
gtgggtgaacgtcttttttattggartatgctacagtgtaaagataaagg

SEQ ID NO: 49720 - DNA, 50 bp, homo sapien
tgataaacagtctctattagaaaaamtaaataacatctccaaaggagagc

SEQ ID NO: 49721 - DNA, 50 bp, homo sapien
gagctattaccaggcagtcctgttayggagccaagagatataggaagtga

SEQ ID NO: 49722 - DNA, 50 bp, homo sapien
cttcaatgtaccagacaaagtgctakactctaaggatataaaaatgatta

SEQ ID NO: 49723 - DNA, 50 bp, homo sapien
cttgccagctgctgctgagtgactcsatttactgtttaaatgagctcact

SEQ ID NO: 49724 - DNA, 50 bp, homo sapien
ccctttaagtactaaaaactttatayagtaaatactaaaaactaatttag

SEQ ID NO: 49725 - DNA, 50 bp, homo sapien
ttagtaacaaatagagaaattataamggagattgctttttagaaatcacc

SEQ ID NO: 49726 - DNA, 50 bp, homo sapien
ttttggaccttctattaatgtcaaarctctcacaagtcactgtggtatga

SEQ ID NO: 49727 - DNA, 50 bp, homo sapien
agaactgaaatgtcctcaagaagacyggtctaacacgagctgacagcatg

SEQ ID NO: 49728 - DNA, 50 bp, homo sapien
gagtaattcctctatctgaagtgccrcagttcttggcagtaaaagactct

SEQ ID NO: 49729 - DNA, 50 bp, homo sapien
tacggaattctgattcagtggatccygagtactgccagtaatctattttc

SEQ ID NO: 49730 - DNA, 50 bp, homo sapien
aagaaaagacaattcttgcttgtaawctcaaaatacattcctgtacccac

SEQ ID NO: 49731 - DNA, 50 bp, homo sapien
aaatataaaccatctttggattatgraatgtggatatttgttttattctt

SEQ ID NO: 49732 - DNA, 50 bp, homo sapien
tgagatcataattaatgtacctcaaractactttgtatatgtggatattg

SEQ ID NO: 49733 - DNA, 50 bp, homo sapien
gccccactttaaaggtagtagaagasaataaaattagaactcagccagcc

SEQ ID NO: 49734 - DNA, 50 bp, homo sapien
tgagcctctttaaagtttaaaatacraattgtgcaaagatgaagctctga

SEQ ID NO: 49735 - DNA, 50 bp, homo sapien
atatttgatataattgcggacattcwatatgatattcacatggagttgtg

SEQ ID NO: 49736 - DNA, 50 bp, homo sapien
tgcttctcaaaagggatctaaggcaycttaaaataaaattcatgtatata

SEQ ID NO: 49737 - DNA, 50 bp, homo sapien
ctttctcctggaaatctcctcccagkatgtcttgagctaaaatattgcat

SEQ ID NO: 49738 - DNA, 50 bp, homo sapien
gtctcataaatatcacttctctttaycatctttgtaattgtacattcaac

SEQ ID NO: 49739 - DNA, 50 bp, homo sapien
gtaagtatactaactctaagttacargtagacatttacataaatatggtt

SEQ ID NO: 49740 - DNA, 50 bp, homo sapien
gtcaaacttccatgtgctctcatacyaccctgttttagtactgattctgt

SEQ ID NO: 49741 - DNA, 50 bp, homo sapien
taattagaggaaagagtacattgcgkagaaaaaaattaagcagcgtaaat

SEQ ID NO: 49742 - DNA, 50 bp, homo sapien
caggaggtggcaaatccagatgagaygttctttgatgggtttggggctgg

SEQ ID NO: 49743 - DNA, 50 bp, homo sapien
ttaagaaacctattaagattatgcawtacaaaataaagttcaaagaaaat

SEQ ID NO: 49744 - DNA, 50 bp, homo sapien
acctaacgtaaagagattagaatccraggaaattgtggtacagctgactt

SEQ ID NO: 49745 - DNA, 50 bp, homo sapien
taccctcaatttggagattacatcaygcaggctgggcacagtggttcatg

SEQ ID NO: 49746 - DNA, 50 bp, homo sapien
ggtgaaacatgaaatcgcaacagcaygaacagttaaaacctacagaggac

SEQ ID NO: 49747 - DNA, 50 bp, homo sapien
accaaaagcacatgttgttagaggcygatctacatgtatcactaggctgc

SEQ ID NO: 49748 - DNA, 50 bp, homo sapien
gagagagggatattttttaactgaasgtattaatccattattgaatgttg

SEQ ID NO: 49749 - DNA, 50 bp, homo sapien
aaccaagatctgctagccactgaaaygtaagaagtcatcagaagaggcac

SEQ ID NO: 49750 - DNA, 50 bp, homo sapien
caaggtatgccatggtcacgttgatmacatagaatttgtcaagatcaatg

SEQ ID NO: 49751 - DNA, 50 bp, homo sapien
tgcagaatgtaaaatccatcatgaamtctgtaatataaaataaccagaaa

SEQ ID NO: 49752 - DNA, 50 bp, homo sapien
gctaagttgtgaaaagtgctttaaaratgaatactgtatagaagtataaa

SEQ ID NO: 49753 - DNA, 50 bp, homo sapien
catcactgtgggagcttgtgataatsatgtaggaatctacggcactgacc

SEQ ID NO: 49754 - DNA, 50 bp, homo sapien
tgtaggaatctacggcactgacctgwaaaactgcacagcctttataaagg

SEQ ID NO: 49755 - DNA, 50 bp, homo sapien
ggggttcacaaacttactaagtctaygatcaagccactcagtgatgaaaa

SEQ ID NO: 49756 - DNA, 50 bp, homo sapien
gtgtatcactaaagttataaacacawtcttgagtaccagaattttaattt

SEQ ID NO: 49757 - DNA, 50 bp, homo sapien
cgttttcacacacatggagtgcagasagtcactgaggacccaaggagaac

SEQ ID NO: 49758 - DNA, 50 bp, homo sapien
aggacatactgtacatttataatcayctagaatagtgccaggcacatagg

SEQ ID NO: 49759 - DNA, 50 bp, homo sapien
ctccgtcacaaacccatctttatccrcgtctattttatctacaatcattc

SEQ ID NO: 49760 - DNA, 50 bp, homo sapien
aaaaataaagttcagccacatcttcrctagagaaaataaaaatgaaaaca

SEQ ID NO: 49761 - DNA, 50 bp, homo sapien
gtgaaaattgtatctgaaggataaaraagtgtgtctcacatatatttgaa

SEQ ID NO: 49762 - DNA, 50 bp, homo sapien
agaccatctatgaacgccaggttaakaatctatgttttctagggaaacag

SEQ ID NO: 49763 - DNA, 50 bp, homo sapien
aaaaccaaaacaccaatacactgagratgtcttttattatacacagaagt

SEQ ID NO: 49764 - DNA, 50 bp, homo sapien
tttttctggctagcatataaatctgraaggttaggttatggtgtgggtca

SEQ ID NO: 49765 - DNA, 50 bp, homo sapien
tttaagaacaccttttggaaactggwaagactgtcaacatcttcaaaata

SEQ ID NO: 49766 - DNA, 50 bp, homo sapien
tgtcaaaaaatatttggctaccatawgttactattctcattttggaaatt

SEQ ID NO: 49767 - DNA, 50 bp, homo sapien
gtgtgctgctaatggcatttagtgargaaggaccaataaagtgaatgcgg

SEQ ID NO: 49768 - DNA, 50 bp, homo sapien
ttcctggagaacataggaagcagacrattttgggttcattcattccaccg

SEQ ID NO: 49769 - DNA, 50 bp, homo sapien
gacagcagggaagagacctcaataaragagactttgaattttgaatggcc

SEQ ID NO: 49770 - DNA, 50 bp, homo sapien
tgatccttacacgaaagcaattcttyaaaaacaatgaccaaaattatgta

SEQ ID NO: 49771 - DNA, 50 bp, homo sapien
ttatcaggcaatgtgataaatagatraggattcgatagtgatttctaatc

SEQ ID NO: 49772 - DNA, 50 bp, homo sapien
aaagggcataattttcattctagaamggaaatgcacaatctcaagttgct

SEQ ID NO: 49773 - DNA, 50 bp, homo sapien
ttctttggaagagagggattatctasgtcagaaaaattaatttaatcctc

SEQ ID NO: 49774 - DNA, 50 bp, homo sapien
tctgcagagatgtaccatccttactragaagctctgaatctctcctatta

SEQ ID NO: 49775 - DNA, 50 bp, homo sapien
tcacaggaaaagtatagtcatctaasgaatcaagtgtcccaggaggaagc

SEQ ID NO: 49776 - DNA, 50 bp, homo sapien
aggctgcttccatagctagtctagcygaaccatttccgagctacaaggca

SEQ ID NO: 49777 - DNA, 50 bp, homo sapien
atttacttgaatctagagtttcttcrcctttgtttctttagaacttttac

SEQ ID NO: 49778 - DNA, 50 bp, homo sapien
actctttcagttaaacagtgtggtayggtttttctactatggccacccaa

SEQ ID NO: 49779 - DNA, 50 bp, homo sapien
agtgtgggacttgggaaggaaataayggattcactgctggggctggtttt

SEQ ID NO: 49780 - DNA, 50 bp, homo sapien
ccattaatgatgattgacatcaataraaacattagcttgcacctccagtt

SEQ ID NO: 49781 - DNA, 50 bp, homo sapien
aaacctcacagatcagataatcctarcactggaatttaagaataaattgg

SEQ ID NO: 49782 - DNA, 50 bp, homo sapien
aaataaaatttgaaatgagatcataygaatttaggtactagcttctccag

SEQ ID NO: 49783 - DNA, 50 bp, homo sapien
ggctgtatggtgagtttataggataygcattaggatgagttagaacttcc

SEQ ID NO: 49784 - DNA, 50 bp, homo sapien
aacagttcttccttataaggtttaaygcagattataaagcacttagtagt

SEQ ID NO: 49785 - DNA, 50 bp, homo sapien
gagaatagtcttagtcacagctctakcctcatgtctgaaacagtgtctgg

SEQ ID NO: 49786 - DNA, 50 bp, homo sapien
ttcataaaggaagtgtagacaataaycctgatcctcaaagcatgaatgac

SEQ ID NO: 49787 - DNA, 50 bp, homo sapien
agactccacctttctcttgttcttamaatcattcaacaactgtatcctta

SEQ ID NO: 49788 - DNA, 50 bp, homo sapien
agcttcctctttaataaaatgggatragtaatccttgcctcgccttcatt

SEQ ID NO: 49789 - DNA, 50 bp, homo sapien
tagttcagtaaacttgtaagcatgcrccaaaggagtatatactaaaccta

SEQ ID NO: 49790 - DNA, 50 bp, homo sapien
aaaattctaccttaaggagattcaayattaataccaatttccaaggagtt

SEQ ID NO: 49791 - DNA, 50 bp, homo sapien
agaaacgtgatctacaccagaatcaycatacattcctcatgaatcatcct

SEQ ID NO: 49792 - DNA, 50 bp, homo sapien
ttctgagcattgatgcacctctatcraacctgttcagcatttctaatttc

SEQ ID NO: 49793 - DNA, 50 bp, homo sapien
aagagcaaatgtttaatatactacargttttgctgtagcatctaccagaa

SEQ ID NO: 49794 - DNA, 50 bp, homo sapien
tgaaaatggtgaataatgagctggaraatgatactgtggagaaaacagaa

SEQ ID NO: 49795 - DNA, 50 bp, homo sapien
tccttctggtccctaacaggcagtcrctaaaaatgttttgagtaaatgag

SEQ ID NO: 49796 - DNA, 50 bp, homo sapien
acttctgcttataggtactcaaggaygaaaaagacctaagaaatggaata

SEQ ID NO: 49797 - DNA, 50 bp, homo sapien
atgcagccattgttagttcatgatayagttctcacctaaaaccttgtcat

SEQ ID NO: 49798 - DNA, 50 bp, homo sapien
ataaagatcatagagtgagttacaargaaagactagcaccagggactcag

SEQ ID NO: 49799 - DNA, 50 bp, homo sapien
atagttattcattcacgtcgttgcayatctcttagctgtatatctgtcac

SEQ ID NO: 49800 - DNA, 50 bp, homo sapien
atctagaatgtggtcttcttataaastgttaacagataaacccaatgcca

SEQ ID NO: 49801 - DNA, 50 bp, homo sapien
tgtggcatgaagtccagctgaaaaargattctgactaaatcattcaactt

SEQ ID NO: 49802 - DNA, 50 bp, homo sapien
ttggaaaattgtgttggatgattcayaaagtagctctgatgacaaagaca

SEQ ID NO: 49803 - DNA, 50 bp, homo sapien
ttgaaataagatttccactaaaggawcacacattgattcaaaaggtgtta

SEQ ID NO: 49804 - DNA, 50 bp, homo sapien
gaggaactgctgaatcagccaacaasgagctctatttctttttttttctt

SEQ ID NO: 49805 - DNA, 50 bp, homo sapien
tgcagacgcttaattgtctgagatascactgaaccctaaaacacaagtgc

SEQ ID NO: 49806 - DNA, 50 bp, homo sapien
gatgtatattggtttaatccagaaaratgggacaataggaagtgggggcc

SEQ ID NO: 49807 - DNA, 50 bp, homo sapien
aattcaatataaatgttaattattaygagtgttagatttgagcctagagt

SEQ ID NO: 49808 - DNA, 50 bp, homo sapien
aggactttcatacttattgtattcayggaaccaaaaactcaactttttca

SEQ ID NO: 49809 - DNA, 50 bp, homo sapien
ctctctgtcgcctactcaaaatcacrctgagaatcacttctttgatgtta

SEQ ID NO: 49810 - DNA, 50 bp, homo sapien
tttataggattaagtgtcaatgaagmacaaattgagaaatactggtttaa

SEQ ID NO: 49811 - DNA, 50 bp, homo sapien
tataaggtagcagatattgtaagatmaagatgagctgtgaatcagacaga

SEQ ID NO: 49812 - DNA, 50 bp, homo sapien
agggcttggtcgagggtttggtgccracacattcctgggagagtcacgtc

SEQ ID NO: 49813 - DNA, 50 bp, homo sapien
gatgcaaaatgtatgagtgaggaaaygggccacatggagttgttagttgt

SEQ ID NO: 49814 - DNA, 50 bp, homo sapien
ccagctgttttgcaaacacgtaatgmagatcactaacgtcccagcatggg

SEQ ID NO: 49815 - DNA, 50 bp, homo sapien
gcctttcttctactgcttgccatgargagattctgtgctttttgatatgg

SEQ ID NO: 49816 - DNA, 50 bp, homo sapien
cttatgctttgagaaacaatgatagraatctaaggtgtgatgagcttaag

SEQ ID NO: 49817 - DNA, 50 bp, homo sapien
tttctccaatttggagtgaagttaaygatatcttttaaagcttctctata

SEQ ID NO: 49818 - DNA, 50 bp, homo sapien
ggatttttctctaaacatgtattaartcaaactttctccaatttggagtg

SEQ ID NO: 49819 - DNA, 50 bp, homo sapien
tcagaaacacagaagattgtaaaacwgtccctataactgattgtgagagg

SEQ ID NO: 49820 - DNA, 50 bp, homo sapien
gttagtggtactatataacttcaaawttgttacagtacattgcaactgag

SEQ ID NO: 49821 - DNA, 50 bp, homo sapien
taagtatgagtgtggaaaataaagaygcagtatggttatgtttaaaaatt

SEQ ID NO: 49822 - DNA, 50 bp, homo sapien
tcaaatagatttgagtctgaattccrgctttgggaatgatgtggccaagt

SEQ ID NO: 49823 - DNA, 50 bp, homo sapien
aagtaaacgtaagtggctgttactaygctcaacaagtccaaattacagag

SEQ ID NO: 49824 - DNA, 50 bp, homo sapien
agacaaatttatgcaattctgagacrgcgttagctcatggtatctcctaa

SEQ ID NO: 49825 - DNA, 50 bp, homo sapien
tgttgagcatagtaacagccacttaygtttacttatactttacaaagcac

SEQ ID NO: 49826 - DNA, 50 bp, homo sapien
ctgaaagaattcactttgtttgaaasagagggtaggaaagttcaagtcca

SEQ ID NO: 49827 - DNA, 50 bp, homo sapien
aaattgtataagctgaaccagttcaratgtctatagtgttggatactgtt

SEQ ID NO: 49828 - DNA, 50 bp, homo sapien
ttttccagcctgatgcttgatgtcartccataactggggatgcccacatc

SEQ ID NO: 49829 - DNA, 50 bp, homo sapien
ggaccgtaaatgagtttcctctaaawcagcatagataaaacaggaaaaat

SEQ ID NO: 49830 - DNA, 50 bp, homo sapien
ccaacatttgcaccctataatctaaycgaccatactgagatctttgcagt

SEQ ID NO: 49831 - DNA, 50 bp, homo sapien
cactcaaccagtttctttgttaccayattgacagatagtcttggctcaca

SEQ ID NO: 49832 - DNA, 50 bp, homo sapien
tttacctaactttgggccaaggactmaggaagaaaagagcctctggaatg

SEQ ID NO: 49833 - DNA, 50 bp, homo sapien
ttatacaataatttagattctataamagtgccatgatattgtattgtata

SEQ ID NO: 49834 - DNA, 50 bp, homo sapien
gtgctgctggaggaaatattttttaygacacctcaatagagatggcattt

SEQ ID NO: 49835 - DNA, 50 bp, homo sapien
ttttatttactgctaaatatttcaargatatattcactttctacttgttt

SEQ ID NO: 49836 - DNA, 50 bp, homo sapien
gatcctccattctctttccttaatayagcctgttgtgacttcatagtact

SEQ ID NO: 49837 - DNA, 50 bp, homo sapien
ttttaaggaagtcttctgtgaaatayaggctacatgacatatgccaaatt

SEQ ID NO: 49838 - DNA, 50 bp, homo sapien
agattaggagactatttagcacaaartaaactgagttcatttttctataa

SEQ ID NO: 49839 - DNA, 50 bp, homo sapien
aggcgtgaaccattgattgtcttgawtacaaagctgtaaatatatgtgaa

SEQ ID NO: 49840 - DNA, 50 bp, homo sapien
atggctagaatttggtaatctccctkacatttatgtgcttatttctttac

SEQ ID NO: 49841 - DNA, 50 bp, homo sapien
ttaaactcaagtattgggagaatctsacttataggaagatattattttaa

SEQ ID NO: 49842 - DNA, 50 bp, homo sapien
gaaccgtttaaataatagatatatamatgttagacgttgtttttattaaa

SEQ ID NO: 49843 - DNA, 50 bp, homo sapien
acatattgcatggaacaagaaaaaasgtccatgtgagtatgagagagtat

SEQ ID NO: 49844 - DNA, 50 bp, homo sapien
tccatttttgcctctcattgtggtcyactacttatattttgctgctaccc

SEQ ID NO: 49845 - DNA, 50 bp, homo sapien
ggagggcaatttcagaggtttcctawgatagtgtttacttgagcccaaga

SEQ ID NO: 49846 - DNA, 50 bp, homo sapien
gataaacccgcatgccctaagtaaaygttgcagagtaattaagctgagag

SEQ ID NO: 49847 - DNA, 50 bp, homo sapien
accaccacgtccttcaggattacaayggtggcaatactctttatgattct

SEQ ID NO: 49848 - DNA, 50 bp, homo sapien
attgtgtagtgtggctgttctcttayatgcagtgagtattaatatattca

SEQ ID NO: 49849 - DNA, 50 bp, homo sapien
tatacaatgatggttattattgctcwaatctttgctgaaattttctttaa

SEQ ID NO: 49850 - DNA, 50 bp, homo sapien
ttggaatttttaatacaaattagagragaataagtatttaaaagtttgtt

SEQ ID NO: 49851 - DNA, 50 bp, homo sapien
cttgtattctgtacagtcctatttaraaatgcaccacataaaataagaat

SEQ ID NO: 49852 - DNA, 50 bp, homo sapien
cttcttgagttaaaggcctcggtaamattatttcaaatcaaatgagttgg

SEQ ID NO: 49853 - DNA, 50 bp, homo sapien
gttttaaacatgtaatctggtctctsaactcaagtagttattctagattt

SEQ ID NO: 49854 - DNA, 50 bp, homo sapien
gggcatgcgggtttatctttaagcaygtaacctgccctcccatgtttaca

SEQ ID NO: 49855 - DNA, 50 bp, homo sapien
taggttcacttaggctatacttctaygcagattttaaagacaactgtcta

SEQ ID NO: 49856 - DNA, 50 bp, homo sapien
tgagccccacactgggttcccgtccrcaagaaccatcttcactcaaggtg

SEQ ID NO: 49857 - DNA, 50 bp, homo sapien
ctttgtcatcacttgaaaatgctaartctccaaaatcacaaattaaatat

SEQ ID NO: 49858 - DNA, 50 bp, homo sapien
taatgatgtgtttgtatggtgttcayattaaagggaatgtagctgaaaga

SEQ ID NO: 49859 - DNA, 50 bp, homo sapien
actacagacccaatagaatgattaaraagaaggtagaacatgatggccaa

SEQ ID NO: 49860 - DNA, 50 bp, homo sapien
tgactactgtgttgttacataaaatwaggtggttgttatacttgattact

SEQ ID NO: 49861 - DNA, 50 bp, homo sapien
atttactttccctgtcatattgtgcragttactcaatagctcaattgagc

SEQ ID NO: 49862 - DNA, 50 bp, homo sapien
atttttaaatctgaattcaaagttcwctagcccttaggtaagtcctagct

SEQ ID NO: 49863 - DNA, 50 bp, homo sapien
gtatcaatggtctttgttttcatcaraatctggataagtattttaaaact

SEQ ID NO: 49864 - DNA, 50 bp, homo sapien
cattaaagtggtgaagttgaaatatyactaacatcacatttaaatagaat

SEQ ID NO: 49865 - DNA, 50 bp, homo sapien
gagtcacatctgcattgaataaacaygtacttttcaatctgaaaaacaga

SEQ ID NO: 49866 - DNA, 50 bp, homo sapien
gtcaaaaaagttgaatcagccaaaayatctttcataaacaaaagagcttt

SEQ ID NO: 49867 - DNA, 50 bp, homo sapien
tttgttacaaacagggtaataaaaarttcttaactataccatatactatt

SEQ ID NO: 49868 - DNA, 50 bp, homo sapien
taaataggcaccttatctttggcaascatatgttagccaagtgttttaac

SEQ ID NO: 49869 - DNA, 50 bp, homo sapien
atggatgctgttaatcctttaaagawctaagacaagtaggagaaaactaa

SEQ ID NO: 49870 - DNA, 50 bp, homo sapien
gtttctattgctcatcagtttccaasatatacttttgcatcttcatctta

SEQ ID NO: 49871 - DNA, 50 bp, homo sapien
caacaaacccaggaccttcgagggaracttattatcctcagggctcagag

SEQ ID NO: 49872 - DNA, 50 bp, homo sapien
cttgttagagatattaacatagttawaaaagagccaagtgctaatagcaa

SEQ ID NO: 49873 - DNA, 50 bp, homo sapien
ccaataacgttttatttacctgaacrcttctaataggacactgcctttgg

SEQ ID NO: 49874 - DNA, 50 bp, homo sapien
tttttctaagtcacttgcctattcayattttctatatctctactcattaa

SEQ ID NO: 49875 - DNA, 50 bp, homo sapien
gccacagcattcatttgattccatgyattacctccttgaataattataaa

SEQ ID NO: 49876 - DNA, 50 bp, homo sapien
gattctatccattgtcactataatargaaggaaactggagatgaatctgt

SEQ ID NO: 49877 - DNA, 50 bp, homo sapien
gaagctttctcatgaagattaggtaygagacaaggaagtcccctctcacc

SEQ ID NO: 49878 - DNA, 50 bp, homo sapien
aaaacctacacctacactagcccaartgagtttctgttgtttgtcttctg

SEQ ID NO: 49879 - DNA, 50 bp, homo sapien
aggagactgggtgcttgaataaaatraaatcataactatttcccaagttc

SEQ ID NO: 49880 - DNA, 50 bp, homo sapien
actaaaatatgctttttaatgaatcraaagcatcagagaagtactctttc

SEQ ID NO: 49881 - DNA, 50 bp, homo sapien
ctgaggaatagctccttagaatttcmataacacaatgatattctgaccag

SEQ ID NO: 49882 - DNA, 50 bp, homo sapien
tactttcaagttgtgaccacaattasaactactatttaggttcaatttca

SEQ ID NO: 49883 - DNA, 50 bp, homo sapien
gaaatatctgaagacgattttattcsctctgtaaatatgtaggtcagggt

SEQ ID NO: 49884 - DNA, 50 bp, homo sapien
ttagatcccagggcacttaccacagraaggatacagggatgaggccattt

SEQ ID NO: 49885 - DNA, 50 bp, homo sapien
tatgttttcccaggatatgagtcacyaagttatatttatattgcaatagc

SEQ ID NO: 49886 - DNA, 50 bp, homo sapien
agacacacactcacatgaagataagmaatagagaattaacctggtgaatg

SEQ ID NO: 49887 - DNA, 50 bp, homo sapien
ttaatcaaccatgtagaaacactacmaaatctcactgggtgcttgattgg

SEQ ID NO: 49888 - DNA, 50 bp, homo sapien
ggatgaaaggaaattttagggattaygagccaaccaggaatccttaatgt

SEQ ID NO: 49889 - DNA, 50 bp, homo sapien
ttaacctttgaaggattacagatgcmcattcttattttgataatgacaca

SEQ ID NO: 49890 - DNA, 50 bp, homo sapien
tatggtgagcccagcacgcttttgartagccaagatgatcctcttaaatg

SEQ ID NO: 49891 - DNA, 50 bp, homo sapien
aatattatgaacaagtctatgtccamaactttgataacctagatgaaatt

SEQ ID NO: 49892 - DNA, 50 bp, homo sapien
tcaattattattagggtgtctgacamagttggtaaatttttatattttat

SEQ ID NO: 49893 - DNA, 50 bp, homo sapien
ggtaaaaacctgaacatttggtgtcmgaaatgctgtgattagagggatcg

SEQ ID NO: 49894 - DNA, 50 bp, homo sapien
agctttatattcttgtgtcttaaackccatcaaaagattccattacatgt

SEQ ID NO: 49895 - DNA, 50 bp, homo sapien
tttttgccatcctaattggtatgaayagttttactagttgtacaagtcag

SEQ ID NO: 49896 - DNA, 50 bp, homo sapien
caggaacaggtaaaaggaggaaatgmataggaaaaggcatgatgggaggc

SEQ ID NO: 49897 - DNA, 50 bp, homo sapien
taaaatgattttgtgcaggaccttckaaatgtgaacaaaatgtctttctc

SEQ ID NO: 49898 - DNA, 50 bp, homo sapien
tcagaaaaaaacagaagctgttgaaycaaagaatcataagaataacttct

SEQ ID NO: 49899 - DNA, 50 bp, homo sapien
ttagcccttattattcatagcaacaygttttggaaggcgaagccatgggt

SEQ ID NO: 49900 - DNA, 50 bp, homo sapien
gtattccaaattatttgtttttaaaygtgcatatgatttggtaacaagca

SEQ ID NO: 49901 - DNA, 50 bp, homo sapien
caagacaagcacgtgccaactaagarcctactcagcactgcctcttcttt

SEQ ID NO: 49902 - DNA, 50 bp, homo sapien
agtgccacaactatttatagcgaacygattgacacactataagaactaag

SEQ ID NO: 49903 - DNA, 50 bp, homo sapien
attggattccacagtttccatcacaytgtaactagtactgtaaatgtttt

SEQ ID NO: 49904 - DNA, 50 bp, homo sapien
gccatcttattttatttttgagaaaytgtcatgttaaaatttataatttc

SEQ ID NO: 49905 - DNA, 50 bp, homo sapien
aatctagtggtgtctctggcacataktaggacactgatcggtgtttgaat

SEQ ID NO: 49906 - DNA, 50 bp, homo sapien
ttaaggagaaaggatatacgcacaaraagttagattagtaataaaaattg

SEQ ID NO: 49907 - DNA, 50 bp, homo sapien
aagcctaggttcttccacctctatamatctctagaaacttccccatgtat

SEQ ID NO: 49908 - DNA, 50 bp, homo sapien
tatgaggctgcactggagatcctgayagccgatatggagggcaccagcca

SEQ ID NO: 49909 - DNA, 50 bp, homo sapien
atgaatcacagtagatatgaaataartgcttgtttagtttattttattgt

SEQ ID NO: 49910 - DNA, 50 bp, homo sapien
aaaatgttaaggccttttcttgccaygtttataaattttctcatctatct

SEQ ID NO: 49911 - DNA, 50 bp, homo sapien
ctttttaccacattaggaaataaccracaacttagaaggcagagtagaat

SEQ ID NO: 49912 - DNA, 50 bp, homo sapien
catggaagctacctgcaaaggataaytgctcaagagactcatttctctca

SEQ ID NO: 49913 - DNA, 50 bp, homo sapien
ttgtaaacctaggcttcttgttttayactgttccctatccaaatcttgag

SEQ ID NO: 49914 - DNA, 50 bp, homo sapien
tgtaaaacaagaagcctaggtttacratgagcaaggaatagttcttgtcc

SEQ ID NO: 49915 - DNA, 50 bp, homo sapien
taagcatttttattttttgcaatcaygttattaaagaactctaagttgca

SEQ ID NO: 49916 - DNA, 50 bp, homo sapien
tatagagtatgtttcttgataacacsggtctataatcaatttatgaaatt

SEQ ID NO: 49917 - DNA, 50 bp, homo sapien
aaaccactgtgttccttgataaaaaygtaacttgctacaaaacaacaaaa

SEQ ID NO: 49918 - DNA, 50 bp, homo sapien
caaaattaaaattttgattaactcayctggtgaatgaaagagtaagttat

SEQ ID NO: 49919 - DNA, 50 bp, homo sapien
ggattttactatgacttatgtcctcragtttattcacagctatcatatat

SEQ ID NO: 49920 - DNA, 50 bp, homo sapien
atattatatgaggctgacatatacawatcaaatccattgtcaaaacaatg

SEQ ID NO: 49921 - DNA, 50 bp, homo sapien
ttaaaggaatgtgtatgtttgtaaaygtaggcaaatctctgtagaaggaa

SEQ ID NO: 49922 - DNA, 50 bp, homo sapien
ctttctcattaattctaaattgccartaatcatagtttagaatgatcttg

SEQ ID NO: 49923 - DNA, 50 bp, homo sapien
agacacacagtcttcgggctgagccraggtggatgttttgagcacagttg

SEQ ID NO: 49924 - DNA, 50 bp, homo sapien
aaacatttccaattaaattcttgtckagtctctgcttgggaatatggatc

SEQ ID NO: 49925 - DNA, 50 bp, homo sapien
tttctttctttttccatcatccaaartctttaataagaggataggatcta

SEQ ID NO: 49926 - DNA, 50 bp, homo sapien
cttgtcgagtctctgcttgggaatawggatcacatagctttcccttttga

SEQ ID NO: 49927 - DNA, 50 bp, homo sapien
actctttgtcatggaggcaaactacrgtagctgattaccattttttaatg

SEQ ID NO: 49928 - DNA, 50 bp, homo sapien
taaagaaagaatacatactacaagtraatatgctgaattcaaaagggaaa

SEQ ID NO: 49929 - DNA, 50 bp, homo sapien
aaagacacataaagttcatgtgttaraagaagcaatattgttaaaatgtc

SEQ ID NO: 49930 - DNA, 50 bp, homo sapien
gcctcttaatttcctattctacacaytataccttcatgatcttatttctt

SEQ ID NO: 49931 - DNA, 50 bp, homo sapien
tattacacagctcctatcaaagtcamtagaatatgaaattatgtttttaa

SEQ ID NO: 49932 - DNA, 50 bp, homo sapien
aaaaaaaaaactatcagtgcaaggaygagtgaaagagctgaattggcagt

SEQ ID NO: 49933 - DNA, 50 bp, homo sapien
catttttaagtgttctaaactctgaygactaatatttctggagatctcaa

SEQ ID NO: 49934 - DNA, 50 bp, homo sapien
aatcaacattctaattctgtaaccascacaattaattttatgtttgataa

SEQ ID NO: 49935 - DNA, 50 bp, homo sapien
gcttctattatcttctaactgataasgtgcatacattgttagtatttttc

SEQ ID NO: 49936 - DNA, 50 bp, homo sapien
gggcctgatttgaatccaatccaagwcgttaccattgaaaagccatgttt

SEQ ID NO: 49937 - DNA, 50 bp, homo sapien
agtcactgaatttgcccattttatayatctctgaacactgttgaatttac

SEQ ID NO: 49938 - DNA, 50 bp, homo sapien
atggaaagtgtctcaatatccagaaygtgtaagaataccaggttttgggg

SEQ ID NO: 49939 - DNA, 50 bp, homo sapien
tattatgacactaatggatattctcmaggtgtttttcactatcaagaaaa

SEQ ID NO: 49940 - DNA, 50 bp, homo sapien
ggagttacattttgttgaatttagaragcaatttatgtggatgttaccat

SEQ ID NO: 49941 - DNA, 50 bp, homo sapien
tgattagtaattgacatatcaattayacatgagtgcttttaaattgttcc

SEQ ID NO: 49942 - DNA, 50 bp, homo sapien
gaaacttacttctaatcacaccctaycatgctatagtctactttttgtcc

SEQ ID NO: 49943 - DNA, 50 bp, homo sapien
caactcggcctctgtaaaacttggayactctcacatatccatggctatca

SEQ ID NO: 49944 - DNA, 50 bp, homo sapien
aaataggaatacagagttattgaaaygattaaattaaatgatgcctataa

SEQ ID NO: 49945 - DNA, 50 bp, homo sapien
gtggggaagatattatacccacgtckattgctaagaaaaataagtttcag

SEQ ID NO: 49946 - DNA, 50 bp, homo sapien
caccttaaattttttaagctacttaygtaattcaaaatttcttgctcttc

SEQ ID NO: 49947 - DNA, 50 bp, homo sapien
ttcttgctcttcttttaaaagtcagyaggatgttcaacatttttctttac

SEQ ID NO: 49948 - DNA, 50 bp, homo sapien
tctcactcttattggctcactagcargcaatctgatcaaacctgaaatcg

SEQ ID NO: 49949 - DNA, 50 bp, homo sapien
tctatcttacttacaatagcaaattmaatttcagttgactcaaaatgcac

SEQ ID NO: 49950 - DNA, 50 bp, homo sapien
acagtgaattataattggctatttayctgtcactgatgctttatcggagt

SEQ ID NO: 49951 - DNA, 50 bp, homo sapien
ttgcaatacaagcagtagaatgagayggagaacgtatggcaattgaacag

SEQ ID NO: 49952 - DNA, 50 bp, homo sapien
atgttcaagtatttttttctaccaawtagattataagctccttgtgggca

SEQ ID NO: 49953 - DNA, 50 bp, homo sapien
ttctttagtctgtttttagctgtcastactttgtgtagaaaaatttcctc

SEQ ID NO: 49954 - DNA, 50 bp, homo sapien
ttgtctcaaagagctgttcacaaaayattggacaccctctccccagatat

SEQ ID NO: 49955 - DNA, 50 bp, homo sapien
atatggaaagaggagcataggaaagsctaactaggacaaattataagcta

SEQ ID NO: 49956 - DNA, 50 bp, homo sapien
cctaattgtttttcgatcaacaggcygagtcataacacagaaaatgtgga

SEQ ID NO: 49957 - DNA, 50 bp, homo sapien
attactgtaagtaccaaaccaagcamtgaacaatttaatgatgccattag

SEQ ID NO: 49958 - DNA, 50 bp, homo sapien
tggaaactaggttgacagttgtttaratctatttctaggctctctattct

SEQ ID NO: 49959 - DNA, 50 bp, homo sapien
gggctccacagtttatggtctgcaaytcgtaaagtctccaggaggcagta

SEQ ID NO: 49960 - DNA, 50 bp, homo sapien
tagtgcttgtgaaaatggtaagagcragacttattgttatgcatgtctct

SEQ ID NO: 49961 - DNA, 50 bp, homo sapien
tgtgcaatatatcaaaagtggagagragaaattaatgtgaacctggggga

SEQ ID NO: 49962 - DNA, 50 bp, homo sapien
ccatgcactattttatagaaattcaraaggctatttcccaggtagcaaat

SEQ ID NO: 49963 - DNA, 50 bp, homo sapien
aaaataaaaactgttgaacatccacrcttataggtaaaaggaggggaaaa

SEQ ID NO: 49964 - DNA, 50 bp, homo sapien
tctgaccttgaagtcacattgagtcyaattcaatcagaaaagtgcaagtg

SEQ ID NO: 49965 - DNA, 50 bp, homo sapien
tgtgttattaagttattgtgcatcawgttttttcttacctctaaaataga

SEQ ID NO: 49966 - DNA, 50 bp, homo sapien
aggatgaactgagtaaatacacgtgraattattgagcatagaataacact

SEQ ID NO: 49967 - DNA, 50 bp, homo sapien
ttctaaatatgtctgtacctgataamagagtgttcaaatagataacattt

SEQ ID NO: 49968 - DNA, 50 bp, homo sapien
ctactggttccaccaaactgaacaaygaagaatccctattttggctaata

SEQ ID NO: 49969 - DNA, 50 bp, homo sapien
ttcagagagtttatggcagatagtcraaggagagaaatgaggaacaagga

SEQ ID NO: 49970 - DNA, 50 bp, homo sapien
tgggcactgctttgtctcctcggaayaggtgagtcctgggcacaggacag

SEQ ID NO: 49971 - DNA, 50 bp, homo sapien
agctggggctgttgtaggtctcttcraatttgtttccaacctgtcaaaga

SEQ ID NO: 49972 - DNA, 50 bp, homo sapien
aaacagaaaggtaggattataaccamaaagggcctttcttcgcttcagca

SEQ ID NO: 49973 - DNA, 50 bp, homo sapien
ttctcagtagctcaaacagtagtccygaaattgaaacttgttagccttga

SEQ ID NO: 49974 - DNA, 50 bp, homo sapien
tgaacattcttcctatttcatttccyactttgaaatctttttttctcctc

SEQ ID NO: 49975 - DNA, 50 bp, homo sapien
actactggatagcctgtgtgattcakccaagttatgttagaacagcctaa

SEQ ID NO: 49976 - DNA, 50 bp, homo sapien
caaagctttgttaaccaaatttcatratatatgccagtattcaaagcaca

SEQ ID NO: 49977 - DNA, 50 bp, homo sapien
agccctttctcgtatgctattacacrgcagaataaagcatttagcacata

SEQ ID NO: 49978 - DNA, 50 bp, homo sapien
gaaaagtcatagaggtagaatccacygactctaactttataacaataaac

SEQ ID NO: 49979 - DNA, 50 bp, homo sapien
cccatactctacatagaaatggtaamgtttccaagggatgaaaaataggc

SEQ ID NO: 49980 - DNA, 50 bp, homo sapien
tggaatagagcttattaatagttaaktatgagaacttgttttctgcaaag

SEQ ID NO: 49981 - DNA, 50 bp, homo sapien
tagactccccttctctttatctccartctctattcagttactaaatccta

SEQ ID NO: 49982 - DNA, 50 bp, homo sapien
cttgcaaaatcactatttcatattcycttttctctaagttgatgttttct

SEQ ID NO: 49983 - DNA, 50 bp, homo sapien
catatcaaaatgatctgaaagtcatragacctgattctcaccattaatta

SEQ ID NO: 49984 - DNA, 50 bp, homo sapien
ttcaaagccctttgcaagtcaacaarcctaagattcattataggaaaaga

SEQ ID NO: 49985 - DNA, 50 bp, homo sapien
cacaactaggtcatgaaaaagactaygtaaaaaatatatgaaagtgtcaa

SEQ ID NO: 49986 - DNA, 50 bp, homo sapien
gttataagcatgcctttgaaagtgcwatacaattttttttaaaataagcc

SEQ ID NO: 49987 - DNA, 50 bp, homo sapien
aggcaaagtttgattactcaataaayataccgaaaccactaaaagtgcta

SEQ ID NO: 49988 - DNA, 50 bp, homo sapien
cactgcctctctcagttttcactacyaacaacatcctaggttggccttct

SEQ ID NO: 49989 - DNA, 50 bp, homo sapien
tgagattttgttttcctattacacaraagaatcgaaaatgaaagatttta

SEQ ID NO: 49990 - DNA, 50 bp, homo sapien
gctcataatatcttattctttcttaygtagttgatagtttggctgggtct

SEQ ID NO: 49991 - DNA, 50 bp, homo sapien
actacattttggcaactattgaaacrctattaagcatctctgggtctctt

SEQ ID NO: 49992 - DNA, 50 bp, homo sapien
aaaaaaaaacaccttaggtacatgamattctcctaaggataaccagtata

SEQ ID NO: 49993 - DNA, 50 bp, homo sapien
gctccacacaagggaggtcctcaaamgattagagatgtgtccatgggaag

SEQ ID NO: 49994 - DNA, 50 bp, homo sapien
ttcaggaaacaaatatatattttcaygttaaaaagggcttaaatgaaacc

SEQ ID NO: 49995 - DNA, 50 bp, homo sapien
ttttatttccctgtgtcaacacataktatgtaaagtctttacaaaatgta

SEQ ID NO: 49996 - DNA, 50 bp, homo sapien
tatttgtggaaaaagaagtggaacaytctcctagcaagatgagagctgga

SEQ ID NO: 49997 - DNA, 50 bp, homo sapien
atccccatttaacattcggaatcaaygtgagtttcttaaaaggtgtatat

SEQ ID NO: 49998 - DNA, 50 bp, homo sapien
atgtcactttttagtttagagcagartatgcatgcacagggattatttgt

SEQ ID NO: 49999 - DNA, 50 bp, homo sapien
ggggctagtccttctctgtgccttgractaaatccataacaagtagcatg

SEQ ID NO: 50000 - DNA, 50 bp, homo sapien
tcccctctgccaaggacattccaaasttaatctgaaaaattagttcaggc

SEQ ID NO: 50001 - DNA, 50 bp, homo sapien
ctgataaaaagtgggtttctttcacyaatagccatatctcacccagaagg

SEQ ID NO: 50002 - DNA, 50 bp, homo sapien
aaaaaaattacagtggacataaaaargattctaccctgccacagtaagaa

SEQ ID NO: 50003 - DNA, 50 bp, homo sapien
cgtggtatattcagtttaacacagarcacatatcagaaaacttcattcta

SEQ ID NO: 50004 - DNA, 50 bp, homo sapien
aactacataaacttattcaacatggraaattgtattgtttgtattggtct

SEQ ID NO: 50005 - DNA, 50 bp, homo sapien
acatttacatgataaattgctgtgasaaacatgatttcttatttgatatg

SEQ ID NO: 50006 - DNA, 50 bp, homo sapien
acctttttctaagcctctcttcacaygttctggcttattctagtttgagt

SEQ ID NO: 50007 - DNA, 50 bp, homo sapien
gcatttactcactgtcgcgtatgacyaggtattccatattcattaatgag

SEQ ID NO: 50008 - DNA, 50 bp, homo sapien
atcaataaagccaaaactttaagatsatctcgtatataaacgcaatttta

SEQ ID NO: 50009 - DNA, 50 bp, homo sapien
gcaagtttatttcaatttatatgaasaggactacttcagtgacagtataa

SEQ ID NO: 50010 - DNA, 50 bp, homo sapien
tgaagcccaggtaagtgcatatctcrctgtatataataataagcatagat

SEQ ID NO: 50011 - DNA, 50 bp, homo sapien
gaatttaaatttagagacaaagaacrctctttccaggaagaactactcct

SEQ ID NO: 50012 - DNA, 50 bp, homo sapien
taatacaaatattctatataatctascattctacctaaatatttgatcat

SEQ ID NO: 50013 - DNA, 50 bp, homo sapien
gattgctgagtggacaaggtatttcyatgtgccgaatttacacagtgcac

SEQ ID NO: 50014 - DNA, 50 bp, homo sapien
ggcaacaccactgaccctgggccgarcatttctgtatctactggatgcta

SEQ ID NO: 50015 - DNA, 50 bp, homo sapien
atggtttctcaatatttattaaacasaaaacattggaatgaactttcaaa

SEQ ID NO: 50016 - DNA, 50 bp, homo sapien
ctttatttgcaagctgggaataatcrgaggaagttaactgagaagctatt

SEQ ID NO: 50017 - DNA, 50 bp, homo sapien
gccttcatagatgtgaagagttacarccttgctcaggctgtggctttagg

SEQ ID NO: 50018 - DNA, 50 bp, homo sapien
cagacctgaaccattactcttaaacrctggcccctgttttattggtggac

SEQ ID NO: 50019 - DNA, 50 bp, homo sapien
acttatcattcactttgttaaaatawatattacgcactttaaattttgaa

SEQ ID NO: 50020 - DNA, 50 bp, homo sapien
gcagtcttgggaggacatctgactcrgagaagaaggacttcctggaggag

SEQ ID NO: 50021 - DNA, 50 bp, homo sapien
gctggataactcctgtcatcttgtayaacacaccgccagtagtttcatta

SEQ ID NO: 50022 - DNA, 50 bp, homo sapien
gaggacctgagattcagtgtagaagycctcgattttaaaagtctgggtgt

SEQ ID NO: 50023 - DNA, 50 bp, homo sapien
acacttctatgaccctctgggtccargtcgtgtggtaatttttctacgtg

SEQ ID NO: 50024 - DNA, 50 bp, homo sapien
aaatggccttgctgatagtgactcargtaactggaacaagaaaaataaat

SEQ ID NO: 50025 - DNA, 50 bp, homo sapien
cagaataaccctacagaatccgtcawtatcctgtcttcactgtgaacaga

SEQ ID NO: 50026 - DNA, 50 bp, homo sapien
acttctgagacactgcagaaatacartggttatcaagaatgtttaacctt

SEQ ID NO: 50027 - DNA, 50 bp, homo sapien
tcccaggtctccatgaggatcaatcrctcaatagcttggatagtctgcgt

SEQ ID NO: 50028 - DNA, 50 bp, homo sapien
actggtactatctgagggtttacgaygcctgtgactctcttaacttctaa

SEQ ID NO: 50029 - DNA, 50 bp, homo sapien
tatattttttatggaactcgtcagcyatacccatcttcaatcttataagc

SEQ ID NO: 50030 - DNA, 50 bp, homo sapien
gcttgtagttcttttacttgataagyccttcaaaaagtttctgaaagcca

SEQ ID NO: 50031 - DNA, 50 bp, homo sapien
tgcagatgactgatcaattccaggawgttagagagcctgacacccactgg

SEQ ID NO: 50032 - DNA, 50 bp, homo sapien
aaagctccaagctccaagtaagcaamgccctgaaagcatggggtacattg

SEQ ID NO: 50033 - DNA, 50 bp, homo sapien; identical to SEQ ID NO: 86

SEQ ID NO: 50034 - DNA, 50 bp, homo sapien
acagcaaccaattgactggatgtgayggtttctataatttttcatctagt

SEQ ID NO: 50035 - DNA, 50 bp, homo sapien
cattcagttccaagttaaatgctacrattcacaatctcattctaaggtaa

SEQ ID NO: 50036 - DNA, 50 bp, homo sapien
tgtgctgtctgaaagaatccttcaaygcgtacttcaacacaaaccaagtc

SEQ ID NO: 50037 - DNA, 50 bp, homo sapien
catctgcagtgcactaaaatcactckcaaagattgtaactcttggagcaa

SEQ ID NO: 50038 - DNA, 50 bp, homo sapien
tgttcttaagataaacaattatgatkacgatttggtgtcagatgaaagta

SEQ ID NO: 50039 - DNA, 50 bp, homo sapien
ccaagtgcattaaatacataaatcayctctcaagaaagaacataaggttc

SEQ ID NO: 50040 - DNA, 50 bp, homo sapien
gcctaaagaagttggataccactgcratttgctctgaagttatacatgtt

SEQ ID NO: 50041 - DNA, 50 bp, homo sapien
tagaaaaatgattaaacatctaatakaaatctaacacattaaaatagttt

SEQ ID NO: 50042 - DNA, 50 bp, homo sapien
agacatatcactacctttgaggtatsaagacacgcgccctgaaaaaactt

SEQ ID NO: 50043 - DNA, 50 bp, homo sapien
tgtgaaaaaaacttgataacttgacycaatcttcctttcaggctgatttt

SEQ ID NO: 50044 - DNA, 50 bp, homo sapien
ggttggcaatcatggaaccagatgasagtgacaagtagggtctgtggagg

SEQ ID NO: 50045 - DNA, 50 bp, homo sapien
cctgttaatataatcctaacatgcgrccatttgactatgttacaaccaag

SEQ ID NO: 50046 - DNA, 50 bp, homo sapien
gttccctgactgcagcaagttactayggaacaagttactaggtagcaaac

SEQ ID NO: 50047 - DNA, 50 bp, homo sapien
tgtttctccttccactgaaggacaastgtacagtctacaatacttgttga

SEQ ID NO: 50048 - DNA, 50 bp, homo sapien
tgaaggtgaccagggctctttcacaratttttacctgtattgttatgcta

SEQ ID NO: 50049 - DNA, 50 bp, homo sapien
agcaaagacatgatggtgccacggcraggacattgacgcctcccggggtc

SEQ ID NO: 50050 - DNA, 50 bp, homo sapien
gcaaggggatgctacctgttgcagaragtgacagaatgaaatcataaatg

SEQ ID NO: 50051 - DNA, 50 bp, homo sapien
gagattgagccaggagcaggcttagyacaggaaatgcaactcctctccca

SEQ ID NO: 50052 - DNA, 50 bp, homo sapien
atttaatgaaaataattaactttaaygtcaccaattgtggtactcaagat

SEQ ID NO: 50053 - DNA, 50 bp, homo sapien
gaaaattattttttaatttgaaagayataaagaagtataggtagcatttg

SEQ ID NO: 50054 - DNA, 50 bp, homo sapien
aattccggaaactgagttttaggctsaagatctctaactggtagtaggga

SEQ ID NO: 50055 - DNA, 50 bp, homo sapien
gcatccaagttggaaaagaagaaatraaattatctctgcttaaagatggt

SEQ ID NO: 50056 - DNA, 50 bp, homo sapien
taacatgttgtagtaattatcatcaycttttggtttatgctattggaaca

SEQ ID NO: 50057 - DNA, 50 bp, homo sapien
ttgccaatttttaaatgcttttaacmatctctacaggtccaaacttaagt

SEQ ID NO: 50058 - DNA, 50 bp, homo sapien
tagcctggatgttttcaatctcagaygctagtcgtgttttttctctaaaa

SEQ ID NO: 50059 - DNA, 50 bp, homo sapien
tgactggtttgtaaaactgttaaccygatgttgggcaaaacaaaaattaa

SEQ ID NO: 50060 - DNA, 50 bp, homo sapien
taaacatcagttaagattttaagtaraacgtctatatcacaattttcaca

SEQ ID NO: 50061 - DNA, 50 bp, homo sapien
gggccaggtgggaatttctgcatctsacgtcccttgtcctggaaaggtcc

SEQ ID NO: 50062 - DNA, 50 bp, homo sapien
ccagaaagaaatagaatatattaacrgcctttaacaaataagattgaatt

SEQ ID NO: 50063 - DNA, 50 bp, homo sapien
accctggagaagggggcctactgtawgagctttgcggcataatagaaggg

SEQ ID NO: 50064 - DNA, 50 bp, homo sapien
ccccaactcctacctttctcgaaacyaggctatttctctccaaatctcct

SEQ ID NO: 50065 - DNA, 50 bp, homo sapien
ttttttctcccacttggtgaacccartgacactcgcccagtggactcacg

SEQ ID NO: 50066 - DNA, 50 bp, homo sapien
atgctgtgaactgtacaggaggtagyatttgttacacatcttcacagtca

SEQ ID NO: 50067 - DNA, 50 bp, homo sapien
ttgatatataaagtgggaaggctaayaaaatgttgatagaagtccttggt

SEQ ID NO: 50068 - DNA, 50 bp, homo sapien
tggagggattaggtagggagaaaatyaaatgctttatttctgtttacaaa

SEQ ID NO: 50069 - DNA, 50 bp, homo sapien
aatatttgcaaaattatattttataygagccagtaataaatgaccatatt

SEQ ID NO: 50070 - DNA, 50 bp, homo sapien
ctgtaaaccgagaacgtgcagagaargaactgagagccagtctagagagg

SEQ ID NO: 50071 - DNA, 50 bp, homo sapien
gagtgagtattcttacattcatgacmatagttgtttgtataggtccaata

SEQ ID NO: 50072 - DNA, 50 bp, homo sapien
atattgatatccacctgttaaaggaraggaacttgatatctttctcaccg

SEQ ID NO: 50073 - DNA, 50 bp, homo sapien
tgcttaactattctattctgtcttamcttttgtttgattggctattcttc

SEQ ID NO: 50074 - DNA, 50 bp, homo sapien
ttgttattttctcttttttgaaataygcttcttagaaattgctatttcac

SEQ ID NO: 50075 - DNA, 50 bp, homo sapien
ggtgtcccgccccttgggacagtgcrataccagattcctcactacttcta

SEQ ID NO: 50076 - DNA, 50 bp, homo sapien
gcatatgtaacagctgaactaacgayaatcataaaggagtccagaacaag

SEQ ID NO: 50077 - DNA, 50 bp, homo sapien
ggccctggtataggactcaagtaccraattgatctgatgtctgaaatttc

SEQ ID NO: 50078 - DNA, 50 bp, homo sapien
cattggctggaattggatcctttgcygaatgctgcatactttaggaatgg

SEQ ID NO: 50079 - DNA, 50 bp, homo sapien
taacacctagaagaaatgatctaaarcctctacaatcagaattaatgtct

SEQ ID NO: 50080 - DNA, 50 bp, homo sapien
ccattatcttatacacatcaggtacyaaatacatatttgtgagtttgttc

SEQ ID NO: 50081 - DNA, 50 bp, homo sapien
ctgctgtaaaccaataaatggatacmagaaatactcgtttttattacaga

SEQ ID NO: 50082 - DNA, 50 bp, homo sapien
gattactctgaattaatctttgaacsctttttcaaacaccaaaaatgcag

SEQ ID NO: 50083 - DNA, 50 bp, homo sapien
ttcagtatcttagctctgcacttcaygtctatttttcattaatactttcc

SEQ ID NO: 50084 - DNA, 50 bp, homo sapien
gaggaatatcagtaaacccttgtaaytgtgcgatcaacttctttgtaaga

SEQ ID NO: 50085 - DNA, 50 bp, homo sapien
tttgtaaagatttgtcagaatctcargctagcagctgactatacacagct

SEQ ID NO: 50086 - DNA, 50 bp, homo sapien
atgaacaatattctgaatcatttcartagatgttgactgcatgactgtgc

SEQ ID NO: 50087 - DNA, 50 bp, homo sapien
gttaatgaagccatccacttgtctgyagtaataaaagactataacatttc

SEQ ID NO: 50088 - DNA, 50 bp, homo sapien
aagtgctgataacctagacaatggcraaaagacctctaaggcacttcaga

SEQ ID NO: 50089 - DNA, 50 bp, homo sapien
gttcatgtcatttcttgattgtgacygacattagaaccacctagaaagtt

SEQ ID NO: 50090 - DNA, 50 bp, homo sapien
gggctcatacactggacccaactgargactagctaaaagggatagggcag

SEQ ID NO: 50091 - DNA, 50 bp, homo sapien
aaatgtgggggtttgggtttgttcartatcttatcctttgaatttatgaa

SEQ ID NO: 50092 - DNA, 50 bp, homo sapien
aacctcccctttctcccagcctacaygagaatctggacaccaccggcccg

SEQ ID NO: 50093 - DNA, 50 bp, homo sapien
tattttattatgctcatgaactcaaygggacaaggattccgacaggacac

SEQ ID NO: 50094 - DNA, 50 bp, homo sapien
gattacacctaagtaccatggctcamattaaaccatcttagagaatattg

SEQ ID NO: 50095 - DNA, 50 bp, homo sapien
gggcacttgaatgctgagtggcaccragaggaatgtgcagatgtcataaa

SEQ ID NO: 50096 - DNA, 50 bp, homo sapien
tgtgttcacaagggttacatagtaastgaacaactggtgtgtaactattt

SEQ ID NO: 50097 - DNA, 50 bp, homo sapien
ggataacatggctctacactgcgtcraacagatttggtggcagtgactca

SEQ ID NO: 50098 - DNA, 50 bp, homo sapien
ttcctcacctttgacctctatatagwcattcattaacaagagtcaagata

SEQ ID NO: 50099 - DNA, 50 bp, homo sapien
agaccctcaaacctcagctgacccasaaactcatgagcaaaaaaaaacta

SEQ ID NO: 50100 - DNA, 50 bp, homo sapien
ccctgtgatcctgcttgaccagaagwagaaattgactcaactggtctgtg

SEQ ID NO: 50101 - DNA, 50 bp, homo sapien
gaaaaattctgatcatcttaacctcrgaataaggtacacttgtttacata

SEQ ID NO: 50102 - DNA, 50 bp, homo sapien
tatgatataaagaaaatatctgtgamtaattctacataccgtgagttcca

SEQ ID NO: 50103 - DNA, 50 bp, homo sapien
tgggcatatgcctagcctttagcacrgtatgcttacactaaatttcaagt

SEQ ID NO: 50104 - DNA, 50 bp, homo sapien
gataagttatacggccttggttaagwcacgaaactttctactactctgta

SEQ ID NO: 50105 - DNA, 50 bp, homo sapien
ccttttcttcttaacttgggactagrcatctattccaaagagcttgttat

SEQ ID NO: 50106 - DNA, 50 bp, homo sapien
gacttttgaattaggatttattttayaggtagtaatagaggctgggcatg

SEQ ID NO: 50107 - DNA, 50 bp, homo sapien
cacagcttagcaccctaacaatggayatgaagtactgactaattgtaatt

SEQ ID NO: 50108 - DNA, 50 bp, homo sapien
cttgctccctgcctcgtgtagcttayggcctatggttcgttttattttaa

SEQ ID NO: 50109 - DNA, 50 bp, homo sapien
aattaaatcagaaaattaaaactgasgcgagacattaaacataaaattgt

SEQ ID NO: 50110 - DNA, 50 bp, homo sapien
gaaagacatcctagaaaagggcgcawcatgtacaaacagaggaatgtgtg

SEQ ID NO: 50111 - DNA, 50 bp, homo sapien
ctaggaaggagttttatggtttccasgtcaaacttattctatgattttgt

SEQ ID NO: 50112 - DNA, 50 bp, homo sapien
gtgcaatttaaattttacagggccamagtcgccgatgatgtcatgattat

SEQ ID NO: 50113 - DNA, 50 bp, homo sapien
ttccttcaagaacttgccaggctaaraatgatattaacattactatagaa

SEQ ID NO: 50114 - DNA, 50 bp, homo sapien
caccaatctcacaaagtttgcaatcyaattagaagagaaaagaatttaaa

SEQ ID NO: 50115 - DNA, 50 bp, homo sapien
gccctgtaaaatttaaattgcactasgttttgttggtcactgtttaaagt

SEQ ID NO: 50116 - DNA, 50 bp, homo sapien
agagctgtggagctaggcagaattayagtcatcattaagttgatatatga

SEQ ID NO: 50117 - DNA, 50 bp, homo sapien
atcttagatttttagtcaaaaagtcrctgttggccaaattataacccctc

SEQ ID NO: 50118 - DNA, 50 bp, homo sapien
gtgtgtttgctgtttttcattttagrataacagagctgtggagctaggca

SEQ ID NO: 50119 - DNA, 50 bp, homo sapien
cggacattcctgcagctcacactcakctttggtcccagtgttgagtgggg

SEQ ID NO: 50120 - DNA, 50 bp, homo sapien
ccgtgtattcccatgggcactttcarcatgaatgcctctgttttctatta

SEQ ID NO: 50121 - DNA, 50 bp, homo sapien
tgcccatgggaatacacggttctgaraaaagagaaaggaaatgaaaagcg

SEQ ID NO: 50122 - DNA, 50 bp, homo sapien
tgggaaatgctcccacaggtatcagsaaacagtagtgaggaacggcatgc

SEQ ID NO: 50123 - DNA, 50 bp, homo sapien
aacgcatcagcaaatgtcagccggayggtttaatttccactcatcccacg

SEQ ID NO: 50124 - DNA, 50 bp, homo sapien
tagtcccaagggaaggtgaccttcgrccagcaatttcaggttaacgcagc

SEQ ID NO: 50125 - DNA, 50 bp, homo sapien
gtgaaaataatctgatgatacaaacrgagaattgtagtacaagaacaatt

SEQ ID NO: 50126 - DNA, 50 bp, homo sapien
ttattaagtatatgtaatgtttgaaygatctgagatcttaacagggattt

SEQ ID NO: 50127 - DNA, 50 bp, homo sapien
aaaggggatagctactttacaatcarattacaagtctcagctaaatccct

SEQ ID NO: 50128 - DNA, 50 bp, homo sapien
aataagtgttagaaagatggaaaacyctacttacagagctatccacagtt

SEQ ID NO: 50129 - DNA, 50 bp, homo sapien
taagaaaaatgaccctcatttggaascgttttcgcagaacgtatctaccg

SEQ ID NO: 50130 - DNA, 50 bp, homo sapien
agcatgtgtgtgtcagactcctctakataccagattttttttaaataatt

SEQ ID NO: 50131 - DNA, 50 bp, homo sapien
acgtttctataatataatattctaaygtagaagttgttccacaaacccat

SEQ ID NO: 50132 - DNA, 50 bp, homo sapien
catctaactagttttacagctatagsatcttcagtagttttcagtaaact

SEQ ID NO: 50133 - DNA, 50 bp, homo sapien
aaacacttcaccatgtttttcattartaacacatatatcctccgtctctg

SEQ ID NO: 50134 - DNA, 50 bp, homo sapien
ataaaataattctgaagttcgcatawaagaagaaatagataggtggtttt

SEQ ID NO: 50135 - DNA, 50 bp, homo sapien
aataaaaggcagtctttttaaagcamagaatccatcgacaggaaaactta

SEQ ID NO: 50136 - DNA, 50 bp, homo sapien
acacaaacaataaattcagacattaktaaacacagaaggcatcatactgc

SEQ ID NO: 50137 - DNA, 50 bp, homo sapien
atggcctcattcatctacatagcttyaagcagaatctgtgttctgaagac

SEQ ID NO: 50138 - DNA, 50 bp, homo sapien
ctcctaaattctcactattgattgarcgtctcatacgcaggcactgagac

SEQ ID NO: 50139 - DNA, 50 bp, homo sapien
tttgcatcgtccagttcaatcatcartagaactctaagggtggcttctaa

SEQ ID NO: 50140 - DNA, 50 bp, homo sapien
aaaagaatagaaatacaatttggtawgaaaattttggagtatgtatggag

SEQ ID NO: 50141 - DNA, 50 bp, homo sapien
aaattgtgctgtgtgttctacaagaragggtcacatttggcttttggttg

SEQ ID NO: 50142 - DNA, 50 bp, homo sapien
tgtgaacttcatgctacttggttcayctcgtctacctgtgtccttaaaag

SEQ ID NO: 50143 - DNA, 50 bp, homo sapien
ctctagtgccttatcaacacctttayctgtggatacaattcaaaggaagc

SEQ ID NO: 50144 - DNA, 50 bp, homo sapien
aatccaagtcgtgacttaagctagcrcccttccgttcctctattacattt

SEQ ID NO: 50145 - DNA, 50 bp, homo sapien
tcagcacaactggcagagccaggacsaggcacgaaggctatttgagctct

SEQ ID NO: 50146 - DNA, 50 bp, homo sapien
agtgtggcacataagatatgaaaccracagtaaaacaatttagacttaca

SEQ ID NO: 50147 - DNA, 50 bp, homo sapien
caaggtatgattggaattaacgcaarctgcaccgacttacaaatggcagt

SEQ ID NO: 50148 - DNA, 50 bp, homo sapien
aagagtgtttaatgcgtgtctcattkaaaacggttccctattgcagcacg

SEQ ID NO: 50149 - DNA, 50 bp, homo sapien
tatttctccctaatcagtggcacaaygttatgctttgtcagtagaaggtg

SEQ ID NO: 50150 - DNA, 50 bp, homo sapien
cattggcaaggggctccacattgcaytcaagccaagaatacaaacaaacc

SEQ ID NO: 50151 - DNA, 50 bp, homo sapien
gtgagatgcggtgtgatatgggttcraagttttgcatcgtccagttcaat

SEQ ID NO: 50152 - DNA, 50 bp, homo sapien
aaggtctttagcaaaatgctgaaatyaagactcactgctagtcaatccgg

SEQ ID NO: 50153 - DNA, 50 bp, homo sapien
gttaagtcacagagtaggcaaaagcratcatcaaagtttactttcccatt

SEQ ID NO: 50154 - DNA, 50 bp, homo sapien
tgattgcttgtgacatcgtcttaaartggtaccagccaaaagaagctgaa

SEQ ID NO: 50155 - DNA, 50 bp, homo sapien
cattgaaaggacttttttcttcaagrcatttacacgaaattgtgttgatg

SEQ ID NO: 50156 - DNA, 50 bp, homo sapien
attagggtgagaggctctgagctacrgcatcgtcctggcaactttcttcc

SEQ ID NO: 50157 - DNA, 50 bp, homo sapien
tctgtttgctctactgattgaaagayaccagatttaccaacagctgaaac

SEQ ID NO: 50158 - DNA, 50 bp, homo sapien
caaacaagtacatttacttttgttaygatttagtgaactaatggaacatg

SEQ ID NO: 50159 - DNA, 50 bp, homo sapien
caatgaatcaattcaggagtcttcayaagcgcaatcattcttttctacta

SEQ ID NO: 50160 - DNA, 50 bp, homo sapien
tccaggtgtactcgggaagatagtarcatttattgggtatatactatgaa

SEQ ID NO: 50161 - DNA, 50 bp, homo sapien
agaacatttcctcgactctagcaaayctcttaattccaggtgtactcggg

SEQ ID NO: 50162 - DNA, 50 bp, homo sapien
tatacctgtgatattctgtgccatgragagactcgtgcttaataattcac

SEQ ID NO: 50163 - DNA, 50 bp, homo sapien
ttccctcttctgcctttcttggtgayagtcctcactacttgttatgagat

SEQ ID NO: 50164 - DNA, 50 bp, homo sapien
atgaagtcaaccagaggaaaaataarcgaagtccttcgagtacaaaggat

SEQ ID NO: 50165 - DNA, 50 bp, homo sapien
caccctctatcagtgtcagtgataaygctgggataaaacaccacaggttg

SEQ ID NO: 50166 - DNA, 50 bp, homo sapien
atattcacttatcttatggagatgartcacagcaagactgaatgttgatg

SEQ ID NO: 50167 - DNA, 50 bp, homo sapien
tacagattttaggaaaagatatttaygttgtctttactaaccagaaccag

SEQ ID NO: 50168 - DNA, 50 bp, homo sapien
agaacaggcagatctcaaaatggaaracagattgttgattcccagcatca

SEQ ID NO: 50169 - DNA, 50 bp, homo sapien
acatctgaggctcttaaatcaataawcaaaggtcctgtgacagtcatata

SEQ ID NO: 50170 - DNA, 50 bp, homo sapien
gttccaattcatctaactcatttgtwaaactggagtcgagtatcatttcg

SEQ ID NO: 50171 - DNA, 50 bp, homo sapien
ttttaaaagttattatagttaatcamaatggcaaagtgtgtctttaagta

SEQ ID NO: 50172 - DNA, 50 bp, homo sapien
cagcagcggaaggctgaatctgaccrggaaaaggaagccggtgtaacaca

SEQ ID NO: 50173 - DNA, 50 bp, homo sapien
ctagcctgcaaaatatcagtttaaasctgcacctcaaatgggatcactta

SEQ ID NO: 50174 - DNA, 50 bp, homo sapien
cttttctgcagtgcttttagagcaastactgttgagtttatattttccaa

SEQ ID NO: 50175 - DNA, 50 bp, homo sapien
atctctagatgaatgcactggagaarggaaaaaagtagatgtgagtggat

SEQ ID NO: 50176 - DNA, 50 bp, homo sapien
tttatttcacctgaataaaaaaatayagtgtgagaatgatctgctgagag

SEQ ID NO: 50177 - DNA, 50 bp, homo sapien
gcaactgaatgtaggtggattgtctsaaacccattaccgttgtccaccca

SEQ ID NO: 50178 - DNA, 50 bp, homo sapien
taacttcttcatgtcataaatacatmaatttccaagcagtcagggaaggt

SEQ ID NO: 50179 - DNA, 50 bp, homo sapien
atgggttaacaaattctcgcctggargtcagttaagaaaaggtttgtgtc

SEQ ID NO: 50180 - DNA, 50 bp, homo sapien
gtttgagttacacacaaatggctgayggttacttaatccaccatccagat

SEQ ID NO: 50181 - DNA, 50 bp, homo sapien
tttcacatgagctttattaactttaygccaagtacttctccttttattga

SEQ ID NO: 50182 - DNA, 50 bp, homo sapien
accattcccagactgtcttttggtcsaaatgtaacacccagtcctgtggt

SEQ ID NO: 50183 - DNA, 50 bp, homo sapien
cttagacctagcctatattatccacrgtatgggaaagagaacaatccttg

SEQ ID NO: 50184 - DNA, 50 bp, homo sapien
agcaagtggagtgtgtagacttggawgaaaaggattcacaattttccata

SEQ ID NO: 50185 - DNA, 50 bp, homo sapien
aggcacacctagggccatctccctamggttgaactgaaagtcaactgaat

SEQ ID NO: 50186 - DNA, 50 bp, homo sapien
atctgtgatactacatctatggtcayctacggagtgtcagatcctggttt

SEQ ID NO: 50187 - DNA, 50 bp, homo sapien
ccttaggctaccacaaccagcatacratccctttcccagcaagaaggtct

SEQ ID NO: 50188 - DNA, 50 bp, homo sapien
gcccacccgctgaagcaagtccctargttccctgtccctctggctggctg

SEQ ID NO: 50189 - DNA, 50 bp, homo sapien
aaaatacttgtagttgaattaagaaytaaaaatgaactcatcagatggga

SEQ ID NO: 50190 - DNA, 50 bp, homo sapien
ctacatactaaagataagcctgtcayggaaattatgaaactctcaacaga

SEQ ID NO: 50191 - DNA, 50 bp, homo sapien
aaatcctgggttgcaataactatacyataaacatatgccatcactgcttt

SEQ ID NO: 50192 - DNA, 50 bp, homo sapien
ctagatttacagtccgtttaataccrgcgacctctcgcacactaatgttc

SEQ ID NO: 50193 - DNA, 50 bp, homo sapien
ctgcgatcgcagcagagaatctgtcygaagagcaaacccagtgctgcacc

SEQ ID NO: 50194 - DNA, 50 bp, homo sapien
aaaacatggttttaagtgaggcaaaygtaaattaaaatgaaagtaatttt

SEQ ID NO: 50195 - DNA, 50 bp, homo sapien
atgaagctacgcaaatatgctaagcsaagtcattaattttggtgatctgg

SEQ ID NO: 50196 - DNA, 50 bp, homo sapien
aggtgacttatttttggtggacacaygtctttgtggctatgactgattgt

SEQ ID NO: 50197 - DNA, 50 bp, homo sapien
tatgacccatggaattttcttaaacygtggcatctcttatcaagtgttat

SEQ ID NO: 50198 - DNA, 50 bp, homo sapien
atgctttttcacttatctaaattcaygaaactgtttggacattgtatctt

SEQ ID NO: 50199 - DNA, 50 bp, homo sapien
taggcaatgggggaaatccgcctggwagagatgttctggatgtcagtagg

SEQ ID NO: 50200 - DNA, 50 bp, homo sapien
aactactattatttaaacaacatgaygaatgagaatgcatatataaatat

SEQ ID NO: 50201 - DNA, 50 bp, homo sapien
gaaaaaaatagttcagagcacagcartatgtccatgttggactaattggt

SEQ ID NO: 50202 - DNA, 50 bp, homo sapien
gaaacattaactgcagagcaaaatcyatttctgtggccagggaaacacgc

SEQ ID NO: 50203 - DNA, 50 bp, homo sapien
aacgtaattttgcatacaaaaggagsacaaattgcatgcgaaacattttg

SEQ ID NO: 50204 - DNA, 50 bp, homo sapien
accaaacataaataatttatagaacsatgagaaagaaatcagtgcttgtt

SEQ ID NO: 50205 - DNA, 50 bp, homo sapien
tttcaaaaatatgcatgcatttacaycgtagcaaactgtttatctcaatt

SEQ ID NO: 50206 - DNA, 50 bp, homo sapien
ctgctaaagtctttcacgtgctattmaaaatcttttgaaaatctagtctc

SEQ ID NO: 50207 - DNA, 50 bp, homo sapien
ctctcctgcagtgtttttgctattayatgaatttgcctcgagagcttgaa

SEQ ID NO: 50208 - DNA, 50 bp, homo sapien
gaggaacgctgagaactaaacaataytatggaatcccttttatgcctttt

SEQ ID NO: 50209 - DNA, 50 bp, homo sapien
attactattgctaaatgaaaaactasgatgtccttctccttcacttccat

SEQ ID NO: 50210 - DNA, 50 bp, homo sapien
ccattacaactatgctagcatttcawtaatagccttgactctcataccct

SEQ ID NO: 50211 - DNA, 50 bp, homo sapien
gtcccctcaacacagggctctaatayctgagtaaaccatggagggagaaa

SEQ ID NO: 50212 - DNA, 50 bp, homo sapien
aatataattacatggcgcagatatartagtttagacacatgtaataaaag

SEQ ID NO: 50213 - DNA, 50 bp, homo sapien
ggacatggtcttcatgattttcaaasttgcttttatccctagaattctct

SEQ ID NO: 50214 - DNA, 50 bp, homo sapien
gaagaccatgtccttctttaaatcaraaaagttcatagacacatacatat

SEQ ID NO: 50215 - DNA, 50 bp, homo sapien
tactgtaatagattgcaagtaatgayggagaaagagagagacgatctgct

SEQ ID NO: 50216 - DNA, 50 bp, homo sapien
agagaaaagcaaacaacatttctaaratttggctccattccctgtctcca

SEQ ID NO: 50217 - DNA, 50 bp, homo sapien
taggtgatttcagaacattgggacaraagagaatatcctaccaaatttcc

SEQ ID NO: 50218 - DNA, 50 bp, homo sapien
ccttatgtggctttcagggtaaatakgccgctgctcgttacggtcttttc

SEQ ID NO: 50219 - DNA, 50 bp, homo sapien
ctgtccctctggttagcactgcttgkattctcattaaagccctgtccatt

SEQ ID NO: 50220 - DNA, 50 bp, homo sapien
ataatatggcaaggcaggatggtgtsaatggtgaacgtacaaggctcctt

SEQ ID NO: 50221 - DNA, 50 bp, homo sapien
ttaatagtaggtattcttatttactyaggtttattgagagatacaaatga

SEQ ID NO: 50222 - DNA, 50 bp, homo sapien
tagaaaatgctaaacgtggcaattcrcattgtaaaaggcaagggaggggc

SEQ ID NO: 50223 - DNA, 50 bp, homo sapien
aaagaggggaagaaggaaagtaagaraattgcccatctttgctgttacag

SEQ ID NO: 50224 - DNA, 50 bp, homo sapien
aagttttcccaaaatgccaagaatartaaaattgcacttgtttgctcctc

SEQ ID NO: 50225 - DNA, 50 bp, homo sapien
aaagcttcccaaagccaatgacaaasattttattatagtgatttatcaaa

SEQ ID NO: 50226 - DNA, 50 bp, homo sapien
gtagaaaatgaggccatataccccarctaaatcttgtcttttcttttttt

SEQ ID NO: 50227 - DNA, 50 bp, homo sapien
aggtgaaatacttccaccctaggatsagattcgattttcatagaactcaa

SEQ ID NO: 50228 - DNA, 50 bp, homo sapien
cctaattgtaagttactgcaaactcmatctataaaacagtatttgtggaa

SEQ ID NO: 50229 - DNA, 50 bp, homo sapien
gtttcaatcagtaagaatttctttasggcttccgtgcaaagtagctagtt

SEQ ID NO: 50230 - DNA, 50 bp, homo sapien
cataatggctggaagtaaaggtgtayggctctggttattaaaatgtagaa

SEQ ID NO: 50231 - DNA, 50 bp, homo sapien
aggaaggacagagagggaataacaayggctataagagcacacgcagaaga

SEQ ID NO: 50232 - DNA, 50 bp, homo sapien
tctctgcgtggaaggggtgatacccrcaaagtacagtcaatcacagatgg

SEQ ID NO: 50233 - DNA, 50 bp, homo sapien
taggttaacaaaaaatcctagcctayagcctgtaacttataaatcaactg

SEQ ID NO: 50234 - DNA, 50 bp, homo sapien
tacagcctgtaacttataaatcaacygaatagctaagcggcctaaatgtt

SEQ ID NO: 50235 - DNA, 50 bp, homo sapien
ctaatgtaaattctaaatgtcaaatyatgttaaattaagattatatgttt

SEQ ID NO: 50236 - DNA, 50 bp, homo sapien
agcagcactcatgggaagctcattcyaacataaaaggcatcttcccaaag

SEQ ID NO: 50237 - DNA, 50 bp, homo sapien
atttcctgtcattggtggcacagaamatagtagcgaatgcagtttgaata

SEQ ID NO: 50238 - DNA, 50 bp, homo sapien
cttctttcagtttcaaagattcgtawgatgactataaaactgacacgtat

SEQ ID NO: 50239 - DNA, 50 bp, homo sapien
cagtagctgaagtgaacaaaacatasatcctactgcaaggtttgatgtca

SEQ ID NO: 50240 - DNA, 50 bp, homo sapien
gggtccacgtcaaggagttggtaaaraacgcacaatgagtacaggctagt

SEQ ID NO: 50241 - DNA, 50 bp, homo sapien
ttaaacacggttttaccaataatcamcataaacctaaaactacaggacag

SEQ ID NO: 50242 - DNA, 50 bp, homo sapien
gcatataataaaatgtggacttttasaactggaaggaacctggaaattct

SEQ ID NO: 50243 - DNA, 50 bp, homo sapien
gcaataaagctttgtcagccaaggcragggtaaacaagttataaatcacg

SEQ ID NO: 50244 - DNA, 50 bp, homo sapien
ttggaaaactgatctctagaatggcsaaatactttcaactttctgacagg

SEQ ID NO: 50245 - DNA, 50 bp, homo sapien
tgatgccttttcttgtttttgcaaargatcacttaagaccttgacagcat

SEQ ID NO: 50246 - DNA, 50 bp, homo sapien
agctggtcatataaagagaaaactaygctgccataaataacttggcttaa

SEQ ID NO: 50247 - DNA, 50 bp, homo sapien
tgtctactaaactttacttgggttgsattttgtacagaaatatgttttat

SEQ ID NO: 50248 - DNA, 50 bp, homo sapien
tcaggcttgattttgcatttatttaycctttgtgcaattatttgcttact

SEQ ID NO: 50249 - DNA, 50 bp, homo sapien
ctgtcagtttacgtggattgtaaccsgatggagatgtttctcatttacct

SEQ ID NO: 50250 - DNA, 50 bp, homo sapien
gacacaaaagaaaatgcacacctaaygcacattcctgtggtccaagacag

SEQ ID NO: 50251 - DNA, 50 bp, homo sapien
gaataaagcttctcagagaatactaygtaaaataaagttcctctgtaatg

SEQ ID NO: 50252 - DNA, 50 bp, homo sapien
caccattaaatgtgaatttttggcastattgtccttggataagattccaa

SEQ ID NO: 50253 - DNA, 50 bp, homo sapien
attaacagaactggagggaaaatagraaacaatatattaacagtatggaa

SEQ ID NO: 50254 - DNA, 50 bp, homo sapien
aataatttcctttgcacgtctaaackgagatgctcagaagtttgctaata

SEQ ID NO: 50255 - DNA, 50 bp, homo sapien
atgtcatccagacatcaaatcaatamgaaagcaatgtacttggccaacag

SEQ ID NO: 50256 - DNA, 50 bp, homo sapien
ctatggacacattactttccataaayatcactctactgtttttatgtttg

SEQ ID NO: 50257 - DNA, 50 bp, homo sapien
gtataagatctgaacaaagagccaastgtgattatgtggaatgctttcat

SEQ ID NO: 50258 - DNA, 50 bp, homo sapien
tatttctttggttatttgcattcaaygtgcttttctatataggaattcaa

SEQ ID NO: 50259 - DNA, 50 bp, homo sapien
cattttgtagattaccagcactaccrctgtgtttttaacctccttgaact

SEQ ID NO: 50260 - DNA, 50 bp, homo sapien
tggcgaaaggctcacatttgaattaygagaaggaacacttattccaggag

SEQ ID NO: 50261 - DNA, 50 bp, homo sapien
tgctaagaatttatccttatgcccaygcggtttttggatgactggcattt

SEQ ID NO: 50262 - DNA, 50 bp, homo sapien
ttttatgtattttctttgtgtctgastatctgttagattatatgatttga

SEQ ID NO: 50263 - DNA, 50 bp, homo sapien
agcaaaccttgcttgataatggcacygtagtttatcctagagcttttttt

SEQ ID NO: 50264 - DNA, 50 bp, homo sapien
gagtagattaccattcagtattaaaygcaaaaattgaaagtgtagtcact

SEQ ID NO: 50265 - DNA, 50 bp, homo sapien
ttctttcaaagtgcgttgaaaaatakctggcattcaaatatagggcagga

SEQ ID NO: 50266 - DNA, 50 bp, homo sapien
ctaggaagaacgctaccattgagtasattaccattcagtattaaatgcaa

SEQ ID NO: 50267 - DNA, 50 bp, homo sapien
gatcctgatgagtcctctaaacaaartccaaagaagaggattggctcaac

SEQ ID NO: 50268 - DNA, 50 bp, homo sapien
tttaaaaggcacatagaaggtacaarcaaatgaaacctataagcagcaat

SEQ ID NO: 50269 - DNA, 50 bp, homo sapien
tcaagcacttatccatgaattgtccracagtggctgggcaagtttcggat

SEQ ID NO: 50270 - DNA, 50 bp, homo sapien
gttaagagaagaatagtgactgtackgccttaggatcttatattcacatt

SEQ ID NO: 50271 - DNA, 50 bp, homo sapien
tgaaacacagaacctaatcagaaaastaataggtctattttgttggtgct

SEQ ID NO: 50272 - DNA, 50 bp, homo sapien
ttggccttgattagagctattagtawagggttcccttgtgagaaaagact

SEQ ID NO: 50273 - DNA, 50 bp, homo sapien
acacaaaattacagataaaagtgaawtgaacctacagatacccatcactc

SEQ ID NO: 50274 - DNA, 50 bp, homo sapien
agaatgtgcactaccacagagtacaygccgagagaatatggtatgaatat

SEQ ID NO: 50275 - DNA, 50 bp, homo sapien
aaactcattattaaataaatcagtcwctatttaaaccaagtgcatggggg

SEQ ID NO: 50276 - DNA, 50 bp, homo sapien
gtattttgtttacacataggtattaraagtttaaaatgaataacaagaga

SEQ ID NO: 50277 - DNA, 50 bp, homo sapien
ctttttcccctttctgacttggtaayatctttgtagtatgagtgacagtg

SEQ ID NO: 50278 - DNA, 50 bp, homo sapien
tctccctacataaaaggagcaagaasaacaattaaagcatatctagaatg

SEQ ID NO: 50279 - DNA, 50 bp, homo sapien
tgaagctcattacccatccaattcartagtaccacaaaaattgacttgat

SEQ ID NO: 50280 - DNA, 50 bp, homo sapien
atatttggcctttaatgtttaaataycattattgtgggtaaatcagtgca

SEQ ID NO: 50281 - DNA, 50 bp, homo sapien
tatattttcgttacacctcataaatkaccggttggcaacatctggaagtc

SEQ ID NO: 50282 - DNA, 50 bp, homo sapien
acagccatgctttgctttatgtaacraaagtaacagcattataaacttct

SEQ ID NO: 50283 - DNA, 50 bp, homo sapien
tgaagtgtcctgggagtattcagaaygacatttgtattgctatcagtgat

SEQ ID NO: 50284 - DNA, 50 bp, homo sapien
agctgtggccattgtggacaaatggyatgtaccctgctcacagtaaacac

SEQ ID NO: 50285 - DNA, 50 bp, homo sapien
atgaatatactatattcaaacaatcrgagagaatactcatgagattatta

SEQ ID NO: 50286 - DNA, 50 bp, homo sapien
acactttcctcattccctatttttaygcatttcgtgaaacctcttttgac

SEQ ID NO: 50287 - DNA, 50 bp, homo sapien
acgcatttcgtgaaacctcttttgasctaaaatgatggccttagccttca

SEQ ID NO: 50288 - DNA, 50 bp, homo sapien
tctggggtttctcttttaaatcaatraagtacaaagagacatcaaaagtt

SEQ ID NO: 50289 - DNA, 50 bp, homo sapien
gcatgtgctttgggccattgtccatsaaagagagaaacaatgtgagtccc

SEQ ID NO: 50290 - DNA, 50 bp, homo sapien
ggttgatgatgacatctaccttcaastggacgaacaacaatggaaacaga

SEQ ID NO: 50291 - DNA, 50 bp, homo sapien
ggcaatgaggagttctgtacttacayagaaaaaagtggagaatggctgct

SEQ ID NO: 50292 - DNA, 50 bp, homo sapien
gtaagagtggatttcacaactttaayggttcaaaattacatcctgaatcg

SEQ ID NO: 50293 - DNA, 50 bp, homo sapien
actgctaccgtgatatatcagttggraagataattgttaatatctgagcc

SEQ ID NO: 50294 - DNA, 50 bp, homo sapien
gataggaaaaaaggtccataaacgasaggtagtgcataatgagtaatcaa

SEQ ID NO: 50295 - DNA, 50 bp, homo sapien
catatatgcattctttacctcttgcwcagtagctgcctaattggttttcc

SEQ ID NO: 50296 - DNA, 50 bp, homo sapien
cacgatgaaatgacttcctgtttaartagtgccttaaggtggtttataag

SEQ ID NO: 50297 - DNA, 50 bp, homo sapien
cctttgcttgtatcagtcttgatgartaagtctcgacacacagataaaac

SEQ ID NO: 50298 - DNA, 50 bp, homo sapien
gcgagaggcactcagattttcagcgyagataaaaagatgggaaaaccaat

SEQ ID NO: 50299 - DNA, 50 bp, homo sapien
caatttcactctaatctctctaaaasctgatgccactagaaagaaaatcc

SEQ ID NO: 50300 - DNA, 50 bp, homo sapien
agcaaaggtatatagtggtgagttasagtaaaggtcatctcatactaacc

SEQ ID NO: 50301 - DNA, 50 bp, homo sapien
atatatacttgcaatgcgatatacaygaatcagggcgtagtggacactca

SEQ ID NO: 50302 - DNA, 50 bp, homo sapien
aatgcaatctcagtaaagagtgaacscggtgacagtttaaagtgctccct

SEQ ID NO: 50303 - DNA, 50 bp, homo sapien
ctgttcaacctgattttgactctgakagaattaaacctgcccctcaaatg

SEQ ID NO: 50304 - DNA, 50 bp, homo sapien
actgggtgaggatgaagtcatttacygagatagggaacgtaggaggggaa

SEQ ID NO: 50305 - DNA, 50 bp, homo sapien
acacatatctgtgcattctttattaycgtgcattcaaaagtatataagga

SEQ ID NO: 50306 - DNA, 50 bp, homo sapien
tggctacagcagtgaatattgattayctctattatgggaatggctaaata

SEQ ID NO: 50307 - DNA, 50 bp, homo sapien
tatataaaccaacctactagtaaaarctactgaacatttttgtaaagctt

SEQ ID NO: 50308 - DNA, 50 bp, homo sapien
tggcttcttgaatttcctctggatakgatggcatttgggggcttagatta

SEQ ID NO: 50309 - DNA, 50 bp, homo sapien
acatgaggtgtggttttatccttgcratttcagtttgtgttgtctagatg

SEQ ID NO: 50310 - DNA, 50 bp, homo sapien
cctcatctcctaaataaagggttcasattagatgctaagatttcacctac

SEQ ID NO: 50311 - DNA, 50 bp, homo sapien
cactctaggcctgtatgtgaaaccamattgtaatggaagaatgcctgctc

SEQ ID NO: 50312 - DNA, 50 bp, homo sapien
ttttcatctttattcaggtgaaggamtcaaaagcccatttagcaaagcat

SEQ ID NO: 50313 - DNA, 50 bp, homo sapien
ccattggaaaaatacatactgaatcycaattatatggtgtgaaatctgtg

SEQ ID NO: 50314 - DNA, 50 bp, homo sapien
gtatattaagttcacgtaaccaacayataaagacatagtgaaaagttaat

SEQ ID NO: 50315 - DNA, 50 bp, homo sapien
aggcagtcagcgcacacactgtctgyagagaatttagaataatagtaaaa

SEQ ID NO: 50316 - DNA, 50 bp, homo sapien
ttatatgttggttacgtgaacttaayatacatttaaccctgaaaatctta

SEQ ID NO: 50317 - DNA, 50 bp, homo sapien
gaatgcatgagaataataaaaatcasactgacctttagttagttttacta

SEQ ID NO: 50318 - DNA, 50 bp, homo sapien
ttgctcagcacatattgcttttataygtattgttttagatctcatactaa

SEQ ID NO: 50319 - DNA, 50 bp, homo sapien
ttccttctacaaatggtgccacgatraaatgacttcctgtttaaatagtg

SEQ ID NO: 50320 - DNA, 50 bp, homo sapien
aacacaaaatctagagtattgcgagwaacataatttatgtaaaaacatgc

SEQ ID NO: 50321 - DNA, 50 bp, homo sapien
taaagcaatatttgttgacctaacamgggattctccaacactagcattca

SEQ ID NO: 50322 - DNA, 50 bp, homo sapien
gtttgtgggcactttccaattctacrgacatttttgattacatagtagca

SEQ ID NO: 50323 - DNA, 50 bp, homo sapien
attactcctgtcaaattgattataawaagagctaagtgccaatcctctcc

SEQ ID NO: 50324 - DNA, 50 bp, homo sapien
agtgtctttacacagtcttaagcatwaataacttgcgtaaaatattttat

SEQ ID NO: 50325 - DNA, 50 bp, homo sapien
ccatgtaccccggaacttaaggaaasataagataattatatgtaaaaaaa

SEQ ID NO: 50326 - DNA, 50 bp, homo sapien
gtcaatatacttgatgcctgccaaaygaggatcaccgaaaatcgttgaaa

SEQ ID NO: 50327 - DNA, 50 bp, homo sapien
ggtattaaccataactaaatgtagayagcatataatgtgccaggtggtgt

SEQ ID NO: 50328 - DNA, 50 bp, homo sapien
aaacccagtgaattaatatcccttaraaatcaatcatatctctggttgat

SEQ ID NO: 50329 - DNA, 50 bp, homo sapien
gatgccacagagacctccaactgtakgtgaaatcttagcatctaatctga

SEQ ID NO: 50330 - DNA, 50 bp, homo sapien
gaactaggaagagatcaagaacatakagaagggaacagaatttccactgg

SEQ ID NO: 50331 - DNA, 50 bp, homo sapien
gattgtgaaccatacccaactaaaaytgctgttcttggtctttgatagac

SEQ ID NO: 50332 - DNA, 50 bp, homo sapien
aagaaaaaccagagtatctttgggcyaaatcggaataaatacgttgctga

SEQ ID NO: 50333 - DNA, 50 bp, homo sapien
ggtggaatgttaagggaattctcaawgaaggaggattagatgggaggtga

SEQ ID NO: 50334 - DNA, 50 bp, homo sapien
agggcacagactcagtcttcctttcrctagttaccctttcaacttcaggt

SEQ ID NO: 50335 - DNA, 50 bp, homo sapien
aaattttgctccttaatgccaatgtsaaatgatcccagagctgctttaag

SEQ ID NO: 50336 - DNA, 50 bp, homo sapien
atataaacttatgttctttcctgtasagcatggccttcctaatttcacag

SEQ ID NO: 50337 - DNA, 50 bp, homo sapien
cacagtcttactctatatagtacttmaacccctaaaattcatgaaaagtg

SEQ ID NO: 50338 - DNA, 50 bp, homo sapien
tgagccaccatgcccggcctatcagyataaatttaaggcagattttagga

SEQ ID NO: 50339 - DNA, 50 bp, homo sapien
cttacgatgagactacaagctcttaraggaaaaagattctggcaaaatct

SEQ ID NO: 50340 - DNA, 50 bp, homo sapien
gctcagcatcttggcatcctaattckgaaacagtgtcaatccctggttta

SEQ ID NO: 50341 - DNA, 50 bp, homo sapien
tttggagctgaaggaaaaattatacrctggtcaatttcagtttaacatct

SEQ ID NO: 50342 - DNA, 50 bp, homo sapien
ctacagacaaatcaattctcagacarattacaagggtttttcaaacctga

SEQ ID NO: 50343 - DNA, 50 bp, homo sapien
ttgagctttgtgtagtagatgatagwaatatggcctacttcagaaactgt

SEQ ID NO: 50344 - DNA, 50 bp, homo sapien
ttctgtccaatagacgctgaagttaygtattgtctttttccagtgatcaa

SEQ ID NO: 50345 - DNA, 50 bp, homo sapien
atagtagcatgtgtcgtctaaagatkagtgctgataactggaaggtcagg

SEQ ID NO: 50346 - DNA, 50 bp, homo sapien
ttttagagacaagaactaatgaaggsattgcagataaagacaacacactg

SEQ ID NO: 50347 - DNA, 50 bp, homo sapien
agggattgcagataaagacaacacamtggattttaatttatagaaaacaa

SEQ ID NO: 50348 - DNA, 50 bp, homo sapien
ggatattacacactggcagctgaatyatgacacttttctcatttaatagt

SEQ ID NO: 50349 - DNA, 50 bp, homo sapien
aataaatagcctaaatgatctctaascaatttaatcagggcagtatccca

SEQ ID NO: 50350 - DNA, 50 bp, homo sapien
gcgattagatacgtattgttcagaaygagcagtgtgtgagttggatttct

SEQ ID NO: 50351 - DNA, 50 bp, homo sapien
gcatcttttagaaatagactcacatkaggaaaattcaggagcctgatgta

SEQ ID NO: 50352 - DNA, 50 bp, homo sapien
ctatttgggaatgtcattttatgccraatggttttacttcccagttctat

SEQ ID NO: 50353 - DNA, 50 bp, homo sapien
caggagcctgatgtataaaacaaaartcttcattagattcaaggtaaaac

SEQ ID NO: 50354 - DNA, 50 bp, homo sapien
ggtaaagatcttgaattcccaatacrcaatagaactgggaagtaaaacca

SEQ ID NO: 50355 - DNA, 50 bp, homo sapien
acacatagtaaattccaggctaggawcatctttatttattaatctgtatg

SEQ ID NO: 50356 - DNA, 50 bp, homo sapien
aaactagataaaatggaccacttccyatttgtttgaaatctcttttagca

SEQ ID NO: 50357 - DNA, 50 bp, homo sapien
ttaaaaataatgaagcctatttcccrgatataagagcaagaaaactattg

SEQ ID NO: 50358 - DNA, 50 bp, homo sapien
cctattatgctcctgggcgtctttaraactatctaagtaattacataaca

SEQ ID NO: 50359 - DNA, 50 bp, homo sapien
aaagctatgtgttcgcatggatgacmattagtaaaaaaaaaatactgtgt

SEQ ID NO: 50360 - DNA, 50 bp, homo sapien
acaaattttcattttgcacttgccartctagtttactacccactgatgaa

SEQ ID NO: 50361 - DNA, 50 bp, homo sapien
aatgaaaatttgtttctttgtaacartaactacacaatttgtcaagaagg

SEQ ID NO: 50362 - DNA, 50 bp, homo sapien
tctactgctccagtgacatcatttgmaagtgagcttctaatttgatgttg

SEQ ID NO: 50363 - DNA, 50 bp, homo sapien
ataatttctagtttaactattaaaarcaatctggtgttgtcaacctacgt

SEQ ID NO: 50364 - DNA, 50 bp, homo sapien
taaccacaagccaactcatataaccrgagtgtcacctcttaggttcaatt

SEQ ID NO: 50365 - DNA, 50 bp, homo sapien
gggtgacatgaagataaatattacasgattacagagtctggtgagagggt

SEQ ID NO: 50366 - DNA, 50 bp, homo sapien
aaatgtaaaaccttagaaaaaagcargatgtgaattgagggacacttgga

SEQ ID NO: 50367 - DNA, 50 bp, homo sapien
cctctgggttatttatttcctcatamtaggtgaacacccattataaagcc

SEQ ID NO: 50368 - DNA, 50 bp, homo sapien
gtgaattgagggacacttggacttaygaaacaaaaataatgagtaaaagt

SEQ ID NO: 50369 - DNA, 50 bp, homo sapien
ttgttacagagcaatagaaaactaakgtacacaacactgcctattatttg

SEQ ID NO: 50370 - DNA, 50 bp, homo sapien
cacactcacacattttagaacataaytgctgctcagaagtctccatccca

SEQ ID NO: 50371 - DNA, 50 bp, homo sapien
ggagaggaagcttcctgagcaatcartgaaaaaagagtaaagatgttttt

SEQ ID NO: 50372 - DNA, 50 bp, homo sapien
atcaaactgaccctaggaattgaaartaaccttcagaatctccacacatc

SEQ ID NO: 50373 - DNA, 50 bp, homo sapien
gggtatattagaaatggcatttctcrattatattatgatgctatgtttaa

SEQ ID NO: 50374 - DNA, 50 bp, homo sapien
tcatttgctgttatgcattttctcayctagttttaggaattagttcaaca

SEQ ID NO: 50375 - DNA, 50 bp, homo sapien
taaacacatggtttaaaatactcagraaatatcaaaggtccatttatttc

SEQ ID NO: 50376 - DNA, 50 bp, homo sapien
attaaggtaaatgtgccttgagatasgaagtcccttctggttcaagtcca

SEQ ID NO: 50377 - DNA, 50 bp, homo sapien
caggaagaagaaagtatggctttgtsaaacctaggaccaagccgatctgg

SEQ ID NO: 50378 - DNA, 50 bp, homo sapien
gcatcgtgctgttcgtttgcaaagtsaccaacaaatttgtattttaaccc

SEQ ID NO: 50379 - DNA, 32 bp, homo sapien
agaattaaaataagcascagttaaatatagta

SEQ ID NO: 50380 - DNA, 50 bp, homo sapien
aatagcaagaaagaaagtcttccaayattttcaggactgatgcaaagact

SEQ ID NO: 50381 - DNA, 50 bp, homo sapien
gacaacataattccttatggttttaygctgttcagagttggatgtgattt

SEQ ID NO: 50382 - DNA, 50 bp, homo sapien
cagtctgacttatagtcaagtattaycatttaatcacagtcaataaaatc

SEQ ID NO: 50383 - DNA, 50 bp, homo sapien
cgagacttttcttaatgcaccaagckatttcattctttctcattcattca

SEQ ID NO: 50384 - DNA, 50 bp, homo sapien
gatatgttgttagaaatttaaaacayggcaatagaaacatcagagttaaa

SEQ ID NO: 50385 - DNA, 50 bp, homo sapien
tcaagctcttaaaatagggcccacasagttacatccaatctcctctactg

SEQ ID NO: 50386 - DNA, 50 bp, homo sapien
ctatggcggggttgatgcactatgaygaagtgggatcacctgttggtgag

SEQ ID NO: 50387 - DNA, 50 bp, homo sapien
atttctagttttcattagataatgayattttggagagtacatttgtttac

SEQ ID NO: 50388 - DNA, 50 bp, homo sapien
ttttgctttcaaatttcaagtttcastattaaagaattagtgcttaatga

SEQ ID NO: 50389 - DNA, 50 bp, homo sapien
ccacactcaccttgctcaaacacaaygatgatttggatttgctatttgaa

SEQ ID NO: 50390 - DNA, 50 bp, homo sapien
aggtatgttgacctgaccaaggttawatatccatccccaaatgtaaattc

SEQ ID NO: 50391 - DNA, 50 bp, homo sapien
aacactagaagaattaatccatatawaaattttcgcaaaactatgacaag

SEQ ID NO: 50392 - DNA, 50 bp, homo sapien
tgtgagatggattaaatgcatgtaayggaagctatggaagcaatagagag

SEQ ID NO: 50393 - DNA, 50 bp, homo sapien
aattaataattaaatctctgaagtgsatatattcttcctaaatcaatgca

SEQ ID NO: 50394 - DNA, 50 bp, homo sapien
aaatggctcttgagaagcatcatgartatttgctagtgtgaattattaaa

SEQ ID NO: 50395 - DNA, 50 bp, homo sapien
ctctgcacttttcattaagtacttasgattagccagtaccccttctacct

SEQ ID NO: 50396 - DNA, 50 bp, homo sapien
aagtgctacactgaaggaataaacamtgctgagtgatgctgagctccaac

SEQ ID NO: 50397 - DNA, 50 bp, homo sapien
cacaatcactcattatcttttcaacmaccttacagaagacccacaatcac

SEQ ID NO: 50398 - DNA, 50 bp, homo sapien
tcatgatcacgatctcatttactgamgagaactatgtcttatgaactatg

SEQ ID NO: 50399 - DNA, 50 bp, homo sapien
aatggttttgctatgtgattgaaaaygtggatagagaggaaggaattgat

SEQ ID NO: 50400 - DNA, 50 bp, homo sapien
tttgacacttggcgtcccttttccartcaaccctgaatgattctgataca

SEQ ID NO: 50401 - DNA, 50 bp, homo sapien
tgacatgaatgttggtataacggtartaagatcacgataagatctgtggc

SEQ ID NO: 50402 - DNA, 50 bp, homo sapien
tttgtaattttcatgttatgtcacastcagttcccacaaagtctatataa

SEQ ID NO: 50403 - DNA, 50 bp, homo sapien
ctccacaccatttaaattgcctacakattcttgaaagtcagagaaaagag

SEQ ID NO: 50404 - DNA, 50 bp, homo sapien
tccacctttttgtcaatgtgaacaayggagtagctttggaagtgattact

SEQ ID NO: 50405 - DNA, 50 bp, homo sapien
gtatcatatttaggatcatatatcaytccttctgaagggggaaaaaaacc

SEQ ID NO: 50406 - DNA, 50 bp, homo sapien
acccagttacttgtggatggcctcartattgcggttacaacagtattggt

SEQ ID NO: 50407 - DNA, 50 bp, homo sapien
tggcctcagtattgcggttacaacastattggtcaaagaaagtagaaagt

SEQ ID NO: 50408 - DNA, 50 bp, homo sapien
ctgtttatcgccctattttacaaaastgattctgacctggagggaaaaaa

SEQ ID NO: 50409 - DNA, 50 bp, homo sapien
ccagtagcagagctaagggtgtgacrgtaaagagcgcctgcaggagccca

SEQ ID NO: 50410 - DNA, 50 bp, homo sapien
tgaaaaaatccagcctaacagaaatsataaacaggaaccaaatgacaaaa

SEQ ID NO: 50411 - DNA, 50 bp, homo sapien
tcaaaagaaaactgagggtgcttctraagtagtttcttatttcaatgtgt

SEQ ID NO: 50412 - DNA, 50 bp, homo sapien
ttctgctcctctcagtgaggtggacrgtcaaggattcagagtaggggtgg

SEQ ID NO: 50413 - DNA, 50 bp, homo sapien
aacaccagaattcttgcattttcagragtatgtcaataacttagtaattt

SEQ ID NO: 50414 - DNA, 50 bp, homo sapien
tgagtacaataagactgactatgcastaaaaagagatttaatgcagtctt

SEQ ID NO: 50415 - DNA, 50 bp, homo sapien
ttgtacaatctccaaaagtcctataratgaagttgttgcacattttttag

SEQ ID NO: 50416 - DNA, 50 bp, homo sapien
gtgttctaatctgacacaaattgtamtaatctattcttagagaaatttgt

SEQ ID NO: 50417 - DNA, 50 bp, homo sapien
ccaactggtagattctggaaggtcasagactgtcgaatacttttagctag

SEQ ID NO: 50418 - DNA, 50 bp, homo sapien
taccctaagtctttctaagccagccratttgataataatactattcatgc

SEQ ID NO: 50419 - DNA, 50 bp, homo sapien
tattctggcctaacaagtgttgaaamtgttagtaatggacttatgtattg

SEQ ID NO: 50420 - DNA, 50 bp, homo sapien
aagttctatccaaaatatgcatcaayggagaatcctggaatgttgatctc

SEQ ID NO: 50421 - DNA, 50 bp, homo sapien
ctgtgagcaacccatgtgatgaaacsaaattagtgccctaggtgagaacc

SEQ ID NO: 50422 - DNA, 50 bp, homo sapien
gtgggtcagtctctcttgggttcatraattgagaatctgatgtaagctat

SEQ ID NO: 50423 - DNA, 50 bp, homo sapien
tttgattctattgttttatttatcaygtgagcactattatttttttttgg

SEQ ID NO: 50424 - DNA, 50 bp, homo sapien
aagacctttattggtaaatattcccygatagcctccaaatatttacaccc

SEQ ID NO: 50425 - DNA, 50 bp, homo sapien
atagacactaaacctagagattcacrctagaatgaaagctgggagagcag

SEQ ID NO: 50426 - DNA, 50 bp, homo sapien
atgagctttgtatatattatgaatasacatttatctgatgctttgcaatc

SEQ ID NO: 50427 - DNA, 50 bp, homo sapien
tcacttagctccagctttcctattayctatacaaatctaagtggaataaa

SEQ ID NO: 50428 - DNA, 50 bp, homo sapien
agttacataattttcctcatgaaaamttaaaagccctagatatgtaagat

SEQ ID NO: 50429 - DNA, 50 bp, homo sapien
gcatgatacacattcactctacggcrctatatctgaaaacctaggggtga

SEQ ID NO: 50430 - DNA, 50 bp, homo sapien
gagtcatatcagatccctattttgascatatcactatacaaggagttgct

SEQ ID NO: 50431 - DNA, 50 bp, homo sapien
ttgcattaataaactagaaaaaacaygaacttgaagaattgacttttgat

SEQ ID NO: 50432 - DNA, 50 bp, homo sapien
accattcattttaaaaaatgtttccyagtgaattgtgttttcagaccaca

SEQ ID NO: 50433 - DNA, 50 bp, homo sapien
tagctatcttcatttccagaaaagcraagactaacttcagaaacactgat

SEQ ID NO: 50434 - DNA, 50 bp, homo sapien
gaaggacagttcatttcaaattatargatatacgaataaaataatactat

SEQ ID NO: 50435 - DNA, 50 bp, homo sapien
tatcatactcttctgctttctctcarattagcattgcttctcatgaattt

SEQ ID NO: 50436 - DNA, 50 bp, homo sapien
ttggttagccaattattcaatgaacwggcttttagcaaatgggtgatcca

SEQ ID NO: 50437 - DNA, 50 bp, homo sapien
taccaggcctccatttcttaatctckcaaatctagataattgtctcctac

SEQ ID NO: 50438 - DNA, 50 bp, homo sapien
actcccatgtgagtagctgggtgaayggaatttgaatccactcagtttgc

SEQ ID NO: 50439 - DNA, 50 bp, homo sapien
gaaaattcttcaactttagccttcaraatttataatgaattgttacttca

SEQ ID NO: 50440 - DNA, 50 bp, homo sapien
ccataaaaagctcttgtacaaatcaygtaaaactgttgttctgacaacat

SEQ ID NO: 50441 - DNA, 50 bp, homo sapien
tacataatttatttataagctataaycttatgtccagttctccttcttag

SEQ ID NO: 50442 - DNA, 50 bp, homo sapien
cttttctcgtgtaacaacatggtacygaaattcctcttgacctcactggt

SEQ ID NO: 50443 - DNA, 50 bp, homo sapien
gctctctagacagatggacacgcacygagttgctttgagaatgtcagacg

SEQ ID NO: 50444 - DNA, 50 bp, homo sapien
atacaatttgaaaaagagaactgtayggagattggatcccttatgagttt

SEQ ID NO: 50445 - DNA, 50 bp, homo sapien
tacagttgctaccttcactaccagarctatcctgaggttcctgtgaaaaa

SEQ ID NO: 50446 - DNA, 50 bp, homo sapien
aatttgctaactagacctacctgtaygggggccagtgtgaactctcctac

SEQ ID NO: 50447 - DNA, 50 bp, homo sapien
ttctggacctcactctgttgaaaggraagatttgtctagctaatcaggac

SEQ ID NO: 50448 - DNA, 50 bp, homo sapien
atcaagttcccttatcaaagaccaaygacaatgaaaatatggcaggtact

SEQ ID NO: 50449 - DNA, 50 bp, homo sapien
tagcctcttgctgctggtctaaggasaaaaccaatgcgtggaaagtgcaa

SEQ ID NO: 50450 - DNA, 50 bp, homo sapien
aaatgtttcacttgtaagccagagawgatcaataagtctagcattggaga

SEQ ID NO: 50451 - DNA, 50 bp, homo sapien
gtaacttcatagcagtaattttgacrctgaagaatcaaacattcttggaa

SEQ ID NO: 50452 - DNA, 50 bp, homo sapien
tagattgtgtttgattctactcttaygtctaagggcatctctttaggttt

SEQ ID NO: 50453 - DNA, 50 bp, homo sapien
atagcactaaaatgaagctgtgaaartaaaggaccttgttgtccaggtca

SEQ ID NO: 50454 - DNA, 50 bp, homo sapien
gtccctcaacacagttccaagtttawatcagttcatgaataatactgcct

SEQ ID NO: 50455 - DNA, 50 bp, homo sapien
atagaaatgctatgacaaaaaaatastagaccatattagtgcaaacatca

SEQ ID NO: 50456 - DNA, 50 bp, homo sapien
tccactgacatcatgctgccaaaaayagagaaacctgaccctttggtaaa

SEQ ID NO: 50457 - DNA, 50 bp, homo sapien
tggtctctctccaggaaggtcacccrgctcgtattgccttccccagtggc

SEQ ID NO: 50458 - DNA, 50 bp, homo sapien
tctccagactcactggtgttccttayaaaaacagctctggttctcggcct

SEQ ID NO: 50459 - DNA, 50 bp, homo sapien
atgtaattgaactgaactgaattgamgtgaggtaacgctggataaaacat

SEQ ID NO: 50460 - DNA, 50 bp, homo sapien
atcaaaaataactctccggtatgtaygtagttcactcacattttaaataa

SEQ ID NO: 50461 - DNA, 50 bp, homo sapien
tcattcacagctaatgctttgtgcartatatcccttcctttcctttcctt

SEQ ID NO: 50462 - DNA, 50 bp, homo sapien
attaaaattccaataagaattgaaamagttgaacacaattaaacaactgt

SEQ ID NO: 50463 - DNA, 50 bp, homo sapien
ggcttaacaaacacgtggaccttgcmatagcccttaggaaaccagttcgt

SEQ ID NO: 50464 - DNA, 50 bp, homo sapien
tcttcattgaacatatttatagcaaygtatgtttataagttgaaattagg

SEQ ID NO: 50465 - DNA, 50 bp, homo sapien
atgtaaaataaattcctagtaaggtyaagacagacagcagacttcatata

SEQ ID NO: 50466 - DNA, 50 bp, homo sapien
aaattatgccatgtaagtcctaagayactttattaatggttatatagttt

SEQ ID NO: 50467 - DNA, 50 bp, homo sapien
agaatgaatatggaaggtacttgacygcatcagagggatttggaagcagg

SEQ ID NO: 50468 - DNA, 50 bp, homo sapien
tattgtatgttcacaactgaaataarcactccacaaatataaattcatgt

SEQ ID NO: 50469 - DNA, 50 bp, homo sapien
taacatccttaagaagcacgtaagasaaacagacacaggcacagcaatat

SEQ ID NO: 50470 - DNA, 50 bp, homo sapien
aaacagacacaggcacagcaatatckaacacaaggtgaaggcaaatgtca

SEQ ID NO: 50471 - DNA, 50 bp, homo sapien
tcttcaagtcatatcaggacaattaygtgaaaatcaaaagaccttttatt

SEQ ID NO: 50472 - DNA, 50 bp, homo sapien
ctaagtgggcaggccttttacgacaygatgataggactgtcagagaaagt

SEQ ID NO: 50473 - DNA, 50 bp, homo sapien
actgctccaacaggaaggaacctcawtattccagaccaaaggttgtaaaa

SEQ ID NO: 50474 - DNA, 50 bp, homo sapien
agtggctcagggcaggctttccaacsaacggccgtgaatcactgcctagc

SEQ ID NO: 50475 - DNA, 50 bp, homo sapien
taatggagaatcctctctatttgggmattgtactaataatccatctcagt

SEQ ID NO: 50476 - DNA, 50 bp, homo sapien
cttttggatctgggaagagaaaataycgacataagatgcttttgatatag

SEQ ID NO: 50477 - DNA, 50 bp, homo sapien
catgggactaaccgctgcaatgagaycccgcagggaggtgggagaggcaa

SEQ ID NO: 50478 - DNA, 50 bp, homo sapien
acagcaaggctgtgattcatactcaraaaggaaaggtctctgggtcacaa

SEQ ID NO: 50479 - DNA, 50 bp, homo sapien
aaccaaatggatataaaatgatatasagattttgactgccatttccctaa

SEQ ID NO: 50480 - DNA, 50 bp, homo sapien
cattgtaatcaaggaagttttctcasgttccttctcatcacaactagctg

SEQ ID NO: 50481 - DNA, 50 bp, homo sapien
gccattgctagttatgttgtaatcayggaataaatagcactttatagagg

SEQ ID NO: 50482 - DNA, 50 bp, homo sapien
aatcatacaagtatatccttcataaygcaaacttcagtaaaggctatctc

SEQ ID NO: 50483 - DNA, 50 bp, homo sapien
ccatggtacatttgccagaactaagsagtaattgttaccacaatattagc

SEQ ID NO: 50484 - DNA, 50 bp, homo sapien
accaactgaaccctcctattctgaarcactccttacttaataggacatgt

SEQ ID NO: 50485 - DNA, 50 bp, homo sapien
ctcagatatatgtaataatagcatgmaagtgaattaaggagaagaaactt

SEQ ID NO: 50486 - DNA, 50 bp, homo sapien
ggggcaaacaaaatgcaacaattaartatgaacataacgtgaactatatt

SEQ ID NO: 50487 - DNA, 50 bp, homo sapien
gaggctaacatcggacactgtccagratctatctgttcaaccacctgaaa

SEQ ID NO: 50488 - DNA, 50 bp, homo sapien
agtagactttgatgagcacagagaaygctacgaaaattcagaaaatggag

SEQ ID NO: 50489 - DNA, 50 bp, homo sapien
agctaacaggattcttaaatgaatasaaatgagcagaccacacccaggca

SEQ ID NO: 50490 - DNA, 50 bp, homo sapien
cttcatatactcaacatcactaccaytaggtgttctcaacttgagatcca

SEQ ID NO: 50491 - DNA, 50 bp, homo sapien
tttttttcttagtgcctcagggttaytaaaaagatcaactgtaatggctt

SEQ ID NO: 50492 - DNA, 50 bp, homo sapien
gcacaaagcccttgttcaccgttccwcctgtctccatcactgctgccggc

SEQ ID NO: 50493 - DNA, 50 bp, homo sapien
attcaaaaatattcattgagtacctractatgtgagtaaaatacaattga

SEQ ID NO: 50494 - DNA, 50 bp, homo sapien
tatatttttccagaattaatgacackggcatttgtagcccacagatactg

SEQ ID NO: 50495 - DNA, 50 bp, homo sapien
tgtgacttacagagtcttaagtctgsaagggaatttagaagtaacaattg

SEQ ID NO: 50496 - DNA, 50 bp, homo sapien
gcagatggtaagtccgtgtgagttayagcatgtgtttagtgacactgctt

SEQ ID NO: 50497 - DNA, 50 bp, homo sapien
tgtgattgttccaaattataaccctraggcagtgaagataaagtgtgttt

SEQ ID NO: 50498 - DNA, 50 bp, homo sapien
tgacaggagttggaggtagctgagtyaattgtattctaggagtgcaataa

SEQ ID NO: 50499 - DNA, 50 bp, homo sapien
ttcatttgaaatgggacacttgaatsagtttttttatcatttatatcaaa

SEQ ID NO: 50500 - DNA, 50 bp, homo sapien
tattataatattataatgcaccgggyaagagaatatgtgctttatataca

SEQ ID NO: 50501 - DNA, 50 bp, homo sapien
aggagttactaaagtggacaagtgcracgggatggagagcacagtacatt

SEQ ID NO: 50502 - DNA, 50 bp, homo sapien
ataccagattggtatcaatccagtaygaaattgccaataatcagcagcaa

SEQ ID NO: 50503 - DNA, 50 bp, homo sapien
tctgccattccgtatgtcatctggaktaagtgtcaacttctcagtctcaa

SEQ ID NO: 50504 - DNA, 50 bp, homo sapien
acaaaagtcagccaaccactaacctkaacaatattgtcttccaattgatg

SEQ ID NO: 50505 - DNA, 50 bp, homo sapien
ttttgtattattaaaatatcctcacwcttatgaaattatggtaataatag

SEQ ID NO: 50506 - DNA, 50 bp, homo sapien
gaaagttcagtgcattgctgtgtaartctactggggctcccataacagaa

SEQ ID NO: 50507 - DNA, 50 bp, homo sapien
tgtgcagtttattatcaagtacctgmcacttagaaagccatatgttctat

SEQ ID NO: 50508 - DNA, 50 bp, homo sapien
gtcttatgaaactatggtgataatasaagctagtttgggatgatgtggat

SEQ ID NO: 50509 - DNA, 50 bp, homo sapien
attaggattatacctaattctaatartacctaattccttgaatgttgaaa

SEQ ID NO: 50510 - DNA, 50 bp, homo sapien
ggattaaagtaagtactttactccaraattaccataacaataattaccta

SEQ ID NO: 50511 - DNA, 50 bp, homo sapien
gctgttgcatacctgactttttacawaattctaacatagattagctttat

SEQ ID NO: 50512 - DNA, 50 bp, homo sapien
aagcttcttatccactgaatcgaaaygtcacctttgttacacatcaaact

SEQ ID NO: 50513 - DNA, 50 bp, homo sapien
caaaaatcaaacaacctgattgaaaracagaccaaggacctaaataggtt

SEQ ID NO: 50514 - DNA, 50 bp, homo sapien
aatgtagcctgctcatctgtaaaacrgaaaattcacttatacaatgtaaa

SEQ ID NO: 50515 - DNA, 50 bp, homo sapien
gtttctgctgcccgaggagagcgaaygtgggcatcgagacctggtttcca

SEQ ID NO: 50516 - DNA, 50 bp, homo sapien
tggtagaaacatgcactgaagtttgragagttactcagtgcacaaagtag

SEQ ID NO: 50517 - DNA, 50 bp, homo sapien
cacagtaaacatgagaaattcatggscatcctcctgctcacctctatgga

SEQ ID NO: 50518 - DNA, 50 bp, homo sapien
tctcactttccttccgctctgggcayggctctctgtccgccaacctgtgc

SEQ ID NO: 50519 - DNA, 50 bp, homo sapien
attaacaggggagaactgcccagaaygggtttggaggcacaggttggcgg

SEQ ID NO: 50520 - DNA, 50 bp, homo sapien
cagcccttgcccacctccctctctayagtctagtaacagttgccgggcca

SEQ ID NO: 50521 - DNA, 50 bp, homo sapien
ttattagaccatgtttgcttaatackaatttgtcagttagaatatgtttc

SEQ ID NO: 50522 - DNA, 50 bp, homo sapien
tcaccagatacaattttagtcttackgaagctgatttctttgcttctagt

SEQ ID NO: 50523 - DNA, 50 bp, homo sapien
gagtgatggaaatgcttcttaacatwatctggtgtgtgtgtgtgtgtgtg

SEQ ID NO: 50524 - DNA, 50 bp, homo sapien
caaaacattggacagttgcttcataraagaagatatccatataaccaact

SEQ ID NO: 50525 - DNA, 50 bp, homo sapien
gttaattctgcatcactctataaagkcgtggctacgaagtctcaggtaat

SEQ ID NO: 50526 - DNA, 50 bp, homo sapien
tggtaagacaaccaggtaaattaggracaaagatttgtaatcacacaaac

SEQ ID NO: 50527 - DNA, 50 bp, homo sapien
acaatgacaactaagcaaaggcatgkaccattttataatatatgcagggt

SEQ ID NO: 50528 - DNA, 50 bp, homo sapien
gtatgtaacatttaattatgaggaamagtcaatttatataccactccgaa

SEQ ID NO: 50529 - DNA, 50 bp, homo sapien
gcagtcatacacagaatcatggggtraatgcctaagcggtgtttcagaga

SEQ ID NO: 50530 - DNA, 50 bp, homo sapien
tgaccatattgacatcatggaaatayctactgggccgtgatggtttacac

SEQ ID NO: 50531 - DNA, 50 bp, homo sapien
aaataataacaaatatgttgttatgyatcttgcctcacaccatccttcaa

SEQ ID NO: 50532 - DNA, 50 bp, homo sapien
tttcttttcttcttctcaggatcccrgagcactctagtcaccaaagcttt

SEQ ID NO: 50533 - DNA, 50 bp, homo sapien
ttctgaggaagaaaaagagaagtagrccctaaaaatgtgggtatatgatc

SEQ ID NO: 50534 - DNA, 50 bp, homo sapien
ggtacttggcagatttaacctttcaraatagcctgaggcattatgtttgg

SEQ ID NO: 50535 - DNA, 50 bp, homo sapien
tccacagatgaaatccaaggttaaartgggagagtatgacaggcacttag

SEQ ID NO: 50536 - DNA, 50 bp, homo sapien
ctttagattcccattctgtgtaaaaygatggatatttattcccagcccct

SEQ ID NO: 50537 - DNA, 50 bp, homo sapien
tttctcagcactgcagggaggaataygtttgagagaaacctgcctacctc

SEQ ID NO: 50538 - DNA, 50 bp, homo sapien
gatgtaaattctgcccaagttgaccraaacctgcaatgtaattccaaaca

SEQ ID NO: 50539 - DNA, 50 bp, homo sapien
ctcagaattaagacttgctcaggaaygtaactgctaccagcctagtgtga

SEQ ID NO: 50540 - DNA, 50 bp, homo sapien
gaatacgagattttagaatcgtgatyagtttatcttggctgagtctaatt

SEQ ID NO: 50541 - DNA, 50 bp, homo sapien
taatagtctctagttccgtccaagtkactgcagaagacattattttgcct

SEQ ID NO: 50542 - DNA, 50 bp, homo sapien
gctgtccacaggattctttgagttaygtaagaaatgatgtctgactttgg

SEQ ID NO: 50543 - DNA, 50 bp, homo sapien
gtgctctgtactcgggggtcgacaaygttaatcacccacaaactgtgttt

SEQ ID NO: 50544 - DNA, 50 bp, homo sapien
ttttatcttatttcatggaggaaagmatcttttataaaataacacccttg

SEQ ID NO: 50545 - DNA, 50 bp, homo sapien
actctccaaaggaattatgtttatayagtgaaaattatatgcaatactgg

SEQ ID NO: 50546 - DNA, 50 bp, homo sapien
ttttcacaacttaagctgcaaataakagatgttaggccattcatttttct

SEQ ID NO: 50547 - DNA, 50 bp, homo sapien
gagaagggacatagatctggccagasagaagacctcttaaccccaggccc

SEQ ID NO: 50548 - DNA, 50 bp, homo sapien
tgatcaaaagaattgagaaatacacmataatagctggagattttaacaca

SEQ ID NO: 50549 - DNA, 50 bp, homo sapien
ttctgaattattattatcgcaatacrctgtcttgttttattttcatattc

SEQ ID NO: 50550 - DNA, 50 bp, homo sapien
tgccctaaggagcttataatcggtayggaaacattcattgaaatcgagcc

SEQ ID NO: 50551 - DNA, 50 bp, homo sapien
tagttcttcctttgtccaaactgtcrccctgataaccacacccatttctt

SEQ ID NO: 50552 - DNA, 50 bp, homo sapien
acgtgttctctttactccagaatgaragaaggtcagagctggaagggctt

SEQ ID NO: 50553 - DNA, 50 bp, homo sapien
agactccgcagcaaataaatcatggraacgaacaatatgtccttaaacca

SEQ ID NO: 50554 - DNA, 50 bp, homo sapien
aacttaaaatactagtgattacttawagagacattaatattcacatgcct

SEQ ID NO: 50555 - DNA, 50 bp, homo sapien
caccctctaaaataagaacagtaccraaagacaggatgtaaaataagggc

SEQ ID NO: 50556 - DNA, 50 bp, homo sapien
tggctagttctacctaatcgtccatmaatgctacttacacctttggccaa

SEQ ID NO: 50557 - DNA, 50 bp, homo sapien
gcaaggtagtgtaaatgatttcctawatgcctgtattgcagtggatcttt

SEQ ID NO: 50558 - DNA, 50 bp, homo sapien
tgacagagaaacactcaaaggaatgyataacgctgcttaaaacatatctg

SEQ ID NO: 50559 - DNA, 50 bp, homo sapien
ctcaaataaaagtcatttgaggacakagatcaaaccttgtatttattctg

SEQ ID NO: 50560 - DNA, 50 bp, homo sapien
ctggacctcctctctggctagtggaygagatgcatcagagagaaacagag

SEQ ID NO: 50561 - DNA, 50 bp, homo sapien
actaaacctaaaaacgattcttgggwatgaaaagagcaaagtgaatcaac

SEQ ID NO: 50562 - DNA, 50 bp, homo sapien
catattcaaaagatattgtcacttaygggcaaactgatgtctataaaatt

SEQ ID NO: 50563 - DNA, 50 bp, homo sapien
atgtgagctttgagcttatgtctaaygcaatatcatgtgtccgactgagg

SEQ ID NO: 50564 - DNA, 50 bp, homo sapien
aagtcttgaatctgctaagacagatsacttgctattttacctgaagtcta

SEQ ID NO: 50565 - DNA, 50 bp, homo sapien
attcggaaagcaagtataggcagatmagttgatgtcagctccctgccaaa

SEQ ID NO: 50566 - DNA, 50 bp, homo sapien
tggtattagaaggtcactgccttagwcattacttatcttcaacatcaatt

SEQ ID NO: 50567 - DNA, 50 bp, homo sapien
ttataatggaaaccctgacaggcaargttgtaattacggttgtgccataa

SEQ ID NO: 50568 - DNA, 50 bp, homo sapien
cttcccttagtacatcggtatgtaawctatagtacatctttgctcaggct

SEQ ID NO: 50569 - DNA, 50 bp, homo sapien
atgtatgtaccttaacaatgcagaawttccacctatgaggaccacaccag

SEQ ID NO: 50570 - DNA, 50 bp, homo sapien
ttctggctaagaaatggaatgctaaygattattcaggaattttcttgaac

SEQ ID NO: 50571 - DNA, 50 bp, homo sapien
acgtcccaatgtccggtatatttcayctttgataaccactcatatgggca

SEQ ID NO: 50572 - DNA, 50 bp, homo sapien
cagtcatctttgtcttcttgaagackgagatgaacagagaaagtgactcg

SEQ ID NO: 50573 - DNA, 50 bp, homo sapien
gggctgggcctacacagtatctggcrgagtgtttacagcgtaatcagatc

SEQ ID NO: 50574 - DNA, 50 bp, homo sapien
gaattcagagcacttgttatattgaygtcactaaaaacaaaatgcaatct

SEQ ID NO: 50575 - DNA, 50 bp, homo sapien
agtcaagttccatgtgcggcgactcyaatgccaacctcttagaatatttt

SEQ ID NO: 50576 - DNA, 50 bp, homo sapien
ccagagcaacacagtggctcaaagamgatgtgtgtgtacattttgtgttt

SEQ ID NO: 50577 - DNA, 50 bp, homo sapien
gggcagtcggccttcctttcttggaygtgcaaagcgacttagttgggatt

SEQ ID NO: 50578 - DNA, 50 bp, homo sapien
agcagtcaccagaagtgaatgtttasacgctagtttgggtcatgtttttc

SEQ ID NO: 50579 - DNA, 50 bp, homo sapien
aaccagagagaggatgataaagggaraaacatgacccaaactagcgtcta

SEQ ID NO: 50580 - DNA, 50 bp, homo sapien
ttcaagagatccatgatgacaaaccrctaaattggataactcccaaagca

SEQ ID NO: 50581 - DNA, 50 bp, homo sapien
ctggagaagtgtgtcaatatcaatcyatttgcaaggtaagagtgtaccca

SEQ ID NO: 50582 - DNA, 50 bp, homo sapien
atgtcaagctggccagagtgtaactsagaatgacaaatgttactgcccgg

SEQ ID NO: 50583 - DNA, 50 bp, homo sapien
tggctccggagaacaaaaatactgaraagattgttcctgggtcctctcta

SEQ ID NO: 50584 - DNA, 50 bp, homo sapien
tgtgtttctttaccactgggacactyaattacattcagctactgtgtatg

SEQ ID NO: 50585 - DNA, 50 bp, homo sapien
actcagaataatggcacatcataagrctctgtaaatatctgttaatccca

SEQ ID NO: 50586 - DNA, 50 bp, homo sapien
gggctttgtgcaaatcaagatagaakggaatgattatatgtggaattaat

SEQ ID NO: 50587 - DNA, 50 bp, homo sapien
caggccttgatgcatgtagtttcacyggataagaacaggctttggtctgt

SEQ ID NO: 50588 - DNA, 50 bp, homo sapien
ggtctctttgggtcaaaggtaaacasaaagtcttagaattttctttagaa

SEQ ID NO: 50589 - DNA, 50 bp, homo sapien
aagaaactattaagtggaaaagttaraggcataaagaattgtcggtggtt

SEQ ID NO: 50590 - DNA, 50 bp, homo sapien
tgagacagtttccttgtaagacagastaaaatcacacctgccatctagag

SEQ ID NO: 50591 - DNA, 50 bp, homo sapien
acagaggaagctcttctgataaagcraccttgcaatgcaacatgtataaa

SEQ ID NO: 50592 - DNA, 50 bp, homo sapien
ctttatggagaagttgggatcttcascggatagaaaaagcagaaaacaaa

SEQ ID NO: 50593 - DNA, 50 bp, homo sapien
tatattgacttaaaatatccgaacastattacaaagtaaaaaggagcaaa

SEQ ID NO: 50594 - DNA, 50 bp, homo sapien
ttttgagatttttataactgcagtgsaacacaattctgggtagagtagaa

SEQ ID NO: 50595 - DNA, 50 bp, homo sapien
cccatgctctcatgtggctcagaatwattctccgtactgccactcttctt

SEQ ID NO: 50596 - DNA, 50 bp, homo sapien
aaagctgatccatgtgttgaagtatyacaggtagttaggcataagcccgg

SEQ ID NO: 50597 - DNA, 50 bp, homo sapien
tctaagagaataagtagtttattaarggcagcaagtgtcaacaccaagat

SEQ ID NO: 50598 - DNA, 50 bp, homo sapien
atattttcattttcgctttgtggaartaccctatgctcttccttaaaatt

SEQ ID NO: 50599 - DNA, 50 bp, homo sapien
atagttggataattgctccagataaktgcttttaatgacatgaatgttgg

SEQ ID NO: 50600 - DNA, 50 bp, homo sapien
attctttctgagaatcaggctcatayctggacagggtcagacatctgtgg

SEQ ID NO: 50601 - DNA, 50 bp, homo sapien
tatctgaattttctttcattttgcaytaaacctatagtgacttgtcattg

SEQ ID NO: 50602 - DNA, 50 bp, homo sapien
atttttctttaacatacatgggacascaaactatggaaagcacgtaggta

SEQ ID NO: 50603 - DNA, 50 bp, homo sapien
tttaaaataattacctatttgccttsaagataaagaagaaaacaatacct

SEQ ID NO: 50604 - DNA, 50 bp, homo sapien
gtaatcaatgcccctccaaaacgcawagaatagagaaaaaatagcaaggc

SEQ ID NO: 50605 - DNA, 50 bp, homo sapien
taagacttacgtccaaacgacaaaayaacttgaaagtttaatggaaccat

SEQ ID NO: 50606 - DNA, 50 bp, homo sapien
aaatgatctcatttcaagaaaatgamgaccttaaaacgaaacgtacacag

SEQ ID NO: 50607 - DNA, 50 bp, homo sapien
gactgggtccttaagatcaacgccakagcatctcttagtgatgttgaata

SEQ ID NO: 50608 - DNA, 50 bp, homo sapien
actaaataatttgtttcctgttttayattgtttgcgtagaagagggggtg

SEQ ID NO: 50609 - DNA, 50 bp, homo sapien
tttttttttttgtatctttctaaatsaatgtagcctattgttctttatta

SEQ ID NO: 50610 - DNA, 50 bp, homo sapien
acatatagtacctggggtaaattcayggtaagagatccttagttaaatat

SEQ ID NO: 50611 - DNA, 50 bp, homo sapien
aatttaccccaggtactatatgtttwaaaatgttcatcatatattcattt

SEQ ID NO: 50612 - DNA, 50 bp, homo sapien
actctaccacctctgaggaaccatasacagaagagtatcattgaattatt

SEQ ID NO: 50613 - DNA, 50 bp, homo sapien
taaagctttcactgatgggttttccrgcattgtagacctctcctgtgtca

SEQ ID NO: 50614 - DNA, 50 bp, homo sapien
tgctggagaatgtcagttccgacagyaaatttaaattgtattgattttgc

SEQ ID NO: 50615 - DNA, 50 bp, homo sapien
atatattttatgtggaacagctggaratttattagatttttaataaaaag

SEQ ID NO: 50616 - DNA, 50 bp, homo sapien
ccataaacaccaattttaagagtaasaacactgcttgcaactcaggttca

SEQ ID NO: 50617 - DNA, 50 bp, homo sapien
cttttatagaaaatgcccaacatagrattaaataatgctagacatacaaa

SEQ ID NO: 50618 - DNA, 50 bp, homo sapien
taatactagagtgcatatttggtccyaagttactgttgaaattgttgtgt

SEQ ID NO: 50619 - DNA, 50 bp, homo sapien
taaaactgaaagcatacggtattagsaaaaacaagtcttatcagtatcca

SEQ ID NO: 50620 - DNA, 50 bp, homo sapien
aactttattaaagcactacagctcaycattcaaataaagtttataggtgg

SEQ ID NO: 50621 - DNA, 50 bp, homo sapien
ttagcaaagtacagctcaatctaaaygatgcattggaaaggaaactccac

SEQ ID NO: 50622 - DNA, 50 bp, homo sapien
ttgcccagatttgtatagcattaccygagcgtaacattacccaacaaagc

SEQ ID NO: 50623 - DNA, 50 bp, homo sapien
tctacatatgtgatgttaacgtcaayatccctgctataaagacagaaata

SEQ ID NO: 50624 - DNA, 50 bp, homo sapien
gaacatttcaatctgatgttggagaygatgtgtgacttttctagtatttc

SEQ ID NO: 50625 - DNA, 50 bp, homo sapien
ccgtatttaaattttcttttagacaraactatgaactaagaaggaaagaa

SEQ ID NO: 50626 - DNA, 50 bp, homo sapien
ctatagagattaaaggtacccaacayataaccagtgctacaaaattgtca

SEQ ID NO: 50627 - DNA, 50 bp, homo sapien
taagagattttcactcggaatatgaygaagagcctttctaacgttacgtt

SEQ ID NO: 50628 - DNA, 50 bp, homo sapien
attcccacaggctttgggccttacgsaaacaatcaatactggtgcagacc

SEQ ID NO: 50629 - DNA, 50 bp, homo sapien
ttttcataaggctaaatgtatattaygtaaactaaaggaatgttctttat

SEQ ID NO: 50630 - DNA, 50 bp, homo sapien
taaggagagacatcttattgataaartggcccaattcacaagaaagatta

SEQ ID NO: 50631 - DNA, 50 bp, homo sapien
tcaataagaatatgtagagtcaacayagtagaaaaatgggcaagagttac

SEQ ID NO: 50632 - DNA, 50 bp, homo sapien
tcacagcatttatttattataaggasactaaatgaaacactgaattcatt

SEQ ID NO: 50633 - DNA, 50 bp, homo sapien
cctaacttaaaatcgagaaacagcaygaatattgaaggagtttgaccaca

SEQ ID NO: 50634 - DNA, 50 bp, homo sapien
aaaatgcattttctccagaggcttcragctctatattccaagctataata

SEQ ID NO: 50635 - DNA, 50 bp, homo sapien
tttgaatcaaatcatataggatactractactgtcttaatacatttggac

SEQ ID NO: 50636 - DNA, 50 bp, homo sapien
actaatgtcaaagaaattatctctcyagcaataaactagatggcaattta

SEQ ID NO: 50637 - DNA, 50 bp, homo sapien
aaatatgaggttagactaggcaaaamgattaggtcagtggtagttttact

SEQ ID NO: 50638 - DNA, 50 bp, homo sapien
aaagttatttggctcctagagaagcrgatgaataaattgaactcatacag

SEQ ID NO: 50639 - DNA, 50 bp, homo sapien
ttatagaatattttagtacctaatgracgttaaaatagttctttttatga

SEQ ID NO: 50640 - DNA, 50 bp, homo sapien
acagtagaaaaatgggcaagagttaygaagaaatcaacaagtgaaattct

SEQ ID NO: 50641 - DNA, 50 bp, homo sapien
gcctagaaaataaagaccaggaagayggagagtacttcacctgcagccag

SEQ ID NO: 50642 - DNA, 50 bp, homo sapien
atcataaaatgaggaatattaattcrcttgcaggacagatttttaaagac

SEQ ID NO: 50643 - DNA, 50 bp, homo sapien
cagactttgaatgggttatgaaaacygagaagatacaagcagacttccga

SEQ ID NO: 50644 - DNA, 50 bp, homo sapien
tggttaaaagatattcagagaaaagwcttaaaatctgagaagggcaaatg

SEQ ID NO: 50645 - DNA, 50 bp, homo sapien
tttaagcttctcaaaacacttgaatsaaatggtgataagtccaagatggc

SEQ ID NO: 50646 - DNA, 50 bp, homo sapien
ttaaaataaagaccagcttttgtaaycttctgggagtagcataatcagat

SEQ ID NO: 50647 - DNA, 50 bp, homo sapien
ctaagaaataagaaaagtagaaagtsaaagatgtattgcatttttaagta

SEQ ID NO: 50648 - DNA, 50 bp, homo sapien
ttacagttcatacccatgtaaatcaygtagttttctttctctggaatata

SEQ ID NO: 50649 - DNA, 50 bp, homo sapien
aaagcactatcttacttttgcttacygcatatgactttattccaaactta

SEQ ID NO: 50650 - DNA, 50 bp, homo sapien
ctgttcatgcaaaacttgagctatasagacagcatgtgtaatgtattagt

SEQ ID NO: 50651 - DNA, 50 bp, homo sapien
ggtatactcacttggaaaatacaacscttacatgcatttttttgcaatat

SEQ ID NO: 50652 - DNA, 50 bp, homo sapien
tatctctctgtctgttgttaaactaygatgacatgtctgtagctatcaga

SEQ ID NO: 50653 - DNA, 50 bp, homo sapien
cctgttatgcagatgtgtaattcaamgactacccacttggtcaaaccatc

SEQ ID NO: 50654 - DNA, 50 bp, homo sapien
cacatctgccatttggtgtagagcckagtaagaactaatgctgcctcaaa

SEQ ID NO: 50655 - DNA, 50 bp, homo sapien
agtgcttttattctaaacattcaaarcagtcttaaatattacttaccggt

SEQ ID NO: 50656 - DNA, 50 bp, homo sapien
agaaggagggcataagagaatattakgagatatggcttctttctggatag

SEQ ID NO: 50657 - DNA, 50 bp, homo sapien
atatgtacatatttgaaggaagaacracaagatttcttgtttactgtgtg

SEQ ID NO: 50658 - DNA, 50 bp, homo sapien
taatcagaatgttttagcctaagaamtaagcagcctcttcatggttttgg

SEQ ID NO: 50659 - DNA, 50 bp, homo sapien
aaaggagagaaatataaaaagagaayagaacttcatggacaaataatgtc

SEQ ID NO: 50660 - DNA, 50 bp, homo sapien
tcaatttaagatatatcaaacaaacsattattttctatattcatgacatg

SEQ ID NO: 50661 - DNA, 50 bp, homo sapien
aaatagtcaaagcattttgcagatayaaacgaattaaccatctggaacca

SEQ ID NO: 50662 - DNA, 50 bp, homo sapien
aactggaatgaatcggagatctagayggttggaattcatgaacagggacc

SEQ ID NO: 50663 - DNA, 50 bp, homo sapien
actttcctttagggatgctaggatartacaactctgcaaattataaggta

SEQ ID NO: 50664 - DNA, 50 bp, homo sapien
tcaaggtaatgtcaaactcactgtayctgtcaatccactaagctggccac

SEQ ID NO: 50665 - DNA, 50 bp, homo sapien
attccatggtgtctcaacctgtggcyatcaataaaataatcaagccaagg

SEQ ID NO: 50666 - DNA, 50 bp, homo sapien
acataataaaaagaatttccataaaytgttttcaggatttcatcttatat

SEQ ID NO: 50667 - DNA, 50 bp, homo sapien
ccaatgaaacatttactgaagaaaayggcagaatcgtggtagtcaactgt

SEQ ID NO: 50668 - DNA, 50 bp, homo sapien
taattaaccttttacctggattcaargattgaggatttgatggaaagctg

SEQ ID NO: 50669 - DNA, 50 bp, homo sapien
tgagcaaaatggatatagtgggttargtttgctcgaaaatggatagtgtg

SEQ ID NO: 50670 - DNA, 50 bp, homo sapien
catctttgaatttcttatcacactartaaaacagctgataagatttccag

SEQ ID NO: 50671 - DNA, 50 bp, homo sapien
ctaaacgattaattgtataaattaasagcaagtacatatttccttagttt

SEQ ID NO: 50672 - DNA, 50 bp, homo sapien
gaaactatctgaaaaacatctgaatratatcaacctgtagatttgcacca

SEQ ID NO: 50673 - DNA, 50 bp, homo sapien
tgtccttagagaatgccactataacragtcttgcttgaatactatctaca

SEQ ID NO: 50674 - DNA, 50 bp, homo sapien
gcgggtgggggttaattatctgaaamctactaaaacggactacagttatc

SEQ ID NO: 50675 - DNA, 50 bp, homo sapien
tagttttttgaaaggcaacgtctttmaaaactatgtagtacaatatcaca

SEQ ID NO: 50676 - DNA, 50 bp, homo sapien
attttcagcaggtattagtcctggartaagttgcatttcattaaaatatg

SEQ ID NO: 50677 - DNA, 50 bp, homo sapien
ctaacagtaattgtcttatgccaggraattattggaggagaggggagaac

SEQ ID NO: 50678 - DNA, 50 bp, homo sapien
gttttccactccacagtaatactcaratatgttgcttgaagctttttaag

SEQ ID NO: 50679 - DNA, 50 bp, homo sapien
cactcatttactgctcattggaattkaaacttggagagccaatgtggacc

SEQ ID NO: 50680 - DNA, 50 bp, homo sapien
gattctctcctcaataagattcatayacagcattctacttagaaaatatt

SEQ ID NO: 50681 - DNA, 50 bp, homo sapien
acagtcttaacatacatttctcatcrcgctcaagggactctttgtgtaca

SEQ ID NO: 50682 - DNA, 50 bp, homo sapien
gtcacttcaaatcactatacttacartgcttgctgatggaaatgtctgaa

SEQ ID NO: 50683 - DNA, 50 bp, homo sapien
attgaaagtatcaccagtgaaacaaygaggaactgttactaatgaagcaa

SEQ ID NO: 50684 - DNA, 50 bp, homo sapien
taattgaaagtacagttaagggagaygtttttagccatgtgaagctcaat

SEQ ID NO: 50685 - DNA, 50 bp, homo sapien
aaagaataattgtgtgaaatcattaygttctactgcaaaaatacaccagg

SEQ ID NO: 50686 - DNA, 50 bp, homo sapien
catgtgaagctcaatacactccctamaaataaatgtgccaagcttaattt

SEQ ID NO: 50687 - DNA, 50 bp, homo sapien
attccccatgcttggtaagccacgcmaaactagacctcacagagcggaga

SEQ ID NO: 50688 - DNA, 50 bp, homo sapien
gcagccaaaatttattttattttagkatgggtagatacaggaagggctag

SEQ ID NO: 50689 - DNA, 50 bp, homo sapien
gaaaactcccttgtctactcacgatmaggaaatacaaaggagcagtattt

SEQ ID NO: 50690 - DNA, 50 bp, homo sapien
ggtatttgcagtaaatgtaagctcaraaactatttatttcaaaccatagg

SEQ ID NO: 50691 - DNA, 50 bp, homo sapien
aatgctattctacaattcttctacarctatttattgggtacctataatgt

SEQ ID NO: 50692 - DNA, 50 bp, homo sapien
ttcatgaatattattgttgtaaatgsaagtagctctgaataagaaataat

SEQ ID NO: 50693 - DNA, 50 bp, homo sapien
tatgctgcctttaacatcagtaacaygtggcgttcataagtgtctgtttg

SEQ ID NO: 50694 - DNA, 50 bp, homo sapien
agaaatgcccgaggtgcttttagaayggagaacaattggtaaattcatgc

SEQ ID NO: 50695 - DNA, 50 bp, homo sapien
taaattttaaaacatgaatagcaaartagatgaaggggaaaaagagtgga

SEQ ID NO: 50696 - DNA, 50 bp, homo sapien
agttttattttaatcatacttagaayaattgtgaaaatacatgtaatata

SEQ ID NO: 50697 - DNA, 50 bp, homo sapien
gtttcttcagaagttttgagttgtcratctttcttaccatgttttgtctt

SEQ ID NO: 50698 - DNA, 50 bp, homo sapien
gtttcctcctattttacttttagaaygcctaatggtaggaagagaagtag

SEQ ID NO: 50699 - DNA, 50 bp, homo sapien
aaattggatactctttttgttaataygacacatccttgggcaaggaagaa

SEQ ID NO: 50700 - DNA, 50 bp, homo sapien
aagaacaggaagagcagtgcacaaawatgttctgtcgagctgaggatatc

SEQ ID NO: 50701 - DNA, 50 bp, homo sapien
tagacctagtactttccttgttaaayttgttccttacatttcataccccc

SEQ ID NO: 50702 - DNA, 50 bp, homo sapien
gtgagacaggtgacattatgtaaccrctgggtcttcctgacttcctctcc

SEQ ID NO: 50703 - DNA, 50 bp, homo sapien
agtacaatacacttggtgtttctcayatcttgcatataatctaaggaaaa

SEQ ID NO: 50704 - DNA, 50 bp, homo sapien
attatgttgacagatttcctggtaamaaatcatcattacatgtctgaaat

SEQ ID NO: 50705 - DNA, 50 bp, homo sapien
tgtcatacatgttagccatgatcatyaaattctttcctttttcacttagt

SEQ ID NO: 50706 - DNA, 50 bp, homo sapien
tgaaagtatttacatgcgtttcatartaaattccggccaagctgaagtaa

SEQ ID NO: 50707 - DNA, 50 bp, homo sapien
actaaaaatgcttgcccttcctatartagtgtaaaaagaccagttgattt

SEQ ID NO: 50708 - DNA, 50 bp, homo sapien
atttgtcacgttcttctttttcttgwatcatgtgattttcgtataaatgc

SEQ ID NO: 50709 - DNA, 50 bp, homo sapien
ttccaaaagtagctatcaatgcaaaygagcgtttatttcaaatagttttc

SEQ ID NO: 50710 - DNA, 50 bp, homo sapien
aacttaagaagtagtaaaagtggtasagactataatcccaagctaataaa

SEQ ID NO: 50711 - DNA, 50 bp, homo sapien
aatcagaggtaatgctgtatccctaygatgatatcaggaagtacaggtgt

SEQ ID NO: 50712 - DNA, 50 bp, homo sapien
ggtattggaattatatcacctgtcaractaggataaacagaagatgatac

SEQ ID NO: 50713 - DNA, 50 bp, homo sapien
aataggaaagaaatctctcccggcayctcaaagtcggtaaaactacaagc

SEQ ID NO: 50714 - DNA, 50 bp, homo sapien
catgccacaaaatgactttttttcayggcttcataagtttgcaaatgttt

SEQ ID NO: 50715 - DNA, 50 bp, homo sapien
atatttagatgggaatttgagcatamaatttgtgtttaattctataaaaa

SEQ ID NO: 50716 - DNA, 50 bp, homo sapien
ttagttattttgctatttccttttcyaagcaatttgaggtgatcacatca

SEQ ID NO: 50717 - DNA, 50 bp, homo sapien
tattttttacattgaaggcatatgaygtaactttagtgtgttaactttct

SEQ ID NO: 50718 - DNA, 50 bp, homo sapien
catgttctttttctggtttggctaamgtgagacatttttcaggcttgagt

SEQ ID NO: 50719 - DNA, 50 bp, homo sapien
cttaactccaaactccatcctttgargttaagattagctgaggactcttg

SEQ ID NO: 50720 - DNA, 50 bp, homo sapien
tagttaataatataagcatcctgaaraagttcatgtaaaacttacactct

SEQ ID NO: 50721 - DNA, 50 bp, homo sapien
cttgctggcacatagtaaaaatggarctcagaaattttattttccagccc

SEQ ID NO: 50722 - DNA, 50 bp, homo sapien
cagttatgcagacagaaagctcactraccagtgtcaaataaaaaggaaat

SEQ ID NO: 50723 - DNA, 50 bp, homo sapien
gaaattgatcctagactctggatcgycaatgtggtccagctcttgtggaa

SEQ ID NO: 50724 - DNA, 50 bp, homo sapien
ataacaacagatggaatttttaataygtcttgaagatcccaaataggagg

SEQ ID NO: 50725 - DNA, 50 bp, homo sapien
tccaaagaatatagtacggaaataayagaggttcatgatgtactatgcta

SEQ ID NO: 50726 - DNA, 50 bp, homo sapien
tcctggctgatttgaacggctggtamaataaatgagcaattttagtatta

SEQ ID NO: 50727 - DNA, 50 bp, homo sapien
accacaatcactaaagaaaactctcrccaggaggtagcttcatttgcatt

SEQ ID NO: 50728 - DNA, 50 bp, homo sapien
tttacatctactgtactgtgtcactwaaaaatataacaggaacaaaaaac

SEQ ID NO: 50729 - DNA, 50 bp, homo sapien
tcttacgtcattttctttgttaatayggttctcatttaactgtccaagcc

SEQ ID NO: 50730 - DNA, 50 bp, homo sapien
ggcggaggtaacccacaaaaccagaygaagggatactaacaaagaaatga

SEQ ID NO: 50731 - DNA, 50 bp, homo sapien
caagaactctgaaataatctaaaacmattttgacacgtaactgtactatt

SEQ ID NO: 50732 - DNA, 50 bp, homo sapien
tatttctaaaagccattcaaaagtamgaaccaggtcatatgtaggaggat

SEQ ID NO: 50733 - DNA, 50 bp, homo sapien
cctgctctttagtgtatctggcgaargttatcatattttcttaacgagat

SEQ ID NO: 50734 - DNA, 50 bp, homo sapien
agatgaagaaatgtagtcattaagartaagttaagtccgatcggtatatt

SEQ ID NO: 50735 - DNA, 50 bp, homo sapien
aaggactccttgcgatcaaagggacrccagagaaaaggtggaggctgaat

SEQ ID NO: 50736 - DNA, 50 bp, homo sapien
ggtatcaattgcaggatatgtttacrcttagaaacttcattactcacatc

SEQ ID NO: 50737 - DNA, 50 bp, homo sapien
atcttaggaaaatatatttcatccaygtttgatcattcagcaatgcagta

SEQ ID NO: 50738 - DNA, 50 bp, homo sapien
gaatgagtgtgaacattgattgttasaaagcatagctgctaaaaatcaga

SEQ ID NO: 50739 - DNA, 50 bp, homo sapien
acttctgtctttcatcatgtaatatmacctgccctcagcactacttttta

SEQ ID NO: 50740 - DNA, 50 bp, homo sapien
ttagtataaatccatgcatttggacmctattcctaaatataatcatatct

SEQ ID NO: 50741 - DNA, 50 bp, homo sapien
cagcatgatcaatgacggcccttaaytgaagtgcacactaaaaagaatgt

SEQ ID NO: 50742 - DNA, 50 bp, homo sapien
tgttaatatgtaaatgttctcaaaayttgtcttataaatgcatgtgacac

SEQ ID NO: 50743 - DNA, 50 bp, homo sapien
aactgtcatcaaagggtttgtataaytctttcctttatgcctcaacaata

SEQ ID NO: 50744 - DNA, 50 bp, homo sapien
ttggagctactctgagatcatggaamcactgtcattaatttttgagaaat

SEQ ID NO: 50745 - DNA, 50 bp, homo sapien
ctgtatgtctttattcaattgtaaasatatgaggctgagaacaaagattc

SEQ ID NO: 50746 - DNA, 50 bp, homo sapien
acccagagaccagaaggtcttggagyagccaaaataaacatttttatcag

SEQ ID NO: 50747 - DNA, 50 bp, homo sapien
gtcttctagtgttaaatgcgctaaasaccactaaaggctccataggcttc

SEQ ID NO: 50748 - DNA, 50 bp, homo sapien
ctagaaaataaatttttgaaaatacsagtcacttttacaaagatatgcct

SEQ ID NO: 50749 - DNA, 50 bp, homo sapien
agtttgggaatccctggtagaattayaaacatagtagacgagaatgatag

SEQ ID NO: 50750 - DNA, 50 bp, homo sapien
ttctgccacaaatatagacaaaggasaaaagataaaataaaaaacccgtg

SEQ ID NO: 50751 - DNA, 50 bp, homo sapien
atgtttaaaatcttttaggatccatmatctgtgaaagaaatgtacaaagt

SEQ ID NO: 50752 - DNA, 50 bp, homo sapien
tccccaaatagttccaagccaaatayatctgtcactaaaacaacaacaaa

SEQ ID NO: 50753 - DNA, 50 bp, homo sapien
ttttgagggttgaataaagagcgaaraagatttgagaattctgcgtgctt

SEQ ID NO: 50754 - DNA, 50 bp, homo sapien
ttctggatgacataagccataaaaarttaagaaacatttcagaaacatta

SEQ ID NO: 50755 - DNA, 50 bp, homo sapien
ctgtggagatttaaagaaagggtgaytattcagaagagagaattcacagg

SEQ ID NO: 50756 - DNA, 50 bp, homo sapien
gtcctgtcccacaactttcatcaacrctaccataaggtcatagacagacc

SEQ ID NO: 50757 - DNA, 50 bp, homo sapien
cagagatatctctttgctctgcagaycctaagtggaagttaaggtactga

SEQ ID NO: 50758 - DNA, 50 bp, homo sapien
ccagtttttatccctcaaattgatayaacttgaaaaacccaaattacaat

SEQ ID NO: 50759 - DNA, 50 bp, homo sapien
tgttgtatccctacacatcaatatayctttcgcttccatactatctggtt

SEQ ID NO: 50760 - DNA, 50 bp, homo sapien
aatgcattgtttatttactttttcaygtaattctcagaaaagcctagtga

SEQ ID NO: 50761 - DNA, 50 bp, homo sapien
tgcactgaggaaattgtttttctgayagttggtaggttctatagttaaaa

SEQ ID NO: 50762 - DNA, 50 bp, homo sapien
aaatgattagaacaggactgcaaaarggaaaaattaagtcaaattgtatc

SEQ ID NO: 50763 - DNA, 50 bp, homo sapien
gaaagagtgtaccctacaatctcccraggcatatcttttcttctgaactc

SEQ ID NO: 50764 - DNA, 50 bp, homo sapien
ctgttcaacaaactgtcagtttctckaaaagatcaagacttaagacattt

SEQ ID NO: 50765 - DNA, 50 bp, homo sapien
tcaatgaaataaaacataaaatagayataaaccaacaacagcaaaaaaga

SEQ ID NO: 50766 - DNA, 50 bp, homo sapien
agtggcttcccatcactcttacagtsactctttgaataactaaacttctt

SEQ ID NO: 50767 - DNA, 50 bp, homo sapien
cctgtaaaattaggaactttgggtaragtcaatgaaataaaacataaaat

SEQ ID NO: 50768 - DNA, 50 bp, homo sapien
cctagagaagaaaaacaaaagactayggatgatttttctcccctttcatt

SEQ ID NO: 50769 - DNA, 50 bp, homo sapien
tgtttgacaaaacaatgatggatccratattagaagttaagctaagtacc

SEQ ID NO: 50770 - DNA, 50 bp, homo sapien
gaatgacattactatgattgatgtgkacaatagcaattcgctccctacaa

SEQ ID NO: 50771 - DNA, 50 bp, homo sapien
taacccatgtccataacaattcttasgctctcatattgctgaggtgatca

SEQ ID NO: 50772 - DNA, 50 bp, homo sapien
atgagagcctaagaattgttatggayatgggttactcaataggactggct

SEQ ID NO: 50773 - DNA, 50 bp, homo sapien
tgtggcaaatccattatctgtgataycttggaagtcagtttgtatgccta

SEQ ID NO: 50774 - DNA, 50 bp, homo sapien
tattggctttcagccaactattacamatgaagattaaatatgttgatttt

SEQ ID NO: 50775 - DNA, 50 bp, homo sapien
actagcttttgaacatattattacartactcatatcattttattgtagag

SEQ ID NO: 50776 - DNA, 50 bp, homo sapien
actatgcaaatcagactagaaaagaragtattaatatgtttaatatgaaa

SEQ ID NO: 50777 - DNA, 50 bp, homo sapien
cagccaaaaatgtttcagttaatacmatgaaatttaagctaaacgattct

SEQ ID NO: 50778 - DNA, 50 bp, homo sapien
ttgggaaagaggcttactctttgcayataattttggcagtattcaagaat

SEQ ID NO: 50779 - DNA, 50 bp, homo sapien
attagctagagtttaacacttttcartaatatagacaaattacacttggc

SEQ ID NO: 50780 - DNA, 50 bp, homo sapien
ctttgaagtttctttgaatataagcycatctaatgttatcaaatagctag

SEQ ID NO: 50781 - DNA, 50 bp, homo sapien
ttaaaagtcatgcagagtgtggtgasattctaacgtaattggcattggct

SEQ ID NO: 50782 - DNA, 50 bp, homo sapien
caacaattttagataatttaaagtayagatgaccctacatgctggagttt

SEQ ID NO: 50783 - DNA, 50 bp, homo sapien
ccaaaggtgaagatctcagcagtaaycaatatttcacaaggatatagacg

SEQ ID NO: 50784 - DNA, 50 bp, homo sapien
caaatacacctcttaacaatcaaaartcatttaatacaatttttcccaaa

SEQ ID NO: 50785 - DNA, 50 bp, homo sapien
actaaatataaggtcatggggaaatmattgttgagtgagtcccttcttgt

SEQ ID NO: 50786 - DNA, 50 bp, homo sapien
acactctcagtaactgtctgatgaakagatgagcgtctgcgataaatgtc

SEQ ID NO: 50787 - DNA, 50 bp, homo sapien
taattaatggtttttatcacctatamaatttagcaaccataatttctcat

SEQ ID NO: 50788 - DNA, 50 bp, homo sapien
ggataacaatagcaataagttctacwattacattttaattttccatttcc

SEQ ID NO: 50789 - DNA, 50 bp, homo sapien
gtaagatatcaaaatactttttcgartatggataggtaaaatatcttaca

SEQ ID NO: 50790 - DNA, 50 bp, homo sapien
ggaaataattcccagaaaggcaatartatgacatcatagaattgttttat

SEQ ID NO: 50791 - DNA, 50 bp, homo sapien
cattggggattagggcttcagcatamaagttatgtgggagaaaaaagttc

SEQ ID NO: 50792 - DNA, 50 bp, homo sapien
gctttttatgtgattttaaaaattasagtatcagcaaattaggagcatgt

SEQ ID NO: 50793 - DNA, 50 bp, homo sapien
aaatcatccaaatttgatgcactggmagagataactccttgagctgcatc

SEQ ID NO: 50794 - DNA, 50 bp, homo sapien
ttaaaacacagatgctcttttcataygggatacatttttgtttcaaattg

SEQ ID NO: 50795 - DNA, 50 bp, homo sapien
tgtaacttattttttgaggtgtctcmagtagtgatatttttgttgcccaa

SEQ ID NO: 50796 - DNA, 50 bp, homo sapien
ctacttgagacacctcaaaaaataakttacacaagacatagctttccagc

SEQ ID NO: 50797 - DNA, 50 bp, homo sapien
agatagtagggaggaaattggtagakacttacgctacagtaattaagttc

SEQ ID NO: 50798 - DNA, 50 bp, homo sapien
atcacgcacagttcctgacaaattcrctcttttcctcctctcccctgttt

SEQ ID NO: 50799 - DNA, 50 bp, homo sapien
ggaaattaatacacccagtttcaccrctgacaaaatggttttaataaagg

SEQ ID NO: 50800 - DNA, 50 bp, homo sapien
gaatttccagcttcatagaaaaactraatgctaagtggcagggaatattt

SEQ ID NO: 50801 - DNA, 50 bp, homo sapien
atgcagacagctatagtgtgagggayacagcgtggttcctggtatacttc

SEQ ID NO: 50802 - DNA, 50 bp, homo sapien
gtgttgcttctgattaactgcaatgrcagcatttgatactactccatgtg

SEQ ID NO: 50803 - DNA, 50 bp, homo sapien
tcaaaatgtcccgtgtaaaagacatragcgcctgcctctgtgtggggata

SEQ ID NO: 50804 - DNA, 50 bp, homo sapien
agatattttcaagctgaagaatatartaactgaaatgaaaaattcagatg

SEQ ID NO: 50805 - DNA, 50 bp, homo sapien
attcatctttttttagcttgttgagyatctttacagtgtttatgcaggta

SEQ ID NO: 50806 - DNA, 50 bp, homo sapien
cgtaaggaacttgtcctgcgtctctsagagaattttacttttatcaaaat

SEQ ID NO: 50807 - DNA, 50 bp, homo sapien
tccagcttcctccatggtgcagcttsaaagacctcccacttgtctgaact

SEQ ID NO: 50808 - DNA, 50 bp, homo sapien
attagtgacagactagactaggtgaycttcggcagtccattaagcttgtg

SEQ ID NO: 50809 - DNA, 50 bp, homo sapien
aagggcccaagaggccattattccaytcccgggtttcgaaaccactcctg

SEQ ID NO: 50810 - DNA, 50 bp, homo sapien
tttctgtgctgttttcatttgtaaayagagtcttcccttgtgacaaagat

SEQ ID NO: 50811 - DNA, 50 bp, homo sapien
catgcctaacggatgactttataacragatcactttaatatctgagaagc

SEQ ID NO: 50812 - DNA, 50 bp, homo sapien
atttgacagatttcaagtttcccaaygtcaaggtaactaacataccccac

SEQ ID NO: 50813 - DNA, 50 bp, homo sapien
gaagaaatgccaaggttggaagtacsagctatatagggtgtgtcaaaaga

SEQ ID NO: 50814 - DNA, 50 bp, homo sapien
gaaataccacatgatgtcaagtttcratcataaaggccataaatctcata

SEQ ID NO: 50815 - DNA, 50 bp, homo sapien
cactttaaatgagggtgtaatttaaygtaggattttggaaaaaaaaaaaa

SEQ ID NO: 50816 - DNA, 50 bp, homo sapien
tcctaaggatttgcccagaatgttaygagtgactctaaagacggtgaatg

SEQ ID NO: 50817 - DNA, 50 bp, homo sapien
gtggaaagtgagtaagccttacaaargacatagggtgggcaatattgtag

SEQ ID NO: 50818 - DNA, 50 bp, homo sapien
tcatttcttattctctatcaaaatakgcattggttgctattatataagaa

SEQ ID NO: 50819 - DNA, 50 bp, homo sapien
tgccttgcattttagcacatacccartgaacttgttcctgtcctatgaag

SEQ ID NO: 50820 - DNA, 50 bp, homo sapien
aaaaataaagccagacaccaattacyggaataaacacccaacttttcaat

SEQ ID NO: 50821 - DNA, 50 bp, homo sapien
aaacaaaaacactcctcaattactcrctaggtacactgtctactccttga

SEQ ID NO: 50822 - DNA, 50 bp, homo sapien
acttattagctgtatgattttgagcrattgactttacttattgtgcctca

SEQ ID NO: 50823 - DNA, 50 bp, homo sapien
ggtatcgagccatccagcagaaacargagtagtagatagttaaacttctt

SEQ ID NO: 50824 - DNA, 50 bp, homo sapien
gaccctgtgataatcatgttagtgayggcggatggtgatgtaggtgttat

SEQ ID NO: 50825 - DNA, 50 bp, homo sapien
agcagcaaggagactcttaaggttcygaaaactaacagaagctgaagtga

SEQ ID NO: 50826 - DNA, 50 bp, homo sapien
gaaggttgttggtctctaatgataayggtgctgcccaggaggaagtgtgg

SEQ ID NO: 50827 - DNA, 50 bp, homo sapien
agttattttagttattacaaaaacaractgtgacacaaaaattagccggg

SEQ ID NO: 50828 - DNA, 50 bp, homo sapien
tctactgtcaaataatggtgggagasgttttcgtttattcattcaaacag

SEQ ID NO: 50829 - DNA, 50 bp, homo sapien
ctgggcaatgtgttatggtcttttaygtgcttcaattcctatgcttaatc

SEQ ID NO: 50830 - DNA, 50 bp, homo sapien
tccattccttccttcctagtagatayctgttgttgagtacgcaaatggtg

SEQ ID NO: 50831 - DNA, 50 bp, homo sapien
gaatctttcccttgtgttatagtgayctcaatttctggatgatcccttct

SEQ ID NO: 50832 - DNA, 50 bp, homo sapien
ctatcagaaagtcataatatggatasaaagtcataatatggatagaaaga

SEQ ID NO: 50833 - DNA, 50 bp, homo sapien
aacttggaaagagcacaatgcactarctgtaagaagtcactttcaggtaa

SEQ ID NO: 50834 - DNA, 50 bp, homo sapien
ccagttcagttgagaagaaaagttgkagagtatagcatgcaaatataaac

SEQ ID NO: 50835 - DNA, 50 bp, homo sapien
aaagcttcacattttagaaatgaacraacaagtatatcactgaaggaatc

SEQ ID NO: 50836 - DNA, 50 bp, homo sapien
atcccatcaaacaaattagctttccraactctctttcacaatccaaacat

SEQ ID NO: 50837 - DNA, 50 bp, homo sapien
tggcatctacctgaaggcagccacgragaacaggctaaacacactttatg

SEQ ID NO: 50838 - DNA, 50 bp, homo sapien
tttcaagtttcaagtggttacaaaargcagttcagaatttgttcctgttg

SEQ ID NO: 50839 - DNA, 50 bp, homo sapien
cagttcagaatttgttcctgttgatractaactcatggattacaaaaagc

SEQ ID NO: 50840 - DNA, 50 bp, homo sapien
gcatagaagcaaaatatgtaatatgratgtgaaaaattaataaattatat

SEQ ID NO: 50841 - DNA, 50 bp, homo sapien
gcaatgagaccttgaacgctaactgraacgtaaaccttattccaatagct

SEQ ID NO: 50842 - DNA, 50 bp, homo sapien
ttgcacgagatgacatttgcaaagayggtcctatggagctgactcaacat

SEQ ID NO: 50843 - DNA, 50 bp, homo sapien
aaattcatatgacattgttgtaaaaycctcaagatattgaatagcttcat

SEQ ID NO: 50844 - DNA, 50 bp, homo sapien
gttagcatggtaattgtcaagtgaartattgattctcttccataacaaac

SEQ ID NO: 50845 - DNA, 50 bp, homo sapien
acatgtagggtaagttctagtttaartacaaaatgcattgccacagctgt

SEQ ID NO: 50846 - DNA, 50 bp, homo sapien
cagcagcatgaaaacggactaatacrcatgcctagcacatgtagggtaag

SEQ ID NO: 50847 - DNA, 50 bp, homo sapien
gaagcttttccgttgaagagccctamtactgtacacagtaatttagtccc

SEQ ID NO: 50848 - DNA, 50 bp, homo sapien
ctagaccagacttttttaacaaccaytgcaccaaaaggaattttaagggc

SEQ ID NO: 50849 - DNA, 50 bp, homo sapien
gctaaatccagtctcccttggtgcayagcagatctcttaatggcacctta

SEQ ID NO: 50850 - DNA, 50 bp, homo sapien
actcaaaatcagttctccactacatwagaaaataacaacattaattctaa

SEQ ID NO: 50851 - DNA, 50 bp, homo sapien
tctcacttggtctgtgggacagggasaagagtagaaaaggtcaactgaaa

SEQ ID NO: 50852 - DNA, 50 bp, homo sapien
aatataaagataaaaattgtgataartgttaatattaatgcatccaaaaa

SEQ ID NO: 50853 - DNA, 50 bp, homo sapien
aatccccaacttttcattttctctayggtacagaattagaagccaaagaa

SEQ ID NO: 50854 - DNA, 50 bp, homo sapien
gaggggacatttgatcagaaagagargtagctgagtgatgagaggctcca

SEQ ID NO: 50855 - DNA, 50 bp, homo sapien
gcaaaatttttgcatcttgctcccayattaggttctgctggcctagaggt

SEQ ID NO: 50856 - DNA, 32 bp, homo sapien
ttatgggtgtagatgcyagtagatgggtaaat

SEQ ID NO: 50857 - DNA, 50 bp, homo sapien
catggaattcctagcaaaaggcacgscatacatagagtcttgttgtttca

SEQ ID NO: 50858 - DNA, 50 bp, homo sapien
tgcaccccctggagctatggcctgarctatatttgggctcctttgaacca

SEQ ID NO: 50859 - DNA, 50 bp, homo sapien
gtggtctcatgttcttgatgagtcasagtccttaaatgagtgaagttttt

SEQ ID NO: 50860 - DNA, 50 bp, homo sapien
gtcatggtgcaagggaaggtaaatawgtttctcatgaatgctaatgagga

SEQ ID NO: 50861 - DNA, 50 bp, homo sapien
tacattagaatctgcattttaccaaraggtccaagtggtttacattcacg

SEQ ID NO: 50862 - DNA, 50 bp, homo sapien
aggctagagtatcaaccaatatcaargatttagggatatcagtgaatatc

SEQ ID NO: 50863 - DNA, 50 bp, homo sapien
atcctagtcttctctgaaagtaaaaytgagtgtcaatagtattctcttta

SEQ ID NO: 50864 - DNA, 50 bp, homo sapien
tgtgattttccagaagagatgatgarcaattacaattaagcatattccaa

SEQ ID NO: 50865 - DNA, 50 bp, homo sapien
ataattttaatatggaacattttcaytattcagttttttgtgatttctaa

SEQ ID NO: 50866 - DNA, 50 bp, homo sapien
tattagcagtttcaggtcagttaatwactaaagctcagtggtattactct

SEQ ID NO: 50867 - DNA, 50 bp, homo sapien
gtgcttcaaatatattttatacaacractactggagtggaatatgctgcc

SEQ ID NO: 50868 - DNA, 50 bp, homo sapien
attaaaaacaaaagaaacatgatgcraagtcttgagccttctacctcaca

SEQ ID NO: 50869 - DNA, 50 bp, homo sapien
ggacacagttcctgatctgtgatagyaaatgtacgttttagataacgaac

SEQ ID NO: 50870 - DNA, 50 bp, homo sapien
ccccgagtgattacagactggatgamaaggacgaatgaatgaagcttttc

SEQ ID NO: 50871 - DNA, 50 bp, homo sapien
cctcatccttttccagtcagaacatyaccgggtagcttcctcatttggct

SEQ ID NO: 50872 - DNA, 50 bp, homo sapien
tgcatttcatggagtcaaactattayacagatgttagcaaatgatcgcag

SEQ ID NO: 50873 - DNA, 50 bp, homo sapien
gtctgtagttttaaaaaagtttaggwatctgcaataaggcatgattatgt

SEQ ID NO: 50874 - DNA, 50 bp, homo sapien
cctttcttaccctactgcttgacaamcatactactctcacccacactaca

SEQ ID NO: 50875 - DNA, 50 bp, homo sapien
ggaaagtgaaggtgctctgagcacaytgaggagcagaaaagcctagtcag

SEQ ID NO: 50876 - DNA, 50 bp, homo sapien
tttgtggccccaaacgtttctgggaycttagtgctcactgagaggtagag

SEQ ID NO: 50877 - DNA, 50 bp, homo sapien
tccaaatgttatgcttatttctgacraatgcttttttgatgcttccctta

SEQ ID NO: 50878 - DNA, 50 bp, homo sapien
ttactggattataaatgtagaaacayggaaagtaaacacaggacctgtca

SEQ ID NO: 50879 - DNA, 50 bp, homo sapien
ttgggctctacttcacatgtaaagamactgaggcttaatgaggtcgttac

SEQ ID NO: 50880 - DNA, 50 bp, homo sapien
tgactggaaggtaatgagctttcaaytgcacgtgtaacttgtaggtaaca

SEQ ID NO: 50881 - DNA, 50 bp, homo sapien
gtgacagcagcagctaaattgatagraactttatctgacctagtattagg

SEQ ID NO: 50882 - DNA, 50 bp, homo sapien
agctactgacccattgcttattatasgttacagttaaatcgagttgtcag

SEQ ID NO: 50883 - DNA, 50 bp, homo sapien
aggaaagagggcaggattcaaaacaratatggaacaataaccaagatact

SEQ ID NO: 50884 - DNA, 50 bp, homo sapien
agacctgggtggactataaagaagamcaaagtgtggcatgttgccaagaa

SEQ ID NO: 50885 - DNA, 50 bp, homo sapien
taggaagttttactatgtgctaaacyctatttgaagtattttatttgtag

SEQ ID NO: 50886 - DNA, 50 bp, homo sapien
tacattttaattcatactctttactyaattccgcctttatctctccactg

SEQ ID NO: 50887 - DNA, 50 bp, homo sapien
attaccattcagaataatagtctggycataacatacctcagctttctgga

SEQ ID NO: 50888 - DNA, 50 bp, homo sapien
ttaggtggcaaagatgcctagaaagycttccaaaccaaatggcaaagcat

SEQ ID NO: 50889 - DNA, 50 bp, homo sapien
attttaaggcatagagacgatagtaraagttgaagaccattgcaaagtat

SEQ ID NO: 50890 - DNA, 50 bp, homo sapien
tattttagaacattcaaaaccattargagaagactcccgtttccagtcca

SEQ ID NO: 50891 - DNA, 50 bp, homo sapien
aatgggccaaagatggagaagaccaygctgctgtattgagtttcatgttc

SEQ ID NO: 50892 - DNA, 50 bp, homo sapien
caatagatatatttaattgcaagacygaatagagtaacatacttttttcc

SEQ ID NO: 50893 - DNA, 50 bp, homo sapien
gactccgtccttttgtgggtttttgyacctctctctaagtgtcttctctt

SEQ ID NO: 50894 - DNA, 50 bp, homo sapien
aggtgctcggctttctgctgatgtgraattctgttttgtctgggtcttga

SEQ ID NO: 50895 - DNA, 50 bp, homo sapien
attctgttttgtctgggtcttgatgraccttaaggtggttgtcatcaggc

SEQ ID NO: 50896 - DNA, 50 bp, homo sapien
ccacagaccccaaaaggaagcaggartacaaccttcgaagttggtgggca

SEQ ID NO: 50897 - DNA, 50 bp, homo sapien
aattaaacaatctctggttaagtcartattttctatttatattaatataa

SEQ ID NO: 50898 - DNA, 50 bp, homo sapien
caagtgaaatagtttgtcctgcagtraaaaaaaggccttaaactgggtag

SEQ ID NO: 50899 - DNA, 50 bp, homo sapien
agaaacagtagctttgtcaggtcatkataacctctataaaaatgactctg

SEQ ID NO: 50900 - DNA, 50 bp, homo sapien
ctgtaaaaggtaattgcagtaaaatmaatttgggtattcatgcacaataa

SEQ ID NO: 50901 - DNA, 50 bp, homo sapien
cattgattttgttacacagtttaatwaacgaataaaaagttcgcgcttgt

SEQ ID NO: 50902 - DNA, 50 bp, homo sapien
tgaaaacggcctgtgaataagagaawgatactgacaaattcaaaggcaga

SEQ ID NO: 50903 - DNA, 50 bp, homo sapien
tcttggctttcagtccattaactackgataacaacactgaaactgtgcct

SEQ ID NO: 50904 - DNA, 50 bp, homo sapien
actaaataaagctaaggtgacagaarttccttgatataaagcaaggaatc

SEQ ID NO: 50905 - DNA, 50 bp, homo sapien
gtgatatcctccatacttttcataaygattcaggaaccacagagaaaaaa

SEQ ID NO: 50906 - DNA, 50 bp, homo sapien
gaactctacaaaaggcatccactacracttattcagtgatgggcactcag

SEQ ID NO: 50907 - DNA, 50 bp, homo sapien
aagctaactcatattgaatcccttaygcatgtgtattttacatatttaat

SEQ ID NO: 50908 - DNA, 50 bp, homo sapien
tttccttctcctgtgtagtaggctcragatagggatgtgaaggattttcc

SEQ ID NO: 50909 - DNA, 50 bp, homo sapien
gagagtgagacaggaaaaaattcacrgatcattcaagtaattaaaactag

SEQ ID NO: 50910 - DNA, 50 bp, homo sapien
attgtcagtacacagatgcccatgawtaatgccgtggatatacacatgtg

SEQ ID NO: 50911 - DNA, 50 bp, homo sapien
caattaggagggtcttaagggagaasataggctaggcctgcatcagaaaa

SEQ ID NO: 50912 - DNA, 50 bp, homo sapien
acaccactaagctgtccttggaatgyacctatgttatgaaaaaattcagt

SEQ ID NO: 50913 - DNA, 50 bp, homo sapien
aaatggcctgatgaatgatataaacygggaaatggtgtttacagtaccta

SEQ ID NO: 50914 - DNA, 50 bp, homo sapien
cgcttggtgctttgcagtgatgcaakttgaccattaggtggcaggagcct

SEQ ID NO: 50915 - DNA, 50 bp, homo sapien
ctctcagggattgaacagtatatccygagaaatgtcttctagctaaagtc

SEQ ID NO: 50916 - DNA, 50 bp, homo sapien
attcttaagtagacaatgccctaacraataagtttttcttctagtagtta

SEQ ID NO: 50917 - DNA, 50 bp, homo sapien
ctgcaaacaggtactccttcaaaaaygtactaagaacaggagagtggctg

SEQ ID NO: 50918 - DNA, 50 bp, homo sapien
taagcaaaaagcacactctgcaacaytgtatacacagtaggcctcagcta

SEQ ID NO: 50919 - DNA, 50 bp, homo sapien
ttaagccaagtagttgagtacaaacmaggacaggcgtttaatgatacaga

SEQ ID NO: 50920 - DNA, 50 bp, homo sapien
gaggaaattaccaaaccagaagagaycaaaattgcctggaaaaatgagaa

SEQ ID NO: 50921 - DNA, 50 bp, homo sapien
ttgtggcatagatgttctttgtcacmataaaccacagtatattatgttta

SEQ ID NO: 50922 - DNA, 50 bp, homo sapien
ctaaaagcttacctaatatttagaaytctgtacctggtatcttcttcgaa

SEQ ID NO: 50923 - DNA, 50 bp, homo sapien
aagaagtagaagagtagataccttcrcactaaactttacttactatatat

SEQ ID NO: 50924 - DNA, 50 bp, homo sapien
aaagaaggcattcactgtttaaccaygttggtgtacagttacatcagaca

SEQ ID NO: 50925 - DNA, 50 bp, homo sapien
cttggcaagttctagtgagaataaasacctggaatcccaaaagcctccac

SEQ ID NO: 50926 - DNA, 50 bp, homo sapien
gtcacttagaagtcaagaagctctaygttccaaggaatgcaaatttaatt

SEQ ID NO: 50927 - DNA, 50 bp, homo sapien
ttaaacccctactttctgtttgataygaggctaggccaaaaataaattat

SEQ ID NO: 50928 - DNA, 50 bp, homo sapien
tccagagggattcagactcccctaaygttgcaatcccttcatctaacata

SEQ ID NO: 50929 - DNA, 50 bp, homo sapien
aattccatttaggttttacaaccaakttaagaagaactctgcttctctga

SEQ ID NO: 50930 - DNA, 50 bp, homo sapien
ctcttttcaccaccagttttccacayctgtgtactctagattaacaaact

SEQ ID NO: 50931 - DNA, 50 bp, homo sapien
gaaattaaggtgtacttgaaaacgartatctatcatatgacccctgcact

SEQ ID NO: 50932 - DNA, 50 bp, homo sapien
gtgggagttgaacattgaacatacamggacacagagaggggaacaacaca

SEQ ID NO: 50933 - DNA, 50 bp, homo sapien
gcacaaaatatctatgaactaaagcratgaatagattcataatttttaga

SEQ ID NO: 50934 - DNA, 50 bp, homo sapien
cactaacctgaggccacatgactaawtgaggttccactgcaggtccctga

SEQ ID NO: 50935 - DNA, 50 bp, homo sapien
tactgatcgtatatcctgtgtcccaygattatttcctgaactttttcata

SEQ ID NO: 50936 - DNA, 50 bp, homo sapien
aactgttaaaaatgctagattcaaasaagtcagaaaggaaactgatggga

SEQ ID NO: 50937 - DNA, 50 bp, homo sapien
tcatggatattcccagagattcccasgttttctccaacaatttcactttg

SEQ ID NO: 50938 - DNA, 50 bp, homo sapien
tggtcctgcctgcagagtaatgggamaggtgaagttggatccagaaaact

SEQ ID NO: 50939 - DNA, 50 bp, homo sapien
tagaaggaaaacattgttgttagackcaagtctctgacattcatttcccc

SEQ ID NO: 50940 - DNA, 50 bp, homo sapien
aaaggctggaacactaggccagtcaygtttctctagagtcaaagccacag

SEQ ID NO: 50941 - DNA, 50 bp, homo sapien
tctcctgagaggacactgattaagakctcaacccaatttcagatgttagg

SEQ ID NO: 50942 - DNA, 50 bp, homo sapien
ttctatagtttcaagttctcctttgsaatttttgtcaagacttttccttc

SEQ ID NO: 50943 - DNA, 50 bp, homo sapien
tgatctgatttaataagatgatacaktaggctaggtgtgatggctcacac

SEQ ID NO: 50944 - DNA, 50 bp, homo sapien
cacctgtgctctctgcctggccggcragaacaacatctagaggcttcttt

SEQ ID NO: 50945 - DNA, 50 bp, homo sapien
gagaagatgtttgctacacaaacagraagggttagtattcagaatatata

SEQ ID NO: 50946 - DNA, 50 bp, homo sapien
ctaaaacagagataatagtggatgaygcaagacctctaggttacaactca

SEQ ID NO: 50947 - DNA, 50 bp, homo sapien
tgccagcattttaggttttccattayaggcagccaaagtcaatccctagt

SEQ ID NO: 50948 - DNA, 50 bp, homo sapien
agcaaaaaatccctgtgttgtttctyactgggattctagaccttgatctt

SEQ ID NO: 50949 - DNA, 50 bp, homo sapien
ggttgacaagtggatcttcttatgcygatatttgtcattatctaaggggt

SEQ ID NO: 50950 - DNA, 50 bp, homo sapien
actgaacatggccatgttaaattacyggtgcacacacataaaaaacatcc

SEQ ID NO: 50951 - DNA, 50 bp, homo sapien
atcaccccactgtgctagcaaacacyacaatttattccttctgtttttgt

SEQ ID NO: 50952 - DNA, 50 bp, homo sapien
ttttgtgtctatccattgcacttcgycatatttcctcccagaagaagctt

SEQ ID NO: 50953 - DNA, 50 bp, homo sapien
gttctctaatcatcaatgatttcccraccctggaattagacactatacta

SEQ ID NO: 50954 - DNA, 50 bp, homo sapien
agacacagctttgaagcacgcagccragttagcctttgggagtcctgaga

SEQ ID NO: 50955 - DNA, 50 bp, homo sapien
tgcatacaatatacaacaatcaaatwagagtaattaggatatccatcacc

SEQ ID NO: 50956 - DNA, 50 bp, homo sapien
acaaaaatcgcaaaggtcagaaagayacagttcaaaaaaaaaccagaaat

SEQ ID NO: 50957 - DNA, 50 bp, homo sapien
aggatgtgaagtacatgaaaagataygatcaaaaatattctatatgagcc

SEQ ID NO: 50958 - DNA, 50 bp, homo sapien
aacacggctcatgtttttgaaaataycgggctcatatgtcctcatcccca

SEQ ID NO: 50959 - DNA, 50 bp, homo sapien
agcaatttaaattcaatcgcatacaraaacttaccctctaatttctctcc

SEQ ID NO: 50960 - DNA, 50 bp, homo sapien
agaagacccatgtgatgactgtgtawctctgtccattaggcagtgaggtc

SEQ ID NO: 50961 - DNA, 50 bp, homo sapien
aggcttcattaatctctgggttctcyaggaaagccaatttgatcatcgtg

SEQ ID NO: 50962 - DNA, 50 bp, homo sapien
gtataggcaccattttggggctttawctacggcaattctcagaggctaga

SEQ ID NO: 50963 - DNA, 50 bp, homo sapien
ttcttgtcctctcagatgaagaaacyatgtacagccctagtgagtcacgt

SEQ ID NO: 50964 - DNA, 50 bp, homo sapien
gaaatgagagattgagaactcagaaygtatttggtacaaaatgaaagata

SEQ ID NO: 50965 - DNA, 50 bp, homo sapien
aggatctggagaggttttgggtctcyagtactgcttaagatacatcacgg

SEQ ID NO: 50966 - DNA, 50 bp, homo sapien
cttaagatacatcacgggtaaatcasgccaggcaactgatctgtcttaga

SEQ ID NO: 50967 - DNA, 50 bp, homo sapien
agcccttcgaataccacagtagccaygggtcaatataaaaagcttcaacg

SEQ ID NO: 50968 - DNA, 50 bp, homo sapien
aagacaaaggaacatgggtaatttasaaaggcctccgaaagttactaagc

SEQ ID NO: 50969 - DNA, 50 bp, homo sapien
atagccagcatcctggattacatacygtagttttcttcaaaatgtgactt

SEQ ID NO: 50970 - DNA, 50 bp, homo sapien
tgctggaccgtgcaggattgttagargttatgtaggtggctctgatctgt

SEQ ID NO: 50971 - DNA, 50 bp, homo sapien
cagtgattctttactgcaattcaaamggttcagttaccagggaatagaat

SEQ ID NO: 50972 - DNA, 50 bp, homo sapien
caagtgagaagccaaatagcaaggakaatactgctttgttatagattggc

SEQ ID NO: 50973 - DNA, 50 bp, homo sapien
gacattacagggtgaccttttagaaygagcagaggaaaggaaggagagta

SEQ ID NO: 50974 - DNA, 50 bp, homo sapien
gttctatctattgggaacgtagcacyacataatggtcattgattagaggg

SEQ ID NO: 50975 - DNA, 50 bp, homo sapien
aagaaagagaaagacaaatactctayccaggatcagctaaatgtttctaa

SEQ ID NO: 50976 - DNA, 50 bp, homo sapien
tcttgcatttagtggataaccaatayacatctgttgaatccaattagtaa

SEQ ID NO: 50977 - DNA, 50 bp, homo sapien
gcttgacctagaagttttctgcttayacagattaagtacgaacttagtag

SEQ ID NO: 50978 - DNA, 50 bp, homo sapien
atagatgagaacagcaatcccagaartaaggtatctgttccaagagtgga

SEQ ID NO: 50979 - DNA, 50 bp, homo sapien
tggaaccaaagcagatcctatccaasgtgaatggcaagcagctatatgag

SEQ ID NO: 50980 - DNA, 50 bp, homo sapien
gaggtgggagtgagggtttctgagaygtaggtgaaacccactgagataaa

SEQ ID NO: 50981 - DNA, 50 bp, homo sapien
ccaatgttctgttcgtgacagtacayatattctcttgggcaatagaagcc

SEQ ID NO: 50982 - DNA, 50 bp, homo sapien
caccatccctcgtgcaggtagggaamcgagactctcagggatattcttaa

SEQ ID NO: 50983 - DNA, 50 bp, homo sapien
ccttggctgacatttcattttatgayaagccgcagagagttttatttgtg

SEQ ID NO: 50984 - DNA, 50 bp, homo sapien
ggggcatgatcccagtggtctgtctyaaaagttgacaccagttgtccagt

SEQ ID NO: 50985 - DNA, 50 bp, homo sapien
catacttcaggatagaacttcgctgraaatttaaaaacattccaccatca

SEQ ID NO: 50986 - DNA, 50 bp, homo sapien
ttttctaattcaggcaaaggtgttakgtaggttactggcagctcgggatc

SEQ ID NO: 50987 - DNA, 50 bp, homo sapien
tataccacccttgaacaattcttccrcagcaaatgcagtgagaacagcag

SEQ ID NO: 50988 - DNA, 50 bp, homo sapien
aagactatgtaggctgttgttaaagyaccctttctgaaaaaattcttaca

SEQ ID NO: 50989 - DNA, 50 bp, homo sapien
ctttagaacgaagtaaatattagaawctctgtctcaaagacatggacaca

SEQ ID NO: 50990 - DNA, 50 bp, homo sapien
aggattaaaaaccatctattcttaartcctacactgttttagagcatcaa

SEQ ID NO: 50991 - DNA, 50 bp, homo sapien
caatacatctcagcatattctatgarcaatacatctcagctgctgtctga

SEQ ID NO: 50992 - DNA, 50 bp, homo sapien
cagtgtgcttttatatttttgaaacragtcagagttttataggcaataat

SEQ ID NO: 50993 - DNA, 50 bp, homo sapien
atgtttctttcctctttaattcttayagtgtctaatgctgaaaaccgaca

SEQ ID NO: 50994 - DNA, 50 bp, homo sapien
ctacaaagggttgcagcagaaggaaygaacaagaaccagtgtgcaggtta

SEQ ID NO: 50995 - DNA, 50 bp, homo sapien
caacactgtaatgtcttaatagctaygggatggcttctctcctttattat

SEQ ID NO: 50996 - DNA, 50 bp, homo sapien
cttggttcctgatggctatccataaractggctctacagtagttcctgtc

SEQ ID NO: 50997 - DNA, 50 bp, homo sapien
attactagggcaataactggcaagaygacaacataatctgttcctctgaa

SEQ ID NO: 50998 - DNA, 50 bp, homo sapien
ttctaataaattcagaaaaaaacaaygcggcaagtcaagatccttggaac

SEQ ID NO: 50999 - DNA, 50 bp, homo sapien
gtggaacatagagatttatgaggaayacagagctgtggtcaagaaagcct

SEQ ID NO: 51000 - DNA, 50 bp, homo sapien
atggaaatgtaacagacctatgagamggcagattcagagagatttgccaa

SEQ ID NO: 51001 - DNA, 50 bp, homo sapien
aaaattaacaaatgagacaataatasgaaatcatgaagggctgcaattac

SEQ ID NO: 51002 - DNA, 50 bp, homo sapien
agaactaagggtgagctattctgaayttaaatcgcataagccaaactgtc

SEQ ID NO: 51003 - DNA, 50 bp, homo sapien
ccttggctcggtgacatgccctcagragccaagaaatcactgagcaattt

SEQ ID NO: 51004 - DNA, 50 bp, homo sapien
cctagtgctacgtgacttcaggttayaaagaagtaggtcaaagtgcagtc

SEQ ID NO: 51005 - DNA, 50 bp, homo sapien
taagtattttagcatggctgtcaagraaattcagagtaaagtcagtgtga

SEQ ID NO: 51006 - DNA, 50 bp, homo sapien
attacagtagttacctaagcagagaraaactaaagcatgaaagaggggtg

SEQ ID NO: 51007 - DNA, 50 bp, homo sapien
acttcacttattataaggtttctgayaagagaggtaaagatctaaatccc

SEQ ID NO: 51008 - DNA, 50 bp, homo sapien
taatagcacgtctacttagtcttcaygcgaggaccgccattccctccctc

SEQ ID NO: 51009 - DNA, 50 bp, homo sapien
ttggcttaaaatactaaattaaaaaragcctagctgctatgcactgcctt

SEQ ID NO: 51010 - DNA, 50 bp, homo sapien
tcttgtagcaacacaatttaattcarctagtaacatttgatggtacacta

SEQ ID NO: 51011 - DNA, 50 bp, homo sapien
attttccatgcatatttaatatatawgattgagagtacatgtttactttt

SEQ ID NO: 51012 - DNA, 50 bp, homo sapien
taaaatttaatcgctcttgtagaaaycttcgctatatgcctagcaactga

SEQ ID NO: 51013 - DNA, 50 bp, homo sapien
ctatctgtcactgcagcggctgatamctgaggaatactgtactttttact

SEQ ID NO: 51014 - DNA, 50 bp, homo sapien
ggttgattttaacttgtggaaaaccyggagtctccattgagaatatattt

SEQ ID NO: 51015 - DNA, 50 bp, homo sapien
aagcttaaactaaaatggtgaacaawgaacatatttaaagagatctccca

SEQ ID NO: 51016 - DNA, 50 bp, homo sapien
ggatacgtttttaaacctgatgacaragacagagctgaagggcttcatcg

SEQ ID NO: 51017 - DNA, 50 bp, homo sapien
gtcttggggtctaaaatagaaaagaygcagctctagagccctgggaatga

SEQ ID NO: 51018 - DNA, 50 bp, homo sapien
gccagcctctcccaagaactgctcaygtaaaggtacacctccacctttag

SEQ ID NO: 51019 - DNA, 50 bp, homo sapien
aaagtttattctatcatgagacaaaycgagtggtcctacataagcagtag

SEQ ID NO: 51020 - DNA, 50 bp, homo sapien
gccgcagaagcaagtgtttcataaaraaggaatgatcattgacaaaaact

SEQ ID NO: 51021 - DNA, 50 bp, homo sapien
tggcctgaaataaaattttataggaytcatcagtaagtggatgttaacgg

SEQ ID NO: 51022 - DNA, 50 bp, homo sapien
ttaatgccctccaaccaactgaacarcaggatctaagaacatttcatttc

SEQ ID NO: 51023 - DNA, 50 bp, homo sapien
tcaacatcctgccatggcagtcaaaygatactctaaggttaacattttta

SEQ ID NO: 51024 - DNA, 50 bp, homo sapien
cagtcagtgaacatgctggtttcccraagagtccaaaatggtagctgcga

SEQ ID NO: 51025 - DNA, 50 bp, homo sapien
ggcagggaatttagccaatggatagycccaatttatatttttccagctta

SEQ ID NO: 51026 - DNA, 50 bp, homo sapien
agccttcggtctgaacgaaacaataygatgaacattgccaatgggcctca

SEQ ID NO: 51027 - DNA, 50 bp, homo sapien
cctcatcaccagtctactgccttgarctactcataggtgttggtagaata

SEQ ID NO: 51028 - DNA, 50 bp, homo sapien
aatcaatccatctttgcctaagtctyacaaatggacacttatttgtctta

SEQ ID NO: 51029 - DNA, 50 bp, homo sapien
agttctcatacatccaaacaatatcyaggaactctggcagcctgagatta

SEQ ID NO: 51030 - DNA, 50 bp, homo sapien
gccagcttgcttttgtctcaaaacartgtccacttcatttatctgtctat

SEQ ID NO: 51031 - DNA, 50 bp, homo sapien
ggcaagatacagtacaagcagagaayggtatgaggtgcattctgcaatgc

SEQ ID NO: 51032 - DNA, 50 bp, homo sapien
atgtgcgaatcatgtaatcaaactcraaaacaaatttagactgggcatgg

SEQ ID NO: 51033 - DNA, 50 bp, homo sapien
acaagcattcaacagtaagctcccaygcaaagaatcagactgcagcaaat

SEQ ID NO: 51034 - DNA, 50 bp, homo sapien
agactctccagaactagtacctttaygtcaaactgaaactcttaagcacc

SEQ ID NO: 51035 - DNA, 50 bp, homo sapien
gtgcaaagtagttaacttgactaacmacaagtaagtgaaggagacataat

SEQ ID NO: 51036 - DNA, 50 bp, homo sapien
actgcataaatgtgtttccttcatayctctgcccagtaagtggccctccc

SEQ ID NO: 51037 - DNA, 50 bp, homo sapien
tcagaaaacacatccatgctctggtsaatgcttcaactgccaatccttga

SEQ ID NO: 51038 - DNA, 50 bp, homo sapien
ctggaaataagtaagttgagaagatmaaaaatgtgccaatccagtctatt

SEQ ID NO: 51039 - DNA, 50 bp, homo sapien
aatcccttcccatggcttgtgattgmaggataattgtgtataactcactg

SEQ ID NO: 51040 - DNA, 50 bp, homo sapien
cccatataattcatatattagggaaraattcgagcattcacttgaatttt

SEQ ID NO: 51041 - DNA, 50 bp, homo sapien
cttcaacagttttttaaaaagatcgmatgaagacaaatctgaaattatgt

SEQ ID NO: 51042 - DNA, 50 bp, homo sapien
tggattggaaagaagctgtgcatgasaagtgaactttgaagtcttttata

SEQ ID NO: 51043 - DNA, 50 bp, homo sapien
tgtcatctgtatttttgtgttctaayggcagccagcacagagagaggcac

SEQ ID NO: 51044 - DNA, 50 bp, homo sapien
tctcaccctcgtttgtatgactccaragttagagctctatctgtgtcact

SEQ ID NO: 51045 - DNA, 50 bp, homo sapien
ttcatggagcttgcattcaacagccrctactaaaataaataataatttgg

SEQ ID NO: 51046 - DNA, 50 bp, homo sapien
tttgaacccagttttacctgtatgaraatgctggtgggggcatgactgtg

SEQ ID NO: 51047 - DNA, 50 bp, homo sapien
aaaattattatactaggttccagtarcaaaatatattttcttatcatgat

SEQ ID NO: 51048 - DNA, 50 bp, homo sapien
gaaacaaatggattatttgtgctcartatgagaattttaacttttatcaa

SEQ ID NO: 51049 - DNA, 50 bp, homo sapien
tcaatcataaaatactcatcctatcrccatactaattgttttctgttggc

SEQ ID NO: 51050 - DNA, 50 bp, homo sapien
aattcctcagctaggtatacagcctsacaatttgctcctagtctggcctt

SEQ ID NO: 51051 - DNA, 50 bp, homo sapien
tcatccatgaaataaggataataacrccttccttatagagtttttgtgag

SEQ ID NO: 51052 - DNA, 50 bp, homo sapien
catttgaatgtggatgcaaactcacmaggaattaagacaaagacagaaat

SEQ ID NO: 51053 - DNA, 50 bp, homo sapien
agtgtttactcacctacgagacaggmacccttttttccacaatatgtgga

SEQ ID NO: 51054 - DNA, 50 bp, homo sapien
aacgcattccaatgtcttatctctcycaaaactacagaaaataaatcatc

SEQ ID NO: 51055 - DNA, 50 bp, homo sapien
gattgtacctggcaaatggattgtayggtcacactaccaagggatatgac

SEQ ID NO: 51056 - DNA, 50 bp, homo sapien
ctatttaacagtgagttttttgacayctcaaattgtaaactatttcctcc

SEQ ID NO: 51057 - DNA, 50 bp, homo sapien
aaaaaaaggattatctcttccataargaatctgcatcttattagaagaaa

SEQ ID NO: 51058 - DNA, 50 bp, homo sapien
tatggaatcagtcaaataaagaataygtccaggttgagcatccctaatcc

SEQ ID NO: 51059 - DNA, 50 bp, homo sapien
tcctaatagcttctcatgactcctaygctaaaatggaaactccttacctt

SEQ ID NO: 51060 - DNA, 50 bp, homo sapien
atttagttacccaaagattaaaagartatagccgtgtggtttttttaagc

SEQ ID NO: 51061 - DNA, 50 bp, homo sapien
attttagagaggcttgaacatcaaakattttcttccgttctgttggttgt

SEQ ID NO: 51062 - DNA, 50 bp, homo sapien
tatcacatatggtattaagttcaatraagtcaaaatgtaatgaaggtact

SEQ ID NO: 51063 - DNA, 50 bp, homo sapien
caaaaccccttagtgtcacggtcacrgtagaacaacctagaatgacttta

SEQ ID NO: 51064 - DNA, 50 bp, homo sapien
taaacttccaatgaaacagagttgarctaaatagcttatttgttaatagg

SEQ ID NO: 51065 - DNA, 50 bp, homo sapien
gagtcgtctggtatttttcgtcacartccctaatggcaagccagtgtggt

SEQ ID NO: 51066 - DNA, 50 bp, homo sapien
ccccagaaatgtgaatgaggaaaaayttatggatgagactaataggccct

SEQ ID NO: 51067 - DNA, 50 bp, homo sapien
taacaaaagtaaagtcttccagcgamctttctttgctgaaatcttttgag

SEQ ID NO: 51068 - DNA, 50 bp, homo sapien
tttttgagatatatagaactttcacraaataataatatatgaatatggtt

SEQ ID NO: 51069 - DNA, 50 bp, homo sapien
ttatgtatacatgcggattataacarcagtttagaatgcatgtcattcct

SEQ ID NO: 51070 - DNA, 50 bp, homo sapien
ttcatagtttgttaggagcactaaaygaatagtagaaagcctgccagaaa

SEQ ID NO: 51071 - DNA, 50 bp, homo sapien
aaaaattcatactttactagtgggckattattggaatatgaagcatttca

SEQ ID NO: 51072 - DNA, 50 bp, homo sapien
gatgggagctgcaattcactgacacraggaagactgctggagaagaggtg

SEQ ID NO: 51073 - DNA, 50 bp, homo sapien
atctgtgggtttatgcccatacacayggttagtcacagtaattcagatat

SEQ ID NO: 51074 - DNA, 50 bp, homo sapien
tacagcacccatgaggaggtgttgaygttcaggttttagcttcaggattt

SEQ ID NO: 51075 - DNA, 50 bp, homo sapien
ctcctcatgggtgctgtaaaaccacratggcattgactatttgactatag

SEQ ID NO: 51076 - DNA, 50 bp, homo sapien
agtaaggaatgctaagcagaaattartaatagggcccggcatccattatt

SEQ ID NO: 51077 - DNA, 50 bp, homo sapien
gacttttaaaatcaatcttatacaaygggtaatcatcattttacaattta

SEQ ID NO: 51078 - DNA, 50 bp, homo sapien
cttagggaaatgatactttcagacayggaaaggatgatgatatgaaattg

SEQ ID NO: 51079 - DNA, 50 bp, homo sapien
ggttgggattcggccttttggtgcarcacagagccagtctttcctgcttt

SEQ ID NO: 51080 - DNA, 50 bp, homo sapien
ccagagaagtgcagtttaagggatayggacaagagacgtactggctagct

SEQ ID NO: 51081 - DNA, 50 bp, homo sapien
agcctactttatcttaggaagaggaygcttttctttattgtttttcttat

SEQ ID NO: 51082 - DNA, 50 bp, homo sapien
aaaataaatacaggaaaggatacagragtagaaacaatgtgaggagaaag

SEQ ID NO: 51083 - DNA, 50 bp, homo sapien
gactgaacacagttcttaattacaaygtacctgccagctaaaaacaaatg

SEQ ID NO: 51084 - DNA, 50 bp, homo sapien
actccatgtgcatgttaacgttatcyatctcattttgcactgagatttgg

SEQ ID NO: 51085 - DNA, 50 bp, homo sapien
cccgtactgtcctccaaagtcaaacygtatgatggaagtcagtgcccttt

SEQ ID NO: 51086 - DNA, 50 bp, homo sapien
tgtaatggaccttaataaatgggtcrccgtctgtttcatgtcatatacac

SEQ ID NO: 51087 - DNA, 50 bp, homo sapien
tggagaccttacttggattgcaccawcttgtgtacagcttttttcgtgct

SEQ ID NO: 51088 - DNA, 50 bp, homo sapien
acttaaatgaccctcaatggagcaayagataaataaaatatggtacattc

SEQ ID NO: 51089 - DNA, 50 bp, homo sapien
tttaaagctcccttcagataatgcaratttcaccatcaatgccctaccct

SEQ ID NO: 51090 - DNA, 50 bp, homo sapien
tcactgtgtaaaagatgctggtatcmatatattctccatgtagttctatg

SEQ ID NO: 51091 - DNA, 50 bp, homo sapien
cataaaacaataaagacagtgctccraattaaagatacagcaatgacatg

SEQ ID NO: 51092 - DNA, 50 bp, homo sapien
tctctgctggtatgtttagaccaggmaatcaaaatgcatgacctagtcag

SEQ ID NO: 51093 - DNA, 50 bp, homo sapien
ggtaacaggtataatgggagacgatraaagatgagatgcccagaaatgaa

SEQ ID NO: 51094 - DNA, 50 bp, homo sapien
taatgagagctggaggcccaagcacygtcgaactgtgaagagccaggagc

SEQ ID NO: 51095 - DNA, 50 bp, homo sapien
tgatccactctggtgggcatacaaargtcctcacactttgagcctactcc

SEQ ID NO: 51096 - DNA, 50 bp, homo sapien
tctgggaatcctgtgttagacaaacratcatactgataagttgttttaag

SEQ ID NO: 51097 - DNA, 50 bp, homo sapien
gtgtcagcaacacagtccctgcgtgyagacgaccacggaaaaagctcaat

SEQ ID NO: 51098 - DNA, 50 bp, homo sapien
ctacactgatcttgcgttcctatacyaccaatcatcacaaatgtttatgc

SEQ ID NO: 51099 - DNA, 50 bp, homo sapien
agaaggcacagaagtgcaccatggcratcattaggataattcattaaagc

SEQ ID NO: 51100 - DNA, 50 bp, homo sapien
gaaggggaggaaatcatcaaagataygagagaaaaagaccctgagctgaa

SEQ ID NO: 51101 - DNA, 50 bp, homo sapien
aagagatgaactagcatttagctcgsatattgaagaatgattaacataat

SEQ ID NO: 51102 - DNA, 50 bp, homo sapien
tggaaataaaagaaggaagattatcrcaaaattaagggagattagattgt

SEQ ID NO: 51103 - DNA, 50 bp, homo sapien
aacaaggcaaatattagaattagaawttaaggatattaagaagtattttc

SEQ ID NO: 51104 - DNA, 50 bp, homo sapien
atattctacatgattggcatatttamatgaatggtttaaaaacccacaat

SEQ ID NO: 51105 - DNA, 50 bp, homo sapien
cactctgaatgaatgctttatatgargcctatgagaaaattctgaaggaa

SEQ ID NO: 51106 - DNA, 50 bp, homo sapien
actatcatttattagtaaacaagtaygtaattcatagaactgcgtaataa

SEQ ID NO: 51107 - DNA, 50 bp, homo sapien
attaagtctaatttttagtttttaaygtatgagcgtttctgtcactttgc

SEQ ID NO: 51108 - DNA, 50 bp, homo sapien
gtaacagtgactctccatacagatamggttctttcctcaacagggcttat

SEQ ID NO: 51109 - DNA, 50 bp, homo sapien
gtttttcatgtatgtacctctttcaygtttgtataacttttaaatctttt

SEQ ID NO: 51110 - DNA, 50 bp, homo sapien
aactttcaaggtacagatatttttaragtctccaagataagtgcgggggc

SEQ ID NO: 51111 - DNA, 50 bp, homo sapien
caaagctttttcagaacaactgttaygtgtctagcgccttgctctcactt

SEQ ID NO: 51112 - DNA, 50 bp, homo sapien
tctatcttaaatagaactagctataycgctgaaatctgagtatattccat

SEQ ID NO: 51113 - DNA, 50 bp, homo sapien
aatccacatctgttttctccatttgyatttaggaagcccactgaattata

SEQ ID NO: 51114 - DNA, 50 bp, homo sapien
ctgccacagtcttacaaagttaaccrccctggaattcattaaaatattta

SEQ ID NO: 51115 - DNA, 50 bp, homo sapien
tagaaaattcctctaaaaatctatascttccctaaacatacactttcact

SEQ ID NO: 51116 - DNA, 50 bp, homo sapien
aaagtacaccaaaactaaatataaaygatctggtggttcaacttcagcta

SEQ ID NO: 51117 - DNA, 50 bp, homo sapien
ttgcaaacaacacaatgtagtgcaartagaagttattattattatagaca

SEQ ID NO: 51118 - DNA, 50 bp, homo sapien
tcttataaactttacagtccagagartcacatttatagacaaaaagactg

SEQ ID NO: 51119 - DNA, 50 bp, homo sapien
aaaaactgggatgtcatcacgagaascaatttaatacgacccttcaaagg

SEQ ID NO: 51120 - DNA, 50 bp, homo sapien
acaaacacaatttcaaataaaccaaygaaggatttggtattaggcttccc

SEQ ID NO: 51121 - DNA, 50 bp, homo sapien
tttaaactttagatacacattacaayacaaagaaatgcactattataaat

SEQ ID NO: 51122 - DNA, 50 bp, homo sapien
gtagtctattaagtagacaataagcrctgagttatgagttgataagtgga

SEQ ID NO: 51123 - DNA, 50 bp, homo sapien
gaccctttctgtccaataataaagaygttggtaagagtaaataaaaggtc

SEQ ID NO: 51124 - DNA, 50 bp, homo sapien
ggaaacatatcaagatattagaagaygtcaatgttatatatgcagaaatg

SEQ ID NO: 51125 - DNA, 50 bp, homo sapien
agagatgaaacttggagtgatataamagaggaagaatgattctggaatac

SEQ ID NO: 51126 - DNA, 50 bp, homo sapien
tcactggaacttcatccacaattacmatgtcttggtggctttctaagttt

SEQ ID NO: 51127 - DNA, 50 bp, homo sapien
ggtagttcttgcaccaagtgactgayggcttcctccaaaacaatgtcagc

SEQ ID NO: 51128 - DNA, 50 bp, homo sapien
tttccataatacttaagtttttcaaygtttagatatttttctttattgaa

SEQ ID NO: 51129 - DNA, 50 bp, homo sapien
taaaacaaaattactattgaaataargtttgtcatgataataatttattt

SEQ ID NO: 51130 - DNA, 50 bp, homo sapien
ggaattttcttattttcgaaaggacrgatgacaaaatacacaatatacat

SEQ ID NO: 51131 - DNA, 50 bp, homo sapien
cttgtgtttaccttgtctgctttagwaaaagtttgtaaagggtttttttt

SEQ ID NO: 51132 - DNA, 50 bp, homo sapien
gtgcatctttccttcccaactgtacygagattttgaattttttataattt

SEQ ID NO: 51133 - DNA, 50 bp, homo sapien
ttcttcattactgaaggagctatcarattgaaggtaatcaaaaggattga

SEQ ID NO: 51134 - DNA, 50 bp, homo sapien
tgccttttagtgccctttacggatcraacataattttgtttaggaacatg

SEQ ID NO: 51135 - DNA, 50 bp, homo sapien
tctttgtggagtttgataggaaccayggatgtctttcctgaggctttcaa

SEQ ID NO: 51136 - DNA, 50 bp, homo sapien
ctatctgctgagtctggaaatatcayctcagaactttgccgctacagttg

SEQ ID NO: 51137 - DNA, 50 bp, homo sapien
gtaattaaaaaatacatctatcccartgcacacacttttattcctatcac

SEQ ID NO: 51138 - DNA, 50 bp, homo sapien
caaacccacttttccacaacagtgaygtgtttcaaggaagtgagttatct

SEQ ID NO: 51139 - DNA, 50 bp, homo sapien
ggaaagatctgtgctattcccacagsacttcgtgttatgaccctttggag

SEQ ID NO: 51140 - DNA, 50 bp, homo sapien
tagcaacaaaccctctacagagttayatagcctcatcatgaaagtttcat

SEQ ID NO: 51141 - DNA, 50 bp, homo sapien
cagtgtgagcatctaaaacatagtgragtagcttaacctatgttttggta

SEQ ID NO: 51142 - DNA, 50 bp, homo sapien
gtgttcaccaatcatattttagtgcycaacatctcatggaagcagctgtt

SEQ ID NO: 51143 - DNA, 50 bp, homo sapien
atatttctatccattagaattcctarctgtactttgcatctggtaagcac

SEQ ID NO: 51144 - DNA, 50 bp, homo sapien
ttctgacaacttcaatatccaagcaygaaacaaaattcagtttctttcaa

SEQ ID NO: 51145 - DNA, 50 bp, homo sapien
ataaaattagaatgtagtcaaacaaygtaactggagaccttcaccccaac

SEQ ID NO: 51146 - DNA, 50 bp, homo sapien
atgatgatgatggtactgggcatgayaccttgatataacttctgttaaaa

SEQ ID NO: 51147 - DNA, 50 bp, homo sapien
ttcttcgcattttatcattttataamctcaccttttagagaaggtattga

SEQ ID NO: 51148 - DNA, 50 bp, homo sapien
taagctccctcacaaactggaactaraacctatttgcatttcttcctaca

SEQ ID NO: 51149 - DNA, 50 bp, homo sapien
gagttgtcccaggcttccagatgaaytatgagaaattggcagtgggagaa

SEQ ID NO: 51150 - DNA, 50 bp, homo sapien
ataaaaataaaaacagaaacatgtaragaattatgatcagaagctccccc

SEQ ID NO: 51151 - DNA, 50 bp, homo sapien
ttagagaagttggcctggtaaatgasagcaaactgtgttgcaatgagcta

SEQ ID NO: 51152 - DNA, 50 bp, homo sapien
ccaatcgatagcttatgtatttgaawgtatattcttggtaaacaacttag

SEQ ID NO: 51153 - DNA, 50 bp, homo sapien
tagagcacatcctttttccttattgractaaatgcatttagcaaaagaaa

SEQ ID NO: 51154 - DNA, 50 bp, homo sapien
aaaacaacttcacatcctcctaagcragtgatcgagtttagatatttgtc

SEQ ID NO: 51155 - DNA, 50 bp, homo sapien
aagtttttttgctagatatacttaaycaaactaatgaaattccttccatt

SEQ ID NO: 51156 - DNA, 50 bp, homo sapien
ggggcatgaagtgaagtgctcaagargatatgtgtcatggagaaccttgg

SEQ ID NO: 51157 - DNA, 50 bp, homo sapien
tcagtcacctcacattagagattgcrgacccattcagtttaggaaactgc

SEQ ID NO: 51158 - DNA, 50 bp, homo sapien
caaaacaacaaaaccaaagatccaamccgtcatatattatctaaaaatta

SEQ ID NO: 51159 - DNA, 50 bp, homo sapien
tactggtcttacttttcacatgagtyaagtttatactagctgagcaccct

SEQ ID NO: 51160 - DNA, 50 bp, homo sapien
aaatttgggggaaagagatactctcragctaaaatttttaatgctgattc

SEQ ID NO: 51161 - DNA, 50 bp, homo sapien
taagtgaggtaaaatatgctaagtartacagtataagatttttaaaaatt

SEQ ID NO: 51162 - DNA, 50 bp, homo sapien
agtatattgaatgtgtttttgttatyaaattctgtccatggtcatcttca

SEQ ID NO: 51163 - DNA, 50 bp, homo sapien
taatatttactctaacaaataccaamggctgtcctgccttcttcagtaag

SEQ ID NO: 51164 - DNA, 50 bp, homo sapien
ccagtaggcagccttcagactataaygtggcttcccggatagcttttcta

SEQ ID NO: 51165 - DNA, 50 bp, homo sapien
gttaagtgacacatgattgtagataygaagccagagaaaaagctttgttt

SEQ ID NO: 51166 - DNA, 50 bp, homo sapien
taactgtctttgttgatttttgtggrcatcatagcacagaagagttctcc

SEQ ID NO: 51167 - DNA, 50 bp, homo sapien
tctgccttctcctggcttacaacaaygccagtcttaaatgatttgcatgc

SEQ ID NO: 51168 - DNA, 50 bp, homo sapien
cttagcttagcttgtgaaacactccraagacttgattaatatcatcctat

SEQ ID NO: 51169 - DNA, 50 bp, homo sapien
ctacccttctcatagagaaacctgartagtcagatttgttttcatcaaaa

SEQ ID NO: 51170 - DNA, 50 bp, homo sapien
gggaattataatgtattcatagaaaygagtgtggagtgcccacttgcaca

SEQ ID NO: 51171 - DNA, 50 bp, homo sapien
acattttcataacaggagttcaaaakgataagagacagataaaaaaccag

SEQ ID NO: 51172 - DNA, 50 bp, homo sapien
caaaaacaattgctctatgttgcccraagtatttttccataactgaaaga

SEQ ID NO: 51173 - DNA, 50 bp, homo sapien
ctcagcttccttctcattatgaaaaragcattatctaacattgaacttgt

SEQ ID NO: 51174 - DNA, 50 bp, homo sapien
ctttatgaattctcaatgctaagatsaccttatttctataatacagcatt

SEQ ID NO: 51175 - DNA, 50 bp, homo sapien
tactgatccccatgtgcttcttatamacctggagtttgagaactactggg

SEQ ID NO: 51176 - DNA, 50 bp, homo sapien
gccaggttattaaccaatgctttcaygttttaatgcctctagttcctcag

SEQ ID NO: 51177 - DNA, 50 bp, homo sapien
gtttgtcaaattaagtgcataacccraatattcagaatagaaatctaaat

SEQ ID NO: 51178 - DNA, 50 bp, homo sapien
tgacgtttgtctattattcaggagaygttctttgtaggagaaagaaaggg

SEQ ID NO: 51179 - DNA, 50 bp, homo sapien
atgaatctttcagttatcaaattgawtaaggaaggagatgatgtttttct

SEQ ID NO: 51180 - DNA, 50 bp, homo sapien
agaccagttttagctgcatattgcartctttctttagaactatcctaaaa

SEQ ID NO: 51181 - DNA, 50 bp, homo sapien
aggaattaaatagctcacacagtgargaaagcaatcttgttaagttgggc

SEQ ID NO: 51182 - DNA, 50 bp, homo sapien
catgggtgataggagatagggttaaygaaacagcagtaatttagagacca

SEQ ID NO: 51183 - DNA, 50 bp, homo sapien
tttttgtacttcgtaggtgtttagamcaagaagaattatatgtgttcctg

SEQ ID NO: 51184 - DNA, 50 bp, homo sapien
gtaatgttgactacaaaaaaaactcmgaatatcaggattcactttttctc

SEQ ID NO: 51185 - DNA, 50 bp, homo sapien
cacactataatgtactggactctcaygaccttctgtccaggcctttatag

SEQ ID NO: 51186 - DNA, 50 bp, homo sapien
caccacaaagcttcataagctcaaartatttagtaagtccagagaacgag

SEQ ID NO: 51187 - DNA, 50 bp, homo sapien
tccttagtaagctgtgaatgatgcarattctctcagatctccctggggac

SEQ ID NO: 51188 - DNA, 50 bp, homo sapien
tgtcaccagcaatggcctaggaaaamattgtgagatatggaaataaatat

SEQ ID NO: 51189 - DNA, 50 bp, homo sapien
tgatggagtcttccattatttcgccyaaatattttatgaagaacagagtt

SEQ ID NO: 51190 - DNA, 50 bp, homo sapien
aggcaactcgttaccgtccctttcawccggagtcagaactaagaatgctc

SEQ ID NO: 51191 - DNA, 50 bp, homo sapien
cagttgttttatatttggtaaacaaygcagttaggtcatgtaaattttaa

SEQ ID NO: 51192 - DNA, 50 bp, homo sapien
caactttagaaaagagagacgcatamaaacagagcatttatcttataatt

SEQ ID NO: 51193 - DNA, 50 bp, homo sapien
gtttttattgtattgtgaaattcaayaataactacttggaaataatctaa

SEQ ID NO: 51194 - DNA, 50 bp, homo sapien
ctctatcagtaaaatctgactgtcaycaaatatacaatatatactactta

SEQ ID NO: 51195 - DNA, 50 bp, homo sapien
gagagcagagggtcaagctgtaaackccaagtactagtgttcaaatattg

SEQ ID NO: 51196 - DNA, 50 bp, homo sapien
cctcctaatttatgttccctcataaytgaaagaggcttaataaaagtgag

SEQ ID NO: 51197 - DNA, 50 bp, homo sapien
atttatacactgaaataaataatgawctaggttgcaagctattttccatg

SEQ ID NO: 51198 - DNA, 50 bp, homo sapien
atagtgctgcaataaacatatgcacrctcaccgaactttgcttcactgtc

SEQ ID NO: 51199 - DNA, 50 bp, homo sapien
aagacaaaactaagcaatcaatttargacagaaaaagaggtatgtataat

SEQ ID NO: 51200 - DNA, 50 bp, homo sapien
ttaccctcctcggttggctccagcartaagcctaatgacctctacaaagc

SEQ ID NO: 51201 - DNA, 50 bp, homo sapien
gcatcacctgattcctttatctttaygatagttaccagcaaaacctacaa

SEQ ID NO: 51202 - DNA, 50 bp, homo sapien
ttggagtccggtgtcctgggcctaaytcaaggttctgtctctctctaact

SEQ ID NO: 51203 - DNA, 50 bp, homo sapien
aagtccaaatctgttaaagtgtaaakgcgctgcgaataatgatctcagag

SEQ ID NO: 51204 - DNA, 50 bp, homo sapien
aaaaatcaatgtcatctaaattatcrattatctttggtatataccatcct

SEQ ID NO: 51205 - DNA, 50 bp, homo sapien
agggcgagggaacaccctgcaccacsagggacagactctagaccatgcgt

SEQ ID NO: 51206 - DNA, 50 bp, homo sapien
ctgcacacactgcgtttcacagtacrcacaaagaatataacctccttaag

SEQ ID NO: 51207 - DNA, 50 bp, homo sapien
gaactcacactgacaacttctggaayactttgagttttgcctttctgggg

SEQ ID NO: 51208 - DNA, 50 bp, homo sapien
tctcctacctctttatgtaagctacyatctcttggtgtctgggagcagat

SEQ ID NO: 51209 - DNA, 50 bp, homo sapien
tttaatcactgaaatagttttaggaygtatacaagagttggagcttgttt

SEQ ID NO: 51210 - DNA, 50 bp, homo sapien
ttcttaaaatctgaattaagccacaygaatgatagtcactttcacaatca

SEQ ID NO: 51211 - DNA, 50 bp, homo sapien
ttccaactattttcctagaaagtaaytgctcacctgataaatttcctgtc

SEQ ID NO: 51212 - DNA, 50 bp, homo sapien
agatggtccatagaacatggattaarcatggcatcagtagtcaggattat

SEQ ID NO: 51213 - DNA, 50 bp, homo sapien
ttagtctattgaggtcatataataaragtttcaacctcaaagaggaacaa

SEQ ID NO: 51214 - DNA, 50 bp, homo sapien
aaagtaataaggacgtagaaagaaartcacctggagtaaatggttacacg

SEQ ID NO: 51215 - DNA, 50 bp, homo sapien
taacccatggatacctgcgttgggtyaaatgaatcctaattactaaaaga

SEQ ID NO: 51216 - DNA, 50 bp, homo sapien
aatcggagttttccaactgttggatragttctccagagtcactgggaagt

SEQ ID NO: 51217 - DNA, 50 bp, homo sapien
tagcttaaaggaatttgtgtcttgamtataacttgaaaaacacatgaaga

SEQ ID NO: 51218 - DNA, 50 bp, homo sapien
taagattgaagatacatgtacggtamaactcagtaattctcctgctagca

SEQ ID NO: 51219 - DNA, 50 bp, homo sapien
gcagagggaaagtcactagatgtaayagaagaagcccagctagagaataa

SEQ ID NO: 51220 - DNA, 50 bp, homo sapien
agacagaagccttcttaatgtcttgratactttttcttgtcttggtgtcc

SEQ ID NO: 51221 - DNA, 50 bp, homo sapien
agtggggtaattcagtgctcccttawgttttgttttcaagacttttggtt

SEQ ID NO: 51222 - DNA, 50 bp, homo sapien
tgaataattaggaatagaaataagawgaaatggagattcaaagtatcttg

SEQ ID NO: 51223 - DNA, 50 bp, homo sapien
aaggtctttgtataccttgcaaggcratagctggacagtaccattgctta

SEQ ID NO: 51224 - DNA, 50 bp, homo sapien
ccaaagaactctctgttgagatgcaygttaaattccaagacaaatgtgcc

SEQ ID NO: 51225 - DNA, 50 bp, homo sapien
gtgggagtaacaaaaataagttacaraggcacaccagagttggtcttatt

SEQ ID NO: 51226 - DNA, 50 bp, homo sapien
attccctgaattcagcatgaagatgracatgtaacaatgactcaacagaa

SEQ ID NO: 51227 - DNA, 50 bp, homo sapien
atacgcctgcagttctgcagaatcartaactatcaaggacaccaaagaag

SEQ ID NO: 51228 - DNA, 50 bp, homo sapien
ttcataaaacttgcattctctttgaygagaataggttgatgcctcctgtt

SEQ ID NO: 51229 - DNA, 50 bp, homo sapien
tgtgttaaagaaaaagatgtctcaaktcatcaaatgagcttccaacctac

SEQ ID NO: 51230 - DNA, 50 bp, homo sapien
ctattgcttacatctgatactgttasctgtatttcttcccaaatgcctgg

SEQ ID NO: 51231 - DNA, 50 bp, homo sapien
cactggatctgagattgccctgggastcaggatttttcccacacagggag

SEQ ID NO: 51232 - DNA, 50 bp, homo sapien
tagtcacagcaaattggatgttgcaygtataagacctacaggaggcggaa

SEQ ID NO: 51233 - DNA, 50 bp, homo sapien
caaggttgagtgccagagtgataacrgcaataaggagtttgtggctcagg

SEQ ID NO: 51234 - DNA, 50 bp, homo sapien
aaagtttagtttgagaacaaatggayaaaaagtcccaaagcacccattac

SEQ ID NO: 51235 - DNA, 50 bp, homo sapien
caaggacacaagaatcctattttgayaacattttaactggtgaagcatat

SEQ ID NO: 51236 - DNA, 50 bp, homo sapien
agcacttcttctaattaacttctaaycttccggccatgggaatttttttc

SEQ ID NO: 51237 - DNA, 50 bp, homo sapien
tgttcttaaccagtacactgtaatayctcacactcaaacatgttctgtag

SEQ ID NO: 51238 - DNA, 50 bp, homo sapien
gtcacaagctttcaaaaaattaaggraagaacacaaagtttgaataccaa

SEQ ID NO: 51239 - DNA, 50 bp, homo sapien
ggtgaacagaaagaaatgcatacacrcacatataaacatacaagcacaat

SEQ ID NO: 51240 - DNA, 50 bp, homo sapien
gcatagaagaaacagaactgaactcrgagtcagaagatatgggttcaaat

SEQ ID NO: 51241 - DNA, 50 bp, homo sapien
aagaagatagggaagtacataaataycaatggtcagcatccatgtttgtc

SEQ ID NO: 51242 - DNA, 50 bp, homo sapien
acgtccttctcccctgatcttcacamtcaaataacaaagcctagtgttca

SEQ ID NO: 51243 - DNA, 50 bp, homo sapien
gctttattgtactctagataattacyaaagagattgaagcaaatgaatgg

SEQ ID NO: 51244 - DNA, 50 bp, homo sapien
ccttggatatggagtccactcaaaartaatctgaactaataaacaaattc

SEQ ID NO: 51245 - DNA, 50 bp, homo sapien
tgtatgagcttgagcgagttactaasggcctttgctcccatctgaatgca

SEQ ID NO: 51246 - DNA, 50 bp, homo sapien
catctgaaaaattcaaataggaaaayaacagaaaaggtgccaatcgtttt

SEQ ID NO: 51247 - DNA, 50 bp, homo sapien
gaacctaatgcacaccaaagtttgarcactagcaatttccaacagtttca

SEQ ID NO: 51248 - DNA, 50 bp, homo sapien
tgtagggcaaggtctgggaggttcaygatttagcaggattcaagagcact

SEQ ID NO: 51249 - DNA, 50 bp, homo sapien
caaatatagaaagccgtgatttcccyaagttggtagtgttattgtctgtg

SEQ ID NO: 51250 - DNA, 50 bp, homo sapien
attaactctgctttggatgattaaaracactcatgaagaaggtggaagtt

SEQ ID NO: 51251 - DNA, 50 bp, homo sapien
cttcaatactgatcccttcaaaggascttaaacttgtctccagatatcag

SEQ ID NO: 51252 - DNA, 50 bp, homo sapien
ggagagacagtgaaaggagaaagcayagcaatttggtggcaagattttat

SEQ ID NO: 51253 - DNA, 50 bp, homo sapien
ctggtgtgtcaaactgtctagcctgratttcgggtctgtatccttcaact

SEQ ID NO: 51254 - DNA, 50 bp, homo sapien
ctattctgatcagggactgcaaagaygtgatttctgaagggtttatttgg

SEQ ID NO: 51255 - DNA, 50 bp, homo sapien
aagctataatacttcctcttatgtgyatcttagagtaaacaagtttcaaa

SEQ ID NO: 51256 - DNA, 50 bp, homo sapien
gtactggaagatttatttaagtttcmaaaagatcgtaactggcccaggaa

SEQ ID NO: 51257 - DNA, 50 bp, homo sapien
gtgcgtccatggttgtggtacgtgawgtagaacatttaaaaagggcacaa

SEQ ID NO: 51258 - DNA, 50 bp, homo sapien
atttttaaaattctcttctgtagaamctaacaccttgagaatcaaaaacc

SEQ ID NO: 51259 - DNA, 50 bp, homo sapien
caaagaatccacaaataggtccccaytgattaccaaatccggaatgtgaa

SEQ ID NO: 51260 - DNA, 50 bp, homo sapien
ttcaaagctataagaatttacagcartgatacagcaaagagccctggatc

SEQ ID NO: 51261 - DNA, 50 bp, homo sapien
tatgaagactggcagttttccattcyaccgtgactgcctacatatttctc

SEQ ID NO: 51262 - DNA, 50 bp, homo sapien
catgtgttttaaagtgattatataarcctagagaatacggcttgaatatc

SEQ ID NO: 51263 - DNA, 50 bp, homo sapien
aaggattatctgagataaccaggtcyatactgtggagtgaactattaagt

SEQ ID NO: 51264 - DNA, 50 bp, homo sapien
gtatagactatgaatacaggagatamgtacatgaaggtgctctgcattac

SEQ ID NO: 51265 - DNA, 50 bp, homo sapien
atgtggcacacataggaattcatccraaccaagcaaaaatcacttagctt

SEQ ID NO: 51266 - DNA, 50 bp, homo sapien
aagcctagatttttcctggctgatayaggtctttctaatcctcgattttc

SEQ ID NO: 51267 - DNA, 50 bp, homo sapien
cacgtagtatctggctgcacatcaaygataaccacaaacatagaaatatc

SEQ ID NO: 51268 - DNA, 50 bp, homo sapien
aaatacaaggtgcaaatacaagccaygactgatatccctctgaaaatgtc

SEQ ID NO: 51269 - DNA, 50 bp, homo sapien
tattcattggtttagtgtatgtttaycctcattagaataagcaaggtctt

SEQ ID NO: 51270 - DNA, 50 bp, homo sapien
atatgtggaacctcaagacttggtcwcttacttcatacacacgtattcat

SEQ ID NO: 51271 - DNA, 50 bp, homo sapien
aaaaactaacccgactctcaactgawaaaatgaaacctcctctgttagaa

SEQ ID NO: 51272 - DNA, 50 bp, homo sapien
agttctcagaccagcattggtctatragctactgtttcaatccactggag

SEQ ID NO: 51273 - DNA, 50 bp, homo sapien
gcactttcctcattagtttagaagtwaccttagctgaagttttatatgcc

SEQ ID NO: 51274 - DNA, 50 bp, homo sapien
ggagaaggggaagaggaattttcacmaggaagtgggttggatgacagaca

SEQ ID NO: 51275 - DNA, 50 bp, homo sapien
ttattttcttggttaatctcactaaygctttatcaattttgtcttttcaa

SEQ ID NO: 51276 - DNA, 50 bp, homo sapien
caacgcatagcccagaaagtactgcwcctgatcagataagaagcgtgttt

SEQ ID NO: 51277 - DNA, 50 bp, homo sapien
cactgagggaaaagtgtgtctgtaaygaaagcagtgtgttcagccctcat

SEQ ID NO: 51278 - DNA, 50 bp, homo sapien
cagccactaacatgagccaacctcargtcaagatgtgaaaataaatatcc

SEQ ID NO: 51279 - DNA, 50 bp, homo sapien
gaaaatgcaaagataagacataaacraggttgcttagactctcaaatctt

SEQ ID NO: 51280 - DNA, 50 bp, homo sapien
atttggggtgtgatcaattctaggaygggattttacatacaaaacgctga

SEQ ID NO: 51281 - DNA, 50 bp, homo sapien
tgtttattactcatccaagatgaacmaataatactctagagtgatattaa

SEQ ID NO: 51282 - DNA, 50 bp, homo sapien
tgtgaggtctcactcttattctgcaycttatacaggcagatgaagaagtc

SEQ ID NO: 51283 - DNA, 50 bp, homo sapien
tttatcttatgtccgtttccagtcartacacatccctgctccgtaatcac

SEQ ID NO: 51284 - DNA, 50 bp, homo sapien
aaatttattgcaatggtaatgacagraaagaaagaacattaatcaatata

SEQ ID NO: 51285 - DNA, 50 bp, homo sapien
ccacagctgggttgcatactgaatgmcaaattaaaaatcagtattcctga

SEQ ID NO: 51286 - DNA, 50 bp, homo sapien
aacgaatgtacacgtttctggtcaawacaacaatcatgctgcaacttcat

SEQ ID NO: 51287 - DNA, 50 bp, homo sapien
gagccccaggcaatatatacatggawcttccaaaaacacgttgtttacaa

SEQ ID NO: 51288 - DNA, 50 bp, homo sapien
atcactataatatcctaatcaattaygtgtgcaaaatcttacatttattt

SEQ ID NO: 51289 - DNA, 50 bp, homo sapien
attttggggagacttgacatcctaasaagactgaatattgcaatccatca

SEQ ID NO: 51290 - DNA, 50 bp, homo sapien
atagcattaaaattttaaagacctayaattcagcctggcaatgatatgca

SEQ ID NO: 51291 - DNA, 50 bp, homo sapien
tgttacctttacataaatgttctaamtcaatctttacccaagtctttgaa

SEQ ID NO: 51292 - DNA, 50 bp, homo sapien
tatcattacaagcattaattgcacayggaaaatgaaagagaaggaattaa

SEQ ID NO: 51293 - DNA, 50 bp, homo sapien
agctcaagaatgctaaataggactcracagtttctaaatgtttcattagt

SEQ ID NO: 51294 - DNA, 50 bp, homo sapien
ttcttttttctgtattcatttaaagrcgaattacatttatttaaatgata

SEQ ID NO: 51295 - DNA, 50 bp, homo sapien
cagggatgggaggtgaagacacatawggtggaggaactacaaaagggcaa

SEQ ID NO: 51296 - DNA, 50 bp, homo sapien
atcaatagcatgaactattgctcatraaatccacctcaaaggttgtaaat

SEQ ID NO: 51297 - DNA, 50 bp, homo sapien
gcacaatatgtagtttatgagggaawtgatcgttaattttgtggatcctg

SEQ ID NO: 51298 - DNA, 50 bp, homo sapien
ctaagcttctatttctggaaaatacyatgccaatgctggcatcagagcct

SEQ ID NO: 51299 - DNA, 50 bp, homo sapien
tgtgatgggtgcttgacactcactgyagcagtcaggtcactttcacttcc

SEQ ID NO: 51300 - DNA, 50 bp, homo sapien
tcactgttaacattacattagctgamccatatcatgatcattagaaataa

SEQ ID NO: 51301 - DNA, 50 bp, homo sapien
atgtccactgggtatgttatttcagyccataatcacctgtaatcccaaca

SEQ ID NO: 51302 - DNA, 50 bp, homo sapien
cttcactttgttcatctgctaagaayaagacttcctttaccctagaatgt

SEQ ID NO: 51303 - DNA, 50 bp, homo sapien
gaaaaaaatgtcattagtatttttawagaatttgtattgaatctgtagat

SEQ ID NO: 51304 - DNA, 50 bp, homo sapien
taacacttaggtggcgtctaaaaccrcagggatggtcagatcatgtatga

SEQ ID NO: 51305 - DNA, 50 bp, homo sapien
cctaactgctacctctgagtgtggcygaactaatgatgcagcaattaaga

SEQ ID NO: 51306 - DNA, 50 bp, homo sapien
agtccccaggggcttggcggttgagraaattgcagcaaaattgctgtcca

SEQ ID NO: 51307 - DNA, 50 bp, homo sapien
ccttaactcctaagtttctctgcagkcactaaagccaaattccttgaaac

SEQ ID NO: 51308 - DNA, 50 bp, homo sapien
cacacacataagcagttgaagcgtgmagttgttactctcatacattaatc

SEQ ID NO: 51309 - DNA, 50 bp, homo sapien
ctttactagtaacaacgcatgaataygtctatgtatctggcacaaatgcc

SEQ ID NO: 51310 - DNA, 50 bp, homo sapien
tctattggttaaaaggaaaatggaargcacatagatgccaatgacagttt

SEQ ID NO: 51311 - DNA, 50 bp, homo sapien
taatccatatattttaaacaatggakaattccttaagaatttaagtgagg

SEQ ID NO: 51312 - DNA, 50 bp, homo sapien
agatgggagaactgtgattggaacaytattgcaaaattactcttgcttta

SEQ ID NO: 51313 - DNA, 50 bp, homo sapien
caagtaatgactggtaacctatagaygatgcactaaaacaagacagatta

SEQ ID NO: 51314 - DNA, 50 bp, homo sapien
agacgatgcactaaaacaagacagaktatagaattctggaacacactcag

SEQ ID NO: 51315 - DNA, 50 bp, homo sapien
atgcagatcttgaaatgcttataaaycacaccatataggtgtgatcacca

SEQ ID NO: 51316 - DNA, 50 bp, homo sapien
caagccccactattcaagaggaaccrctagataaagaggtttttccttct

SEQ ID NO: 51317 - DNA, 50 bp, homo sapien
gtcttaagggaattgattgatagcasgttcaatatgactgttgattcgtg

SEQ ID NO: 51318 - DNA, 50 bp, homo sapien
ctgagttttgaggcaagaatcttcayatggttaaagctcaccagtgaatg

SEQ ID NO: 51319 - DNA, 50 bp, homo sapien
tcaggtgggcagatatgagaataccrgaccagatgatattgaaagagctt

SEQ ID NO: 51320 - DNA, 50 bp, homo sapien
tctccagagattgatttccactttgmaaggagtcattataaaaacctcgg

SEQ ID NO: 51321 - DNA, 50 bp, homo sapien
tgactcttgcaacattgtacttgtgraatcaactgaccagctgggagctt

SEQ ID NO: 51322 - DNA, 50 bp, homo sapien
tttgtattattaatcatctttcaaartagttccagctttagtgaacatta

SEQ ID NO: 51323 - DNA, 50 bp, homo sapien
aaggagagaggctgtaactcaccttyaacctcattatctgtatgacctcc

SEQ ID NO: 51324 - DNA, 50 bp, homo sapien
cataaggattaaatgggataataaawggaaagaatttagagcaatgccca

SEQ ID NO: 51325 - DNA, 50 bp, homo sapien
ttatgacggctgtttacaaagaccasagcagggagttccaggtagtttct

SEQ ID NO: 51326 - DNA, 50 bp, homo sapien
ggaaataattaggctctcaggtatasatgctttttaaattcttcattttg

SEQ ID NO: 51327 - DNA, 50 bp, homo sapien
attcatttttcataacatccacacargtatctatttttttggcattttaa

SEQ ID NO: 51328 - DNA, 50 bp, homo sapien
ttaaaccttgaaatgtcgaagtaaaytgacaccagtggtatgcacgggtc

SEQ ID NO: 51329 - DNA, 50 bp, homo sapien
ctagaaacagagacaactccttccaratcaaataaagatctaacatccca

SEQ ID NO: 51330 - DNA, 50 bp, homo sapien
gatctacagactgctttcctctaaaytgtgtaaatacaactcctttactt

SEQ ID NO: 51331 - DNA, 50 bp, homo sapien
ttagtataccattatagagcaataayaataatcacttacataatgtcttg

SEQ ID NO: 51332 - DNA, 50 bp, homo sapien
ggaaatggaaggcagttactctgaawagaatcattgtagagctttgcaca

SEQ ID NO: 51333 - DNA, 50 bp, homo sapien
ccaaaaaggtcacaccaaataagtawaaatacactagtcctagagtaaag

SEQ ID NO: 51334 - DNA, 50 bp, homo sapien
aagtcatgggagtatcaggttgaaaygaagacaaatccataggagacaaa

SEQ ID NO: 51335 - DNA, 50 bp, homo sapien
ggagcagggtgcctgtgtctttaccraaaggctctgacaagcaaaaacgg

SEQ ID NO: 51336 - DNA, 50 bp, homo sapien
ggctcagagctcccttcctgaaaaaytctatcccagggcaattgcttaac

SEQ ID NO: 51337 - DNA, 50 bp, homo sapien
tataaaacttctagcagaaaatagasagaaagctccttgccattggtctg

SEQ ID NO: 51338 - DNA, 50 bp, homo sapien
cacctaaaagattaggagactggagmatctatacgccaattcccagctat

SEQ ID NO: 51339 - DNA, 50 bp, homo sapien
ccaactcccgtcgtcctagaacacaratccagaaaggcaggcacctgagg

SEQ ID NO: 51340 - DNA, 50 bp, homo sapien
cagcagttcccaaatttgtctcctcrataatagggtccttcccgatcagt

SEQ ID NO: 51341 - DNA, 50 bp, homo sapien
ccccagtggaatcagattttccctcraagaccatgatggtatcggactag

SEQ ID NO: 51342 - DNA, 50 bp, homo sapien
ctctcaagactcaagacttcttcttraaccaaatttctcaccatcccaat

SEQ ID NO: 51343 - DNA, 50 bp, homo sapien
tttttaaagctctgtatttattttaygtaaacatccatctggttctatag

SEQ ID NO: 51344 - DNA, 50 bp, homo sapien
aagctttctgggtcttcttgacagarcaactcttttctcttctgtgccac

SEQ ID NO: 51345 - DNA, 50 bp, homo sapien
gttggtaaacataattacatcaacawaatgagtattacaatagtcacttc

SEQ ID NO: 51346 - DNA, 50 bp, homo sapien
aaaaagttaggagtggctttattgargaagtggtttggacagagtgaagt

SEQ ID NO: 51347 - DNA, 50 bp, homo sapien
cactcatcttctctccctctcgccartaaactgagttatttcttctgttt

SEQ ID NO: 51348 - DNA, 50 bp, homo sapien
caaagaccaataaccaactctgaaargtgcaagcccaggatttatatgtg

SEQ ID NO: 51349 - DNA, 50 bp, homo sapien
agcatccacataaaaagctaaaggcycagataacaggaaaaacagacaat

SEQ ID NO: 51350 - DNA, 50 bp, homo sapien
actgctttgataactagtgtaatcartcaggtctcccacatgcattatcc

SEQ ID NO: 51351 - DNA, 50 bp, homo sapien
acattatctttctctttactgtcacygccaatcctactgaagataaccac

SEQ ID NO: 51352 - DNA, 50 bp, homo sapien
ttgatttttaagaaaatcacataatsactagaaattttaacatcaaattt

SEQ ID NO: 51353 - DNA, 50 bp, homo sapien
ggttgcgaatccctcctgagggagaygcttgaaggcatgcctggaagttg

SEQ ID NO: 51354 - DNA, 50 bp, homo sapien
cagagttaaaataaattatttgatgmatgtgagtcaaaaagcaaaaagat

SEQ ID NO: 51355 - DNA, 50 bp, homo sapien
gccataactttaatttctagaatacrcaagcactttaagaaaaatcacat

SEQ ID NO: 51356 - DNA, 50 bp, homo sapien
atattaatctccatgatgacacagcragggaatacagagcccttttcatg

SEQ ID NO: 51357 - DNA, 50 bp, homo sapien
gaaactgacattaggtccctatgcgrcaatttctccctgcggccctggct

SEQ ID NO: 51358 - DNA, 50 bp, homo sapien
taacaacatttgtaagcagcaagtcmattaaaatcaaaagaatactacta

SEQ ID NO: 51359 - DNA, 50 bp, homo sapien
cttatgttaggttaagatgtgtggawctggtgacaccaatgctatgtgta

SEQ ID NO: 51360 - DNA, 50 bp, homo sapien
tattggaagacaacatcactttaccrcatgaatgcaatctaatgagatca

SEQ ID NO: 51361 - DNA, 50 bp, homo sapien
gtcatcaatgtaatttaatttagcaytcacagtaggattatgagttgggt

SEQ ID NO: 51362 - DNA, 50 bp, homo sapien
actgtgaatgctaaattaaattacaytgatgacacatagaaagatactta

SEQ ID NO: 51363 - DNA, 50 bp, homo sapien
tgtgaaaattatatgaaatgattaaktacagtaaggctcaatgtttcagc

SEQ ID NO: 51364 - DNA, 50 bp, homo sapien
aagatacttacataggcctaggacaygataagtactcaaaaacacttttt

SEQ ID NO: 51365 - DNA, 50 bp, homo sapien
tagacaccctttagttatacaaaacrgtttctaatattaagggagttgtc

SEQ ID NO: 51366 - DNA, 50 bp, homo sapien
tatttgtgtaataccatgagagcatyaaaggttgagaggccattccagtt

SEQ ID NO: 51367 - DNA, 50 bp, homo sapien
gcatctccactcagtttgttcttagycataggttcaggaacccatgcatt

SEQ ID NO: 51368 - DNA, 50 bp, homo sapien
tgcagttctcattctcatttgcttayggtattagaaaggtattgctgagt

SEQ ID NO: 51369 - DNA, 50 bp, homo sapien
tgtttcacctctcagaaatactcaasgacctagtcgctcactaatctagt

SEQ ID NO: 51370 - DNA, 50 bp, homo sapien
aagatatgactgtgctgagaagttgsatacacagtttaaagttcaggaga

SEQ ID NO: 51371 - DNA, 50 bp, homo sapien
gcagagaggacttctagagtacgcgrattgcatatcgtcaggcgaatagt

SEQ ID NO: 51372 - DNA, 50 bp, homo sapien
cctttgtttgcaaagtttgactgcayagttctgtacctcagttgtgagct

SEQ ID NO: 51373 - DNA, 50 bp, homo sapien
taatgttaaattacaagagttgaccrgattaatgttactccagaaagaag

SEQ ID NO: 51374 - DNA, 50 bp, homo sapien
cagtgccttctgttttgcaaatataygacttttggtagcactgttattaa

SEQ ID NO: 51375 - DNA, 50 bp, homo sapien
aggttaagcaccttatctaatgtcaygtagtaagcagaacaacagataac

SEQ ID NO: 51376 - DNA, 50 bp, homo sapien
ggaatctaccttttgtcctctttcayagtagacaggcttgacctccttcc

SEQ ID NO: 51377 - DNA, 50 bp, homo sapien
ctaggctcctctggatgtagtaggamcctgtaagagtatacaagaaagac

SEQ ID NO: 51378 - DNA, 50 bp, homo sapien
ggaatgacatcctttgtctctcctgrattggtggtcgcatggaaaatgtc

SEQ ID NO: 51379 - DNA, 50 bp, homo sapien
agaacataatctctgcagaagcccaratgatgagattcaaatccttgttt

SEQ ID NO: 51380 - DNA, 50 bp, homo sapien
agataaataaaccattgcttacaatyactaaatatccagctcaatttcct

SEQ ID NO: 51381 - DNA, 50 bp, homo sapien
tctggaaaaaaaacaacgaggcatawcaatcttggaatgggtcctgatgt

SEQ ID NO: 51382 - DNA, 32 bp, homo sapien
ggtacttggcactaaawtcactttagcattac

SEQ ID NO: 51383 - DNA, 50 bp, homo sapien
ggataattttgatgatgctcattaaytagatccaggaacaatgagtataa

SEQ ID NO: 51384 - DNA, 50 bp, homo sapien
atgacttcacctggtgaatgaaatayatgatgagttgtctggttaaatat

SEQ ID NO: 51385 - DNA, 50 bp, homo sapien
gagatccagcagagaagaggacaccrattgtttcaggaagatgcgcctct

SEQ ID NO: 51386 - DNA, 50 bp, homo sapien
taagaatggaagttccagtcagtccrattttctttagtccatattttaaa

SEQ ID NO: 51387 - DNA, 50 bp, homo sapien
tgcaaaaaaaattgcttggtagatayccaaaatatttctacataataaaa

SEQ ID NO: 51388 - DNA, 50 bp, homo sapien
atcatattaattgaattgcttaatawataatcttcaaatacttggctaat

SEQ ID NO: 51389 - DNA, 50 bp, homo sapien
tcttcactggatggagattacccaayggtcagatcataaactcagcaatc

SEQ ID NO: 51390 - DNA, 50 bp, homo sapien
tctagtataactcttgtagcaaatarctccccagaaaggcaaaactcaaa

SEQ ID NO: 51391 - DNA, 50 bp, homo sapien
tcaataccaagattactttagtgtayattatctgtagaagatgacagata

SEQ ID NO: 51392 - DNA, 50 bp, homo sapien
caggaagtattgagttttcctaaagyatctgtgagttattcattcaatca

SEQ ID NO: 51393 - DNA, 50 bp, homo sapien
aagtcataaaaaagagagaaatctargggagtttaaaaatcactctgcga

SEQ ID NO: 51394 - DNA, 50 bp, homo sapien
aaaagtagccacagcacttgcgttcrccggtttctgttcctcttagaggc

SEQ ID NO: 51395 - DNA, 50 bp, homo sapien
tcagacatccctttaccttagaatakagtgattccctttgagtcttgtag

SEQ ID NO: 51396 - DNA, 50 bp, homo sapien
ttatctttgaaaccgtagctctaaartcatttccactgagaaactttctg

SEQ ID NO: 51397 - DNA, 50 bp, homo sapien
tgaatgatgggcaaaggtaatgacaracatttagacacaacttaaaacaa

SEQ ID NO: 51398 - DNA, 50 bp, homo sapien
tcatctcttcgctcacgtttcaaggraaatatcttgtctgacccgtgaag

SEQ ID NO: 51399 - DNA, 50 bp, homo sapien
agttgggtctcagatctctcaaaaakatgtcttgccctgctgctgttggg

SEQ ID NO: 51400 - DNA, 50 bp, homo sapien
cttcattttctgtcctcttctctgaratcattattcgcagcgcctttaca

SEQ ID NO: 51401 - DNA, 50 bp, homo sapien
ttctcaaaacttgaagtattattagrccatatttattcatatcacatttt

SEQ ID NO: 51402 - DNA, 50 bp, homo sapien
ctgacaacatcaatttcctgagcctraaaccctttaattagtgcttaaaa

SEQ ID NO: 51403 - DNA, 50 bp, homo sapien
attttaagaaatagagagaataacakttttcattcttcatgctcatccag

SEQ ID NO: 51404 - DNA, 50 bp, homo sapien
ttttattaccaagtcctcatttcacrattatgactgacaaatgtgtggca

SEQ ID NO: 51405 - DNA, 50 bp, homo sapien
aactccaacttggcaagagtaagccraagaagaaaatgcaggaagcgagg

SEQ ID NO: 51406 - DNA, 50 bp, homo sapien
ctttggaaataaattgaatttgggcmatgttatgctagggatcctcagcc

SEQ ID NO: 51407 - DNA, 50 bp, homo sapien
tgctatccattcgatcaacatactcrgaaatatcaccccctccttccttc

SEQ ID NO: 51408 - DNA, 50 bp, homo sapien
aggaaattttaacactactactaatwagcatttactaagcatgttggcca

SEQ ID NO: 51409 - DNA, 50 bp, homo sapien
tttcattctctgattgttggtcctaygcttcatgctcaggatcctttctt

SEQ ID NO: 51410 - DNA, 50 bp, homo sapien
agcatacccagaattgtggttgacaytgggcacagtacattaaagaacag

SEQ ID NO: 51411 - DNA, 50 bp, homo sapien
gtacaacctaatgaccctggaatagratggagtcaaatcacactcaccat

SEQ ID NO: 51412 - DNA, 50 bp, homo sapien
tggagcatcgaaatggaactagccasgtataggaagagctgctgcaaaga

SEQ ID NO: 51413 - DNA, 50 bp, homo sapien
tgtttcaatgcgaagtttaaaataartcaatgccaaaaaagcccatgatc

SEQ ID NO: 51414 - DNA, 50 bp, homo sapien
aatgttaacatctgattaatgtaaaraaatatgtgtgcatggtttttctt

SEQ ID NO: 51415 - DNA, 50 bp, homo sapien
tgctaagcctgggaatacagctgtgmaacagacaaacatggtcgtggttt

SEQ ID NO: 51416 - DNA, 50 bp, homo sapien
atattttttattacaagcatttgcakctgggaatcatggtgacaccatgg

SEQ ID NO: 51417 - DNA, 50 bp, homo sapien
accctttctgccatataaggtaatayacacagattccaggaatttgaatg

SEQ ID NO: 51418 - DNA, 50 bp, homo sapien
gatgccagtgctctaatacgcactayatttcaagccaaagagacagattt

SEQ ID NO: 51419 - DNA, 50 bp, homo sapien
ctctctggagaattctaaaaagagaractccctggtcatgtcctgtagtg

SEQ ID NO: 51420 - DNA, 50 bp, homo sapien
agctaataacctctttcagtaattaygccttttaattatgaagcacaaac

SEQ ID NO: 51421 - DNA, 50 bp, homo sapien
agtttctcagtaagatcatgctctcratgggtcaataaaggtgaaaacta

SEQ ID NO: 51422 - DNA, 50 bp, homo sapien
ctcctagagcatctccctctgatcartgaagaaaataattccaaaaagag

SEQ ID NO: 51423 - DNA, 50 bp, homo sapien
gaactgtcagttaatacaacagccartagccataagcaagagattgggaa

SEQ ID NO: 51424 - DNA, 50 bp, homo sapien
ttctggagagatgcacatagcagccratgttgcagtttagaggtaatcat

SEQ ID NO: 51425 - DNA, 50 bp, homo sapien
agaggtgaattaggccactttcaatyatcttacatggtcagacccaaatc

SEQ ID NO: 51426 - DNA, 50 bp, homo sapien
atgctcatcttccatcatttgtgaaraaggactgcattttccctgctgct

SEQ ID NO: 51427 - DNA, 50 bp, homo sapien
ggctgggatggaggaagtggtgaacraataccagtggacaaccagccatt

SEQ ID NO: 51428 - DNA, 50 bp, homo sapien
ctttaatgctttagcctttatcacartactcgtcaatatgtgaggggaaa

SEQ ID NO: 51429 - DNA, 50 bp, homo sapien
tactgtaataatacattaaatactamccctcaatggacaaaacaatgtca

SEQ ID NO: 51430 - DNA, 50 bp, homo sapien
attgctctgtgtgacgagtcatgcartcttagatataactttactattca

SEQ ID NO: 51431 - DNA, 50 bp, homo sapien
ccctggaggaaagggagcttatgtargagaacctaagtttatgcaagcca

SEQ ID NO: 51432 - DNA, 50 bp, homo sapien
agtaaaataccaaaaactgtttggargaattggagagtttacactgtact

SEQ ID NO: 51433 - DNA, 50 bp, homo sapien
ctgggacatttctatgccaacaatargtatggtgacagcccatgctgtga

SEQ ID NO: 51434 - DNA, 50 bp, homo sapien
atgagttaaaaaatcactgtatccartaagtcaggttattctctaattca

SEQ ID NO: 51435 - DNA, 50 bp, homo sapien
gtaggattgcctaaattatccaccaraagttctgaatatgtaactgtatt

SEQ ID NO: 51436 - DNA, 50 bp, homo sapien
cctgttatgacacattgttacatacrctccctaacatgacatctagttgt

SEQ ID NO: 51437 - DNA, 50 bp, homo sapien
cccagaagagctgcaatatgtaagamggtgtcattaacctagaaaacaga

SEQ ID NO: 51438 - DNA, 50 bp, homo sapien
gtaaagttgagtttacaagctgagcrccagaaaaacaaataaaagagact

SEQ ID NO: 51439 - DNA, 50 bp, homo sapien
ttttggtaataacagctgtaaactayatttggaaaataaaattttctctc

SEQ ID NO: 51440 - DNA, 50 bp, homo sapien
ggaattcagccttgatgaatagtacwcaaaaagcataaagttaagttgtc

SEQ ID NO: 51441 - DNA, 50 bp, homo sapien
ttatttcttacacacattatctcacygcattaatttatcttgtttaagta

SEQ ID NO: 51442 - DNA, 50 bp, homo sapien
cacagatggaagtgttcactttgaasaggagactagaatgatcccaactt

SEQ ID NO: 51443 - DNA, 50 bp, homo sapien
taatgattaagatctagaatatacasagtcctagaaatcaataagaatga

SEQ ID NO: 51444 - DNA, 50 bp, homo sapien
cttttcccagggagcctcttgagtcratgctaactggttgttgaaattac

SEQ ID NO: 51445 - DNA, 50 bp, homo sapien
agcacagtaaaataacatctgatacsaaattcatttgttttcccagcatt

SEQ ID NO: 51446 - DNA, 50 bp, homo sapien
agctatttagcttgactgtgatgaaytgtgtctctgtgcacccagactag

SEQ ID NO: 51447 - DNA, 50 bp, homo sapien
ctaattcagttctgacagtatttgcycagagacagtgtcagatctcacag

SEQ ID NO: 51448 - DNA, 50 bp, homo sapien
gcccatatttttcttactccttcaaygaaaatatatgttgctagaggttt

SEQ ID NO: 51449 - DNA, 50 bp, homo sapien
gaagaactagttgattttgataagaraactagtggcaacataaggcatgc

SEQ ID NO: 51450 - DNA, 50 bp, homo sapien
catgaaaaatgtgtccttgtaaacakcatattattggatcatatttattt

SEQ ID NO: 51451 - DNA, 50 bp, homo sapien
tttactgctgttcttaaagtgattaycaactgcggaccattcttgtactt

SEQ ID NO: 51452 - DNA, 50 bp, homo sapien
aactccatgctccctcgactattacygagtatccttcacaggctagtggt

SEQ ID NO: 51453 - DNA, 50 bp, homo sapien
gaaggaatatgatagaaatcagtagmcaagctccaaaatgcaccctaagg

SEQ ID NO: 51454 - DNA, 50 bp, homo sapien
tttgtcattaggaaatacttcaaaaygaggtcacttgaaataactactgt

SEQ ID NO: 51455 - DNA, 50 bp, homo sapien
ggaattctagagtgtatctttttcawatattaaatcttgtggaaaaaacc

SEQ ID NO: 51456 - DNA, 50 bp, homo sapien
tatataagtattcattataattttaygtttgtttgaaattattcataaaa

SEQ ID NO: 51457 - DNA, 50 bp, homo sapien
tcaataatagaaaaatacagatataracacaaattaatatttcaagcctc

SEQ ID NO: 51458 - DNA, 50 bp, homo sapien
ctttcactacacaaagtacctactakgaaccaggcattgttgtaggctct

SEQ ID NO: 51459 - DNA, 50 bp, homo sapien
gcattcaacattgtcagatgtctaaycttctttctgttgaacatgcaatc

SEQ ID NO: 51460 - DNA, 50 bp, homo sapien
gatccacccgcataccattaggcagmaattccacctctggaaatttgtct

SEQ ID NO: 51461 - DNA, 50 bp, homo sapien
aataggacaatttttttttctaatcycacacagtttctttgactcagaaa

SEQ ID NO: 51462 - DNA, 50 bp, homo sapien
aaaaggatgatgattactatcatgaraacatatgacaatataaaactcgc

SEQ ID NO: 51463 - DNA, 50 bp, homo sapien
taaggtaaattcaaagagttccacaycaaaacagcttgatattatcaaat

SEQ ID NO: 51464 - DNA, 50 bp, homo sapien
ccattggtgcttatagatctttttawcatcttgacaagtattaaaagtga

SEQ ID NO: 51465 - DNA, 50 bp, homo sapien
gtcacaatttacatatttttatatcrcatatttcttagcaacttaatgta

SEQ ID NO: 51466 - DNA, 50 bp, homo sapien
gctctgatagctccatcagttcctascctacagctgagcacggcttagcc

SEQ ID NO: 51467 - DNA, 50 bp, homo sapien
taaaattgccggtttgacaggagatwatctatgtaaagagggagataagt

SEQ ID NO: 51468 - DNA, 50 bp, homo sapien
catgcagtttccatcaaattccacayactcggttctgttggaaataagca

SEQ ID NO: 51469 - DNA, 50 bp, homo sapien
tccataagtttgtggctgttttccaytaattgttcgtatttttcttgaac

SEQ ID NO: 51470 - DNA, 50 bp, homo sapien
gaccctctgtgtttttcataagaaartctgacatacttaacagctcaaga

SEQ ID NO: 51471 - DNA, 50 bp, homo sapien
agcagggagcagttatttttgactayatttgtaaagcacagatacatttc

SEQ ID NO: 51472 - DNA, 50 bp, homo sapien
ttactctgtcttcatccaagtatgaygatcgactcgcctttgtccttaaa

SEQ ID NO: 51473 - DNA, 50 bp, homo sapien
tgttgttatgacgtttgctcttgacygatccacttttgctttgactggac

SEQ ID NO: 51474 - DNA, 50 bp, homo sapien
acatccttctcgttagaaactcaggraccttattataatactgttactgc

SEQ ID NO: 51475 - DNA, 50 bp, homo sapien
catgacttcaggtaccaggctgggawctaccctacgaaaagcatcacaat

SEQ ID NO: 51476 - DNA, 50 bp, homo sapien
tagacagggaattctaaactaagacrcatacatttgagagggatgtcagg

SEQ ID NO: 51477 - DNA, 50 bp, homo sapien
gtcttggatatggtcatcaactgacyatatctatctgtctatctaatcta

SEQ ID NO: 51478 - DNA, 50 bp, homo sapien
agaatattttggaaattaatgagacygtatacctaaaatcctgaatagtt

SEQ ID NO: 51479 - DNA, 50 bp, homo sapien
agagggatgtcaggtatcaggaaaaraacactcagagaactttcctctca

SEQ ID NO: 51480 - DNA, 50 bp, homo sapien
tgactacatacacaaatatagataaygaaagcattccatttgatcagccg

SEQ ID NO: 51481 - DNA, 50 bp, homo sapien
agagaactttcctctcaacactgcayggctgctacaggatcaggtgaata

SEQ ID NO: 51482 - DNA, 50 bp, homo sapien
tctgccctctgggagtgtttcttcayggcccttggttccaccctcagaag

SEQ ID NO: 51483 - DNA, 50 bp, homo sapien
caaagtgtaagttctaggttacaaamccaacatcaagctcactcagcaga

SEQ ID NO: 51484 - DNA, 50 bp, homo sapien
cagcatttgctgataaactccagatraagtgtaagagaaagaaaagccaa

SEQ ID NO: 51485 - DNA, 50 bp, homo sapien
ttcataacaagccataggagacgaaytactcacaaagtggaagattcaaa

SEQ ID NO: 51486 - DNA, 50 bp, homo sapien
ttctgtaagtaattattgaactccaraggtgtcttttttgagtaatgtgt

SEQ ID NO: 51487 - DNA, 50 bp, homo sapien
tcaagattaacttaacagaactacayggttggagaaacagttcaaacttt

SEQ ID NO: 51488 - DNA, 50 bp, homo sapien
gagacacaaagcctagccatatcaamtaccaagctgggagttcttcatca

SEQ ID NO: 51489 - DNA, 50 bp, homo sapien
tttaattggttatgagttatttaccrccttcctactaataagacaacaaa

SEQ ID NO: 51490 - DNA, 50 bp, homo sapien
gccacaacattttcatttgttcttaygtattcttagaccagatgaagtgg

SEQ ID NO: 51491 - DNA, 50 bp, homo sapien
tgcagcagagaacaagtttaatgacygcagggtactgagagaggagatga

SEQ ID NO: 51492 - DNA, 50 bp, homo sapien
ctcaatgagggtgtataaaccacagyccaggctaagtacagcacagtcac

SEQ ID NO: 51493 - DNA, 50 bp, homo sapien
tatgtgaggagaagggatgccactckaatgctcagggcatttcacggcct

SEQ ID NO: 51494 - DNA, 50 bp, homo sapien
cccacaatggtcttactacccgattraagaagataggcttttaaaagaaa

SEQ ID NO: 51495 - DNA, 50 bp, homo sapien
attacaagattacaaggtgaagaacyacagactttatctaatagtccatg

SEQ ID NO: 51496 - DNA, 50 bp, homo sapien
gtactagctgttccctgctttagacrctgaccttgaatatcttacttcgt

SEQ ID NO: 51497 - DNA, 50 bp, homo sapien
gttatccctcaggattatcagagtcrctgtgcatcatggcaaaagaaaag

SEQ ID NO: 51498 - DNA, 50 bp, homo sapien
gcaaaagaaaagaatataccttctayaaccaaatataatagatacagttg

SEQ ID NO: 51499 - DNA, 50 bp, homo sapien
tcatgctaaattccaatgatcattcyctaaagtgcctgcagttttgacta

SEQ ID NO: 51500 - DNA, 50 bp, homo sapien
agttcttagaatgatctatcacttgratataaatccttacaatttttagt

SEQ ID NO: 51501 - DNA, 50 bp, homo sapien
ctccaatgaacaaagacatagcaggmattatagcagtatctgaggttgac

SEQ ID NO: 51502 - DNA, 50 bp, homo sapien
ctgtggtagttatgctaaatttttarctgtgtatatggctttctgtgact

SEQ ID NO: 51503 - DNA, 50 bp, homo sapien
tcatgcacatcttcaaaaatgctaargaaatcacaaagtcaagatgttgt

SEQ ID NO: 51504 - DNA, 50 bp, homo sapien
gttgctctacattgtttttcacttcratgtttgtcttgtgtgaaaacagt

SEQ ID NO: 51505 - DNA, 50 bp, homo sapien
cccctccacaacacaggcacaaaatsaagtccagtgagattctgaacatg

SEQ ID NO: 51506 - DNA, 50 bp, homo sapien
taaaatgaaaaactgcttaggataartacaaatcaagagatagaagctaa

SEQ ID NO: 51507 - DNA, 50 bp, homo sapien
gagcttggcctctcggtttagttgaycttgcacttgaatactattttaag

SEQ ID NO: 51508 - DNA, 50 bp, homo sapien
gtagaatcagagcattggccatataygaaagaggaaatctgatgtctctt

SEQ ID NO: 51509 - DNA, 50 bp, homo sapien
tttaaacaataagtctctaaatagtsaaaactgcaggcactttagggaat

SEQ ID NO: 51510 - DNA, 50 bp, homo sapien
gggggctctagggaaatacggtgtaygctgtataaactagacttttacat

SEQ ID NO: 51511 - DNA, 50 bp, homo sapien
ttatcaaagtgagttaacagaatccratttaaataccaattcagatttgt

SEQ ID NO: 51512 - DNA, 50 bp, homo sapien
ctaaataatgctctattttaacgtaygccacacagtagcggccagtgaat

SEQ ID NO: 51513 - DNA, 50 bp, homo sapien
ttcttaatccatagaattttgaaagsaatctgtctactttaacatatgac

SEQ ID NO: 51514 - DNA, 50 bp, homo sapien
tgctttctgcatcttcatattttccraggcatgcatgaatcacctccgtt

SEQ ID NO: 51515 - DNA, 50 bp, homo sapien
ctttgatagtattaaagaagccaagwctaagttctcaataaaaactctgg

SEQ ID NO: 51516 - DNA, 50 bp, homo sapien
ttaagaaggtgtcttcctgagtagasagcttcctcccaaaaccttcagac

SEQ ID NO: 51517 - DNA, 50 bp, homo sapien
ctgtgtccctcctcactgggtttccrctgcacacttggttgcagtgaagg

SEQ ID NO: 51518 - DNA, 50 bp, homo sapien
tgtttctaggagaactaccttcacaratatgtgtccactacaatgataaa

SEQ ID NO: 51519 - DNA, 50 bp, homo sapien
tgctgaggtttagcatttcttttccrcatatcccatcacactgtgtccct

SEQ ID NO: 51520 - DNA, 50 bp, homo sapien
ggccaatatgtcaagactcttaaaasgctgaatatttccctgtttgtttt

SEQ ID NO: 51521 - DNA, 50 bp, homo sapien
aatgtcagtgacaagatagtactgargacccctgactcctgggatcatgt

SEQ ID NO: 51522 - DNA, 50 bp, homo sapien
ggcaagtattacttagacagcctaakaaaggaaaacaaatgataatgccc

SEQ ID NO: 51523 - DNA, 50 bp, homo sapien
tcatgactattaaatgtattaagtarctaggaattatatccccattttat

SEQ ID NO: 51524 - DNA, 50 bp, homo sapien
gccttaatccagaatttttgtcaacyatattactgtggtttgttttgatg

SEQ ID NO: 51525 - DNA, 50 bp, homo sapien
ttgagctcctgttgagattagaagawggaagtaacagttttagatggaaa

SEQ ID NO: 51526 - DNA, 50 bp, homo sapien
aaaatcatatgctctatagaagataygctgtccacttttataagaaaata

SEQ ID NO: 51527 - DNA, 50 bp, homo sapien
ttgaacagtctctttctaaaaccaaragaactggtaattcagagaaatac

SEQ ID NO: 51528 - DNA, 50 bp, homo sapien
actgggaagcccattccaatgagtcratccttggcacggtccaggccaca

SEQ ID NO: 51529 - DNA, 50 bp, homo sapien
aagatgtgtcaataggtaggttcacmaagtggaagatgtaacaggtcgat

SEQ ID NO: 51530 - DNA, 50 bp, homo sapien
tagcaaattatcccgcataactcaaycatttcttagtggctgagggtcat

SEQ ID NO: 51531 - DNA, 50 bp, homo sapien
gttatgcgggataatttgctaagacygtagaactaatacactatataaag

SEQ ID NO: 51532 - DNA, 50 bp, homo sapien
tgagaaagagacccagaatcaaatayatgcatgaaagtctgaactcatag

SEQ ID NO: 51533 - DNA, 50 bp, homo sapien
tttatcagttaggcacgagtgacagraatcccaattcatagtgttaagca

SEQ ID NO: 51534 - DNA, 50 bp, homo sapien
tatttttcagtgtggttagtgtttaygcactgaggacatgaaaattaata

SEQ ID NO: 51535 - DNA, 50 bp, homo sapien
aagtggcatttgattggttgaagaayagaaacctgatgtaatggagcaaa

SEQ ID NO: 51536 - DNA, 50 bp, homo sapien
aattttctgcattaatttactgagcrccatcctgtatcttatttatgctt

SEQ ID NO: 51537 - DNA, 50 bp, homo sapien
attttcatccaaatttagtgggactsaggtatctaataattctctggctt

SEQ ID NO: 51538 - DNA, 50 bp, homo sapien
tttttatagtgaccataatagcaaasactttatggcaatgcagaataaaa

SEQ ID NO: 51539 - DNA, 50 bp, homo sapien
agataattcaccaagaagaacacctwaagctgaagaacagaatgagaaag

SEQ ID NO: 51540 - DNA, 50 bp, homo sapien
tgtgagatcaaagctgcaggagataratggtctctatgtgaggagggaca

SEQ ID NO: 51541 - DNA, 50 bp, homo sapien
gccatccatatcatcattgcaccatyatgataacttgctggttaaaatag

SEQ ID NO: 51542 - DNA, 50 bp, homo sapien
tgattcatgccagatgggatgataaygaactttacaattatgcagtaatt

SEQ ID NO: 51543 - DNA, 50 bp, homo sapien
tattaatctgtcatcaatgattccaygagtcaataaaactcacttaaaga

SEQ ID NO: 51544 - DNA, 50 bp, homo sapien
ggaatcattgatgacagattaataayttaaggttcaagtctggcattgct

SEQ ID NO: 51545 - DNA, 50 bp, homo sapien
tatttatttgtaccttctatttatcycaatatctactaaacaacttttat

SEQ ID NO: 51546 - DNA, 50 bp, homo sapien
cactgaatacatctgaggagaaaaaygatatcttaataatactccatttc

SEQ ID NO: 51547 - DNA, 50 bp, homo sapien
ctgggagattggttcctcagaagggkatctctcagtctgaccctatacac

SEQ ID NO: 51548 - DNA, 50 bp, homo sapien
agaaataaagtctaaactatacatayattctaacaatgttacggagttaa

SEQ ID NO: 51549 - DNA, 50 bp, homo sapien
aaggtttgaatgtagaaagaaaaccrcaggctgtcagacaaatgtattaa

SEQ ID NO: 51550 - DNA, 50 bp, homo sapien
agactgaccatcctttgtacattaamaaactaccaccaaacgaactttaa

SEQ ID NO: 51551 - DNA, 50 bp, homo sapien
ccttcagtcaaatactatttattgascactagctttgtgcaatgactgag

SEQ ID NO: 51552 - DNA, 50 bp, homo sapien
ttaattcataatcacctcaactgccragattatttagcaatattcaagag

SEQ ID NO: 51553 - DNA, 50 bp, homo sapien
ttcttataattttatgtgctcttgakaagatggatgattaagaataatat

SEQ ID NO: 51554 - DNA, 50 bp, homo sapien
tgtctgtggttctggctattttttgmactgttaatcgctagtcctcttta

SEQ ID NO: 51555 - DNA, 50 bp, homo sapien
gctcagagggtcgggaaatatcagtsacaaccataaactgagcatgttat

SEQ ID NO: 51556 - DNA, 50 bp, homo sapien
tgatgtattccaacttcaaaatagaygacttcaactttattatatgatgt

SEQ ID NO: 51557 - DNA, 50 bp, homo sapien
ctggaatcatcaagtaatggtagtargagcagtagcagtgggtgttgtag

SEQ ID NO: 51558 - DNA, 50 bp, homo sapien
taaaagggaaaccattataacaacarcatctacttactgaacattattta

SEQ ID NO: 51559 - DNA, 50 bp, homo sapien
ttgtgattagggaatgaagatatcayggaagatcaagataggtttggcaa

SEQ ID NO: 51560 - DNA, 50 bp, homo sapien
ccctttgcttttggtaatgtgaaaayatggattgaagaatgaatgaaatc

SEQ ID NO: 51561 - DNA, 50 bp, homo sapien
atttaaatgctttaattgggaatcayactgtcagaactgaattagaaata

SEQ ID NO: 51562 - DNA, 50 bp, homo sapien
agggacctaccagtttgctaccttayacttttaagccacaggaagcttta

SEQ ID NO: 51563 - DNA, 50 bp, homo sapien
ttccaagtgggatatctttaaattayggatacttttcaattgagcctaat

SEQ ID NO: 51564 - DNA, 50 bp, homo sapien
ctgaaaccaccatccctcaggtaatractcagtgatccaggttgcttcaa

SEQ ID NO: 51565 - DNA, 50 bp, homo sapien
aacacaatcattcactttgagtatawataggtaaaacaggaagaggaatc

SEQ ID NO: 51566 - DNA, 50 bp, homo sapien
accctattaaaaaataattgagacargatgattaaacttgcatcacacag

SEQ ID NO: 51567 - DNA, 50 bp, homo sapien
aaatatctaccagtgctggacttgarattcataaacctggattccaggat

SEQ ID NO: 51568 - DNA, 50 bp, homo sapien
actttgaggcagattttgaattagarctcatattgactaagcatccaacc

SEQ ID NO: 51569 - DNA, 50 bp, homo sapien
tcctcagaaaagtaatagtgtgttaygaggacactagatacaatactctt

SEQ ID NO: 51570 - DNA, 50 bp, homo sapien
gggttggagacagaatcaagagttargtgtggtgttcaggtggacaggtt

SEQ ID NO: 51571 - DNA, 50 bp, homo sapien
gacaattactgccatccatctcttayatgtgcccctaaataagcactaac

SEQ ID NO: 51572 - DNA, 50 bp, homo sapien
atcaggggtaagaaatagtttaaacmcatttgcatgaacaaaggtagtct

SEQ ID NO: 51573 - DNA, 50 bp, homo sapien
tacatgcctaggataatgctgtatayggtaggctggagatctcagtgcta

SEQ ID NO: 51574 - DNA, 50 bp, homo sapien
agggacaaatacatctctgctagacyggaatgaagtagttatggaaaaca

SEQ ID NO: 51575 - DNA, 50 bp, homo sapien
tctttgtcatttacatttgtgattckcattaaggcccataactttaacac

SEQ ID NO: 51576 - DNA, 50 bp, homo sapien
tctaagctcatcataggaatcatcaygtattcacaaacctcattcgttag

SEQ ID NO: 51577 - DNA, 50 bp, homo sapien
cccatcctgaccgcgactgcgcggcsgagaactggttaagctgccccgga

SEQ ID NO: 51578 - DNA, 50 bp, homo sapien
taacatcctaatcatactccattagraattatctgtcttttgattaaata

SEQ ID NO: 51579 - DNA, 50 bp, homo sapien
ctattttcatttcaaagtttcaagcycaagtctatttaaataagctgaaa

SEQ ID NO: 51580 - DNA, 50 bp, homo sapien
tggtctatgagacaaatgagaatccrcttacttatctagctttgtctttg

SEQ ID NO: 51581 - DNA, 50 bp, homo sapien
ccagtgtatattgatctaatgttcastaatactcttagaaattgatactg

SEQ ID NO: 51582 - DNA, 50 bp, homo sapien
tttgagaccacaggaaatactgactyactttttctaaagagacaactgat

SEQ ID NO: 51583 - DNA, 50 bp, homo sapien
aaagaatcctgccaaataaatctacrctaagacacatcataataaaaata

SEQ ID NO: 51584 - DNA, 50 bp, homo sapien
agctgagggaagggccgttcaggtaragtgaaaggaatgaagatgtgaac

SEQ ID NO: 51585 - DNA, 50 bp, homo sapien
ccaaggagatttgttaaaagggtacsattgtcctgtgatctagagtagca

SEQ ID NO: 51586 - DNA, 50 bp, homo sapien
tttctcttggtatctgttaacattasgagggataaatgtgtatgtaagga

SEQ ID NO: 51587 - DNA, 50 bp, homo sapien
attaaactgtacactttaaattagtwaattgtattgtttgtgaattatat

SEQ ID NO: 51588 - DNA, 50 bp, homo sapien
acgtattcacaaacctcattcgttakaacatgccagtaaaggaaaaatat

SEQ ID NO: 51589 - DNA, 50 bp, homo sapien
agaaaagtagagcagagcagaatgcrgaaatattagagaacatcgcccac

SEQ ID NO: 51590 - DNA, 50 bp, homo sapien
aatttatcacatatttgatacatagmatttaccaagaatgtttggaatct

SEQ ID NO: 51591 - DNA, 50 bp, homo sapien
gtgttgaaataatacctcaatttatyacatatttgatacatagcatttac

SEQ ID NO: 51592 - DNA, 50 bp, homo sapien
tttctgtttgaaaattagtctgacayattctctgatttaatttgtcaaaa

SEQ ID NO: 51593 - DNA, 50 bp, homo sapien
aagtagagtcacaagaaaatctttasgtcaccatcagacaactttggtaa

SEQ ID NO: 51594 - DNA, 50 bp, homo sapien
aggttggggaccactgctctagctamcctagactcctgatgatttgccat

SEQ ID NO: 51595 - DNA, 50 bp, homo sapien
aacaaaatagtttgaagccagatgargtagattagaattgaattttgcaa

SEQ ID NO: 51596 - DNA, 50 bp, homo sapien
ctctatgtttcttaatattttgaacyaaggatccatttgagaatttgatg

SEQ ID NO: 51597 - DNA, 50 bp, homo sapien
aagagaattggaaaaacattattaastcaggcaaaggaaaaatgaaatgc

SEQ ID NO: 51598 - DNA, 50 bp, homo sapien
aaatatgaattcttcaatatcaaaargtcatattgtttactaatactgct

SEQ ID NO: 51599 - DNA, 50 bp, homo sapien
tgaaactaagaaaccacattgaatayggaaacaaatttcaggatcaaaag

SEQ ID NO: 51600 - DNA, 50 bp, homo sapien
atgtacctgacagttatggccacacraatggatgaaaccattgaaaggga

SEQ ID NO: 51601 - DNA, 50 bp, homo sapien
agcaatcaaagtgtttggtgatttayctaagatgcatttctaaattctgg

SEQ ID NO: 51602 - DNA, 50 bp, homo sapien
atttctaaattctggatacgttaaasaaaacttcaattcccatatgatgt

SEQ ID NO: 51603 - DNA, 50 bp, homo sapien
catctgttctccctcttcttcatacrcagccactgaataggaagaagtac

SEQ ID NO: 51604 - DNA, 50 bp, homo sapien
atttgtttgcaaataaaacggatgaktagtgataaagcaaacagcaaaca

SEQ ID NO: 51605 - DNA, 50 bp, homo sapien
atacattatatttcagcaggaagacmagatattaagcagctaaattcatt

SEQ ID NO: 51606 - DNA, 50 bp, homo sapien
actgaatggcatgcaaataagcaaartatagcatgtaagtgctctgaaga

SEQ ID NO: 51607 - DNA, 50 bp, homo sapien
ctcatttagcatgtaaaattccaaayggcttcgtgagtgattatctgagt

SEQ ID NO: 51608 - DNA, 50 bp, homo sapien
gaaaagagggccaagtgtatgatcartcctatattgtaaaaagataactt

SEQ ID NO: 51609 - DNA, 50 bp, homo sapien
caagagtactgtcaaacctttgagaragtactgctgaatcttcagggaag

SEQ ID NO: 51610 - DNA, 50 bp, homo sapien
tgagaaacaataagtccttattgtaycctggcatttaattagataagtaa

SEQ ID NO: 51611 - DNA, 50 bp, homo sapien
agtaaagaaaccttatctgaaatcawacttctagggtctaatttttgact

SEQ ID NO: 51612 - DNA, 50 bp, homo sapien
actataatgtttttaaaaggtaagayaccacatagaatagtaataagttc

SEQ ID NO: 51613 - DNA, 50 bp, homo sapien
taggtaaacctaatcctaactaatayagactaagttgtctgccaaagcaa

SEQ ID NO: 51614 - DNA, 50 bp, homo sapien
catcagagactgaaactgccagtagraaatacaacccacatccaacaagg

SEQ ID NO: 51615 - DNA, 50 bp, homo sapien
ccgtcaagccagatgatggtaggtayatttagcaacaaagttctatacaa

SEQ ID NO: 51616 - DNA, 50 bp, homo sapien
aacacaatgagaagattgcataatamagtagaaagaaccagattctaggt

SEQ ID NO: 51617 - DNA, 50 bp, homo sapien
aaaatttccttgctaatagctcatayagtgcctggcatgcaatcaacact

SEQ ID NO: 51618 - DNA, 50 bp, homo sapien
ttcaagtctcactatcatttctaccratgaactagtcctccatgttcacc

SEQ ID NO: 51619 - DNA, 50 bp, homo sapien
agtagaattttatatccaggcaaacygtcattcaaatatggggacataaa

SEQ ID NO: 51620 - DNA, 50 bp, homo sapien
ggggaaaatcctaaaaatgcctaacrattaatgaatggttaataaattag

SEQ ID NO: 51621 - DNA, 50 bp, homo sapien
agctgggctagtctcttagaagaagscttaggcctagtccttgatcacct

SEQ ID NO: 51622 - DNA, 50 bp, homo sapien
atgatattgcatgtaagagtttccayggcaatatctataggtggatttgt

SEQ ID NO: 51623 - DNA, 50 bp, homo sapien
aaggggctgttgaaaagattaatgasattgtgtatacaaaattccagcca

SEQ ID NO: 51624 - DNA, 50 bp, homo sapien
agaattcatttaaaaatgaatcctaygaaatgttaggtgaacctaaacta

SEQ ID NO: 51625 - DNA, 50 bp, homo sapien
attttgacttcctacaacttctgaawttaatggaagatagtttccaaatt

SEQ ID NO: 51626 - DNA, 50 bp, homo sapien
ggcacttactctgggctattttcaawcacctcactaggtgtcactagccc

SEQ ID NO: 51627 - DNA, 50 bp, homo sapien
atgttgacataacacagatgaaggtracaccagatagatgaaaacctaaa

SEQ ID NO: 51628 - DNA, 50 bp, homo sapien
aaggctttatcttaccatgcattcartagtttcactggacagaaactgat

SEQ ID NO: 51629 - DNA, 50 bp, homo sapien
ccctcccattgcaattgatcccggargtcgctgggctgtcactggatctc

SEQ ID NO: 51630 - DNA, 50 bp, homo sapien
acactaaaaaacctctgcattaaggsaataactcatgactctgaagccta

SEQ ID NO: 51631 - DNA, 50 bp, homo sapien
ttagagatttgtgtgctatcacaaargacagtggaagcaaaaccagagtg

SEQ ID NO: 51632 - DNA, 50 bp, homo sapien
acagttctaggagatgataataatayattccttgtgatgactgttcatat

SEQ ID NO: 51633 - DNA, 50 bp, homo sapien
catattcagtggtgtgcaggtaaaamtttaacataggttctcgaaacatg

SEQ ID NO: 51634 - DNA, 50 bp, homo sapien
cttccttccactgcttttctgaatcrcaaccactgttttctaggtgccat

SEQ ID NO: 51635 - DNA, 50 bp, homo sapien
aatcagctaattatcatcaaagaaayagttatcctatctaagaaattcaa

SEQ ID NO: 51636 - DNA, 50 bp, homo sapien
cataaagacaacttgtgactagagayaaattgcaattttatttcattgag

SEQ ID NO: 51637 - DNA, 50 bp, homo sapien
aaatcttagtgaccttccatgtcatyagaacagtcaaaacttctcaacta

SEQ ID NO: 51638 - DNA, 50 bp, homo sapien
ctcaaaagaggaaatgtatcacagakgctaacagatgacaatgtatctta

SEQ ID NO: 51639 - DNA, 50 bp, homo sapien
agaataatttatgaatccagtttagwacacagttaatgtccaacctgtgc

SEQ ID NO: 51640 - DNA, 50 bp, homo sapien
tgatagatgattctacaaatgattaratgaaaagcaggataaaattcatg

SEQ ID NO: 51641 - DNA, 50 bp, homo sapien
cttgtgagtgattttagaaatcctgratgcaaatcccaatatttatagca

SEQ ID NO: 51642 - DNA, 50 bp, homo sapien
aaaatgaattcagtcttccccagtaygaaaattgctcaaagattaattta

SEQ ID NO: 51643 - DNA, 50 bp, homo sapien
attactaagggtttgctaggacttaycatgggttttctcagcttagaatg

SEQ ID NO: 51644 - DNA, 50 bp, homo sapien
aatatccagtaaacataaaattatastaagcctcagcagtgatcaaggaa

SEQ ID NO: 51645 - DNA, 50 bp, homo sapien
tgaattctttgtcagttatctaaaamccttcatttatcaagaactttatt

SEQ ID NO: 51646 - DNA, 50 bp, homo sapien
aggctcatatgtaaaagttgggatargaattgctcaaaagctcttaatac

SEQ ID NO: 51647 - DNA, 50 bp, homo sapien
gtactggctgtgcctcttgctggcartattactgtggacaagtttcttaa

SEQ ID NO: 51648 - DNA, 50 bp, homo sapien
agggtttgatctgccatcataataamtgcataaggccttactcaagcaaa

SEQ ID NO: 51649 - DNA, 50 bp, homo sapien
catggtaatttctattttcgtcaaaycaccagggtccagctgaggcttca

SEQ ID NO: 51650 - DNA, 50 bp, homo sapien
attcagtgaatttcaagtcacataartgttttgaatgttgtcctaagcac

SEQ ID NO: 51651 - DNA, 50 bp, homo sapien
accaaagtaatagacaaactttatcmagctgagtgatcttatttataact

SEQ ID NO: 51652 - DNA, 50 bp, homo sapien
taaatgattggtttatagatcctgarctaaagagagggtacaaatgtgat

SEQ ID NO: 51653 - DNA, 50 bp, homo sapien
tgaggcagtaagaataatagcctgaygaaaggttaacgttttaatgtacg

SEQ ID NO: 51654 - DNA, 50 bp, homo sapien
ttccaattgtcccagtatagtttggmatggctcatatcaatctagcagca

SEQ ID NO: 51655 - DNA, 50 bp, homo sapien
gaaactgcttatttagaaaagtagaraaagttatggcagtgaggaagtca

SEQ ID NO: 51656 - DNA, 50 bp, homo sapien
agtttttatggaagttcaggattcaygaggattgtggaaaagtacaacac

SEQ ID NO: 51657 - DNA, 50 bp, homo sapien
aagtactaaagaaaaccttgattaargaagtaaaggaagatataacaatg

SEQ ID NO: 51658 - DNA, 50 bp, homo sapien
aacaatggtgtattcttctatttcayaatttcactggatagccatataga

SEQ ID NO: 51659 - DNA, 50 bp, homo sapien
ggattagcccactaaaatttaagtgratatgaggaggcacatgtaaaaga

SEQ ID NO: 51660 - DNA, 32 bp, homo sapien
tcatatacaaattagtwacatgggattttttg

SEQ ID NO: 51661 - DNA, 50 bp, homo sapien
gtgggctaatccattattttccctayattgtgccagtactttgtattatc

SEQ ID NO: 51662 - DNA, 50 bp, homo sapien
gtaacactagcattttcaaccatgawgagagtagagtcgttgtgagaaaa

SEQ ID NO: 51663 - DNA, 50 bp, homo sapien
gctgaagtttgggagaatacagatartaagacctagcattctttgaatga

SEQ ID NO: 51664 - DNA, 50 bp, homo sapien
aaacatgacaagaatgcttttagcaracaagcagtcaagagttgtgatct

SEQ ID NO: 51665 - DNA, 50 bp, homo sapien
tttcctcagctgttacataaaagaaktgcactatgattgctgaattttct

SEQ ID NO: 51666 - DNA, 50 bp, homo sapien
gtgcaagccaaatgttaaaaggaagycaattttgcccagtatacaatcta

SEQ ID NO: 51667 - DNA, 50 bp, homo sapien
ccaagaagggagatttctccttctawgattgtgcttttgcttattattca

SEQ ID NO: 51668 - DNA, 50 bp, homo sapien
aatacagatggaactttgggatgagwccatactttacatgttaggttaat

SEQ ID NO: 51669 - DNA, 50 bp, homo sapien
aactgtttcccagctagtgcataacrctttaccgtctgacttaaaaaaat

SEQ ID NO: 51670 - DNA, 50 bp, homo sapien
gaagcaaaatatattgtctattgtaraatgagaagaccgaaggcaaaact

SEQ ID NO: 51671 - DNA, 50 bp, homo sapien
tgtgctattatcaataactacaaatmactacaattaaagctcaagaaaat

SEQ ID NO: 51672 - DNA, 50 bp, homo sapien
acaaatgatctattagatggatgaaycatattggtagcatctgtgcttac

SEQ ID NO: 51673 - DNA, 50 bp, homo sapien
cagatctatggaagtgggattaaaaytttgatgcagagtaaagtcagggt

SEQ ID NO: 51674 - DNA, 50 bp, homo sapien
agttatttgtagttattgataatagyacagtactaggtaagtgcatctgt

SEQ ID NO: 51675 - DNA, 50 bp, homo sapien
cagaataatattacctggtgaattgmagttaaaaactggtgtaagaagca

SEQ ID NO: 51676 - DNA, 50 bp, homo sapien
accgtgcctcaggtaccattttgaargatattgtagagagctgaagaagt

SEQ ID NO: 51677 - DNA, 50 bp, homo sapien
gcaagtgacaaatctaaactgctcawacatagtctgggggtgcactggct

SEQ ID NO: 51678 - DNA, 50 bp, homo sapien
aataacttctggctgaagatgtctayattgctccttcactgtttatagcc

SEQ ID NO: 51679 - DNA, 50 bp, homo sapien
atcaccctcaggcatgggtactttckctggtcacttttgggacaatcaca

SEQ ID NO: 51680 - DNA, 50 bp, homo sapien
aacatgttaaaaagctgttctgaaarttgtttagatttaagtgtgctatt

SEQ ID NO: 51681 - DNA, 50 bp, homo sapien
gacttagtgctatttaaagatcacaygctgactacactgtgctcagcagt

SEQ ID NO: 51682 - DNA, 50 bp, homo sapien
tcccatctactgtaaatcttgggatraaatagtaggctgccaacctctgt

SEQ ID NO: 51683 - DNA, 50 bp, homo sapien
tctcataataaaaatccaggacattmaagaaaataaataaacagttcaag

SEQ ID NO: 51684 - DNA, 50 bp, homo sapien
ggcaaagttcagccttcgacctgacrgcatttagatttttgcctttctgg

SEQ ID NO: 51685 - DNA, 50 bp, homo sapien
ctaggggttttgttataatccttcaygcgcttatcttagtcctaactctt

SEQ ID NO: 51686 - DNA, 50 bp, homo sapien
ggaatttatggtcacagtagtagtcraacactatacccaagaggtttgag

SEQ ID NO: 51687 - DNA, 50 bp, homo sapien
aaatgaaaagtatgtgctttaaaaargaaatatagaggtgctatctcttt

SEQ ID NO: 51688 - DNA, 50 bp, homo sapien
aaccagcaattgcttaaaggaaagcrgagtcattgagatgctctctccac

SEQ ID NO: 51689 - DNA, 50 bp, homo sapien
ggatgaccctgtaatttttcattcasacagatagttttgagagtgaaata

SEQ ID NO: 51690 - DNA, 50 bp, homo sapien
aggaatgtgggagtatgtttttgtcsataaaagaaacatgaagagacata

SEQ ID NO: 51691 - DNA, 50 bp, homo sapien
gcaaacagcaagggttcagttaatayagatagcgttatcaaatgactaaa

SEQ ID NO: 51692 - DNA, 50 bp, homo sapien
acatgagctgcacagagctgcttaarattagaatactgcccttcacatca

SEQ ID NO: 51693 - DNA, 50 bp, homo sapien
catgagaaaaacagtacttacacaayttatcagcttaaactccttaccag

SEQ ID NO: 51694 - DNA, 50 bp, homo sapien
ggatattcatgcttctatccactccygagatgcttcagttccaaggttac

SEQ ID NO: 51695 - DNA, 50 bp, homo sapien
aaagtatgtattgtaaacagatatcrgataaatggaatcacacctttaag

SEQ ID NO: 51696 - DNA, 50 bp, homo sapien
aaacgataaatacttggctaaagcaraaccatttaaatctcccaaggcaa

SEQ ID NO: 51697 - DNA, 50 bp, homo sapien
atatatgtgaactttatttgcgtaaytatgaaatattaaacaaatgccag

SEQ ID NO: 51698 - DNA, 50 bp, homo sapien
aactttctctccctaattaagtaaamgtgttcatgaactagaaaacctgc

SEQ ID NO: 51699 - DNA, 50 bp, homo sapien
gtccaaattccttaaaaaggaatccmagatcacaacaatctggccctgac

SEQ ID NO: 51700 - DNA, 50 bp, homo sapien
aaacagtaaaaaatgtgcagaacaaycaaggaagaagattttaaagcata

SEQ ID NO: 51701 - DNA, 50 bp, homo sapien
gaaaatattctcattttggtacacayctacttaattataaaggagctcac

SEQ ID NO: 51702 - DNA, 50 bp, homo sapien
tggggctggcagtaactagttccaaratttgtgtgaagtagatatatttg

SEQ ID NO: 51703 - DNA, 50 bp, homo sapien
tcaaacatgagacaatgcttcccaaygctacaacacacacctccaaaaga

SEQ ID NO: 51704 - DNA, 50 bp, homo sapien
aatatattataaattttgtcttcaaraacaatcccaaagataaattttca

SEQ ID NO: 51705 - DNA, 50 bp, homo sapien
cttaggaattcagtgcagcaatatcyagaggaatgttccagcatttcttt

SEQ ID NO: 51706 - DNA, 50 bp, homo sapien
tttttttctgggactttttggaatcraatctatcttgccccccaatatgt

SEQ ID NO: 51707 - DNA, 50 bp, homo sapien
ctattgtttagcaatctttttcctcyaatactttgaatatatcatttcac

SEQ ID NO: 51708 - DNA, 50 bp, homo sapien
tgctgctgtcacagaagaaagaacayatgactcagagtggatgaggtagt

SEQ ID NO: 51709 - DNA, 50 bp, homo sapien
cttggttaaagtaaatcagtgttgayggaattgtttaagatattccccct

SEQ ID NO: 51710 - DNA, 50 bp, homo sapien
aaggagtaatttggtctgattatacrgtacttaagtctgaacctgtatga

SEQ ID NO: 51711 - DNA, 50 bp, homo sapien
acgcttgaaaaacgccagcattatayggtatcaactaagcatgtcgctcg

SEQ ID NO: 51712 - DNA, 50 bp, homo sapien
tttcctttggaaaatgtattgctgaygtgtttgaaattaaactttcttac

SEQ ID NO: 51713 - DNA, 50 bp, homo sapien
gccaatcaagatacctggaaatccamgactaaagagtcactcttgggtgt

SEQ ID NO: 51714 - DNA, 50 bp, homo sapien
attttcaaagactcttccggctccartcagaattagtacttccatttatt

SEQ ID NO: 51715 - DNA, 50 bp, homo sapien
aaaaatgaaacaaaaggatgtaaccyaattttaagtactgtaaaccatta

SEQ ID NO: 51716 - DNA, 50 bp, homo sapien
aattattcaagatcgcagtacagtcwcttagtgttttactggattcctgt

SEQ ID NO: 51717 - DNA, 50 bp, homo sapien
ggttaacattttcctcctctgcaagrcactagctggatgaaattagagac

SEQ ID NO: 51718 - DNA, 50 bp, homo sapien
atttaaacatgaactgaatggtttayaggtattcagatacagaaaatatt

SEQ ID NO: 51719 - DNA, 50 bp, homo sapien
tcaggcagacagtgaaactgatgtargagtaatactaatggagaattttc

SEQ ID NO: 51720 - DNA, 50 bp, homo sapien
agacaataaacaaataattgcactgyagggttaataagcacaaagcttat

SEQ ID NO: 51721 - DNA, 50 bp, homo sapien
ctatgacctgaacaaggaacttcacrctttcacgtcttggttttctcata

SEQ ID NO: 51722 - DNA, 50 bp, homo sapien
gcttagccaagctgacgtataaaacygaccatcctggatactacttttca

SEQ ID NO: 51723 - DNA, 50 bp, homo sapien
aagatattccatcctatttttagcaycaggttatttctgtcaattagaat

SEQ ID NO: 51724 - DNA, 50 bp, homo sapien
atcagatctaatgagaactgacagartaagaacacactcacccctgaggg

SEQ ID NO: 51725 - DNA, 50 bp, homo sapien
gtgtgtagataaaatatctgaaaaaytggcttataatttcaatattcccc

SEQ ID NO: 51726 - DNA, 50 bp, homo sapien
gtaaggcaaaaatgtgtaaagtctaygctaatcacacaaatgcatgacaa

SEQ ID NO: 51727 - DNA, 50 bp, homo sapien
gaaagttatcagcatagtaggctaasaaggaataatcaaaagagcaagag

SEQ ID NO: 51728 - DNA, 50 bp, homo sapien
acattgagtttttcttgaatccttcyaagagagaccttcagataaatatt

SEQ ID NO: 51729 - DNA, 50 bp, homo sapien
cttctctcttcagaagagatttggayctgaaagcctaatcaatgagtttt

SEQ ID NO: 51730 - DNA, 50 bp, homo sapien
aacaatgtaacgatgataataaaaawttgaattaaggaagtccttttgtt

SEQ ID NO: 51731 - DNA, 50 bp, homo sapien
tgtgtgtttctcataaccaagactayctgaaaagtgagctgcaaagaagc

SEQ ID NO: 51732 - DNA, 50 bp, homo sapien
tttgcctcatgtactgagaaatctayggcaggtataataaacccaagctc

SEQ ID NO: 51733 - DNA, 50 bp, homo sapien
gcatgaaacacctcataagcataccractcactagaaatctaaatgcaaa

SEQ ID NO: 51734 - DNA, 50 bp, homo sapien
acagcctgggagattgttacacacartggtcttatgcacacccagccacc

SEQ ID NO: 51735 - DNA, 50 bp, homo sapien
aaattcaggaacaagcctcagtgacrgagtagaaaaaccctcacattttt

SEQ ID NO: 51736 - DNA, 50 bp, homo sapien
ttactaaataaccttagagactaaaratacagcattgtgagataattagg

SEQ ID NO: 51737 - DNA, 50 bp, homo sapien
ctattccttatattgtatccctgtcsacattaaaatatgcatgtaatcat

SEQ ID NO: 51738 - DNA, 50 bp, homo sapien
tgcaaatcacttggtactgaattgasaaccagtgaaaatttaaccaacaa

SEQ ID NO: 51739 - DNA, 50 bp, homo sapien
ggtttcttttccttaattacatcccraattatcacttggaaattctctaa

SEQ ID NO: 51740 - DNA, 50 bp, homo sapien
ctaggttacttaatttgccttcacastattttcacgtcacaataacattt

SEQ ID NO: 51741 - DNA, 50 bp, homo sapien
cccatagcctcagccatgttgctcascttctccgtagtaattgtattatt

SEQ ID NO: 51742 - DNA, 50 bp, homo sapien
agcttttgccctcaccctgtgcatarcattttcctaggatgaggagctca

SEQ ID NO: 51743 - DNA, 50 bp, homo sapien
gcatttataatgtgatatggaatatraaaaatcagaaataggaatgatgg

SEQ ID NO: 51744 - DNA, 50 bp, homo sapien
gcatcagtcctagcatcattctcccrcgtcatttctgtaagtacttctac

SEQ ID NO: 51745 - DNA, 50 bp, homo sapien
tacaatacaaatctttgattctatgwaagtcctcaatgtaataaaaaaca

SEQ ID NO: 51746 - DNA, 50 bp, homo sapien
gtgctatatttgtgacaatttccacrggtacaccaagattctggggtctg

SEQ ID NO: 51747 - DNA, 50 bp, homo sapien
taaaatagtattttaatatttaaggwcaaaataattctccttatatgtta

SEQ ID NO: 51748 - DNA, 50 bp, homo sapien
ctctatcagccactatatataaaacmaaatcactaggaataacttaatgg

SEQ ID NO: 51749 - DNA, 50 bp, homo sapien
aacaagttcccgaatccaactgggaygtggtttccttatccttaagaaca

SEQ ID NO: 51750 - DNA, 50 bp, homo sapien
ttgataaagttctttataaattggaygtaagcaaagtaattggaaaaccc

SEQ ID NO: 51751 - DNA, 50 bp, homo sapien
ctttttccataaccttataaattggwattttacaaagagcatgtaaaagc

SEQ ID NO: 51752 - DNA, 50 bp, homo sapien
actgtaataccagattgaacatggamggtcccaccaaagaattctagcac

SEQ ID NO: 51753 - DNA, 50 bp, homo sapien
tcactgaggatttattcagggttcargatgttatatttgtcactgcaaag

SEQ ID NO: 51754 - DNA, 50 bp, homo sapien
tatgacatttgctaattggcctgacwgcaactacctttaaagggccatta

SEQ ID NO: 51755 - DNA, 50 bp, homo sapien
tgaaacatcaggctcagatcggttayagacgcagactctgaaatgacttg

SEQ ID NO: 51756 - DNA, 50 bp, homo sapien
ttgatattttttaaagcagggatacycaaaagtacatcacaatgggtttt

SEQ ID NO: 51757 - DNA, 50 bp, homo sapien
taaagcagatcacaacaggtgaattmaatcaaacattcatgtgtgaaata

SEQ ID NO: 51758 - DNA, 50 bp, homo sapien
tatatgctgttatgtttttacatgargcaacataagagttcactgggacc

SEQ ID NO: 51759 - DNA, 50 bp, homo sapien
ccaggaaaacttccacttcaaagtcraaatgagaagtatgacatcaaatg

SEQ ID NO: 51760 - DNA, 50 bp, homo sapien
agagaatttgtacacaagcaagagamaagaacagaaaacaaagtgaggat

SEQ ID NO: 51761 - DNA, 50 bp, homo sapien
tttgtatattgctatgttttctaaaytgtctcagtcaagcccttaaggaa

SEQ ID NO: 51762 - DNA, 50 bp, homo sapien
agctgtgttctcaattctgtgtgtarctctttcccaatatttcaatagtg

SEQ ID NO: 51763 - DNA, 50 bp, homo sapien
gaaaaatctttgagagtaaagataaygaaggaacactgcagaggggttgt

SEQ ID NO: 51764 - DNA, 50 bp, homo sapien
tataagatgtaacagaatcaaattayatttttgtaagataagggagaact

SEQ ID NO: 51765 - DNA, 50 bp, homo sapien
tttgatacgttatgttttagtttccrttctattcaatgttcttatggtca

SEQ ID NO: 51766 - DNA, 50 bp, homo sapien
gtaatttctggtctgtatggtaatcycatgtacagttttttttcagtttt

SEQ ID NO: 51767 - DNA, 50 bp, homo sapien
gaaagtagcattcaactccagctaaytccctggttttatcttcccttttc

SEQ ID NO: 51768 - DNA, 50 bp, homo sapien
ctttcccacttggatacaatattcayctttgtgttaggaggtagagatat

SEQ ID NO: 51769 - DNA, 50 bp, homo sapien
gtagtgatcacacagggaaaaactcrgaaagaacatgagctgcctgtgag

SEQ ID NO: 51770 - DNA, 50 bp, homo sapien
gctatagacttggtcctatagttatkacaaaacaagaatatgtctcttta

SEQ ID NO: 51771 - DNA, 50 bp, homo sapien
gctaagtgtaaataatatcaatgccrcgtacacacaaagaaaacctacct

SEQ ID NO: 51772 - DNA, 50 bp, homo sapien
aaaaggcctatggtgggtactaaaayaaaacaaggccatgttatgttccc

SEQ ID NO: 51773 - DNA, 50 bp, homo sapien
ttcagtccatcagtcacctctgaaartgtcttagccccaatattacctga

SEQ ID NO: 51774 - DNA, 50 bp, homo sapien
ttttaaaaacatgaactctttggccyatcacattactgaccataaacata

SEQ ID NO: 51775 - DNA, 50 bp, homo sapien
cttgtgccatggagcttacagcagaygaggaaaattgtattacaagagat

SEQ ID NO: 51776 - DNA, 50 bp, homo sapien
agcaattgaatagagactgttggagratgtcccctgtgataggaaagtaa

SEQ ID NO: 51777 - DNA, 50 bp, homo sapien
ggaataaaagaggaggctagaaaackataaccaacagtgaaaggcagact

SEQ ID NO: 51778 - DNA, 50 bp, homo sapien
tcatgtttattgattgcctttgtcayatgtaattctaaatcctccccgat

SEQ ID NO: 51779 - DNA, 50 bp, homo sapien
ttgaggatacagtgtattttttgtcycttgttcatgtgacttgatttgac

SEQ ID NO: 51780 - DNA, 50 bp, homo sapien
gaatctctagatctttgacaagatarcatcaatgggaatagtaaacttca

SEQ ID NO: 51781 - DNA, 50 bp, homo sapien
atataatgcacatgtctgaaaatcayggcttctctgtcattctttggaga

SEQ ID NO: 51782 - DNA, 50 bp, homo sapien
ctcatgggcaggaaagcctggaaacygagattcttacaatgctgggcagg

SEQ ID NO: 51783 - DNA, 50 bp, homo sapien
caactaggtagcactacttctaatgmaaacctgctagttggctggggagt

SEQ ID NO: 51784 - DNA, 50 bp, homo sapien
taggtaagggagttagtgcttctcartcatgcagcttggatgcatgtgtt

SEQ ID NO: 51785 - DNA, 50 bp, homo sapien
cctagggaaatgtttgagttagggaragatgccaggactggagatgctag

SEQ ID NO: 51786 - DNA, 50 bp, homo sapien
aatacttttacatgcattttaatcaragtcctgaaatttctaatttttat

SEQ ID NO: 51787 - DNA, 50 bp, homo sapien
cttcaaagtaggtaacattaaaaacyctgattgtcaaagtctttcagcaa

SEQ ID NO: 51788 - DNA, 50 bp, homo sapien
tccagactgcccacatgataaagagsatagtgcttagaaagcattcaagg

SEQ ID NO: 51789 - DNA, 50 bp, homo sapien
ggaattattactgcaggtctttttasctactacaagagtttggttttaac

SEQ ID NO: 51790 - DNA, 50 bp, homo sapien
tttcagtaaggttgaatagtggataygtgggaaaattggtcctcaagact

SEQ ID NO: 51791 - DNA, 50 bp, homo sapien
tgtaggggacacaatcagtccataasgcctccagaatgataggattgacc

SEQ ID NO: 51792 - DNA, 50 bp, homo sapien
agatctagtcaaacttggtcattctraatatccctgcaagaaaaattaac

SEQ ID NO: 51793 - DNA, 50 bp, homo sapien
ctatatttaggaatgtcttgtaaacrgatagataattacaagaggttgtt

SEQ ID NO: 51794 - DNA, 50 bp, homo sapien
gtatcataactttgacattatgagaktcaaagtaattgaaactattgtgt

SEQ ID NO: 51795 - DNA, 50 bp, homo sapien
ccttaagtttcaggaattatgttacmgattaaaaattagtgcattatgta

SEQ ID NO: 51796 - DNA, 50 bp, homo sapien
agtaactacaaatcagaacattatcmatcaaaagttttaaatcattgtta

SEQ ID NO: 51797 - DNA, 50 bp, homo sapien
tgcattcttcaaaattaagggagcascaaaaatatcatgtatctcaaatt

SEQ ID NO: 51798 - DNA, 50 bp, homo sapien
ttattaagaaataaaaacacttcatraaaggtaagcatgaaagctaggtg

SEQ ID NO: 51799 - DNA, 50 bp, homo sapien
agagagcccagggccagtaatgagaragcccagtcagtaatgggtgagtc

SEQ ID NO: 51800 - DNA, 50 bp, homo sapien
aatcccatcacttattctgtccctgwacaattgaaacttttagcaatggt

SEQ ID NO: 51801 - DNA, 50 bp, homo sapien
tgatctgggtatagaagagcaagtargagttcaacaggtagatgggctag

SEQ ID NO: 51802 - DNA, 50 bp, homo sapien
gaaaatccagcatagctactgtagcragatggcccttgaaaattagatga

SEQ ID NO: 51803 - DNA, 50 bp, homo sapien
tgacaagaacctatataggaagtgamaagaagataaaagtggtatgaaac

SEQ ID NO: 51804 - DNA, 50 bp, homo sapien
ttctcctgtagatatttgtatggctyactctatatcttcaggcaccaact

SEQ ID NO: 51805 - DNA, 50 bp, homo sapien
gtagctactcctgaagaatctctcckatagggttctcaagtgatccatca

SEQ ID NO: 51806 - DNA, 50 bp, homo sapien
atttataggcagtcacaattttttcratctaaagaggtgaatcaggaata

SEQ ID NO: 51807 - DNA, 50 bp, homo sapien
ctgtgcagttcaagctcaaactcagycactaagaagtatgacttcaagca

SEQ ID NO: 51808 - DNA, 50 bp, homo sapien
atgggagagccttcacctccttcaasaagtatccagaagtgttcttttga

SEQ ID NO: 51809 - DNA, 50 bp, homo sapien
agacatggaaagagagtacgtagaargagatgttagctggtcatttgaaa

SEQ ID NO: 51810 - DNA, 50 bp, homo sapien
tcagtgcctagaatagtgtctggcayatgtaggctcaatatcaaagtaaa

SEQ ID NO: 51811 - DNA, 50 bp, homo sapien
aagtgcaccacgtcaccttttgtccyagtgattttatttctctatagact

SEQ ID NO: 51812 - DNA, 50 bp, homo sapien
tccgagggttgctcatagttgctggsataccactaggagccaccatgctt

SEQ ID NO: 51813 - DNA, 50 bp, homo sapien
agttacttctttggttgacatgaaamaatttctatatttacattacatga

SEQ ID NO: 51814 - DNA, 50 bp, homo sapien
gctttcaaatatataaacatatatgmacttgtagacattgacataaacat

SEQ ID NO: 51815 - DNA, 50 bp, homo sapien
tggtgtgtgaaaactgagaataatamagatgcactctgatgcagaaaccc

SEQ ID NO: 51816 - DNA, 50 bp, homo sapien
ctgtcagggaaagcaccttaattatwactgtggtatgaaaagtatggcta

SEQ ID NO: 51817 - DNA, 50 bp, homo sapien
ttagcagttgtttaatgaacataacwaactccagcattgctctggcccct

SEQ ID NO: 51818 - DNA, 50 bp, homo sapien
caagtgaattaataatagtgaattartaagtagaagtcttttaaggaagt

SEQ ID NO: 51819 - DNA, 50 bp, homo sapien
tagtctgctgttgaacttccctagcraatttttagtttacagttactatg

SEQ ID NO: 51820 - DNA, 50 bp, homo sapien
tataatctgaaatattaagcaagtamacaattggctacaatacaaagtga

SEQ ID NO: 51821 - DNA, 50 bp, homo sapien
aatctacctacctatcaactatatayctgtctctctctacctatcattat

SEQ ID NO: 51822 - DNA, 50 bp, homo sapien
tttgcagacacatagatatgaatggycactagctttctttattatacttg

SEQ ID NO: 51823 - DNA, 50 bp, homo sapien
attctataaatgtgttcaggttacakatttctagcctacagaatttctgc

SEQ ID NO: 51824 - DNA, 50 bp, homo sapien
atttttcactgcatgcacaaactgaraaagaacttctaaacatatttaag

SEQ ID NO: 51825 - DNA, 50 bp, homo sapien
gtttttatttattttgcaggagtaawctagctttagatgaccaaaaaata

SEQ ID NO: 51826 - DNA, 50 bp, homo sapien
atactgctaagctcagtgcttgtcamataacagttagtcaatccatattt

SEQ ID NO: 51827 - DNA, 50 bp, homo sapien
ctacttgatcactttacaatcaatayacttacttagcatgcttcaaacct

SEQ ID NO: 51828 - DNA, 50 bp, homo sapien
caacatactaagcaaaagattagaaytaggtgccatggaaacaggtcctg

SEQ ID NO: 51829 - DNA, 50 bp, homo sapien
gaaaagactctccggggtagagaatratataatgcagatgacaaatgaca

SEQ ID NO: 51830 - DNA, 50 bp, homo sapien
ctaggtgttcattgacgaacattcamggtattaacttctcctgggggaat

SEQ ID NO: 51831 - DNA, 50 bp, homo sapien
ctcttttttcttagtaaaattgcaaragtaatgataaaagttatgccact

SEQ ID NO: 51832 - DNA, 50 bp, homo sapien
gcagctcacgcacacggcattggaayggcaccgcttcccaaagtcagcag

SEQ ID NO: 51833 - DNA, 50 bp, homo sapien
tgtacctttaaaatatccgcttgaawggatgcagacagtctgaaagttgc

SEQ ID NO: 51834 - DNA, 50 bp, homo sapien
tgagaattgtcattattattgccacrcttccatctttcagacgaagaaat

SEQ ID NO: 51835 - DNA, 50 bp, homo sapien
catcttggacttaccctactttgcaygatagagatgccaagggctggcct

SEQ ID NO: 51836 - DNA, 50 bp, homo sapien
ttattgtgattgtatcttattttcaraaatctggttggttattgccagca

SEQ ID NO: 51837 - DNA, 50 bp, homo sapien
gagatgagagcattcaagagctccaytcaaaattatgaaacatgattttc

SEQ ID NO: 51838 - DNA, 50 bp, homo sapien
tttataaatttttttaaaagcgcaawtagctgtgattttactcataaaaa

SEQ ID NO: 51839 - DNA, 50 bp, homo sapien
agcatctgaggccagccgttagtaayagtctgatcatgggcaattcattt

SEQ ID NO: 51840 - DNA, 50 bp, homo sapien
gggaaatagtattttctcatagacartagaatcattcataacgtcgaacg

SEQ ID NO: 51841 - DNA, 50 bp, homo sapien
gcctcttatccaacatgagaatccartcttttatttaactatatactgaa

SEQ ID NO: 51842 - DNA, 50 bp, homo sapien
ttatgtgtgtacagaatgcggaaaamctaatttgaatacgagacaaagaa

SEQ ID NO: 51843 - DNA, 50 bp, homo sapien
tattaatagacaatgagaaatttacsagtctaaatatagtagtaagtcag

SEQ ID NO: 51844 - DNA, 50 bp, homo sapien
gaggttcagtagatgctaaataacakctggttaaataaatgcatatattc

SEQ ID NO: 51845 - DNA, 50 bp, homo sapien
aaattaagtaaaagtctaccgtcaakgaattaaacgtatgtttagagata

SEQ ID NO: 51846 - DNA, 50 bp, homo sapien
tagtgagagaatggtaaggtatgtamaagagagtctgtggtcatttttgt

SEQ ID NO: 51847 - DNA, 50 bp, homo sapien
cactccttggcttagtgcccatcacrcgaaccatactgaaccagttgtaa

SEQ ID NO: 51848 - DNA, 50 bp, homo sapien
taatgaccctgtgatgtgggtattayacttgcatgttgtagatgataaaa

SEQ ID NO: 51849 - DNA, 50 bp, homo sapien
gagcttcattacaaaatatgctactyagatatcctcaaatataactgtat

SEQ ID NO: 51850 - DNA, 50 bp, homo sapien
tctttggctatacagagctatgcaayttcaggtttataaatattattatc

SEQ ID NO: 51851 - DNA, 50 bp, homo sapien
tgggtggttaggagtaagagaacaaygtggcaaattgctcagagttacaa

SEQ ID NO: 51852 - DNA, 50 bp, homo sapien
gacagctgaggactgacaaaaattayagctttcccttgaacaatttggtt

SEQ ID NO: 51853 - DNA, 50 bp, homo sapien
atgagagattgcttagtgttactcargtttaaacatttgtgctattatta

SEQ ID NO: 51854 - DNA, 50 bp, homo sapien
agactctttaatcttttatatgtccygattcttcagagttaacaaccaca

SEQ ID NO: 51855 - DNA, 50 bp, homo sapien
agttaaacctataatggttccccaaygccgtatggcaaagtccaagttcc

SEQ ID NO: 51856 - DNA, 50 bp, homo sapien
cccccccacaagataaaatctcctaygtaatactttagatatattattgg

SEQ ID NO: 51857 - DNA, 50 bp, homo sapien
taatactttagatatattattggcascagtgagtttagagagagattctt

SEQ ID NO: 51858 - DNA, 50 bp, homo sapien
gaccacctataatgggatagggaaaygaatctgttgttacaagtccctgg

SEQ ID NO: 51859 - DNA, 50 bp, homo sapien
aaactgaaatcacctgttagtcataygtggcattttctaatctagtgata

SEQ ID NO: 51860 - DNA, 50 bp, homo sapien
cactgcacccagccatcaactgtcamaatttatggtacagccaagataca

SEQ ID NO: 51861 - DNA, 50 bp, homo sapien
tgtgtacagagatcacatggtaagasagaaagtgagagagatgagtaagg

SEQ ID NO: 51862 - DNA, 50 bp, homo sapien
acaggcctaaggcacaatcagaggayggaatgtgaatggaactggatttt

SEQ ID NO: 51863 - DNA, 50 bp, homo sapien
atttctctcttgcaatgtttagggayattttcttactctgttttatgaac

SEQ ID NO: 51864 - DNA, 50 bp, homo sapien
ggaaattccatcaacactctgctaamggacaaggatccactcagaaatga

SEQ ID NO: 51865 - DNA, 50 bp, homo sapien
attgcctgtctgtctcttctccaaayactttacaccatccactcactctc

SEQ ID NO: 51866 - DNA, 50 bp, homo sapien
gacagttacaatacagtgcaatataygctgtgatagcaggaggcgttgag

SEQ ID NO: 51867 - DNA, 50 bp, homo sapien
tcagactagtatggactgggaaatayactgacactttgttttagttatct

SEQ ID NO: 51868 - DNA, 50 bp, homo sapien
ttaaattaaaaacaccacctcaaacrgcaattaaatgcgcatacacatgt

SEQ ID NO: 51869 - DNA, 50 bp, homo sapien
taaaatccataattgtaaggctaccratttgaaagaaacttgaaatcctg

SEQ ID NO: 51870 - DNA, 50 bp, homo sapien
tctttcctttacctagattgtcttcycagatccttggctggttcagtttc

SEQ ID NO: 51871 - DNA, 50 bp, homo sapien
catcaccaatcctctccttgaagctractctaatgatcttttctggatcc

SEQ ID NO: 51872 - DNA, 50 bp, homo sapien
tgagctctgtggagagcatgtcacasgagataatgggcatctgcagggga

SEQ ID NO: 51873 - DNA, 50 bp, homo sapien
aagctttttaatcagaaggacaaaamgtgttaatgacaccatagagacct

SEQ ID NO: 51874 - DNA, 50 bp, homo sapien
tcatctggcaacttgggcttttcaayttcccagagaagaaaaatcagcga

SEQ ID NO: 51875 - DNA, 50 bp, homo sapien
ctaacatggtatgttttccacgtgckagaacttgttaagtgcttttcata

SEQ ID NO: 51876 - DNA, 50 bp, homo sapien
gagctgatcttactgactgacataaytggactgaatcttcctcaattgtt

SEQ ID NO: 51877 - DNA, 50 bp, homo sapien
atcctgctctaagggaacaattttawcatctcaggtgagttgatgtactg

SEQ ID NO: 51878 - DNA, 50 bp, homo sapien
atgttgcagtctacgaattgtctacmcagtacatcaactcacctgagatg

SEQ ID NO: 51879 - DNA, 50 bp, homo sapien
atacccctccatgcacacctcaatgsatcaaggttagattaccatctggg

SEQ ID NO: 51880 - DNA, 50 bp, homo sapien
acgagttcctttatcgtatgcattayagtcagaatcatctgccagttgac

SEQ ID NO: 51881 - DNA, 50 bp, homo sapien
ttctgcagaatctctgacaatgcacrgattaaataattagcaaacttctg

SEQ ID NO: 51882 - DNA, 50 bp, homo sapien
ataattatattcttaattgtagatasaaaaaccttggtgtaagagtagtg

SEQ ID NO: 51883 - DNA, 50 bp, homo sapien
ctgagaatttacatgaaatggctaarcataatctcttacttcatttgaaa

SEQ ID NO: 51884 - DNA, 50 bp, homo sapien
tctctgtatatattttataaagcaasatttgagaattaggtatttttcat

SEQ ID NO: 51885 - DNA, 50 bp, homo sapien
agctcacaaaattagatacatttgargtttagaagtggtcttacctgtcc

SEQ ID NO: 51886 - DNA, 50 bp, homo sapien
aaggagcagctgtttgctttgaaacrgtggaacaggtatggaacagcagc

SEQ ID NO: 51887 - DNA, 50 bp, homo sapien
catgtaatataattctacaaaaaaasttcctttccaatatgaattcaaga

SEQ ID NO: 51888 - DNA, 50 bp, homo sapien
cccttcaaagtccatggcatttctaraatgataccacagtgttctacttc

SEQ ID NO: 51889 - DNA, 50 bp, homo sapien
gttaaaaaaaaaacttctaaatggartaactggatagtatataaaaaagt

SEQ ID NO: 51890 - DNA, 50 bp, homo sapien
ttctctttattatccatattgtttayactgtattaggccatctgagtcaa

SEQ ID NO: 51891 - DNA, 50 bp, homo sapien
tttactcctgtggcattgtggaaagwcatcaataagtaaaatatcaaatt

SEQ ID NO: 51892 - DNA, 50 bp, homo sapien
gacaaaatactagcaaatatctttcycaaaaaaatgtaaagacattctgc

SEQ ID NO: 51893 - DNA, 50 bp, homo sapien
atctgatgaatggtaggcataaaaakttccctttaagtgacaacaggaga

SEQ ID NO: 51894 - DNA, 50 bp, homo sapien
tcctgccatttgaagtagttacttayacaccaaaagggcctttttagatc

SEQ ID NO: 51895 - DNA, 50 bp, homo sapien
cacagagattcaaagtgacttaaaarcacagtaatttgccaatgattcct

SEQ ID NO: 51896 - DNA, 50 bp, homo sapien
tatgccagcctgagcaaactaatacrcaaggtttcaaagtttttcttcta

SEQ ID NO: 51897 - DNA, 50 bp, homo sapien
caatagctatagtcaccagttctatyacaaattcagtgggacctaccaca

SEQ ID NO: 51898 - DNA, 50 bp, homo sapien
acttgtaataactggtgcaaatgaastgaaaaatatcattctacaattat

SEQ ID NO: 51899 - DNA, 50 bp, homo sapien
tcatgtgggccaatgcccaggatgcrcttaaaacacagcctggcctggca

SEQ ID NO: 51900 - DNA, 50 bp, homo sapien
tagcagtcaattcgaatagcaaacaratagttaaaaggtgaatcaaactt

SEQ ID NO: 51901 - DNA, 50 bp, homo sapien
atatagcttttgagaagaatgcaaastaataaagtaagaaggatgaattc

SEQ ID NO: 51902 - DNA, 50 bp, homo sapien
ggtatcgcacacactccaagctctayggcatttcaagtggtatgtttact

SEQ ID NO: 51903 - DNA, 50 bp, homo sapien
tgggcgctgttacactttgtgaagaytctaacttagcataggagcagata

SEQ ID NO: 51904 - DNA, 50 bp, homo sapien
tgaattgataccagcaactcacaccrcattagatttgatttggatcaagc

SEQ ID NO: 51905 - DNA, 50 bp, homo sapien
tttaaaaggatgcagaaatgtgtcawccctgaacgtcctccctgactcag

SEQ ID NO: 51906 - DNA, 50 bp, homo sapien
gtaaaagtcattctttttgcacaatkaatcactctccttaaccattaatc

SEQ ID NO: 51907 - DNA, 50 bp, homo sapien
tagctgactcttattgataaagcaamctgtgaatgaatgatggcagatag

SEQ ID NO: 51908 - DNA, 50 bp, homo sapien
taatgagatgaaaaacgcgtcttagyatgagaatttattttaagtgtgat

SEQ ID NO: 51909 - DNA, 50 bp, homo sapien
atgatgagatggaaggttgaagttgraataattgcggtagaacttaagct

SEQ ID NO: 51910 - DNA, 50 bp, homo sapien
aagctaagcatcttatagccatgtaycatattactagtagtattaccaat

SEQ ID NO: 51911 - DNA, 50 bp, homo sapien
cttttagtattggactggaataaaasctgagcactagaattttagaaagc

SEQ ID NO: 51912 - DNA, 50 bp, homo sapien
tattgagattttgggtaagcatgagraccgcagtacataccccgtcttca

SEQ ID NO: 51913 - DNA, 50 bp, homo sapien
gaatttcagaggcatggaaatttgcsattttctacccaggtaaagttatt

SEQ ID NO: 51914 - DNA, 50 bp, homo sapien
ataccaaaatacatagcacttaaaaytggtgttcagaatcaagcttcaaa

SEQ ID NO: 51915 - DNA, 50 bp, homo sapien
gttaaatttagatgacatttgtttgkaatattttgactgaatgttataca

SEQ ID NO: 51916 - DNA, 50 bp, homo sapien
ctagtagaaggaggattgtttcaaayacttctgggctccactctccttga

SEQ ID NO: 51917 - DNA, 50 bp, homo sapien
caatccttagtgtgcagttcattaamtaatagaagatttttccatggggc

SEQ ID NO: 51918 - DNA, 50 bp, homo sapien
ggcaaactattttcctgagcaactaygtttcatccaggttttcaaatttg

SEQ ID NO: 51919 - DNA, 50 bp, homo sapien
tctctttcttccaaatccttccaaaktaaacaaacatcgtcatggagttt

SEQ ID NO: 51920 - DNA, 50 bp, homo sapien
cttgcaccagaaccccagtatctcargtggctggaactggcttctgctct

SEQ ID NO: 51921 - DNA, 50 bp, homo sapien
accccatgaattcaaattggattgaragagaaagctcctggaaagttgat

SEQ ID NO: 51922 - DNA, 50 bp, homo sapien
tataccaactactatctttcattgcrctcctaccatatgccaggcattgt

SEQ ID NO: 51923 - DNA, 50 bp, homo sapien
ctgctacctagctgcgaaatgtgtaraagacttttatctgataaattgta

SEQ ID NO: 51924 - DNA, 50 bp, homo sapien
acacaatagctgctttagctgaataycaggttcagtactttttatagtaa

SEQ ID NO: 51925 - DNA, 50 bp, homo sapien
acccttggttccaatggaaccaacaygtaaagcaagatcaactcagtaat

SEQ ID NO: 51926 - DNA, 50 bp, homo sapien
gttaatgttttataacttcacagccyatattgtgcaagctacaaaagtat

SEQ ID NO: 51927 - DNA, 50 bp, homo sapien
taaaaaataaataagtaagataagcrcaggtcttcatccttctgttctgt

SEQ ID NO: 51928 - DNA, 50 bp, homo sapien
ttaaagggtggtccacaggaaggaawcatttaagaggttgttaaaactac

SEQ ID NO: 51929 - DNA, 50 bp, homo sapien
gatatatcatttgtcatgttttcaaygcctagtaaaagatgagcaaactc

SEQ ID NO: 51930 - DNA, 50 bp, homo sapien
agacaaaagtatgatctatgatctasaggtcaagctgttcaaatcccagt

SEQ ID NO: 51931 - DNA, 50 bp, homo sapien
catcagaatgaagtaaatataggaaytgcctgaaagtgaaggctcccagg

SEQ ID NO: 51932 - DNA, 50 bp, homo sapien
atttgtttgcgttgtgttatggataragaggaagcaccaaacacctacag

SEQ ID NO: 51933 - DNA, 50 bp, homo sapien
aaaaggtatatagcttctttatctaygttcagggaaaacagagaaaaaac

SEQ ID NO: 51934 - DNA, 50 bp, homo sapien
cccctgttcaggttttcaacacctcrcgcctcagtgcctgtgacagctcc

SEQ ID NO: 51935 - DNA, 50 bp, homo sapien
acttagttgtcaaaaaagcaactcayccaaattaattgtgtcatattgaa

SEQ ID NO: 51936 - DNA, 50 bp, homo sapien
gctgaaaacatttagctgaaaacagscagcttgattctaaagcttatatt

SEQ ID NO: 51937 - DNA, 50 bp, homo sapien
aagtcttcaaatctttcttatgaaasctccaaatattattatgaataaaa

SEQ ID NO: 51938 - DNA, 50 bp, homo sapien
cctgttatttataagaactcgtgtasgttaaatagccttcattttttaaa

SEQ ID NO: 51939 - DNA, 50 bp, homo sapien
tctattaactaaggttttatctctaygttcccaagcaaatccagtgattt

SEQ ID NO: 51940 - DNA, 50 bp, homo sapien
ttcagcataattaccagtgcctacaytctagaaagatggaaataggatga

SEQ ID NO: 51941 - DNA, 50 bp, homo sapien
gaagtaggatgtgctggatgtcttcrctgaattgactcaataatcattgg

SEQ ID NO: 51942 - DNA, 50 bp, homo sapien
ttttttttaccctgtcacatgactcmacattctttaaacagcaagaaata

SEQ ID NO: 51943 - DNA, 50 bp, homo sapien
gtacagagaaaaacaaggcaatgggyattaatgaaccaaaaggggaaacc

SEQ ID NO: 51944 - DNA, 50 bp, homo sapien
cagagaaattagagaggaattttgcyacttgttaggtataagaacttggg

SEQ ID NO: 51945 - DNA, 50 bp, homo sapien
tgatttttattaaagcctctagaaartccagacaatctagaaattagata

SEQ ID NO: 51946 - DNA, 50 bp, homo sapien
tacacttaggaaagtgaaataggaakgatgtaaattcaaatacaaaacct

SEQ ID NO: 51947 - DNA, 50 bp, homo sapien
tttacatagtaagtagatgctcaacmgttatctgctgaattagtgaagat

SEQ ID NO: 51948 - DNA, 50 bp, homo sapien
tgtgctgtcactttggagacagccartcaacctaagcatggttcaccatg

SEQ ID NO: 51949 - DNA, 50 bp, homo sapien
gctttgttgttttatctgtagagcayagacagagtagatatagcataatt

SEQ ID NO: 51950 - DNA, 50 bp, homo sapien
gcattcttgaacagtaacaagtccgwagagcaagaggcagttatggagaa

SEQ ID NO: 51951 - DNA, 50 bp, homo sapien
tgtgttctttgtaggatgctatgtarccacagggtgctgctggtggtctg

SEQ ID NO: 51952 - DNA, 50 bp, homo sapien
aaaatttgcatgtcttttttacaacrgtatagccagtaatatccagcaca

SEQ ID NO: 51953 - DNA, 50 bp, homo sapien
aagtagctgatcttttcagcttctaragtatgagatcagctctatgcctc

SEQ ID NO: 51954 - DNA, 50 bp, homo sapien
caggtcaaggaacaaaacacatctartacacagaagttacatatttttcc

SEQ ID NO: 51955 - DNA, 50 bp, homo sapien
cagtcttatggttaatagtaggtagscattttttttgaaaggtctgtgca

SEQ ID NO: 51956 - DNA, 50 bp, homo sapien
ttgatcagtctgataagccatctggraacaattgagagtgacgtcacaag

SEQ ID NO: 51957 - DNA, 50 bp, homo sapien
ggtttgacagctttagaagacaccaygttcagctgccatagctctcagag

SEQ ID NO: 51958 - DNA, 50 bp, homo sapien
ggccgaatgctaggaattcaaaaacwaacaattgagtgagatggattctg

SEQ ID NO: 51959 - DNA, 50 bp, homo sapien
tactgggaaatcacagatagcaaaaycttaattggacaaaaccaatttct

SEQ ID NO: 51960 - DNA, 50 bp, homo sapien
attctgaatgcctcagtgcacatgcratactgggaaatcacagatagcaa

SEQ ID NO: 51961 - DNA, 50 bp, homo sapien
tggattcctggaatatctctcataaygtcaatgtccactctctctggttt

SEQ ID NO: 51962 - DNA, 50 bp, homo sapien
tattagttgcatgacttgatgtgaartgagcagtctaatctactcagata

SEQ ID NO: 51963 - DNA, 50 bp, homo sapien
gttaatctctcctattaaaatacaayggttgattgaatggataaaaccca

SEQ ID NO: 51964 - DNA, 50 bp, homo sapien
ttgataactgcacaatcatcaatcaytctcagagaacagaaagctccagt

SEQ ID NO: 51965 - DNA, 50 bp, homo sapien
aaatctcaagaactgtttctttctcracagtaatacactgtagtataaag

SEQ ID NO: 51966 - DNA, 50 bp, homo sapien
tgtgtttggtattgtaaaagtaacayctattttagaacattgaaaaaaat

SEQ ID NO: 51967 - DNA, 50 bp, homo sapien
ttacatcaccagtgatctcatgactractagaatggtccttttctatttc

SEQ ID NO: 51968 - DNA, 50 bp, homo sapien
agtaaacacaaagctgagtttgggaygctataaacaattctgtggacttt

SEQ ID NO: 51969 - DNA, 50 bp, homo sapien
aattaatgaaagagccaggatgttarcccatataatctgtcggcaatatg

SEQ ID NO: 51970 - DNA, 50 bp, homo sapien
ctttgtatttttataatcattattgmaagtagagtgggctaagtatttaa

SEQ ID NO: 51971 - DNA, 50 bp, homo sapien
tacttttagagaaacatatttaaaamttcaaacaggtgatcagtatcatt

SEQ ID NO: 51972 - DNA, 50 bp, homo sapien
cccacctgtgaggcattcctttatasgtgccaatatgtgaaaatcgtttt

SEQ ID NO: 51973 - DNA, 50 bp, homo sapien
cctttgtattgatttttttgaaatakctagccctcaaattaataataatg

SEQ ID NO: 51974 - DNA, 50 bp, homo sapien
gatcctccctttaaatctgcaaaatsagaggaaatgagaagattggaccc

SEQ ID NO: 51975 - DNA, 50 bp, homo sapien
cacagaaggcatccttatgcacggaraagtttgagaaccattaatatggg

SEQ ID NO: 51976 - DNA, 50 bp, homo sapien
agaagaaacttgacacacgtatgaarcaaattctacaaatatgagctgga

SEQ ID NO: 51977 - DNA, 50 bp, homo sapien
tgaattttggctgaactgacattccrcaaagtcatcccaggctcttagcc

SEQ ID NO: 51978 - DNA, 50 bp, homo sapien
ggttgtaaaatgaatgcttggtatcraaacatattagagattgatgtgtg

SEQ ID NO: 51979 - DNA, 50 bp, homo sapien
catgaacagaagtagctgtcattaastgagcataattccagatttagttt

SEQ ID NO: 51980 - DNA, 50 bp, homo sapien
tttctttggggccctgagtaaccaayttgcatgagttttccaatctgtac

SEQ ID NO: 51981 - DNA, 50 bp, homo sapien
tgagagatacacaaccactggaggamcttctacttttccaggcatcaggg

SEQ ID NO: 51982 - DNA, 50 bp, homo sapien
aatgccaatcatgtgctttatgtaamgtggataactttgttctttctggt

SEQ ID NO: 51983 - DNA, 50 bp, homo sapien
cttgggaagaccaagctgtgtctaaycttatacatcatttttctgctcat

SEQ ID NO: 51984 - DNA, 50 bp, homo sapien
gaaaaatttagtcagaattcttaatraaataaagtgatttaaactctagc

SEQ ID NO: 51985 - DNA, 50 bp, homo sapien
tattattattaacatttatcatacayggttactattccaatctttcatgc

SEQ ID NO: 51986 - DNA, 50 bp, homo sapien
attttggatttcatatgatgttaagwatggatatattcaaaacaattact

SEQ ID NO: 51987 - DNA, 50 bp, homo sapien
atgtaaatcatattctgtttcctaamatgttttctagagcaatattctgt

SEQ ID NO: 51988 - DNA, 50 bp, homo sapien
ttatacgactccctcacaaagatctraatgtgtaagcagatgtgagtcac

SEQ ID NO: 51989 - DNA, 50 bp, homo sapien
taaacaacgaatgtatcactgatttwaaaaaataaccacttagtcactga

SEQ ID NO: 51990 - DNA, 50 bp, homo sapien
ggccccaggatattccattgaacaartattgaccattatcttcctaggtg

SEQ ID NO: 51991 - DNA, 50 bp, homo sapien
agccttcatagagtataggtggcaartatatcttttcagatgttaaaagc

SEQ ID NO: 51992 - DNA, 50 bp, homo sapien
aacggctatatgtgacaactaacacygggcactaggcccaatgtacaaaa

SEQ ID NO: 51993 - DNA, 50 bp, homo sapien
taaactctaggcaaggaaaagactcycaaggaacgctgcctttgtgtagt

SEQ ID NO: 51994 - DNA, 50 bp, homo sapien
aagtttcttcttaagtctgctgccarattatcctaagactcaatgtttgt

SEQ ID NO: 51995 - DNA, 50 bp, homo sapien
gccagagaaaaaagggacaccataascagttgaaacagcaggggcagggg

SEQ ID NO: 51996 - DNA, 50 bp, homo sapien
atgctacacaggaaaagatctacttsaactaacaaaataatacttcagta

SEQ ID NO: 51997 - DNA, 50 bp, homo sapien
ataaagaagatagcacatcctgaagscttactctaaagaaaagaagtaat

SEQ ID NO: 51998 - DNA, 50 bp, homo sapien
ttagacttttgtcagaggttatgtasaatcaggatcaaatatgtacagta

SEQ ID NO: 51999 - DNA, 50 bp, homo sapien
tatattaattagacacacttgagaakcgaatacaaaaaatagataataca

SEQ ID NO: 52000 - DNA, 50 bp, homo sapien
tccaaagggatactagcaagtacaayctaagtagaacatttatcacttgt

SEQ ID NO: 52001 - DNA, 50 bp, homo sapien
catgtaccaggcatttaggaaacaamgacattaaggagatacaattcctg

SEQ ID NO: 52002 - DNA, 50 bp, homo sapien
acggctgcaactgtgaggaaacatamaagagccacgcaactgagcaagag

SEQ ID NO: 52003 - DNA, 50 bp, homo sapien
acacaatccaagcaaaataaaaatcrcaatatagcaatatgggagctgag

SEQ ID NO: 52004 - DNA, 50 bp, homo sapien
tctatgcaggttgtatttctcagtcrcccaatctcctttcacatatctgt

SEQ ID NO: 52005 - DNA, 50 bp, homo sapien
tatagccaaattgtaccagaaatacraagaggaactgatacctttttttc

SEQ ID NO: 52006 - DNA, 50 bp, homo sapien
atcgattcattctctcagcttactayaacactcaaccatggaaattctta

SEQ ID NO: 52007 - DNA, 50 bp, homo sapien
aaagtccatttaatttgcacttttawatgggttacaagaacatttttgtt

SEQ ID NO: 52008 - DNA, 50 bp, homo sapien
tttataataaaacaagctatgtttgraaaccaaaatgtagtatctaccat

SEQ ID NO: 52009 - DNA, 50 bp, homo sapien
aagttgatttttctgtctcctttaastgagtaggataatgttaattgcct

SEQ ID NO: 52010 - DNA, 50 bp, homo sapien
aacatattttaccagtgaaaataatraaacaatcatgtgctggatcctaa

SEQ ID NO: 52011 - DNA, 50 bp, homo sapien
gcacaattttgaagacttctggtaargctcaaaaaagatttagagaacca

SEQ ID NO: 52012 - DNA, 50 bp, homo sapien
agaagacaagtatctcttgctaactmaatattctgcaagctataaatagt

SEQ ID NO: 52013 - DNA, 50 bp, homo sapien
aaatattatgtaagaagttgaagaawcattcatattccaaacataacatc

SEQ ID NO: 52014 - DNA, 50 bp, homo sapien
gtccccatttgactagaatgtttatraatacccataaaatggaagctggc

SEQ ID NO: 52015 - DNA, 50 bp, homo sapien
tagagcaggttttggaaataatagaytccaggatgcaggggttgagcagt

SEQ ID NO: 52016 - DNA, 50 bp, homo sapien
agaaaatacaaacttaaacataaacratgtacaaatgatataaaaaaggt

SEQ ID NO: 52017 - DNA, 50 bp, homo sapien
ttgagatccataactgccagtggcaygaatgtgtatgtcaactgttcaat

SEQ ID NO: 52018 - DNA, 50 bp, homo sapien
ctccttcatgggcacccttgatctayatcccaaacatcttagatgaattc

SEQ ID NO: 52019 - DNA, 50 bp, homo sapien
ggcagcggcctgactctcacagtcckatcgatttactaaacaaactgaaa

SEQ ID NO: 52020 - DNA, 50 bp, homo sapien
gctaccatcataggcataagacataycctcagggagtttaagagtgtttg

SEQ ID NO: 52021 - DNA, 50 bp, homo sapien
acagagatacaacatgggtaactgartaactttataaaaagcaaattaaa

SEQ ID NO: 52022 - DNA, 50 bp, homo sapien
acttgctctagcttacatttccacakaagagccatccaaccaatgaacaa

SEQ ID NO: 52023 - DNA, 50 bp, homo sapien
ttttgacctctattgtggtcacatakgttacttctctaagtttctctgac

SEQ ID NO: 52024 - DNA, 50 bp, homo sapien
cctgaagtagataccacaaggtctaygctcattttaggtctttgtgaagt

SEQ ID NO: 52025 - DNA, 50 bp, homo sapien
ctttgttggcattttgatgacagccragggactagataagatattttaga

SEQ ID NO: 52026 - DNA, 50 bp, homo sapien
ctatgttttgttgcttgtttcactaygaacattatgattaacaagacaga

SEQ ID NO: 52027 - DNA, 50 bp, homo sapien
agagttttgaatgaccaagtgttaarattactgacattgtctattaagag

SEQ ID NO: 52028 - DNA, 50 bp, homo sapien
ttcctgtacagaatatagtctagaawttcatgtagcaatatagaatatga

SEQ ID NO: 52029 - DNA, 50 bp, homo sapien
aaagagcatgaacaatggcctgagaygtcattatgcttttaaggtgttac

SEQ ID NO: 52030 - DNA, 50 bp, homo sapien
agtgtgggtttgaagaaaaagttcartaaatatagttcaattagtaggtt

SEQ ID NO: 52031 - DNA, 50 bp, homo sapien
tgattgtcctttatgctttaaggtayactttgcttttaaataactttatt

SEQ ID NO: 52032 - DNA, 50 bp, homo sapien
aaggaatgcatgttgactgtgggtgyatcttccatgctccagtgtcttaa

SEQ ID NO: 52033 - DNA, 50 bp, homo sapien
tgctatgtagcatggaggactttgakgagaaccaacggagtgttcagtga

SEQ ID NO: 52034 - DNA, 50 bp, homo sapien
atgtccgaggcccgagtgaatagtgsaagtctcagaaggggatgttactg

SEQ ID NO: 52035 - DNA, 50 bp, homo sapien
agctgctttttatgctacactgaaawgactgacttgctatttacaagaat

SEQ ID NO: 52036 - DNA, 50 bp, homo sapien
cccgattttaagaatttcacaggtcraagatatatgggtgtgcaatacca

SEQ ID NO: 52037 - DNA, 50 bp, homo sapien
tatgagcacagtatctttcataaggycaacactaaatgatatttcatgaa

SEQ ID NO: 52038 - DNA, 50 bp, homo sapien
ctgttttggatgagttaggaatttaraggttgaatattttaatctgatgg

SEQ ID NO: 52039 - DNA, 50 bp, homo sapien
aaagttctggaagctgtgtgagttayctcaattttgtccactaagcttct

SEQ ID NO: 52040 - DNA, 50 bp, homo sapien
ctaaattcctaactcatccaaaacarcttactcattctaacaattttatg

SEQ ID NO: 52041 - DNA, 50 bp, homo sapien
ccattttttttttttttgctaggccraaagcccaatttttagcatcattt

SEQ ID NO: 52042 - DNA, 50 bp, homo sapien
ctattgtttcaacgtaactattaacmgcccactttccactctcaagagtg

SEQ ID NO: 52043 - DNA, 50 bp, homo sapien
cattagctggactttcttttttcccragaccagatgtggtcccaattgtc

SEQ ID NO: 52044 - DNA, 50 bp, homo sapien
tattttcttcactctgttagattccraaagtctggtctgcctaatcaatg

SEQ ID NO: 52045 - DNA, 50 bp, homo sapien
ctttaggcttttgaaatatacttgawgttccaactacaaaccagagaagg

SEQ ID NO: 52046 - DNA, 50 bp, homo sapien
tgccaggaagtgacattccttactcrcctataagcctggaaacgctgtaa

SEQ ID NO: 52047 - DNA, 50 bp, homo sapien
gacatgatccctgggctctgggaggwcatactctgtgtaaatacaatcta

SEQ ID NO: 52048 - DNA, 50 bp, homo sapien
ctcccagagcccagggatcatgtcaygttatctttctatcctgagcatgt

SEQ ID NO: 52049 - DNA, 50 bp, homo sapien
tatgaggaaagagatcctgttgttayacatgttttattttatgtcctttc

SEQ ID NO: 52050 - DNA, 50 bp, homo sapien
aatgcaagtattgttccttctttcaktagttggtttattcactcagcaaa

SEQ ID NO: 52051 - DNA, 50 bp, homo sapien
ttgaggtagtcttctgtgagctaaawctgcttagtgttctataaccttct

SEQ ID NO: 52052 - DNA, 50 bp, homo sapien
gtttgccaaacttttttcttttattwaagagcatctcaaattggagtggg

SEQ ID NO: 52053 - DNA, 50 bp, homo sapien
agaattttaaggacatgaaggttaayactggattttatatttctcttcga

SEQ ID NO: 52054 - DNA, 50 bp, homo sapien
ctggaaagaaattaaattaccgaagscttcagctcttgagtttgaaagct

SEQ ID NO: 52055 - DNA, 50 bp, homo sapien
taaataggtataattattcctaggasaaaagaaaaagaaaaaaagcagtt

SEQ ID NO: 52056 - DNA, 50 bp, homo sapien
ttcagtaatgaagacacgttagcaartgggtttcagattcaaaggaattc

SEQ ID NO: 52057 - DNA, 50 bp, homo sapien
tcaggtttcccagtccattcagataragccattgaaatcataagcctgtg

SEQ ID NO: 52058 - DNA, 50 bp, homo sapien
gttgccaagttccttacagccttaartgttggagaagaggtcactggagt

SEQ ID NO: 52059 - DNA, 50 bp, homo sapien
atcatgacctctccaggtcaataacratggtacgatatgacatttgatat

SEQ ID NO: 52060 - DNA, 50 bp, homo sapien
ctgtggctgacattctggaattcatkacgagtttttcaacagctgaacat

SEQ ID NO: 52061 - DNA, 50 bp, homo sapien
cttgcccttttcacttcttacagcasgataccactaagaaaaataaggaa

SEQ ID NO: 52062 - DNA, 50 bp, homo sapien
ctaaactcatcatccaatcaatccastcgctcatcagatattttagcacc

SEQ ID NO: 52063 - DNA, 50 bp, homo sapien
agaaagggatggattaaaggtgaaaygcttgaaacattgtattctcggtc

SEQ ID NO: 52064 - DNA, 50 bp, homo sapien
tgtctttctgaaatcttgaataaagsctttaaacctgatggcaatacctt

SEQ ID NO: 52065 - DNA, 50 bp, homo sapien
tcagatgttgaaactgtcaaaaggaractataaagcagctactaaaactt

SEQ ID NO: 52066 - DNA, 50 bp, homo sapien
tcttcatgtgacttcattccaacacrgatattataatatggccggaatgt

SEQ ID NO: 52067 - DNA, 50 bp, homo sapien
ctgcttcctgtaaaattctgatttcyaagacagagtagtaaaataagatt

SEQ ID NO: 52068 - DNA, 50 bp, homo sapien
ccagaggaaaagaataaagttcagastagatgaagcaagacatggaaaat

SEQ ID NO: 52069 - DNA, 50 bp, homo sapien
gtcaaattctcatttaaattccttcratatcttcagtgactacctaagca

SEQ ID NO: 52070 - DNA, 50 bp, homo sapien
tttggaaattgttttggaaataaacyggcatattagtaagtgttaaataa

SEQ ID NO: 52071 - DNA, 50 bp, homo sapien
ctttcaaaatttaccatatttttgastaccttcctaatctcctaggtgga

SEQ ID NO: 52072 - DNA, 50 bp, homo sapien
ctaaagtctctgaaattgcttattcraagagatttcaatatttactctga

SEQ ID NO: 52073 - DNA, 50 bp, homo sapien
tgatacaaacacaaacaaaagaatamcccatcagcttttgcccaaaatat

SEQ ID NO: 52074 - DNA, 50 bp, homo sapien
gtatttgtaaacacattttctcataycttaaaaaacgcaggagctgataa

SEQ ID NO: 52075 - DNA, 50 bp, homo sapien
caagaaatggaatccaaagaatgaamagcaaggtggactaaagacccaaa

SEQ ID NO: 52076 - DNA, 50 bp, homo sapien
aaggtgtgaaaaatgaaagaaatccractgctagccagatttattctttt

SEQ ID NO: 52077 - DNA, 50 bp, homo sapien
catttgctttgtgaatgcttgatgaygctgttgtataatgactgaagtaa

SEQ ID NO: 52078 - DNA, 50 bp, homo sapien
attatttggctgttctttgcttcaaycttctttatagttcatatgataat

SEQ ID NO: 52079 - DNA, 50 bp, homo sapien
tttatttgtgttgaattagcaattasctccgctcaataaatcctactcta

SEQ ID NO: 52080 - DNA, 50 bp, homo sapien
gtcaaatggcttttagctctcataarttagtaccctcatctgcacagaga

SEQ ID NO: 52081 - DNA, 50 bp, homo sapien
cgacattgccacaagtagtactaagraagataaagaaagactttaataat

SEQ ID NO: 52082 - DNA, 50 bp, homo sapien
cataacctgtagggatgatctcataygcatagccagaagaaaacggacag

SEQ ID NO: 52083 - DNA, 50 bp, homo sapien
tgtaactttgtcctagggactgatcmgaattagttggagatattctaaaa

SEQ ID NO: 52084 - DNA, 50 bp, homo sapien
ttgtggggtctgagaggttgtctggmaactttgtatgaagtctggatttg

SEQ ID NO: 52085 - DNA, 50 bp, homo sapien
aggtcgaaataaatctgtgcaaacayacttaaaggacagtttcctatttt

SEQ ID NO: 52086 - DNA, 50 bp, homo sapien
cacttcaaattttatatataatcaartacttagagcatacattacttaaa

SEQ ID NO: 52087 - DNA, 50 bp, homo sapien
atatcttggaggctggagaatatcartacatatgagacatcccagctcta

SEQ ID NO: 52088 - DNA, 50 bp, homo sapien
ccctaacctacctgatttataattawgtctgtaactctataaaacatata

SEQ ID NO: 52089 - DNA, 50 bp, homo sapien
acaatggtgtaatttgaaagttagawcatttattctggactcaattatta

SEQ ID NO: 52090 - DNA, 50 bp, homo sapien
gctcaggtgagcaatgacatgtatayagaacaaccattagggtattatta

SEQ ID NO: 52091 - DNA, 50 bp, homo sapien
ctggaatgtagattatactggtaagraaactgaagtgtggatataaggaa

SEQ ID NO: 52092 - DNA, 50 bp, homo sapien
cttaatagatttcaaatttagataarcaatcaatatattatgaaatcagg

SEQ ID NO: 52093 - DNA, 50 bp, homo sapien
gtactatatatggttatatttagaargacagaaagttgtatattgcttaa

SEQ ID NO: 52094 - DNA, 50 bp, homo sapien
tctttgtaatttcctgtttgtcataktacttcttttcaaccacctgatga

SEQ ID NO: 52095 - DNA, 50 bp, homo sapien
atctcttttatagtgttttaaagtayagtattcgtgtcttaaaagactat

SEQ ID NO: 52096 - DNA, 50 bp, homo sapien
aattctaaagacatgtagaactaaayattgtaaaggcactgtaatgattt

SEQ ID NO: 52097 - DNA, 50 bp, homo sapien
ctcttttcttcatcagcttaacattraagaacttaagaatgtgcaatgag

SEQ ID NO: 52098 - DNA, 50 bp, homo sapien
caaagagcattagcaagggacttatwaaagatatggcataggttattaaa

SEQ ID NO: 52099 - DNA, 50 bp, homo sapien
ttgagctatttctctatttctcctcractacaaaaacctccttaacagat

SEQ ID NO: 52100 - DNA, 50 bp, homo sapien
taggatttagtgattaattctattayactcaggtctatagcctaggtgat

SEQ ID NO: 52101 - DNA, 50 bp, homo sapien
taaaaggatacattcatggaacacarataactatgaagacaatttaagct

SEQ ID NO: 52102 - DNA, 50 bp, homo sapien
cacagcatctgacacattcaagagayggtagctgcaggtgttgttactgc

SEQ ID NO: 52103 - DNA, 50 bp, homo sapien
tagttaatattctttcatttcaacckatattgcttgcacaattttaacaa

SEQ ID NO: 52104 - DNA, 50 bp, homo sapien
aaacacccagtagcagaataagtaasaaatagatcctttctgaagtcctg

SEQ ID NO: 52105 - DNA, 50 bp, homo sapien
tccaccaaatatttcagaatcagaaytcacactatcctttatattcttag

SEQ ID NO: 52106 - DNA, 50 bp, homo sapien
ttcataaaatgtacaattcaaagcgwcataagtaaaggaaatgaaagtct

SEQ ID NO: 52107 - DNA, 50 bp, homo sapien
tgatatcagtagggaaaaattcttgyaataaggatgatgttttaataacc

SEQ ID NO: 52108 - DNA, 50 bp, homo sapien
tttctacaaccactgggtagtaaccrgaagctgactcctgacttgagtat

SEQ ID NO: 52109 - DNA, 50 bp, homo sapien
aaaaaaagttattcctcagttgtcaycagttttattgcttctttctttta

SEQ ID NO: 52110 - DNA, 50 bp, homo sapien
caactgagaaatatagaaagtcttayattctgagtgaacagcatatgcct

SEQ ID NO: 52111 - DNA, 50 bp, homo sapien
tgtgtcccattctcaccaataatgayggccttcaccacaacttctttgta

SEQ ID NO: 52112 - DNA, 50 bp, homo sapien
gatttgagaaccaccaatgcatagaygataccaggaaccactggaggaaa

SEQ ID NO: 52113 - DNA, 50 bp, homo sapien
tacatccaccatgttgtaaccatcakctctttaatactcccatcacctct

SEQ ID NO: 52114 - DNA, 50 bp, homo sapien
attcagaccaagctcaagcaaacagyatcagttagaatatgaattatcgg

SEQ ID NO: 52115 - DNA, 50 bp, homo sapien
gaaagtctatctggagtaatcacacygtaacctgttatttgtcatttgta

SEQ ID NO: 52116 - DNA, 50 bp, homo sapien
acttttctccattagtttaagctacyctggataagtgactctgtttatgt

SEQ ID NO: 52117 - DNA, 50 bp, homo sapien
gaactctcacatctcagattctaaaytaataccactcaacagaaaatttc

SEQ ID NO: 52118 - DNA, 50 bp, homo sapien
ggttgaaatgttaacatagttgagayataagaaactttccaatgcttatg

SEQ ID NO: 52119 - DNA, 50 bp, homo sapien
atagttatttaaatggagagactacrgtaatattaaccttttccatccct

SEQ ID NO: 52120 - DNA, 50 bp, homo sapien
cgcttttttctacacgcaacttcacrgagttcccatatgcatagaacgat

SEQ ID NO: 52121 - DNA, 50 bp, homo sapien
ttccaacttcctatacctgacatacrgcattgttaagcattcaaaaaaat

SEQ ID NO: 52122 - DNA, 50 bp, homo sapien
aaatccttgggctgtgcagaacttcratagagtggagatcagcatttaaa

SEQ ID NO: 52123 - DNA, 50 bp, homo sapien
agcatcgatacaaaaggtctgcaaascgcaagtcactggcctgacaatat

SEQ ID NO: 52124 - DNA, 50 bp, homo sapien
acatatattcatggtcaatttttgarcctattctcagagtcttgctctcc

SEQ ID NO: 52125 - DNA, 50 bp, homo sapien
atcatccccaacgagctttgtcttcrcatgtttaagcataaatgtactca

SEQ ID NO: 52126 - DNA, 50 bp, homo sapien
gacagtggacaagagagctgttagcraagagacagggaagaaagactaga

SEQ ID NO: 52127 - DNA, 50 bp, homo sapien
aatgtactcatacacacagtgcatcrattatttagagtgaagtctttagc

SEQ ID NO: 52128 - DNA, 50 bp, homo sapien
tgatgtaagcttacaatacaggaacrcaatttcaagctaacacataaaat

SEQ ID NO: 52129 - DNA, 50 bp, homo sapien
taaacttaaaatatctagcctaagawtatattggttttatgacaatttac

SEQ ID NO: 52130 - DNA, 50 bp, homo sapien
aattaataaaccaaaaaaaacagtascactagcatatcacttaaaaattt

SEQ ID NO: 52131 - DNA, 50 bp, homo sapien
aaattatttgcataagagtaaatgaygttttcaatattactttggcaaca

SEQ ID NO: 52132 - DNA, 50 bp, homo sapien
atcttgtatgtttctcaatgtaatayatggacacagttaaaaatcaagta

SEQ ID NO: 52133 - DNA, 50 bp, homo sapien
cctcacacccacgttatcctaccacygtactgaattccttgataatcccc

SEQ ID NO: 52134 - DNA, 50 bp, homo sapien
agataattgttttttagggaaaacastcatctaaagaataagcacgtgag

SEQ ID NO: 52135 - DNA, 50 bp, homo sapien
caatctctcaggaacggtgttagtcragcgagaatcctgagcagtggccg

SEQ ID NO: 52136 - DNA, 50 bp, homo sapien
ctatctaaccatacttcccacagaawgtcttatttacaactttaaaaaca

SEQ ID NO: 52137 - DNA, 50 bp, homo sapien
ttgcccattaattggatctcatcaaycttttcctccaaatgttttatgcc

SEQ ID NO: 52138 - DNA, 50 bp, homo sapien
tttgatgtagttgatcttcaagacargtattgccataaatgtccctgcac

SEQ ID NO: 52139 - DNA, 50 bp, homo sapien
aaattattaaaaaagacaatttggtwaaatgaaacaggttagataatgat

SEQ ID NO: 52140 - DNA, 50 bp, homo sapien
ctttggaataccattactggtgctaytacatctcttaagaagcttttgtt

SEQ ID NO: 52141 - DNA, 50 bp, homo sapien
tctgcagagtgggcatgttacaaaaraagtattataaacaatgttgtcag

SEQ ID NO: 52142 - DNA, 50 bp, homo sapien
cactacaataaagctaatgccacaaytaagcaagtcacacaatttttaaa

SEQ ID NO: 52143 - DNA, 50 bp, homo sapien
tagtgtaaatataactgttatatgcmctggaaacatttaaaaattgtgtg

SEQ ID NO: 52144 - DNA, 50 bp, homo sapien
agacataatgctattgtacacagtakactacagtttagtgtaaatataac

SEQ ID NO: 52145 - DNA, 50 bp, homo sapien
tttgtaggcctcctactagatgttaygtaagggatttgagatagccatcc

SEQ ID NO: 52146 - DNA, 50 bp, homo sapien
atcagatctgaagcatacgcgttatraattgcccatgcattgaaatctaa

SEQ ID NO: 52147 - DNA, 50 bp, homo sapien
gaggatactatttaatataccaacawgtaacatatacatacacatatata

SEQ ID NO: 52148 - DNA, 50 bp, homo sapien
aaaaaacttgtggaattctctatgaracaacttaaaaaatctttaccaat

SEQ ID NO: 52149 - DNA, 50 bp, homo sapien
cctgagcagtggccgccatatggaamcaataaagggtcaaagaggaattg

SEQ ID NO: 52150 - DNA, 50 bp, homo sapien
atggttaatgtgtccaccagtagacracaaggagcaataataaagttcaa

SEQ ID NO: 52151 - DNA, 50 bp, homo sapien
ttgatttccatgaatgtggcctcacrctttataccaacattatagtatat

SEQ ID NO: 52152 - DNA, 50 bp, homo sapien
tcggtgactggtcagtgtactcatcratttccaaaatttgtataaatatc

SEQ ID NO: 52153 - DNA, 50 bp, homo sapien
cagctaacaaaatgcctgcagtcccraaatgttttattctctagtaaaga

SEQ ID NO: 52154 - DNA, 50 bp, homo sapien
ttattatagaaaagcataaaacttaraagtccagattactatgtggttct

SEQ ID NO: 52155 - DNA, 50 bp, homo sapien
tgagaacttaatcaatcatatataamaacattcggtatatgcttatatgt

SEQ ID NO: 52156 - DNA, 50 bp, homo sapien
cttaaggtaagaataaatatgctgamgtttgattatttggcacattattc

SEQ ID NO: 52157 - DNA, 50 bp, homo sapien
catataaatcatgaagaatttcagartaaagcagtgaacagtaaagcttc

SEQ ID NO: 52158 - DNA, 50 bp, homo sapien
taaaaaatcatttcttgcaggctaawcctaccataattatctacataaaa

SEQ ID NO: 52159 - DNA, 50 bp, homo sapien
tctacagtctatgttccaaaccacaragagaaaggaatcattcatccctg

SEQ ID NO: 52160 - DNA, 50 bp, homo sapien
tgacttcagttttgaaattgatgaayctgcatacaacatatcccttaaaa

SEQ ID NO: 52161 - DNA, 50 bp, homo sapien
tgataatcccttccccgactaaagtkaatgtaaagagatttagtaacata

SEQ ID NO: 52162 - DNA, 50 bp, homo sapien
aaaaattcattaaaaattgctgagayattagtgaaacactgcatcaaaag

SEQ ID NO: 52163 - DNA, 50 bp, homo sapien
ccatgatttccttgttgacagtgagyacttaaacagacttctatgaccag

SEQ ID NO: 52164 - DNA, 50 bp, homo sapien
attactgaatgcacaagaataattcrccttttgaaggcaaccaggttggg

SEQ ID NO: 52165 - DNA, 50 bp, homo sapien
ttttcagcagaaccatagtattcaayataaaacccaattgatggggcaac

SEQ ID NO: 52166 - DNA, 50 bp, homo sapien
aaatgatagctgcaaccactgcaaakaaagtagctcaagtcccacttttc

SEQ ID NO: 52167 - DNA, 50 bp, homo sapien
cttacttcaacaagaataaactgtaygaaagctctggagttctcagagaa

SEQ ID NO: 52168 - DNA, 50 bp, homo sapien
gctctgggagaggtgatagtgtagcycaaattgtgaattaggatgtgaat

SEQ ID NO: 52169 - DNA, 50 bp, homo sapien
acacacacaaagaaatattagcgaartggtcctatagaatgctgaaatag

SEQ ID NO: 52170 - DNA, 50 bp, homo sapien
aattttatcacaacaatttatatcawcatattcttctcaggtatgcaaaa

SEQ ID NO: 52171 - DNA, 50 bp, homo sapien
ttcccaaaatttataagggaagctaygaatcagaacaaaggaacaatcaa

SEQ ID NO: 52172 - DNA, 50 bp, homo sapien
ttacagagatttgcttagtcctcgayggctacttcagcatgctctgaaag

SEQ ID NO: 52173 - DNA, 50 bp, homo sapien
agtggcttcatgcagagaagcgaaakgacacgatgattcatttacacatt

SEQ ID NO: 52174 - DNA, 50 bp, homo sapien
cctttcatgttaaaaactctcaatgwaataagtattaaaggaacatatgg

SEQ ID NO: 52175 - DNA, 50 bp, homo sapien
actaggctgaaagcagacttctaacrgcaacaataaaagacagaagacat

SEQ ID NO: 52176 - DNA, 50 bp, homo sapien
gtagctttgattatccttgagttaarataggtaatccaaaatgtttacca

SEQ ID NO: 52177 - DNA, 50 bp, homo sapien
tccatttcagtctggtagaataagcragatagaaaataaatgtgtaaatg

SEQ ID NO: 52178 - DNA, 50 bp, homo sapien
ttacagagcttaattcaaatgtacastatgagctgatcgataatggaaag

SEQ ID NO: 52179 - DNA, 50 bp, homo sapien
caatctggcaggatacactggagaayacattattagctgacatttaccca

SEQ ID NO: 52180 - DNA, 50 bp, homo sapien
ttatttttaaaatccagagtggtggwcatcagctttaaaatctttgttta

SEQ ID NO: 52181 - DNA, 50 bp, homo sapien
tgaacatgtgtatgtgtgcaagaaakgctaaataccaagagaactgtata

SEQ ID NO: 52182 - DNA, 50 bp, homo sapien
acatgatatggattaggttttaaaargactactgtggtgctaaatgagaa

SEQ ID NO: 52183 - DNA, 50 bp, homo sapien
tgaactttcatctcagaataaaagcyagtccttaaaatggtcttcaggcc

SEQ ID NO: 52184 - DNA, 50 bp, homo sapien
gttggaaaagtcggtgaaccacaaakatggcagagcggaaaagcttcact

SEQ ID NO: 52185 - DNA, 50 bp, homo sapien
tattttttaaaaaatgtggctaccawtaatagtacatacatgaacaaaaa

SEQ ID NO: 52186 - DNA, 50 bp, homo sapien
tagggagaactgaaaagatcctactsagggagcacggctgggcaaaagta

SEQ ID NO: 52187 - DNA, 50 bp, homo sapien
tgttttacctcaactgcagccgatcratacttcattaggctgaattgtct

SEQ ID NO: 52188 - DNA, 50 bp, homo sapien
agaactgcaatccctgattaattaamcatgaagagtactcataaaaggct

SEQ ID NO: 52189 - DNA, 50 bp, homo sapien
actcttgtatcttcatgagttatacraaaagaacaacaattataattata

SEQ ID NO: 52190 - DNA, 50 bp, homo sapien
tgttagtaatagtaaataaattcaamtactactagaggacatttcattaa

SEQ ID NO: 52191 - DNA, 50 bp, homo sapien
gagctacggatggcataacatagcamctacatctccttagccatttgttc

SEQ ID NO: 52192 - DNA, 50 bp, homo sapien
tcattctgaacagacctgaacttccrctatgacataaattcattgtccta

SEQ ID NO: 52193 - DNA, 50 bp, homo sapien
gagcgaaagttaggactgcaccaackgggtagtttctcagagcatttact

SEQ ID NO: 52194 - DNA, 50 bp, homo sapien
ctcctacactttcccgcattcacacrgctatggtcaccaaattccttgct

SEQ ID NO: 52195 - DNA, 50 bp, homo sapien
aaaagttatcagtgtcaatccttatyaatttaaagtgttctccatccaat

SEQ ID NO: 52196 - DNA, 50 bp, homo sapien
agagactctgttatctgtgaatggaractatcaatactaacttcataatt

SEQ ID NO: 52197 - DNA, 50 bp, homo sapien
acacgaacatagtttgatattttaamctggacttagagattatcacattt

SEQ ID NO: 52198 - DNA, 50 bp, homo sapien
ttgacagtgtcaccagaataaatagsatggtgcccaaagcatggtagagt

SEQ ID NO: 52199 - DNA, 50 bp, homo sapien
attgatttaagctttctttatacagratcatcatacagcatgagttaatt

SEQ ID NO: 52200 - DNA, 50 bp, homo sapien
cagcatgagttaattagtatctacarggcctcacaactaggcaaattctc

SEQ ID NO: 52201 - DNA, 50 bp, homo sapien
ttgactatgtttcattcacctaagtyaatgctctgtgccttttaacctga

SEQ ID NO: 52202 - DNA, 50 bp, homo sapien
attggttgacatgatctttcagtgaygtagtttagtgaattttatattta

SEQ ID NO: 52203 - DNA, 50 bp, homo sapien
actacaactcatgaaaataaactacrattgtctacttaagcttcactgct

SEQ ID NO: 52204 - DNA, 50 bp, homo sapien
attattttttagaactccattaaaartcatacaaagtagccatttggcat

SEQ ID NO: 52205 - DNA, 50 bp, homo sapien
tggacaatttacctaagccatatagraccaaggtttccttactttaaagg

SEQ ID NO: 52206 - DNA, 50 bp, homo sapien
ggtagctaatctgaatcaatacaagrcagtgttataatctttgtttctaa

SEQ ID NO: 52207 - DNA, 50 bp, homo sapien
caacatcaagaatttattagcaggaraaaaagagggagtagatattggtt

SEQ ID NO: 52208 - DNA, 50 bp, homo sapien
taaaatggtgttagatggtaaactgwatgtaaaagaaagaaaattgtatt

SEQ ID NO: 52209 - DNA, 50 bp, homo sapien
caagtacttcctaaaacagtcatgcragaattaagaaccataaatcctaa

SEQ ID NO: 52210 - DNA, 50 bp, homo sapien
attatagaaactcacctaggatcaaygcagaagggtaaaaatgctaaata

SEQ ID NO: 52211 - DNA, 50 bp, homo sapien
atggagccctccctactatagatgaygccaaatagacagctgcttcagtt

SEQ ID NO: 52212 - DNA, 50 bp, homo sapien
tatattaagtattcctataacagtcrcagattgcttatcttttttgaaag

SEQ ID NO: 52213 - DNA, 50 bp, homo sapien
ccttcatatatgctgaggacagaaakaagcacttaaataaaatggtgtca

SEQ ID NO: 52214 - DNA, 50 bp, homo sapien
tggaagatgatgttatgcaaaagaasatgattagaatttcattaggtagg

SEQ ID NO: 52215 - DNA, 50 bp, homo sapien
atgagaagctactttcatttcacagrattaactgtagcatctggccaagt

SEQ ID NO: 52216 - DNA, 50 bp, homo sapien
atttaagtataagataactatatcawctaagctatttatcattttgaaaa

SEQ ID NO: 52217 - DNA, 50 bp, homo sapien
tcttactggtcaaattacccagtaargattttccaaatatattattttag

SEQ ID NO: 52218 - DNA, 50 bp, homo sapien
gtgctgggggtccacttcagccctcratcacctcagacactctgaagccc

SEQ ID NO: 52219 - DNA, 50 bp, homo sapien
gaaaatgtgtgaagaaattctgtagyccaatttatgaataactagtgaaa

SEQ ID NO: 52220 - DNA, 50 bp, homo sapien
tttcagaaaaattcagtgagtcatarctatctaattatattttttaagtt

SEQ ID NO: 52221 - DNA, 50 bp, homo sapien
ggtttaagaaaacattgtcctccgakaaatatagagaagaatctgggata

SEQ ID NO: 52222 - DNA, 50 bp, homo sapien
aagctcaccctggctgggataggtgycaaacagtcagtgatgaaggagag

SEQ ID NO: 52223 - DNA, 50 bp, homo sapien
atgtgtcagaaggttttagtgggaastgctatgaccaaccaactttttga

SEQ ID NO: 52224 - DNA, 50 bp, homo sapien
cttgattttattgtttacttataaarttatggccaattaatttatatcta

SEQ ID NO: 52225 - DNA, 50 bp, homo sapien
gatgtttgaaacatgaacaaatgtcrgaaaagtattatgataaactttac

SEQ ID NO: 52226 - DNA, 50 bp, homo sapien
gttaaggaatcatttagattatcacyggaaactgataaaaggtgtagaga

SEQ ID NO: 52227 - DNA, 50 bp, homo sapien
ctgccaatcttcatagcaactaaacygtcagatggatccccttactcaag

SEQ ID NO: 52228 - DNA, 50 bp, homo sapien
tctcaccaagcctgagtcatattaastgattcaaatgtatttgcacattc

SEQ ID NO: 52229 - DNA, 50 bp, homo sapien
tttgttcttgctgatggtacactgastcagaaggcttgcagcagtagaga

SEQ ID NO: 52230 - DNA, 50 bp, homo sapien
agaaataatttattccttttcagtarggatcatcaggatgtgtgtgtaca

SEQ ID NO: 52231 - DNA, 50 bp, homo sapien
tctgaaagatgtcactttatagaaayggtgtgtacacacacatcctgatg

SEQ ID NO: 52232 - DNA, 50 bp, homo sapien
aaccaaacgataaagacagcttgacraatttaagacagggaaaaatgtca

SEQ ID NO: 52233 - DNA, 50 bp, homo sapien
ttttgagttcaaatgtaaaatctaartatgtttgcaggaataactacaga

SEQ ID NO: 52234 - DNA, 50 bp, homo sapien
agtaatgtagtctctgtattattccyatggctgtaaacagcattagttga

SEQ ID NO: 52235 - DNA, 50 bp, homo sapien
gaggatatcacccatcagaaatgagragggtttagacagctggggttttc

SEQ ID NO: 52236 - DNA, 50 bp, homo sapien
gaagaagtaactgttataccacttaygcaaatatcaaggtaaggatatag

SEQ ID NO: 52237 - DNA, 50 bp, homo sapien
ttagaatggctgtgaccacctaacasgctattggtgatggaggatggata

SEQ ID NO: 52238 - DNA, 50 bp, homo sapien
actggagaattctatttcttatgcaygtcaaatatgtttccttctcctgc

SEQ ID NO: 52239 - DNA, 50 bp, homo sapien
aataaacaggagggcaaggagccaawgtcgtttgtagtggagggtagtca

SEQ ID NO: 52240 - DNA, 50 bp, homo sapien
ttttatctcagcctgaggctggccaytgataaattgtgtctaaaacatac

SEQ ID NO: 52241 - DNA, 50 bp, homo sapien
ctcaacagcagtgcctctttcagacratggatatggagggggtgttggca

SEQ ID NO: 52242 - DNA, 50 bp, homo sapien
catctcgatgctacatcttatttaargtcttatccatctttttaagttag

SEQ ID NO: 52243 - DNA, 50 bp, homo sapien
ttgtaaaaatgtcctagccattaacsagtcaaagctgttctcccattctt

SEQ ID NO: 52244 - DNA, 50 bp, homo sapien
tgcaatatagagtttataatcattcrctacagattgcaacatataggcta

SEQ ID NO: 52245 - DNA, 50 bp, homo sapien
ttgtatttagaaatactctgagaaarcctcaatgagaagttgacatttga

SEQ ID NO: 52246 - DNA, 50 bp, homo sapien
actattgaaatagttcaggcatgaarttaaaaggacctgcacatagagga

SEQ ID NO: 52247 - DNA, 50 bp, homo sapien
aagtccaagttcaagttcatttccartagactgaaacctaggcttacatg

SEQ ID NO: 52248 - DNA, 50 bp, homo sapien
tgtacataagagagaattggaatgcratacaacctagtggtctgatgcaa

SEQ ID NO: 52249 - DNA, 50 bp, homo sapien
ttatagtgagcaactgttaggggtaygataatgctagttctcctctccct

SEQ ID NO: 52250 - DNA, 50 bp, homo sapien
tacatgaatgtacaagcatgggtgaygtagcagtgatgaggacacattgt

SEQ ID NO: 52251 - DNA, 50 bp, homo sapien
gaacttcacatgtagtttcacttaawtgttatgacagtccagcaaggtat

SEQ ID NO: 52252 - DNA, 50 bp, homo sapien
tcagattgctggaattctgttgtaaygaatcaaccctatatatccttaga

SEQ ID NO: 52253 - DNA, 50 bp, homo sapien
cctccacccacttgcattttggtaaytacaaggatacattatcgattttt

SEQ ID NO: 52254 - DNA, 50 bp, homo sapien
ctatacccaggctctgtctctgtgaygctaaaacaatgagtcaagttgac

SEQ ID NO: 52255 - DNA, 50 bp, homo sapien
tctataaaactaacatacatttgtasgtatatatttatctatatatacat

SEQ ID NO: 52256 - DNA, 50 bp, homo sapien
tcattttatttcccaccattttctcyattcctttaatgcagtctcagtgt

SEQ ID NO: 52257 - DNA, 50 bp, homo sapien
agcaaagttttaagtacatagctaastatccatccccaaagattctaaat

SEQ ID NO: 52258 - DNA, 50 bp, homo sapien
cccaacaacttcattttagagacgamgaaaatgagaattagcatggcgga

SEQ ID NO: 52259 - DNA, 50 bp, homo sapien
ttctgggatagaaagaaactaattcrctccagttatattctacctatgag

SEQ ID NO: 52260 - DNA, 50 bp, homo sapien
ctcaatacaggcagaaaaagaattgsaaaatattaacaccctttaacaat

SEQ ID NO: 52261 - DNA, 50 bp, homo sapien
ttttttttttttgctggtgtgctaaytgcaaagtgatctcctctcaggac

SEQ ID NO: 52262 - DNA, 50 bp, homo sapien
tcttacatgcctcagtgctttgacartgggtggtaaatagaataaggaga

SEQ ID NO: 52263 - DNA, 50 bp, homo sapien
tattaacgattcttgcttgcaacaastattactgaggtgttagccaagta

SEQ ID NO: 52264 - DNA, 50 bp, homo sapien
tgctacaggaaaagagatgggatgaygagacaacacatgttatagtctca

SEQ ID NO: 52265 - DNA, 50 bp, homo sapien
ttccttcccaaaatgcaaacagcagscctttcttaattatccacaacaaa

SEQ ID NO: 52266 - DNA, 50 bp, homo sapien
ccaggacaggcacataattttaagaktaattggtacagaaaaatagacta

SEQ ID NO: 52267 - DNA, 50 bp, homo sapien
agaagaaacacacaagttcagaagargagatattgctgaaggataaaaga

SEQ ID NO: 52268 - DNA, 50 bp, homo sapien
agcaaggctatttctggaagatttayatttgaaagcagcatacagaagga

SEQ ID NO: 52269 - DNA, 50 bp, homo sapien
ccatcactggggtttggtctttcaayttagctacacgctgaagtttacat

SEQ ID NO: 52270 - DNA, 50 bp, homo sapien
tttctatggagtagtttccagagatyacattccacagtaacttacagagt

SEQ ID NO: 52271 - DNA, 50 bp, homo sapien
gatgactaaagctttcttgagataawtctatggcttaagtaatttataaa

SEQ ID NO: 52272 - DNA, 50 bp, homo sapien
tgtcaagactgctcactgggacattkaacaacccagggaacaaaacactg

SEQ ID NO: 52273 - DNA, 50 bp, homo sapien
aaaataagggagacctcgctgacggrataggagaatgaggttccgggaac

SEQ ID NO: 52274 - DNA, 50 bp, homo sapien
ctagtcacttcactgagattttagartaaggatgtgagtagtgagataca

SEQ ID NO: 52275 - DNA, 50 bp, homo sapien
tccatatattgagttacaaggatgaygaggcaaagagtctagtgccaaag

SEQ ID NO: 52276 - DNA, 50 bp, homo sapien
tattattcatttgtattttctaagawgatgtcatttaatttagtactttg

SEQ ID NO: 52277 - DNA, 50 bp, homo sapien
tgtgtatgtgccataggtagactggwaagagacatatgaatagattggca

SEQ ID NO: 52278 - DNA, 50 bp, homo sapien
agaaaattggtctgtctaggaaagargaatttgaattttattgttgttgt

SEQ ID NO: 52279 - DNA, 50 bp, homo sapien
tcacttctgctctgcatacctttaakattcttccttaggattctctagta

SEQ ID NO: 52280 - DNA, 50 bp, homo sapien
tggaaaatatacaaagataaagctgratataataaatgactaaatttttg

SEQ ID NO: 52281 - DNA, 50 bp, homo sapien
aaccactgattcttaactgagtggarataagtgacggttatttctgggtt

SEQ ID NO: 52282 - DNA, 50 bp, homo sapien
tttttcttatccagtacaaaaccaaygaatttaagagctagtggaactaa

SEQ ID NO: 52283 - DNA, 50 bp, homo sapien
tttatctgtattagtttgtgtaatawtagaatctggcacataatagttcc

SEQ ID NO: 52284 - DNA, 50 bp, homo sapien
ttgggtgaggtggaggactctgctcygaatgaaagaagaggcactgcctt

SEQ ID NO: 52285 - DNA, 50 bp, homo sapien
tttcttctctaaaaggtaagcatgamaataacatctatttcagagttgct

SEQ ID NO: 52286 - DNA, 50 bp, homo sapien
ttgtcatagcaatcaccttacttggycagctttcggctggtgtgtatagt

SEQ ID NO: 52287 - DNA, 50 bp, homo sapien
ataaaatgcttatgatgtgtcaaacratgtactaagtcacttacgccatc

SEQ ID NO: 52288 - DNA, 50 bp, homo sapien
tgtggtttgggattgtcatgtagaaygtggcaacgaggtttttcagtttt

SEQ ID NO: 52289 - DNA, 50 bp, homo sapien
agtaaactgaaacactgataaattayggtacttgccacatttacttatta

SEQ ID NO: 52290 - DNA, 32 bp, homo sapien
gaattctcaagatagargtaacagagatccta

SEQ ID NO: 52291 - DNA, 50 bp, homo sapien
tgttctgctcaatttattgcccacargatgacttcctccaatttccagag

SEQ ID NO: 52292 - DNA, 50 bp, homo sapien
aaacagaaattaattattagttgccygaagtagatgggcctagttaaatc

SEQ ID NO: 52293 - DNA, 50 bp, homo sapien
catagtaaattaatgcacaatgaagsaggttgccaacaaaaaatagtccc

SEQ ID NO: 52294 - DNA, 50 bp, homo sapien
aacaacaaatatgactctgtagtgartcaaacaacaaatatgttaatttc

SEQ ID NO: 52295 - DNA, 50 bp, homo sapien
acaggctgattgatacttaaggaatraagtgttacaaagcatattatgcc

SEQ ID NO: 52296 - DNA, 50 bp, homo sapien
taaattgtaccacctcctgagagacraacattttcaaattagagaacagt

SEQ ID NO: 52297 - DNA, 50 bp, homo sapien
ctattaagcttctaaatagccaagakctctaattatatatgtgtgtatat

SEQ ID NO: 52298 - DNA, 50 bp, homo sapien
gttgaggtaggtgtacagttgaagcyactacaaaaagagtgaccatgagc

SEQ ID NO: 52299 - DNA, 50 bp, homo sapien
ataagtaaatgtgttaagaatctcarctttatctgtgcacattcatatgt

SEQ ID NO: 52300 - DNA, 50 bp, homo sapien
tattttgaaacactttttagattgcmctcaagagaatagacaaaagttgc

SEQ ID NO: 52301 - DNA, 50 bp, homo sapien
tgctttgcttctgactatcatttgaygaagtttctggtgtgctagagaat

SEQ ID NO: 52302 - DNA, 50 bp, homo sapien
ggcttgcaagatatattggtctcgawgatttaaatatagaaatcagaagg

SEQ ID NO: 52303 - DNA, 50 bp, homo sapien
atattattaatgataggaatactaargcggagataccaggaacccaatct

SEQ ID NO: 52304 - DNA, 50 bp, homo sapien
ctatttctaccttaacattaaaaaarttgatgtatttcgtctgagtgcaa

SEQ ID NO: 52305 - DNA, 50 bp, homo sapien
accactgaatagctagaaacgaggamtcatcttaaattctgttctcttct

SEQ ID NO: 52306 - DNA, 50 bp, homo sapien
ttactgtacagtgctttagcagttaragtgataaatgggtaaacaatctg

SEQ ID NO: 52307 - DNA, 50 bp, homo sapien
gttgattgaaccacactgaaactaakgtattccagttctaaagtcagtat

SEQ ID NO: 52308 - DNA, 50 bp, homo sapien
taaaatcagaaatgaaaattgagaartaagctattctacttaaattgtaa

SEQ ID NO: 52309 - DNA, 50 bp, homo sapien
tagtattctcttataatctttttacratttaagtagaatagcttatttct

SEQ ID NO: 52310 - DNA, 50 bp, homo sapien
gcagtttaaatgattttgacaagtayagaaaagtgtcattgacaggtgca

SEQ ID NO: 52311 - DNA, 50 bp, homo sapien
tgtgacattttcatttatgttaatakggcttttatgttttaatgttcatt

SEQ ID NO: 52312 - DNA, 50 bp, homo sapien
tttactttacatttcatgaatacackccagcttctgaaaaccatagctaa

SEQ ID NO: 52313 - DNA, 50 bp, homo sapien
tttgtttagataatcaaatgtctaayaatatacaccaatctaaaatgttc

SEQ ID NO: 52314 - DNA, 50 bp, homo sapien
tcccaagaaaatacaactaaagtgarctctataaaaagaagtgtatttac

SEQ ID NO: 52315 - DNA, 50 bp, homo sapien
caaataattgcaatactgaagcaagsaaatatttattagaagggacttta

SEQ ID NO: 52316 - DNA, 50 bp, homo sapien
tttgtacttatttatgtatgtagcckaagggccaggagtatgtattagac

SEQ ID NO: 52317 - DNA, 50 bp, homo sapien
cctttgtgaattctgagaattggtgwactcacctttatagctcccacagt

SEQ ID NO: 52318 - DNA, 50 bp, homo sapien
cagaagaggcaaggtgaggtcacaartgataacatctactgttctgaaac

SEQ ID NO: 52319 - DNA, 50 bp, homo sapien
aatgctaggcctatggcaagtaaagwccacaattgaaggaatgtgaacaa

SEQ ID NO: 52320 - DNA, 50 bp, homo sapien
tatgcacatttaaaattttggttgayatttcaataagatttggggttggt

SEQ ID NO: 52321 - DNA, 50 bp, homo sapien
tgaccttctagcaacctgttttgtayaagaaatcaagaaaacctgttcac

SEQ ID NO: 52322 - DNA, 50 bp, homo sapien
tatgctaaggaaaaatgctcttcagwaagaaagtaaattatcccagatag

SEQ ID NO: 52323 - DNA, 50 bp, homo sapien
aaagttaaggaaagaaattctctcawatttttagaagcacccttgatttt

SEQ ID NO: 52324 - DNA, 50 bp, homo sapien
ttatgtgtgcttgtgtgagaagatcraggttttcctggcttggagccctg

SEQ ID NO: 52325 - DNA, 50 bp, homo sapien
agagtctgacaaccatgtcagggtayggcaatgcttaacttggtgaccaa

SEQ ID NO: 52326 - DNA, 50 bp, homo sapien
attgtcagggaaattaacagtttcayctcttttgtattccatttcctaaa

SEQ ID NO: 52327 - DNA, 50 bp, homo sapien
aaacattttcagaggtttgttgttcyaattataaataagtgagctacgtt

SEQ ID NO: 52328 - DNA, 50 bp, homo sapien
taaagatgaattataacatacttcamgggcaatcagtaaattgagagaac

SEQ ID NO: 52329 - DNA, 50 bp, homo sapien
gaaaacatttgactgagcaatactcyatgttatttttaaagggcatgttg

SEQ ID NO: 52330 - DNA, 50 bp, homo sapien
tcttcatttatgggaaaatgcaaaastgttcttgttgttctcagagacat

SEQ ID NO: 52331 - DNA, 50 bp, homo sapien
tttagtttgattccatataccacccrgatacttatttttgtcccccttgt

SEQ ID NO: 52332 - DNA, 50 bp, homo sapien
ttagcctgatagtctaaatagaatartagtattccagcataatagtctaa

SEQ ID NO: 52333 - DNA, 50 bp, homo sapien
ctattagttaacctgaacttctaacyacatcccatctcctaatgtggaga

SEQ ID NO: 52334 - DNA, 50 bp, homo sapien
atttgtaatgtcttagacctctttcyagttgaagactgatgggaacagta

SEQ ID NO: 52335 - DNA, 50 bp, homo sapien
ggaggttacaaaaaaccagcacttaygttttgttcaaccggcagcaatgc

SEQ ID NO: 52336 - DNA, 50 bp, homo sapien
acgttatcctaaatatttaaaatcasataatctagcggttgaacagtcta

SEQ ID NO: 52337 - DNA, 50 bp, homo sapien
aaatagtctcctagttggttttatcrcattataatatggcactcaagcca

SEQ ID NO: 52338 - DNA, 50 bp, homo sapien
caggttttagctacaattttatctcraatggaaatacttatttctgctgc

SEQ ID NO: 52339 - DNA, 50 bp, homo sapien
ctgttttgcactggcaattagagaarctcttagaagtaggagttagtgtt

SEQ ID NO: 52340 - DNA, 50 bp, homo sapien
actcccaggtacctgagttaaagaastctcttatatcacaaaaggaaagt

SEQ ID NO: 52341 - DNA, 50 bp, homo sapien
cttagaagtaggagttagtgttatayccagaacatatgcagccacagctc

SEQ ID NO: 52342 - DNA, 50 bp, homo sapien
gagttagaaatggcctacctgagatsaactactaaatgttataagactct

SEQ ID NO: 52343 - DNA, 50 bp, homo sapien
aaatcatcccccagattgtgtcacckaagataaaccttttcagagagcag

SEQ ID NO: 52344 - DNA, 50 bp, homo sapien
atgtttttggtttgtcataatacaamgtcagggcaagatacaataacaca

SEQ ID NO: 52345 - DNA, 50 bp, homo sapien
tgcatacctacatgcttttaaactcrcatacttgattttccagattgcat

SEQ ID NO: 52346 - DNA, 50 bp, homo sapien
gtaatgtttgtttttctttcattagycatactatcaaatcaaaatgcata

SEQ ID NO: 52347 - DNA, 50 bp, homo sapien
cttctataaatcagaattgaaacagyaactttgcaaccagaggcattttt

SEQ ID NO: 52348 - DNA, 50 bp, homo sapien
aactaaaatgtatgctatttaacacraaaacttcatttaattgagtccat

SEQ ID NO: 52349 - DNA, 50 bp, homo sapien
atatctattgaaattgctgtattaarattagaactgagaaacaaaaagta

SEQ ID NO: 52350 - DNA, 50 bp, homo sapien
ctaattagctctgtgtttccactaarcctcatatcacaaacaaattactt

SEQ ID NO: 52351 - DNA, 50 bp, homo sapien
tttgagtggatacattcagaccatarcattactgaagcaaaaacacaact

SEQ ID NO: 52352 - DNA, 50 bp, homo sapien
tgattattatgttaaattatgcaaamcttttgggtatcccctaggaagat

SEQ ID NO: 52353 - DNA, 50 bp, homo sapien
tgtttaaatggacacaataccaaaamtacattctgattacatatttctca

SEQ ID NO: 52354 - DNA, 50 bp, homo sapien
ttcatgtttgtttacccaaactttarcatggcaccgggcatatgttgtat

SEQ ID NO: 52355 - DNA, 50 bp, homo sapien
taaaactttccccatcctgtcatcasctaaaatgtgggaggaggacttgg

SEQ ID NO: 52356 - DNA, 50 bp, homo sapien
gacatagatgaagcatgcaccaaagscacaaggattcgtcaactttcatg

SEQ ID NO: 52357 - DNA, 50 bp, homo sapien
tcaagagataaagcctatagaaaccmaatgaatagaagaaaatccagaca

SEQ ID NO: 52358 - DNA, 50 bp, homo sapien
ctgttaagaaaatcaagactaaaaawcacatggtgaaaaatctcagctat

SEQ ID NO: 52359 - DNA, 50 bp, homo sapien
cattgaggttcagaatcaggttctayatggaagtactttctcattcatct

SEQ ID NO: 52360 - DNA, 50 bp, homo sapien
cactaaggaagtggataaatgtgtayagtaaatatggcataaaataccac

SEQ ID NO: 52361 - DNA, 50 bp, homo sapien
caaaggcctttgtccattgagatggyattatatagtggtattatctgatg

SEQ ID NO: 52362 - DNA, 50 bp, homo sapien
actccaaggggatgacttttcctaaygcagccgggcttgatggagtctgg

SEQ ID NO: 52363 - DNA, 50 bp, homo sapien
gcatgaatttcgatctcaagaagcgyatggaattttcatttcttattttt

SEQ ID NO: 52364 - DNA, 50 bp, homo sapien
cttttccaaacaattgaagaggaagraatagtttccaattcattttatga

SEQ ID NO: 52365 - DNA, 50 bp, homo sapien
aagtgcatgtttagtccaagaaatgwcacccaagcaaatggaagaagctt

SEQ ID NO: 52366 - DNA, 50 bp, homo sapien
cttatgtttaaatatttaaactacargaataaatctcacttgatcaaggg

SEQ ID NO: 52367 - DNA, 50 bp, homo sapien
agagcctgaaaaactcactaaaaaawtttcataataaaatcagaagtagt

SEQ ID NO: 52368 - DNA, 50 bp, homo sapien
ataaggatattttctcaccttttcayctgttggattttgacatacttaat

SEQ ID NO: 52369 - DNA, 50 bp, homo sapien
ctattcagctcaaggcttacgtgagragataaagtaattgcacttacaat

SEQ ID NO: 52370 - DNA, 50 bp, homo sapien
ttgaggcagtaataaatattgagtartaaatgttcatccagatatagaac

SEQ ID NO: 52371 - DNA, 50 bp, homo sapien
tgcaccaaccctaggactcctattcrgaataaaataaggaacttcaaatt

SEQ ID NO: 52372 - DNA, 50 bp, homo sapien
gcttttactcgtttgagcttctgtarcagtattagtgtagcatgagattc

SEQ ID NO: 52373 - DNA, 50 bp, homo sapien
aggattgttttattttttaaagcaakttcactacttaaagcaaagattgg

SEQ ID NO: 52374 - DNA, 50 bp, homo sapien
aattgaattaagtgttttatgtgtcrctttttgaaaaataaactccatga

SEQ ID NO: 52375 - DNA, 50 bp, homo sapien
atgtagcttgtttgtcaactgtcaastagcttttctcttaccttcacagg

SEQ ID NO: 52376 - DNA, 50 bp, homo sapien
tccaagcttaggatcctgttcagagraccaaagtccaagaggcttgagta

SEQ ID NO: 52377 - DNA, 50 bp, homo sapien
atgggcatttctaaggggtactgcaygaattaatgatggttgcacagaga

SEQ ID NO: 52378 - DNA, 50 bp, homo sapien
gaaaatgtactaccttattaaggaaytacaggcaaatattccccaatatt

SEQ ID NO: 52379 - DNA, 50 bp, homo sapien
gttttaagttctgtctctagtatcayggaactggaaagatattctgctag

SEQ ID NO: 52380 - DNA, 50 bp, homo sapien
ttagtatcactgtgattaccatcaawttcattacattactctgtttggag

SEQ ID NO: 52381 - DNA, 50 bp, homo sapien
agtgatgaactgatgaacaagcgtcyatggttgtctcctccatgcaatca

SEQ ID NO: 52382 - DNA, 50 bp, homo sapien
ctgcagaggtaagccataagacatayctgtgattcacagttttcccacat

SEQ ID NO: 52383 - DNA, 50 bp, homo sapien
tttagagaactaatatttaggctcargttaatcaatatcttttttattca

SEQ ID NO: 52384 - DNA, 50 bp, homo sapien
tattcacaggtaaccacttactccaratacaaaaatatctaaagagacag

SEQ ID NO: 52385 - DNA, 50 bp, homo sapien
catttctagctaacttaagacagtamaataagacaggcaaagctattagg

SEQ ID NO: 52386 - DNA, 50 bp, homo sapien
cactgaacataactatatcaaagacmacatattgagaatcaatcaattga

SEQ ID NO: 52387 - DNA, 50 bp, homo sapien
gtgtgtacataggcttattaaattarcgtcagctcctcctacccaaggac

SEQ ID NO: 52388 - DNA, 50 bp, homo sapien
gttatctctgaatcatgggctgttasgtgataccaagaaggaaactggta

SEQ ID NO: 52389 - DNA, 50 bp, homo sapien
tgaaggaagtagatgatatccatgaygtttaagattagatgtgcacagca

SEQ ID NO: 52390 - DNA, 50 bp, homo sapien
gccttggtgtgggaaaggatcagatragaagtcattgctggcattttctc

SEQ ID NO: 52391 - DNA, 50 bp, homo sapien
gaaattttccttttcggtatggcaarttaagcacattagctattccttat

SEQ ID NO: 52392 - DNA, 50 bp, homo sapien
gtacaacaatgtctcttgcaaaaaawtgagttttatttattatcttccaa

SEQ ID NO: 52393 - DNA, 50 bp, homo sapien
tataatgctggcatatgttcagatayggtatgaggtaagacaattcgtgt

SEQ ID NO: 52394 - DNA, 50 bp, homo sapien
atacaaaatggtcactgtgactaaayatacagtgctcctttctgcattag

SEQ ID NO: 52395 - DNA, 50 bp, homo sapien
gcctgggaaataacatttcaaaatarggtatatggaagtcttagatctca

SEQ ID NO: 52396 - DNA, 50 bp, homo sapien
agttctcagccttgtccctattccaygttccagttctacctcttgggcct

SEQ ID NO: 52397 - DNA, 50 bp, homo sapien
tttattattttttcttttaatgggcyatgctttcctctttcttttcatcc

SEQ ID NO: 52398 - DNA, 50 bp, homo sapien
ctatgtctatctttaggtatatctayccctgcagcagcagtgtattgctc

SEQ ID NO: 52399 - DNA, 50 bp, homo sapien
cacaatgcaattgcaagtattaacakcagaataaatcaaactgaggaaat

SEQ ID NO: 52400 - DNA, 50 bp, homo sapien
agagattagtgatcacatagagtgargtttgggaatctgtatttttaaat

SEQ ID NO: 52401 - DNA, 50 bp, homo sapien
cctaaagcgtgtacaactgaaataastgaaagacgtgaaaaggtaattgc

SEQ ID NO: 52402 - DNA, 50 bp, homo sapien
tagcaaatgttcattaattcactcaratataatcaatcacctacaatttt

SEQ ID NO: 52403 - DNA, 50 bp, homo sapien
tttgcagattgtcataaaatttgaartcatgtagcaataatgatagactg

SEQ ID NO: 52404 - DNA, 50 bp, homo sapien
aagattaagggcctccataggaaaamgtgactttcaattacagaccagca

SEQ ID NO: 52405 - DNA, 50 bp, homo sapien
tataaggtacttacctactttaatayattggaaccttcttataaaacaat

SEQ ID NO: 52406 - DNA, 50 bp, homo sapien
ttgtatttaaatcaaagtcataggaytacgaaagtaacattggattaatg

SEQ ID NO: 52407 - DNA, 50 bp, homo sapien
gtggcacaggactgtgagctaagaasgatgaattctgctgggtttattaa

SEQ ID NO: 52408 - DNA, 50 bp, homo sapien
atataaatttaagaacttgagaaaaygaaaaatacagactcaaaattatt

SEQ ID NO: 52409 - DNA, 50 bp, homo sapien
tatctatactacttggtactgtataygtttatttgaaagaattttaattt

SEQ ID NO: 52410 - DNA, 50 bp, homo sapien
agattaggcttgacaataaagctaaygtctgcaacccttgaatctcttct

SEQ ID NO: 52411 - DNA, 50 bp, homo sapien
aaaatctggccttgatcttaactaaytccatacttgaaaactacttttgt

SEQ ID NO: 52412 - DNA, 50 bp, homo sapien
attttctaactgctttttttcaacasagaacatagtataattgacttaaa

SEQ ID NO: 52413 - DNA, 50 bp, homo sapien
gtaatgtgatttagcactccaaaaawttctctagagttacatgagctttt

SEQ ID NO: 52414 - DNA, 50 bp, homo sapien
acttagcatgccagaaagttcgaaarcaaaggctctggaatcagaaatgt

SEQ ID NO: 52415 - DNA, 50 bp, homo sapien
tttgtagaatgatatgccagtgataygatgactgggaggtgagcatagac

SEQ ID NO: 52416 - DNA, 50 bp, homo sapien
catatcattctacaaactcatgtcawccgaaccctcaggtgttccaagcc

SEQ ID NO: 52417 - DNA, 50 bp, homo sapien
ataaagtagggattaagggcataccyattcagaggtctgacaacacccag

SEQ ID NO: 52418 - DNA, 50 bp, homo sapien
aacgtattgatgggattttgtaatgyaagtgttttgaaattcaaaagcaa

SEQ ID NO: 52419 - DNA, 50 bp, homo sapien
tggaggggctgtccatctggatctcrcaggcctctggatgctgacacgtt

SEQ ID NO: 52420 - DNA, 50 bp, homo sapien
ggctttgatgaccatattttccacawagtcttggaattcaggctatttag

SEQ ID NO: 52421 - DNA, 50 bp, homo sapien
aaacaggtgtttttagattctcaacmctattccattgttgcttatgtcta

SEQ ID NO: 52422 - DNA, 50 bp, homo sapien
cctaaatggcacaggagatttgggasacttctagagcttgtttccacttc

SEQ ID NO: 52423 - DNA, 50 bp, homo sapien
tctgttttggtaaatggctgtaaaarcattaagacattaacatctaaagc

SEQ ID NO: 52424 - DNA, 50 bp, homo sapien
gttggagatatctgttagccatccaragggagatactgagtagcagattg

SEQ ID NO: 52425 - DNA, 50 bp, homo sapien
ctgaatttgaaagttaatgcttagcygcgtcttcctgcccgattctccaa

SEQ ID NO: 52426 - DNA, 50 bp, homo sapien
ggcgaaaggataggattaagtgaacrgaagttatagtttattagctaagc

SEQ ID NO: 52427 - DNA, 50 bp, homo sapien
ctttttggagaatccacctagtaacwcttagtgaggagaccagagcctaa

SEQ ID NO: 52428 - DNA, 50 bp, homo sapien
taataattcataacataaaactgtartaatagttagcaggtgcttattat

SEQ ID NO: 52429 - DNA, 50 bp, homo sapien
agctttctcagaattaaataagacartggcagttacttttgcctgacctc

SEQ ID NO: 52430 - DNA, 50 bp, homo sapien
ttttggaatctatctgacatctgacraaaaagagaagctgctggataaat

SEQ ID NO: 52431 - DNA, 50 bp, homo sapien
atgaggaacatctcagcagaggatarcctggacctaggtctgcagggccc

SEQ ID NO: 52432 - DNA, 50 bp, homo sapien
ctgagtccattctctgatttagacayaattgaatcagattttgttttaaa

SEQ ID NO: 52433 - DNA, 50 bp, homo sapien
actccttgccttcagtataaagtccmaagtcctgtgcttgaccttcagtg

SEQ ID NO: 52434 - DNA, 50 bp, homo sapien
aaggaggaatgattggatgtgtcaargagagtagtatagtgccgttagga

SEQ ID NO: 52435 - DNA, 50 bp, homo sapien
tactgccatttactttgggaaatgarctaatctggaaatctgatgttgct

SEQ ID NO: 52436 - DNA, 50 bp, homo sapien
gaaggcatatctaggattgtcaacartgtgtaggattccagactcatatt

SEQ ID NO: 52437 - DNA, 50 bp, homo sapien
gttcaaggtataatctgatgatttcyaaaactgggataatagtcctcacc

SEQ ID NO: 52438 - DNA, 50 bp, homo sapien
tcagaggatcaaagtgacttaatgcrcatgaataggccttaaaatcacaa

SEQ ID NO: 52439 - DNA, 50 bp, homo sapien
aagatatgccaaaaaactctgtaaartataaatcatagtagtaatgtaat

SEQ ID NO: 52440 - DNA, 50 bp, homo sapien
attaaagagagaacatgaaggaaagkatggactatcttcaacctttaaaa

SEQ ID NO: 52441 - DNA, 50 bp, homo sapien
tttctttttttgtttcattcactcarctgaaacattgatacagtagcttt

SEQ ID NO: 52442 - DNA, 50 bp, homo sapien
cctgtttaggtagatggaatctctgsaataaaaatgctcttagcctctgc

SEQ ID NO: 52443 - DNA, 50 bp, homo sapien
taatcccctacctgattaatgcaacygcaacccaaattggttcacacatg

SEQ ID NO: 52444 - DNA, 50 bp, homo sapien
tactatgtaatccttgacctctctcratgatgatgaacctgggtacatct

SEQ ID NO: 52445 - DNA, 50 bp, homo sapien
atctacctaaacaggctatttaaatkaccagaatgcactaagctttgagc

SEQ ID NO: 52446 - DNA, 50 bp, homo sapien
aaaaaaaaaaaaggtgagacctaagmaattcagtttacatcctaatgaaa

SEQ ID NO: 52447 - DNA, 50 bp, homo sapien
aatgtgaccttctaatcctgtgtccmaatcataggtaaacacaggcttcc

SEQ ID NO: 52448 - DNA, 50 bp, homo sapien
ctttacaaagatttgccatataagtracagtgtaagcactttataatagt

SEQ ID NO: 52449 - DNA, 50 bp, homo sapien
tatgcaggaaccaatgtaccagaaarctgaggtacttcaagaactaaatg

SEQ ID NO: 52450 - DNA, 50 bp, homo sapien
ccagccccacacggtcacactcacartaggcacccttcaatgcctttctg

SEQ ID NO: 52451 - DNA, 50 bp, homo sapien
tcagtgtcactcaaaccacaagacckgaaagtgagtgggttgatgcctgg

SEQ ID NO: 52452 - DNA, 50 bp, homo sapien
gtgactttagtctttaccttacgtayatttagaattttgaactgtgacta

SEQ ID NO: 52453 - DNA, 50 bp, homo sapien
ttggatcaccagagtttaggtaagastacagcataatggaaaagaaaaaa

SEQ ID NO: 52454 - DNA, 50 bp, homo sapien
aggaattatcaatctgtcttattcartatatatctttggcagttttagaa

SEQ ID NO: 52455 - DNA, 50 bp, homo sapien
ctgaaatacgacactaatttttcaayctaattctccaactatgcaaaagt

SEQ ID NO: 52456 - DNA, 50 bp, homo sapien
tcaagtgtagccagtagtccttccaracgagaatgtaacatggaggcatg

SEQ ID NO: 52457 - DNA, 50 bp, homo sapien
actatgtaagtaatagctataaaccrgatgtaaaattttgtctttttagt

SEQ ID NO: 52458 - DNA, 50 bp, homo sapien
ctgaaattcttaattgtatacaagargcaagtatgagtgttattaaaatt

SEQ ID NO: 52459 - DNA, 50 bp, homo sapien
gctttgagtccagtgaatatataggractgataccagctgggggagcaga

SEQ ID NO: 52460 - DNA, 50 bp, homo sapien
gagctgtgacatacaagggtcaaccmaagtactggaggtttttatgctat

SEQ ID NO: 52461 - DNA, 50 bp, homo sapien
caaggttaacatctttgtgagattamcatcttttaacctgccatacagta

SEQ ID NO: 52462 - DNA, 50 bp, homo sapien
atcccatgccccaatcacactgagargtaaaatgttcaagcatgaaacta

SEQ ID NO: 52463 - DNA, 50 bp, homo sapien
ggaggcaagaaggaggtcaaaccacyggccaaagtttatcttccctaaag

SEQ ID NO: 52464 - DNA, 50 bp, homo sapien
ttccttttcatggttgcacattttcyattctgtatcatttagagttagtt

SEQ ID NO: 52465 - DNA, 50 bp, homo sapien
ataagataaagagctgacaatgggaktaatttggctatataaagacaggc

SEQ ID NO: 52466 - DNA, 50 bp, homo sapien
gcttctcaaatacatttcccaaataractatgtgcactccggaccttgtt

SEQ ID NO: 52467 - DNA, 50 bp, homo sapien
tatccttacttgtacatgggaataayagcagatacatcaaggaaaagatg

SEQ ID NO: 52468 - DNA, 50 bp, homo sapien
tttagtgccaggacctttacttctgraccctacacgagaagggtgtcggc

SEQ ID NO: 52469 - DNA, 50 bp, homo sapien
ctagacagaatatatataagaatcamcatcctattccttcatggaaaact

SEQ ID NO: 52470 - DNA, 50 bp, homo sapien
aacataaagtgatatcatgttgatcrataaactcatatctaatatccaaa

SEQ ID NO: 52471 - DNA, 50 bp, homo sapien
gtggtttgacctcaagtatagtaggyatatgtttagctttaaacactagc

SEQ ID NO: 52472 - DNA, 50 bp, homo sapien
ctgcgttccagaatgcctacaaaaarttttcataaatggaagagtgattc

SEQ ID NO: 52473 - DNA, 50 bp, homo sapien
tctgtatatgatgaatacatttttayacactaacattagcattaacaggt

SEQ ID NO: 52474 - DNA, 50 bp, homo sapien
aaatacaggcaacaaaagtaaagacrgacaagtgggattgcatcaaacta

SEQ ID NO: 52475 - DNA, 50 bp, homo sapien
ggagagtcaaaatctatgagataaayatagatttccatgtcttgggtgtc

SEQ ID NO: 52476 - DNA, 50 bp, homo sapien
cctgttatactacttgtgtaatttgwatctctgagcataaaagctggcac

SEQ ID NO: 52477 - DNA, 50 bp, homo sapien
gggcaatacaaatattttttactccraaatggattgattttcctcccatt

SEQ ID NO: 52478 - DNA, 50 bp, homo sapien
aaatagtcttttttgctcttacaaaygtgacccactatttaaaatgatat

SEQ ID NO: 52479 - DNA, 50 bp, homo sapien
gtaagaaatattgggttaccttatgratgactgtgagatgggtaaaatca

SEQ ID NO: 52480 - DNA, 50 bp, homo sapien
aacaataaagtgtctgactaacttayagggtcgttactttgtgctttatt

SEQ ID NO: 52481 - DNA, 50 bp, homo sapien
aaatgctaccatttaatcaccacaastgcataagtgaaaccatgcaacat

SEQ ID NO: 52482 - DNA, 50 bp, homo sapien
aataaattgtgggttgaactacttayccctgtgtgaacattgaattactt

SEQ ID NO: 52483 - DNA, 50 bp, homo sapien
tttattatacttgattccaaaatagwacagccttgaatctataaaactgt

SEQ ID NO: 52484 - DNA, 50 bp, homo sapien
tgtgtgatgttccatataactgcaayagtcacatcacaaatttgtatcta

SEQ ID NO: 52485 - DNA, 50 bp, homo sapien
atcaagcagtgtatttgagcagacastatgcatggcactggggaaacaga

SEQ ID NO: 52486 - DNA, 50 bp, homo sapien
actctgagccctttctgtacaatagrataaaactaatacctatttcatgt

SEQ ID NO: 52487 - DNA, 50 bp, homo sapien
gtcctatcaaaaacataagacttaayaccctacaataaaatacattataa

SEQ ID NO: 52488 - DNA, 50 bp, homo sapien
agtgaagagttagggaattagaggamcttggatacagacttggctctgct

SEQ ID NO: 52489 - DNA, 50 bp, homo sapien
attgttttgtagtctttctattacaracaattctttaatgaatctctttg

SEQ ID NO: 52490 - DNA, 50 bp, homo sapien
ttttcttgctctgttttcctctacgyacttcttgtattgtgtgcttgcct

SEQ ID NO: 52491 - DNA, 50 bp, homo sapien
tgataaggacatataccttacttgargcataactactctatattaaacac

SEQ ID NO: 52492 - DNA, 50 bp, homo sapien
cagtcactcatcaagtcagggcaaarccagtgttatgatgcatggctctc

SEQ ID NO: 52493 - DNA, 50 bp, homo sapien
cacagacatttagattaaggttccasggtgcattgtttctatctcctggt

SEQ ID NO: 52494 - DNA, 50 bp, homo sapien
tgagcatcttctatgcaatttataayctccaaaggattggactagtcggg

SEQ ID NO: 52495 - DNA, 50 bp, homo sapien
cttttagtccgagggtgcaaaacaaygtcctggatttttctagagcagaa

SEQ ID NO: 52496 - DNA, 50 bp, homo sapien
agaaggatgtttctgtgttcttgatyatattgttctgcaaaactgctaag

SEQ ID NO: 52497 - DNA, 50 bp, homo sapien
taaaacttaatctgttttatccagastattaatttaattgttaatctcat

SEQ ID NO: 52498 - DNA, 50 bp, homo sapien
tctggcctccactatcactctgaagragaagagagaactgaaagtttgca

SEQ ID NO: 52499 - DNA, 50 bp, homo sapien
cactgatcctatctacttcaaaaccyaaataagtactgcaattttggtag

SEQ ID NO: 52500 - DNA, 50 bp, homo sapien
tggctgtttttctggtagtagcccawaaactgtaaacaacccagatgtcc

SEQ ID NO: 52501 - DNA, 50 bp, homo sapien
acaaggtcttacaattgtgcaatacrgcaatccagatcaggcatgaaaat

SEQ ID NO: 52502 - DNA, 50 bp, homo sapien
agtagggctagggtctacacgaggargtatcagagaaagaaatgggttat

SEQ ID NO: 52503 - DNA, 50 bp, homo sapien
atatgcattcaatctgtcttctttarctgaactacaattagaaatctcaa

SEQ ID NO: 52504 - DNA, 50 bp, homo sapien
gggcctgtgtatccatgctttttccratggaatcaaatatataaactgct

SEQ ID NO: 52505 - DNA, 50 bp, homo sapien
agtgttttaacatttttgaactaggmatgaacagaaaaaattgacaatat

SEQ ID NO: 52506 - DNA, 50 bp, homo sapien
agaatcgagagagaaaaattcttcckcaatttaccacatcaaaaaatgat

SEQ ID NO: 52507 - DNA, 50 bp, homo sapien
aggtataggtttttataatttgaaarcgacatgtagaaactgtaatttta

SEQ ID NO: 52508 - DNA, 50 bp, homo sapien
gttgcaagcaattgtgtaatcttgarcagtatcctcttgacatgcagaat

SEQ ID NO: 52509 - DNA, 50 bp, homo sapien
gaaaaggagaaagaaataaccagaamgcaccaagcctaggtggtggtgga

SEQ ID NO: 52510 - DNA, 50 bp, homo sapien
gaattcacaagcaactaacaagttcyctaagtcagcaactatcagatctg

SEQ ID NO: 52511 - DNA, 50 bp, homo sapien
ttttttctcctccaagagttcaatamacgtttggtgaaaaaatagtgttt

SEQ ID NO: 52512 - DNA, 50 bp, homo sapien
cggaagcctcatcacagagtgggaayggacagccttgaacatttcaagaa

SEQ ID NO: 52513 - DNA, 50 bp, homo sapien
aaatgatactatattaggtctcattraacagcccaatgaagcctgcagta

SEQ ID NO: 52514 - DNA, 50 bp, homo sapien
aacagtgatttagcacttgctttatyagacagaaaacatgcatgagtcaa

SEQ ID NO: 52515 - DNA, 50 bp, homo sapien
ggattgttcacagattatttcaaaargcaagaccttattattgccatccc

SEQ ID NO: 52516 - DNA, 50 bp, homo sapien
ttaatcacagttcctcacaaaactayctttgctctattgaagaaatatac

SEQ ID NO: 52517 - DNA, 50 bp, homo sapien
aattcatcaaccatatgtctgtaaartcagtctacactacgtaactgtcc

SEQ ID NO: 52518 - DNA, 50 bp, homo sapien
ctatcgctataggcatttttaagtaygattctcttgttttccataaattt

SEQ ID NO: 52519 - DNA, 50 bp, homo sapien
aagcatttttctgcttaatttggaakattaaatgtatctaactggaagcg

SEQ ID NO: 52520 - DNA, 50 bp, homo sapien
aaaagaattaatttgagggccttcawtatttccaggccaattgataataa

SEQ ID NO: 52521 - DNA, 50 bp, homo sapien
gcaagaggcagtaagccaaataatckaacacaccattcctacaaaaactc

SEQ ID NO: 52522 - DNA, 50 bp, homo sapien
ttgttcttacctacatactttcttaycaatcccaggcttcaacaatcatc

SEQ ID NO: 52523 - DNA, 50 bp, homo sapien
cagaactgaggttgatgtagggaaartaaaagatgccactcttctaacct

SEQ ID NO: 52524 - DNA, 50 bp, homo sapien
agttattgaaaaacttcacaatatcragctgcaattcttttttcttttta

SEQ ID NO: 52525 - DNA, 50 bp, homo sapien
ttatgtaacaacaataggtgtaaagyatagcttcaaagttcagataaaaa

SEQ ID NO: 52526 - DNA, 50 bp, homo sapien
accaagtaaaattaatacaagatacrcaaaagatagtaaaataagaatct

SEQ ID NO: 52527 - DNA, 50 bp, homo sapien
tcagggcattaaagactatatacagrctggtcaacttccctaaaagagag

SEQ ID NO: 52528 - DNA, 50 bp, homo sapien
ggcttaattgtaaagataaacacccragcagttaattgcaatagtgtgtg

SEQ ID NO: 52529 - DNA, 50 bp, homo sapien
gatcagttaggtaaatcataactaakaggtatacattgaatgcttagaaa

SEQ ID NO: 52530 - DNA, 50 bp, homo sapien
ccaattactgttaatctcagttttamatggaaatggaagacaagaataac

SEQ ID NO: 52531 - DNA, 50 bp, homo sapien
tgcttcacttaccatttgtgtgttcmcttgtaatttcctttaagagcttt

SEQ ID NO: 52532 - DNA, 50 bp, homo sapien
cttcctggaaaacgttatgttattayctattacaagattaaaaattttac

SEQ ID NO: 52533 - DNA, 50 bp, homo sapien
gggctgtagtcatttcaaggcttgaytaggggatgatccacttccaagct

SEQ ID NO: 52534 - DNA, 50 bp, homo sapien
ttttggcaagagatttgctacataaygtgccaaaggtggtccacaataaa

SEQ ID NO: 52535 - DNA, 50 bp, homo sapien
gcctcagtctgcttctttttcatagraagttcagactcagaggccttttt

SEQ ID NO: 52536 - DNA, 50 bp, homo sapien
gtctacattaaattaatattaagtcmctgtatttataatgtaagaccctt

SEQ ID NO: 52537 - DNA, 50 bp, homo sapien
tatattaattgactgtaataaaggcmactcttctattaatccaagtctac

SEQ ID NO: 52538 - DNA, 50 bp, homo sapien
tgatagctcacagctgtttctctcartaaattgacctcagaagagggtgc

SEQ ID NO: 52539 - DNA, 50 bp, homo sapien
ctcaccccacttccttctctatccaytcactggctgttgtggttgattcc

SEQ ID NO: 52540 - DNA, 50 bp, homo sapien
aaagaaggataataactttggcctcraggttctgaatgtatggagcaaag

SEQ ID NO: 52541 - DNA, 50 bp, homo sapien
caaggcagctggagagaaaccatgaygatacatacaacagagagagaaat

SEQ ID NO: 52542 - DNA, 50 bp, homo sapien
tttaaagggtatgtaatagaagttcragggatgttatataacttggtcaa

SEQ ID NO: 52543 - DNA, 50 bp, homo sapien
ctcatatacattattctcacactcaygttcaagtaattctgaattctgaa

SEQ ID NO: 52544 - DNA, 50 bp, homo sapien
agcacctgctatatgcctggctctakgcttaagactctcttatgtcatta

SEQ ID NO: 52545 - DNA, 50 bp, homo sapien
ggcacagcatgataggacatcccaaragagctgtgtataggacactagtg

SEQ ID NO: 52546 - DNA, 50 bp, homo sapien
tatgttctttcctagaagccaattaraagttgcaggtatgtaaaacttta

SEQ ID NO: 52547 - DNA, 50 bp, homo sapien
atagcatgatgaactctagtcttccyattgggtacttttaagcttttctc

SEQ ID NO: 52548 - DNA, 50 bp, homo sapien
aatggtttgattttaaagcctataaytgaatgttgaaataaatggcagag

SEQ ID NO: 52549 - DNA, 50 bp, homo sapien
gcacaaaaatgaatgaatagatgaakcaagggctctttaattaaaaaaaa

SEQ ID NO: 52550 - DNA, 50 bp, homo sapien
taaaataatttaatattagtaattakatgggacaacaggtataaaccaga

SEQ ID NO: 52551 - DNA, 50 bp, homo sapien
aaaatgagttgtgtacattaatagcyaggaaaagattaaaattgaaaaga

SEQ ID NO: 52552 - DNA, 50 bp, homo sapien
tgataataagatttctctctgcccartaaattaaaaaatcatgatagtct

SEQ ID NO: 52553 - DNA, 50 bp, homo sapien
taggagttagcaacatagcagaatayatcgagacccatgtcaagaactac

SEQ ID NO: 52554 - DNA, 50 bp, homo sapien
tacaaagatctatgccacattgggcraattgcattagcttcccaggaact

SEQ ID NO: 52555 - DNA, 50 bp, homo sapien
aatgtttttaatattatcttaagcaycaaggctgtaaatatttctctgtt

SEQ ID NO: 52556 - DNA, 50 bp, homo sapien
aaacctagaaatcaactaaagaaaaraggttagcattttcaagagaccca

SEQ ID NO: 52557 - DNA, 50 bp, homo sapien
gaccctgtcattgggatctgcgagaraagtggtacctccccctctttctc

SEQ ID NO: 52558 - DNA, 50 bp, homo sapien
gaattaaaagagggcttttagataarcacattcagtaatgattttattat

SEQ ID NO: 52559 - DNA, 50 bp, homo sapien
caggtacattaaaagcagctcacaaygaaacagtttttaccactgtcatc

SEQ ID NO: 52560 - DNA, 50 bp, homo sapien
ccaagagagtgcaaaactgattaaaragttattcacagtgatttatcaat

SEQ ID NO: 52561 - DNA, 50 bp, homo sapien
ttttaaatccagtgattgtattcagwcatgtgttataatcctccccctct

SEQ ID NO: 52562 - DNA, 50 bp, homo sapien
tgccatgtcatattgtaggctcttawccagattaacattatatgcaaact

SEQ ID NO: 52563 - DNA, 50 bp, homo sapien
tttctctataagcagatccacttacrgactggtattattgtttggaattg

SEQ ID NO: 52564 - DNA, 50 bp, homo sapien
aacttccttccacacaactgcagaaygtaactgaaaagcaggacagtatt

SEQ ID NO: 52565 - DNA, 50 bp, homo sapien
attgttcttttaaatgactctagtakaaattcatagtgattaagctataa

SEQ ID NO: 52566 - DNA, 50 bp, homo sapien
ttagtttgaatctaaacacttcaaarctctttctgtatctattttccctc

SEQ ID NO: 52567 - DNA, 50 bp, homo sapien
ttctaaaatataacctactataaatsattatgcagtgagggaatgaatag

SEQ ID NO: 52568 - DNA, 50 bp, homo sapien
cattgtaaataaaagatgcatgttaycatatttcaatacaatacttttta

SEQ ID NO: 52569 - DNA, 50 bp, homo sapien
aaaatgaaaggtaatagatacatgcrcagaaggcaaaaaaaactgatgga

SEQ ID NO: 52570 - DNA, 50 bp, homo sapien
aaatatgttctctctccctcactcamatgttaactgctttttggctcaat

SEQ ID NO: 52571 - DNA, 50 bp, homo sapien
atcctctttgagaaactgctcgaatragtggattgtcaaaaaaaaaaata

SEQ ID NO: 52572 - DNA, 50 bp, homo sapien
cgagggtaggagggtaggagtctgayattgagtcaagggtgagtgtgaaa

SEQ ID NO: 52573 - DNA, 50 bp, homo sapien
acaatttattcatttattctcatggycattcatttggtcagcaaatattg

SEQ ID NO: 52574 - DNA, 50 bp, homo sapien
gtcataaacatcacaagagtcagcaygtataaagcatatggacttgtact

SEQ ID NO: 52575 - DNA, 50 bp, homo sapien
tggagaaaatcttcaagtttgtggtyaatcagatctcccagggcttcaga

SEQ ID NO: 52576 - DNA, 50 bp, homo sapien
aaaggctttttgctttaaaaagcagyctcacaggtgtttgagaggcaagg

SEQ ID NO: 52577 - DNA, 50 bp, homo sapien
taaaacataccagttgatggacagargcctatttgcattgataagtcact

SEQ ID NO: 52578 - DNA, 50 bp, homo sapien
aaacttgaagattttctccaatttayagattagcttcaaattccatacaa

SEQ ID NO: 52579 - DNA, 50 bp, homo sapien
ctgatctctagtttaagccttttaartgtactaatccatttgccttttca

SEQ ID NO: 52580 - DNA, 50 bp, homo sapien
tttaaaaggcttaaactagagatcarctcatgataagcactaatgaatgt

SEQ ID NO: 52581 - DNA, 50 bp, homo sapien
aaatagtagttatcctttttaggaaktcgtgcataaaatcactgggctcc

SEQ ID NO: 52582 - DNA, 50 bp, homo sapien
ctcatttttgttagtaagaagattcrcttagttattttatgtaaaaatca

SEQ ID NO: 52583 - DNA, 50 bp, homo sapien
cagatgacctctgctacaataagtaygatgtgacttagtaactgcatagc

SEQ ID NO: 52584 - DNA, 50 bp, homo sapien
agttacaatgcaggaaacaacatcartgacaacaatgtaatgtaacatgg

SEQ ID NO: 52585 - DNA, 50 bp, homo sapien
aagctggtttccgcataacaaagacracatccagagaagtgaagttgtgg

SEQ ID NO: 52586 - DNA, 50 bp, homo sapien
ctttaagactcacaatattctgcatyagccatttattcttatatctggga

SEQ ID NO: 52587 - DNA, 50 bp, homo sapien
taaatccacttttgaagtaatattargcacctcttgttaaaatgaacaga

SEQ ID NO: 52588 - DNA, 50 bp, homo sapien
tttttccagttccctaagtttcaaartccatcttggttgtctgatcccct

SEQ ID NO: 52589 - DNA, 50 bp, homo sapien
tttcctgttctcttgagacagataasagagatgaggataatgctttcgtg

SEQ ID NO: 52590 - DNA, 50 bp, homo sapien
tttccccagagttaatttgggccacmatcaattccaaggtctctgatgga

SEQ ID NO: 52591 - DNA, 50 bp, homo sapien
aaatagtgagggatttatttacacaygttgttaccaatacacagggtaag

SEQ ID NO: 52592 - DNA, 50 bp, homo sapien
cagtaacagaaagatatatgggaaaycgctaagtcaaaccacatacttaa

SEQ ID NO: 52593 - DNA, 50 bp, homo sapien
gttgatgtatctccatgctacaaaaytgaacccataacgtcccaacgtgt

SEQ ID NO: 52594 - DNA, 50 bp, homo sapien
agttgtacactgattttctactgtgsaaggagttgacacccataaccccc

SEQ ID NO: 52595 - DNA, 50 bp, homo sapien
ctgtgctggatgaatgaatggaaaayatgtcctttatttattccaatagc

SEQ ID NO: 52596 - DNA, 50 bp, homo sapien
actgcatgcttcatgtgatttatctkacttaagagcatgaattttggagt

SEQ ID NO: 52597 - DNA, 50 bp, homo sapien
cctataatcagaggctaaaatggtcrataaccaaaattatcatcaacctt

SEQ ID NO: 52598 - DNA, 50 bp, homo sapien
agagtttaagagacgtattcaaaccrcatagttagttggcaggagattct

SEQ ID NO: 52599 - DNA, 50 bp, homo sapien
tatatttctaattaatatttaattayctcaatggcatctaatttctttta

SEQ ID NO: 52600 - DNA, 50 bp, homo sapien
tgcaacctgctttttgcatttaataktacagccttccagatcagatatgg

SEQ ID NO: 52601 - DNA, 50 bp, homo sapien
cattcagtgcttttcccatggacaargatgtgcttttcagtgtgtgcagt

SEQ ID NO: 52602 - DNA, 50 bp, homo sapien
tagtttagccttagatgtggcctacyattccagtgatttctcagcccttc

SEQ ID NO: 52603 - DNA, 50 bp, homo sapien
tagagagaaggcttttctagcagtayagctcattgccaaactatgtagaa

SEQ ID NO: 52604 - DNA, 50 bp, homo sapien
aggttatgctagcagaagtagagtargtttggaggaggagtataaatgct

SEQ ID NO: 52605 - DNA, 50 bp, homo sapien
atcatttacctacagtactactcaasacctgaaagaacctctaaattatt

SEQ ID NO: 52606 - DNA, 50 bp, homo sapien
cacggtgcagtcaagcagcttttccrctacatcgctggaaactgccatct

SEQ ID NO: 52607 - DNA, 50 bp, homo sapien
ggccaacactcaaattcaggaaatamacagactgccacaaagatactcct

SEQ ID NO: 52608 - DNA, 50 bp, homo sapien
tgtgttctttgacccaagtctggtcrcaatgccatttggcctcctggtac

SEQ ID NO: 52609 - DNA, 50 bp, homo sapien
acttgagattgaacttggctgtttawcttaatgtactcagggtagaattt

SEQ ID NO: 52610 - DNA, 50 bp, homo sapien
aactttttaatgacaaacaatactasagagttacaaaaatatttttagat

SEQ ID NO: 52611 - DNA, 50 bp, homo sapien
atgaaaagaatgctgacgctgaaacrgtcaaatactatatattgtttgtt

SEQ ID NO: 52612 - DNA, 50 bp, homo sapien
atgaataccttggttttctgtttgayatttctggagctcctacaatatgt

SEQ ID NO: 52613 - DNA, 50 bp, homo sapien
agaatttcaggaataagaattttcaraaccggagatgactaaaagagttc

SEQ ID NO: 52614 - DNA, 50 bp, homo sapien
cactttggtctatttctcttcttccrctgagtcaacgtcaaaagttgcca

SEQ ID NO: 52615 - DNA, 50 bp, homo sapien
cctgctgtgtttgaaaattggcatcrcttctccatttctgtacctccttc

SEQ ID NO: 52616 - DNA, 50 bp, homo sapien
agaatgtaaggtataggacagccaayctctgttttattcactgctgtata

SEQ ID NO: 52617 - DNA, 50 bp, homo sapien
taagttctagtccacagttattacaytggagacttaagaaaactgggtgt

SEQ ID NO: 52618 - DNA, 50 bp, homo sapien
ttagcaaatgtcttcatcaaacatamgggagaacattagtctagcataca

SEQ ID NO: 52619 - DNA, 50 bp, homo sapien
gcccagcagagtatttgagaataaaktgttgtgcgtttgagtcaaccaaa

SEQ ID NO: 52620 - DNA, 50 bp, homo sapien
caacccattgtgatttcctctttacsactaaaaacaagacttggtctcct

SEQ ID NO: 52621 - DNA, 50 bp, homo sapien
ataaccagtaggatggtgtagaaacratggtgtgtaatttccaagactcc

SEQ ID NO: 52622 - DNA, 50 bp, homo sapien
aagcccagaatgcttagactgatgartacatagagtttcaaatcagttga

SEQ ID NO: 52623 - DNA, 50 bp, homo sapien
attttgttacctgttgatgaactcaygggatttaacgctgtggcctcttt

SEQ ID NO: 52624 - DNA, 50 bp, homo sapien
gatttaacgctgtggcctctttatcrcagagaaaggcgttttggccagct

SEQ ID NO: 52625 - DNA, 50 bp, homo sapien
agaatttttaacatattgccttgcaygtgtcttcatgtactgttctattt

SEQ ID NO: 52626 - DNA, 50 bp, homo sapien
cccatgaaactctaaatgtaccaccrgaatcctcctggtaggttgtcagg

SEQ ID NO: 52627 - DNA, 50 bp, homo sapien
taatctgagaatttacagcaaggacmgggaattgttgtaaagaaaattgg

SEQ ID NO: 52628 - DNA, 50 bp, homo sapien
ttgtatgttactctgtttctttgaayggtgttgagaggaaatggatccat

SEQ ID NO: 52629 - DNA, 50 bp, homo sapien
atccaataagatgcttactgagtaayagaccccattccataaggttcaag

SEQ ID NO: 52630 - DNA, 50 bp, homo sapien
gactcatgtagattttaggaaagccragatttgttttgggaatgagcaag

SEQ ID NO: 52631 - DNA, 50 bp, homo sapien
ggcagaaggaacagcagcaaaacacwgaagtggaaattagtagcagcatt

SEQ ID NO: 52632 - DNA, 50 bp, homo sapien
tatctgtgtgcacaaacataaagcarctaagaatttctcagttctcatgg

SEQ ID NO: 52633 - DNA, 50 bp, homo sapien
gaaagtccagaatctttcaaccatakgaagggccatccatgagcttgtcc

SEQ ID NO: 52634 - DNA, 50 bp, homo sapien
tcactttcaatggtattgtagtgagwaggtagcattgattacctactcat

SEQ ID NO: 52635 - DNA, 50 bp, homo sapien
tgcaaaagtgatttagaatgaagtaycttctctgatgccaagacacttaa

SEQ ID NO: 52636 - DNA, 50 bp, homo sapien
ttaagtccttctgatatcatagttasagtaaaaacttcaccattagcttt

SEQ ID NO: 52637 - DNA, 50 bp, homo sapien
gtgtacatggttaatataagcaagcygaaagttgaggtgatgctcccgag

SEQ ID NO: 52638 - DNA, 50 bp, homo sapien
actgccaacagacaactcggagctgmaaagtattctaaaggtctgcggtc

SEQ ID NO: 52639 - DNA, 50 bp, homo sapien
agacacagttgcagttatttgatagmaacatcataaaatcctagctaagc

SEQ ID NO: 52640 - DNA, 50 bp, homo sapien
ttttatctagctctatgaaaacacaygagtagcagacacatcttaagagg

SEQ ID NO: 52641 - DNA, 50 bp, homo sapien
taaagcttgcctaaaattgtgcaacwaccaaaggtcaaagctgagatttt

SEQ ID NO: 52642 - DNA, 50 bp, homo sapien
ctccaaagggaaaaagtgtgtgaaaytattaaactatatcataggtgctg

SEQ ID NO: 52643 - DNA, 50 bp, homo sapien
tagaaccacgaaaagttagatatcartataagacgaagttagcataacaa

SEQ ID NO: 52644 - DNA, 50 bp, homo sapien
ggtagttttcctctttacaatttgarcaagggtttctcctcttagtttct

SEQ ID NO: 52645 - DNA, 50 bp, homo sapien
cctcaagttccataattcaaattcarataagacaggggcaaaatggtcac

SEQ ID NO: 52646 - DNA, 50 bp, homo sapien
gggatgacagatgccttcttgggtargtaaggagactgaaattaaaactc

SEQ ID NO: 52647 - DNA, 50 bp, homo sapien
caattatccagttccctgttaaaacraatgacaccaattgtggaaggttt

SEQ ID NO: 52648 - DNA, 50 bp, homo sapien
agcaaacccactaaatcaatagaaamgtattcagtaaatactgagtttct

SEQ ID NO: 52649 - DNA, 50 bp, homo sapien
aaaggtaggtatcaagttagtctcaytcaatgacaaaacatgagcataaa

SEQ ID NO: 52650 - DNA, 50 bp, homo sapien
ttgttagtaacttacattctctcacraaaagtattctgcattatattata

SEQ ID NO: 52651 - DNA, 50 bp, homo sapien
tagtgggttggagcagtaatggtgaygaattcttctctgcttaggttgtg

SEQ ID NO: 52652 - DNA, 50 bp, homo sapien
ctgtggcttctggaattcagagagcrcaagtaacatcaattcttaacaac

SEQ ID NO: 52653 - DNA, 50 bp, homo sapien
gatctcaagataactttatcgaaaaygaacaatgcatactgtactgtaat

SEQ ID NO: 52654 - DNA, 50 bp, homo sapien
ataggtggagtgaatacataagagamtaatcaatctttgacttttaaaaa

SEQ ID NO: 52655 - DNA, 50 bp, homo sapien
atgacaagctaacatccttgaatgayagtgagtcacctctcaaagacccc

SEQ ID NO: 52656 - DNA, 50 bp, homo sapien
cagtcatgtctatcataatgctttgyagctagtagaaaattaagatatat

SEQ ID NO: 52657 - DNA, 50 bp, homo sapien
aatttatatcctttgcttaattggcyatcattattaaaagggttctaatt

SEQ ID NO: 52658 - DNA, 50 bp, homo sapien
aaaaaatattttggaagtgatcagcrcattctaattgaccatggatgctc

SEQ ID NO: 52659 - DNA, 50 bp, homo sapien
gtgctttccaggatgaagacacatamatgatgagttaaacacagaaacca

SEQ ID NO: 52660 - DNA, 50 bp, homo sapien
attttcagaaattctaaatcattcarataaaagggcctaaaggtaaactt

SEQ ID NO: 52661 - DNA, 50 bp, homo sapien
ttttgtcaggcctccatttgcagtcmaagtaggaatatggtggggaccca

SEQ ID NO: 52662 - DNA, 50 bp, homo sapien
ggtgcctgagagtaaaaagtttccayatgatcctcctagaaccatagttg

SEQ ID NO: 52663 - DNA, 50 bp, homo sapien
acaaattaaatctttagtatgaaaayatcacgttaaattcagaataatct

SEQ ID NO: 52664 - DNA, 50 bp, homo sapien
gccaccagcaacgtcagttcccaaarcaccaaagtggataatatacagga

SEQ ID NO: 52665 - DNA, 50 bp, homo sapien
aggcaatcaacaaatagctactatcrcattttccctttcaaataaaatcc

SEQ ID NO: 52666 - DNA, 50 bp, homo sapien
ccctttagccttgtgttggatcaccyagttgtaatctaagcttctacaca

SEQ ID NO: 52667 - DNA, 50 bp, homo sapien
ctacctgccacagcattccaatttgwaagaaaaacattggtttaaaagtt

SEQ ID NO: 52668 - DNA, 50 bp, homo sapien
aaaaataccccaaaccgcctgattayaccgttcctgtacaccacttttat

SEQ ID NO: 52669 - DNA, 50 bp, homo sapien
ctattgtggaccagttaaaaacagayatagtttctagcaatctatgtgga

SEQ ID NO: 52670 - DNA, 50 bp, homo sapien
aacattcaaatacacagtcattaaamagtctgtattcctcacctcttaaa

SEQ ID NO: 52671 - DNA, 50 bp, homo sapien
ctcagtacctccttagaacatgaaargaatcctctatcctagtggccaga

SEQ ID NO: 52672 - DNA, 50 bp, homo sapien
atgataatagccaccatttattgggmacaccttgaattctcttcttgatg

SEQ ID NO: 52673 - DNA, 50 bp, homo sapien
tcttaactttttctattatcttttaygttttcctgaatgtcttctaatta

SEQ ID NO: 52674 - DNA, 50 bp, homo sapien
tgtgtagatctgaacatttttgaacratttagttcctggttacttgattg

SEQ ID NO: 52675 - DNA, 50 bp, homo sapien
tcaaagataaaaatcagatttaaccsggtcatgaataaagtaatgaagat

SEQ ID NO: 52676 - DNA, 50 bp, homo sapien
caaatatttgttatgctttatgatayatgtcaagaagagagtaagccagg

SEQ ID NO: 52677 - DNA, 50 bp, homo sapien
aatacctgttagtgcattattattaycttgaacactttcctctgacttag

SEQ ID NO: 52678 - DNA, 50 bp, homo sapien
gtactaaatatggaaattatactgamactaaagtaaggaatgtaaaacgg

SEQ ID NO: 52679 - DNA, 50 bp, homo sapien
gtggtgtacatgatcatttgtgtaayataaataacaaccagaaagccgga

SEQ ID NO: 52680 - DNA, 50 bp, homo sapien
aaattacaaattattctggtgaaaakacataaatgaatgttagtataaac

SEQ ID NO: 52681 - DNA, 50 bp, homo sapien
atttttgcatatgaaaggctctcackcaagcatttttctgtagctcattg

SEQ ID NO: 52682 - DNA, 50 bp, homo sapien
ccaaccctgccagaagttcctaacaygttctggataaggtagggtaagta

SEQ ID NO: 52683 - DNA, 50 bp, homo sapien
gctgaccaatgggagctagagtcaaycttagtgatgcttacccaccacag

SEQ ID NO: 52684 - DNA, 50 bp, homo sapien
ggagaaaaagcaaagtactccaatgmagcctagaggaaggcctgccccac

SEQ ID NO: 52685 - DNA, 50 bp, homo sapien
catttgttcaggtaattataccctaygtcctttcaaaatgatttgaattt

SEQ ID NO: 52686 - DNA, 50 bp, homo sapien
agtccaagctgataaattcttccacrattttcctttacattaagcttatg

SEQ ID NO: 52687 - DNA, 50 bp, homo sapien
gaacctgtgcaatctatgttctcacrgtcttaggacagctctgatgtaat

SEQ ID NO: 52688 - DNA, 50 bp, homo sapien
cctcttggctggtcatttaaaatcaygttggtcagggagccagacagtca

SEQ ID NO: 52689 - DNA, 50 bp, homo sapien
cccacagccaagactatggagatccraaagttaatttctctgaatttaga

SEQ ID NO: 52690 - DNA, 50 bp, homo sapien
acctattatttatagattatgaaacsgggtaaaagatgttgaagtcaaaa

SEQ ID NO: 52691 - DNA, 50 bp, homo sapien
aagaatgaaaattaagcatacccaamacacaagtcgtaatgaaagtgtgg

SEQ ID NO: 52692 - DNA, 50 bp, homo sapien
cttttccagaaatgctagatgtgaawttatgaattttttcttttgcattt

SEQ ID NO: 52693 - DNA, 50 bp, homo sapien
agtttatagtctagttcaagagtcastatgtataaacagaatagaaatac

SEQ ID NO: 52694 - DNA, 50 bp, homo sapien
aaggtcaaatgaagtaatactctaarcaaattttgtggcaggtatataac

SEQ ID NO: 52695 - DNA, 50 bp, homo sapien
ttgaaataatcgaaatgggaaaaacmgaacttatccataacgcctcccca

SEQ ID NO: 52696 - DNA, 50 bp, homo sapien
ttttcttattaaattgtttgatctcraatctggaagcacgcccaagatat

SEQ ID NO: 52697 - DNA, 50 bp, homo sapien
tctatctcacatcataggtttatgayataaatgatttcaagttctagata

SEQ ID NO: 52698 - DNA, 50 bp, homo sapien
cagctaaatatcatccgcatttcaaytcagtgaagttattctgacagtag

SEQ ID NO: 52699 - DNA, 50 bp, homo sapien
cagggtaaaatcacattctagaaaayatggaagaatcaatgagcccatgt

SEQ ID NO: 52700 - DNA, 50 bp, homo sapien
agaccagcctaggcaatatagtaaarccttgtctctacaattttttttaa

SEQ ID NO: 52701 - DNA, 50 bp, homo sapien
tcaagaataacatcattattcaagawgatagagtccacagtatcaccatt

SEQ ID NO: 52702 - DNA, 50 bp, homo sapien
taaaagacaagcaataccaccagacratagatgtaatttggaacaaagat

SEQ ID NO: 52703 - DNA, 50 bp, homo sapien
gctttacagttcctgcctaagaacartggttttcagctaggtttgcttgg

SEQ ID NO: 52704 - DNA, 50 bp, homo sapien
gacaggagccatttctagctaattayacagtttgtgctttgctcttaaag

SEQ ID NO: 52705 - DNA, 50 bp, homo sapien
tttaaaaacttgtgtatttctatcakgaatggcttaattgtataagtcgt

SEQ ID NO: 52706 - DNA, 50 bp, homo sapien
gaaaagcaagaattgactcttatgayggaaattaatcggaactaatctgc

SEQ ID NO: 52707 - DNA, 50 bp, homo sapien
tgtagaaatgacctcaggcttgtcckctttatctcttccaattcacacca

SEQ ID NO: 52708 - DNA, 50 bp, homo sapien
tgggcagcaaagggacatgaaaacargtatagtatttttagttttaaaat

SEQ ID NO: 52709 - DNA, 50 bp, homo sapien
cactcactaccggatttacatagccyaatttgatagcatgcatggtttca

SEQ ID NO: 52710 - DNA, 50 bp, homo sapien
aatacttacaatctcatgagaaacaytgaatggagtaagataaaaatgta

SEQ ID NO: 52711 - DNA, 50 bp, homo sapien
gagatattataatgaggcaacaaggyagttctagtgaattaataaagaga

SEQ ID NO: 52712 - DNA, 50 bp, homo sapien
gtccattttaatttcattataaaacyggcttgagaaataaaggtctggga

SEQ ID NO: 52713 - DNA, 50 bp, homo sapien
cacatttcttttagtgtagtatatayggtgtctatatttgaaatgcatgg

SEQ ID NO: 52714 - DNA, 50 bp, homo sapien
caactttaatttcgttttcccaggartcagatgactgccttactttttgt

SEQ ID NO: 52715 - DNA, 50 bp, homo sapien
tttataatttaatctctcctttatawctcatctctttaaccatagtagca

SEQ ID NO: 52716 - DNA, 50 bp, homo sapien
ggtatagtaacaatgaaagttatgaycctgaattaaccaggcatggtgat

SEQ ID NO: 52717 - DNA, 50 bp, homo sapien
aaaaatgcaaatttatgcactcacayatatagaaaccatgattaccactg

SEQ ID NO: 52718 - DNA, 50 bp, homo sapien
tacttttaatatggaaattatttcarcattcattgacaaccactttatta

SEQ ID NO: 52719 - DNA, 50 bp, homo sapien
gtagtgagacaatataattactctaygaaataacatctacttatctactc

SEQ ID NO: 52720 - DNA, 50 bp, homo sapien
tctttgaaaaataaagtacaaacacrccttttatatagacatttcttctt

SEQ ID NO: 52721 - DNA, 50 bp, homo sapien
cagcattgtgatgtccctgagtgccraaataaaagttttccatgcatccc

SEQ ID NO: 52722 - DNA, 50 bp, homo sapien
ttatagatagtaatctaaactaaaayattgagaacatcatatttagtctc

SEQ ID NO: 52723 - DNA, 50 bp, homo sapien
tcccaaaagccacctctggaccttcyagactctgttaccttgtctaacat

SEQ ID NO: 52724 - DNA, 50 bp, homo sapien
aagcattaaccatgggacaccattckaaagatttttctaaataattgtat

SEQ ID NO: 52725 - DNA, 50 bp, homo sapien
aatcaaatgctattaaataacaacakagtaatggctgaacgtatttctaa

SEQ ID NO: 52726 - DNA, 50 bp, homo sapien
taagtaaaaatttagctaaaatctcrctggttaaactgaatgtgaaaaca

SEQ ID NO: 52727 - DNA, 50 bp, homo sapien
atgttacacttgattttaacttgacrccattgtgcattgtaaccatatta

SEQ ID NO: 52728 - DNA, 50 bp, homo sapien
ctttatgctgtttcttagtcctgccratcttccatgccgtgtggaaggct

SEQ ID NO: 52729 - DNA, 50 bp, homo sapien
cctaaacagaaacagtatttcttcaraaggctcattctaaagagggggga

SEQ ID NO: 52730 - DNA, 50 bp, homo sapien
ttactttttgccaaaaaacagatagkatgaaatgtagcttttaaagtata

SEQ ID NO: 52731 - DNA, 50 bp, homo sapien
accaagaacaagtgtatatcaaaagraaagaggttagttgagtctgcagc

SEQ ID NO: 52732 - DNA, 50 bp, homo sapien
tacctgtgactgtgacttaattcctyacatacaagtgtctttatgctaaa

SEQ ID NO: 52733 - DNA, 50 bp, homo sapien
aatagtcttgagaaattacccttgaygtgaatatgaaatccaaaatatat

SEQ ID NO: 52734 - DNA, 50 bp, homo sapien
gagaattataagtcagttgtggttayagaatttcacaatttgcagaatca

SEQ ID NO: 52735 - DNA, 50 bp, homo sapien
catttaagcttggccttgaaggctasataagatgacagctgccacagaat

SEQ ID NO: 52736 - DNA, 50 bp, homo sapien
agaagtcaaatgcagttaggaaaaawgtatcagacaagaagctctcaact

SEQ ID NO: 52737 - DNA, 50 bp, homo sapien
ttcctttttctcttcaatctacatcragttgctctccctaccttgcttta

SEQ ID NO: 52738 - DNA, 50 bp, homo sapien
tgcaaagacaagatatctggtaagamtatgtctcaaaaagacaatgattc

SEQ ID NO: 52739 - DNA, 50 bp, homo sapien
aagatgtactggcccttcatcattayaaagcaagatcaattttgacctga

SEQ ID NO: 52740 - DNA, 50 bp, homo sapien
ccttattcggcactctaagcaattcmaaacaagacattatgtacgcttca

SEQ ID NO: 52741 - DNA, 50 bp, homo sapien
tcctttaaggtaggtgtcagcaaackatgtctctgtgggctaacgatagt

SEQ ID NO: 52742 - DNA, 50 bp, homo sapien
gcaagaaaccatggaggatctaaaakagttttgttcattaaccttaaagt

SEQ ID NO: 52743 - DNA, 50 bp, homo sapien
tacagaaaccagtacttggaaataargtgttataaataaatccataaaat

SEQ ID NO: 52744 - DNA, 50 bp, homo sapien
aaaaaaacaaagtatcactatattawctcattttaaaaaatctgcataat

SEQ ID NO: 52745 - DNA, 50 bp, homo sapien
aattgtcaattcaaactattttttargctgtaaacaaggctaaaatagca

SEQ ID NO: 52746 - DNA, 50 bp, homo sapien
taggaaaagacaatatttgtcactayagacgtactgaacaatttgcaagc

SEQ ID NO: 52747 - DNA, 50 bp, homo sapien
gactttgaaattaattttacagttayatttgactacgtgtaagtcctaaa

SEQ ID NO: 52748 - DNA, 50 bp, homo sapien
gggaaaacaatccaaatctaccgaasaaaggctcacctgggagacagaaa

SEQ ID NO: 52749 - DNA, 50 bp, homo sapien
atgtattttgtctgttatttaagtcyatggatatctgatgcccatcaaac

SEQ ID NO: 52750 - DNA, 50 bp, homo sapien
aaaattatccaataattgtaatatcyagtgctgacccttgcctgaatcaa

SEQ ID NO: 52751 - DNA, 50 bp, homo sapien
ccaggtttaaggtacagcagctgaartgtttaagtgatctgagaaagtga

SEQ ID NO: 52752 - DNA, 50 bp, homo sapien
ctgtcaataggactgaatacaccgtraaaaattgcggatttgccaacatg

SEQ ID NO: 52753 - DNA, 50 bp, homo sapien
ggaaggacaggagttttgggtcatasagttggataataagacaacatttc

SEQ ID NO: 52754 - DNA, 50 bp, homo sapien
taatccacattagtagctattacagragaacctcaaaccaagtatttaca

SEQ ID NO: 52755 - DNA, 50 bp, homo sapien
ccaaagcatcttcttctgtggcataygtaagttcatggatggatcgcttg

SEQ ID NO: 52756 - DNA, 50 bp, homo sapien
tgttctcctcttccttttacatacamgactggactgcatctggctcttcc

SEQ ID NO: 52757 - DNA, 50 bp, homo sapien
ttaatcttcatgacttttttccaaasaggcacaaaacattactgaggtct

SEQ ID NO: 52758 - DNA, 50 bp, homo sapien
agcagtcctattactgggtatgtacygagaggaaaataaatcgttgtacc

SEQ ID NO: 52759 - DNA, 50 bp, homo sapien
ggctgtggagaaaagggaacgcctayatactgttagtggaaatgtaaatt

SEQ ID NO: 52760 - DNA, 50 bp, homo sapien
taccccatcattctctcctctgtgcyaaaaccatacctagtcagaacatg

SEQ ID NO: 52761 - DNA, 50 bp, homo sapien
atggtgggtatatgggtgttcactayaaaattctttcaacttttctgtat

SEQ ID NO: 52762 - DNA, 50 bp, homo sapien
aaaaattaaaaattctgacatgtaargatgtgcaatagtagagtttcaca

SEQ ID NO: 52763 - DNA, 50 bp, homo sapien
gtaataccaattggcacttgtccaaygagctgagtgaaactgatccaaaa

SEQ ID NO: 52764 - DNA, 50 bp, homo sapien
tagcattcctatcaatagccttaacwctgttcctcacctgcattttacca

SEQ ID NO: 52765 - DNA, 50 bp, homo sapien
ttggtatgtatgtgggaagggaattkaattaatgacatctttcttacata

SEQ ID NO: 52766 - DNA, 50 bp, homo sapien
cagatggtgtcaagaaaacttaatcrgagtggcaattggaataaactcag

SEQ ID NO: 52767 - DNA, 50 bp, homo sapien
gccatgtacagcactatcaggactayggtgaggcgaccgtagatagctgg

SEQ ID NO: 52768 - DNA, 50 bp, homo sapien
ccagcataacagagatatcatggatmaagatgaaaggtagaaagagtaaa

SEQ ID NO: 52769 - DNA, 50 bp, homo sapien
tatattttaccacgataacaataaartgtaaaaagtagaggagtttagag

SEQ ID NO: 52770 - DNA, 50 bp, homo sapien
taccaactgccttacagagttgttaygaagctccaatgacataacgcact

SEQ ID NO: 52771 - DNA, 50 bp, homo sapien
tttcaactcatctggataaaacatarctttctgcatttcagcatgtgact

SEQ ID NO: 52772 - DNA, 50 bp, homo sapien
gaagatctaaactagccactctgtasaatgaggaattgctgaacagagaa

SEQ ID NO: 52773 - DNA, 50 bp, homo sapien
gcacccttactcagccttcctaaackatttgaagacatggcctttaaatt

SEQ ID NO: 52774 - DNA, 50 bp, homo sapien
aatttcttctgctaaacattgatcaraagtaacaatccaaaatcttggtt

SEQ ID NO: 52775 - DNA, 50 bp, homo sapien
catttgtccttcttctgatactatakgctctaacagggtagactgttttg

SEQ ID NO: 52776 - DNA, 50 bp, homo sapien
gaatggtatataattaatgcattacyagaacacttaatagaactgtatca

SEQ ID NO: 52777 - DNA, 50 bp, homo sapien
aatcccagcctctggaattatttgaygtatttagttatttgtgcaaaacg

SEQ ID NO: 52778 - DNA, 50 bp, homo sapien
cacattaaaaatgctagataaaacamagcaaaataattttggaacataaa

SEQ ID NO: 52779 - DNA, 50 bp, homo sapien
gtcccatgtctaataactcctaaaayttgtattaaaaattcaattggttt

SEQ ID NO: 52780 - DNA, 50 bp, homo sapien
taatattggtcatgttctcagactayatgaaaatcaaacatgctatagtg

SEQ ID NO: 52781 - DNA, 50 bp, homo sapien
attctttttgtttcacgtaccagaartgtaaaggcctatgggattgacat

SEQ ID NO: 52782 - DNA, 50 bp, homo sapien
atggagacaaggaattggatcattgmaagtacgtgtgtatgtgtgtgagg

SEQ ID NO: 52783 - DNA, 50 bp, homo sapien
ttgaattctactcattgcaaggagaygctttaaagacagaggggcagcaa

SEQ ID NO: 52784 - DNA, 50 bp, homo sapien
ttcatatttcaattaaatggtttcastcgttatataattcttccaacaat

SEQ ID NO: 52785 - DNA, 50 bp, homo sapien
gggatataaagtgtttgctcttccarataaacaaagataaattcacctag

SEQ ID NO: 52786 - DNA, 50 bp, homo sapien
cttcaaactcatatttcccactttascatgactcagactgaaacacagga

SEQ ID NO: 52787 - DNA, 50 bp, homo sapien
agttcagagagttctgctaatgtaaygagtcagctccttctacctctcct

SEQ ID NO: 52788 - DNA, 50 bp, homo sapien
ccatcacccattgctaaacctatcaytaatcaaaatgcaccaaattgttg

SEQ ID NO: 52789 - DNA, 50 bp, homo sapien
caactctgaagttgatgccaaacaayctctcagtccaatattcacttttc

SEQ ID NO: 52790 - DNA, 50 bp, homo sapien
gcaaggttcctggtagtttctaataycagagtcaaaagtctaggtagaga

SEQ ID NO: 52791 - DNA, 50 bp, homo sapien
aaacaattgcattatttagaaagaaygtgttggaatataagatcaggaaa

SEQ ID NO: 52792 - DNA, 50 bp, homo sapien
tagaacaataccctttgcctatttaygaggaggttcaagcagtggttttc

SEQ ID NO: 52793 - DNA, 50 bp, homo sapien
gttattttgctcatcctccagtccaragaatgtttatctcatctagggtt

SEQ ID NO: 52794 - DNA, 50 bp, homo sapien
gggcaaaatcgttcctttgtgctgaraacatgtggctgacaagatgccac

SEQ ID NO: 52795 - DNA, 50 bp, homo sapien
gcctgtaaatttacacaagctgtgcyagataggaacacagaacattgctg

SEQ ID NO: 52796 - DNA, 50 bp, homo sapien
aaaactgggttacatttgctacttamacattaaaacagagttttgtggtg

SEQ ID NO: 52797 - DNA, 50 bp, homo sapien
tgtgatttatatggagttttgaagcrcttaagagaactcaagtttcacca

SEQ ID NO: 52798 - DNA, 50 bp, homo sapien
gactcagaagcctcatgacccacagraactaatatctctcataataactc

SEQ ID NO: 52799 - DNA, 50 bp, homo sapien
tttaagaacctctgatatgcaagacwactcacataattcagtattactga

SEQ ID NO: 52800 - DNA, 50 bp, homo sapien
cttctttatcaaagtggaggaattaygattataagtaatcacagggatta

SEQ ID NO: 52801 - DNA, 50 bp, homo sapien
tgttacaattaataaataaaagaaawgtacgagaaacaaagatttgtaat

SEQ ID NO: 52802 - DNA, 50 bp, homo sapien
gtgcatcaataaataaggtaataaakgaatgttgcttgaaatgccacaac

SEQ ID NO: 52803 - DNA, 50 bp, homo sapien
attcaattccatgaatactaagataratgaggaagctgtagaacaaaaaa

SEQ ID NO: 52804 - DNA, 50 bp, homo sapien
ttctctaatttttcatcctgggctcyatttattaaactcataatgtattt

SEQ ID NO: 52805 - DNA, 50 bp, homo sapien
ttcattattatttctgttatggtgaygtataaacaatgaaatttgatgtt

SEQ ID NO: 52806 - DNA, 50 bp, homo sapien
gtcctttatatacagatctgtgtgayaaattctccatagaattttgtgtc

SEQ ID NO: 52807 - DNA, 50 bp, homo sapien
gaaactgctgtgtgaagtcagctacyggaagtttttgttgctgttttctg

SEQ ID NO: 52808 - DNA, 50 bp, homo sapien
aaagacattatttaattaacaaaaawatttgagattcccaggcaaggtgg

SEQ ID NO: 52809 - DNA, 50 bp, homo sapien
ggaccctagaattgaacacttaatamtatctagtcccacttagccaccct

SEQ ID NO: 52810 - DNA, 50 bp, homo sapien
tatgacactataaaatataaaactascacattaagtaagataaaacagag

SEQ ID NO: 52811 - DNA, 50 bp, homo sapien
agaaaacctgcttggacaagtagtasaatttacaagtcaagtggtcaggc

SEQ ID NO: 52812 - DNA, 50 bp, homo sapien
tacccctgtatttttaactaaaggayacttatggactgaaatagactttg

SEQ ID NO: 52813 - DNA, 50 bp, homo sapien
tctcagttttcaaatttgaagaaaarttaatgacaaagaggaaaacaagg

SEQ ID NO: 52814 - DNA, 50 bp, homo sapien
atttaagatttcaaaaaagctcaagwatatcctatcaaaactttaataca

SEQ ID NO: 52815 - DNA, 50 bp, homo sapien
cataatgttttaaaatgtttgtcctyagagggaattttgttgtagttgtt

SEQ ID NO: 52816 - DNA, 50 bp, homo sapien
atcaagcactattcattcagtatacrcaaaattgcaatataaaaggttaa

SEQ ID NO: 52817 - DNA, 50 bp, homo sapien
ataatctgaataaatgaatgagggcyatctttaaacctttcattgtatgt

SEQ ID NO: 52818 - DNA, 50 bp, homo sapien
acttaagctctagtagtaacagccartatattatatcaatgttttattta

SEQ ID NO: 52819 - DNA, 50 bp, homo sapien
ctatgaagcagctaatgcaacttctraaatgttaccaaatttataaacag

SEQ ID NO: 52820 - DNA, 50 bp, homo sapien
tgggctaggacaaaggaagtgagaaygaaaatagtggtaaatttgagcaa

SEQ ID NO: 52821 - DNA, 50 bp, homo sapien
aacagtttaaaagtaactataaaacyggataatatgtgtagatcatgggt

SEQ ID NO: 52822 - DNA, 50 bp, homo sapien
atgaaaatgtgatttttgtaagaacygtgtataatacaggaatatatcat

SEQ ID NO: 52823 - DNA, 50 bp, homo sapien
gatgggcttccctttgtacataaccygaccgttgtctctggctgccctta

SEQ ID NO: 52824 - DNA, 50 bp, homo sapien
acagaaattgttatataagaatccaragaaaaatcagtttgaagttacaa

SEQ ID NO: 52825 - DNA, 50 bp, homo sapien
catgaaacacaattccaaatgacaaygagtcttattctggtagaacagag

SEQ ID NO: 52826 - DNA, 50 bp, homo sapien
tatttgttgattttgattgctacaayttagtacatgcattataaactaat

SEQ ID NO: 52827 - DNA, 50 bp, homo sapien
ctcttcctatgttacttaccttccamctggcaatatttttccatgactga

SEQ ID NO: 52828 - DNA, 50 bp, homo sapien
aaacttttagtaaacatagactaagycctcagtatttcagagttaatgaa

SEQ ID NO: 52829 - DNA, 50 bp, homo sapien
atgacaagattctgtggaagtagcakataaactttttaaaaggctcaagc

SEQ ID NO: 52830 - DNA, 50 bp, homo sapien
attgaatctaataatcagcgtttcarctatgcacttttttttgtatatcg

SEQ ID NO: 52831 - DNA, 50 bp, homo sapien
aggttttctgcagtgatttgcggtamaacttcagatagtatatccaattg

SEQ ID NO: 52832 - DNA, 50 bp, homo sapien
catatggaggtgagtttcgattgagraagagcgtacatgcaactgaaggt

SEQ ID NO: 52833 - DNA, 50 bp, homo sapien
tatttagtactcaaaatggcattaartcatatattgttctttggaataca

SEQ ID NO: 52834 - DNA, 50 bp, homo sapien
tttcggcactgaaaagtagcatcacygtagtaaaatggaaaagatgtgtt

SEQ ID NO: 52835 - DNA, 50 bp, homo sapien
ccattcattcagtggaggtgttctgraatctttaaggaagatcgagttta

SEQ ID NO: 52836 - DNA, 50 bp, homo sapien
tgtaataaaattttccataagtataracaataacatacttgaaaagctta

SEQ ID NO: 52837 - DNA, 50 bp, homo sapien
tttaccctatcatctttaaaaattaygaggaacacagtaagagctttttg

SEQ ID NO: 52838 - DNA, 50 bp, homo sapien
gcctcccatgcattgtgaattaaaasgatattccataaagaacccaaaga

SEQ ID NO: 52839 - DNA, 50 bp, homo sapien
tattagagtcactagctcaacttccrgcatagagtaggttttaaacaaat

SEQ ID NO: 52840 - DNA, 50 bp, homo sapien
tgctacaatttcatacttcttgcacygcacaaatacgcttaacatatgca

SEQ ID NO: 52841 - DNA, 50 bp, homo sapien
acccaggaacatagacactatttcaytcggtggagtcaataaaccaaact

SEQ ID NO: 52842 - DNA, 50 bp, homo sapien
tgataagtcaaaagtgaaatctagaraactaacattacagtgcaaattgg

SEQ ID NO: 52843 - DNA, 50 bp, homo sapien
ctggtcttactaagtctcataattgwagggccttttctacttttccttta

SEQ ID NO: 52844 - DNA, 50 bp, homo sapien
gcaataaaaaaatttgcctaaaaacmaaccttatgacatttttatccatg

SEQ ID NO: 52845 - DNA, 50 bp, homo sapien
tcatttaaatatatgacaaaaagcawgtttatacttttgtattaagatat

SEQ ID NO: 52846 - DNA, 50 bp, homo sapien
cttcccatggacagaatatgacaaaygctctcttgatttggttactgtta

SEQ ID NO: 52847 - DNA, 50 bp, homo sapien
tatgtttagaaagagacaccttccastatgtttgtagagctttgggtgtc

SEQ ID NO: 52848 - DNA, 50 bp, homo sapien
gtatcacactttggcctatgtcttayatgatgaatagggcttcaacaagt

SEQ ID NO: 52849 - DNA, 50 bp, homo sapien
acatttcaaatggcagtgatcaataygggacttccccagctgtttgaaat

SEQ ID NO: 52850 - DNA, 50 bp, homo sapien
ccatagaaggaatgtttgcaactagmagaggtaggttcatgagatttaag

SEQ ID NO: 52851 - DNA, 50 bp, homo sapien
gagtgtacttaataaatcgtcacagratttaggattttgaagattagaga

SEQ ID NO: 52852 - DNA, 50 bp, homo sapien
aaaatcatgcctttaggtaaatatgyatgtaacactaatggaacagtgca

SEQ ID NO: 52853 - DNA, 50 bp, homo sapien
ttaaatctttggtctaatcttgacasgagtccagtttctgcaggatcaat

SEQ ID NO: 52854 - DNA, 50 bp, homo sapien
caatttatgaactgtggacaaaaatsagagcacaaaagcacaatcatatt

SEQ ID NO: 52855 - DNA, 50 bp, homo sapien
ggagagtgagatattggatattaagragtgggcaatatataaagataaag

SEQ ID NO: 52856 - DNA, 50 bp, homo sapien
caagtggaagctgcttattatcacaytcaggcctgtgtatggcactaggc

SEQ ID NO: 52857 - DNA, 50 bp, homo sapien
cttgtttttacaagaaaataaatgcwgaatattcatagcctgaaatgagg

SEQ ID NO: 52858 - DNA, 50 bp, homo sapien
ggaaatattcggaagcatattgtgarctcttttcataaaaacaaggcata

SEQ ID NO: 52859 - DNA, 50 bp, homo sapien
ttaaaatctgacagctctactaaaastctttctggtgctgtattttttaa

SEQ ID NO: 52860 - DNA, 50 bp, homo sapien
aatttcccagataactaaactctagscatcccgaaatatctcgttattgc

SEQ ID NO: 52861 - DNA, 50 bp, homo sapien
ataggaagggacccaacagtcatcargttaaaataagtaaacaaacataa

SEQ ID NO: 52862 - DNA, 50 bp, homo sapien
aacattctattaactttcacagatamcagtaaccaaatcaagagagcgtt

SEQ ID NO: 52863 - DNA, 50 bp, homo sapien
taaagtgtctttaaacagaagcataygtaaaacaagattatgtaatgatt

SEQ ID NO: 52864 - DNA, 50 bp, homo sapien
gtggaaaatgtatctcccacggtcaycttacctcgttaatatgcctacct

SEQ ID NO: 52865 - DNA, 50 bp, homo sapien
ttttctttgtaaggttttcaagtagragtagatatgtggggataccaggt

SEQ ID NO: 52866 - DNA, 50 bp, homo sapien
tgcaattcagatgcaaagaattcacrgactaatatgtgggaaccacaggt

SEQ ID NO: 52867 - DNA, 50 bp, homo sapien
atatctgatgtgtctttctctacaayatatctatccagaaaaatcagtta

SEQ ID NO: 52868 - DNA, 50 bp, homo sapien
gctgtgctcttcctctgttcattcaycagaagaaatgagacctctgaaca

SEQ ID NO: 52869 - DNA, 50 bp, homo sapien
tagtaggtttcccctactcttaacaytgatgaatatttttgcccataata

SEQ ID NO: 52870 - DNA, 50 bp, homo sapien
atgtgttgggtgtatctttcttgtaraatgtgtaatgttaattgatatgt

SEQ ID NO: 52871 - DNA, 50 bp, homo sapien
aggtgctcagttagcttttatggaargtgtagtgtgtattcttcattcat

SEQ ID NO: 52872 - DNA, 50 bp, homo sapien
atctgataacatttatagagctcaayctaaaaaacaaacaaacaaacaaa

SEQ ID NO: 52873 - DNA, 50 bp, homo sapien
attggagaatattattgacaagtacyaccctggatctatagatgctaaac

SEQ ID NO: 52874 - DNA, 50 bp, homo sapien
ttcaaataatcgtataaggtggtaamcaaaatgcagttaggaaaattagc

SEQ ID NO: 52875 - DNA, 50 bp, homo sapien
gaagtagtctatgatgttgagaatcraaggcaaaatgtcaattttataac

SEQ ID NO: 52876 - DNA, 50 bp, homo sapien
agttatgaggttgaatgctctgaatratgttgtttaatttaaatgccatt

SEQ ID NO: 52877 - DNA, 50 bp, homo sapien
gtcacaaatgatgcataaccctccaraaatacagcttaaaagaagaaaat

SEQ ID NO: 52878 - DNA, 50 bp, homo sapien
tgcgagagtcagattacttgcttaayagaaaagagaatttttagagtctg

SEQ ID NO: 52879 - DNA, 50 bp, homo sapien
atttttgctctttttggttatggatkatattgtttaagactgtttctgaa

SEQ ID NO: 52880 - DNA, 50 bp, homo sapien
tctattgtggtaagaacaaagaagcygctcaataatgatcacagtgtaca

SEQ ID NO: 52881 - DNA, 50 bp, homo sapien
ctgccgtagaccatatttacaataayttagccacttttgaaaaacattct

SEQ ID NO: 52882 - DNA, 50 bp, homo sapien
gtttaaaaatagagaataattaaacycagaatgctatgctatagtaggga

SEQ ID NO: 52883 - DNA, 32 bp, homo sapien
caagttcactatgaaartccacccagaagttt

SEQ ID NO: 52884 - DNA, 50 bp, homo sapien
tattggcatgactaagcctaggcaasgccaatagaaccacccagtcaacc

SEQ ID NO: 52885 - DNA, 50 bp, homo sapien
gtgcccttttacatgtatataaaaakctctggttatttgttttattgtac

SEQ ID NO: 52886 - DNA, 50 bp, homo sapien
ccaatcagacaatggtcttcaatgaygaaaaaatctttaggtaaaaaaat

SEQ ID NO: 52887 - DNA, 50 bp, homo sapien
catattttggagggctagaagtctayaaatttcagaatgtatttaaagta

SEQ ID NO: 52888 - DNA, 50 bp, homo sapien
gggttcagttagtttaaatggctcaycttgatctctgggctcataagtgc

SEQ ID NO: 52889 - DNA, 50 bp, homo sapien
gtttctggaatatgtccacaggagaratgaatctgctatagcacaagtga

SEQ ID NO: 52890 - DNA, 50 bp, homo sapien
aatcaccctgactgtagagtagatartagatttctaacaggcaagatagt

SEQ ID NO: 52891 - DNA, 50 bp, homo sapien
ctctctaggattactactgagattawcattctggagtctagaatgtacaa

SEQ ID NO: 52892 - DNA, 50 bp, homo sapien
tttctttcttttcctcattggtgatrataagtaattggttccacaagtcc

SEQ ID NO: 52893 - DNA, 50 bp, homo sapien
taatatatcatttaatgggatattargattaatgtgtctataatgatagc

SEQ ID NO: 52894 - DNA, 50 bp, homo sapien
ctattacaaataaaagtgtgctaaarttgtgtgcgatttttctaagattt

SEQ ID NO: 52895 - DNA, 50 bp, homo sapien
tacattctgtaagagctgagaaaaawtaactttagaacatgaataaactt

SEQ ID NO: 52896 - DNA, 50 bp, homo sapien
caagtaaagtactgatgactttttaygaaaagaggtgaaaataagactca

SEQ ID NO: 52897 - DNA, 50 bp, homo sapien
aaggactaacttccacttccagttayaagaaaccagactaaccgtacata

SEQ ID NO: 52898 - DNA, 50 bp, homo sapien
attgcctttcatctgttctattgtcrctgaatggattccatataacagtt

SEQ ID NO: 52899 - DNA, 50 bp, homo sapien
aatacattagagggtctcaaaagcaraatttatcaaaaaaagtatttgtg

SEQ ID NO: 52900 - DNA, 50 bp, homo sapien
cagtaaaaactatttgtggaaataayggcaaactgaagagtgcagggtgc

SEQ ID NO: 52901 - DNA, 50 bp, homo sapien
gcttctttacttagtacctctgtgamctttgcgattaagtgacttcacca

SEQ ID NO: 52902 - DNA, 50 bp, homo sapien
tttatagattatggtgtcattgatgyagatataagcagagaggtgggggg

SEQ ID NO: 52903 - DNA, 50 bp, homo sapien
gaaaaaccccttttgatctttccaartagtgagtttatgaatccattact

SEQ ID NO: 52904 - DNA, 50 bp, homo sapien
aaatctggacaacataacagctgacyctgatttcttaggactgatgccta

SEQ ID NO: 52905 - DNA, 50 bp, homo sapien
tacaatgtgttccagggagaaatgaytattgagaatttactgcttctttt

SEQ ID NO: 52906 - DNA, 50 bp, homo sapien
tgaggacatggatgatacataactcycataacctataaagtatattgctc

SEQ ID NO: 52907 - DNA, 50 bp, homo sapien
aatccattaactttttatgaacctamcctaaatttattcctagcaaactg

SEQ ID NO: 52908 - DNA, 50 bp, homo sapien
actgaacaagtgtcagggagcaaaaygtatgaacgagtttccagttctgc

SEQ ID NO: 52909 - DNA, 50 bp, homo sapien
tccagagaagttcctctgtaactcasgatgttattttccctagcggggac

SEQ ID NO: 52910 - DNA, 50 bp, homo sapien
agggcccttgctccttgataaacaasctaaaaattcaaattcaattcaag

SEQ ID NO: 52911 - DNA, 50 bp, homo sapien
ggtaacttattagtttttaataagasattcgcttctcggacatccatcca

SEQ ID NO: 52912 - DNA, 50 bp, homo sapien
tgattggttatgcacacacgcaaaaktttgaattctctttggtttagatg

SEQ ID NO: 52913 - DNA, 50 bp, homo sapien
tgcctctggtttcaacatattcctcrcatgttccaagcacttaataaatg

SEQ ID NO: 52914 - DNA, 50 bp, homo sapien
gaagtagtgacaagttcatattgaaragagtgaattagtgttcctttcaa

SEQ ID NO: 52915 - DNA, 50 bp, homo sapien
taattcagtatatatttttagagcayggaatttaatgtgctctttcattt

SEQ ID NO: 52916 - DNA, 50 bp, homo sapien
tattttagttcttatcatggactacraggctctacctttccctcctccta

SEQ ID NO: 52917 - DNA, 50 bp, homo sapien
atttttcaaaatatgacaatattcaytaatcctttgttaatccatcttcc

SEQ ID NO: 52918 - DNA, 50 bp, homo sapien
gatttccctaattgatatatttgtgragcatatttggacacagacaattg

SEQ ID NO: 52919 - DNA, 50 bp, homo sapien
aaaggattgggaggtggagataaagwattggaaatctggcgttttaagtg

SEQ ID NO: 52920 - DNA, 50 bp, homo sapien
ttcctcatttgtaaaataatacctaygtcaaaacttgtaatgaataccaa

SEQ ID NO: 52921 - DNA, 50 bp, homo sapien
gaaatgcttgatgttgtacatgggcrcatattaatggtaattagcaatga

SEQ ID NO: 52922 - DNA, 50 bp, homo sapien
gaaccacttctctagatcagtaccaytaagatcattttatctatattcct

SEQ ID NO: 52923 - DNA, 50 bp, homo sapien
gagataggagatatgacttattcaartaaagtgagatccagaattaaaac

SEQ ID NO: 52924 - DNA, 50 bp, homo sapien
ttcagagagaaagaaatctgagagakacataaaatttgagataaggtaca

SEQ ID NO: 52925 - DNA, 50 bp, homo sapien
aaataatgccttctaagctatttacrcgtcagagttgagctcactcctcc

SEQ ID NO: 52926 - DNA, 50 bp, homo sapien
attcggctcagcttaaacacagacayaaacatttagcaagctttgtgctt

SEQ ID NO: 52927 - DNA, 50 bp, homo sapien
atatgacagacgctttctttcaaccrctagttacaggaagcacattctaa

SEQ ID NO: 52928 - DNA, 50 bp, homo sapien
taggaaaaacaaactggcctcagtaygttagaaaatattgtatatttaag

SEQ ID NO: 52929 - DNA, 50 bp, homo sapien
aatcagtcttttttcataatctgtargcaccattcatactctagtaatca

SEQ ID NO: 52930 - DNA, 50 bp, homo sapien
attaccccaacttatctgaccataaragccaacatgccatcacagatggc

SEQ ID NO: 52931 - DNA, 50 bp, homo sapien
ccccggaataagtactacagctacastcttgccagaaagtgagttctaag

SEQ ID NO: 52932 - DNA, 50 bp, homo sapien
cattgaatacatgctagaaccttgargtaggtactcttatttgtcctgtt

SEQ ID NO: 52933 - DNA, 50 bp, homo sapien
gatctttgtgttggactggaaaaatractgttggcattagcagaatgata

SEQ ID NO: 52934 - DNA, 50 bp, homo sapien
aaaaaaaatttaattgaagtctaaayttgtggtaaaaagagttgtaaaat

SEQ ID NO: 52935 - DNA, 50 bp, homo sapien
gcattatgtgtctttctttccctaayggcaaccacagtcattcttgatac

SEQ ID NO: 52936 - DNA, 50 bp, homo sapien
gtaagcagagctctaaattataagartcattatcctgaatcatgaaccct

SEQ ID NO: 52937 - DNA, 50 bp, homo sapien
caagcaagcttatttgtttatgagarcttagccacagcgctcactttcac

SEQ ID NO: 52938 - DNA, 50 bp, homo sapien
aaaataatgaagtcctaaggagcagyagcgtttggctctataaaaatatt

SEQ ID NO: 52939 - DNA, 50 bp, homo sapien
ataacattaaagaaaacatttaatcraagcatcaatgaataatgtgtacc

SEQ ID NO: 52940 - DNA, 50 bp, homo sapien
ttttaagggtatagtaattaggagamtatctaggacaatggctttcaaag

SEQ ID NO: 52941 - DNA, 50 bp, homo sapien
ggctatctactctctcttccaaaaayacatcatatctataacattaaaga

SEQ ID NO: 52942 - DNA, 50 bp, homo sapien
agttgtcacaatttattgtatgtaaytcacaatatgttacatgcaatatt

SEQ ID NO: 52943 - DNA, 50 bp, homo sapien
acttcactttcctgagttatataaaygtccatggattagaaatgttaaaa

SEQ ID NO: 52944 - DNA, 50 bp, homo sapien
acaataagttttacgtgtcacatacraaatattgcatgtaacatattgtg

SEQ ID NO: 52945 - DNA, 50 bp, homo sapien
cgtgaggttctggaagaatagtctgyaagaggatgtcaaatgtctatatt

SEQ ID NO: 52946 - DNA, 50 bp, homo sapien
gattttgttaactcaatatccaaacsaacatggtaattaatttaaaatta

SEQ ID NO: 52947 - DNA, 50 bp, homo sapien
ttcctgaggcaaagaacacttttaaygggtcaataatggaagtaaaatgc

SEQ ID NO: 52948 - DNA, 50 bp, homo sapien
tttgtgatgatgacaaataaatgtargtaaatggttgactggatagaacc

SEQ ID NO: 52949 - DNA, 50 bp, homo sapien
ggtaattatatttactaaatatttaygttaagagttatctgtttgagctt

SEQ ID NO: 52950 - DNA, 50 bp, homo sapien
tgtttcatttaagaactggtctcaaytaagctcaaacagataactcttaa

SEQ ID NO: 52951 - DNA, 50 bp, homo sapien
tgtaagtctaatatgctattccatartacattagatcaggagtagggtgg

SEQ ID NO: 52952 - DNA, 50 bp, homo sapien
cagatatcattggttaaaattctcawataggatgggactaagaaaatatt

SEQ ID NO: 52953 - DNA, 50 bp, homo sapien
agttttgcatcttcacaggttgcaartgttaattaaatctgtatttacat

SEQ ID NO: 52954 - DNA, 50 bp, homo sapien
ggtactagagtttctgcagaacttasatgataagcaacgacaaagccagc

SEQ ID NO: 52955 - DNA, 50 bp, homo sapien
gttgggagaaatattcaaggtaatayagtctaacctcttactcagaaaac

SEQ ID NO: 52956 - DNA, 50 bp, homo sapien
tacatatgtatatgttagccagaagwagttagctataacttgaagttcag

SEQ ID NO: 52957 - DNA, 50 bp, homo sapien
ttgataaaatctagttatttttaagwctctctacccaatattaacctgca

SEQ ID NO: 52958 - DNA, 50 bp, homo sapien
tatagcatgatgcagggaatactaaygaaggcaaagcgtattttgactaa

SEQ ID NO: 52959 - DNA, 50 bp, homo sapien
acccataactagaagcaaagcgaccyactactgaaaaggtgagaaggtca

SEQ ID NO: 52960 - DNA, 50 bp, homo sapien
tagacatcagccagcaaatgaggcastagtaaagaaattgaaaaagtgtc

SEQ ID NO: 52961 - DNA, 50 bp, homo sapien
taaaatgggactgctgttttaggcaragtaaatataaacaaagaataaac

SEQ ID NO: 52962 - DNA, 50 bp, homo sapien
atttcctcccttctctcctcactacrggtaggctccaacctatcacgcca

SEQ ID NO: 52963 - DNA, 50 bp, homo sapien
gaaagatatcaatatctaaggacacraaggttgtagaacaccaagcagat

SEQ ID NO: 52964 - DNA, 50 bp, homo sapien
tactatttatttgagagatcaacaartataggtcactgcaatgaaatgtt

SEQ ID NO: 52965 - DNA, 50 bp, homo sapien
actgtcactgttatggaaaaccacawcaatatatacatttataatgcaaa

SEQ ID NO: 52966 - DNA, 50 bp, homo sapien
tgcatacacctaatttatacaactawgtaactcccaatgtcgtaatgaaa

SEQ ID NO: 52967 - DNA, 50 bp, homo sapien
agtcgtcttcatctcacactactcarattcacaaaggaccagtatataaa

SEQ ID NO: 52968 - DNA, 50 bp, homo sapien
gtcagtgtataaacgtggtgtgttasaatcagatggctttacatttatgt

SEQ ID NO: 52969 - DNA, 50 bp, homo sapien
cctgctctatgacctcggaagctccraattaagtttaccaagaatgttct

SEQ ID NO: 52970 - DNA, 50 bp, homo sapien
gtgaaagagaaaaaggataagaggasaacgaatagtgaaaatttttttct

SEQ ID NO: 52971 - DNA, 50 bp, homo sapien
gtgaattttctttttattgctactaygttttgtcaaattttttttagttt

SEQ ID NO: 52972 - DNA, 50 bp, homo sapien
ggacaaccagaaatacaggtgctatracaatgaccaggcagacaaaaaaa

SEQ ID NO: 52973 - DNA, 50 bp, homo sapien
aaatactatgtaatacttcaaatackatgtaatacttcaaatatttgttt

SEQ ID NO: 52974 - DNA, 50 bp, homo sapien
gaaaaaataggaagtagatacatacscttgtccagaattcaaatgaagta

SEQ ID NO: 52975 - DNA, 50 bp, homo sapien
tcatttatttttgcaaatccataacyatatttctactgagatatgttagt

SEQ ID NO: 52976 - DNA, 50 bp, homo sapien
tatttcctaattcaaaaaatgaacargtcagattctgtaaagatatccag

SEQ ID NO: 52977 - DNA, 50 bp, homo sapien
tatctgttaataaaatgcgttagtcmcaatgtttgcttgttaaacagtaa

SEQ ID NO: 52978 - DNA, 50 bp, homo sapien
atacaatttataccttgttcctttcragagtaagtacagaatataatttt

SEQ ID NO: 52979 - DNA, 50 bp, homo sapien
caataagccttatacctacgaattcyaatgttttgattcaggtaaaagat

SEQ ID NO: 52980 - DNA, 50 bp, homo sapien
tggcagtttttcagggacagtctaaraaattatctggattatttatcatc

SEQ ID NO: 52981 - DNA, 50 bp, homo sapien
ggaaagctaacatttttaaaaatcayacagagtgaacattaagcatttta

SEQ ID NO: 52982 - DNA, 50 bp, homo sapien
tacacatttatgaagaatctataagratcacaatttctattctgggtaca

SEQ ID NO: 52983 - DNA, 50 bp, homo sapien
gggtggtaattgattttaatttgtgraaatctgataggactacattgaga

SEQ ID NO: 52984 - DNA, 50 bp, homo sapien
gatgccagtatcatactcaaataacygaacatgcattacaagtttactaa

SEQ ID NO: 52985 - DNA, 50 bp, homo sapien
gagaagatttacttttaagcaagtargtacaatcagttctctttagcgga

SEQ ID NO: 52986 - DNA, 50 bp, homo sapien
tcgatgtactaaaagaataagtgatyaacagctagaagaattggaagaga

SEQ ID NO: 52987 - DNA, 50 bp, homo sapien
acgaagtttgaaaataaagtgattamagtatagtgtgagtactactagaa

SEQ ID NO: 52988 - DNA, 50 bp, homo sapien
cctatatccattaactttctggacaygaagtttgaaaataaagtgattac

SEQ ID NO: 52989 - DNA, 50 bp, homo sapien
gtgggacgggggtaggaaaccaccaratgtcaaatgggaggaacataagg

SEQ ID NO: 52990 - DNA, 50 bp, homo sapien
caggatctcctctagttttgatgaastcagtgttaatgctactgataacc

SEQ ID NO: 52991 - DNA, 50 bp, homo sapien
taacaataataacaacaaaaggccawagattcttcaggaaagggttgctg

SEQ ID NO: 52992 - DNA, 50 bp, homo sapien
gagttccaattgtcaacacttgtaamcaactcaatcatgctttctttatt

SEQ ID NO: 52993 - DNA, 50 bp, homo sapien
aaatgtcctgaaagtatactataaaytccactaagtcagagactgtcatt

SEQ ID NO: 52994 - DNA, 50 bp, homo sapien
tcaggcctttatcacttctcatttgratagttatgaagtcccaaccctag

SEQ ID NO: 52995 - DNA, 50 bp, homo sapien
atgcaataatatcccccactgctaasctgcaaccatgcctttgtcttcag

SEQ ID NO: 52996 - DNA, 50 bp, homo sapien
taggctcacttacaagaactaccaamtccacaagaaacaaatgtaagctt

SEQ ID NO: 52997 - DNA, 50 bp, homo sapien
taatgagttttggcattatgtacttsaaaagaaaatcctattaggaaatt

SEQ ID NO: 52998 - DNA, 50 bp, homo sapien
aaacactgaataactatgctattcaratcgtaagtttcatcattgtgaaa

SEQ ID NO: 52999 - DNA, 50 bp, homo sapien
tgtagaacttatccacttagagtaayggaatgtatttcttacttcttcct

SEQ ID NO: 53000 - DNA, 50 bp, homo sapien
ggctgtgcattgaggaagagtatatmataggaagagtaaaatttagggtc

SEQ ID NO: 53001 - DNA, 50 bp, homo sapien
atctaaacctaatggccagagaccarattatgcaaattcttccaggcagc

SEQ ID NO: 53002 - DNA, 50 bp, homo sapien
tcctttgtgttgtagtaagcaaaatwaaaaattggccactccaaatatga

SEQ ID NO: 53003 - DNA, 50 bp, homo sapien
acaccaaatcctgcttactgcctcaraagattttaagtgggagagacaag

SEQ ID NO: 53004 - DNA, 50 bp, homo sapien
ttgacaggggcatatgtcccatgacwatctgatgacttcagttgacacaa

SEQ ID NO: 53005 - DNA, 50 bp, homo sapien
agtgaagaaagggagatgccaattgyagataacttctttgaaaattgcga

SEQ ID NO: 53006 - DNA, 50 bp, homo sapien
tttttgagagtaggactgtacttaamgttttagaaattcgtgactgactg

SEQ ID NO: 53007 - DNA, 50 bp, homo sapien
caattgcttctcttccagtttcatasgttactgcctaagctcaccctaca

SEQ ID NO: 53008 - DNA, 50 bp, homo sapien
gtacacatgcagagaattcattattkaaaagttatgcaatttgaaatgta

SEQ ID NO: 53009 - DNA, 50 bp, homo sapien
agtccattgaagatttctccatttayattcattcctatatgaactgattc

SEQ ID NO: 53010 - DNA, 50 bp, homo sapien
tgcaccagggctggtcaacatctacraatataaaggcatatgtctggtag

SEQ ID NO: 53011 - DNA, 50 bp, homo sapien
tttatagaaaggaagagatcaccaasagagcaaggtgaattcagcaagca

SEQ ID NO: 53012 - DNA, 50 bp, homo sapien
caggcacccagaccttcttgttttakgtagacacttcagagatttaacat

SEQ ID NO: 53013 - DNA, 50 bp, homo sapien
tctttcactggtcatctttaaagcayctgtattatgtactgggcactata

SEQ ID NO: 53014 - DNA, 50 bp, homo sapien
ggaaaggaactattttcatttaagarcatacctcggccgggtacggtggc

SEQ ID NO: 53015 - DNA, 50 bp, homo sapien
atgaacacttgcatgaacagctacaygaataaataaatagacaaatctgt

SEQ ID NO: 53016 - DNA, 50 bp, homo sapien
gtcaactaacatggagaaaaagctayacttgattggacgttttttgccat

SEQ ID NO: 53017 - DNA, 50 bp, homo sapien
tggagatttagttttgatgacaaagkaggttcttttcctgaacacacctt

SEQ ID NO: 53018 - DNA, 50 bp, homo sapien
caggaacttgtactctagattctctsaaaaatcccatggttcatcatatt

SEQ ID NO: 53019 - DNA, 50 bp, homo sapien
tgtagattttctcttccccctagaayggtctgtgcttatctatggcagca

SEQ ID NO: 53020 - DNA, 50 bp, homo sapien
cccagctaggtaaaatgagatttacratggctcccttacacattgcataa

SEQ ID NO: 53021 - DNA, 50 bp, homo sapien
gatggtgtttaatacttcagcagtcraaagaggagtgaaaaatcgttact

SEQ ID NO: 53022 - DNA, 50 bp, homo sapien
taattacaaaaaatatatgtagcaaygtacttcatgagttatgaagggaa

SEQ ID NO: 53023 - DNA, 50 bp, homo sapien
tttttttggtgagtatgctacaatcraatagacctttaaattccacgtcc

SEQ ID NO: 53024 - DNA, 50 bp, homo sapien
ctgtcttcatcaccactgctagtacyctggttcgaactctcatcatttcc

SEQ ID NO: 53025 - DNA, 50 bp, homo sapien
ggtttcatccccagccaccatgtgcrgaaagataaacagattgaaaaaaa

SEQ ID NO: 53026 - DNA, 50 bp, homo sapien
aatgtcagaaaactgcaattgcataygagttgtggaaatcatgtcccaga

SEQ ID NO: 53027 - DNA, 50 bp, homo sapien
atttgctgaattaatcaatgaaggayatcgtgcctctgtacatagcgctc

SEQ ID NO: 53028 - DNA, 50 bp, homo sapien
gcacttttccttagaggttatcataycagtttagcagatttttaattttc

SEQ ID NO: 53029 - DNA, 50 bp, homo sapien
tgcagtctgatggctccctagtaaawctaactctgtcatgctgtctcctt

SEQ ID NO: 53030 - DNA, 50 bp, homo sapien
aagtttttcttcatgattaacacaaktcacaaaataagaaatggtatttg

SEQ ID NO: 53031 - DNA, 50 bp, homo sapien
ttgagacctgggtttatcctaccaaygagcagactgagaaacaccactat

SEQ ID NO: 53032 - DNA, 50 bp, homo sapien
atttaactagtaatatttaggtaagwatctaaaccaatatttaatttttt

SEQ ID NO: 53033 - DNA, 50 bp, homo sapien
attctttggggaaatgctgatttaamataaaactttgcaattcaataaac

SEQ ID NO: 53034 - DNA, 50 bp, homo sapien
agcctggagcaggctagtgcacccaygttctagtcttactgttttatttt

SEQ ID NO: 53035 - DNA, 50 bp, homo sapien
aaaaaattagtgatttgtactaagakgcgtttctcgctcccattttagtg

SEQ ID NO: 53036 - DNA, 50 bp, homo sapien
gggtggaggcagtaaataatgaggarcaataacacaatctaccatgcagg

SEQ ID NO: 53037 - DNA, 50 bp, homo sapien
gcaagccaaatgtcttgaagaatacractttggaaacttctagattggcc

SEQ ID NO: 53038 - DNA, 50 bp, homo sapien
aagtaattaattgtgggatactttcraatagcacctactcatatctgtta

SEQ ID NO: 53039 - DNA, 50 bp, homo sapien
tggccatttttttttcctcttggtawcaacatggatttttaaaataagaa

SEQ ID NO: 53040 - DNA, 50 bp, homo sapien
tcactttctcttctgaataataggartaataactgtgctttacatttcaa

SEQ ID NO: 53041 - DNA, 50 bp, homo sapien
gtgcgagtgaggctagcaaaccacaytgagtaggacagcctgagggttaa

SEQ ID NO: 53042 - DNA, 50 bp, homo sapien
gtccactgtctttttgtactggctawaacttctaaaataatattaaacat

SEQ ID NO: 53043 - DNA, 50 bp, homo sapien
ggaagagttattaatggaatcaggaratagaaacttatatggtacaatgc

SEQ ID NO: 53044 - DNA, 50 bp, homo sapien
gagaagaataatgcacaaaaactatyatagctcatccattcaagtggtat

SEQ ID NO: 53045 - DNA, 50 bp, homo sapien
ttcagggatttaagtaagaaactcaygttccactcagagcagagcaatgg

SEQ ID NO: 53046 - DNA, 50 bp, homo sapien
acagaaataagtgtttgtttccatcmaaatacatacatatgagaatgttc

SEQ ID NO: 53047 - DNA, 50 bp, homo sapien
caatacattgcttgtctggaatataragtagggacctaatgggagagaag

SEQ ID NO: 53048 - DNA, 50 bp, homo sapien
gtattgtttagttgtacatgacaacmaatgttataaaggctgttttgcaa

SEQ ID NO: 53049 - DNA, 50 bp, homo sapien
acatattttgtgttataaaaggatayatgccaaactgttcccattgttac

SEQ ID NO: 53050 - DNA, 50 bp, homo sapien
cggtgtagttcataagtggcaatcayaaactgtgtaattccacaatagtc

SEQ ID NO: 53051 - DNA, 50 bp, homo sapien
ttttctttgtattggcaaagtgatayataggagaatctgcctactccttg

SEQ ID NO: 53052 - DNA, 50 bp, homo sapien
gaaaggagacattgatgtactgcggrcatcccaacttctacctcatcatg

SEQ ID NO: 53053 - DNA, 50 bp, homo sapien
cccagctcccctttttactctaactsaggataactctgagaggccatctt

SEQ ID NO: 53054 - DNA, 50 bp, homo sapien
atagcatttattcaattcagtaagaygtagtggaattctgtacaaattgt

SEQ ID NO: 53055 - DNA, 50 bp, homo sapien
tattttcagtgttttcatatgtgacrgtaaaacaagagaaagcccaacaa

SEQ ID NO: 53056 - DNA, 50 bp, homo sapien
gtgtgggccgctttgtctcaaatccrcagttctatctgggagggtcttgc

SEQ ID NO: 53057 - DNA, 50 bp, homo sapien
gtcttcactgaggtggactgtccaayaactatccctttcaaacatcagcc

SEQ ID NO: 53058 - DNA, 50 bp, homo sapien
aggatatctggaaaaactgaatatgratatactggtgccaaacttcaggc

SEQ ID NO: 53059 - DNA, 50 bp, homo sapien
acttggatgcagttgagctcgtgccrcaaaatttggaaggattataaaaa

SEQ ID NO: 53060 - DNA, 50 bp, homo sapien
gataagcatcaaggaaagcattccargaagagagacgggcatatgcaaag

SEQ ID NO: 53061 - DNA, 50 bp, homo sapien
gtttacaacaaaactataatgtatgwagcagtcataaaagaaactttatt

SEQ ID NO: 53062 - DNA, 50 bp, homo sapien
tagttcaagagagtgctaggtgtaaragataagttatgatgtgttgacat

SEQ ID NO: 53063 - DNA, 50 bp, homo sapien
tcaggtctgaatacaaatctactaaktaaaaatcctgggagtaaatttat

SEQ ID NO: 53064 - DNA, 50 bp, homo sapien
gaggatagatttccatgctactatasagtgaacgtcttccatagtgaaag

SEQ ID NO: 53065 - DNA, 50 bp, homo sapien
atggaaccttattaactctggatagsaaatagcccagaacaggagttggc

SEQ ID NO: 53066 - DNA, 50 bp, homo sapien
aagctttgcagtgccatgaatggccracaaatctgtatcagttagcagtc

SEQ ID NO: 53067 - DNA, 50 bp, homo sapien
gaacagaccagcaggctagcgacccrcagaggagttaatgttgcagccta

SEQ ID NO: 53068 - DNA, 50 bp, homo sapien
gcgagctcatataaacatctcttacrcatgattctgatccttaaacattg

SEQ ID NO: 53069 - DNA, 50 bp, homo sapien
atttaagacaatttgagaatcaaaamggaaaactaaagaattgaaaacta

SEQ ID NO: 53070 - DNA, 50 bp, homo sapien
aatgaccctaacaatgaattacctamgagatcacccttaacacattcaaa

SEQ ID NO: 53071 - DNA, 50 bp, homo sapien
ctcatataaattagatctaacttagmaaaaatatgatttagccaaggtta

SEQ ID NO: 53072 - DNA, 50 bp, homo sapien
tatcccaatacttacatagataaaastgaactctactcaaaagcccatgt

SEQ ID NO: 53073 - DNA, 50 bp, homo sapien
aatttggcatgaagtaaaataacaartgatgtatatacgtgggaaatttt

SEQ ID NO: 53074 - DNA, 50 bp, homo sapien
ttttaaaacttcctttgttaatttayggaatactatttgattacttaata

SEQ ID NO: 53075 - DNA, 50 bp, homo sapien
gactaggatactgtataatccatgayaacataaggaacggttgctgcata

SEQ ID NO: 53076 - DNA, 50 bp, homo sapien
gtcagaggattttcaaaaaggaagaratctagttgtgcttccaaatgcca

SEQ ID NO: 53077 - DNA, 50 bp, homo sapien
ggcagcatgatgtcgttgattttagratgctaaagaaaattatgctgaga

SEQ ID NO: 53078 - DNA, 50 bp, homo sapien
atcagtatgttttagattcccaagargtacaatgccaagtgtcatgttat

SEQ ID NO: 53079 - DNA, 50 bp, homo sapien
gctagacgaagagaggccactttctraatgagaaccaacatttctgttac

SEQ ID NO: 53080 - DNA, 50 bp, homo sapien
aagaaaaataagacaagaataacaascactattgcaagcattttacatat

SEQ ID NO: 53081 - DNA, 50 bp, homo sapien
gggccggttctccagctgcttgacgycgagccatattctcgctcgggaat

SEQ ID NO: 53082 - DNA, 50 bp, homo sapien
atatcataactagttttgaaatgcaygtgtaactatttaggaacagaaag

SEQ ID NO: 53083 - DNA, 50 bp, homo sapien
actagaataagtaggataatctaggycaaattttctgaatgatggcattt

SEQ ID NO: 53084 - DNA, 50 bp, homo sapien
tcaaagaccaggaatgcagatagcartgaacatattaactaaaatccagg

SEQ ID NO: 53085 - DNA, 50 bp, homo sapien
taatggagatgtccagaaactagaargagaaaggaacacagtggcatcat

SEQ ID NO: 53086 - DNA, 50 bp, homo sapien
tataaaaatggtctgggtatatccaygcaaaactaaagggagtggaagag

SEQ ID NO: 53087 - DNA, 50 bp, homo sapien
acatcagattaaccaatagcttgtcragagtgctccatattggatgatgg

SEQ ID NO: 53088 - DNA, 50 bp, homo sapien
acgcttactgagtgagtgactcgaarcgggctgaatatcccagtaagata

SEQ ID NO: 53089 - DNA, 50 bp, homo sapien
agccttgaaggatgcccaagagttasgaaaggagagtggcaagcagagtt

SEQ ID NO: 53090 - DNA, 50 bp, homo sapien
aaaatctgacagactgacttatacaytgggcattattcaattggagtcac

SEQ ID NO: 53091 - DNA, 50 bp, homo sapien
ctccaaatcacaggctttggagtctwacagatagaggttagaatctcagc

SEQ ID NO: 53092 - DNA, 50 bp, homo sapien
tagacagtcaattgttttcctatacrcaagcaataaaaactgaaatttga

SEQ ID NO: 53093 - DNA, 50 bp, homo sapien
tcaatgacttttccttgattcctatkagtaggtaactccatgattgatac

SEQ ID NO: 53094 - DNA, 50 bp, homo sapien
atgtcaggggtcgaggtaggaaaatyaagtcgtagggctggatggtcata

SEQ ID NO: 53095 - DNA, 50 bp, homo sapien
gtaggcaattgtaacacagtggtaartattggtgcatttaagcctattta

SEQ ID NO: 53096 - DNA, 50 bp, homo sapien
ttcatcaacaattgttgccataacaycacataaaaatcaactcccaaagc

SEQ ID NO: 53097 - DNA, 50 bp, homo sapien
tgtcttcaataaacatcttagtatcratcaacataattttacatagccaa

SEQ ID NO: 53098 - DNA, 50 bp, homo sapien
accagtccctgttcaaaatcatctaygggtctatcataagttatcttatt

SEQ ID NO: 53099 - DNA, 50 bp, homo sapien
ccctaggtttatttcagattgtcaawgtccaaaatataaatgcaataaat

SEQ ID NO: 53100 - DNA, 50 bp, homo sapien
agcactggaatgttcaacatatgatsaatcaagacctgggtttcaggcac

SEQ ID NO: 53101 - DNA, 50 bp, homo sapien
ttgtacacttgaaatcagaaatctamaaaacaattcaagatacaggttat

SEQ ID NO: 53102 - DNA, 50 bp, homo sapien
gagataaatgctcacccactttaaaraagaaatcgataattgtaattcac

SEQ ID NO: 53103 - DNA, 50 bp, homo sapien
ccataaatattccttggacacccacyatgaagacatactttattttcctc

SEQ ID NO: 53104 - DNA, 50 bp, homo sapien
cttccattatcacacatatgcttaayccaggcagggagcagagtcagctg

SEQ ID NO: 53105 - DNA, 50 bp, homo sapien
ttgaattgtacaggagatacttaacraagagactgtgagcatatgaaaca

SEQ ID NO: 53106 - DNA, 50 bp, homo sapien
cttatcagggctcctagcctaaaacyactactaattccaaatcccagcca

SEQ ID NO: 53107 - DNA, 50 bp, homo sapien
actagaatttactcactgtgatggaratggtgtttgtaaggtaaaaatgt

SEQ ID NO: 53108 - DNA, 50 bp, homo sapien
ttttactgtcttcagcacttttcaaytcataccatgttcaggatgaatat

SEQ ID NO: 53109 - DNA, 50 bp, homo sapien
gttacttggtacttaccttctttatsaaaataatcatgtcaagctctact

SEQ ID NO: 53110 - DNA, 50 bp, homo sapien
tgtaatttagtgcatatattttacasacatatggaagagattcctttatt

SEQ ID NO: 53111 - DNA, 50 bp, homo sapien
ctttttaaagtacacttttcatataytaactccaagtttaatataatatt

SEQ ID NO: 53112 - DNA, 50 bp, homo sapien
ttccaaaccacaattttgagtagaayaggagaactgtggtggatttagtc

SEQ ID NO: 53113 - DNA, 50 bp, homo sapien
gccatttaactcttgtgaatttctastaatgcagaagacacccaaacact

SEQ ID NO: 53114 - DNA, 50 bp, homo sapien
gtccttgcagaaatacagccagaaawctcctcactcaagcataaaatact

SEQ ID NO: 53115 - DNA, 50 bp, homo sapien
ccagtcatgccacggttgagtgcacraagttctcccagccctcttctcta

SEQ ID NO: 53116 - DNA, 50 bp, homo sapien
atattcccctatcataaactttgaawaatccaccctgtcaacaaatttca

SEQ ID NO: 53117 - DNA, 50 bp, homo sapien
ctcctaatttatattactttgattastaacttaaatgctttttcacacag

SEQ ID NO: 53118 - DNA, 50 bp, homo sapien
tatagactagtttagacattatcaamaaggtacgcaccttgtgctgaaga

SEQ ID NO: 53119 - DNA, 50 bp, homo sapien
ttagcaaagtactctaatattggcckatcacttacaaaggaatttattta

SEQ ID NO: 53120 - DNA, 50 bp, homo sapien
ctttgtgtccacagcaaataatgcaygaagtccttgaaactactgaactc

SEQ ID NO: 53121 - DNA, 50 bp, homo sapien
gaaactactgaactcattagttgccrgagcaatagactgagtgcaaatcg

SEQ ID NO: 53122 - DNA, 50 bp, homo sapien
catttccttacggagcaagtacttaygacaccgatgaaaaagggcatgaa

SEQ ID NO: 53123 - DNA, 50 bp, homo sapien
cagtcattgcttcagatatcacatcmagtggaaattattagatgtgatat

SEQ ID NO: 53124 - DNA, 50 bp, homo sapien
ggtggcacattttcagagcatttgcmatattagtaacaaaactgcaacta

SEQ ID NO: 53125 - DNA, 50 bp, homo sapien
ccctcttttggagagaacttaattgraagtaagattatgaaccaaatcac

SEQ ID NO: 53126 - DNA, 50 bp, homo sapien
tctaataatttatgactgaatgaaartgagacttagacactgtcaatgta

SEQ ID NO: 53127 - DNA, 50 bp, homo sapien
ctgagacttagtagcatggtcttaargaaaacatagccaaattattagtg

SEQ ID NO: 53128 - DNA, 50 bp, homo sapien
gcagacaaataaatttgtgcacaaasaagatgactgggtttgcctcaggc

SEQ ID NO: 53129 - DNA, 32 bp, homo sapien
atgggttcagagacaaygtggtcccaccacag

SEQ ID NO: 53130 - DNA, 50 bp, homo sapien
ggaaattagcaaggcatagaagataygtgttttttcctagttttattcaa

SEQ ID NO: 53131 - DNA, 50 bp, homo sapien
aagtgggaactgctcctaaatcaaastaacaaataaataaataatattca

SEQ ID NO: 53132 - DNA, 50 bp, homo sapien
ggattcctatagcatgtatgtttccrgattatttattgtaacaaactggt

SEQ ID NO: 53133 - DNA, 50 bp, homo sapien
taagcttttaagtttcacacgaaaayttattctattccagagtgaatatc

SEQ ID NO: 53134 - DNA, 50 bp, homo sapien
tttctattaatttacaattttgctargacggtagatctcacgttatatag

SEQ ID NO: 53135 - DNA, 50 bp, homo sapien
aggatgagtagcaaagacacattaarcagaataaattatatagtcttgtt

SEQ ID NO: 53136 - DNA, 50 bp, homo sapien
ctttttccctcatttgaatcctgaargcatgtaatatttaaacaactttc

SEQ ID NO: 53137 - DNA, 50 bp, homo sapien
tgtgtcgtttctatgagatgcacagyagatattggaagttagccataaaa

SEQ ID NO: 53138 - DNA, 50 bp, homo sapien
gaggtccaaagatgaaaatgttgtaycctagtgaaggtgatgggcttgca

SEQ ID NO: 53139 - DNA, 50 bp, homo sapien
gttccaagatcaaaggcttatcatcragggactacatatggttagaatct

SEQ ID NO: 53140 - DNA, 50 bp, homo sapien
tcaaaccattgcgacttctttgtcartcctggctgtgctctgaagccagg

SEQ ID NO: 53141 - DNA, 50 bp, homo sapien
tgccaaaataagatacaacactaagrataatatatgggctcatgaagctc

SEQ ID NO: 53142 - DNA, 50 bp, homo sapien
cctaacttaagtgggcacctcataarggttctcattagtaatactgtact

SEQ ID NO: 53143 - DNA, 50 bp, homo sapien
tcatgaatcttattttgccttatgcyacaaacattgcatggccatacaca

SEQ ID NO: 53144 - DNA, 50 bp, homo sapien
caccactgattttcattataattaamcctacagtgatggatgaggtgtgt

SEQ ID NO: 53145 - DNA, 50 bp, homo sapien
cagcatgaacaagaactactcaaagycttggaaaccacaaggaatggcct

SEQ ID NO: 53146 - DNA, 50 bp, homo sapien
ttaatcaattcttttttgccctcacygtactttgctcagattttatcata

SEQ ID NO: 53147 - DNA, 50 bp, homo sapien
atccctggtaccctcatctttgctcyacgctactttcttacaaaagcaag

SEQ ID NO: 53148 - DNA, 50 bp, homo sapien
gctgcatacatcctgatttatattcratgagagttataaaaggcttttat

SEQ ID NO: 53149 - DNA, 50 bp, homo sapien
gtcatgtgatccaatttagaaaacartaacacagtgtgccaaataatact

SEQ ID NO: 53150 - DNA, 50 bp, homo sapien
actatttatcaatgtacaaagcacartgatatgaataaaaatacaaatgt

SEQ ID NO: 53151 - DNA, 50 bp, homo sapien
gccaaaatacccaagggtagatttayaccagtttatacaaatatggcaca

SEQ ID NO: 53152 - DNA, 50 bp, homo sapien
aatttttttgtgaaatttaatgatcratttttggatccttattcatgtag

SEQ ID NO: 53153 - DNA, 50 bp, homo sapien
taagggacctttcctatcccaactckctggacttatatatacacacatag

SEQ ID NO: 53154 - DNA, 50 bp, homo sapien
aatgtttacataagagattatttccrgatgtaagaattagaggggaattt

SEQ ID NO: 53155 - DNA, 50 bp, homo sapien
agggtaggaggtagaagaattcacartacaacctaataatctgggccatg

SEQ ID NO: 53156 - DNA, 50 bp, homo sapien
ctgtacataatggctcatctttatcwaattttttcctgttttgggaagtg

SEQ ID NO: 53157 - DNA, 50 bp, homo sapien
aggaaaacaataaatataaccaaagwaaagctattctaagtaaaggaaca

SEQ ID NO: 53158 - DNA, 50 bp, homo sapien
tggctcaatgcctcatggattataartgctcaacaaatgctagatgtagt

SEQ ID NO: 53159 - DNA, 50 bp, homo sapien
atcttcttgccccaccatcctatcayatgactttttcttcacggtggctg

SEQ ID NO: 53160 - DNA, 50 bp, homo sapien
catttcatagatctttacaatgtcasactgttgctccagcttatttagaa

SEQ ID NO: 53161 - DNA, 50 bp, homo sapien
ttgtctatacgtttatatcttcaccrgcaatatgcattttagctgttcta

SEQ ID NO: 53162 - DNA, 50 bp, homo sapien
cctaggatagtctctggccttcatckatgcatccactcatgcattaactg

SEQ ID NO: 53163 - DNA, 50 bp, homo sapien
aagaaaatctggtgaaactactttaraacaattgtataggaaagcattac

SEQ ID NO: 53164 - DNA, 50 bp, homo sapien
tctttataatacccaggatgtcttgwaacttttaccttacaattctgtga

SEQ ID NO: 53165 - DNA, 50 bp, homo sapien
agcagggaaggaggaaaaagaggagratttagtgtgtcctatgtaaggca

SEQ ID NO: 53166 - DNA, 50 bp, homo sapien
tgttcaggtcacttctaatctcaatwacctatgatttccaataattcatt

SEQ ID NO: 53167 - DNA, 50 bp, homo sapien
gttttcttatttctagaactaaaackctttaaagtgtctagatgtctttc

SEQ ID NO: 53168 - DNA, 50 bp, homo sapien
ttaagaacctaccatgtgcaaaaaamgtgctgcaaaaacacgagttaaga

SEQ ID NO: 53169 - DNA, 50 bp, homo sapien
atagttgtaaagattttgaaaatagycacagaagttggttatcactttgt

SEQ ID NO: 53170 - DNA, 50 bp, homo sapien
atttggcagttcattataaaattaargtagtctagataatatcaagactc

SEQ ID NO: 53171 - DNA, 50 bp, homo sapien
aaaacacttttaccagatcagtatcmctacaaaacctgtcttgctcatca

SEQ ID NO: 53172 - DNA, 50 bp, homo sapien
atcttgtaataagaatttgtcatcaygttctgttttgtgattttgctgtt

SEQ ID NO: 53173 - DNA, 50 bp, homo sapien
tattgtgaaaacattgcttaagaagraaaccctcaagtgagaaaaacaaa

SEQ ID NO: 53174 - DNA, 50 bp, homo sapien
ctgcaatatttatttcaactagcaargtgttatttcagatgaaactagtc

SEQ ID NO: 53175 - DNA, 50 bp, homo sapien
agttatacaagagctggtagttctcmaagacttttaaagctgaagatcac

SEQ ID NO: 53176 - DNA, 50 bp, homo sapien
aacatttcagttaagctgcttatgaraataattaggccagtgaagcgagg

SEQ ID NO: 53177 - DNA, 50 bp, homo sapien
cccattgtgggcaatactggtggaayaataaatcaggtgctctaacctcc

SEQ ID NO: 53178 - DNA, 50 bp, homo sapien
agcaacaaaactgtgaataccttcakgttcttggattataagcaataggg

SEQ ID NO: 53179 - DNA, 50 bp, homo sapien
tcataaaacaccagcatctgagtcaytatgttccatcttactaagtaatt

SEQ ID NO: 53180 - DNA, 50 bp, homo sapien
tgacaccaacgcagggaccagtaccyataaactgtattactagctacatc

SEQ ID NO: 53181 - DNA, 50 bp, homo sapien
gaaagaccaaagagttggctggctayctaagtgccttgctgagcctggtc

SEQ ID NO: 53182 - DNA, 50 bp, homo sapien
ttcatgtttctgtacccagtggtaartctattttcagctcacactctaat

SEQ ID NO: 53183 - DNA, 50 bp, homo sapien
ttacttcacagaacttgttctgagtraagattaaaatatagatctctgga

SEQ ID NO: 53184 - DNA, 50 bp, homo sapien
ttcagatttttaaatagtgctgcaartaaattctcctaacgtgtaacaac

SEQ ID NO: 53185 - DNA, 50 bp, homo sapien
aatcctcatactgtctcctctcaggrattaagtctttagcttaggtcagt

SEQ ID NO: 53186 - DNA, 50 bp, homo sapien
ttagctcaaattctggctctccctgyaaaggagcgatggtggtaatttgg

SEQ ID NO: 53187 - DNA, 50 bp, homo sapien
accatatcagttgatatagtggtgamctgaataaaatgttactgaagcac

SEQ ID NO: 53188 - DNA, 50 bp, homo sapien
cacacaggctaaatgtaggatactcrccctggaggcatgacttgggattt

SEQ ID NO: 53189 - DNA, 50 bp, homo sapien
cttagctgatgctcatggatccaaamcatcaatagtaagttactaagcct

SEQ ID NO: 53190 - DNA, 50 bp, homo sapien
gtttatacctagaccagtcaacaaayatcaaacagtaagtggtgtcactt

SEQ ID NO: 53191 - DNA, 50 bp, homo sapien
attttgattttgttagcaaaattcaygacagagtaaaaataatttgggtt

SEQ ID NO: 53192 - DNA, 50 bp, homo sapien
tgtctatggaaccataatttattaayccttgctctgttaagtaaaagcct

SEQ ID NO: 53193 - DNA, 50 bp, homo sapien
ttgtttctcagaaatgggaatcccamgtgtatttaaagtgatgaaaagtt

SEQ ID NO: 53194 - DNA, 50 bp, homo sapien
agactctcagttcttactggtgaaaygaccaaccacatgtaagcgtgtag

SEQ ID NO: 53195 - DNA, 50 bp, homo sapien
atgaaaattatggatttggctctgaygcaaaataaagtaagcttcctata

SEQ ID NO: 53196 - DNA, 50 bp, homo sapien
aagaccaaagagattttactccaccragcacatagcatttcactccaaaa

SEQ ID NO: 53197 - DNA, 50 bp, homo sapien
atgactcagtgctatgcagatagaayggttttccttctccaataaagcat

SEQ ID NO: 53198 - DNA, 50 bp, homo sapien
ggtttccggggaccacaatgaacaasttgctgtgctgcgcgctcgtggta

SEQ ID NO: 53199 - DNA, 50 bp, homo sapien
atgcttcccctagggtgtccttttamgctgcaaagttcctgctgacttta

SEQ ID NO: 53200 - DNA, 50 bp, homo sapien
tacgttcatgcttctctcttgagacragatgccacacaatgtaaggtaaa

SEQ ID NO: 53201 - DNA, 50 bp, homo sapien
ttcatctcctcttttctgctcttagycagtctctgctgccctttacctca

SEQ ID NO: 53202 - DNA, 50 bp, homo sapien
ccaaacttctttccctagaatatacrgaaacaacccagctttccacaggc

SEQ ID NO: 53203 - DNA, 50 bp, homo sapien
aaaccagccctgtgtgtgaaggaaaygtcatcggcactgagtagccagtc

SEQ ID NO: 53204 - DNA, 50 bp, homo sapien
ggattctgcttttctccatcactaaygtttggctctcttcagagtgaagg

SEQ ID NO: 53205 - DNA, 50 bp, homo sapien
ttcgcatcagtctttataatctccaygacaaaaatgaaacaaataacaac

SEQ ID NO: 53206 - DNA, 50 bp, homo sapien
aacatatgagtaaaccatcagataarcatgggaagtcagcctgcgaagtc

SEQ ID NO: 53207 - DNA, 50 bp, homo sapien
gctctccagatggtttttgatcttaygtctcgaaggatctctctttttct

SEQ ID NO: 53208 - DNA, 50 bp, homo sapien
aatcctggtcctctgcttactaagayggcaacttcagacaagttccttaa

SEQ ID NO: 53209 - DNA, 50 bp, homo sapien
taacataagtgattagtgtaagataygattttaaatggaaagatgtgata

SEQ ID NO: 53210 - DNA, 50 bp, homo sapien
aagacttagaatgatgttgtgtatayagcaagtagtcagtgaatattgcc

SEQ ID NO: 53211 - DNA, 50 bp, homo sapien
ctaaaactataaagaggacctaaacygagactggagaagtcactagtagc

SEQ ID NO: 53212 - DNA, 50 bp, homo sapien
gactgaaaaagtgaatgaacgaaaakgttgctaccaacataggcattata

SEQ ID NO: 53213 - DNA, 50 bp, homo sapien
tctacctgaatttaaaagacttttgracaagaatctatcattgcagtttg

SEQ ID NO: 53214 - DNA, 50 bp, homo sapien
cacagtagagcatctgtggccactgyagttaaggtgaaaaggaaaaagga

SEQ ID NO: 53215 - DNA, 50 bp, homo sapien
aacataattctatgtaagtttgagcyctgatttaccaaaattcctttact

SEQ ID NO: 53216 - DNA, 50 bp, homo sapien
ttcatttttcagttaacagggagtamcttcagtatttttctttaaatatt

SEQ ID NO: 53217 - DNA, 50 bp, homo sapien
tatcaatagttaaatcatttatctayacttaaggccatctctttgaaatc

SEQ ID NO: 53218 - DNA, 50 bp, homo sapien
agagtaagttttggacttggacaaartgagaactgaggaggattttggtg

SEQ ID NO: 53219 - DNA, 50 bp, homo sapien
tttgactagtaattgaaagatgaaawtaagctcgggtttttcctacaatc

SEQ ID NO: 53220 - DNA, 50 bp, homo sapien
tcctcttattttacctagtatcacargcagagagaaggtggtatctggct

SEQ ID NO: 53221 - DNA, 50 bp, homo sapien
atcgtacagaaaccatgtcttattcmctgttagtccattccatcatgatg

SEQ ID NO: 53222 - DNA, 50 bp, homo sapien
acactttataaactctgaaatgctaygtaaacttaagagattagcatatt

SEQ ID NO: 53223 - DNA, 50 bp, homo sapien
ggcaaagcttcacagaggacacaccraggaggctgaatctggaaaggtga

SEQ ID NO: 53224 - DNA, 50 bp, homo sapien
catgctagatagacaagacccaaaartgacctaaagtcagagtttgggat

SEQ ID NO: 53225 - DNA, 50 bp, homo sapien
tttcctagctgctctttcttccacastgtaagtcatctggtattagaaat

SEQ ID NO: 53226 - DNA, 50 bp, homo sapien
ttgtctatcaaacaggaagccttaaytggagatgaagatttagaaaaggg

SEQ ID NO: 53227 - DNA, 50 bp, homo sapien
catcacctgtgatcaagtgcaaacasgtcttcaccctacctgcaccctta

SEQ ID NO: 53228 - DNA, 50 bp, homo sapien
cctggggaagttttttcaaagtagayatattcccagaaccactactgtaa

SEQ ID NO: 53229 - DNA, 50 bp, homo sapien
ggagactcaaacaaggctggaaatargtaggtgccaagaagaactgagat

SEQ ID NO: 53230 - DNA, 50 bp, homo sapien
tcagcatagggccctgggcttacaayggtgccatgagccttagaacagag

SEQ ID NO: 53231 - DNA, 50 bp, homo sapien
gtttgcaggaacctcataagacatargtccaaactattgtgggattatca

SEQ ID NO: 53232 - DNA, 50 bp, homo sapien
tagattgccagagcagccctgtatargcatcatctctacaaacattgaca

SEQ ID NO: 53233 - DNA, 50 bp, homo sapien
cctgaagtggacctaatcattcttayactgtcattccactggctagtggt

SEQ ID NO: 53234 - DNA, 50 bp, homo sapien
ctactttatattccactgggttatakacctggattctcaagcctactaga

SEQ ID NO: 53235 - DNA, 50 bp, homo sapien
cgattgagaaaaaggagtcagtgtaygaggaaacactaacatttcccaaa

SEQ ID NO: 53236 - DNA, 50 bp, homo sapien
ctgcctggaagacttttccctcctcrctgttagcctaaactctactcttt

SEQ ID NO: 53237 - DNA, 50 bp, homo sapien
ggccatcccatctatggaaacacgaygtaatattccccaacctgtcaagt

SEQ ID NO: 53238 - DNA, 50 bp, homo sapien
ctgactcttctgcctctctcacaaayatttaaggatgtttgtgaatacac

SEQ ID NO: 53239 - DNA, 50 bp, homo sapien
atcaaaactggatggaacccattaaktgcctttatgaccttttaaaataa

SEQ ID NO: 53240 - DNA, 50 bp, homo sapien
tatagtcatgccatctagaacatacracctccagggtcaccaaggcagag

SEQ ID NO: 53241 - DNA, 50 bp, homo sapien
ctctgggtctgtgtgaagaccaagarctgggaacagaagcagggctctag

SEQ ID NO: 53242 - DNA, 50 bp, homo sapien
tagctgcattgagttatgctgtctaygttaaagaaacatgaccataacaa

SEQ ID NO: 53243 - DNA, 50 bp, homo sapien
ccaggagggttcagcgtgccaggccrattctcagaactgcacagattaat

SEQ ID NO: 53244 - DNA, 50 bp, homo sapien
attcgtatgttcagtaaagttgaagwaacccagctctgaagacactaaat

SEQ ID NO: 53245 - DNA, 50 bp, homo sapien
tcaaagcataaagcgtaaatcaacamccaggtttagaaactctttctaac

SEQ ID NO: 53246 - DNA, 50 bp, homo sapien
atgctttccgtattacaagcaagaarttcagattccaggacatcaatatg

SEQ ID NO: 53247 - DNA, 50 bp, homo sapien
aagaagttcagattccaggacatcartatgtgtttgttcacatgtggctt

SEQ ID NO: 53248 - DNA, 50 bp, homo sapien
gcatgtgtgcctgtctcccttgttamacataaacagtaagctcctggagg

SEQ ID NO: 53249 - DNA, 50 bp, homo sapien
cagggtgtgagaggactctttcatayggtgtgcatggaagtgaggcaaag

SEQ ID NO: 53250 - DNA, 50 bp, homo sapien
caactatcacaatactttaaagcagrcaacaaactttcaaaacagcctca

SEQ ID NO: 53251 - DNA, 50 bp, homo sapien
gtatatgaagagagtagcccatggamatcattcaataatttgatattatt

SEQ ID NO: 53252 - DNA, 50 bp, homo sapien
agggaggaaacaaatctgacaatcaraaagagattgactgtggtttatta

SEQ ID NO: 53253 - DNA, 50 bp, homo sapien
actttctcccaaagacaattggccayggttctacctcttactttatcatg

SEQ ID NO: 53254 - DNA, 50 bp, homo sapien
gagttcattagaaaatgttgtatacrataagtcaaatcggcaatcatttt

SEQ ID NO: 53255 - DNA, 50 bp, homo sapien
cacggttctacctcttactttatcaygaattcaggaagactggctgttcc

SEQ ID NO: 53256 - DNA, 50 bp, homo sapien
ggttgttgagacagaaggaagtttgragtcaaataagccaatcccttgca

SEQ ID NO: 53257 - DNA, 50 bp, homo sapien
ataggaaaaaaaatgtgttgtcttamcaagaaaggactagtccattttgc

SEQ ID NO: 53258 - DNA, 50 bp, homo sapien
gttcctttgccccaggggacatggastaatttatattattgataactttg

SEQ ID NO: 53259 - DNA, 50 bp, homo sapien
ttctttaaattctcaaagactttcaygacccagaaaatgttgagaatcat

SEQ ID NO: 53260 - DNA, 50 bp, homo sapien
aaagtaaaatgaaaaatgaagtcacygctatttgcaaggcaaaacagaca

SEQ ID NO: 53261 - DNA, 50 bp, homo sapien
atgatagtcttttacagaaacactaratgagacctgagacttgtccggtg

SEQ ID NO: 53262 - DNA, 50 bp, homo sapien
tgcggcaaggtcatgacttgaaacaygtcttttgttaacttaaatcatac

SEQ ID NO: 53263 - DNA, 50 bp, homo sapien
atagctaagcttctaatttcttataygtaatttgaggatgatacctacct

SEQ ID NO: 53264 - DNA, 50 bp, homo sapien
ctggtctcctaggacttcttagactyaacaatatgtaataaaatttatca

SEQ ID NO: 53265 - DNA, 50 bp, homo sapien
atgttcctgttaactgaagacacaaygagaggcctggcttaggcaaaagc

SEQ ID NO: 53266 - DNA, 50 bp, homo sapien
tatgcagtcatctatgttacatctaycctgcctaagaaaaagctgcacat

SEQ ID NO: 53267 - DNA, 50 bp, homo sapien
aatgggaaagaaatggacgtagaaaycatgacttggaagcagaagttgag

SEQ ID NO: 53268 - DNA, 50 bp, homo sapien
gagggaagggagggtagaaagatccrccagtcggaccgagtgtggcttca

SEQ ID NO: 53269 - DNA, 50 bp, homo sapien
tcactgatgaagtcacttggtgacartcttttaatgtaaagagccttaaa

SEQ ID NO: 53270 - DNA, 50 bp, homo sapien
ctctgagacaatgtggcgataacaaygcaaaggctctccttcaaccctta

SEQ ID NO: 53271 - DNA, 50 bp, homo sapien
gtccaatattcaattttatgtacaaracccaattatggtatcatggcaat

SEQ ID NO: 53272 - DNA, 50 bp, homo sapien
cttataaactttttgtagttacagayggaaacagaaggctttaccagaat

SEQ ID NO: 53273 - DNA, 50 bp, homo sapien
ggcactattctggcaacaaggtagakgaactggaatatgcaaaggtttag

SEQ ID NO: 53274 - DNA, 50 bp, homo sapien
tgaaactggagcatttgcttaatcaraaggaacagtgcaccaggggaaat

SEQ ID NO: 53275 - DNA, 50 bp, homo sapien
tgatgtcatggtaataagtggaacartgaccataataagtacctaatgaa

SEQ ID NO: 53276 - DNA, 50 bp, homo sapien
tcttcctagtcagaagtcaagcaaayggttaaaagtgttaataaaacatc

SEQ ID NO: 53277 - DNA, 50 bp, homo sapien
tctaagttgtgtctcctcagcccagyagttgtggctcctcatcactagga

SEQ ID NO: 53278 - DNA, 50 bp, homo sapien
caaaggctctcagagtgttgtgctamcatcgtaaatggctaaacatccaa

SEQ ID NO: 53279 - DNA, 50 bp, homo sapien
aagcaatagaacaagcacagaccackctaacatgttcaagtctcgggagc

SEQ ID NO: 53280 - DNA, 50 bp, homo sapien
ccattaagaaaatgagatcactttgratgagaaaaagtcgagactctggg

SEQ ID NO: 53281 - DNA, 50 bp, homo sapien
agatgaaaaggagtaaccagcttcaygtaggatcttctttcagacagctg

SEQ ID NO: 53282 - DNA, 50 bp, homo sapien
actggcagagaaagtgaattctctaycgtaaagccctgttagacctttgt

SEQ ID NO: 53283 - DNA, 50 bp, homo sapien
tttgttcgtttgtttgttttttcacygaaatgagagttctttcaggatag

SEQ ID NO: 53284 - DNA, 50 bp, homo sapien
taagaatcaatatgatgcaaagataygaagtcctctggatgatacaaaac

SEQ ID NO: 53285 - DNA, 50 bp, homo sapien
ccaggaaaacatcaaaaatctctcasaaacaaagtgaagaggaagaaagt

SEQ ID NO: 53286 - DNA, 50 bp, homo sapien
ggatgatacaaaactacctacatgayagattcagcagtaagaaaagcaaa

SEQ ID NO: 53287 - DNA, 50 bp, homo sapien
aagttccactcctctgtaagccatakgtcaattcttttcagtaaattaag

SEQ ID NO: 53288 - DNA, 50 bp, homo sapien
gaagcaaaacaacatggtaatcctaraagtaaaagttgctgaagttaacc

SEQ ID NO: 53289 - DNA, 50 bp, homo sapien
agcccagaggggcaggcttgaatgcmgagagtagagccaagatcccagag

SEQ ID NO: 53290 - DNA, 50 bp, homo sapien
tcattaaatgcacatcctctgaaacygcaattttacctctaggaaacttt

SEQ ID NO: 53291 - DNA, 50 bp, homo sapien
aatgcgcacgtatgtctttatatacrgatagcttttaacaaatagcaggt

SEQ ID NO: 53292 - DNA, 50 bp, homo sapien
gaatagaaagttagtagggaattgayatttagattcaactaaaatttaat

SEQ ID NO: 53293 - DNA, 50 bp, homo sapien
tttaatctcaactcattcaacttacraaggaaacacctgagacccaggga

SEQ ID NO: 53294 - DNA, 50 bp, homo sapien
acattctcttttcattatacaaaaayggccttagcaaattgagggcagga

SEQ ID NO: 53295 - DNA, 50 bp, homo sapien
cctgggcttccgtttttccacctcawactcaggaaagacaaggatggacc

SEQ ID NO: 53296 - DNA, 50 bp, homo sapien
caacttaaatactattgaaaacacartaaatgtacgcattagaaatgttt

SEQ ID NO: 53297 - DNA, 50 bp, homo sapien
tctctctcccaggaggtaattaacarcatatccagtgggacatcattgaa

SEQ ID NO: 53298 - DNA, 50 bp, homo sapien
ggcagaaaaaggcttttcttttataygaaggagagaacaaggctagaaag

SEQ ID NO: 53299 - DNA, 50 bp, homo sapien
caggtctgtaaatctccattcttcamcactttccattttctccctagatt

SEQ ID NO: 53300 - DNA, 50 bp, homo sapien
cctgggaatgataagtatcaaagtcrgaaagtggttacccttgggaagag

SEQ ID NO: 53301 - DNA, 50 bp, homo sapien
cacaattattattgaaagagatcagwatataccaccaccataaaaatatg

SEQ ID NO: 53302 - DNA, 50 bp, homo sapien
tctgaagccacgatacctactgatarcatccagggttggccacctagtga

SEQ ID NO: 53303 - DNA, 50 bp, homo sapien
gttctgacttaaagcaaaaatacacrgcatagattgcaacagcaaagaag

SEQ ID NO: 53304 - DNA, 50 bp, homo sapien
acctaaacaccctaataactgtgaaytgaacacgtgaaaattgatatgga

SEQ ID NO: 53305 - DNA, 50 bp, homo sapien
aacacaattctagaaaccaaattccyagtctctaagatgtccaaccagta

SEQ ID NO: 53306 - DNA, 50 bp, homo sapien
ggtatgtcacaaactttcatgatcaratagcactacagaggtcaggatct

SEQ ID NO: 53307 - DNA, 50 bp, homo sapien
taacaaggtgagctgagatagagaayatggaactggtgctgaactatatc

SEQ ID NO: 53308 - DNA, 50 bp, homo sapien
tcttccctccagacttgactcagatsataccagctctatgaagccttcat

SEQ ID NO: 53309 - DNA, 50 bp, homo sapien
gatactgcccttttgtcagtgcaacraaaacattaagcatgctgtctgga

SEQ ID NO: 53310 - DNA, 50 bp, homo sapien
actgctattcttatgtaatcctccaygtcattcttatgatttcaatcctg

SEQ ID NO: 53311 - DNA, 50 bp, homo sapien
tcaaagtaatcataagtttcaattcraatgttcctattacttgctctatc

SEQ ID NO: 53312 - DNA, 50 bp, homo sapien
taacagctgctttttttgattgtaayggattgaacaggatttctgctata

SEQ ID NO: 53313 - DNA, 50 bp, homo sapien
tgaccatgtgatggatctttggaacrgaattgggcaaatgggcaatggca

SEQ ID NO: 53314 - DNA, 50 bp, homo sapien
tcagagtagagtcaacccaactctargaaaacagcaaactggtttatgct

SEQ ID NO: 53315 - DNA, 50 bp, homo sapien
acacttgatgatttaggcctaagaakgagcctcataagatttgttcagac

SEQ ID NO: 53316 - DNA, 50 bp, homo sapien
ccacactgacaagcgctgggctagargtgtaagtaaatgaaggtgagctg

SEQ ID NO: 53317 - DNA, 50 bp, homo sapien
cacagttagaattagtaggagaacgwcattgataatgttaatgataccgg

SEQ ID NO: 53318 - DNA, 50 bp, homo sapien
ctgtcttcatatctaatgagaggaaratggtaagttggtgagtgattgca

SEQ ID NO: 53319 - DNA, 50 bp, homo sapien
cttcctagcagatgccaatattgtaycttgttctaataagaatagtttat

SEQ ID NO: 53320 - DNA, 50 bp, homo sapien
cagaaagtacatggaacagtgttagracaaatgaaggaaaaacaaactaa

SEQ ID NO: 53321 - DNA, 50 bp, homo sapien
accttcatttaagtcttacatcaacyctgcaaagtagctttgtttccatg

SEQ ID NO: 53322 - DNA, 50 bp, homo sapien
ggcaagagcttagaatttttgagcaytacgttgtactgtctcccaggaaa

SEQ ID NO: 53323 - DNA, 50 bp, homo sapien
aaaaatgaaaatgttgcactagatamtaggtgagcagaagaaaaaaaaaa

SEQ ID NO: 53324 - DNA, 50 bp, homo sapien
accaaaatgtctgtaaacaatcaccrgctgagagacagaacagagatttt

SEQ ID NO: 53325 - DNA, 50 bp, homo sapien
caaacttttatatgacagaaggtgasaatgttatttctgaaaacgtagag

SEQ ID NO: 53326 - DNA, 50 bp, homo sapien
atctcattattttaactgtaaagtartacattgctaagtggagtcgagaa

SEQ ID NO: 53327 - DNA, 50 bp, homo sapien
agagtagtagagggtaaaggaggacraaatgctatagctgctttttggcc

SEQ ID NO: 53328 - DNA, 50 bp, homo sapien
ctagatttttgcaaccgtatccaaayattctaaagttgtatagtccacac

SEQ ID NO: 53329 - DNA, 50 bp, homo sapien
ttaggtcccacctcttctctttctaygtaaatcttggatattcttggatg

SEQ ID NO: 53330 - DNA, 50 bp, homo sapien
tctccaggacctgagggtggaatccrgccaacagctatccagaagctggg

SEQ ID NO: 53331 - DNA, 50 bp, homo sapien
ataagccttccaaaagtactgaggcygataatgtaatttcattctgctaa

SEQ ID NO: 53332 - DNA, 50 bp, homo sapien
tgcaaattttaaatcaaggttgatascattatcagacaataaacacttgt

SEQ ID NO: 53333 - DNA, 50 bp, homo sapien
tactttcctattcattaaatctcackctgggcattacttctgttggttcc

SEQ ID NO: 53334 - DNA, 50 bp, homo sapien
tgggtggagcctcaagaacattgacyggttgtctgtaaatcagtatagaa

SEQ ID NO: 53335 - DNA, 50 bp, homo sapien
tcaattcctcctgcccttcaagccaragataaagacatccaaacagcccc

SEQ ID NO: 53336 - DNA, 50 bp, homo sapien
ggtttcatcacagccattcttagccrcttattggctctgctaactctcag

SEQ ID NO: 53337 - DNA, 50 bp, homo sapien
aaagtagagtgggtaaagttagatayagaccaacttcacagttaggcaga

SEQ ID NO: 53338 - DNA, 50 bp, homo sapien
aaagaattttattaagcgaagaagamaagcagaacatagaattttagcta

SEQ ID NO: 53339 - DNA, 50 bp, homo sapien
agttcgtggaaactattcataccaayactttagaagtggaggaccaataa

SEQ ID NO: 53340 - DNA, 50 bp, homo sapien
aaaggctctgagcagggggtgatacrctctagtttgcatattgaaaagat

SEQ ID NO: 53341 - DNA, 50 bp, homo sapien
aattcaattaagactgatactaaagsctttaatcactgctctgttctata

SEQ ID NO: 53342 - DNA, 50 bp, homo sapien
tagaatcactttgccaagttccaaartttaaagacgaaaacaaaacaaaa

SEQ ID NO: 53343 - DNA, 50 bp, homo sapien
acatccagtatttcactttattttayatttatgcatgggtacatatttat

SEQ ID NO: 53344 - DNA, 50 bp, homo sapien
ttactggccacttgcaaacttcagamtatagtggaaattttatgttttaa

SEQ ID NO: 53345 - DNA, 50 bp, homo sapien
agctttcttatctgtaatcaacaacmagttatattgatataaggaaagaa

SEQ ID NO: 53346 - DNA, 50 bp, homo sapien
aatgaaaagacaggaagtccacaaaractattttataagaccaatggaat

SEQ ID NO: 53347 - DNA, 50 bp, homo sapien
atttgagggtgttgaaaacattttcrctaggtcataaagaaaacataaat

SEQ ID NO: 53348 - DNA, 50 bp, homo sapien
ttcaaacttggctctcagtgcgggcmgaattggcaaaactctgtaatact

SEQ ID NO: 53349 - DNA, 50 bp, homo sapien
gtttgtatctctgaaaattcataagyaaaagagctctgtaattgaaattc

SEQ ID NO: 53350 - DNA, 50 bp, homo sapien
caaggagaagtttaatcaaaataacygagaagcataatcatgagtcaaat

SEQ ID NO: 53351 - DNA, 50 bp, homo sapien
ctgagtagctaagataacacacaacrgattactaactagttctctgcctt

SEQ ID NO: 53352 - DNA, 50 bp, homo sapien
atttcgtttagtgctctttttacaasaagaaacaggtagtccaatgtaag

SEQ ID NO: 53353 - DNA, 50 bp, homo sapien
gataaagttccttcttttctttccaygtgctaatgcaaagattagttgag

SEQ ID NO: 53354 - DNA, 50 bp, homo sapien
aatctgggctcaaatcctgttcccawcgtttcttaattatatgattttag

SEQ ID NO: 53355 - DNA, 50 bp, homo sapien
tatccttagaatcttcacaacttgamctttgcttggataattccggtgaa

SEQ ID NO: 53356 - DNA, 50 bp, homo sapien
attgattaataatatttatgagaggyattgcatttaataaaatatccata

SEQ ID NO: 53357 - DNA, 50 bp, homo sapien
gtatcgtacttaataaaatatgctawctctgatggtcaagcttaagcttt

SEQ ID NO: 53358 - DNA, 50 bp, homo sapien
caactagggtagtgactatatataawtgcacatcactgcaccctactctg

SEQ ID NO: 53359 - DNA, 50 bp, homo sapien
aaagaaagagtagacctgagccaacygaacaacagaggtaaaggcatgaa

SEQ ID NO: 53360 - DNA, 50 bp, homo sapien
ttcccctatttcttgaagaaccaaartctaagggaaactttcaggtttga

SEQ ID NO: 53361 - DNA, 50 bp, homo sapien
agctacttaatattttagcctgaackgttacttttagttaacaaggctta

SEQ ID NO: 53362 - DNA, 50 bp, homo sapien
ctttcttgggacctctgagctaccaygtagaaattcagattacattactg

SEQ ID NO: 53363 - DNA, 50 bp, homo sapien
aagattaaaaaccactgtcaagagckgaaaagtaataaaagtaacttcag

SEQ ID NO: 53364 - DNA, 50 bp, homo sapien
ttaccatttacatttttaactaagcyaaatgtattttcaaataaattata

SEQ ID NO: 53365 - DNA, 50 bp, homo sapien
aggatggactttaatgcatctaatawgcagcttcttaccatctatctaat

SEQ ID NO: 53366 - DNA, 50 bp, homo sapien
agctgggggaaaaaaagacaaatgaraagatagcttagatagcactgtgg

SEQ ID NO: 53367 - DNA, 50 bp, homo sapien
ggtgggaaaattacagagttagaaayataagggagctggcccaaactcat

SEQ ID NO: 53368 - DNA, 50 bp, homo sapien
taacaccttacctctgacgaatgtcratcctcatgatataggagttaaga

SEQ ID NO: 53369 - DNA, 50 bp, homo sapien
gggatcacttcctgcagaagtgacawcggagctgagtcctcaggaagtgt

SEQ ID NO: 53370 - DNA, 50 bp, homo sapien
gagtccaatctccaagttcagaaaaygggatcaaaatgatgttcttcatc

SEQ ID NO: 53371 - DNA, 50 bp, homo sapien
aggggattttaattgctgttatccaygacatatagtcagtgttaaataaa

SEQ ID NO: 53372 - DNA, 50 bp, homo sapien
taatctgcaaaagacattgacctcasaagaaacaattgcaatcaggttct

SEQ ID NO: 53373 - DNA, 50 bp, homo sapien
tatcttagagtaaaattttcctttaygtatctactgttaattaggggatt

SEQ ID NO: 53374 - DNA, 50 bp, homo sapien
caagatctgcacaatcaaatgaagayatagtcaaggcaaaatattaagag

SEQ ID NO: 53375 - DNA, 50 bp, homo sapien
gaaagaaaagtcagttttaaaattargagctagaaaacaagatctgcaca

SEQ ID NO: 53376 - DNA, 50 bp, homo sapien
gatcttactaatcacaaccgagtaawgtaacagactttcataactccagc

SEQ ID NO: 53377 - DNA, 50 bp, homo sapien
cattgttctctatagttttgctccartaggtcaaggatatactagtatat

SEQ ID NO: 53378 - DNA, 50 bp, homo sapien
aaaaggggtttactgcaaatatatgyattagaccacagattgctgcactc

SEQ ID NO: 53379 - DNA, 50 bp, homo sapien
ggctagttgataaagtgtatgacggracatgttagcaacatctcattcat

SEQ ID NO: 53380 - DNA, 50 bp, homo sapien
ttacagaaaaagaagtttattcagamaacagcagtagcaccaacatctac

SEQ ID NO: 53381 - DNA, 50 bp, homo sapien
aagtagaagcagagccatggactcaycaagaaacatttaatggcagaaca

SEQ ID NO: 53382 - DNA, 50 bp, homo sapien
ggtggcaggaggtgggacagataaaycacagtttgtgaagagccataaaa

SEQ ID NO: 53383 - DNA, 50 bp, homo sapien
tagggagaagcttttactgagaaatragccacatggctccacagccagcc

SEQ ID NO: 53384 - DNA, 50 bp, homo sapien
agagtccctgcaagctgctgcctaawcagcaattgatcctttacttatcc

SEQ ID NO: 53385 - DNA, 50 bp, homo sapien
ctgtagccagatgagtaaagataaaygttcccacctggaggtgaaatcaa

SEQ ID NO: 53386 - DNA, 50 bp, homo sapien
gtgaatccaaaaactattctcagtargtctaaaagcctctttactgctca

SEQ ID NO: 53387 - DNA, 50 bp, homo sapien
aaattatagtagtatttgaccaaaayagacattagagcttgccagacctc

SEQ ID NO: 53388 - DNA, 50 bp, homo sapien
tttgactgtccaaggggccatttgtkaatcctatacagttctcctgctat

SEQ ID NO: 53389 - DNA, 50 bp, homo sapien
tttgaattttttacatcaaacaagcrattcatatacaccacctcttcagc

SEQ ID NO: 53390 - DNA, 50 bp, homo sapien
aatgtgtaggaaattacccaaaacaytacaagtctcagataacatgaatt

SEQ ID NO: 53391 - DNA, 50 bp, homo sapien
tttccatctcttcattcaggaaaaawtgttggttggacaacggacaatca

SEQ ID NO: 53392 - DNA, 50 bp, homo sapien
aaaaatttataactctattcctaaakaatttgtctgaaatataaaaatct

SEQ ID NO: 53393 - DNA, 50 bp, homo sapien
gttctaatctcatatacgttattaastagacacaaagaccttgagaaagt

SEQ ID NO: 53394 - DNA, 50 bp, homo sapien
gctaagtaatgattgatcagtaacascaatgaaggttttgcggtcccggg

SEQ ID NO: 53395 - DNA, 50 bp, homo sapien
ataccacagatttcaactaacttgaygaggttaatgatgtttaacatttg

SEQ ID NO: 53396 - DNA, 50 bp, homo sapien
tgtattggtttcttcaaatttcaaayggagacttggaccaggtggttcct

SEQ ID NO: 53397 - DNA, 50 bp, homo sapien
acttatcctcatagcttaacccagaygtgacctaagcattttaaaaaaga

SEQ ID NO: 53398 - DNA, 50 bp, homo sapien
tggcccatggtgacttagttcagaaycaagcggaacttagcagcaagaca

SEQ ID NO: 53399 - DNA, 50 bp, homo sapien
gaagtaagttaaatggtaaatctaawcctattctctatgaaaatagtcct

SEQ ID NO: 53400 - DNA, 50 bp, homo sapien
agccctcctaagcaagtgttagctcraaccttctcactcttgctcagatt

SEQ ID NO: 53401 - DNA, 50 bp, homo sapien
ttctggttagtttaatttctaggaamcttagtattctgctatattatgta

SEQ ID NO: 53402 - DNA, 50 bp, homo sapien
gtacatacatgttattttgcctagaycaaaatgggaaaatagtaatcaca

SEQ ID NO: 53403 - DNA, 50 bp, homo sapien
cttagtcatgaaatcaaggcttagawggaccatagaagtaattgtcctgt

SEQ ID NO: 53404 - DNA, 50 bp, homo sapien
caagtcaatgagctctaaactggcaygaattcttacccaagatcataaga

SEQ ID NO: 53405 - DNA, 50 bp, homo sapien
gtaaagctttttttttcataacgtcratattcacacagaggttacagttc

SEQ ID NO: 53406 - DNA, 50 bp, homo sapien
ctccttttaactccagaattaatgasatttaaaagttattcttttatgta

SEQ ID NO: 53407 - DNA, 50 bp, homo sapien
aaaattagcctttctattttcatcaytgaaatcgccatttgtcattctca

SEQ ID NO: 53408 - DNA, 50 bp, homo sapien
tctaatttggagatacaaactcaaaygtgttgtcactgggagccaagaca

SEQ ID NO: 53409 - DNA, 50 bp, homo sapien
tgaatttgacatgaataatggaccayagttagcatgagaaggtaggactg

SEQ ID NO: 53410 - DNA, 50 bp, homo sapien
tggattccctgtcttttgtaattcayactctaggcaaccagagctactct

SEQ ID NO: 53411 - DNA, 50 bp, homo sapien
attatctaaaatctatccattatcastatgatgtgtgtaagttgcattaa

SEQ ID NO: 53412 - DNA, 50 bp, homo sapien
atcagatgagcaatgtgctacattasaaaaagtggtaaaatgataaattt

SEQ ID NO: 53413 - DNA, 50 bp, homo sapien
gccagtgctgggtctgaagccataaytgatttctattttctcccccatct

SEQ ID NO: 53414 - DNA, 50 bp, homo sapien
actggatttaacgtagtaaacaaacygatctgagtgctgtatgagatggg

SEQ ID NO: 53415 - DNA, 50 bp, homo sapien
tctgaatagctctcaggaatttttcyatactcttataatgattatcacat

SEQ ID NO: 53416 - DNA, 50 bp, homo sapien
cagtgactgtctcatagacagacaakctcatagacgaagcccaataaata

SEQ ID NO: 53417 - DNA, 50 bp, homo sapien
ccaagaatttgggaaagggcatgaaygtgtaaactgagtactacagatct

SEQ ID NO: 53418 - DNA, 50 bp, homo sapien
gagacatgctgtgtttcattaggcayggagcgaactttgacatgcaggtc

SEQ ID NO: 53419 - DNA, 50 bp, homo sapien
ggttggtcttgatatgtgactttatyaatcgatcctctgaaaaagacttt

SEQ ID NO: 53420 - DNA, 50 bp, homo sapien
tgttttacattaactgcactatatakaaataaaaagggatgaagctgtga

SEQ ID NO: 53421 - DNA, 50 bp, homo sapien
gtgctacctgtagacattgggaagascttcaaggaagaaatattggagtt

SEQ ID NO: 53422 - DNA, 50 bp, homo sapien
acatactcagtcactctgagaccaawgggcaattagtaataaagtagaca

SEQ ID NO: 53423 - DNA, 50 bp, homo sapien
tctgagtgcactaatatgacaattargctataaggaaaaggaagctttaa

SEQ ID NO: 53424 - DNA, 50 bp, homo sapien
ggagaatgagcactagaggtggaagyaaaagatagattcacatcctattc

SEQ ID NO: 53425 - DNA, 50 bp, homo sapien
gaagggtctaaatgaattctcaatamacagttgacaaaattaaatttata

SEQ ID NO: 53426 - DNA, 50 bp, homo sapien
tgcctttggcaatataaaccttaaaygctcatgaaggcctcacatgagtt

SEQ ID NO: 53427 - DNA, 50 bp, homo sapien
gtcattggagcatccgtctccaaggwcagtaaaacagaactgaaatagaa

SEQ ID NO: 53428 - DNA, 50 bp, homo sapien
tgttataggaatcagaatagaaaacraagtgatagagtgtcttcctcatt

SEQ ID NO: 53429 - DNA, 50 bp, homo sapien
gtgttcactcacagcaccaatttaargcagcttcttagaccaaaaaacaa

SEQ ID NO: 53430 - DNA, 50 bp, homo sapien
ttcattacatctgctcagaaagataragtgccctaccaacacctttgcaa

SEQ ID NO: 53431 - DNA, 50 bp, homo sapien
ataaaacagaaatgcaatgtttttaratcatgttgcattgcaaacagtaa

SEQ ID NO: 53432 - DNA, 50 bp, homo sapien
cttccctcactgacctcgtcctgtawaattatcccttttactcagcacac

SEQ ID NO: 53433 - DNA, 50 bp, homo sapien
aaatttatattgaaccacaagaagcycatatagtcaaaacaaccttgaaa

SEQ ID NO: 53434 - DNA, 50 bp, homo sapien
tggcttaacctttaaacacgtgtagsataccttctgatgttatttccttc

SEQ ID NO: 53435 - DNA, 50 bp, homo sapien
gcctatgctaaaggtgtatttattasagtgtaccattagcgtcaccctcc

SEQ ID NO: 53436 - DNA, 50 bp, homo sapien
gattcattcatgcttgtttccttgaygttttctagacatgttatttttaa

SEQ ID NO: 53437 - DNA, 50 bp, homo sapien
tttatgaaatggtaactattatctayagctgagtaactttcttcaatggc

SEQ ID NO: 53438 - DNA, 50 bp, homo sapien
ttgctgaaaggatgtggtggcatgargaacgtacagctcctgacattgca

SEQ ID NO: 53439 - DNA, 50 bp, homo sapien
cttgttccctgacacttacccaaaasaaatagaggtggattatattaaat

SEQ ID NO: 53440 - DNA, 50 bp, homo sapien
tcagcaaacttgtagctatgatcaaygaataaggctagaagctagagtgg

SEQ ID NO: 53441 - DNA, 50 bp, homo sapien
ctagcaactgtttcattttgtactarattcattttgcctgtgtaaaagtt

SEQ ID NO: 53442 - DNA, 50 bp, homo sapien
tggcttttcctttcttgtagttctckatattggacataaatcttttatta

SEQ ID NO: 53443 - DNA, 50 bp, homo sapien
taaattattctattgtaaagagtaartgacaataccatctgttgccatat

SEQ ID NO: 53444 - DNA, 50 bp, homo sapien
aacttctttgcaaatctctagagacrgaatcgttttgtctgaaaatattc

SEQ ID NO: 53445 - DNA, 50 bp, homo sapien
cagagggcaaagagtattgagaaagwaccttacccatcacagactatttg

SEQ ID NO: 53446 - DNA, 50 bp, homo sapien
actgaaaacgttgagaagtccttgargcccagctgagaccatgccttaaa

SEQ ID NO: 53447 - DNA, 50 bp, homo sapien
tgggacctcttttggccaagtaagasagcagaatttccagggctggagat

SEQ ID NO: 53448 - DNA, 50 bp, homo sapien
ttattggatatatttgcttagagaawctttactgctaggttgctgcctcc

SEQ ID NO: 53449 - DNA, 50 bp, homo sapien
aagttgagcaatttgaccaaggtaaragagctaataaatggcagagagaa

SEQ ID NO: 53450 - DNA, 50 bp, homo sapien
gaaggggcttggagaaacatgagackgcacggaagctcgggccagcttac

SEQ ID NO: 53451 - DNA, 50 bp, homo sapien
attaaaaataaaggaaacacgaatargaaaatataagatgtgcccaaaca

SEQ ID NO: 53452 - DNA, 50 bp, homo sapien
aacgttttgtctcttcataaatttgrattccaatggagaagacaaatata

SEQ ID NO: 53453 - DNA, 50 bp, homo sapien
tttgacctagttttggttgtgctcargatgtggttatacttaactaagct

SEQ ID NO: 53454 - DNA, 50 bp, homo sapien
taccacgaaatttcatgtgtcagaaytgaaatgcaaataatcatgctcag

SEQ ID NO: 53455 - DNA, 50 bp, homo sapien
aatttctggaccaagtgttcatggckaatgagaagaactaatacttattt

SEQ ID NO: 53456 - DNA, 50 bp, homo sapien
ctgaaacttagcagatattgagaaaygactctccaaaatggtggaaccaa

SEQ ID NO: 53457 - DNA, 50 bp, homo sapien
aagcccatcacagccagtttctccayagagttgtgatcagatcactattt

SEQ ID NO: 53458 - DNA, 50 bp, homo sapien
tggtggagctttcttctgaaatgtcrcacaacgcagctgtgtaccctgaa

SEQ ID NO: 53459 - DNA, 50 bp, homo sapien
aacgttatgtttcccagattttccakattgatatatatctttccaattca

SEQ ID NO: 53460 - DNA, 50 bp, homo sapien
acaggtgcctgccaccttacacagtkaattttgtatttagtagagagggg

SEQ ID NO: 53461 - DNA, 50 bp, homo sapien
ttgcaaagtgacactctaaaattaayagggctgatttgaaaactagactt

SEQ ID NO: 53462 - DNA, 50 bp, homo sapien
atagtgctctatatatctatccctgraaaatctcatgtttgcaaagtgac

SEQ ID NO: 53463 - DNA, 50 bp, homo sapien
atatgtataacgaaagctatatcaawggaaccattctctagctgtgagaa

SEQ ID NO: 53464 - DNA, 50 bp, homo sapien
gctgcatcggataaccacacagtgayagatgtccagacactacagacaag

SEQ ID NO: 53465 - DNA, 50 bp, homo sapien
ggcataagttctttggccttgcagaygttgagcaaggagtggtgggttta

SEQ ID NO: 53466 - DNA, 50 bp, homo sapien
aaagtaagtattcaataggagtttgmataaagagtgccatgataaaaaat

SEQ ID NO: 53467 - DNA, 50 bp, homo sapien
cttttatagagaaagacaatgataaygagaacattggaagacttgcttca

SEQ ID NO: 53468 - DNA, 50 bp, homo sapien
ttctatgtgccagtctctgtgctaayattaaagatactcaagtaaagcag

SEQ ID NO: 53469 - DNA, 50 bp, homo sapien
tctatgtagagtccagagcttgtgartagagacaagattgtgacagataa

SEQ ID NO: 53470 - DNA, 50 bp, homo sapien
tggtaaatgtcaacattgtatttccrgattgatgtactttgattttatat

SEQ ID NO: 53471 - DNA, 50 bp, homo sapien
ggtttatcagaagacagtaagtagaytagtaataaggcagtcttttataa

SEQ ID NO: 53472 - DNA, 50 bp, homo sapien
ataatcctcacattgctggtttacakgtccacttcctcttacctcacctt

SEQ ID NO: 53473 - DNA, 50 bp, homo sapien
tcttcccatttcaggtcactcaacaygaagtttaaaaatatacttcggat

SEQ ID NO: 53474 - DNA, 50 bp, homo sapien
ttggacttttcctattctattatccyctgatgaagcactaaaccgagttc

SEQ ID NO: 53475 - DNA, 50 bp, homo sapien
tatgcattcagctcctttccaaaccrctagtcatttgcccagcgggccat

SEQ ID NO: 53476 - DNA, 50 bp, homo sapien
attttctaaatcatgattgtgattasgccatatgctcagtgatgtaactc

SEQ ID NO: 53477 - DNA, 50 bp, homo sapien
aggtgacaaattcagtatatctgtcyctgggtatttatgcattgatcaga

SEQ ID NO: 53478 - DNA, 50 bp, homo sapien
atattgtcatcatcatgtggaaatasagaagtttcagctttcaaaggtga

SEQ ID NO: 53479 - DNA, 50 bp, homo sapien
acctctatccattataaattactaastctcagtatatctttattagcagc

SEQ ID NO: 53480 - DNA, 50 bp, homo sapien
taaatgatttaagtaactttgctatmaaaatcaggagagaataatgtggg

SEQ ID NO: 53481 - DNA, 50 bp, homo sapien
cttcagcaataatctctcctgctaayggatcagatggatgatttctgcaa

SEQ ID NO: 53482 - DNA, 50 bp, homo sapien
ggtcattaaaggcacttttctctaaygttgacctaattttaatttcttgt

SEQ ID NO: 53483 - DNA, 50 bp, homo sapien
cctcttggcttagtggagaaataaaratatgtgattatgacagatgaaat

SEQ ID NO: 53484 - DNA, 50 bp, homo sapien
tatctggagctgactaacactagtargaactaaaacagatgatcacttac

SEQ ID NO: 53485 - DNA, 50 bp, homo sapien
tgtaacccttttgaacctaccataayggaactgagctccattcatgtatc

SEQ ID NO: 53486 - DNA, 50 bp, homo sapien
tgcttactttcttgcttcagaactayggaggcaaggcatgggtcccacag

SEQ ID NO: 53487 - DNA, 50 bp, homo sapien
tggacaaatgtcaaaggactgagtakaaagatcaatatttgaccaaagcc

SEQ ID NO: 53488 - DNA, 50 bp, homo sapien
ctggcagaagacggaaaggcaaaaargtctacctatgtctctccaggtat

SEQ ID NO: 53489 - DNA, 50 bp, homo sapien
tagcgcagatgactgggtacaaggayatctattagcactgggaatcttag

SEQ ID NO: 53490 - DNA, 50 bp, homo sapien
tgaatgccagaattgcaatagcctcraaagaactaagaaactgttagcac

SEQ ID NO: 53491 - DNA, 50 bp, homo sapien
tataaaaaataaataaatttaaaacsgagttgaggtctcgtcccctctga

SEQ ID NO: 53492 - DNA, 50 bp, homo sapien
tcccatccttgccaatacagcagctraaattaagtgttctctgcttggaa

SEQ ID NO: 53493 - DNA, 50 bp, homo sapien
aaatgagatatttctgtatatgataygtttcccacacttttcaagtctta

SEQ ID NO: 53494 - DNA, 50 bp, homo sapien
tttctcagtgaatccttctcatcgckagctggaccatttcaagtctctct

SEQ ID NO: 53495 - DNA, 50 bp, homo sapien
ctttataaatgttcagaattgttaaygctcattttataagcggctcagct

SEQ ID NO: 53496 - DNA, 50 bp, homo sapien
agcacctagtaagtacacagcactaygttcggttataccctcatattctt

SEQ ID NO: 53497 - DNA, 50 bp, homo sapien
acagatatagaatatagaatattatmaccatgcaaaaaagctaagaatca

SEQ ID NO: 53498 - DNA, 50 bp, homo sapien
tttccagaactaaaagagagaagaarataaacaaatttaaactgcaactg

SEQ ID NO: 53499 - DNA, 50 bp, homo sapien
tttactttttttaatttggcataagmacgtgatacctctcctctacacta

SEQ ID NO: 53500 - DNA, 50 bp, homo sapien
tgacacttttttatatctttaaaagraccactgtcaagtaattcttagaa

SEQ ID NO: 53501 - DNA, 50 bp, homo sapien
gaaagaagtctaccatttctcgagcygatccgatgtattaggtaaggtgc

SEQ ID NO: 53502 - DNA, 50 bp, homo sapien
ctccaaagcaagtactagtggcccgrccttaatccagttgcacctgctca

SEQ ID NO: 53503 - DNA, 50 bp, homo sapien
gagacaagtcatactataaaaataayaccaaaagctgcaaacataaaatt

SEQ ID NO: 53504 - DNA, 50 bp, homo sapien
tgattagtaatgttagtttatcttamctcagtgaaggaatcattattacc

SEQ ID NO: 53505 - DNA, 50 bp, homo sapien
tgacctttaattcttagtctaaaaaraagtaatacatctatctcacacag

SEQ ID NO: 53506 - DNA, 50 bp, homo sapien
tctatatgctgtgatggatagaagamcactaggcctgagaggtgaagcca

SEQ ID NO: 53507 - DNA, 50 bp, homo sapien
tttgttgtaccggttacccatcctaygaccttgggctaagaatttaacct

SEQ ID NO: 53508 - DNA, 50 bp, homo sapien
atggcaacgcagccagatgtttcaartcagcggaggcacttcagggttgt

SEQ ID NO: 53509 - DNA, 50 bp, homo sapien
acaagtttaatattgatcttatagaratattaggcaagtcacttgttcaa

SEQ ID NO: 53510 - DNA, 50 bp, homo sapien
gaaaagaaccagtatcaattatccayaaactactccaaaagatccaagaa

SEQ ID NO: 53511 - DNA, 50 bp, homo sapien
agccagcattatagctgaatataatyagtcatccgcaatggtagtggctg

SEQ ID NO: 53512 - DNA, 50 bp, homo sapien
gtttttctacaggaaattattctttyaaactacagtgtctaggaagtacc

SEQ ID NO: 53513 - DNA, 50 bp, homo sapien
aacagtgttaacccaaagttaacagratagtgccttatcaaggaagctgg

SEQ ID NO: 53514 - DNA, 50 bp, homo sapien
cactggttcacatcatcccagatacraggacaattaaaaagtgacttttt

SEQ ID NO: 53515 - DNA, 50 bp, homo sapien
atcttgaaattccctaagtccaatarctccgtgccaggtcgttttagggg

SEQ ID NO: 53516 - DNA, 50 bp, homo sapien
cacagcagtgtgaggtagctattgtmaaggaaaatgaggctcataaaggt

SEQ ID NO: 53517 - DNA, 32 bp, homo sapien
tagtaaggacttaaaamtggtagccaataata

SEQ ID NO: 53518 - DNA, 50 bp, homo sapien
tcatttgtctgctgattagtttagarcatttgttgtactgtaattgcagg

SEQ ID NO: 53519 - DNA, 50 bp, homo sapien
gtattgtatctattagaggttatagyccattgcactgtaagcttttccaa

SEQ ID NO: 53520 - DNA, 50 bp, homo sapien
tgaagagcagctttttacatcattamatgtccttgcatttttggcctctg

SEQ ID NO: 53521 - DNA, 50 bp, homo sapien
ttcccctccctcctacttgggaagarccttagcagccactcttcccagca

SEQ ID NO: 53522 - DNA, 50 bp, homo sapien
ctcccagttacttacagtagatgtarcaagaatgaagaatagtgtggtcc

SEQ ID NO: 53523 - DNA, 50 bp, homo sapien
tgcttcaaatccatattaatgaagargtgatggctaagaggaatctgtct

SEQ ID NO: 53524 - DNA, 50 bp, homo sapien
agaatctcttagcttttgaaaggtgrcaatgtggctacacgtaattcagg

SEQ ID NO: 53525 - DNA, 50 bp, homo sapien
acacggaccctgcttggcaggccacsatgagattgcaccagcctcctgtg

SEQ ID NO: 53526 - DNA, 50 bp, homo sapien
gcatgcctacctcttctatctctaargatgctgtaagttacccccagaaa

SEQ ID NO: 53527 - DNA, 50 bp, homo sapien
tggggtatgaaagcataaggaaataycataggcagtcatgggtgaatcgg

SEQ ID NO: 53528 - DNA, 50 bp, homo sapien
ggcctatttacctcagtgtcttttayctagtatatcatgtccaacttttg

SEQ ID NO: 53529 - DNA, 50 bp, homo sapien
aggtaaatcttgcaggaaaaatcccrattcacccatgactgcctatgata

SEQ ID NO: 53530 - DNA, 50 bp, homo sapien
ggagactgggtattatctaggcaccygaactagaggttccaaagaagcaa

SEQ ID NO: 53531 - DNA, 50 bp, homo sapien
ggatcattgccattttgatgtagaayctttgctctcattttcatgttcaa

SEQ ID NO: 53532 - DNA, 50 bp, homo sapien
cttactcgggttcccacatctataamcttctaaatagcttctcttggatg

SEQ ID NO: 53533 - DNA, 50 bp, homo sapien
ctcatagtttgttatgcagcattacyatggcaaatagctgacagatacaa

SEQ ID NO: 53534 - DNA, 50 bp, homo sapien
tgacttttctcctcaagcatctaaaygtgccctaacgtcttccattatgg

SEQ ID NO: 53535 - DNA, 50 bp, homo sapien
cctgcattatgcggatgttctggacmaagagtgatgagtggacaagacct

SEQ ID NO: 53536 - DNA, 50 bp, homo sapien
tttgaaagatatagccgtcatgataygagacatcctcttggtcaccgcat

SEQ ID NO: 53537 - DNA, 50 bp, homo sapien
tgctgttgcgaaaaaaagggatctayagtcggtaaatttgggaaatactc

SEQ ID NO: 53538 - DNA, 50 bp, homo sapien
taagaaacttttaaagtgtgagtaawtgataattaaaggttataaatctt

SEQ ID NO: 53539 - DNA, 50 bp, homo sapien
gcagtataaccaatgcataacttacmataaaatgcctctcttaaccactc

SEQ ID NO: 53540 - DNA, 50 bp, homo sapien
gtggaaagggaaccgtaagtattcaygttctcctgtgttcctggccctgt

SEQ ID NO: 53541 - DNA, 50 bp, homo sapien
actcatactcccttcattctcaatcyacatgtgttcattgcccttatcca

SEQ ID NO: 53542 - DNA, 50 bp, homo sapien
attgctgtgggtattgtaagatctargttatgaggctagtgtaaacaata

SEQ ID NO: 53543 - DNA, 50 bp, homo sapien
caggttcaggaagagcatttccacastgcattaatttgttgcactactct

SEQ ID NO: 53544 - DNA, 50 bp, homo sapien
ttcagacctttataatgcagcacaartatgaatccatctcatttcacaca

SEQ ID NO: 53545 - DNA, 50 bp, homo sapien
ccccttctaaaccgacagacgaagtmaaaggctctgaaattctccaatgg

SEQ ID NO: 53546 - DNA, 50 bp, homo sapien
gatgtgagcattaattgaaaggatamaggtaatgggcttggcacagaccc

SEQ ID NO: 53547 - DNA, 50 bp, homo sapien
agaaaaagggatagttcaaaaattaygatattttacttacatgtaactac

SEQ ID NO: 53548 - DNA, 50 bp, homo sapien
gccataacagggctactggaggcaaygggcttatgtcacaaaaggaagtc

SEQ ID NO: 53549 - DNA, 50 bp, homo sapien
gttaagctcttagtatgtgacagacracaacgtggtggacactttacaca

SEQ ID NO: 53550 - DNA, 50 bp, homo sapien
gcactcgtgtgcagacaaaacagagsactctaacaatgaggtagatgtag

SEQ ID NO: 53551 - DNA, 50 bp, homo sapien
agatgtaggacagagacaagaagaasctgagtgcacccatttctttcatc

SEQ ID NO: 53552 - DNA, 50 bp, homo sapien
ctgcagtatgggaagaagtcacacarcaatgaataaatggcttttgaaag

SEQ ID NO: 53553 - DNA, 50 bp, homo sapien
tattgattgattggttgaaatacacyctataaatggaaactgtctccata

SEQ ID NO: 53554 - DNA, 50 bp, homo sapien
aaatctcactgataatcatattgaarttaaaatcaaataaaatcacctaa

SEQ ID NO: 53555 - DNA, 50 bp, homo sapien
caccaacactgtatagtgttcttcaraaggatatcaaattttgactgcat

SEQ ID NO: 53556 - DNA, 50 bp, homo sapien
ggaagtaagctagtccagctctacarccatttagtggcacagctagtatt

SEQ ID NO: 53557 - DNA, 50 bp, homo sapien
taggttaatgttgataatgactaccmatatataatttcctccctcattca

SEQ ID NO: 53558 - DNA, 50 bp, homo sapien
tcatggtcttgtctctttccttaaaygtgtgaactggtagaaggccagga

SEQ ID NO: 53559 - DNA, 50 bp, homo sapien
aaattcctccttaaatgcaacagaastctactttattggtgtagctattc

SEQ ID NO: 53560 - DNA, 50 bp, homo sapien
tcctccctacttctgagttcacctgyagttcatagataattctcagcatg

SEQ ID NO: 53561 - DNA, 50 bp, homo sapien
tctgaatttggagtagcatttctcaragtattcagtggacatcatcagtg

SEQ ID NO: 53562 - DNA, 50 bp, homo sapien
taatactagcttttgtattttctgcrcttggtatacagtaagcattccat

SEQ ID NO: 53563 - DNA, 50 bp, homo sapien
ctgctggcaataattgctttttaaaygactcactgcaactcagggtaaac

SEQ ID NO: 53564 - DNA, 50 bp, homo sapien
ttaagcatctatcagtggatgaacgratttttaaaatgtggtatatacat

SEQ ID NO: 53565 - DNA, 50 bp, homo sapien
acaatctgtgagatgtattctaatgyactaattctctgtgtttcttggcc

SEQ ID NO: 53566 - DNA, 50 bp, homo sapien
gccaggagtcccaggcctgcacataraaggtgttagtaccctcagtcaga

SEQ ID NO: 53567 - DNA, 50 bp, homo sapien
catccagccaacatgtagcgattcaytcaacccttgttgagcccctacca

SEQ ID NO: 53568 - DNA, 50 bp, homo sapien
cctcagtttccacaaatgactaagarcagactggtctaaagagacagaga

SEQ ID NO: 53569 - DNA, 50 bp, homo sapien
ccattcccattgggtcacataaactragtgagagcagacaggggagatgg

SEQ ID NO: 53570 - DNA, 50 bp, homo sapien
atatttctgatattatggacagatcyaactagctgaacaaactgtgcaca

SEQ ID NO: 53571 - DNA, 50 bp, homo sapien
gatgattacttatagctatgtcctaracttatattctaaatgagagatac

SEQ ID NO: 53572 - DNA, 50 bp, homo sapien
tcctttggctatcacccacaagatasagtaattggctttcaacaattcat

SEQ ID NO: 53573 - DNA, 50 bp, homo sapien
tcatggagaagaacatttcagtaacrggttgctctggctgagaggtattt

SEQ ID NO: 53574 - DNA, 50 bp, homo sapien
aacttctatatttgaattgtactgarctattattatatctcccagagaaa

SEQ ID NO: 53575 - DNA, 50 bp, homo sapien
taaaactgaggcagagtgatggtccrggaacgtactcaagcaactggtag

SEQ ID NO: 53576 - DNA, 50 bp, homo sapien
gaggaggagatgaggaaaagtctaaygaacgggtgaagaaccccatcctg

SEQ ID NO: 53577 - DNA, 50 bp, homo sapien
ataatttcatcactaccacccagcartatgcaatctagaaatttcagctt

SEQ ID NO: 53578 - DNA, 50 bp, homo sapien
tcatcacctactttctctcacgtatsaaatggaaccacccacacccatcc

SEQ ID NO: 53579 - DNA, 50 bp, homo sapien
gctcagatgtgtgggggcgttgacartgctagggatgaccttcaaccagc

SEQ ID NO: 53580 - DNA, 50 bp, homo sapien
cataccattcctctgttgttgaaagwatcttggataaatgaggagaggca

SEQ ID NO: 53581 - DNA, 50 bp, homo sapien
caaactgcaagatcttatttgatggraatgattgtagctttaggtaattc

SEQ ID NO: 53582 - DNA, 50 bp, homo sapien
aatgttaagtgacactgacacaaggraaaacgtgtggaattctgaattaa

SEQ ID NO: 53583 - DNA, 50 bp, homo sapien
atccagtagaaagtggcaactaagamactaaaacagaaaaaaacataagt

SEQ ID NO: 53584 - DNA, 50 bp, homo sapien
tcgctttctttgctcctttttgctgyatgtactaaaaagaaaacgcagtt

SEQ ID NO: 53585 - DNA, 50 bp, homo sapien
atgattgaaatattgaaatatagtayggaaaatctgatgaaaaaattatg

SEQ ID NO: 53586 - DNA, 50 bp, homo sapien
tgaagactgcagaggatagtttatayacagtattcccattctcaaaatcg

SEQ ID NO: 53587 - DNA, 50 bp, homo sapien
ccagtttgcaagtgtacacatttacygaagtcatatcttttcaggacaac

SEQ ID NO: 53588 - DNA, 50 bp, homo sapien
caacaaaaatgcatggctttatctaygcatgtattcattcacacatttag

SEQ ID NO: 53589 - DNA, 50 bp, homo sapien
aggcagaagctttcaaggattcttayggcctaactccagaagacccataa

SEQ ID NO: 53590 - DNA, 50 bp, homo sapien
ttgttagcaaatgagatctgcaaggrcctatttagaattcttttaaaaaa

SEQ ID NO: 53591 - DNA, 50 bp, homo sapien
atctatatatactatccagaaatagwcaagtaattgcaaaatcattactt

SEQ ID NO: 53592 - DNA, 50 bp, homo sapien
caataagccaagtgggttctgacatsacattaacagaatataactgctag

SEQ ID NO: 53593 - DNA, 50 bp, homo sapien
tttaagccagagttattttaaaacarctattctccaaattcttcacccca

SEQ ID NO: 53594 - DNA, 50 bp, homo sapien
agttaactgtgagtttaacatgaagractcacattggtaagaggcaattc

SEQ ID NO: 53595 - DNA, 50 bp, homo sapien
gggccaggagttgttattgtttccarggaatatgttattgatggggatgg

SEQ ID NO: 53596 - DNA, 50 bp, homo sapien
gactgctgtgtggtagtaattctgaygtttgtttttaaaatggatttctg

SEQ ID NO: 53597 - DNA, 50 bp, homo sapien
aaggatatcaaagttcagggttataygtgatcatcaggtcattgacatga

SEQ ID NO: 53598 - DNA, 50 bp, homo sapien
caacttagtataaaaatagcagtgaratatagcttaaagcccaaagtcac

SEQ ID NO: 53599 - DNA, 50 bp, homo sapien
gtatacctatgtaacaaaccagcacraagttttgcatgtgtatcctggaa

SEQ ID NO: 53600 - DNA, 50 bp, homo sapien
cacattccatccatgggggcagagamtatccctttagactttctttttcc

SEQ ID NO: 53601 - DNA, 50 bp, homo sapien
ctaatagcctccaacacactacttawgggagaatacaaagcacaaataag

SEQ ID NO: 53602 - DNA, 50 bp, homo sapien
gagaacatgctgtttctcactaaagwcagttgaactatatgggccagttt

SEQ ID NO: 53603 - DNA, 50 bp, homo sapien
ctaatccacctaagtcatgggtctcratgctttctatatgaaaggctgga

SEQ ID NO: 53604 - DNA, 50 bp, homo sapien
tccatttgagaaaagtcaattttaartaaatacaaaggcaactttaaatg

SEQ ID NO: 53605 - DNA, 50 bp, homo sapien
gctgcctgaccctttcacccaatgcrgatcttcgaggcttgtgccattta

SEQ ID NO: 53606 - DNA, 50 bp, homo sapien
acctcttacactgagccacagccaasacggtaaaatgaatgtgatgaact

SEQ ID NO: 53607 - DNA, 50 bp, homo sapien
aatgtttggtatctggtaaattggasaaaagactgggggtaaatcttgcc

SEQ ID NO: 53608 - DNA, 50 bp, homo sapien
tagtttagttagagttgatatgacasacagaaaagcatctcattttcact

SEQ ID NO: 53609 - DNA, 50 bp, homo sapien
tggaggtgagaaaagtacacctggargagatctgaaatattcctgattct

SEQ ID NO: 53610 - DNA, 50 bp, homo sapien
atacaattaaacagcagaatcaaagsaaagggagtataaagggctccaga

SEQ ID NO: 53611 - DNA, 50 bp, homo sapien
tggcgcagaaacttggggccagatamcacctcattggacataaatctctc

SEQ ID NO: 53612 - DNA, 50 bp, homo sapien
ccagacctctgtctatagatttatgyaaacttgtcattcaagggcatctc

SEQ ID NO: 53613 - DNA, 50 bp, homo sapien
tgggctatcaggtagatctattcacsgaggtagagaatcaggaaggagat

SEQ ID NO: 53614 - DNA, 50 bp, homo sapien
tgttggacaatacagaaaaatggcastaaatgaacttcagaaatacccca

SEQ ID NO: 53615 - DNA, 50 bp, homo sapien
ttggagcttctcagatggtttgatcygagttttgaaagtaacagaactct

SEQ ID NO: 53616 - DNA, 50 bp, homo sapien
gaaatatgagtcatccactgattcaygtagcaacgcaaaacatcttctct

SEQ ID NO: 53617 - DNA, 50 bp, homo sapien
taacggccctgcttttgttcccttayaatttgcttcaacggagggtttgc

SEQ ID NO: 53618 - DNA, 50 bp, homo sapien
aattacactccactgaaatatcagaygttaaaatgtatttatataactga

SEQ ID NO: 53619 - DNA, 50 bp, homo sapien
ctgagactggataatttatgatcaawataggtttaattgactcacagtct

SEQ ID NO: 53620 - DNA, 50 bp, homo sapien
aaagagcaagaattcctactaatgaktacttgaggaagaaaaatcacagg

SEQ ID NO: 53621 - DNA, 50 bp, homo sapien
aagaaaccatctctataacattaaaytgcaaggtgaaggaacaagtactg

SEQ ID NO: 53622 - DNA, 50 bp, homo sapien
gttaccagataaagataactgcaaamtcgaggaagaccaagccctagtaa

SEQ ID NO: 53623 - DNA, 50 bp, homo sapien
ttttagaaacaaggaaatgaaagatsagagtttgaatgatttacctgggg

SEQ ID NO: 53624 - DNA, 50 bp, homo sapien
atccaccattgaacaaagctccctayggacagagaccctctcttgttcat

SEQ ID NO: 53625 - DNA, 50 bp, homo sapien
aattgtcactcaagaagttcctaaakctgctgagtcttggcactatagcc

SEQ ID NO: 53626 - DNA, 50 bp, homo sapien
atctctgagttctctcttattctaamcatgtgcctgggattaaatgcttg

SEQ ID NO: 53627 - DNA, 50 bp, homo sapien
caatcccagcagcaaaagggtgctaygcttatctcctttacattcccaaa

SEQ ID NO: 53628 - DNA, 50 bp, homo sapien
agagaaagggaataaagtaagagtcmattatgcagacgtctctgagtagg

SEQ ID NO: 53629 - DNA, 50 bp, homo sapien
tttgccacacactaagcaagatgcarctgtcctctgttgttcttgttctt

SEQ ID NO: 53630 - DNA, 50 bp, homo sapien
aacaaatatactctacagccatgatrataaaaagaagaacaagaacaaca

SEQ ID NO: 53631 - DNA, 50 bp, homo sapien
gactggttctgtctgctacttatgascttcaagaacttggccctacctag

SEQ ID NO: 53632 - DNA, 50 bp, homo sapien
tacaccaggtgttgaattaggtacakgaattaggttgtctattaaacctc

SEQ ID NO: 53633 - DNA, 50 bp, homo sapien
ctataaattaattcttcactcaacaytgcactcacctggagctacctttc

SEQ ID NO: 53634 - DNA, 50 bp, homo sapien
tcatatatgctttattttccctaagsatggatggcaattattaaataatc

SEQ ID NO: 53635 - DNA, 50 bp, homo sapien
ggcgctggcctatactgttgttagcrattcacactcttattaggaaagtg

SEQ ID NO: 53636 - DNA, 50 bp, homo sapien
cccccagtaacaggctctgttataarcatttcaagccaatttgaccaatc

SEQ ID NO: 53637 - DNA, 50 bp, homo sapien
cccaaaggctgtattatttatgcaaygagcatgctgaattacatcacttc

SEQ ID NO: 53638 - DNA, 50 bp, homo sapien
ctttttcaatactggcaagttttgastacttttttcaaatatcatttcaa

SEQ ID NO: 53639 - DNA, 50 bp, homo sapien
agataaagaccttagaaggttgtagrcactgaaaatagtataacgcttta

SEQ ID NO: 53640 - DNA, 50 bp, homo sapien
gattagggttttctaaacaaatgaasgatctgcaaatgctacaaccaaag

SEQ ID NO: 53641 - DNA, 50 bp, homo sapien
tccaacactggggattatatctcaaygggagattcagaagggatatctga

SEQ ID NO: 53642 - DNA, 50 bp, homo sapien
tgccagagagaggagagtacattctraaactgttgggttgatggcagagt

SEQ ID NO: 53643 - DNA, 50 bp, homo sapien
agcttttctaagaactaattgacaayatggtaaggctatggggggtaggg

SEQ ID NO: 53644 - DNA, 50 bp, homo sapien
tgtagagttactggagtttcagtaaycgaaaaggtgacacatgtaaataa

SEQ ID NO: 53645 - DNA, 50 bp, homo sapien
aagggtgcttgagcatattagtaaaygatagagccatgttgaggatgagg

SEQ ID NO: 53646 - DNA, 50 bp, homo sapien
cttggtctcaactctatttactcgcygagacaacaaagaccctccggact

SEQ ID NO: 53647 - DNA, 50 bp, homo sapien
tgtgtctggatctgctctagttctamgtatgaggactaactctctaggag

SEQ ID NO: 53648 - DNA, 50 bp, homo sapien
ccaggtgagctcagccttcaaggtcraacatgcagacctccaggagggct

SEQ ID NO: 53649 - DNA, 50 bp, homo sapien
gtctcaccctagccctctactttgawaaggcagactgcaagtggcaatag

SEQ ID NO: 53650 - DNA, 50 bp, homo sapien
ctattcctatctctttcactgtgtcrgaaacagttgtccacctctagagg

SEQ ID NO: 53651 - DNA, 50 bp, homo sapien
tagaaaaataagctgtctgcacttamgtgttggtagttttcatcataaaa

SEQ ID NO: 53652 - DNA, 50 bp, homo sapien
tagctccaataattgatcatagaccrggaataagatgaaaaaactgcacc

SEQ ID NO: 53653 - DNA, 50 bp, homo sapien
ctaaactgaccaggccatgaggaaayaacgttagtgtgggagaggacagg

SEQ ID NO: 53654 - DNA, 50 bp, homo sapien
cagattaatttgcttgttgtggttaygtaatccttacactcatcaatgtt

SEQ ID NO: 53655 - DNA, 50 bp, homo sapien
cttagtaatattaatagtgctttgaygtagactttgtctgcatatgatta

SEQ ID NO: 53656 - DNA, 50 bp, homo sapien
agtggagagggagtacaacaacagargtggcaacgaatccaaaacctcaa

SEQ ID NO: 53657 - DNA, 50 bp, homo sapien
aatggggccttgttagtagtgaccaygcggtgcagcttagcaatgatctc

SEQ ID NO: 53658 - DNA, 50 bp, homo sapien
ctgaaataacagtggcaattactatmaaaattagctatcctctccaggac

SEQ ID NO: 53659 - DNA, 50 bp, homo sapien
agcatgtatgcaaaataaccatgtascagtccacaaagaaagtctctaca

SEQ ID NO: 53660 - DNA, 50 bp, homo sapien
agggtggttcctgttggaggacatarcacctgcaaaggtgtggagggggc

SEQ ID NO: 53661 - DNA, 50 bp, homo sapien
gcatagcaagctccttagctcaaaayaggcattgaatggacactggcccc

SEQ ID NO: 53662 - DNA, 50 bp, homo sapien
cactcactttctagattcagacacaygactacctttttcgttacaaaaca

SEQ ID NO: 53663 - DNA, 50 bp, homo sapien
tacatttaataaacaacttcagcaawctttatgtacacaaaatcattgta

SEQ ID NO: 53664 - DNA, 50 bp, homo sapien
ctagtcatttgaattagccaaggaayggagacaaagacaaagtgaatttc

SEQ ID NO: 53665 - DNA, 50 bp, homo sapien
tgcttgggggatttctcaaaatgtastaaaaatattctagtagaggaatt

SEQ ID NO: 53666 - DNA, 50 bp, homo sapien
cacttaagcttttccctttttaatayaggagactcagaacattctctgct

SEQ ID NO: 53667 - DNA, 50 bp, homo sapien
aaaaaaaagaaaacaatacacaccawataaagaggcatattgatcctaca

SEQ ID NO: 53668 - DNA, 50 bp, homo sapien
gaacaaaactaggccctctgattcaygatgtagagctcttcctatacaga

SEQ ID NO: 53669 - DNA, 50 bp, homo sapien
gaagaaggttagctaaatgtatgtaygagccagaataaaatcatatactg

SEQ ID NO: 53670 - DNA, 50 bp, homo sapien
caaacaagatgaattgtttcctcacrgactgatgtggctggcctgctgct

SEQ ID NO: 53671 - DNA, 50 bp, homo sapien
ctttgtcataataacaatttccttcyctttgtttgtaattctctttgttt

SEQ ID NO: 53672 - DNA, 50 bp, homo sapien
agcagccacagcagcagagagaggcscttaggcaagccaagcccctgccc

SEQ ID NO: 53673 - DNA, 50 bp, homo sapien
gctaactgggcttaaactgggaaccwatttccttggatgaaattaagtcc

SEQ ID NO: 53674 - DNA, 50 bp, homo sapien
tgagtcttcattcagatatttgccaygtcagtgaatttacagatcatttt

SEQ ID NO: 53675 - DNA, 50 bp, homo sapien
cccctcttcctaaccacttcgtttgsagttatttctggttcatttctttc

SEQ ID NO: 53676 - DNA, 50 bp, homo sapien
gagaatgatgataatttgagaaaaawtttccaaaaggactgcatataaac

SEQ ID NO: 53677 - DNA, 50 bp, homo sapien
tttctgatggttaattgagatatcartgaaagtgattagagtgcctgtat

SEQ ID NO: 53678 - DNA, 50 bp, homo sapien
ctatctgtctccccagcaaactttascatctggccaagcataatagctta

SEQ ID NO: 53679 - DNA, 50 bp, homo sapien
aaaatgtacatgaaataacaagtcaytactcaaaaagtacattttttttc

SEQ ID NO: 53680 - DNA, 50 bp, homo sapien
aaagtccatatagccgttgaaatcamgtatagattgtgattaaaatgtgt

SEQ ID NO: 53681 - DNA, 50 bp, homo sapien
atctattgctcagcacagtgtaggaygcaattctcagtgtctacttcaac

SEQ ID NO: 53682 - DNA, 50 bp, homo sapien
actgtgctgggtttgaaacggtctayggtgcaatgttgtgttgtacctta

SEQ ID NO: 53683 - DNA, 50 bp, homo sapien
ctctgcttaggggtctcggccaatawcatctttggtataatgaaggaact

SEQ ID NO: 53684 - DNA, 50 bp, homo sapien
agcaatgctgtgccagatgatctgawaaaagtattccagtgggtagccag

SEQ ID NO: 53685 - DNA, 50 bp, homo sapien
taacaacccctatgttggtcatagcygattctctcctctgcttaggggtc

SEQ ID NO: 53686 - DNA, 50 bp, homo sapien
tcagaaagctaaggcaatcccaggcracaagaggaaggctaatgcatcag

SEQ ID NO: 53687 - DNA, 50 bp, homo sapien
aatgaaaatcttttcttcgttagtcycaaatttcctataatctgacttcc

SEQ ID NO: 53688 - DNA, 50 bp, homo sapien
cctttattgcatctgaaaataaaccrcatattgacagagactagaaagtg

SEQ ID NO: 53689 - DNA, 50 bp, homo sapien
cgcccagctacatggctgataacaaygaattagaatttaccggtcagcaa

SEQ ID NO: 53690 - DNA, 50 bp, homo sapien
tttatccattttctcagagaaggtcsagtcagattagggacttctcaact

SEQ ID NO: 53691 - DNA, 50 bp, homo sapien
ctgggtcttgagcagaccaactggascaaggaggttagatctccactcac

SEQ ID NO: 53692 - DNA, 50 bp, homo sapien
gccagaccctaagaaatttccaaagragaagaaagcctgttgggagcatc

SEQ ID NO: 53693 - DNA, 50 bp, homo sapien
ttaagccctcttaatttcaaaattaygttcatatgtgccaataaagttgt

SEQ ID NO: 53694 - DNA, 50 bp, homo sapien
ttcttgagcagaatccaggcgacaarcaggaacttctgcagatatgggtg

SEQ ID NO: 53695 - DNA, 50 bp, homo sapien
tttaatggacttgcattcctaacacrcttcataatctgtacgtatacatc

SEQ ID NO: 53696 - DNA, 50 bp, homo sapien
ttactaacctaatgctactgtgtcasataataggtaatgtaacaacctcg

SEQ ID NO: 53697 - DNA, 50 bp, homo sapien
aaaatccacacataaaattgacgctyacgtataaatccacactgggtatt

SEQ ID NO: 53698 - DNA, 50 bp, homo sapien
aataggtaatgtaacaacctcgcaaractaataatatgcttctgcctccg

SEQ ID NO: 53699 - DNA, 50 bp, homo sapien
ccaaaaacccacagagtctacaaggrattgtttaaagatagtttatatat

SEQ ID NO: 53700 - DNA, 50 bp, homo sapien
ttaatttccctagtttcaggttggawaactgccttccttgttttgaatgg

SEQ ID NO: 53701 - DNA, 50 bp, homo sapien
agtgagagaagcagaactgtatagargcattgaaatgtgatatagctaca

SEQ ID NO: 53702 - DNA, 50 bp, homo sapien
gggtggagaggcacacaagcccaaakagagttgagtaacacatcaaatgc

SEQ ID NO: 53703 - DNA, 50 bp, homo sapien
atgagagaaaagaatccatcaataasaactatcaataaaagctatgggag

SEQ ID NO: 53704 - DNA, 50 bp, homo sapien
aacactttgtttcactaggcttcaayaggtctcttcaaagctgtcatttt

SEQ ID NO: 53705 - DNA, 50 bp, homo sapien
tgcccctagaggtcaagttccatacrcctgtgattgtttctttcgctgcc

SEQ ID NO: 53706 - DNA, 50 bp, homo sapien
tttcagaggtgcatttgtattaagtsactctctggatatattgaataggg

SEQ ID NO: 53707 - DNA, 50 bp, homo sapien
agaatgacacttaatagtaaagatakgtcatagaggaaggggaagaagag

SEQ ID NO: 53708 - DNA, 50 bp, homo sapien
ttcagatgtacactgttactatagaygtcactaacatataagccggtgaa

SEQ ID NO: 53709 - DNA, 50 bp, homo sapien
aactgcccacaaagcaaaagttgtcyatctgaaatcagtgataaaggcaa

SEQ ID NO: 53710 - DNA, 50 bp, homo sapien
ggaaatttgatccacacagaatacartcctgagaaacttctttgtctctc

SEQ ID NO: 53711 - DNA, 50 bp, homo sapien
cgtaagagtagccttcaaattcttargcattttctataaatcttcagtga

SEQ ID NO: 53712 - DNA, 50 bp, homo sapien
actatccaaagaacacctgctgacayaattgagcatcacctttcttaaag

SEQ ID NO: 53713 - DNA, 50 bp, homo sapien
aaaaatactcagagatagccataaayaccacctagaatagatcaaatagg

SEQ ID NO: 53714 - DNA, 50 bp, homo sapien
atattctctaactcttgctgaacacraagatccattttcatttgatattt

SEQ ID NO: 53715 - DNA, 50 bp, homo sapien
tgatttcacacctgataagccctacraatggaaggaggagaaagagagtt

SEQ ID NO: 53716 - DNA, 50 bp, homo sapien
ctgaagtgacttttgcttggcattamaactaaacctgccacaaagcaatg

SEQ ID NO: 53717 - DNA, 50 bp, homo sapien
ccagagcccatgcacttaatcactamatacattaaaaagtaaaataactt

SEQ ID NO: 53718 - DNA, 50 bp, homo sapien
ttttacaatgggcaaaaatatagaamaaaatatccactcattatttgtgg

SEQ ID NO: 53719 - DNA, 50 bp, homo sapien
gggatcctgacacatggtcatgtacyactatttgaataatgtgtcacagc

SEQ ID NO: 53720 - DNA, 50 bp, homo sapien
ttaagccactttcccttgctggagartaaaagaggaatcgcactaaaaat

SEQ ID NO: 53721 - DNA, 50 bp, homo sapien
cttaagaatttgaaggctactcttayggaataacaggtttccaaatgggt

SEQ ID NO: 53722 - DNA, 50 bp, homo sapien
tgaatgatggtcaaaaacgagatcartaccagcttaacacatagctcaca

SEQ ID NO: 53723 - DNA, 50 bp, homo sapien
tacacactagggcccagtggttttaygaatatgggaatgccctggaaggg

SEQ ID NO: 53724 - DNA, 50 bp, homo sapien
gctgatgttcaaaaagtctttcacayggtccatcctggggacagttacaa

SEQ ID NO: 53725 - DNA, 50 bp, homo sapien
tggaggagaggctcaaggaaaggaargttctcaaagaaacagactatgat

SEQ ID NO: 53726 - DNA, 50 bp, homo sapien
ctagctagttataaaagatgtagacmagttggaggatatttggaggagag

SEQ ID NO: 53727 - DNA, 50 bp, homo sapien
ctgttgagggccgttaaatgattacyggcgaaaatgaatagagacttggg

SEQ ID NO: 53728 - DNA, 50 bp, homo sapien
agttatggcaaatggcttttcaccartcatctcataatggaagtataagt

SEQ ID NO: 53729 - DNA, 50 bp, homo sapien
tcagtaaataaaaccaaggatcttaygtggattagtgtttttagttgcag

SEQ ID NO: 53730 - DNA, 50 bp, homo sapien
cctctcctcctcttctttattcatcyatgtgttaactcattaagcaacaa

SEQ ID NO: 53731 - DNA, 50 bp, homo sapien
agggaggacaagttatcaagaggcaygtcctagtttctggcttgtatgac

SEQ ID NO: 53732 - DNA, 50 bp, homo sapien
tcagttttctcatctgaaaaatggaygggttaggctggaaggtctctaag

SEQ ID NO: 53733 - DNA, 50 bp, homo sapien
cttggtctgagaacacaatgtatgayggtgaaagcaaagatctccctact

SEQ ID NO: 53734 - DNA, 50 bp, homo sapien
ggagattagcaagtgatcaaagaggratgttaatagatataagcatctat

SEQ ID NO: 53735 - DNA, 50 bp, homo sapien
aagagtatgtgaacgctagagtctargcatccaagaatgaattctttcaa

SEQ ID NO: 53736 - DNA, 50 bp, homo sapien
ttaaatatttttactttgaatactaytaacacatcctataattgaatatc

SEQ ID NO: 53737 - DNA, 50 bp, homo sapien
acctaatcacctcttaaagggctcayctcttaatatcattacattggcca

SEQ ID NO: 53738 - DNA, 50 bp, homo sapien
acttttaaaaaaacttgttttccaayatgatgacctcctctgatagcacc

SEQ ID NO: 53739 - DNA, 50 bp, homo sapien
gagttgacctctggatccattgggasagtaaatgaaagaatatcatctct

SEQ ID NO: 53740 - DNA, 50 bp, homo sapien
taggaaggacgttattttctttaaascacaggccacttctgccattcttc

SEQ ID NO: 53741 - DNA, 50 bp, homo sapien
agcagctattgacctcaatctgtgartaagttcttaggagctggaagctt

SEQ ID NO: 53742 - DNA, 50 bp, homo sapien
gatttgaacttaagacattcagcaasgtttgaaatcagaagacttgtcca

SEQ ID NO: 53743 - DNA, 50 bp, homo sapien
cactaatgtctggctagaattgtgcratgttgataaagaggatggaggaa

SEQ ID NO: 53744 - DNA, 50 bp, homo sapien
ttgtttagagaacacaacacactaaygtctggctagaattgtgcgatgtt

SEQ ID NO: 53745 - DNA, 50 bp, homo sapien
aaagactgagatatcagcctggtaartaagtcagggaaagacacatctac

SEQ ID NO: 53746 - DNA, 50 bp, homo sapien
tcaggtcatcagttgtaatgcactayacaaatgtaaaatatcagtaatag

SEQ ID NO: 53747 - DNA, 50 bp, homo sapien
tgttttcaaacacaattgtgaagtargacactaatacaaaaataagctgg

SEQ ID NO: 53748 - DNA, 50 bp, homo sapien
catttgtgtagtgcattacaactgaygacctgacattgatacactattgt

SEQ ID NO: 53749 - DNA, 50 bp, homo sapien
catgtattgcccgatttgtgtagaasgcactggtacctgttctttattca

SEQ ID NO: 53750 - DNA, 50 bp, homo sapien
ttgattatgtcttatttgccagttawcctattagctactgggaaatacaa

SEQ ID NO: 53751 - DNA, 50 bp, homo sapien
catccaggcttagccagttttaaacrctactttgtccacagttttaaatt

SEQ ID NO: 53752 - DNA, 50 bp, homo sapien
attaagactagaaaatacaaacctaygtgcagaaccatgatttacagtca

SEQ ID NO: 53753 - DNA, 50 bp, homo sapien
acttgcacatgtttgcattgctgagrcataaaccaatcctcctttaaaag

SEQ ID NO: 53754 - DNA, 50 bp, homo sapien
ccatttctatagcacaaatgtaggaygtcaaatgggagcttcatggacca

SEQ ID NO: 53755 - DNA, 50 bp, homo sapien
tttcctgggagccttgcttctctaartagttaactttgctacacagacac

SEQ ID NO: 53756 - DNA, 50 bp, homo sapien
cacacaatagaaatcctgaacgatgragacagtggttttgagggcgttag

SEQ ID NO: 53757 - DNA, 50 bp, homo sapien
actctcagactactggaaattaacamacgagttgacatttagagagacaa

SEQ ID NO: 53758 - DNA, 50 bp, homo sapien
tgttgttaggagaaaaagtgctcagyaagggacttggccctggttgggcg

SEQ ID NO: 53759 - DNA, 50 bp, homo sapien
ggaacaggctctaacttctaaaatayatcaacttataagtgacctttgga

SEQ ID NO: 53760 - DNA, 50 bp, homo sapien
gagatcacactgagtatgtttgtcaytatgaattagaagttgaaagtcca

SEQ ID NO: 53761 - DNA, 50 bp, homo sapien
tggccttgtaaaaccagtgtctacgsatgtgttgaacaaagccacatcct

SEQ ID NO: 53762 - DNA, 50 bp, homo sapien
agtaagaaactagaaataaatacacwatcctaactggccaacaaaattta

SEQ ID NO: 53763 - DNA, 50 bp, homo sapien
tagtcataaaaaacaaacttggaaaygtcctgtaaattttgttggccagt

SEQ ID NO: 53764 - DNA, 50 bp, homo sapien
aaccagaatggagggaaaagctacayataatactctaacattcattttct

SEQ ID NO: 53765 - DNA, 50 bp, homo sapien
acattttggtaattttcctaaaggcratgacacttaaaaatttccgagag

SEQ ID NO: 53766 - DNA, 50 bp, homo sapien
cattcccttggtgctgtcctcatgawaaaattctcacaagacctggttgt

SEQ ID NO: 53767 - DNA, 50 bp, homo sapien
taagaacacaaaagtgaaaacaaacrcattcatagaaatgcctttgaaag

SEQ ID NO: 53768 - DNA, 50 bp, homo sapien
tttttttcttaattcaactgtggacraaattacttaaatttttaaaggcc

SEQ ID NO: 53769 - DNA, 50 bp, homo sapien
aggaaggaagcttggatttggactcygaagaattgaacgccagagtaaag

SEQ ID NO: 53770 - DNA, 50 bp, homo sapien
agctaagtaattcaaagactcaaaaygctttatcacttgggctcggggaa

SEQ ID NO: 53771 - DNA, 50 bp, homo sapien
agcacgtttttgttaactacagtcaytgacgttatttcttctaccttact

SEQ ID NO: 53772 - DNA, 50 bp, homo sapien
tggaagagaaaccaatctagaagaayttactctgtgctaaataaaaggat

SEQ ID NO: 53773 - DNA, 50 bp, homo sapien
aaacaacataataaaacatttttgartacaatagatctcagagtttatgc

SEQ ID NO: 53774 - DNA, 50 bp, homo sapien
tgagggaaaaggtaaacatgtaactractacagtaaaagcaaaatacaag

SEQ ID NO: 53775 - DNA, 50 bp, homo sapien
aatatgaaatacaggggcactttaartgtggttcaagacctggtattttt

SEQ ID NO: 53776 - DNA, 50 bp, homo sapien
ggccaacagtctctaaaatgggcgcratagtaaacgttctatgctgtctg

SEQ ID NO: 53777 - DNA, 50 bp, homo sapien
tgtggcagatgtcctgtctaaagcayggaaggcgatgtacagagactact

SEQ ID NO: 53778 - DNA, 50 bp, homo sapien
actgaagggcatcttacatggtagasgtctcaatttgtcacagagttcag

SEQ ID NO: 53779 - DNA, 50 bp, homo sapien
atgctatctatctgtcacttcattcrataccataataacctgggcaaggg

SEQ ID NO: 53780 - DNA, 50 bp, homo sapien
ttgtatattagagcagaaacctcagrcatcttttgaagaacagtacagaa

SEQ ID NO: 53781 - DNA, 50 bp, homo sapien
ggggcatatatattttaagaaatgayggtactattgcttaaatgaataaa

SEQ ID NO: 53782 - DNA, 50 bp, homo sapien
ttttgcttgaagactgaacatcatamataatatgctatagtgactctgga

SEQ ID NO: 53783 - DNA, 50 bp, homo sapien
gatacaaccacctactgagcagttaygaatgggttctaaagctggggcac

SEQ ID NO: 53784 - DNA, 50 bp, homo sapien
agttccagaacacaagataaataaakgctgaaaagaaagccctggtatgg

SEQ ID NO: 53785 - DNA, 50 bp, homo sapien
atcaaagatagcaatttttgctccarccattttgctgtttttattggctt

SEQ ID NO: 53786 - DNA, 50 bp, homo sapien
tacagggttagactgttttcattgaygataatttggtttcacagagtttg

SEQ ID NO: 53787 - DNA, 50 bp, homo sapien
atggagagatatttcatggtaataaktatgccaatctttcataatatttg

SEQ ID NO: 53788 - DNA, 50 bp, homo sapien
agtagaacatatgagagagacttcayattgcaagaaatagccaagagtac

SEQ ID NO: 53789 - DNA, 50 bp, homo sapien
gaaaagtgctcaccctgttactcaamgaaagtgctcagcaattgtagttc

SEQ ID NO: 53790 - DNA, 50 bp, homo sapien
agccctttggttatcttagcaaacaygaaaatgaaatattcaagaaggaa

SEQ ID NO: 53791 - DNA, 50 bp, homo sapien
aacctgactcttacagcactccatamatgcatacttgaaagtgcttgccc

SEQ ID NO: 53792 - DNA, 50 bp, homo sapien
tgtttgagtgattaccggagggtgawaagtatgcatagtccacctagcaa

SEQ ID NO: 53793 - DNA, 50 bp, homo sapien
agacatgaatacagagagtatattcrctcagggccactttacggataaaa

SEQ ID NO: 53794 - DNA, 50 bp, homo sapien
tgacctccttcagaagtcatggttawctaagaagaatggggtctaaatta

SEQ ID NO: 53795 - DNA, 50 bp, homo sapien
aacttttgtaactgcaataatgtatsaatagaaggtgccaaatgtcacag

SEQ ID NO: 53796 - DNA, 50 bp, homo sapien
cggtctcctccttcttcctgtgaagmacactagctcattgaaatctagac

SEQ ID NO: 53797 - DNA, 50 bp, homo sapien
acacaaacacactcctttcaaaactsaagcaacataatgatgggacatct

SEQ ID NO: 53798 - DNA, 50 bp, homo sapien
ctgagctttgagtgctgcccatgcartattattttctcaatgtcagtaca

SEQ ID NO: 53799 - DNA, 50 bp, homo sapien
acttaatagtttaaaatgaaacaagyatattacctaatagttctttaggt

SEQ ID NO: 53800 - DNA, 50 bp, homo sapien
aataagtttccctcctcttaggatayagaaagccacaacatagcctcgct

SEQ ID NO: 53801 - DNA, 50 bp, homo sapien
gagtatgaatgtgatataaatcacawgccatagatgaatgactgaacaac

SEQ ID NO: 53802 - DNA, 50 bp, homo sapien
agcacctcagtacttcctttctcgayctcattctctgagtagcctgcaca

SEQ ID NO: 53803 - DNA, 50 bp, homo sapien
ctcttctcagggaacaactgagtcasgtcttctcttacaggggttattca

SEQ ID NO: 53804 - DNA, 50 bp, homo sapien
aagaattgcccgtctttgatgccagragtaaccctagccgtgaaattcct

SEQ ID NO: 53805 - DNA, 50 bp, homo sapien
agtgcaagacccttcatgtacataakctcatgtaatcctgaaacccctct

SEQ ID NO: 53806 - DNA, 50 bp, homo sapien
tacattaccagcacaccactggcaaygacgatgaccaaattctgatcaga

SEQ ID NO: 53807 - DNA, 50 bp, homo sapien
actcaacttgtctttgtagctggaamgcaaccatcgataacatgtaaatg

SEQ ID NO: 53808 - DNA, 50 bp, homo sapien
ctcccaaagctggaactcacactcaygcggagcctccaacctcttggttt

SEQ ID NO: 53809 - DNA, 50 bp, homo sapien
ttgagttgatggagaaaacactaaartcaatgagataatcccaaattgat

SEQ ID NO: 53810 - DNA, 50 bp, homo sapien
ctagccagacacatgctgtggaaaakgttctcctcattcagggcatccgg

SEQ ID NO: 53811 - DNA, 50 bp, homo sapien
tcaacttgcatgctggaagatcagasacagacatcttagactagtggaag

SEQ ID NO: 53812 - DNA, 50 bp, homo sapien
actctgtaatcattttgaaacttcaygctataaaagacttcagatgtaga

SEQ ID NO: 53813 - DNA, 50 bp, homo sapien
taaatggtcaacatacggatttgtawaacttagattggtaaaactgctat

SEQ ID NO: 53814 - DNA, 50 bp, homo sapien
cttggtaactgttaacaatagtcctsaatttgatgatcctaagttttggt

SEQ ID NO: 53815 - DNA, 50 bp, homo sapien
tagcagatttagtgtttttaatatcracagcaaacagtagtttgtttcta

SEQ ID NO: 53816 - DNA, 50 bp, homo sapien
atagtcaatttttagctcactttagraatataaatgatacaactgagaat

SEQ ID NO: 53817 - DNA, 50 bp, homo sapien
ttaaggaatcacagacagttaaaaasggatctgcaccacatttactttct

SEQ ID NO: 53818 - DNA, 50 bp, homo sapien
ttatcttcttgtaatgcgttagaaartctgcaaatctagtcagtctcttt

SEQ ID NO: 53819 - DNA, 50 bp, homo sapien
aatggcaacagtgaagaatgaaataratcttccattatcactcagccatt

SEQ ID NO: 53820 - DNA, 50 bp, homo sapien
gacaaatatttgcgcaggaagacaarattcttaggtgagaagcattatat

SEQ ID NO: 53821 - DNA, 50 bp, homo sapien
taattgaagttatttgtatttatgargagaacttgtcaatcagaaggact

SEQ ID NO: 53822 - DNA, 50 bp, homo sapien
gctgattttctgtgtatatgccctcraattatgctggatgtttattgggt

SEQ ID NO: 53823 - DNA, 50 bp, homo sapien
atattgaatatttttaaaaatcatamagctcttgcctggatccaatctag

SEQ ID NO: 53824 - DNA, 50 bp, homo sapien
gtagagagttaatggagtcagccaamggatgtttgccacagttttccata

SEQ ID NO: 53825 - DNA, 50 bp, homo sapien
ttccaagctgcaatgcaaagctgtasaggtgaaaaggaatagggcctctc

SEQ ID NO: 53826 - DNA, 50 bp, homo sapien
tctaacttccttaaatcaaatgtacrcccttcaaattgggagacttcatg

SEQ ID NO: 53827 - DNA, 50 bp, homo sapien
atgaacaacattggaactgatttatracagtcatccaagtgttttctttc

SEQ ID NO: 53828 - DNA, 50 bp, homo sapien
gatgaatcaagagagtacctatgaastggaacaaatactttttcttaaaa

SEQ ID NO: 53829 - DNA, 50 bp, homo sapien
ttaccgcatcataatgtattgactayctgagaaaaatgttgattagctat

SEQ ID NO: 53830 - DNA, 50 bp, homo sapien
gcccccattgcagtcaaagattggaycaattgcagtttccaggacatctg

SEQ ID NO: 53831 - DNA, 50 bp, homo sapien
tatgtagccagaaaaggtgacattamaaagggatttttccactgtagttc

SEQ ID NO: 53832 - DNA, 50 bp, homo sapien
gacacacacgagaactactgcaaagsaatacattgttacacacaaaatgt

SEQ ID NO: 53833 - DNA, 50 bp, homo sapien
agcagtttttgaacctaaatacacaracctcttctaacaatacaagtttc

SEQ ID NO: 53834 - DNA, 50 bp, homo sapien
ttgatatgcaatgtaatggcttagarcaggacactgatgacaacctcagc

SEQ ID NO: 53835 - DNA, 50 bp, homo sapien
gaaatccaatttctgtcacttgctayggaattcagcatcagaaattgttc

SEQ ID NO: 53836 - DNA, 50 bp, homo sapien
agacagtgatatcttaatagcagaartgtctcacaatttgattctttatt

SEQ ID NO: 53837 - DNA, 50 bp, homo sapien
gggaacttgttagaactgtctggcasaaattcagattcttgggactcact

SEQ ID NO: 53838 - DNA, 50 bp, homo sapien
tagctaagtcaccttgggtagtttaygtttctttatatttctgagcctca

SEQ ID NO: 53839 - DNA, 50 bp, homo sapien
cattttccatttcactgtattccatratatgctgtgtaacagagtctaga

SEQ ID NO: 53840 - DNA, 50 bp, homo sapien
ccaaaaaagtgctcctcttactagaygagttgataagaatggattagtaa

SEQ ID NO: 53841 - DNA, 50 bp, homo sapien
attcagcttcctcgccagtctggagycctttgaagacagatcactcctgt

SEQ ID NO: 53842 - DNA, 50 bp, homo sapien
ctccgagaactatgggattatcttamaagactgaacctatgactaatagg

SEQ ID NO: 53843 - DNA, 50 bp, homo sapien
ctccaaaacatttgacaactaagacygggttggaaataataaccaagata

SEQ ID NO: 53844 - DNA, 50 bp, homo sapien
ctggagctgagtgtcagattactaargttcattaaagctcttgctcatag

SEQ ID NO: 53845 - DNA, 50 bp, homo sapien
agcaggcagccatttggttgtacaakaaaatctcatgctttctacccagg

SEQ ID NO: 53846 - DNA, 50 bp, homo sapien
cacatggattgatcagttgattggcscttgtaataattctattggaagaa

SEQ ID NO: 53847 - DNA, 50 bp, homo sapien
tcacagtattggtatttatcatgagrcctgtcataggagatcgagggtac

SEQ ID NO: 53848 - DNA, 50 bp, homo sapien
tttcagtttgcctgattccttgctakgctgaaagattcaaggtcatcttt

SEQ ID NO: 53849 - DNA, 50 bp, homo sapien
aagattcgaaatggagatggacagargaaactgacggtttagaaacattg

SEQ ID NO: 53850 - DNA, 50 bp, homo sapien
gctgtttgggcagggcttctaaaaasaatttcaggataaaaactgtctcc

SEQ ID NO: 53851 - DNA, 50 bp, homo sapien
ccaacctatggtctagattttaaaamttgatgaagaaaatgctaataatg

SEQ ID NO: 53852 - DNA, 50 bp, homo sapien
atgcagcactcagcaagtctgagaartcccttaaggcataatcatcaatg

SEQ ID NO: 53853 - DNA, 50 bp, homo sapien
atgacaggtaaaattgaagcagcatyagttatgcatttaggaaatatatt

SEQ ID NO: 53854 - DNA, 50 bp, homo sapien
atcctgagtgtctttgtaaagccaayagaaaacatggagtccttgtgggg

SEQ ID NO: 53855 - DNA, 50 bp, homo sapien
actttaggaatcctttggagactacyactgagagaaagaaggacagaact

SEQ ID NO: 53856 - DNA, 50 bp, homo sapien
tctctgccagtccccaaaatgtagayaatgctccaaaagttctgtccttc

SEQ ID NO: 53857 - DNA, 50 bp, homo sapien
ttggttgccttggttaatggtagaasaggttccaaaaagaaaagaactgg

SEQ ID NO: 53858 - DNA, 50 bp, homo sapien
cctctcatctcctgtctttagcccarggcttgcctctgacattccctcca

SEQ ID NO: 53859 - DNA, 50 bp, homo sapien
ggaaattctctctattcttgaaggarcgctttagaagcacagaattatta

SEQ ID NO: 53860 - DNA, 50 bp, homo sapien
cggcaaaagctgactgatacagaccrcttagccaaagtaaagtatattca

SEQ ID NO: 53861 - DNA, 50 bp, homo sapien
actgaaattcttggtaaattattaarcagtaatcacagactcatttatat

SEQ ID NO: 53862 - DNA, 50 bp, homo sapien
gattccagggcctatcctaaaaccaytggaagagaattacacagaggtag

SEQ ID NO: 53863 - DNA, 50 bp, homo sapien
tataatttttctcattagtggtgaaragaatggaaaatgtgcttgcataa

SEQ ID NO: 53864 - DNA, 50 bp, homo sapien
ttctcttgatttgcactgtagctggyagtataagtgtagcctaaataaga

SEQ ID NO: 53865 - DNA, 50 bp, homo sapien
caatagcagttgaatattgccactarggaagagagtcaccaaagatgctt

SEQ ID NO: 53866 - DNA, 50 bp, homo sapien
ctacttctaaagccctaggtatgaaygaatgcatgacaactcagtgctgc

SEQ ID NO: 53867 - DNA, 50 bp, homo sapien
gttctggcctttacacacccaaatcrcctgagagagagtgcaaaccagat

SEQ ID NO: 53868 - DNA, 50 bp, homo sapien
atctaccttttcagagttatggtagraaagacatgagatcatttttatct

SEQ ID NO: 53869 - DNA, 50 bp, homo sapien
aagaatgtgggaggatacacattcasctgttagagttcattaccttaagg

SEQ ID NO: 53870 - DNA, 50 bp, homo sapien
ctcctgcgtcagagataaaaaacatractggaagaccagcttgttcactt

SEQ ID NO: 53871 - DNA, 50 bp, homo sapien
acttacttcacaagttgttgctacaratttctcagaatatcaataaagaa

SEQ ID NO: 53872 - DNA, 50 bp, homo sapien
tggaaagacagagttctttgccacayggtatacaccttacctagaaggct

SEQ ID NO: 53873 - DNA, 50 bp, homo sapien
aagtgtgaagctattaaaattgttaygcatctagtgacgtggaaagataa

SEQ ID NO: 53874 - DNA, 50 bp, homo sapien
aaaaggagtcaattataagatatgcrgatgggatgcacactgaagaatca

SEQ ID NO: 53875 - DNA, 50 bp, homo sapien
ttgctatggcacattgctggttataktaccatttttataatgtcagaaaa

SEQ ID NO: 53876 - DNA, 50 bp, homo sapien
caacctattcatatgttctgagatasaaaatacatcaaggaaatttttgt

SEQ ID NO: 53877 - DNA, 50 bp, homo sapien
aagaaaacagtacagggtgatgtaayaaaataatagcaatgggtaaagaa

SEQ ID NO: 53878 - DNA, 50 bp, homo sapien
tatttaggtcatactgcctttggtayagtaggtagatagccaggcaccag

SEQ ID NO: 53879 - DNA, 50 bp, homo sapien
cttctctcccccaatacttgcttaamcaaatttatactctgcctttttgt

SEQ ID NO: 53880 - DNA, 50 bp, homo sapien
aactgactaattaattcttctttacrggataagtgacaaaaatttccttg

SEQ ID NO: 53881 - DNA, 50 bp, homo sapien
cattataaaagtatcatccttaccakatatatttgtaatgggcaccaatg

SEQ ID NO: 53882 - DNA, 50 bp, homo sapien
tcaaggaataccaaggggaacaatcygacttcaccgacggatgagagacc

SEQ ID NO: 53883 - DNA, 50 bp, homo sapien
gagtcttttcctcactgaccatcacygggtaattttctgagcgctccctg

SEQ ID NO: 53884 - DNA, 50 bp, homo sapien
caaagcatttagtggcaagcatcaaygaatagtggccatcaatataattg

SEQ ID NO: 53885 - DNA, 50 bp, homo sapien
ttttaaaaggggacatttagagccamtacattgtagaattttcagtaaca

SEQ ID NO: 53886 - DNA, 50 bp, homo sapien
ggctgcagaaatttgcataagtaaasacaaggcaagtactgacagccaag

SEQ ID NO: 53887 - DNA, 50 bp, homo sapien
tggaggcgtgaagaagtcggccacaytcagatcttttgaaggtctgatgg

SEQ ID NO: 53888 - DNA, 50 bp, homo sapien
aaaaatcactgaccttggtttcaagyccaagtcatgtctaaatgttttac

SEQ ID NO: 53889 - DNA, 50 bp, homo sapien
acaagatcatgctcgcaagaattacmagaatatccaacaaaatcactaga

SEQ ID NO: 53890 - DNA, 50 bp, homo sapien
acgtaataattggtgtgattaaggcrattagggctattatagtagtggaa

SEQ ID NO: 53891 - DNA, 50 bp, homo sapien
aaacaaaagtatgaatttgaatgtakgttcagttctacttgactcctttt

SEQ ID NO: 53892 - DNA, 50 bp, homo sapien
tgttggacatgattaaccaaataacyctttgtggcatgtacacacaagac

SEQ ID NO: 53893 - DNA, 50 bp, homo sapien
aaagacctcagtgccttcagaaaggkagaagattagagattacaggagag

SEQ ID NO: 53894 - DNA, 50 bp, homo sapien
aaaagaatcttatttatatcatacamcttggtaggaatttcatgaaatag

SEQ ID NO: 53895 - DNA, 50 bp, homo sapien
aaaatctctgagttagtgggtatcasatccagaactcaagaccatgtctt

SEQ ID NO: 53896 - DNA, 50 bp, homo sapien
aaccctagtgttagagactcttgaakggataagaacaccaagaattcaaa

SEQ ID NO: 53897 - DNA, 50 bp, homo sapien
agcctgattctactttcacagtttcwattttaaactccctttttgtagtc

SEQ ID NO: 53898 - DNA, 50 bp, homo sapien
aaactaacacatttatttttatgtgyagttaaagtcatagaaacctgttt

SEQ ID NO: 53899 - DNA, 50 bp, homo sapien
taataatccatcgccaaaactaaccrccaggaagataaggagggtataga

SEQ ID NO: 53900 - DNA, 50 bp, homo sapien
actttctaattcatcggttcatccasctaggcattcattaacaattcagc

SEQ ID NO: 53901 - DNA, 50 bp, homo sapien
ttgataaaaattcaacagtttaggartagaaggaaattcaacataacaaa

SEQ ID NO: 53902 - DNA, 50 bp, homo sapien
cactgtaacaggagattggataataratggctcctttgcgcgttgaggag

SEQ ID NO: 53903 - DNA, 50 bp, homo sapien
ttacatggcagtcagcaagaattaargcctatgataatgaaaaagaatga

SEQ ID NO: 53904 - DNA, 50 bp, homo sapien
cctgctggttgttcgattatcagtgracagcttaaataatcggtttgata

SEQ ID NO: 53905 - DNA, 50 bp, homo sapien
tgtatataaaatcattatagcactaygttgagtttgttggtacttgtttg

SEQ ID NO: 53906 - DNA, 50 bp, homo sapien
cttcaggatatcaatagcatcttaaygttcaaaattcacagtgataatca

SEQ ID NO: 53907 - DNA, 50 bp, homo sapien
tcaaaaacatatttgtgtgatgaacraccaacacttaattaaagccagcg

SEQ ID NO: 53908 - DNA, 50 bp, homo sapien
ggttgtgtaattgttttagaatatamctcattgcatggacattttattga

SEQ ID NO: 53909 - DNA, 50 bp, homo sapien
ctccctatcaatttgaaagagggtcraagaaatgtaacacaataatggac

SEQ ID NO: 53910 - DNA, 50 bp, homo sapien
agcctgagagtgactttgaacaaackaccctttacctcacttttcacctc

SEQ ID NO: 53911 - DNA, 50 bp, homo sapien
aagatcacttcactttcgtcaagtcyctgctacgtaagatttcccatgtg

SEQ ID NO: 53912 - DNA, 50 bp, homo sapien
aacaaagaatgactcctaagtactgyagtttataatgtgaactggatgac

SEQ ID NO: 53913 - DNA, 50 bp, homo sapien
ataaattgcattttcacttagaggcrgaagatcaacagtggaacaattta

SEQ ID NO: 53914 - DNA, 50 bp, homo sapien
gatatgccacatcttggcatcaaccraatatggcatcatctgcctggagg

SEQ ID NO: 53915 - DNA, 50 bp, homo sapien
gcagcctctgtttatacatggaatartaatgttaagaatcaacataggtc

SEQ ID NO: 53916 - DNA, 50 bp, homo sapien
catgtaccttgagatgagtgtctacracttacgcttgttcgatattccct

SEQ ID NO: 53917 - DNA, 50 bp, homo sapien
cactattttgataacattttgagtayggagagagaatacagagcattttt

SEQ ID NO: 53918 - DNA, 50 bp, homo sapien
ttttcttgtttattgctgcaaccccrggacctagaacagtacttcatata

SEQ ID NO: 53919 - DNA, 50 bp, homo sapien
tacaactctactcaaagatcatttayataggaactcaaagacacatgtac

SEQ ID NO: 53920 - DNA, 50 bp, homo sapien
gtcaagggagggatattataaaaccrgagaaagtatagtaatcatagcct

SEQ ID NO: 53921 - DNA, 50 bp, homo sapien
tttagaacatttgctatacttctgayataattttacctccagccttgtaa

SEQ ID NO: 53922 - DNA, 50 bp, homo sapien
tggagaggagaacctaaataggcaarcaggattttatttagaagaaatag

SEQ ID NO: 53923 - DNA, 50 bp, homo sapien
agactaatccacaaactggataaggycattaagaatccactcatcatcac

SEQ ID NO: 53924 - DNA, 50 bp, homo sapien
tgtgtcaggaaaaggcagcctaacasaattttaagaacataagctttgga

SEQ ID NO: 53925 - DNA, 50 bp, homo sapien
ctttttctccctctattgtccacaastcataactgtataaattcatcata

SEQ ID NO: 53926 - DNA, 50 bp, homo sapien
catccttgacatttccttatatactyaccctcaatatatgaggaaataat

SEQ ID NO: 53927 - DNA, 50 bp, homo sapien
tggaagtcgctagcatataaatggtracagagccacgggattagacaaaa

SEQ ID NO: 53928 - DNA, 50 bp, homo sapien
atgaaattaaaagggcaaaaatgtawccagtgtctaagagtaggttccct

SEQ ID NO: 53929 - DNA, 50 bp, homo sapien
gaatttagataaaagtaagaggctgraaaattgaaagggagctcataccc

SEQ ID NO: 53930 - DNA, 50 bp, homo sapien
atgtatgaatgaaaataaattattgraaaatgaatgaagggtaagagttg

SEQ ID NO: 53931 - DNA, 50 bp, homo sapien
aaagtcagtgtattgtcaggtctcasaggattcagaagaccagacaatac

SEQ ID NO: 53932 - DNA, 50 bp, homo sapien
ataattcatcatctcagtctcacacrgaaatattaactttcttaaatttt

SEQ ID NO: 53933 - DNA, 50 bp, homo sapien
tctgcttctataggttgtcaggaaasattaaatcctctgatcttttatgt

SEQ ID NO: 53934 - DNA, 50 bp, homo sapien
ttgggtttaatgcaggctctattacratgggactcacacatcacactggt

SEQ ID NO: 53935 - DNA, 50 bp, homo sapien
tatccatactcaggatagtcattcasaatgctgcttggaatgttacatgc

SEQ ID NO: 53936 - DNA, 50 bp, homo sapien
ttctcttatttctccacaatactgamctgagagatctgaaaatcactaaa

SEQ ID NO: 53937 - DNA, 50 bp, homo sapien
tgagcaggcgcccagaacctaaaagwaagtactgtgtgtctaatataaaa

SEQ ID NO: 53938 - DNA, 50 bp, homo sapien
tgatagcaatctctcctttccacaamagtttatgataggtgttgtcagtg

SEQ ID NO: 53939 - DNA, 50 bp, homo sapien
caagcaaataagtaaataaataaggwcaaagaagggacttggttggtagt

SEQ ID NO: 53940 - DNA, 50 bp, homo sapien
gccacaagcttctctgactccagaakaggaatgggcagtattaatttcag

SEQ ID NO: 53941 - DNA, 50 bp, homo sapien
cttgcagaattgtatctgctcttcawtcaacctagaatcacagcaatttt

SEQ ID NO: 53942 - DNA, 50 bp, homo sapien
tgagattttcatatatctagaaaagycagtttggagatcagcagtctaat

SEQ ID NO: 53943 - DNA, 50 bp, homo sapien
taccagtgttacatacaatataaacmggaaatatgcacgtcaaaataata

SEQ ID NO: 53944 - DNA, 50 bp, homo sapien
ataaatgaataatgagcaaatcatamactgagatcacccagcctaattca

SEQ ID NO: 53945 - DNA, 50 bp, homo sapien
aattataccactgagaaaaaagaccrctgttaaggactggtcaaatattt

SEQ ID NO: 53946 - DNA, 50 bp, homo sapien
ctggttcttactcttaaaaagctcartctatcaaaggtaggccaggctac

SEQ ID NO: 53947 - DNA, 50 bp, homo sapien
gaagcctccaagcaactggtttcaamtccaaatcactgctattggcacag

SEQ ID NO: 53948 - DNA, 50 bp, homo sapien
agcgtttcatgttgtcttacctctaygaggctccattggtctctgtcccc

SEQ ID NO: 53949 - DNA, 50 bp, homo sapien
tctttacaaatatatagatacataartgaaatcactgctatttggtgact

SEQ ID NO: 53950 - DNA, 50 bp, homo sapien
ctggaaataaactggcttaataccaygtgcctaggatttgtggtacaaag

SEQ ID NO: 53951 - DNA, 50 bp, homo sapien
tgctacatagtgatgggagccatttwaaaagaggtaagaatccataattt

SEQ ID NO: 53952 - DNA, 50 bp, homo sapien
atttatcctagctttacgtgcatctyacggaaacaggatacacggtgtat

SEQ ID NO: 53953 - DNA, 50 bp, homo sapien
gaacttctgttttagagaacatcaasctattcatcttacggttttcagca

SEQ ID NO: 53954 - DNA, 50 bp, homo sapien
ttctgctatggaattttctctttaaygctgaaggccacattgggatgcct

SEQ ID NO: 53955 - DNA, 50 bp, homo sapien
aagactgaaaggttcctgagatcatsaagtttgaaatttaaagggagata

SEQ ID NO: 53956 - DNA, 50 bp, homo sapien
aaatcaaaaactgttctgcacccaastcatgctataaaatctagtttaag

SEQ ID NO: 53957 - DNA, 50 bp, homo sapien
tttcttataaaaacatacagagagtmaatacaatatccaataacaaatat

SEQ ID NO: 53958 - DNA, 50 bp, homo sapien
atgagcatttgctggagccaaagtcyacaagtgtcctcgaattctcaaaa

SEQ ID NO: 53959 - DNA, 50 bp, homo sapien
catgaaaagtccttgacaaattccartaactaataaactgggttttatat

SEQ ID NO: 53960 - DNA, 50 bp, homo sapien
gagaacaactatcttacataccaagratatactaggcatatgtatgcatt

SEQ ID NO: 53961 - DNA, 50 bp, homo sapien
agagctcattacagacaagtattggrcaagacatttaaagagtagaataa

SEQ ID NO: 53962 - DNA, 50 bp, homo sapien
ttctaacgaactctgtactttccaayctattctatagccaagttagggtt

SEQ ID NO: 53963 - DNA, 50 bp, homo sapien
tgctttcttttgaaatacctcttgamggagcaacctgaggctgttttatt

SEQ ID NO: 53964 - DNA, 50 bp, homo sapien
acacacactgcctgctgttacctacrggcaaaatccttgccatccatgga

SEQ ID NO: 53965 - DNA, 50 bp, homo sapien
catgttgaatagacttgtattttaamcgtttcattgccagtttctactgg

SEQ ID NO: 53966 - DNA, 50 bp, homo sapien
tttattttggctggcaagagttgcartaaaatcctcggcctataatttaa

SEQ ID NO: 53967 - DNA, 50 bp, homo sapien
gttaagtgagatagctttctcagcayaagggtgacgcagacaagcagaaa

SEQ ID NO: 53968 - DNA, 50 bp, homo sapien
caagatcagcaattaattatgcatasaaatgtcacttaaagaaaagtctg

SEQ ID NO: 53969 - DNA, 50 bp, homo sapien
gagaatgttatcactacggagaaaargattcaatcatatttgatggctgc

SEQ ID NO: 53970 - DNA, 50 bp, homo sapien
ggtttggtgatcccagttccactcaraaaaattatctatgtgcaaagcat

SEQ ID NO: 53971 - DNA, 50 bp, homo sapien
actttcaggtttacaggttaataaawcttgtgaccaacaagcagaagggg

SEQ ID NO: 53972 - DNA, 50 bp, homo sapien
ttagcatgatgagaacacctttctgwaaatgtgactttcaaactttgaaa

SEQ ID NO: 53973 - DNA, 50 bp, homo sapien
tttattgttctctcctagaaaatatragtcaaccttcaggctgatatgat

SEQ ID NO: 53974 - DNA, 50 bp, homo sapien
tttagctatatgtgtgcagatcataygtaccttgagatctcagaaggcat

SEQ ID NO: 53975 - DNA, 50 bp, homo sapien
ggaccaatattttgttctctaaaggycatggatgtgagctaattacacag

SEQ ID NO: 53976 - DNA, 50 bp, homo sapien
atgcagatttttttccttatcacagractgcagaatttaaaatgatttca

SEQ ID NO: 53977 - DNA, 50 bp, homo sapien
ttttgctaggtaatggccattatacmgagtttaaagtcaattcattttct

SEQ ID NO: 53978 - DNA, 50 bp, homo sapien
acagtgagaaaatatatgctacttayaactcactgagtcatacatgtatg

SEQ ID NO: 53979 - DNA, 50 bp, homo sapien
acaggattttaaaatgtccttagctkaatttaccataatttagctaccag

SEQ ID NO: 53980 - DNA, 50 bp, homo sapien
tgcactttgtgaacgatgccgttgargtcatgcaatgtgatggccctgat

SEQ ID NO: 53981 - DNA, 50 bp, homo sapien
aggaagaattcactctgacttaaatsattattctcaaggatttgccataa

SEQ ID NO: 53982 - DNA, 50 bp, homo sapien
tttttaaaaattaaaattactttacmgcataatggtgaaatgctgatgtg

SEQ ID NO: 53983 - DNA, 50 bp, homo sapien
catcctacactggtgtagtgggtcastgaaattataatgtctgaagaaac

SEQ ID NO: 53984 - DNA, 50 bp, homo sapien
acccattttccctggaaagaaaagasgtattgacttgtatgtgagaaatg

SEQ ID NO: 53985 - DNA, 50 bp, homo sapien
caaaactggagagacgagattggaaygggctaaattttggttaggaaaaa

SEQ ID NO: 53986 - DNA, 50 bp, homo sapien
ctttcaacaaatatgatacacaaaastctggattagctcaaaaggcctcc

SEQ ID NO: 53987 - DNA, 50 bp, homo sapien
ccatgatcgaaccatctcctttacartacttaaaccttgttatagtttgg

SEQ ID NO: 53988 - DNA, 50 bp, homo sapien
ttcattaaaagcttccaggggaaccyaatgtgctgtaacactggagaatc

SEQ ID NO: 53989 - DNA, 50 bp, homo sapien
ttaatattcctggggacctcggcccraaatataactgtgtttcttatagt

SEQ ID NO: 53990 - DNA, 50 bp, homo sapien
tgcaacttactttgaactgcatggargaacaacgtgggtttatggatacg

SEQ ID NO: 53991 - DNA, 50 bp, homo sapien
tctttcatttttccatgagaagaaastaagataggccgaagaaacgcttt

SEQ ID NO: 53992 - DNA, 50 bp, homo sapien
tttttccatttaacatacagaagaaycttatgaggaaagtaggagagaga

SEQ ID NO: 53993 - DNA, 50 bp, homo sapien
ttgaaatggggctagtcaaaattcayatggggtgtcaagtacaaaataaa

SEQ ID NO: 53994 - DNA, 50 bp, homo sapien
ctcctcctcaggttaaatgaataagratctacaaagttaatacacaggta

SEQ ID NO: 53995 - DNA, 50 bp, homo sapien
gatagctaaagataaatcctttaacraaatcaaccagcaagaatctttcc

SEQ ID NO: 53996 - DNA, 50 bp, homo sapien
cctgtctaatctttgttggccttaayattttgccccttgctccttgtaaa

SEQ ID NO: 53997 - DNA, 50 bp, homo sapien
caatttgagaggaggtgctcttaagsaaacgaagaacaataagtaagtaa

SEQ ID NO: 53998 - DNA, 50 bp, homo sapien
taaccttgaactcatctcctcgtctraacacgatcaaatttaattcagat

SEQ ID NO: 53999 - DNA, 50 bp, homo sapien
aatgttaatactggcctaaaggtaartctgcaaccatatgatatttacaa

SEQ ID NO: 54000 - DNA, 50 bp, homo sapien
cctgaccttccatgaatcagtcctaraggccgcttgtatccattctaaat

SEQ ID NO: 54001 - DNA, 50 bp, homo sapien
gagatattttactttagtggctacarcattaggaatataatggttaggta

SEQ ID NO: 54002 - DNA, 50 bp, homo sapien
ccaagtgcaaactatagggttcaaascataaatgaatattatccaagact

SEQ ID NO: 54003 - DNA, 50 bp, homo sapien
tatgaccaattttttaaatatccacragggtcacaaaaggaaacatttta

SEQ ID NO: 54004 - DNA, 50 bp, homo sapien
cagggagagcttgccgtatattgtgyaacagagcatgtacttccaagaca

SEQ ID NO: 54005 - DNA, 50 bp, homo sapien
taggctgaaggggtcaagcacattayggtgatttttctgagctgagcagg

SEQ ID NO: 54006 - DNA, 50 bp, homo sapien
cctgctattacattctttcttgtccyagtagcggttaaatatttgataga

SEQ ID NO: 54007 - DNA, 50 bp, homo sapien
actgagttttatagtttagttagtaytacaccagcattcagcctacctat

SEQ ID NO: 54008 - DNA, 50 bp, homo sapien
aggattgggggttagaactaagccaracattcccaattcccactaccaag

SEQ ID NO: 54009 - DNA, 50 bp, homo sapien
tggaggtaccaagagtggacaaggaraagttcaactggtcttgtaaccaa

SEQ ID NO: 54010 - DNA, 50 bp, homo sapien
taaaccttactcaacataaatgtcaygttctagtggtttttatgagcaaa

SEQ ID NO: 54011 - DNA, 50 bp, homo sapien
agcatttgaatccacacttgtggcayatgagtacctgtccggcgaccagg

SEQ ID NO: 54012 - DNA, 50 bp, homo sapien
ggtcctaaagatgaaacaaagtgatsaaatgtactgagtgcagacaaaaa

SEQ ID NO: 54013 - DNA, 50 bp, homo sapien
ctggagcgaggattacaaaacaaaartagaggagatgccatgttagaagt

SEQ ID NO: 54014 - DNA, 50 bp, homo sapien
aaagaaatgctcataaaaatggaaakgaggcataattttccatggagcaa

SEQ ID NO: 54015 - DNA, 50 bp, homo sapien
aaataagaacttcacttggacttaaracgtttgtgaatccaagtgtttag

SEQ ID NO: 54016 - DNA, 50 bp, homo sapien
acttgtgtgagaacatttaaagcacrattcacccaaacattaagccatta

SEQ ID NO: 54017 - DNA, 50 bp, homo sapien
gttaattaaagaattaccaacaaacratttgatttcctatctatccagct

SEQ ID NO: 54018 - DNA, 50 bp, homo sapien
taggaaactggccaaatgaagtttgyaatcaaattggttcccatttacca

SEQ ID NO: 54019 - DNA, 50 bp, homo sapien
tttcatagaaataatctcagttcaastattgatgatatctagctggtatg

SEQ ID NO: 54020 - DNA, 50 bp, homo sapien
agtggctgttctttccaccaatgaargctagaattacatctcaaaacatc

SEQ ID NO: 54021 - DNA, 50 bp, homo sapien
gttataggttggtacacataatgaamatagttttatatcctgtgccttaa

SEQ ID NO: 54022 - DNA, 50 bp, homo sapien
gtgaattttcccaaactttggaaaayggatgtataatttaagcttttgcc

SEQ ID NO: 54023 - DNA, 50 bp, homo sapien
taggaacttggaatactctaagacamaaacggtcaaacaaatcccagtcc

SEQ ID NO: 54024 - DNA, 50 bp, homo sapien
gtatcattttaaatagaaacatttayatttgagccatactcttcctttgt

SEQ ID NO: 54025 - DNA, 50 bp, homo sapien
aatgtttcaggtgttaagtggttaaygtgctgcaaatttttaaaatatca

SEQ ID NO: 54026 - DNA, 50 bp, homo sapien
tgtgaactcagctagcgtcaatcaartaaataacctgttaacaatgtcct

SEQ ID NO: 54027 - DNA, 50 bp, homo sapien
aatccttatatggtcagttcctaatsatgagaggagttcagctagcatct

SEQ ID NO: 54028 - DNA, 50 bp, homo sapien
gaaaagactcagctgtctaggatacrggattcatttactgttagccataa

SEQ ID NO: 54029 - DNA, 50 bp, homo sapien
tcttctccacataaaatagaaagcasataaaatgtatgaataaattgtaa

SEQ ID NO: 54030 - DNA, 50 bp, homo sapien
tgatcaataccttgcttgttttacaygtgaggaaaagtgtgcaggcattg

SEQ ID NO: 54031 - DNA, 50 bp, homo sapien
caggtaatccattgaccaagacaaaytgttctgcgcgatctctcatcttt

SEQ ID NO: 54032 - DNA, 50 bp, homo sapien
aagataattcatttgctaggaagaaygagaacaatgatttttatacatgt

SEQ ID NO: 54033 - DNA, 50 bp, homo sapien
ttgaaaacatttaaatacagttagawgtaatattttttctattgatttgt

SEQ ID NO: 54034 - DNA, 50 bp, homo sapien
aacaatagaccaagaaatggatagayaagagattgcaagttagagaggca

SEQ ID NO: 54035 - DNA, 50 bp, homo sapien
gatgcactgatgtctacttaacacaratatatttataaagagtaaataat

SEQ ID NO: 54036 - DNA, 50 bp, homo sapien
acgttgtgatacattgaatactaaamattccagagagtgatgatagccct

SEQ ID NO: 54037 - DNA, 50 bp, homo sapien
ttttatatccactcaagactagtcamaatagctgaatgcaaagtagttag

SEQ ID NO: 54038 - DNA, 50 bp, homo sapien
caaagagagggctcagaacttataamcaatcacctctcagcatatcttac

SEQ ID NO: 54039 - DNA, 50 bp, homo sapien
ggaggccacaaacgcagtgaattaasaataagttctatgagccagatctc

SEQ ID NO: 54040 - DNA, 50 bp, homo sapien
gatcccaagaaatacttctctaccayaggtctccctccttcctattcctc

SEQ ID NO: 54041 - DNA, 50 bp, homo sapien
gtcctctgtaccttgttggctgtccrgatatttcaaataaacatcaattt

SEQ ID NO: 54042 - DNA, 50 bp, homo sapien
agttcccagtccgctgcgactcctcygacactaagatgatcaagatctcc

SEQ ID NO: 54043 - DNA, 50 bp, homo sapien
gtgttgctcttagtttgccagatgcyatcttgagatcacgcttataaaaa

SEQ ID NO: 54044 - DNA, 50 bp, homo sapien
tatctgctcagaatgctaatagataygtggaataattagaaaagattcag

SEQ ID NO: 54045 - DNA, 50 bp, homo sapien
attttctctcatttccaagatatcaratgtataccagagaaagaacatat

SEQ ID NO: 54046 - DNA, 50 bp, homo sapien
atttagaatgcgtatgtttcctctaygtataaggtttcctagagtcagat

SEQ ID NO: 54047 - DNA, 50 bp, homo sapien
gaatcctgcctattaggatatctaamaagttccaggtactaatctggttc

SEQ ID NO: 54048 - DNA, 50 bp, homo sapien
ctaaaatgttagacaatattttaacygtgtatgttgccacttgcataaca

SEQ ID NO: 54049 - DNA, 50 bp, homo sapien
tcttaagcggagggaacaacccttaygaaagtgcagaagtttgaaaatac

SEQ ID NO: 54050 - DNA, 50 bp, homo sapien
ctgagctcttcaccacttgttctaaytgatcatgtattttcaaacttctg

SEQ ID NO: 54051 - DNA, 50 bp, homo sapien
aaacattacagtaacaattagctcayacatattttattagaaaaggtgac

SEQ ID NO: 54052 - DNA, 50 bp, homo sapien
tcccaggtatcttatcagtttcccakatcatgccggtttgattctgtctg

SEQ ID NO: 54053 - DNA, 50 bp, homo sapien
acaaaagtgacatccacagacctaaygacttacatgatattatcatgcct

SEQ ID NO: 54054 - DNA, 50 bp, homo sapien
aagtataagttatccaggacaaagcratacttcttagaaagtaaaacaca

SEQ ID NO: 54055 - DNA, 50 bp, homo sapien
tttgcgagttttgagtaagtgtctaygtttaattgcttcttgttagaaac

SEQ ID NO: 54056 - DNA, 50 bp, homo sapien
aacatccattcacctcctaaatgtaractgagggaccaggaatggaaaag

SEQ ID NO: 54057 - DNA, 50 bp, homo sapien
gggccatattttttgttggacttagsaaataagtttattgatgtcattgt

SEQ ID NO: 54058 - DNA, 50 bp, homo sapien
atttcttgctagtattgctgaaatasacctctaataggttcctaacctta

SEQ ID NO: 54059 - DNA, 50 bp, homo sapien
taatatgagaactaactaatataatsaactcaccactagcttcggagaaa

SEQ ID NO: 54060 - DNA, 50 bp, homo sapien
aagctttctgtagtttctcaaataayctctggacttgcagagttcctcaa

SEQ ID NO: 54061 - DNA, 50 bp, homo sapien
ccttcagtaacacaaacctttggaaytgtacttattgaataaaatgaccc

SEQ ID NO: 54062 - DNA, 50 bp, homo sapien
ttttaaagttacattaaaaaaagaayatagggcctcaatcactaaactca

SEQ ID NO: 54063 - DNA, 50 bp, homo sapien
aaagagcaagtcaaagatcaaagtaraatttaaagacattgtagtcaaga

SEQ ID NO: 54064 - DNA, 50 bp, homo sapien
ggaaactacctacagtcaggaaaagyattatcatcattatcctcagaact

SEQ ID NO: 54065 - DNA, 50 bp, homo sapien
agcccaacctcaagcaaagggttcartaaattgtagcaagcaaataccat

SEQ ID NO: 54066 - DNA, 50 bp, homo sapien
aaaatgacaaaccatagagtccgaargtgaagatgaagcgggatgggagt

SEQ ID NO: 54067 - DNA, 50 bp, homo sapien
ctttttattgcctatctgataaacartcacatcaaattattcttgttccc

SEQ ID NO: 54068 - DNA, 50 bp, homo sapien
ttaataccttaagataatcattacartccatttgttgagaaatactcatt

SEQ ID NO: 54069 - DNA, 50 bp, homo sapien
tgataataggcctttcataagaactraataattgtcaatgtaggtggcac

SEQ ID NO: 54070 - DNA, 50 bp, homo sapien
ttttctaaagtattctcagtagtgamagttcgttgaatttgaattaatta

SEQ ID NO: 54071 - DNA, 50 bp, homo sapien
aatagtgcatatttatctgtgtctayggaaatattacccaaatatctcta

SEQ ID NO: 54072 - DNA, 50 bp, homo sapien
agtagaccatgccacatttccatcartctgtagaaacatttaaaggtcta

SEQ ID NO: 54073 - DNA, 50 bp, homo sapien
ctatgaagtcaggcctaagtatataygtaatcagtagaatagattgattt

SEQ ID NO: 54074 - DNA, 50 bp, homo sapien
ctgcctaagaactcccatttaaaaarcagaatgaatcgtatctttgagta

SEQ ID NO: 54075 - DNA, 50 bp, homo sapien
gctttctccagcttcatctaaatgcraagacccatctttgcactctcagt

SEQ ID NO: 54076 - DNA, 50 bp, homo sapien
cagaatgaacaccacaaaccaaaackctcagcatctttttccaactgata

SEQ ID NO: 54077 - DNA, 50 bp, homo sapien
gaagatattaagtaacaggtggaagkactgattaatctctgctgaataaa

SEQ ID NO: 54078 - DNA, 50 bp, homo sapien
aaaggaggagtggtcagtcttttcamgtccaaattggcacacagtattta

SEQ ID NO: 54079 - DNA, 50 bp, homo sapien
acaataccttctattgagtcattcargtattcatcaaatatttgtttagt

SEQ ID NO: 54080 - DNA, 50 bp, homo sapien
aggatggctctagtcatggatgtaamaaatgctcttcttatttaatatct

SEQ ID NO: 54081 - DNA, 50 bp, homo sapien
tcctatttttcagtctccagttaccyagattagaccacgtaactgtaact

SEQ ID NO: 54082 - DNA, 50 bp, homo sapien
tatgaattcccataatggtcaaccamgaaatcttatgggaaacataacga

SEQ ID NO: 54083 - DNA, 50 bp, homo sapien
cattgtatgtcaagggcaatagcaamccaagataaccttcatctgttcag

SEQ ID NO: 54084 - DNA, 50 bp, homo sapien
tgctatgttgtttcattggttataawacatgaattagctgattttgaaat

SEQ ID NO: 54085 - DNA, 50 bp, homo sapien
tgacgtctattgaatattgcaggaaygactattaagaatatctgtgttag

SEQ ID NO: 54086 - DNA, 50 bp, homo sapien
atctgaatttttcagtatcaatcaaygttatgtttaattagagagaagat

SEQ ID NO: 54087 - DNA, 50 bp, homo sapien
cattttaaatcaattattcatatggracaagtgagtaaaggtcagtttat

SEQ ID NO: 54088 - DNA, 50 bp, homo sapien
attccttcacatggttttgttggtaygaggccattgaagaaatgatttca

SEQ ID NO: 54089 - DNA, 50 bp, homo sapien
gcattttgctgtatgttaggaggccragctcgcactgagatagctcctcc

SEQ ID NO: 54090 - DNA, 50 bp, homo sapien
taaattcagtgttcatttggattgasgtagcgcaaagaaaccttacagga

SEQ ID NO: 54091 - DNA, 50 bp, homo sapien
attcttgtaatttatgttctctagayatcagtttctcatacaaattttaa

SEQ ID NO: 54092 - DNA, 50 bp, homo sapien
gtatttcaatctgcagttggtttaayctaaggatgtagaactctcagatt

SEQ ID NO: 54093 - DNA, 50 bp, homo sapien
aaacaagcttaaaaaatcttccaagwatagaaaatcgaaaaaaaggattc

SEQ ID NO: 54094 - DNA, 50 bp, homo sapien
tattaaataatccatcttttctctgscaatcgcatctctttctggaatct

SEQ ID NO: 54095 - DNA, 50 bp, homo sapien
aagctctctcaatgtttctttcacartagtctaactgaatagaattttgg

SEQ ID NO: 54096 - DNA, 50 bp, homo sapien
aggtcccatttgcccacagttctgayggaagtatatagctaacaataaac

SEQ ID NO: 54097 - DNA, 50 bp, homo sapien
tccatgcttcattcagatgacgaaaraagaatttctaaaaggaataattg

SEQ ID NO: 54098 - DNA, 50 bp, homo sapien
gtaggaaattagccagtctaaaatasaacatacagatactgaataatcag

SEQ ID NO: 54099 - DNA, 50 bp, homo sapien
ttatggaattacaatttggttctcastatgatttacttagtgtgggttga

SEQ ID NO: 54100 - DNA, 50 bp, homo sapien
caagtgctttgtataattacaaaaakatgtacacatgcacacacacttgc

SEQ ID NO: 54101 - DNA, 50 bp, homo sapien
tattgttgggaaggttgtcctctggkatagttttgtagaccggacggttc

SEQ ID NO: 54102 - DNA, 50 bp, homo sapien
gagatggcatttgagctaagatacayaaaaggaggttcactaggaagata

SEQ ID NO: 54103 - DNA, 50 bp, homo sapien
taaagaaatagtaaataaataggacygtatcaaaatgaaacacttctgca

SEQ ID NO: 54104 - DNA, 50 bp, homo sapien
ccttgaagagatgagggctttagaargaaagatattggtgttccccacgt

SEQ ID NO: 54105 - DNA, 50 bp, homo sapien
cctgagctttctcttcttcctatcamctaaagaggattctcagtttttgc

SEQ ID NO: 54106 - DNA, 50 bp, homo sapien
tttcaaaaatatgtaaaaattctgakgctaaaacaggtaatagtaaacat

SEQ ID NO: 54107 - DNA, 50 bp, homo sapien
tgttactaactgctctgtatctcaaktacctcatctgtacaatggaaata

SEQ ID NO: 54108 - DNA, 50 bp, homo sapien
atgcataatggtagttatattgttgwagaccattagaaaaatatggtata

SEQ ID NO: 54109 - DNA, 50 bp, homo sapien
ctaaattgatgtctgtgctcctttargtatgtgtgctccatgaagtttat

SEQ ID NO: 54110 - DNA, 50 bp, homo sapien
tggccaagcagccatgggcctgagakaattcatgtttgataatagaacat

SEQ ID NO: 54111 - DNA, 50 bp, homo sapien
ccaacataactacaaaggatgtaggyaaatgtagcctttatgtatgccag

SEQ ID NO: 54112 - DNA, 50 bp, homo sapien
caacaagtatgtgtttggccaaaacyaagccaatcaatttctctcttctt

SEQ ID NO: 54113 - DNA, 50 bp, homo sapien
tccacatagattttgaaagtcttackatgaagatgccagatgtatcagat

SEQ ID NO: 54114 - DNA, 50 bp, homo sapien
attaaccactgtgccgtggattttgratcatctgacagacctaacactgc

SEQ ID NO: 54115 - DNA, 50 bp, homo sapien
gcatgtaaggatcacaaaaaccttaygctatattattcccactgaggaga

SEQ ID NO: 54116 - DNA, 50 bp, homo sapien
aagctatctgcaaaattctcaaatargtgtaagttaaaatattcttctaa

SEQ ID NO: 54117 - DNA, 50 bp, homo sapien
tgaacagagttttacaaattaacacmaaaacatatttgaaacattagaga

SEQ ID NO: 54118 - DNA, 50 bp, homo sapien
cggactagtcagaatactgatggtcrcgtaaatcattaatatttgattct

SEQ ID NO: 54119 - DNA, 50 bp, homo sapien
atgtatataatgagtctaacagttaygataccagtcatcatttctcatac

SEQ ID NO: 54120 - DNA, 50 bp, homo sapien
taggagaaaaacgtgatcagccaacmattcatcagggacttattttgttg

SEQ ID NO: 54121 - DNA, 50 bp, homo sapien
aagctagcactttactctgaagtcaytcaaggtttctgagcaggatgatg

SEQ ID NO: 54122 - DNA, 50 bp, homo sapien
ccttgactcagtcttcagtcctaacyggctatatctggagtaaacactgc

SEQ ID NO: 54123 - DNA, 50 bp, homo sapien
tctttaacaattagatagttagattsaagcaaaacttttcaagttatata

SEQ ID NO: 54124 - DNA, 50 bp, homo sapien
ggactttgttaagcaagtgatgcaamggtacaaagcagaaaggcggtggg

SEQ ID NO: 54125 - DNA, 50 bp, homo sapien
tcattgagagaaatttcccttagaasaagaatgtacattggaaattccaa

SEQ ID NO: 54126 - DNA, 50 bp, homo sapien
gatgtcatttaatactacagtcatayggcaagtctgaaaatggtcttgtc

SEQ ID NO: 54127 - DNA, 50 bp, homo sapien
ggcagcttccatccaaataatgtcarcgtaaacagagctccttgtttctc

SEQ ID NO: 54128 - DNA, 50 bp, homo sapien
tgcttttatatacaaggacatagaartctgcattaaaataagaatcagca

SEQ ID NO: 54129 - DNA, 50 bp, homo sapien
cctattatatgagagtttcatatcaracaactacaaatgattgagggaag

SEQ ID NO: 54130 - DNA, 50 bp, homo sapien
taccaattttttttccacagtgccargagaaaatgcttattagatgaata

SEQ ID NO: 54131 - DNA, 50 bp, homo sapien
aatagttcacaaagagagttttaagwaatctaacacattgttcgttacca

SEQ ID NO: 54132 - DNA, 50 bp, homo sapien
gttcctggttactgagctagaagatratcagaatgacaggcatgtggtgt

SEQ ID NO: 54133 - DNA, 50 bp, homo sapien
gaaatcctggtttggacaaaatggargcagtcggtaaagaactgttctcc

SEQ ID NO: 54134 - DNA, 50 bp, homo sapien
tatctaattctgactttcctccctgsagactgaattgcaagaatgcctga

SEQ ID NO: 54135 - DNA, 50 bp, homo sapien
ttgaatatatcttccaaaaacaactraattttgaaataatcggtctgaaa

SEQ ID NO: 54136 - DNA, 50 bp, homo sapien
agatactaaacaactacgtactataygaccaataccggaaaaatattcca

SEQ ID NO: 54137 - DNA, 50 bp, homo sapien
gcataatttttcattagatattcaasagtataattgctagatcttatgcc

SEQ ID NO: 54138 - DNA, 50 bp, homo sapien
atcacttatgctactccatttgatartaactgcagaagtacaatgatatc

SEQ ID NO: 54139 - DNA, 50 bp, homo sapien
caggcttccagtgaggtttgtcccayaggtagtctagtcaagaaaccaga

SEQ ID NO: 54140 - DNA, 50 bp, homo sapien
tgatagagttttgaaattccatataygctagtcgtagcctttattatgtt

SEQ ID NO: 54141 - DNA, 50 bp, homo sapien
gagcggggtttatcctttatcctcakacttccatctgtgctgccatctta

SEQ ID NO: 54142 - DNA, 50 bp, homo sapien
gcaaatatcattctctccttgtagcsctttttaatctcagatcattctgg

SEQ ID NO: 54143 - DNA, 50 bp, homo sapien
tattgtcaccgaccctaaaggatatsaagtgcacatagttagatgtttgc

SEQ ID NO: 54144 - DNA, 50 bp, homo sapien
tctctagaaggtaatggctagaaaamattgacacttgggctgcttgatgg

SEQ ID NO: 54145 - DNA, 50 bp, homo sapien
agtgtagaggagatacaaatatgaaygtggtgtccacaagttacttagag

SEQ ID NO: 54146 - DNA, 50 bp, homo sapien
ttctagacattcagacaacattttcrctctcacatgaaatttgtaaacaa

SEQ ID NO: 54147 - DNA, 50 bp, homo sapien
taatttactcctatctcctgaagtaygttaaaaggaatctaaatcagaat

SEQ ID NO: 54148 - DNA, 50 bp, homo sapien
aactaggtaaagataactgggaaaaygaaccatgaaattcaggaggtatt

SEQ ID NO: 54149 - DNA, 50 bp, homo sapien
atctcactagaagtttatgggtgccyatcttaactgagttctcttactgg

SEQ ID NO: 54150 - DNA, 50 bp, homo sapien
aaactacccagtatattcaagtcacrcagaactaaaaggataagctacca

SEQ ID NO: 54151 - DNA, 50 bp, homo sapien
tttgcagtgtctatatggctagaaastaagaagtaaattaggaatgatta

SEQ ID NO: 54152 - DNA, 50 bp, homo sapien
aacaataactttgcaggatgattatragaaataaaaataatttttgagtt

SEQ ID NO: 54153 - DNA, 50 bp, homo sapien
tttttaattgtacattttgaacttcrgaaactttagattttgaagtgaat

SEQ ID NO: 54154 - DNA, 50 bp, homo sapien
ataagtctgtggtcccttgcttaatratgtggtgtttggacttgaaggta

SEQ ID NO: 54155 - DNA, 50 bp, homo sapien
tgtatgaattttcttttatttctacratcccataaaccaacattaagtgc

SEQ ID NO: 54156 - DNA, 50 bp, homo sapien
gggaagtagatcttggagtagcagaygaaagagtatctacaatgaagtac

SEQ ID NO: 54157 - DNA, 50 bp, homo sapien
attagactaacacagaatttttaaartaacacaagatacaaatatgttaa

SEQ ID NO: 54158 - DNA, 50 bp, homo sapien
atacaaactgtcagaattacacaagrataaatactctaaatcagcctata

SEQ ID NO: 54159 - DNA, 50 bp, homo sapien
ccaaactcatactctctcatctaaamaatgtagtaaccttgtgaattcag

SEQ ID NO: 54160 - DNA, 50 bp, homo sapien
tgttaaaatgcactggatagcataartacagtgaacgacacacacttcta

SEQ ID NO: 54161 - DNA, 50 bp, homo sapien
cactgatgtcgtcattaagcactatkaaggttaagaggaatttaatgaca

SEQ ID NO: 54162 - DNA, 50 bp, homo sapien
gagagattgctatttgccttttacargatgatgaaagaagcttggagatg

SEQ ID NO: 54163 - DNA, 50 bp, homo sapien
actgggtgaccataggctataataamtaaggcatttcaccttccatgcta

SEQ ID NO: 54164 - DNA, 50 bp, homo sapien
ttctccatcaattgtgtcacacaaartaactcaatataggactcatactc

SEQ ID NO: 54165 - DNA, 50 bp, homo sapien
aaataaaaaaggattaatcatttaargagaagctcatatgttaatgagct

SEQ ID NO: 54166 - DNA, 50 bp, homo sapien
tcgcaattaagcaattggtgctaaayacattcaatttgaaatgcataaga

SEQ ID NO: 54167 - DNA, 50 bp, homo sapien
aacatcagtgtccaacacaagtaagwcctcaagaaacgcttgctgaatga

SEQ ID NO: 54168 - DNA, 50 bp, homo sapien
gatgaaacagactatttttttctcartactcaccaacttgccatatatcc

SEQ ID NO: 54169 - DNA, 50 bp, homo sapien
aaatggtgatgaaggtaacaagactragagataccagtctgttgactcac

SEQ ID NO: 54170 - DNA, 50 bp, homo sapien
tatgttttctttattatgaaatatasatccttgtctgtttttaaagcatc

SEQ ID NO: 54171 - DNA, 50 bp, homo sapien
aggcaagcagtgcttacaatcagaakactataatgataacaaataaaggt

SEQ ID NO: 54172 - DNA, 50 bp, homo sapien
atttattggagtatactttcaccagratgagaacagtcattcatatcttc

SEQ ID NO: 54173 - DNA, 50 bp, homo sapien
attaaaggttaaattcaccaaacagraggatactaattaactgcctctta

SEQ ID NO: 54174 - DNA, 50 bp, homo sapien
atttgtcactaaaaagacctctaaartcaaagttgttacatgatggaagt

SEQ ID NO: 54175 - DNA, 50 bp, homo sapien
gacagttgtcaaaaagctcaactaawcgtgtatctccttcagagatgtaa

SEQ ID NO: 54176 - DNA, 50 bp, homo sapien
ccttactcagctgacgaggaagtagrattatacaatagccgtgaatgtgg

SEQ ID NO: 54177 - DNA, 50 bp, homo sapien
atacctcacttttgaatttctttcasgtttatgtttcagtaggaatgtct

SEQ ID NO: 54178 - DNA, 50 bp, homo sapien
tatatctactaggttgtgcttatcaygtgaggcagctttacacatgaact

SEQ ID NO: 54179 - DNA, 50 bp, homo sapien
tctgcagctgagagagtcctgaaaasaggtcaatcctagaaatgtcacgt

SEQ ID NO: 54180 - DNA, 50 bp, homo sapien
ttctactttttgtcagtacaaatccyaggaagtaactcctcttctcaata

SEQ ID NO: 54181 - DNA, 50 bp, homo sapien
cagtttaaaagctgttctctcttcarctaagtaagattcaacagtataat

SEQ ID NO: 54182 - DNA, 50 bp, homo sapien
atgggtggaaaatggtactctttctyaataaacaaggtgtggtaggtata

SEQ ID NO: 54183 - DNA, 50 bp, homo sapien
gtaccttgaacatctatttattttaygcagttccggcccttatcctaatg

SEQ ID NO: 54184 - DNA, 50 bp, homo sapien
gttttattacctctttgtattataasgattgtgtaataccatttctgtag

SEQ ID NO: 54185 - DNA, 50 bp, homo sapien
gcaagaaactgcagaggaaattacasgtatatcatgactgaaaaccattt

SEQ ID NO: 54186 - DNA, 50 bp, homo sapien
tatttcttgaaatctagaaaatcacrcatatagtttagagctctgtgtat

SEQ ID NO: 54187 - DNA, 50 bp, homo sapien
tcttctccatctacaatttcaatggmaggtggttgttttgacattgtctg

SEQ ID NO: 54188 - DNA, 50 bp, homo sapien
gaaacgagagagtagtaagtctgccraaaaagctaagctatttttaagca

SEQ ID NO: 54189 - DNA, 50 bp, homo sapien
aaacacagggatggaaggaaacacasaggctaaggagagggattgaaact

SEQ ID NO: 54190 - DNA, 50 bp, homo sapien
ggagaacgggttgcagtatgggaaaytggtaggcagagagtaataaagtg

SEQ ID NO: 54191 - DNA, 50 bp, homo sapien
gactttcatggcagagataattacawtctttcacaaatacctactttcaa

SEQ ID NO: 54192 - DNA, 50 bp, homo sapien
tgtggccacaccttcccacaaatgamagcctccatgttcttgaaggagga

SEQ ID NO: 54193 - DNA, 50 bp, homo sapien
atcttggcatgtctatcttggaaaaycaaactagtctatgtaaaatcttt

SEQ ID NO: 54194 - DNA, 50 bp, homo sapien
gtctttgccagaggattgcttgcagraatcagataacaaagctggcaatg

SEQ ID NO: 54195 - DNA, 50 bp, homo sapien
gatgataatatgaattaacttatggkaggaagtgaaaacatgttactacc

SEQ ID NO: 54196 - DNA, 50 bp, homo sapien
tgctctctagaacctcattttacaasctcaattaccaaactaattttaaa

SEQ ID NO: 54197 - DNA, 50 bp, homo sapien
tgcaggcatgagtaaccacgcccagratcactgtagttttaagttgcatt

SEQ ID NO: 54198 - DNA, 50 bp, homo sapien
acagtgaccaacgatctgttttgacyacaccttggacttccaatgctaaa

SEQ ID NO: 54199 - DNA, 50 bp, homo sapien
agaaaaaagtcactgcctgacaataygcttacctggcagcttacaaatct

SEQ ID NO: 54200 - DNA, 50 bp, homo sapien
aggggaagcagcaagtactaatgtaraggcttcagcaagttatccagaag

SEQ ID NO: 54201 - DNA, 50 bp, homo sapien
atgcctagatctttgctctgagatayagtcgtagtacccaaaaaagaagt

SEQ ID NO: 54202 - DNA, 50 bp, homo sapien
aatataaatacattaggagccataakagcttgaattgttcaacttttctt

SEQ ID NO: 54203 - DNA, 50 bp, homo sapien
tgctagtggctcactattcacatcamtctcatcagaaaatgttatttcct

SEQ ID NO: 54204 - DNA, 50 bp, homo sapien
ttggtagctggtgctgagagaaaacscttgattgcatccttgccctggga

SEQ ID NO: 54205 - DNA, 50 bp, homo sapien
accccaaaaatgatgatgatagccarctttcactgagtgtccattaagga

SEQ ID NO: 54206 - DNA, 50 bp, homo sapien
cttatgagattatgagaaattctgasattatgagaaatctgtatattgtg

SEQ ID NO: 54207 - DNA, 50 bp, homo sapien
tcttcatttggataactcctacttakgccttaccattcagcataggcatt

SEQ ID NO: 54208 - DNA, 50 bp, homo sapien
tgttttaaattgttcccagtagttgratcaaaaatctatgttactgatca

SEQ ID NO: 54209 - DNA, 50 bp, homo sapien
cttcaagcttccgatctaactttgaygtgaacgaaatcaccaaatttgtt

SEQ ID NO: 54210 - DNA, 50 bp, homo sapien
aaagtctatgaagttaggagttctawatttgttcatgtccattccctaga

SEQ ID NO: 54211 - DNA, 50 bp, homo sapien
acgaactaaataatttcccaaaaaaygtaatgcctaaccaaaatattaac

SEQ ID NO: 54212 - DNA, 50 bp, homo sapien
atataaactttaagaccataacaaasaaaatattatggctaaaaattcag

SEQ ID NO: 54213 - DNA, 50 bp, homo sapien
tctggcattcaatgattagtgtacgyatctgggcagtttggcaccatttc

SEQ ID NO: 54214 - DNA, 50 bp, homo sapien
ctaataggtttttctaagactttgarataaaacagaaaatttttttaaag

SEQ ID NO: 54215 - DNA, 50 bp, homo sapien
gagaacttcttcccgctaactcgtayggctattttctccattttcaagcc

SEQ ID NO: 54216 - DNA, 50 bp, homo sapien
cctttgagatgtacaattttcgttckagctcaagggatgtgtgcttggtg

SEQ ID NO: 54217 - DNA, 50 bp, homo sapien
ttctctcatctcccttggtcctcaawggttacaatctgtaagagcaatgg

SEQ ID NO: 54218 - DNA, 50 bp, homo sapien
tcactttgggctacccacttaagtaragacataccatgatacactgccca

SEQ ID NO: 54219 - DNA, 50 bp, homo sapien
agctaagaagtggaacatcaaattcrcttcagaccatgttgaaataaagt

SEQ ID NO: 54220 - DNA, 50 bp, homo sapien
tgaatctgtcttggttccttcttgaygtaaaacacaatgtccataataca

SEQ ID NO: 54221 - DNA, 50 bp, homo sapien
ttccaaaaaatcagagtatatgccamagcgggtttcgtatccttacagaa

SEQ ID NO: 54222 - DNA, 50 bp, homo sapien
aactttgcctaagattaaccataagmagttaggaccatttttgcttgtga

SEQ ID NO: 54223 - DNA, 50 bp, homo sapien
ctttccatctttcccgacaatcaaaytcctccctgggtaatgcctataac

SEQ ID NO: 54224 - DNA, 50 bp, homo sapien
ctgttagcattcagccatgaaaatartaacttgtaagaccagcttgtaag

SEQ ID NO: 54225 - DNA, 50 bp, homo sapien
cacctgccaataagacgtgtacttayatatctcccatgcaccttaggaag

SEQ ID NO: 54226 - DNA, 50 bp, homo sapien
ccacactcacatgaatacagagatayacaatttacaaattaatgtaacat

SEQ ID NO: 54227 - DNA, 50 bp, homo sapien
caaagaaaaaataggattaaatggawtaagtaggaataactgccttactt

SEQ ID NO: 54228 - DNA, 50 bp, homo sapien
aacagttgcacttttaagccattacmagttgaacaaaagggaccgtcact

SEQ ID NO: 54229 - DNA, 50 bp, homo sapien
catgtatctcatgaactcttctgaayataggccaataaaaggctctctca

SEQ ID NO: 54230 - DNA, 50 bp, homo sapien
tcattcatggttgtgattgtgtcackgcagaaaagtgtgagatcctggaa

SEQ ID NO: 54231 - DNA, 50 bp, homo sapien
agagtctgcttattcaccaaaaagargttaacatttagagattctatgat

SEQ ID NO: 54232 - DNA, 50 bp, homo sapien
atttttttaactaagaaaaccagcaygaataggaataaaaataacacaat

SEQ ID NO: 54233 - DNA, 50 bp, homo sapien
cactacgctctttaagaaagtacatsaaaaagctaatggacttttacaag

SEQ ID NO: 54234 - DNA, 50 bp, homo sapien
attactctaagcacgtcacctattaycttatttcatcttacaagcgcatt

SEQ ID NO: 54235 - DNA, 50 bp, homo sapien
tttccttgcttcacagttgaagaaasgcaacactcagaagatcattaggt

SEQ ID NO: 54236 - DNA, 50 bp, homo sapien
caccctgttacagaattgacttttckcttcagtagcaagggacaggcttc

SEQ ID NO: 54237 - DNA, 50 bp, homo sapien
aatagaatatggtttctgacatcaarggagttaacagcccattggggaag

SEQ ID NO: 54238 - DNA, 50 bp, homo sapien
acatgtacacacaggtagcctggaawggatgtccagaatgcaggggccaa

SEQ ID NO: 54239 - DNA, 50 bp, homo sapien
caggagactgaacttaggttggcaasgtatgatgtttaggaaccttaagt

SEQ ID NO: 54240 - DNA, 50 bp, homo sapien
gaattaacttttcagaagcctggaartagaactcaacacacctgtttgag

SEQ ID NO: 54241 - DNA, 50 bp, homo sapien
gatttttgagttatagcacatgttgragtagaaattccagtcataaagtc

SEQ ID NO: 54242 - DNA, 50 bp, homo sapien
ccacgccaaaggtcaggtgtgataayaatgaagagggaattatcattttt

SEQ ID NO: 54243 - DNA, 50 bp, homo sapien
aaataataatttaaaaaagggatgcraagccatattgaaaagggttagta

SEQ ID NO: 54244 - DNA, 50 bp, homo sapien
ggctgggagagaggaatgattgcaarctcacaagagaaatctttttggca

SEQ ID NO: 54245 - DNA, 50 bp, homo sapien
acaaaatccagaaatggtatgagacraaaagagaatctatgtgacagaat

SEQ ID NO: 54246 - DNA, 50 bp, homo sapien
agtgcctggaagagagccttggaaakatttgtttagcacagctgttgggt

SEQ ID NO: 54247 - DNA, 50 bp, homo sapien
tcttgactggagtttcactctcttcrcaagcaatctaggaccctgtgaat

SEQ ID NO: 54248 - DNA, 50 bp, homo sapien
atttaaaaaataaaaaattaggttamgccaaaagaactataatgaaaaag

SEQ ID NO: 54249 - DNA, 50 bp, homo sapien
tctatctctgtttttgctttctttaygcactctctacatgtgtttaaaaa

SEQ ID NO: 54250 - DNA, 50 bp, homo sapien
ctactgtgaaggggaggcacagttayacatgttactgattcaatgagcat

SEQ ID NO: 54251 - DNA, 50 bp, homo sapien
agccttacattttcaccagatgtctwactttttgtaaacacttccccatt

SEQ ID NO: 54252 - DNA, 50 bp, homo sapien
agagaccttagtagtagttttaactsagggtcttttgcttgtctcctggg

SEQ ID NO: 54253 - DNA, 50 bp, homo sapien
gagaagcacagcaggcgaagctaaayctagtggtaaaattagatggacac

SEQ ID NO: 54254 - DNA, 50 bp, homo sapien
agcagatgttgcttatcagttaccayggcctgttcaatctaagcagtacc

SEQ ID NO: 54255 - DNA, 50 bp, homo sapien
cctgggttaagagggttgctgaggayagaagagtcttagcatacaccttg

SEQ ID NO: 54256 - DNA, 50 bp, homo sapien
tcggaaaaggctcttgataacgtcaytcagggccagcattttggccacac

SEQ ID NO: 54257 - DNA, 50 bp, homo sapien
aggatcatatttagattcagactcarattgaactagataatcgtttccat

SEQ ID NO: 54258 - DNA, 50 bp, homo sapien
acctggaatttgatataaggagtgargtttgtaccagttgtattgggagc

SEQ ID NO: 54259 - DNA, 50 bp, homo sapien
gttctgggtagatttttttctagctsaagggagaattgtatattgggcac

SEQ ID NO: 54260 - DNA, 50 bp, homo sapien
taaaagcttatgaatgggctgaaatwaataattcctaattccacaaaata

SEQ ID NO: 54261 - DNA, 50 bp, homo sapien
cttgttaacatgtaaaacacctccartgcattttgactattgcagcaaag

SEQ ID NO: 54262 - DNA, 50 bp, homo sapien
tcttaaatctctgtgaactcatcatyacaaccactctacactcaacaaca

SEQ ID NO: 54263 - DNA, 50 bp, homo sapien
acgggaaagcaaattacaaaacttaycatgccaacactacaatgtgattc

SEQ ID NO: 54264 - DNA, 50 bp, homo sapien
taggaaaatagaaatcaggaccaacyggcttggaagtgagtttagttgca

SEQ ID NO: 54265 - DNA, 50 bp, homo sapien
tctctgctgaggacattcatttcaamggtgtgcttttaagtgaattgaaa

SEQ ID NO: 54266 - DNA, 50 bp, homo sapien
cagagcttttgattattccttgcacraagatatttaaaaagcacagtcca

SEQ ID NO: 54267 - DNA, 50 bp, homo sapien
tgtgttaatgctctgtcaagagatamggtttattttacttgttctcctct

SEQ ID NO: 54268 - DNA, 50 bp, homo sapien
ccagggggctactgagcatttttaarctaatcactacctggtacacactc

SEQ ID NO: 54269 - DNA, 50 bp, homo sapien
aatcttgttactcttgtgtccactgwacgtactacttacctagtccttgg

SEQ ID NO: 54270 - DNA, 50 bp, homo sapien
ttaataaccctcatcacccttatatsaactggaatttttatattattctt

SEQ ID NO: 54271 - DNA, 50 bp, homo sapien
tgagagctctgccattattccccaamgatcaagctagctctctgcctcat

SEQ ID NO: 54272 - DNA, 50 bp, homo sapien
aaaagcacatcttcctttatatgacraggaaagccagcaaaagacacaac

SEQ ID NO: 54273 - DNA, 50 bp, homo sapien
ttgaaaatgaacagccaggaaccacrctggaacaggaagcagctatactg

SEQ ID NO: 54274 - DNA, 50 bp, homo sapien
gctggactcagcccatagagaagaargcagtgaaaaaggaaaagcacatc

SEQ ID NO: 54275 - DNA, 50 bp, homo sapien
taacctttaccagtaaatcgaaggcyattgaataaggaatgtgtaaggat

SEQ ID NO: 54276 - DNA, 50 bp, homo sapien
aggggcccctgactgatgcttgagasataaccaacaagttttgttggaca

SEQ ID NO: 54277 - DNA, 50 bp, homo sapien
gcatttagatgagctactcaaaatakgcaaggcgccagctggctccagtg

SEQ ID NO: 54278 - DNA, 50 bp, homo sapien
tgtaatcagccagattagtttattamgcccttgcaggtttaaatgagcca

SEQ ID NO: 54279 - DNA, 50 bp, homo sapien
actgcacccggccatatagtctggayattttaaggactaagtaaagtgat

SEQ ID NO: 54280 - DNA, 50 bp, homo sapien
cccacagaactacatacagctgcctsaaattgcaataatatttcatgaca

SEQ ID NO: 54281 - DNA, 50 bp, homo sapien
ctaatattataaataagacagtaatratagtcatttgctaggtattccac

SEQ ID NO: 54282 - DNA, 50 bp, homo sapien
tctctctttcaattaggtgtggcccrataatgtagtttggtcagtgagat

SEQ ID NO: 54283 - DNA, 50 bp, homo sapien
tttgagaactactaatatagacagamaataaatacatatggcaaaactac

SEQ ID NO: 54284 - DNA, 50 bp, homo sapien
ataataggttaccagaacttgcttaygttaattgttttattatgtatagt

SEQ ID NO: 54285 - DNA, 50 bp, homo sapien
tttcccagatattagcagaaaatgaygtttatgagcttctcatctccttt

SEQ ID NO: 54286 - DNA, 50 bp, homo sapien
tgaagtttcactgcctggttgaatayagtcatttaccaaaaatctatttt

SEQ ID NO: 54287 - DNA, 50 bp, homo sapien
aaaggagggtccagttaagcaatatragctgcattaactacatatgattc

SEQ ID NO: 54288 - DNA, 50 bp, homo sapien
aaaactaaagcagactgatgcactamaaaaacctttccgatttagtggaa

SEQ ID NO: 54289 - DNA, 50 bp, homo sapien
cttttgaaacaagactgaagttaaargaaccaactataggaaaaaatgaa

SEQ ID NO: 54290 - DNA, 50 bp, homo sapien
ctaacaattgcacacggtgaagacamtcaggattaaaatgagagtaaccc

SEQ ID NO: 54291 - DNA, 50 bp, homo sapien
tatctagggtatttgatcgttaccaygtttgtctctttttaagcacaccc

SEQ ID NO: 54292 - DNA, 50 bp, homo sapien
ttacctacttcatatggtatatcaaytaaagagagagaaactttaaaaat

SEQ ID NO: 54293 - DNA, 50 bp, homo sapien
ggccatcatcaaaattagttcatgascaaaacttttcccagtcaccttaa

SEQ ID NO: 54294 - DNA, 50 bp, homo sapien
ctacattgtcttcatccgcgaaggaytccctgtctcctattcctcaaagg

SEQ ID NO: 54295 - DNA, 50 bp, homo sapien
ttgaggaggtataattcactatccamattcatccagattctggagcaaca

SEQ ID NO: 54296 - DNA, 50 bp, homo sapien
agttagacgttgtaaccaagttagawcctgtaagcataaaatacccctag

SEQ ID NO: 54297 - DNA, 50 bp, homo sapien
cctttgaaggcttgatttatgctaarccaacaaaaggatctgccggtgaa

SEQ ID NO: 54298 - DNA, 50 bp, homo sapien
cagtagttaaatcttatttctttccrctgtccatatttccttgttgaacc

SEQ ID NO: 54299 - DNA, 50 bp, homo sapien
ttttatgcaaggctctgttgtagcaygagtgaggcagtaaaaataggaat

SEQ ID NO: 54300 - DNA, 50 bp, homo sapien
tgagtgccaatcttagagttcaaaamagttctactcccattaatacatcc

SEQ ID NO: 54301 - DNA, 50 bp, homo sapien
ataatgacctcctctttaacctctaratactgcatgcatataaagtagaa

SEQ ID NO: 54302 - DNA, 50 bp, homo sapien
atgtggaagaacagcctaaagatgaygtgtaagagcataataaacataaa

SEQ ID NO: 54303 - DNA, 50 bp, homo sapien
ttaggcctttcaaactctatacctascataatttatatattcttcagcac

SEQ ID NO: 54304 - DNA, 50 bp, homo sapien
gatacttaaattttcattttcaacawggaaagtaaaggagatgttctctc

SEQ ID NO: 54305 - DNA, 50 bp, homo sapien
caaaaatcaattgttcatatacagtraaggtctacttctgggctctatca

SEQ ID NO: 54306 - DNA, 50 bp, homo sapien
gtctaccagatgtgatgcttcatagsaaagatctgttactacctaaaagt

SEQ ID NO: 54307 - DNA, 50 bp, homo sapien
tatagggaagaatgagtggcagagayctagaaaacacttcaaaggcctgc

SEQ ID NO: 54308 - DNA, 50 bp, homo sapien
ccatttccctaggattccatgttagkaggagtatcacctggagtgacctc

SEQ ID NO: 54309 - DNA, 50 bp, homo sapien
aaagttagcaggaaaatccacattckgaagtgtaaagtaaaacttccttt

SEQ ID NO: 54310 - DNA, 50 bp, homo sapien
agtagttgatcacttcagtatttccratctctttcttatgtatctttcag

SEQ ID NO: 54311 - DNA, 50 bp, homo sapien
aaggaatataaaccatgctgttatamaggaatataagtcattctgtcata

SEQ ID NO: 54312 - DNA, 50 bp, homo sapien
ttgctgctgatctgacttaaccagawgaaggctgtaaagaattcagccag

SEQ ID NO: 54313 - DNA, 50 bp, homo sapien
gtttagataaataacaacaatggcartatttttggcaagaaatcacatat

SEQ ID NO: 54314 - DNA, 50 bp, homo sapien
cctggcacatagtgagtattaagtargtcaatttaaaaattacttgtttt

SEQ ID NO: 54315 - DNA, 50 bp, homo sapien
aattatatatatatatatttaccccmagttgtcatttattttcatgaggg

SEQ ID NO: 54316 - DNA, 50 bp, homo sapien
aaatacaatagctgtcagcaatacaytggttttgatattccaaagagaaa

SEQ ID NO: 54317 - DNA, 50 bp, homo sapien
gctttcctttcttcttccctttaacyaaattcaactttgtagttttcatc

SEQ ID NO: 54318 - DNA, 50 bp, homo sapien
tctcagaacataatgatcaaatacargaaatatgttgttgattattatgt

SEQ ID NO: 54319 - DNA, 50 bp, homo sapien
actcactgcttcctcttccttgaatraccgattttcctctcatttctact

SEQ ID NO: 54320 - DNA, 50 bp, homo sapien
ttttatgccaaggcccaccaaagaayctgcacatacattaagcccaataa

SEQ ID NO: 54321 - DNA, 50 bp, homo sapien
agttaatgatcttatccaaggtgcarcatacagcagtggcaaagctggag

SEQ ID NO: 54322 - DNA, 50 bp, homo sapien
tgcaaactgcagtgaccttaagtaasagactgtagctgattcaagggaaa

SEQ ID NO: 54323 - DNA, 50 bp, homo sapien
ggattagttgggaaattcctctgaartgtgtgcattatgtctgactttgg

SEQ ID NO: 54324 - DNA, 50 bp, homo sapien
cctctgaaatgtgtgcattatgtctkactttggtcttagttgggtcacag

SEQ ID NO: 54325 - DNA, 50 bp, homo sapien
cttctcctgctctccctacctactaygatcaagcatgctactcaagctta

SEQ ID NO: 54326 - DNA, 50 bp, homo sapien
tccttgcctgttctctctctatgaaytgataatgatctctgagtttgata

SEQ ID NO: 54327 - DNA, 50 bp, homo sapien
ggctacattagaaaaattagaggacmcataaatattcaagcacaaattcc

SEQ ID NO: 54328 - DNA, 50 bp, homo sapien
tcctcttctcataaggccggttatcragggagtttgtgtgtctggggaaa

SEQ ID NO: 54329 - DNA, 50 bp, homo sapien
gggaatcaaaaatagaaccactgtgraaaaaggcgtctcagtccaccctc

SEQ ID NO: 54330 - DNA, 50 bp, homo sapien
tgtttcatctctcataaggatgtaaygaaaggaaattaggagccagtggg

SEQ ID NO: 54331 - DNA, 50 bp, homo sapien
agagtgcagggacttaggtgtaaatsataggtgaatcttttttttttttt

SEQ ID NO: 54332 - DNA, 50 bp, homo sapien
taattgtgaagatgagtacctttatsagtagagatggcttcatatcagaa

SEQ ID NO: 54333 - DNA, 50 bp, homo sapien
caacttaggagatgtgaatctcctargttagagtaatagcctactccatg

SEQ ID NO: 54334 - DNA, 50 bp, homo sapien
catgatacagatgattcagctgtcartgaaatgagggatattttaataag

SEQ ID NO: 54335 - DNA, 50 bp, homo sapien
aatagcaatccttattatgtaaaaaytttaaatcccagctagtaaatact

SEQ ID NO: 54336 - DNA, 50 bp, homo sapien
tgcaacaaatttaacctaacaaatcwcttgagcagtaaagaagatattaa

SEQ ID NO: 54337 - DNA, 50 bp, homo sapien
aacctacaggttgttatatggcttaycttcattatcattcacttcaaact

SEQ ID NO: 54338 - DNA, 50 bp, homo sapien
gaatgtggtaaacttgtggacagaastgttactaagttagggcacagaat

SEQ ID NO: 54339 - DNA, 50 bp, homo sapien
ccagttagaattgatattttccaaasagagtgacttctttatctccagga

SEQ ID NO: 54340 - DNA, 50 bp, homo sapien
aaagtggtgagagtggtgcagttaamgatgtcctagaactgctcagtgaa

SEQ ID NO: 54341 - DNA, 50 bp, homo sapien
tctggagttactcattatctgtagakctcttttaaaagtggtttttacac

SEQ ID NO: 54342 - DNA, 50 bp, homo sapien
atcataggaaaacaactttgaatcascaacatttgtttgattccccagtt

SEQ ID NO: 54343 - DNA, 50 bp, homo sapien
gttcaagacttgaggatgcacttccratctgagaacttacattttttcaa

SEQ ID NO: 54344 - DNA, 50 bp, homo sapien
tgcttttccaagaaataaagtagcartcactattctcgattgtcattatt

SEQ ID NO: 54345 - DNA, 50 bp, homo sapien
agctgaaaacctttgatctttattcrctgaggatgaagcccaagatcctg

SEQ ID NO: 54346 - DNA, 50 bp, homo sapien
tgcttgccaagcgccatcctccatakctgaaacgtgttttactctaatta

SEQ ID NO: 54347 - DNA, 50 bp, homo sapien
caggcccctcattacaactcagctasaccattgtaacaatgccctaagca

SEQ ID NO: 54348 - DNA, 50 bp, homo sapien
tgagactttgtcctgcatgtgattayactaattatcaataacactatagg

SEQ ID NO: 54349 - DNA, 50 bp, homo sapien
tatgttttttcaggcttattttctcrctctgtttcagattattgtttttt

SEQ ID NO: 54350 - DNA, 50 bp, homo sapien
cataaagttgccaaatagtttgtgawatactgagtcagaattttagttag

SEQ ID NO: 54351 - DNA, 50 bp, homo sapien
ctgcagacattcctttgtccctaaayaactagaacttttgctgtctgcta

SEQ ID NO: 54352 - DNA, 50 bp, homo sapien
acaacaagaagttatggtatcatgcragtcaaaagaagagaattctaagt

SEQ ID NO: 54353 - DNA, 50 bp, homo sapien
agtttttagtgtctgaaagtgcaaaytaaacctgcttctctgaatcttca

SEQ ID NO: 54354 - DNA, 50 bp, homo sapien
tatacatttttcacctggaaagctcygacattatttaatctatttcagcc

SEQ ID NO: 54355 - DNA, 50 bp, homo sapien
atctgacacctttaaagatctaaagragacatttgccatctactccctct

SEQ ID NO: 54356 - DNA, 50 bp, homo sapien
ctctatcataatgtccacatggagayaattaagcattaggggaggaaatc

SEQ ID NO: 54357 - DNA, 50 bp, homo sapien
gctgtaggaattattttgttctatamagttgggaaaggaattttaagaaa

SEQ ID NO: 54358 - DNA, 50 bp, homo sapien
cacactcattgccacactcaatcacraaaggtttagagtgcaaacatgca

SEQ ID NO: 54359 - DNA, 50 bp, homo sapien
tcagaaaacgatataaatatcctacraacctagatacaagactagtcctg

SEQ ID NO: 54360 - DNA, 50 bp, homo sapien
gtccagaaagcatacctctagacackaagaatgccgttgcctgtctggtg

SEQ ID NO: 54361 - DNA, 50 bp, homo sapien
atgctctatggttacaaggctcgaaygtttaaaatttatgtgagtgatat

SEQ ID NO: 54362 - DNA, 50 bp, homo sapien
cttattccaatccagcttgagcatcygatctgtagtgattccttgaataa

SEQ ID NO: 54363 - DNA, 50 bp, homo sapien
aataatttagaggttgtacttcaaaracagatttgggaataaataaaatt

SEQ ID NO: 54364 - DNA, 50 bp, homo sapien
tgctgctggataaatgacacttcacrcacttaagaaagttagcttcctaa

SEQ ID NO: 54365 - DNA, 50 bp, homo sapien
acacttttgctttttaagctacctgscaagccataaacttcaaagaaaga

SEQ ID NO: 54366 - DNA, 50 bp, homo sapien
acctaattttgactgatgtgtattcyctttggatgaaaaaataagtttga

SEQ ID NO: 54367 - DNA, 50 bp, homo sapien
tactgaatgtatttttcttgctaaartacatccgttagtaatgcttaaat

SEQ ID NO: 54368 - DNA, 50 bp, homo sapien
gagtccaagaaataactcttaccaawttaattttgcctactgcaacaaat

SEQ ID NO: 54369 - DNA, 50 bp, homo sapien
tttgcctactgcaacaaattggaatratatatccctgttttgcaagaaaa

SEQ ID NO: 54370 - DNA, 50 bp, homo sapien
ccctcatttctttcagccagaattayatgccattgtgaaagatcaactgc

SEQ ID NO: 54371 - DNA, 50 bp, homo sapien
tcatatggtgtccaattacctaaaayggcctcagttgaatgttaaagact

SEQ ID NO: 54372 - DNA, 50 bp, homo sapien
tgtgcctcaattcctgtatctttcasgtaataaagttattctagacaatg

SEQ ID NO: 54373 - DNA, 50 bp, homo sapien
ttcactattctgcttttttcacatamgtttttcaatcaccctttttccct

SEQ ID NO: 54374 - DNA, 50 bp, homo sapien
gggaacgagggacacaaaggtctatragatgtcatccctgtctttgtggg

SEQ ID NO: 54375 - DNA, 50 bp, homo sapien
ctacctatctttccgcggcaatcaasagtgaagatgtatttacctctaat

SEQ ID NO: 54376 - DNA, 50 bp, homo sapien
tgtctcttcaaattctataagcaaayggatcttataataatgttgcaatt

SEQ ID NO: 54377 - DNA, 50 bp, homo sapien
ttacagttttattataacagaaggaracaaattagaatcagccaaaggaa

SEQ ID NO: 54378 - DNA, 50 bp, homo sapien
cactactttaaaaaaattgtgatcasgtggtcatcctggactgcaagccg

SEQ ID NO: 54379 - DNA, 50 bp, homo sapien
tcagtgagtttgctgaagagcttgartattggaaggtaaggcaagggaaa

SEQ ID NO: 54380 - DNA, 50 bp, homo sapien
ggtcaaaatcaagggagctgcagcaygaagttcagatagtggatagggag

SEQ ID NO: 54381 - DNA, 50 bp, homo sapien
gctttctcttaattttcttgtaatascatagcttgccactaaaagtgagc

SEQ ID NO: 54382 - DNA, 50 bp, homo sapien
ttagttgaggagtgaaccagatagcraaacttatgcccaagtctttaggc

SEQ ID NO: 54383 - DNA, 50 bp, homo sapien
gattattggcatggctgaatgatcayatttagaattatttcaagtttccc

SEQ ID NO: 54384 - DNA, 50 bp, homo sapien
tcctaggaataggagagataattgtyaatacatgggtgctgctaaaactt

SEQ ID NO: 54385 - DNA, 50 bp, homo sapien
gtttggagggactagaagaaaccaargagatctagttgacctagtagtgc

SEQ ID NO: 54386 - DNA, 50 bp, homo sapien
agttagttgctccctgtactggcacrgataaccagggctataaaaattca

SEQ ID NO: 54387 - DNA, 50 bp, homo sapien
tgcaagtggccattccaaattctaascgtaatacctctctaaagtgatgt

SEQ ID NO: 54388 - DNA, 50 bp, homo sapien
tccaagcctctgcagatcaggaaggyatgctagaaggaaagtggaataga

SEQ ID NO: 54389 - DNA, 50 bp, homo sapien
gtttgcatagcccgtgtgtgtgttayccactttgaactggaagggggagc

SEQ ID NO: 54390 - DNA, 50 bp, homo sapien
taaatgaaagaatcagaaatttagtyacaatggtcaacaatgttttccaa

SEQ ID NO: 54391 - DNA, 50 bp, homo sapien
gctccacttcaggttgtctggccacsgtacaagtatggagaggaccgatc

SEQ ID NO: 54392 - DNA, 50 bp, homo sapien
gaaactggccctgagcctttgctaasaacctttcattaaatctggtccct

SEQ ID NO: 54393 - DNA, 50 bp, homo sapien
taattaacatttaagacagatttcartatttgggcagcctccatactaaa

SEQ ID NO: 54394 - DNA, 50 bp, homo sapien
tttttgactataaataattgctgtgyatagagaacaagaagtgatgcccc

SEQ ID NO: 54395 - DNA, 50 bp, homo sapien
cagagcccacgtgattaactccaacrgtaacagaggcctctccctccttg

SEQ ID NO: 54396 - DNA, 50 bp, homo sapien
gtatgaggatctttataacaatttcrccagagctctaatgcaacaagagt

SEQ ID NO: 54397 - DNA, 50 bp, homo sapien
tgcaccatacaaaaaaacaacttgayatgggtcatagatctaaatttaca

SEQ ID NO: 54398 - DNA, 50 bp, homo sapien
caaaataacaactgctgtggtgatgrcaacaataactaacattggtatag

SEQ ID NO: 54399 - DNA, 50 bp, homo sapien
tgaagagtttgtttcttttttgttasatggagagaatgagaatgtggcaa

SEQ ID NO: 54400 - DNA, 50 bp, homo sapien
agatacagttgtccttgccattttcmagatattacccactgtctttgtat

SEQ ID NO: 54401 - DNA, 50 bp, homo sapien
tttctataatgctacagtttaaacakatcactcttatataatactatttt

SEQ ID NO: 54402 - DNA, 50 bp, homo sapien
tgttaaaaagtgtagctcatagacamaaaaaaattgttcaaatttcttca

SEQ ID NO: 54403 - DNA, 50 bp, homo sapien
tttcaagtctttctaagatactagcrgaaaagaaaatgttggagcaagaa

SEQ ID NO: 54404 - DNA, 50 bp, homo sapien
agtatatgtggctattaaagaagtayaacaaggatgtaaagaagattgag

SEQ ID NO: 54405 - DNA, 50 bp, homo sapien
tatgggaagggctccttgtaacccartatccacacattgctattataata

SEQ ID NO: 54406 - DNA, 50 bp, homo sapien
cttgttatttagtggagattaattgyatgcattctataaactcttattca

SEQ ID NO: 54407 - DNA, 50 bp, homo sapien
tccattgttccaatactaactgagckctatcaacttcaaatactgctgct

SEQ ID NO: 54408 - DNA, 50 bp, homo sapien
gtgagaaattactattttcaaaggakgcttttaatgtgcacttaagataa

SEQ ID NO: 54409 - DNA, 50 bp, homo sapien
gtctttccagttgatcatgtaagtakatttaaactccgtcagtggttcct

SEQ ID NO: 54410 - DNA, 50 bp, homo sapien
aagctctgtggaagactagccctacmaactgttgcactttataagaaaaa

SEQ ID NO: 54411 - DNA, 50 bp, homo sapien
ttttttttttttttactatccacatratgaattcactttggaaaatgacc

SEQ ID NO: 54412 - DNA, 50 bp, homo sapien
aagattttcttcccttctcagtggtyaacagcatatccacccagatgtaa

SEQ ID NO: 54413 - DNA, 50 bp, homo sapien
aagcagaagttgctagcagcctgtgratgaagggttttactctagtgcat

SEQ ID NO: 54414 - DNA, 50 bp, homo sapien
tggtgctgtcaactatttagtctgargctgtttatactttctgggatata

SEQ ID NO: 54415 - DNA, 50 bp, homo sapien
aagtaaactaagttgagattaaggasaactacagtataagactgtgtaag

SEQ ID NO: 54416 - DNA, 50 bp, homo sapien
atgctgtagtagtcaggatgtggtaraaccgaattagagttttctagttg

SEQ ID NO: 54417 - DNA, 50 bp, homo sapien
ttctgattcagtacctttgactccgratgccattttttgatgaaaattat

SEQ ID NO: 54418 - DNA, 50 bp, homo sapien
taaataaacacagattatggttctcraccaccttgttcttggcattgaat

SEQ ID NO: 54419 - DNA, 50 bp, homo sapien
ccccattatttccagacatctgaccraaatttaacctcttcccacactat

SEQ ID NO: 54420 - DNA, 50 bp, homo sapien
ttgtttaatgattcttaactttttgsaggtcaccgacactttacagaatc

SEQ ID NO: 54421 - DNA, 50 bp, homo sapien
aaaaactaaagaaatgctttctatamcaggtatctccaacttcctgaatt

SEQ ID NO: 54422 - DNA, 50 bp, homo sapien
ctagactggttgattgaaatataaastagtgatataaaaaaaaaccttca

SEQ ID NO: 54423 - DNA, 50 bp, homo sapien
cccatagactttatgttcaacaaaargagaaacttcaggaactgatatag

SEQ ID NO: 54424 - DNA, 50 bp, homo sapien
atcaagaaacaattgttatttatagwatttagtatttgtttcttactgat

SEQ ID NO: 54425 - DNA, 50 bp, homo sapien
aaagaatgcttttagtctttccttcsattatgagtccaatcagtatagtg

SEQ ID NO: 54426 - DNA, 50 bp, homo sapien
aagcacattgtaaatagcctcataartgtaaggtacagttactattaagg

SEQ ID NO: 54427 - DNA, 50 bp, homo sapien
gtttgtacttgtcccagtaggcgaakagtagacataggctgtttcattcc

SEQ ID NO: 54428 - DNA, 50 bp, homo sapien
atgtagcatttccaatttcagggacracagagaagaaggggacccatgtc

SEQ ID NO: 54429 - DNA, 50 bp, homo sapien
tttggaagttcctaaggaatctatcrccagcttacaaagagctgcctttc

SEQ ID NO: 54430 - DNA, 50 bp, homo sapien
ataaggtattttaatttaatatgacraaagagatttaacagataaacaag

SEQ ID NO: 54431 - DNA, 50 bp, homo sapien
ttccaacgtggtctctgtggcagccsaacaaagcattcaaaatgctcagt

SEQ ID NO: 54432 - DNA, 50 bp, homo sapien
taaattagaacaacttttcactgacraagattaaactttttcatcattcc

SEQ ID NO: 54433 - DNA, 50 bp, homo sapien
catgaaagttactgcttataaacaawttagaacctttgagaagtatctca

SEQ ID NO: 54434 - DNA, 50 bp, homo sapien
attgttatgttctatgtctagcagayggtacagtatccaaaaatcacaat

SEQ ID NO: 54435 - DNA, 50 bp, homo sapien
atatacaatagcctttcttcccacakgagattgaaggagtaatagaaata

SEQ ID NO: 54436 - DNA, 50 bp, homo sapien
aagatttctgctatctggcatggccsagagaaagaacataaaattcctat

SEQ ID NO: 54437 - DNA, 50 bp, homo sapien
ggcaaataccgggcatgtgctaccartcagacactacaattaaggtgtag

SEQ ID NO: 54438 - DNA, 50 bp, homo sapien
cagggtatcaagccctcagcagataygaattattttaacctgtggctttc

SEQ ID NO: 54439 - DNA, 50 bp, homo sapien
agaaaaaaaatttattacagcgtaargaattggcaaagtgattagggagg

SEQ ID NO: 54440 - DNA, 50 bp, homo sapien
taagtcattaaattattcaacctgayaaagcagtgacaatcactcaatca

SEQ ID NO: 54441 - DNA, 50 bp, homo sapien
ttgacattttgaaaagagagtttcartcaagaagttaaataaatattatg

SEQ ID NO: 54442 - DNA, 50 bp, homo sapien
tagagtggtgtggttcaaagagcacygtaaataaaatcagaagcccagga

SEQ ID NO: 54443 - DNA, 50 bp, homo sapien
ctgataaagtaggtataagagagtayggctgttttgagaacaaatactac

SEQ ID NO: 54444 - DNA, 50 bp, homo sapien
ataaatgagtttctgtggagtaggayagtcttttccgcaaagtcccgtgg

SEQ ID NO: 54445 - DNA, 50 bp, homo sapien
ttagattagtagcattgcctcatagratttagcccagtccacgagaatat

SEQ ID NO: 54446 - DNA, 50 bp, homo sapien
atcctagatcaaaatcttgagtatasagctccagttttcagctttgatta

SEQ ID NO: 54447 - DNA, 50 bp, homo sapien
attggattccgtgagatgacctttaygagacacaaagcaaggttcaggct

SEQ ID NO: 54448 - DNA, 50 bp, homo sapien
attgactgggaatgagctttgcgtaygattgtgtttcatctaagttctgt

SEQ ID NO: 54449 - DNA, 50 bp, homo sapien
agtatcaatttatcccaatggctaartcagtgagaactcttcattgattc

SEQ ID NO: 54450 - DNA, 50 bp, homo sapien
atatatggtcttgatttggcaagtckaagtggaaatgacgttactgtttc

SEQ ID NO: 54451 - DNA, 50 bp, homo sapien
aattacaaataaaaaaaaaatcatcygaacataaagttttcgcctcaagg

SEQ ID NO: 54452 - DNA, 50 bp, homo sapien
ccattttgtatcaggaatatcaaggwcattggaaatccttacatctggat

SEQ ID NO: 54453 - DNA, 50 bp, homo sapien
atttcaagcttctggaatttgaaaasattcgattttattgtgtgtcaggt

SEQ ID NO: 54454 - DNA, 50 bp, homo sapien
gtacacaaattttcaactgcatgagkatgttggtgttcctaatccacatg

SEQ ID NO: 54455 - DNA, 50 bp, homo sapien
attatcttaatgtatggtacagccakcggacttactgacttaaaaccttc

SEQ ID NO: 54456 - DNA, 50 bp, homo sapien
tgtacccaaggttggataaggatggwattataggacaaagatgtgtttag

SEQ ID NO: 54457 - DNA, 50 bp, homo sapien
atgttttcaaatgactgttaataaartaatgtaataaatacattttttcc

SEQ ID NO: 54458 - DNA, 50 bp, homo sapien
gaaggctctcctccaggaaatcttayaggtgtttaaattctaagatgatc

SEQ ID NO: 54459 - DNA, 50 bp, homo sapien
atttcataaagaaccaaattcaagargatctatgcagaaaacattcatct

SEQ ID NO: 54460 - DNA, 50 bp, homo sapien
actttatttgatgtaaaattaccagkagaatgttttattacacaaagacc

SEQ ID NO: 54461 - DNA, 50 bp, homo sapien
cagcagtcatagatactcccttccargaatatttctaacgcttacaacta

SEQ ID NO: 54462 - DNA, 50 bp, homo sapien
attcctgttgataggcatgaagaaasttaattatcacagtatttttaatt

SEQ ID NO: 54463 - DNA, 50 bp, homo sapien
tatgttgactttgatttctttatgcyatgtgattcctgcatatctgacaa

SEQ ID NO: 54464 - DNA, 50 bp, homo sapien
aaaagctgtcatgtcatagttcttayatatcacatagctggctggtaaac

SEQ ID NO: 54465 - DNA, 50 bp, homo sapien
tattctgctaagataactaaagcccrgctgcagttttgcatggctcatag

SEQ ID NO: 54466 - DNA, 50 bp, homo sapien
cagaatttgtattttgttcctttgtraactatctatctcttttgtaaatt

SEQ ID NO: 54467 - DNA, 50 bp, homo sapien
acaggtatgaatccagccatcctcascagtggcaccgatatcttcaaaag

SEQ ID NO: 54468 - DNA, 50 bp, homo sapien
taccactaaatcaatgtggaacaacmatttaaagaatattgcttaaggag

SEQ ID NO: 54469 - DNA, 50 bp, homo sapien
tggccacagcctgggctggcagttgragaacacacatgcccaagtcccag

SEQ ID NO: 54470 - DNA, 50 bp, homo sapien
gggtgtacatttagatatacgcatgmaggattaacctgagatatgaggac

SEQ ID NO: 54471 - DNA, 50 bp, homo sapien
ttcctaggagacattctggcttaacyggaaacagtgtcaaaccttggaag

SEQ ID NO: 54472 - DNA, 50 bp, homo sapien
cagcaatgattcttgtctgcagccaraattaaggtgggttccttgactgt

SEQ ID NO: 54473 - DNA, 50 bp, homo sapien
atgaaaaatcaggtagaataaacacrcctgatgccattgtattacagaaa

SEQ ID NO: 54474 - DNA, 50 bp, homo sapien
gagctaagatcagtctaaatacctcyaatactgagacaataagtcaacat

SEQ ID NO: 54475 - DNA, 50 bp, homo sapien
actgttggccatgtgctagatgtaarcaaagagaagaggtaaataaagag

SEQ ID NO: 54476 - DNA, 50 bp, homo sapien
tggccatcctattcacccatcttcartaagctcaccttttgtaaccacct

SEQ ID NO: 54477 - DNA, 50 bp, homo sapien
tggggctgaatctgtatgtaccaggmaaactcaaatccttgaaaataatg

SEQ ID NO: 54478 - DNA, 50 bp, homo sapien
tatctactgctgaagtctaatctcamatagaaagagagtaaattccctcc

SEQ ID NO: 54479 - DNA, 50 bp, homo sapien
tgctccaggctcttattattggaackggctaccttcttgtcctgctgtct

SEQ ID NO: 54480 - DNA, 50 bp, homo sapien
gggaagaaattctctcaaggatgtartaagttaacaaaccaaattagtac

SEQ ID NO: 54481 - DNA, 50 bp, homo sapien
ttgtaatcaccataccagaggcacaygagattgcaaaaatgccaattttg

SEQ ID NO: 54482 - DNA, 50 bp, homo sapien
cagaaaacaacttaaaagtcatctcrcccaactctttgctagatgcttga

SEQ ID NO: 54483 - DNA, 50 bp, homo sapien
cttgtcctgctgtctactggtcaacyaactactcttcctcagggtcggct

SEQ ID NO: 54484 - DNA, 50 bp, homo sapien
ctacagatgtggacactaacattaayatgccccgagttatagaattacca

SEQ ID NO: 54485 - DNA, 50 bp, homo sapien
agttttgcctatacaggttattactsaatcagatttgagaactataagaa

SEQ ID NO: 54486 - DNA, 50 bp, homo sapien
tgtacagtccagatgtgactagagayagtggaatgctgtgaagattttcc

SEQ ID NO: 54487 - DNA, 50 bp, homo sapien
ggagcttctcaagattattttccacsaagggatttcccagatccaccaca

SEQ ID NO: 54488 - DNA, 50 bp, homo sapien
atgggtatgtccttgatgacaagaaygacgtgtgatggctctttcctccc

SEQ ID NO: 54489 - DNA, 50 bp, homo sapien
ctactctcgattcttttggatcaacmaactttttgagtgccctggtgctg

SEQ ID NO: 54490 - DNA, 50 bp, homo sapien
atggatggaataaatctgagttataygaggtaaaggcattacataattaa

SEQ ID NO: 54491 - DNA, 50 bp, homo sapien
gtttattgagggtttactatgtgccraatattgtgatgccaagatggttg

SEQ ID NO: 54492 - DNA, 50 bp, homo sapien
aaaaagaccactcagtctgtgccaartggtaggattcaacaagacagaaa

SEQ ID NO: 54493 - DNA, 50 bp, homo sapien
tttggctgagttggtccacacatcaragggtgacttaagtcagttaatac

SEQ ID NO: 54494 - DNA, 50 bp, homo sapien
tacattaaaaaaagtttagattaaartatcagccttccacttgattgcat

SEQ ID NO: 54495 - DNA, 50 bp, homo sapien
attaaatagcatgcctaaatttacayattaaacaagtagcagagccagaa

SEQ ID NO: 54496 - DNA, 50 bp, homo sapien
atttccaattacgcttaaagaatcakaagatccagcaatgtcaggtcttt

SEQ ID NO: 54497 - DNA, 50 bp, homo sapien
agatatagaaatcttcacatggaatsagtttaaggcaatgtctagaaaaa

SEQ ID NO: 54498 - DNA, 50 bp, homo sapien
tcaccagtatttactaaataaatgcycagaaaaaaaatagttcatcttta

SEQ ID NO: 54499 - DNA, 50 bp, homo sapien
gtcatctcagtgcttatcaagtccaytagcctttgatacaagatttccta

SEQ ID NO: 54500 - DNA, 50 bp, homo sapien
gcctgatgtatcaaattagtaacatkacctgtagccattaaaatagtaat

SEQ ID NO: 54501 - DNA, 50 bp, homo sapien
tttcctgcttaccatgacctgagcamaacacttaaggtccctgagcctca

SEQ ID NO: 54502 - DNA, 50 bp, homo sapien
gaagtttagacatgggttattaaackctttagcgcattagaagtttctta

SEQ ID NO: 54503 - DNA, 50 bp, homo sapien
aggagagtaacaactgaaacagaacmaagaatatagaacagaggtagaaa

SEQ ID NO: 54504 - DNA, 50 bp, homo sapien
gtgatgaggttttaagtgagctcctyaataaaatataaagctttgtatgg

SEQ ID NO: 54505 - DNA, 50 bp, homo sapien
ggaccctgtgtaacagccggagagcrgacctggtaccagggtcaggaaag

SEQ ID NO: 54506 - DNA, 50 bp, homo sapien
gcagtggaaatgtggttaaaggtaamagctaatcggtgtgcctgggctca

SEQ ID NO: 54507 - DNA, 50 bp, homo sapien
ttagatattatgtgtaaaatgctcayagagtaccttatatagcaattcat

SEQ ID NO: 54508 - DNA, 50 bp, homo sapien
gaattactcatttgatacaaataaastaaagtcactatttgcccctgtgc

SEQ ID NO: 54509 - DNA, 50 bp, homo sapien
tcacagttggatcttgggctttccartgaatctcttatgctctggagctt

SEQ ID NO: 54510 - DNA, 50 bp, homo sapien
caggaagtccacacttagagaaataygatgggtaacatagttcaagggtg

SEQ ID NO: 54511 - DNA, 50 bp, homo sapien
ttaaataatgagctaaatatcttcartctagttgtaacatcttagaaaac

SEQ ID NO: 54512 - DNA, 50 bp, homo sapien
taaaagccaaaagaagaccctcaccrgatatagctcctcgatcttggact

SEQ ID NO: 54513 - DNA, 50 bp, homo sapien
taatcttaaatggccaatttaataayagttctttctccaccctctgccaa

SEQ ID NO: 54514 - DNA, 50 bp, homo sapien
ccagaagcttggacagttttcctccrattgctgtgccttaccatgttttt

SEQ ID NO: 54515 - DNA, 50 bp, homo sapien
cagctttagctataaggcactcaaamgtgcaggatgctaagtgcctttct

SEQ ID NO: 54516 - DNA, 50 bp, homo sapien
gtcacttgtgtcacttcctataccaytgaccatttgtttttccattgctg

SEQ ID NO: 54517 - DNA, 50 bp, homo sapien
attccccatgtttgtaccacttaatyacaaagaccaattgatgagagcaa

SEQ ID NO: 54518 - DNA, 50 bp, homo sapien
tatatatgcacccaacactagagcayctggattcataaaacaaattcttc

SEQ ID NO: 54519 - DNA, 50 bp, homo sapien
aatagtagcaggtgtggtatggtgcmacatagtttcgcagaaatgttttt

SEQ ID NO: 54520 - DNA, 50 bp, homo sapien
atattttttcaatctcttgctgaacmaattttgcaaaaccaaataaaaag

SEQ ID NO: 54521 - DNA, 50 bp, homo sapien
atttttgaacatactatacttgtcasgctctcactgtatgattgccactt

SEQ ID NO: 54522 - DNA, 50 bp, homo sapien
acttctcagtaattgtttgcatgtartacaaagacattttagggatggag

SEQ ID NO: 54523 - DNA, 50 bp, homo sapien
gacattgggatacatagttgaaggayggcaacctacaaactttgctatat

SEQ ID NO: 54524 - DNA, 50 bp, homo sapien
atgttacagttgaccaaaataaggayacccagttaacagaatccatttgc

SEQ ID NO: 54525 - DNA, 50 bp, homo sapien
actcaggacagttcctggctccatcrctctaggtgcgtgaacttaaccaa

SEQ ID NO: 54526 - DNA, 50 bp, homo sapien
tatattttagaaatttgaccgataawaagacactcaggacagttcctggc

SEQ ID NO: 54527 - DNA, 50 bp, homo sapien
aatttgggacaaatgaaaatcatccrcaactctatttggacaagcatggt

SEQ ID NO: 54528 - DNA, 50 bp, homo sapien
cacaaaaatatctaggcacaacaaartaaaatttataatgcttaatatcc

SEQ ID NO: 54529 - DNA, 50 bp, homo sapien
ctaacttatatgagatttttctgcartaagtctctatgtacttcctctgg

SEQ ID NO: 54530 - DNA, 50 bp, homo sapien
aaattctgtggtaattaagtgaagaytatttgaactaatataaattaatg

SEQ ID NO: 54531 - DNA, 50 bp, homo sapien
tgaacaccctctccactaatgaggarcatatattacaagctgttatgttc

SEQ ID NO: 54532 - DNA, 50 bp, homo sapien
aattgtgctggatatcctttgtcaastcctcccgtccccagtctactctc

SEQ ID NO: 54533 - DNA, 50 bp, homo sapien
aaagaagagaagtttgacctatgtasgatgtgagtagggaaaagtagaag

SEQ ID NO: 54534 - DNA, 50 bp, homo sapien
caaatggaagaaaaaatatttggtcratgctaaggaacaattgtgctgga

SEQ ID NO: 54535 - DNA, 50 bp, homo sapien
tttttatgtaagcctatgatagagakaaaacattttgagaaattagactg

SEQ ID NO: 54536 - DNA, 50 bp, homo sapien
ctctaccaccaatggcaccagttcartcaccaatgttgccagctccacca

SEQ ID NO: 54537 - DNA, 50 bp, homo sapien
aacatttttctttatgattcctgackattgactctttcctccactgcatt

SEQ ID NO: 54538 - DNA, 50 bp, homo sapien
acattttttagcatgtagatatcgaygtacagtatttcagtcaaatgcct

SEQ ID NO: 54539 - DNA, 50 bp, homo sapien
ggttaaaattggattcagtgtatcamcaagccattgacaatctcacttac

SEQ ID NO: 54540 - DNA, 50 bp, homo sapien
caactaaccaattaaccaggagatayctataatcgctactccaatctgga

SEQ ID NO: 54541 - DNA, 50 bp, homo sapien
caattctaaaaaaaacttagaccaaygtgcttcttaagcatctcaataaa

SEQ ID NO: 54542 - DNA, 50 bp, homo sapien
aagcaagagtgtccttgaaagtctgsaagaaaattaaggacaccatgtga

SEQ ID NO: 54543 - DNA, 50 bp, homo sapien
tctttcatgacgtaaagcctggtgtraatgtttctgctatttctcttctt

SEQ ID NO: 54544 - DNA, 50 bp, homo sapien
tgtttctgggaatataaaatatatarccatcagcattttacgacctataa

SEQ ID NO: 54545 - DNA, 50 bp, homo sapien
aaaataacaagtacatatcacctgtwaagtattcctacaaatagtttaat

SEQ ID NO: 54546 - DNA, 50 bp, homo sapien
aattaaatctgtaagactgtacacamaactgtcaatggacaatattgctt

SEQ ID NO: 54547 - DNA, 50 bp, homo sapien
tgactccaatgagtgtgatacttaayggaactcctgggaacacagtgggc

SEQ ID NO: 54548 - DNA, 50 bp, homo sapien
ttaactacacacaattaatgatatgsactgtgggcccaagtagacccaag

SEQ ID NO: 54549 - DNA, 50 bp, homo sapien
cacaagcaacatattcttttccaaaygtggtgaatatctttgactttcta

SEQ ID NO: 54550 - DNA, 50 bp, homo sapien
ctaaatgtgtagaaagctatatccargaaatttaaatcaatcgtatgagg

SEQ ID NO: 54551 - DNA, 50 bp, homo sapien
gaagatacttgaaaaagtttaatgaragagcaaataaccattatttagaa

SEQ ID NO: 54552 - DNA, 50 bp, homo sapien
tttgtcatctctaaaactagaataaygaaatctacccatataatggggac

SEQ ID NO: 54553 - DNA, 50 bp, homo sapien
gccctatctatcacgagattctgcasatcaaattaaaacgtatattcaca

SEQ ID NO: 54554 - DNA, 50 bp, homo sapien
ttattttcctatgttctcacaatacragatttcaacaactgtctatatgg

SEQ ID NO: 54555 - DNA, 50 bp, homo sapien
gactagacagagccagacacgcaggsataataggtcatcataaaagcaaa

SEQ ID NO: 54556 - DNA, 50 bp, homo sapien
gggcacacgggattacttttcagtcscagcagtctatgtgtagtgactac

SEQ ID NO: 54557 - DNA, 50 bp, homo sapien
gaccatccctttcatcagattcttaraaaggtacataatgttaagaaagg

SEQ ID NO: 54558 - DNA, 50 bp, homo sapien
actcccttgtgtgagcggccttacaygaatctcagtccatggtcaatata

SEQ ID NO: 54559 - DNA, 50 bp, homo sapien
gaggtgaggacatttcaggcagagaraattatatgagaggttacagagca

SEQ ID NO: 54560 - DNA, 50 bp, homo sapien
ggcctgtagccaggccaggcatgtaycaattctagtcgagcgaaggttgc

SEQ ID NO: 54561 - DNA, 50 bp, homo sapien
cctgccttcgaggagttaaaaatcartacaacacaaaatgagataatgtt

SEQ ID NO: 54562 - DNA, 50 bp, homo sapien
atcaaattggaattaggttatatcamgttgtaatttggttagtaattagg

SEQ ID NO: 54563 - DNA, 50 bp, homo sapien
atgtttaattgtattccttttaacaktcctttaaccatattccttttcat

SEQ ID NO: 54564 - DNA, 50 bp, homo sapien
cataaataccctaacttatggcccgraagaacaccactcctaactgtata

SEQ ID NO: 54565 - DNA, 50 bp, homo sapien
aaacttctctctggcttaacttcaamtcctggtaaagcagagggaacaag

SEQ ID NO: 54566 - DNA, 50 bp, homo sapien
tgagcacatataaaatgggctataakagaagagtaagatgaggactagtc

SEQ ID NO: 54567 - DNA, 50 bp, homo sapien
gatctgtgggagctcaaagaacgtaygaattttcctaagttccagttcca

SEQ ID NO: 54568 - DNA, 50 bp, homo sapien
ttgtttctaccattgcctggaaacartaaataatattcactactggtttt

SEQ ID NO: 54569 - DNA, 50 bp, homo sapien
ctgtaaacccttactacaactgagtsaatgtgatactgacatagactcac

SEQ ID NO: 54570 - DNA, 50 bp, homo sapien
aaagcataaaacttgcatttttagartagagtcaaggcctagatacttga

SEQ ID NO: 54571 - DNA, 50 bp, homo sapien
tttagcagaacagatagggcttcaayggcctgaggagactaccgagcatt

SEQ ID NO: 54572 - DNA, 50 bp, homo sapien
aaatttcacagttccacgggttgtamaggtttctgcttctggggaggcct

SEQ ID NO: 54573 - DNA, 50 bp, homo sapien
tattagggtcaccgtatagatctctmaaaccattctctacagtgatttta

SEQ ID NO: 54574 - DNA, 50 bp, homo sapien
aactaggttctcaacacatgttcaaytaactccagatatggaactcttcc

SEQ ID NO: 54575 - DNA, 50 bp, homo sapien
gattaggccaagcctacactttcagragagtctatcattgggttgacttt

SEQ ID NO: 54576 - DNA, 50 bp, homo sapien
tctgcatatcaaaactagaaaatacsgcaattggcaatgcttcaggacga

SEQ ID NO: 54577 - DNA, 50 bp, homo sapien
gactgttgatacatctatgataatcygaagacaactattgcaacctcata

SEQ ID NO: 54578 - DNA, 50 bp, homo sapien
agtaacagtgaaaggaagtgtgaacmatcaacaagataactgctgtcact

SEQ ID NO: 54579 - DNA, 50 bp, homo sapien
agtctaagcttgtgttttggctacakaaattaagttacaaaaacagtgct

SEQ ID NO: 54580 - DNA, 50 bp, homo sapien
aaaaatggagtaattctgcagaacawgtttaagatagtaactgaaaaaca

SEQ ID NO: 54581 - DNA, 50 bp, homo sapien
gtgtcaaaagtgtttgaggagtcaargaatggaaagtttgaaaagcattt

SEQ ID NO: 54582 - DNA, 50 bp, homo sapien
atagccagtgacttgtagcaaagagyatggtcttctaatttactctattt

SEQ ID NO: 54583 - DNA, 50 bp, homo sapien
cattaaacatctgtaaatcaaatccmataatttaacataatgcctaatgt

SEQ ID NO: 54584 - DNA, 50 bp, homo sapien
cttataactgaatggatttcagagcmaaaggtacaaggaacaggatgcta

SEQ ID NO: 54585 - DNA, 50 bp, homo sapien
tttccacagaactctatttttaaacygccagcaaggaattccccagagct

SEQ ID NO: 54586 - DNA, 50 bp, homo sapien
tctagaatattttcacttcatctacyagaaatctttgtgtcaaggtaatt

SEQ ID NO: 54587 - DNA, 50 bp, homo sapien
atacagttgtgaattttagaaaacayaagctactgttccctaagtaaaag

SEQ ID NO: 54588 - DNA, 50 bp, homo sapien
tggacatacagagagatacatacagraggaatatgaagaggagagaactt

SEQ ID NO: 54589 - DNA, 50 bp, homo sapien
tagattggtgtctgactacataaaamtggactattgggatgttctttatg

SEQ ID NO: 54590 - DNA, 50 bp, homo sapien
taaagaaaattcacaccaaaccttayggaagctagtaacatggatttgaa

SEQ ID NO: 54591 - DNA, 50 bp, homo sapien
gctgccaataccagagatagaaggartatagtgaaagagagccaaccaag

SEQ ID NO: 54592 - DNA, 50 bp, homo sapien
gtcatgtgagatatgctattacctamatctgactgaaaggaaggtgattt

SEQ ID NO: 54593 - DNA, 50 bp, homo sapien
gagttcctaaaaacactaatccatgmattttactctttctttaccctctg

SEQ ID NO: 54594 - DNA, 50 bp, homo sapien
gccaaattgataacttcctgggtagratatatactataggtcaattcctc

SEQ ID NO: 54595 - DNA, 50 bp, homo sapien
tgagagatgatggtagaaaccgatayatacgtcctcaagaaaagagaaaa

SEQ ID NO: 54596 - DNA, 50 bp, homo sapien
gcttgtgttttctaaaattcacaacygtataattaaacatagtggtcaga

SEQ ID NO: 54597 - DNA, 50 bp, homo sapien
ctgggtgtttgtcttgtcagaaatawataaggttgagctttgatagaatg

SEQ ID NO: 54598 - DNA, 50 bp, homo sapien
ttaatgtccatgggatctgtagtaayggcccccttttgtctccccttaag

SEQ ID NO: 54599 - DNA, 50 bp, homo sapien
attcatccaaatccagggctatactkaacatgtgttgttgtttaaaatgg

SEQ ID NO: 54600 - DNA, 50 bp, homo sapien
acagtattgaaacttcttattcgtgracatacgcaatcatggcatctgtg

SEQ ID NO: 54601 - DNA, 50 bp, homo sapien
tcccatgcctagtaaagttctagaasagagtatgagttcaataaaccctg

SEQ ID NO: 54602 - DNA, 50 bp, homo sapien
ccccagtatcacaaggcagagtgtayaagagtgggcttggagaacatact

SEQ ID NO: 54603 - DNA, 50 bp, homo sapien
aaaaagtgaaaaatgctatggtaaargtatgactcacaaaattatacaaa

SEQ ID NO: 54604 - DNA, 50 bp, homo sapien
tgggtagattttcttgactacaatgsatgtctataactgagtgaagctgc

SEQ ID NO: 54605 - DNA, 50 bp, homo sapien
tgtataaattatctgcagctatcaayctattgctacacttttgtccagta

SEQ ID NO: 54606 - DNA, 50 bp, homo sapien
ccatacgtagtaataaatgtgctgayaggatagtggaaaagaagagatat

SEQ ID NO: 54607 - DNA, 50 bp, homo sapien
atttcaagtccagatgcctagaagastattaaattaatcacattattaat

SEQ ID NO: 54608 - DNA, 50 bp, homo sapien
agcatatcatccgagataggcaaatragattcctcttttaggaacaaaat

SEQ ID NO: 54609 - DNA, 50 bp, homo sapien
aggatgtttttcttcttgcatcaggractaatcctttacctctctggccc

SEQ ID NO: 54610 - DNA, 50 bp, homo sapien
accaaacacaacaaagaatgacctcraagactctacatcaaaaagtattg

SEQ ID NO: 54611 - DNA, 50 bp, homo sapien
agggccagagattataaagactgaaragttctctgctacccattttcaag

SEQ ID NO: 54612 - DNA, 50 bp, homo sapien
gttgatgttggttgtgatggccgagrcgaagttattgaatctcacatttg

SEQ ID NO: 54613 - DNA, 50 bp, homo sapien
atcatagaacagcccaggacataacrgcttcactgatgaattctatctaa

SEQ ID NO: 54614 - DNA, 50 bp, homo sapien
gtctgtctgtctgtctatctatctayatacctaaaatgcttttgggtttt

SEQ ID NO: 54615 - DNA, 50 bp, homo sapien
gaagtttggaaatgctgaaggtatckgaaaacatctcgttcatttctatc

SEQ ID NO: 54616 - DNA, 50 bp, homo sapien
aaaacgaattgaaaaaagtaacaaaygtatgcattgctctgtaatggatg

SEQ ID NO: 54617 - DNA, 50 bp, homo sapien
attaaagtacagatattaataagaayggttgtttaaataaatggcagtgt

SEQ ID NO: 54618 - DNA, 50 bp, homo sapien
ggattttactctaattgtcaaattcratttagggtatgcaacataaggca

SEQ ID NO: 54619 - DNA, 50 bp, homo sapien
gccacattgtcaccaacactcagtayggacagcctgtcatctgaaacctc

SEQ ID NO: 54620 - DNA, 50 bp, homo sapien
ggatggaaaggtgcgcaaagaatacragaacactcaagagaaaatttcag

SEQ ID NO: 54621 - DNA, 50 bp, homo sapien
aaagggacaaatataatatgtgaaaytagaatacatatatacatatatat

SEQ ID NO: 54622 - DNA, 50 bp, homo sapien
ctgagatgatagtaactctgataaayggagcaggagcagggttcagctgc

SEQ ID NO: 54623 - DNA, 50 bp, homo sapien
tccgaatattcacaatgaatacgacrgcgacaacttacgctgaaagatgt

SEQ ID NO: 54624 - DNA, 50 bp, homo sapien
ccttttcaagatattaagagcacaayattactttgagaattccagtatgc

SEQ ID NO: 54625 - DNA, 50 bp, homo sapien
caatgtttgtgagtgttagagaagaycaagtaaataaataaagccctacg

SEQ ID NO: 54626 - DNA, 50 bp, homo sapien
gatgatggagttgaggtgagaacaartcctaatgctgttagttgtactta

SEQ ID NO: 54627 - DNA, 50 bp, homo sapien
tttgggaacataacagaaggagtaargagcatatctaaacgattttttcc

SEQ ID NO: 54628 - DNA, 50 bp, homo sapien
acttgttttttctctcactccattayagtcagagtgccttggtctgttgt

SEQ ID NO: 54629 - DNA, 50 bp, homo sapien
ctctttgctttttctcattcaatcaracagaattgtgcatgtcctccctg

SEQ ID NO: 54630 - DNA, 50 bp, homo sapien
aaatgaatcaagtagtacatgcatcraaccaaaataaataccattttaaa

SEQ ID NO: 54631 - DNA, 50 bp, homo sapien
caattttacactgattttatagaaasgatggcttattgttcatgagaaac

SEQ ID NO: 54632 - DNA, 50 bp, homo sapien
aacaatgaagtgatggaaagatacayattttcaatgacttgtaaatagag

SEQ ID NO: 54633 - DNA, 50 bp, homo sapien
ggtgatgaggtcataaaactatccaygtagaagacagacacattatctaa

SEQ ID NO: 54634 - DNA, 50 bp, homo sapien
ctgtccaaaaagcagatcaatattasaggattctcatataaaatatatag

SEQ ID NO: 54635 - DNA, 50 bp, homo sapien
attattctacagatccctgaggttawgttaattttttcatctattttctt

SEQ ID NO: 54636 - DNA, 50 bp, homo sapien
ctccaaataacaaaaagatggctgaktagttaattggtattattgggaaa

SEQ ID NO: 54637 - DNA, 50 bp, homo sapien
gtggcagatgtatttgtccacattasactcctcattatataagacagctg

SEQ ID NO: 54638 - DNA, 50 bp, homo sapien
ttacacttatttgtcttccctatgasagagtgagcaaatggggggctact

SEQ ID NO: 54639 - DNA, 50 bp, homo sapien
aaggtttttttcctgaaagcaataayagtggggctgccaaccagcacaaa

SEQ ID NO: 54640 - DNA, 50 bp, homo sapien
aatttcagctgaagtacgatgcccargaaacattttctaatctttgccat

SEQ ID NO: 54641 - DNA, 50 bp, homo sapien
aaaggcagtgggatttggacaaccartgatggcaggacaacctaaatgtc

SEQ ID NO: 54642 - DNA, 50 bp, homo sapien
ttgggacaaacaaagggatagagaarcattctgcaggcattgctaagaga

SEQ ID NO: 54643 - DNA, 50 bp, homo sapien
aaaagacaaaccaataacttcctaamctagtacctgatgtaagccttgat

SEQ ID NO: 54644 - DNA, 50 bp, homo sapien
ttgtccaaatcccactgccttttaasgtctatctcaaatgttccttgttt

SEQ ID NO: 54645 - DNA, 50 bp, homo sapien
taatattaacttgacgaagctctaaytactatttctatattatttctctc

SEQ ID NO: 54646 - DNA, 50 bp, homo sapien
gcctgcaggaactgtgctctcttcasctggttttagaaataacagataaa

SEQ ID NO: 54647 - DNA, 50 bp, homo sapien
aaagtcaaataacagtggatttgaamgagtttttagacacagcactgagt

SEQ ID NO: 54648 - DNA, 50 bp, homo sapien
agacaataagaaacataataaataayaatggatgaggattaatggaaaag

SEQ ID NO: 54649 - DNA, 50 bp, homo sapien
aagagtaatttgaagagccaattaaktcatactaggcagtaatctttcag

SEQ ID NO: 54650 - DNA, 50 bp, homo sapien
gttaggaggtgcacaagtgatgaaasgacttgaatattaggcagactagc

SEQ ID NO: 54651 - DNA, 50 bp, homo sapien
ttctccttcctgaagcaaaataacartaatacaaataggagctaccggcc

SEQ ID NO: 54652 - DNA, 50 bp, homo sapien
ctgaagaattacaagtaaggaacgaygattattagagattagaaagcatt

SEQ ID NO: 54653 - DNA, 50 bp, homo sapien
caatcatcttagcttggttcattagyagagcatttttagtaactgtaaca

SEQ ID NO: 54654 - DNA, 50 bp, homo sapien
atgttgagccaagtatttttaactcrcagaaagtgtatgatctctgaaaa

SEQ ID NO: 54655 - DNA, 50 bp, homo sapien
aatgaaggaaacatgaagactttacygatttaccctaattttcttactga

SEQ ID NO: 54656 - DNA, 50 bp, homo sapien
cttctgaagataaaagccatgcatayctatttaacatagtacatctgtaa

SEQ ID NO: 54657 - DNA, 50 bp, homo sapien
gattaaataccagcgacaaccaacaygaattttaggtagctcctcattaa

SEQ ID NO: 54658 - DNA, 50 bp, homo sapien
gattgctgaacttgaaagtaggccartagaagttatcaaaactgcaatat

SEQ ID NO: 54659 - DNA, 50 bp, homo sapien
cttttaaacaattcgttgtttgatayattggctttccctctgtctgaata

SEQ ID NO: 54660 - DNA, 50 bp, homo sapien
ttgggacactcctgcctagggtagcrctaaaagtgaagagcttgacccag

SEQ ID NO: 54661 - DNA, 50 bp, homo sapien
agagaaagagagactgaacattacayattatctaaattttatttccccct

SEQ ID NO: 54662 - DNA, 50 bp, homo sapien
agtttaccatagttccaagatccaartgacaactagaaataagtatcaat

SEQ ID NO: 54663 - DNA, 50 bp, homo sapien
agctaaattaccactgcatctccaayaaaatacaagtcgcccttttttgc

SEQ ID NO: 54664 - DNA, 50 bp, homo sapien
tgaggcagcaagctctagatttccawtagtatctcagcaacaattagaac

SEQ ID NO: 54665 - DNA, 50 bp, homo sapien
tttccaccttctctttaacactgcarcacattgactaaagggtatagctg

SEQ ID NO: 54666 - DNA, 50 bp, homo sapien
aataggactgtttatgccaccgagcrattagatacatgcctctattatta

SEQ ID NO: 54667 - DNA, 50 bp, homo sapien
cataactcactgtggcctggagttaygacaccaacttatatttggccaat

SEQ ID NO: 54668 - DNA, 50 bp, homo sapien
gtcttgcaagacatctcctagaatgmatagagaggaaagcctgtgccaaa

SEQ ID NO: 54669 - DNA, 50 bp, homo sapien
attacaattttgtattttttcaacawtagaaattaagctatgcaaggcaa

SEQ ID NO: 54670 - DNA, 50 bp, homo sapien
tttgagaagtgagtaatcaattataycaggtgttgatgaatgccgttcag

SEQ ID NO: 54671 - DNA, 50 bp, homo sapien
atgagaatgtctcttgtggatctgayggtatgaagtcatcaatgatcttg

SEQ ID NO: 54672 - DNA, 50 bp, homo sapien
gtattcttcacattatgtggatgaayggttatctttttatgctattaaaa

SEQ ID NO: 54673 - DNA, 50 bp, homo sapien
ttgaaatatttccagagtactgctasatagtttccattttgtcatgattt

SEQ ID NO: 54674 - DNA, 50 bp, homo sapien
cctaggatacattatataatactaaytgatatccattttgagtattatat

SEQ ID NO: 54675 - DNA, 50 bp, homo sapien
cactgattctcttttgctaagatatwatactcaaaatggatatcaattag

SEQ ID NO: 54676 - DNA, 50 bp, homo sapien
cctctcatgacggaatggccttctaycactgattctcttttgctaagata

SEQ ID NO: 54677 - DNA, 50 bp, homo sapien
tccatttcccctacaatagactgagwatcagacaagactcccagagggct

SEQ ID NO: 54678 - DNA, 50 bp, homo sapien
gtttctccattggtaccatgagttgractagattgattgattgattcatg

SEQ ID NO: 54679 - DNA, 50 bp, homo sapien
ggtaatgaaaatagagatgcgcacaragttttatggggccagagaacaga

SEQ ID NO: 54680 - DNA, 50 bp, homo sapien
caggtgaccatacagttgtgaaggasagagccgagacatcaggctggtat

SEQ ID NO: 54681 - DNA, 50 bp, homo sapien
gtctttgtttcttatctcagtgaaaytgcaccaacaaacatccagtttcc

SEQ ID NO: 54682 - DNA, 50 bp, homo sapien
ctctgagaaagagttgaatatcgacmgagaaaattaagcctctggacttc

SEQ ID NO: 54683 - DNA, 50 bp, homo sapien
aacaatggaagcacaattctggttgyaagaatactaagaagtgaggagaa

SEQ ID NO: 54684 - DNA, 50 bp, homo sapien
acttactatcaggtggtgatctcacraaataaagagggtttaagaagtgc

SEQ ID NO: 54685 - DNA, 50 bp, homo sapien
aactgctaatgtgatggtgttaggaygtaggatgtttgggaggtgattag

SEQ ID NO: 54686 - DNA, 50 bp, homo sapien
ttgtcttgccagatgtaattaccaaraaaggagtgttgaacctttgttca

SEQ ID NO: 54687 - DNA, 50 bp, homo sapien
acccattttctaaagctgctccctayattacacagttgtaccaccacttg

SEQ ID NO: 54688 - DNA, 50 bp, homo sapien
ttaaaggcttcctgatcctttaaaargtagagtcattgctatatgatata

SEQ ID NO: 54689 - DNA, 50 bp, homo sapien
gataattgatgcctggcataacttcrattattaaacaaaaggtcctttct

SEQ ID NO: 54690 - DNA, 50 bp, homo sapien
ttaaacaaaaggtcctttcttctacyaaatgtgacccatttccactcacc

SEQ ID NO: 54691 - DNA, 50 bp, homo sapien
ttacgtcattctcttttcaaatttcyctagagctccttcttagaacttat

SEQ ID NO: 54692 - DNA, 50 bp, homo sapien
cgtctggcaaagaactattcagataygtttaagagtagatactattcacc

SEQ ID NO: 54693 - DNA, 50 bp, homo sapien
ggttcttatcaggatggtacttcaargccagtttcctataagcctttttc

SEQ ID NO: 54694 - DNA, 50 bp, homo sapien
tacatcttcgtcacatggttcataamaaagaattgcaaagctcttctcct

SEQ ID NO: 54695 - DNA, 50 bp, homo sapien
ttccaaagtatttactctttacctckcagattccttatctatcaatgaga

SEQ ID NO: 54696 - DNA, 50 bp, homo sapien
tacactagcctagggttagcaaataygtagcctccaattaagtatccatt

SEQ ID NO: 54697 - DNA, 50 bp, homo sapien
tgactggtgaacttatggtttctcartattactgtgtctggaatttattc

SEQ ID NO: 54698 - DNA, 50 bp, homo sapien
aggcccagagaaggaaaaatacttaygctctgagcctaaggctggcagcg

SEQ ID NO: 54699 - DNA, 50 bp, homo sapien
actggctggcctatagaaaagaaaaytcatgcagtggctcacgcctgcaa

SEQ ID NO: 54700 - DNA, 50 bp, homo sapien
ttagtacaaaatcattacattaccgsaggctcatcattgctgaggaagct

SEQ ID NO: 54701 - DNA, 50 bp, homo sapien
aggagaaatatgtagaatcaaatgcmcacatgttaaatacaagttctatt

SEQ ID NO: 54702 - DNA, 50 bp, homo sapien
ggaaatatgagtttgcaaagtataargtactgaggaaccttctctgtaaa

SEQ ID NO: 54703 - DNA, 50 bp, homo sapien
atagaaatcaaatcaattcttttcartataagcaattactttgtgtattt

SEQ ID NO: 54704 - DNA, 50 bp, homo sapien
tattatataaagctaaaatgagagawctgtacttactaaactgtaaagca

SEQ ID NO: 54705 - DNA, 50 bp, homo sapien
tgtgggtgattctaggttatgtcaartatctcagaagcctggactcaatc

SEQ ID NO: 54706 - DNA, 50 bp, homo sapien
tttttaaaaattaagtatctattaayctagaaaaagcacagaaaaatgtg

SEQ ID NO: 54707 - DNA, 50 bp, homo sapien
cctgggtttttcctcctgtaacagayaatcataccaaccaggatctggga

SEQ ID NO: 54708 - DNA, 50 bp, homo sapien
gtccattaatgtaagaattgctatartaagttccctaattgaatcatatt

SEQ ID NO: 54709 - DNA, 50 bp, homo sapien
gagttttgaattcatgcagatagtcraggtagcaaacaaacctatgagga

SEQ ID NO: 54710 - DNA, 50 bp, homo sapien
ttggaggaagaatgaatattaaacgkcctatttttctaagatgtcaatta

SEQ ID NO: 54711 - DNA, 50 bp, homo sapien
caatcattgtttcttctttcaccagracccctgactgacaatcattgtgt

SEQ ID NO: 54712 - DNA, 50 bp, homo sapien
cctaaatatactcataattggaggckctaatgaaaggtaggagtggtggt

SEQ ID NO: 54713 - DNA, 50 bp, homo sapien
catagtcacattttaaagtctctaawcaggttaacaagatgagaagcaaa

SEQ ID NO: 54714 - DNA, 50 bp, homo sapien
gaaagaacaataaaaatttaaatcayggtctatatttgtcaaagagaaat

SEQ ID NO: 54715 - DNA, 50 bp, homo sapien
ggactatgtgatgatcttcaataaartcatcccatttggtttcatagcca

SEQ ID NO: 54716 - DNA, 50 bp, homo sapien
agagaaatacagtgataactgtgaamaaagaagctgagtttctcccttct

SEQ ID NO: 54717 - DNA, 50 bp, homo sapien
aacttaggaagggaaacaaaacctamatgtcagctaataaccctaaagta

SEQ ID NO: 54718 - DNA, 50 bp, homo sapien
tgatgacagcaaataatatgattaaytcaagcaccattacaatttaactt

SEQ ID NO: 54719 - DNA, 50 bp, homo sapien
aagcttggaagatatagctcgtaacmctttgttgaaatttaacatgtgtt

SEQ ID NO: 54720 - DNA, 50 bp, homo sapien
ttttcttggattcgctgtagcgcaaragagctagtggaaagctgtcgggg

SEQ ID NO: 54721 - DNA, 50 bp, homo sapien
ttatgcagatataatgatgaagtcastaaataacatgcaatttaattata

SEQ ID NO: 54722 - DNA, 50 bp, homo sapien
agcattgttaaggagttgatgctacrataatggagggtacccttgaacat

SEQ ID NO: 54723 - DNA, 50 bp, homo sapien
agcaaaatatctgtgaagccagatarctcatttttaactggtgtgtgtgt

SEQ ID NO: 54724 - DNA, 50 bp, homo sapien
tttcagcttggctaatatgagtctaycttaagaaaaggcctcagctgggc

SEQ ID NO: 54725 - DNA, 50 bp, homo sapien
gactacgagcacatccttctctctcyacctagaaccagaccttggactgt

SEQ ID NO: 54726 - DNA, 50 bp, homo sapien
gaaaacacactcatatattattcacyctgtactagaaattatgctacaat

SEQ ID NO: 54727 - DNA, 50 bp, homo sapien
ttgtagagagacagtggggactcccraccgaggatatacacctggccctt

SEQ ID NO: 54728 - DNA, 50 bp, homo sapien
tcacctctaaccactaagtcggttgragagttatattctcttactgccaa

SEQ ID NO: 54729 - DNA, 50 bp, homo sapien
ttaccaaagtttaacttaagtacaaktatgtaaaccatgaactgtatgta

SEQ ID NO: 54730 - DNA, 50 bp, homo sapien
ataatatattacccaatattgcacaycattggttagaaagcaggtgtaag

SEQ ID NO: 54731 - DNA, 50 bp, homo sapien
tatggccataatttggtcacatgaarccgtaatgtagaaaagatgcttcc

SEQ ID NO: 54732 - DNA, 50 bp, homo sapien
acttggcagcagcccgtgaaggataratggtcaggataaagaaagccaaa

SEQ ID NO: 54733 - DNA, 50 bp, homo sapien
tataggaagtgacagcaggaacacartactaccttaattaccaaagccat

SEQ ID NO: 54734 - DNA, 50 bp, homo sapien
aaaagaaatgccacaattagaagccrctgctgtaggcaaaacagagactc

SEQ ID NO: 54735 - DNA, 50 bp, homo sapien
tcaatccaatttgaggtgctataaargactctcaaagatacttagacaaa

SEQ ID NO: 54736 - DNA, 50 bp, homo sapien
gtttcttagtcactaaacaattgacycttgcatttcagggtagcaagtcc

SEQ ID NO: 54737 - DNA, 50 bp, homo sapien
taaggtgaaaaggcaaagtagcaacmactcctttaagctgcagcttgtta

SEQ ID NO: 54738 - DNA, 50 bp, homo sapien
agtaaccaggaaactttgctatgaaygattatgtgattacaaaaaataga

SEQ ID NO: 54739 - DNA, 50 bp, homo sapien
ttcattcctgctcataacagtttcayattgcagaatagtgatcctagtca

SEQ ID NO: 54740 - DNA, 50 bp, homo sapien
gggagcacataggagaggttcataaygcaatgtgagggttaaggaaagct

SEQ ID NO: 54741 - DNA, 50 bp, homo sapien
gagaccagtggtgcagggtctatctyaaactggcaaggatgggtctcagg

SEQ ID NO: 54742 - DNA, 50 bp, homo sapien
ctctgtatgtaaattatcagcacaakgagtatatgcatgaaattatttga

SEQ ID NO: 54743 - DNA, 50 bp, homo sapien
gaccagcctggacaacatggcaaaayctagtgtctcccagaaaaattttt

SEQ ID NO: 54744 - DNA, 50 bp, homo sapien
tacttaaatatgcttcaaatagatargtgttctcctaggaaaatctggcc

SEQ ID NO: 54745 - DNA, 50 bp, homo sapien
gggattttccctgggagacgcaaacrccataactttattgacctcaaatc

SEQ ID NO: 54746 - DNA, 50 bp, homo sapien
ctgcatggagcagcattgttgagtayatttacttactgtgaaggtcacaa

SEQ ID NO: 54747 - DNA, 50 bp, homo sapien
ggtaaattaatcttcttctctaaccraaccctgtgtgtatctatccgatt

SEQ ID NO: 54748 - DNA, 50 bp, homo sapien
atggaaaggccttgctcatgtcaacrgatcacgtccctatagctgaatgc

SEQ ID NO: 54749 - DNA, 50 bp, homo sapien
gtggagaaggccttttgcctgatcaygttgatagagatgtcagcacaggc

SEQ ID NO: 54750 - DNA, 50 bp, homo sapien
aatgtcaaagatgtacatgaggagtraatacaattggttcatgaattaaa

SEQ ID NO: 54751 - DNA, 50 bp, homo sapien
tattacaagcttaggttgtcttagaygaaagggtttccataatggcattg

SEQ ID NO: 54752 - DNA, 50 bp, homo sapien
tcattccaccctgcattctgttaaaytccctgtgaagctcctccaaagca

SEQ ID NO: 54753 - DNA, 50 bp, homo sapien
aactactctctgtctctaaaaccaamtgttacaatcaattcttcttactt

SEQ ID NO: 54754 - DNA, 50 bp, homo sapien
acacaatgccctataaattctatgcwcaatgaaatttcctaaactcacat

SEQ ID NO: 54755 - DNA, 50 bp, homo sapien
ccatatttactctcctgtgtgaaagraatttttagagaaacagtttaaga

SEQ ID NO: 54756 - DNA, 50 bp, homo sapien
ttttcaccacacttttctacttcaasttatcaagtaagtttacctcagtc

SEQ ID NO: 54757 - DNA, 50 bp, homo sapien
gaattaaaaacacatggataatgcaragttaattacatgagcttgactac

SEQ ID NO: 54758 - DNA, 50 bp, homo sapien
actggtggttcagaacctatgcatawgtgtaaggccacaattttatcatg

SEQ ID NO: 54759 - DNA, 50 bp, homo sapien
gggggagtcagatctagaaacaaagscttaataggaggagacacccctac

SEQ ID NO: 54760 - DNA, 50 bp, homo sapien
tattggcaaatgaagattgccaaagsaacaaaataaagatgcagtcatcc

SEQ ID NO: 54761 - DNA, 50 bp, homo sapien
caatcttcttatttttagtactcaaygattacaaagcaacttaagtatgt

SEQ ID NO: 54762 - DNA, 50 bp, homo sapien
taaatttatatttcaatatactctgraaggagaaatcatttagaatttta

SEQ ID NO: 54763 - DNA, 50 bp, homo sapien
ttaaaagatagcttcctgtattaaarattggtaaagaaataatggcattc

SEQ ID NO: 54764 - DNA, 50 bp, homo sapien
tatactaacagactatccgtaagaargtggaacaactatttactatgtac

SEQ ID NO: 54765 - DNA, 50 bp, homo sapien
ccctcccattgtgtagacgtggaacygaagctcagtgggataatctggtc

SEQ ID NO: 54766 - DNA, 50 bp, homo sapien
attggtaagaggttttccacaaagawtatcacaatgacaggaaatttctg

SEQ ID NO: 54767 - DNA, 50 bp, homo sapien
catcttcattcctgctccttaaaacmattatcaccaccagaaactaccca

SEQ ID NO: 54768 - DNA, 50 bp, homo sapien
ccttgcctcactgtccctgataacaygtaagaaaaaacaaaataagacaa

SEQ ID NO: 54769 - DNA, 50 bp, homo sapien
gcggtcactcactcctggagtataastgtagacctgtgaggattttccta

SEQ ID NO: 54770 - DNA, 50 bp, homo sapien
acaggctgcctctccacctaagaacygggatacctgggacattaggtcca

SEQ ID NO: 54771 - DNA, 50 bp, homo sapien
tttaacaagtgttactggcttgaagkttgatgaaaatcccctctcatact

SEQ ID NO: 54772 - DNA, 50 bp, homo sapien
ggttgcagtgaattgtagaagaaaarctactctcacctccctggattgtg

SEQ ID NO: 54773 - DNA, 50 bp, homo sapien
acatactctaaggtaataaacgtgamaaaatgaagaaaaatatgctgaga

SEQ ID NO: 54774 - DNA, 50 bp, homo sapien
actccttttgtgctttccttgtgaayatttaggtcccagaatttacccag

SEQ ID NO: 54775 - DNA, 50 bp, homo sapien
cattcccttctgcctttgatattcayaggtcttactggtctagcctctac

SEQ ID NO: 54776 - DNA, 50 bp, homo sapien
aacacagagaggaaactacaatagaragaaggaatatgaaggagtcagtc

SEQ ID NO: 54777 - DNA, 50 bp, homo sapien
acgttgtaaaatggttttgggtacaytgaacatgcattctttccaacttt

SEQ ID NO: 54778 - DNA, 50 bp, homo sapien
tttcagacatgaagactaaaccaaamagaatataagaacaaatatggaca

SEQ ID NO: 54779 - DNA, 50 bp, homo sapien
attctaggcaaaattttttgctaaasgtccatccaatttagaaaccacag

SEQ ID NO: 54780 - DNA, 50 bp, homo sapien
ataacctgggttagcacttataaccrgagttaggtggtagcatattggca

SEQ ID NO: 54781 - DNA, 50 bp, homo sapien
caaaaatgaacaaagcataagaggartcaaaatggaagaaagaatatact

SEQ ID NO: 54782 - DNA, 50 bp, homo sapien
gcattgaggagggaatgagcagctaygaagaggagggtgtctgtctcttt

SEQ ID NO: 54783 - DNA, 50 bp, homo sapien
tgttgttttctgatccttatatgagragaatgactagaaaagtgaaacct

SEQ ID NO: 54784 - DNA, 50 bp, homo sapien
gtccacagtaaattctaatgtcttasatgatccctgcagaatattggagc

SEQ ID NO: 54785 - DNA, 50 bp, homo sapien
agtaatagaacaaaaattatgccatraaataggttttctaggggtgcaat

SEQ ID NO: 54786 - DNA, 50 bp, homo sapien
atacaggtaaaataacaatagcatargaatttaatcaagtaaaactttgg

SEQ ID NO: 54787 - DNA, 50 bp, homo sapien
gaatcttattgtaaaacctcaactayggaaaattaatcttcatccaatga

SEQ ID NO: 54788 - DNA, 50 bp, homo sapien
ggcagctgggtgcacatgacagttaygaaatagaaaattaaagtattccc

SEQ ID NO: 54789 - DNA, 50 bp, homo sapien
ttgctttcaatcagttcttcaatcayggttatcacagggaatactttaat

SEQ ID NO: 54790 - DNA, 50 bp, homo sapien
gataaccatgattgaagaactgattraaagcaagtttgaagcaaaggagg

SEQ ID NO: 54791 - DNA, 50 bp, homo sapien
gtctacaccgtaatcttctgatttargtcaagcatcctaattacttttct

SEQ ID NO: 54792 - DNA, 50 bp, homo sapien
atggaatgacagtctttattccaaaytgagaacagaactgcttagtgact

SEQ ID NO: 54793 - DNA, 50 bp, homo sapien
gagaaatattacgcatgtaactggamgaaaatgcatttcctgtatcatag

SEQ ID NO: 54794 - DNA, 50 bp, homo sapien
gtttgctttggatgtacaaaagcgaygttggtccctggaaaagcagggaa

SEQ ID NO: 54795 - DNA, 50 bp, homo sapien
actgtgaattcatttgcgtcctacawatagcattaattggttagagagtt

SEQ ID NO: 54796 - DNA, 50 bp, homo sapien
tgctgagaatcgatgaaatattgaawgacttcctttaaaaaataactttt

SEQ ID NO: 54797 - DNA, 50 bp, homo sapien
ttctaatgactagtataaagacagaygagaatcagaggtagatgaaagct

SEQ ID NO: 54798 - DNA, 50 bp, homo sapien
tagttcaatctttggcatatgttacracgtgcctataaatccttagaggg

SEQ ID NO: 54799 - DNA, 50 bp, homo sapien
caaacagaagccagataaaccattgrcaaggacactgtaggatggaggtt

SEQ ID NO: 54800 - DNA, 50 bp, homo sapien
cttattaaaatcaggggatcagttaygccattcctgttgcccatctttgt

SEQ ID NO: 54801 - DNA, 50 bp, homo sapien
tttaatttgatctaatatccggaaakaatactgctgcccagaaattcgtc

SEQ ID NO: 54802 - DNA, 50 bp, homo sapien
gagcctatctatttctagatgccacrgatcactctggtttcattcaccct

SEQ ID NO: 54803 - DNA, 50 bp, homo sapien
ccaaagttacagataaagatagggargatgaaacacagacagtccagtcc

SEQ ID NO: 54804 - DNA, 50 bp, homo sapien
tagaaggtcatttctttggaccacgyaagagatacatgatggcatgaatt

SEQ ID NO: 54805 - DNA, 50 bp, homo sapien
ggtggcgggtagtgacgggctaatgraaagctcatgcttgtttcaagaaa

SEQ ID NO: 54806 - DNA, 50 bp, homo sapien
tcagatgcttgaatctacataaagartctatggccataccaccctgaacg

SEQ ID NO: 54807 - DNA, 50 bp, homo sapien
taataataatgaaactcctctctaaygtaaaatttcagtctgaaagatca

SEQ ID NO: 54808 - DNA, 50 bp, homo sapien
gctctcactaaaatctaccaaaaacscgagcagcatctttggttggtagg

SEQ ID NO: 54809 - DNA, 50 bp, homo sapien
caccatccgattttctagggtctcamtaattaattggttagttattatta

SEQ ID NO: 54810 - DNA, 50 bp, homo sapien
tttttgagcaactattgtgtataagrcagaatactaaattctgtggggaa

SEQ ID NO: 54811 - DNA, 50 bp, homo sapien
aatttggctagctttcttcatccacrccagaaaactcgcttttgaattgg

SEQ ID NO: 54812 - DNA, 50 bp, homo sapien
tgagcttacaactggcattggtcaayactatggtcatgcactttccactt

SEQ ID NO: 54813 - DNA, 50 bp, homo sapien
ctcctgcacatgtttacaattaatgsaagatgtcaccatgtgttttttga

SEQ ID NO: 54814 - DNA, 50 bp, homo sapien
ctaataaacatgcagaatgatgggasaatagatgtgatggaaatgaagct

SEQ ID NO: 54815 - DNA, 50 bp, homo sapien
attttagaagtaatttaacttagccsaaaagaggaaatacctggtttgtg

SEQ ID NO: 54816 - DNA, 50 bp, homo sapien
cattaggggcatcttggtgaaacacrgaaaccatgtggcagaatggagac

SEQ ID NO: 54817 - DNA, 50 bp, homo sapien
ggacctttctgagaccatgtctgtayattaaataaccatgtgttgagagc

SEQ ID NO: 54818 - DNA, 50 bp, homo sapien
aagcagaagagttcagacaataatamggcatcctaattgttctagtgtaa

SEQ ID NO: 54819 - DNA, 50 bp, homo sapien
gtcctttctcagactgtctcgattargtcaaattcactaactccacagca

SEQ ID NO: 54820 - DNA, 50 bp, homo sapien
atttttgcatgcctcaggaaaaagcratcataggtggttttgagaggagg

SEQ ID NO: 54821 - DNA, 50 bp, homo sapien
tttggacaagcttgatctaactcaarataagcctatggaataattaccac

SEQ ID NO: 54822 - DNA, 50 bp, homo sapien
cacaaaggtaagggctgaacccggaygtctatctaggacacagtgcgcag

SEQ ID NO: 54823 - DNA, 50 bp, homo sapien
gtgggatcatcgtgttctaaacctcyaattgcctgaggccaaaacctaga

SEQ ID NO: 54824 - DNA, 50 bp, homo sapien
ataaagcagagaactttaaatcaaaragacatagagacatagttctgact

SEQ ID NO: 54825 - DNA, 50 bp, homo sapien
taaaggaagaatcggaatgacagacyggatagaatcaaagaacctctgat

SEQ ID NO: 54826 - DNA, 50 bp, homo sapien
agagattcaaaataacagtggatgargtaaagaaagttctaatttgattt

SEQ ID NO: 54827 - DNA, 50 bp, homo sapien
atccctgatggtgaggaagcagacgmacctggagtgtctaactctgtggt

SEQ ID NO: 54828 - DNA, 50 bp, homo sapien
attaggaaactgctcttccgaacacygtagtcattccaggccttcgaccc

SEQ ID NO: 54829 - DNA, 50 bp, homo sapien
taaactaggcagactgttaaacaagwatgagctgtacatcaaagcagtat

SEQ ID NO: 54830 - DNA, 50 bp, homo sapien
tcatcaaaggcaaagactatttctckaattcaaaatgcaaattgaggcca

SEQ ID NO: 54831 - DNA, 50 bp, homo sapien
aagactattaattatgtcacttaacrggggaacatcttcaaggatattag

SEQ ID NO: 54832 - DNA, 50 bp, homo sapien
tgaaaatctagttgagaaagtagacsaacaattacaaagcatcagaatac

SEQ ID NO: 54833 - DNA, 50 bp, homo sapien
gtttctatatgcttatgagtctaagyccgaaaacaaagtctgagcctaaa

SEQ ID NO: 54834 - DNA, 50 bp, homo sapien
aaacctgaaccttaaaatgtttgaarccttgatggatagaacctagaaaa

SEQ ID NO: 54835 - DNA, 50 bp, homo sapien
catttatataacatgttcagaatagkcaaagcaggttagtgggtgccaga

SEQ ID NO: 54836 - DNA, 50 bp, homo sapien
taattcacaatataattggcactgaygagctttggtacagggatgctgtg

SEQ ID NO: 54837 - DNA, 50 bp, homo sapien
ttctaggccaccttgacagaaaggaygtagagcacagcaaagctgcagac

SEQ ID NO: 54838 - DNA, 50 bp, homo sapien
agattttggtcactctatattctccyaaaacgacatactcattattatga

SEQ ID NO: 54839 - DNA, 50 bp, homo sapien
aggaattaagtgaggtcatacatacrcctccatttctgagaggcccttaa

SEQ ID NO: 54840 - DNA, 50 bp, homo sapien
tactaggcgcattaacagaggattayggaaaaatgaaaaccaaagcccca

SEQ ID NO: 54841 - DNA, 50 bp, homo sapien
atagaaagggctctttcatatatcawccaagagtgaatattttagataat

SEQ ID NO: 54842 - DNA, 50 bp, homo sapien
aggaaacaaaccagtattaaacgtcraaatgccctctccaataaaataaa

SEQ ID NO: 54843 - DNA, 50 bp, homo sapien
tatatacaccggagaaaggaaataaragagatagctgcactcccatgctt

SEQ ID NO: 54844 - DNA, 50 bp, homo sapien
atttgcttttcctctctatttatgcygcaaaaaaatccttttaaaaagat

SEQ ID NO: 54845 - DNA, 50 bp, homo sapien
ttgttgggataatcaaaccagatgawtcagataaagcacctggctttatc

SEQ ID NO: 54846 - DNA, 50 bp, homo sapien
ttttagcaccagtggtttgtttagayccatgtggttttgataagaccaca

SEQ ID NO: 54847 - DNA, 50 bp, homo sapien
ggcaaaggggttttcttgcaaaggaraagtctaatgggaagtacaatata

SEQ ID NO: 54848 - DNA, 50 bp, homo sapien
gaagcaatggaattttggactgaaaytgcaggcaaaacattctactttac

SEQ ID NO: 54849 - DNA, 50 bp, homo sapien
aaacagatgtttacacttgttgtcasctgtatttgtcactgtacaggctg

SEQ ID NO: 54850 - DNA, 50 bp, homo sapien
attgtaactctgcaactttatggaayggagagttaacgtatgtaatggaa

SEQ ID NO: 54851 - DNA, 50 bp, homo sapien
tgtacatcactgattactaccctgaygacttctctattcaggcccggaag

SEQ ID NO: 54852 - DNA, 50 bp, homo sapien
aaatatgtgtgtaagctgatgtataycctctaatgagtcctgcgagctgt

SEQ ID NO: 54853 - DNA, 50 bp, homo sapien
attgtctttctgactcgccacattaygagaattccttatggaagagctga

SEQ ID NO: 54854 - DNA, 50 bp, homo sapien
ctcaaatatctgcaagtcttgtaaaygtagcatgcttttgcatacctctt

SEQ ID NO: 54855 - DNA, 50 bp, homo sapien
agacatttttctacaagatgcttcartagttcaattcaatccatcaaata

SEQ ID NO: 54856 - DNA, 50 bp, homo sapien
catgttatgtgtgaatgggtacatayggtaataagagcacagaagaaggg

SEQ ID NO: 54857 - DNA, 50 bp, homo sapien
tagggtcctgcccatgaaactcagayggacaggaaggctgctcataaagc

SEQ ID NO: 54858 - DNA, 50 bp, homo sapien
acacagagaatacctgtagccttgaytcaaacctgtaggcctctttcctt

SEQ ID NO: 54859 - DNA, 50 bp, homo sapien
tggttaatctcaaaagatctctaagrcttaacccatttcttacttttgtg

SEQ ID NO: 54860 - DNA, 50 bp, homo sapien
agaacgatggcacattctcaaccaaycttattttctaagtaattctaact

SEQ ID NO: 54861 - DNA, 50 bp, homo sapien
aggtaggaaatttgactgaatataarccttaataatgggcaaatttgcaa

SEQ ID NO: 54862 - DNA, 50 bp, homo sapien
ccaggaatcttgtgtggaatacagaygaataaactggcaatggtgacaca

SEQ ID NO: 54863 - DNA, 50 bp, homo sapien
cccactggggcagtcagcactttccraactgccaggtctgagacccattg

SEQ ID NO: 54864 - DNA, 50 bp, homo sapien
tccattagaatgaaaactactaaacygatgtggctgtttctttatgtata

SEQ ID NO: 54865 - DNA, 50 bp, homo sapien
agagcagctgaaaaaaatgtcctccrcatgaaactacaccaagcttacac

SEQ ID NO: 54866 - DNA, 50 bp, homo sapien
tggcagaagaaggctttgtgggcccragaatcaggcatatggacttttag

SEQ ID NO: 54867 - DNA, 50 bp, homo sapien
tcattgtataaataagacattacagrattaaacagaaaatatctgtttta

SEQ ID NO: 54868 - DNA, 50 bp, homo sapien
ctggataaatggtgcaaacatctgasagcaggtaaccgcaccttgacact

SEQ ID NO: 54869 - DNA, 50 bp, homo sapien
gctaggttcacgtgcatcagggagayagagttatagtcctcatgaagctt

SEQ ID NO: 54870 - DNA, 50 bp, homo sapien
actacattgccatggcctcttattgyactatcacttctaaagccaaaaag

SEQ ID NO: 54871 - DNA, 50 bp, homo sapien
aagaaaagaactttaatattatatgragaaaagattttacaaactgtaat

SEQ ID NO: 54872 - DNA, 50 bp, homo sapien
tattctccagtgtattaatttgtcaygctgaatcattaaattccacctct

SEQ ID NO: 54873 - DNA, 50 bp, homo sapien
aacagctgccctgttgttaattcccratcaatagtcccgagatgctgctg

SEQ ID NO: 54874 - DNA, 50 bp, homo sapien
gtcataatagataaagctataacaaktctgtaagtaaaatagcatgttaa

SEQ ID NO: 54875 - DNA, 50 bp, homo sapien
taaaaaactaaaattctaagcatacratcatctgataaggaagttttaat

SEQ ID NO: 54876 - DNA, 50 bp, homo sapien
tattcgcaaactttttactactgccygagtacttatttttgtaaaaacct

SEQ ID NO: 54877 - DNA, 50 bp, homo sapien
ttgagaatgagtgctttacctatatwaacttccaataaaacatctgtaat

SEQ ID NO: 54878 - DNA, 50 bp, homo sapien
gatattgctattacctaagaacaacrgctctcaaacataccatatggaac

SEQ ID NO: 54879 - DNA, 50 bp, homo sapien
ttgctggccctgtaagaacttcatgraataatacaaatacaaacctttgt

SEQ ID NO: 54880 - DNA, 50 bp, homo sapien
gaggcagttggttgagctccaaaaaygtggtcgtccacaaatcagccagc

SEQ ID NO: 54881 - DNA, 50 bp, homo sapien
ttttccctccatgaccttttgttgamaactagcttaaatagtgtctgctc

SEQ ID NO: 54882 - DNA, 50 bp, homo sapien
ttgtcgtgcagccatctgcactatcygaccttagagctcttcatcttgta

SEQ ID NO: 54883 - DNA, 50 bp, homo sapien
gaaggccatgctgggcctgatccaasaatgaggctggaaatgggtgtact

SEQ ID NO: 54884 - DNA, 50 bp, homo sapien
aggaagagcttaaaatgcagcttgawatataagaaatggcctatatattg

SEQ ID NO: 54885 - DNA, 50 bp, homo sapien
ttagggctttttatatatattgtaargttatggttcagaaaagttttatc

SEQ ID NO: 54886 - DNA, 50 bp, homo sapien
tcagtaagaggtctgtataacttggraaatacaaagcaaagcaaaacaaa

SEQ ID NO: 54887 - DNA, 50 bp, homo sapien
tgcctgtccattagtacagaacatayattgaagactgcatttggagagca

SEQ ID NO: 54888 - DNA, 50 bp, homo sapien
aagagacctggtcccttacttcacarctacaaagtccctatgatcccgtg

SEQ ID NO: 54889 - DNA, 50 bp, homo sapien
tctatcttagcttaacaggatgatcmatgatgctgaaacagggtggatgc

SEQ ID NO: 54890 - DNA, 50 bp, homo sapien
atagatgtacctgttaaagaattgargaaaatgagaaaatgatcccacct

SEQ ID NO: 54891 - DNA, 50 bp, homo sapien
tgtgtgttgttggttttcagaaatarctactggaaaaaggaaattaccta

SEQ ID NO: 54892 - DNA, 50 bp, homo sapien
tttggttaatatttacagatgtataygcctgtattaccagagcccagatc

SEQ ID NO: 54893 - DNA, 50 bp, homo sapien
caaagccaggcttgttaacggacacrggaaacagttttgttttgctgaat

SEQ ID NO: 54894 - DNA, 50 bp, homo sapien
atataatgaactaatgtgcagtacaragatggaaataattagctcagaca

SEQ ID NO: 54895 - DNA, 50 bp, homo sapien
catcatcatcacagagtcattaaaaytgtacttagcacgtcttcaaagct

SEQ ID NO: 54896 - DNA, 50 bp, homo sapien
taaaatttttgaaattgaggcataasttaaaatacaattaaatgcataaa

SEQ ID NO: 54897 - DNA, 50 bp, homo sapien
gttcagaaaggggaacttcaaccccrctaggactggcaggaagagcctcg

SEQ ID NO: 54898 - DNA, 50 bp, homo sapien
aagcacatgcatacttaaaaagcacraattatatctgcatagcttaataa

SEQ ID NO: 54899 - DNA, 50 bp, homo sapien
acaagtttattaagtaaaaccagaakagtcttaagtagcattgaaagtat

SEQ ID NO: 54900 - DNA, 50 bp, homo sapien
cccatttcagatctcagtactccaaycttgatctctgtgcttttacttta

SEQ ID NO: 54901 - DNA, 50 bp, homo sapien
tgtgaaaagagtattttagattcgamagtcatggtggaccctcttggatt

SEQ ID NO: 54902 - DNA, 50 bp, homo sapien
gttttgctagacatctctagcaaaaygaagtaattctctccaggtttgag

SEQ ID NO: 54903 - DNA, 50 bp, homo sapien
aaatattaatttcttgtgttgatacsaatcctatagatacagctaaccat

SEQ ID NO: 54904 - DNA, 50 bp, homo sapien
aatgagtttaagctctcgcttcttgsaaaaggggtcctgaaaaaacatat

SEQ ID NO: 54905 - DNA, 50 bp, homo sapien
aaacacacattttctacactacaaayacttggcctaaacaagggtttctt

SEQ ID NO: 54906 - DNA, 50 bp, homo sapien
gtagaactgaatcgaaatctaatcargatcccatctgtagtacttaagag

SEQ ID NO: 54907 - DNA, 50 bp, homo sapien
ggaaagtagccagggagcatgtcaaytgtgtcattatccatgtaattcaa

SEQ ID NO: 54908 - DNA, 50 bp, homo sapien
aaataatgttttgaggtttcgactgratgtataactgtctttgaattttt

SEQ ID NO: 54909 - DNA, 50 bp, homo sapien
ttactaagtacattacacttcactamtaatttgcagtgttaaacagaagg

SEQ ID NO: 54910 - DNA, 50 bp, homo sapien
caaacaggtagtgaccaaccatgackctacagcaggcaaacaaactatgg

SEQ ID NO: 54911 - DNA, 50 bp, homo sapien
aatgacagcatcccagttttgacaasacaaatataaagccagccgactaa

SEQ ID NO: 54912 - DNA, 50 bp, homo sapien
acattattttgttgctaaaatgctcygaagtgaccacacaatgaagtcca

SEQ ID NO: 54913 - DNA, 50 bp, homo sapien
gttacagatatttaattgctaacaaycaacccacagcaacagcctgctaa

SEQ ID NO: 54914 - DNA, 50 bp, homo sapien
taaatcatcatgctttgttttaaaayccttgctcaagaaccaagttttgg

SEQ ID NO: 54915 - DNA, 50 bp, homo sapien
aacaccttcattcctttcaagtaaakcaggtagttgcaactcttccacca

SEQ ID NO: 54916 - DNA, 50 bp, homo sapien
tctccatcctcaagggagtgcatacraaacttccctggtattgaaaaaaa

SEQ ID NO: 54917 - DNA, 50 bp, homo sapien
attggcatttgataagaaaaaaatgycatacaacagtaataattaggata

SEQ ID NO: 54918 - DNA, 50 bp, homo sapien
gatttcagtagattttctaacattgractaaatttgtattactaaccgag

SEQ ID NO: 54919 - DNA, 50 bp, homo sapien
aggtgattcaagcaagccatttggargttcataattttgtggttttttcc

SEQ ID NO: 54920 - DNA, 50 bp, homo sapien
caaaaacaatgaaactgccttacaarttctcagtcttctccagacttctc

SEQ ID NO: 54921 - DNA, 50 bp, homo sapien
acccactttcttctcctatgaatcawctaacacctttcaaatggatcctt

SEQ ID NO: 54922 - DNA, 50 bp, homo sapien
cttgaggagactggaggagagggacygaaatcttagataatagaaggaac

SEQ ID NO: 54923 - DNA, 50 bp, homo sapien
gcggccaacagctcttcctaaaccaygtcttgtggccaagtgcaaactga

SEQ ID NO: 54924 - DNA, 50 bp, homo sapien
aaagccagccgactaagtctggtaayagtctggagtggtatgttacagct

SEQ ID NO: 54925 - DNA, 50 bp, homo sapien
acagtgaagccctttgtgcattgtgyatcagccactgtaaactgtttgga

SEQ ID NO: 54926 - DNA, 50 bp, homo sapien
gtgataaggaaggcaaatattcgaartggaaagataagtataaccagtga

SEQ ID NO: 54927 - DNA, 50 bp, homo sapien
catctctttacatagtgcagctacgrccctctagtggatgctagtgagaa

SEQ ID NO: 54928 - DNA, 50 bp, homo sapien
gggatgtttactgggaaactggttcrcttcttttgtagggaaagtcaagt

SEQ ID NO: 54929 - DNA, 50 bp, homo sapien
atctatgtacataaacagagtaatcrgaaatttaaaagaaaaagtctttg

SEQ ID NO: 54930 - DNA, 50 bp, homo sapien
aaagctgttaacctggtgtcaattargaatttgcaccaatgtgacctctg

SEQ ID NO: 54931 - DNA, 50 bp, homo sapien
aaggaaattatagtctgtctgaatargataggttgtgctgcagtaacaaa

SEQ ID NO: 54932 - DNA, 50 bp, homo sapien
aactgctattattttgaacaactgaractcatagggtgcaatcagaaaaa

SEQ ID NO: 54933 - DNA, 50 bp, homo sapien
ttaggttttatggtcaatctcagatrataagaagcctattggtcccattt

SEQ ID NO: 54934 - DNA, 50 bp, homo sapien
aagataacctttccccaaagagtgargtctaagtgttaaaaaccagaggt

SEQ ID NO: 54935 - DNA, 50 bp, homo sapien
acatatgtacatgaagatgaaaaaamtagtgccctaattcctcactggaa

SEQ ID NO: 54936 - DNA, 50 bp, homo sapien
gcagaagtgttgtggcaattataaarcatacagttccatgcctagaggta

SEQ ID NO: 54937 - DNA, 50 bp, homo sapien
ctataagttcctctttcataagtccrctcatcagtttctcttgcttgcaa

SEQ ID NO: 54938 - DNA, 50 bp, homo sapien
gaaatactcttttagttatacagacmaatgcgtgctataattggttctac

SEQ ID NO: 54939 - DNA, 50 bp, homo sapien
tgtttaagctcccagttaacaacgastagaaactgcagtatcttatttag

SEQ ID NO: 54940 - DNA, 50 bp, homo sapien
gatttggactaaacagttggtaggawatggtaaaaagtagttggttttgg

SEQ ID NO: 54941 - DNA, 50 bp, homo sapien
cagacagacttgcgatttctataatyaccattcctcaagatacaggaatc

SEQ ID NO: 54942 - DNA, 50 bp, homo sapien
ggatccaatatctgcttctctttcaytcataaaatttaccaagttcacat

SEQ ID NO: 54943 - DNA, 50 bp, homo sapien
aggatttggctggacctgcaagaccrgacgagttacatccaccttcaatt

SEQ ID NO: 54944 - DNA, 50 bp, homo sapien
gtttcttcaagtcagtactacacaarcatttgtataggacacagaaagtg

SEQ ID NO: 54945 - DNA, 50 bp, homo sapien
aataaataacttttgttacactgaayggaaaataaatatgacctattcat

SEQ ID NO: 54946 - DNA, 50 bp, homo sapien
ttttgttctttttcagggtcatagayaaaggcaggattaagagggagtaa

SEQ ID NO: 54947 - DNA, 50 bp, homo sapien
aagagtctatgttccacattaagtcractgctggatcaccgggtaaagag

SEQ ID NO: 54948 - DNA, 50 bp, homo sapien
gataatgaattcaaacaatgttactyacagcctttaatgtcacagcccct

SEQ ID NO: 54949 - DNA, 50 bp, homo sapien
ccatcaactcaacctaaataacatayagacagaaggtttctataagaaaa

SEQ ID NO: 54950 - DNA, 50 bp, homo sapien
tgatcctctgagagaggctggaggcyataaaaattcacctgtgtccctca

SEQ ID NO: 54951 - DNA, 50 bp, homo sapien
atttaacttttggcattggatcgcaygaacaaatggaaatttgctaatta

SEQ ID NO: 54952 - DNA, 50 bp, homo sapien
tgtcaatcttgctcattatctgttaraggtttcattgaattacatgtttt

SEQ ID NO: 54953 - DNA, 50 bp, homo sapien
tgagtcaaagtcagggatggccacakgacccaagatagatcgatcagttt

SEQ ID NO: 54954 - DNA, 50 bp, homo sapien
ctaaaatagaataatcaccatagtasaagggaaaaataacaaactcaagt

SEQ ID NO: 54955 - DNA, 50 bp, homo sapien
tggtttgaatctggaaatcataagamtatacatggcaattaaagtcaggt

SEQ ID NO: 54956 - DNA, 50 bp, homo sapien
gttcaatgcctcaatttgtccttcaygtcctttgagacctactccatctt

SEQ ID NO: 54957 - DNA, 50 bp, homo sapien
gtaagtagtcatttgtgaacttaatraagaacattaaatttctggggcct

SEQ ID NO: 54958 - DNA, 50 bp, homo sapien
atttggcccttttagagaggtagcawccaattcatttgactgttaacaag

SEQ ID NO: 54959 - DNA, 50 bp, homo sapien
atcagaagtagtgcatctgtttcaaytgaagcaacgtaaaagattggcaa

SEQ ID NO: 54960 - DNA, 50 bp, homo sapien
actgggaacattccaagttcaaaatkaaatgtttaacttatacgtaatac

SEQ ID NO: 54961 - DNA, 50 bp, homo sapien
ggacaacctgcttacaatctgtttaygtgagagaagaatccatttccatc

SEQ ID NO: 54962 - DNA, 50 bp, homo sapien
ttccccccaaaatggaaaacgcgatkatcataagacattcattggaaact

SEQ ID NO: 54963 - DNA, 50 bp, homo sapien
tccttaatgtgtagaaagaaagacaygaaagacatcaatgagtcaatcaa

SEQ ID NO: 54964 - DNA, 50 bp, homo sapien
gcacatgttcagctgaaatattccawaaagattcagtattactattgcca

SEQ ID NO: 54965 - DNA, 50 bp, homo sapien
tacacttgacttgctatcaaacatgmattcctgaaaagttgtgtgaaaat

SEQ ID NO: 54966 - DNA, 50 bp, homo sapien
atcatcttccaactctttatgtcaawgagggttctgaagtgagttctact

SEQ ID NO: 54967 - DNA, 50 bp, homo sapien
gagtgacagaaaagctaggagaagaygtgaggcatacttgtaggaaacag

SEQ ID NO: 54968 - DNA, 50 bp, homo sapien
aagcaaaataactgaaagctgagagratatgagtagaagagcttttgatg

SEQ ID NO: 54969 - DNA, 50 bp, homo sapien
ccctggtaaggcaaagtatacagaakaggcatttcaccacacgggcaaac

SEQ ID NO: 54970 - DNA, 50 bp, homo sapien
cttccagtgctgttttcttttatgamattccagtcaaattctttttctga

SEQ ID NO: 54971 - DNA, 50 bp, homo sapien
tgaaaccagtgtaattgttggtttargtaagtatcattgatgaatgtcta

SEQ ID NO: 54972 - DNA, 50 bp, homo sapien
atttctgtcttcagtctctttgtaartatgctaagttattctccacactc

SEQ ID NO: 54973 - DNA, 50 bp, homo sapien
gtaagtatcattgatgaatgtctaarccatttgatgaaatgttggtcaca

SEQ ID NO: 54974 - DNA, 50 bp, homo sapien
tgggatacagacacaagtatttccartcatgcttattgtgtagggctgat

SEQ ID NO: 54975 - DNA, 50 bp, homo sapien
atataaaacagtatgcctgtaggagratagcagaactgggtaaattagaa

SEQ ID NO: 54976 - DNA, 50 bp, homo sapien
gatcatctgaatctgttaaaaaggcrcacttctcatgatgtttgtgttag

SEQ ID NO: 54977 - DNA, 50 bp, homo sapien
gaggcgagcaaggacaaggacctacratagatctggaggcctcactcctc

SEQ ID NO: 54978 - DNA, 50 bp, homo sapien
gaacagagaaatggagaaagtaaaasaacatgagatcacaaagaaggcct

SEQ ID NO: 54979 - DNA, 50 bp, homo sapien
gaggcaggactcaccaaaaggaggayatggtttaggcaaaatatgatggt

SEQ ID NO: 54980 - DNA, 50 bp, homo sapien
ctctgaatgacctcatattctgcaasgtaaataaaatacggatgacatat

SEQ ID NO: 54981 - DNA, 50 bp, homo sapien
acttttaagaaatcagagttttcgaygtactcactacttctccaagtaca

SEQ ID NO: 54982 - DNA, 50 bp, homo sapien
ttggccaaattgacatctggtaacargtgataataatttaaagcaaaaca

SEQ ID NO: 54983 - DNA, 50 bp, homo sapien
ataaaggaaagcttatactaaaaackcctacaaatcataatattagtagg

SEQ ID NO: 54984 - DNA, 50 bp, homo sapien
gcccatctttctgcagctagttaackaatccttgcctacgggtagacaga

SEQ ID NO: 54985 - DNA, 50 bp, homo sapien
tttctgcaattcttatttaattaccmatgtttatgttagatccatgtgtc

SEQ ID NO: 54986 - DNA, 50 bp, homo sapien
tggtttatttatttttgccaatagaragtgcaatttatcatatgcttcaa

SEQ ID NO: 54987 - DNA, 50 bp, homo sapien
attagtgtttactttctctatcctayactattagcttcatgagaatagga

SEQ ID NO: 54988 - DNA, 50 bp, homo sapien
gaatcaaaggcacatcacgaggagtmaacattttgcctgaagttgctcgc

SEQ ID NO: 54989 - DNA, 50 bp, homo sapien
aggaaatcctaatggcgtttagcaayggagagggtataacaacacatcat

SEQ ID NO: 54990 - DNA, 50 bp, homo sapien
aatacaaagtaagcaatttgtctagyaatttttgtttaaaaggtgaaggt

SEQ ID NO: 54991 - DNA, 50 bp, homo sapien
agcgaagtgtcttcatatcacttccraagaaaagaaaattgctcacaaat

SEQ ID NO: 54992 - DNA, 50 bp, homo sapien
aagggtcttgtttaatccttaggtaygtgaaaagacagtggtgcagagct

SEQ ID NO: 54993 - DNA, 50 bp, homo sapien
gatataggggagcatattaattacartatttctgcactactgtaacagaa

SEQ ID NO: 54994 - DNA, 50 bp, homo sapien
aattacagtgacagaacatagcgtcracaccttcaacatgggaaatctcg

SEQ ID NO: 54995 - DNA, 50 bp, homo sapien
acatagaaggaacagaaaatgcttamggctacatagaaggaacagaaata

SEQ ID NO: 54996 - DNA, 50 bp, homo sapien
tcaaaatatgtccttccattccatamccagatccaaagttctgtttcacc

SEQ ID NO: 54997 - DNA, 50 bp, homo sapien
tgcagcaggctctagagtcacccttyaaatctggttttcgcttcccattt

SEQ ID NO: 54998 - DNA, 50 bp, homo sapien
gctgccaaaggatgccattttttgtsaaggattcttgttaaggtattctg

SEQ ID NO: 54999 - DNA, 50 bp, homo sapien
atgaaatgttgcagaataatgtgtayggtcctatctgtgtgtgtgcgtgt

SEQ ID NO: 55000 - DNA, 50 bp, homo sapien
ttgattgttccatgtcctcagcataycatgtttgtctttcccagcactga

SEQ ID NO: 55001 - DNA, 50 bp, homo sapien
taaaggcagttattttttccagaaamcctacatctggtgtgattagaccg

SEQ ID NO: 55002 - DNA, 50 bp, homo sapien
atgaaaattgtgaaacctcaagatawgttactcatttacaattaaataaa

SEQ ID NO: 55003 - DNA, 50 bp, homo sapien
cagcagaatttgatgctgtctccaamgatactagctcttgaatacgggca

SEQ ID NO: 55004 - DNA, 50 bp, homo sapien
aatccaatatttttgacctattatasctggctagcatctatttctttctt

SEQ ID NO: 55005 - DNA, 50 bp, homo sapien
gtatttgatcaaaacaatatttagcrcttgaaaattcacaatgaaaattg

SEQ ID NO: 55006 - DNA, 50 bp, homo sapien
atttacaagagatgttgggtgtcaargtaaacattgtatattaataagcc

SEQ ID NO: 55007 - DNA, 50 bp, homo sapien
tctccagttaccttgcctgtacaacwcacttagataacactgagaccaac

SEQ ID NO: 55008 - DNA, 50 bp, homo sapien
ataattggcattaattcattcatgasgttggaattctcatgaccaaaaca

SEQ ID NO: 55009 - DNA, 50 bp, homo sapien
gttgcataagtatgttcttaaataaygtttatcagtgaattcaagctaag

SEQ ID NO: 55010 - DNA, 50 bp, homo sapien
tctgtattctccaactgaagctatcraaggctcataggagcaggcttatg

SEQ ID NO: 55011 - DNA, 50 bp, homo sapien
attagatgggaggagtagatattatyaaagggtgtgaaaggagaaacaaa

SEQ ID NO: 55012 - DNA, 50 bp, homo sapien
ttaagatattttttatgtaggtagaktaaaagagttgataaaattttcag

SEQ ID NO: 55013 - DNA, 50 bp, homo sapien
tatttgttgaaatctttgtagcccamatgcaaatatgaggaggtatttcg

SEQ ID NO: 55014 - DNA, 50 bp, homo sapien
tttgtggaacattagtcaactgtgakgtacaaatccaaggcagtccctga

SEQ ID NO: 55015 - DNA, 50 bp, homo sapien
gttttgttgtagcttttttaaatacygctatgtcattactgcgcatgtat

SEQ ID NO: 55016 - DNA, 50 bp, homo sapien
caacagtaataacagtaccttaaaaytgatagtatgaactataatttact

SEQ ID NO: 55017 - DNA, 50 bp, homo sapien
attactggtaggctcagtgcagcaartcatgcagaattttattgctattc

SEQ ID NO: 55018 - DNA, 50 bp, homo sapien
aatgtggttctactaaaacaatgccrctagtatttctccctgcaggaagg

SEQ ID NO: 55019 - DNA, 50 bp, homo sapien
aaaaggaggtgtgaaaggagaaatcwacacaataccttcaactgagtccc

SEQ ID NO: 55020 - DNA, 50 bp, homo sapien
ttgatttttatatcaaattgttcaamcaaccttcctgcagggagaaatac

SEQ ID NO: 55021 - DNA, 50 bp, homo sapien
tgagggcagaaaatattgatgcagamagagatacagtaaagagtcaaaga

SEQ ID NO: 55022 - DNA, 50 bp, homo sapien
acaataccttcaactgagtcccttgraaagactttgtgtacctccatggt

SEQ ID NO: 55023 - DNA, 50 bp, homo sapien
gggcagccattttatttaaaatcatraagtgagtctagacttctccggaa

SEQ ID NO: 55024 - DNA, 50 bp, homo sapien
tttaaatgtctgtttggcattcttaycagtccattgtacggttgaactga

SEQ ID NO: 55025 - DNA, 50 bp, homo sapien
tgttcctgtttcaattaaacaaccaraacacctacaaatgtctggggttg

SEQ ID NO: 55026 - DNA, 50 bp, homo sapien
gtcagatgagtggaagcaacacattkaacattgtcaacttcagaaaacct

SEQ ID NO: 55027 - DNA, 50 bp, homo sapien
tggggaagattgagtgttcctcttayggttttcacataaaaacaaaaggg

SEQ ID NO: 55028 - DNA, 50 bp, homo sapien
agatatttgactgtatccatggaaaycttctagactaccattcttagatt

SEQ ID NO: 55029 - DNA, 50 bp, homo sapien
tcaaaggctcataggagcaggcttakgaccatctgacttcttgagtaaat

SEQ ID NO: 55030 - DNA, 50 bp, homo sapien
tcttagcgttctatgtctcctgttcraaaactgcatattattttgatatt

SEQ ID NO: 55031 - DNA, 50 bp, homo sapien
ttccaagtatgtgggtcttagtctaratgaaaattattttgactacttaa

SEQ ID NO: 55032 - DNA, 50 bp, homo sapien
agccatctttaaatttcaaaggtaaygaattgcaaacaattcagacaaaa

SEQ ID NO: 55033 - DNA, 50 bp, homo sapien
agctaacatttcaccaattgcttagyatatttttgttgaatagtgtttta

SEQ ID NO: 55034 - DNA, 50 bp, homo sapien
gctggaacacttgcttcagtcattaycaagttgctccctgtacattcagt

SEQ ID NO: 55035 - DNA, 50 bp, homo sapien
gtaaatattctcttcatctatgggaraaagtcaaccaacaccgtgagaga

SEQ ID NO: 55036 - DNA, 50 bp, homo sapien
attcctttttaagaaattgcattacrgagcataggtttgcggatgatctt

SEQ ID NO: 55037 - DNA, 50 bp, homo sapien
ggatgggagaggcactatccatgaayatgatccagttgtccaagaaagtt

SEQ ID NO: 55038 - DNA, 50 bp, homo sapien
acttaaaatataatacaaaaaatacrgaatacagatgtcaaactcgaaaa

SEQ ID NO: 55039 - DNA, 50 bp, homo sapien
tggctgtgtgccttgtgggagaataygttactaatggtcactggaagaaa

SEQ ID NO: 55040 - DNA, 50 bp, homo sapien
atgtgtaattaagaaaatgcaatcargaatattatgagatataattttat

SEQ ID NO: 55041 - DNA, 50 bp, homo sapien
taagaggaaaaataacatacttcaaycttttaagcgactgtattttactt

SEQ ID NO: 55042 - DNA, 50 bp, homo sapien
ctcactgagtgattacgtggcagtamaatattggctgtatatagtttttt

SEQ ID NO: 55043 - DNA, 50 bp, homo sapien
accaaacagttagttaaattcttcasagtgaacttcagatccctttgact

SEQ ID NO: 55044 - DNA, 50 bp, homo sapien
cctgcatttcctgaatgttaatgccrgcatgtctagctatgttggggaag

SEQ ID NO: 55045 - DNA, 50 bp, homo sapien
attttctctagcccactccaggtaamtgaactaattttcaacccccaaaa

SEQ ID NO: 55046 - DNA, 50 bp, homo sapien
agagagctacaagaagagactgccaytcttattctggatagtctagagtt

SEQ ID NO: 55047 - DNA, 50 bp, homo sapien
tgaccacacatttcttttccaaaccrgaacatcaggacctgtaagggagg

SEQ ID NO: 55048 - DNA, 50 bp, homo sapien
acatagcttagaggaaaagaattccrccgtgatttcctggtctgccactc

SEQ ID NO: 55049 - DNA, 50 bp, homo sapien
ttctattcatcagttcctcttccgtkaatttgccttacagctgcatttcc

SEQ ID NO: 55050 - DNA, 50 bp, homo sapien
taccgctttcacagcttgctaatgartaagtctaaagcattttcaattgt

SEQ ID NO: 55051 - DNA, 50 bp, homo sapien
aactcaatctcaatttgattaagtcrcagaatgaccatatagagtataca

SEQ ID NO: 55052 - DNA, 50 bp, homo sapien
gaagctttgcaaataaagccactggyaactcacgctgcctgcccatccag

SEQ ID NO: 55053 - DNA, 50 bp, homo sapien
tgtcctttgtcccaaatagctccatraacaaggactaaaagcttgcctgt

SEQ ID NO: 55054 - DNA, 50 bp, homo sapien
actacagatgctttgtttggtaatascgtctttcagcttcctgtctttaa

SEQ ID NO: 55055 - DNA, 50 bp, homo sapien
ggaaatgataaatgaatcagtaccayagggtgtgaaggtgtggttcctat

SEQ ID NO: 55056 - DNA, 50 bp, homo sapien
aacaatattattgtccagacatacarattaaaatatatgtaaattattta

SEQ ID NO: 55057 - DNA, 50 bp, homo sapien
tcaagtagttgttataagaatcggakaagataatacataaaaaacagaca

SEQ ID NO: 55058 - DNA, 50 bp, homo sapien
gtgaattattctacattcccaataaycagtggaagtctttgaatcttatc

SEQ ID NO: 55059 - DNA, 50 bp, homo sapien
aagttccgtcttgttgtttccctccrctcggaattcctccacgcccccgt

SEQ ID NO: 55060 - DNA, 50 bp, homo sapien
aatcagtggaagtctttgaatcttaycagtggaaaggagtttaaaaatct

SEQ ID NO: 55061 - DNA, 50 bp, homo sapien
gcctggaactgtagtagacactttaygttcctaataacattcattcctag

SEQ ID NO: 55062 - DNA, 50 bp, homo sapien
agacatgaatataaagtgtctggtgmagtatattttagtggaaaatagta

SEQ ID NO: 55063 - DNA, 50 bp, homo sapien
aaaggtgaatatgtccacttttcaamggtacacagtatatacacagtttt

SEQ ID NO: 55064 - DNA, 50 bp, homo sapien
tctatttattccatttataggctccmatgatgcctggtaaagatctccaa

SEQ ID NO: 55065 - DNA, 50 bp, homo sapien
ataaaattaaatgaagtggtctaaasttacccatgatgagttaaaggaaa

SEQ ID NO: 55066 - DNA, 50 bp, homo sapien
tgatgttaatgattattatttcttayggaacaaaatatcactgagaaaag

SEQ ID NO: 55067 - DNA, 50 bp, homo sapien
aattcacttctccctctgttcagaawaatatggttaatatgatgaattat

SEQ ID NO: 55068 - DNA, 50 bp, homo sapien
acgttttcatgcagattagaagagaygttagggtaagtcactgataaatg

SEQ ID NO: 55069 - DNA, 50 bp, homo sapien
tgatattcagtaagtgcgagaaaaayagttacttagtgaatgagtttgtg

SEQ ID NO: 55070 - DNA, 50 bp, homo sapien
gtatatataatcctcctgaatcatawtaagttactatttattccttttct

SEQ ID NO: 55071 - DNA, 50 bp, homo sapien
agagtggtacaaaatgtacggtaaawgagattgcagtttactcacagctt

SEQ ID NO: 55072 - DNA, 50 bp, homo sapien
gggctaccaagtgattaagaattgcrccgatcactcatcacagtttcagc

SEQ ID NO: 55073 - DNA, 50 bp, homo sapien
ttctcaggttctgtgaataaaattcraagcctcttctctccttgactgat

SEQ ID NO: 55074 - DNA, 50 bp, homo sapien
ataaaaacttggaggtacttactgakaatactagagctgggtctgagagc

SEQ ID NO: 55075 - DNA, 50 bp, homo sapien
accaagactgcagtgaggttaaaacmaacgtagcatttctcatcctgtag

SEQ ID NO: 55076 - DNA, 50 bp, homo sapien
gcttccatgaaatagttatttcaccragactggataaatggtaaagcttt

SEQ ID NO: 55077 - DNA, 50 bp, homo sapien
aatggaaataaagagcttggcatatsataggctaccaaagacaagcgtca

SEQ ID NO: 55078 - DNA, 50 bp, homo sapien
aaagggaaaaaaattaactccatacmcagatgataggatcttatatgtgg

SEQ ID NO: 55079 - DNA, 50 bp, homo sapien
aagaataacatgaggttaacgttatwactttctgagaactttcaaagcaa

SEQ ID NO: 55080 - DNA, 50 bp, homo sapien
aggggttcactctactggagatgagrccaaggaaactcagcaagaaattc

SEQ ID NO: 55081 - DNA, 50 bp, homo sapien
agtagatactcaaatctttatcctayagggagtgctgacattggcatgaa

SEQ ID NO: 55082 - DNA, 50 bp, homo sapien
aaacaggaattgagtcagtcgttgawctaaatagcttttaaggcccatct

SEQ ID NO: 55083 - DNA, 50 bp, homo sapien
tcaatgctgataaagatggagataayacatgcagaccatctgttccagcc

SEQ ID NO: 55084 - DNA, 50 bp, homo sapien
atctccatcaacaattagctaatgaycaacagacaaataagaatgtatcc

SEQ ID NO: 55085 - DNA, 50 bp, homo sapien
gtggcttgttaatcagcataatgaaygttagaaatgggttctgaattgtg

SEQ ID NO: 55086 - DNA, 50 bp, homo sapien
aattttgccaacaacattaatttcaygtcattcaacatgttcctacatgt

SEQ ID NO: 55087 - DNA, 50 bp, homo sapien
ttgtaactagaaatttgattctcacrgtccattcttttctttgtccttaa

SEQ ID NO: 55088 - DNA, 50 bp, homo sapien
aagcgtcatgatgatttattgagatyaggaacctactgtaccattataac

SEQ ID NO: 55089 - DNA, 50 bp, homo sapien
aaatttttggacccactaggattgtyaataaatctactctacatgtggga

SEQ ID NO: 55090 - DNA, 50 bp, homo sapien
ctccacaattacatcaatggctaacyatcaagagagaagatctcccacat

SEQ ID NO: 55091 - DNA, 50 bp, homo sapien
actacattatttttagctctacaacrctgtaattctaactaatctaagaa

SEQ ID NO: 55092 - DNA, 50 bp, homo sapien
aatctaatgaatggtatattagaaamatgatttgtgtacattccaatgga

SEQ ID NO: 55093 - DNA, 50 bp, homo sapien
aggggcaggagataggctcagtgccrgagacgtcagcattgttgaggagc

SEQ ID NO: 55094 - DNA, 50 bp, homo sapien
caagtcatggtggcaaagtcaagcayggctcactcatgaatctcagacat

SEQ ID NO: 55095 - DNA, 50 bp, homo sapien
ctttgtcctatgaacactaaaatgcrcggttagacctcaaattggtttgg

SEQ ID NO: 55096 - DNA, 50 bp, homo sapien
gatttgctcatgcacaaattacagartacagcgttatggtgtctttttca

SEQ ID NO: 55097 - DNA, 50 bp, homo sapien
gctattccattgtatgtatagaccayagtttatttattcatttatccctc

SEQ ID NO: 55098 - DNA, 50 bp, homo sapien
ggactgataacacttctttttaacayacattttgctactaaaaacttgtg

SEQ ID NO: 55099 - DNA, 50 bp, homo sapien
ttagacgataaaaattagagaatcgycaagcaaaggtaccttgctccttt

SEQ ID NO: 55100 - DNA, 50 bp, homo sapien
tattcttgtcagacagaagccttacyaccatttctaaaatgaaaattctc

SEQ ID NO: 55101 - DNA, 50 bp, homo sapien
ataaacctctaaggattattcagtarcaattagggtaatatttatgaaga

SEQ ID NO: 55102 - DNA, 50 bp, homo sapien
ctctgcagagaaaatgtcttctaaargcgatacgagatcatcttttgaaa

SEQ ID NO: 55103 - DNA, 50 bp, homo sapien
atagtagattttatatttatttcaaytacctgcaccctgatccaataaga

SEQ ID NO: 55104 - DNA, 50 bp, homo sapien
ttgcttatattgaatgcaaggcacamcatcagtaaaagcagctactagat

SEQ ID NO: 55105 - DNA, 50 bp, homo sapien
ttcatgtatcagtgtgcacaccctckaatcaatcctagcttgtcatctcc

SEQ ID NO: 55106 - DNA, 50 bp, homo sapien
aatagaagttcactgggatgtaccawagagagcactaaccattggggaaa

SEQ ID NO: 55107 - DNA, 50 bp, homo sapien
ttcacttaaacacctgttaggggtcractttggataatgtaccaaatgca

SEQ ID NO: 55108 - DNA, 50 bp, homo sapien
ggaaatattccacaaatccttaaagrcaaattagtggcaatactatagat

SEQ ID NO: 55109 - DNA, 50 bp, homo sapien
ttaacagtttggagggtttcagaacyagacacaaagataagaggaaaatc

SEQ ID NO: 55110 - DNA, 50 bp, homo sapien
cttgctttatgtagtaagatttctgmaacagttgagtgtgacttgaatta

SEQ ID NO: 55111 - DNA, 50 bp, homo sapien
atttcaccgttgaatagcctcctctmagaaaagtgccctgtattttcact

SEQ ID NO: 55112 - DNA, 50 bp, homo sapien
agcccataggtgggcactttagacawcaagcacgaaggtgtaacacgcat

SEQ ID NO: 55113 - DNA, 50 bp, homo sapien
aaggagacaccaagaaaagactcaaygagatcatgcaacttgggcactga

SEQ ID NO: 55114 - DNA, 50 bp, homo sapien
caacagacatacatattttggtctcygagaaaatttgtgaatctattcca

SEQ ID NO: 55115 - DNA, 50 bp, homo sapien
tggagcattttatgtttaatggaaaytgtctttctgagcaggtagttgtg

SEQ ID NO: 55116 - DNA, 50 bp, homo sapien
cgtcggttgaactagttcctgagacygacccttcaacacttgttggacac

SEQ ID NO: 55117 - DNA, 50 bp, homo sapien
ttcctttgtgcttccaacaagaaaawcatttgaaaaagaaggtaggaaga

SEQ ID NO: 55118 - DNA, 50 bp, homo sapien
gtgctaatattcttttaaaccttccwcatcaaaggagaaagctatttttc

SEQ ID NO: 55119 - DNA, 50 bp, homo sapien
aggtgagtgtgtgctaatgggaaatmacaaatagcaaccacacatacata

SEQ ID NO: 55120 - DNA, 50 bp, homo sapien
cccagcctctgaattcccagttctayactcaagactttttgactctgttg

SEQ ID NO: 55121 - DNA, 50 bp, homo sapien
gaaattcataccagccactacttacrgtaacaggacataactttggatat

SEQ ID NO: 55122 - DNA, 50 bp, homo sapien
gtaataagagaaataatgtgcgtaaygaatgtaatgtgcttgaatcatcc

SEQ ID NO: 55123 - DNA, 50 bp, homo sapien
ttgtttttgcattaatcaaaatctgmagttagggagtagagggataagga

SEQ ID NO: 55124 - DNA, 50 bp, homo sapien
tgaggtatttgacagtttagccaaaygaggacactaacccttttccttcc

SEQ ID NO: 55125 - DNA, 50 bp, homo sapien
tgaaatggcacacagggcctctaaarttatattagagatgtttcccatct

SEQ ID NO: 55126 - DNA, 50 bp, homo sapien
agacctgaagcagagaatgactctayctgccatgaaggtcaggtggttat

SEQ ID NO: 55127 - DNA, 50 bp, homo sapien
tattatctgcccaatgcctagaatayagtgggtccctaatagttattagt

SEQ ID NO: 55128 - DNA, 50 bp, homo sapien
ctagtctaagtgctgggaattctaaycctagtttatccttgagcttgacc

SEQ ID NO: 55129 - DNA, 50 bp, homo sapien
cctctgaaaaacaaaattgctcaaayaattgctcttctgaatctgtggaa

SEQ ID NO: 55130 - DNA, 50 bp, homo sapien
tagatagcattttactcaaagaaaaktccgaatactctaagaactaaatc

SEQ ID NO: 55131 - DNA, 50 bp, homo sapien
tctgtaagaattagatcagagattasaaactcgaatgtttagagaggaag

SEQ ID NO: 55132 - DNA, 50 bp, homo sapien
gattatcagaagcaaatgggagatgsactcagacctaggagacagcagat

SEQ ID NO: 55133 - DNA, 50 bp, homo sapien
ccatttttttgttatcattacaccargtcattataagcccgtatttatga

SEQ ID NO: 55134 - DNA, 50 bp, homo sapien
ggattggaagatagaaaggtagaagrcaacagttaggaagttaatgcaaa

SEQ ID NO: 55135 - DNA, 50 bp, homo sapien
gtaatgatgcaatatgatcctaagaygcggaaatattactaacatagatt

SEQ ID NO: 55136 - DNA, 50 bp, homo sapien
gcactcaatacgggtttatagtagaygaaattgtgcatatgtttttccca

SEQ ID NO: 55137 - DNA, 50 bp, homo sapien
tgaagattgtttgcacacgcactcartacgggtttatagtagatgaaatt

SEQ ID NO: 55138 - DNA, 50 bp, homo sapien
ctttagatattcactcctttaggaaygaaatcttacctctatgattcacc

SEQ ID NO: 55139 - DNA, 50 bp, homo sapien
ttacttgtccttgtgaggttaaatarcattagatagatggcaagttgtta

SEQ ID NO: 55140 - DNA, 50 bp, homo sapien
catcatacagcaagtacttcactgaygatgaaacacaactgacagataaa

SEQ ID NO: 55141 - DNA, 50 bp, homo sapien
gcaatgccgaggactatctcgatgaygaagactcagattaattcctttct

SEQ ID NO: 55142 - DNA, 50 bp, homo sapien
aaaatttatggtaacattcattcackattatgtaacattgtctgctactg

SEQ ID NO: 55143 - DNA, 50 bp, homo sapien
agggattcatatgaaggagagacatyaagtacatataggatatgaactaa

SEQ ID NO: 55144 - DNA, 50 bp, homo sapien
cagtgatgttgaaaaaggtagttccragagaggccagcaatttttcaggt

SEQ ID NO: 55145 - DNA, 50 bp, homo sapien
acctggcaactgcttgcatgtcagayagatcatacttatggctggcaggg

SEQ ID NO: 55146 - DNA, 50 bp, homo sapien
tcctcggattttgtgtccacatgaaygcaatagaaattctgaggcatata

SEQ ID NO: 55147 - DNA, 50 bp, homo sapien
ggcagaaagggtacaggacagaaaawacgacatgatgtgcactaaactat

SEQ ID NO: 55148 - DNA, 50 bp, homo sapien
attgttcagtttatgttgagacttakcctctgttttttgaaaattcacac

SEQ ID NO: 55149 - DNA, 50 bp, homo sapien
gtgtgcagcataactgaacataccartgggccagttctgaaatacacacc

SEQ ID NO: 55150 - DNA, 50 bp, homo sapien
agacaagaaagcattaaatttacacycgaggtcatgagagcttcagctaa

SEQ ID NO: 55151 - DNA, 50 bp, homo sapien
ctgtgactgggccaaacttgagatamaacttcagtgacctgccttgttta

SEQ ID NO: 55152 - DNA, 50 bp, homo sapien
ttcaaagagggtaattttgagtcacyctacttctgtcttcaaatctagga

SEQ ID NO: 55153 - DNA, 50 bp, homo sapien
tctctttggattatttgacaagcagracagctctggtagagaggcatttt

SEQ ID NO: 55154 - DNA, 50 bp, homo sapien
gggaaagtagggtctaacaattctayaatattgccagtcaggctcgaatc

SEQ ID NO: 55155 - DNA, 50 bp, homo sapien
ggcctatttattaaaacaggtggcaytaagccaagagtgactattaaatt

SEQ ID NO: 55156 - DNA, 50 bp, homo sapien
atacagcagaaactatctaaaatgamatacaggcagctggagccaagatg

SEQ ID NO: 55157 - DNA, 50 bp, homo sapien
attagacagtggttttgtttttataytactgctgttttccagtaaccttt

SEQ ID NO: 55158 - DNA, 32 bp, homo sapien
aaagtgaacattaaatmaacagatcatgatgg

SEQ ID NO: 55159 - DNA, 50 bp, homo sapien
ggtagggccaaaatttgaacccagasagtgagatatgagagttgggatat

SEQ ID NO: 55160 - DNA, 50 bp, homo sapien
caaagtccaattttatagaaaaggaraacagagacttagtgtatgttatt

SEQ ID NO: 55161 - DNA, 50 bp, homo sapien
attattctttgacgccattttctcawactgttaaagaagaagcccatgac

SEQ ID NO: 55162 - DNA, 50 bp, homo sapien
accgtccatcttcacaggagacagarcaccgggatccctgcaggctggaa

SEQ ID NO: 55163 - DNA, 50 bp, homo sapien
atgatgactaagaacttgcataaacyggtattcatctggaataataaaaa

SEQ ID NO: 55164 - DNA, 50 bp, homo sapien
aggagagacatgcctaagaggttaasaggaaaactgagaacaggtgtggg

SEQ ID NO: 55165 - DNA, 50 bp, homo sapien
atgtatctgtagtatttgtgtattaygtattttaatttgtgatatatctg

SEQ ID NO: 55166 - DNA, 50 bp, homo sapien
tttcaaaatagagaagtgattaacarggttttcataccaaataagtattt

SEQ ID NO: 55167 - DNA, 50 bp, homo sapien
agtagcacaacaaagaattgtgggaratgtagaatcctgtcaatttagaa

SEQ ID NO: 55168 - DNA, 50 bp, homo sapien
taggcaacagataaattaacagataraggcatgactttctttccagatga

SEQ ID NO: 55169 - DNA, 50 bp, homo sapien
tggtagaaactgcctgtagaatgtgratggaaaataatagcattgaggac

SEQ ID NO: 55170 - DNA, 50 bp, homo sapien
ccacctatatacatttcaaaagtccwcaatgctattattttccatccaca

SEQ ID NO: 55171 - DNA, 50 bp, homo sapien
tgagagcagtgtgttttaaaccatcrctgttggccaggtgcggtggctca

SEQ ID NO: 55172 - DNA, 50 bp, homo sapien
gatcattattcagagtttgtatcacragagtattgaatgctatttacacc

SEQ ID NO: 55173 - DNA, 50 bp, homo sapien
gtggtacttaaaaatatgaatggaayggaaaactaaaaataattttaaat

SEQ ID NO: 55174 - DNA, 50 bp, homo sapien
cactgtgcctggcccaaaaatataaytgatgacaacagtgctaaccccta

SEQ ID NO: 55175 - DNA, 50 bp, homo sapien
cctctattgaattagaacatttctcycaagagtactcaaataaattttca

SEQ ID NO: 55176 - DNA, 50 bp, homo sapien
atattttaaatctaaaaagtatgtargactaatgctgaaaattatgaagt

SEQ ID NO: 55177 - DNA, 50 bp, homo sapien
caaggaaagaactctgcagcactcarctttagatacagctgaagcttgac

SEQ ID NO: 55178 - DNA, 50 bp, homo sapien
acagtgaaaatgaattatgtcaagaragtcagtaggtttatttttgccat

SEQ ID NO: 55179 - DNA, 50 bp, homo sapien
gccaggaaaacaatatatgctgaacraaaaggttagtgttctttgtacca

SEQ ID NO: 55180 - DNA, 50 bp, homo sapien
aaaatgatttccgatactttcacatwaaattgttctttagtattatggga

SEQ ID NO: 55181 - DNA, 50 bp, homo sapien
ttgtatattagaagcctcagagaaasagttagaagtatattttatgcaat

SEQ ID NO: 55182 - DNA, 50 bp, homo sapien
tttaattttgaggcttctggaaactsaatgccaaagaaagagtagaatag

SEQ ID NO: 55183 - DNA, 50 bp, homo sapien
ttttttaactggctattaacttctgmaataattgaaacatatacttttgg

SEQ ID NO: 55184 - DNA, 50 bp, homo sapien
tactatagtttgttactggacaagamatctgattgacaaatagcattaaa

SEQ ID NO: 55185 - DNA, 50 bp, homo sapien
gtgtgtgttcaatgctcacccataawgaagaatgcaaagcagttagcaag

SEQ ID NO: 55186 - DNA, 50 bp, homo sapien
agttgtttacttaaccaaactacgaraagagtggaagtgcagctggtcct

SEQ ID NO: 55187 - DNA, 50 bp, homo sapien
cggaggaatgatattgttcaagttaygagtatgagcaagtgccaaacagt

SEQ ID NO: 55188 - DNA, 50 bp, homo sapien
ctgacttaaggccactctctcactaygaatctcattgctgcctcataata

SEQ ID NO: 55189 - DNA, 50 bp, homo sapien
atgcctcctacttaagtttctcatcygaaaaattgtagtaataatgttac

SEQ ID NO: 55190 - DNA, 50 bp, homo sapien
atgtacgaatgcatatgcatctcagmaaatcagctagatagaaaaataga

SEQ ID NO: 55191 - DNA, 50 bp, homo sapien
aatcttaggtcaagtatgaacgtggscaccttataccaagttgatatttg

SEQ ID NO: 55192 - DNA, 50 bp, homo sapien
gggaattaccacaagatagaagatgragactatcaaatgtgaatccagaa

SEQ ID NO: 55193 - DNA, 50 bp, homo sapien
ttaacctctgttctctgaagttttarggccaaaaatcaaattccatgact

SEQ ID NO: 55194 - DNA, 50 bp, homo sapien
gttctttttcccaaatctactttacwgatattattcataatttgtgccat

SEQ ID NO: 55195 - DNA, 50 bp, homo sapien
aagctcaagctcaaaaagactgttayggagacttagaaattatggtaagg

SEQ ID NO: 55196 - DNA, 50 bp, homo sapien
gacttatttccattcagatggagaartcatccctagtacgtgatttgcta

SEQ ID NO: 55197 - DNA, 50 bp, homo sapien
gggaatgatgcatgcttcactgcagmaaaactataactgctgagaagttc

SEQ ID NO: 55198 - DNA, 50 bp, homo sapien
cagcagactccagggttccatgaaaygcttttggaaaactgatggtctcc

SEQ ID NO: 55199 - DNA, 50 bp, homo sapien
aagggaagcctcaaagataactctargattttgaacatgaaatctgagga

SEQ ID NO: 55200 - DNA, 50 bp, homo sapien
ctatagagttgtcaagatttaaaaayattgttaaggtgagtcaaaataat

SEQ ID NO: 55201 - DNA, 50 bp, homo sapien
tcataataaagctgatgatgcagtaratttgtgagcctgaggaagcaagg

SEQ ID NO: 55202 - DNA, 50 bp, homo sapien
aaagaataacagttatagaactcaastccaaaattggggaaatggaaggt

SEQ ID NO: 55203 - DNA, 50 bp, homo sapien
gatgtacacttccctattcctctcamtaagtgcaactaaaaaccttgcat

SEQ ID NO: 55204 - DNA, 50 bp, homo sapien
ggctgggaagggataagggtctgccraagtcctatgtggaggatgaaggg

SEQ ID NO: 55205 - DNA, 50 bp, homo sapien
ccaggtccatctatgtaaaactctayatttaaagggctcatatggttagg

SEQ ID NO: 55206 - DNA, 50 bp, homo sapien
ccttttgtgtctataaagcctttccratagttaccatccacatcagcttc

SEQ ID NO: 55207 - DNA, 50 bp, homo sapien
aagagacatttgacaacctaatatcratggcttgaacaatggctttacta

SEQ ID NO: 55208 - DNA, 50 bp, homo sapien
cagtagcaatccagtgaataccaggwagataacttcaagtgatttaatat

SEQ ID NO: 55209 - DNA, 50 bp, homo sapien
aatacatttaactgcaaggaggttargtgatccaacatcatccaactcat

SEQ ID NO: 55210 - DNA, 50 bp, homo sapien
tattagaagcaaaggctagaaagtamgtttggagaaatgttacagagggc

SEQ ID NO: 55211 - DNA, 50 bp, homo sapien
aagtacttactatgcactgtatgtayggactagcagcattgctaaaaatg

SEQ ID NO: 55212 - DNA, 50 bp, homo sapien
aaagattacactcatgcataaacackgtgtggatccccttcagacctccc

SEQ ID NO: 55213 - DNA, 50 bp, homo sapien
agtttctatttcttcatctggaaaayagtccttgttacagctgccctgat

SEQ ID NO: 55214 - DNA, 50 bp, homo sapien
gaagtctgcactaatgacgctatacratattcaagggtaaaagacttggg

SEQ ID NO: 55215 - DNA, 50 bp, homo sapien
ctcacccatttctctgtcccaaatgkcatctaggtgcagggaggcacatc

SEQ ID NO: 55216 - DNA, 50 bp, homo sapien
acctaatgcataacgagttaaaatcrgagccaggatttaaattcaggttt

SEQ ID NO: 55217 - DNA, 50 bp, homo sapien
tgagatgtctctttaactttcaagakgtacagcaaaactgaaatcaatgg

SEQ ID NO: 55218 - DNA, 50 bp, homo sapien
aggaatcctgtcattcatagagagaratagacactcttgtttatttgtta

SEQ ID NO: 55219 - DNA, 50 bp, homo sapien
tatcacattaagaagtgaataaagcraggttgattcccttttaatgatgc

SEQ ID NO: 55220 - DNA, 50 bp, homo sapien
gaaagaaggagaacattgttctgacmaattcccgtctttaataaatgcta

SEQ ID NO: 55221 - DNA, 50 bp, homo sapien
tttttgattcatgaagatgtcttacraagtgttgacttacttgcttttct

SEQ ID NO: 55222 - DNA, 50 bp, homo sapien
ggcagtggggaaaagccacattaaamcttctgatcagtgaatagaggcaa

SEQ ID NO: 55223 - DNA, 50 bp, homo sapien
catagatcgtgttttgtgaaacttayatgaacacagaggttaaagtatgt

SEQ ID NO: 55224 - DNA, 50 bp, homo sapien
ataacaccagcctctttcatctcagyaatagatagcgccagactgtggca

SEQ ID NO: 55225 - DNA, 50 bp, homo sapien
cactgccaccaagtctaggttctcayagtccaatccaatccagtcctccg

SEQ ID NO: 55226 - DNA, 50 bp, homo sapien
gaccagtcagatagacatcctctaartctggtgtgagagccactgatttc

SEQ ID NO: 55227 - DNA, 50 bp, homo sapien
tttcagtaccctatccagattataarttaaggcctctgatcttggttgga

SEQ ID NO: 55228 - DNA, 50 bp, homo sapien
aaaagcacaaaaattatacctgggcsagtctcacatagcaggttagcatc

SEQ ID NO: 55229 - DNA, 50 bp, homo sapien
tttaggaataaaacagaagctactgrcaacacgtactagtgactacttcc

SEQ ID NO: 55230 - DNA, 50 bp, homo sapien
tgtcaagtaacagaaaagctattcarctggcttaaacaattaagggaatt

SEQ ID NO: 55231 - DNA, 50 bp, homo sapien
tttcagcttgtgttggaaacgtgatyaacttagagaaagaagctgcagaa

SEQ ID NO: 55232 - DNA, 50 bp, homo sapien
tgttgtcagggaataacggaggatcygatcaaagggaaagcaggggtaaa

SEQ ID NO: 55233 - DNA, 50 bp, homo sapien
cactgaattttgctctctcaccaacmatatctgtttcaggccccacttct

SEQ ID NO: 55234 - DNA, 50 bp, homo sapien
aattcgaggtattacagcctcaagayaaaagccttctaatgagtgaattt

SEQ ID NO: 55235 - DNA, 50 bp, homo sapien
aggaaagaccattccctctaaccaayggagatcatgcaaaatgagaagaa

SEQ ID NO: 55236 - DNA, 50 bp, homo sapien
gaatcagagaagaggagccttcagayaagaatcttttacatctgtttatg

SEQ ID NO: 55237 - DNA, 50 bp, homo sapien
aaatattatgctttaggaagtcatasaaaaccatgttaagcttcaaaatg

SEQ ID NO: 55238 - DNA, 50 bp, homo sapien
ttccaatgaatttctagagcaaatasagctggctccctacccaagagcag

SEQ ID NO: 55239 - DNA, 50 bp, homo sapien
ttgcaaagctagggaaacataaatarggaatcatggcttgagcttttcaa

SEQ ID NO: 55240 - DNA, 50 bp, homo sapien
gcactgtagtgtgttaagaaggacaytgcatttgtaatcaactccagacc

SEQ ID NO: 55241 - DNA, 50 bp, homo sapien
ttatgacaaatgttaactccatgaakaaatccttgtaaatatactgttca

SEQ ID NO: 55242 - DNA, 50 bp, homo sapien
agaatatgggatcataattagttcaytaccattctatggttatttcaaaa

SEQ ID NO: 55243 - DNA, 50 bp, homo sapien
cctggagaacagagttgaactgagargttgatagcacaatggaaggtaca

SEQ ID NO: 55244 - DNA, 50 bp, homo sapien
aggttatttattcaaattctgataakacttggtaaaggttattcaaaatg

SEQ ID NO: 55245 - DNA, 50 bp, homo sapien
ctaactctttcttaagaaactgaaarcgtctttaaattatatcaaataag

SEQ ID NO: 55246 - DNA, 50 bp, homo sapien
ctggttaaatagtgtgtgcatggaartaaagtcttaagagttctatgatt

SEQ ID NO: 55247 - DNA, 50 bp, homo sapien
attggctacttgaaggaattgtaacygctaatgacacctcaagcttgtgg

SEQ ID NO: 55248 - DNA, 50 bp, homo sapien
tctgcagtcagtgattcattctcaascaaaaacgtttcttttctctacca

SEQ ID NO: 55249 - DNA, 50 bp, homo sapien
catgcttacaatgtgaaaaattaaayccttgtagtgcttctccagcaggg

SEQ ID NO: 55250 - DNA, 50 bp, homo sapien
caattttctcttaaactgaagtccaractagcttatatcaatgcactata

SEQ ID NO: 55251 - DNA, 50 bp, homo sapien
tcttctcctcctgcttattagcataygaaagagaagttatttattttgag

SEQ ID NO: 55252 - DNA, 50 bp, homo sapien
acacgtactccctcaagatgatacaytcagaacagatttgacagcacaga

SEQ ID NO: 55253 - DNA, 50 bp, homo sapien
gtgggaaagggaaattcaggcttccragtaaggttttcaaatgagtccat

SEQ ID NO: 55254 - DNA, 50 bp, homo sapien
actcaatcattaccaaatataaaaarccaattcaagtgattcctgcaaaa

SEQ ID NO: 55255 - DNA, 50 bp, homo sapien
tactaacaagaacattagaaattaamgtaagctattacttataaaccatc

SEQ ID NO: 55256 - DNA, 50 bp, homo sapien
ggtgatactctcaaattaagcaggtsaaggagagattaatagagcaccta

SEQ ID NO: 55257 - DNA, 50 bp, homo sapien
aataacttactctaggttcacaaggscattaagtgatcctatatcagaga

SEQ ID NO: 55258 - DNA, 50 bp, homo sapien
atccttatttggatttgtttgttcayatacttattaaactgtattgacca

SEQ ID NO: 55259 - DNA, 50 bp, homo sapien
acaatgcatagaataatcatatttayagagcaaaaaacgaatgttattga

SEQ ID NO: 55260 - DNA, 50 bp, homo sapien
gaaactgcacacatccttgcacctcrgaagatccatttgcagtcaaagtc

SEQ ID NO: 55261 - DNA, 50 bp, homo sapien
catctagcataatatacctaccaccrataatgtgctgcaggctgtgtgtt

SEQ ID NO: 55262 - DNA, 50 bp, homo sapien
tagggatatagggccataagcatgayctggagctatgccaacccactatc

SEQ ID NO: 55263 - DNA, 50 bp, homo sapien
agagatttgatttatgaggggttacrctgagtctacccagttatttttct

SEQ ID NO: 55264 - DNA, 50 bp, homo sapien
tccattgaaatcacagaattttacarctaaagagaacttccagatggttt

SEQ ID NO: 55265 - DNA, 50 bp, homo sapien
ttagaaacacatactgcttacggaartatttcattatagaaaaaaagagc

SEQ ID NO: 55266 - DNA, 50 bp, homo sapien
aaacgttaaatggttgtgactaattyaattaaccatggttaatcagggca

SEQ ID NO: 55267 - DNA, 50 bp, homo sapien
aacaacctcagtgtctccaagggtcraatcttatgtctactttccttaac

SEQ ID NO: 55268 - DNA, 50 bp, homo sapien
ttgaaatgagttatctgtttagtaartgtcaatgtttctcaattgaatga

SEQ ID NO: 55269 - DNA, 32 bp, homo sapien
cttcttttttttcctasctggcaatacaaatt

SEQ ID NO: 55270 - DNA, 50 bp, homo sapien
tacctaactgtgctgaaacccaatcratacttctgttctgagttgttaca

SEQ ID NO: 55271 - DNA, 50 bp, homo sapien
tgtttggtaaagatgccacatgatcrgacttctttaatttatgctgaggt

SEQ ID NO: 55272 - DNA, 50 bp, homo sapien
cagaagcttacttctgggtaggccaytattttcactgcaacaacgagaaa

SEQ ID NO: 55273 - DNA, 50 bp, homo sapien
aaaaggaaatcgtagagacactaaamaattacttgcagctgtctttacaa

SEQ ID NO: 55274 - DNA, 50 bp, homo sapien
ttcctttttaagcagattccaattckcttccaaggttctccaaattttca

SEQ ID NO: 55275 - DNA, 50 bp, homo sapien
atttagtttggatatttcctgttgaytagtttttgagtttgctcaaccta

SEQ ID NO: 55276 - DNA, 50 bp, homo sapien
atactcatgttttctcaactctagaytcctcaccagctattgtagaaacc

SEQ ID NO: 55277 - DNA, 50 bp, homo sapien
gatttgggagaaaatttaaaaagatkatacatgtgacaaacttaccaagg

SEQ ID NO: 55278 - DNA, 50 bp, homo sapien
aagactgagtgttgatggatgattayggtggcactgaggtggtgggtgat

SEQ ID NO: 55279 - DNA, 50 bp, homo sapien
gcacattggattatgactactcaaaraaagaaatatttgaaactggagga

SEQ ID NO: 55280 - DNA, 50 bp, homo sapien
accccaatgctgctgcatctccaccraagataaagacttgggtggagact

SEQ ID NO: 55281 - DNA, 50 bp, homo sapien
atatcttgatatccctaaaatgtcaygtctctatacctagtgagcacacc

SEQ ID NO: 55282 - DNA, 50 bp, homo sapien
tgctttttcaatataacagcacatartaaactttttcctatgataattat

SEQ ID NO: 55283 - DNA, 50 bp, homo sapien
aatccagagctccgccccttctttcratcatctcgctgcaggcactgacc

SEQ ID NO: 55284 - DNA, 50 bp, homo sapien
caggtaactcccttccttgacattaycttctaccaaagacagccaacttg

SEQ ID NO: 55285 - DNA, 50 bp, homo sapien
gagaaacaaagactttgatctgatcyatgatagaacacattcctttctgt

SEQ ID NO: 55286 - DNA, 50 bp, homo sapien
gctgtcagttgcatgagaaaaagtaytaaaattcagggctctttagaatg

SEQ ID NO: 55287 - DNA, 50 bp, homo sapien
ttaccatcctccagaactgtaagaartagattgcttttaaaattatttca

SEQ ID NO: 55288 - DNA, 50 bp, homo sapien
aaaatctgattgcagcaaacaggaartctccctgctaatactcacccctg

SEQ ID NO: 55289 - DNA, 50 bp, homo sapien
tgtgagtctttcaagaataagtgggyactgtggaaaatgtctacttttag

SEQ ID NO: 55290 - DNA, 50 bp, homo sapien
atcgacaactcacgcactcacagcartcttaggaacgccggcttttgata

SEQ ID NO: 55291 - DNA, 50 bp, homo sapien
aatactgatgatattaacataaccaraaaatataatatgtccaaatgaat

SEQ ID NO: 55292 - DNA, 50 bp, homo sapien
tttcctaatgtttgcaaagatgcatsaaactcttctttactcttggcttt

SEQ ID NO: 55293 - DNA, 50 bp, homo sapien
ggatgatggactacttaaggaatacraaatgcaatcctgtgagcactgaa

SEQ ID NO: 55294 - DNA, 50 bp, homo sapien
ttgcgaagaagctagaaaccttgaaraaagatcagatgaatggctaacta

SEQ ID NO: 55295 - DNA, 50 bp, homo sapien
gtccctatgttctactgcaactcaaygaaagaaaatacagttcccaatac

SEQ ID NO: 55296 - DNA, 50 bp, homo sapien
aaagggccatttatcttgaatgttaygtcatctttactactggctcaatt

SEQ ID NO: 55297 - DNA, 50 bp, homo sapien
taacaataagcaattttttccagatmatataagaagagaaaatatttccc

SEQ ID NO: 55298 - DNA, 50 bp, homo sapien
gcacctttccagctgaaccatggacyatatacaatgatgatggtgacggt

SEQ ID NO: 55299 - DNA, 50 bp, homo sapien
cttgttttggttaaattttgtcttcratcaatacatattttgacactgaa

SEQ ID NO: 55300 - DNA, 50 bp, homo sapien
atgcccaactaaagactgaagcagaragcctggccagatgcctcatacca

SEQ ID NO: 55301 - DNA, 50 bp, homo sapien
actatttaataaggctgttttttaaygagttgaaatggaccgaaatactt

SEQ ID NO: 55302 - DNA, 50 bp, homo sapien
ttcagtgtttctgtttcactttaacrgtattgctcaaaagatcaaaatga

SEQ ID NO: 55303 - DNA, 50 bp, homo sapien
tttctggctatggagaaagtcaccasagagtagcagagctgccagaaact

SEQ ID NO: 55304 - DNA, 50 bp, homo sapien
gtaataaaatctgttcagatatatamgcaaaaaaaatgttttatacccat

SEQ ID NO: 55305 - DNA, 50 bp, homo sapien
aatagagcaagatggtgacttttgamacaagtcctttaaggcaggggtcc

SEQ ID NO: 55306 - DNA, 50 bp, homo sapien
ggacaggaacccttgagggagcaaayttgagtgtcttttttgatgcttcg

SEQ ID NO: 55307 - DNA, 50 bp, homo sapien
ggtgaggcttccctgtgcaggcaccrgatttaatttggatcctactgtta

SEQ ID NO: 55308 - DNA, 50 bp, homo sapien
acatttttatttcattgcctccttaygcaaaccaggtgcacacagatatg

SEQ ID NO: 55309 - DNA, 50 bp, homo sapien
ttatattttttgcaaccctgtacacmatcaatgccacaggcagggctccc

SEQ ID NO: 55310 - DNA, 50 bp, homo sapien
ttttaaaggtaaactgaggaattgcygaaaagttccttaagatgcatagt

SEQ ID NO: 55311 - DNA, 50 bp, homo sapien
aaaatggattataaacccagtccacygagaagaagagaggcccagcagat

SEQ ID NO: 55312 - DNA, 50 bp, homo sapien
ctgcacccccggaggaaagcagtaaygtagcaagcctgctatcggtgccc

SEQ ID NO: 55313 - DNA, 50 bp, homo sapien
caaaatattattcaagagatgactaytaggttctgcatcttgtggtacag

SEQ ID NO: 55314 - DNA, 50 bp, homo sapien
gttcgaatcctgccgttattagccartcctctcatgaatctgatcccctt

SEQ ID NO: 55315 - DNA, 50 bp, homo sapien
atttatagaaatatttagttttatgsaggtcagaagcactgtgctatgcc

SEQ ID NO: 55316 - DNA, 50 bp, homo sapien
aataatacgcaaataaataatatccwcagtaaccatgcatacggcaaatt

SEQ ID NO: 55317 - DNA, 50 bp, homo sapien
tatggagtattgatcagtggcgggayacagtttgaaggtagagggagagg

SEQ ID NO: 55318 - DNA, 50 bp, homo sapien
cactgtcggcctcaagcagggaaacrctaactgtggaatgaacgagttcc

SEQ ID NO: 55319 - DNA, 50 bp, homo sapien
atccgtcccagcactatatttcaacsatgcagaaaaacttttagaaacta

SEQ ID NO: 55320 - DNA, 50 bp, homo sapien
gttattcctcagttattagcacaaaygttatttccttaggaactaggctg

SEQ ID NO: 55321 - DNA, 50 bp, homo sapien
cacctggagggcacataacagctcayatttaacgcatcaagcttaatatg

SEQ ID NO: 55322 - DNA, 50 bp, homo sapien
gtcatgggagataggaacaaaaaaayctcattagagtcacaagttgtttt

SEQ ID NO: 55323 - DNA, 50 bp, homo sapien
gcagaatccccaggtttaaaacagayagactgacgcaaaggtggggccca

SEQ ID NO: 55324 - DNA, 50 bp, homo sapien
tttgaaaaatttcctccaggtcaaarcattcattcattttcctttgaaat

SEQ ID NO: 55325 - DNA, 50 bp, homo sapien
gttgtctatttgttagttctcttgaygttttacctaaattcaccttatag

SEQ ID NO: 55326 - DNA, 50 bp, homo sapien
catataggatacaagttctgtgaaaygatacgcaaaatattagaagacat

SEQ ID NO: 55327 - DNA, 50 bp, homo sapien
tgtgatgggacgctgtaacaattgayagcctgttggagattcagttagca

SEQ ID NO: 55328 - DNA, 50 bp, homo sapien
cactcccacacttcataaacttgcartccaattatttactcaacaaatga

SEQ ID NO: 55329 - DNA, 50 bp, homo sapien
gggctccacacagacattcatggaamcaggttgatatgggttacaccatc

SEQ ID NO: 55330 - DNA, 50 bp, homo sapien
tgaacatattttcacctagtaccaaygtgataacaatggctcagtgtacg

SEQ ID NO: 55331 - DNA, 50 bp, homo sapien
tcagtacacagctctccgttctccasggttgaaacaccatagtgtaccct

SEQ ID NO: 55332 - DNA, 50 bp, homo sapien
aggcgcaatatcaccctggacactgraagtctggttggatgctggggtca

SEQ ID NO: 55333 - DNA, 50 bp, homo sapien
acaaatatgcatgaatatagaggcarcctgaatagtaggtatattttgga

SEQ ID NO: 55334 - DNA, 50 bp, homo sapien
acttcataatgtttccaaaaatagayggaattactcctgagttccactaa

SEQ ID NO: 55335 - DNA, 50 bp, homo sapien
tccctgcttcatgttatcagtctaarccaaggtcggtagctaaagaaagg

SEQ ID NO: 55336 - DNA, 50 bp, homo sapien
ttacaccagtggctgccattgtgtamagacataaaacaaagcacagaaca

SEQ ID NO: 55337 - DNA, 50 bp, homo sapien
gatgtgcttatctcgctgaacttcasagtagaaaaatagcagatgaggta

SEQ ID NO: 55338 - DNA, 50 bp, homo sapien
ccaaagtctcccttcttggtttctamagggatgagagagaaagcaaggat

SEQ ID NO: 55339 - DNA, 50 bp, homo sapien
ttctgttggtacctttgtcagtctcraagctgagaaggaggaatgagcag

SEQ ID NO: 55340 - DNA, 50 bp, homo sapien
caagaagggagactttggctcacaayggttatgttctgaattattccagc

SEQ ID NO: 55341 - DNA, 50 bp, homo sapien
ggaaagttgaataaacaaggatatcrgaggctcagacaaacgggaaagat

SEQ ID NO: 55342 - DNA, 50 bp, homo sapien
ttttgttgagtgagctttggttctakctccgtggtaggatggtgagtgtg

SEQ ID NO: 55343 - DNA, 50 bp, homo sapien
gttttgccatgtgggtgatgaaatayggagaacacacagctgcattcaaa

SEQ ID NO: 55344 - DNA, 50 bp, homo sapien
acaacacacataataaactgtttacyctgaaatgcatgtttcaaaggctt

SEQ ID NO: 55345 - DNA, 50 bp, homo sapien
actgggcttggagtgccctgttaaayaaatatggctgcagtgaccaaaga

SEQ ID NO: 55346 - DNA, 50 bp, homo sapien
agaagttacagaacacagagtgctcraaactaagaatgtgctagttgtat

SEQ ID NO: 55347 - DNA, 50 bp, homo sapien
gctgcaccctctaaaggcttctcaartgacagagctcaatgaatatagaa

SEQ ID NO: 55348 - DNA, 50 bp, homo sapien
gagttaattcctctatatttattcargaaatctcacttcagttctaattt

SEQ ID NO: 55349 - DNA, 50 bp, homo sapien
gacccctgcactccaaaaccagcacsatggacatgctcacaccacctctc

SEQ ID NO: 55350 - DNA, 50 bp, homo sapien
ggaagaaataaagtgatccaccataygtaggcagatggtcagttcgccag

SEQ ID NO: 55351 - DNA, 50 bp, homo sapien
gcgacttgatctggtcttatggaaaygacatatttaaaccagaggaaggg

SEQ ID NO: 55352 - DNA, 50 bp, homo sapien
cactgtaattagtcctaaaatatccracacaatttttttgaataaatcaa

SEQ ID NO: 55353 - DNA, 50 bp, homo sapien
tgccacagtatcttcagtgattaacmacgattttctttagaaaccttgtg

SEQ ID NO: 55354 - DNA, 50 bp, homo sapien
aggagcagaaaggttatactttcacyctgtagcaaaaagtggattggaaa

SEQ ID NO: 55355 - DNA, 50 bp, homo sapien
gcactttagacatgcaagacagttakgactcctggagcagtccttaacca

SEQ ID NO: 55356 - DNA, 50 bp, homo sapien
gattttaaacacacctattgaaaagsaatggtgacgaggagactggagtc

SEQ ID NO: 55357 - DNA, 50 bp, homo sapien
agcactacctccgtgccttcagaccrctgtttcctgtacttagaggggaa

SEQ ID NO: 55358 - DNA, 50 bp, homo sapien
taaaccttatttctgtgtatcaaatkataatactcactgaacagatggag

SEQ ID NO: 55359 - DNA, 50 bp, homo sapien
ttaatgatgagaacatcttcaaagarccaccacttcttacaaagcccttc

SEQ ID NO: 55360 - DNA, 50 bp, homo sapien
tcaagtggtgattattgctttgtgaygatgataggaagtgacaaaaattt

SEQ ID NO: 55361 - DNA, 50 bp, homo sapien
tgctggtttgctgtttttgttgttaygtaatcctttcagaaagccatcct

SEQ ID NO: 55362 - DNA, 50 bp, homo sapien
ccagctaatgcggagtctgccaacayacgtggactagattgtgtccacat

SEQ ID NO: 55363 - DNA, 50 bp, homo sapien
acatggtcaatatacagtatctcaaygtcaacagcatttattgcagtatt

SEQ ID NO: 55364 - DNA, 50 bp, homo sapien
tattagtggagaatgaacggaaaagyctgtggttcctgtagttttcatgg

SEQ ID NO: 55365 - DNA, 50 bp, homo sapien
atttttattgtgctaattaaacctcragtggtatttcaagtacagattgt

SEQ ID NO: 55366 - DNA, 50 bp, homo sapien
cccaggggatctctagaaccctatgraagactaaggaggaatgagacttc

SEQ ID NO: 55367 - DNA, 50 bp, homo sapien
cgtaagggttttgctagtatttaaarttgttttgcttttctttttaacaa

SEQ ID NO: 55368 - DNA, 50 bp, homo sapien
gaactttacttgggaaggtaaaagawctagaatacccaacacaataccca

SEQ ID NO: 55369 - DNA, 50 bp, homo sapien
ctttcagctcgaagaacaatcaaaaygcgtaagtcaaaaggaagatgtgg

SEQ ID NO: 55370 - DNA, 50 bp, homo sapien
tttctctcttatttttaaaggtcagsctagatgtttttcagtttcattaa

SEQ ID NO: 55371 - DNA, 50 bp, homo sapien
attttcagaggattacaacattttcyataggagaccagtgcatacattaa

SEQ ID NO: 55372 - DNA, 50 bp, homo sapien
taaaaaagcttctgtgaagggataartgattaagatttcatgagttttaa

SEQ ID NO: 55373 - DNA, 50 bp, homo sapien
ctaagtttcagttgtgctcattatargctatattacactaaggagaaatc

SEQ ID NO: 55374 - DNA, 50 bp, homo sapien
aattggtggtgtccagatgtcctacrgcaaggtttttttgttttgttttg

SEQ ID NO: 55375 - DNA, 50 bp, homo sapien
ccatatcttcaggaaaatctgatcawccctttagtcttcagtgacacgca

SEQ ID NO: 55376 - DNA, 50 bp, homo sapien
gtttaataggagaaatgtaaagacartaatcatggccaataattaaatat

SEQ ID NO: 55377 - DNA, 50 bp, homo sapien
ttgatgtaggattaaggaacttctayacttctatgctcttctcagccaaa

SEQ ID NO: 55378 - DNA, 50 bp, homo sapien
aaaataatcttaatctaatggtttaygtatattggaagtgagatatgtta

SEQ ID NO: 55379 - DNA, 50 bp, homo sapien
tttactttcttgtgtttcctgaccaytctatctaaaatcttcagtgacat

SEQ ID NO: 55380 - DNA, 50 bp, homo sapien
aatttaagaaaataaatcacaaaccrcttcaaatctctgcaagctccact

SEQ ID NO: 55381 - DNA, 50 bp, homo sapien
tggaaaatagactcatacttatcccrgccttaccaagctgatcagaaagc

SEQ ID NO: 55382 - DNA, 50 bp, homo sapien
tagtcttacaaagtatagttgaccamattgacagttttgcttaaggtggg

SEQ ID NO: 55383 - DNA, 50 bp, homo sapien
ctgtcttcaacatgagggatacagayagcttctttactgttgtagggaaa

SEQ ID NO: 55384 - DNA, 50 bp, homo sapien
gagctgatcccatttttgaacagtarcatgcaatattgagagcgagcatt

SEQ ID NO: 55385 - DNA, 50 bp, homo sapien
aaagaaaaaatacagtgtagttgaartctacagaaaagatccaactgatg

SEQ ID NO: 55386 - DNA, 50 bp, homo sapien
aggtcattggatggcttattgggaasatacagagtagctttagggttttt

SEQ ID NO: 55387 - DNA, 50 bp, homo sapien
ttaggagagctttctgatcatccaargactcttaaggaattcgccatttt

SEQ ID NO: 55388 - DNA, 50 bp, homo sapien
aacccaccttccattttggtccttcraaaccctccatctgtgaagcttgc

SEQ ID NO: 55389 - DNA, 50 bp, homo sapien
tacagaggaacgatgataagcattayaggagacttttaataaaaaaccat

SEQ ID NO: 55390 - DNA, 50 bp, homo sapien
ggctatagcgaggcctagttatttasctgccaataatcatggtttccatt

SEQ ID NO: 55391 - DNA, 50 bp, homo sapien
attcaacttccaacatcaagtggtamcttctagtgctgaaatcctattgg

SEQ ID NO: 55392 - DNA, 50 bp, homo sapien
gagtttctcctaggaatgcaatttcyatatagtgctgataggtcatcgtt

SEQ ID NO: 55393 - DNA, 50 bp, homo sapien
ttactaatgggacaatggttatgaamgatgacctatcagcactatataga

SEQ ID NO: 55394 - DNA, 50 bp, homo sapien
agctattggccagagcataggcatargagcctgttttcaaaccaacaggg

SEQ ID NO: 55395 - DNA, 50 bp, homo sapien
tgtacttgtctcctaactcaacataygtagaaacaaactaaacctgcact

SEQ ID NO: 55396 - DNA, 50 bp, homo sapien
ttttcttaaattaatttcaaggcacraaagaaggaatttgcagagccaaa

SEQ ID NO: 55397 - DNA, 50 bp, homo sapien
cacgttcagcctctgcttaaccggarcggccgaacagcgcaggccggcag

SEQ ID NO: 55398 - DNA, 50 bp, homo sapien
gtgaaacagcagaaatatttgtagaygcctcatttccactaacatacttg

SEQ ID NO: 55399 - DNA, 50 bp, homo sapien
gctcccccatccaagacactggaaakttcttcaatgcagggaaaaacatt

SEQ ID NO: 55400 - DNA, 50 bp, homo sapien
gtacaaatattcattaaaccataacraagcaccatttttacctatccact

SEQ ID NO: 55401 - DNA, 50 bp, homo sapien
caagtgcttggaccttggataggtcraccggctgaaggttggacagttgt

SEQ ID NO: 55402 - DNA, 50 bp, homo sapien
catacagcactgtaattgtgacccamctaagtctgtgacccacttaagtt

SEQ ID NO: 55403 - DNA, 50 bp, homo sapien
aataaagttgtaaatctcttgccgayaaatcctcagtcaggcccgtttta

SEQ ID NO: 55404 - DNA, 50 bp, homo sapien
gagagcaacagtgcttggtggaataycacttttcttgatgaatgaattct

SEQ ID NO: 55405 - DNA, 50 bp, homo sapien
acaatggatatgattgaacaattcarctggagtatccaaaaacgtatgac

SEQ ID NO: 55406 - DNA, 50 bp, homo sapien
acaaccccttgacgtatgtattgaamattttttggcatatttgtttccag

SEQ ID NO: 55407 - DNA, 50 bp, homo sapien
ctcctgtgaccaggccaggccacagrattggctcccacatttgcctaaag

SEQ ID NO: 55408 - DNA, 50 bp, homo sapien
tcttgatgaccttgttttacaccaakttgatgcagtaataggtggagaat

SEQ ID NO: 55409 - DNA, 50 bp, homo sapien
tgaagattagcacaaaaaagagtaamtcaagccttgggtgaacagaatgt

SEQ ID NO: 55410 - DNA, 50 bp, homo sapien
tttaattacagcaaattttctttcayaatgtacataaactcaggggaaat

SEQ ID NO: 55411 - DNA, 50 bp, homo sapien
catcctttttacgcatgttacagcayggacaggtcaagcgtgcctaaaaa

SEQ ID NO: 55412 - DNA, 50 bp, homo sapien
tattagactaagcagtcaaggggtakactgtagcagactgtggttactta

SEQ ID NO: 55413 - DNA, 50 bp, homo sapien
agttttttattgtattacattcctcrattaaacatgggtcgctgaaccga

SEQ ID NO: 55414 - DNA, 50 bp, homo sapien
aacagtaacctaatacaccgttatawctcactggaacatgtccctgtttt

SEQ ID NO: 55415 - DNA, 50 bp, homo sapien
tatgtcacaaagtctctgaaacacakaagtttaatctcaaaaactatctc

SEQ ID NO: 55416 - DNA, 50 bp, homo sapien
caaaaactgcttttaatagcccaaayatcggttttcttccctaaataact

SEQ ID NO: 55417 - DNA, 50 bp, homo sapien
acatttcctcacaaaggacacttgargttgtgcccacagaggcaaatgct

SEQ ID NO: 55418 - DNA, 50 bp, homo sapien
ataaataaaagtaatgtctaatatayggcttcaattccactagctttcag

SEQ ID NO: 55419 - DNA, 50 bp, homo sapien
gcttataattaaatggtaacagaackgaaatatttgaacaattttctgct

SEQ ID NO: 55420 - DNA, 50 bp, homo sapien
ggaaaaggaaaagcaaatgaaaatamtatcacagagaaatttcttggtag

SEQ ID NO: 55421 - DNA, 50 bp, homo sapien
ttcattctataccatttattcacttkaaactttcatatatgtttaattat

SEQ ID NO: 55422 - DNA, 50 bp, homo sapien
gagaaaggtctcaaaaaccaggagasaggatccaataggtagctctgggt

SEQ ID NO: 55423 - DNA, 50 bp, homo sapien
gtagaataaaaagtgaggactccacrgaggtttacaggaggaaaactatg

SEQ ID NO: 55424 - DNA, 50 bp, homo sapien
aaaatctcaagcccttgtatgaaacraagaagtgtggcctgtccctacgt

SEQ ID NO: 55425 - DNA, 50 bp, homo sapien
ttgatttctataatttggctttcaasatgacaatcagatctactattgtt

SEQ ID NO: 55426 - DNA, 50 bp, homo sapien
ttttgcttactatcaccaagcacacrcctataacataataagatcttgga

SEQ ID NO: 55427 - DNA, 50 bp, homo sapien
gtgcttaacaataacaactgaattasaattgctcttggattcatgagggg

SEQ ID NO: 55428 - DNA, 50 bp, homo sapien
cccggccagacacttcattcttcacygtgaaattctatgcaatccattaa

SEQ ID NO: 55429 - DNA, 50 bp, homo sapien
taggccctacaggatgaacgttaacragtttttactgacagtgacctctc

SEQ ID NO: 55430 - DNA, 50 bp, homo sapien
ctttttattacttttaaatattatcwctaaaatgctaagtacaaaccaag

SEQ ID NO: 55431 - DNA, 50 bp, homo sapien
attaagccctgaaaacacttacttayaggtagcccttcaaagggggtaaa

SEQ ID NO: 55432 - DNA, 50 bp, homo sapien
gaccaagctcaagacagtatggaccraacagtaaggacaccccttcttag

SEQ ID NO: 55433 - DNA, 50 bp, homo sapien
ttttctctttttattcttcctgacayaaactttggatgcaacataaagct

SEQ ID NO: 55434 - DNA, 50 bp, homo sapien
cgaagggtaggttaggtcaataataycaaccaagagttctgacattactg

SEQ ID NO: 55435 - DNA, 50 bp, homo sapien
gtcatccttcttctacctaaaggagkccagttgatatccattgccttaaa

SEQ ID NO: 55436 - DNA, 50 bp, homo sapien
tgtttaaacatcactgtgcatctaamattcttctggcgttcttcttggct

SEQ ID NO: 55437 - DNA, 50 bp, homo sapien
gagaatagaggccagtaatccagcaygggttggagccatttctttgcact

SEQ ID NO: 55438 - DNA, 50 bp, homo sapien
acaccagacatccctgaggctaaatkacagatgtcctaccagttcagagt

SEQ ID NO: 55439 - DNA, 50 bp, homo sapien
tagcttttatgtggaagatatctcartacgaaagcatttgtatggaagga

SEQ ID NO: 55440 - DNA, 50 bp, homo sapien
ctgttctcattgaacttccgtagacrccagagatgagagaaattgcttaa

SEQ ID NO: 55441 - DNA, 50 bp, homo sapien
ataaaataataatgattataacagaygaaatgtagtgagcacatactatt

SEQ ID NO: 55442 - DNA, 50 bp, homo sapien
tattaccctgccataccgtcattcayaggaggctacctgggaagaaaatg

SEQ ID NO: 55443 - DNA, 50 bp, homo sapien
gtttttggcttctttattttaacatyatctttatctgtggaccaatattt

SEQ ID NO: 55444 - DNA, 50 bp, homo sapien
taaaacaacctgacataagagcgtayaggtccacctaaattattttgttt

SEQ ID NO: 55445 - DNA, 50 bp, homo sapien
tctaacaaatatttgggtcatgatgyaatcctttattctcagcttagagt

SEQ ID NO: 55446 - DNA, 50 bp, homo sapien
aaactatgtgcagatctgaaataacrcaggcagcaaaagtgtgtctcact

SEQ ID NO: 55447 - DNA, 50 bp, homo sapien
aggaaattgggaaacatctgtgtgaytaatgaataagggagtgaaggagg

SEQ ID NO: 55448 - DNA, 50 bp, homo sapien
ctaatcctgaaagcaatgagagtatraagacaaaaggcttggattcagta

SEQ ID NO: 55449 - DNA, 50 bp, homo sapien
aagaatttccattatgaatgttggaytcagtcatggacatttacatgaat

SEQ ID NO: 55450 - DNA, 50 bp, homo sapien
caaattatatctcctaaggtacaaarcataaagtccaacatacatttgat

SEQ ID NO: 55451 - DNA, 50 bp, homo sapien
atacaaaacaactttttgtctgaaasctctattgaagtcagtataagatt

SEQ ID NO: 55452 - DNA, 50 bp, homo sapien
agggaacaagccattcagtgatataragcaaaactatcacaggagaatcc

SEQ ID NO: 55453 - DNA, 50 bp, homo sapien
aatactttttggctagttcagcacasgcaccaaccagtcggagtggacac

SEQ ID NO: 55454 - DNA, 50 bp, homo sapien
tcatcggcttcccctatcctaagtcraaaacgagaatgtactcaaccaag

SEQ ID NO: 55455 - DNA, 50 bp, homo sapien
tggttagaagaatgtgcagatctaaytactcccattaagaccattgatta

SEQ ID NO: 55456 - DNA, 50 bp, homo sapien
ttttgtttcttattcacaggacttaygttctaccattggacagaattttc

SEQ ID NO: 55457 - DNA, 50 bp, homo sapien
ggtgcatatccagctgctgatacaaygaagtattaaaaatattgttggcc

SEQ ID NO: 55458 - DNA, 50 bp, homo sapien
taaggtaatggattttgtgtttgcawaaaaggaatagtttgagatgtcaa

SEQ ID NO: 55459 - DNA, 50 bp, homo sapien
tagcccaagtgatacagatgaaaacrcaaccaatacacagagtaccacat

SEQ ID NO: 55460 - DNA, 50 bp, homo sapien
ttttcagtgaaaaggcaaatgtataycttcactgggacaacagaatcacc

SEQ ID NO: 55461 - DNA, 50 bp, homo sapien
tactataagattaacaaatcaatacrgaagacaatgcccaatgaatccta

SEQ ID NO: 55462 - DNA, 50 bp, homo sapien
gcaagaaaatcaggtcaaaaattcarcgcaaatgtagggagaaagcctgt

SEQ ID NO: 55463 - DNA, 50 bp, homo sapien
tcatttaatttataatgtctttccaygttcaatatgttaaaaaatccttt

SEQ ID NO: 55464 - DNA, 50 bp, homo sapien
ggttgtgatgggattgggcgctctaygtggatttctattgaccttgtgca

SEQ ID NO: 55465 - DNA, 50 bp, homo sapien
gaagcttggatttccatgtcatttarctactctatcttaggctccttttg

SEQ ID NO: 55466 - DNA, 50 bp, homo sapien
aagataggattatattaaaggatcartagagtggaagtgaggaatctggg

SEQ ID NO: 55467 - DNA, 50 bp, homo sapien
actctaagtttagatctgaaacaacrcaagcagggatgaacatgtaattg

SEQ ID NO: 55468 - DNA, 50 bp, homo sapien
ttgtgttgtttcagatctaaacttasagttcaatgaatttgctgattaga

SEQ ID NO: 55469 - DNA, 50 bp, homo sapien
aattccaagcctccataaattaaaamtacaaatcgagataaaaatacaaa

SEQ ID NO: 55470 - DNA, 50 bp, homo sapien
tctgtactgtttacatccagagaaawgtttatactgactaaataatttcc

SEQ ID NO: 55471 - DNA, 50 bp, homo sapien
attacatattataaaatgttttcgaygtatatttacctgtgggctatagg

SEQ ID NO: 55472 - DNA, 50 bp, homo sapien
ggctccattcttgaagtcaacgagamcacaagaccacgaacccacccgca

SEQ ID NO: 55473 - DNA, 50 bp, homo sapien
ttaaggccacagctatatgggaaaaygattcagttaggggacccaaaaga

SEQ ID NO: 55474 - DNA, 50 bp, homo sapien
atactgagggacaaaggtatatagcrgacattgtactgagtgcttcacac

SEQ ID NO: 55475 - DNA, 50 bp, homo sapien
atctgtcccctgtctgataatctgcrccaaaatttaggaagtaacacgtc

SEQ ID NO: 55476 - DNA, 50 bp, homo sapien
caagattgtcagcaatgcctcctacrctaccaactgcttagcctccctgg

SEQ ID NO: 55477 - DNA, 50 bp, homo sapien
tccgtgttttgtcctttaaacaatcrcccctataattctctatcacccat

SEQ ID NO: 55478 - DNA, 50 bp, homo sapien
gtggccagcacataggtgactgaccrcaagagacactgtggacagagagc

SEQ ID NO: 55479 - DNA, 50 bp, homo sapien
ttcaaagagccttgaatgccaagcaraaagagatcattaatggtggcaga

SEQ ID NO: 55480 - DNA, 50 bp, homo sapien
aggctctttgaaataagactgtgacscactttgatagttttgtcctggat

SEQ ID NO: 55481 - DNA, 50 bp, homo sapien
taatcagtctggtgagaaaaccagckatagttccttcgagcatgtgtctt

SEQ ID NO: 55482 - DNA, 50 bp, homo sapien
aggaaaaagaaactgctttctgttaygaatatctttgaggaagcagcaaa

SEQ ID NO: 55483 - DNA, 50 bp, homo sapien
aaataaaatagccaaatagataatcrcctcgtgcagcactttttatacca

SEQ ID NO: 55484 - DNA, 50 bp, homo sapien
acggggtcagctgtttccacgtaggrccacagatctaggctgagcttaag

SEQ ID NO: 55485 - DNA, 50 bp, homo sapien
tgtcatcttctaaaacacataataascaatcatttaggaatccaaatgta

SEQ ID NO: 55486 - DNA, 50 bp, homo sapien
tttactgtcttttgcaatactgtaaytcaagttttacacttaccatatgg

SEQ ID NO: 55487 - DNA, 50 bp, homo sapien
ggtatggggtgaggccaaagaaccartatttctagcaagctcccagggaa

SEQ ID NO: 55488 - DNA, 50 bp, homo sapien
tcctcatctgggcgatgtgggctcckagaagagtaaggataacatcctgg

SEQ ID NO: 55489 - DNA, 50 bp, homo sapien
aaagcttcaattcaaactgtgctaartgttataaacagaggtatgtatgt

SEQ ID NO: 55490 - DNA, 50 bp, homo sapien
ggactctcacacatctgagatctacsgccttctggctcagctccggaatc

SEQ ID NO: 55491 - DNA, 50 bp, homo sapien
tctgcacgtggacgaccctttagcaygttcttctggaaggtttaatgttt

SEQ ID NO: 55492 - DNA, 50 bp, homo sapien
ctttgaagaaccatttctgatgatcsgagttggtgcagtctcgtaagagt

SEQ ID NO: 55493 - DNA, 50 bp, homo sapien
aaaagctgtgaaaatccaagacaatraacaagagccagctgctgtgagtg

SEQ ID NO: 55494 - DNA, 50 bp, homo sapien
gtgctggagtttttattgagaaaccyaatgccatttcttgttactggagc

SEQ ID NO: 55495 - DNA, 50 bp, homo sapien
tattttcatgattgcctaagtagtamcatggtcattacagaagattgtaa

SEQ ID NO: 55496 - DNA, 50 bp, homo sapien
aagttagcaaaggaacaagaagatamaatgggaatagaaaaaaagaaata

SEQ ID NO: 55497 - DNA, 50 bp, homo sapien
tcattgcatgtactatcatatttcamgttcaatcatgctttaacagctat

SEQ ID NO: 55498 - DNA, 50 bp, homo sapien
gatgaagaaaatacttggatacttaygcagatcactttaaattagttttt

SEQ ID NO: 55499 - DNA, 50 bp, homo sapien
tttctcgttatgctttggtggttgayctctcactgggctcacttcatgaa

SEQ ID NO: 55500 - DNA, 50 bp, homo sapien
tttcttcccatagtcaatgtatttamgagtgttgattttagaaagaaaca

SEQ ID NO: 55501 - DNA, 50 bp, homo sapien
acaatgtgcagtctctgaacataaayagttgatagccagcacttgtatga

SEQ ID NO: 55502 - DNA, 50 bp, homo sapien
caaagggttctcatatattccatagycagtttcccatattcttaacatct

SEQ ID NO: 55503 - DNA, 50 bp, homo sapien
attttgaggtcaatgaatttagggayagtctcaatcttgaattccagccc

SEQ ID NO: 55504 - DNA, 50 bp, homo sapien
aacagtctcctgagttcatgccttaycaacaaattagaagcctaggtttt

SEQ ID NO: 55505 - DNA, 50 bp, homo sapien
gaaaaaaaaaaactaaaggctaataygcctgataaacctaaatgcaaaag

SEQ ID NO: 55506 - DNA, 50 bp, homo sapien
taaagtaacaactcttacacaaagckaaaaacaaaacaggttttaatggt

SEQ ID NO: 55507 - DNA, 50 bp, homo sapien
ggatgtagcccacgatatgttctgamgtaaatggctttccagttttctcc

SEQ ID NO: 55508 - DNA, 50 bp, homo sapien
taagctatgccttatgatgctcttargtacctgttcctcaaatggtagtt

SEQ ID NO: 55509 - DNA, 50 bp, homo sapien
gattggtgtgatctatattgacaaartttctcctcatctgaacgcttatt

SEQ ID NO: 55510 - DNA, 50 bp, homo sapien
ccaactctgatttacgtaatctacaragacacttaaagatggcacaaagt

SEQ ID NO: 55511 - DNA, 50 bp, homo sapien
ttgtgtagaagcttgggtgccattaractgagagtcaattagactgaaga

SEQ ID NO: 55512 - DNA, 50 bp, homo sapien
caggaagcaatagaaaatagtcttgsagatgagagggtaaggacaagcaa

SEQ ID NO: 55513 - DNA, 50 bp, homo sapien
aaggaaaaagccagatctctctttaracaggaccaaattatttgctaagc

SEQ ID NO: 55514 - DNA, 50 bp, homo sapien
aaaaatgatgcaaaatagcctaatcraaatttaattaatatttttataca

SEQ ID NO: 55515 - DNA, 50 bp, homo sapien
gaaacaaagtgaaatctgaacatcayggcattgagtgcgtcaacacgaaa

SEQ ID NO: 55516 - DNA, 50 bp, homo sapien
aataagaatattctagaagacaaagkattgagaccctaaccaagcctgca

SEQ ID NO: 55517 - DNA, 50 bp, homo sapien
aaatattatacagaaatgatataaaygcttcacaatagtaacaaaaaaca

SEQ ID NO: 55518 - DNA, 50 bp, homo sapien
cagttttgccaacttttttatgccaygattggaatgagaaccatgtaaac

SEQ ID NO: 55519 - DNA, 50 bp, homo sapien
tagaaaacacattgaattgattggayaaccatcattttaaaatggacaac

SEQ ID NO: 55520 - DNA, 50 bp, homo sapien
ggtatattcaatttgctctaatttayccatttctaaagtggacatttggt

SEQ ID NO: 55521 - DNA, 50 bp, homo sapien
acattatagagatactcagtttacayagtcaatttatttttcttactaac

SEQ ID NO: 55522 - DNA, 50 bp, homo sapien
gataaatattttgcattacttttaaycctagacattatagagatactcag

SEQ ID NO: 55523 - DNA, 50 bp, homo sapien
aagcaatacaaaactggcttgctaamggttaaaaaatatttacagctatt

SEQ ID NO: 55524 - DNA, 50 bp, homo sapien
ctgaattaattaaatttgaaactctyactccaagattatagcctagatgt

SEQ ID NO: 55525 - DNA, 50 bp, homo sapien
actatgtgtccatttccaaggaagaygaattttgagtcaggttctctaca

SEQ ID NO: 55526 - DNA, 50 bp, homo sapien
gtttctgtacattttaaataaataamctaggcaataggtgatggattttt

SEQ ID NO: 55527 - DNA, 50 bp, homo sapien
ggacactattattaattacattgggwcaacacatatgaactggaattgtc

SEQ ID NO: 55528 - DNA, 50 bp, homo sapien
ttcacatagcactgacaacacttggrattatttttataatttgccttccc

SEQ ID NO: 55529 - DNA, 50 bp, homo sapien
ttagtgattgtggacattcattaaamagaggctgagccaatagcgaaaag

SEQ ID NO: 55530 - DNA, 50 bp, homo sapien
ggaacgatgtgctggtgcattcagaraagaaaatgagacccagaaaagca

SEQ ID NO: 55531 - DNA, 50 bp, homo sapien
ctgcctagtgcaagttacaatattayagcgtgttcggggagtgccctcct

SEQ ID NO: 55532 - DNA, 50 bp, homo sapien
acccatttacaagggcacatttgcawtcttttcgctattggctcagcctc

SEQ ID NO: 55533 - DNA, 50 bp, homo sapien
cagttacctatcacgacctttggcaycttgcaggtagtctatatctgttt

SEQ ID NO: 55534 - DNA, 50 bp, homo sapien
tttctccggtactttgtctctctacrcagacctggtattagtagcattgt

SEQ ID NO: 55535 - DNA, 50 bp, homo sapien
cagttttaattccaggttctttggcraaacccactttgagacaactatct

SEQ ID NO: 55536 - DNA, 50 bp, homo sapien
gtgaacataaggagaaaagactaaaycgtcaaggagaaaaaagagataag

SEQ ID NO: 55537 - DNA, 50 bp, homo sapien
gttcttataaaaagaggaacaaagaycagaacgtttgctctatctctctc

SEQ ID NO: 55538 - DNA, 50 bp, homo sapien
ctgcaactgcgtgctggttcttagaygtgcaaagagctcctcaggccaaa

SEQ ID NO: 55539 - DNA, 50 bp, homo sapien
ttccttattctgtgtttttgatttayacaactataacaagactctacaag

SEQ ID NO: 55540 - DNA, 50 bp, homo sapien
tttccttaaacttgggccacatcaarttctcaggcaggaagttttctccc

SEQ ID NO: 55541 - DNA, 50 bp, homo sapien
aagggtagttggcagtagtatgcaamatggaatgaaaaatattggagtca

SEQ ID NO: 55542 - DNA, 50 bp, homo sapien
aagaaaaaacaaaaacaagaaggtasgttgttcaagttgtgcccataagg

SEQ ID NO: 55543 - DNA, 50 bp, homo sapien
acacacatgtttggagtggaattcaraacttaagtgcttttaaagataaa

SEQ ID NO: 55544 - DNA, 50 bp, homo sapien
gtctgaagtcacatggattccatgayaggtgattaacacacaacaactta

SEQ ID NO: 55545 - DNA, 50 bp, homo sapien
aactaggataacatgcaggtaagccracacaatgggcactttctgctact

SEQ ID NO: 55546 - DNA, 50 bp, homo sapien
gggagcttctggagttgaggggacasaatcaaagagacactttattgagc

SEQ ID NO: 55547 - DNA, 50 bp, homo sapien
acctagagcaagttgatgatcctcaytgagattcagattatttataaaag

SEQ ID NO: 55548 - DNA, 50 bp, homo sapien
caataccacagtagctagatcattayagatttaaaataagttcctaatga

SEQ ID NO: 55549 - DNA, 50 bp, homo sapien
gaacatttttcaggatatatcatacrataagatacaaacaaatctcaaca

SEQ ID NO: 55550 - DNA, 50 bp, homo sapien
cactcaagagtgatacatacttcaartcagcatcatgtacaggatcatgt

SEQ ID NO: 55551 - DNA, 50 bp, homo sapien
atcgcacctggtcccattgttttaaygtgccaaaattgtgtactactcta

SEQ ID NO: 55552 - DNA, 50 bp, homo sapien
aaattttcatttttctgactctgaasgaaatcagaggatttgggcactca

SEQ ID NO: 55553 - DNA, 50 bp, homo sapien
aggagttcatctaactggagtcccamtagaagtgagaaacccctattgtt

SEQ ID NO: 55554 - DNA, 50 bp, homo sapien
actgaggtccctggttcctcgatgayggtattgttctgagccctggggtt

SEQ ID NO: 55555 - DNA, 50 bp, homo sapien
aaaggaatgccctagccgatgtgcaygttaaatcagctagtgctgacact

SEQ ID NO: 55556 - DNA, 50 bp, homo sapien
actaattcctaggctgctttagcackaatggtcataacaactgggatagc

SEQ ID NO: 55557 - DNA, 50 bp, homo sapien
tggctattattttaactaaagacacrgtaattaatggaagttcgtagtct

SEQ ID NO: 55558 - DNA, 50 bp, homo sapien
cacctttcaccctgtatggctatgayccctagaatggcaaagctttgtat

SEQ ID NO: 55559 - DNA, 50 bp, homo sapien
aacatatacacctagtcaaacaacayggagaaaaaccaatcatcccttcc

SEQ ID NO: 55560 - DNA, 50 bp, homo sapien
aaaaatattttcaaagacatctccayaaacttaccttctgaaaatttagt

SEQ ID NO: 55561 - DNA, 50 bp, homo sapien
cctggctccagtttcaatagaagtaraagctcttatttgatttaaaataa

SEQ ID NO: 55562 - DNA, 50 bp, homo sapien
tgactttttcttccaaataattttarcaatgctcacgctttctggtattg

SEQ ID NO: 55563 - DNA, 50 bp, homo sapien
cagcccatatagtggaatagttctamaggcttgaaacaattagagccata

SEQ ID NO: 55564 - DNA, 50 bp, homo sapien
aggaatttgcctagattcagctaacygtccctctacttccttcttcagaa

SEQ ID NO: 55565 - DNA, 50 bp, homo sapien
cagaaaagaaaccacaatcttgtaaygaggtggtgagactaaatcagcaa

SEQ ID NO: 55566 - DNA, 50 bp, homo sapien
ggccaccaaaggtaaacttcttcccraaagtagtgacaaaattccactgt

SEQ ID NO: 55567 - DNA, 50 bp, homo sapien
tggtactctgtctcatatcctgaaaygttttgaaaagaatattgaatttg

SEQ ID NO: 55568 - DNA, 50 bp, homo sapien
agaaaaggggtaaggcagattactcrgaagaactggggtagaagaatagg

SEQ ID NO: 55569 - DNA, 50 bp, homo sapien
ttttgatttcagctttgactgcatckcctacgttttgaaagttgtacaat

SEQ ID NO: 55570 - DNA, 50 bp, homo sapien
ctgttaaaccaaacgctaggtgctcrctagtccaattgtaccactgaact

SEQ ID NO: 55571 - DNA, 32 bp, homo sapien
tatttctctgtaaatgycaggccatattcagt

SEQ ID NO: 55572 - DNA, 50 bp, homo sapien
tatatatgtttatttttaaagtccaytgaaattctgaaagacagtgggag

SEQ ID NO: 55573 - DNA, 50 bp, homo sapien
tggtgttttctttgactcatttttasgctagactgcatgcttgttatatt

SEQ ID NO: 55574 - DNA, 50 bp, homo sapien
ttttaatggctatgcttatttagaarcagcaaaaatactattatgaccga

SEQ ID NO: 55575 - DNA, 50 bp, homo sapien
gagtataagtaagttacaaattagartagaatcttagagatgttacaaaa

SEQ ID NO: 55576 - DNA, 50 bp, homo sapien
ggatccagaaaataatagacccttamaatgaactaagtctctgttgttga

SEQ ID NO: 55577 - DNA, 50 bp, homo sapien
tctaggagcaatgtcagggcaattascacttggtcagtttctagtgtttc

SEQ ID NO: 55578 - DNA, 50 bp, homo sapien
taaagacaacattataaaagttctayagtagacatggttaggtatctttt

SEQ ID NO: 55579 - DNA, 50 bp, homo sapien
aaccctgtaacccattgacattcccragagaaaataagagagagtaagca

SEQ ID NO: 55580 - DNA, 50 bp, homo sapien
ttgaattatttatctttagtaaatcraaatgtgttttaagtgtgctcacc

SEQ ID NO: 55581 - DNA, 50 bp, homo sapien
ataaataattcaagccttcaataaamaggactgtgagttttttgaaagca

SEQ ID NO: 55582 - DNA, 50 bp, homo sapien
attatgtcaaagaaaagagacttgtyaagaggtaagagccttggctacaa

SEQ ID NO: 55583 - DNA, 50 bp, homo sapien
cagagcagctgtgttgatcacctagraagtacaaactaaatgtggatcat

SEQ ID NO: 55584 - DNA, 50 bp, homo sapien
taatggctataaaacttatcagaacrctcatagtttcccacagaaatctc

SEQ ID NO: 55585 - DNA, 50 bp, homo sapien
taaagtaaagccttcaattagtgtaygcaaaagtcatcaaggggattcag

SEQ ID NO: 55586 - DNA, 50 bp, homo sapien
tatgaagtcccagatgtgtgtccaartgtttggaagttagttttagcctt

SEQ ID NO: 55587 - DNA, 50 bp, homo sapien
gggattcagaaggctcagtgtgaaaygttaacgagagaagctgaccagtc

SEQ ID NO: 55588 - DNA, 50 bp, homo sapien
ttcagtttcacaaatgggtgtcaaamgcatgccaaaataatataatcgtt

SEQ ID NO: 55589 - DNA, 50 bp, homo sapien
ggatttctgcctttgctacttgccaygtttgtgaagtctcctaccctttg

SEQ ID NO: 55590 - DNA, 50 bp, homo sapien
caaagtctggacaagaaaccaacacsgtatttacatgatcctcaatttct

SEQ ID NO: 55591 - DNA, 50 bp, homo sapien
atcttctttatgtatgcgaaaccgamgtctcaagacctgattggggaaga

SEQ ID NO: 55592 - DNA, 50 bp, homo sapien
agaaataatcacagatcacatcggaygttggaaaaatctcctattttaga

SEQ ID NO: 55593 - DNA, 50 bp, homo sapien
gagtaataaatcactgactctctacmaaagtatctgcaggattctgtccc

SEQ ID NO: 55594 - DNA, 50 bp, homo sapien
gattagaaacaaagactgccaactaytaatgttccattttcaagacagaa

SEQ ID NO: 55595 - DNA, 50 bp, homo sapien
gctaagatgtagttgtagcatattaygatgggaaataattcaatgacata

SEQ ID NO: 55596 - DNA, 50 bp, homo sapien
gtgtttcccaggctgagtattcgtcrccaaagaagactttgttttctggg

SEQ ID NO: 55597 - DNA, 50 bp, homo sapien
caaatggaactaaatttgaattctascttcaccatctgaaaccttttgtc

SEQ ID NO: 55598 - DNA, 50 bp, homo sapien
ggcttaaaatactattctgatgttaratatagtgtcaatttaatagaaac

SEQ ID NO: 55599 - DNA, 50 bp, homo sapien
tgggttagatgatactaggtcacccrccaacctcaagaaaatgtctgtgc

SEQ ID NO: 55600 - DNA, 50 bp, homo sapien
agttacctttaaaactaaagcccackgatcactgttaacacccaaaatca

SEQ ID NO: 55601 - DNA, 50 bp, homo sapien
taaaagagctagaagaagcaaagaayacggagcaatgttgagacgcctgt

SEQ ID NO: 55602 - DNA, 50 bp, homo sapien
caggatcttcaagggtgaataggaastctacaggcaaatatggagggaaa

SEQ ID NO: 55603 - DNA, 50 bp, homo sapien
ctgccttaggacccaggatatgctgwaggctacaaaatcaacagaaagaa

SEQ ID NO: 55604 - DNA, 50 bp, homo sapien
ttattgagtgccacaaaactagtacygtacagggagaacctgttctgtac

SEQ ID NO: 55605 - DNA, 50 bp, homo sapien
ttgacaccaagtggatctttacttgsaaatactacacaaatagaaatggg

SEQ ID NO: 55606 - DNA, 50 bp, homo sapien
tggtctgcatagagtatctgtaacarcctgctgacattgcccatttagca

SEQ ID NO: 55607 - DNA, 50 bp, homo sapien
tacggagcaaaaccatggctcatgcmaacaatatcccatctacacgcata

SEQ ID NO: 55608 - DNA, 50 bp, homo sapien
gtctatacggtgcccagtagaatacrgaaggcgctcaatacagagttagc

SEQ ID NO: 55609 - DNA, 50 bp, homo sapien
cagaccagaatgttctgtctgaagtmaaagttaactgtcttttggtggta

SEQ ID NO: 55610 - DNA, 50 bp, homo sapien
gcaagatttttaaacagggaagtgaycttacttataggaaatgagtcagc

SEQ ID NO: 55611 - DNA, 50 bp, homo sapien
cgttgctctggcactgtattgtagcraaagttggtattagactttcctcc

SEQ ID NO: 55612 - DNA, 50 bp, homo sapien
gtaaatggtactgtttatgaatcaaytggcattcttacgcactaaatctc

SEQ ID NO: 55613 - DNA, 50 bp, homo sapien
aagtgctgccatactcttttcaacaycctgatcctatatccttaaagcca

SEQ ID NO: 55614 - DNA, 50 bp, homo sapien
tgaagctgtggaagattagaggaaaratcaactaactcaccctgtagaag

SEQ ID NO: 55615 - DNA, 50 bp, homo sapien
tgaaactcttacaatctcattctccygaaatagaaaggtcattatgtcat

SEQ ID NO: 55616 - DNA, 50 bp, homo sapien
taaggctgacgctcactcactccacrctctcagaagggtaacatctctgc

SEQ ID NO: 55617 - DNA, 50 bp, homo sapien
gatacttggagtcaaagataaatccyatagttgaacctggaatacaaata

SEQ ID NO: 55618 - DNA, 50 bp, homo sapien
gtgaaatagcacggatctggcagaakccatcaccatatgccaccctgatg

SEQ ID NO: 55619 - DNA, 50 bp, homo sapien
agaggtgggaagaaagcaggtacaaytccaaatttttcatttgagtaact

SEQ ID NO: 55620 - DNA, 50 bp, homo sapien
cctctacttggcaaaagaggaaatgkaaatgagtcactccggaagtaaga

SEQ ID NO: 55621 - DNA, 50 bp, homo sapien
agaccttgactgtactaaggaagcamaattattggcaattctgctaagat

SEQ ID NO: 55622 - DNA, 50 bp, homo sapien
tgctacttaacttttgataagaggartatttgctttcacttgggctgtga

SEQ ID NO: 55623 - DNA, 50 bp, homo sapien
ttattttggcttgttgatagaactgrcaggttaagaaatgactgtggcca

SEQ ID NO: 55624 - DNA, 50 bp, homo sapien
ttttttcataagccactggagagaasgaacagagttaatttgatttttgg

SEQ ID NO: 55625 - DNA, 50 bp, homo sapien
aggggttgacttgtcaggtcaaggamgatacaggatcctatgggaactct

SEQ ID NO: 55626 - DNA, 50 bp, homo sapien
atcagtaatacggacaggcttccacratcaaatcctttataggcaggtca

SEQ ID NO: 55627 - DNA, 50 bp, homo sapien
atcttaccgcgttcacatattttaaytgggcaggaagactcatattaaat

SEQ ID NO: 55628 - DNA, 50 bp, homo sapien
gagttctctaattcctgatactgaayccttttcttgtagtcttaaaaaaa

SEQ ID NO: 55629 - DNA, 50 bp, homo sapien
atactcattccgtctttagttctcartctttcacttctttataggaagcc

SEQ ID NO: 55630 - DNA, 50 bp, homo sapien
ccttttgactcttcagccaaatggayagaagtcaaagccagagatgctgc

SEQ ID NO: 55631 - DNA, 50 bp, homo sapien
tagcaagctgggtagtggcttaacaycaaagtcaaactattctgataagg

SEQ ID NO: 55632 - DNA, 50 bp, homo sapien
tggttgggatctaaactgaatagaaygaagacgaaagcacagctagaaaa

SEQ ID NO: 55633 - DNA, 50 bp, homo sapien
ttatcctgtaggtttggggtgccaaygaaagcagcagtgggtggcataga

SEQ ID NO: 55634 - DNA, 50 bp, homo sapien
ggggtggcaccagggtaaagacacawtactgagctctaaggagcactggc

SEQ ID NO: 55635 - DNA, 50 bp, homo sapien
gagaccactatatgacatccacagamtagatgctggtggtaaaaaggtga

SEQ ID NO: 55636 - DNA, 50 bp, homo sapien
gctacaagaaggatatatgttcttcycactaatttgatgttggcctcact

SEQ ID NO: 55637 - DNA, 50 bp, homo sapien
tctcttaatagtaggtcagagaaaarggtttgtattaatgccaagacatg

SEQ ID NO: 55638 - DNA, 50 bp, homo sapien
aaccttgatgaaaaactgtgacgtcmaactgagtaaaatttcactaacta

SEQ ID NO: 55639 - DNA, 50 bp, homo sapien
gagagatgagaacttctggataataragcaaatcttctaagtaatccaga

SEQ ID NO: 55640 - DNA, 50 bp, homo sapien
tttggcatgttatccatcgttagaawcctgttcttctgaaatccagggtg

SEQ ID NO: 55641 - DNA, 50 bp, homo sapien
caacttaatattttggttaattatgraaggtaaaattctaaatgattttc

SEQ ID NO: 55642 - DNA, 50 bp, homo sapien
aattatgtagctgagtaaatatgaarcatttataatgatacttctatgta

SEQ ID NO: 55643 - DNA, 50 bp, homo sapien
tatgtcccatttgtgttcacccataycatgcatttagtagagcaggactc

SEQ ID NO: 55644 - DNA, 50 bp, homo sapien
tatatatttcatcatatgaatgtacygaactttgggtagaaaaatcacac

SEQ ID NO: 55645 - DNA, 50 bp, homo sapien
aggaaaaaagaacagatcctactcawataatggtcttatgatgtcaactc

SEQ ID NO: 55646 - DNA, 50 bp, homo sapien
taaagacggaatgagtatcatgagayggaggaagaaaatatgcctgccta

SEQ ID NO: 55647 - DNA, 50 bp, homo sapien
tcagtctaatactaaagcatctatarcatcagtcacagaaagcttcttta

SEQ ID NO: 55648 - DNA, 50 bp, homo sapien
atagcaatgcaaatggactaacacaytaaaattagcattagaattagaat

SEQ ID NO: 55649 - DNA, 50 bp, homo sapien
acaatacaaatatacaacagttagtraccttatatacaattaacagttag

SEQ ID NO: 55650 - DNA, 50 bp, homo sapien
tttagaaaacagaaatagaacacaamatttaccagtacttattaaaccaa

SEQ ID NO: 55651 - DNA, 50 bp, homo sapien
ttctgtgtcaatgaatacacttatasagcattatttttaacatcttcatt

SEQ ID NO: 55652 - DNA, 50 bp, homo sapien
gctagaaaaaagaatatatccctcartcgaaactaacagcacccttagct

SEQ ID NO: 55653 - DNA, 50 bp, homo sapien
ctcaaagactccttgggtttcttctracgtggtctgtgttctgatattaa

SEQ ID NO: 55654 - DNA, 50 bp, homo sapien
tacccatgggacagatggcatttaawctaggccttgaagcaagggtggct

SEQ ID NO: 55655 - DNA, 50 bp, homo sapien
gtaggtatttgtgtgtctaaacataraaggatacagtaaaaatacagtat

SEQ ID NO: 55656 - DNA, 50 bp, homo sapien
attttggatccatgatctatattaartggcaaaaaaggagaaagtgtatt

SEQ ID NO: 55657 - DNA, 50 bp, homo sapien
ttggatacaagatatgtgttataaakcatgagactatttacatagcatat

SEQ ID NO: 55658 - DNA, 50 bp, homo sapien
ttgggagcaatattttgtgtaaggaratcaagctgtgtgagaaaagaagg

SEQ ID NO: 55659 - DNA, 50 bp, homo sapien
gcaggtagggaagagcactcggtacracaggattctgttctaaggtagta

SEQ ID NO: 55660 - DNA, 50 bp, homo sapien
gatctgaccctagctagagctccaastgatgatatagttcatagttagac

SEQ ID NO: 55661 - DNA, 50 bp, homo sapien
caaacagcatgagaaggaagaactgwcaaccaattttgattctgagacac

SEQ ID NO: 55662 - DNA, 50 bp, homo sapien
tcagtttctccccagagagaggaacraccaacttgtcaacaagtggaaat

SEQ ID NO: 55663 - DNA, 50 bp, homo sapien
tgtattttccttaccaaatcttaacycattgcagaccagtggaacatggc

SEQ ID NO: 55664 - DNA, 50 bp, homo sapien
cttaagagtttgagatttagaacccrgctccttccaggctctttctgcag

SEQ ID NO: 55665 - DNA, 50 bp, homo sapien
aaaaggataataattcctacatcaakaaatcaggcatgtgaagctcttgt

SEQ ID NO: 55666 - DNA, 50 bp, homo sapien
cttaaatagttttgtggttaataaakaaattggctggcatggtggttcat

SEQ ID NO: 55667 - DNA, 50 bp, homo sapien
gggacctagttcagtctactagttgragttcttgccttttctgaagttta

SEQ ID NO: 55668 - DNA, 50 bp, homo sapien
gaattcctcttcaaagattatatgaygcaaaatagttagatgataccaca

SEQ ID NO: 55669 - DNA, 50 bp, homo sapien
ggcctgggtgcttctaaaagcctacrctcacttccacaagtaaagagatc

SEQ ID NO: 55670 - DNA, 50 bp, homo sapien
ctccaactttattgttgttctttggrattgtattggctattctgggtctt

SEQ ID NO: 55671 - DNA, 50 bp, homo sapien
gaatctttctaccttttccttagagyctcggatggctttatctttcccct

SEQ ID NO: 55672 - DNA, 50 bp, homo sapien
actaggtcaagcgtcgaaagtttaayggtctcagataatgtattgggtta

SEQ ID NO: 55673 - DNA, 50 bp, homo sapien
tttttaaatgccagtatactatggarccaagacataagctactgttataa

SEQ ID NO: 55674 - DNA, 50 bp, homo sapien
tgatctgtttcacagaaactcagacyggggattctagataagaaactctt

SEQ ID NO: 55675 - DNA, 50 bp, homo sapien
ctgtctgcttaaaatagttaaagcarctggtctgtaggaaaatgagcaca

SEQ ID NO: 55676 - DNA, 50 bp, homo sapien
ttcttaagttcaagattgccaatcasgtcctaaaacttgtatttattcat

SEQ ID NO: 55677 - DNA, 50 bp, homo sapien
agccgatgttactcaaagactaccamaatgagtgatcttaggaacctaac

SEQ ID NO: 55678 - DNA, 50 bp, homo sapien
caatgcagattagtcatatcatatcyctatcctcaggatgaagtccaaat

SEQ ID NO: 55679 - DNA, 50 bp, homo sapien
tgcaagtttagccagttaccttagaygacgtactgcacgttttagagcct

SEQ ID NO: 55680 - DNA, 50 bp, homo sapien
caatgccttctctgagtcacacaaayattaaagactgttgtttgaaagga

SEQ ID NO: 55681 - DNA, 50 bp, homo sapien
agcaatttccatggataggcgggaawcatgtctacacctctgaggggtgg

SEQ ID NO: 55682 - DNA, 50 bp, homo sapien
cataactaccaagacacaaatacaarcattagcctaggcatacatgttaa

SEQ ID NO: 55683 - DNA, 50 bp, homo sapien
cttctgtcaagtgaagagagagaacrgattttgttattctcccacagcat

SEQ ID NO: 55684 - DNA, 50 bp, homo sapien
gatttgttgccaagttggatggaacygtgagtaacctggagatccactct

SEQ ID NO: 55685 - DNA, 50 bp, homo sapien
aaaaaaatgaagacataagaaaaaartttctgagtacctgaagctttgtc

SEQ ID NO: 55686 - DNA, 50 bp, homo sapien
aaacacttcttgtgttccagctacaragttaaaaggtacagtcataatct

SEQ ID NO: 55687 - DNA, 50 bp, homo sapien
ggacttcggtcgtgccacctttccarcacatgacacgttcactgacccag

SEQ ID NO: 55688 - DNA, 50 bp, homo sapien
catgcaaacaggcccttagaccaacyatatgatctattctgcagctctct

SEQ ID NO: 55689 - DNA, 50 bp, homo sapien
aacccttgtgcattatccagcaccasatttcattgagtattttgttctct

SEQ ID NO: 55690 - DNA, 50 bp, homo sapien
ccaaaactatgtgtctatagatttaygattcaaaatctccttccacaaga

SEQ ID NO: 55691 - DNA, 50 bp, homo sapien
tctgaaattccttgcttctttgacaytctctccttggtgttctggtttct

SEQ ID NO: 55692 - DNA, 50 bp, homo sapien
gaatacaaggttagctcgcttgcctyagatagggtagactgtaatctgta

SEQ ID NO: 55693 - DNA, 50 bp, homo sapien
cccaacacacacacgatgggaaggcrcacgagaagcggaaatgaatacta

SEQ ID NO: 55694 - DNA, 50 bp, homo sapien
actctgtttaggagaaagatgttaaygatattggactctctgaggctgcc

SEQ ID NO: 55695 - DNA, 50 bp, homo sapien
aacatgctccaacttacacaattgawcagcttattttctttgggaagaaa

SEQ ID NO: 55696 - DNA, 50 bp, homo sapien
cctgtgacgtttattggcaagacaaygtttgatacaattaacagttttaa

SEQ ID NO: 55697 - DNA, 50 bp, homo sapien
attagtaggttaacaacaaaaataaygagatagataagtagataaaaaag

SEQ ID NO: 55698 - DNA, 50 bp, homo sapien
gctgtcagggtgtgtctagaaataaktgtcttaattttacttttgcctga

SEQ ID NO: 55699 - DNA, 50 bp, homo sapien
atgcctcttagctttctagccataaytctttttctttagtggtttctcta

SEQ ID NO: 55700 - DNA, 50 bp, homo sapien
catagcatataccctctatctacatyatctttctcacacatccccatagg

SEQ ID NO: 55701 - DNA, 50 bp, homo sapien
aaatggcgattgtgttgatgtcttaraattttggctaaagctcaaagctg

SEQ ID NO: 55702 - DNA, 50 bp, homo sapien
taatacatgctccttataaaaaacargcatacctaatcccagcactttgg

SEQ ID NO: 55703 - DNA, 50 bp, homo sapien
ttactgtccattatgcaaggccacaygggttgcagtttgagaggaaatac

SEQ ID NO: 55704 - DNA, 50 bp, homo sapien
gccttccaagttacgtcttaaaccarcttgtcagcattttgtacctgttg

SEQ ID NO: 55705 - DNA, 50 bp, homo sapien
attgtttaccatgctttatattcaargtgagcgaagcaaagcacttgtta

SEQ ID NO: 55706 - DNA, 50 bp, homo sapien
agaattctgcactaggattgtctcayaagagcttgaaatttctttctctg

SEQ ID NO: 55707 - DNA, 50 bp, homo sapien
ttcggccatcttggaaagccctcacraagtatctttttaaatgcagttgg

SEQ ID NO: 55708 - DNA, 50 bp, homo sapien
agactctttcataacaaaggaaatcyaataggctaaacatattaagaatt

SEQ ID NO: 55709 - DNA, 50 bp, homo sapien
ttggagctccttaaatataatgataygagaccaagtgcttctcttcctgg

SEQ ID NO: 55710 - DNA, 50 bp, homo sapien
gaaaagccttctggatccattgttayatatgcatgcattttcctttttat

SEQ ID NO: 55711 - DNA, 50 bp, homo sapien
gcttacgtttacaaagttggtatgaraattaataggcatctacattccta

SEQ ID NO: 55712 - DNA, 50 bp, homo sapien
ctagccacatttattccagggagaawgccctgacttgaatttctgtggat

SEQ ID NO: 55713 - DNA, 50 bp, homo sapien
caaaggcatctcatatacagggttcsaagttggtgctcacagaatcctta

SEQ ID NO: 55714 - DNA, 50 bp, homo sapien
gtgaggattgtctgagccaatgtaartaaagttcctggcacacaactggt

SEQ ID NO: 55715 - DNA, 50 bp, homo sapien
ctccttcatttatttgctttctccarcatgggactgaccagttacttctc

SEQ ID NO: 55716 - DNA, 50 bp, homo sapien
atttggaaacagaggccctggtgaaygaagagagttgcccaagttcatgt

SEQ ID NO: 55717 - DNA, 50 bp, homo sapien
acgttaaataagttggtccagaaacmcttttgaagtcctccatcctttca

SEQ ID NO: 55718 - DNA, 50 bp, homo sapien
gggtaattaataaggaagataatacragatgaggaagaagatgtcagaat

SEQ ID NO: 55719 - DNA, 50 bp, homo sapien
gctatgataatgttatttagaaaaamacgagatgtgaaggaggaaaggcc

SEQ ID NO: 55720 - DNA, 50 bp, homo sapien
tttcccaggaagaaaacttccattcmatataataaacattggtgctattg

SEQ ID NO: 55721 - DNA, 50 bp, homo sapien
catctgcttatgcaggtacataaacygttgctgaggaatattggagatgt

SEQ ID NO: 55722 - DNA, 50 bp, homo sapien
tgcctcacacaaagtaggcatcccaygaattaagaatcttattgtattgt

SEQ ID NO: 55723 - DNA, 50 bp, homo sapien
ttaagtacattttttcaggtccccaratatgagaccaagagggcctacct

SEQ ID NO: 55724 - DNA, 50 bp, homo sapien
caaaaaacaacaataaaatagccctmagaaagctaagagtcacaatagca

SEQ ID NO: 55725 - DNA, 50 bp, homo sapien
ccagtttgagaaacaccagtatatcmagattacaagaaaaagcgagtcaa

SEQ ID NO: 55726 - DNA, 50 bp, homo sapien
tgctctgtgtttacatcttgagttcragcctaaagtgttgatgtttgcat

SEQ ID NO: 55727 - DNA, 50 bp, homo sapien
actttacttattctggaaataaatgwaaagccaacacctattacataccg

SEQ ID NO: 55728 - DNA, 50 bp, homo sapien
ttatcagtagtcacatgcttcaaggmaggccaggctcatgccccaggggg

SEQ ID NO: 55729 - DNA, 50 bp, homo sapien
caaagacctaatttgagatcctagtracgctacctgaacaaggacaagct

SEQ ID NO: 55730 - DNA, 50 bp, homo sapien
agacttgattctggttttggtctacyagtttcaaccccagcacagcttcc

SEQ ID NO: 55731 - DNA, 50 bp, homo sapien
acattagtatctttcaaaagctaccracaaacaaattttccttggcttct

SEQ ID NO: 55732 - DNA, 50 bp, homo sapien
agatcagcaggtgtacaaaactcacrcagtctaacatcggactctcacat

SEQ ID NO: 55733 - DNA, 50 bp, homo sapien
attaaacaatgtctgctttgtaagasatttgtgttttttgagttggtggt

SEQ ID NO: 55734 - DNA, 50 bp, homo sapien
tttctttcctaccactgtgaccaccractcaaaaaacacaaatctcttac

SEQ ID NO: 55735 - DNA, 50 bp, homo sapien
ccagcctcagaatttgatatgccaarctgttttatactaagaaaaatttg

SEQ ID NO: 55736 - DNA, 50 bp, homo sapien
aagcccaaaaaaatgttttatggaakgtgtttcaaggcatatactcaaaa

SEQ ID NO: 55737 - DNA, 50 bp, homo sapien
gagatggtcctggtttatggaaaagrcatgagcacagtccaggaatggat

SEQ ID NO: 55738 - DNA, 50 bp, homo sapien
aagaatgtggattgtttctcctagarataaaaagatgctctcagagacag

SEQ ID NO: 55739 - DNA, 50 bp, homo sapien
ataacgaaagaataaacgtctcaaaygggatacaaacaagaccctaggcc

SEQ ID NO: 55740 - DNA, 50 bp, homo sapien
ggtgggagggacacgattctacctaygcagaaatacaggttacaaaaatt

SEQ ID NO: 55741 - DNA, 50 bp, homo sapien
ctccagaatatatgagaaatcatcaraagacattgaaaacaagaatgcca

SEQ ID NO: 55742 - DNA, 50 bp, homo sapien
ggcctaagctatgctatctctccatraacggacaaggaagcattgttatt

SEQ ID NO: 55743 - DNA, 50 bp, homo sapien
tctgaattgtctcctgaacggtcccrgctcacatccagaactcacatggg

SEQ ID NO: 55744 - DNA, 50 bp, homo sapien
attagaaatattaactaacagacaargcgtggtgaaattttagaatttga

SEQ ID NO: 55745 - DNA, 50 bp, homo sapien
atggcaagttataatacgactaacartaggttacgatccattaatgagtc

SEQ ID NO: 55746 - DNA, 50 bp, homo sapien
ctgaaaagctagtttctatgaaccaytataatctgtagtgtcatcctgaa

SEQ ID NO: 55747 - DNA, 50 bp, homo sapien
taaagtagcttacagactaaaggaamactattatagatacatcatcataa

SEQ ID NO: 55748 - DNA, 50 bp, homo sapien
taacattaaagttaggggaattctcyacataatgaatggtgactcacaga

SEQ ID NO: 55749 - DNA, 50 bp, homo sapien
accgtgagaggtttaaaaccttgtayctagaggagaaagcaaagcttgaa

SEQ ID NO: 55750 - DNA, 50 bp, homo sapien
aatagactcattaatgctttgctctraccaactgggcaaatccgcatgct

SEQ ID NO: 55751 - DNA, 50 bp, homo sapien
tgttgcagttggtatgatatcggcaygtagtttaattaatgcagcccaag

SEQ ID NO: 55752 - DNA, 32 bp, homo sapien
gtggcttgagaatgaakgtgacaagtaagaaa

SEQ ID NO: 55753 - DNA, 50 bp, homo sapien
gaatggattcagctgtgctatcaatratgaaaaagaattgtagggagaag

SEQ ID NO: 55754 - DNA, 50 bp, homo sapien
cacaagagtgttttaaaggtcagagyatggcgtccattcacaaagttttc

SEQ ID NO: 55755 - DNA, 50 bp, homo sapien
agaagcacagtccaaagagcccagaktaataaaaagtttcaatctggaac

SEQ ID NO: 55756 - DNA, 50 bp, homo sapien
attcctcattttcctctatggctacyagtcaatttctgaggtttgactga

SEQ ID NO: 55757 - DNA, 50 bp, homo sapien
cttgaagttatcttagacaataggakacttttttacatacaatcataaaa

SEQ ID NO: 55758 - DNA, 50 bp, homo sapien
gactttaaaaaatgatcttgaacacyataagttggttaaaggtttattat

SEQ ID NO: 55759 - DNA, 50 bp, homo sapien
actagcgttttgggtaaattacacaytggttgtagcacagccacgtgcag

SEQ ID NO: 55760 - DNA, 50 bp, homo sapien
tcagtggaaatgataattatccacarctacaaaatttctgtactcagagt

SEQ ID NO: 55761 - DNA, 50 bp, homo sapien
tttagtcactggctctaccagattcrcacactctttattcacccctgatg

SEQ ID NO: 55762 - DNA, 50 bp, homo sapien
cagataataattcattatttggtgakagctactcaagagactgagattgt

SEQ ID NO: 55763 - DNA, 50 bp, homo sapien
gtcagagcagagctgactttcctgcragaaacagtagctatgccctcagc

SEQ ID NO: 55764 - DNA, 50 bp, homo sapien
actattaccattaccaacgagccaawattaggcaaagcaaaaagtacata

SEQ ID NO: 55765 - DNA, 50 bp, homo sapien
acttggtcccactcccagcattgagmaaggcagagttaaaccatcagaaa

SEQ ID NO: 55766 - DNA, 50 bp, homo sapien
agggtttcagtgcatacgttagaacmaaactccctaaaagtcctctgtaa

SEQ ID NO: 55767 - DNA, 50 bp, homo sapien
agtgataattgacataaccttcaggracctcagaaaccttaggcatctgc

SEQ ID NO: 55768 - DNA, 50 bp, homo sapien
gacaaatcacgacaccagtgagaggratcaaatgagcacattacaaaaat

SEQ ID NO: 55769 - DNA, 50 bp, homo sapien
aggcctattgaaggaaaaatctataraaaaagctcacagctgtgcctgag

SEQ ID NO: 55770 - DNA, 50 bp, homo sapien
tgctcaatacgtgttcatttgataaytgaataagctcctgcttaaggtaa

SEQ ID NO: 55771 - DNA, 50 bp, homo sapien
aatctgtgaggtatttagtatacagmagtgattttctctctttccttttt

SEQ ID NO: 55772 - DNA, 50 bp, homo sapien
tttgagaaacacaacatcgaacattyaagataactaatacaatttcattt

SEQ ID NO: 55773 - DNA, 50 bp, homo sapien
ttaaaatactgattaagccatggcakgtactgactgaagatgcaatccaa

SEQ ID NO: 55774 - DNA, 50 bp, homo sapien
tataatgatgcaaaatgtataacaawtcaaatatcctatataatcattcg

SEQ ID NO: 55775 - DNA, 50 bp, homo sapien
ggagtagaaagctgttgagttacgtsacccgattgatttataacttgtat

SEQ ID NO: 55776 - DNA, 50 bp, homo sapien
aagaatgagtaagagttttctaggtmaataggatgtgatgagtgaaccaa

SEQ ID NO: 55777 - DNA, 50 bp, homo sapien
atgttgcactcctatgagttaatcargaccattacagatctatcagctgg

SEQ ID NO: 55778 - DNA, 50 bp, homo sapien
tgcacaccactaaatccacagtaccyggcatagcaaatggtaggtcgtag

SEQ ID NO: 55779 - DNA, 50 bp, homo sapien
gattcatcatcattttagacaaataygtaatgaaacaggaagtaactttg

SEQ ID NO: 55780 - DNA, 50 bp, homo sapien
gcctcctggatctgcaaacctcataygattctaggcctctgagcctctgg

SEQ ID NO: 55781 - DNA, 50 bp, homo sapien
acatgttgagtgactaaggttcaatracattcataacagacccacccact

SEQ ID NO: 55782 - DNA, 50 bp, homo sapien
atggaggactcagaagacctgctacygagaagaggtgtggtacagtaagc

SEQ ID NO: 55783 - DNA, 50 bp, homo sapien
aattcaccagtatgctgaagctggcrcaggtagtaaaagaactgctgact

SEQ ID NO: 55784 - DNA, 50 bp, homo sapien
aggtggtggttctctctggacatgargttccataatcttagaaactgttg

SEQ ID NO: 55785 - DNA, 50 bp, homo sapien
aacctccatgacttcaggtttcaaaytgactcattttttattccccagtc

SEQ ID NO: 55786 - DNA, 50 bp, homo sapien
cttcaatttgaggttaaatacagagwacgctttccatagtcaaacagaaa

SEQ ID NO: 55787 - DNA, 50 bp, homo sapien
ttcttcaagtattgaggaaagaaaartgactttgggccaggcatggtggc

SEQ ID NO: 55788 - DNA, 50 bp, homo sapien
attacgtgttacttggtttgcaaatraaatgtccatgccttgttcattta

SEQ ID NO: 55789 - DNA, 50 bp, homo sapien
gggcctctgaattccttttctagaayttatggaaaatagaaaaaatcgtt

SEQ ID NO: 55790 - DNA, 50 bp, homo sapien
attcttcccagaaatagtaagcaacsaaaggaacagcaggagcaatgact

SEQ ID NO: 55791 - DNA, 50 bp, homo sapien
agactgagactttatagatcataacwactataacaacaaagaactactag

SEQ ID NO: 55792 - DNA, 50 bp, homo sapien
acgtaccaccacatgggctaaataartgtgttgaataaataaataaattg

SEQ ID NO: 55793 - DNA, 50 bp, homo sapien
gacagtttctcacctcgtcttccttsaaacacgtcattgatttctctcag

SEQ ID NO: 55794 - DNA, 50 bp, homo sapien
ccatgcaattgccagccttggtttayagtaattgtaataaaagaccttgt

SEQ ID NO: 55795 - DNA, 50 bp, homo sapien
tattgttgacatgaagaaactcagakaagatttagccaaggtgtactcag

SEQ ID NO: 55796 - DNA, 50 bp, homo sapien
tcctataaaacaggaatctgaaatgyaaaaccgaaataaaaccagcaggc

SEQ ID NO: 55797 - DNA, 50 bp, homo sapien
ggaaatggtcaaaaatgggaagaaaygtaggtcacaaaatattgcacaaa

SEQ ID NO: 55798 - DNA, 50 bp, homo sapien
caaatgtatctgttgtttcaaaagamgcatgttagttgaattatctgaat

SEQ ID NO: 55799 - DNA, 50 bp, homo sapien
agcaactagttgggtaatttaatcartatggaatgaagggattgtaggag

SEQ ID NO: 55800 - DNA, 50 bp, homo sapien
agtctttgaagagggccagtgttaaygaagagaggctgagaaggaagtga

SEQ ID NO: 55801 - DNA, 50 bp, homo sapien
cccaagaaaacaatttatctcttgawgtctctttcgtctccaggatctat

SEQ ID NO: 55802 - DNA, 50 bp, homo sapien
acagtagtcggtgagaatgccatggwcacatttttcttttctatgttatg

SEQ ID NO: 55803 - DNA, 50 bp, homo sapien
cttgctaataatatgtacgccctaayagagtccatgcatctcttaaccaa

SEQ ID NO: 55804 - DNA, 50 bp, homo sapien
gtctgaaaattaccagtggagaatcraagcgttttaagaaaaaaaatgat

SEQ ID NO: 55805 - DNA, 50 bp, homo sapien
aaaattgattctttgaatgatgactyaaagtgcgattctgataaaatttt

SEQ ID NO: 55806 - DNA, 50 bp, homo sapien
tgtgttaataatggtcgttaagagaktcccttttctgtaatctgaatcct

SEQ ID NO: 55807 - DNA, 50 bp, homo sapien
tgttgagaactaaggattatccaacycagtcattttgaattcccctaaca

SEQ ID NO: 55808 - DNA, 50 bp, homo sapien
attttttcccagacatttgcccaacsagataatcattccctcctctgtga

SEQ ID NO: 55809 - DNA, 50 bp, homo sapien
gaaaaaattgtaggacccaggcagayggtttattacaatggagttgatac

SEQ ID NO: 55810 - DNA, 50 bp, homo sapien
agcaggaaaccaaaacaatccgataygtaactgttgaccttcagactcaa

SEQ ID NO: 55811 - DNA, 50 bp, homo sapien
gaataagccacagtttggaatcctcraagggaatgacccacacaggatct

SEQ ID NO: 55812 - DNA, 50 bp, homo sapien
catcaaacatgaggcaacagcattakagaaagaagggtagaatacccatg

SEQ ID NO: 55813 - DNA, 50 bp, homo sapien
ggaaggaaggtagtttcttcccaaaygtgaagctgcaatcatagtttctg

SEQ ID NO: 55814 - DNA, 50 bp, homo sapien
gtaaaccagcactcttcaagaatgawctttgcactatttaatctagtaga

SEQ ID NO: 55815 - DNA, 50 bp, homo sapien
gacttcatagctctattttataaacrattttatggccctgaaactggtta

SEQ ID NO: 55816 - DNA, 32 bp, homo sapien
gcattttaggtagaagkaatagcacgagcaaa

SEQ ID NO: 55817 - DNA, 50 bp, homo sapien
aatagggaaatggagaaagatgctaygactaattccataaagtgtaacta

SEQ ID NO: 55818 - DNA, 50 bp, homo sapien
aatggtgaaagacttcataaattacyagttgaagaaaaactttctgagtg

SEQ ID NO: 55819 - DNA, 50 bp, homo sapien
tgagtgcatgcatatctaaaaacacrattttggcacgtttactttagtag

SEQ ID NO: 55820 - DNA, 50 bp, homo sapien
ctgattgattacatttgaaaatcacygggtaggaaaaagtctttcctgca

SEQ ID NO: 55821 - DNA, 50 bp, homo sapien
tttgcagaatgattctattcacatcyctaggctaagaatgccttacttga

SEQ ID NO: 55822 - DNA, 50 bp, homo sapien
gatcttctaagctctgtcacttaagkattctatatttatgtcattcattt

SEQ ID NO: 55823 - DNA, 50 bp, homo sapien
aagcaaacacttctaggtccctggcraatatgggattcctccattgactg

SEQ ID NO: 55824 - DNA, 50 bp, homo sapien
ttcctgggattcatgtggatctcaayatcttgtatagtcaacccctacca

SEQ ID NO: 55825 - DNA, 50 bp, homo sapien
aaaccaggcatcagaataaagaggayaccagatatgtaaatcccaagcaa

SEQ ID NO: 55826 - DNA, 50 bp, homo sapien
agtattggtgctgtgaagtggtgctyaccattaagtgtgtgtgtgtgttt

SEQ ID NO: 55827 - DNA, 50 bp, homo sapien
taatcgttggactaaaagagaatatyataatgccaatcactgttttatta

SEQ ID NO: 55828 - DNA, 50 bp, homo sapien
atctctcaagctcacttgggttccartcatcctaccctgagtagattgtg

SEQ ID NO: 55829 - DNA, 50 bp, homo sapien
taacacactgtgtaattgaaatggamcataatcactaatattaaagacag

SEQ ID NO: 55830 - DNA, 50 bp, homo sapien
cagaaagctcggatgtcattaatcayggttgtttccataaagtgccatca

SEQ ID NO: 55831 - DNA, 50 bp, homo sapien
caggccgtgcattctctatgtgttcyctatgcttcacatgtaaaacaaga

SEQ ID NO: 55832 - DNA, 50 bp, homo sapien
atattattttccatgtaagtaaaaaktgagtattgctattaaacactttt

SEQ ID NO: 55833 - DNA, 50 bp, homo sapien
cacagtaggtgttcagtaaatgttayggaaacagtgaatctaggctgata

SEQ ID NO: 55834 - DNA, 50 bp, homo sapien
acaacctccagaatggcaattctacyatttgtatccaatcaatctgtgca

SEQ ID NO: 55835 - DNA, 50 bp, homo sapien
caaactgtcattcaagtgtgagggtraactaaactcattttgaggtctgc

SEQ ID NO: 55836 - DNA, 50 bp, homo sapien
tagaggaaaagaaaggaagaaattawtaaatatcacaagaaaattttcca

SEQ ID NO: 55837 - DNA, 50 bp, homo sapien
ttatgctttcagaagtagaaaatgcygaatcctcacaaaaaattttgagt

SEQ ID NO: 55838 - DNA, 50 bp, homo sapien
tagtctagagaaaaatctttcattaycaagctcaaagtccttgaattttt

SEQ ID NO: 55839 - DNA, 50 bp, homo sapien
aatatatctttgaatggtccactgaygaataatgagaaataaataaattt

SEQ ID NO: 55840 - DNA, 50 bp, homo sapien
tttataagaaacttccctctcttaaytcattctaccatacagtcaggtac

SEQ ID NO: 55841 - DNA, 50 bp, homo sapien
cctgaactagaaccaagatttaagamcttattttgtacagttggctgatt

SEQ ID NO: 55842 - DNA, 50 bp, homo sapien
attttcaaagagaaatcagttgtaaktcttatctttagtcctcctatagg

SEQ ID NO: 55843 - DNA, 50 bp, homo sapien
agtaaagttcaaagactgatgaacaygagcagatggcaggaggctggcag

SEQ ID NO: 55844 - DNA, 50 bp, homo sapien
catggagagaaattccatcagaataktactgtatttctcagcagaaacct

SEQ ID NO: 55845 - DNA, 50 bp, homo sapien
gatactgtttgcaaatcggcaattasaagactcgtgtgaaatctttattt

SEQ ID NO: 55846 - DNA, 50 bp, homo sapien
ctttgtccctcagtttactaatgacrcccagagaggctgtcacttgccaa

SEQ ID NO: 55847 - DNA, 50 bp, homo sapien
tttagtcataatactaattgttaaartatgaaaccataaatatcaactca

SEQ ID NO: 55848 - DNA, 50 bp, homo sapien
gtattgaaccagagatgaatttagayggcacatgagtgttttaacttcga

SEQ ID NO: 55849 - DNA, 50 bp, homo sapien
cctctactcatatctctatctgcaakatgtcaacctcaatgtgaaactca

SEQ ID NO: 55850 - DNA, 50 bp, homo sapien
gacatgtgggacagagggtagagaargaagaggtaaaattgagagggaat

SEQ ID NO: 55851 - DNA, 50 bp, homo sapien
tataattgcttcttagatacacccartgcaaactcttaccattttcatga

SEQ ID NO: 55852 - DNA, 50 bp, homo sapien
agctgctccctgcaaatctttataastagatcacacataggtaatttgga

SEQ ID NO: 55853 - DNA, 50 bp, homo sapien
tgtccggggtgtatttaagtcaacastagtaggaatctctccatttgcac

SEQ ID NO: 55854 - DNA, 50 bp, homo sapien
ttgtggggtgagaattcaaacccagratgtctgagtccaaagcttttgtg

SEQ ID NO: 55855 - DNA, 50 bp, homo sapien
ttctctcgcagttagatttaattaaygcttaccctcatcatgatcttgca

SEQ ID NO: 55856 - DNA, 50 bp, homo sapien
tacatatagggatagagttgttaaamctaatttcagactaagtattgcta

SEQ ID NO: 55857 - DNA, 50 bp, homo sapien
atggctgtgacaaacctaaacttcayatgtcttaacagatctgcatacat

SEQ ID NO: 55858 - DNA, 50 bp, homo sapien
gagacagttggttagaaaaatatacrcatacatattttgtacagagacat

SEQ ID NO: 55859 - DNA, 50 bp, homo sapien
gagaagagtccactctctgaagtcamgcaactagtcagtgaaagtcagtg

SEQ ID NO: 55860 - DNA, 50 bp, homo sapien
aagttgaaattatctcttgcctgaaktattaacgggtctcgctgcaatta

SEQ ID NO: 55861 - DNA, 50 bp, homo sapien
acagctctggctctggcccaggctaygggtgaatctcctccacaaagctc

SEQ ID NO: 55862 - DNA, 50 bp, homo sapien
ggatacccaacaataaaaggagatcratttagcaaaaaagaatgttggcc

SEQ ID NO: 55863 - DNA, 50 bp, homo sapien
cattgggccaaactaataatcttaasaggtgatatggtttaatgaaaaga

SEQ ID NO: 55864 - DNA, 50 bp, homo sapien
gccttagttctgtttgaatcattcayggttcctggcatagtgactggcat

SEQ ID NO: 55865 - DNA, 50 bp, homo sapien
aaaaagaagcttttgttcaaaaggaygctgttagaaatgtgcacctcttt

SEQ ID NO: 55866 - DNA, 50 bp, homo sapien
attggtgtcagtatttgataagatayctaaggctcctttgaactatttca

SEQ ID NO: 55867 - DNA, 50 bp, homo sapien
ttgtagaaagctttagccattatgcrctgaaactgtcattctctcagctc

SEQ ID NO: 55868 - DNA, 50 bp, homo sapien
acttgggtatccaatttgtcattgasacgtgacacctattcatttaaatt

SEQ ID NO: 55869 - DNA, 50 bp, homo sapien
ttctctgagatctcaagtcagttaaktcagatgggagtaagacatggaag

SEQ ID NO: 55870 - DNA, 50 bp, homo sapien
taaccaactttatccagacctagaaygctttccaaaaatctctttcatat

SEQ ID NO: 55871 - DNA, 50 bp, homo sapien
agaacaaccactcatctgagtccctraagaaatctccatctccaggggta

SEQ ID NO: 55872 - DNA, 50 bp, homo sapien
tctccaggggtaaaagctgaggaaarttggtgtacgtctctgccaagcct

SEQ ID NO: 55873 - DNA, 50 bp, homo sapien
tgtgctgtctcttctaatcacttctracatctggaggttatcaccacagc

SEQ ID NO: 55874 - DNA, 50 bp, homo sapien
ggcagctggttcctacggcaaaagargcaatgaagggaaagagttatgca

SEQ ID NO: 55875 - DNA, 50 bp, homo sapien
tctaccttagtggggaggagtaaagkatgttgggcaagagagagatttgg

SEQ ID NO: 55876 - DNA, 50 bp, homo sapien
gacaagtgtcactggaaagatattamagaatcaaagtagtctttgtagac

SEQ ID NO: 55877 - DNA, 50 bp, homo sapien
tgaaaagcaatgatgagaaaaggaargtgtgctcacttagtggccctctg

SEQ ID NO: 55878 - DNA, 50 bp, homo sapien
aagtcaaatgattgaaacttgagcaraactggttactctgccatgcttga

SEQ ID NO: 55879 - DNA, 50 bp, homo sapien
tgggttggttgggttaagaaagttaraagactcctaggagacagatccag

SEQ ID NO: 55880 - DNA, 50 bp, homo sapien
aaggaacagacaaagcctccttttgmatggattaggaaaacatatttgga

SEQ ID NO: 55881 - DNA, 50 bp, homo sapien
atgtatcctggcttccaaaggaaaayggctgagctgtactgtgctttcag

SEQ ID NO: 55882 - DNA, 50 bp, homo sapien
agggaccaccagactggacaccttgmagggaaaagcagggtctgagttga

SEQ ID NO: 55883 - DNA, 50 bp, homo sapien
aggtaattattgagctcagattaaakgttatatagaaattcactagatag

SEQ ID NO: 55884 - DNA, 50 bp, homo sapien
aggaagatgctcatggtttagatgayacatggttcttagtgcattgtatc

SEQ ID NO: 55885 - DNA, 50 bp, homo sapien
tttcttatggatggctgtcaatcccraggcagaagttttcaggtggagac

SEQ ID NO: 55886 - DNA, 50 bp, homo sapien
gatactcaataagtgaataaacagargtctctcaagcacattcccttggt

SEQ ID NO: 55887 - DNA, 50 bp, homo sapien
ttttcttcctggaggctaggtctgayggtgtactcagaaactaaaggcac

SEQ ID NO: 55888 - DNA, 50 bp, homo sapien
gttctctatatggtgattattcccaygctaaacccattcatttatagctt

SEQ ID NO: 55889 - DNA, 50 bp, homo sapien
atagctgtgcaagacacccagaatasgagatgatctgactctgggtatga

SEQ ID NO: 55890 - DNA, 50 bp, homo sapien
cccaaatagcttactttcatggatcyaggataccttttcctttaccctga

SEQ ID NO: 55891 - DNA, 50 bp, homo sapien
tcctctggccactcagagagtcctaraaggaggaagtctgaaacagtggt

SEQ ID NO: 55892 - DNA, 50 bp, homo sapien
ggggagggagtattgccatttcatakaattaagccaaagaactggaaatt

SEQ ID NO: 55893 - DNA, 50 bp, homo sapien
agtatttatttattagatcaatttasagatatgcatctgtgtggccagaa

SEQ ID NO: 55894 - DNA, 50 bp, homo sapien
aagaaagggagttatttccagaaacyctgaatagcttactatttctcata

SEQ ID NO: 55895 - DNA, 50 bp, homo sapien
ttgattcttgctctgaatgataaaartgatgaccgctaaacaggtttgtt

SEQ ID NO: 55896 - DNA, 50 bp, homo sapien
ctgttgaggttggagtttgactaaaygggattgactttagctttattttt

SEQ ID NO: 55897 - DNA, 50 bp, homo sapien
ccttgaaaaagtgatacctaaacccraaggatgagtagaaataagccaga

SEQ ID NO: 55898 - DNA, 50 bp, homo sapien
ccagcccttggaagacagtggctaarcacataatctctttgggtaatctg

SEQ ID NO: 55899 - DNA, 50 bp, homo sapien
tttttttcttttttactcaccactayacaaatgaggataggcatattttg

SEQ ID NO: 55900 - DNA, 50 bp, homo sapien
ttgtggcaaacatctcaagacgtgarcttgtccttatcctaaatcaagat

SEQ ID NO: 55901 - DNA, 50 bp, homo sapien
cccaggcaccaaggttggaagaatcyctttctgctttgttttcttttgtg

SEQ ID NO: 55902 - DNA, 50 bp, homo sapien
agctactaaataacataagtgataargatcaaaaagagtggatggtgtgc

SEQ ID NO: 55903 - DNA, 50 bp, homo sapien
tatcaagatttaaaaatgccttatasaacatctagttgaggcccccattg

SEQ ID NO: 55904 - DNA, 50 bp, homo sapien
tatacaaggcatattacttacattayacaatttaatctgtacaacaatgt

SEQ ID NO: 55905 - DNA, 50 bp, homo sapien
ctgttcataaatcatgctaggtaacrcagttcatatatgtgacaaaagta

SEQ ID NO: 55906 - DNA, 50 bp, homo sapien
ggtcttatttattccagtatctccaraactaacaaagattagcacgttgt

SEQ ID NO: 55907 - DNA, 50 bp, homo sapien
ttattatagaggctgtgttacgtgasaggataaaggttgatttataagta

SEQ ID NO: 55908 - DNA, 50 bp, homo sapien
agaactccagagcctcttctctcaargtatttatctccctctgggtccca

SEQ ID NO: 55909 - DNA, 50 bp, homo sapien
tttatactcaggcccaaaaaattccragagaaaagtgcttagaaagataa

SEQ ID NO: 55910 - DNA, 50 bp, homo sapien
ggtatggtcatgaaggataaataaamatttagtagatgaggaggtgcatt

SEQ ID NO: 55911 - DNA, 50 bp, homo sapien
agtccactttccttgcaatgaactaygacattttatgagctgttccctgc

SEQ ID NO: 55912 - DNA, 50 bp, homo sapien
ctacacagtgcctcatatatagcaargcccaaataagtgttgaattaact

SEQ ID NO: 55913 - DNA, 50 bp, homo sapien
gaatgccactttgtttagaagacaartaagataaatggcatgtctgtttt

SEQ ID NO: 55914 - DNA, 50 bp, homo sapien
gtgagacacatcttctccgattccayagcaaaagatttaaatccctattc

SEQ ID NO: 55915 - DNA, 50 bp, homo sapien
agtgccaacaacttcttctgagatgwactattattctgttcaactgtcat

SEQ ID NO: 55916 - DNA, 50 bp, homo sapien
taaattaaagcatgaactacgaggarcctgtatctaagtaaagggactga

SEQ ID NO: 55917 - DNA, 50 bp, homo sapien
agaaaggtaaagaaagtttcaaaatkatatggaaaagccagtatgtacac

SEQ ID NO: 55918 - DNA, 50 bp, homo sapien
caagactatgaagaagctcctctatragaaagttgtattttgagtgagct

SEQ ID NO: 55919 - DNA, 50 bp, homo sapien
gcagttggaaaatgaaattcacataytagagaatgcatcagagtctttta

SEQ ID NO: 55920 - DNA, 50 bp, homo sapien
tgagatataaatgggaagaaaatgcrcccatagtatttaaccagtagaaa

SEQ ID NO: 55921 - DNA, 50 bp, homo sapien
cctggaggtctggaaccatagtggayagatctcctttctcacactcagat

SEQ ID NO: 55922 - DNA, 50 bp, homo sapien
tgcttgggaaagtcattagtacaaasgacatccagatgagtggactgatg

SEQ ID NO: 55923 - DNA, 50 bp, homo sapien
tcataataaatcagttatagataccyggatgttgaggtagacttcaaact

SEQ ID NO: 55924 - DNA, 50 bp, homo sapien
ccagccatactgtaaaacctcaaaayttatgggcaacttggtagagcaca

SEQ ID NO: 55925 - DNA, 50 bp, homo sapien
gtgtgattaaaaaaatattggggtaycactaggccagaattgacagttgc

SEQ ID NO: 55926 - DNA, 50 bp, homo sapien
tgtttgaactgggccttaaattatgkatatgatttcaacaacatggaaag

SEQ ID NO: 55927 - DNA, 50 bp, homo sapien
cactgtgccaggtgctgtgttgggcrctatatttacatctctgtgtcact

SEQ ID NO: 55928 - DNA, 50 bp, homo sapien
accacacgtgtcacacaggcacccartctccaaggtggttcctgcagccc

SEQ ID NO: 55929 - DNA, 50 bp, homo sapien
gcccttggatctcctgtacttcttamgatattgtgatggcttaattttat

SEQ ID NO: 55930 - DNA, 50 bp, homo sapien
gtttgtgatgatttaaagacaatgcragactagtatttccacatagtaag

SEQ ID NO: 55931 - DNA, 50 bp, homo sapien
cccaggcatacatattttacccacartctttacctctgcctgtatccatc

SEQ ID NO: 55932 - DNA, 50 bp, homo sapien
ctagctggagttattccccatattgygatggtagtagaaacctcttgaaa

SEQ ID NO: 55933 - DNA, 50 bp, homo sapien
gagggactaaaatatggtcaagaagraattgtaatcagatattatttctg

SEQ ID NO: 55934 - DNA, 50 bp, homo sapien
cataccatggagtgaaatattgtacrgaactcatatgataataagatagg

SEQ ID NO: 55935 - DNA, 50 bp, homo sapien
ggtttgttttctgcattcccagctgratgttgagcacttctgtcagttta

SEQ ID NO: 55936 - DNA, 50 bp, homo sapien
ctactaaataaaagacttgaccacartggactgatatctcatcattgaag

SEQ ID NO: 55937 - DNA, 50 bp, homo sapien
gaatcatatgcgcatgagcactaagmaagtgaggacccacttatggtttt

SEQ ID NO: 55938 - DNA, 50 bp, homo sapien
ccactcaaagcaggtgaacagctaamggaaagagccctcaatttttcctt

SEQ ID NO: 55939 - DNA, 50 bp, homo sapien
gccctttaactttctttggtcaatgragacatagaaaatgtcatacaagg

SEQ ID NO: 55940 - DNA, 50 bp, homo sapien
cagtattgtgaagagatgatggatayataaatgccatttagcagaataaa

SEQ ID NO: 55941 - DNA, 50 bp, homo sapien
tgagtaaataagctaatatggaagayacttagtgtatataacaggtactc

SEQ ID NO: 55942 - DNA, 50 bp, homo sapien
tgcattcaaatgtttcaggccatacmagaggaaaaaaataggtgagagca

SEQ ID NO: 55943 - DNA, 50 bp, homo sapien
ttctggattttgtggaagtttgagasacatcttccagagcttgtctggac

SEQ ID NO: 55944 - DNA, 50 bp, homo sapien
tgatgaataccttttcttttaagtcmagatgtttctttccacatcattta

SEQ ID NO: 55945 - DNA, 50 bp, homo sapien
ggaaagcttgggagagaattttctcrcaaaagtattctgtccccctcact

SEQ ID NO: 55946 - DNA, 50 bp, homo sapien
agctgtgctattagtccaaagaaaaytgaatggaggtgttaacgtggcta

SEQ ID NO: 55947 - DNA, 50 bp, homo sapien
acaaaaagccacacatgggcaagagycatatctttttccatgcagacatg

SEQ ID NO: 55948 - DNA, 50 bp, homo sapien
gatcaagttcccaagttagttttackcctctactcgattgacatcatgcc

SEQ ID NO: 55949 - DNA, 50 bp, homo sapien
gccacagtgggatttagagggcagcrgaatttcatgttctcattgtaaaa

SEQ ID NO: 55950 - DNA, 50 bp, homo sapien
ccttccccaggcaaatgaatagcatmatgaagtgaaagaccccttgactt

SEQ ID NO: 55951 - DNA, 50 bp, homo sapien
aaagagcagagtaaacaatacatgaygttagcaaaaggagcattgcaagg

SEQ ID NO: 55952 - DNA, 50 bp, homo sapien
actgtacaataggtaagggaatctcracttaaacgataccttcatagagc

SEQ ID NO: 55953 - DNA, 50 bp, homo sapien
actatgaagcacatgaaactcaaaasactataaatgctttggtatgccta

SEQ ID NO: 55954 - DNA, 50 bp, homo sapien
taaacccactgaccaggatgtgacartatctatcatcataataaaattga

SEQ ID NO: 55955 - DNA, 50 bp, homo sapien
catttctcctttgatcctttagacarcttgtatgactgttctgcaatctg

SEQ ID NO: 55956 - DNA, 50 bp, homo sapien
tacccttaaataccagcaatggccgrcagtgatagataggaaggcattgt

SEQ ID NO: 55957 - DNA, 50 bp, homo sapien
gtaacgacctctacagccagaactayggaaagtgtttcagcagtaggtgc

SEQ ID NO: 55958 - DNA, 50 bp, homo sapien
aatatatgatctttgataagccatcsaataagcaaaaaggatatagcttg

SEQ ID NO: 55959 - DNA, 50 bp, homo sapien
tagaccatcacaatatccaacaatamcgacatcaaatacttattgatctc

SEQ ID NO: 55960 - DNA, 50 bp, homo sapien
ctcaagtgttctattcaaaggtccayggaaatattgtgagactttggaat

SEQ ID NO: 55961 - DNA, 50 bp, homo sapien
aaaaaaattgccattaaaggaacacscataagacttacagatgactttcc

SEQ ID NO: 55962 - DNA, 50 bp, homo sapien
aagaagcttgcctagattggtgtagraccagccaaaatcaaaggaattta

SEQ ID NO: 55963 - DNA, 50 bp, homo sapien
aagaaacctgcttaattttgttgaamgtggtgtttctaaaacatttttgt

SEQ ID NO: 55964 - DNA, 50 bp, homo sapien
gaggacaggtgagatcctacagaacygaggcactggaattttctctacag

SEQ ID NO: 55965 - DNA, 50 bp, homo sapien
aatgtcctcagtctgttgtcccagaygatagaagagagaactgtagctat

SEQ ID NO: 55966 - DNA, 50 bp, homo sapien
aatcaatctaaccatccaccatgtgyacatcctgtttattattcaatgca

SEQ ID NO: 55967 - DNA, 50 bp, homo sapien
aagagaagaaagtacagaggttagartacgaagaagtaggtcatatttaa

SEQ ID NO: 55968 - DNA, 50 bp, homo sapien
ggaggtttttcttaaatctaagaaayacttgtttagctaatgtcctgcaa

SEQ ID NO: 55969 - DNA, 50 bp, homo sapien
ggttaactacttcttcaagtgtacayagtgatatggtttgatacttgttc

SEQ ID NO: 55970 - DNA, 50 bp, homo sapien
ggcatttcacattcaaaacacttcaracctaataacaggaaattatcatg

SEQ ID NO: 55971 - DNA, 50 bp, homo sapien
tccaggatatcagcttgtggactcgkaatttttttcttttcacttttgca

SEQ ID NO: 55972 - DNA, 50 bp, homo sapien
cctccttcaaagagtattagtgggcygattcatttaaaagtattttgtca

SEQ ID NO: 55973 - DNA, 50 bp, homo sapien
gagatggcatacagagataagaaacmgagtaactgggctggaatttaact

SEQ ID NO: 55974 - DNA, 50 bp, homo sapien
ctgtttttacaatatcatctgtcaartgaaataatgattctgaaatcctg

SEQ ID NO: 55975 - DNA, 50 bp, homo sapien
aagtctacctctgttattaagagtaragaacagaacacagactctggagt

SEQ ID NO: 55976 - DNA, 50 bp, homo sapien
tctctgtttcagaggatgggcaatcrcttgctgaggttgagagaaggatc

SEQ ID NO: 55977 - DNA, 50 bp, homo sapien
cattcagacaccaaaaggaggaaacragaagacgataatgaaattcagac

SEQ ID NO: 55978 - DNA, 50 bp, homo sapien
cataccttttggcatgtgggtactcyacaatcagacaccaatttgtcttc

SEQ ID NO: 55979 - DNA, 50 bp, homo sapien
cattcttgtttgtttaagttgaataytaatcagcaatagggagaacacag

SEQ ID NO: 55980 - DNA, 50 bp, homo sapien
aagacttcattttgcatttgatatcyatctttgagggaaaagttatcagt

SEQ ID NO: 55981 - DNA, 50 bp, homo sapien
tgtggcattgatatgcaccaaacacraagtctggagtgtgagtggaaagg

SEQ ID NO: 55982 - DNA, 50 bp, homo sapien
caccaatgtggtattttctttactcrcaattacttattgcctatcattac

SEQ ID NO: 55983 - DNA, 50 bp, homo sapien
tgaagttgtttttggatatcttgaawgtgtaataacttaaaatacccaag

SEQ ID NO: 55984 - DNA, 50 bp, homo sapien
tgatacaaacctagaaggaacggcaygatggtttctattatcttcagctg

SEQ ID NO: 55985 - DNA, 50 bp, homo sapien
agagaagagagactccacggaaaccrctgtattgggctgtccctcccaca

SEQ ID NO: 55986 - DNA, 50 bp, homo sapien
ttacctactccaaaccaaagaattamctttcacctctttcacccattccc

SEQ ID NO: 55987 - DNA, 50 bp, homo sapien
accaactcctatctgttcagcttaamtataattcctctgagtgaactttt

SEQ ID NO: 55988 - DNA, 50 bp, homo sapien
ttgcagatgattacagggtcttagartatagcagagccaagggatacggg

SEQ ID NO: 55989 - DNA, 50 bp, homo sapien
agggcaaggcagaggccaaagtccaygcaaagttccagactgaagagcaa

SEQ ID NO: 55990 - DNA, 50 bp, homo sapien
gacagagggtccaacagatagtacayacattagtcgctatggattacgag

SEQ ID NO: 55991 - DNA, 50 bp, homo sapien
tcatcgggatgagcaggaattaggcrgatcaattagaaaaagagggcaag

SEQ ID NO: 55992 - DNA, 50 bp, homo sapien
gacagcggcatttaggtgggaagaayagtagtaaagtcggcttgaggtgg

SEQ ID NO: 55993 - DNA, 50 bp, homo sapien
gctgctcctctgcctagctagcaagwcccttagttgtcagtcacaactgt

SEQ ID NO: 55994 - DNA, 50 bp, homo sapien
gtgagagtccaattttattcttctgmatgtcaatatccagctttcccagc

SEQ ID NO: 55995 - DNA, 50 bp, homo sapien
ctttctttcctattgttcataaacayggtattaaaatgaccactaaagag

SEQ ID NO: 55996 - DNA, 50 bp, homo sapien
gtccagatgcaagtataatagctgtyacagagcaggcactcaataaatct

SEQ ID NO: 55997 - DNA, 50 bp, homo sapien
ttgtttgatcatggggtcttttttayagcatatcttgtaagataactgtt

SEQ ID NO: 55998 - DNA, 50 bp, homo sapien
tgttagattgtctacaagagttgaaragaaaagggatattgaggtgatac

SEQ ID NO: 55999 - DNA, 50 bp, homo sapien
cctaacttggtcttctcttaaatcaygccagtcttgggtattgggggtgc

SEQ ID NO: 56000 - DNA, 50 bp, homo sapien
tgctgacagcacgcatgtctcttccraagtcacttccccacttaaattgt

SEQ ID NO: 56001 - DNA, 50 bp, homo sapien
cttttccttgcttatctgggaatcasgcaaaagttggccagagttagctc

SEQ ID NO: 56002 - DNA, 50 bp, homo sapien
agccatgaattttcctaattctcagraatcatcttccaaaaggcctacat

SEQ ID NO: 56003 - DNA, 50 bp, homo sapien
actcaacaagtgctcctgaaagaaaygctagaagcctaagaactgtggtc

SEQ ID NO: 56004 - DNA, 50 bp, homo sapien
attttgagtcccatgctttttctcgyaatctgtatttctttcaccaattg

SEQ ID NO: 56005 - DNA, 50 bp, homo sapien
tttaagtgcctggtatcttgttctayggcacagatctcttgggcatgagg

SEQ ID NO: 56006 - DNA, 50 bp, homo sapien
ttttctatataaagttgggtaatgargagttaagttattagtgcacatca

SEQ ID NO: 56007 - DNA, 50 bp, homo sapien
tgctctgccatctcactgccacttayaaatgttaaattcacagttttctt

SEQ ID NO: 56008 - DNA, 50 bp, homo sapien
tatgaagtctccttaagaagttaccygaatcctgcctttgtaatatgaca

SEQ ID NO: 56009 - DNA, 50 bp, homo sapien
agtgcctgctaagtcctagagtggtraataaaagagacagggctcctcag

SEQ ID NO: 56010 - DNA, 50 bp, homo sapien
actcaattacaagctctgactttggraagagaagaaccagactgtagtct

SEQ ID NO: 56011 - DNA, 50 bp, homo sapien
gcttgattagcaaaattaacacaatsaatctgagtaccatgggttcttat

SEQ ID NO: 56012 - DNA, 50 bp, homo sapien
cctgctagagctgagattagaataartgctaggttcattcgttcacattt

SEQ ID NO: 56013 - DNA, 50 bp, homo sapien
atttaaaatggtactctttgaaggayattgcccataaattgctctgcatt

SEQ ID NO: 56014 - DNA, 50 bp, homo sapien
ttcgattacacgacaatgaaaaacayggactattttcctgtggcacatgg

SEQ ID NO: 56015 - DNA, 50 bp, homo sapien
atgctgttcatttttattatgttcgycacgccttatcaagtctttgttta

SEQ ID NO: 56016 - DNA, 50 bp, homo sapien
gctctgccttgctgtatctatttaasaattcttgccatttcatttgcccc

SEQ ID NO: 56017 - DNA, 50 bp, homo sapien
gtgtcaccgaagtgggcctgattgargaaggtaaggaattggcacatgga

SEQ ID NO: 56018 - DNA, 50 bp, homo sapien
tcagattctttccaattctaaaagaraactgagttatccagcaagacaca

SEQ ID NO: 56019 - DNA, 50 bp, homo sapien
atttctgggctccttttctatcttaygtttgccccctactcacagccctt

SEQ ID NO: 56020 - DNA, 50 bp, homo sapien
caatttgaatcactgcaattttaagrcgcaatgataattttggggaagta

SEQ ID NO: 56021 - DNA, 50 bp, homo sapien
aataatttgtctttaattagtgacamataaaatctaattctaactcccag

SEQ ID NO: 56022 - DNA, 50 bp, homo sapien
acagagtctccagatttaaaggggcrcactggtctatcaggcttacaggc

SEQ ID NO: 56023 - DNA, 50 bp, homo sapien
aaaaggactctctgcaggtgtaacartctgaaacataggaggactatttt

SEQ ID NO: 56024 - DNA, 50 bp, homo sapien
aaatgtaaacagtggtctctaaaaaytaagttgaggcccatctacatgac

SEQ ID NO: 56025 - DNA, 50 bp, homo sapien
agtgtaatgttagtactgattgtaartaaaattaaaatttgaaaaaaatc

SEQ ID NO: 56026 - DNA, 50 bp, homo sapien
aaatgtagtcctgtctggaacagtaygttagatatgttagcatatacagt

SEQ ID NO: 56027 - DNA, 50 bp, homo sapien
ggaggagcatgtctggaacttgggayatttactaagttatggtccaataa

SEQ ID NO: 56028 - DNA, 50 bp, homo sapien
actgggataaatgaaaaagccaccargttcaccgttcctaatgaacatca

SEQ ID NO: 56029 - DNA, 50 bp, homo sapien
gaaaatcaggtatttgaaggtatcaytactacttgcaaaaagagccataa

SEQ ID NO: 56030 - DNA, 50 bp, homo sapien
gatcattcccctactaagatagaaamtgagaggtaaatgaataatcactt

SEQ ID NO: 56031 - DNA, 50 bp, homo sapien
caaaaaggcagttaggaagtatttcrgaaaccactgggaaatgcctaaga

SEQ ID NO: 56032 - DNA, 50 bp, homo sapien
ttggtatttcagctggggatatctcyagaaaaggaaataactgatatgaa

SEQ ID NO: 56033 - DNA, 50 bp, homo sapien
ccgagcttcctcgatctccattcacsatgaccaattttttcccccacaaa

SEQ ID NO: 56034 - DNA, 50 bp, homo sapien
gagatatggggctgcacagcattcaytacagatccctagtttttacaact

SEQ ID NO: 56035 - DNA, 50 bp, homo sapien
cttaaggaactaccaaatctactaakggacctccaagaattttgtgaccc

SEQ ID NO: 56036 - DNA, 50 bp, homo sapien
aatcatcttattctctactggtttaragttactatgataagcctattttc

SEQ ID NO: 56037 - DNA, 50 bp, homo sapien
ctgactgaaaatgaaaaaaaggccamcagaatgatatcaacacttccaga

SEQ ID NO: 56038 - DNA, 50 bp, homo sapien
cttgctaaaatctcctaagcataaartttaacaggctctccttgagagtg

SEQ ID NO: 56039 - DNA, 50 bp, homo sapien
atgtactacatctctcttctttacawcagctagtttgagcagatttctaa

SEQ ID NO: 56040 - DNA, 50 bp, homo sapien
aagtttgttcagatttattcatccaycatcagggaatcaaacgtgtccta

SEQ ID NO: 56041 - DNA, 50 bp, homo sapien
aaaaatcgtacatgaaacccaaagamctgagggaaattatcctttctaat

SEQ ID NO: 56042 - DNA, 50 bp, homo sapien
gctatcttgcataaaatttcagagastatcattcaagaatttaaaactgc

SEQ ID NO: 56043 - DNA, 50 bp, homo sapien
cctgacccaagtaccttctcgttccrctcccaagcaaggcaccctctcgc

SEQ ID NO: 56044 - DNA, 50 bp, homo sapien
atcaaggagaggaagttatccctgaycttggtaaaatccagaattacacc

SEQ ID NO: 56045 - DNA, 50 bp, homo sapien
gtgtggggctttactaatatgtttargagacaggtattaaagttagtttc

SEQ ID NO: 56046 - DNA, 50 bp, homo sapien
tattatttaaattccaaactatccartctgagcctcagagggggtataag

SEQ ID NO: 56047 - DNA, 50 bp, homo sapien
tttaaatttcaacctttgcttaaaasatcctagggaatgaaaaaattttt

SEQ ID NO: 56048 - DNA, 50 bp, homo sapien
tctcaatgacaagaatccaataagawacctgtaagagctgaataagggtc

SEQ ID NO: 56049 - DNA, 50 bp, homo sapien
tgaaaataatagctgacagttatcaratgtctattatagcccacacactg

SEQ ID NO: 56050 - DNA, 50 bp, homo sapien
gggggctccatggcaaatgagaaacmgaggaagaagaactaaccttccta

SEQ ID NO: 56051 - DNA, 50 bp, homo sapien
cttgggagaaaaggaattatggtgcrgaattagttgtaggagaaatggaa

SEQ ID NO: 56052 - DNA, 50 bp, homo sapien
gtttatgcatattagagacatacctsaaagtgtttgaacaggcatgtcaa

SEQ ID NO: 56053 - DNA, 50 bp, homo sapien
tttaccctaaaagttcaaagaaatcraactgacttacactggttatttaa

SEQ ID NO: 56054 - DNA, 50 bp, homo sapien
tgcaaatgaggatactagtaatcacyaagaataatgaagaccttaacgag

SEQ ID NO: 56055 - DNA, 50 bp, homo sapien
tttcataagctttatcttaaggacarcactgggttaacaagaattctgaa

SEQ ID NO: 56056 - DNA, 50 bp, homo sapien
tggggtttggatatttggtgatctawggagttggcgtgatgaagagagat

SEQ ID NO: 56057 - DNA, 50 bp, homo sapien
tccccagagtcatggaactcactgaygagcaataaacaagttactcaagg

SEQ ID NO: 56058 - DNA, 50 bp, homo sapien
ccaagtgcaccacggaagaccgtacsaatggcgctgagcagtccaaggtt

SEQ ID NO: 56059 - DNA, 50 bp, homo sapien
gacattgtgattgaccgaacctaacrctctaagaattagtggctaccagt

SEQ ID NO: 56060 - DNA, 50 bp, homo sapien
aggggagagaagataaaattggttasaaggttgagagttgttatttcatg

SEQ ID NO: 56061 - DNA, 50 bp, homo sapien
tggaacttcatattaccttatagacrgtatcagacaatatttgagataaa

SEQ ID NO: 56062 - DNA, 50 bp, homo sapien
cataggagacctgcaggtaaacggakgataagcattgtctagtgtcctgt

SEQ ID NO: 56063 - DNA, 50 bp, homo sapien
acacaaatccaaactctatcacctayatattgtttggtcagttttatttt

SEQ ID NO: 56064 - DNA, 50 bp, homo sapien
tcttgaaatacctcaaatgtgttagscctttttacttaccataaaggtca

SEQ ID NO: 56065 - DNA, 50 bp, homo sapien
gactgtgttagatgtcagttttcccrcatgactgatgtcactctattgca

SEQ ID NO: 56066 - DNA, 50 bp, homo sapien
tggctcagagcacagcaacaactcamggtggggtccagtcctccgttaac

SEQ ID NO: 56067 - DNA, 50 bp, homo sapien
tgtccaaaacaatttggatcagaacygtctatatgtatctctggttacat

SEQ ID NO: 56068 - DNA, 50 bp, homo sapien
attctgtgtggctccaatgcgtacaktctaccctaccaggccagctgtga

SEQ ID NO: 56069 - DNA, 50 bp, homo sapien
gttagggcaggtttgtaggaagatargcgtctttttcacttatgctcaga

SEQ ID NO: 56070 - DNA, 50 bp, homo sapien
cagggggaagatatttcgtatagaasagttcattttcatatggcttcatt

SEQ ID NO: 56071 - DNA, 50 bp, homo sapien
cctgtcttcagaaagttgccactcargtggagaagtaaaaaagaaaaaaa

SEQ ID NO: 56072 - DNA, 50 bp, homo sapien
caaactgagttccagagaaaggaatsacggtcccatgtttggaaatggtc

SEQ ID NO: 56073 - DNA, 50 bp, homo sapien
ctgcacgatgaactattggagcatayagtactgcggtgtgtctcctccca

SEQ ID NO: 56074 - DNA, 50 bp, homo sapien
actcagggaagctgttcttcctttasagcaattaaacccaaggtcagggc

SEQ ID NO: 56075 - DNA, 50 bp, homo sapien
tgtcctcggtctgaaagatattactsaggattcctttcaaaagcttagga

SEQ ID NO: 56076 - DNA, 50 bp, homo sapien
gtggcagcctttctgtagttgaataygtatcaaagtgagggacaagttgt

SEQ ID NO: 56077 - DNA, 50 bp, homo sapien
gattctttttgcagacactcctatcsatgctcagtatcagtttgggctat

SEQ ID NO: 56078 - DNA, 50 bp, homo sapien
acagccaaccggatcggctgaagagmaattaggaactcaaccgacagctc

SEQ ID NO: 56079 - DNA, 50 bp, homo sapien
ttgttgactccttgttcttaggacasatactgggaagaattatttttgca

SEQ ID NO: 56080 - DNA, 50 bp, homo sapien
tgttcaggttctatgtgcaaataacsaaacttcaggtatttagatgagtt

SEQ ID NO: 56081 - DNA, 50 bp, homo sapien
tataaacttataggctgtaaacttaygcagaaaatcttgactgaaaggag

SEQ ID NO: 56082 - DNA, 50 bp, homo sapien
aagctccctgtctcacggctcaatcraattgattcggtggggccatcagt

SEQ ID NO: 56083 - DNA, 50 bp, homo sapien
gcttcttgcttaacaagattgtttayatcagtaatatataagaatgccat

SEQ ID NO: 56084 - DNA, 50 bp, homo sapien
agtgaatgtagatgtttaataaggayggctggattttgacagttgctgaa

SEQ ID NO: 56085 - DNA, 50 bp, homo sapien
tgagtcctaagaatttgtagatacasgatggaatgtttcccagtggtaat

SEQ ID NO: 56086 - DNA, 50 bp, homo sapien
gagaggcagtgtcgtttaataaagcracctattctgtagtaaagcctcca

SEQ ID NO: 56087 - DNA, 50 bp, homo sapien
agcagaaaattctaatgtctaagaayatattaaaggtaagaaaactgtct

SEQ ID NO: 56088 - DNA, 50 bp, homo sapien
tgaccatacgaccctgaatatgatasaaaaagagaaagcattaaaatggc

SEQ ID NO: 56089 - DNA, 50 bp, homo sapien
gtgagagaatcccaagggcaggtcaygatattggatctgaacatagaggt

SEQ ID NO: 56090 - DNA, 50 bp, homo sapien
gggtcgtatggtcatagattattcaygatgtttcagataacttcttttac

SEQ ID NO: 56091 - DNA, 50 bp, homo sapien
tttttcatgtttttcctgattgtaawatcttttgagcaagatggaattca

SEQ ID NO: 56092 - DNA, 50 bp, homo sapien
tgtaaaacaaggagtcaagctcttaycgttgcctataaagattccacacc

SEQ ID NO: 56093 - DNA, 50 bp, homo sapien
attgctcccttcctcccagaaacctraaataagccatccacatgagcaga

SEQ ID NO: 56094 - DNA, 50 bp, homo sapien
aagctatactaggtgcccactttcakgagatggttgactaaattcaaacc

SEQ ID NO: 56095 - DNA, 50 bp, homo sapien
actggatggaggactctgaaacaagscttcctagaactgggtctttgacc

SEQ ID NO: 56096 - DNA, 50 bp, homo sapien
taacccaagcttagggatcgtcttcratgtgcaaagggcaatggtccctt

SEQ ID NO: 56097 - DNA, 50 bp, homo sapien
atctcaaccttggaggagagttctgyatcattcattgtcttacagacaat

SEQ ID NO: 56098 - DNA, 50 bp, homo sapien
ttttccttctttaaggggtcatttcraggataaagtaggacaaccattgt

SEQ ID NO: 56099 - DNA, 50 bp, homo sapien
acaccatgttaaaccctaagacagayggatataaggataatatgtatgca

SEQ ID NO: 56100 - DNA, 50 bp, homo sapien
aggtctcatttgcatagaaaggttawgaaatgaaataaaatccatggtcc

SEQ ID NO: 56101 - DNA, 50 bp, homo sapien
gatgtggattatcacgtcacactccrcaaggaaatggcaaaacaaaaaga

SEQ ID NO: 56102 - DNA, 50 bp, homo sapien
ctgtatccatgtgaaggaaaattgtyaaccctgtggtttggatcaatgaa

SEQ ID NO: 56103 - DNA, 50 bp, homo sapien
ggggaatgaaggctcgttctgtgtcragacagctgccccagggttccact

SEQ ID NO: 56104 - DNA, 50 bp, homo sapien
agttgaagttttaaaatttttgaaastcactgcccaaagaaattcagata

SEQ ID NO: 56105 - DNA, 50 bp, homo sapien
tattggagctgcaacgctcaaccaargtgtatattaaatctgcctcttga

SEQ ID NO: 56106 - DNA, 50 bp, homo sapien
caaagaaataattaaaacagcttcaragtgatagaaaagttggaagtaca

SEQ ID NO: 56107 - DNA, 50 bp, homo sapien
agaatgtggccaagggatcgccaccragtacgaactgaagacgttttcta

SEQ ID NO: 56108 - DNA, 50 bp, homo sapien
tagctttaagtcagctactttttaayagagttgaaagataatgaacttca

SEQ ID NO: 56109 - DNA, 50 bp, homo sapien
tggctcagagacaaagcaaactaaasgcagacaatagtaaaatgtaggtt

SEQ ID NO: 56110 - DNA, 50 bp, homo sapien
ccgtgggtcaggctttaggttggacrctttgcaggccatagttatatcca

SEQ ID NO: 56111 - DNA, 50 bp, homo sapien
ctaaaggaaattatgcttatgtgtayagatcatggattgcttgtgagtga

SEQ ID NO: 56112 - DNA, 50 bp, homo sapien
aatgcttttccctaggcatgaactcrcttaaaactactgagaagcttata

SEQ ID NO: 56113 - DNA, 50 bp, homo sapien
gattgtctaaatttagctttacttgragttgggaagtccttgttgggttt

SEQ ID NO: 56114 - DNA, 50 bp, homo sapien
ctcttgtggatacctccaggtacaamgtatatcagaacattcaccaacaa

SEQ ID NO: 56115 - DNA, 50 bp, homo sapien
gagaagcactgatatatttatttccyatatagcaggggagcatgcacgtg

SEQ ID NO: 56116 - DNA, 50 bp, homo sapien
tccgtcagacgcattgagtccgaaaygtttttaccacatgctgttggggt

SEQ ID NO: 56117 - DNA, 50 bp, homo sapien
aattaagggatttgcatcaactccasattctaggccgatagtgagtaacc

SEQ ID NO: 56118 - DNA, 50 bp, homo sapien
tctctcccctggttctcgacagctcyacccaccctttgtgcaataagtct

SEQ ID NO: 56119 - DNA, 50 bp, homo sapien
ttcagcagtaaaaaccagggaattaygaggcccaatatgctcctttactt

SEQ ID NO: 56120 - DNA, 50 bp, homo sapien
tcatagactgaaaatgccaattaaaygaggtgtaggtggctggcttggaa

SEQ ID NO: 56121 - DNA, 50 bp, homo sapien
aagatatttaatgctaataaaagtaygcaaaaatgcaaggtagacataaa

SEQ ID NO: 56122 - DNA, 50 bp, homo sapien
aaagtaatctttatataatgtttcaygtagtaattgaatagcttgtatga

SEQ ID NO: 56123 - DNA, 50 bp, homo sapien
gtataaataaactcataatccatgcraatcatcaaagtgctcattctata

SEQ ID NO: 56124 - DNA, 50 bp, homo sapien
aggaggcataactgtggtttgggaayctcggatcaaggggaagatgacag

SEQ ID NO: 56125 - DNA, 50 bp, homo sapien
gggagagatacattcacatatactcraatctctcgtgtcacaaacagaaa

SEQ ID NO: 56126 - DNA, 50 bp, homo sapien
catagccgtccatggtgtgatcctgkcaagttcacgtactgtcgacccat

SEQ ID NO: 56127 - DNA, 50 bp, homo sapien
ccaaggcaaggggacaagtgataaayaaggacaaataaggaacaaggtca

SEQ ID NO: 56128 - DNA, 50 bp, homo sapien
caaaacattgttacgtggtacatgaygtaatttaaatctgtatgctgctg

SEQ ID NO: 56129 - DNA, 50 bp, homo sapien
gccagtgcatgtctgtttgttgataygtatctaatttagacttagtttaa

SEQ ID NO: 56130 - DNA, 50 bp, homo sapien
ggcattatgagaactggcctccaagkaaccgcctaaacctgtgtttgagg

SEQ ID NO: 56131 - DNA, 50 bp, homo sapien
taaaaaacctaatgtattttttaacrgtgcatttattaccactgtactgc

SEQ ID NO: 56132 - DNA, 50 bp, homo sapien
cctatgtaaaggtaggttcttaaacmaatacaccaattggagtcacaaaa

SEQ ID NO: 56133 - DNA, 50 bp, homo sapien
ctgaaagggctctaagtcatatacaktaaccagtacacaaatggttagcc

SEQ ID NO: 56134 - DNA, 50 bp, homo sapien
gaaagaaaatataatgcagttatacrggtatgaaggagtaggagtctgga

SEQ ID NO: 56135 - DNA, 50 bp, homo sapien
taaaaataggcttgcttttaactgawattcaatttgggagatgttcaatc

SEQ ID NO: 56136 - DNA, 50 bp, homo sapien
ttgagatctggtcatacagtggtgamgaaaatactgggtgatcactaccc

SEQ ID NO: 56137 - DNA, 50 bp, homo sapien
ctatctaactataatacagcactatkatagattaccgacttgtgtttttt

SEQ ID NO: 56138 - DNA, 50 bp, homo sapien
gtctgtctatctatcctatcaccaaycttccctggagtaagatgctctga

SEQ ID NO: 56139 - DNA, 50 bp, homo sapien
ttaggttttccattgctcttaggctraactaaaaaatctgtaatattgcc

SEQ ID NO: 56140 - DNA, 50 bp, homo sapien
caaaaactcttaagatgatcttaagmagcagtataccatagtggttatac

SEQ ID NO: 56141 - DNA, 50 bp, homo sapien
atagagaggacaatcagcaaatatcraaagtgtgaagaatgttccaatta

SEQ ID NO: 56142 - DNA, 50 bp, homo sapien
gagtaggacatttcaagagatagttsaaataatatggtaccttttgttta

SEQ ID NO: 56143 - DNA, 50 bp, homo sapien
ctatgggagtgggaaaatgaatatcygagtacagcaggaaatctcttcca

SEQ ID NO: 56144 - DNA, 50 bp, homo sapien
cctggtgttccttcagggcgttggcyacctttttaatcacaaaatcatgg

SEQ ID NO: 56145 - DNA, 50 bp, homo sapien
gtgattcccaacgcgtatcctgaaastctgataaaacaatgtgcctctgt

SEQ ID NO: 56146 - DNA, 50 bp, homo sapien
tttacatatcactacatctttccccmaactacagagagagattaagtcat

SEQ ID NO: 56147 - DNA, 50 bp, homo sapien
acatggtgctattaagtgaggatcayggatattgacttgttagtgcagcc

SEQ ID NO: 56148 - DNA, 50 bp, homo sapien
aatcattaaatacttgagggcctaaygtatgccaggcactcttctagcta

SEQ ID NO: 56149 - DNA, 50 bp, homo sapien
ccaaggctccattcagaataacaaaygtggaagctatttcatctctgccc

SEQ ID NO: 56150 - DNA, 50 bp, homo sapien
catttacagatcttttaaaacagtayaatcgttattgtgtgtgacatcac

SEQ ID NO: 56151 - DNA, 50 bp, homo sapien
cctcatgttttcaaacctaattaccsgagactggctgagaacttatgggc

SEQ ID NO: 56152 - DNA, 50 bp, homo sapien
gagtaacttgagtagcttgtagagargtataggccatttgtttcatgccc

SEQ ID NO: 56153 - DNA, 50 bp, homo sapien
aaaaaggggtcccctgggtgacatcyacgccagaggtgcagcttgacagt

SEQ ID NO: 56154 - DNA, 50 bp, homo sapien
cctgcaatgcccattagtgtccacawagattttactaaagctcacaaaca

SEQ ID NO: 56155 - DNA, 50 bp, homo sapien
tgtaaaaaaaaattcatcccaaatgrattgtagtcctaaatataaaagca

SEQ ID NO: 56156 - DNA, 50 bp, homo sapien
gcttaggatcaattattcaagccaaygagttccatctaaaaaacgcactt

SEQ ID NO: 56157 - DNA, 50 bp, homo sapien
cagcacctgtaaaggaacagagatgraggtacaaagacgtcgctatctgt

SEQ ID NO: 56158 - DNA, 50 bp, homo sapien
acacataagtatcatttcaccttcamaaagattttatgagaatagattaa

SEQ ID NO: 56159 - DNA, 50 bp, homo sapien
aaaatgtatcttaaatgctcactaartccgcccctgaggcacagtggttg

SEQ ID NO: 56160 - DNA, 50 bp, homo sapien
ggaaagcatctgcaggagaaattacratgaattcgtagtgtcagaggcat

SEQ ID NO: 56161 - DNA, 50 bp, homo sapien
gtacatgactgtgtactcagacatgyattctaaagtatgaataaagttaa

SEQ ID NO: 56162 - DNA, 50 bp, homo sapien
acggtggctgcttctccttttgtccracagcgagatgtgctggtgtctgt

SEQ ID NO: 56163 - DNA, 50 bp, homo sapien
ggtgacttcaagagtaatatctacayggctaatcaagttctgaaatagag

SEQ ID NO: 56164 - DNA, 50 bp, homo sapien
gcctagacagaggggatttatcaacsgaggagaattgcaatagggaaaga

SEQ ID NO: 56165 - DNA, 50 bp, homo sapien
tgaaaaaactcaatgatgcctaaagraagtcattaccaaggagtctttct

SEQ ID NO: 56166 - DNA, 50 bp, homo sapien
attaatatacatcgaatgataacaaytgcatttagtgttttggttgatat

SEQ ID NO: 56167 - DNA, 50 bp, homo sapien
ggttttttgtgttttgcaacagatcygatcctttgaaagaatttaaatct

SEQ ID NO: 56168 - DNA, 50 bp, homo sapien
gatcatcgtttgaacgaacatttgawtatatcacctgaacaaaggcaagg

SEQ ID NO: 56169 - DNA, 50 bp, homo sapien
gtggggtttgggacacacaagtccasgtaactggtcagaaatgtgatagg

SEQ ID NO: 56170 - DNA, 50 bp, homo sapien
agcaagatttaacagaagtttaatawcacaatagactgaagataaatggt

SEQ ID NO: 56171 - DNA, 50 bp, homo sapien
actcaccaaaacaaatcaatactgaygggaaaacaccttagaaatccatt

SEQ ID NO: 56172 - DNA, 50 bp, homo sapien
caacaaaccagggtcttaaattgtaygaccaaatgttcagtaagaagcat

SEQ ID NO: 56173 - DNA, 50 bp, homo sapien
tctgattctcatgcatatttttatgwagatataatagatctggaaagaga

SEQ ID NO: 56174 - DNA, 50 bp, homo sapien
atgtaaagcacatatttgcttatggraccacactttctcctagcagccag

SEQ ID NO: 56175 - DNA, 50 bp, homo sapien
caagcagcatgaaggtggattctcaygcattttaacccaagcagcataat

SEQ ID NO: 56176 - DNA, 50 bp, homo sapien
aggagatactctctcctctcctgaasagaatgaatggccaggcatcttca

SEQ ID NO: 56177 - DNA, 50 bp, homo sapien
ggaaattctgagcaggacttagagaygttagcaaaagcaagtgtgcaagg

SEQ ID NO: 56178 - DNA, 50 bp, homo sapien
tgagatagtggtaagtaaaatgttaratcactgaaacagtgtgtaaagct

SEQ ID NO: 56179 - DNA, 50 bp, homo sapien
ccccagcacttggctgtttgctacaragcgggcttattttcctaacttaa

SEQ ID NO: 56180 - DNA, 50 bp, homo sapien
gcaactgacaactcagggcaatgccrcaagtttctcctgaagcttcatct

SEQ ID NO: 56181 - DNA, 50 bp, homo sapien
gataacagaaaacaaagttcacacaygacaagacataacatggcataaca

SEQ ID NO: 56182 - DNA, 50 bp, homo sapien
gtgcaagacagtgtattgatcaaagsagataacactatagaaggtgacaa

SEQ ID NO: 56183 - DNA, 50 bp, homo sapien
tgagtaataaagcaaaaatggatacrcaaaccagatgtagattagaaagc

SEQ ID NO: 56184 - DNA, 50 bp, homo sapien
ttgagagggaacatccagagcagcaygtttcaacagttaatagtaaggag

SEQ ID NO: 56185 - DNA, 50 bp, homo sapien
cgactactccccgtgtctttccgcamgctgtggtaagaaacgctgcttct

SEQ ID NO: 56186 - DNA, 50 bp, homo sapien
aagtgggtagaggaaacagatcaaaygaactctgcccttcctgcccaagg

SEQ ID NO: 56187 - DNA, 50 bp, homo sapien
taaacaaaactctcagacatgcttayaaaaacttgctcactcagaaatta

SEQ ID NO: 56188 - DNA, 50 bp, homo sapien
acagccatctccttgggggattatckcatttcggtcagggaggcgtgttt

SEQ ID NO: 56189 - DNA, 50 bp, homo sapien
aacatcaaacagacacattagggacrgagccatgttagctttaatggata

SEQ ID NO: 56190 - DNA, 50 bp, homo sapien
cagaaagttaagaggttgagttcacrgcatttctgtctcagcgactccag

SEQ ID NO: 56191 - DNA, 50 bp, homo sapien
cttcacctgcattggcgtctgtcackgagtcttgttaaagcaaaataaat

SEQ ID NO: 56192 - DNA, 50 bp, homo sapien
aggaggtctgatagagtacgatgaawcagaggaagaggatttgcatgtgt

SEQ ID NO: 56193 - DNA, 50 bp, homo sapien
aagagtcatagacctgctttcagtawctggatctccatgagaaaagatcc

SEQ ID NO: 56194 - DNA, 50 bp, homo sapien
aaaataatcctgtgaattcaagaacygattccccataatgaagctttgtg

SEQ ID NO: 56195 - DNA, 50 bp, homo sapien
tgaagtcatttggcctaaataattayatggaagagagtgaaaaagtttat

SEQ ID NO: 56196 - DNA, 50 bp, homo sapien
gcttactatatttacggttactatayactggtatctttctcaaacaactt

SEQ ID NO: 56197 - DNA, 50 bp, homo sapien
agagaacagtaagctgaagtcacaaygcgaataaacacgcttgaagtgta

SEQ ID NO: 56198 - DNA, 50 bp, homo sapien
tgagatctgtctgccagctgttttayggcatgtggcccggacttctgtta

SEQ ID NO: 56199 - DNA, 50 bp, homo sapien
tttaaaacttggccactttttacaamctatccatcaaaaagactttaaag

SEQ ID NO: 56200 - DNA, 50 bp, homo sapien
cccaggccctgcattggaaaaaatcsaaaatgtggcttggttgcaaagag

SEQ ID NO: 56201 - DNA, 50 bp, homo sapien
ggaaaataaccacactttcacagtcrgaatgtagataagcgctgtcttgt

SEQ ID NO: 56202 - DNA, 50 bp, homo sapien
tgagtactctgcataaaatatcaaastaatcacatcattctcttaagtca

SEQ ID NO: 56203 - DNA, 50 bp, homo sapien
ggaacttgagcaagatacagatctaygtgtcaatgacatatccagaaaat

SEQ ID NO: 56204 - DNA, 50 bp, homo sapien
cgcttagaaagtgactaatcactcartatttgtcctgtagatacctgagt

SEQ ID NO: 56205 - DNA, 50 bp, homo sapien
ctaagagagttatttctctacccacmatttagtaggctcatgtgaaatta

SEQ ID NO: 56206 - DNA, 50 bp, homo sapien
cttagttcctagtagctgatttttamatgaatctttgaacaaacagggtt

SEQ ID NO: 56207 - DNA, 50 bp, homo sapien
ctgggaaagctgttctactttttaakagacagaatcctaaaaggatgtct

SEQ ID NO: 56208 - DNA, 50 bp, homo sapien
cactcatgttcatctgcataagcaaragggaaacaagatgaagctttggt

SEQ ID NO: 56209 - DNA, 50 bp, homo sapien
tgcatcttgccttcccagaaaagaaygtcggcgatagcaagaaagggccc

SEQ ID NO: 56210 - DNA, 50 bp, homo sapien
atgggaggtattgactccagcaaaamgattactggtggtccatggaacat

SEQ ID NO: 56211 - DNA, 50 bp, homo sapien
atttttagttatctgtggaaggatcratggcatcatatatctcatccacc

SEQ ID NO: 56212 - DNA, 50 bp, homo sapien
gacatgagctgacagttggacgctawcactattacaaatggaaaaaaaca

SEQ ID NO: 56213 - DNA, 50 bp, homo sapien
ttactgtattaattctctgttaataytatcgagttgcagtggaaaatgct

SEQ ID NO: 56214 - DNA, 50 bp, homo sapien
aaaaggagaatgttaatgaagctaaragtatttataacaattttatcggt

SEQ ID NO: 56215 - DNA, 50 bp, homo sapien
taaacatcaaaccatattcgttgacrgataattgtcttcatagttttata

SEQ ID NO: 56216 - DNA, 50 bp, homo sapien
actgtggatctgtaaacatgccaatraaatgtaaaaactcactctcccat

SEQ ID NO: 56217 - DNA, 50 bp, homo sapien
gttttgagtctgagcaaatgagtgawtagagttaatatataagaaaatag

SEQ ID NO: 56218 - DNA, 50 bp, homo sapien
aattgggtgaagtttactgatggaargggttatttcttacacattgcttc

SEQ ID NO: 56219 - DNA, 50 bp, homo sapien
atgaagaaaatagtctatgttaaaakaccatggccagggaaaatctcagt

SEQ ID NO: 56220 - DNA, 50 bp, homo sapien
ctcctcctcagacactcataagtcgyataatcatccacggaagaagctga

SEQ ID NO: 56221 - DNA, 50 bp, homo sapien
gcggagaaactcagttcagccttctsaaaaggtaaaattgaccaaagctt

SEQ ID NO: 56222 - DNA, 50 bp, homo sapien
gaattactaatagcaatacattagasaagttgaatacgttatatattttt

SEQ ID NO: 56223 - DNA, 50 bp, homo sapien
agactaagaacccatatcctaccatsatgagaaccaaaaatatgggtgac

SEQ ID NO: 56224 - DNA, 50 bp, homo sapien
tgcaataaacttcggtggtaaaacartctaattccattaccatctgaatg

SEQ ID NO: 56225 - DNA, 50 bp, homo sapien
accacttgagcctaaatctgaagaaygtttggcagaataccaagcctaaa

SEQ ID NO: 56226 - DNA, 50 bp, homo sapien
cttaccattttctaccttgtttactsaggagaaataataagcggaatcaa

SEQ ID NO: 56227 - DNA, 50 bp, homo sapien
ctcagtgttctattgtcttcaaccckagttacatcaatgactaagtaaaa

SEQ ID NO: 56228 - DNA, 50 bp, homo sapien
tacaaacaagaaggttaaatcactamgcatttccaatactaataaagaaa

SEQ ID NO: 56229 - DNA, 50 bp, homo sapien
cagtgtggcaggtggatggaagatascagtagccgccttccagaaatctt

SEQ ID NO: 56230 - DNA, 50 bp, homo sapien
agtagtcagtcttatgtcagataaayagtatacctctagctcattattga

SEQ ID NO: 56231 - DNA, 50 bp, homo sapien
gcaacaaaaatctgagttgtattcaytcctgtagtctgttaaaaacatca

SEQ ID NO: 56232 - DNA, 50 bp, homo sapien
tgcagaaaatatacgctaacaatcasgagattcctccctcacaccattgt

SEQ ID NO: 56233 - DNA, 50 bp, homo sapien
cttataaagtacctcagattatcgcycagggaagtgtacctacttccatg

SEQ ID NO: 56234 - DNA, 50 bp, homo sapien
tcttggatggtgtgtgatgggtaacratgatttatcattctacatagttg

SEQ ID NO: 56235 - DNA, 50 bp, homo sapien
gcctcacgtccataatgaccgaaaargtttaaaacatgtctactgtcaag

SEQ ID NO: 56236 - DNA, 50 bp, homo sapien
agttagatttgtgggcaattcaatastactctcaacactcccattctata

SEQ ID NO: 56237 - DNA, 50 bp, homo sapien
aatactactctcaacactcccattckatagttttaatgctggtagatttc

SEQ ID NO: 56238 - DNA, 50 bp, homo sapien
cttctctggtcttgtaaccacacaartgaaatgggaaattgggccaagga

SEQ ID NO: 56239 - DNA, 50 bp, homo sapien
aagtgactattaggaaggaaacttartaaatctgtggcaacatcactagc

SEQ ID NO: 56240 - DNA, 50 bp, homo sapien
attagtgcttcctaaactttattgayacccggagatcctgatttagcagt

SEQ ID NO: 56241 - DNA, 50 bp, homo sapien
agcagttttataaatcatgctaagaktaatggatgttcctttgagaacag

SEQ ID NO: 56242 - DNA, 50 bp, homo sapien
tcaatcctagaccatgttaaatggarctcaaatattagtcctgctggttt

SEQ ID NO: 56243 - DNA, 50 bp, homo sapien
aaatgaaaacagtataactttacacratagagagaacaggagaaatgaaa

SEQ ID NO: 56244 - DNA, 50 bp, homo sapien
aagtttcagtttaagatatataagamgccatgataaacagcagctcacga

SEQ ID NO: 56245 - DNA, 50 bp, homo sapien
gacaatgctcttggtattgagagccraatttagtagaaacctcatgtaca

SEQ ID NO: 56246 - DNA, 50 bp, homo sapien
ccttactttaggtatctggatttcayctgccggttgtaaaagttactgtg

SEQ ID NO: 56247 - DNA, 50 bp, homo sapien
atcttctgagactcgaataattttaycttactgtttatatactgctaact

SEQ ID NO: 56248 - DNA, 50 bp, homo sapien
ggacagcaaggaggaaatctggttayggtacaccaataatcaagaaagac

SEQ ID NO: 56249 - DNA, 50 bp, homo sapien
tgtaatatctgacaaaagttagtgcyatttaatggtttaaaataatttaa

SEQ ID NO: 56250 - DNA, 50 bp, homo sapien
tatcaaagcaggtgatgtttaggaartacccagtggccactgtaaaattc

SEQ ID NO: 56251 - DNA, 50 bp, homo sapien
aagtcacgattttcttgcagtgaaaytcagctttacagtcttctttctgc

SEQ ID NO: 56252 - DNA, 50 bp, homo sapien
acagaagtagataggaaggtatcaasgatcgtggctcatggatttatgtg

SEQ ID NO: 56253 - DNA, 50 bp, homo sapien
atacgagttggagatgttgagagtamaatttcctgatttctttttttttg

SEQ ID NO: 56254 - DNA, 50 bp, homo sapien
ccctgtttcttcagatcttttcctayagaacacacacacacacacacaca

SEQ ID NO: 56255 - DNA, 50 bp, homo sapien
taccatctctcaactagactctctcmacaacgttcctttaaaatttttaa

SEQ ID NO: 56256 - DNA, 50 bp, homo sapien
tgttataatgtgatgcagaaatagayagtcaatacaatggcctaacagga

SEQ ID NO: 56257 - DNA, 50 bp, homo sapien
atgcagcacattatatggtttattawgcaaacagatttgccattttgcta

SEQ ID NO: 56258 - DNA, 50 bp, homo sapien
agatgtgtaaaatgttggaggcagaygttattatctttaaagacagactt

SEQ ID NO: 56259 - DNA, 50 bp, homo sapien
ctcaacttcatcatgggtgtctatcyagtatttctctaatgtttcctttc

SEQ ID NO: 56260 - DNA, 50 bp, homo sapien
caactaaaaataaggtggcctatacyatatcctccttagaggtgattctg

SEQ ID NO: 56261 - DNA, 50 bp, homo sapien
ggatacttgccttgtcaccttgacaycatacatatttggtaaagaaaatt

SEQ ID NO: 56262 - DNA, 50 bp, homo sapien
ggagataattttttaaagtgtaaacwatcgtgatatgacttcacagaata

SEQ ID NO: 56263 - DNA, 50 bp, homo sapien
aggatctctgaaacgtgctaagcgarcagagatttcctttaaaaacatcc

SEQ ID NO: 56264 - DNA, 50 bp, homo sapien
gccagaaactgttccatgcacttcartacattaattcgcatcaccctcac

SEQ ID NO: 56265 - DNA, 50 bp, homo sapien
gaattagagcatattttattcaaaaygtctagggtgagctcaatgcacta

SEQ ID NO: 56266 - DNA, 50 bp, homo sapien
gtgtcaaagattggttcagttgaaamatcattacgttaagagcaaaaggg

SEQ ID NO: 56267 - DNA, 50 bp, homo sapien
cagaaaattaaaaaaatctctccaaygtatgccgcaggttctagttgctt

SEQ ID NO: 56268 - DNA, 50 bp, homo sapien
atgtgtgaaaatatcaaggagcatcracaatgtggtgcaacaccactctt

SEQ ID NO: 56269 - DNA, 50 bp, homo sapien
cccttgagaccaataacatcagcaaygggattagattataaatcaggttg

SEQ ID NO: 56270 - DNA, 50 bp, homo sapien
tagatttcaaattagtggtatatacmggctacttgatatatattttaatg

SEQ ID NO: 56271 - DNA, 50 bp, homo sapien
aagtcaagaaaatatccttatctcaytccatctcaattttattccaaata

SEQ ID NO: 56272 - DNA, 50 bp, homo sapien
catccatcttactctaagtttgcaaytctaaggatatggccatctatatc

SEQ ID NO: 56273 - DNA, 50 bp, homo sapien
cagcattgtataggaaaacaaaagcycggtcatgtcaacatgatcttccc

SEQ ID NO: 56274 - DNA, 50 bp, homo sapien
atcgtctaggcacaaagatttggaayggcatgttaaagagatactttttc

SEQ ID NO: 56275 - DNA, 50 bp, homo sapien
attaagatctacatggttctgttgargagtagacattcctgaaacattga

SEQ ID NO: 56276 - DNA, 50 bp, homo sapien
tagtcagaccacagcaaaatcaattraagtataggaatgaccctaaaact

SEQ ID NO: 56277 - DNA, 50 bp, homo sapien
agacctacttaccctctataataacraactgctctaagactcactgttct

SEQ ID NO: 56278 - DNA, 50 bp, homo sapien
aagtaagaatttactggatagtttamcaagtggacaatatgtggggtgaa

SEQ ID NO: 56279 - DNA, 50 bp, homo sapien
cacatgccataacaagctcacatgcraattgagaagcagccctttcaagt

SEQ ID NO: 56280 - DNA, 50 bp, homo sapien
tggaaagtgtacctaaccttcgaacrctcattcacatggtatatgatcaa

SEQ ID NO: 56281 - DNA, 50 bp, homo sapien
gcgtcacaaaggaactatctcaagcyaccctttaattgtcacacccatcc

SEQ ID NO: 56282 - DNA, 50 bp, homo sapien
caataacttaaatctcacatgaagartctcagcagtataatcaacgtcgt

SEQ ID NO: 56283 - DNA, 50 bp, homo sapien
gctttccaaatccctggaaaattgcygcaaattcatgagctgatcctggt

SEQ ID NO: 56284 - DNA, 50 bp, homo sapien
aatgcaagaagccatcgagagttgaygtaaccatagagcagtggttctca

SEQ ID NO: 56285 - DNA, 50 bp, homo sapien
ttgttacacgagaacaacatattacrgactcaagtgcacagtatgtgaac

SEQ ID NO: 56286 - DNA, 50 bp, homo sapien
ttggctctccctgtcctttgtaaaayctcaatctattaaatgatcatttt

SEQ ID NO: 56287 - DNA, 50 bp, homo sapien
aaatgacaacaagtaggaagtgactyagatgtaagaatgctcactcctag

SEQ ID NO: 56288 - DNA, 50 bp, homo sapien
ctctatctcttcccttctctgctcamtagataatcccaatacagcctttt

SEQ ID NO: 56289 - DNA, 50 bp, homo sapien
tctctgcatgacggttcactctagakccttggtgaagtcagagcagatct

SEQ ID NO: 56290 - DNA, 50 bp, homo sapien
tgcaggtcacttctgccttctgtaaygccttctagaatattctggactcc

SEQ ID NO: 56291 - DNA, 50 bp, homo sapien
gcacaaatcttttacaccaatcttaygagggactgaagaaccaatgcacg

SEQ ID NO: 56292 - DNA, 50 bp, homo sapien
caagcacaactccagtttctaatcasaatgtagcactcagttctacacga

SEQ ID NO: 56293 - DNA, 50 bp, homo sapien
atgttttaaaatattcataccttgarattctttttgagagaaaaaagaaa

SEQ ID NO: 56294 - DNA, 50 bp, homo sapien
gtgaacattttttgaaattcatcaaygtggagtaattccctgtcacatac

SEQ ID NO: 56295 - DNA, 50 bp, homo sapien
ccaaaataaatctacaatagatatamatgcagctttgaaagatctaaata

SEQ ID NO: 56296 - DNA, 50 bp, homo sapien
ttgatatattcagctatattaagaaraatttctgcatggtcaaaaaaaga

SEQ ID NO: 56297 - DNA, 50 bp, homo sapien
taagtcaagctcatggtctaatgaasgaaagtctttatctgcaactgtct

SEQ ID NO: 56298 - DNA, 50 bp, homo sapien
aaccaacaattattattaacaacaaycacgtatcttgttgaaaattatga

SEQ ID NO: 56299 - DNA, 50 bp, homo sapien
aagtgatttatctggatccgtacaarctagaatatctctgtagctctatc

SEQ ID NO: 56300 - DNA, 50 bp, homo sapien
atatctctgtagctctatcttagcartagcacttgtcttgggttgcattc

SEQ ID NO: 56301 - DNA, 50 bp, homo sapien
tcctcttccacttaggctatgaagayaattgtagctaacacacagttgct

SEQ ID NO: 56302 - DNA, 50 bp, homo sapien
aattaggccaaatggaatgggcctartaacttcatctaaaatgaaaatct

SEQ ID NO: 56303 - DNA, 50 bp, homo sapien
gcttttccatactgttgtagtcaacrattcttaatatttctggtagaaaa

SEQ ID NO: 56304 - DNA, 50 bp, homo sapien
ctcacactaagcatttctttctgatmaagggctaattcacaagaagctca

SEQ ID NO: 56305 - DNA, 50 bp, homo sapien
agaatttttggatgtactcacgggasaattgtgcaatgagggcttccatg

SEQ ID NO: 56306 - DNA, 50 bp, homo sapien
taattttgttcatgaattattttgasacaggtaaatcattaaccgagttt

SEQ ID NO: 56307 - DNA, 50 bp, homo sapien
ttttaagtggaccttaggaatgttayaataaagcccagtgctaggacaaa

SEQ ID NO: 56308 - DNA, 50 bp, homo sapien
ccaaagcttgtcttaagtgtgaatakaaaagtggctttctggtttgaatt

SEQ ID NO: 56309 - DNA, 50 bp, homo sapien
ttctgtgaattcttctaacaaatcayctatcctgagagtggtcttgggga

SEQ ID NO: 56310 - DNA, 50 bp, homo sapien
taaaggaaataagataatgctactayaaattttcctggaaaaatataaat

SEQ ID NO: 56311 - DNA, 50 bp, homo sapien
ccagttatatgtctcttaatgctaaracacttattttttgatgtagttac

SEQ ID NO: 56312 - DNA, 50 bp, homo sapien
gcaaactatgggtggttatgaaaccrgagtaggaaaggtctgagagttaa

SEQ ID NO: 56313 - DNA, 50 bp, homo sapien
aagtggatgaataatttatttgcgcycttaaagtccctcagctggtggaa

SEQ ID NO: 56314 - DNA, 50 bp, homo sapien
cccaaatctaagtaatgaaagcctcrccatacatatggaatttactagca

SEQ ID NO: 56315 - DNA, 50 bp, homo sapien
ggagcgatgatgttgtttgaggaagragagtgttttgtgtcaagaatttt

SEQ ID NO: 56316 - DNA, 50 bp, homo sapien
tttaatatatattctgaaagcataasaaagggtggctaattaaaaaatat

SEQ ID NO: 56317 - DNA, 50 bp, homo sapien
tcaccatatagggcaagctgtgaccrcctttctcctttcccagggctaca

SEQ ID NO: 56318 - DNA, 50 bp, homo sapien
gaattgatgaaatatgtagattttarataaagtcaagaatgtgtttagat

SEQ ID NO: 56319 - DNA, 50 bp, homo sapien
ttacagacatgctgtagatggatatractatttaaagcaggagtctgcaa

SEQ ID NO: 56320 - DNA, 50 bp, homo sapien
cctttattgcttaccattgtaacttyaaggaatatatttagatgattttt

SEQ ID NO: 56321 - DNA, 50 bp, homo sapien
caggacaagaaaatgtggcattagartagaaatatctttggaaatgtgaa

SEQ ID NO: 56322 - DNA, 50 bp, homo sapien
attttagcaatttatttggtccataygtggatagaaaatatcaagcacag

SEQ ID NO: 56323 - DNA, 50 bp, homo sapien
cacaatttaaaatctgaaagttaaaratacgtatgttgggaaagggctag

SEQ ID NO: 56324 - DNA, 50 bp, homo sapien
ctattggtgggaatgtaaatgggtamagtcgttataaaaaaacagcatgg

SEQ ID NO: 56325 - DNA, 50 bp, homo sapien
tcctgcatgtttgattaacttaaggkcctaagaataacgtcctgaaaagc

SEQ ID NO: 56326 - DNA, 50 bp, homo sapien
gatttagtgatggaaagagttttagsacggaaatagaatatctataaaaa

SEQ ID NO: 56327 - DNA, 50 bp, homo sapien
aagccaaaagattggatacagctgakctaaagcaacaggttcatctactc

SEQ ID NO: 56328 - DNA, 50 bp, homo sapien
ctttgttgaatatgaagtttccttaycacattgcattcacattatccatc

SEQ ID NO: 56329 - DNA, 50 bp, homo sapien
ataactcacattttagcactgtttcyagttaatgtggtacatgcacatgt

SEQ ID NO: 56330 - DNA, 50 bp, homo sapien
tagatatttatactcttgacttccartatctacagaagaatggttcatag

SEQ ID NO: 56331 - DNA, 50 bp, homo sapien
atccctttacagttaagaccactgargtttagtttcaccaaaatcactca

SEQ ID NO: 56332 - DNA, 50 bp, homo sapien
gacaacgaaactgcttcacctgggtraatttagcggtgaatcaattttag

SEQ ID NO: 56333 - DNA, 50 bp, homo sapien
agagtcagtacaatttgaagctgaascattttaatgacagcatccaaaaa

SEQ ID NO: 56334 - DNA, 50 bp, homo sapien
aatacctctgaagtttcaatgttgayatggcagagccacaagatgaaagc

SEQ ID NO: 56335 - DNA, 50 bp, homo sapien
cttcttcctgaaagcaatttctaaayttcagtgtgaggtaaacatcttta

SEQ ID NO: 56336 - DNA, 50 bp, homo sapien
gctttggatctaatattgactcccaygcctaaatccctttggagaactcc

SEQ ID NO: 56337 - DNA, 50 bp, homo sapien
gctaggacttgccaatgggtatagasgccaccagaaactggtgaactatt

SEQ ID NO: 56338 - DNA, 50 bp, homo sapien
tttgcttttcattttcaactactcaraatggaaattctctcccatcagaa

SEQ ID NO: 56339 - DNA, 50 bp, homo sapien
tctgaaccaaagtggtcatcctgtcrcaatctgtaattttaccccatttt

SEQ ID NO: 56340 - DNA, 50 bp, homo sapien
gagtaatagctttaaaattgataaaycaggtcacgatacctcttccaaca

SEQ ID NO: 56341 - DNA, 50 bp, homo sapien
cttgcctatgtaatatgaaaaataaragcaattataatacaagacaaagt

SEQ ID NO: 56342 - DNA, 50 bp, homo sapien
tgtcaatacaggattaagaagtcacrcctgtttcacggaaagggaatgga

SEQ ID NO: 56343 - DNA, 50 bp, homo sapien
agataaatcatctgctggtatctaasctcagtattattaatacacaccaa

SEQ ID NO: 56344 - DNA, 50 bp, homo sapien
ccaacaagcataacatatttatacaractgaacaaaagactgctttaatt

SEQ ID NO: 56345 - DNA, 50 bp, homo sapien
gaagtcctgtaaagccctagtggaaragttagaaaagtacagtagtcccc

SEQ ID NO: 56346 - DNA, 50 bp, homo sapien
ctctgtatcagtccactaaccctcaratgatgatgtagtggatacagtgg

SEQ ID NO: 56347 - DNA, 50 bp, homo sapien
aaattttgggacagaggaatatccaytaaatgatccttccatgccctgct

SEQ ID NO: 56348 - DNA, 50 bp, homo sapien
tttatatgaagaaaaacttattataycagacttacctatcattctaaatc

SEQ ID NO: 56349 - DNA, 50 bp, homo sapien
ataaacatttgttagttgactgattraaacgctctttttctttggtatag

SEQ ID NO: 56350 - DNA, 50 bp, homo sapien
tattaagtatttaaggtgtacacgaygggtccataattaacaaacagatc

SEQ ID NO: 56351 - DNA, 50 bp, homo sapien
atgtggtctaagtctgtggtgtgaartaacatataatccatgtttctata

SEQ ID NO: 56352 - DNA, 50 bp, homo sapien
gtatcattcccacacatttttatcastacgaatgaatctgcccataaatt

SEQ ID NO: 56353 - DNA, 50 bp, homo sapien
ttaatcagctctagattccacattayggataagacactgttacagagaag

SEQ ID NO: 56354 - DNA, 50 bp, homo sapien
tgtgagcatctattattatttactaygcctacagcctacatgtaatcatg

SEQ ID NO: 56355 - DNA, 50 bp, homo sapien
cttggaactcattgtctccttttcaracacgcagcaagaattgcttcaga

SEQ ID NO: 56356 - DNA, 50 bp, homo sapien
tggcagtatgacttagtagaatttgracagatattaataaaggcataaga

SEQ ID NO: 56357 - DNA, 50 bp, homo sapien
tacttggctgatttatggtgtttcayatgcaatgtaggctttcttcattc

SEQ ID NO: 56358 - DNA, 50 bp, homo sapien
ggcaacccagcccaaataggtagagyctacagcctggtctaatggttaac

SEQ ID NO: 56359 - DNA, 50 bp, homo sapien
aataacactggaatgaatcataatayatacaaaagataacgtgtattcct

SEQ ID NO: 56360 - DNA, 50 bp, homo sapien
gttgaatgagagtaccatgtgtatcygaacttgctaccttttcccaaaag

SEQ ID NO: 56361 - DNA, 50 bp, homo sapien
aaccacatggaggtacaaaaagagcycagtactggtagataccacaaaag

SEQ ID NO: 56362 - DNA, 50 bp, homo sapien
aatgctttaagggttgaggtttaacraagctgcatgacatctgccaattt

SEQ ID NO: 56363 - DNA, 50 bp, homo sapien
acactcacacagctaacttgagatasagagcaatgtgaggcagccatttt

SEQ ID NO: 56364 - DNA, 50 bp, homo sapien
ctccatgttagcaaactctaccctakgtctccaagtgctctctgtcttct

SEQ ID NO: 56365 - DNA, 50 bp, homo sapien
agagaaatcctaccctagtgctggartaccaatttctactccactgtcag

SEQ ID NO: 56366 - DNA, 50 bp, homo sapien
cagttaaattgtgcagtgtcctgtaygtatattacacttcagttaaaagc

SEQ ID NO: 56367 - DNA, 50 bp, homo sapien
tctttatttacctaaaagcctgttgrattaccctttatttcaccatcctg

SEQ ID NO: 56368 - DNA, 50 bp, homo sapien
acaagactggtttagtagataaagckagctctgaacataaagattctagg

SEQ ID NO: 56369 - DNA, 50 bp, homo sapien
ggcttacatcctgagtttcctttatsaagacaagttgttgaaatatgcaa

SEQ ID NO: 56370 - DNA, 50 bp, homo sapien
tatttccagctgtcaaaatctggtayctcatttttgttcaagttgttcaa

SEQ ID NO: 56371 - DNA, 50 bp, homo sapien
aattgctgttgcttaagcacataaaracatagttcacctgtagtggattg

SEQ ID NO: 56372 - DNA, 50 bp, homo sapien
cctcttctcaaatcctcaactgccartaagtcaatataaaaagtaattta

SEQ ID NO: 56373 - DNA, 50 bp, homo sapien
aatctattgcttggaaggtaatataygttctggcccaagtctacgcatgc

SEQ ID NO: 56374 - DNA, 50 bp, homo sapien
atcaaaatgacaggattgggaggtamatgttggctcaggttcttccaggc

SEQ ID NO: 56375 - DNA, 50 bp, homo sapien
tctattgagtctttagcacaattaaytatgtttcattctgttttgttttt

SEQ ID NO: 56376 - DNA, 50 bp, homo sapien
attgaaatctggatacatttgaataragaatttgtgaatcagaaaacagt

SEQ ID NO: 56377 - DNA, 50 bp, homo sapien
cctaaattgatccatctatcaagcaytcggaggagcgaatctcaggaggg

SEQ ID NO: 56378 - DNA, 50 bp, homo sapien
agaaaaatgcatactctatctgacamaactacacacctagaaattgtgct

SEQ ID NO: 56379 - DNA, 50 bp, homo sapien
ctttgtaacacaactgctttacttamaaaaaccagtggtatatgggcaac

SEQ ID NO: 56380 - DNA, 50 bp, homo sapien
aagttttctatcaaccatgaatccargtgttaccagagtttgaagctgaa

SEQ ID NO: 56381 - DNA, 50 bp, homo sapien
cccagacttcatgaaccatgtaaaaytacgaactctttatgtgaatgagc

SEQ ID NO: 56382 - DNA, 50 bp, homo sapien
aatgtaaggaatgtgtaactgtaaargagatgggctctgtggtttagtgt

SEQ ID NO: 56383 - DNA, 50 bp, homo sapien
tatacattttctgatctttctctgakccagttaagagtcattcagccatt

SEQ ID NO: 56384 - DNA, 50 bp, homo sapien
aattcatttcccgtggttgaagatasgaataaaacaaattgcttatatct

SEQ ID NO: 56385 - DNA, 50 bp, homo sapien
atctaattaggtgtgagagtctgtaygtatatatatatattctcagtatt

SEQ ID NO: 56386 - DNA, 50 bp, homo sapien
cgaaatacccacaaaacgtgtaacartgacatcccgtccttatgtttcca

SEQ ID NO: 56387 - DNA, 50 bp, homo sapien
gttttgtgggtatttcgttaatatargtccactctacttctgttttgtag

SEQ ID NO: 56388 - DNA, 50 bp, homo sapien
ccaggcagaaggcagatggctctcayggtcaaggtcatctaagaaccctt

SEQ ID NO: 56389 - DNA, 50 bp, homo sapien
aattcagcctaaactgaagattagargtgaagaggaaatatattcccctc

SEQ ID NO: 56390 - DNA, 50 bp, homo sapien
cctaaaatgttgccacatcatcgggmatgtagctgcatacttagccagag

SEQ ID NO: 56391 - DNA, 50 bp, homo sapien
ccattttatatactcttcaggtgcaygcataaacatatatagtctacaga

SEQ ID NO: 56392 - DNA, 50 bp, homo sapien
ttaacatcattaaataagttcaggaygagcaagtaaatttcctcttcaca

SEQ ID NO: 56393 - DNA, 50 bp, homo sapien
tatttcctagaactcttaatctaaawcaaatattgcaaaatatatcactg

SEQ ID NO: 56394 - DNA, 50 bp, homo sapien
acttactggttagtatatgaaatacraagaggaatcccacatttgctgtt

SEQ ID NO: 56395 - DNA, 50 bp, homo sapien
attgctccctgtccttgtcactcccratactgtttgtgcacgatagacat

SEQ ID NO: 56396 - DNA, 50 bp, homo sapien
tctcattcatgtttagacggaattamagaggagtcaaatagagaacaata

SEQ ID NO: 56397 - DNA, 50 bp, homo sapien
tcattgtgaactctgatgcaggctaygaatagtgactcctctgagagatg

SEQ ID NO: 56398 - DNA, 50 bp, homo sapien
ttaacttccacttactggtcctgaaragagttgccatctttctgagtctt

SEQ ID NO: 56399 - DNA, 50 bp, homo sapien
ggagaccttttactacaacgtttaaygaagtatttggatgacttgaggct

SEQ ID NO: 56400 - DNA, 50 bp, homo sapien
ctttttctaggaaggaattaagcccraatggttgacttcatgcaactaca

SEQ ID NO: 56401 - DNA, 50 bp, homo sapien
tccccacaatctccctggtactagcrgcaatagtattattaaatcggggt

SEQ ID NO: 56402 - DNA, 50 bp, homo sapien
tccaaccatgctgggcttgcttctaycaacctgattttagtacatatagc

SEQ ID NO: 56403 - DNA, 50 bp, homo sapien
atgggcatcctacttgcacccatccrgagtatcagtgacctatatgcact

SEQ ID NO: 56404 - DNA, 50 bp, homo sapien
ctcagctggacttcgtgccattttasaaggatatcaagagttagaggcat

SEQ ID NO: 56405 - DNA, 50 bp, homo sapien
acaagaacatatattcaataatgcargctaagattaattcagcattacca

SEQ ID NO: 56406 - DNA, 50 bp, homo sapien
ttttgcataatctgaggaagtagcayggtataatacaacgaacattcatt

SEQ ID NO: 56407 - DNA, 50 bp, homo sapien
tctgtgatatagcacatacattgtamctcataagagaatcttgactataa

SEQ ID NO: 56408 - DNA, 50 bp, homo sapien
tttttcatgattttggtctatataawggcatacagttaaatagcatttcc

SEQ ID NO: 56409 - DNA, 50 bp, homo sapien
ttcttttaagtatcctagcatctcartgaacaggcattactatttccacc

SEQ ID NO: 56410 - DNA, 50 bp, homo sapien
ggaaaaagcagttctatgcaggactraaatacggttcactgaagtattcc

SEQ ID NO: 56411 - DNA, 50 bp, homo sapien
attatgttagaatctgtggaagtgaratttgcgaatcagtatttttaaaa

SEQ ID NO: 56412 - DNA, 50 bp, homo sapien
aggggtcagatggagagactcaaaayacaatgaagtttgtagtcaaacat

SEQ ID NO: 56413 - DNA, 50 bp, homo sapien
aatctataggctcaacatatacacamccgtttctcaaaacctctgtcctt

SEQ ID NO: 56414 - DNA, 50 bp, homo sapien
ttattagaatttttgctgcattgcayggttgacttcaatttgctaaatgt

SEQ ID NO: 56415 - DNA, 50 bp, homo sapien
aaaggaaagagctttaatggacttgmagtaccacatgggcagggaggcct

SEQ ID NO: 56416 - DNA, 50 bp, homo sapien
tcatttctggcaaattgagtcagcastaacagctaatgacccagatggct

SEQ ID NO: 56417 - DNA, 50 bp, homo sapien
gggattcaaattcagacttttgacaytatcctaaatgaactgataactct

SEQ ID NO: 56418 - DNA, 50 bp, homo sapien
aactactctgactgtagtgacttaayaactgtgcatgtacatgtgtgctt

SEQ ID NO: 56419 - DNA, 50 bp, homo sapien
tgggctactgcaaccttaatgccatratactactgaaggcccatagccaa

SEQ ID NO: 56420 - DNA, 50 bp, homo sapien
agcttcttatctcaataccttcacartcttttccatgtgaccttccagca

SEQ ID NO: 56421 - DNA, 50 bp, homo sapien
cccagaggaaggagaaccttcattcrctactactaatctaatagattttt

SEQ ID NO: 56422 - DNA, 50 bp, homo sapien
gcacatactgaggactcaaacatcartagctgtcattatcatcatgcact

SEQ ID NO: 56423 - DNA, 50 bp, homo sapien
aggttgtaggaagaatttttgaatcygatatctatggtatccttccaatc

SEQ ID NO: 56424 - DNA, 50 bp, homo sapien
cctcaccatttgggagtttttgctasgagagaaaagtggttaatcctcac

SEQ ID NO: 56425 - DNA, 50 bp, homo sapien
aagctggtgtgaattggtgaaagacratgcgcaaatgcactgttatttat

SEQ ID NO: 56426 - DNA, 50 bp, homo sapien
atatattgtaacttctgcttgcgtgyatttaaaatttttctttattcttt

SEQ ID NO: 56427 - DNA, 50 bp, homo sapien
cttttcaggctaaaagaagcatgtamaagtttatgtgcaaagactggcag

SEQ ID NO: 56428 - DNA, 50 bp, homo sapien
tatttaggggattaaattcttttgasaactagtcattatggaaagaagga

SEQ ID NO: 56429 - DNA, 50 bp, homo sapien
agccttacttttagtacagttagaaytgagaatgcaacttgaacaagaga

SEQ ID NO: 56430 - DNA, 50 bp, homo sapien
acaagagagaccctaatgccactgakgactaaaacctttcacttaagctc

SEQ ID NO: 56431 - DNA, 50 bp, homo sapien
gtggcattagggtctctcttgtctcyaatagctctggctggtatctgcag

SEQ ID NO: 56432 - DNA, 50 bp, homo sapien
agaatccttgttctgattaattttamatgcaaatattcatgttaagagat

SEQ ID NO: 56433 - DNA, 50 bp, homo sapien
cgaggacaccctggtcaaacttgctyaataccttcatctctatgaactgt

SEQ ID NO: 56434 - DNA, 50 bp, homo sapien
tacacacttataaaatatgataccamataaagcctaatgatgatggaatc

SEQ ID NO: 56435 - DNA, 50 bp, homo sapien
ttcttcactgatgagatagaaaaagratttgtctggcacaatgtatgacc

SEQ ID NO: 56436 - DNA, 50 bp, homo sapien
ggtagcctcttggcatctgttataayatcagaaagcatgttcctggtttc

SEQ ID NO: 56437 - DNA, 50 bp, homo sapien
tagaaacttcaaaactccacaaatcmaaagtatgtcatgtacggatagaa

SEQ ID NO: 56438 - DNA, 50 bp, homo sapien
gattgaaatatattagagtgcatcaytgatacatgtgtaagcagatatag

SEQ ID NO: 56439 - DNA, 50 bp, homo sapien
gtttttcatactcataaagatttccyatttgaccaccacaaaccctctgc

SEQ ID NO: 56440 - DNA, 50 bp, homo sapien
aagaaaaggctcatgtcttggaatayattgtcttttgaggaataccagca

SEQ ID NO: 56441 - DNA, 50 bp, homo sapien
aatgagttatgtaatgagggaaactmagtattacattaacacctcaaaag

SEQ ID NO: 56442 - DNA, 50 bp, homo sapien
ggctacttaacacttcacactttctraattagacctagagtttcttgctt

SEQ ID NO: 56443 - DNA, 50 bp, homo sapien
aaatgatgcaatgaatactggatacmaattagatgttcagagagtttatc

SEQ ID NO: 56444 - DNA, 50 bp, homo sapien
cactttttcagcaggaattcaaaaamatcttaaacctcagaattatttcc

SEQ ID NO: 56445 - DNA, 50 bp, homo sapien
gcaactgggaaaaaggaaagagggcratgactggatatctttgtgggtca

SEQ ID NO: 56446 - DNA, 50 bp, homo sapien
aactcgtttttgacattaataatcartaatccatacatgatgctgggaaa

SEQ ID NO: 56447 - DNA, 50 bp, homo sapien
ctatttggccatcttggaaccgcccratgcagtttcttcatggtgtcttt

SEQ ID NO: 56448 - DNA, 50 bp, homo sapien
gggcactgagtcctcaccaaggacasagttggccaccaagcttcactggc

SEQ ID NO: 56449 - DNA, 50 bp, homo sapien
tcccatgaagcattgatgattgatcrctgaataggttagaatgatagaca

SEQ ID NO: 56450 - DNA, 50 bp, homo sapien
ctcctgagataagtaggaatgtgaaygtagctctgaaactcaggcttgga

SEQ ID NO: 56451 - DNA, 50 bp, homo sapien
gccagaaaattagcttctttattgaytaccttgtgcagttggagtagaat

SEQ ID NO: 56452 - DNA, 50 bp, homo sapien
tccttttagaagaagataactcttgwcaaaaaattgggtattctcccttc

SEQ ID NO: 56453 - DNA, 50 bp, homo sapien
gttctttctgcttaaaatgtgtcacygcctaaggataaaaatgcaaagac

SEQ ID NO: 56454 - DNA, 50 bp, homo sapien
acctaagattgacactggataccaayggtcactgaaacttaatttctata

SEQ ID NO: 56455 - DNA, 50 bp, homo sapien
tacagactcagataaatcttcatacracagcatgctataatgaaaagaac

SEQ ID NO: 56456 - DNA, 50 bp, homo sapien
tggaccctaaatgatgataccagaaytagattattttcttttttgcccat

SEQ ID NO: 56457 - DNA, 50 bp, homo sapien
atggaagaggaaaacatgggaatcastattaaacctcagaaaaaaggatc

SEQ ID NO: 56458 - DNA, 50 bp, homo sapien
tacctgaagccaggtgggtaaatacygaagaatgttttgcttaaacttac

SEQ ID NO: 56459 - DNA, 50 bp, homo sapien
ggcttaaattgtcaacatagcttctyaaaatatcgaatataccacaaggg

SEQ ID NO: 56460 - DNA, 50 bp, homo sapien
ttacattcccatcagcaatattagaragacccagttcctttgcatccctg

SEQ ID NO: 56461 - DNA, 50 bp, homo sapien
actttgtacttatgaagctgtaaacrattaggtatatctggagtaacatg

SEQ ID NO: 56462 - DNA, 50 bp, homo sapien
ggggtctcctcagtatcatcccttcragtttcaccagaaagatgttatca

SEQ ID NO: 56463 - DNA, 50 bp, homo sapien
gtcatcctgtcaactcactttaaaasatccgctatattgttttacacaat

SEQ ID NO: 56464 - DNA, 50 bp, homo sapien
taaagaactacctaagactgcgtaaygtgtaaaggaaagaagcttaattg

SEQ ID NO: 56465 - DNA, 50 bp, homo sapien
cttctattataacaaatgatacttaygctctcaatacaaactatgctcca

SEQ ID NO: 56466 - DNA, 50 bp, homo sapien
taatgaaaaaaacctgaatgtatacraaagagaagaacaacatatactga

SEQ ID NO: 56467 - DNA, 50 bp, homo sapien
ccaaaatataccactttggcataagsattgttttgatttgaaagcaatta

SEQ ID NO: 56468 - DNA, 50 bp, homo sapien
cttacgggtaagaacaggacaaagaygtatagacctgatccctgctaaca

SEQ ID NO: 56469 - DNA, 50 bp, homo sapien
caggaacttccaagcactctactcaygatggtaatagaaaatctaacaaa

SEQ ID NO: 56470 - DNA, 50 bp, homo sapien
tctttccattaccttactttattgaygaggactctaggatctgtctccca

SEQ ID NO: 56471 - DNA, 50 bp, homo sapien
atgaaagttgttggaactttaaaggkaagtgaacgtgctaaagaaatcag

SEQ ID NO: 56472 - DNA, 50 bp, homo sapien
gtttctcatgtaggtaattttttgartagatcattgttgaattggatatt

SEQ ID NO: 56473 - DNA, 50 bp, homo sapien
cacactttttttttttttccaacacratccattctccaaacaggagccaa

SEQ ID NO: 56474 - DNA, 50 bp, homo sapien
gcagaagatgaagttttgagtaacaygccaaaaagacagaggtgaggctg

SEQ ID NO: 56475 - DNA, 50 bp, homo sapien
ctctgggccatgaattcagaagaccrattctttctaaaaccttcagagag

SEQ ID NO: 56476 - DNA, 50 bp, homo sapien
tggagagaaggtatttcaccactagycactctttcctgaaaacaaaaaga

SEQ ID NO: 56477 - DNA, 50 bp, homo sapien
aatgagaagtcccattgggcacatamagaaagattcttcaaataaaagct

SEQ ID NO: 56478 - DNA, 50 bp, homo sapien
gtgtgttcatttgttatgtaatatawaaggtagagaacccaatttgaagg

SEQ ID NO: 56479 - DNA, 50 bp, homo sapien
actgctcagagatgtatcttttggasaataaatctatctgtttttgtatt

SEQ ID NO: 56480 - DNA, 50 bp, homo sapien
ttaacagaactcctcgtatgccagarctgtttggttaacttgaaatatgc

SEQ ID NO: 56481 - DNA, 50 bp, homo sapien
tgagacagtacgaaagaagattgtayatttgatggaaaatgatgagattt

SEQ ID NO: 56482 - DNA, 32 bp, homo sapien
tccagtttatgactctracgtgtgatttctag

SEQ ID NO: 56483 - DNA, 50 bp, homo sapien
tatacaaattaattgtgagctatgargagaacctaaacataaatattccc

SEQ ID NO: 56484 - DNA, 50 bp, homo sapien
agctgatggtacacagaagtgtcaargttgagagggactgtactaatttg

SEQ ID NO: 56485 - DNA, 50 bp, homo sapien
agtttggaaaagagaagaatcagtargacttggtctcagacatcagattg

SEQ ID NO: 56486 - DNA, 50 bp, homo sapien
ccagaaaaacaaggaaactaccacartggaatatacctactatatgtgcc

SEQ ID NO: 56487 - DNA, 50 bp, homo sapien
cacttagagccaggctcgaatcaatragaggagataatccagataaagaa

SEQ ID NO: 56488 - DNA, 50 bp, homo sapien
agaaattcacagatgagctgaacaamtgtaaatattcatgtggtaacacc

SEQ ID NO: 56489 - DNA, 50 bp, homo sapien
cagtataaggacacttcttctgacaytgggtgaacccttggactacctaa

SEQ ID NO: 56490 - DNA, 50 bp, homo sapien
ataaaaaaaactcatactttcttgarcatactgattattgctcacttttc

SEQ ID NO: 56491 - DNA, 50 bp, homo sapien
tttgtgaagatgatttgattatagcygatctatttcttggcattgtgtgt

SEQ ID NO: 56492 - DNA, 50 bp, homo sapien
tttagaaagagggtagagatagtgaytaaatgtcgactttatgctgtaat

SEQ ID NO: 56493 - DNA, 50 bp, homo sapien
taatgctagaaaatctaaaaattcarcttgagacctagtgaacctgaact

SEQ ID NO: 56494 - DNA, 50 bp, homo sapien
gctttactgcgtactgattgagaacygttccttttatcattctttgattg

SEQ ID NO: 56495 - DNA, 50 bp, homo sapien
agttccttactctgataattacctaygtgtacaataatatcactgaattg

SEQ ID NO: 56496 - DNA, 50 bp, homo sapien
ttatggattgaaaagattctcatatwatactaacagccccttctagttct

SEQ ID NO: 56497 - DNA, 50 bp, homo sapien
atactgttctttatttgtattgaaayaataaatcttcagctgacttgctt

SEQ ID NO: 56498 - DNA, 50 bp, homo sapien
tgaaagtcacatgtcatcaaccgaarcccaaggtgttagaacatctgggc

SEQ ID NO: 56499 - DNA, 50 bp, homo sapien
acgctgtcaattagggctatgactaygatcagaacccacaattacacacc

SEQ ID NO: 56500 - DNA, 50 bp, homo sapien
tgaaatttaccttctttgcctgatayggtaacacataaagcttcagcaat

SEQ ID NO: 56501 - DNA, 50 bp, homo sapien
gaagaaaatcaaggtataaaaataayaactttggatgagaaggaacatgg

SEQ ID NO: 56502 - DNA, 50 bp, homo sapien
tgactttaaaatcaacacataattarcggtcacatattttgttcattata

SEQ ID NO: 56503 - DNA, 50 bp, homo sapien
agccactattaaaagtgctagacgarcaaccacaaagtgcacttgcacca

SEQ ID NO: 56504 - DNA, 50 bp, homo sapien
caagggctgcctgatataccaagaaygatggagtcaattgagcaaggtgt

SEQ ID NO: 56505 - DNA, 50 bp, homo sapien
agctctaaagcactctctttcacaawaggatgatatacggccttggcatc

SEQ ID NO: 56506 - DNA, 50 bp, homo sapien
tttttctttgtgaaacgagttgaaamtactttcgcataatgtttcatttt

SEQ ID NO: 56507 - DNA, 50 bp, homo sapien
gtccgggtctgaccttgaaaacccaratagtgtgagagccaagcagacca

SEQ ID NO: 56508 - DNA, 50 bp, homo sapien
ctaatttgcttccatggttcacaaaytgatgaaattccagtcatacagag

SEQ ID NO: 56509 - DNA, 50 bp, homo sapien
ccaaggatcggcctttctctgaccayggtaaatagccaaagaaaagtcaa

SEQ ID NO: 56510 - DNA, 50 bp, homo sapien
atgaatctatggagatcctagagaasataaaacctgtgcttggcaaatgt

SEQ ID NO: 56511 - DNA, 50 bp, homo sapien
taccaaatggatacagtattacaatkattatgaaaacctatcccaaaatt

SEQ ID NO: 56512 - DNA, 50 bp, homo sapien
ccagactcaggtaagtatgtccacaratatttctactggtgaaacatttc

SEQ ID NO: 56513 - DNA, 50 bp, homo sapien
tctgaacaagtttcaaaagaattacrgattcctaagtcagcattgctcat

SEQ ID NO: 56514 - DNA, 50 bp, homo sapien
cttttgcaggtgaatctcatcctgaytaatttcgcacaaaatgctcagct

SEQ ID NO: 56515 - DNA, 50 bp, homo sapien
aggcacttgacagggacagatgaacragaatggagagctttgaaaagggt

SEQ ID NO: 56516 - DNA, 50 bp, homo sapien
aatacaatagggaaagggaccgacaytcttggcattactatcttgttaac

SEQ ID NO: 56517 - DNA, 50 bp, homo sapien
atcattttttcctgaccgcatctcayagctactgggtggaagcttcttgc

SEQ ID NO: 56518 - DNA, 50 bp, homo sapien
gattttgaaggtaagagatggcactkaataattttactcggacatgagaa

SEQ ID NO: 56519 - DNA, 50 bp, homo sapien
cctttctaattccagacacagaaaaytcctccaggtcctctgaacttaac

SEQ ID NO: 56520 - DNA, 50 bp, homo sapien
cttttccactctggatgttttcttcwacgcagaggattgttctttaacat

SEQ ID NO: 56521 - DNA, 50 bp, homo sapien
tacataaaatgatgtggtcagctaaratatattggacaaacaaaaccccc

SEQ ID NO: 56522 - DNA, 50 bp, homo sapien
agatgttgggtatacatacatactgyaattgccatcaggttcaccttgcc

SEQ ID NO: 56523 - DNA, 50 bp, homo sapien
atttgtgactttctttcaaggaaaaygggttgagtcaaatgaacagatcc

SEQ ID NO: 56524 - DNA, 50 bp, homo sapien
aggtaagtcaatgcccagtactcacrcccttatataatgccttggcacac

SEQ ID NO: 56525 - DNA, 50 bp, homo sapien
tgggaaacctctataaaaccttcgtraagcaggattttcccctaagtgat

SEQ ID NO: 56526 - DNA, 50 bp, homo sapien
ttatagcttactctcctacccttgaratgactttatatcttcatttttat

SEQ ID NO: 56527 - DNA, 50 bp, homo sapien
aatcaaagccagcatgctctacccartcaagccctaggaaacatcagcag

SEQ ID NO: 56528 - DNA, 50 bp, homo sapien
gtgggagatcagataagcaagtatcragagattgaaatttaatgattaca

SEQ ID NO: 56529 - DNA, 50 bp, homo sapien
ggaatttccttgaattatttgtggartatcacacagaaaatactgtaacc

SEQ ID NO: 56530 - DNA, 50 bp, homo sapien
taaaacctaaaacaggtgaagttcckattaaccatgacaccaagagtttt

SEQ ID NO: 56531 - DNA, 50 bp, homo sapien
ggcggatagaaatcatctgaaatgcrctaatggaatatagaatggagtag

SEQ ID NO: 56532 - DNA, 50 bp, homo sapien
tctgtctatgcgggagctctggaatyatctctggaaaacaactgggcaca

SEQ ID NO: 56533 - DNA, 50 bp, homo sapien
tttcatttaaaaagcaaggtaatttkaaaacacataacatagattgatgc

SEQ ID NO: 56534 - DNA, 50 bp, homo sapien
aaagaggaaagaagacacatatgtayggatagaatctacacacagagatc

SEQ ID NO: 56535 - DNA, 50 bp, homo sapien
aacttcctacttgacttggactaacrcttccaatgtgagggtctgttttc

SEQ ID NO: 56536 - DNA, 50 bp, homo sapien
atgaccagagaaaagatggtagacaracctaggaacaccataaacatgga

SEQ ID NO: 56537 - DNA, 50 bp, homo sapien
acgtttctatagtaggttttgttgayctcctatctctcaaattctgatgt

SEQ ID NO: 56538 - DNA, 50 bp, homo sapien
cattcacattatgttcaataagcacyagtttaaaatttcaatagcgatga

SEQ ID NO: 56539 - DNA, 50 bp, homo sapien
atactgaggaggaccatcttgaaagscttagtgttcaacaacaggcccca

SEQ ID NO: 56540 - DNA, 50 bp, homo sapien
gaaaataggtgctctgatggagggtsaattaacatgtgatacaaacacag

SEQ ID NO: 56541 - DNA, 50 bp, homo sapien
tatccatgtttatcactgttaccacygacatttcaaataatccaatctga

SEQ ID NO: 56542 - DNA, 50 bp, homo sapien
tgtcctgttccacccttcaggcagaraattctgagagtcgtttacatggc

SEQ ID NO: 56543 - DNA, 50 bp, homo sapien
tgtattgactactcaaaaacatttargtgtcttcctgtgtcagatgggaa

SEQ ID NO: 56544 - DNA, 50 bp, homo sapien
cctcagggaaattattaaaccactawaactgtatgcaacattttgtgaat

SEQ ID NO: 56545 - DNA, 50 bp, homo sapien
tacttttgtgggatgttagtccttcratgtttatgtgagcaaactaatta

SEQ ID NO: 56546 - DNA, 50 bp, homo sapien
gggaatgcttctatcagtaactcaaracctgaacattaataggatttgtt

SEQ ID NO: 56547 - DNA, 50 bp, homo sapien
aacatataatgtatggtatttattaycacaaaatttctagaaataaaata

SEQ ID NO: 56548 - DNA, 50 bp, homo sapien
atgtgctatatatagtgaaatgaaayaagtcttcttgcaggaacacaagc

SEQ ID NO: 56549 - DNA, 50 bp, homo sapien
aaatggttgctgattatggatgtacsattttgatttggggaactttcaca

SEQ ID NO: 56550 - DNA, 50 bp, homo sapien
aaaaataacagaacctaagtgatgamtaaaagaggccactgtgcaaatca

SEQ ID NO: 56551 - DNA, 50 bp, homo sapien
gaaactgagccacacatatagaacaratgcttaatatggatacattgtga

SEQ ID NO: 56552 - DNA, 50 bp, homo sapien
tcccttcatgactggtcaaaattccygactgcaatgtcctggatggtcct

SEQ ID NO: 56553 - DNA, 50 bp, homo sapien
gaatcaaaagtataagtcaaatgggscatcattctgaaggggtacagtca

SEQ ID NO: 56554 - DNA, 50 bp, homo sapien
aatgaaaacatttagaagagtaggasagcatagatacagtaaaagtgatc

SEQ ID NO: 56555 - DNA, 50 bp, homo sapien
tctggttcctaggtaaacatttcagwaaaagctacttcactccacaatgt

SEQ ID NO: 56556 - DNA, 50 bp, homo sapien
tccaatggtggtcatcccctgggtayagatttgatgtcaccgtcttttat

SEQ ID NO: 56557 - DNA, 50 bp, homo sapien
gcaaacacatatgcacacgcactaargcacccaaatgagttggagcggac

SEQ ID NO: 56558 - DNA, 50 bp, homo sapien
cctcccccaaccttctgcatccaacrcatccaagtgagaacagtccagag

SEQ ID NO: 56559 - DNA, 50 bp, homo sapien
gtgccacacaaagacgctcttgcccragtgtccagggtcttaatgaacac

SEQ ID NO: 56560 - DNA, 50 bp, homo sapien
acctaaggtgtggtgactactagaawgacaaatgccgcctacaccttact

SEQ ID NO: 56561 - DNA, 50 bp, homo sapien
aatgtcactctgaaattcaccagtcrctttattcgtcctgctgaagcttc

SEQ ID NO: 56562 - DNA, 50 bp, homo sapien
ctaaacagtagcacagaatgtcctawgaatttccctcaaaacaattcata

SEQ ID NO: 56563 - DNA, 50 bp, homo sapien
catctgaaagagaccatgaggcctasataatttaaaactcattatgtcct

SEQ ID NO: 56564 - DNA, 50 bp, homo sapien
ctttaaatccaattcataacctcaayggaaaacttatttgcaccagcatt

SEQ ID NO: 56565 - DNA, 50 bp, homo sapien
ccatagcctcttcaccattatactaygtcttagactgccaaattgaagat

SEQ ID NO: 56566 - DNA, 50 bp, homo sapien
actaaggttaccacatacaagaatayaccctttccaacaatgactaaagc

SEQ ID NO: 56567 - DNA, 50 bp, homo sapien
taggtgacatgagcctatatatagaraatgccaaataatccacaaaaaaa

SEQ ID NO: 56568 - DNA, 50 bp, homo sapien
ataaatttaaccaaggaggtgcaagragtgtacactgaaaactacaaaat

SEQ ID NO: 56569 - DNA, 50 bp, homo sapien
actttcatattcaagatgaagtatargttagtaggaaaagtgctgtaata

SEQ ID NO: 56570 - DNA, 50 bp, homo sapien
ggcctcttttttttcatctaaagacwctcataagaccttacatgtagagt

SEQ ID NO: 56571 - DNA, 50 bp, homo sapien
gagagatagagacaaaatagaggtarattggccacttctttttctctggg

SEQ ID NO: 56572 - DNA, 50 bp, homo sapien
ctttaacttttcctgtagttggctasggcccgtctgtgagctgggatgtg

SEQ ID NO: 56573 - DNA, 50 bp, homo sapien
tttcctcagagcaaggcactagcgcygagtggagacatgtacctaaaatt

SEQ ID NO: 56574 - DNA, 50 bp, homo sapien
tactagatttataaatagaataataygatttgtaggttgaacttaaaagc

SEQ ID NO: 56575 - DNA, 50 bp, homo sapien
ctagttgggaattattgtctgggtamcttctatataaataagctgagttt

SEQ ID NO: 56576 - DNA, 50 bp, homo sapien
tgcatgtaattgtattttggacttawatagaatgtaatccgtttgataat

SEQ ID NO: 56577 - DNA, 50 bp, homo sapien
gaaccaagaacctacattgggtaaargacgccctcttcactaaatagtat

SEQ ID NO: 56578 - DNA, 50 bp, homo sapien
actaagactcacttgtaaacataacrcaaccaaagtttcttgttttaaaa

SEQ ID NO: 56579 - DNA, 50 bp, homo sapien
attggaagcaaagagaaacttttccrcctatacttgtctttggactgttc

SEQ ID NO: 56580 - DNA, 50 bp, homo sapien
accaacatggaccactcagctataakgtgtcaaggaggagtggtgcctct

SEQ ID NO: 56581 - DNA, 50 bp, homo sapien
ttgttgtttatttctgagtgttctayatccaaatggattgcagagtatta

SEQ ID NO: 56582 - DNA, 50 bp, homo sapien
tggaaattatctagaacatgactgcsctacttaaacatttgcactcttct

SEQ ID NO: 56583 - DNA, 50 bp, homo sapien
cataagtactcttttgattgttgtcyatgaactacttgggaagcttctgt

SEQ ID NO: 56584 - DNA, 50 bp, homo sapien
caatgccaaatactcctacaaaccargggtaacatctctaccattgtctt

SEQ ID NO: 56585 - DNA, 50 bp, homo sapien
atttctgttgcaaactgaggactacmatatgtgcacagaaaggacggtgc

SEQ ID NO: 56586 - DNA, 50 bp, homo sapien
cccacaatttgagaaatattatttcractaaagtaggagatgaaatcatt

SEQ ID NO: 56587 - DNA, 50 bp, homo sapien
ccattgcatcaaggtaatttcccacracagatggattgtattaatgatct

SEQ ID NO: 56588 - DNA, 50 bp, homo sapien
agggtgtgaagtctcttaactcactragggtctatgttccaaagctgaga

SEQ ID NO: 56589 - DNA, 50 bp, homo sapien
tgccttctataatagaaagactggawggaactttaatcttcccaacaaga

SEQ ID NO: 56590 - DNA, 50 bp, homo sapien
atctgttttcttctgaggagtatcartagcataaatgtgattaggaacaa

SEQ ID NO: 56591 - DNA, 50 bp, homo sapien
tacggtatcttactcaagttgtatayggtagaatatagaagagagatttc

SEQ ID NO: 56592 - DNA, 50 bp, homo sapien
taaagaggtaaaaaaacaccctagaycgtgcagaagatgtacaagacctc

SEQ ID NO: 56593 - DNA, 50 bp, homo sapien
tttatttttactgccaggccttaatsagtcagtaatggatatgtcatttt

SEQ ID NO: 56594 - DNA, 50 bp, homo sapien
taaacatgtggaatataccaaagaaracgactccaaaaggacagacaagg

SEQ ID NO: 56595 - DNA, 50 bp, homo sapien
tgattttaattctgtaactatatgcrgaatgtatgggtgggtgcatgcat

SEQ ID NO: 56596 - DNA, 50 bp, homo sapien
tatactctaaacttaatttgtaccaytccacaaactataactttgcattg

SEQ ID NO: 56597 - DNA, 50 bp, homo sapien
aaataggtgattaccaggctggcacragtatagtaaaattgcaagaatcc

SEQ ID NO: 56598 - DNA, 50 bp, homo sapien
ggtgtgtggctaaaggagtcaatgcrctgagaagtcgcacagatgctgca

SEQ ID NO: 56599 - DNA, 50 bp, homo sapien
cctgatttctgtcagcgatggctaasgctaaacaatccaccaggccatgg

SEQ ID NO: 56600 - DNA, 50 bp, homo sapien
aacacagacataacaagatcatactkaggttttaataagttcgctttggc

SEQ ID NO: 56601 - DNA, 50 bp, homo sapien
tgagcttgttgaattactccatacakaggctgttgaaaaggctccagtgt

SEQ ID NO: 56602 - DNA, 50 bp, homo sapien
agagagatgtgtaaaatcagttgctwaattgggcaggtcaaatgctaagc

SEQ ID NO: 56603 - DNA, 50 bp, homo sapien
acctttaagtgcgaacacttcatagraaatagattcacctggtatcaact

SEQ ID NO: 56604 - DNA, 50 bp, homo sapien
agtcataaagacagacattaatgaawtaatcacacacataattatcagtt

SEQ ID NO: 56605 - DNA, 50 bp, homo sapien
gctggaaaatgatacatatcataaakagctactttttgctaggatataag

SEQ ID NO: 56606 - DNA, 50 bp, homo sapien
aagataagagcatgaatgtacagtcyatcgaaatctgagtagaagccaaa

SEQ ID NO: 56607 - DNA, 50 bp, homo sapien
attatttttacccatgtaaataataygtcttttagccaaagtcggtttgt

SEQ ID NO: 56608 - DNA, 50 bp, homo sapien
tggcctccagaaccgtgagagaataratagctgctgttttatgtaaccca

SEQ ID NO: 56609 - DNA, 50 bp, homo sapien
atggaccctctaaagttcatctaacrctcagattctcgacattctctgac

SEQ ID NO: 56610 - DNA, 50 bp, homo sapien
taaacctaggaggtgaatgagaaccratataaatgttaatctgttttgaa

SEQ ID NO: 56611 - DNA, 50 bp, homo sapien
acatactcatgagatcgtctgagatsaacattaaagaaaaaaatcttaaa

SEQ ID NO: 56612 - DNA, 50 bp, homo sapien
tgtaatgacacttagaattcagggakgttctatattagtaaagttgaaaa

SEQ ID NO: 56613 - DNA, 50 bp, homo sapien
taaatcattgaataaacgaatcatgraattaatatgtaaattgtgtgttt

SEQ ID NO: 56614 - DNA, 50 bp, homo sapien
caaaataagttgaccaatgattatcraccaccagctccattttctactct

SEQ ID NO: 56615 - DNA, 50 bp, homo sapien
acacagtatccaaaaacttaaaacaygatggattaaaagagcaatctaaa

SEQ ID NO: 56616 - DNA, 50 bp, homo sapien
gtgaaatggccaggtttgtactcaaytgtgttatggtggagcctgtcaaa

SEQ ID NO: 56617 - DNA, 50 bp, homo sapien
tttaatactcctggatattaaatacwccttcatatgtttggggaatacag

SEQ ID NO: 56618 - DNA, 50 bp, homo sapien
tcgtacagcaaaaacctgaccttcaygcttctagttctggacaagatgga

SEQ ID NO: 56619 - DNA, 50 bp, homo sapien
aaagaagaaagtatgtaggaacaaawttaagagaagaagcgcaaatcttg

SEQ ID NO: 56620 - DNA, 50 bp, homo sapien
atgttttccctcaaccaccattgaaygtctaagaaaatattgtagaacaa

SEQ ID NO: 56621 - DNA, 50 bp, homo sapien
tttaaaaatcttggccaattctagaygtccccatataagtatctcattgt

SEQ ID NO: 56622 - DNA, 50 bp, homo sapien
gtgttggactccatttctcttcaatkatctccagaatattttccttctat

SEQ ID NO: 56623 - DNA, 50 bp, homo sapien
gaagaaaggttcgtatcctctattayatggttgtgcttagcatcattggc

SEQ ID NO: 56624 - DNA, 50 bp, homo sapien
gtctaacccaggtctgaacttgaackatcattatcctgtttcaatcccct

SEQ ID NO: 56625 - DNA, 50 bp, homo sapien
taagtacaccatgctatgataaagaygcattgtttaattcttagagaaac

SEQ ID NO: 56626 - DNA, 50 bp, homo sapien
tttcaattatctatgaatactttaargacaactgtaattcattgcctcca

SEQ ID NO: 56627 - DNA, 50 bp, homo sapien
gcaaacatcccttttacaggtagtarggccgtgaaatggtaaacaggttt

SEQ ID NO: 56628 - DNA, 50 bp, homo sapien
tccctaaacaagagtcttaatagcasatgttactacatatggcttccctc

SEQ ID NO: 56629 - DNA, 50 bp, homo sapien
atgctctaagttcatacataccataygatattagcttaaaatttcttact

SEQ ID NO: 56630 - DNA, 50 bp, homo sapien
cctgaaagtgacggggagaatggtcractgaacaaagttggaacaactcc

SEQ ID NO: 56631 - DNA, 50 bp, homo sapien
atccaacagacctggtgctctagtgycaagttatacatgggacagttgct

SEQ ID NO: 56632 - DNA, 50 bp, homo sapien
atccccaataccaagcatatgtcccractcacgataaaggttcaacaata

SEQ ID NO: 56633 - DNA, 50 bp, homo sapien
ggattggtgcaattttaaattatcastatgatttgctatttccatttgag

SEQ ID NO: 56634 - DNA, 50 bp, homo sapien
taatcaactctgattactttgaggakctaaggttttggatacattatgga

SEQ ID NO: 56635 - DNA, 50 bp, homo sapien
tcaacaacaacaacaaaaagaagccrcggtgctagtccatgaacactgag

SEQ ID NO: 56636 - DNA, 50 bp, homo sapien
tgctaatagagtctcctgggatttayatcaatagtaatcaccaaatgtga

SEQ ID NO: 56637 - DNA, 50 bp, homo sapien
aatggatagtgtaaagatttccttcrcatgtcatgatgtcaagattttcc

SEQ ID NO: 56638 - DNA, 50 bp, homo sapien
aataatgactaacttgatacaattgsataagatgatttaaaatgtttata

SEQ ID NO: 56639 - DNA, 50 bp, homo sapien
tgagataagaagttacataatgagawactctgagttaatcttttatgttt

SEQ ID NO: 56640 - DNA, 50 bp, homo sapien
atacctctcccagttcctactaaaaygctaatagaaaaacaaactaatgg

SEQ ID NO: 56641 - DNA, 50 bp, homo sapien
aaccattttcttaagattgcatgccrgaagtaaatttggccattataact

SEQ ID NO: 56642 - DNA, 50 bp, homo sapien
aacaacatctattaaaaaaaaaagamcaatggatctaatctggtgacaat

SEQ ID NO: 56643 - DNA, 50 bp, homo sapien
tacctgcattagtctgttctttcacygctatagagaactacctgagactg

SEQ ID NO: 56644 - DNA, 50 bp, homo sapien
ttgaacaaaaagaggtcaagtaatamagttgtgtttataactcaaaaatt

SEQ ID NO: 56645 - DNA, 50 bp, homo sapien
cttcagtcattttcctggatccaccyatttattcagaggcccaaacagca

SEQ ID NO: 56646 - DNA, 50 bp, homo sapien
tgtctcagatattttgggttcacaamgtatattcatatattgcatcaagc

SEQ ID NO: 56647 - DNA, 50 bp, homo sapien
ttgctcttgtgtccaacttaattcartacttaccactagtccttctctca

SEQ ID NO: 56648 - DNA, 50 bp, homo sapien
ttcattgtctgtggatatgaataatyagaatgcgtaataactattgaggt

SEQ ID NO: 56649 - DNA, 50 bp, homo sapien
acagatggtattcaaatggaagtaaygcttcatagtgagatgagtcatca

SEQ ID NO: 56650 - DNA, 50 bp, homo sapien
atgacttacacaagtcatatgaatawcatttatatccacttgataggaaa

SEQ ID NO: 56651 - DNA, 50 bp, homo sapien
aaatcatagactacttttgccctaarcaatcacttttaaagaatatgttt

SEQ ID NO: 56652 - DNA, 50 bp, homo sapien
attgaaaaaagaattatcacaatgtracatgatgcacctattctgcaatt

SEQ ID NO: 56653 - DNA, 50 bp, homo sapien
aaatctataacacagtgtcggcatartaaattcagctcagtgaatgctta

SEQ ID NO: 56654 - DNA, 50 bp, homo sapien
tatcagtgttttgatgaagtagacaytgaggatcagataaaagaaatgat

SEQ ID NO: 56655 - DNA, 50 bp, homo sapien
atgattgaacttctggtacccttaayggccagctaaaagataatgcctct

SEQ ID NO: 56656 - DNA, 50 bp, homo sapien
atatgccttattcaaagctgtgagayattattactaaggaattcaccaca

SEQ ID NO: 56657 - DNA, 50 bp, homo sapien
ccttgtattgtgtgttaaaaagttargacatcatcctgatcatatttttt

SEQ ID NO: 56658 - DNA, 50 bp, homo sapien
gaaaattgattctgagtggcataaargctatgtaaagatggaatgcttgg

SEQ ID NO: 56659 - DNA, 50 bp, homo sapien
cagaaatcaattcacaaatataagaytcaactgatctttaacaggatacc

SEQ ID NO: 56660 - DNA, 50 bp, homo sapien
attatctgaccttacttgtatgaaaygcagaaagttaaaacaacattttc

SEQ ID NO: 56661 - DNA, 50 bp, homo sapien
ccttagtgtttgtgtaggtatatacycattatgtgtgtgtacatatatat

SEQ ID NO: 56662 - DNA, 50 bp, homo sapien
agaaggagacacatgcggtaggttaraatcagagaagccgtggtgtgtag

SEQ ID NO: 56663 - DNA, 50 bp, homo sapien
aatagattcgggcgtgtgtttagtgmataacaagttttgttttttgacat

SEQ ID NO: 56664 - DNA, 50 bp, homo sapien
tttatgtatttcttataatctgaagsctgctatatcttgttctcttctct

SEQ ID NO: 56665 - DNA, 50 bp, homo sapien
atggggaggtatagaaataaaagtayagaagttttgtatgtgatcaaatt

SEQ ID NO: 56666 - DNA, 50 bp, homo sapien
attctgaatttgactatatacttacycttaccaatgagttgtagacagtc

SEQ ID NO: 56667 - DNA, 50 bp, homo sapien
ggcctataaaatacttagacaatcayacaatagtaatagtagactccaga

SEQ ID NO: 56668 - DNA, 50 bp, homo sapien
ttttaaactgattttaaggatataaratgagacacaaaaggcagaatata

SEQ ID NO: 56669 - DNA, 50 bp, homo sapien
tgccatctttactactgcccacttcyaggttcgcatcaagtttcttaccg

SEQ ID NO: 56670 - DNA, 50 bp, homo sapien
acagtattaccctaatacacatatasgagggaaaaaaatcatacataaat

SEQ ID NO: 56671 - DNA, 50 bp, homo sapien
aatgcatattttctattggcataaaktagagtgtggtcaaaaatcagact

SEQ ID NO: 56672 - DNA, 50 bp, homo sapien
tatgatgtcacagaaaattaattgargtacattgcctagaaactgaaaaa

SEQ ID NO: 56673 - DNA, 50 bp, homo sapien
gaaagtgggaaacatgctgtatttawcttggaatagagagggaaattata

SEQ ID NO: 56674 - DNA, 50 bp, homo sapien
attttgattttaattgtttaattcaygaactactcagatcttttattcgg

SEQ ID NO: 56675 - DNA, 50 bp, homo sapien
ggagcagggtctgggcaactgtgtcyataggatcctagagaagggaggac

SEQ ID NO: 56676 - DNA, 50 bp, homo sapien
agtggtagcaatgatatttttaaacsagtggatgtcaatattgtgggtct

SEQ ID NO: 56677 - DNA, 50 bp, homo sapien
attttcaagtctgtagtcacataccrctttcatataatcctcaaagttat

SEQ ID NO: 56678 - DNA, 50 bp, homo sapien
aaccagatccccagaaaggattgaamgtagtattctttagagtttttaag

SEQ ID NO: 56679 - DNA, 50 bp, homo sapien
ttgagacctgtcttagagacttttasgttcatagaaataactaaattaga

SEQ ID NO: 56680 - DNA, 50 bp, homo sapien
acttttttaaaactttattcacttaygaaggagacaatacctaaaggtct

SEQ ID NO: 56681 - DNA, 50 bp, homo sapien
cattattctccttaaccttcataagyctattagaaacaatgagagatggc

SEQ ID NO: 56682 - DNA, 50 bp, homo sapien
aaaagtcacttcatttaggctttccratttggtttctccattttgtctat

SEQ ID NO: 56683 - DNA, 50 bp, homo sapien
tcccctgtgatgatgaaaataatagwattgaaactctgtaataataaatt

SEQ ID NO: 56684 - DNA, 50 bp, homo sapien
aaacaaccaagtatctgttctcttcragaggctgacctaacacataaaaa

SEQ ID NO: 56685 - DNA, 50 bp, homo sapien
agggaagacgaaaatgatcctggagkagtataaccaccagcccgcccctg

SEQ ID NO: 56686 - DNA, 50 bp, homo sapien
tacccataatgtcctcttagctctayctaattgcaaaccatggaccaatg

SEQ ID NO: 56687 - DNA, 50 bp, homo sapien
actttttctactattttaacagcaayggcaagattgtagctgggatacat

SEQ ID NO: 56688 - DNA, 50 bp, homo sapien
aaataatctcatgaaataaatcgcarccattatataagtagaacagtaca

SEQ ID NO: 56689 - DNA, 50 bp, homo sapien
ctctttttttagagacctcagcctasagaagttaaacttaatggccagac

SEQ ID NO: 56690 - DNA, 50 bp, homo sapien
tagagtgatatgcttgagtagtttaygttacatgggctagagtgcacaag

SEQ ID NO: 56691 - DNA, 50 bp, homo sapien
atcgacacagtgttgacattagggartatcagaacactctgaataacatg

SEQ ID NO: 56692 - DNA, 50 bp, homo sapien
acagatctttaggagtcggtaaaacratagtgggatagcattaataaaat

SEQ ID NO: 56693 - DNA, 50 bp, homo sapien
aattgttacctaaggattctgactaytacaatatgctgctgaagaagtta

SEQ ID NO: 56694 - DNA, 50 bp, homo sapien
cttactgcaattacttaaaggagaartaaagagtagcagataaaaaaaaa

SEQ ID NO: 56695 - DNA, 50 bp, homo sapien
tctagtctggtttgtactcttgtaaygatgtattagcaccttcttaaata

SEQ ID NO: 56696 - DNA, 50 bp, homo sapien
tatcataattaaatttgctactaatwatgatggtgtctacaatggtgatt

SEQ ID NO: 56697 - DNA, 50 bp, homo sapien
attattgatttaaaaacgcaccttaygataagatatatcttagattcaga

SEQ ID NO: 56698 - DNA, 50 bp, homo sapien
gcctacattatcaaatagaaattccrcagactgacatcaaaggtcttcct

SEQ ID NO: 56699 - DNA, 50 bp, homo sapien
atttgttggaacaacttaaatgttcrgaaatagaggagtacttaaactac

SEQ ID NO: 56700 - DNA, 50 bp, homo sapien
tttgtagaattttaaatgttgctaaktaatgaagagaataagaccagtgc

SEQ ID NO: 56701 - DNA, 50 bp, homo sapien
aataaggaaatgaattctctggagaytaattagcacttgacaattcactt

SEQ ID NO: 56702 - DNA, 50 bp, homo sapien
aggaaaattacaattttttacatcamatgatctagtaaatcaatttaaaa

SEQ ID NO: 56703 - DNA, 50 bp, homo sapien
gactgaagttgccctgggacctctgrattaacattaatatatacagctgg

SEQ ID NO: 56704 - DNA, 50 bp, homo sapien
acagcagatattgaatttagggcaaygagattttaagcctcaaactaagt

SEQ ID NO: 56705 - DNA, 50 bp, homo sapien
agtataatgtcgttttcataagtacrctgtatcatgttgaggaatgtccc

SEQ ID NO: 56706 - DNA, 50 bp, homo sapien
cccacataatcaaatcaatgaatgcygaaaaaggtgtttgactaaagcac

SEQ ID NO: 56707 - DNA, 50 bp, homo sapien
aatcaagtgtgatttatcctaggaaygtaagggtgcaccaacataagaat

SEQ ID NO: 56708 - DNA, 50 bp, homo sapien
ttggttactaacttacttgaggacaraagagaaaggttaaaaccaactta

SEQ ID NO: 56709 - DNA, 50 bp, homo sapien
ataaaatgatacaaaaatactggacrattacaacatgggagatttcagga

SEQ ID NO: 56710 - DNA, 50 bp, homo sapien
ttaatggaaattacagactatgacarccagtaagaatttgacttagcttc

SEQ ID NO: 56711 - DNA, 50 bp, homo sapien
ttaattgcacagggaaggtatttcgmaagtgttttaattcacatgtgctg

SEQ ID NO: 56712 - DNA, 50 bp, homo sapien
ggcttttaaaaaatggtccttaatayaggtcactgacatcacaaaacaga

SEQ ID NO: 56713 - DNA, 50 bp, homo sapien
gttgtacagtttatttcatcaaccargtattcagtctagtgcccattagt

SEQ ID NO: 56714 - DNA, 50 bp, homo sapien
aagaaaggttggaaggcctagccttyaactctactaatcatgggggtcct

SEQ ID NO: 56715 - DNA, 50 bp, homo sapien
agaaaattattctaaggcctgaaaaygtaatagatggatttttgaaactt

SEQ ID NO: 56716 - DNA, 50 bp, homo sapien
gaaaaagcttataagagaacagtgakagataatcatttgatatggctatc

SEQ ID NO: 56717 - DNA, 50 bp, homo sapien
caaaatgaaaaagaatcagatttggwcaatcaacaaagtcataaattata

SEQ ID NO: 56718 - DNA, 50 bp, homo sapien
cacaatggggtactcttgagccatamaagaatataagtgaataagtaata

SEQ ID NO: 56719 - DNA, 50 bp, homo sapien
tttatgtaatcattaatagagctaaygttaagagagttcctaaaaataat

SEQ ID NO: 56720 - DNA, 50 bp, homo sapien
ataataccatgatttgggtatcataraccagaaaagacttgagttctaat

SEQ ID NO: 56721 - DNA, 50 bp, homo sapien
tacacaatgggagaaaatagttgtawcctgtacacctgataaggggttaa

SEQ ID NO: 56722 - DNA, 50 bp, homo sapien
tatgaatagaggtgaaaagtttatcragcctggtgatagctggttgtcta

SEQ ID NO: 56723 - DNA, 50 bp, homo sapien
caagcttccacagagccaggaaatcrataacagaataaagaaacaactta

SEQ ID NO: 56724 - DNA, 50 bp, homo sapien
ttcggtaaaaattaaccaaaattaayggtgctttccaatggacgcaggaa

SEQ ID NO: 56725 - DNA, 50 bp, homo sapien
aattgtagttagcatttggttaacamtatgttttaataactttatacatt

SEQ ID NO: 56726 - DNA, 50 bp, homo sapien
tacttggtcaaccattggtctcatasgaatgacaaataatgagattttat

SEQ ID NO: 56727 - DNA, 50 bp, homo sapien
aagatgctggtacaatctaaagctamactaggagaagtattttgtctgct

SEQ ID NO: 56728 - DNA, 50 bp, homo sapien
gagaaagcttccttcatgttgcaaasctgcttgaaagaaagagtaattgt

SEQ ID NO: 56729 - DNA, 50 bp, homo sapien
acacaggccccattacttcctatagkactgaagaccactggggataaagg

SEQ ID NO: 56730 - DNA, 50 bp, homo sapien
tggagttgacttcagaggctacataktaaggaaatgagatttacctggtg

SEQ ID NO: 56731 - DNA, 50 bp, homo sapien
ggtttgtggggaaaatcaggttgaastctttcagcaataatttgaatatg

SEQ ID NO: 56732 - DNA, 50 bp, homo sapien
ctccaacaattgaacttaggcaggaytagaagttagacaacctaaaggaa

SEQ ID NO: 56733 - DNA, 50 bp, homo sapien
agtttaaattaataaaatgtttatawagcagaaaattatcctgccatctc

SEQ ID NO: 56734 - DNA, 50 bp, homo sapien
agtataaaattaatactcatgaatcsatactggtataaataagtgactta

SEQ ID NO: 56735 - DNA, 50 bp, homo sapien
tgggtctcccattgtttgcaacatargccttaccagtcttcacagggatg

SEQ ID NO: 56736 - DNA, 50 bp, homo sapien
aagagtaatgatttgccttttgtgarggataattttaatggtacattgca

SEQ ID NO: 56737 - DNA, 50 bp, homo sapien
atatcaaaaccaactgtatgtacacmctcataagaatcaattcgagatag

SEQ ID NO: 56738 - DNA, 50 bp, homo sapien
atgaatatgataaaaatatttaggargccattttagtattccaggtaaga

SEQ ID NO: 56739 - DNA, 50 bp, homo sapien
agaaaggaaatcggtgtgttgaagcratatctgctcttccatctttgttg

SEQ ID NO: 56740 - DNA, 50 bp, homo sapien
cagttgatcacttccagtgatggaastatcatttacaaagtgattttgaa

SEQ ID NO: 56741 - DNA, 50 bp, homo sapien
taaaggtactgagtaattctagggaytaaattaggctaagctaatcctga

SEQ ID NO: 56742 - DNA, 50 bp, homo sapien
tagtttacttctatatctgtttcaayccaattaaacacttttgatgtaat

SEQ ID NO: 56743 - DNA, 50 bp, homo sapien
ctaacattgatttttgatgaattccraaactgtttaattttctaatgaca

SEQ ID NO: 56744 - DNA, 50 bp, homo sapien
acttgctttctagttaaagatatatragacagtatcacaaaatgtaagac

SEQ ID NO: 56745 - DNA, 50 bp, homo sapien
gttaccttaaaaatcccttccctagraactgccataagagcagaaagcca

SEQ ID NO: 56746 - DNA, 50 bp, homo sapien
attatgttccaggcactggaagtacratagtgaataaaacagtaaccgta

SEQ ID NO: 56747 - DNA, 50 bp, homo sapien
gagctatataggcacaaagtttttayatgctactgaaaataaggttatat

SEQ ID NO: 56748 - DNA, 50 bp, homo sapien
agttcatgtcttcttgtactgtgtaygtctggaaaagttgctgtagttat

SEQ ID NO: 56749 - DNA, 50 bp, homo sapien
aagctgagtcattttatcaatatctyacctatcctacaagaaatgctaaa

SEQ ID NO: 56750 - DNA, 50 bp, homo sapien
acacagaagacattttcttcatcaakaccttgtgaaatagatttgtcaga

SEQ ID NO: 56751 - DNA, 50 bp, homo sapien
aaatgggatttttaaaaataagctargcatctatctagcacagtgattgc

SEQ ID NO: 56752 - DNA, 50 bp, homo sapien
cagcctctctgccactgccactttaygggtacctggccttgctgacatca

SEQ ID NO: 56753 - DNA, 50 bp, homo sapien
gcatcctatcttttctgtggctcaaygggaatagaacctaggtctgtctg

SEQ ID NO: 56754 - DNA, 50 bp, homo sapien
tatacatgatctgattaggactaaakgtactgatatgaacaactaactga

SEQ ID NO: 56755 - DNA, 50 bp, homo sapien
aaacatattcatccttcatcttttarcaattctaccacattaaaggaaaa

SEQ ID NO: 56756 - DNA, 50 bp, homo sapien
taactttctcccttactcattcaaawtgtgcttggctaatgcctcatact

SEQ ID NO: 56757 - DNA, 50 bp, homo sapien
ctgtaaagagagtattcttctgagawaaaattatggtatcaccagtaaac

SEQ ID NO: 56758 - DNA, 50 bp, homo sapien
gtctggtcttctataatttcctcaaygtcaaaactaacagctgtaagcac

SEQ ID NO: 56759 - DNA, 50 bp, homo sapien
gaaaaaatctggagttaagaataagraatcaactcttactactccattca

SEQ ID NO: 56760 - DNA, 50 bp, homo sapien
tgattttgacacagccaggaagaaaytatgcttgaaacctctctgtatta

SEQ ID NO: 56761 - DNA, 50 bp, homo sapien
gatatataatgtacagcatgagttawatgtagccttttgaagagtggatc

SEQ ID NO: 56762 - DNA, 50 bp, homo sapien
ttaccctattgcatatgctaagaaascagaatgcgtatggtagcatggcg

SEQ ID NO: 56763 - DNA, 50 bp, homo sapien
cactgtgagtagagcatttccattaygccatgctaccatacgcattctgg

SEQ ID NO: 56764 - DNA, 50 bp, homo sapien
acatcagcctcacgtagtatacccargtaacaatcctccacatgtaccca

SEQ ID NO: 56765 - DNA, 50 bp, homo sapien
attccaaactcttcctctcttcacaktgtatttgaaatctgtaataagct

SEQ ID NO: 56766 - DNA, 50 bp, homo sapien
agtccagacatatttagttttgtgayagtttgagatctctgctggatttg

SEQ ID NO: 56767 - DNA, 50 bp, homo sapien
ttttgtcttgagctttgtatgcaaaytggtgtcaggagacatggatttct

SEQ ID NO: 56768 - DNA, 50 bp, homo sapien
gttataaatttgtcattgaattttasagtcattagttgttttcaagattt

SEQ ID NO: 56769 - DNA, 50 bp, homo sapien
atgcctttggattgaagagattaaayacccgagatttctcaggtaaggaa

SEQ ID NO: 56770 - DNA, 50 bp, homo sapien
aataaaactcacgatgggaaaacggratgaatacactttcagcacacaga

SEQ ID NO: 56771 - DNA, 50 bp, homo sapien
aattacaaggtcttcctttgtaatgyatgaaagtttaatactatcaagaa

SEQ ID NO: 56772 - DNA, 50 bp, homo sapien
tttctatcatattggaccttatgacmatctctggtataacaggaacacat

SEQ ID NO: 56773 - DNA, 50 bp, homo sapien
ggagcacattttgaggctaatatacrcaagagagtctgtctgtaaacact

SEQ ID NO: 56774 - DNA, 50 bp, homo sapien
acttgtcacttctttatcatcttagrcctgcatttaaatcttatattaat

SEQ ID NO: 56775 - DNA, 50 bp, homo sapien
acataggaattttccattgtgaacayatagtttcagaaataagatttttc

SEQ ID NO: 56776 - DNA, 50 bp, homo sapien
tcgttattacctctctattttgtcartagcaacatatttataatggtctg

SEQ ID NO: 56777 - DNA, 50 bp, homo sapien
tacacattaactcataatgaccctamattacataacacattattattagt

SEQ ID NO: 56778 - DNA, 50 bp, homo sapien
cagtttataatccatgtactcattayctcttatttataattgccctactc

SEQ ID NO: 56779 - DNA, 50 bp, homo sapien
tactgtgattaaattattaacctaaygattatggctaatattttataagc

SEQ ID NO: 56780 - DNA, 50 bp, homo sapien
tcctaccccatgactatcttctaccrcagtatccaattgaataatttcat

SEQ ID NO: 56781 - DNA, 50 bp, homo sapien
catagtcatttttaggccattataascactgtggacttttttaaaaagta

SEQ ID NO: 56782 - DNA, 50 bp, homo sapien
tcctgcaataaaagtttattcttctytggttgatgagattcccaaggagg

SEQ ID NO: 56783 - DNA, 50 bp, homo sapien
ttaataaagtgctgtgtggtcataaygagtaggaggcatcactgatattt

SEQ ID NO: 56784 - DNA, 50 bp, homo sapien
ttcatatgcctctaacttattctgargagtttattgctcatttcatgtgc

SEQ ID NO: 56785 - DNA, 50 bp, homo sapien
ataagttatggaagtttaatttacargatgatagctgtaattaatattaa

SEQ ID NO: 56786 - DNA, 50 bp, homo sapien
gctcttagcaatagtggttggtatayagtcaatacttattatcacagtca

SEQ ID NO: 56787 - DNA, 50 bp, homo sapien
ctctacaattcagaccctacaattcrgaaacagaggatacagtttctttt

SEQ ID NO: 56788 - DNA, 50 bp, homo sapien
tttattttgaaataggttgagtaacraagttgcaaaactggtacatcaag

SEQ ID NO: 56789 - DNA, 50 bp, homo sapien
ccaagctcatctagctcttgagagakaatttattttatgttggagtgcga

SEQ ID NO: 56790 - DNA, 50 bp, homo sapien
ttctagttctgtaactcaaactgtcraataatgaactagataacatattc

SEQ ID NO: 56791 - DNA, 50 bp, homo sapien
tgctgccagttccaacctccatctcrctaatcaagctctataaaattatt

SEQ ID NO: 56792 - DNA, 50 bp, homo sapien
gaacagcaggtttatggagtcctacrcctgtatcctaacctaaggtatcc

SEQ ID NO: 56793 - DNA, 50 bp, homo sapien
tcctctgtatattgaccacattatcraatatgaaagtttttaaggggaag

SEQ ID NO: 56794 - DNA, 50 bp, homo sapien
gatgctctgtgtagaggtgggagatraacgctgcccttcatgcaacatat

SEQ ID NO: 56795 - DNA, 50 bp, homo sapien
taggcatattttgcagtttgttgatwagtaaagagaatagtaaaagtagc

SEQ ID NO: 56796 - DNA, 50 bp, homo sapien
tctttgtttgataatttgttcttaayacagctagcagagttcaattttca

SEQ ID NO: 56797 - DNA, 50 bp, homo sapien
gcaaaatattgcatgtgctgttacasagaaggtttattgaactggatcat

SEQ ID NO: 56798 - DNA, 50 bp, homo sapien
aacatatgctggtgttttgaaaatayagactcttccaggttatttgtggt

SEQ ID NO: 56799 - DNA, 50 bp, homo sapien
agaaatatcgatacactttctctaayaacctctgcaaattttgaatacat

SEQ ID NO: 56800 - DNA, 50 bp, homo sapien
tgaataattcaagaattctttctaargtataaaacaagtcaagatggcta

SEQ ID NO: 56801 - DNA, 50 bp, homo sapien
tttggagtctttaaggctttctgcakgtaagatcgtttcatatgcaaaca

SEQ ID NO: 56802 - DNA, 50 bp, homo sapien
aacatgtagagtgaaacttttgccastaggattataaaatgggtacaaca

SEQ ID NO: 56803 - DNA, 50 bp, homo sapien
aaagaatatttcacatgttgcactayagatggaaatatttttagtaacgt

SEQ ID NO: 56804 - DNA, 50 bp, homo sapien
ctctgttaggactccctggacaaccrgaaagttttatgttgctgtaggat

SEQ ID NO: 56805 - DNA, 50 bp, homo sapien
ccctgcatcacagatatttttagaasctgatactggatttaagtgaattt

SEQ ID NO: 56806 - DNA, 50 bp, homo sapien
taaagtagccagaattactaagtagsaaggatagctgccctgaagagtca

SEQ ID NO: 56807 - DNA, 50 bp, homo sapien
aacagcctaaggtttaaatcaccacygaataggaatttcagataactttt

SEQ ID NO: 56808 - DNA, 50 bp, homo sapien
ctatctcatttggcctaccatgaccratgatctgtaaaggcctttcccat

SEQ ID NO: 56809 - DNA, 50 bp, homo sapien
aatggataaacactgtttgtgcctayatctttatctctttgcaatcacct

SEQ ID NO: 56810 - DNA, 50 bp, homo sapien
attaaaatttctttcatactctcaawacaggttttactttatttttgatt

SEQ ID NO: 56811 - DNA, 50 bp, homo sapien
ttctctttacgtaagatttccatgaytacctaggacaggtttttgtattc

SEQ ID NO: 56812 - DNA, 50 bp, homo sapien
ttggtggtttgaaagcctgtgtctaygacccttacataactgagtctctc

SEQ ID NO: 56813 - DNA, 50 bp, homo sapien
gtattatttattaactgcagggaaaytgtaagaataggaagttgtataat

SEQ ID NO: 56814 - DNA, 50 bp, homo sapien
ttctcagaagcaaaactgctatctcrcctacagataagagaggaataagc

SEQ ID NO: 56815 - DNA, 50 bp, homo sapien
gtatcccagatttatttctcctgatwaaggcattgaggcttcagtaattg

SEQ ID NO: 56816 - DNA, 50 bp, homo sapien
cacatattttagagatgaatacttaygtagccaatatatgaaaacaaatt

SEQ ID NO: 56817 - DNA, 50 bp, homo sapien
tttaactagaaatcactccattcatkagacatgttttatagctacatgaa

SEQ ID NO: 56818 - DNA, 50 bp, homo sapien
taagttttcacgctaggtcttaaaaygatagcaactagcagcattcccct

SEQ ID NO: 56819 - DNA, 50 bp, homo sapien
gtgacccttcctatctgcagggaaaygaagacatacataatcatttcttc

SEQ ID NO: 56820 - DNA, 50 bp, homo sapien
ctgtttcagaactgatctctgcttargtctgaaactctcttctctcccac

SEQ ID NO: 56821 - DNA, 50 bp, homo sapien
taacactagacctgatgaggagagaraataaccttcttatatagacgatc

SEQ ID NO: 56822 - DNA, 50 bp, homo sapien
atcacaaaggtatagttaaaatatgwaatgcatttggaatagtgcctagc

SEQ ID NO: 56823 - DNA, 50 bp, homo sapien
gaaaaggtcttgttggtactgatacyggtttaaaataaacacctctcttt

SEQ ID NO: 56824 - DNA, 50 bp, homo sapien
attattttttttcctaggagaagtayggttttaagccactcagccattat

SEQ ID NO: 56825 - DNA, 50 bp, homo sapien
gatatacaagagacatgaaagagcaycatagtatggacacaagacagaga

SEQ ID NO: 56826 - DNA, 50 bp, homo sapien
acaagcgcttggatgctgtagtggayatacctggtttttctgtccagcac

SEQ ID NO: 56827 - DNA, 50 bp, homo sapien
taagtgttcttgaaactttggacttsaaccattaatgagaagacataatt

SEQ ID NO: 56828 - DNA, 50 bp, homo sapien
gtaaatgttctgctttctatctaaaytcagctcttggatctagaaagtct

SEQ ID NO: 56829 - DNA, 50 bp, homo sapien
actgtatttcacacctttagttatcmatctgagaaacactttatcattac

SEQ ID NO: 56830 - DNA, 50 bp, homo sapien
ggctggagtcctgtttacaggagacrcttcttgaacaacagtttcagggg

SEQ ID NO: 56831 - DNA, 50 bp, homo sapien
ttcaagtaccagctctaccacttatyaatcctatgagttttggaaagtca

SEQ ID NO: 56832 - DNA, 50 bp, homo sapien
taatcatcttccattggtattgccasaataaggtttgtcagggcaactga

SEQ ID NO: 56833 - DNA, 50 bp, homo sapien
tcagaaaactactggaactgtatcargccctctatcatagacccaccaca

SEQ ID NO: 56834 - DNA, 50 bp, homo sapien
ataagtataaatatatggcataaagyattagtactgtcaaaatagaaaga

SEQ ID NO: 56835 - DNA, 50 bp, homo sapien
ctgttgggaaggggactgtaatagtmaccttagtctgtgtggaccctcaa

SEQ ID NO: 56836 - DNA, 50 bp, homo sapien
gtaaagtaaataacagtagataggayattgaaataaaaataactttatga

SEQ ID NO: 56837 - DNA, 50 bp, homo sapien
cctttctcgcggatcctgcatttaayggctgtcacattgcttgggaaact

SEQ ID NO: 56838 - DNA, 50 bp, homo sapien
caagctttaaatacatagtgtctgarataaaatctagtttggtaggtggt

SEQ ID NO: 56839 - DNA, 50 bp, homo sapien
tgttcataatcagtaatacttgacayggtgtaccaagaagaaaaaatgag

SEQ ID NO: 56840 - DNA, 50 bp, homo sapien
ttatttccaaagggcttttgcatackctcactgctatttcctttggataa

SEQ ID NO: 56841 - DNA, 50 bp, homo sapien
tgggactatgtatagacagcatacaygacactgtgatacttaagatcagt

SEQ ID NO: 56842 - DNA, 50 bp, homo sapien
gcccacagattgatctatagtggcaktattgagacatatcatttgtgttg

SEQ ID NO: 56843 - DNA, 50 bp, homo sapien
actgggctattcccagtaaaattcasgtctggtcctgtgttgctactagg

SEQ ID NO: 56844 - DNA, 50 bp, homo sapien
tctgtctctatgtcagctaattaacsaatttgagcttcttttcccccaag

SEQ ID NO: 56845 - DNA, 50 bp, homo sapien
acactttgtgatgactaggctaataygttgataaaacatctgtgttaagg

SEQ ID NO: 56846 - DNA, 50 bp, homo sapien
taggaccttgaaggccattatatagkatctggtttatatcttgaattcaa

SEQ ID NO: 56847 - DNA, 50 bp, homo sapien
ttgaagagggctagaagtatagagaytcagtaacgtgtgattggtttttg

SEQ ID NO: 56848 - DNA, 50 bp, homo sapien
gtcccaggggcagagatttctctacraatactctaatcagaatgatttct

SEQ ID NO: 56849 - DNA, 50 bp, homo sapien
aaaatgtaagtcttgttttcccatcraagaagaagaaactggcaagtatc

SEQ ID NO: 56850 - DNA, 50 bp, homo sapien
gaaaaaatgcctgcaagtgtcctaaygccatccctttctcaaacattttg

SEQ ID NO: 56851 - DNA, 50 bp, homo sapien
tcaaatacccatgagtatcctctaastctaagcaagggtttctgtgtagg

SEQ ID NO: 56852 - DNA, 50 bp, homo sapien
ttggagagcatctcttgtccatgtcraagtgtgacgcttcatttattaat

SEQ ID NO: 56853 - DNA, 50 bp, homo sapien
cgaaaaccactggactagattatctyaacctctttcagttcttatagtct

SEQ ID NO: 56854 - DNA, 50 bp, homo sapien
aatagtttcagggatgattaacaaaygattcttggctaaaagaaagaaat

SEQ ID NO: 56855 - DNA, 50 bp, homo sapien
ggaattggagtgccagctgaaaagcrataggctacatgaggaatctataa

SEQ ID NO: 56856 - DNA, 50 bp, homo sapien
cttttatctcttcagtgtgtccagawtattttcactccttcaaaaccagc

SEQ ID NO: 56857 - DNA, 50 bp, homo sapien
gctcttcaccattctacactagttaycttcaatgaaacctaaagctgtta

SEQ ID NO: 56858 - DNA, 50 bp, homo sapien
atctcattctatgcattgatgcacaygctggttggcctatctgtttttca

SEQ ID NO: 56859 - DNA, 50 bp, homo sapien
cacatgttttgaggaatatcccttaygcatagtagtactgaacatcagtt

SEQ ID NO: 56860 - DNA, 50 bp, homo sapien
tctttttcagtgttagaattcaatcraactataattcattttctgactaa

SEQ ID NO: 56861 - DNA, 50 bp, homo sapien
ggagcaaaatggtgcttgtatatcayaaccgttattgaacaatgaattaa

SEQ ID NO: 56862 - DNA, 50 bp, homo sapien
gggtcttcccatggacaaagacttcrccttaattgcttggtgttggcggt

SEQ ID NO: 56863 - DNA, 50 bp, homo sapien
tctcttacttggttactttgggacaycattgtagattcaggtcacttttg

SEQ ID NO: 56864 - DNA, 50 bp, homo sapien
ggttacaggactaaactaaattacartaggttgccacttgttttttgcat

SEQ ID NO: 56865 - DNA, 50 bp, homo sapien
ttgcatttgagacttttggcccgtarctaagattagacatggtccctgct

SEQ ID NO: 56866 - DNA, 50 bp, homo sapien
ttggaaaatatctttacctgtgttayagcctatatcttggtattcctctg

SEQ ID NO: 56867 - DNA, 50 bp, homo sapien
aattgccttttgtttttgcatatcaygtgctattcttcagcttaaatcat

SEQ ID NO: 56868 - DNA, 50 bp, homo sapien
tgaaaattatctatttgattccaagmagatatagctcaagtttctgccat

SEQ ID NO: 56869 - DNA, 50 bp, homo sapien
ggattttttttcttttccattcttcratattacaaggcatagtcaaggtt

SEQ ID NO: 56870 - DNA, 50 bp, homo sapien
aactatcttcttccttcatctgtcamgtatgtcaggccctcaggacatga

SEQ ID NO: 56871 - DNA, 50 bp, homo sapien
ctggtggcaattttgtctcccaggargtatttgacagtctggaggcattt

SEQ ID NO: 56872 - DNA, 50 bp, homo sapien
taaattagttgacaatgcgttgcaawctctaatacagggtttctcacagt

SEQ ID NO: 56873 - DNA, 50 bp, homo sapien
aaacaaaaaccctaggaactcacctkaccataagaactggaagaaaaaag

SEQ ID NO: 56874 - DNA, 50 bp, homo sapien
aaaataggtgctacaatgcaaagacratttttacatgaagtatttgaagg

SEQ ID NO: 56875 - DNA, 50 bp, homo sapien
ctgagacttttggacccatgttttayaactgatagatgatctgtcagttg

SEQ ID NO: 56876 - DNA, 50 bp, homo sapien
ccatgtgaggcatagacttccgttcyattaaagccagagtctctaggaac

SEQ ID NO: 56877 - DNA, 50 bp, homo sapien
catagtgttgcctttgtcacacttamcttatgcatttgtaagcttcctaa

SEQ ID NO: 56878 - DNA, 50 bp, homo sapien
tttttaaagactgaacacaaaacaaytaggttacaagttcaagacttcag

SEQ ID NO: 56879 - DNA, 50 bp, homo sapien
actaggtcaggaatatcaccaaaggwtttaaatgtatagatagtttaagt

SEQ ID NO: 56880 - DNA, 50 bp, homo sapien
ccattttgcaatattgactcctcagmatacttgccaatatatatttctat

SEQ ID NO: 56881 - DNA, 50 bp, homo sapien
taatcctgactttgagtgatcactaygaagctaaataataattagcatgc

SEQ ID NO: 56882 - DNA, 50 bp, homo sapien
caactctatcagcagctgtggttctraaagaagtaatattaaatactagc

SEQ ID NO: 56883 - DNA, 50 bp, homo sapien
aaacagtacaatgcctcgcactttgyaaatattcaataaatgttagggta

SEQ ID NO: 56884 - DNA, 50 bp, homo sapien
taggtgagagttactgttaaaccacygtattttcaaatattcagctattt

SEQ ID NO: 56885 - DNA, 50 bp, homo sapien
gtgctgtgagttcatgtaaaataccwctttctaggaagtttactgatgtc

SEQ ID NO: 56886 - DNA, 50 bp, homo sapien
aagatatgtgataaaactagtcaaayggtaatggtagcatttaggtggta

SEQ ID NO: 56887 - DNA, 50 bp, homo sapien
gggctagtagagtgcttttgtaaaayagtaatgctgttgcaataaatatg

SEQ ID NO: 56888 - DNA, 50 bp, homo sapien
acgtgatcgtatcccaatacaatggmaagttgaatttttattgttacctc

SEQ ID NO: 56889 - DNA, 50 bp, homo sapien
tgcttgagaaacaagtgaataaaaartaagttccttctagctcaaacatt

SEQ ID NO: 56890 - DNA, 50 bp, homo sapien
gcactctactagcccctgtgggtaayacaacagtgagtaagttccagtcc

SEQ ID NO: 56891 - DNA, 50 bp, homo sapien
tagcctttaaaataatgacaatctaygtaatactaagggaagacgattta

SEQ ID NO: 56892 - DNA, 50 bp, homo sapien
agtctctcaaatagcataattttcaygggctcaatcgaaagtggttagtg

SEQ ID NO: 56893 - DNA, 50 bp, homo sapien
gaataaggaaattattttcaccattkaaggagcttatatgtgcctatttt

SEQ ID NO: 56894 - DNA, 50 bp, homo sapien
gtcccatggtgtcagcgtaatggaaragtccagataaacctgggaatagg

SEQ ID NO: 56895 - DNA, 50 bp, homo sapien
agttagccttgccttgcttgatggasagtcagaatttcactagctgtgtc

SEQ ID NO: 56896 - DNA, 50 bp, homo sapien
aaaacaatcttacatagcagctcagkctataaaatatataagcagaaaac

SEQ ID NO: 56897 - DNA, 50 bp, homo sapien
tttgggaggtggcagtgatttcaaarttaatggtgcctgaggtacttgtg

SEQ ID NO: 56898 - DNA, 50 bp, homo sapien
tgaggtgctttcttagaaataatgaygtactgatatactttttgtagcta

SEQ ID NO: 56899 - DNA, 50 bp, homo sapien
caactagttattgacagagtcagaartaaaattcctgtctcttgacaaaa

SEQ ID NO: 56900 - DNA, 50 bp, homo sapien
cacagcatgattatgtgactagaacsattttggatatggtaatctgaact

SEQ ID NO: 56901 - DNA, 50 bp, homo sapien
ctcacagatactcatgactgagacartattttaaacaagtataaacaatc

SEQ ID NO: 56902 - DNA, 50 bp, homo sapien
gtttaagtcaaaataatgatacttayaaagcagagacaagggataaagaa

SEQ ID NO: 56903 - DNA, 50 bp, homo sapien
caaacaaaaatgtggcatttttatcygaattaactagaacattatgaaat

SEQ ID NO: 56904 - DNA, 50 bp, homo sapien
cagtgataacttggctaattcatgtyaatagacaattgtgaattttcaag

SEQ ID NO: 56905 - DNA, 50 bp, homo sapien
aagggacgcctttatttcagattacrcggtcatcttgatcatcctccagt

SEQ ID NO: 56906 - DNA, 50 bp, homo sapien
attcttgtcccctaactatattgccratcacaaagtctagtcctgttttg

SEQ ID NO: 56907 - DNA, 50 bp, homo sapien
ccttaagactactcatgcaacaaaaygagttacctatatttgtgtttaat

SEQ ID NO: 56908 - DNA, 50 bp, homo sapien
taaatagtttctattctcatcgtcawatgtcatatcctatcctctccctc

SEQ ID NO: 56909 - DNA, 50 bp, homo sapien
aagttgctgcctatctctcttctcarggactctctgcaattttgtatcac

SEQ ID NO: 56910 - DNA, 50 bp, homo sapien
aatgcctttttcttcctctcctatayacttttatcacatctcagctactc

SEQ ID NO: 56911 - DNA, 50 bp, homo sapien
agcccattattttagtgtctcccaayggcccaaagttatgctcatttctc

SEQ ID NO: 56912 - DNA, 50 bp, homo sapien
atggggtcaaagatctcagttaccaratggatagtatggcctctgcctca

SEQ ID NO: 56913 - DNA, 50 bp, homo sapien
ttttcttttagctgaaagtcctaccyggcaattttgcaatgctcctaact

SEQ ID NO: 56914 - DNA, 50 bp, homo sapien
accacacccataatgcaatatcacaratgggctttcataaatatgtacac

SEQ ID NO: 56915 - DNA, 50 bp, homo sapien
tggccaagaagagagtcttcgttaasagttaggctgtcataatcagtctg

SEQ ID NO: 56916 - DNA, 50 bp, homo sapien
taactctgggtttgtatgctaaagamaagaaatgtagctgtacttaggac

SEQ ID NO: 56917 - DNA, 50 bp, homo sapien
gtgcccaacatgcactaggctatgayactatgtttggaaaactggaacaa

SEQ ID NO: 56918 - DNA, 50 bp, homo sapien
accctgatgctcttgtagagtggtcragttaccaggcattgataggattg

SEQ ID NO: 56919 - DNA, 50 bp, homo sapien
aggagtggttccgtttcagcgcttcyctaaatgcaaacataacaaacatt

SEQ ID NO: 56920 - DNA, 50 bp, homo sapien
gagcttttctctactggagctattawacgaaatctggctgatgccagcca

SEQ ID NO: 56921 - DNA, 50 bp, homo sapien
aacttggtaaccaatgttgtgggcawaatttgttccaacggtcatgttca

SEQ ID NO: 56922 - DNA, 50 bp, homo sapien
aaagtaagccaggaaaaagaatgtcrcacaaaaatagttatagtcattta

SEQ ID NO: 56923 - DNA, 50 bp, homo sapien
atttagcattagtcatgtggttgaayggatatttcatattgttataaaaa

SEQ ID NO: 56924 - DNA, 50 bp, homo sapien
aaaattggaagaaactgaattcaatsaaaggagcagaactagcctgcttt

SEQ ID NO: 56925 - DNA, 50 bp, homo sapien
aggcagagaaagagcagggtcaggawatttgagtacatgtgtaggctttc

SEQ ID NO: 56926 - DNA, 50 bp, homo sapien
ctatccttccttttatccaaacagcraggtcttactgaaaacgaaattgt

SEQ ID NO: 56927 - DNA, 50 bp, homo sapien
tgtcacatttctaatagcctttaagyctgaataaggacgagaggactgtg

SEQ ID NO: 56928 - DNA, 50 bp, homo sapien
taaattatgtgcaatttgcagtacakgaatacatccctgaatagaaggtc

SEQ ID NO: 56929 - DNA, 50 bp, homo sapien
aaatctgagcattttgctagaacaaraaagaatagtgacattgagtttga

SEQ ID NO: 56930 - DNA, 50 bp, homo sapien
tgactatgtctacatgatgcctaaasagacagttgattcagtcaaaaaat

SEQ ID NO: 56931 - DNA, 50 bp, homo sapien
cacagttttctgagctctttagataycaagaaatgagtattaatatttat

SEQ ID NO: 56932 - DNA, 50 bp, homo sapien
tgttctaagtttttgtgtttgtagcragaaatatggttcaaaatgttcaa

SEQ ID NO: 56933 - DNA, 50 bp, homo sapien
tgtaaaaatgcaacatgactttatcraccttctgtagcaatatttttctg

SEQ ID NO: 56934 - DNA, 50 bp, homo sapien
atggtatttggaaatggagcctttasgaaataattagggttagatagggt

SEQ ID NO: 56935 - DNA, 50 bp, homo sapien
cctgaacctattacatctttagtccsaggaactacatgttttgaagtgta

SEQ ID NO: 56936 - DNA, 50 bp, homo sapien
gcaaaccataactgtagcacttatgmacattgttttacaattaggtgcgt

SEQ ID NO: 56937 - DNA, 50 bp, homo sapien
ccaggagaaagtggcctacttattayggtggttgatagaattgaagcaag

SEQ ID NO: 56938 - DNA, 50 bp, homo sapien
ctgcataagctagaccacacattccmagagttgaagacccatagaagatt

SEQ ID NO: 56939 - DNA, 50 bp, homo sapien
aagaggagttaattaggttggccaamtgtttttatttctcagctgcataa

SEQ ID NO: 56940 - DNA, 50 bp, homo sapien
actaaagtatgctattagtgcagcayagaaagaacctagactgttccact

SEQ ID NO: 56941 - DNA, 50 bp, homo sapien
aaacactggtatgtgcttgctattamctttttggagaccaatgcagaata

SEQ ID NO: 56942 - DNA, 50 bp, homo sapien
tattattgagcacacattcagtacayagcaatttaatagtcactgagaat

SEQ ID NO: 56943 - DNA, 50 bp, homo sapien
taagtggctaatggctaattccctaygtgaatgctctatttattatacag

SEQ ID NO: 56944 - DNA, 50 bp, homo sapien
aaatgcctttgcagtattattttgargccatcagtttaaacatttaccat

SEQ ID NO: 56945 - DNA, 50 bp, homo sapien
ttctgtgctgaggtctaagaaatcartgaggaacttaacactcttaagcc

SEQ ID NO: 56946 - DNA, 50 bp, homo sapien
ctgaaagagaagactcaactcactcraaagacagacttacctcattctct

SEQ ID NO: 56947 - DNA, 50 bp, homo sapien
tttcaggacctcctgtacggctagastagaggttacaaatttcctcagcc

SEQ ID NO: 56948 - DNA, 50 bp, homo sapien
atttgagcgtgataattaagaaggamaattgtatatcctttgtttaagaa

SEQ ID NO: 56949 - DNA, 50 bp, homo sapien
tgaaactcaatgtttcatttataaaragagtggatcatggtgaaagagcc

SEQ ID NO: 56950 - DNA, 50 bp, homo sapien
tgttctaagataaacttaataattcrcattgaagacaaaaggcaaattaa

SEQ ID NO: 56951 - DNA, 50 bp, homo sapien
ccagttccaggaaaatgaataagaaygattgatttttcagaaagggagcc

SEQ ID NO: 56952 - DNA, 50 bp, homo sapien
ggattatactaatcaaaagcaatctraacagtttattataaagtctaaac

SEQ ID NO: 56953 - DNA, 50 bp, homo sapien
cattgtcttgttccagatctcagagraacagtttttggtttctcccattc

SEQ ID NO: 56954 - DNA, 50 bp, homo sapien
acaatccaaagacataaatttaatcrcctaaatgttttaaaaactctacg

SEQ ID NO: 56955 - DNA, 50 bp, homo sapien
tgttcattttaacaggtccatagaawtccattatgtagatattttaacac

SEQ ID NO: 56956 - DNA, 50 bp, homo sapien
aatggtcttttattacagaatcatamggtaactgatgaggagactggatt

SEQ ID NO: 56957 - DNA, 50 bp, homo sapien
agattggaactacactttataaatamatgctttaaaaatcttctttacag

SEQ ID NO: 56958 - DNA, 50 bp, homo sapien
tattttttaaatatgcccacaggaamggtttttctcctacttagttttgt

SEQ ID NO: 56959 - DNA, 50 bp, homo sapien
ggatattcttttacatcgggttctgsagtaagagtcttctgttccattct

SEQ ID NO: 56960 - DNA, 50 bp, homo sapien
acagaaacctacaattatgaagcaaytcgtggttatgtcttgataaaggt

SEQ ID NO: 56961 - DNA, 50 bp, homo sapien
ctttgaagccttcttcagctttatgragtattatttttatctcctcagag

SEQ ID NO: 56962 - DNA, 50 bp, homo sapien
tgctgaagaacaaaccaacccgctarattggaatggccattcatccaaac

SEQ ID NO: 56963 - DNA, 50 bp, homo sapien
gccaccagggacatatgctctggtawctataaacagaccagagataaaga

SEQ ID NO: 56964 - DNA, 50 bp, homo sapien
tttaatcatctctttcaacacttaartcaccaaaatgtaatgcattattt

SEQ ID NO: 56965 - DNA, 50 bp, homo sapien
ctgaatgtaaacttgaagccaaacasaacagtcacagcacaattaaatgc

SEQ ID NO: 56966 - DNA, 50 bp, homo sapien
acaaatgaaagcttagagagtgttascaaagaaatagaaagcctcagcaa

SEQ ID NO: 56967 - DNA, 50 bp, homo sapien
taatatctcataacccattgttttaraccgatgacaatttaataaagatt

SEQ ID NO: 56968 - DNA, 50 bp, homo sapien
acaatttatctccactatctgattaraccacttgatatctggttaaaaaa

SEQ ID NO: 56969 - DNA, 50 bp, homo sapien
ctgttgttctgagatggtcagaatarcatgatttagagtttaggaatgga

SEQ ID NO: 56970 - DNA, 50 bp, homo sapien
aggaaaatagatatagttagtcatasattataaaagggcttcaaaggtac

SEQ ID NO: 56971 - DNA, 50 bp, homo sapien
aattacactcagttggcaaagtagcratagttccaatgctgccattttac

SEQ ID NO: 56972 - DNA, 50 bp, homo sapien
acttcttttatgacagaggtagcaaygcagaaaaatagaataaggtgtgt

SEQ ID NO: 56973 - DNA, 50 bp, homo sapien
agtaaagaagcttaagataagaagaraaggatttaaatgtccagtaacag

SEQ ID NO: 56974 - DNA, 50 bp, homo sapien
aaaagggaaagatgcagtaagaccaycgttggcttttcccatccttcagc

SEQ ID NO: 56975 - DNA, 50 bp, homo sapien
atgtaatttgaagtacaacaatggcyctatcaaagatcattctcaggcca

SEQ ID NO: 56976 - DNA, 50 bp, homo sapien
ctctatgatgagttgaatccttttayatgagttttgaatgcaccaaagtt

SEQ ID NO: 56977 - DNA, 50 bp, homo sapien
gatatgtatattgtttctttttagayataatattactacacacctaatat

SEQ ID NO: 56978 - DNA, 50 bp, homo sapien
tggccaccatgaacccaagatctagrcctgctccagtggacacaggctcc

SEQ ID NO: 56979 - DNA, 50 bp, homo sapien
aaggtaaaagaatcccagcgtgctamaactactaaaaacaggcaggaggt

SEQ ID NO: 56980 - DNA, 50 bp, homo sapien
gttcatttctacctcatggtatagartaacatccatgcagagacaaaaag

SEQ ID NO: 56981 - DNA, 50 bp, homo sapien
ggtttcactttattgatgagctaacmaatgtatatattatgagtgctaca

SEQ ID NO: 56982 - DNA, 50 bp, homo sapien
aattcacatggttgtgcagattgacrccgccaagttcgattttccaagct

SEQ ID NO: 56983 - DNA, 50 bp, homo sapien
gcatcactttgatttccataaagaastattatcagaggttgacacgttat

SEQ ID NO: 56984 - DNA, 50 bp, homo sapien
cattttatgcaagtcacatagaggaygcataatggaataggggtaataga

SEQ ID NO: 56985 - DNA, 50 bp, homo sapien
gtaaagtcacctgtgacaggaagtayggtcacaacttcaaaaagcctaca

SEQ ID NO: 56986 - DNA, 50 bp, homo sapien
gacagaggaagaaactgctaggtatyaattacaatcaaatcattcacaaa

SEQ ID NO: 56987 - DNA, 50 bp, homo sapien
tgatggatacactcaaagccctaacyaacttggcctctgtgcaatctatg

SEQ ID NO: 56988 - DNA, 50 bp, homo sapien
ttgccatcatgtcctgcagctattcyagtaaacctcttaatggttgccat

SEQ ID NO: 56989 - DNA, 50 bp, homo sapien
gtcacagaaacacttcagtatggtaygtatctttcagcctataattatga

SEQ ID NO: 56990 - DNA, 50 bp, homo sapien
tcagtagtttgctcatttggcatcaytaatcagaactttgaagtgcggta

SEQ ID NO: 56991 - DNA, 50 bp, homo sapien
ttttcgagttaatcttccctacttcyaattttcagttccagattaccata

SEQ ID NO: 56992 - DNA, 50 bp, homo sapien
gatggcaaattattgcttaactttgyacaggtgagactactaacaaagtc

SEQ ID NO: 56993 - DNA, 50 bp, homo sapien
gcacactaacttcaagcattctgaastcaggaataaggagaaaaaacaat

SEQ ID NO: 56994 - DNA, 50 bp, homo sapien
acctaaaaggagaaataatgccttgractttactatgtgacttatttact

SEQ ID NO: 56995 - DNA, 50 bp, homo sapien
cccataatttagttcaggccacagayaagtaaattgatgaattatttatt

SEQ ID NO: 56996 - DNA, 50 bp, homo sapien
ccagctgggatagatgcttcactaaragacatgtgtgcactttgtcctga

SEQ ID NO: 56997 - DNA, 50 bp, homo sapien
aaaggcttataactgtgaatgtagarcgtcgccactaaacatttccattc

SEQ ID NO: 56998 - DNA, 50 bp, homo sapien
cttctaaaatttttattgtttcttcragtttatgtgcggactctaaagaa

SEQ ID NO: 56999 - DNA, 50 bp, homo sapien
tgacctaatgtgtaccttacgcctamgtacaatggcataagatatattta

SEQ ID NO: 57000 - DNA, 50 bp, homo sapien
aacggtcataacttactgatattaayggccaaatgagagatgactttctg

SEQ ID NO: 57001 - DNA, 50 bp, homo sapien
ttcctcactaaaacatctatgactaraaattgttacttttttggaatttt

SEQ ID NO: 57002 - DNA, 50 bp, homo sapien
agtttttcattttgtatgtcttacartcagtccagctctaacgtttttct

SEQ ID NO: 57003 - DNA, 50 bp, homo sapien
ttcttctcttcctaggcttaaatggwataattagttaaaaaaatcaagaa

SEQ ID NO: 57004 - DNA, 50 bp, homo sapien
agtaaaaaaactgttaaccttcatcyaactgatagttctgtgtcttacat

SEQ ID NO: 57005 - DNA, 50 bp, homo sapien
tgggcttccctttgtagtaacccgamctttctatctcgctgaccttaata

SEQ ID NO: 57006 - DNA, 50 bp, homo sapien
actggagacatccaaggaatgaacarccagacctattgtgttcattcttt

SEQ ID NO: 57007 - DNA, 50 bp, homo sapien
ctgctgcaacacacaacttcttccarctacctgaaggatgaaggaataag

SEQ ID NO: 57008 - DNA, 50 bp, homo sapien
aggctgcaaagggaaatgttggagascgtctctataaaactaagggtaag

SEQ ID NO: 57009 - DNA, 50 bp, homo sapien
aaagccaagttgccattctgtaataygcaaaatgaatgggacttaatgtc

SEQ ID NO: 57010 - DNA, 50 bp, homo sapien
ccagaataaagcttatctaatgcacrgcttttctttgtagagaatatcac

SEQ ID NO: 57011 - DNA, 50 bp, homo sapien
ccttttcctgagaatcattggtgcastatactctgatttatttttcagtt

SEQ ID NO: 57012 - DNA, 50 bp, homo sapien
aggttattataaattgtcattgctcscatgtggcacaattttgccacatg

SEQ ID NO: 57013 - DNA, 50 bp, homo sapien
gcagaaatgtgctaaaataggtttaratgttctactcttcaaatagctgg

SEQ ID NO: 57014 - DNA, 50 bp, homo sapien
agagctttcaaaggtggaaactcagraaagtggaatgtaactcagtaaat

SEQ ID NO: 57015 - DNA, 50 bp, homo sapien
ctggttgactgagatgaactccctcrcgtacttccttaggggtgccagct

SEQ ID NO: 57016 - DNA, 50 bp, homo sapien
tttagtattcaagtcaaaatgtgaartaaagcgatgagaaatagatcatt

SEQ ID NO: 57017 - DNA, 50 bp, homo sapien
ttttccacatttcttttctgatttcrcttacctaggtcatcatattttcc

SEQ ID NO: 57018 - DNA, 50 bp, homo sapien
gcaatggtcatggatggagcttttaragtttcttaacagactgtggcatg

SEQ ID NO: 57019 - DNA, 50 bp, homo sapien
aattggatgcttgttggggaagataygatcaaaggagaatagagggggta

SEQ ID NO: 57020 - DNA, 50 bp, homo sapien
atgatttgaagaaatgagagacagakgaggttaacacaccaaggaaagag

SEQ ID NO: 57021 - DNA, 50 bp, homo sapien
gaggttgccgaaagtacacaatagargatagccttttcaaacaaatgatt

SEQ ID NO: 57022 - DNA, 50 bp, homo sapien
tggacttcaagtatatccttacttgsaatcctttgtcgggtttactgtag

SEQ ID NO: 57023 - DNA, 50 bp, homo sapien
gtaaaaagtgcaattaaatactgacyggtttttagaacagatttcacagg

SEQ ID NO: 57024 - DNA, 50 bp, homo sapien
cagtgagaaaactcagatatatctamaacatgaggttaaagcaaaattca

SEQ ID NO: 57025 - DNA, 50 bp, homo sapien
ttttatttttagtgattcaactcacrctagttcatctatcacaattacga

SEQ ID NO: 57026 - DNA, 50 bp, homo sapien
ccttggaaatttagttaacacaggayggtatttttccagtatcttttcat

SEQ ID NO: 57027 - DNA, 50 bp, homo sapien
ggactagagggccttgagtctaaaastaaatcctctaagactctagggac

SEQ ID NO: 57028 - DNA, 50 bp, homo sapien
agaatgaatgagtagttggatctaakaaatacattaaagagatagtatat

SEQ ID NO: 57029 - DNA, 50 bp, homo sapien
atggaattctatcggacaatgtagaytaacagttttttgaggggatcacc

SEQ ID NO: 57030 - DNA, 50 bp, homo sapien
acaagacctaaaaccgtgtgtctcaytcagaatgcaaataagtcataggg

SEQ ID NO: 57031 - DNA, 50 bp, homo sapien
tttctactcttaaatgtgatacgaarcattatccttttgttcggttgccc

SEQ ID NO: 57032 - DNA, 50 bp, homo sapien
tgcagaagctaaagcctttttaaaaratgttagctgctgtagcccccatg

SEQ ID NO: 57033 - DNA, 50 bp, homo sapien
tttaaattttttgagcattattaaartctccacctactgtgtacatgtat

SEQ ID NO: 57034 - DNA, 50 bp, homo sapien
attgggtattttgtaatgcagaataygccgtaagaaataaaaactgcatt

SEQ ID NO: 57035 - DNA, 50 bp, homo sapien
agataaaagcacagcttccttcccaktagtaccaacaactgcacttctct

SEQ ID NO: 57036 - DNA, 50 bp, homo sapien
actgaggggcagataagttaggagayaaacacatccaataagtggtggag

SEQ ID NO: 57037 - DNA, 50 bp, homo sapien
tgaaaagttctgaggacatattatasaggctcaggatgcaggaattgcaa

SEQ ID NO: 57038 - DNA, 50 bp, homo sapien
cacactgctcctttatttcttttgawagtcttcactgctccatctcatgg

SEQ ID NO: 57039 - DNA, 50 bp, homo sapien
gagctccttatgtcttccgagttaaycggtgtgaaggcagtggtggtgta

SEQ ID NO: 57040 - DNA, 50 bp, homo sapien
ttggaagagtagtctatacttgtaayctctacttttttccttcactccat

SEQ ID NO: 57041 - DNA, 50 bp, homo sapien
tctaaatccaaatagctgacttataratggccctttggaacacaacccat

SEQ ID NO: 57042 - DNA, 50 bp, homo sapien
cctataaatattttttgtttaatccyaattcttcatattaggagacaaag

SEQ ID NO: 57043 - DNA, 50 bp, homo sapien
atcaatgttcttatttgtcaggaacrattattttacatgtaaaaacatgg

SEQ ID NO: 57044 - DNA, 50 bp, homo sapien
tacacacatacatatatacttttatraggtggcaccatagcataaaattg

SEQ ID NO: 57045 - DNA, 50 bp, homo sapien
tcttaagaatctgccttattacaackggagactctagtaagaagtaaaac

SEQ ID NO: 57046 - DNA, 50 bp, homo sapien
aaaacttttttttgaatagttaacaygtataagggaggttatgcgcagca

SEQ ID NO: 57047 - DNA, 50 bp, homo sapien
aaaaaatgtaattccatcttttgtcwcttcttataatcctgagagattaa

SEQ ID NO: 57048 - DNA, 50 bp, homo sapien
atatgcccccatgctaatgaggtacrgactctgatttgtatttaaatgat

SEQ ID NO: 57049 - DNA, 50 bp, homo sapien
cttctctttagggtctaacgttctgsaaatagtaaagtctattttgctat

SEQ ID NO: 57050 - DNA, 50 bp, homo sapien
cacttagcgtgcagtacttctgttayagcatccgatgtgtcctttatttt

SEQ ID NO: 57051 - DNA, 50 bp, homo sapien
gctttattgctttattatttcttcaygaaaatactgcttaaaataattat

SEQ ID NO: 57052 - DNA, 50 bp, homo sapien
attcaggcactacttgttggtcagayccaggaacctaatgattctgcaaa

SEQ ID NO: 57053 - DNA, 50 bp, homo sapien
ctaaagaagcaaggtgaatcatgaargtcagtattgcagcaagcaaaatc

SEQ ID NO: 57054 - DNA, 50 bp, homo sapien
ttcacaaaggtactttttggccctayctttaactcatgctgtgctaattc

SEQ ID NO: 57055 - DNA, 50 bp, homo sapien
ctaagagaggaagtggcactgcaacratgttgtatctgtactaaggtgct

SEQ ID NO: 57056 - DNA, 50 bp, homo sapien
agaagtaaaaatttaaaacatcaacycttgaatgaactttctgcttggtc

SEQ ID NO: 57057 - DNA, 50 bp, homo sapien
tgataatgaaacaagtgagtcttatyaatgagagtagctttaggtaggtg

SEQ ID NO: 57058 - DNA, 50 bp, homo sapien
gccccagtcactgctccaacttacayctttgttaccaggtggcaaacagc

SEQ ID NO: 57059 - DNA, 50 bp, homo sapien
acaaacgataaagtcactaggccaayaaatgaaaagagcctggtatcaac

SEQ ID NO: 57060 - DNA, 50 bp, homo sapien
aattactacaattgaacttattgaaytagacagtaaaatgataattacca

SEQ ID NO: 57061 - DNA, 50 bp, homo sapien
actaacaaagcctttggaagtttaasagcatttaaaggtaagtggagaat

SEQ ID NO: 57062 - DNA, 50 bp, homo sapien
gtggcacagcaagtaaacaacgtackacaaatctgtttacagcggcttct

SEQ ID NO: 57063 - DNA, 50 bp, homo sapien
catatactttcttgtaaatcctggarcgatgatgagtaaatttgacagct

SEQ ID NO: 57064 - DNA, 50 bp, homo sapien
ctaattgaaaacatggtgcatagggmatactcagtgtgtgtgtgtgttta

SEQ ID NO: 57065 - DNA, 50 bp, homo sapien
caattgctgatgtgattcatgaataratgatgcaacttataatgacttgg

SEQ ID NO: 57066 - DNA, 50 bp, homo sapien
cactaaagaaatgcagtgcttaaatraaagggcttcatgaaataccatgc

SEQ ID NO: 57067 - DNA, 50 bp, homo sapien
gacacatgttccaaatgagtatacawgcctaatagagtttctgtatatag

SEQ ID NO: 57068 - DNA, 50 bp, homo sapien
cctccttaactgaccagtgaaagcaragaccggttattgccattcaggag

SEQ ID NO: 57069 - DNA, 50 bp, homo sapien
agtgagaccaaaggcagatgcaaaasttacttaatatatgtcctggggcc

SEQ ID NO: 57070 - DNA, 50 bp, homo sapien
gatttgtttggggagagaagaattayctacacatcattaaaatctttttt

SEQ ID NO: 57071 - DNA, 50 bp, homo sapien
atttcaaaagcctacttgatttcccraattactccattaaaaattaactc

SEQ ID NO: 57072 - DNA, 50 bp, homo sapien
ctcattagcactctacacttttacaygaaagccaagttaataggccattc

SEQ ID NO: 57073 - DNA, 50 bp, homo sapien
tttttgttgttgttaaaaatgtctayaaagttggcagtcaatgctgaatt

SEQ ID NO: 57074 - DNA, 50 bp, homo sapien
aactaatagttgttgcagttaatctkagaaattaaatatgatcaagtttc

SEQ ID NO: 57075 - DNA, 50 bp, homo sapien
tgtgcttttgtcagcctcaagtgccratgtacatacagaaaagaccacgg

SEQ ID NO: 57076 - DNA, 50 bp, homo sapien
tattgtcagcaaactgctggaaacckaaactaccagaaaaagtgatctgg

SEQ ID NO: 57077 - DNA, 50 bp, homo sapien
aatactctttgggaaggacctttgaraacaagactatagtcaaagtttgg

SEQ ID NO: 57078 - DNA, 50 bp, homo sapien
tgatatgaaatattgatgacttataraagagaatgtatcggtgctatatt

SEQ ID NO: 57079 - DNA, 50 bp, homo sapien
tgtaacgaaatatagaaaatgcttayggtggcttcgcggtagttaaaaat

SEQ ID NO: 57080 - DNA, 50 bp, homo sapien
actttaagacaagaagggaactattkaactaataccagcatttccatgac

SEQ ID NO: 57081 - DNA, 50 bp, homo sapien
aatctatagcctaaggaggagttcawctagaacctgaatcaagattaatt

SEQ ID NO: 57082 - DNA, 50 bp, homo sapien
aacaaagttttgaattaccaaattgmatagatgtgaagcagccgtaagcc

SEQ ID NO: 57083 - DNA, 50 bp, homo sapien
agctggatgtgccagaagacttacgrcaaatgtaagttgatacacaagaa

SEQ ID NO: 57084 - DNA, 50 bp, homo sapien
tctcccttttacaaccaaagttaatratcacacaatacagtgactgaata

SEQ ID NO: 57085 - DNA, 50 bp, homo sapien
tataaatcaaaactttctgaatgtaygaaaatcacttaaagacaaacata

SEQ ID NO: 57086 - DNA, 50 bp, homo sapien
tacaaaaagtgatattccattttaaraagattgacaaattcaactacata

SEQ ID NO: 57087 - DNA, 50 bp, homo sapien
atgtacttcaaacttttatcagctayggttaatgggcatttttggcacac

SEQ ID NO: 57088 - DNA, 50 bp, homo sapien
ttagttagtgcaaagtacagagtgaygtaaagagttaaatgactgatcgc

SEQ ID NO: 57089 - DNA, 50 bp, homo sapien
agggagattttcagggtgtgatcaayattagtttagccccaagacaaact

SEQ ID NO: 57090 - DNA, 50 bp, homo sapien
attgtaccttccacacgagtaatgamaagacttaaagaagaatcacatac

SEQ ID NO: 57091 - DNA, 50 bp, homo sapien
ttaaaaagcctccacattctctatamacaattcagtggatttttgctttg

SEQ ID NO: 57092 - DNA, 50 bp, homo sapien
taatgcatgtaaaatggtgtctaackcacggaaagggctaagtaaatata

SEQ ID NO: 57093 - DNA, 50 bp, homo sapien
ctaggaggtcactggcctgagcatayggtgatcccaagggcttagaattt

SEQ ID NO: 57094 - DNA, 50 bp, homo sapien
agttctgttagattattaactctgcygatattatcctatattattgattt

SEQ ID NO: 57095 - DNA, 50 bp, homo sapien
gtatgtatggagtaaatagtgatcaragctatttaccggctagagctcag

SEQ ID NO: 57096 - DNA, 50 bp, homo sapien
aggcctacaagactatgaaagaggaygaaaaaagatacaatgaaagaatt

SEQ ID NO: 57097 - DNA, 50 bp, homo sapien
tctctcttagggaaattgttctttcratgtgtccagagacccgtttattt

SEQ ID NO: 57098 - DNA, 50 bp, homo sapien
cttccatctgatgactattagatgakccataggaaattaattgcaggttt

SEQ ID NO: 57099 - DNA, 50 bp, homo sapien
gctggaggttactgttccttctgaaytctcatagtgcatcatctataaag

SEQ ID NO: 57100 - DNA, 50 bp, homo sapien
gcaataaaatgaacttctttagtccygctaatacttgttggcattagaca

SEQ ID NO: 57101 - DNA, 50 bp, homo sapien
tgtagacatatgactatcccgcttayaaccctttcttgtgtttttgtata

SEQ ID NO: 57102 - DNA, 50 bp, homo sapien
gaacatgaaaagttcgctactcaaayatacctgtacgcaccagaccattg

SEQ ID NO: 57103 - DNA, 50 bp, homo sapien
tgggatggaaatttaaaaagaagaamgtatgtctccaaattgagtggctg

SEQ ID NO: 57104 - DNA, 50 bp, homo sapien
tacaacatactgttcttttgtgatgkatttagatagtgtcaacggggtca

SEQ ID NO: 57105 - DNA, 50 bp, homo sapien
aatattcctcattggaaaagaacccrctgttaattattaatgaagccagg

SEQ ID NO: 57106 - DNA, 50 bp, homo sapien
ctggtgtgacatctttagtacatacyaccacatcatgcacagatcagggg

SEQ ID NO: 57107 - DNA, 50 bp, homo sapien
ctggcttctatccccaaatgggccartagacttttgctcacatttcaagt

SEQ ID NO: 57108 - DNA, 50 bp, homo sapien
actctaaccaactaagaaaattacasataccattaataccatttaaaagc

SEQ ID NO: 57109 - DNA, 50 bp, homo sapien
ctcaggacgtgaatcaagtaaaagcygatggaaatacggcatggtgaggt

SEQ ID NO: 57110 - DNA, 50 bp, homo sapien
aaagctttacttacttctcaaatgakataaaaggttcaaatcctcttttg

SEQ ID NO: 57111 - DNA, 50 bp, homo sapien
ggcaactgtggttaaataggatcaaygtttcaaacaatgttagtatttat

SEQ ID NO: 57112 - DNA, 50 bp, homo sapien
accacaaaagctgaacgtgaatctgractagaggccagtttcctaaggct

SEQ ID NO: 57113 - DNA, 50 bp, homo sapien
tttctgagtttcttaagggtgatgayagttgttgcagatagactgttaga

SEQ ID NO: 57114 - DNA, 50 bp, homo sapien
tgtgaccaaatatttcaacctgacasaattaggttaggaagcaaagtacc

SEQ ID NO: 57115 - DNA, 50 bp, homo sapien
agtttggaagcttttattagtcataygttactgagtttagtattttcttt

SEQ ID NO: 57116 - DNA, 50 bp, homo sapien
attacaattgaaggactttccaagayaacgcatgaaagctcctacagaaa

SEQ ID NO: 57117 - DNA, 50 bp, homo sapien
ttttagtgctcactagcatcttacartcaggtttacacaggttaaaaaga

SEQ ID NO: 57118 - DNA, 50 bp, homo sapien
tcatcaatctgtattgttaatacacygcacatgtgtaagggcaagtccac

SEQ ID NO: 57119 - DNA, 50 bp, homo sapien
tgttgaagaaagaactttgattcaaytgtctggaacatatttcatttcct

SEQ ID NO: 57120 - DNA, 50 bp, homo sapien
tacagcactatccttcacagagactwaccagctatttagtgttaagttga

SEQ ID NO: 57121 - DNA, 50 bp, homo sapien
gactataaatttcttctaacacatayggaaagcggtttctcagtagactc

SEQ ID NO: 57122 - DNA, 50 bp, homo sapien
ttctccatcttttccaataccttctyacaatacccgcctcttactgagct

SEQ ID NO: 57123 - DNA, 50 bp, homo sapien
ttaaccgttttaatttgtggcacaamgatttagtggtatatagtataagt

SEQ ID NO: 57124 - DNA, 50 bp, homo sapien
gcttgaaactgagatagtaatattayctacccaaggggatgtttggaaat

SEQ ID NO: 57125 - DNA, 50 bp, homo sapien
tatatggtggacagcaagtgttgaamattattgctgtttgtatacatgca

SEQ ID NO: 57126 - DNA, 50 bp, homo sapien
agaaaagtagttgcctgacaatgtayatgtgtgaatagaccattttttgg

SEQ ID NO: 57127 - DNA, 50 bp, homo sapien
cagtcagctacctgaggtgtcaatayataagggacacacttaggtattag

SEQ ID NO: 57128 - DNA, 50 bp, homo sapien
ccgattgctcataataatagtgtaayggaggagataagagatttcaacaa

SEQ ID NO: 57129 - DNA, 50 bp, homo sapien
ctcaagcaagagaagtacatgatgayggacctttgtactcaagtgccatt

SEQ ID NO: 57130 - DNA, 50 bp, homo sapien
actttaattttcaagaatgttcttaygttagcacaagatttacttttcca

SEQ ID NO: 57131 - DNA, 50 bp, homo sapien
acacttttattcaacatcctgaaaamgccttaaggacagtggcacctccc

SEQ ID NO: 57132 - DNA, 50 bp, homo sapien
gtcatggcaaggccaccatgtgaaartgtttgttaatattgatcaggaaa

SEQ ID NO: 57133 - DNA, 50 bp, homo sapien
attgtatcataattgataagacccartcctttcacacaaggaactcatac

SEQ ID NO: 57134 - DNA, 50 bp, homo sapien
tgccatgtttttcacactttaaaacyacacactttcagtactttgatatt

SEQ ID NO: 57135 - DNA, 50 bp, homo sapien
ctgagcaagtcatgttctagaactaygagactaaacaatgaagaactttg

SEQ ID NO: 57136 - DNA, 50 bp, homo sapien
tcattttaaagtggctataattctayacttgtgttctataatcaggaatt

SEQ ID NO: 57137 - DNA, 50 bp, homo sapien
cggcttccacatgaaaggcgtaacartgtgaggtatagataactgagcag

SEQ ID NO: 57138 - DNA, 50 bp, homo sapien
ctggcaggcagcccaaagagctgaarttagaggagaccaggagtccaaaa

SEQ ID NO: 57139 - DNA, 50 bp, homo sapien
gagttcaggatttctgagttgctgamaacctgacaccctcagactaacca

SEQ ID NO: 57140 - DNA, 50 bp, homo sapien
tgagactggggactgtgggatcaacrgaatgtttccaggacttcattcta

SEQ ID NO: 57141 - DNA, 50 bp, homo sapien
ataaatgaaatttaggaaaatgccakaactagaatcttgactgaggaaag

SEQ ID NO: 57142 - DNA, 50 bp, homo sapien
gataaaaattgtttagtttggtataygacaaatgaggtagatctaagaaa

SEQ ID NO: 57143 - DNA, 50 bp, homo sapien
cagttaatttaaggtagggaaatctsaaaagaatatgaaaagggaatgtg

SEQ ID NO: 57144 - DNA, 50 bp, homo sapien
cccaaatttaagtatgtttagtacartccttagactaatcatgaaaaaac

SEQ ID NO: 57145 - DNA, 50 bp, homo sapien
ctgggagtgggctctgattttgttargaatggtagaatatgttagaataa

SEQ ID NO: 57146 - DNA, 50 bp, homo sapien
aatagttgaaatgagcttccataaamcttagtgttgaatttgaagcttaa

SEQ ID NO: 57147 - DNA, 50 bp, homo sapien
ttacactctcttcttgcacttcttaygctctactacaattatttgttttc

SEQ ID NO: 57148 - DNA, 50 bp, homo sapien
ctatcactgtgataacaacaagtagraaggataaaagaggaggaatacaa

SEQ ID NO: 57149 - DNA, 50 bp, homo sapien
agcctgaatattgtattcggaaggaycatgttatttattaaactgtgtga

SEQ ID NO: 57150 - DNA, 50 bp, homo sapien
tatgagaacaagattgaattactcarataagtgaaatataccctcacttt

SEQ ID NO: 57151 - DNA, 50 bp, homo sapien
aagctatttagaagcagtaggtaaayaatacatctctaagcttggatcgc

SEQ ID NO: 57152 - DNA, 50 bp, homo sapien
ctgtccgcttttctatggcccaaccratgctttcttggtctcaagtgacc

SEQ ID NO: 57153 - DNA, 50 bp, homo sapien
ttccttctggcccagggtgtatctawcaatgtcatccaggagctagggcc

SEQ ID NO: 57154 - DNA, 50 bp, homo sapien
aacattgatttatttgaaactttgaygattttgagtgctctattccaaag

SEQ ID NO: 57155 - DNA, 50 bp, homo sapien
gaacaaatatgtgcattccaaatcayacatgtagctggaaaagaggttag

SEQ ID NO: 57156 - DNA, 50 bp, homo sapien
caaacacaaggaagatcaaaatagaygtagaggatatttagcctttggat

SEQ ID NO: 57157 - DNA, 50 bp, homo sapien
ctcttgaagttttgatttgccatccrgagttgtaaagcacttccttactc

SEQ ID NO: 57158 - DNA, 50 bp, homo sapien
gagtgctcataagtgcatgcaaagaygttacaagtaattttaccagttgc

SEQ ID NO: 57159 - DNA, 50 bp, homo sapien
atcataattaattaaaaagtatatcsagatccctgggcatgacatagaag

SEQ ID NO: 57160 - DNA, 50 bp, homo sapien
aggaacctcaggaacaaatggctaaycaagagaagaagcccaataagttg

SEQ ID NO: 57161 - DNA, 50 bp, homo sapien
aatgatgtcacttataaagttgataragagtattagtgtattgaattcct

SEQ ID NO: 57162 - DNA, 50 bp, homo sapien
agtctgacataggaaggaggctgaawcactgttattgtcagagttcaaag

SEQ ID NO: 57163 - DNA, 50 bp, homo sapien
gcctctgtcgaagctgtaagttcaarctatatgttcctattgctgctaat

SEQ ID NO: 57164 - DNA, 50 bp, homo sapien
aatataactaccatgactagaagaayggactgtatatgcgtatgtggaaa

SEQ ID NO: 57165 - DNA, 50 bp, homo sapien
cattcatatatttcaactctttatcrctctcctgaattgagcaatttcat

SEQ ID NO: 57166 - DNA, 50 bp, homo sapien
ttaagtaaagatatgtttcacatagkatatcgtagtaccatatttaccaa

SEQ ID NO: 57167 - DNA, 50 bp, homo sapien
tagtcatatagccagttagtgatgasgctgaacaaaaaccaagtcctctg

SEQ ID NO: 57168 - DNA, 50 bp, homo sapien
ctcccattctctagattatctgtacwctctgattatagttcattttgcta

SEQ ID NO: 57169 - DNA, 50 bp, homo sapien
ttattatgagtttcaaaatcactgamccaaagtaagaccaaacaaaaagt

SEQ ID NO: 57170 - DNA, 50 bp, homo sapien
aagctaaaggggcaggatggtttacmatagttacgtctctaaaaatgggt

SEQ ID NO: 57171 - DNA, 50 bp, homo sapien
gctgagaaatgtataagttccaagayctatgtccctgtctgaatgactga

SEQ ID NO: 57172 - DNA, 50 bp, homo sapien
aatttcttcctctgcctcaggtgaamtattgcttgacttagccaaccaat

SEQ ID NO: 57173 - DNA, 50 bp, homo sapien
aaagcacaggactggacttaaaagtractattgaatccaggtttcctacc

SEQ ID NO: 57174 - DNA, 50 bp, homo sapien
ttcatatttctttcaaaatgttctcratcaattttgccggcactttctct

SEQ ID NO: 57175 - DNA, 50 bp, homo sapien
atgcattaaatcctaatgagctgccrattaggtgaaatccctgagttttg

SEQ ID NO: 57176 - DNA, 50 bp, homo sapien
attgcaagactcttactagtgaaaartatggtagaagaggattgggaagg

SEQ ID NO: 57177 - DNA, 50 bp, homo sapien
gtgttaaacatttgtcttttcttcaygtagaaccagtacaattctagcta

SEQ ID NO: 57178 - DNA, 50 bp, homo sapien
ctggatagtagacctgtccacctcastcttttactttcagaaggatgaga

SEQ ID NO: 57179 - DNA, 50 bp, homo sapien
aaatcactatttctgtgcagtttaawtccaaaaattgtacaaattagact

SEQ ID NO: 57180 - DNA, 50 bp, homo sapien
tcacttgtttctcctcactggtagcractcttcattcaatgatcccattt

SEQ ID NO: 57181 - DNA, 50 bp, homo sapien
tgggaggtaaagaactgggaataaaygtgtcaaaaactgcctaaaaatca

SEQ ID NO: 57182 - DNA, 50 bp, homo sapien
atttgttcagtggtgcagtcatttcrcctataatgtgcaagtcaaatgtc

SEQ ID NO: 57183 - DNA, 50 bp, homo sapien
taaagtttctcttgcataagctacaygtataaggctgctcacctgtgtga

SEQ ID NO: 57184 - DNA, 50 bp, homo sapien
gactcagttgactgtggttacatcaygggttggcagcttggaaacaggat

SEQ ID NO: 57185 - DNA, 50 bp, homo sapien
tcttagaatttattccagaggcatargaacttacaaggagatgtgaaggg

SEQ ID NO: 57186 - DNA, 50 bp, homo sapien
gccatattagagtaccttctgcagcrataacaatgtatgcattgccccaa

SEQ ID NO: 57187 - DNA, 50 bp, homo sapien
tcctggtcttgattgttcatgtagayagaatgataactattgaaactgtc

SEQ ID NO: 57188 - DNA, 50 bp, homo sapien
aagataactgacttattactccagaratacgcttcataggcctttaaatt

SEQ ID NO: 57189 - DNA, 50 bp, homo sapien
gcacacatattgtcaacagcagtaakggacacggaaaaaatggaaacaac

SEQ ID NO: 57190 - DNA, 50 bp, homo sapien
gtctgcccataagcacctcacctctractatcttctagtaatcagcactc

SEQ ID NO: 57191 - DNA, 50 bp, homo sapien
ggcggcggtaaagcactctacagaaygtctacaaaatgaaatcataataa

SEQ ID NO: 57192 - DNA, 50 bp, homo sapien
tcaatattggaggacctcaacaagasagtatttcacctaagtgtataggg

SEQ ID NO: 57193 - DNA, 50 bp, homo sapien
agaaacatggcaacttatatatgcargtaattttcacattattctttagt

SEQ ID NO: 57194 - DNA, 50 bp, homo sapien
gcagaagcttgcttcagaaagtaacraaatgggatataagcaggaaattg

SEQ ID NO: 57195 - DNA, 50 bp, homo sapien
gcagggattcgggttcaagataaacrcttgcccatccaaggcaccagtat

SEQ ID NO: 57196 - DNA, 50 bp, homo sapien
tgaaatgattttttaaaagcaatcaytcattattaaaatatggaattgac

SEQ ID NO: 57197 - DNA, 50 bp, homo sapien
gggctaaagttagcgataagaaaatragatggcctaccctaaagttatat

SEQ ID NO: 57198 - DNA, 50 bp, homo sapien
ccaaacttaatggacagcccttagawcgagagtccatatcctatatattg

SEQ ID NO: 57199 - DNA, 50 bp, homo sapien
tccacaaggtaaaaatccaaagttaygctttatgaggctccaagctgcct

SEQ ID NO: 57200 - DNA, 50 bp, homo sapien
tgaccaccaaagtgtccttggagaayggttatagaattataggaactcat

SEQ ID NO: 57201 - DNA, 50 bp, homo sapien
tgaaagctgtgtttacatctattccrattcctaaataattgctcccagca

SEQ ID NO: 57202 - DNA, 50 bp, homo sapien
taggccccagtggtaataagacatasaaacgatgaaccagagcacaggca

SEQ ID NO: 57203 - DNA, 50 bp, homo sapien
taaaaataccatcatgaattgcaaayccaaatatataaaccaagctttat

SEQ ID NO: 57204 - DNA, 50 bp, homo sapien; identical to SEQ ID NO: 56708

SEQ ID NO: 57205 - DNA, 50 bp, homo sapien
aagcacatggattctcacagcaaatyagacacaaagtagtagcctagagc

SEQ ID NO: 57206 - DNA, 50 bp, homo sapien
ggcagcagactgcctgacttggaaaygaggtagagcctacttaatatctg

SEQ ID NO: 57207 - DNA, 50 bp, homo sapien
tatatttctgtatactagcaataaaygatatgaaaatgaaattaagacaa

SEQ ID NO: 57208 - DNA, 50 bp, homo sapien
taatgctatggacagctataagatcraaatagttttctaaagaaaatact

SEQ ID NO: 57209 - DNA, 50 bp, homo sapien
actttgcatcttaaaaatatttaatyacgcaagttgtgcatgaacacatt

SEQ ID NO: 57210 - DNA, 50 bp, homo sapien
acagagtaggtgtgccgtaggaagcraagaatagaattggctccctttgg

SEQ ID NO: 57211 - DNA, 50 bp, homo sapien
tgaaaaattacactgccttgaagtaygctaaactataccaactgtgtact

SEQ ID NO: 57212 - DNA, 50 bp, homo sapien
aggttgaacaacaactatccttaggmaagtggaaataatgtattaataaa

SEQ ID NO: 57213 - DNA, 50 bp, homo sapien
attctgaagaaatggagttattcatsagcaagaacgatgtcatatatggg

SEQ ID NO: 57214 - DNA, 50 bp, homo sapien
tacaattccactcctagatatatgcscaagaggattgaaaacagagattc

SEQ ID NO: 57215 - DNA, 50 bp, homo sapien
agccattttgtgaatgtataagagasagaattacaacagggtggatttcg

SEQ ID NO: 57216 - DNA, 50 bp, homo sapien
tttagtttcatactccttttttggcyacatatttcactacttcttcatgt

SEQ ID NO: 57217 - DNA, 50 bp, homo sapien
tactaaacattataacaaattagtayagtttaaggagatacatatgtgtg

SEQ ID NO: 57218 - DNA, 50 bp, homo sapien
tcacttgtgacataactgattaacamgctgcaaatagagttaaatctcaa

SEQ ID NO: 57219 - DNA, 50 bp, homo sapien
taaatgttattcaaatcattttatargtaaactcaagagcagccctgtgc

SEQ ID NO: 57220 - DNA, 50 bp, homo sapien
gcacagaaaagtcatgagattacaaraaaaagttgaattgcctgatatgt

SEQ ID NO: 57221 - DNA, 50 bp, homo sapien
tacatatctctatctcccttatcacrattatagtaatttaatgtaaccct

SEQ ID NO: 57222 - DNA, 50 bp, homo sapien
catgataaaactttttggtttctgcracttctcatcacaacccaagcatt

SEQ ID NO: 57223 - DNA, 50 bp, homo sapien
ttctcagcttctataatggtgtaagscaatacttcatgataaatctctct

SEQ ID NO: 57224 - DNA, 50 bp, homo sapien
tgcctgtggtttcaaggtataagttmaactggaaagtgaaagaacaagtt

SEQ ID NO: 57225 - DNA, 50 bp, homo sapien
caatgagggtcggcatgatctaatcyatttatggtccaaatagagccaaa

SEQ ID NO: 57226 - DNA, 50 bp, homo sapien
ctatgcacttttctgaacacaattakcttttgtatcttacaatattatta

SEQ ID NO: 57227 - DNA, 50 bp, homo sapien
cttctacaaatccagctagaaacaaraagatggaaattgggaggatgctg

SEQ ID NO: 57228 - DNA, 50 bp, homo sapien
ggctgattctggcttttctccaacaygctgtggctcagatcatactccag

SEQ ID NO: 57229 - DNA, 50 bp, homo sapien
cctaatgactcctggttcttattgtraacttcgcttcctgtccttggcca

SEQ ID NO: 57230 - DNA, 50 bp, homo sapien
ctagtagtcttcagaactaggcatayataacgctaacttctagaaaaagc

SEQ ID NO: 57231 - DNA, 50 bp, homo sapien
aaaaccattattgaatggagacatasgatttaacaaaacatttttatgct

SEQ ID NO: 57232 - DNA, 50 bp, homo sapien
tgaatgaaattagcgcatggatttayatggaacttccattctttttgcta

SEQ ID NO: 57233 - DNA, 50 bp, homo sapien
aagaggtgtctggtgttctcctatcrcagttattctgatgacacttcaaa

SEQ ID NO: 57234 - DNA, 50 bp, homo sapien
tacacaagcccattctgtgataatasctcaaatgaatgcatcactttgtt

SEQ ID NO: 57235 - DNA, 50 bp, homo sapien
ccaccctgcattcctacttcaagaargctcagatgtgctggcctccagct

SEQ ID NO: 57236 - DNA, 50 bp, homo sapien
gagcaaagacatgaaatcatccttamataaccataaatgatagactagat

SEQ ID NO: 57237 - DNA, 50 bp, homo sapien
tgtgttgaaggcagcctattagatamaaaactccttaccagcctatggac

SEQ ID NO: 57238 - DNA, 50 bp, homo sapien
aagtacatggagtcatttctgatcartcctgtgctgtctacaactctgca

SEQ ID NO: 57239 - DNA, 50 bp, homo sapien
agcttaaataccatcttgatgttackgaaagaattgggattggaatttga

SEQ ID NO: 57240 - DNA, 50 bp, homo sapien
gggatacctcctagcaccagggctamcctattttatttcctcttcgccag

SEQ ID NO: 57241 - DNA, 50 bp, homo sapien
ctgctagtcttgtgtgagttctgagyatagttcttttaaaacttcccagt

SEQ ID NO: 57242 - DNA, 50 bp, homo sapien
caacatttatccgttagctccgtcaycttatataggcacagtttatggca

SEQ ID NO: 57243 - DNA, 50 bp, homo sapien
caacaagatgcagaattatgccaagsaatcttactggcagcaggtttgag

SEQ ID NO: 57244 - DNA, 50 bp, homo sapien
tcctgagagttttcttttgagggtawctgggaatattcaggagccaagat

SEQ ID NO: 57245 - DNA, 50 bp, homo sapien
tactactgagatgtcagagggaaatragtcaattcttgaattgtcttctt

SEQ ID NO: 57246 - DNA, 50 bp, homo sapien
catttgcataacaaatgtgacagaayggttacttaagagactaaaacagg

SEQ ID NO: 57247 - DNA, 50 bp, homo sapien
gtcattaaaaaataatgtatggatamctgctatgatatgggtgaaccttg

SEQ ID NO: 57248 - DNA, 50 bp, homo sapien
ctcttctcattatttgttttgtaaaragaccctgagtttgttgggagtag

SEQ ID NO: 57249 - DNA, 50 bp, homo sapien
gcagcttaacagcaaaactagaagasaacagggcttattcacctgataat

SEQ ID NO: 57250 - DNA, 50 bp, homo sapien
tctcttggttttaatcttgggtctayaaatctgtgtttgagaagtagcat

SEQ ID NO: 57251 - DNA, 50 bp, homo sapien
aattttctctgccaaattaagctgayagagattggccactttcaaccagt

SEQ ID NO: 57252 - DNA, 50 bp, homo sapien
gagaaaacaaggaaagagggaactaygaaggagaagaaaagaagggaacg

SEQ ID NO: 57253 - DNA, 50 bp, homo sapien
gattctcaaccttggccacacagtcraatcaccaaggagtcttcaaaggc

SEQ ID NO: 57254 - DNA, 50 bp, homo sapien
cattgatgcatgctttctgatattcrcccagtggcagtactttttgttgg

SEQ ID NO: 57255 - DNA, 50 bp, homo sapien
ctctagtgggtttgaacgaagaacayctaatggttttgtcagtagtagtt

SEQ ID NO: 57256 - DNA, 50 bp, homo sapien
attccacagaccttagctatacttakgaaactcagataaagaataccctg

SEQ ID NO: 57257 - DNA, 50 bp, homo sapien
tctagaaaaggcataactatgaagayaagaaaaagatcagtggtttccag

SEQ ID NO: 57258 - DNA, 50 bp, homo sapien
ttcatctacaggctccaatatcctayggtttctcccaacacctgggaaat

SEQ ID NO: 57259 - DNA, 50 bp, homo sapien
ttaggcatccaagggtcttcgggcaytatttcagaaggcgtctcaagctc

SEQ ID NO: 57260 - DNA, 50 bp, homo sapien
aaaaatcagcatatctcagccataaytggtcttcactcagccaccagctc

SEQ ID NO: 57261 - DNA, 50 bp, homo sapien
cccccaagtgctatatctcctgtcartactggttgatgtgtgatattgaa

SEQ ID NO: 57262 - DNA, 50 bp, homo sapien
ctgtaaatagcttgtcacataggacrggatccgaaaaggagagttttgtg

SEQ ID NO: 57263 - DNA, 50 bp, homo sapien
aaagatactgacatccaaggatcaargatcactcccattcatgggtctca

SEQ ID NO: 57264 - DNA, 50 bp, homo sapien
cagcaagaaaaagtgtttaggagatsactataggcaaagctttcattatc

SEQ ID NO: 57265 - DNA, 50 bp, homo sapien
cttcaaataaaaactgtacttaatcrataaactgcatttaaaaattctaa

SEQ ID NO: 57266 - DNA, 50 bp, homo sapien
gagtaacatacaacggtagagtaatraactatgatgctaaattttcatta

SEQ ID NO: 57267 - DNA, 50 bp, homo sapien
gcttagctagcattatctcaataaaractttacaagaatctcacaaggga

SEQ ID NO: 57268 - DNA, 50 bp, homo sapien
gtcaaggggttctgtacttctgtagycattactttggaatgggctattcc

SEQ ID NO: 57269 - DNA, 50 bp, homo sapien
cacttgctatgtgctttgcagatggracttgacttttttttttttgagac

SEQ ID NO: 57270 - DNA, 50 bp, homo sapien
tggagcatgcacacaaatgatttaakacattgtagtgcatgttgggatag

SEQ ID NO: 57271 - DNA, 50 bp, homo sapien
aagctgtgctgaagggacttgatacrctgctggcccagaagcttcgcccc

SEQ ID NO: 57272 - DNA, 50 bp, homo sapien
cctgggacaaagataggatcttacarctttccagagaggaacaaccaacc

SEQ ID NO: 57273 - DNA, 50 bp, homo sapien
cctggagtttttgtagggatgtccckgattctttaagacatttgcactgt

SEQ ID NO: 57274 - DNA, 50 bp, homo sapien
ggccctcataatccttcccttggacyattgcagtaacctccctgtcggca

SEQ ID NO: 57275 - DNA, 50 bp, homo sapien
ggcacgggtctgtgtgagacattacraaggcagtagccatggagcacgag

SEQ ID NO: 57276 - DNA, 50 bp, homo sapien
ttctggggatgcgctggttcatgcaycgttgtatcctgctaggaaggtat

SEQ ID NO: 57277 - DNA, 50 bp, homo sapien
tttctagagaattcaggacaagaaaratccctaggactgagatgggtgga

SEQ ID NO: 57278 - DNA, 50 bp, homo sapien
aatgctatatccaacccagatgttaygagggtatagagtaaggacatttg

SEQ ID NO: 57279 - DNA, 50 bp, homo sapien
gtgtcttagtgtcgctgttgagaaayacgatggtcaaaagtggaaggaaa

SEQ ID NO: 57280 - DNA, 50 bp, homo sapien
aaaatacacatgatacaaaaagataygcagtaagaaggctctctctccca

SEQ ID NO: 57281 - DNA, 50 bp, homo sapien
cttttttattattatgaaaatacgcmactggcaaaaatacacatgataca

SEQ ID NO: 57282 - DNA, 50 bp, homo sapien
atgaaatcacataactgtctaaaacrtaagtgctattttaagttttattc

SEQ ID NO: 57283 - DNA, 50 bp, homo sapien
gtggcttacttaggttctctgaacasattcccggtgtcccctcacatacc

SEQ ID NO: 57284 - DNA, 50 bp, homo sapien
agatactggagatgtacctactgcawatggcttctcctcacagtggattg

SEQ ID NO: 57285 - DNA, 50 bp, homo sapien
gacgtgcacctggaaactgagatccmagtcatctggctgtaggtttccct

SEQ ID NO: 57286 - DNA, 50 bp, homo sapien
gttccacagcacaaatacatagaccygactacagtggtttaaatagatag

SEQ ID NO: 57287 - DNA, 50 bp, homo sapien
ttcacatttgacaacttggtatttckttcattcttagaattcctcgtccc

SEQ ID NO: 57288 - DNA, 50 bp, homo sapien
cgaggcaagaggactgcttaaggccrtaagtccgaaaccagcctgggcaa

SEQ ID NO: 57289 - DNA, 50 bp, homo sapien
ggctcaatgtccccagtacttgtcaygggcttcaacgttatgctccaagc

SEQ ID NO: 57290 - DNA, 50 bp, homo sapien
cttttccagctttctaaaagcactamtactgtaaaacttaggttattttt

SEQ ID NO: 57291 - DNA, 50 bp, homo sapien
tgcttctgcaggactggatcagatcraggatttcatgtatttaccatccc

SEQ ID NO: 57292 - DNA, 50 bp, homo sapien
atgcaaaggctgataaaatatttccmagacatgctctaaatagcaggcac

SEQ ID NO: 57293 - DNA, 50 bp, homo sapien
ggccaggatagaaaaacctgaccagragaattgtagcgaaaaccacagga

SEQ ID NO: 57294 - DNA, 50 bp, homo sapien
cctcctctagaacggctggcccaacrcttttccagggctcagccatttct

SEQ ID NO: 57295 - DNA, 50 bp, homo sapien
ccttccagaaaacttcccggcatccragttcagaccctccatttggtaag

SEQ ID NO: 57296 - DNA, 50 bp, homo sapien
actcaataaatgtgcattttccttaygttgctaatacaaggcccactgaa

SEQ ID NO: 57297 - DNA, 50 bp, homo sapien
gtgaaagccgctcaccactggcttargaaactcccgggaggcagttgcaa

SEQ ID NO: 57298 - DNA, 50 bp, homo sapien
gaggagtggccacgggaaggctgaaytggatgctcaccaagattcctccc

SEQ ID NO: 57299 - DNA, 50 bp, homo sapien
acgggcaagcctccccatgaagagaygatccaggtgcgacacaggaggtg

SEQ ID NO: 57300 - DNA, 50 bp, homo sapien
tgaccaccactagaaaaaagataaaygaccgctgggcagggtggcttacg

SEQ ID NO: 57301 - DNA, 50 bp, homo sapien
ggggggctctgattgtttgggcctcrcaaagacctctctccccagccagg

SEQ ID NO: 57302 - DNA, 50 bp, homo sapien
gttcccccatctgtagagtggggacratgcaattccttcctcccaagggt

SEQ ID NO: 57303 - DNA, 50 bp, homo sapien
gcttctgctgaggtcagtacaataarcagaagggaataataatggcccct

SEQ ID NO: 57304 - DNA, 50 bp, homo sapien
tttctaatatttgaagatacatcacrcctgcagaattatgcactccattc

SEQ ID NO: 57305 - DNA, 50 bp, homo sapien
aaccaaaggcattgggtaattcactsaaaccctagcatgtcttcctactc

SEQ ID NO: 57306 - DNA, 50 bp, homo sapien
cctatttgttctgcagttggagaatrcaaggtggatggtctggaatggca

SEQ ID NO: 57307 - DNA, 50 bp, homo sapien
tgctggtctcagctccagggaagcayggactggattaacacagaattaaa

SEQ ID NO: 57308 - DNA, 50 bp, homo sapien
ttcagcagcaattccatttttcttaygcactggagtatttgtatttcttc

SEQ ID NO: 57309 - DNA, 50 bp, homo sapien
aaccccttcaggaattaagcctgagkcagggtcctctcagatgcaatgcc

SEQ ID NO: 57310 - DNA, 50 bp, homo sapien
atgtggtgtagacacgaggtacagaygcatatggatgtgccgtgtagatg

SEQ ID NO: 57311 - DNA, 50 bp, homo sapien
aaattaggactgattcagaagggaaratggatgataagaaagaggaccat

SEQ ID NO: 57312 - DNA, 50 bp, homo sapien
gtctcagggtagctggtttaggatcrgagagacacagattggaatcccaa

SEQ ID NO: 57313 - DNA, 50 bp, homo sapien
actgatgacacgtcatgaactcagcrttggaagtttttctagtgttcatc

SEQ ID NO: 57314 - DNA, 50 bp, homo sapien
agctcaattcaaaactcgaatttgaygaaaggaggctctgcaattcagcc

SEQ ID NO: 57315 - DNA, 50 bp, homo sapien
tgatcccactctgggtggtattcacrgccactctgattcagtcatgtata

SEQ ID NO: 57316 - DNA, 50 bp, homo sapien
ccacttgcctttgcattttgcaagaygcttttacatatgtttgtttcttt

SEQ ID NO: 57317 - DNA, 50 bp, homo sapien
gtgtcttatactcattaaaaaagccrgagcataaacccagtgcttgagct

SEQ ID NO: 57318 - DNA, 50 bp, homo sapien
ggtgccagcgtgcatcgtttgagaayggaacatctttggttttttgatgt

SEQ ID NO: 57319 - DNA, 50 bp, homo sapien
atgcccaagcctttggacactttgaycattgcatggttgccgtccctggc

SEQ ID NO: 57320 - DNA, 50 bp, homo sapien
acggtgaccttcaactatagttttgraaatgatgatctaggccaggggtt

SEQ ID NO: 57321 - DNA, 50 bp, homo sapien
atgtgtccatcctgaaagctgaaagyaatccctatggcctgtaggaagaa

SEQ ID NO: 57322 - DNA, 50 bp, homo sapien
aatctgagaattttcacccttcagaragcaacatcattattctaaacaag

SEQ ID NO: 57323 - DNA, 50 bp, homo sapien
ccgacactggcttagggccttgggaygtgtgcaacctcaccgtgtgcaac

SEQ ID NO: 57324 - DNA, 50 bp, homo sapien
gagccatgcttctgttaataaagatraagtttgggccgggtgcagtggct

SEQ ID NO: 57325 - DNA, 50 bp, homo sapien
ttcagtgctctggtacttaactacaraagtgtgaggaaagaaggatttaa

SEQ ID NO: 57326 - DNA, 50 bp, homo sapien
agataaatgaatagatgggtaaacgratggatagattaaaggttgggtga

SEQ ID NO: 57327 - DNA, 50 bp, homo sapien
gcaaagctgttcaagcatactcatakcaaggaagcatgaactcaaatatt

SEQ ID NO: 57328 - DNA, 50 bp, homo sapien
tcacaggttacctggtttagagcaamagacattgatggtctctcatggtt

SEQ ID NO: 57329 - DNA, 50 bp, homo sapien
cccttcttgaagatgacgaggaacasgagctggaagctgcagggaagcat

SEQ ID NO: 57330 - DNA, 50 bp, homo sapien
actgggggcatagcagcgagtaagcrcgtagtaaagggcttaacagagtg

SEQ ID NO: 57331 - DNA, 50 bp, homo sapien
gccagccttgagtccagtgacaagarggaacaagatggtttacaagtcac

SEQ ID NO: 57332 - DNA, 50 bp, homo sapien
tgggactcaaatggtttaccagtgcratgtggggtcaccatgcagacctg

SEQ ID NO: 57333 - DNA, 50 bp, homo sapien
tgggatgctcattacctgtcagcacsgcacactgcatcattgtcagcttg

SEQ ID NO: 57334 - DNA, 50 bp, homo sapien
agaagaagaatgtgtgttttaaagasagacaggcctgggtttgtactgta

SEQ ID NO: 57335 - DNA, 50 bp, homo sapien
cttctcctcatccagtttctccccaragcaagagcaaggctggctgagat

SEQ ID NO: 57336 - DNA, 50 bp, homo sapien
attcaatgaaatcaggaaaacaaatyatgatctgaatgagaaattcaaca

SEQ ID NO: 57337 - DNA, 50 bp, homo sapien
atccagcgcacatctatctatatcaygagtggaacaaaatctgttactgt

SEQ ID NO: 57338 - DNA, 50 bp, homo sapien
aggagaactgacagcagagtaccaaytgaatgagcagcttgtgtctagag

SEQ ID NO: 57339 - DNA, 50 bp, homo sapien
ctccctctgaagctgtggctcagacrggttaagtcacataatcatacagc

SEQ ID NO: 57340 - DNA, 50 bp, homo sapien
ctttcaaaacactttgcaggcactaygttactgaatcttcacaagtacct

SEQ ID NO: 57341 - DNA, 50 bp, homo sapien
cattttagttgggcacatgtcactayaaacgaaccatggttttgtgagtg

SEQ ID NO: 57342 - DNA, 50 bp, homo sapien
taagactaatcggtttgcaaaataartttggtctcattaaacttggcctg

SEQ ID NO: 57343 - DNA, 50 bp, homo sapien
tgttggtttcttagtgtattctaaamctctagcacaatgcttatattata

SEQ ID NO: 57344 - DNA, 50 bp, homo sapien
ggcttcacacattttcccactcttasagttcatttttcatagtaggaagg

SEQ ID NO: 57345 - DNA, 50 bp, homo sapien
aacatagttgagccttcatatgaaaycaatcccagttgctatctgaccac

SEQ ID NO: 57346 - DNA, 50 bp, homo sapien
ttctgaaagctgtgaataatgagaayggcaaaacagaaaaacggcatcag

SEQ ID NO: 57347 - DNA, 50 bp, homo sapien
ttgcatcactcaacatgactgaaacscactgtctgaaggccattgatcat

SEQ ID NO: 57348 - DNA, 50 bp, homo sapien
agtcactcacaactctgcagccaccragaggaagacttgcagccccctgc

SEQ ID NO: 57349 - DNA, 50 bp, homo sapien
ctggaacagttatgaggtacccaacygaaattgagtcatgaacagcactg

SEQ ID NO: 57350 - DNA, 50 bp, homo sapien
aaacattcaaccttgggcattgggaracagatgcaggaacgcgcatctca

SEQ ID NO: 57351 - DNA, 50 bp, homo sapien
ctcaattacggtgaaaagccatcggyaaaagttaaagtgagtaatatgac

SEQ ID NO: 57352 - DNA, 50 bp, homo sapien
aatctatatgttttcaaagcacctayactccttactcacagtggccatca

SEQ ID NO: 57353 - DNA, 50 bp, homo sapien
attcatttctatgatgaagtggttargatgagaaatttcaaatgtcagct

SEQ ID NO: 57354 - DNA, 50 bp, homo sapien
acatttaccagtacaccactgtctcraacacaaggacagtttcttacatg

SEQ ID NO: 57355 - DNA, 50 bp, homo sapien
tgagcgaggaagttctcagtaaataygaagttgtcattagaattactgtg

SEQ ID NO: 57356 - DNA, 50 bp, homo sapien
gggtaaggcagcagtaataggtctgraaagattaacagaggctgactcta

SEQ ID NO: 57357 - DNA, 50 bp, homo sapien
aatgatttgagaagtagaaggtagaytcatgggctggacttctgaaatag

SEQ ID NO: 57358 - DNA, 50 bp, homo sapien
ccctatgctggcaggatcaagccaargctaagctctttaactttcaacac

SEQ ID NO: 57359 - DNA, 50 bp, homo sapien
ttctggaattggccatgtgcattacyatcctgtaaaggaggcaggcagaa

SEQ ID NO: 57360 - DNA, 50 bp, homo sapien
ttcgggagggcttccatgggagttcrgaacaggagtccctgcaccaggct

SEQ ID NO: 57361 - DNA, 50 bp, homo sapien
tgggcagatccttgcaaacagagtaygactcccttattcatctcaatgtc

SEQ ID NO: 57362 - DNA, 50 bp, homo sapien
cccaggtgtagaagcctgagacaccrggaaggacatgttccccagggtgg

SEQ ID NO: 57363 - DNA, 50 bp, homo sapien
agggggaatgaggtttgctcatccayatgcggcccaacccgttggacggg

SEQ ID NO: 57364 - DNA, 50 bp, homo sapien
gttgaacttgctcatcctttgctaayatgtctttttgcaaagatgacacc

SEQ ID NO: 57365 - DNA, 50 bp, homo sapien
tctcttgctcctgttggtgtccacayggtgaagcgatgcccttgcacgcc

SEQ ID NO: 57366 - DNA, 50 bp, homo sapien
tccctacgtacacccctcttatttaygatggagtattctggctgttactc

SEQ ID NO: 57367 - DNA, 50 bp, homo sapien
agaagtaaaagaagagggctacgtcratgtcatttctgcctctgttaaca

SEQ ID NO: 57368 - DNA, 50 bp, homo sapien
agagatcctggcgggaaaatgatgamggatgtggcctaccctgggtcttg

SEQ ID NO: 57369 - DNA, 50 bp, homo sapien
attttgttgactccattttgcagaaratttaagatgccagtgagtgcccg

SEQ ID NO: 57370 - DNA, 50 bp, homo sapien
agaattaaacaagacagaggatgtaragcatttgggttgctgtccagtgc

SEQ ID NO: 57371 - DNA, 50 bp, homo sapien
ccggattggctgaatgtgattcagayggaaaggtacacaacaacatctac

SEQ ID NO: 57372 - DNA, 50 bp, homo sapien
gggattgtttttggcgctgggagaayagcctcctttctgctgaagttgcc

SEQ ID NO: 57373 - DNA, 50 bp, homo sapien
aaccatttctgcccttatccagattraaatgggtcacaactttgtttaaa

SEQ ID NO: 57374 - DNA, 50 bp, homo sapien
gttcactttcaactgctcacttaaarttcctgcattatttaaggagacaa

SEQ ID NO: 57375 - DNA, 50 bp, homo sapien
ccatactttgttagcatattgaacarcactgaaattttggaatttttttc

SEQ ID NO: 57376 - DNA, 50 bp, homo sapien
acatacctatccacaactgctagaakccaggagataaattcttcccccta

SEQ ID NO: 57377 - DNA, 50 bp, homo sapien
catcttccgttaccttgatattgaarcattcatttattgaacacattgac

SEQ ID NO: 57378 - DNA, 50 bp, homo sapien
tcaatcttcctaacctctgtaacagsacatagcacatccgcccaagtcag

SEQ ID NO: 57379 - DNA, 50 bp, homo sapien
cctaacgcattcctgggaataagctsgatgtgaaggcttttagttcctta

SEQ ID NO: 57380 - DNA, 50 bp, homo sapien
taggaaatccttttcatcaaagcccsagagaataatcaaaaaaaaaaaat

SEQ ID NO: 57381 - DNA, 50 bp, homo sapien
aggcatcggcctaagcactgcaaatsgcatcagactgagggcggctcctc

SEQ ID NO: 57382 - DNA, 50 bp, homo sapien
ctaaggtcaactcccttctcgggaaygaaacgattaagtcagcggcatta

SEQ ID NO: 57383 - DNA, 50 bp, homo sapien
cctcggtacaacctgaaaaagagacmaaaattggccatttctggtatttt

SEQ ID NO: 57384 - DNA, 50 bp, homo sapien
tggccatcctccttccttcagtaaayatccatgctgctgcgtgtggggtg

SEQ ID NO: 57385 - DNA, 50 bp, homo sapien
tgctttgacataaggattatattgarctgaagacaactgagaaaacagta

SEQ ID NO: 57386 - DNA, 50 bp, homo sapien
gtcataacaatgagaatcccatcagkaattttttttctggatctagaaca

SEQ ID NO: 57387 - DNA, 50 bp, homo sapien
agggtgagtttagcacaatggttagraggttaagttctgggtggaaagtg

SEQ ID NO: 57388 - DNA, 50 bp, homo sapien
ttatcctaatatatggggtgtcaccragttcaaatccgacaaaccagcca

SEQ ID NO: 57389 - DNA, 50 bp, homo sapien
ctttctccagcaaggaagaaagttaygcaaaagcacataatgaaaaacat

SEQ ID NO: 57390 - DNA, 50 bp, homo sapien
gagtagggagcagttttattgaacarcacattttcaaattcttcagttgt

SEQ ID NO: 57391 - DNA, 50 bp, homo sapien
agcccaggcagcccagggaatggtcrctaactcagggacagggtcaggag

SEQ ID NO: 57392 - DNA, 50 bp, homo sapien
cggccaagaccctcagacttttaaayggacagatgttccactggaaggga

SEQ ID NO: 57393 - DNA, 50 bp, homo sapien
gcaacattgttataagttccaggcckcctgtttttactcaacttctattt

SEQ ID NO: 57394 - DNA, 50 bp, homo sapien
ctgaaaagtcagacaatctggtttcrcagggcccacattcccacatggcc

SEQ ID NO: 57395 - DNA, 50 bp, homo sapien
caggtacattggaaagaacatgaaayttgaaataaaactcagttctgtga

SEQ ID NO: 57396 - DNA, 50 bp, homo sapien
tggctcctggtcattcagaaatgtakgctttcccaggaaactgttttttc

SEQ ID NO: 57397 - DNA, 50 bp, homo sapien
tgagttggctgttatcaccgttttcratttctacactcctgaagtcggtc

SEQ ID NO: 57398 - DNA, 50 bp, homo sapien
gaggctcagagaatgggctacagtaygcagcttctccaaaacttgtttcc

SEQ ID NO: 57399 - DNA, 50 bp, homo sapien
ctctgcctggttcctggagctgtccygataaggttgccaagtggagcaaa

SEQ ID NO: 57400 - DNA, 50 bp, homo sapien
cagtcccatcctccaagaagtccaargtgtgagtcacaggcacctgctca

SEQ ID NO: 57401 - DNA, 50 bp, homo sapien
gtaccaagaagaaagtacaatgaaayatctctgtggttctgcaatgtttg

SEQ ID NO: 57402 - DNA, 50 bp, homo sapien
gcccactggtgaggctccgattgtayttctaataagctcccaggagaagc

SEQ ID NO: 57403 - DNA, 50 bp, homo sapien
gaaccccacgctggccacttttactytgagcatgaagagctgtatgggtg

SEQ ID NO: 57404 - DNA, 50 bp, homo sapien
gacatttattacaagtgaacaaataygtgggttggtgtacatcagggctg

SEQ ID NO: 57405 - DNA, 50 bp, homo sapien
actaaaataagcccgttatatatcawcaatgagagtcaaactaaattact

SEQ ID NO: 57406 - DNA, 50 bp, homo sapien
cagcccatttatatgttcaaggggasagtgatcaatatctctgcagctct

SEQ ID NO: 57407 - DNA, 50 bp, homo sapien
cctaagaaaaagaggcaatgactatsagaagggctgttacccaaaaacta

SEQ ID NO: 57408 - DNA, 50 bp, homo sapien
aagcactggtttagataccaaggggratttatggctctcacaactgggaa

SEQ ID NO: 57409 - DNA, 50 bp, homo sapien
gcaggtgagggtagaggttcagggakatttgacagtgatggcagaggtgt

SEQ ID NO: 57410 - DNA, 50 bp, homo sapien
atttagtagagacatggtttcattaygtaggccaggctgttctcaaatta

SEQ ID NO: 57411 - DNA, 50 bp, homo sapien
ggccagtcccttcaatgtcaggatayggaacttagtgtttcggaagctgt

SEQ ID NO: 57412 - DNA, 50 bp, homo sapien
aagtggtgtatctttttcaacaaaayggtttggacacagatttgctaggg

SEQ ID NO: 57413 - DNA, 50 bp, homo sapien
aaaaaaaagtctgtaattattaaaaytgtgtatataggagaatttagcct

SEQ ID NO: 57414 - DNA, 50 bp, homo sapien
gggtgtctagcagggcagccctgaartgaatcaccagattagaaacacca

SEQ ID NO: 57415 - DNA, 50 bp, homo sapien
tgctgaatggcattaagttgtattamacctactcttcgttgagtcttatt

SEQ ID NO: 57416 - DNA, 50 bp, homo sapien
cattcctgagtaattccagttgtacyaatgaaactatgtttgtgtgtatg

SEQ ID NO: 57417 - DNA, 50 bp, homo sapien
cgcccgggaaccagagagaagacaaygcgcccacgccgcttaccacaaag

SEQ ID NO: 57418 - DNA, 50 bp, homo sapien
ttgccacttctatgctggttcttctyaagcccttttaactcatgggctac

SEQ ID NO: 57419 - DNA, 50 bp, homo sapien
gaacaaatcagactctgtcattcacscttggctctcggtcatgttgcctg

SEQ ID NO: 57420 - DNA, 50 bp, homo sapien
tatttttcatgaacctgtactagagraggcataaccaaaacaacaacaac

SEQ ID NO: 57421 - DNA, 50 bp, homo sapien
gtgtgcttttaccaagggcacacatsagacacgtacaaatccactgactt

SEQ ID NO: 57422 - DNA, 50 bp, homo sapien
atactctgaagcacattattacaaamctttctatacacttacaaatgtgt

SEQ ID NO: 57423 - DNA, 50 bp, homo sapien
agtcatattagagttacctggttccrcttcagagcagactgggaaaatca

SEQ ID NO: 57424 - DNA, 50 bp, homo sapien
catccattccccactcacatccaaaygtaggaatacttgagatctcagtt

SEQ ID NO: 57425 - DNA, 50 bp, homo sapien
agatacaacaggcctgagatgagacmaaaatgtttactgtggtccaccca

SEQ ID NO: 57426 - DNA, 50 bp, homo sapien
gtttctacacaggtgggtttggccakgtgactcgtcctgatgaggtgtga

SEQ ID NO: 57427 - DNA, 50 bp, homo sapien
ttataaatggaaatagcctgtaccartccttttaaataacatagatattt

SEQ ID NO: 57428 - DNA, 50 bp, homo sapien
gtaaacattagtgggatggaagaaaktaatgtgtttagcagattgggggc

SEQ ID NO: 57429 - DNA, 50 bp, homo sapien
ttgccattgaaaattcttaagtgagratcattgacaccttgaggccaagg

SEQ ID NO: 57430 - DNA, 50 bp, homo sapien
aggcagaaaagaaaaaataagagcamccgaggaagcatgtagctttcagc

SEQ ID NO: 57431 - DNA, 50 bp, homo sapien
cctccacttactcagagatccggaarccaataagaactatttcttatcta

SEQ ID NO: 57432 - DNA, 50 bp, homo sapien
acaacaggagaatgtgcctgaattcrcaagtccaataatagcctggaaat

SEQ ID NO: 57433 - DNA, 50 bp, homo sapien
gcaggtaggataaggtgcctgatcayaagaccacacattgccctgggaca

SEQ ID NO: 57434 - DNA, 50 bp, homo sapien
aacccatctagaacctgttccatgasctggagcgtgaggccaggcagggg

SEQ ID NO: 57435 - DNA, 50 bp, homo sapien
aacatttcttaaatgtgaacatcatyaaacagattttttttcataatttg

SEQ ID NO: 57436 - DNA, 50 bp, homo sapien
actgttggccaccaactctgttttamatattcatcacatggccaggagtc

SEQ ID NO: 57437 - DNA, 50 bp, homo sapien
taacaggcccttttggctttgtgaasacttgttactacccaggttgtcta

SEQ ID NO: 57438 - DNA, 50 bp, homo sapien
ttttctaactgtttcatagtactgaygatttccaagttagaggcaagaac

SEQ ID NO: 57439 - DNA, 50 bp, homo sapien
aaggagaaattcaggcatatgaatartacctgaaacaagaaacatcttaa

SEQ ID NO: 57440 - DNA, 50 bp, homo sapien
actccattgctaaccgtaccactcartcaaaaagatgagcaatgcttcca

SEQ ID NO: 57441 - DNA, 50 bp, homo sapien
cagcaattagtaataaggggatccaraatgttaggagcagacttttaaaa

SEQ ID NO: 57442 - DNA, 50 bp, homo sapien
gatgccttatgtgttgaaggaataaytacttgttcattttgtagtgctaa

SEQ ID NO: 57443 - DNA, 50 bp, homo sapien
gtgactacaggcacatggctctatayattttaggtaggcaacttaattta

SEQ ID NO: 57444 - DNA, 50 bp, homo sapien
tgagaggctccctgcccgtctcctcrctcatagcctaatagaatatttgt

SEQ ID NO: 57445 - DNA, 50 bp, homo sapien
acatgattcctaaatgacatctttaycattatgggaaactattctagaac

SEQ ID NO: 57446 - DNA, 50 bp, homo sapien
cccaggctcattcttaaaagaactayacaatcatggaaatccaaactgtt

SEQ ID NO: 57447 - DNA, 50 bp, homo sapien
caatgaatagcctctcaccatcaagragtaaacggtttttggcttttcta

SEQ ID NO: 57448 - DNA, 50 bp, homo sapien
tgactcagaaaatcagcatcactccytttaaaggataaaggtacaggccc

SEQ ID NO: 57449 - DNA, 50 bp, homo sapien
ctgggggccatctctctttgggaccrcaaaatctaggagacaccatgatg

SEQ ID NO: 57450 - DNA, 50 bp, homo sapien
agagaggaaaaaattccagaaagtayggcattctcagctacagtggagta

SEQ ID NO: 57451 - DNA, 50 bp, homo sapien
agtaagaaaatcttgaaatgaaaaaragattgaataaacaagtactttaa

SEQ ID NO: 57452 - DNA, 50 bp, homo sapien
tatgaaaaaaataagaaagttataartctcctcacaagtgttggagggga

SEQ ID NO: 57453 - DNA, 50 bp, homo sapien
tcagctctgaaactccagaatataasagattcccactgcatatactagaa

SEQ ID NO: 57454 - DNA, 50 bp, homo sapien
atactatttacagagaaaattatgcyggggaatgcctttaaaattaatcc

SEQ ID NO: 57455 - DNA, 50 bp, homo sapien
gtaatggttacatagggtcatcacayactagtcattctatttgtctgtat

SEQ ID NO: 57456 - DNA, 50 bp, homo sapien
tcccctgaaacccaccgtgagttcaraatggagacaaggaggtggttgca

SEQ ID NO: 57457 - DNA, 50 bp, homo sapien
tcctgacaacctttgttgcttcatamaggtaactcggccagcagtttgct

SEQ ID NO: 57458 - DNA, 50 bp, homo sapien
aataggaagaaccaggcttatcctayggtcgtcagtcctgccaaggacag

SEQ ID NO: 57459 - DNA, 50 bp, homo sapien
gtttcatttttgggttttgtgaataytacgaacagcttttcctagtttgc

SEQ ID NO: 57460 - DNA, 50 bp, homo sapien
ctaaaatcagtgggtgaaagttggaygatcaacaggatttctataggaaa

SEQ ID NO: 57461 - DNA, 50 bp, homo sapien
tggagttgcagaatgatagcaagaartgctccataattgtccctggagaa

SEQ ID NO: 57462 - DNA, 50 bp, homo sapien
ctctttaagatgcattatatgttaayctatccaacaaaatatagaaaata

SEQ ID NO: 57463 - DNA, 50 bp, homo sapien
ctctctgaggtctggtaacagcttcyttctggaccggggtggaaacagcc

SEQ ID NO: 57464 - DNA, 50 bp, homo sapien
aacaggagtagaaagatattgggtgyttattccctggctccctccctctt

SEQ ID NO: 57465 - DNA, 50 bp, homo sapien
cttcttccgtatgttgacgatggagwaattcactatgagagattcctgtt

SEQ ID NO: 57466 - DNA, 50 bp, homo sapien
ttgaaaaggcaattgacatggccgcyaattaaaacattctctccattaat

SEQ ID NO: 57467 - DNA, 50 bp, homo sapien
gcaggggcaagtttggacagatacayattttagaaagctcattggcggca

SEQ ID NO: 57468 - DNA, 50 bp, homo sapien
ctccatttcctcacctgtaaaatggractaagaatacctcccccatagga

SEQ ID NO: 57469 - DNA, 50 bp, homo sapien
atatctcttctggaaagtatatcctwaactaagcccacctctagttgctc

SEQ ID NO: 57470 - DNA, 50 bp, homo sapien
gtttcattttacatttattactgagragagccttgttgggcagaggaagg

SEQ ID NO: 57471 - DNA, 50 bp, homo sapien
cagatcacattaaaaggcccaatcartcaatctgtctgcagccctgaagt

SEQ ID NO: 57472 - DNA, 50 bp, homo sapien
gataaactaaaaatcacacttactgracaaaaaataattgtaccatgcag

SEQ ID NO: 57473 - DNA, 50 bp, homo sapien
attacatctattattattattaaaaygcgacagtaaccataacaattact

SEQ ID NO: 57474 - DNA, 50 bp, homo sapien
tagacaataagaaggattcctggacrattcagaaccccagcgttctcagg

SEQ ID NO: 57475 - DNA, 50 bp, homo sapien
cagagtcctcctgctactggtttgamgctaagccttaatttagaataaaa

SEQ ID NO: 57476 - DNA, 50 bp, homo sapien
acctgttatcctaacctaatgcctgracatcacctcttggaaagcattat

SEQ ID NO: 57477 - DNA, 50 bp, homo sapien
ttctttacccgcatacctaattatcragaatcctgaaactgtttatatca

SEQ ID NO: 57478 - DNA, 32 bp, homo sapien
agcctacaagtttccaragaagaacatagttt

SEQ ID NO: 57479 - DNA, 50 bp, homo sapien
atttcctatcaggatgtccaaggaaktagtcaacactttccctgccaggc

SEQ ID NO: 57480 - DNA, 50 bp, homo sapien
cacttccttctcctataaagtacctsactgtttaggcataaaggaaacaa

SEQ ID NO: 57481 - DNA, 50 bp, homo sapien
ttctatggtgactaataccgctgaaycaactcattcaaagatatttttaa

SEQ ID NO: 57482 - DNA, 50 bp, homo sapien
tagtacaaactgaattgtattaaaamgcatttatttgtctgccttatata

SEQ ID NO: 57483 - DNA, 50 bp, homo sapien
cggccagccaggtcatagggcccagmctcaacctaggaatgaaggtggga

SEQ ID NO: 57484 - DNA, 50 bp, homo sapien
aatataaattaaagccacaagtaaaycctgtagtcactataacccaagga

SEQ ID NO: 57485 - DNA, 50 bp, homo sapien
gtcatatgcctttttgtggcaatgaytattaaaggttttatagtattcta

SEQ ID NO: 57486 - DNA, 50 bp, homo sapien
agcctcagtttccttctctgtaaagyagaactcacaatcccaatcctgta

SEQ ID NO: 57487 - DNA, 50 bp, homo sapien
accctgaccctccaaaattggctagmatttcggctcacgcgtgtaatccc

SEQ ID NO: 57488 - DNA, 50 bp, homo sapien
atgctgttccttctctttggaccaamcttcctccttcacttcacatggct

SEQ ID NO: 57489 - DNA, 50 bp, homo sapien
ctccgggtgctctcagtggcctacgmatcgccagtcctgacaacagccta

SEQ ID NO: 57490 - DNA, 50 bp, homo sapien
ctttaactgacttctgtccactctgragagcagtgaggaattaatcttgc

SEQ ID NO: 57491 - DNA, 50 bp, homo sapien
ccaagttgtgtaaaagcaggctatcracctgaattatccaataaagagct

SEQ ID NO: 57492 - DNA, 50 bp, homo sapien
gaactctgtcctccccatctaatccrggatggaagctgtctgttgcaggg

SEQ ID NO: 57493 - DNA, 50 bp, homo sapien
caatgcttacagtatctaagttatcygaccttaggcaatgtgggcgcaat

SEQ ID NO: 57494 - DNA, 50 bp, homo sapien
ttctaaggctttgactttagacaaakaggaagttgtagagataaatgaga

SEQ ID NO: 57495 - DNA, 50 bp, homo sapien
tgatttttaaaagaccttgccatccractctcataatttttagaagacct

SEQ ID NO: 57496 - DNA, 50 bp, homo sapien
atgagtgaagttagagacatgagaayttattatgtacttgaaactgcaag

SEQ ID NO: 57497 - DNA, 50 bp, homo sapien
cctgcaggcatacacttaggagttaygtgaggatgaggtgccctaaagag

SEQ ID NO: 57498 - DNA, 50 bp, homo sapien
cattttgttggtcccaccctaagcaygaaccttttgaatattaaagggac

SEQ ID NO: 57499 - DNA, 50 bp, homo sapien
gtcctccctcattgtaaatcacaacraaacaattgatcaaaattcatgtg

SEQ ID NO: 57500 - DNA, 50 bp, homo sapien
ttacattctagaagggtttgcttagyatgggatgagccttcagcaggtgc

SEQ ID NO: 57501 - DNA, 50 bp, homo sapien
gctggaatggagaaggttcaacctcratagtgactgctataggtatggta

SEQ ID NO: 57502 - DNA, 32 bp, homo sapien
tgttcaaaaatcagtargaatttcaggacagc

SEQ ID NO: 57503 - DNA, 50 bp, homo sapien
tttagatggtgccagagacacagaartgagtatcctagcacaatacctac

SEQ ID NO: 57504 - DNA, 50 bp, homo sapien
tcaatatgcaacttctgacttagcargatttccattgattcaacacttca

SEQ ID NO: 57505 - DNA, 50 bp, homo sapien
gctctcagaaacttccagcattgacrctatacaagggagcagcaggagag

SEQ ID NO: 57506 - DNA, 50 bp, homo sapien
gctgtgcggtgtcatcagcactcacygtctcgattttctcaccttcctcc

SEQ ID NO: 57507 - DNA, 50 bp, homo sapien
actgagtgtccctttaaaaactaacmcactgaatattccgtgtgatctag

SEQ ID NO: 57508 - DNA, 50 bp, homo sapien
tcacgatgtgaccatttttaatgttygagtgtttctgcttccctcacctc

SEQ ID NO: 57509 - DNA, 50 bp, homo sapien
actaatggtgtgcatttgatctgaaycttcttgatgctatcatgtttcag

SEQ ID NO: 57510 - DNA, 50 bp, homo sapien
aattctgttttctacttaggattgaraagagttctgggagtcttatatca

SEQ ID NO: 57511 - DNA, 50 bp, homo sapien
catgcagcacgggaccatcagttccrcttcagccatctttgatatgatga

SEQ ID NO: 57512 - DNA, 50 bp, homo sapien
tgggttgatgtatgaggttccttggragagcagatttgcagaaattctgg

SEQ ID NO: 57513 - DNA, 50 bp, homo sapien
atagaagaaacgctacctggagagcragaattataatttcatgtaaaacc

SEQ ID NO: 57514 - DNA, 50 bp, homo sapien
gcactaatgataatattaacacaaayatggagcaattactgcatgccagg

SEQ ID NO: 57515 - DNA, 50 bp, homo sapien
agtttagtctacgtttctttgactcratggagcttagggtcttaatttct

SEQ ID NO: 57516 - DNA, 50 bp, homo sapien
ggggagtcttaattatcctgagacaycttaggagttactatgagccaaaa

SEQ ID NO: 57517 - DNA, 50 bp, homo sapien
gatcagaatatgggcccaaattgtcrctactcattgtattctcaccattt

SEQ ID NO: 57518 - DNA, 50 bp, homo sapien
gactgcattccttccaactctaatgraatccaattttccttccctcaatc

SEQ ID NO: 57519 - DNA, 50 bp, homo sapien
aaaaattaaataatatatcagcttasaaaaaagcacagataattttcatc

SEQ ID NO: 57520 - DNA, 50 bp, homo sapien
atgcccttccttggcttctccacctracaatttctattcgtctgtcaagg

SEQ ID NO: 57521 - DNA, 50 bp, homo sapien
aacgtttgctgacctctgtactcaasagtgaattgtttccgtgccttgca

SEQ ID NO: 57522 - DNA, 50 bp, homo sapien
aaccagaacattccattctgctttcratattcagagtctacaccatttct

SEQ ID NO: 57523 - DNA, 50 bp, homo sapien
gcatagctaggctagaaacccagaaygtgcattttgtaaaacctcttcag

SEQ ID NO: 57524 - DNA, 50 bp, homo sapien
tctgggtatttcatttcaaaccacamgagtccagttacataacactggat

SEQ ID NO: 57525 - DNA, 50 bp, homo sapien
cctgctgggaaatgttttcgtgcacygctgacatgcacctgtgttttagg

SEQ ID NO: 57526 - DNA, 50 bp, homo sapien
taaagggggatcctaagctcagggaygcgataatttgctactactgaggg

SEQ ID NO: 57527 - DNA, 50 bp, homo sapien
agatctagaaacttaatcagattgarcttccatttttttagcaagaatat

SEQ ID NO: 57528 - DNA, 50 bp, homo sapien
tctagcagatagagcagttctttccmtttttgtatatgcaatctagaagc

SEQ ID NO: 57529 - DNA, 50 bp, homo sapien
tctgtgccaggtactgggtatagaasagagagaaacaacaatttctggcc

SEQ ID NO: 57530 - DNA, 50 bp, homo sapien
atacatagcacgtaataggtgtcaayagatgcttgctgaatgaataaaaa

SEQ ID NO: 57531 - DNA, 50 bp, homo sapien
tgtggttcctcttaattatggtggcygagccaagcctaaaattacctaat

SEQ ID NO: 57532 - DNA, 50 bp, homo sapien
ttagggctataatcttctaaatatcrcttttactgcatccaacaaatttt

SEQ ID NO: 57533 - DNA, 50 bp, homo sapien
ggtgctgttctgtggtctggggatamagaataagccaagtccctgccttt

SEQ ID NO: 57534 - DNA, 50 bp, homo sapien
acggacctaatggcactggtactacrctactgcatatgtcctggtgtgtg

SEQ ID NO: 57535 - DNA, 50 bp, homo sapien
ggaagtccatgtagttctctacagayagacttcaaagaaacgttacctta

SEQ ID NO: 57536 - DNA, 50 bp, homo sapien
cttcacaagcctttctgagtttggtrtgatcattaggtgcattttacaga

SEQ ID NO: 57537 - DNA, 50 bp, homo sapien
cacgagtgctgatgtcagcaatcacrgacctaatggcactggtactacgc

SEQ ID NO: 57538 - DNA, 50 bp, homo sapien
gtctgtctcctccactaaactgtgarcatacctaggtcagaagccagagt

SEQ ID NO: 57539 - DNA, 50 bp, homo sapien
cagatagtgagagccatgttatgaawgagtgatccagggcaattcagcct

SEQ ID NO: 57540 - DNA, 50 bp, homo sapien
aagtcttaaaatcacacctgggagtraaatgaacagagatggtagctgta

SEQ ID NO: 57541 - DNA, 50 bp, homo sapien
gtcatggccagccctccagggactaygaagttataaacataaatttgtcc

SEQ ID NO: 57542 - DNA, 50 bp, homo sapien
atgagattgttcgttagggacactaygtgatttggaggacaaacaggatt

SEQ ID NO: 57543 - DNA, 50 bp, homo sapien
ttgatccccacacccaattaaatcaycacatcttttggattctatcttgt

SEQ ID NO: 57544 - DNA, 50 bp, homo sapien
agtactgtcccctcattttggcacarttttgcagaggatagaccatggct

SEQ ID NO: 57545 - DNA, 50 bp, homo sapien
ccttaggaggccaagctaaacaggawcaaagggtacccaccatacaccca

SEQ ID NO: 57546 - DNA, 50 bp, homo sapien
gccccagatggagaaatgactcaaasaaagttaaataaaaggtgggtgca

SEQ ID NO: 57547 - DNA, 50 bp, homo sapien
ttctaaggaagaggagtcctgattaytgaattgaagggagtttttgttca

SEQ ID NO: 57548 - DNA, 50 bp, homo sapien
gccctacatgtaagagctatatacaygaaaagttataaaattgtccttgg

SEQ ID NO: 57549 - DNA, 50 bp, homo sapien
tcaggcttcctcttgttctccactgmaaaaaacttaaatcaggttaataa

SEQ ID NO: 57550 - DNA, 50 bp, homo sapien
ggtgggggagtttgctctcactcttmatacaatcgccaaaatttctccat

SEQ ID NO: 57551 - DNA, 50 bp, homo sapien
ctgggagctagttcagcgaaaacttstaaggatggaattcagagaaacta

SEQ ID NO: 57552 - DNA, 50 bp, homo sapien
tttgattattctcacttggatgtagmataatcagatacattatctagcat

SEQ ID NO: 57553 - DNA, 50 bp, homo sapien
ttatttcccccaactgcttatttaartggatgaagaggataaggtcacga

SEQ ID NO: 57554 - DNA, 50 bp, homo sapien
cttggatgctcttcccaaagatctcragtcctgagccactgagccaagtg

SEQ ID NO: 57555 - DNA, 50 bp, homo sapien
cccatcaccatcagccttcttagcakggcattagctaagaaaaggcctca

SEQ ID NO: 57556 - DNA, 50 bp, homo sapien
cacacaattactcatatttaagagayctaggaatgaggagtctctgatcc

SEQ ID NO: 57557 - DNA, 50 bp, homo sapien
tgactagaaatagcaagccaccaaasatagcaagaagtggttatcaggtc

SEQ ID NO: 57558 - DNA, 50 bp, homo sapien
agaggcagtaagccatgaccactaarggcaattaattcggcattttaatg

SEQ ID NO: 57559 - DNA, 50 bp, homo sapien
taattccctgacacttggccatggasgattgtttcactgactgcatccga

SEQ ID NO: 57560 - DNA, 50 bp, homo sapien
agttgggatgtaggaggagattaaartcctatgggagagactacactaat

SEQ ID NO: 57561 - DNA, 50 bp, homo sapien
attttccctaagcctttcttacctcyaaatgttgctaatagtatgtatcc

SEQ ID NO: 57562 - DNA, 50 bp, homo sapien
gctctagaggctcaagttgaaatcaygtttataaaactcttagcagcatt

SEQ ID NO: 57563 - DNA, 50 bp, homo sapien
tactcagtaacaggtgttgaatggaygacggaatgaatgactcattgaat

SEQ ID NO: 57564 - DNA, 50 bp, homo sapien
tttaaagaatacacttattatcttayagtttcagagacagaagtcctaat

SEQ ID NO: 57565 - DNA, 50 bp, homo sapien
gcccttggtccgtattttctcaagawcctgggtttctcctctgttcctct

SEQ ID NO: 57566 - DNA, 50 bp, homo sapien
ggaagcctctacaggtgcagtcagcrcatcgagtcaggcctaccttctcc

SEQ ID NO: 57567 - DNA, 50 bp, homo sapien
ggtgatttacattctgtatctaaacsctttgcctttggaaaagccaaagg

SEQ ID NO: 57568 - DNA, 50 bp, homo sapien
taaaacctccctctctgttcattgaygggtttcttgaaggagttctgtat

SEQ ID NO: 57569 - DNA, 50 bp, homo sapien
ttgtaacctaagctgagaggtcttgmggatatctagaaaactggggtcaa

SEQ ID NO: 57570 - DNA, 50 bp, homo sapien
gaaggaaggccagactcctggatgaygagcaaggtcttctcctgtgtgcc

SEQ ID NO: 57571 - DNA, 50 bp, homo sapien
gtgcccacatttctctccgtagcatracgagatgagcacgtccccgggaa

SEQ ID NO: 57572 - DNA, 50 bp, homo sapien
aattcatttatacctaggtatgttcraaaactggaagagagggccaaaag

SEQ ID NO: 57573 - DNA, 50 bp, homo sapien
agattccagattcagccttagcatawcagctgggagacttaacaatgagt

SEQ ID NO: 57574 - DNA, 50 bp, homo sapien
cctctgcctcaccaaatcccaaagckagattccctcatggccctgcctgc

SEQ ID NO: 57575 - DNA, 50 bp, homo sapien
aaaggcaacagaatcttgggacttayaggaggcagcaagaacacttggaa

SEQ ID NO: 57576 - DNA, 50 bp, homo sapien
ctataacaggaactttcttggaccaytcctgcaagacactgtcagaactc

SEQ ID NO: 57577 - DNA, 50 bp, homo sapien
taggtgataacagtggtgtcctaaaraacaaatgagtgcttatacctaga

SEQ ID NO: 57578 - DNA, 50 bp, homo sapien
aagttagctctgttgaattagtaacmaagtattcattcaaaacttgcttc

SEQ ID NO: 57579 - DNA, 50 bp, homo sapien
gtggggcggaagagctgtaattgacmgaataaacatggaaagaccattac

SEQ ID NO: 57580 - DNA, 50 bp, homo sapien
tattcatttatttattcaccatttcratgaatatctgagtgcctactatg

SEQ ID NO: 57581 - DNA, 50 bp, homo sapien
atcagagtcctgcatccctaagccayagtaactggttcaggatgggccaa

SEQ ID NO: 57582 - DNA, 50 bp, homo sapien
gtttacagcagcacattgcacatgcrttaaaaaaaagaatgatctcaaat

SEQ ID NO: 57583 - DNA, 50 bp, homo sapien
tcttatttactcactgtaaggctgasaactcttgaagtcaggcattacac

SEQ ID NO: 57584 - DNA, 50 bp, homo sapien
aggggtcatagcaggattagatttgyacttcagagccgtctttctggttg

SEQ ID NO: 57585 - DNA, 50 bp, homo sapien
ccaacaccaataaagacacaagggartaatatgtgcttattggcttagac

SEQ ID NO: 57586 - DNA, 50 bp, homo sapien
gtagtagcattattttagatgaatarcagcttttaacctaactttctaga

SEQ ID NO: 57587 - DNA, 50 bp, homo sapien
aaggcccatcctggatctggagtgaytcctcacatcgcatttctgggaca

SEQ ID NO: 57588 - DNA, 50 bp, homo sapien
actaattaattatccaggtgagagaygacaggaacctaaagtaaggcagt

SEQ ID NO: 57589 - DNA, 50 bp, homo sapien
tgcttctgtatccaaaatggttggcyatgttttagaggcttttgcttcca

SEQ ID NO: 57590 - DNA, 50 bp, homo sapien
aagtttgcactgattatggatcccaratactacacttctcaggggcaggt

SEQ ID NO: 57591 - DNA, 50 bp, homo sapien
atctggttcggccttttgccaggaaytgaatgcccatagggacatgatgg

SEQ ID NO: 57592 - DNA, 50 bp, homo sapien
ctaaagcaagttggaaaaatcaatamgtaataaaagttaacatgaaagca

SEQ ID NO: 57593 - DNA, 50 bp, homo sapien
acccactcctccgacctctgcagacrtgtggagaccaagtctcaaccttc

SEQ ID NO: 57594 - DNA, 50 bp, homo sapien
cagtggatgagctcatcaccaggtcragtctaaggggagaacaggactgt

SEQ ID NO: 57595 - DNA, 50 bp, homo sapien
atgacctttgtggaaaatctgtacartgtgttacccaaatcttcaaagat

SEQ ID NO: 57596 - DNA, 50 bp, homo sapien
acgtccaggagccatctgaggcctasgaggacatgagaacaagcagggac

SEQ ID NO: 57597 - DNA, 50 bp, homo sapien
tggaaagcctgaagaatctgctcctygaagtagggaccttaatggggtgc

SEQ ID NO: 57598 - DNA, 50 bp, homo sapien
ttgttacaaacatgtcttcatcataratttcaaggtataaagatgagatt

SEQ ID NO: 57599 - DNA, 50 bp, homo sapien
ggacagcgtgtctccaaatcatcccyatcacagcacttccttggtggatt

SEQ ID NO: 57600 - DNA, 50 bp, homo sapien
agctctgggcctttaccactctctcrctgtataacttatgcaaatttctt

SEQ ID NO: 57601 - DNA, 50 bp, homo sapien
acctggccacagtgctactgtagagwttcatcggctcctcccttcttagc

SEQ ID NO: 57602 - DNA, 50 bp, homo sapien
aaaaaagaccctcttattcagataamctgctacaatattttaaaactgat

SEQ ID NO: 57603 - DNA, 50 bp, homo sapien
gctggcatttattcccaataaatgcygcaattatgttgcaatactgacaa

SEQ ID NO: 57604 - DNA, 50 bp, homo sapien
gatatgacactagaccagggatgttyaaatgaaagaggttcagtttgcag

SEQ ID NO: 57605 - DNA, 50 bp, homo sapien
cagtaggaaactaatatcaaacaagrcatcaagaaatcaaacaccaattg

SEQ ID NO: 57606 - DNA, 50 bp, homo sapien
aatggccattcaggtctctttttccrtgaaatgcctgttcatgtctttca

SEQ ID NO: 57607 - DNA, 50 bp, homo sapien
gcacagtaggtttcaatcagtgtcckctaaattgcatttttgcccccatc

SEQ ID NO: 57608 - DNA, 50 bp, homo sapien
gcaatctgtctataaagtggctgcayggatgagggacattattatgggtt

SEQ ID NO: 57609 - DNA, 50 bp, homo sapien
aattactcaggcttcccattagatcytgacctgcctcgctggaccttgtc

SEQ ID NO: 57610 - DNA, 50 bp, homo sapien
tcagcagacgtgttgctcattttacrtataaaggaaagggttttgtgttt

SEQ ID NO: 57611 - DNA, 50 bp, homo sapien
gtgtcttttgctttcccaggtgaackaaccctagctctgtcttggcctcc

SEQ ID NO: 57612 - DNA, 50 bp, homo sapien
ctgacagcttcagactggacatctaytgggaatccagaaggttcactcat

SEQ ID NO: 57613 - DNA, 50 bp, homo sapien
gaaataatgatgccaatctgagagcrttgttaggagagtgaaatgagatc

SEQ ID NO: 57614 - DNA, 50 bp, homo sapien
taaattgagttatgatgggacaaccrccactgaatccttcacatatttga

SEQ ID NO: 57615 - DNA, 50 bp, homo sapien
tggagcactcagcaccacttcccaayaggatcagacctggggaaactgac

SEQ ID NO: 57616 - DNA, 50 bp, homo sapien
accagggacctggtgttggttccacragaggctcagggacacacttccag

SEQ ID NO: 57617 - DNA, 50 bp, homo sapien
gaatctaggtctgcttaaaaaaatayagtctcctgaatctagaagtcatt

SEQ ID NO: 57618 - DNA, 50 bp, homo sapien
gccaggtgaccatggctacattgccraacctctgactgccacagctgcag

SEQ ID NO: 57619 - DNA, 50 bp, homo sapien
gatttcaagaatccaggatttaagtwaacaggaaagccacaagcacactg

SEQ ID NO: 57620 - DNA, 50 bp, homo sapien
atgggaatatttgagactgaaaatartcatcatctccaaaatacaaagac

SEQ ID NO: 57621 - DNA, 50 bp, homo sapien
ttgttgaaaacaaaataagccaaacygatatgaagtagaaaaatgaaagg

SEQ ID NO: 57622 - DNA, 50 bp, homo sapien
gtgtctatatggaagattatacttascactattaagggtttctacttggg

SEQ ID NO: 57623 - DNA, 50 bp, homo sapien
caatatcaccaacttctaaaatatargatctacaaatagtcttcaacagt

SEQ ID NO: 57624 - DNA, 50 bp, homo sapien
ccaaatcctgactctgccactgacamaggtgaccttgagaaaattgctac

SEQ ID NO: 57625 - DNA, 50 bp, homo sapien
cctacccacttgtgtggctgctgcartattaagttccttgtggttggtgg

SEQ ID NO: 57626 - DNA, 50 bp, homo sapien
tcatggttttaggttttgtatttagwcctataataaatttggagttaatt

SEQ ID NO: 57627 - DNA, 50 bp, homo sapien
agttatagactagaaatgagcccagytgaacactctatatgaaaaagaca

SEQ ID NO: 57628 - DNA, 50 bp, homo sapien
gagcgggagagatagatgaacactcygaatgtaggccctggccagagacc

SEQ ID NO: 57629 - DNA, 50 bp, homo sapien
tgttccttactacctatactgtttaygccactacttagagaaggactaca

SEQ ID NO: 57630 - DNA, 50 bp, homo sapien
aaacattagccatttatttaactccratgttatcttattattatatatct

SEQ ID NO: 57631 - DNA, 50 bp, homo sapien
gaactgcagttgtccctgtcatatcrcacatggccctgatcctagaaggt

SEQ ID NO: 57632 - DNA, 50 bp, homo sapien
ttccctgtgggttgaccacactgaaycagtatagatctctccctttccaa

SEQ ID NO: 57633 - DNA, 50 bp, homo sapien
ttttgctggcagcagtcaacctaatsaagtggtatctccattctaggaag

SEQ ID NO: 57634 - DNA, 50 bp, homo sapien
attcaaatgttgatgtgttttaacayggatattttgcactaatattaatt

SEQ ID NO: 57635 - DNA, 50 bp, homo sapien
gtcctaccttttgtctccaggattcrcagtaggcgcaagtgagaagtgga

SEQ ID NO: 57636 - DNA, 50 bp, homo sapien
tttgaaattatactttgacagcttaygtgtgccccggaaatagggaactc

SEQ ID NO: 57637 - DNA, 50 bp, homo sapien
acctttgacttagtatgagccattaraagaccagactttagaagttatat

SEQ ID NO: 57638 - DNA, 50 bp, homo sapien
agaaataccagataacggataaaaaygttcaagaaggctgggtgcaatgg

SEQ ID NO: 57639 - DNA, 50 bp, homo sapien
agagttggattttgaactccagtctracttcagagcctgattctcttcaa

SEQ ID NO: 57640 - DNA, 50 bp, homo sapien
aggtgcttcttgactaactagtctamagcagagttgtatgagacgttcta

SEQ ID NO: 57641 - DNA, 50 bp, homo sapien
agagtctttactgtttcgggcattayacttattatccacatgcattatct

SEQ ID NO: 57642 - DNA, 50 bp, homo sapien
atgtacgggcatccgaggtgcgggcyacatccctggtgctgcagtgggaa

SEQ ID NO: 57643 - DNA, 50 bp, homo sapien
ttgcagttgttgagtgctggctaaaygtgtattgggaagagactatacag

SEQ ID NO: 57644 - DNA, 50 bp, homo sapien
atgaacttgacctcgtggtttagtargagagtaggaagataagagcagga

SEQ ID NO: 57645 - DNA, 50 bp, homo sapien
ataaaaatgagggctagtatgtcgcrattgatcatttacctagctctgtg

SEQ ID NO: 57646 - DNA, 50 bp, homo sapien
attctctctgcagacaacccacaggmctaaacttgccatgggggataaag

SEQ ID NO: 57647 - DNA, 50 bp, homo sapien
ttgtattatctatcataagcagtacmataggccacttcctttagtaaata

SEQ ID NO: 57648 - DNA, 50 bp, homo sapien
caggaaggcagcctcttatttttggwagccttttatgatggctcaccacc

SEQ ID NO: 57649 - DNA, 50 bp, homo sapien
ggtgggacctgtatgctctcaaataratggccctcatggtgttcacgtgt

SEQ ID NO: 57650 - DNA, 50 bp, homo sapien
ctgaacacgtgttttaaagaatcaaytatgtttactattttaccactaaa

SEQ ID NO: 57651 - DNA, 50 bp, homo sapien
atttagggcattctggaagaaatcartcttgtcctaagttggtaatgctt

SEQ ID NO: 57652 - DNA, 50 bp, homo sapien
ctcagagggtttagcaaataaagaaygatgtaggtcacaaagcaaaggaa

SEQ ID NO: 57653 - DNA, 50 bp, homo sapien
ggtttcccagcagctgtgtcatgtaygaattggaacagaatagagagaaa

SEQ ID NO: 57654 - DNA, 50 bp, homo sapien
taagcatcacaactataacaaccatratctggatagtgcagatactatac

SEQ ID NO: 57655 - DNA, 50 bp, homo sapien
agaaagtcatcttgctaatctttttkatcctccaattcctaatttataaa

SEQ ID NO: 57656 - DNA, 50 bp, homo sapien
ccctgcaaagacgttggtgttcatcyaggatgagctgcaagcattggagg

SEQ ID NO: 57657 - DNA, 50 bp, homo sapien
cctccaatactactgaaatgtttgcrcaatcttgaagcatttatttaaaa

SEQ ID NO: 57658 - DNA, 50 bp, homo sapien
gatattttctaatttctagttgttayaaaaattctatgaatatatacagt

SEQ ID NO: 57659 - DNA, 50 bp, homo sapien
ctcaggatagtagtaaaccttaagayagttcgtaatcaaggcccccaagt

SEQ ID NO: 57660 - DNA, 50 bp, homo sapien
tcacttaacattgggttatcaagtayatgtcagatatctttccctggatc

SEQ ID NO: 57661 - DNA, 50 bp, homo sapien
ttcactttgtgactatgtaaacttgraccagccatttctgcttttggttt

SEQ ID NO: 57662 - DNA, 50 bp, homo sapien
gcttacttttaggtctgttctttctytattgtttggatatttgaacgtct

SEQ ID NO: 57663 - DNA, 50 bp, homo sapien
ccagggtcaccatggttctagtaaaygcacggtgtaattctctgaaatgt

SEQ ID NO: 57664 - DNA, 50 bp, homo sapien
ggcctttaggtggtgggcttataatratattgagattagggacatatgaa

SEQ ID NO: 57665 - DNA, 50 bp, homo sapien
atactgtatcaaaaaactgcacaatkagttatttagccatcccccttgtt

SEQ ID NO: 57666 - DNA, 50 bp, homo sapien
attgccaaatgtttcttgaggaaaarggggcaaaattacctccagtcaaa

SEQ ID NO: 57667 - DNA, 50 bp, homo sapien
cagagatcacacagctaaaaagcgargaataaggcaccactcagcttcca

SEQ ID NO: 57668 - DNA, 50 bp, homo sapien
tgcaaatatactcagcaatttcactkcttagaacttaatagaaataatta

SEQ ID NO: 57669 - DNA, 50 bp, homo sapien
ttgaaggttaccttaactctgactayctggaacagttaaattctgaaatg

SEQ ID NO: 57670 - DNA, 50 bp, homo sapien
tagcaccttatctcagcagataaaaygacttacgattttgtcatgtaaca

SEQ ID NO: 57671 - DNA, 50 bp, homo sapien
gaagaaaaagagggcgaatggagaaytatatgtcagagaattttatggat

SEQ ID NO: 57672 - DNA, 50 bp, homo sapien
cttaatatcttgttcgagttgcttasaggtctctcttgtcctaaatagac

SEQ ID NO: 57673 - DNA, 50 bp, homo sapien
ggaaaggaggttgccgggctggttcyaaaagctgaaggccatccgctaga

SEQ ID NO: 57674 - DNA, 50 bp, homo sapien
gcgtctttcccaagcactccacggarcgtccttaggcacctccctctctc

SEQ ID NO: 57675 - DNA, 50 bp, homo sapien
cccactgcccactggatcaagcccayactcaacaaggtccttcaacaatt

SEQ ID NO: 57676 - DNA, 50 bp, homo sapien
agactcactccgttgccacaggttaycagaacagactgaaagtactctac

SEQ ID NO: 57677 - DNA, 50 bp, homo sapien
acaatgagttagacttagtttcctarataaataaacgtgtctacataaaa

SEQ ID NO: 57678 - DNA, 50 bp, homo sapien
tttttgtgagaccactaccattcccragatacttctgattagccatgcac

SEQ ID NO: 57679 - DNA, 50 bp, homo sapien
aaatttggaaatgcgtagaatttccmagtaatcaactcagagaatcatac

SEQ ID NO: 57680 - DNA, 50 bp, homo sapien
tcccctcaggtggctgaaaggtaacyacataattgataagagtattagga

SEQ ID NO: 57681 - DNA, 50 bp, homo sapien
ggatatctttgtgacctgggattagkcaaagagtttttatacatgtaacc

SEQ ID NO: 57682 - DNA, 50 bp, homo sapien
caattataactgtcaagccaactaaygttcctattgacttaacattgcct

SEQ ID NO: 57683 - DNA, 50 bp, homo sapien
tttaacccctcattttacggaaaaakaatcgaccaggaggtagttagtgg

SEQ ID NO: 57684 - DNA, 50 bp, homo sapien
gttaaacctctaaagcacctctgaayactgtctggaatctccatttccca

SEQ ID NO: 57685 - DNA, 50 bp, homo sapien
tactgtactttagattcaaatccacwttccacttaatatcccagtgttat

SEQ ID NO: 57686 - DNA, 50 bp, homo sapien
aggattttttctgccttgagccttcsaaaacgtatcagaatgcagcttgt

SEQ ID NO: 57687 - DNA, 50 bp, homo sapien
attcaatgactggagacctgtttaakagttcttactaaagcagttctaag

SEQ ID NO: 57688 - DNA, 50 bp, homo sapien
tatgtctcaggataagagccctatawcttcggcgaaaaaaaagcttacag

SEQ ID NO: 57689 - DNA, 50 bp, homo sapien
taattccacagaggagtcagcatacscttgtttgagctgggttttgaact

SEQ ID NO: 57690 - DNA, 50 bp, homo sapien
tgggcaacatattcagtttccagggyttagaatgtggatagtttgggggt

SEQ ID NO: 57691 - DNA, 50 bp, homo sapien
gaggcaacaacccaacaggagacaaytacaaaatcgatgaagaagatgcg

SEQ ID NO: 57692 - DNA, 50 bp, homo sapien
taacctgaagaaattatttagtacaytgacaattttagggcagaaaaata

SEQ ID NO: 57693 - DNA, 50 bp, homo sapien
aggccacacttggagcctactgaatragaacttctgaaggtgaggcccag

SEQ ID NO: 57694 - DNA, 32 bp, homo sapien
aacctgtgaacattttrtcttaaatggtaaaa

SEQ ID NO: 57695 - DNA, 50 bp, homo sapien
ttaggttggagtccctagctcaatarctgatgtggccttatgacattctg

SEQ ID NO: 57696 - DNA, 50 bp, homo sapien
tctccatttctgaggtcacgtgataycaacaaggtgcattactggtgatg

SEQ ID NO: 57697 - DNA, 50 bp, homo sapien
cacatgtgaatatcattctcataaawcttgaaataaaacactttcaagaa

SEQ ID NO: 57698 - DNA, 50 bp, homo sapien
tatagagaatatcttccccacagggytaggatgattaagatattttaagg

SEQ ID NO: 57699 - DNA, 50 bp, homo sapien
agtagcagccaaccacaaagcacacrtgggcatttgctcagcattccata

SEQ ID NO: 57700 - DNA, 50 bp, homo sapien
cccccctgtgtttttcccaaccatcrctacagttaattgcaatgttatat

SEQ ID NO: 57701 - DNA, 50 bp, homo sapien
gtacttcagatgctttattatagtgraggccagcaaaacattaaaccaga

SEQ ID NO: 57702 - DNA, 50 bp, homo sapien
aaacagagcactataacatgtgagayagtatggaatatgacgtgatgggc

SEQ ID NO: 57703 - DNA, 50 bp, homo sapien
tacaactgtacactcaagaaatatayatccatcatctatgacactgaatt

SEQ ID NO: 57704 - DNA, 50 bp, homo sapien
tgtttacttaataaagatgctcacaygttgattgtactaataagtgacat

SEQ ID NO: 57705 - DNA, 50 bp, homo sapien
gatgtcttccaaaacgcacttgtacygatagattaagatctacatcagaa

SEQ ID NO: 57706 - DNA, 50 bp, homo sapien
agttatagtgtatctatttctgttaygcttcctgatatgtctgtaggctt

SEQ ID NO: 57707 - DNA, 50 bp, homo sapien
ccccagagaactctcacatgtatcaraagtgggcatgtatacagttcaga

SEQ ID NO: 57708 - DNA, 50 bp, homo sapien
ataatgtgaggtatgaatgtcacaasggaaaaggtggaaaactggaagac

SEQ ID NO: 57709 - DNA, 50 bp, homo sapien
tggaactggggagtcagcatacccawcctgaaagaatctaaagccttgtt

SEQ ID NO: 57710 - DNA, 50 bp, homo sapien
agccagcatccctctctacaccctamctagaatacatcaggtgactgtag

SEQ ID NO: 57711 - DNA, 50 bp, homo sapien
gaactcagagaaggtgccaaacccamgctgaaaggctcaatcaggagagg

SEQ ID NO: 57712 - DNA, 50 bp, homo sapien
gagatgtaccttaatagtggctgaargatcatctgaacaggagaaagtgg

SEQ ID NO: 57713 - DNA, 50 bp, homo sapien
gactataccacctcagaccatactgraaaatcatctgcagtgttaaaata

SEQ ID NO: 57714 - DNA, 50 bp, homo sapien
ttgagtggcaaggtcctaactaaacrgctccatagtggggaggcactggc

SEQ ID NO: 57715 - DNA, 50 bp, homo sapien
ctcaataatgaattaaatcacagacmgtattatgaaatactgtacagatg

SEQ ID NO: 57716 - DNA, 50 bp, homo sapien
tttgaaaaaatatggttgtacttgtyaagagccttagaaatgtctataac

SEQ ID NO: 57717 - DNA, 50 bp, homo sapien
tcctgaagaaataacttgttcactakgaaataacttaaaccagaaatgtg

SEQ ID NO: 57718 - DNA, 50 bp, homo sapien
aaaagagaagagggtgggagacctgrcactttaaaacagggcggtgtgca

SEQ ID NO: 57719 - DNA, 50 bp, homo sapien
ggcagaacattaaaaatgagagatgytggttttaagtctgaatagcaatg

SEQ ID NO: 57720 - DNA, 50 bp, homo sapien
aattcagctgtttccaccacagtaartaatggacaaattgggcatctggc

SEQ ID NO: 57721 - DNA, 50 bp, homo sapien
ttgcctctgactaatcgccttagccraagatctggctcatcgcctctctc

SEQ ID NO: 57722 - DNA, 50 bp, homo sapien
tgacttccttacttttgcttacagaygcgaccatactaaaacttgtgaga

SEQ ID NO: 57723 - DNA, 50 bp, homo sapien
tgttaggcctttgctgccaggttcamactgggagacgttctgtgacttct

SEQ ID NO: 57724 - DNA, 50 bp, homo sapien
aatgtgcctgtgtaattgccactttyatggactagtgcatttcacagttg

SEQ ID NO: 57725 - DNA, 50 bp, homo sapien
agtgaatccatcattgtgaccatacrtttaaaaacaaaatggcacaagca

SEQ ID NO: 57726 - DNA, 50 bp, homo sapien
agacccatcacttaattgctgataarctcagaccaaggcgtgtggctgtc

SEQ ID NO: 57727 - DNA, 50 bp, homo sapien
aacataagctccaatccaaattatayctttgtgaatacataaaactgaat

SEQ ID NO: 57728 - DNA, 50 bp, homo sapien
tcctgggcatgactggtattctgggyagacagttattttgtgtagggcat

SEQ ID NO: 57729 - DNA, 50 bp, homo sapien
caggggtcagtctgcttcaccaggaragttgctcaacttctcccagatca

SEQ ID NO: 57730 - DNA, 50 bp, homo sapien
ggtgctgtggcatttacttacgataygttcacctatctccaactgacccc

SEQ ID NO: 57731 - DNA, 50 bp, homo sapien
gttctgaatgtggacactccaaagamgacagatggctttgctgagactca

SEQ ID NO: 57732 - DNA, 50 bp, homo sapien
gatcacttttgcctggaattttgaaygtgactacagttctacaggatatt

SEQ ID NO: 57733 - DNA, 50 bp, homo sapien
aagagtatttgccaaatagaagtatsacaggtatttttcatatatagaaa

SEQ ID NO: 57734 - DNA, 50 bp, homo sapien
gagttagaaagctcagcttcctaccrctatggtccagatcctcagggagc

SEQ ID NO: 57735 - DNA, 50 bp, homo sapien
gtatgtgaacacagtaagcaaaatartaatactgactttctttgtggtca

SEQ ID NO: 57736 - DNA, 50 bp, homo sapien
cattacacttttatcttctagtcccrcatcgtcaatctacatcataaaag

SEQ ID NO: 57737 - DNA, 50 bp, homo sapien
aataaattttggttgaatttaactgmacataggctgtactgtgatagagc

SEQ ID NO: 57738 - DNA, 50 bp, homo sapien
actgtatacgttttctttgagtacaraaatgatatatggtcactgtagag

SEQ ID NO: 57739 - DNA, 50 bp, homo sapien
tttaaatctatgctttggactacaartaaatttcggtgttaattaggtct

SEQ ID NO: 57740 - DNA, 50 bp, homo sapien
ggtttttctttgcattagaagttggycatttagctctgctgatcaagaaa

SEQ ID NO: 57741 - DNA, 50 bp, homo sapien
atttacaaatacttactctgtgcccrattctatactagactctagggaga

SEQ ID NO: 57742 - DNA, 50 bp, homo sapien
ggaaattagatagtataggagagaakgtgtcaattactccacttgtgtcc

SEQ ID NO: 57743 - DNA, 50 bp, homo sapien
gaccatgtatttaacaccacagataygcagtagagtgcacatagaagtct

SEQ ID NO: 57744 - DNA, 50 bp, homo sapien
ctttttgagtttcttctatttatcaytcacttcacagactctagcttgcc

SEQ ID NO: 57745 - DNA, 50 bp, homo sapien
ggagaaccactttataactaactcasaagaccaggatgacaactggaaag

SEQ ID NO: 57746 - DNA, 50 bp, homo sapien
tggaaacatgactggagagggttcakgtgaaatcagagggaggaaggtga

SEQ ID NO: 57747 - DNA, 50 bp, homo sapien
cagctttggcttcagctttgacagartattgatttttgataattggtaat

SEQ ID NO: 57748 - DNA, 50 bp, homo sapien
agaaaactgtcatgtcaactgtgtcrccctttaccaagcaagccaacctc

SEQ ID NO: 57749 - DNA, 50 bp, homo sapien
cttccctttgtggactgagacttaarattcttttggtggccaagacagaa

SEQ ID NO: 57750 - DNA, 50 bp, homo sapien
atgctaagcccattatcttgtttaaycttcagagtaatcttgggacataa

SEQ ID NO: 57751 - DNA, 50 bp, homo sapien
aaaaatatactgataagtttggagtmaagtccaccttcgttcgaggctag

SEQ ID NO: 57752 - DNA, 50 bp, homo sapien
acagatgattttctttattgcctcayggtactttgtatgtctatcatagt

SEQ ID NO: 57753 - DNA, 50 bp, homo sapien
ctcaggggtccccagccagttctaaygtatctgaaagcctgtgacccagg

SEQ ID NO: 57754 - DNA, 50 bp, homo sapien
gactagccattcaagaacttattctsaactcaagaggccctggagaaact

SEQ ID NO: 57755 - DNA, 50 bp, homo sapien
ctgatttgttctgccagaggaagcaytgatttaagactcgatatacaaca

SEQ ID NO: 57756 - DNA, 50 bp, homo sapien
taaagatgaaactccgtcagaagcarcacaatattggcagctgggcatgc

SEQ ID NO: 57757 - DNA, 50 bp, homo sapien
gcacattaaattggaactggataaamcctaactcttgaaaaaagtgttag

SEQ ID NO: 57758 - DNA, 50 bp, homo sapien
agtcatttttcctggaaaataggagwcagaaccctcatctgcagaaggag

SEQ ID NO: 57759 - DNA, 50 bp, homo sapien
ggagaggagtatagccgaagtagtcratttgtagatagtggtagtttcct

SEQ ID NO: 57760 - DNA, 50 bp, homo sapien
ggatgaaatgagcatcagagagaaastaatgaatactgaaattgaacctt

SEQ ID NO: 57761 - DNA, 50 bp, homo sapien
aaatttttagctgtattggattcacygtattagattttgataccatgcca

SEQ ID NO: 57762 - DNA, 50 bp, homo sapien
ctaagtaacaaaaagtcttcatttaycaaggggcagaaacccagatatct

SEQ ID NO: 57763 - DNA, 50 bp, homo sapien
cttttcaaagtttcaaagtagagacwcaaggatatcaaaatattttatcc

SEQ ID NO: 57764 - DNA, 50 bp, homo sapien
agcatagattcaatgtagtctcaatmaaaaactcagtgggttctggcaag

SEQ ID NO: 57765 - DNA, 50 bp, homo sapien
ggagaagtaatggacatctctaatayagttgggtttcaggtttgcaaagt

SEQ ID NO: 57766 - DNA, 50 bp, homo sapien
agtcttaaataaaaaagactggataraattgtctggataaaaatgaattg

SEQ ID NO: 57767 - DNA, 50 bp, homo sapien
ggctgtgagcaaaaagttgcataaaractgagtttgaagaactgtttatg

SEQ ID NO: 57768 - DNA, 50 bp, homo sapien
cacgagccatccctttctggcattaygtatttcatttttaccttgaacac

SEQ ID NO: 57769 - DNA, 50 bp, homo sapien
tatccacaaattgctgaacatgttcsatacacatacaaagtccctgcctt

SEQ ID NO: 57770 - DNA, 50 bp, homo sapien
ctcctagactgtaaagcgtagttaaragcatagcctctgaaggaagagaa

SEQ ID NO: 57771 - DNA, 50 bp, homo sapien
ggagagaagtaagaatatggtatacrcttttggccaggcatggtggctca

SEQ ID NO: 57772 - DNA, 50 bp, homo sapien
actaaaggaattgctaaggaaataayttatggcatatacacacactaatc

SEQ ID NO: 57773 - DNA, 50 bp, homo sapien
ctgagaagccccagtggaagtgccaygtatttctggtgaacagtgtgcac

SEQ ID NO: 57774 - DNA, 50 bp, homo sapien
actgcttttcatttggactcaggaasgctaaagactaggccataggagga

SEQ ID NO: 57775 - DNA, 50 bp, homo sapien
atacttctatattattctgatcatayctataatgtaatcacccataaata

SEQ ID NO: 57776 - DNA, 50 bp, homo sapien
tctgctatacgaagtcattcaagaakaataacatggtcagttttcaaagt

SEQ ID NO: 57777 - DNA, 50 bp, homo sapien
atataaatacagatggtaataacacrgcaaataagacatttgggaatatg

SEQ ID NO: 57778 - DNA, 50 bp, homo sapien
gtgggaaggtaagttgcatgtatacrctcagaaatcgggcatgcacattt

SEQ ID NO: 57779 - DNA, 50 bp, homo sapien
actgcaatttttttaaaagctcatargctagaacaagagacgtaggtagg

SEQ ID NO: 57780 - DNA, 50 bp, homo sapien
agatgaggacatggggacttagggarcagaaggagctggtcagagtcatg

SEQ ID NO: 57781 - DNA, 50 bp, homo sapien
aagtgatctcccttatgtatatgacygcacatgtcactccattgttaata

SEQ ID NO: 57782 - DNA, 50 bp, homo sapien
ccagaacagatgcacaagtaggaccyagagacagagtttacttccataaa

SEQ ID NO: 57783 - DNA, 50 bp, homo sapien
ttattcctttacattctggcagctargtacctatttttcatgttgataaa

SEQ ID NO: 57784 - DNA, 50 bp, homo sapien
aaggaaaaaagtctctatgtgttcartacagatgcagccatctatttttt

SEQ ID NO: 57785 - DNA, 50 bp, homo sapien
ttcctttctctaaatttgctacttaygatgtgaaagcagctcttttccaa

SEQ ID NO: 57786 - DNA, 50 bp, homo sapien
gtgcggtctcctgtgatatcccatcyagtctggaattgaatctgcacagt

SEQ ID NO: 57787 - DNA, 50 bp, homo sapien
caagagctgagggtgagatgtagtaraagatgtcagggagacgccccgaa

SEQ ID NO: 57788 - DNA, 50 bp, homo sapien
aaaattactgtacactgtactgtgaycttctttaatatttcatgaacatt

SEQ ID NO: 57789 - DNA, 50 bp, homo sapien
gagcagcaccagctggctgagtacgraacagtcagaaagcctaaggttgg

SEQ ID NO: 57790 - DNA, 50 bp, homo sapien
agctacagagtcaagaggcagaattyaactgtcacaaagcctgctgagat

SEQ ID NO: 57791 - DNA, 50 bp, homo sapien
aagtgtctattatgtatgatctacaraaaataaccgtttgacaattattt

SEQ ID NO: 57792 - DNA, 50 bp, homo sapien
cagctctgccataaatagcccaagarcttctaaatatgccctaagtcaga

SEQ ID NO: 57793 - DNA, 50 bp, homo sapien
ccctgaaaaccaatccctattttgcyaagcttagattcaccagattcagc

SEQ ID NO: 57794 - DNA, 50 bp, homo sapien
gaattcattaattcataattgaaaasttagtgtgtagactggttcagcta

SEQ ID NO: 57795 - DNA, 50 bp, homo sapien
ttcctaaaacatattagggaacataycattttaactgaccagggactttc

SEQ ID NO: 57796 - DNA, 50 bp, homo sapien
ttttgttttatcatgccctaccatayaaatgagaaaagtgaagctcagag

SEQ ID NO: 57797 - DNA, 50 bp, homo sapien
ccctcgcttctgacatccagtcatcyacaaagtttctcattttgcctcaa

SEQ ID NO: 57798 - DNA, 50 bp, homo sapien
gcccctcccctgtctactccttataygtgatattgatatatattcagaat

SEQ ID NO: 57799 - DNA, 50 bp, homo sapien
atggttaacttcagacaaactgatgsacaaaaccaatggtgaagtcagag

SEQ ID NO: 57800 - DNA, 50 bp, homo sapien
gttctaagtactatttctattactayaacctagtcatccagggtcttatc

SEQ ID NO: 57801 - DNA, 50 bp, homo sapien
atcctcatgcttatttcatggaagasgaaactgaacctcagaaaagtcaa

SEQ ID NO: 57802 - DNA, 50 bp, homo sapien
ccagttgtttctttaaacaggaccaygtgcaggtagtttttctagactat

SEQ ID NO: 57803 - DNA, 50 bp, homo sapien
ggtctcattatgttcttggcattgawatcctacctgatgagtttgggcac

SEQ ID NO: 57804 - DNA, 50 bp, homo sapien
aatccttacaacttgcaggtatctcsactcacaatgccgctgctcttggg

SEQ ID NO: 57805 - DNA, 50 bp, homo sapien
ctggcccagggatccctgctggggaygacctaactgacctagtcctcctg

SEQ ID NO: 57806 - DNA, 50 bp, homo sapien
tggcaagatcaagtgtagatatgctkagatacataaatactttccattga

SEQ ID NO: 57807 - DNA, 50 bp, homo sapien
caagtatctacttgagtcaaaagccraaaagagatcagtgttccaggcaa

SEQ ID NO: 57808 - DNA, 50 bp, homo sapien
cagagctagatgcatagaacctatartcaacttttaatcccctccctggg

SEQ ID NO: 57809 - DNA, 50 bp, homo sapien
gggctcttggagttgtaatgatatarcaagtcaaagttcctggatgcagg

SEQ ID NO: 57810 - DNA, 50 bp, homo sapien
gatattgggattaaggtgataacackaggagcaagaatcaccactggaga

SEQ ID NO: 57811 - DNA, 50 bp, homo sapien
aggcttcgtgaggttaagaaacatamaagatctcactggtagaaagtgac

SEQ ID NO: 57812 - DNA, 50 bp, homo sapien
aagagagtaaaaggaagccaggtcaraataagaataacagtatggaagac

SEQ ID NO: 57813 - DNA, 50 bp, homo sapien
atgagacaggcaggtaagttcttaayggactggtactgtcataagacagc

SEQ ID NO: 57814 - DNA, 50 bp, homo sapien
gggctgcaggagcagcgcgtcaaagraactgcaggtgtggggcttagagc

SEQ ID NO: 57815 - DNA, 50 bp, homo sapien
atgcaagaataaaggtccaatacgasacaagaaaagtcaagaaaagaacg

SEQ ID NO: 57816 - DNA, 50 bp, homo sapien
tcagtaaatgaaccaagccatgttaygtgaatttattgttaatatctgaa

SEQ ID NO: 57817 - DNA, 50 bp, homo sapien
caggaacagcgtctcgccaattgcaygatgattgctcctttgcccgagat

SEQ ID NO: 57818 - DNA, 50 bp, homo sapien
ttcaccctcaccacaacctcatcaartaagtctcattatggccattttat

SEQ ID NO: 57819 - DNA, 50 bp, homo sapien
aaaaatatctaataatggcaatcaarcaaattataataaaaacatgctat

SEQ ID NO: 57820 - DNA, 50 bp, homo sapien
aagattgattatggtcattaattaarcttccaaagtgccttcataggaga

SEQ ID NO: 57821 - DNA, 50 bp, homo sapien
ccaaacacaacagtctaccaaatgckgaacattaagctctcccgacccag

SEQ ID NO: 57822 - DNA, 50 bp, homo sapien
caactttccatctgttattcctttayactaaatgtccctctctgacattc

SEQ ID NO: 57823 - DNA, 50 bp, homo sapien
taggctttggaagccaggcaaagacrttgattccaaggcaggagctcttc

SEQ ID NO: 57824 - DNA, 32 bp, homo sapien
taaagatttgaagtagrtgagcaaggtggatt

SEQ ID NO: 57825 - DNA, 50 bp, homo sapien
tcaagtgcataagtgagatggatatrcctaacagttgacagaaatttcag

SEQ ID NO: 57826 - DNA, 50 bp, homo sapien
tccacatttttgcttgtgtttcttcrctgcaccacacacatggaattcat

SEQ ID NO: 57827 - DNA, 50 bp, homo sapien
gggtcctaaagacagccttcactaaygcagtaagaaatgtgctagtgaaa

SEQ ID NO: 57828 - DNA, 50 bp, homo sapien
gcttgggtagactggaatcagggacktttcctggaggagctgattcatga

SEQ ID NO: 57829 - DNA, 50 bp, homo sapien
aatgctagagtagattttctatagargtctggagaacccatcaggctgat

SEQ ID NO: 57830 - DNA, 50 bp, homo sapien
ggttgaatgatctctttctgcctgayggtttgagctaggacatcagtctt

SEQ ID NO: 57831 - DNA, 50 bp, homo sapien
ggggtgagaaagattagctgtagccrcacattccagaaggagactttaca

SEQ ID NO: 57832 - DNA, 50 bp, homo sapien
ttaagggctgttttttttttctttayatgatgttcagcttggtattaacc

SEQ ID NO: 57833 - DNA, 50 bp, homo sapien
gaacagcccatacaaagagatctatkaggttatctccagttttgaggttt

SEQ ID NO: 57834 - DNA, 50 bp, homo sapien
cactataaaaattactgaaagaaaaygacatagattatataatgttcatg

SEQ ID NO: 57835 - DNA, 50 bp, homo sapien
aaatgccagaattatcttccaacaartagattaggaggatgagaaagtgg

SEQ ID NO: 57836 - DNA, 50 bp, homo sapien
gttttgaggattgatatgatatttcygaaaacaactagcaaagatatagc

SEQ ID NO: 57837 - DNA, 50 bp, homo sapien
gtccaacattgtgtataaaaacttayagagctagcatgaggctctgaatg

SEQ ID NO: 57838 - DNA, 50 bp, homo sapien
gatcagttctatgttggaataagcayaactcaatctggggatcagggaaa

SEQ ID NO: 57839 - DNA, 50 bp, homo sapien
ggatgggccgaacaagaaagaagcamcatggtagacatcatgtagaagtg

SEQ ID NO: 57840 - DNA, 50 bp, homo sapien
ggtcatgcataaacatggttgtatcyactgtaactctatgaatgaaggta

SEQ ID NO: 57841 - DNA, 50 bp, homo sapien
atcctgcttctccaaccctaataaastatgacctgccacactttcctcac

SEQ ID NO: 57842 - DNA, 50 bp, homo sapien
gctcagcagtgagctcctgtgcaaaractatgggctgcatgtgctggttc

SEQ ID NO: 57843 - DNA, 50 bp, homo sapien
tgtctttgacagattttggtatcacrattattttggcctcatagaacata

SEQ ID NO: 57844 - DNA, 50 bp, homo sapien
gcaaagaaagaatttggctaataaamatctcctcggtcatcaggtgtcct

SEQ ID NO: 57845 - DNA, 50 bp, homo sapien
tccttagatgtcctagagattgcacratgtgtcctttacttcaataacaa

SEQ ID NO: 57846 - DNA, 50 bp, homo sapien
taaagtacctagcctgttataaataygtagatgaaataaaattctgtgaa

SEQ ID NO: 57847 - DNA, 50 bp, homo sapien
ttagctgctattgattctcacttaayggtcttgttcctcctagatgctgg

SEQ ID NO: 57848 - DNA, 50 bp, homo sapien
aatatggttatactacttgtcctcartcttttgcaataaatacctaagac

SEQ ID NO: 57849 - DNA, 50 bp, homo sapien
attattttccatacctaaagaacggkagaacctgtgagggtcacatttcc

SEQ ID NO: 57850 - DNA, 50 bp, homo sapien
tcctttagaaaggagacacagtctgragttaggagtgcaaaatatttatt

SEQ ID NO: 57851 - DNA, 50 bp, homo sapien
cccagacttcctgatgtccctgtgarcgctgttgccctaggggatgtcct

SEQ ID NO: 57852 - DNA, 50 bp, homo sapien
ttctgttaattgcatcttcatataasaaaaagctatgttctacaaaacaa

SEQ ID NO: 57853 - DNA, 50 bp, homo sapien
aacattcacggtttttagcaacaaastattttctaattaaggtattcaca

SEQ ID NO: 57854 - DNA, 50 bp, homo sapien
ctatctttcttcctttctttctttcrccatttagattcctttaagcctct

SEQ ID NO: 57855 - DNA, 50 bp, homo sapien
actgcagaaaatattggacttgttcrgaaaacctcacttgaaatgtttct

SEQ ID NO: 57856 - DNA, 50 bp, homo sapien
tcatatattatgtctgaacagtctayatgagtctctttgacacaagtctc

SEQ ID NO: 57857 - DNA, 50 bp, homo sapien
ccttcagaagagtttaagcttatctsaagccatcataatatcatgtgaac

SEQ ID NO: 57858 - DNA, 50 bp, homo sapien
aaagtagaaacacaatattttttcarggaaagacgagacataaatatcag

SEQ ID NO: 57859 - DNA, 50 bp, homo sapien
tgtagcttgatgcagcttcagtaaasgggacaaagatagagggatgggga

SEQ ID NO: 57860 - DNA, 50 bp, homo sapien
atgttaatgaggtgaatcctaagaayataagttgtttgggatctactgag

SEQ ID NO: 57861 - DNA, 50 bp, homo sapien
tcataataataaatagttatagatasatacattagttataaacagacaat

SEQ ID NO: 57862 - DNA, 50 bp, homo sapien
cctgaaaataaaggtaaattccataygataagcttgcattttaaaagttc

SEQ ID NO: 57863 - DNA, 50 bp, homo sapien
ccttttgccttttcagtctggaaatkaatgttcatgtgtgtgtggtgtgt

SEQ ID NO: 57864 - DNA, 50 bp, homo sapien
ggcttagctgggaagagaagggagaytataactgttaaggaaaagagtaa

SEQ ID NO: 57865 - DNA, 50 bp, homo sapien
ctacttctgttcccttggattcatayacctgaattggaaacacccaaagt

SEQ ID NO: 57866 - DNA, 50 bp, homo sapien
tgagaagtaaacttatttaggttaayccattgatatcatggaattgttag

SEQ ID NO: 57867 - DNA, 50 bp, homo sapien
attgagcatctgctactgcagatacrgtaaccacaagacatatgcttcct

SEQ ID NO: 57868 - DNA, 50 bp, homo sapien
gtagcagatgctcaataaataaaggsaccaatacttgtttcactgaatat

SEQ ID NO: 57869 - DNA, 50 bp, homo sapien
caatgctacactcactggagatatcyaagtcctgcagtaaatgcattgcc

SEQ ID NO: 57870 - DNA, 50 bp, homo sapien
gggaactagttcttctgcaaaggctyaagagcatctcaaaagaagagcat

SEQ ID NO: 57871 - DNA, 50 bp, homo sapien
ttgagaaggatgaccaaataattcaraatgcacatactcttagagtacag

SEQ ID NO: 57872 - DNA, 50 bp, homo sapien
cagaagaactagttcccttcacaccraactaccacaagtcagttttttgt

SEQ ID NO: 57873 - DNA, 50 bp, homo sapien
caattaaatgctaaataaaaattggycattattgttactgataggctacc

SEQ ID NO: 57874 - DNA, 50 bp, homo sapien
tagtccttcatgtttctgtctccaayattcacttagaattgtattgtaat

SEQ ID NO: 57875 - DNA, 50 bp, homo sapien
tcacgtagaagacagcataagggccygctaggtcaggaattggactgccc

SEQ ID NO: 57876 - DNA, 50 bp, homo sapien
acacaactacaaatagtttgtctatsaggtaagtagataagagtagccat

SEQ ID NO: 57877 - DNA, 50 bp, homo sapien
gccagtcagtaggtcaggcttggagratacgactacaatgaagacagacg

SEQ ID NO: 57878 - DNA, 50 bp, homo sapien
ggattaaataaataatgtcttcatcrgtttatttcttctgaggaactaca

SEQ ID NO: 57879 - DNA, 50 bp, homo sapien
accggagtgtgctttgctgttcagaycttttaacctcagcttatcaactt

SEQ ID NO: 57880 - DNA, 50 bp, homo sapien
ccaacccttcttctgtaaaggattcraattttaaacagctaaaaatacat

SEQ ID NO: 57881 - DNA, 50 bp, homo sapien
gggtcaggatggcacttctctgccamctggatatgttctgtgcatgtctc

SEQ ID NO: 57882 - DNA, 50 bp, homo sapien
catgggcaagaggaacatgaacaaakattggaactttctatgacatctct

SEQ ID NO: 57883 - DNA, 50 bp, homo sapien
gctggggtgtggttgtgttctggtcrcaattcatttaccatcagtttaca

SEQ ID NO: 57884 - DNA, 50 bp, homo sapien
agtagctaccacatacggttgccatragcattatctggtttcatacatac

SEQ ID NO: 57885 - DNA, 50 bp, homo sapien
gtaatgtaccaatgttaattccatgrttttgacaagtgcaccattgtaat

SEQ ID NO: 57886 - DNA, 50 bp, homo sapien
gctattttactgtgcacaaccataarttagagcacttgataaatggtctc

SEQ ID NO: 57887 - DNA, 50 bp, homo sapien
cttcctgttcctccttagtgacaaayggtggaccagctctcccatcacct

SEQ ID NO: 57888 - DNA, 50 bp, homo sapien
tatcaaatcactaaggtggtcgagarccatatttaaaagattagcactgt

SEQ ID NO: 57889 - DNA, 50 bp, homo sapien
cttaatgcctagcattttctttgtawgtatctatggtggataaggtgcat

SEQ ID NO: 57890 - DNA, 50 bp, homo sapien
gggtgagtttgtggttctcactggastagcatctatacagacaaactttg

SEQ ID NO: 57891 - DNA, 50 bp, homo sapien
agtacctggaggacaaggaggaagayaatttactagggaaaataaataca

SEQ ID NO: 57892 - DNA, 50 bp, homo sapien
tttcttactggagacgactgctccakaattactcctaaatgaatttcaac

SEQ ID NO: 57893 - DNA, 50 bp, homo sapien
tgggttaaagttctttccacatattygatttgctaattctcatttatggc

SEQ ID NO: 57894 - DNA, 50 bp, homo sapien
gggatatgtgcaatctgttggtaagwcacatcctatgtttggcctcattt

SEQ ID NO: 57895 - DNA, 50 bp, homo sapien
gtatcaacacaaccttcccagatcayaacggcaaggggagaagatgctag

SEQ ID NO: 57896 - DNA, 50 bp, homo sapien
cagaggccttatgtcaacgtatgggkactgttaacaccacctttctcaac

SEQ ID NO: 57897 - DNA, 50 bp, homo sapien
aattaaaatggctgctggtggtcaakctggactaggtagagaaaacatac

SEQ ID NO: 57898 - DNA, 50 bp, homo sapien
tgtgtagaactgatgatggggtaaartagaagaaaccacacatatacacc

SEQ ID NO: 57899 - DNA, 50 bp, homo sapien
aaatactgtaagggagaaagcaagaygcactattttgaaaatgaaaaata

SEQ ID NO: 57900 - DNA, 50 bp, homo sapien
aaaaaaaaaattctaaatatcaaaaygacatggttgcatatagcacaaat

SEQ ID NO: 57901 - DNA, 50 bp, homo sapien
aagaggagtgaaaaaatggacatcgratggtttaatgtaaggtattgaca

SEQ ID NO: 57902 - DNA, 50 bp, homo sapien
atgtcctttttatagttccttaatakttttttacatgcctgtatcataat

SEQ ID NO: 57903 - DNA, 50 bp, homo sapien
ttcatccaagtgttaagatacgcatmaaagcattatgttaaaaaaaaatt

SEQ ID NO: 57904 - DNA, 50 bp, homo sapien
aaacgggattttcaaataacaaaaargtgttaggtgtctgtgacctggta

SEQ ID NO: 57905 - DNA, 50 bp, homo sapien
ttcttgcctttttgacattgggaaartgaattaacatctttggccttaga

SEQ ID NO: 57906 - DNA, 50 bp, homo sapien
ggaaagaaggacactggcaaagttayaggttggttcattttagtacattt

SEQ ID NO: 57907 - DNA, 50 bp, homo sapien
atccatatttggtccattaagtttamctgaaagcctctaccagagtgatt

SEQ ID NO: 57908 - DNA, 50 bp, homo sapien
tctcatctgtaaaatggggctatgamtatttgccttacaacagtattaca

SEQ ID NO: 57909 - DNA, 50 bp, homo sapien
ttctttccaatatcaaccttcaaacrccagtgtaaaaatgcatttgcaat

SEQ ID NO: 57910 - DNA, 50 bp, homo sapien
actcaaccatatgctgcttacaaaakacaaacggtaaaagaaaaatgaga

SEQ ID NO: 57911 - DNA, 50 bp, homo sapien
catgaatatataactactcatatcasatatttatgcaaatttaataaaca

SEQ ID NO: 57912 - DNA, 50 bp, homo sapien
tggtttttaaagatggctgtattctyaaaggaggaggtttgttcttgagt

SEQ ID NO: 57913 - DNA, 50 bp, homo sapien
gttccctgtctctaatcttcacacaytctacttgactctctgcagttttg

SEQ ID NO: 57914 - DNA, 50 bp, homo sapien
cagatatacttaatttgttcatgtcrcacagtaaagcttaagttgagaac

SEQ ID NO: 57915 - DNA, 50 bp, homo sapien
atataacatcagatagggaaaagtgmaatgaagttgatgaaggagataca

SEQ ID NO: 57916 - DNA, 50 bp, homo sapien
ttcttccagagggagtaaacttataygattcatctgcccaaacggagcat

SEQ ID NO: 57917 - DNA, 50 bp, homo sapien
ggtcatcctcaaggattgtgactcakacccaaggtggtgttcctgccctc

SEQ ID NO: 57918 - DNA, 50 bp, homo sapien
aggatgcagcctcagcaaagacatayaagtgatgcctcaaagaaccatgt

SEQ ID NO: 57919 - DNA, 50 bp, homo sapien
caatctagcattaggccatatggtcrcttgaattgttctctccttttttc

SEQ ID NO: 57920 - DNA, 50 bp, homo sapien
ttgatttcttgactgggttatctcaytgaaccatccttccctccatctat

SEQ ID NO: 57921 - DNA, 50 bp, homo sapien
tgttggaggcatccaagaaattccartagttccatctcagtgacttaaga

SEQ ID NO: 57922 - DNA, 50 bp, homo sapien
ggagatactaggatgcctaggtcagygatcagcaccaaataggactctct

SEQ ID NO: 57923 - DNA, 50 bp, homo sapien
aagtatgaaactctttgttctgacartgactgtaagttgttgaaattctt

SEQ ID NO: 57924 - DNA, 50 bp, homo sapien
cataggtctgttggaaaattttgaamggaggagcatgtgatttgacttac

SEQ ID NO: 57925 - DNA, 50 bp, homo sapien
tgtgtcagtgactggttgtataatcmaaggcaggtccctaaacctctcct

SEQ ID NO: 57926 - DNA, 50 bp, homo sapien
acaggcaggatctatagaagaacaargtggactgccggctgtatgagtcg

SEQ ID NO: 57927 - DNA, 50 bp, homo sapien
tcagtaagtctgaggtggccaattckaatgatcagaaaagtttaggaaat

SEQ ID NO: 57928 - DNA, 50 bp, homo sapien
tttctataaagatcgtattttcctcyagtaagtgtgacttccattttagc

SEQ ID NO: 57929 - DNA, 50 bp, homo sapien
aggacaggcctgacactatggaagaygctttcagacttaaatctagaacg

SEQ ID NO: 57930 - DNA, 50 bp, homo sapien
acatgtcttttgctctgggaccaggmgttgtgcagcccatccttttctca

SEQ ID NO: 57931 - DNA, 50 bp, homo sapien
aggtaatttaaatgacttttctatgmaccccaacacccatacctcctttc

SEQ ID NO: 57932 - DNA, 50 bp, homo sapien
aacagtatttgttaattccttgcaaygaaagatttagcataattacctca

SEQ ID NO: 57933 - DNA, 50 bp, homo sapien
gctgaagcctcagtatatccccccartaactatactctgagcagcttcat

SEQ ID NO: 57934 - DNA, 50 bp, homo sapien
gtaattcccagaacctgtggatatgyaccttgtgtggcaaaaggaactgc

SEQ ID NO: 57935 - DNA, 50 bp, homo sapien
actgtacttaatatagtttctggcayatattagacatgcaataaatatat

SEQ ID NO: 57936 - DNA, 50 bp, homo sapien
gaaagaacatgtgatagagcttttaygacctgcattattattatttttaa

SEQ ID NO: 57937 - DNA, 50 bp, homo sapien
ccactaggtgctggagaaaccctgcrgcagaggaatggtgagatgcaaag

SEQ ID NO: 57938 - DNA, 50 bp, homo sapien
gaggggaaacagcgcaggaattggamagcatttgtctaccaactcaaagc

SEQ ID NO: 57939 - DNA, 50 bp, homo sapien
ttttctttttaaatgaggctatgaaygcaaggaaacttatttgtatacgg

SEQ ID NO: 57940 - DNA, 50 bp, homo sapien
tgtgtaagagagattaatgcttacamaaaatcaagtttcaattaagaaca

SEQ ID NO: 57941 - DNA, 50 bp, homo sapien
tttcaattaagaacaagaagagggaygtgaataataaatggacaaccacc

SEQ ID NO: 57942 - DNA, 50 bp, homo sapien
catgaggaggaggaaaaatgctagcraaagattcattggaggttaaataa

SEQ ID NO: 57943 - DNA, 50 bp, homo sapien
aggaaagcccccataagtgagagccyggagaagtatctcctaccctggac

SEQ ID NO: 57944 - DNA, 50 bp, homo sapien
accctcactacctgatcactcttgaygtctaaccaaatttctcaccccca

SEQ ID NO: 57945 - DNA, 50 bp, homo sapien
aatgagactctgatttgtcatggcartatcttttagtacctccaaaggtt

SEQ ID NO: 57946 - DNA, 50 bp, homo sapien
cactattttagcttctgttttctgcyagtgagtaaattaaggaatgaact

SEQ ID NO: 57947 - DNA, 50 bp, homo sapien
agttacctctccaaatgtagtaatayagccccagaataattctccttcaa

SEQ ID NO: 57948 - DNA, 50 bp, homo sapien
gaaaatgcatagaaataactgagagrattttcctgcatggacctcatttc

SEQ ID NO: 57949 - DNA, 50 bp, homo sapien
tggtactctcattatgcacccgtttwtacttggtgtcccacatgtctcca

SEQ ID NO: 57950 - DNA, 50 bp, homo sapien
gggcaactacaaatacttatggctasaaattactatttggaaaatgcata

SEQ ID NO: 57951 - DNA, 50 bp, homo sapien
ttctcctgggaatgccatgcacatargataaggactggtctccggttggt

SEQ ID NO: 57952 - DNA, 50 bp, homo sapien
actaaaatatcagaagaaaactgatsactaaatatatttcctgcctgtca

SEQ ID NO: 57953 - DNA, 50 bp, homo sapien
acagtaaatggaaaagcagaaggaarctgggtccgtgatgacaatgtgag

SEQ ID NO: 57954 - DNA, 50 bp, homo sapien
agctctatttacagtatcagtaaaayggatatagtagtatctactccata

SEQ ID NO: 57955 - DNA, 50 bp, homo sapien
ccaacaggatttgaagtgtcttcaaragatacaaataatacaggtaaaaa

SEQ ID NO: 57956 - DNA, 50 bp, homo sapien
ttgaaaatgatcaaaatgtttttgascaacttaattttatctaagaacaa

SEQ ID NO: 57957 - DNA, 50 bp, homo sapien
tccatagagtgaagaaaccgaactayactatgggaaacagcttttataca

SEQ ID NO: 57958 - DNA, 50 bp, homo sapien
caattacaatgatagattgaggtaaygctcataactgttagtacagcacc

SEQ ID NO: 57959 - DNA, 50 bp, homo sapien
cagtaatcaccaaagatatgttttayaactctcatgaagttgtttgacct

SEQ ID NO: 57960 - DNA, 50 bp, homo sapien
ccatatcacaactatcttcaacaaartatcattatcgtgggtttgctttg

SEQ ID NO: 57961 - DNA, 50 bp, homo sapien
tccacttatctgtaaactgcagataygatctacttcataaggatgttatg

SEQ ID NO: 57962 - DNA, 50 bp, homo sapien
catcaataaaaaagagaaccacctaygtaaaaggcatctactcactaggc

SEQ ID NO: 57963 - DNA, 50 bp, homo sapien
ggacagatgtctttagcacctaataragaacaatagaaagacttcgtgag

SEQ ID NO: 57964 - DNA, 50 bp, homo sapien
gtgaggacaagagagactaaattgawatagatgggcttcctttttgctac

SEQ ID NO: 57965 - DNA, 50 bp, homo sapien
atttttttaaacttaatgtgaacaayataatgcagctattgaatattttt

SEQ ID NO: 57966 - DNA, 50 bp, homo sapien
tttaccatatttaagctgaataaacsgaggttcagtgtttttgacttatc

SEQ ID NO: 57967 - DNA, 50 bp, homo sapien
atatgtgtgtatagacatgtctggawtaataggtctgagtgatatttctg

SEQ ID NO: 57968 - DNA, 50 bp, homo sapien
ggaccaaagatttcagctatggaagragcacactattccaaggacccaga

SEQ ID NO: 57969 - DNA, 50 bp, homo sapien
ctcacatgggatagtggtggaaaaaygaatcttgtcaggtaatcatatct

SEQ ID NO: 57970 - DNA, 50 bp, homo sapien
tagaaaacaacaaaccatgcaacaayttgctaacaattagtaccacccaa

SEQ ID NO: 57971 - DNA, 50 bp, homo sapien
tatattacttctggacactgcacatractttagcttagaagtcatcacca

SEQ ID NO: 57972 - DNA, 50 bp, homo sapien
tagagttgtgagaattaagtgagaaygtgtataattaagtagaagaaata

SEQ ID NO: 57973 - DNA, 50 bp, homo sapien
tgatggagctaattcacattcagaayacgtactacaaagaaacccagaaa

SEQ ID NO: 57974 - DNA, 50 bp, homo sapien
tctatgcatcaaaggacatgatcaamagagtaataagtggtaagaaaaaa

SEQ ID NO: 57975 - DNA, 50 bp, homo sapien
tcacaattcagaaagtttgacaaatraataaatgacagtttggctttcta

SEQ ID NO: 57976 - DNA, 50 bp, homo sapien
aaatataaaaccagcaagtatacagraagttagaaggtatgagtcctatg

SEQ ID NO: 57977 - DNA, 50 bp, homo sapien
gcaacttgggaatcataaactttaaygtcaaacttcatgtgtttagtaaa

SEQ ID NO: 57978 - DNA, 50 bp, homo sapien
aaattttgagttttagagagagttargagttaatgaagtcaaacagaggg

SEQ ID NO: 57979 - DNA, 50 bp, homo sapien
gtcccctgttaatagtgctccagacmgtagaaattgaggtaaataagcag

SEQ ID NO: 57980 - DNA, 50 bp, homo sapien
tttatctgaaattaaacaagacatcygatatgattatccttctgtataag

SEQ ID NO: 57981 - DNA, 50 bp, homo sapien
gcatataatagatgcagaggtgtaawatatgttatcaaataaatttcaca

SEQ ID NO: 57982 - DNA, 50 bp, homo sapien
ggtgttttaatctaagtgggataagyagtaaaagaaatgtttggtctgtg

SEQ ID NO: 57983 - DNA, 50 bp, homo sapien
atgagctatactgggggaacatgccractcaggctgatcctacagtacta

SEQ ID NO: 57984 - DNA, 50 bp, homo sapien
taaattcttatcattttatgaatcaygttctactttgaaaatatgagaaa

SEQ ID NO: 57985 - DNA, 50 bp, homo sapien
ctaactactataaggccttagcactsactttccctggatgccatcaggct

SEQ ID NO: 57986 - DNA, 50 bp, homo sapien
ggacatatatttaaacaaaattatgraaactagttatgttatgtatattt

SEQ ID NO: 57987 - DNA, 50 bp, homo sapien
gaagttttagtcttcatgagtcttaygcgcttagggtgtggatttaaatt

SEQ ID NO: 57988 - DNA, 50 bp, homo sapien
gaacagagacaattaaggctaatacstataataacatttctcatgtattt

SEQ ID NO: 57989 - DNA, 50 bp, homo sapien
gtattattttatcccttttatagacratgaaataaatatttagagaagtt

SEQ ID NO: 57990 - DNA, 50 bp, homo sapien
cttctaccataaggagcagcacaaakagagaaataattaatcatcacaat

SEQ ID NO: 57991 - DNA, 50 bp, homo sapien
ctgtcagaaggaccagttgactccayggccgacctggcagttgtggagcc

SEQ ID NO: 57992 - DNA, 50 bp, homo sapien
taaattaccagtggtctcagagccartaaatagtgaagccaagactcgta

SEQ ID NO: 57993 - DNA, 50 bp, homo sapien
ttgctttggacccagctgcataatcsaagatcctctcctttaattccatt

SEQ ID NO: 57994 - DNA, 50 bp, homo sapien
taattcttctctgacctgagtgatayccactggaggcccacagtgagccc

SEQ ID NO: 57995 - DNA, 50 bp, homo sapien
ctttaacatagagagaacggttggasagcgtgacatttaaagttaaggtg

SEQ ID NO: 57996 - DNA, 50 bp, homo sapien
cccttactggaaatagcatcttttargtttcaaggctctccagtgctact

SEQ ID NO: 57997 - DNA, 50 bp, homo sapien
taattccttctgaaaacattttcaaytgtgggaatcaagactggctcagt

SEQ ID NO: 57998 - DNA, 50 bp, homo sapien
aatgtcagtaagtactactatgctcrcaaacaatgtatgattatgttgtt

SEQ ID NO: 57999 - DNA, 50 bp, homo sapien
gctatttgtcagcctctcaaagtcayggaacaaatgaaagtaactatgag

SEQ ID NO: 58000 - DNA, 50 bp, homo sapien
atatgttgaaatcatctgttcatatrtctgcttcccattctctgactgag

SEQ ID NO: 58001 - DNA, 50 bp, homo sapien
gcttcagtttcttcatctgattgtgraaagaataatagtatctatttcat

SEQ ID NO: 58002 - DNA, 50 bp, homo sapien
gtacattctgacaattataccaccawcctgttcttaatgatacacattag

SEQ ID NO: 58003 - DNA, 50 bp, homo sapien
attctgtgacaactttaaaaaagcastcgtagggcacaactgtgatgaaa

SEQ ID NO: 58004 - DNA, 50 bp, homo sapien
tgtttttttaatcaatactcataacraatgacttaaaacaagccccatag

SEQ ID NO: 58005 - DNA, 50 bp, homo sapien
agatagtgaggctatctggagattgracattgaccttcactatagaacaa

SEQ ID NO: 58006 - DNA, 50 bp, homo sapien
caacttcagaaatgtcttcctatacytaccactacttgaggcaagtgagc

SEQ ID NO: 58007 - DNA, 50 bp, homo sapien
aaactacatctcctagagtttaagtractggtccaaaagattgcgtagct

SEQ ID NO: 58008 - DNA, 50 bp, homo sapien
gtatggtgatggactggctttgggtmaaaaatgcactatagtaaattgca

SEQ ID NO: 58009 - DNA, 50 bp, homo sapien
tcttctacctggctttgttctatcayccgtatctgctaagatgttactgc

SEQ ID NO: 58010 - DNA, 50 bp, homo sapien
cagttgttacaatgtagagcctcaargataatgtaaaattagacaagaca

SEQ ID NO: 58011 - DNA, 50 bp, homo sapien
atacaatatttctgtcctctaatacrctaatattaccagcacacttttgt

SEQ ID NO: 58012 - DNA, 50 bp, homo sapien
agcatttcacaaacatgtggtagacyggagaattggactaagaactgtgt

SEQ ID NO: 58013 - DNA, 50 bp, homo sapien
ttatattgaaaatagagttctcttasaagccatgaaaagaggcgattgtc

SEQ ID NO: 58014 - DNA, 50 bp, homo sapien
atatacagaacttggattggagggamgaaataactctatgatttaaatct

SEQ ID NO: 58015 - DNA, 50 bp, homo sapien
caataatcccagcactgattctctgyaaagacaattgatcctaaagatgc

SEQ ID NO: 58016 - DNA, 50 bp, homo sapien
tctggggagttcagacaagtaaacasatgagtataaggcatgatgtgaat

SEQ ID NO: 58017 - DNA, 50 bp, homo sapien
tgtttacagcacctgaaaagacaaakatctggagcttgatcaactataga

SEQ ID NO: 58018 - DNA, 50 bp, homo sapien
cttatgcacttaagtagatccatcartgaactagcctgaaggactttcct

SEQ ID NO: 58019 - DNA, 50 bp, homo sapien
tcagaaaatgactcaaatctgtccakagcaatgttcaagtctaggctttt

SEQ ID NO: 58020 - DNA, 50 bp, homo sapien
cttttctcctatcaaaaccctgtgcrtacttcaagcctcatctcaaacat

SEQ ID NO: 58021 - DNA, 50 bp, homo sapien
taggatacatcccaggaaagagccasatgttcagtgagactagagcaaat

SEQ ID NO: 58022 - DNA, 50 bp, homo sapien
acaagggtttcagcaaatgaaaaaarggtttttgtgacagaccttgggtt

SEQ ID NO: 58023 - DNA, 50 bp, homo sapien
gttatctgtgttttatcaatatgtascttcacatgaatccaaatgctttt

SEQ ID NO: 58024 - DNA, 50 bp, homo sapien
agtcaccaggtctaacacatgttttrtgagcatatgcataccaggtgggc

SEQ ID NO: 58025 - DNA, 50 bp, homo sapien
atacatagaaaagagcatagaaaatwatctagcagacatctattatatat

SEQ ID NO: 58026 - DNA, 50 bp, homo sapien
tctgaacaaatgccctctttatttaygaccaagctatggcttattcctgt

SEQ ID NO: 58027 - DNA, 50 bp, homo sapien
aggaaaagctagaaacatcagaaggratttcagtttggcctggaaaaatc

SEQ ID NO: 58028 - DNA, 50 bp, homo sapien
acctcgaaagcattatattgagttawagaagttagataagaaagccacat

SEQ ID NO: 58029 - DNA, 50 bp, homo sapien
ggggttctcatgagaatagaaatgakgatatatgtaaaagaactagctca

SEQ ID NO: 58030 - DNA, 50 bp, homo sapien
ttcagtcagcctccagactccaaatsatagctacataccatgctatttac

SEQ ID NO: 58031 - DNA, 50 bp, homo sapien
gaccatgaatgagagctttaactccratgtctataggaacacaggcatga

SEQ ID NO: 58032 - DNA, 50 bp, homo sapien
aatgtggtctggggaaaacagttgcrtaaagcagaatgccaattctggca

SEQ ID NO: 58033 - DNA, 50 bp, homo sapien
ttcctcaccatctcttgcagattaasgaaacactacatgttctaaatgac

SEQ ID NO: 58034 - DNA, 50 bp, homo sapien
aaacaggcataaatagtgaagaggcmatgagaaaggcatttcaaatctgt

SEQ ID NO: 58035 - DNA, 50 bp, homo sapien
tgttaccagatttattaatgctggcsaattcctttttattttgagacagg

SEQ ID NO: 58036 - DNA, 50 bp, homo sapien
gtgttctgattaaatcataaagggartaaaaatggcataatgggaacatc

SEQ ID NO: 58037 - DNA, 50 bp, homo sapien
taaaaaagttatttgcatctctgaasgaattaattacattcttttctcat

SEQ ID NO: 58038 - DNA, 50 bp, homo sapien
acgtctcatccattctctcaattacygggaaaaacaccaacacctaagtg

SEQ ID NO: 58039 - DNA, 50 bp, homo sapien
gagtgatcagtttaaaggattgttgyaatacttactttgaaaaccaaatg

SEQ ID NO: 58040 - DNA, 50 bp, homo sapien
ccgggtactcttccagacaggattcyatttacagaggaggaaaccaagga

SEQ ID NO: 58041 - DNA, 50 bp, homo sapien
tgcaaggataaaacatacagtctacraggaacagtaagatacacacacac

SEQ ID NO: 58042 - DNA, 50 bp, homo sapien
agtgctgaggtttgggaatcaccaarcatatagctcatgtttcccccaca

SEQ ID NO: 58043 - DNA, 50 bp, homo sapien
cccagtgaggagaagcaaatggtccragattaggtggttagagaaagggg

SEQ ID NO: 58044 - DNA, 50 bp, homo sapien
atattaagatgagaataggcacttasgatatataatgagtgggaagcacc

SEQ ID NO: 58045 - DNA, 50 bp, homo sapien
ataaagtgttgcagtatttacacacracttatgcacatcttaccatattc

SEQ ID NO: 58046 - DNA, 50 bp, homo sapien
tgacctcacttgacccttgccgctaygctggaggagtagttattagcatt

SEQ ID NO: 58047 - DNA, 50 bp, homo sapien
accatttcacagcccatgttaatcamgcgaacaccagagaaatcaaaaat

SEQ ID NO: 58048 - DNA, 50 bp, homo sapien
aaactaagtcattgaatatctttggkagatagagctactatattcccctg

SEQ ID NO: 58049 - DNA, 50 bp, homo sapien
ttccatttcacaggaggtccaaggaraaaaatagaagatccctgtattgc

SEQ ID NO: 58050 - DNA, 50 bp, homo sapien
ggattgatataattctagccaaaacrgtttaggcagtgtgtgcaacacta

SEQ ID NO: 58051 - DNA, 50 bp, homo sapien
gtaaaaaaaatcaattgattctataygtgcaggtctattttggacactgt

SEQ ID NO: 58052 - DNA, 50 bp, homo sapien
agtcaccttcaattcctgaacatcarctagattcccccaactatactgta

SEQ ID NO: 58053 - DNA, 50 bp, homo sapien
gttcttactgccttattagtaaacaygggcactgtatctttatgaactgc

SEQ ID NO: 58054 - DNA, 50 bp, homo sapien
ctccttgccacatccttaaataagtmactaggataactgtggtaattgcc

SEQ ID NO: 58055 - DNA, 50 bp, homo sapien
tgcctacagaggtagtctatggtccrattataaaatgctttgagtatctt

SEQ ID NO: 58056 - DNA, 50 bp, homo sapien
ctagacgacagcaatggcttcttaawtgggtttccctcttcaagatgtct

SEQ ID NO: 58057 - DNA, 50 bp, homo sapien
ccaagtgtaccataggccttcaatakctgagccaccattaatccaatacg

SEQ ID NO: 58058 - DNA, 50 bp, homo sapien
tagaaattaaataatagagacagaaycaagtttaagaatcttgtattaaa

SEQ ID NO: 58059 - DNA, 50 bp, homo sapien
tcattgcatgtcatttaggtcattgyatgtcattttaatgtatgtcattt

SEQ ID NO: 58060 - DNA, 50 bp, homo sapien
tattaattaatgatactcgcaatacracataatctttcagggttgtttag

SEQ ID NO: 58061 - DNA, 50 bp, homo sapien
ttcttttttttatcattaaattacastggaaggcttgatctttcttaaaa

SEQ ID NO: 58062 - DNA, 50 bp, homo sapien
aaaaaagtatattttaaaagggatamaatctaatgtttgtaagggattta

SEQ ID NO: 58063 - DNA, 50 bp, homo sapien
tcttcctatattgaccagctctaccyattgaattagagtcctatttaatt

SEQ ID NO: 58064 - DNA, 50 bp, homo sapien
ggcttcagtaagtgttgctttcatgrcacattttaaaatttatacatgta

SEQ ID NO: 58065 - DNA, 50 bp, homo sapien
ctagaataggcacccaagtgagaatytttaatcacatccaaagcatttag

SEQ ID NO: 58066 - DNA, 50 bp, homo sapien
aaggaatacttttctctgagctaaarcctattttgctcaataaagcagga

SEQ ID NO: 58067 - DNA, 50 bp, homo sapien
atgtttaagtaagatctctaactaargtgagctgcacttcaccaagtatc

SEQ ID NO: 58068 - DNA, 50 bp, homo sapien
cctcatgccttttacagtgagtttaraggagataacacatgaaacttcca

SEQ ID NO: 58069 - DNA, 50 bp, homo sapien
gctaggaggtagaggttagtattaayagctgcatggtgctggggggaaag

SEQ ID NO: 58070 - DNA, 50 bp, homo sapien
ctgttgaactcttttcttctctgtgrttccaagtgttttgattatataca

SEQ ID NO: 58071 - DNA, 50 bp, homo sapien
cagactttgttcaaatttgcccttckcaagtagccctcctctgatcaccc

SEQ ID NO: 58072 - DNA, 50 bp, homo sapien
cacccactttctaatgtaaatgtcaraaatactatcacatcctttcaatt

SEQ ID NO: 58073 - DNA, 50 bp, homo sapien
tgggatgaatcaaggatgtttgaaasgatggattgctggttcttggtaac

SEQ ID NO: 58074 - DNA, 50 bp, homo sapien
tttaaaatatcacacattatgtgatyaaagtatgactgaaagctcaaaca

SEQ ID NO: 58075 - DNA, 50 bp, homo sapien
taagaaaaatatgagaggaaatcaasgacgagtctcaggtttctagttta

SEQ ID NO: 58076 - DNA, 50 bp, homo sapien
agagttaatcatagctcatatcaaaycaagtcatttattctatacatgtt

SEQ ID NO: 58077 - DNA, 50 bp, homo sapien
aaattaaagttccaatgacaggaaartgaataactaaattatgatagcat

SEQ ID NO: 58078 - DNA, 50 bp, homo sapien
acttcccaatgattaagataccaaaygcttgaggactagtagcatttgta

SEQ ID NO: 58079 - DNA, 50 bp, homo sapien
tattataatttcctttaatcagcaayaatgactaaaacatgtgatctaaa

SEQ ID NO: 58080 - DNA, 50 bp, homo sapien
aaaaattttttaactgccagttcaakatattacagctgacatctgttttt

SEQ ID NO: 58081 - DNA, 50 bp, homo sapien
ggtgacatttgcgctgttaatactamacgcattttaattttaatttaaag

SEQ ID NO: 58082 - DNA, 50 bp, homo sapien
gtctaaggcttatgacatggtctggmatgagtctaagtattcatatcctg

SEQ ID NO: 58083 - DNA, 50 bp, homo sapien
tgtgatgctcaataatatatgtcagratatgaatacttagactcatgcca

SEQ ID NO: 58084 - DNA, 50 bp, homo sapien
agagcagttagtgttattccatcaayacataagggagttgaggtctagaa

SEQ ID NO: 58085 - DNA, 50 bp, homo sapien
tgaaagaataaaggtaagaagccccractggataacatatgctttctgct

SEQ ID NO: 58086 - DNA, 50 bp, homo sapien
ctgacattccttgaccatcacagaayctaagtaaatggatagaattcggg

SEQ ID NO: 58087 - DNA, 50 bp, homo sapien
tttagttaatttacttttcaaaagcytacattatataaaaagtaaaataa

SEQ ID NO: 58088 - DNA, 50 bp, homo sapien
tacaggaaaagaaaatttgggcatarctttagaaactttagaagttcaga

SEQ ID NO: 58089 - DNA, 50 bp, homo sapien
actttgctcaccaatacaacgggaakgataacagtcataccttattgagt

SEQ ID NO: 58090 - DNA, 50 bp, homo sapien
aaacttcttgccttcttggagagcartcttattttcataacttcaagttc

SEQ ID NO: 58091 - DNA, 50 bp, homo sapien
tacaaacctactcataaggttactawgaggattgagttaataaatgaaac

SEQ ID NO: 58092 - DNA, 50 bp, homo sapien
aaaatatatgatataagttcttcttyaaaaaacatataactggccgggcg

SEQ ID NO: 58093 - DNA, 50 bp, homo sapien
atgtgtagcactatatgaatgtaagytggatgtactattttatttcatat

SEQ ID NO: 58094 - DNA, 50 bp, homo sapien
aacaaaaatgtatgactcttatttaycattttgcaattagttgatcataa

SEQ ID NO: 58095 - DNA, 50 bp, homo sapien
agtttaccacacggtaaaatgggacyaagaatgctcccagcataaaacat

SEQ ID NO: 58096 - DNA, 50 bp, homo sapien
cagaggtggggcacactccaggaatyaagtctttaccatgttaccagggc

SEQ ID NO: 58097 - DNA, 50 bp, homo sapien
acagatgcaaaggcatgaggtaccarataacataccaagttcaggaagct

SEQ ID NO: 58098 - DNA, 50 bp, homo sapien
aaatcaaagtagataaaaatgtttcyatttcaacaatcagttgatattgt

SEQ ID NO: 58099 - DNA, 50 bp, homo sapien
aatggtaaccgaaactcaaagttaayggagccaaatttaataaaggtata

SEQ ID NO: 58100 - DNA, 50 bp, homo sapien
tagaaagagaattctgatgtcaaccmggagaatgagttggaaaggtggtg

SEQ ID NO: 58101 - DNA, 50 bp, homo sapien
attagtcaaagctgcctgttctggcrcagatatgcagaatcaggtatttc

SEQ ID NO: 58102 - DNA, 50 bp, homo sapien
tctcaaggccaataataataaacaaygaccagcataaagccaaatttgat

SEQ ID NO: 58103 - DNA, 50 bp, homo sapien
acattagagaataagctagtattcartaaaaacagactaaggtaaaaata

SEQ ID NO: 58104 - DNA, 50 bp, homo sapien
aacaaaatctacaagagggtcagcamtacaattaaatagaagaatctaaa

SEQ ID NO: 58105 - DNA, 50 bp, homo sapien
gacagtatttgattatgtacggccaygttttatataaagaacactttgtt

SEQ ID NO: 58106 - DNA, 50 bp, homo sapien
tggttctctttccactgctcaatccrtacagtgagtaaaattttacgtct

SEQ ID NO: 58107 - DNA, 50 bp, homo sapien
ccagtaaggactagagtgaagctaaratataatggaagggagacaaaaca

SEQ ID NO: 58108 - DNA, 50 bp, homo sapien
gatgctggctacagaatatggtcatmaaattatttctaaagatgatacag

SEQ ID NO: 58109 - DNA, 50 bp, homo sapien
agtgctgtcagagcacctaaatgacrgagaacaggaatttcctccagctt

SEQ ID NO: 58110 - DNA, 50 bp, homo sapien
agccctgccaaaaatgagcacaatamcaggataagtctcttgactcttct

SEQ ID NO: 58111 - DNA, 50 bp, homo sapien
atatgggtgctttagttgatactaasatagggcaaacaatttccattcta

SEQ ID NO: 58112 - DNA, 50 bp, homo sapien
gtaatgagaacctcaatcagggtacyggtgaaaggattagaaatgagtag

SEQ ID NO: 58113 - DNA, 50 bp, homo sapien
cacttctgggatcgatacgggtttayacaaaataagtagtctatagaatt

SEQ ID NO: 58114 - DNA, 50 bp, homo sapien
ctgctgtaacaaaatagcatagaccrgatagcttaaacaatacatatttg

SEQ ID NO: 58115 - DNA, 50 bp, homo sapien
aaagtttcacagcttttgagagataygctcaatttcatttttttcccttt

SEQ ID NO: 58116 - DNA, 50 bp, homo sapien
aaaaatttttaaaaaccaagcttcgraaagggtaaatgaatatttcttta

SEQ ID NO: 58117 - DNA, 50 bp, homo sapien
cattttcttagtgcctacatgatacyatctcctctctataactctgagct

SEQ ID NO: 58118 - DNA, 50 bp, homo sapien
tcatttgattgttcttatggaaaaaraaaaccacaacaacaacactacta

SEQ ID NO: 58119 - DNA, 50 bp, homo sapien
cttgatgttttagttagtcttatgaygagcacattttgagtttttttctt

SEQ ID NO: 58120 - DNA, 50 bp, homo sapien
ggctcttagggtaatttaaattcagyctcttgcacaaagtagtagggttt

SEQ ID NO: 58121 - DNA, 50 bp, homo sapien
aaactcttatgcttatgtgatatgayaatatgatgaaaataagttaagta

SEQ ID NO: 58122 - DNA, 50 bp, homo sapien
taaagtactctttgtagcacagacargcgttcaattttgacttagaggaa

SEQ ID NO: 58123 - DNA, 50 bp, homo sapien
ttaattcttctcagaaatagtcctasagggcttcacaaaattaatctgaa

SEQ ID NO: 58124 - DNA, 50 bp, homo sapien
gcacctagaacagtaccagcacctastaggaactcaataaataaatagtt

SEQ ID NO: 58125 - DNA, 50 bp, homo sapien
gacacgcccagctgctatccacttcyaatcttaccaattccagaaaagat

SEQ ID NO: 58126 - DNA, 50 bp, homo sapien
ccaaccatgctatcaaatattgcaarccttcttgaccactttccaatccc

SEQ ID NO: 58127 - DNA, 50 bp, homo sapien
acactgagtgagattcaaagacaagragttaatttccaaggtagaggtgg

SEQ ID NO: 58128 - DNA, 50 bp, homo sapien
cttacagcacccaccaagtgctcaarttataccaagtattttctgctcca

SEQ ID NO: 58129 - DNA, 50 bp, homo sapien
tgtttgcatattgtggctctcaaaastatgtctcttggtgacttttttct

SEQ ID NO: 58130 - DNA, 50 bp, homo sapien
taaattcagtagagaaatccacaaasaggaacacattattttaaagataa

SEQ ID NO: 58131 - DNA, 50 bp, homo sapien
gtactgaacctaagcacttggcttgyaattgattgataattcagagtgcc

SEQ ID NO: 58132 - DNA, 50 bp, homo sapien
aaggaagcaatgactcttctatgatyaggaaatgacgtctctgaatcaca

SEQ ID NO: 58133 - DNA, 50 bp, homo sapien
gtatcataaagggcattgaataccaygataaaggctttatacttgacctc

SEQ ID NO: 58134 - DNA, 50 bp, homo sapien
tttctgtacctgatttctggataccrcacctgtttttctacacttcgtgt

SEQ ID NO: 58135 - DNA, 50 bp, homo sapien
gaaagggttatttcaaagcatgtaasctcaatacagcaatgactcaagtg

SEQ ID NO: 58136 - DNA, 50 bp, homo sapien
agttcttaagcagggaggaacaagaygaaagctgggttttaaatacaact

SEQ ID NO: 58137 - DNA, 50 bp, homo sapien
tttataggaaccaaactctgcatccrataggaataggtttgtttataagt

SEQ ID NO: 58138 - DNA, 50 bp, homo sapien
ttgtcttcccctcacacattctacartggctgttccaaactttctactct

SEQ ID NO: 58139 - DNA, 50 bp, homo sapien
cctcattggaatcctacattatttcratttgcacaccctaataattcagg

SEQ ID NO: 58140 - DNA, 50 bp, homo sapien
acagaacctagcccagtgcctgaagragaatttctgataaatggatgatt

SEQ ID NO: 58141 - DNA, 50 bp, homo sapien
aaaacaatgtaagttaaacgaaatasaaatgggcttctacagtatatttc

SEQ ID NO: 58142 - DNA, 50 bp, homo sapien
tgctctatttatagtattaaggatcrtttttgagtattacggaataatca

SEQ ID NO: 58143 - DNA, 50 bp, homo sapien
attcattttttatgaagcaagtctcrcaattcaaggtgaccatatctcct

SEQ ID NO: 58144 - DNA, 50 bp, homo sapien
aaaagaaatagttcatttgaaaatawgtacttgagcttgaattgttttgg

SEQ ID NO: 58145 - DNA, 50 bp, homo sapien
aaggacctttaataatgagtatgccytaaaattgtgtgtatttttttctt

SEQ ID NO: 58146 - DNA, 50 bp, homo sapien
catctaatagaatggcaacatttaakatttctgatgtaactaactgttga

SEQ ID NO: 58147 - DNA, 50 bp, homo sapien
tagagtcaattctaaggccacagggyattaatatgattccaaagtagatg

SEQ ID NO: 58148 - DNA, 50 bp, homo sapien
ctggtaaaggaagtgctagtgaacamagatagaatagtagcagcagcagt

SEQ ID NO: 58149 - DNA, 50 bp, homo sapien
gtcacaaaactgatgttcctaaccaytatgctactcaagtcttggttgtg

SEQ ID NO: 58150 - DNA, 50 bp, homo sapien
attctgcttatatgaacaatctaaamtagtcatgttcttagaatcaaaga

SEQ ID NO: 58151 - DNA, 50 bp, homo sapien
cagagatcacctggatttcctttaastcaagtagaaatgtaggtgaagca

SEQ ID NO: 58152 - DNA, 50 bp, homo sapien
taaaatcatatgatctgatatacgaygggctgaattcctaattctaacca

SEQ ID NO: 58153 - DNA, 50 bp, homo sapien
tggtcttttccagcttctatgggacrctcacattccttggttcattggcc

SEQ ID NO: 58154 - DNA, 50 bp, homo sapien
atttcgttgacttccacaaaattagkatcactgaggaggtagtaacattt

SEQ ID NO: 58155 - DNA, 50 bp, homo sapien
acattagtggactctgagaatgtgcyaccaaacatctagttaaaatcata

SEQ ID NO: 58156 - DNA, 50 bp, homo sapien
gattactatctacaggtaagtttgaraaatgtcttaacagcctagaatga

SEQ ID NO: 58157 - DNA, 50 bp, homo sapien
gttacacaaactagatggcctgtgamaagtaaaatttattctctcatagt

SEQ ID NO: 58158 - DNA, 50 bp, homo sapien
acgtgggtatcatcatttaatgagcrtcttagttatataaccactacttc

SEQ ID NO: 58159 - DNA, 50 bp, homo sapien
aaagtcttaaggtgtattagtgggaytcaggtattaaagtataggtctga

SEQ ID NO: 58160 - DNA, 50 bp, homo sapien
tttggagtgcatgtggtttgtttagraagcagtgggttctatgagtctaa

SEQ ID NO: 58161 - DNA, 50 bp, homo sapien
tgcttgatgtattattatgacattcrctcctctccacaatcctatcaagc

SEQ ID NO: 58162 - DNA, 50 bp, homo sapien
ctcattctactgtataaaaagtcaaygaactgaagagcaaatattaaagg

SEQ ID NO: 58163 - DNA, 50 bp, homo sapien
ataagcaccaatgaggtcacttcatragcttcatcagggcagtcagtaga

SEQ ID NO: 58164 - DNA, 50 bp, homo sapien
ttgaatcatcaatgaatgactaaatragtatggataaactatattattaa

SEQ ID NO: 58165 - DNA, 50 bp, homo sapien
tcgcaaaggactatggatagtgagayattttgttaggattgaaaagagca

SEQ ID NO: 58166 - DNA, 50 bp, homo sapien
agagatatgggtcttggttgataggrcaaaattaaggaaaagagagaaaa

SEQ ID NO: 58167 - DNA, 50 bp, homo sapien
aagcacgattgatttgacacttggaratactatttttggttttctctctt

SEQ ID NO: 58168 - DNA, 50 bp, homo sapien
agtcggtgtccctctcccatcgattscaacttttcccctccttccctctc

SEQ ID NO: 58169 - DNA, 50 bp, homo sapien
catcttgcttcttttgtttcctcaaygactaggcctgttctggattttta

SEQ ID NO: 58170 - DNA, 50 bp, homo sapien
taggtaggagagggatgagtttacayaaaagtgacataagactgggtgat

SEQ ID NO: 58171 - DNA, 50 bp, homo sapien
ttgtagatattgacaagcagattttwaaatttatgtggaattgcaaagga

SEQ ID NO: 58172 - DNA, 50 bp, homo sapien
attgggtagagctaatctggtgaaasactgtaggcattatgaattaaaac

SEQ ID NO: 58173 - DNA, 50 bp, homo sapien
tggagactggttgtagccaggcaaasggtgtgccaagaaggggattgcat

SEQ ID NO: 58174 - DNA, 50 bp, homo sapien
caattgcaatttcaggagacgcagawcaaacttactaataaactcctttt

SEQ ID NO: 58175 - DNA, 50 bp, homo sapien
tgcaaatgatttcccagttcacaaasggattttagagacatttcgtttga

SEQ ID NO: 58176 - DNA, 50 bp, homo sapien
tatttgtaaaaggagtggctctatayggtcagaagcattttcacccagac

SEQ ID NO: 58177 - DNA, 50 bp, homo sapien
actgtaaatgtcttttggtcaagagractaacaaatataaaggaacttga

SEQ ID NO: 58178 - DNA, 50 bp, homo sapien
aaaggtacacagccaaaattcttgayggtacagatgacaatattttgtaa

SEQ ID NO: 58179 - DNA, 50 bp, homo sapien
atctgaattctagatgattatattcrattatttcatagagtattctcttt

SEQ ID NO: 58180 - DNA, 50 bp, homo sapien
agatttgggcttgaatcttattctcyatggaatcccttggacaatgcttt

SEQ ID NO: 58181 - DNA, 50 bp, homo sapien
ctgaagtacagttcctgtccatcaayacttaccccttgcacttctgaagg

SEQ ID NO: 58182 - DNA, 50 bp, homo sapien
aactgtgtagtactaatagcccccayatttgagcactccaaatacgtgat

SEQ ID NO: 58183 - DNA, 50 bp, homo sapien
aattctagatgaaagggaaatgtacmctgaaatagtcttttgcgtggtgc

SEQ ID NO: 58184 - DNA, 50 bp, homo sapien
atacaaagcaacctgcagttccaaayaacaataaattccaagctggataa

SEQ ID NO: 58185 - DNA, 50 bp, homo sapien
tgaataatttgaaaaaggcttacagsagattgtgagcaggaatccgggct

SEQ ID NO: 58186 - DNA, 50 bp, homo sapien
ctggactcagccatatgctgtcaatkgtcaacactcttagtagctggggg

SEQ ID NO: 58187 - DNA, 50 bp, homo sapien
cttgttgctctgggatcccatcacckatttaattcaaggggctcatttcc

SEQ ID NO: 58188 - DNA, 50 bp, homo sapien
atatcaaatgccttacagatattgargttccatattctctttttccccat

SEQ ID NO: 58189 - DNA, 50 bp, homo sapien
gacaaaacagatactcagcatcttcktcgtctcctatcactcccctcagt

SEQ ID NO: 58190 - DNA, 50 bp, homo sapien
atggtgaatagttaactgttaatgamaacagacttccactcccttagaaa

SEQ ID NO: 58191 - DNA, 50 bp, homo sapien
tgtagttacttcaggcttcattacawcatagttcattcaccacagtaata

SEQ ID NO: 58192 - DNA, 50 bp, homo sapien
agcaaaatgtaaacaaatctcccaastcatttaaacctttttgtgtagac

SEQ ID NO: 58193 - DNA, 50 bp, homo sapien
tgtcttcagtgcttataccatggagkctaggtttccttcaagccattcat

SEQ ID NO: 58194 - DNA, 50 bp, homo sapien
cttccaagtccagtgcttgctgccayatacatagtgctgaattttgtgtt

SEQ ID NO: 58195 - DNA, 50 bp, homo sapien
tttattactgaactgggaagaatgaygccttctatatttgtatagcacca

SEQ ID NO: 58196 - DNA, 50 bp, homo sapien
ctccccaccgtcctggtgaatgtccratattagttacagagaaccacagg

SEQ ID NO: 58197 - DNA, 50 bp, homo sapien
gcctacagctgcagaaaagagaagcsatcttatgcagccagtttaaccct

SEQ ID NO: 58198 - DNA, 50 bp, homo sapien
ttgggagtccagaagaccttcacaarccataattatagaaattatctggg

SEQ ID NO: 58199 - DNA, 50 bp, homo sapien
taatcctaccatagggattccaaggyaaatttgaaagttttgtgacattt

SEQ ID NO: 58200 - DNA, 50 bp, homo sapien
attaaaatgcctcaaaagttccaagrgagtgtaaaagcttttttttttgg

SEQ ID NO: 58201 - DNA, 50 bp, homo sapien
gcagaaaagcttccaggggcatcagrtaccagtaaaagaccaaacaattt

SEQ ID NO: 58202 - DNA, 50 bp, homo sapien
aaagaccaaacaatttcctggcagartcaggaagaaaagttcacaagtaa

SEQ ID NO: 58203 - DNA, 50 bp, homo sapien
gaaattacagtttggggctcaataakgtaatggttcaaaagattttctgt

SEQ ID NO: 58204 - DNA, 50 bp, homo sapien
gtctggcaagcctgagttcttatccrcacttattcacttagttctgcaat

SEQ ID NO: 58205 - DNA, 50 bp, homo sapien
acttgcattacttgcatctgaaaaawatttaatgaatttataatgagcaa

SEQ ID NO: 58206 - DNA, 50 bp, homo sapien
cttgttcttttataatatagcaccaygaatgggacccacattgggtcgta

SEQ ID NO: 58207 - DNA, 50 bp, homo sapien
cataaataatatggcataataataasaccaaacacatacatgctaagtga

SEQ ID NO: 58208 - DNA, 50 bp, homo sapien
tttggtatcatggaataaggaatccrgtaacttgaaggcagatagaaatt

SEQ ID NO: 58209 - DNA, 50 bp, homo sapien
gctgtgagttacacaccacaaagtaygaggtcccacattgatgaatcggg

SEQ ID NO: 58210 - DNA, 50 bp, homo sapien
tgacaagttaatgtttaattttttaygatagagcaaaggtactttaaatt

SEQ ID NO: 58211 - DNA, 50 bp, homo sapien
tctgaactttaaactcatataaccarctgcttcctagacttctctgccta

SEQ ID NO: 58212 - DNA, 50 bp, homo sapien
ttatgtcctgtaattctaattcttgyagtacccaatttattattctctga

SEQ ID NO: 58213 - DNA, 50 bp, homo sapien
ttaaatctctgccagtgatgtgtcaygtacttcccatagcctattatcac

SEQ ID NO: 58214 - DNA, 50 bp, homo sapien
gaggagaacgtgaaaagcaattggcsagaatctaagccttgagaataatg

SEQ ID NO: 58215 - DNA, 50 bp, homo sapien
  misc_feature (5)..(5): n is a, c, g, or t
aatanaactggtcagacaagagataraaagataataaaaagtgattgttg

SEQ ID NO: 58216 - DNA, 50 bp, homo sapien
ttggcctatgcaaccatagcaactcrataatacctcaagtggacatcata

SEQ ID NO: 58217 - DNA, 50 bp, homo sapien
tgatcccattatggcaaataaagtakgctaagctcctgttatattgacaa

SEQ ID NO: 58218 - DNA, 50 bp, homo sapien
gccaccagaatccaagcaaaatcctsacaatccaggcaccaaagccattg

SEQ ID NO: 58219 - DNA, 50 bp, homo sapien
gagtttgtgaaaaactggatctctaygtcatcctttgtccctttcacaca

SEQ ID NO: 58220 - DNA, 50 bp, homo sapien
aatttcatgacaaacaattcactttwaaaatatagcaattagaggactaa

SEQ ID NO: 58221 - DNA, 50 bp, homo sapien
attaaaccttgaacttgtgattaaartataggtttataactcattggaaa

SEQ ID NO: 58222 - DNA, 50 bp, homo sapien
tcctgcttcctattatatgtcttaawcttttgatatgaggccagcatatg

SEQ ID NO: 58223 - DNA, 50 bp, homo sapien
tgttaaacaaatttctaaaaactgayagagtttgtgttaaaacatattac

SEQ ID NO: 58224 - DNA, 50 bp, homo sapien
gaaagaacattcaaagctttcctaaycatctcaggtagatctataaatac

SEQ ID NO: 58225 - DNA, 50 bp, homo sapien
actggagaaaactgtccaaaccaacmattttagtcttctgggaatggaca

SEQ ID NO: 58226 - DNA, 50 bp, homo sapien
agcacaaattggataattttaaatcwcagacatgtaaaatcagtacagat

SEQ ID NO: 58227 - DNA, 50 bp, homo sapien
gtcttctcaaggctttctcactttaygataatgatcagtaccttgcatgg

SEQ ID NO: 58228 - DNA, 50 bp, homo sapien
ttctaggggtacagttaaggtctcayggatgttcaactaactaaatgaga

SEQ ID NO: 58229 - DNA, 50 bp, homo sapien
tgtgttatttcatgtgacctcataayaaccaagaggcacatgcaactaag

SEQ ID NO: 58230 - DNA, 50 bp, homo sapien
tttgatactgataacttttacagtaygcagataggaaatgtacaatagct

SEQ ID NO: 58231 - DNA, 50 bp, homo sapien
cgtgggttacggaaactgttagtaargacaaaatggaggtagttggcata

SEQ ID NO: 58232 - DNA, 50 bp, homo sapien
ggtaaagaaaattctttaattcacakctgattatatcataaaaattcttg

SEQ ID NO: 58233 - DNA, 50 bp, homo sapien
gcctgcaaagctacttacagagataygttttactggtagcagatcaatat

SEQ ID NO: 58234 - DNA, 50 bp, homo sapien
aaatgtttaagaaaaaataaaggagkagaaatctatagatcaaaacaatc

SEQ ID NO: 58235 - DNA, 50 bp, homo sapien
aaggcaacatacaatcctgttactaycactcccaggtctctagaaaacag

SEQ ID NO: 58236 - DNA, 50 bp, homo sapien
gactctctttgcacttttagcttaasgtctaggctaggaaatgcctcaga

SEQ ID NO: 58237 - DNA, 50 bp, homo sapien
atacacatctatataaaatacatttraaaacacgacattatgcacaaaaa

SEQ ID NO: 58238 - DNA, 50 bp, homo sapien
tttcctgcatgactcctgacaaatcwaagattaccttgagttgtaacctt

SEQ ID NO: 58239 - DNA, 50 bp, homo sapien
attgccacaaatttcttattgactastagctagaaatatgtgatgaagca

SEQ ID NO: 58240 - DNA, 50 bp, homo sapien
gacatatcaagcagagatgtagaaamctatctgcaaattgtttgatgctc

SEQ ID NO: 58241 - DNA, 50 bp, homo sapien
cacatgtctggtgtctcgactgagargacaaaaacagctggagtctggaa

SEQ ID NO: 58242 - DNA, 50 bp, homo sapien
gaaccaacaactctggataaataccraacaatttccctgtgcgcggtcat

SEQ ID NO: 58243 - DNA, 50 bp, homo sapien
gagagtcctttcaaattcctatctcracactgatgattcatagtgtttgt

SEQ ID NO: 58244 - DNA, 50 bp, homo sapien
ccttttagttattctgcaaagtaatratatcttggaggaatgaattggaa

SEQ ID NO: 58245 - DNA, 50 bp, homo sapien
aaaacaaagtgagaatgattttgtaygcatgctcaattttataaaacaca

SEQ ID NO: 58246 - DNA, 50 bp, homo sapien
aactttgagccactatgaaaccatamatctgatacatctactattctaaa

SEQ ID NO: 58247 - DNA, 50 bp, homo sapien
accatttgtctataattttcttcaawctgaacagcgaatcttgatagcaa

SEQ ID NO: 58248 - DNA, 50 bp, homo sapien
ttaattccttccacaactggctgtargctgaggaaaaaaataaaaccagt

SEQ ID NO: 58249 - DNA, 50 bp, homo sapien
atgacaatttgagccttatgctatgsgagccactatgaagatcctaagag

SEQ ID NO: 58250 - DNA, 50 bp, homo sapien
atgtaaccagcctttcacgatcaacrattggtatttttccaaaccatgca

SEQ ID NO: 58251 - DNA, 50 bp, homo sapien
aataactattagggcaattggtaaayaatgtatcaaaaaatgaaataaat

SEQ ID NO: 58252 - DNA, 50 bp, homo sapien
tatacacatggtagagtataaccaamattcttgctgtagacttatgaatt

SEQ ID NO: 58253 - DNA, 50 bp, homo sapien
tgtagttctactactagtagctaagsacttcaattcttaatgttagttta

SEQ ID NO: 58254 - DNA, 50 bp, homo sapien
ctttaggcccctgttatacacagagragacaagatatttgttgtttactc

SEQ ID NO: 58255 - DNA, 50 bp, homo sapien
tttaaaacacgcataaaaattcatcrcactgaaaaaaggaagcaaacagc

SEQ ID NO: 58256 - DNA, 50 bp, homo sapien
ctatctcttctgtttcttgttagtgycatcccgtaagctatcaaggcata

SEQ ID NO: 58257 - DNA, 50 bp, homo sapien
atgtcagaaattctatgcctgactayggtgtagaattcaattagaataga

SEQ ID NO: 58258 - DNA, 50 bp, homo sapien
agtaaaatattaccacagatattaawtaaaagcttctattaaaaaggctg

SEQ ID NO: 58259 - DNA, 50 bp, homo sapien
tttttgctcacttcatcatcttttcrctgtcactcactttccctttacct

SEQ ID NO: 58260 - DNA, 50 bp, homo sapien
gggcaggctggggaccgtccttccawtgagcgttctcacaccacttcgtg

SEQ ID NO: 58261 - DNA, 50 bp, homo sapien
gggctgacagcagagactatgtccaygtcggtattcctggtattgagttc

SEQ ID NO: 58262 - DNA, 50 bp, homo sapien
caacaatgtgctaggagctgttgaartacaggcactgcatatcaaagaaa

SEQ ID NO: 58263 - DNA, 50 bp, homo sapien
gctgtcaaaatcttttatgaaaatcraaacctactatatccacttttctt

SEQ ID NO: 58264 - DNA, 50 bp, homo sapien
aaatttctgtcaaacctgtaattcartctaaatatgctctctatcacaat

SEQ ID NO: 58265 - DNA, 50 bp, homo sapien
accatgccgttacatggattttataygcacattccaagttaaaccacaga

SEQ ID NO: 58266 - DNA, 50 bp, homo sapien
attttctgtttgaaatgaagagaaargtaattgacagataaacagatagt

SEQ ID NO: 58267 - DNA, 50 bp, homo sapien
atttgaggatgttaaagagaaatgcmcaaacattataaagccgaagtatt

SEQ ID NO: 58268 - DNA, 50 bp, homo sapien
attcagcaccagaattcagcttttakgtattgtttctcacatccccatac

SEQ ID NO: 58269 - DNA, 50 bp, homo sapien
gtagaactgacactattccagttccrgcctaacccaactgccatattgcg

SEQ ID NO: 58270 - DNA, 50 bp, homo sapien
tgatagagagaacactggactgaaaytcttaagtatacttctgctaattc

SEQ ID NO: 58271 - DNA, 50 bp, homo sapien
acgaaaaaaacactgagattgagaawttatttcagagagtgtgataatag

SEQ ID NO: 58272 - DNA, 50 bp, homo sapien
attttttttgcaactaagaagataayggtgccatgaggaactatatttta

SEQ ID NO: 58273 - DNA, 50 bp, homo sapien
atgtggactatgtggatgggtttaayataatcagaagcaccatcagaagc

SEQ ID NO: 58274 - DNA, 50 bp, homo sapien
gaaggagcagggacctaaggaagtayagcaagattagaaagtggggatga

SEQ ID NO: 58275 - DNA, 50 bp, homo sapien
ttttatttcatctgcccaagtcctakcaatggtgaagttactctctgatt

SEQ ID NO: 58276 - DNA, 50 bp, homo sapien
ggcttttatctagatgctctggttargactcaacttccaatttcattcag

SEQ ID NO: 58277 - DNA, 50 bp, homo sapien
tccttaggtccctgctccttcctaakaatgactttctcttcaaactaggc

SEQ ID NO: 58278 - DNA, 50 bp, homo sapien
ttttaaaaagtgttctaacaatctayctgtgttggcaagagaaaaaggga

SEQ ID NO: 58279 - DNA, 50 bp, homo sapien
aaaatacccaagaaaagtgtcagaayatagctttgaatcttgagttttct

SEQ ID NO: 58280 - DNA, 50 bp, homo sapien
ccatatggtacctttgtgtagattakaaaaagatgccctgtccactgggt

SEQ ID NO: 58281 - DNA, 50 bp, homo sapien
tataatttcttttagaccttcctccrcagcaattagttctagactctgcc

SEQ ID NO: 58282 - DNA, 50 bp, homo sapien
gcagaggccagagcaatgagatttasagaaactgtgcttagtaagaagga

SEQ ID NO: 58283 - DNA, 50 bp, homo sapien
tctcatgtgggaggagtcactctaaytgagccttcttcagatcttcccac

SEQ ID NO: 58284 - DNA, 50 bp, homo sapien
catctatcccatccctacatgaagayattttagactcttattttatagta

SEQ ID NO: 58285 - DNA, 50 bp, homo sapien
atcattatactttttcctttccaaartattatgcacatattatagtaaag

SEQ ID NO: 58286 - DNA, 50 bp, homo sapien
tattatagagaaacaaattgagttgyaaagaagttatcttcctttgaatt

SEQ ID NO: 58287 - DNA, 50 bp, homo sapien
agcatgctgaagtcactcatattctmaaaatcaccctttcatctagacac

SEQ ID NO: 58288 - DNA, 50 bp, homo sapien
aacttctggtattgaaaatttcacakattgacaactatagttttataact

SEQ ID NO: 58289 - DNA, 50 bp, homo sapien
tctttgtcattgttacaaaagaacamatcctatggctaaagatcttgaaa

SEQ ID NO: 58290 - DNA, 50 bp, homo sapien
cctgaatataggagtgcagacttggraatacaaaaccatttcatgaacct

SEQ ID NO: 58291 - DNA, 50 bp, homo sapien
aataaaatctgttataaacataagarcacaatgcaaagatcaatcagttc

SEQ ID NO: 58292 - DNA, 50 bp, homo sapien
gataaaactacttcttagactagacsattgatgcaacattcaacttgcta

SEQ ID NO: 58293 - DNA, 50 bp, homo sapien
tgccatatttattgttgattgagaamacattatgtcccatttaagccaat

SEQ ID NO: 58294 - DNA, 50 bp, homo sapien
aaaagagtgatagataatgacatcayagagaaaagaggagggtgacctaa

SEQ ID NO: 58295 - DNA, 50 bp, homo sapien
aaattctgcaagtttgcaatggtaawgaagggcatttctttcagacacaa

SEQ ID NO: 58296 - DNA, 50 bp, homo sapien
gttaccatgtcacctattaaccttcrataacttgatatcgtcagaaccga

SEQ ID NO: 58297 - DNA, 50 bp, homo sapien
atctagaatgattttcttttcttaakgtatccatggtagctcctagtaat

SEQ ID NO: 58298 - DNA, 50 bp, homo sapien
ctagagcttgaggggcacggaggtawctcttcgatagagtggtcaaaaaa

SEQ ID NO: 58299 - DNA, 50 bp, homo sapien
ataactgaataacatatgacttagawgcaacagcttgttggccaactata

SEQ ID NO: 58300 - DNA, 50 bp, homo sapien
gggatgaggtgatcttcctgcctcaragtttcttataccatgaatccaat

SEQ ID NO: 58301 - DNA, 50 bp, homo sapien
caaattgacggaaaaaaaatgatgaygggcacagtctcagagttatcttg

SEQ ID NO: 58302 - DNA, 50 bp, homo sapien
taatgtaaatgaaagcatctacacamccttagcaaatataagtaggtgtg

SEQ ID NO: 58303 - DNA, 50 bp, homo sapien
attttaatccctgttttcatgactgsaatgactgctcctgggagttacta

SEQ ID NO: 58304 - DNA, 50 bp, homo sapien
tcatcatgaacaaatacactaacacyatttgagtcattagtatccagtgt

SEQ ID NO: 58305 - DNA, 50 bp, homo sapien
caataataccccaataatttaaagcygatacacttaagacacatgaaaca

SEQ ID NO: 58306 - DNA, 50 bp, homo sapien
aggccatgagggtatcatttttctaygactgattaaatgcaaccctcata

SEQ ID NO: 58307 - DNA, 50 bp, homo sapien
tcccagaaggctgaatatgagaacaytatgcgtcctactctataacagag

SEQ ID NO: 58308 - DNA, 50 bp, homo sapien
tgtttatcacttcattgttacattgwaagaattttctccatgttgctttt

SEQ ID NO: 58309 - DNA, 50 bp, homo sapien
ggtatttctttaatactgaattttaygtttacaggtttactcttttcaaa

SEQ ID NO: 58310 - DNA, 50 bp, homo sapien
tattttaggaagatttgttactaagratggtaagataaagagattggaga

SEQ ID NO: 58311 - DNA, 50 bp, homo sapien
aacagataataatgatatcagtttaycccacatctgtttgtcactctctt

SEQ ID NO: 58312 - DNA, 50 bp, homo sapien
aataatttggactgagatagtctaayaacaacattgagaccatgttatgt

SEQ ID NO: 58313 - DNA, 50 bp, homo sapien
agtaacagatttctctacaggacaamagagtgtgaggatatggaagccag

SEQ ID NO: 58314 - DNA, 50 bp, homo sapien
tttctgcctgttcattataccaaccrattagttttaagacaggacttttt

SEQ ID NO: 58315 - DNA, 50 bp, homo sapien
tatgtaaagaaaatgtctattcttcrgaaattaacacggagatatctaga

SEQ ID NO: 58316 - DNA, 50 bp, homo sapien
attgttttatgcttcttttcagaaayactacttgctgctgctaggtcaga

SEQ ID NO: 58317 - DNA, 50 bp, homo sapien
ggatggatgaacagattgagtagacrcagtcattctttggattcaacaga

SEQ ID NO: 58318 - DNA, 50 bp, homo sapien
agaatggaggagtaacaggaagtcasaagaacctagtcactacaagttga

SEQ ID NO: 58319 - DNA, 50 bp, homo sapien
ccaaaattctaatatataatggctgraaagagaaagttgagcatgcaaaa

SEQ ID NO: 58320 - DNA, 50 bp, homo sapien
cctatgtttctgatattgggccaagycttagggaaatacataagtttatg

SEQ ID NO: 58321 - DNA, 50 bp, homo sapien
gtttacccactaattgctctcagtastacctcccgactttacttttacca

SEQ ID NO: 58322 - DNA, 50 bp, homo sapien
atgttggtctacccctcttactgcaycttcagtctctatgagagattctc

SEQ ID NO: 58323 - DNA, 50 bp, homo sapien
atatttattttatgaaatccataaargcacaaaaaataaactaagcaata

SEQ ID NO: 58324 - DNA, 50 bp, homo sapien
aatgcattttattctcaagtaaaaartcatgcaagttttgcagtgatctt

SEQ ID NO: 58325 - DNA, 50 bp, homo sapien
aggttaatgagaaattgatagtaatmaccaaaaatataccaagaggattt

SEQ ID NO: 58326 - DNA, 50 bp, homo sapien
ctttttagataccttttaatctgcaytgaagtatttcaaatttaccaagt

SEQ ID NO: 58327 - DNA, 50 bp, homo sapien
cccatcctgtggagctcaggccatasaggggatggaggaactttgatttc

SEQ ID NO: 58328 - DNA, 50 bp, homo sapien
ggtgtgggtgctttatgattgaataratacagagccactccccctaatat

SEQ ID NO: 58329 - DNA, 50 bp, homo sapien
aggaaaaggagagttgttgataaaarggcataatatttcagacaggtgaa

SEQ ID NO: 58330 - DNA, 50 bp, homo sapien
taagaatgcataaaatgtaagataaygtttactgagaaaagaacaacaat

SEQ ID NO: 58331 - DNA, 50 bp, homo sapien
aggtgctcaatactgagctaagaacygtgagagcgcgtaaagaggggact

SEQ ID NO: 58332 - DNA, 50 bp, homo sapien
tttttgtagtataagtttcaagaackgttattgctggcgtaagagtgtat

SEQ ID NO: 58333 - DNA, 50 bp, homo sapien
acaaaaacgttatatgtgggaatacwaaagactgaaatatttgcaatggt

SEQ ID NO: 58334 - DNA, 50 bp, homo sapien
aaataaaaggtaatgatagtgctaaytgcaaagtataaatattaaaaatc

SEQ ID NO: 58335 - DNA, 50 bp, homo sapien
aaaattttttaatgaaatgataaaamcctataagaaaatagtaatggtta

SEQ ID NO: 58336 - DNA, 50 bp, homo sapien
aagatgaatagactggaaaaaaatayatactgtacctgatagttaacaac

SEQ ID NO: 58337 - DNA, 50 bp, homo sapien
acagtgaaacccagctactacatcayggtccttgggtaagcctctgagaa

SEQ ID NO: 58338 - DNA, 50 bp, homo sapien
tctgactccaaagtttgtacttttarctattgtgctataattattaatga

SEQ ID NO: 58339 - DNA, 50 bp, homo sapien
cactttccagctgtcattactatacrgaatcagctcaatcttatcatctg

SEQ ID NO: 58340 - DNA, 50 bp, homo sapien
atagtcttcaatgttgtaatcataasgcagtaaataaaatttaatgtcaa

SEQ ID NO: 58341 - DNA, 50 bp, homo sapien
cattgtgtgttacttgtttttttgcwcttgatgcttttaggaccttttct

SEQ ID NO: 58342 - DNA, 50 bp, homo sapien
aatgtttgcatgagaactgttacaarataatatagatacacacatataca

SEQ ID NO: 58343 - DNA, 50 bp, homo sapien
agaaggagagtaggaggagataggamcaattttcagtggattccaagttt

SEQ ID NO: 58344 - DNA, 50 bp, homo sapien
tatttataggagataactgaaagggwattgattcactggatagtaaggaa

SEQ ID NO: 58345 - DNA, 50 bp, homo sapien
gtgtcagcacggtccattccttctamggtctatgagggagaatccatccc

SEQ ID NO: 58346 - DNA, 50 bp, homo sapien
agtggaatatacaacagaaagaaagsataagcttatctgagaaggataaa

SEQ ID NO: 58347 - DNA, 50 bp, homo sapien
cagataggaaagatataagtgaacaygtgagtttaatcttggggtgattt

SEQ ID NO: 58348 - DNA, 50 bp, homo sapien
agtccaaactagtggagagataatayagctgaaaatattgagagaaagta

SEQ ID NO: 58349 - DNA, 50 bp, homo sapien
gaagagacgtttacaatcaaatgtayaaattcctgaatatccctttttgt

SEQ ID NO: 58350 - DNA, 50 bp, homo sapien
aggcatgaaagattacagatttcccyaggtaagcattgatgggagcaggc

SEQ ID NO: 58351 - DNA, 50 bp, homo sapien
aaattaaaaacacaatactatttacrttaacaccaaacaattatatactt

SEQ ID NO: 58352 - DNA, 50 bp, homo sapien
accttacatttacatggacaagcaamttcagattcttcctagtaacaagg

SEQ ID NO: 58353 - DNA, 50 bp, homo sapien
taagacatggcaactgtctccaataratcaaaattgtagttggagaaatt

SEQ ID NO: 58354 - DNA, 50 bp, homo sapien
taattctaataaaagaggcagagtayaagttttgagttgagaaagaataa

SEQ ID NO: 58355 - DNA, 50 bp, homo sapien
acagtggtcaagtgtgctaaacacarcatattacaaacatcaagacaaaa

SEQ ID NO: 58356 - DNA, 50 bp, homo sapien
aaaatatccaactaaggaccatggcratcgtcaggccactagaaaaaacc

SEQ ID NO: 58357 - DNA, 50 bp, homo sapien
ataaaaggattattctgatatttgayaatttgaagaggagtgatacctac

SEQ ID NO: 58358 - DNA, 50 bp, homo sapien
tccactcttctagtcttcttgagaamatgactctttcttttaaaacctca

SEQ ID NO: 58359 - DNA, 50 bp, homo sapien
tagaacaaccatgatttatcctggargtgaaaatagatttatccttcccc

SEQ ID NO: 58360 - DNA, 50 bp, homo sapien
aataacaaaaatctcatctaagacawgacggtaataccatcttcacaaag

SEQ ID NO: 58361 - DNA, 50 bp, homo sapien
gataagtaataggtctaggatcacasaagtaggatggaatatagttggag

SEQ ID NO: 58362 - DNA, 50 bp, homo sapien
atttctgtctagttttcatggggagyccttaagtcattggcaaacaattc

SEQ ID NO: 58363 - DNA, 50 bp, homo sapien
agaataatgtttgaccaaatatatasgcaccatgatctagccagttgacc

SEQ ID NO: 58364 - DNA, 50 bp, homo sapien
atgaattattttttagaccttagaakgtgtttatgactattttcttggga

SEQ ID NO: 58365 - DNA, 50 bp, homo sapien
tttcaaatctatatttgatacttgayttttatattcaatggattcaatgg

SEQ ID NO: 58366 - DNA, 50 bp, homo sapien
taatagaatgtgatgcaagtaaaaamatgtattttcaacatttcaaatat

SEQ ID NO: 58367 - DNA, 50 bp, homo sapien
gccctctcttagaagatctaaatgargaaaatgatttgcctctgcaaaga

SEQ ID NO: 58368 - DNA, 50 bp, homo sapien
aggaaatagagacatggataataaaytgcgcttttcagaggttaggctat

SEQ ID NO: 58369 - DNA, 50 bp, homo sapien
aggctttaggcagtaattgtaagagracctataattttaagtagaggttt

SEQ ID NO: 58370 - DNA, 50 bp, homo sapien
agttctaactctaatgactactcaaygacatagtgtagcttgcaatcaga

SEQ ID NO: 58371 - DNA, 50 bp, homo sapien
caaatacatgagattatttggattgycaaacttatttaagagaagtatct

SEQ ID NO: 58372 - DNA, 50 bp, homo sapien
tattacttccaatcagacagcttatyttcagctcagttaagtttaaaatt

SEQ ID NO: 58373 - DNA, 50 bp, homo sapien
aaagaatttgtgagcggcaggtagcrcagtacataagggtagagttatag

SEQ ID NO: 58374 - DNA, 50 bp, homo sapien
tggaaccagttagaagaaggaaaaaygcatctaggtatagagtgcaagct

SEQ ID NO: 58375 - DNA, 50 bp, homo sapien
tgataaaactggtgaagtaggtatayacattttaaagagggaaaaatctt

SEQ ID NO: 58376 - DNA, 50 bp, homo sapien
gcatatattagatacctaaattacaygaaccaggagatcttgaggtgact

SEQ ID NO: 58377 - DNA, 50 bp, homo sapien
aaaatactgccgaagattctcctacyacgtgaagcattccagggtactgt

SEQ ID NO: 58378 - DNA, 50 bp, homo sapien
aagaggagcgagagttatggttctcratgtggagcaaacttctattggtg

SEQ ID NO: 58379 - DNA, 50 bp, homo sapien
ctgatctatgctgaagaaatggatgycatatttaactccgagctctacag

SEQ ID NO: 58380 - DNA, 50 bp, homo sapien
tagtttcccaatgagacatgataggkatattaaacttcttgatacaactt

SEQ ID NO: 58381 - DNA, 50 bp, homo sapien
accatgtttaaggcactggagagtcygcagtgaccaattggaaataatct

SEQ ID NO: 58382 - DNA, 50 bp, homo sapien
taggtcagacatattttaacacacakataagcagggtaggattgacaaca

SEQ ID NO: 58383 - DNA, 50 bp, homo sapien
attacgttgtcttcctatagtctgcraaataatgaaaaaagtctagacat

SEQ ID NO: 58384 - DNA, 50 bp, homo sapien
taaccttctttattcttcatattacratgtcaggtaagaactctcattag

SEQ ID NO: 58385 - DNA, 50 bp, homo sapien
caggcattgaaagtaagtatctctayggaatggcaattgaaattttccac

SEQ ID NO: 58386 - DNA, 50 bp, homo sapien
taaaacttagcttcaattcctctggraagactcgtgatctctgcactctc

SEQ ID NO: 58387 - DNA, 50 bp, homo sapien
tgttagtcatgagaggtgatgttgaragactcttgggagtaagaactccc

SEQ ID NO: 58388 - DNA, 50 bp, homo sapien
aattgatgacaaaatgttagaaataytaagcttgagaaaaaactgattta

SEQ ID NO: 58389 - DNA, 50 bp, homo sapien
ggaactcaggttttgactcctgacayggataatttgcctctggctagggc

SEQ ID NO: 58390 - DNA, 50 bp, homo sapien
gccatagatcctttttgattccttcrgaaaagcctggtagaaagattaac

SEQ ID NO: 58391 - DNA, 50 bp, homo sapien
gtcattcacacattctaacagcagargttactaaaacactttaaccagag

SEQ ID NO: 58392 - DNA, 50 bp, homo sapien
tgcaaatctgaattttaaaatgagaygttttagagagtgatgattcactt

SEQ ID NO: 58393 - DNA, 50 bp, homo sapien
tcaagttactgaagcgtttcttatcscaaggcagtattgtattttaagtc

SEQ ID NO: 58394 - DNA, 50 bp, homo sapien
aaatgcaagcagtttagaatagaagwctaatcagaagatagagaagcttt

SEQ ID NO: 58395 - DNA, 50 bp, homo sapien
aaaatgctttgcttatctatatgatsactttcaattaaactgccagttgt

SEQ ID NO: 58396 - DNA, 50 bp, homo sapien
caaagaatggtgtgcggcataacctmaagctgtggattggggaacagaac

SEQ ID NO: 58397 - DNA, 50 bp, homo sapien
tgaaaataaagctatattttaactcragagaaccaaactattatcagtag

SEQ ID NO: 58398 - DNA, 50 bp, homo sapien
gttttatctaataactacttttcaaytcccttcatcagtagtaaaggtaa

SEQ ID NO: 58399 - DNA, 50 bp, homo sapien
caggtatgggatggaagaaggagcaygagtaaggtcaagcactaaaacat

SEQ ID NO: 58400 - DNA, 50 bp, homo sapien
cagcaaactaaatcttctgcaagtcraaggaaacaatcaacagagtgaag

SEQ ID NO: 58401 - DNA, 50 bp, homo sapien
ttaccagtcccccagagccagacatwtattccgcaatggaaaataaatat

SEQ ID NO: 58402 - DNA, 50 bp, homo sapien
agaaagtgagtcccttatcataaaarggccatccacattttagcataatt

SEQ ID NO: 58403 - DNA, 50 bp, homo sapien
gctgaagacccacatgaagattgagraaggagatggatgtgtagagtcta

SEQ ID NO: 58404 - DNA, 50 bp, homo sapien
aacatgttgatctgaatatcactcayatatccaagaaaagagtcagaaat

SEQ ID NO: 58405 - DNA, 50 bp, homo sapien
ttgagcctaggctgctgttatagcgrcccacatgttgttcaaaattgaac

SEQ ID NO: 58406 - DNA, 50 bp, homo sapien
aatgtttccagcttgtgtccatttastatgttgttggctgtgggtttgtc

SEQ ID NO: 58407 - DNA, 50 bp, homo sapien
tctctctatacagtctgctgcccgamgttagaatttagagacagcatcta

SEQ ID NO: 58408 - DNA, 50 bp, homo sapien
acagacaaagacttcacagatagccyataatgcatgcttaatgaatattt

SEQ ID NO: 58409 - DNA, 50 bp, homo sapien
tgttgtgctatgtccttgagtttcawtagaagaaagagtcacactgactt

SEQ ID NO: 58410 - DNA, 50 bp, homo sapien
ggcgtatttctacactattggaaacygcaaaacttttacaagtaaattta

SEQ ID NO: 58411 - DNA, 50 bp, homo sapien
atctataacacaacaatacatttctractcttttcttggatatatgagtg

SEQ ID NO: 58412 - DNA, 50 bp, homo sapien
gtcattcttataaatatctaaaaccraatgcaataaattcaaatgtataa

SEQ ID NO: 58413 - DNA, 50 bp, homo sapien
ttgctattaattaatctgccacagastcagtttaaatctaggtgtctaca

SEQ ID NO: 58414 - DNA, 50 bp, homo sapien
atctttgccatatgatgttgttacgyatccctcacccagtcaggccaaac

SEQ ID NO: 58415 - DNA, 50 bp, homo sapien
tattcagaagtcaaataggtagtcartgacgaggagagcacagatgttac

SEQ ID NO: 58416 - DNA, 50 bp, homo sapien
ccagaatggaaaacagtaaaggccastatttatgctctgatactggaaag

SEQ ID NO: 58417 - DNA, 50 bp, homo sapien
ctcacgttcccctctctgcatgtgayacaactaccagagaactgaattta

SEQ ID NO: 58418 - DNA, 50 bp, homo sapien
tgttgagcaattcagttaggccccaratctgcatttcccaacaaaacagg

SEQ ID NO: 58419 - DNA, 50 bp, homo sapien
ttatgatatatgtagcatatagaatrtctgaaccgaggccaaacttagac

SEQ ID NO: 58420 - DNA, 50 bp, homo sapien
atgcttatataggccttttcagataygtaatatgatgactgttgtgataa

SEQ ID NO: 58421 - DNA, 50 bp, homo sapien
aaatataaacatctgcattttaaacwcacaatcagtaatttaaattaagt

SEQ ID NO: 58422 - DNA, 50 bp, homo sapien
agcttgtgactaagaggcataaatamaaacagcaccagaaatgtagtagc

SEQ ID NO: 58423 - DNA, 50 bp, homo sapien
aattcatgaccccactagtgtaatakatcattatccaaaacttcaaatta

SEQ ID NO: 58424 - DNA, 50 bp, homo sapien
cagcaatacattcaccaaatcaatayaaatgtagtgcatagtcaataata

SEQ ID NO: 58425 - DNA, 50 bp, homo sapien
aaattttttcctttctacattgtacmctgtattaccccatgattaaacta

SEQ ID NO: 58426 - DNA, 50 bp, homo sapien
atgaaatcagctgggacaggtcagcrgaagaaatacatttttggccagag

SEQ ID NO: 58427 - DNA, 50 bp, homo sapien
gggttattatttgaaaggtgcataayggactcccttctctggccaaaaat

SEQ ID NO: 58428 - DNA, 50 bp, homo sapien
tactggcaggtcttagaatactaaaygtgattttcgaaaaagttactttt

SEQ ID NO: 58429 - DNA, 50 bp, homo sapien
acactctggttttacatgcatgaaayatttttgtcttcttaattgcactg

SEQ ID NO: 58430 - DNA, 50 bp, homo sapien
aataaatgattagacaaagttaggaytcaccatatatttttgctcagcaa

SEQ ID NO: 58431 - DNA, 50 bp, homo sapien
atcccatcagcttatgcaatatgtaygtgaacgaagagataaaagagtaa

SEQ ID NO: 58432 - DNA, 50 bp, homo sapien
tatgaggagttctacgtgctttacaratactgcataaataatcctgcagc

SEQ ID NO: 58433 - DNA, 50 bp, homo sapien
ttttctaaaagattaatgtggctgargtatttgtttcatgttaaggaaaa

SEQ ID NO: 58434 - DNA, 50 bp, homo sapien
ccattgagtctccatacatttcaaasgatcaaaatttttcagtacatatt

SEQ ID NO: 58435 - DNA, 50 bp, homo sapien
cgacctgtaatccaatgctatcttgyatggacaataaaaaacacgccagc

SEQ ID NO: 58436 - DNA, 50 bp, homo sapien
acgtataattttgagtatattcttcmctaacatttaacaaaatatatttt

SEQ ID NO: 58437 - DNA, 50 bp, homo sapien
tagaagaaattaattgagtaaaaaayaatctgctgttcatttgcctaaaa

SEQ ID NO: 58438 - DNA, 50 bp, homo sapien
agacagcacaaatagtatatttaaasgtatcactatgagaaaaggcaaat

SEQ ID NO: 58439 - DNA, 50 bp, homo sapien
ctcataagaaggttatatcaagttcratcctatagctaaaaactactaca

SEQ ID NO: 58440 - DNA, 50 bp, homo sapien
ttgtttattctctaccttattctacraaggattaaggctgaatatgaaaa

SEQ ID NO: 58441 - DNA, 50 bp, homo sapien
ggaaacagaacattaaattgaaaggmaagccaataaaaacaaagcaactt

SEQ ID NO: 58442 - DNA, 50 bp, homo sapien
ttatctcttccttctcttaaagcaarttagtcttcctctatcccaataaa

SEQ ID NO: 58443 - DNA, 50 bp, homo sapien
atttttgtcactgatcctgacaccamtaaccgagaaactgagtaattata

SEQ ID NO: 58444 - DNA, 50 bp, homo sapien
atatcaatatctaaggtttctgagamctttttgtgttaccacttcataaa

SEQ ID NO: 58445 - DNA, 50 bp, homo sapien
ctactcatgtttttgatacgaataarccagcgacatgctttctaaaatct

SEQ ID NO: 58446 - DNA, 50 bp, homo sapien
aaatttggggagatatctctgaagayggtatgtaattaaattatgctatt

SEQ ID NO: 58447 - DNA, 50 bp, homo sapien
actgaatttgatggaatgtaaattgyatctcgacaaaacttttaagaaaa

SEQ ID NO: 58448 - DNA, 50 bp, homo sapien
aagaaatgttattactgcaatcatcyatactcagttctacctcataaatt

SEQ ID NO: 58449 - DNA, 50 bp, homo sapien
aagctaacaactgcaatctgtgcagragaaagtaactatgatggttagga

SEQ ID NO: 58450 - DNA, 50 bp, homo sapien
gattagaaattgtgaggctgaaggaygtaataactgaatttaaaaattcg

SEQ ID NO: 58451 - DNA, 50 bp, homo sapien
attcttttttaagcaataaggaaaayatgacgtgaaaagacatggaagaa

SEQ ID NO: 58452 - DNA, 50 bp, homo sapien
cagtttcaccaggcaacctccaacaytcagcagctcttggtgtatcaatg

SEQ ID NO: 58453 - DNA, 50 bp, homo sapien
atctctttcagctctaaaagcctgamctacttaaaaaggctagcactggc

SEQ ID NO: 58454 - DNA, 50 bp, homo sapien
tattatacgtgtgtctgtttttatayagaatttgttagaagtctctagta

SEQ ID NO: 58455 - DNA, 50 bp, homo sapien
ctccataaccatatattaaacaaaaycccaaacagatctgcattagaact

SEQ ID NO: 58456 - DNA, 50 bp, homo sapien
gaggagcataataattgtataaagakaattgatcatattctgtttccaga

SEQ ID NO: 58457 - DNA, 50 bp, homo sapien
ttcattatctttactacagttgtctyaattggaagaaagagaaacccata

SEQ ID NO: 58458 - DNA, 50 bp, homo sapien
ctaccttaaattcccagcacatatgragtgagaatttttcagaagaataa

SEQ ID NO: 58459 - DNA, 50 bp, homo sapien
agataacattctactgcctcttttaygaaggattggggagggaaaaatat

SEQ ID NO: 58460 - DNA, 50 bp, homo sapien
ttcttccctctctcactctcacaaamgtttcataagccctgaggagacat

SEQ ID NO: 58461 - DNA, 50 bp, homo sapien
atccctagaagattccattcaaatarcagggtccattcaaacaatcaaca

SEQ ID NO: 58462 - DNA, 50 bp, homo sapien
atatcaaggaaacttaagctcatagrcatgtttaaaatttccatgtcaca

SEQ ID NO: 58463 - DNA, 50 bp, homo sapien
caatgtcatgattgagtatttaaatraacaaaagtcaggaaaatcatttt

SEQ ID NO: 58464 - DNA, 50 bp, homo sapien
tcccagagcttattcatcttataacwgaatgtttgctgtaccctttgatc

SEQ ID NO: 58465 - DNA, 50 bp, homo sapien
agcaacaccaataatgtaaatgatamgtatagctcagtatagtaaaaatg

SEQ ID NO: 58466 - DNA, 50 bp, homo sapien
catctgcaacctgagggtgaggaaakactgtcccttaaatcatgttaaag

SEQ ID NO: 58467 - DNA, 50 bp, homo sapien
gagataacagtgaatacttctcaagratacattgtgaaaaaaatacagag

SEQ ID NO: 58468 - DNA, 50 bp, homo sapien
aaagtgtgtgtgtttgtgtgtatatraataaagagttgatataatagaag

SEQ ID NO: 58469 - DNA, 50 bp, homo sapien
tagacatactgagatatatattgaasaaaacactgaagaaaatttgagtt

SEQ ID NO: 58470 - DNA, 50 bp, homo sapien
gttgagctgaggttttagtattgaaytgacaggcgaagaggtggataatg

SEQ ID NO: 58471 - DNA, 50 bp, homo sapien
tggagatcatttctacaacagtggcsagaaaagcagaaatatattcagta

SEQ ID NO: 58472 - DNA, 50 bp, homo sapien
aatatatgttagaatttgataaatasctgaagagttttaaagagctatgg

SEQ ID NO: 58473 - DNA, 50 bp, homo sapien
gcttcccacacattgttattttaccrctattgcatgccagtctaactaga

SEQ ID NO: 58474 - DNA, 50 bp, homo sapien
atgagtgaatttggagaagagagaawttactataaacagaactaattaaa

SEQ ID NO: 58475 - DNA, 50 bp, homo sapien
ctgacgtctgagtcagacagttggawtagttttcatgagtagtactactt

SEQ ID NO: 58476 - DNA, 50 bp, homo sapien
ccagatccgtatctcttctgtacagrcaaaattaggtgagctgaataggg

SEQ ID NO: 58477 - DNA, 50 bp, homo sapien
ttggacaaggtgttccatctctctgwatctgagttgccttgatgtaaatg

SEQ ID NO: 58478 - DNA, 50 bp, homo sapien
atcccttgatttttggatttgtgaamgatggctataggagaaacagaacc

SEQ ID NO: 58479 - DNA, 50 bp, homo sapien
ttataagttccttgaagtcttagaargtattttattcaaattcctatttc

SEQ ID NO: 58480 - DNA, 50 bp, homo sapien
gatacttaccatgacatagctccatragttaaccccatcagccacttccc

SEQ ID NO: 58481 - DNA, 50 bp, homo sapien
aacttggtttcaatcacatgtcctaygtcctatattgttttttaatttgt

SEQ ID NO: 58482 - DNA, 50 bp, homo sapien
tttttataaacttctcttctaaaacrgacttaactttgactcgcatcctt

SEQ ID NO: 58483 - DNA, 50 bp, homo sapien
ctaacttccaaattgtgaaataacartaaaaagattgtgacttttcagct

SEQ ID NO: 58484 - DNA, 50 bp, homo sapien
taaaaggctaattcaaggagctgaaragtcacaatctttttactgttatt

SEQ ID NO: 58485 - DNA, 50 bp, homo sapien
tttatggcctctaccaattatgaaarcctgtgattacataattccattag

SEQ ID NO: 58486 - DNA, 50 bp, homo sapien
ataacaggaatgaacttatcattcaygagcatttaatggaggttgtagtg

SEQ ID NO: 58487 - DNA, 50 bp, homo sapien
agtactataatccaatggttataatsatattgttccttccttttttttgt

SEQ ID NO: 58488 - DNA, 50 bp, homo sapien
ggaaatacaaatgtatgccacaaaayggaataatgtaagaactgggggat

SEQ ID NO: 58489 - DNA, 50 bp, homo sapien
aaggaaaattatacatctcatctcamactaaaaatgcagaaaatatacta

SEQ ID NO: 58490 - DNA, 50 bp, homo sapien
aagacactgattttgccaatttaaamtagcaatggttttcaaataaaatg

SEQ ID NO: 58491 - DNA, 50 bp, homo sapien
agatcatctgacaattattttgcctkactttggagttcagggtcagttaa

SEQ ID NO: 58492 - DNA, 50 bp, homo sapien
aaattttcgctttgttggattgactyaaactcttttaaatacatttaatg

SEQ ID NO: 58493 - DNA, 50 bp, homo sapien
acagtactaaataattccatccagcragtcaatccatcctattacttagg

SEQ ID NO: 58494 - DNA, 50 bp, homo sapien
agccaccatgtccagctgacatggcwatgtttaaataaaatatatcacat

SEQ ID NO: 58495 - DNA, 50 bp, homo sapien
gaatgtttgggctagcttacaaacamaataaacattagttaagaactaat

SEQ ID NO: 58496 - DNA, 50 bp, homo sapien
agaattgaacttccagaaaacaatcrtaaagaaggcaatgttttgcaatt

SEQ ID NO: 58497 - DNA, 50 bp, homo sapien
gtaagtcaaaaatagctattgaagakgaagtaaaattactacataaaaga

SEQ ID NO: 58498 - DNA, 50 bp, homo sapien
aagaagtgctttattgcatagaaacrcgatttgtatgggaataacatggg

SEQ ID NO: 58499 - DNA, 50 bp, homo sapien
tgaaatttgtaacatgctactatgcygattttactctgaacctctttatt

SEQ ID NO: 58500 - DNA, 50 bp, homo sapien
ttgtaccttgggctcctcctaagatractgaaggacaatgcccttaaact

SEQ ID NO: 58501 - DNA, 50 bp, homo sapien
tatatgttcatataacactctcatcrcattttatacttaacaaaccactc

SEQ ID NO: 58502 - DNA, 50 bp, homo sapien
aataggaaacctcaaagtaagacaamgagaatatggtcttaccccattga

SEQ ID NO: 58503 - DNA, 50 bp, homo sapien
acataccacttaatatgtactgagarctagtctacgcatttgtctttaaa

SEQ ID NO: 58504 - DNA, 50 bp, homo sapien
gtacatggtgactctcattgttgatragtataaggaccaagacttggtca

SEQ ID NO: 58505 - DNA, 50 bp, homo sapien
ttgcttttatgtcatccctttaacaycattaccatggaaacacttctggg

SEQ ID NO: 58506 - DNA, 50 bp, homo sapien
agacattacagatagatacatagacygataggtgacgtattaaagtctga

SEQ ID NO: 58507 - DNA, 50 bp, homo sapien
aaaataagggaaatacccgtaaagaycataatgagatataatttacatcc

SEQ ID NO: 58508 - DNA, 50 bp, homo sapien
cacattttggtgagtatagaggaaargaagaagcagagtaatgaaagaca

SEQ ID NO: 58509 - DNA, 50 bp, homo sapien
ataaggaacctactccttcagtgacraataacattaatctattcatgaag

SEQ ID NO: 58510 - DNA, 50 bp, homo sapien
tatttttgagccaacatacaaaacartatctatgagaaatcagaagactt

SEQ ID NO: 58511 - DNA, 50 bp, homo sapien
taaaatagcatgcttatttagaaaaytcaactatcacccagcggcaacca

SEQ ID NO: 58512 - DNA, 50 bp, homo sapien
atactctaataacggatatgcaacaytatgaatttgtcaaaatccacaga

SEQ ID NO: 58513 - DNA, 50 bp, homo sapien
tgttcctctctcaaatgatttgcctsagagtttttttgtccaaagttttt

SEQ ID NO: 58514 - DNA, 50 bp, homo sapien
tcttaaaatatacaaataagtgaackgtaccattttcatcgatagaataa

SEQ ID NO: 58515 - DNA, 50 bp, homo sapien
ataaaattaattattacactatccakcacaagaatatgagacacatcacc

SEQ ID NO: 58516 - DNA, 50 bp, homo sapien
tggtatgtaagttatgccagcctcartaaataaaaaagagagtctactct

SEQ ID NO: 58517 - DNA, 50 bp, homo sapien
aaacacacacagtgactattctggaragattacccaacagagattagttg

SEQ ID NO: 58518 - DNA, 50 bp, homo sapien
gtgagggcatcaaagaactcttaaaygctttcaaatgtggtgggagcatc

SEQ ID NO: 58519 - DNA, 50 bp, homo sapien
ctttcacagaatacttatttattctygtggatggtctaatgcctaggtgt

SEQ ID NO: 58520 - DNA, 50 bp, homo sapien
ttatcctattcatcttctcccacaartctgtctttagcggaagatttttt

SEQ ID NO: 58521 - DNA, 50 bp, homo sapien
gtctaatgtgagttttactcttcaaygaagtcatgtaagcaactacaatt

SEQ ID NO: 58522 - DNA, 50 bp, homo sapien
gcaggtaccgtgtttgggctgcacayctgagacatgtcatccatccaact

SEQ ID NO: 58523 - DNA, 50 bp, homo sapien
gccaggaggaggcctactctctagcrtttataggagactggcgtccgatg

SEQ ID NO: 58524 - DNA, 50 bp, homo sapien
accagtcgctcccccactacctccayagagatgttttaacacagacacat

SEQ ID NO: 58525 - DNA, 50 bp, homo sapien
tcatagataatggaactaagagcaamctagtatttagaataaaaggacta

SEQ ID NO: 58526 - DNA, 50 bp, homo sapien
atctctgtggaggtagtgggggagcsactggtttgttcactctgcagaaa

SEQ ID NO: 58527 - DNA, 50 bp, homo sapien
ttcaggaaagagatagggattagaamaaaaagcatgaggcatattattaa

SEQ ID NO: 58528 - DNA, 50 bp, homo sapien
tttagcctacattaaccagtacacayattatttcttccatagatggtcac

SEQ ID NO: 58529 - DNA, 50 bp, homo sapien
gattttaacattgaaagctgaacgartatttttcagactttaagttatta

SEQ ID NO: 58530 - DNA, 50 bp, homo sapien
gctgtttggctgaaatacaagttcaytaccaaataagaaaacatgtttta

SEQ ID NO: 58531 - DNA, 50 bp, homo sapien
ctctttggctcttagtaggatgaatmattagcaaaataatcataaaagtt

SEQ ID NO: 58532 - DNA, 50 bp, homo sapien
cttattatatcctcataaaaaagccsaaataacttctccaagtcacataa

SEQ ID NO: 58533 - DNA, 50 bp, homo sapien
aaaaagtgtggtgatccctagtttayggtgtcaaatgcagcaaaggtcaa

SEQ ID NO: 58534 - DNA, 50 bp, homo sapien
taaatgaacacacactttaaaagacratcaggaaaaggaagtcaaggaat

SEQ ID NO: 58535 - DNA, 50 bp, homo sapien
gagcaattgttaaatgaatttaatcwacctggatcataaactacctaggt

SEQ ID NO: 58536 - DNA, 50 bp, homo sapien
taaatagtacttgctttttcctcatwatacttaacgacagtttaaaaact

SEQ ID NO: 58537 - DNA, 50 bp, homo sapien
tttttgttattcgttactaagatgasatagttagagctgcaagaaatgca

SEQ ID NO: 58538 - DNA, 50 bp, homo sapien
ttttattctatgccaggtagagaaaygaggttatgatgtactagaaattc

SEQ ID NO: 58539 - DNA, 50 bp, homo sapien
ttttccttagagtgcaggccatgtcyatattgtaaaaacaatagtgaaga

SEQ ID NO: 58540 - DNA, 50 bp, homo sapien
tgacatgattatttatttcttcatawgtctccaaggatcataagacattc

SEQ ID NO: 58541 - DNA, 50 bp, homo sapien
tgccttcaacagacttgcagttaacracctaagtaaacaaaaaaatctaa

SEQ ID NO: 58542 - DNA, 50 bp, homo sapien
tttatttatccagatagtggttatgmaattatttgccttataattacttg

SEQ ID NO: 58543 - DNA, 50 bp, homo sapien
taaaataaaaatatatttaatatgaygctattttggggatatatctatag

SEQ ID NO: 58544 - DNA, 50 bp, homo sapien
acaggtgtcatgatgctacttttagygatggcaacttggattaaaaagag

SEQ ID NO: 58545 - DNA, 50 bp, homo sapien
gaatcagtaagttactttgggcactsactttcttcaaagaattagaaaaa

SEQ ID NO: 58546 - DNA, 50 bp, homo sapien
taactattagtaaatatctttcatcyggtaaccactcatgactatctcta

SEQ ID NO: 58547 - DNA, 50 bp, homo sapien
gtaccctaccagaacaataccagaamgataccactgatgtatcgttttat

SEQ ID NO: 58548 - DNA, 50 bp, homo sapien
ttctaaataatttccttgaactctgwattaaccaaaatgagacaaatctc

SEQ ID NO: 58549 - DNA, 50 bp, homo sapien
ttttgtaaaaagtcctgagtttacaycctttctgagaatttctcaatcac

SEQ ID NO: 58550 - DNA, 50 bp, homo sapien
gtctgctactgccctgactgtcaccrcatatcctaaccttggtgatggcc

SEQ ID NO: 58551 - DNA, 50 bp, homo sapien
agacccagtgtaataaagaagatgaygaccttttgaacacgttgagtttg

SEQ ID NO: 58552 - DNA, 50 bp, homo sapien
atgtcttctttcctttgttcagtgasataatgctttttatctctcattac

SEQ ID NO: 58553 - DNA, 50 bp, homo sapien
ctgtgactgcaagtccttaatggaarctggtctttatttgcaatggatga

SEQ ID NO: 58554 - DNA, 50 bp, homo sapien
tagtgtatcacatggaattaggatgratcactcagttgcaagcaaaagac

SEQ ID NO: 58555 - DNA, 50 bp, homo sapien
taacatcctagaaaatattttaaaasttgttacagatctactatgacctg

SEQ ID NO: 58556 - DNA, 50 bp, homo sapien
tccactgcctctttatttctactgawgctcttcaaaatagagacctcatt

SEQ ID NO: 58557 - DNA, 50 bp, homo sapien
tgcactatatttaatcattgttttayacctgggatagtgtatttttaagt

SEQ ID NO: 58558 - DNA, 50 bp, homo sapien
tgctgcgaaattggaccaagagtacmaagttctccatgaaccaaaactac

SEQ ID NO: 58559 - DNA, 50 bp, homo sapien
atcaatagcaaataataggaaaatgkcatacaaatgattatcattgttct

SEQ ID NO: 58560 - DNA, 50 bp, homo sapien
ttattttaggcttacattcctcacamaacttctaggtatatttgcattct

SEQ ID NO: 58561 - DNA, 50 bp, homo sapien
agagtcaggacttgacaaatagtacmaaaactagtcactacaagtataga

SEQ ID NO: 58562 - DNA, 50 bp, homo sapien
tcatggctctacgtttgtatgtccaragcttaagtggtcagttgaagaat

SEQ ID NO: 58563 - DNA, 50 bp, homo sapien
gggcaggccagacagtttgcataaaratactgcagcagaaaaagtaatgt

SEQ ID NO: 58564 - DNA, 50 bp, homo sapien
tttctacaacatttcacttctacaaytccagagtggcatgggacttttct

SEQ ID NO: 58565 - DNA, 50 bp, homo sapien
agctcaactcctactcattcatccakactaacctcagatgtcatcgcctt

SEQ ID NO: 58566 - DNA, 50 bp, homo sapien
tcttcttaatgagattctacatatarctttttatcaatttagagggaggg

SEQ ID NO: 58567 - DNA, 50 bp, homo sapien
gattctctttcactgtccttttatcmacatgccttaagattttttaaaaa

SEQ ID NO: 58568 - DNA, 50 bp, homo sapien
catacaattaccctgattgagtaaayatggcaaagaacagctacataatt

SEQ ID NO: 58569 - DNA, 50 bp, homo sapien
attgcatatagtcattccatggtgaragcaatataaagtctgtaagtctt

SEQ ID NO: 58570 - DNA, 50 bp, homo sapien
aaaagttaatatgccatcactgggaycagaaactcttattgtgcttttca

SEQ ID NO: 58571 - DNA, 50 bp, homo sapien
tatatgtatatattgtatgtaaggcmaggtgttgcaaataaaagtacata

SEQ ID NO: 58572 - DNA, 50 bp, homo sapien
caaaagcatgtggaaacataatttcsaagcaaactgaagaccgtgaacgt

SEQ ID NO: 58573 - DNA, 50 bp, homo sapien
atatttatgttcatttatgaatacamacaaatctaatatctaaaatctga

SEQ ID NO: 58574 - DNA, 50 bp, homo sapien
ttattgctaatagaatatcgctattrttcaatgtggcaaaaaatctattt

SEQ ID NO: 58575 - DNA, 50 bp, homo sapien
tttctcactggcaatacaacctgatsagaatttatctaccttagctagtg

SEQ ID NO: 58576 - DNA, 50 bp, homo sapien
cttttaaactataagtcagaaattcrcacagtcaatgttagggtacagac

SEQ ID NO: 58577 - DNA, 50 bp, homo sapien
aagtcattctggcaacatggtactcratgtgagaaacaactacacacgtg

SEQ ID NO: 58578 - DNA, 50 bp, homo sapien
actcccttgtgaaatgccatttgcayctgttaagtggcttccttgctttt

SEQ ID NO: 58579 - DNA, 50 bp, homo sapien
atgataggattgttctgatgtttccragtttttatactcattgttctcag

SEQ ID NO: 58580 - DNA, 50 bp, homo sapien
gaattccaggtttgaattgtttgaaygcacttcgtcttgtttgttgcttt

SEQ ID NO: 58581 - DNA, 50 bp, homo sapien
agtttcccattaaactcaagagtatsacaagaatgctcgttaccactgct

SEQ ID NO: 58582 - DNA, 50 bp, homo sapien
cataagtttgtcaggaaaatgataasagagtaccctggaaaagcaccccc

SEQ ID NO: 58583 - DNA, 50 bp, homo sapien
cagcctgccagctatcccttagcgasgttccagcttcatgcttacacaac

SEQ ID NO: 58584 - DNA, 50 bp, homo sapien
ctacataaaatgctgaatattgtgcrtgacacctagaaaacactaaaata

SEQ ID NO: 58585 - DNA, 50 bp, homo sapien
aactatatgttggcagtttagattaygccttgctttctcctttgctaaca

SEQ ID NO: 58586 - DNA, 50 bp, homo sapien
agtaaatgtagaatcttactttcccraggtacatataatttaagtttctt

SEQ ID NO: 58587 - DNA, 50 bp, homo sapien
aaatatttcttgatccacaagaatamaggtttttgttgttgttgctgctg

SEQ ID NO: 58588 - DNA, 50 bp, homo sapien
aggatatacaactgtaatgtgccaaygttcacaggaagagattttagaaa

SEQ ID NO: 58589 - DNA, 50 bp, homo sapien
gagcaaagtatcactctcatcgtcawacattacaaagaaaacagtcagga

SEQ ID NO: 58590 - DNA, 50 bp, homo sapien
ttccagattatttggtgtaattaagycctcatgtctatttcctatgttca

SEQ ID NO: 58591 - DNA, 50 bp, homo sapien
cttggcaagatataatagtatagaaygatcagtagtgtgaaagtttttct

SEQ ID NO: 58592 - DNA, 50 bp, homo sapien
actttgtatggaagtctggactagayaacattttcctgtaccctgtaaga

SEQ ID NO: 58593 - DNA, 50 bp, homo sapien
gtcaaaacccgatgatgacattacartacaaatcatagaagctctataaa

SEQ ID NO: 58594 - DNA, 50 bp, homo sapien
attgcttgacctgggacaggaatgaygagtacttgctgagagttataaga

SEQ ID NO: 58595 - DNA, 50 bp, homo sapien
cttctttaggttgctcctagctcatratataaaaccacgtattcactaga

SEQ ID NO: 58596 - DNA, 50 bp, homo sapien
ggttagaattatttcacagtaaaaastaagtaaatttgagatctaatatt

SEQ ID NO: 58597 - DNA, 50 bp, homo sapien
tcactgaggcatgggactatgactaygaatgaaggacagaagatggtctg

SEQ ID NO: 58598 - DNA, 50 bp, homo sapien
taatgttttttggtccattacattayagactgttttagtttagagtcact

SEQ ID NO: 58599 - DNA, 50 bp, homo sapien
atgatgcagtctcttttactttcggraaataatgagtcagagaagcacta

SEQ ID NO: 58600 - DNA, 50 bp, homo sapien
actctcttgacttttcctaaatgtcrcacagaattatccaggattctaag

SEQ ID NO: 58601 - DNA, 50 bp, homo sapien
ttatggatagtcatctgtttgaacawattaccctttatttgaaagtctct

SEQ ID NO: 58602 - DNA, 50 bp, homo sapien
tttaatcaactttcacatttaatagraagccaagccctgttcatttttgt

SEQ ID NO: 58603 - DNA, 50 bp, homo sapien
ctcacttataagacgcttaatagccrcagaccaatatctgtgccagatct

SEQ ID NO: 58604 - DNA, 50 bp, homo sapien
taaataatgaaataggaatgcctgakagtatagctaatagttagcaggta

SEQ ID NO: 58605 - DNA, 50 bp, homo sapien
tttggttttggacatgttgaatatawgataatgagatattctggaagatg

SEQ ID NO: 58606 - DNA, 50 bp, homo sapien
tgtggcagaaagaaagggatgcttayctcatatttaatgctttaaagaca

SEQ ID NO: 58607 - DNA, 50 bp, homo sapien
gaagacagttcaatagagaatatccraattgaagtcgagaggagaaaaat

SEQ ID NO: 58608 - DNA, 50 bp, homo sapien
ctggacagggagcattaggaggccamgctagaagggagagtttgtggtgg

SEQ ID NO: 58609 - DNA, 50 bp, homo sapien
ctgcatgcatgattaattgagacaawcattccatttaactaatatttgag

SEQ ID NO: 58610 - DNA, 50 bp, homo sapien
gattttggtaaagttgtatgcatcarggtatttatagccacttcaattat

SEQ ID NO: 58611 - DNA, 50 bp, homo sapien
gaagatatggaaaacttattttgcartcttcatgaacacacagagaggag

SEQ ID NO: 58612 - DNA, 50 bp, homo sapien
tagaagcagtgattgactttatagawtaaactggagacttgaaatttctt

SEQ ID NO: 58613 - DNA, 50 bp, homo sapien
tccatgcaagtaacttaatagactaygtaaaagtggagcgaacagaaatc

SEQ ID NO: 58614 - DNA, 50 bp, homo sapien
gagttgccaatgagttaaccagtcaygagaagtagctgacgaagagagca

SEQ ID NO: 58615 - DNA, 50 bp, homo sapien
aataaaaaggaaaaatattaatcacractagtttcagaaacattggtata

SEQ ID NO: 58616 - DNA, 50 bp, homo sapien
tgacaaaacttcaagacctcaaagawatccataaagattttgctcaaaag

SEQ ID NO: 58617 - DNA, 50 bp, homo sapien
cccttaatgtgtactcagaaatcaaycttttgtaatttgttctagaacct

SEQ ID NO: 58618 - DNA, 50 bp, homo sapien
taatgtgattcccatctctaagttcyaaataagtgaattttgagaaatag

SEQ ID NO: 58619 - DNA, 50 bp, homo sapien
cattggaaaacagaagctactgaaamactgatttctaaagatccaactat

SEQ ID NO: 58620 - DNA, 50 bp, homo sapien
tttacatttgtaatgaattattgagrgttgttcattggaaaacagaagct

SEQ ID NO: 58621 - DNA, 50 bp, homo sapien
gttagatgcccatctctggactcatsaattgtggccaaaacaacggggcc

SEQ ID NO: 58622 - DNA, 50 bp, homo sapien
actctgccatcattaatagattaagrccaatattgcaagagtggttttat

SEQ ID NO: 58623 - DNA, 50 bp, homo sapien
aagctagtttagtaaaaaatggaaayttatcagttcagttgtctgcagga

SEQ ID NO: 58624 - DNA, 50 bp, homo sapien
atttggattattttatggtaagatasagagaatttagatgaaattattta

SEQ ID NO: 58625 - DNA, 50 bp, homo sapien
atactaagttctttgaaaatgttaaytattactatggtattaatagattt

SEQ ID NO: 58626 - DNA, 50 bp, homo sapien
tttgaaatgagctttatcaaagaccragatttagataataaagcagttag

SEQ ID NO: 58627 - DNA, 50 bp, homo sapien
tctctctttataaaagtttaagctgratatgttggaaaacatcttttatt

SEQ ID NO: 58628 - DNA, 50 bp, homo sapien
aaaaagaaatacatgtttaagaagaycctggagactcacagatgacacgg

SEQ ID NO: 58629 - DNA, 50 bp, homo sapien
ttttattataaaactatttcatttawttgaatcaccggtttcatattttt

SEQ ID NO: 58630 - DNA, 50 bp, homo sapien
ttccttataaaatgtaattgataaakgaagactgaatctccaaagaaaca

SEQ ID NO: 58631 - DNA, 50 bp, homo sapien
aattattgaatgaagagtggatttcrctgtaatctaatttgcttcatatg

SEQ ID NO: 58632 - DNA, 50 bp, homo sapien
tttcatattttaataacattccaccrtagttcagactatatagcctttac

SEQ ID NO: 58633 - DNA, 50 bp, homo sapien
agacatttcacattgaaatacttgamccaaattagcacgagggaactggt

SEQ ID NO: 58634 - DNA, 50 bp, homo sapien
ggagtgttatactggttgtatagacyaatgaatacaaagcaatgaaggga

SEQ ID NO: 58635 - DNA, 50 bp, homo sapien
aggagcaaaggacacagtccctttcrcagaaatccaatcctacacagata

SEQ ID NO: 58636 - DNA, 50 bp, homo sapien
ctttaagatttttaatgggatcagargaaaattcggtacttaatcacttc

SEQ ID NO: 58637 - DNA, 50 bp, homo sapien
ccatgggtcccaacgtgcccaggtamattcccagacaactgttgtcaata

SEQ ID NO: 58638 - DNA, 50 bp, homo sapien
ttgaaccttatctatattgaaccaartctaatatctatttgcctggacac

SEQ ID NO: 58639 - DNA, 50 bp, homo sapien
ttgatgatgatataaaggctaaaagrataggaattcaaatcagctacaca

SEQ ID NO: 58640 - DNA, 50 bp, homo sapien
cctctttgttttattcatatgcctayagctagatcctcttttctgtctgt

SEQ ID NO: 58641 - DNA, 50 bp, homo sapien
catatgtgttaaataaaggaataaaygaaggcactgttcactatcattta

SEQ ID NO: 58642 - DNA, 50 bp, homo sapien
aagcaaaaacagtaaagaatggtaaytgatcccagtaagaaaattgtgaa

SEQ ID NO: 58643 - DNA, 50 bp, homo sapien
gttttgattgaagtctctaagaaaayatgaccttatactaatatgtagtt

SEQ ID NO: 58644 - DNA, 50 bp, homo sapien
ttagtacctgcaacattataggatawaggtcatactagcaggtgatgaat

SEQ ID NO: 58645 - DNA, 50 bp, homo sapien
tacatgacttcaggcaaagtgctaartgtattctttgagtcctgggactt

SEQ ID NO: 58646 - DNA, 50 bp, homo sapien
gctcacaaactgaagaaggcaataamccttttttagtcagtgcagctacc

SEQ ID NO: 58647 - DNA, 50 bp, homo sapien
ggaatgacagcactagctctcatacraagtcccaaaagcatggaattcca

SEQ ID NO: 58648 - DNA, 50 bp, homo sapien
gtatcgccacagacccagtgctagaygtagatcccaatcacacaggacca

SEQ ID NO: 58649 - DNA, 50 bp, homo sapien
tccctgatgattcagtgcttagttgyaattaaaagtgcacctaccttctc

SEQ ID NO: 58650 - DNA, 50 bp, homo sapien
accagagattctgacttccctgttayagaaaaagtaagacttgcgagaaa

SEQ ID NO: 58651 - DNA, 50 bp, homo sapien
ggaaatcctttttggacacaagtgcraaagaaattcagtagagaaaggat

SEQ ID NO: 58652 - DNA, 50 bp, homo sapien
gagttatgctttgtacatgaagagayatgagaacaaacttgtcttttata

SEQ ID NO: 58653 - DNA, 50 bp, homo sapien
acatacatctgttgaacacttactayatgcaggctgctgtgggaggatga

SEQ ID NO: 58654 - DNA, 50 bp, homo sapien
atattacaaatatgtgtagaacatcrccttttctttattgaccatggatt

SEQ ID NO: 58655 - DNA, 50 bp, homo sapien
cctctgcaccaacacttgttttacaytccttggagcaaccagcctcccac

SEQ ID NO: 58656 - DNA, 50 bp, homo sapien
taaatccctgattgggtgtctctctyaataatgaacagcttaggaaccct

SEQ ID NO: 58657 - DNA, 50 bp, homo sapien
ggctgttctgggaattcagaggtgasaagttgaaggacagtggggacaca

SEQ ID NO: 58658 - DNA, 50 bp, homo sapien
ccaaagctatttgttcctctctgaaygcctttctagtaggctctttaaaa

SEQ ID NO: 58659 - DNA, 50 bp, homo sapien
gataatggctggcatccgggatgtakaaaaaattccaaaacctcaataat

SEQ ID NO: 58660 - DNA, 50 bp, homo sapien
tgtaagaaagtaccaaaaacatttaratccccatcatcactgtctgagtg

SEQ ID NO: 58661 - DNA, 50 bp, homo sapien
tgaatgcatatgtctgtaaggaaaayttgtacagaagttatcatagtaga

SEQ ID NO: 58662 - DNA, 50 bp, homo sapien
tagatagatgatagatagatcatagwtgacagatatgtaaaaatatagac

SEQ ID NO: 58663 - DNA, 50 bp, homo sapien
aaaatttgtacagaagttatcatagyagactaatttgtaatagcaagata

SEQ ID NO: 58664 - DNA, 50 bp, homo sapien
ttttctactaaaggaattttaaacaytgatgagtataaaagggtcaaata

SEQ ID NO: 58665 - DNA, 50 bp, homo sapien
tatcaagttgtaaatatttgtagaayctgtagtaacgtctcccttttcct

SEQ ID NO: 58666 - DNA, 50 bp, homo sapien
ttctaaacattcctctgttaattcawagacataagagaaataaatcactt

SEQ ID NO: 58667 - DNA, 50 bp, homo sapien
tctctcagatttagatcactgttagrcctccttatcttatatgcttaata

SEQ ID NO: 58668 - DNA, 50 bp, homo sapien
taaggaaataaatggtaattaaagtsatgagagtggacaatttagccctc

SEQ ID NO: 58669 - DNA, 50 bp, homo sapien
cttctagaatcgtcaacttggattaygcattcttttgctcttatcactga

SEQ ID NO: 58670 - DNA, 50 bp, homo sapien
ggttcgacattgcctataaatcaggyattcgaggcaatcatcatgacatt

SEQ ID NO: 58671 - DNA, 50 bp, homo sapien
ttttcataagaacaggagcaaataakattcatgccatgtcctaacacacc

SEQ ID NO: 58672 - DNA, 50 bp, homo sapien
tgatttatgttgctttatcttagtgmagggaaataggaaggggcacttat

SEQ ID NO: 58673 - DNA, 50 bp, homo sapien
aatatgttgatattaaggtttatcamgttacatcaattgacacatttaat

SEQ ID NO: 58674 - DNA, 50 bp, homo sapien
caagaaaggaagtttacaaattatcmagggaaaaatcaagttgcaaaaca

SEQ ID NO: 58675 - DNA, 50 bp, homo sapien
cactgtctagatgactatagctttayattaactattgaagtcagatagtg

SEQ ID NO: 58676 - DNA, 50 bp, homo sapien
aaaagtgttgacttctggtactaaasagagaaaatagataaatgaaaaat

SEQ ID NO: 58677 - DNA, 50 bp, homo sapien
aggtcaaaacaaaacaaaaatcctaygtataaatgttatgtttctatttt

SEQ ID NO: 58678 - DNA, 50 bp, homo sapien
ggctcaagagatggggataagaagcraaagaagggaaggaaaaagagcac

SEQ ID NO: 58679 - DNA, 50 bp, homo sapien
aagtaatctccattttgtgtagctaygagggaaacattatggagaccatc

SEQ ID NO: 58680 - DNA, 50 bp, homo sapien
aattttccaattccagagtataatakccaggacatcattatgactagact

SEQ ID NO: 58681 - DNA, 50 bp, homo sapien
acataattgacctatacatcatgcayattctggattaaacaaaatatttg

SEQ ID NO: 58682 - DNA, 50 bp, homo sapien
gctaactatgagagttgacaccaatwatgttgacttgacctgactttaat

SEQ ID NO: 58683 - DNA, 50 bp, homo sapien
aatactggcaatttttagggatctcraagatgaattattcatgcagtaca

SEQ ID NO: 58684 - DNA, 50 bp, homo sapien
tatctctttaaaatcagagacaagarcttctgaggatcaaaactaatatt

SEQ ID NO: 58685 - DNA, 50 bp, homo sapien
agcataaatattagtgaaaaaataayatattggcttcgtgaaagaagagg

SEQ ID NO: 58686 - DNA, 50 bp, homo sapien
gatcaggaataaaaactaaaaacaasagagagagtaaatataaaggcaaa

SEQ ID NO: 58687 - DNA, 50 bp, homo sapien
taactctgcttcataatgttgccgcyaagagagctaaagctcatctagag

SEQ ID NO: 58688 - DNA, 50 bp, homo sapien
agcggcagccactgatacataaaggraaaccggagatgattatgtctaag

SEQ ID NO: 58689 - DNA, 50 bp, homo sapien
gtgatgttagtggttggttaagagamaggtatctccagaaataaaacacg

SEQ ID NO: 58690 - DNA, 50 bp, homo sapien
aatatagttgaactaataataggaaracgaggatgtaaaacaaaagttct

SEQ ID NO: 58691 - DNA, 50 bp, homo sapien
aaggtcctagatgatatgacacaaaygctaagaaacacacagaaaagaga

SEQ ID NO: 58692 - DNA, 50 bp, homo sapien
gagatgacaggatcgcaggtgaagcycaatgcataagggccttgtctgcc

SEQ ID NO: 58693 - DNA, 50 bp, homo sapien
gacgagactgtcacatctctctgttyattcccagcacctaaagcaatgcc

SEQ ID NO: 58694 - DNA, 50 bp, homo sapien
gaggaacaccaaggtcctgaaaagaygggaaatgattagagatcaagatt

SEQ ID NO: 58695 - DNA, 50 bp, homo sapien
tgttctcagattagcaaaaatattayatggaaggggactcaaaatctttt

SEQ ID NO: 58696 - DNA, 50 bp, homo sapien
atctctcacacatcagatcataaacmatcactccacccaaaccatgctgg

SEQ ID NO: 58697 - DNA, 50 bp, homo sapien
taagggtaaaggggaaatttctatcraaggagagattgggataaaggtga

SEQ ID NO: 58698 - DNA, 50 bp, homo sapien
tttcaattctacagaattacactttwatgccctcaaatatgggaaaaaat

SEQ ID NO: 58699 - DNA, 50 bp, homo sapien
ttataaaagcctaaataataccatakgtttggtgactagaaaaagaatat

SEQ ID NO: 58700 - DNA, 50 bp, homo sapien
tcttgccgcagtgcattgaaccaaastgtgttgttaaattacttatccaa

SEQ ID NO: 58701 - DNA, 50 bp, homo sapien
gttgttaaattacttatccaacttcratatttggaggattatttcctttt

SEQ ID NO: 58702 - DNA, 50 bp, homo sapien
ccaccaggcccagcccaggtatttawctttctaaactctgttctatttct

SEQ ID NO: 58703 - DNA, 50 bp, homo sapien
atttccaggtcagatatcctgcaaartgcttttcataggagcttgtatac

SEQ ID NO: 58704 - DNA, 50 bp, homo sapien
caatctcatcagatctttataaacarctctgtaggatgaatattttattt

SEQ ID NO: 58705 - DNA, 50 bp, homo sapien
cataaaagcccatgagaatctcccawgttactccataagatatgtttgtt

SEQ ID NO: 58706 - DNA, 50 bp, homo sapien
cacactgaaactagtggcacctcttsaccttccacaaattattacccatg

SEQ ID NO: 58707 - DNA, 50 bp, homo sapien
tcaactattgcaatggtcaagggaamtgatcactcttccaatagatggct

SEQ ID NO: 58708 - DNA, 50 bp, homo sapien
aatcggaagcctgtagaggtgtttamgcaaagatacagtctggcggggtt

SEQ ID NO: 58709 - DNA, 50 bp, homo sapien
ttgaccattacccattggacactacyaatttcatgtattttcactgaatt

SEQ ID NO: 58710 - DNA, 50 bp, homo sapien
ttactcggtattcctttgagagagartagagatgagaaagtctaataaaa

SEQ ID NO: 58711 - DNA, 50 bp, homo sapien
ggggtgacagcactttggtatacgayagaaaataggtaggactggggaaa

SEQ ID NO: 58712 - DNA, 50 bp, homo sapien
agcagttaaaagacacaaaaaactargattgcaactatttttttttaagt

SEQ ID NO: 58713 - DNA, 50 bp, homo sapien
catacctgtaattaaaatatatgaamtggcatattgtacaatcaatgtaa

SEQ ID NO: 58714 - DNA, 50 bp, homo sapien
agagctttattaaacacaaccatgcraaatttccatacattttcaagatc

SEQ ID NO: 58715 - DNA, 50 bp, homo sapien
agaagaatcagaaaaaaatggaccaygcagtgttggagcattaataaggc

SEQ ID NO: 58716 - DNA, 50 bp, homo sapien
gttaggcacaacattgattttaggartagacgaattatctcttctgctac

SEQ ID NO: 58717 - DNA, 50 bp, homo sapien
cttgttatcaggcatttgtgacatayactcccttcatggccttccctagc

SEQ ID NO: 58718 - DNA, 50 bp, homo sapien
ctcagggaaggctgatagatggagayccaaaggcttaagaaaggaaaact

SEQ ID NO: 58719 - DNA, 50 bp, homo sapien
ctatgactaagtgcaatgaaaaataygaagaacatttccaagaagtacct

SEQ ID NO: 58720 - DNA, 50 bp, homo sapien
taataaacctcaaccacagtcaacarctttgaaactatggctaaaacttt

SEQ ID NO: 58721 - DNA, 50 bp, homo sapien
ccagataactcaaatcctcagactakagaaaaattattaagatttcttga

SEQ ID NO: 58722 - DNA, 50 bp, homo sapien
catctgcctgacttacggtctgttayctatgctaaaaaatctaccactgt

SEQ ID NO: 58723 - DNA, 50 bp, homo sapien
aggagcagaatactaataatgtgtgragcatttttatccataatgaaaag

SEQ ID NO: 58724 - DNA, 50 bp, homo sapien
cattgagccctttgccctactctacwacttttcaccagcaaatattcctt

SEQ ID NO: 58725 - DNA, 50 bp, homo sapien
cctttgacttgggttgctgatgtcaytgaacttaaataggcaactcagga

SEQ ID NO: 58726 - DNA, 50 bp, homo sapien
taacactgcgctagaatcatactgawcttttcattatggataaaaatgct

SEQ ID NO: 58727 - DNA, 50 bp, homo sapien
tagaggtagaaataattaatagttcrcggtaaaccaggttgaaaagcaga

SEQ ID NO: 58728 - DNA, 50 bp, homo sapien
tcctagtccctaagtctattttccawcttgtcacctaagctgtttttcta

SEQ ID NO: 58729 - DNA, 50 bp, homo sapien
tcaacctgaatgtttcatcattaaakagctccctgtccctttggttcaag

SEQ ID NO: 58730 - DNA, 50 bp, homo sapien
tcaggataaattcagattatgtataygtcctgggagttctgctttatctg

SEQ ID NO: 58731 - DNA, 50 bp, homo sapien
tggttttgagtaatactcaaagtacrataacctcaacaccatctagattc

SEQ ID NO: 58732 - DNA, 50 bp, homo sapien
tagtcaggataagcagagtgcatagyaattaattctgagaagctgccttc

SEQ ID NO: 58733 - DNA, 50 bp, homo sapien
gatactcatcagggatgaagaaagasaatacttagttcgaagctccacaa

SEQ ID NO: 58734 - DNA, 50 bp, homo sapien
tgacagggacagaacctggacctgaygactctaactcctgtcaatgaggg

SEQ ID NO: 58735 - DNA, 50 bp, homo sapien
atttgggaaaatgtttgagcacataygcaaaaataaatatacaaagagtg

SEQ ID NO: 58736 - DNA, 50 bp, homo sapien
cttctatttgccttcagcactctgawatttcacaatgatgtgagttaatt

SEQ ID NO: 58737 - DNA, 50 bp, homo sapien
ttctgttcactgcattctcttaccartgaggcccagtcttcagggaattg

SEQ ID NO: 58738 - DNA, 50 bp, homo sapien
ttccttagtatgaaatgaggagggcratcaataaaggaatggactcattt

SEQ ID NO: 58739 - DNA, 50 bp, homo sapien
ttgggtgattctgatgtgcctctagktttgatcattgatacagttcatca

SEQ ID NO: 58740 - DNA, 50 bp, homo sapien
ccaagttcctccttgaacaaagttasactaattggtctgtggattgttcc

SEQ ID NO: 58741 - DNA, 50 bp, homo sapien
ctcagtgtcatttgatggtatctcaytcttgaaaatgggccatgtcttga

SEQ ID NO: 58742 - DNA, 50 bp, homo sapien
gaaataggcacccactgaatctttayagtacacaaatatcttacatggcg

SEQ ID NO: 58743 - DNA, 50 bp, homo sapien
gtgattggtctcatgacctaactaasgaaaagcagaaagtcaaacgtgac

SEQ ID NO: 58744 - DNA, 50 bp, homo sapien
gactttccaagtcattgagctggacmctgaggtaggttgagccatatttg

SEQ ID NO: 58745 - DNA, 50 bp, homo sapien
tgaaaaccaaaaccatatttccatarcaaatgcgtgtataaaggcccatg

SEQ ID NO: 58746 - DNA, 50 bp, homo sapien
tttgcctggccagcactgaaaaatakgtagagtggcccatttgaaatcag

SEQ ID NO: 58747 - DNA, 50 bp, homo sapien
cattagttaactctgtgatcttggaygtgtaaaacttaaaacttcctgaa

SEQ ID NO: 58748 - DNA, 50 bp, homo sapien
gttttgactatcataaatgagaagaragatatttggtgtataaaatgtga

SEQ ID NO: 58749 - DNA, 50 bp, homo sapien
aaaatctagcaaaaaaaaagcagtargacttggtgatcaagttggctata

SEQ ID NO: 58750 - DNA, 50 bp, homo sapien
ttattaggatatcttcagagtgaaaytgtatactagtaaaaaatagtaat

SEQ ID NO: 58751 - DNA, 50 bp, homo sapien
ctcaggagaaatgtaccatcggctcwaaactagtaatgaaactactaatc

SEQ ID NO: 58752 - DNA, 50 bp, homo sapien
tgcttgctaatccaatggtctccaastcctgcaatccattcccttctttg

SEQ ID NO: 58753 - DNA, 50 bp, homo sapien
tttggggaacacattcagttcataamacaacctaatctctaaaaggcagc

SEQ ID NO: 58754 - DNA, 50 bp, homo sapien
aaaaagaaaaaaaagaagtaagctargagaaaaaagagctggggactagc

SEQ ID NO: 58755 - DNA, 50 bp, homo sapien
tttcatatgaagattccatggtcttkgttcattttcacccattttaggtt

SEQ ID NO: 58756 - DNA, 50 bp, homo sapien
ttcagtattgtttcactgataagaaytgttataatttaaagatcattgca

SEQ ID NO: 58757 - DNA, 50 bp, homo sapien
ttatttcctggtgtggaagtatttcrcagagaagcggaagttccaggatg

SEQ ID NO: 58758 - DNA, 50 bp, homo sapien
aaacaaaagaaattcagtcactggtyaaaagccaaaaggtttccagggtt

SEQ ID NO: 58759 - DNA, 50 bp, homo sapien
tttgtgtcttagcgtctttgtattakgagtacttagcacagggccctcac

SEQ ID NO: 58760 - DNA, 50 bp, homo sapien
ggacgtacatagttactaaacgccayatttttgattttgaagttttatct

SEQ ID NO: 58761 - DNA, 50 bp, homo sapien
aatgactcattaaggctcttaccaamcagtggaaataaaaatagaattgg

SEQ ID NO: 58762 - DNA, 50 bp, homo sapien
aacattcaaggattgcatatgcatamaggagttttacatccctaaaggat

SEQ ID NO: 58763 - DNA, 50 bp, homo sapien
ccaggaaaaggacagttagaaaagtyaaatagttgctatgttttggtttt

SEQ ID NO: 58764 - DNA, 50 bp, homo sapien
tatttttaagctaaagaataaaaccmaaacatagcaactatttaactttt

SEQ ID NO: 58765 - DNA, 50 bp, homo sapien
gccccaggctattgtcattactttcraccccatctgtttcaacttgaatt

SEQ ID NO: 58766 - DNA, 50 bp, homo sapien
acataagaaaaattatagaaaagagmaccaatgcataccgacaaaagtga

SEQ ID NO: 58767 - DNA, 50 bp, homo sapien
ttctaaaatgggctaatagaataaartagatatggtggacatgaagcatt

SEQ ID NO: 58768 - DNA, 50 bp, homo sapien
tgtcactgagaccacttagggaagamaattcctttgcctaagggattgaa

SEQ ID NO: 58769 - DNA, 50 bp, homo sapien
tgctaataaacatgcttaataagtayccatgaagattttaactaacacat

SEQ ID NO: 58770 - DNA, 50 bp, homo sapien
acacaccaaatcatgcaagaagttcyattgggatgaaaattgataggaat

SEQ ID NO: 58771 - DNA, 50 bp, homo sapien
cctccatgaaagggtttgaagacaayagacatttatgctaagggtaatat

SEQ ID NO: 58772 - DNA, 50 bp, homo sapien
ataattctaatggcacttataataamaacaacaatagaaatatcaacaat

SEQ ID NO: 58773 - DNA, 50 bp, homo sapien
aattatttttacaatgtcttacaatyatctgatgacaagtgctatgctta

SEQ ID NO: 58774 - DNA, 50 bp, homo sapien
atgcttagcttcagcagcccgcaaaygtaatcacccaacgttacacaaac

SEQ ID NO: 58775 - DNA, 50 bp, homo sapien
ctcaaagttccaagatgactatcacsctctttcttggtttgatatcactg

SEQ ID NO: 58776 - DNA, 50 bp, homo sapien
agggcctagatccttcctgtccaaastaattcagtggggaggagtcatgg

SEQ ID NO: 58777 - DNA, 50 bp, homo sapien
tggcacttggaaaaggagaagtaaaygagaatgatagcagagcatatagt

SEQ ID NO: 58778 - DNA, 50 bp, homo sapien
aatcatcctctagaatggcatactgragattttacatattgaaaagaatg

SEQ ID NO: 58779 - DNA, 50 bp, homo sapien
aatttgttttaaaaaatggaggcaamaatatttggttattcttggacaaa

SEQ ID NO: 58780 - DNA, 50 bp, homo sapien
tatgggtaacataaatacctattcgraacaataattaagctgggtcttca

SEQ ID NO: 58781 - DNA, 50 bp, homo sapien
gaatatataaactttgaagcaagtasattaaagagtcaaatcactataat

SEQ ID NO: 58782 - DNA, 50 bp, homo sapien
tttgttcatttgctaagtaagaatgmatatagtccatcgggagaaactca

SEQ ID NO: 58783 - DNA, 50 bp, homo sapien
tgataggaatagattagatttattayctggatgattttacagatgcctac

SEQ ID NO: 58784 - DNA, 50 bp, homo sapien
tagtaagaaccaaagttggaaaagtraattgggatcagaatttggtgagt

SEQ ID NO: 58785 - DNA, 50 bp, homo sapien
tgtgaattgcatcatattacaattawgtttacctgtatctcttgacctta

SEQ ID NO: 58786 - DNA, 50 bp, homo sapien
agtctttatcttacttagttctcaamactctataaagcagttattttaat

SEQ ID NO: 58787 - DNA, 50 bp, homo sapien
aggtataagacagtaaacactgcaartgcctaaagatagtgaggaaatgt

SEQ ID NO: 58788 - DNA, 50 bp, homo sapien
aataataacatttcctcatcactgargaggacctagtatatgtcaacact

SEQ ID NO: 58789 - DNA, 50 bp, homo sapien
ttgcacaacataagagtctaaggaayctttgttggacagaagtatgaatg

SEQ ID NO: 58790 - DNA, 50 bp, homo sapien
aataattactgtctttacctggtagraaattatattgtgcttgtaagaca

SEQ ID NO: 58791 - DNA, 50 bp, homo sapien
gctctcaggaattatgctaattttakgtaaatcttgatagtctcttatct

SEQ ID NO: 58792 - DNA, 50 bp, homo sapien
aaaagaatagggagaagagagaatakgtataggtataatgtggtatacgt

SEQ ID NO: 58793 - DNA, 50 bp, homo sapien
gcatgagtaactcaaaccactactamttccaggtcagacttacccatgga

SEQ ID NO: 58794 - DNA, 50 bp, homo sapien
aatagataactatttttaaggttcasgaatcgaaagaaataggtataaac

SEQ ID NO: 58795 - DNA, 50 bp, homo sapien
gcaacctatagcataagagggaacaygtagatgcgtgcatgtgtataaat

SEQ ID NO: 58796 - DNA, 50 bp, homo sapien
tcagttctaatagttagaaaaataaraatgaacagcggtatctatttact

SEQ ID NO: 58797 - DNA, 32 bp, homo sapien
gtgttcagaaagcataycacttattaaaatgg

SEQ ID NO: 58798 - DNA, 50 bp, homo sapien
tcaaagaaagctgtctttaacattaraacaatcaaagtccaattcagagt

SEQ ID NO: 58799 - DNA, 50 bp, homo sapien
tccctttgaaaatgaaatgtgatagkcaaatttgtgatgctaaagaaggt

SEQ ID NO: 58800 - DNA, 50 bp, homo sapien
aagaaaacaattgagaaatataaaaraataggagcatttcataatgccaa

SEQ ID NO: 58801 - DNA, 50 bp, homo sapien
aacaatggacattgggcatacagaaracataccgaagaccagaatatttg

SEQ ID NO: 58802 - DNA, 50 bp, homo sapien
attcccttgataagaatgaatgacartattttccaaatgttcaagtgaac

SEQ ID NO: 58803 - DNA, 50 bp, homo sapien
tggcaaggatcatgagacatgtttamgtttgcactctttctctagagggg

SEQ ID NO: 58804 - DNA, 50 bp, homo sapien
ccaagcacaaggttcactatgactaygcgactattgtaacaaagctaaag

SEQ ID NO: 58805 - DNA, 50 bp, homo sapien
tgagattgcatgaagaatatgagtcsaaggccctaaacaataaagagagt

SEQ ID NO: 58806 - DNA, 50 bp, homo sapien
atagcggggtaagtaacttcctcaargttgcaaagaagatgggagaatct

SEQ ID NO: 58807 - DNA, 50 bp, homo sapien
caagggatttatttcctctgtaagayatttttgggttttgtttatttttt

SEQ ID NO: 58808 - DNA, 50 bp, homo sapien
actttttaagaaaaaagattctcagraagacccagaagcaaacctagggt

SEQ ID NO: 58809 - DNA, 50 bp, homo sapien
tatactactgatttaatctccttacwagacaggtctgcttggattttcta

SEQ ID NO: 58810 - DNA, 50 bp, homo sapien
ggcaatcttctgtgatttttaacaaygatttgtggaagtgcatctggtaa

SEQ ID NO: 58811 - DNA, 50 bp, homo sapien
taatatacattcactcaagtgttaastgatacaaacaaattaatgagtca

SEQ ID NO: 58812 - DNA, 50 bp, homo sapien
tgaattttgatggtgaaaagtcaaarcatgatgatgcatagcctttgact

SEQ ID NO: 58813 - DNA, 50 bp, homo sapien
agcaaatgcattttgtgattgttaayaggtttgcaagcactccaacaaaa

SEQ ID NO: 58814 - DNA, 50 bp, homo sapien
atagacttttagaaaagaaggccacygtatatcaaccattaaaccaaagt

SEQ ID NO: 58815 - DNA, 50 bp, homo sapien
cttcttttctaaaagtctatatagarcataagcttctgagataaaacatt

SEQ ID NO: 58816 - DNA, 50 bp, homo sapien
tttggattttaaaaaatcctactatragtcagacctatgagtcaaagata

SEQ ID NO: 58817 - DNA, 50 bp, homo sapien
agcacctgtgtttagttggctcttaygtatttggcattaaaccgaatcac

SEQ ID NO: 58818 - DNA, 50 bp, homo sapien
agtagttctattttcctggagatgayagtacataaacagagcaatgaaac

SEQ ID NO: 58819 - DNA, 50 bp, homo sapien
ctcctagaaatatatgtgttttgaaratactaacgcacaaaaaaagaaag

SEQ ID NO: 58820 - DNA, 50 bp, homo sapien
tcaaagaaatcagggcacttaagacmctagtagaaccatacaaaggctta

SEQ ID NO: 58821 - DNA, 50 bp, homo sapien
cggttttagctctaaagtatctccaygaggttggtcattggctgaggttg

SEQ ID NO: 58822 - DNA, 50 bp, homo sapien
aaggcatattcctaagaatagaaagraggttagtgtaggtggcaggtgga

SEQ ID NO: 58823 - DNA, 50 bp, homo sapien
tgatgaaacaaccaaagagcttagtyggatttgagggaaaagaggcaagg

SEQ ID NO: 58824 - DNA, 50 bp, homo sapien
caatgaagtgagaagttttcatctcmaaaattttaagctcttgagaacac

SEQ ID NO: 58825 - DNA, 50 bp, homo sapien
gatttcaaaacacattgggtattgayagttcaaaaatctaaaaagcaggc

SEQ ID NO: 58826 - DNA, 50 bp, homo sapien
tgctaagcttattcagactttaccaygtgggtgatgaggaagggaatgac

SEQ ID NO: 58827 - DNA, 50 bp, homo sapien
ttagctataatttggcagagaagtaytaactgtgctaaaagaagtatgtg

SEQ ID NO: 58828 - DNA, 50 bp, homo sapien
atgaaaaaattgtgactgcagagtaygattctgtgataacccatgggact

SEQ ID NO: 58829 - DNA, 50 bp, homo sapien
agcaaaaccattcattattgcttcargtttaaattatgcccgaaacattg

SEQ ID NO: 58830 - DNA, 50 bp, homo sapien
cctgtataagataaagatgagtaaawcaaactgtagcttccactgctgca

SEQ ID NO: 58831 - DNA, 50 bp, homo sapien
atactgatgccagctattttttaaarcacgattcttatcatgttactccc

SEQ ID NO: 58832 - DNA, 50 bp, homo sapien
aaaagcaaggtcacacatttctatakcaacatgtatgcacacttccttgg

SEQ ID NO: 58833 - DNA, 50 bp, homo sapien
aaaacagaatgcacataagaaaaaayggaagatgataaggatgtgagcag

SEQ ID NO: 58834 - DNA, 50 bp, homo sapien
cttgagttgttagccatattattgcrgacctgttagatgtgtcaaaatct

SEQ ID NO: 58835 - DNA, 50 bp, homo sapien
atgacctcagctggaacagcaatgcrtgtggtggtgtaatgaccccagct

SEQ ID NO: 58836 - DNA, 50 bp, homo sapien
ccagttggatatcttttaacattacyaccaccaacatgaacaattaagcc

SEQ ID NO: 58837 - DNA, 50 bp, homo sapien
actaagttggagccttaattctcacyatataaaaacaaacttcatataat

SEQ ID NO: 58838 - DNA, 50 bp, homo sapien
cataacttttatatgcactggaaaaycaaaagaatcatgtgacctgcttt

SEQ ID NO: 58839 - DNA, 50 bp, homo sapien
gcaagttaactaaagaattgaatgawgtttcttctgaatgtgtgagaggc

SEQ ID NO: 58840 - DNA, 50 bp, homo sapien
gttctctcactgttcagcatatgtamgtcaaagacagaagtgcatgaaga

SEQ ID NO: 58841 - DNA, 50 bp, homo sapien
agataacatttatgttatcttatgamggtgatcctagagtgttgcactga

SEQ ID NO: 58842 - DNA, 50 bp, homo sapien
gtttaacattcttactatgttaccayacttcctctaaaccactccttcag

SEQ ID NO: 58843 - DNA, 50 bp, homo sapien
aaattagtgtaccattttgataatayaccaggatttatagaaaattagtt

SEQ ID NO: 58844 - DNA, 50 bp, homo sapien
taagaattattttgttttataggaaraaatctaggctaaattcaaaaggc

SEQ ID NO: 58845 - DNA, 50 bp, homo sapien
tgaactattttccagtcgaattgaargctctaaaatgcaaacatgctaag

SEQ ID NO: 58846 - DNA, 50 bp, homo sapien
gtttaacccctcagagtctccctcakctcttgcatggtatggtagctttt

SEQ ID NO: 58847 - DNA, 50 bp, homo sapien
agttgtgtggcagtcatacctcttaygggaatactaaccaggtcatccaa

SEQ ID NO: 58848 - DNA, 50 bp, homo sapien
aagtcttactattgatgtttttcctyactatcatcctttgtaccatcaaa

SEQ ID NO: 58849 - DNA, 50 bp, homo sapien
aaaccctggaagcagttcaatcccartagtttcttgatctataaatccag

SEQ ID NO: 58850 - DNA, 50 bp, homo sapien
tcttagacaaggcattatgcaaccaygggataagtgcggttctagaagcc

SEQ ID NO: 58851 - DNA, 50 bp, homo sapien
tttgtgggttatcaggatcaaagaaracttcgatatttatcaaaaaattt

SEQ ID NO: 58852 - DNA, 50 bp, homo sapien
tgattgtaactaattggcatgactayctctttggcatacctcttggtgac

SEQ ID NO: 58853 - DNA, 50 bp, homo sapien
tgcaacacaggaagtatcacgatttmtcttcctttttcaggctgtactca

SEQ ID NO: 58854 - DNA, 50 bp, homo sapien
atttatcatttatcagttgccaacartatatcactctgagttatgtgcat

SEQ ID NO: 58855 - DNA, 50 bp, homo sapien
tgaatgctcttcatttttctaagcgyatttagagctatcagaaagagaca

SEQ ID NO: 58856 - DNA, 50 bp, homo sapien
gtttcacctgttaagatctgaaaaaytgcaggccaagaacattaacaggt

SEQ ID NO: 58857 - DNA, 50 bp, homo sapien
gtttaaaaaaacataattgagctagmaacaatccaaatatgtaccaatgt

SEQ ID NO: 58858 - DNA, 50 bp, homo sapien
aattctgttaatctgcatttagaccrcctacttcctactcaaagagttca

SEQ ID NO: 58859 - DNA, 50 bp, homo sapien
ctgggaaggagttgttttggacaggraaattaagttttgttctgtacact

SEQ ID NO: 58860 - DNA, 50 bp, homo sapien
cagagctttctcacagtatttattamcaaatggaaaagtgtcagtttctg

SEQ ID NO: 58861 - DNA, 50 bp, homo sapien
cctaagattcccaggattagtctccrtggctgattcactacatttaacaa

SEQ ID NO: 58862 - DNA, 50 bp, homo sapien
atttttcctacatccttaggtaaaaytgaacttccttgaaagcagagacc

SEQ ID NO: 58863 - DNA, 50 bp, homo sapien
aaactgcacaaatatgaggtgtagargtcaatgaagttttatatatgtgt

SEQ ID NO: 58864 - DNA, 50 bp, homo sapien
cagcagctgcctaagctaataatacygtacacaagatttatatcatcttc

SEQ ID NO: 58865 - DNA, 50 bp, homo sapien
ggcaaatcatcttctaatatcagttwtaaggactagattaaataggttga

SEQ ID NO: 58866 - DNA, 50 bp, homo sapien
tcattgaagaacaatggacatccacyggtagtattcaaaaataacagagg

SEQ ID NO: 58867 - DNA, 50 bp, homo sapien
agcacatctgcaggaataactattasaatcagcattgcagagacccatgg

SEQ ID NO: 58868 - DNA, 50 bp, homo sapien
cctgcagctaaccatgacccacttayagagaatatgctgttgtacaaatc

SEQ ID NO: 58869 - DNA, 50 bp, homo sapien
ttccttcccatctttgtctggataaytcttattcttctttgaaaatcaag

SEQ ID NO: 58870 - DNA, 50 bp, homo sapien
gaaatatgtcattactttttacaaaytggaagtgaggaagagtagataag

SEQ ID NO: 58871 - DNA, 50 bp, homo sapien
tctgatttatgcagtaaggaatatamgataggcattaaaaataaggtgca

SEQ ID NO: 58872 - DNA, 50 bp, homo sapien
atttttaattaggtcatccttggaartaatagtttgaataattaattgaa

SEQ ID NO: 58873 - DNA, 50 bp, homo sapien
caccatgtgcaagttatctgaagaamgaaaccttgtctctcttttcatgg

SEQ ID NO: 58874 - DNA, 50 bp, homo sapien
tgcttaatacattgctgagaacatamgaggcaccccatgaatccttgcag

SEQ ID NO: 58875 - DNA, 50 bp, homo sapien
aagtgtaggtcactctgacagtataygttaggacctgaactactgggggt

SEQ ID NO: 58876 - DNA, 50 bp, homo sapien
ttgaggggaccatcctttcttcaatrtaagttctcagcacattagtcaaa

SEQ ID NO: 58877 - DNA, 50 bp, homo sapien
tactaaccaaataatttttttcagtraagtaggagtaatgtaatagttat

SEQ ID NO: 58878 - DNA, 50 bp, homo sapien
ttacttcatagggtcgttgggaggayaaactataaagcatttagaacagt

SEQ ID NO: 58879 - DNA, 50 bp, homo sapien
catttgctgaaactttgtgatgataraaactttttcttaaatttcaggct

SEQ ID NO: 58880 - DNA, 50 bp, homo sapien
aaactgataaacctaccattaataasaaatgttgaagtctccattattat

SEQ ID NO: 58881 - DNA, 50 bp, homo sapien
tgaaaaccacgtctcttgcccactcrataactctcaaaataaccttggga

SEQ ID NO: 58882 - DNA, 50 bp, homo sapien
gtaagatagagatgtatgtttattaygtagaagaagtacagagttggcac

SEQ ID NO: 58883 - DNA, 50 bp, homo sapien
tgagctagagaattgcaagtagtaasgtgaaaagtaagaggggaacgaag

SEQ ID NO: 58884 - DNA, 50 bp, homo sapien
cctccttgtccacttacggtgactcratacattcaagttccacccacagg

SEQ ID NO: 58885 - DNA, 50 bp, homo sapien
catccttaagaaaaaaattgccaaargtaaagcatgagatggattttaaa

SEQ ID NO: 58886 - DNA, 50 bp, homo sapien
acctaccactaatatgcattctttastaagcggtctcaatatacaccgat

SEQ ID NO: 58887 - DNA, 50 bp, homo sapien
ggcctctcaaaagaggctgtgctttyataagagcaaaatgctttttgttc

SEQ ID NO: 58888 - DNA, 50 bp, homo sapien
tgccccactggcccatattgagtgasacctgttaagaaaagtcccaccag

SEQ ID NO: 58889 - DNA, 50 bp, homo sapien
taaagagttattagaatgtatgcctyaaaaaaacaagaaatacaccaaga

SEQ ID NO: 58890 - DNA, 50 bp, homo sapien
ctgctgcatttccttcttgagaactyaggaacagagaagcctccagcatt

SEQ ID NO: 58891 - DNA, 50 bp, homo sapien
catattttttaactttacatccttcwcataggagtttgttttgttttgtt

SEQ ID NO: 58892 - DNA, 50 bp, homo sapien
attttgttgggtatgatcatagcatsgtgattttgttaaaacaagttctt

SEQ ID NO: 58893 - DNA, 50 bp, homo sapien
tccacctgtggccattttactgctaygtctctcaggtctcttttcatctc

SEQ ID NO: 58894 - DNA, 50 bp, homo sapien
ctggagtgaaagagtgagtttccackgtgaaagattccttgaaaaggccc

SEQ ID NO: 58895 - DNA, 50 bp, homo sapien
aaatacattttcaagatacttggagrataacagaagatatgatagctata

SEQ ID NO: 58896 - DNA, 50 bp, homo sapien
gaccataatcatgatccatctattcyaagtatcccaaccccctttctcat

SEQ ID NO: 58897 - DNA, 50 bp, homo sapien
aatcattatcagttagaagataactrgcagtgttcctggaagactcacgg

SEQ ID NO: 58898 - DNA, 50 bp, homo sapien
aatggagagccactgaaaggcttaasgcacagagagtaacgtaataagaa

SEQ ID NO: 58899 - DNA, 50 bp, homo sapien
tttcgtggtgctcaaatactttaacyacagtgtcaatgcacatggttttt

SEQ ID NO: 58900 - DNA, 50 bp, homo sapien
catttagatcattcctacgtatgtgraaaaattacatcaccacccagtgt

SEQ ID NO: 58901 - DNA, 50 bp, homo sapien
atataacactctatatttaaaaggastaccataataaatgagaaaaaatg

SEQ ID NO: 58902 - DNA, 50 bp, homo sapien
cccattcaagtggtaagcttctgaawccttatcaaacatacccagagtag

SEQ ID NO: 58903 - DNA, 50 bp, homo sapien
catttggaatctactttcaatatcaygctcaggccaggcatggtggctca

SEQ ID NO: 58904 - DNA, 50 bp, homo sapien
taccagttaattattctttgcctaastaaaagccttccctcagttgttat

SEQ ID NO: 58905 - DNA, 50 bp, homo sapien
ggatatatccatttcctataccaaartgtgttattaaagaactataaaat

SEQ ID NO: 58906 - DNA, 50 bp, homo sapien
aaagataaatgatttgttccttgaarcttaattctgttagcctagatttt

SEQ ID NO: 58907 - DNA, 50 bp, homo sapien
ccaagctttgtaggacacagtaagargttcaatgaaagccactggagagt

SEQ ID NO: 58908 - DNA, 50 bp, homo sapien
cattaatggggatacagccagggtcrttgccatcccacaaccatcaggga

SEQ ID NO: 58909 - DNA, 50 bp, homo sapien
acataaaactaatagcctgaatgacrgacccagtggatatgacttgcttg

SEQ ID NO: 58910 - DNA, 50 bp, homo sapien
atatatgtgcttcatttataagtggycaactaagcttatggtgggagaaa

SEQ ID NO: 58911 - DNA, 50 bp, homo sapien
catttaaatttgctttagggagacckcaatgttgtacaaagataagtagt

SEQ ID NO: 58912 - DNA, 50 bp, homo sapien
tccagaagaaacaaacatttattgasaacttttggtgtgtgacctgttta

SEQ ID NO: 58913 - DNA, 50 bp, homo sapien
taagtcctacatctcatttaaggacyggtcaatgttaggctaggcaatgc

SEQ ID NO: 58914 - DNA, 50 bp, homo sapien
ccaggcttaagtgacaccacgctgaygagatattaataatgatcttaaaa

SEQ ID NO: 58915 - DNA, 50 bp, homo sapien
ccacccatggttgtcaaagtggctawcacccatgtgaacaggtggcctag

SEQ ID NO: 58916 - DNA, 50 bp, homo sapien
gcttccacatctttgctattccctcyatttgaaatgcctttatctcagcc

SEQ ID NO: 58917 - DNA, 50 bp, homo sapien
ggcggagttcttcatggtgtatgacmctcagaaacattgacccctggctg

SEQ ID NO: 58918 - DNA, 50 bp, homo sapien
tgcctgtaaaagagtatagagagaasttagcccaggatgacaacatattt

SEQ ID NO: 58919 - DNA, 50 bp, homo sapien
tatggttacagctaaaacttttagaygcttatgttttcatgtgcagagag

SEQ ID NO: 58920 - DNA, 50 bp, homo sapien
caaaaagtttgcaatttatggccagsaaattaattacaaaatagataaac

SEQ ID NO: 58921 - DNA, 50 bp, homo sapien
gtccctaagtggaggccttaggccaygatctggagccactctcctacagc

SEQ ID NO: 58922 - DNA, 50 bp, homo sapien
atggaggtcaaaaacagctgttgcargaatctaatcctacctcataataa

SEQ ID NO: 58923 - DNA, 50 bp, homo sapien
cacaaaagaaactggagtatgagacraaccacaaataatagcatgcagtg

SEQ ID NO: 58924 - DNA, 50 bp, homo sapien
ataaaccatgctaatgtgaccatagrcaaaataataatcaactatttcta

SEQ ID NO: 58925 - DNA, 50 bp, homo sapien
ttgtatgactgtttctagcttaaatsagtactttattagtatttttgctt

SEQ ID NO: 58926 - DNA, 50 bp, homo sapien
ttgaataaaaattttatttacaggcraattgtttaaaatggtgaagcaaa

SEQ ID NO: 58927 - DNA, 50 bp, homo sapien
ttgagattaattctgaaataatgaayagcctaagttctaatttttgaata

SEQ ID NO: 58928 - DNA, 50 bp, homo sapien
gaagtttatgagccagagagtggtayggtcaaagccagatgattgaagaa

SEQ ID NO: 58929 - DNA, 50 bp, homo sapien
taaattctgatagtcaaacttcttcmctaaattttcaaaccactgaccct

SEQ ID NO: 58930 - DNA, 50 bp, homo sapien
tgtctcagtcatttgtgtcattgtamgggttttgttttgctctgtttgga

SEQ ID NO: 58931 - DNA, 50 bp, homo sapien
ttaattatcacttcaggtagtaaatyagtttctcctatgtgaaaggaatg

SEQ ID NO: 58932 - DNA, 50 bp, homo sapien
attttcctttccctcttttagtataygaggtttcctctgatgatgggcag

SEQ ID NO: 58933 - DNA, 50 bp, homo sapien
tatttcagttcaaagtgtaatgcctyaaacatcaacaactctgaagtatt

SEQ ID NO: 58934 - DNA, 50 bp, homo sapien
aaggtatgaaagtatagatgagcaartaagggcagataccaggggatttg

SEQ ID NO: 58935 - DNA, 50 bp, homo sapien
tggagatgtgccctgggtgattccartgaagagccactatcaagaaccac

SEQ ID NO: 58936 - DNA, 50 bp, homo sapien
tcactgctgcaattatatacaatttwaaaagccttcagaaaatccttagt

SEQ ID NO: 58937 - DNA, 50 bp, homo sapien
aattgtgttgaataaattaaaaagaraagtcttgagctgaaacaaattcc

SEQ ID NO: 58938 - DNA, 50 bp, homo sapien
aatcaaggacctttgtccgtgctackaaataatgtccgtgatatcacaca

SEQ ID NO: 58939 - DNA, 50 bp, homo sapien
agaaacagagagtggtaaattatgarcatcttgttggaggcagagcccca

SEQ ID NO: 58940 - DNA, 50 bp, homo sapien
aattggaaagtcagataaatggtgcrattaaaatttttttttcctttcta

SEQ ID NO: 58941 - DNA, 50 bp, homo sapien
ttggctaagccctttccacatattaygtcatttaactctttccctcataa

SEQ ID NO: 58942 - DNA, 50 bp, homo sapien
agaagatgagcttggactaactagaygatggttggtggccatgtgaagtt

SEQ ID NO: 58943 - DNA, 50 bp, homo sapien
tttctgctgctggataaaagcccaamggaacttgacaaaaaaaatcccat

SEQ ID NO: 58944 - DNA, 50 bp, homo sapien
ctgagatctgactcaaagaaaggaamagtgtatgcagtgttatactgggc

SEQ ID NO: 58945 - DNA, 50 bp, homo sapien
actttaagttagtaaatttgatggaygcacagtcataaaaattccaaagt

SEQ ID NO: 58946 - DNA, 50 bp, homo sapien
tctcttcatttaaatagattatcaartacttacaatcagtcttcatttaa

SEQ ID NO: 58947 - DNA, 50 bp, homo sapien
atcatgatgagaacttctgaaaccgratacagttaaatataaggacagaa

SEQ ID NO: 58948 - DNA, 50 bp, homo sapien
atactgggctagttctagtactcaargaaaaagaaatagtactttccatc

SEQ ID NO: 58949 - DNA, 50 bp, homo sapien
cattgttagttttggtacatatttarcagaggagttcaggcagatgaatt

SEQ ID NO: 58950 - DNA, 50 bp, homo sapien
agacactaatctgaggtttggaaagsaaaatactaccaccatcatcacac

SEQ ID NO: 58951 - DNA, 50 bp, homo sapien
aggaaccgagttaaatagatttttcycaattacaataactttgcattgct

SEQ ID NO: 58952 - DNA, 50 bp, homo sapien
ggctgaacctgtttttttaaaaaaaygatgtctggtgtgaatgactttga

SEQ ID NO: 58953 - DNA, 50 bp, homo sapien
ttatagaaataaatatttgaatatakaagtacagctaagaaaataaacat

SEQ ID NO: 58954 - DNA, 50 bp, homo sapien
gctttgaatttaaggacatcagaaastatttttaagtacctgacagataa

SEQ ID NO: 58955 - DNA, 50 bp, homo sapien
tttgacttgatcttctgttctaaaasattggtgaggctggaaaatgaagt

SEQ ID NO: 58956 - DNA, 50 bp, homo sapien
ttattcactcaatctctctctaaaakatctcatttcttctcagactttca

SEQ ID NO: 58957 - DNA, 50 bp, homo sapien
agcaagaaatgagtgcagattcaaaytgtctgctggactccaaaaatgat

SEQ ID NO: 58958 - DNA, 50 bp, homo sapien
gcttgggtggctgcagctatgcctgragctcatgcctgctcccactcctc

SEQ ID NO: 58959 - DNA, 50 bp, homo sapien
aagattttgctttgacacaagatacygcaaagattttcagacatggctcc

SEQ ID NO: 58960 - DNA, 50 bp, homo sapien
aaaagaaagcgcacaagtgaatttasaaataaatatcaataaattctaaa

SEQ ID NO: 58961 - DNA, 50 bp, homo sapien
atgccccatagagggaagattaaaakagacaaacaattagtaagacagga

SEQ ID NO: 58962 - DNA, 50 bp, homo sapien
ccttccagattcttttctatgcatawgtcacctaaaacaaaacagaaaaa

SEQ ID NO: 58963 - DNA, 50 bp, homo sapien
attcagaatttttcaaaagccagtayacttctacatctttatttttattt

SEQ ID NO: 58964 - DNA, 50 bp, homo sapien
gttttctaggaacaaatggtatagartatcaggtgaactgagggctaact

SEQ ID NO: 58965 - DNA, 50 bp, homo sapien
aaaatgttacggaagataatgattcmaaagaacctagagaagttggtgtt

SEQ ID NO: 58966 - DNA, 50 bp, homo sapien
ctgtaacaattacatacatctctaasaagtacaactatattatgtctgta

SEQ ID NO: 58967 - DNA, 50 bp, homo sapien
ttctattattaagaacatggaagaartctattattaagtacaatcaagaa

SEQ ID NO: 58968 - DNA, 50 bp, homo sapien
attttacttatgaggaattagaagaygatccagagaagaacatttgagct

SEQ ID NO: 58969 - DNA, 50 bp, homo sapien
aaaatggaagcaactgtgtgttcaayagagaatttgttaactaagttatg

SEQ ID NO: 58970 - DNA, 50 bp, homo sapien
agaagcgtctcatactgtagctaaayggaattggtatttcatccaatgta

SEQ ID NO: 58971 - DNA, 50 bp, homo sapien
attattacaaattaatgtcctaacckaaatattcttagtccaaaccatct

SEQ ID NO: 58972 - DNA, 50 bp, homo sapien
aattactccatgctatgagattacayggggagcagatgaaggcagaataa

SEQ ID NO: 58973 - DNA, 50 bp, homo sapien
gcccaggaagggtgcctgtaccaagytggtccaatcagagttcttcctgg

SEQ ID NO: 58974 - DNA, 50 bp, homo sapien
catgtaatctcatagcatggagtaawttaaaagaaatattgttcctatgt

SEQ ID NO: 58975 - DNA, 50 bp, homo sapien
gcatttgccatttaagttgactatasagctaagaactaactataattttc

SEQ ID NO: 58976 - DNA, 50 bp, homo sapien
attgtttcctgtttagtgtatttagyatattgaaatggtaaaaacagggc

SEQ ID NO: 58977 - DNA, 50 bp, homo sapien
caagcatacatgcacttctctgacaytaggctgaatcttagggtggaaca

SEQ ID NO: 58978 - DNA, 50 bp, homo sapien
aaagtatagttatgaaggtcatgtayagggaaatataggaaagaggtatg

SEQ ID NO: 58979 - DNA, 50 bp, homo sapien
atatttattgatgcttactgtatgamaatcactattccagtaatgaagat

SEQ ID NO: 58980 - DNA, 50 bp, homo sapien
gacaaaaattcttgcctttgtggaamttaaatgctagcagtatgtatata

SEQ ID NO: 58981 - DNA, 50 bp, homo sapien
gtccctgaataaggatttcaagaaarcatttttgtcctttattagcaaat

SEQ ID NO: 58982 - DNA, 50 bp, homo sapien
catgggagctagctggcactttatckcaaaagcatttagagggctgatgg

SEQ ID NO: 58983 - DNA, 50 bp, homo sapien
agagcacctttgtgccccagcataayggtcggaggagcagcagatcattc

SEQ ID NO: 58984 - DNA, 50 bp, homo sapien
ttatatcattttagcttcaattccayaaattagatctaaacattctatac

SEQ ID NO: 58985 - DNA, 50 bp, homo sapien
agcttatgttgtgataggaaactccsgaacctagcacagctgtatatatt

SEQ ID NO: 58986 - DNA, 50 bp, homo sapien
gtggcccactgctcctctaaaatagrcctgtttctgtataagaacctggt

SEQ ID NO: 58987 - DNA, 50 bp, homo sapien
ctagggcatgcactgttcttttgtarattctccttaagatggtgctgctc

SEQ ID NO: 58988 - DNA, 50 bp, homo sapien
ttcctagtccaacaacagtaggttartactcagaatgtttggtcaatttt

SEQ ID NO: 58989 - DNA, 50 bp, homo sapien
ttgtcatagaggaaataaaaatagarcagcaccatcttaaggagaattta

SEQ ID NO: 58990 - DNA, 50 bp, homo sapien
gcaattagagaagctataaggaaaamcagaaacttactaatagaaggaaa

SEQ ID NO: 58991 - DNA, 50 bp, homo sapien
ctgaaaaactttagataataaaaaaygaaggtcagtggtaacacacactg

SEQ ID NO: 58992 - DNA, 50 bp, homo sapien
cattttggaacaatcaagtaggaaakgttacagaggctaatggctatgtt

SEQ ID NO: 58993 - DNA, 50 bp, homo sapien
aggagtcagatctcatatccaataaycacttaagtcctgtgggattttat

SEQ ID NO: 58994 - DNA, 50 bp, homo sapien
cagaacagaagagaaagaaatgttaraagtagcagaaagctaggagataa

SEQ ID NO: 58995 - DNA, 50 bp, homo sapien
aactttatgtaaagatatagattggkagtcatcagataagtactgtaatt

SEQ ID NO: 58996 - DNA, 50 bp, homo sapien
aataaagtttctaaaatgcacaaaamcctagtgtgagtgctgggggagat

SEQ ID NO: 58997 - DNA, 50 bp, homo sapien
cttaaaaaaaaaaagactaaagaaawggtgtcatactatgtgggtcacac

SEQ ID NO: 58998 - DNA, 50 bp, homo sapien
cccaaagcaagggatctgcacgtgarctaagcctggacaatcaggaaata

SEQ ID NO: 58999 - DNA, 50 bp, homo sapien
ctccatggtttcttctcattgggaakatctctgaatccagaattacatta

SEQ ID NO: 59000 - DNA, 50 bp, homo sapien
ccttcatcctgtgccaggccttataraagtgtacatcacagaggtattta

SEQ ID NO: 59001 - DNA, 50 bp, homo sapien
tcccctgggagacaaaatctctttcratattacccaggacttcatgcttc

SEQ ID NO: 59002 - DNA, 50 bp, homo sapien
ctctttttcaagtggatcaaaccacrcttttcataatagattgagccttt

SEQ ID NO: 59003 - DNA, 50 bp, homo sapien
tagagaggtggaatgagaccttgtawctggtaacactgttaagtctctga

SEQ ID NO: 59004 - DNA, 50 bp, homo sapien
atttcaggaacctgtctaaggtaacrcaggaaatgacagagacggtggaa

SEQ ID NO: 59005 - DNA, 50 bp, homo sapien
aatcaggttaccatggatttacttaracgaagcaaaatagtttcttttct

SEQ ID NO: 59006 - DNA, 50 bp, homo sapien
tcagcactctggttcaattgttggtraaatacagtattgctcagtaagtt

SEQ ID NO: 59007 - DNA, 50 bp, homo sapien
tgagtaggatttttgacttgcttaaytaccatgaatgagaaactctcatg

SEQ ID NO: 59008 - DNA, 50 bp, homo sapien
aagctctgtcgacatctccaaagtaygctcttctgaggaaattcctggaa

SEQ ID NO: 59009 - DNA, 50 bp, homo sapien
gtggctagccaattatcccagcacayggatacaagacttagatcaatttc

SEQ ID NO: 59010 - DNA, 50 bp, homo sapien
ttattgtctgagaaatgcaactggartaaagaatatttccttaccacaaa

SEQ ID NO: 59011 - DNA, 50 bp, homo sapien
tgactattttcttctcaacaggaatsaacgagttaccattgtggtgtgaa

SEQ ID NO: 59012 - DNA, 50 bp, homo sapien
gtgccagttaactcaggtttccacawgtaattccttatgttagcagccta

SEQ ID NO: 59013 - DNA, 50 bp, homo sapien
accagttgcagaagatgctcaattakgtgaaattagtaaatatagaagaa

SEQ ID NO: 59014 - DNA, 50 bp, homo sapien
atgtttattaagcaccctgacaccayatttattataagtggggataagac

SEQ ID NO: 59015 - DNA, 50 bp, homo sapien
tagacacacactgcttgcttatggcraaattcctagaaagttacctgtgg

SEQ ID NO: 59016 - DNA, 50 bp, homo sapien
tcagccagatgccttctatttgtccraggaaagaataaatagagccaagt

SEQ ID NO: 59017 - DNA, 50 bp, homo sapien
cagaaccatctattttgtccttcaargtactctaatttctttttccttta

SEQ ID NO: 59018 - DNA, 50 bp, homo sapien
cttgatcaatgattagcaaccaaaartttacaaatcaagtgacttttcta

SEQ ID NO: 59019 - DNA, 50 bp, homo sapien
tactaaggcaatttatttatattcawcccattgccacttggtttctcctc

SEQ ID NO: 59020 - DNA, 50 bp, homo sapien
aaaagccacatctcttgctttcaagragtttgctaccctatagaggagga

SEQ ID NO: 59021 - DNA, 50 bp, homo sapien
catttttattgttttatgaaactacyagtctgtgacatggaaggtagagg

SEQ ID NO: 59022 - DNA, 50 bp, homo sapien
tttcctaatgtcagtttattttggaygtagagctagattttcttattatt

SEQ ID NO: 59023 - DNA, 50 bp, homo sapien
agagattaattccatgtcactgctasgaaaacatggccttggaggtctag

SEQ ID NO: 59024 - DNA, 50 bp, homo sapien
tcataccacttttatgaaagatgccrctatctgctttgtgttatgttatt

SEQ ID NO: 59025 - DNA, 50 bp, homo sapien
ttcatgaaatattggtgttcaaacartgaggagataaaatttagagaaag

SEQ ID NO: 59026 - DNA, 50 bp, homo sapien
aaatatttttaacataagtaatacastaaggtgagtcacaaaatcttcag

SEQ ID NO: 59027 - DNA, 50 bp, homo sapien
ttagaattacaaacttgtgtaatcayctaaattcaagcgaatgactttgt

SEQ ID NO: 59028 - DNA, 50 bp, homo sapien
aaaaagacattttcccaggtttcagragaggaatattggtgtttctctag

SEQ ID NO: 59029 - DNA, 50 bp, homo sapien
aaaagggcacctttttcagcctgaargacaagaggtaaacagcatgctgc

SEQ ID NO: 59030 - DNA, 50 bp, homo sapien
caacaaaaccttagtaactggtatayattaataggatcccattcttagaa

SEQ ID NO: 59031 - DNA, 50 bp, homo sapien
agggaaagtgctcgaaggaagtggaygagtttaaatacctgtcattttgc

SEQ ID NO: 59032 - DNA, 50 bp, homo sapien
agggaagactaacaggataacagatwacaagatacaaattggggtagtct

SEQ ID NO: 59033 - DNA, 50 bp, homo sapien
ttcaacacacctattcagtgcttcaktcaaatggaataattctacagtac

SEQ ID NO: 59034 - DNA, 50 bp, homo sapien
tatacggggcacgagtctctactctraaaagtgagaatttccgaaaagtc

SEQ ID NO: 59035 - DNA, 50 bp, homo sapien
atagagaaggaagtgaaaataggagwactgtttaagaaggttaaaaacaa

SEQ ID NO: 59036 - DNA, 50 bp, homo sapien
gaaggatatcaatattcaagtagacraaggttatagaacactaagcagat

SEQ ID NO: 59037 - DNA, 50 bp, homo sapien
aagtcatgtttactgtcttacaaacraataacctaataaggaaaaaaaca

SEQ ID NO: 59038 - DNA, 50 bp, homo sapien
ttcagcttgttttgaccccaaattayattatcctgacttgaccacccacc

SEQ ID NO: 59039 - DNA, 50 bp, homo sapien
agcccagtgaactaagctcttattakaatattcaaggccagaatgtggga

SEQ ID NO: 59040 - DNA, 50 bp, homo sapien
ggggacagctgccagtcagagttgargcaccaagaagcagagccacacca

SEQ ID NO: 59041 - DNA, 50 bp, homo sapien
tgatggaagcgtgttttctaacttargctgctgattttaaccaatgtgcc

SEQ ID NO: 59042 - DNA, 50 bp, homo sapien
attaacttggctaagatttgttacaytctcagatagaaccccgtttttct

SEQ ID NO: 59043 - DNA, 50 bp, homo sapien
ctgtatagatttaaaataaaatgaaygcttgtttaaggacttatatgaaa

SEQ ID NO: 59044 - DNA, 50 bp, homo sapien
atctcttccaacttgaatccaaatasagaaaaaatcatgcccatgttcct

SEQ ID NO: 59045 - DNA, 50 bp, homo sapien
taactgatgttttgccagtatgttaygggcttcatcagagaatgcaaaca

SEQ ID NO: 59046 - DNA, 50 bp, homo sapien
aggtgagttgtctgagataatacaaytagctgttaatagtgatagggcca

SEQ ID NO: 59047 - DNA, 50 bp, homo sapien
ttactgtaaagattatatgaagggaygttatataaaatttagcacagact

SEQ ID NO: 59048 - DNA, 50 bp, homo sapien
tattacaaaatctgttaatatatcaygcaatatgagatcaaagaaaaatc

SEQ ID NO: 59049 - DNA, 50 bp, homo sapien
catttctccctattcttcttgataaygatgacaataaaagcaactatttt

SEQ ID NO: 59050 - DNA, 50 bp, homo sapien
acctcattaaataattggtccttctragaagcttagtcttgggtccatat

SEQ ID NO: 59051 - DNA, 50 bp, homo sapien
actgctgtttttccccagctacttaygttttatgggattttgttttttaa

SEQ ID NO: 59052 - DNA, 50 bp, homo sapien
taatttacttagcaaaataaacttgractgaagggtaggagattgaggca

SEQ ID NO: 59053 - DNA, 50 bp, homo sapien
aggttggactacaaaggagatatagyaacccaatgaaaacagtagaagca

SEQ ID NO: 59054 - DNA, 50 bp, homo sapien
cttagacaattgtgtttttttccctwcagaatgattgagtctcagaattg

SEQ ID NO: 59055 - DNA, 50 bp, homo sapien
tgatacgtcccacaagagtgtgtacraaaaggttaagattccacaatgct

SEQ ID NO: 59056 - DNA, 50 bp, homo sapien
tacttgatcctaaggttaacaatgcrcgagtaacatagtgactgtaggtg

SEQ ID NO: 59057 - DNA, 50 bp, homo sapien
aaattgtctataattataagaagtcyatgtagaaattcagactctcaaac

SEQ ID NO: 59058 - DNA, 50 bp, homo sapien
ttcatgtcatatagagagagatattsacatttaattactgaatagtgttc

SEQ ID NO: 59059 - DNA, 50 bp, homo sapien
agcagtcacatcatatgacaaatcargagcaagagaaagaggggagagat

SEQ ID NO: 59060 - DNA, 50 bp, homo sapien
atgttgtcacagatatttgctaaaartgctccccacatcctcccaggtgc

SEQ ID NO: 59061 - DNA, 50 bp, homo sapien
cccagccctacctggctcttcttacrctgcaattcaccgccttagggatg

SEQ ID NO: 59062 - DNA, 50 bp, homo sapien
ttattccaggaatgtgaggatcattmactgtccagaaatctattaaagta

SEQ ID NO: 59063 - DNA, 50 bp, homo sapien
agcttcccaggacacatgttgggcaytccatatatatttgtcaaagaaac

SEQ ID NO: 59064 - DNA, 50 bp, homo sapien
gtcagtactaagatatacacacaaayagtttaccacacttcctgtagaca

SEQ ID NO: 59065 - DNA, 50 bp, homo sapien
ggatgtagtataaaatgaaaaaaggwagataatctttgtgtacaagtaat

SEQ ID NO: 59066 - DNA, 50 bp, homo sapien
ttttctttttactctcaaccagccargtagtatttttaaaacatggcatc

SEQ ID NO: 59067 - DNA, 50 bp, homo sapien
ataattgcaactcagggaagtaaaayaatattaatcagggataacattgt

SEQ ID NO: 59068 - DNA, 50 bp, homo sapien
tatttaaccaatcctctattcttgtrtaccgagactatatccagtttttg

SEQ ID NO: 59069 - DNA, 50 bp, homo sapien
taccataatcaacaacttcaacataragatcactctaccattgaccttta

SEQ ID NO: 59070 - DNA, 50 bp, homo sapien
ttgccaagaaacactaaaattcaaayctattatgtgtttgaaattcaaaa

SEQ ID NO: 59071 - DNA, 50 bp, homo sapien
ctttgacatcacatagaaaattttgwatttcaaacacataataggtttga

SEQ ID NO: 59072 - DNA, 50 bp, homo sapien
ctttatcagaactaatacttttctayggttcacagctatttttagtacat

SEQ ID NO: 59073 - DNA, 50 bp, homo sapien
atgtcccattaatttctaaggcatgrcaacatctatgatttcactgatca

SEQ ID NO: 59074 - DNA, 50 bp, homo sapien
tttatatacctagaacataactggartaccaaaaataaaagccccaaaac

SEQ ID NO: 59075 - DNA, 50 bp, homo sapien
ctagaaaggcacagtgtagagtgaaktcgtaactaaacgaatagggattt

SEQ ID NO: 59076 - DNA, 50 bp, homo sapien
aggtcttctcaggatttgtttaaaamggtcagctcaggaactactgaccc

SEQ ID NO: 59077 - DNA, 50 bp, homo sapien
ctgctcaagctagctctgtaaatggycaaacaaccatatctaaaaagccc

SEQ ID NO: 59078 - DNA, 50 bp, homo sapien
  misc_feature (2)..(2): n is a, c, g, or t
anagcattcattagaaagcatactargtgtgtgatttattgtgacttcca

SEQ ID NO: 59079 - DNA, 50 bp, homo sapien
tggaaacagcagtgcccattgaagartactgaacgtggaatcaatactca

SEQ ID NO: 59080 - DNA, 50 bp, homo sapien
ctaatttttgtattcttagtaaaaaygggatttcaccatgttggccaggc

SEQ ID NO: 59081 - DNA, 50 bp, homo sapien
tctccttgctttctcagatctcttakgcctctaaaaaatatggtgttgtg

SEQ ID NO: 59082 - DNA, 50 bp, homo sapien
cttaagttttaaattatggttttcayagtgaatcatactagttattattg

SEQ ID NO: 59083 - DNA, 50 bp, homo sapien
tatctgacagggtggtccggaatggyggaagtaaatcgacaggtgaggac

SEQ ID NO: 59084 - DNA, 50 bp, homo sapien
aggcagcgttattaaaggattcttgracatttctaggaccaagaaatgtt

SEQ ID NO: 59085 - DNA, 50 bp, homo sapien
agtccattgtggccttattggtaccmggtaaagtagaatgagatgaggac

SEQ ID NO: 59086 - DNA, 50 bp, homo sapien
ttacattacttaaagtcactgaatcrcataagcaataatataaatgtgtt

SEQ ID NO: 59087 - DNA, 50 bp, homo sapien
ccgagggtctatatttggcttggtaygtagatagtggctaaaaacataag

SEQ ID NO: 59088 - DNA, 50 bp, homo sapien
aagtcacctagcaaatgactgtagakgtagatgagaaaaattcaaagtag

SEQ ID NO: 59089 - DNA, 50 bp, homo sapien
atctaaatgtaaagcacaaaaatatraaattcctacaagataacacagaa

SEQ ID NO: 59090 - DNA, 50 bp, homo sapien
ataaaaatgtctgaatctccaaacamtgatacatttagagttagtgaagc

SEQ ID NO: 59091 - DNA, 50 bp, homo sapien
tttggagaataaattcatattcttcyctttccgtgccatagtgagaagga

SEQ ID NO: 59092 - DNA, 50 bp, homo sapien
cctattccaagaaatctataatgaayggttaatacttttaaacagggctg

SEQ ID NO: 59093 - DNA, 50 bp, homo sapien
aatctatgctacaatttcacttttaygtgtaccactttatgtagacattt

SEQ ID NO: 59094 - DNA, 50 bp, homo sapien
tgaatttgaactagggagacccactsacaatccctaagcagggaaagtaa

SEQ ID NO: 59095 - DNA, 50 bp, homo sapien
aaatgttcaagaatcctttaataacrctgcctttttctttctgaattcca

SEQ ID NO: 59096 - DNA, 50 bp, homo sapien
aaataatagaatttgaagaaatccargagtcctgcaaatgactgctggtg

SEQ ID NO: 59097 - DNA, 50 bp, homo sapien
aggactagattattgatgtctgaatygattggcagtaaatggtgtcaaga

SEQ ID NO: 59098 - DNA, 50 bp, homo sapien
actgtgtttccattctgggctgattrttctcaaagcccactgcatagttg

SEQ ID NO: 59099 - DNA, 50 bp, homo sapien
atttctgaagaaagagttcattgtargtaaatttttggaaagtgcacatg

SEQ ID NO: 59100 - DNA, 50 bp, homo sapien
caagatcacagagtgatagaattaaygaagacatgtttgttgggctaagg

SEQ ID NO: 59101 - DNA, 50 bp, homo sapien
tgggtttgcctgggagtctgaccaaygtttgtaataacatatccatgaaa

SEQ ID NO: 59102 - DNA, 50 bp, homo sapien
accaccatcaatgaggatggcttccratgtcaatgccacccaatcatacc

SEQ ID NO: 59103 - DNA, 50 bp, homo sapien
taaacatgacaagttttcaacttcaytaataatcacataaacataaataa

SEQ ID NO: 59104 - DNA, 50 bp, homo sapien
ttcactaaaaaatatgtgttttggartacctattatgtgtgtgctgttca

SEQ ID NO: 59105 - DNA, 50 bp, homo sapien
aaaaaggagctgctatcatgtataaygtaaaaggaaaaagcaactcctag

SEQ ID NO: 59106 - DNA, 50 bp, homo sapien
gccacagagcaatgtccaagcaccamcgtgttatttttttcagaggtgat

SEQ ID NO: 59107 - DNA, 50 bp, homo sapien
agtgtctaggagactgagaactgacygatttgaatgcacccagactgaag

SEQ ID NO: 59108 - DNA, 50 bp, homo sapien
aagttcacatttgtatattttagacmcttaatacttggaatgtctcaatt

SEQ ID NO: 59109 - DNA, 50 bp, homo sapien
agtccttgaaggcccatgacaagtayaattttaagactgctaaagctgga

SEQ ID NO: 59110 - DNA, 50 bp, homo sapien
atgtaggaaaccaaattatttactgsagataggtagtgacaaaatgaatc

SEQ ID NO: 59111 - DNA, 50 bp, homo sapien
taacaactatcaggagagtgtatgaycacatggatttcctgtcccttgga

SEQ ID NO: 59112 - DNA, 50 bp, homo sapien
taaagtttagactggtatagaaaaakgttggtaacagtgaagggagaaaa

SEQ ID NO: 59113 - DNA, 50 bp, homo sapien
tctactcctattcttgtattctttayctcagttaatggcatcaccatcca

SEQ ID NO: 59114 - DNA, 50 bp, homo sapien
tttcatgacattatgactattccagraaaattagaatacatatttgtcat

SEQ ID NO: 59115 - DNA, 50 bp, homo sapien
tgcctaacttttaaaaaatacatgcrctaaactaccagcacctacctagc

SEQ ID NO: 59116 - DNA, 50 bp, homo sapien
attatttgtaaaaatccctagccatracaataaatccaaataaaggaatc

SEQ ID NO: 59117 - DNA, 50 bp, homo sapien
cccagggtcacatggctaggaagccractgcaaatgctctggatatcaga

SEQ ID NO: 59118 - DNA, 50 bp, homo sapien
ctcttttctgaaggagagagaaagawacactgagtggcctctccaaagga

SEQ ID NO: 59119 - DNA, 50 bp, homo sapien
atatacttagtgtgataaataatacyctttcactgatgtcaaagaaagtg

SEQ ID NO: 59120 - DNA, 50 bp, homo sapien
ccaggtaagagtcagttggattttgyttccattaatgtttccctgttgtg

SEQ ID NO: 59121 - DNA, 50 bp, homo sapien
tttccaactcatccagctccagtggwagggtaggaaaaacagcacctctc

SEQ ID NO: 59122 - DNA, 50 bp, homo sapien
tttgtgtacctttctctacttgtgckatactccatgacaagcttacacaa

SEQ ID NO: 59123 - DNA, 50 bp, homo sapien
tttcctctcttttctttatcagagcrgacaataagttgtttactttttgg

SEQ ID NO: 59124 - DNA, 50 bp, homo sapien
tgttttgagagcaaaagaaatattargtaagacaggcaataaaaatttta

SEQ ID NO: 59125 - DNA, 50 bp, homo sapien
caattaaactgggtacatgtattgckcgtaacactggtggtgtgagttca

SEQ ID NO: 59126 - DNA, 50 bp, homo sapien
gcttgctatagatttgcccatattaracctaaaaagagcaagcgtgtcag

SEQ ID NO: 59127 - DNA, 50 bp, homo sapien
cgtgaataactgcctaattagtggayatgaaaactggacagtctccaaag

SEQ ID NO: 59128 - DNA, 50 bp, homo sapien
aacaaagagagaaggccataggatartaaagaaaacttagctgaaattaa

SEQ ID NO: 59129 - DNA, 50 bp, homo sapien
ataagaagatattagatagactataraagtgtgatggatattactttgat

SEQ ID NO: 59130 - DNA, 50 bp, homo sapien
gtgtccttgtagctattcaaatcccratgtgatgctgaaatctgccattc

SEQ ID NO: 59131 - DNA, 50 bp, homo sapien
tggtgcttccctggcttgctgtgccrctctttcatagaacctaccacaca

SEQ ID NO: 59132 - DNA, 50 bp, homo sapien
tagacagataataattaaaacctaascagcaatgactgcctaagtatgtg

SEQ ID NO: 59133 - DNA, 50 bp, homo sapien
gggcatattttaaaagaatatacacmgagtaggaagttcttactcaattt

SEQ ID NO: 59134 - DNA, 50 bp, homo sapien
acagctccttcttcaccaatactccrcagctattgagactccttattcca

SEQ ID NO: 59135 - DNA, 50 bp, homo sapien
cattaggattcattttattacttaarcgctatattcatgctctagctctt

SEQ ID NO: 59136 - DNA, 50 bp, homo sapien
aattatctactctcttagaattatamctttagatctttgtcaagaagacc

SEQ ID NO: 59137 - DNA, 50 bp, homo sapien
ttttatgagatttaatgtaactatgyattacttcagacaagatacacata

SEQ ID NO: 59138 - DNA, 50 bp, homo sapien
gttttatctttgtgcctaagtttgayaatgtcttcagtacagttaggttc

SEQ ID NO: 59139 - DNA, 50 bp, homo sapien
cctttctccacagcatacctaaaaaygactaaaccaccgagcaacatctt

SEQ ID NO: 59140 - DNA, 50 bp, homo sapien
ttgtcaagttttggtgtaatatcaakaaagaatacctgaaaaggctatta

SEQ ID NO: 59141 - DNA, 50 bp, homo sapien
tgaaatagtatgctcacactgagaaraaattggtttgtgtttaacatatg

SEQ ID NO: 59142 - DNA, 50 bp, homo sapien
tttgttgaatgcatgaatgaactaartaaactatctttaaaaatagaaac

SEQ ID NO: 59143 - DNA, 50 bp, homo sapien
tttatcttttatctctgtaacaaaaygagagataaacacctttaatacag

SEQ ID NO: 59144 - DNA, 50 bp, homo sapien
taggaagaggatgagctggagctacrgagatatagttattgaagacttga

SEQ ID NO: 59145 - DNA, 50 bp, homo sapien
gactccttttgatagaatctctaacrgggactaagtcttatctgtggctc

SEQ ID NO: 59146 - DNA, 50 bp, homo sapien
ctgaaaactccattgtaacttgtatsagagaaactaagatattattttaa

SEQ ID NO: 59147 - DNA, 50 bp, homo sapien
taacaaatccctatttgcgtcttagwattccaaaatagctagcaagaata

SEQ ID NO: 59148 - DNA, 50 bp, homo sapien
atacatacacctactcatatatatgyaactgcaatggtgggaaagactct

SEQ ID NO: 59149 - DNA, 50 bp, homo sapien
taattgtttttcaaggagggtataaytgataacagtgcaggataactcca

SEQ ID NO: 59150 - DNA, 50 bp, homo sapien
atagtagaagactcatagtaaatacrgcgtttatttcaaattgagttata

SEQ ID NO: 59151 - DNA, 50 bp, homo sapien
tgagactgctattttgagtagttacraacattctggacagattatagaga

SEQ ID NO: 59152 - DNA, 50 bp, homo sapien
cttaattctctcaagtaaataattaygacagaaacctagtagaaaatgaa

SEQ ID NO: 59153 - DNA, 50 bp, homo sapien
ttctgatcataaaactttaaaaaacrctatgctcatcactgcttctatac

SEQ ID NO: 59154 - DNA, 50 bp, homo sapien
gatttttaagagagtccatataatayagcttttactttatgattcattgt

SEQ ID NO: 59155 - DNA, 50 bp, homo sapien
cattttcatggatagaaagaattagktaatgtggccatactgcctaaagc

SEQ ID NO: 59156 - DNA, 50 bp, homo sapien
ctttctacctattttactcaaaagcrgctcttctaaaattgaggaaataa

SEQ ID NO: 59157 - DNA, 50 bp, homo sapien
ttttctgttacttagaatactcaaakctgggcaatttttaaagaaaggga

SEQ ID NO: 59158 - DNA, 50 bp, homo sapien
ttacagggctataaacctaactcaayattttctgtgttttgccactcgtc

SEQ ID NO: 59159 - DNA, 50 bp, homo sapien
aatgtacatcagccttcactcaacaktagtttttgtttcatggtgtacat

SEQ ID NO: 59160 - DNA, 50 bp, homo sapien
tcagccattgtttgggccaatcgtamaccacaggaatgcagggatttcag

SEQ ID NO: 59161 - DNA, 50 bp, homo sapien
ccatcacgtgactggcgctaaaatayaaacgttcccattttgtgtggtat

SEQ ID NO: 59162 - DNA, 50 bp, homo sapien
caaatatccccctttacttttatgcrcaatgaaacttcataaatccagat

SEQ ID NO: 59163 - DNA, 50 bp, homo sapien
cacatctgttgatataggaaatcaaycttgtaatcgtcaacctcaaagac

SEQ ID NO: 59164 - DNA, 50 bp, homo sapien
gcataaagattttgccaattctcaaktatttcaaatccataaaacatgaa

SEQ ID NO: 59165 - DNA, 50 bp, homo sapien
tgctcttcatctgatctgatcattakcataatccacctactgggaaacag

SEQ ID NO: 59166 - DNA, 50 bp, homo sapien
tgcctgttgaaattgactagcattamctcaggacttctgttgacttctga

SEQ ID NO: 59167 - DNA, 50 bp, homo sapien
ttatctgttaattacaaaggagaggwatccgtgaagaaagaacagggaaa

SEQ ID NO: 59168 - DNA, 50 bp, homo sapien
tcttaaggcccctataatgtaaaggraactaaaagcgtcatggggatcta

SEQ ID NO: 59169 - DNA, 50 bp, homo sapien
actaaagtcagcatgtctgaaaaacmcttatctagcagaaaggaaattgt

SEQ ID NO: 59170 - DNA, 50 bp, homo sapien
gaacccattgggctattattataacsaagttttccaaaaagtttttacag

SEQ ID NO: 59171 - DNA, 50 bp, homo sapien
tggaatatcaggagaagctagaaaartaaaaccatcaagtttattaatac

SEQ ID NO: 59172 - DNA, 50 bp, homo sapien
aaatccaaccaaaaaggctctaaagmacatctatatctgtacctgtcttt

SEQ ID NO: 59173 - DNA, 50 bp, homo sapien
atttcagtggaagaaagttaccacaygtagacttgaaattctgtaaacta

SEQ ID NO: 59174 - DNA, 50 bp, homo sapien
taacttcaacactttccttacagaayataataaagaatttcccaaatagc

SEQ ID NO: 59175 - DNA, 50 bp, homo sapien
taattaaggcttcaatatatgggaarcctccttgaaacaggactttgttt

SEQ ID NO: 59176 - DNA, 50 bp, homo sapien
actgttaagaagatcttatgtagaargacgagtcatatgtgattaagtag

SEQ ID NO: 59177 - DNA, 50 bp, homo sapien
ctctttatatagccacaagcagtacygaatatgatttaatggagataatt

SEQ ID NO: 59178 - DNA, 50 bp, homo sapien
atctccttttgtgattacagtaatawcatcaggatagagttgaaaaaact

SEQ ID NO: 59179 - DNA, 50 bp, homo sapien
tgaattttcttatgaatgtcccatayagtcaatgagatctctccactctg

SEQ ID NO: 59180 - DNA, 50 bp, homo sapien
tttactagttaataatcagtaagcaracacttcagtgaatctttccagct

SEQ ID NO: 59181 - DNA, 50 bp, homo sapien
gaagagagctcttggaagaaaccaayctactgatgtcttgatctcaaata

SEQ ID NO: 59182 - DNA, 50 bp, homo sapien
aactgggcatacatttgtggatggaktaaataaatacatgtgaaactcta

SEQ ID NO: 59183 - DNA, 50 bp, homo sapien
acactttttccatattcaaagaaatraaattgctccagtaaggttgaatg

SEQ ID NO: 59184 - DNA, 50 bp, homo sapien
ttgacccaaggaatagataaagggaktaactgctgagagaggtgtggaga

SEQ ID NO: 59185 - DNA, 50 bp, homo sapien
acaacttgctctggttgctaataagwcactatgaattaaggttttgacag

SEQ ID NO: 59186 - DNA, 50 bp, homo sapien
aaagtttagagcttctttgcctatargatgactgttttctctccaggagt

SEQ ID NO: 59187 - DNA, 50 bp, homo sapien
ccctgtcacactcatgtattgcaaaycgagtgggtgctaaataaaagcat

SEQ ID NO: 59188 - DNA, 50 bp, homo sapien
gaaaaagcattgggaaatagtatgaratcaaaatcagttactaatatggc

SEQ ID NO: 59189 - DNA, 50 bp, homo sapien
accagtaacagaccctaaagaaatgragatttgtgaattgcctgacaaaa

SEQ ID NO: 59190 - DNA, 50 bp, homo sapien
gtagccaatagcagtaataatagcaygtaaagttatacaaagttgacttc

SEQ ID NO: 59191 - DNA, 50 bp, homo sapien
ctgtggttgcctaaaagactccacarggacaaatgtccagagcacagtca

SEQ ID NO: 59192 - DNA, 50 bp, homo sapien
tgagatgttaacttcaggcatttctsaatcttttcttgttaaaatagatt

SEQ ID NO: 59193 - DNA, 50 bp, homo sapien
gggaacacccaacagtaatcttagasgtggttcctgtgttttactgtttg

SEQ ID NO: 59194 - DNA, 50 bp, homo sapien
cactgaacttagagaacttagagaayggaatatgtaaactgttgcttaat

SEQ ID NO: 59195 - DNA, 50 bp, homo sapien
tatttatgatggtcaataaaatccaratattacttcaagggtacaccaat

SEQ ID NO: 59196 - DNA, 50 bp, homo sapien
ttctctctggctccttatcacatgartacttggggttccctttttatttt

SEQ ID NO: 59197 - DNA, 50 bp, homo sapien
tctcaggagagggaacagtaaatacmaataccctaagccaacattaaact

SEQ ID NO: 59198 - DNA, 50 bp, homo sapien
ataagcaaataaagctattttaagakaagtagtttgtggttcacattgtc

SEQ ID NO: 59199 - DNA, 50 bp, homo sapien
aagtgcttcattgtttcaatagcacratacttcatttagcttaaaataat

SEQ ID NO: 59200 - DNA, 50 bp, homo sapien
gaaacaagcagaaaccaatgtttggraagttcatgaaaacagttcatgag

SEQ ID NO: 59201 - DNA, 50 bp, homo sapien
acacattctcacaaagaaatcttcamccaggagtacctaacatgagaaac

SEQ ID NO: 59202 - DNA, 50 bp, homo sapien
aataattctttagagacttatagaamactttcaaaagctattgctttcat

SEQ ID NO: 59203 - DNA, 50 bp, homo sapien
aaaataaataatatgaggcacaacaytggttagttggagttattttagta

SEQ ID NO: 59204 - DNA, 50 bp, homo sapien
aattttatttcaatcacacaaacgamgttaaattattatatacatttgct

SEQ ID NO: 59205 - DNA, 50 bp, homo sapien
gcttaagcaggactgagagaatggamaaactgatccacaggagatccgcc

SEQ ID NO: 59206 - DNA, 50 bp, homo sapien
tgggagggtgtatttgtccagaacaytgttcatttcttttagattttcta

SEQ ID NO: 59207 - DNA, 50 bp, homo sapien
tcccaaatctctttggtaacatatamccttagagtttttttgttaagtta

SEQ ID NO: 59208 - DNA, 50 bp, homo sapien
tccaaaagcactgctgtaaagcaacrgttcttagctgagacctgagaact

SEQ ID NO: 59209 - DNA, 50 bp, homo sapien
taaaaaatccttacagcatgctaatragaaagtaaagaccaaaattcaga

SEQ ID NO: 59210 - DNA, 50 bp, homo sapien
ctctttttcttcattttgaactccaycactttataaatagaactaatgag

SEQ ID NO: 59211 - DNA, 50 bp, homo sapien
ctgcctctcagtactgtttaatagcrggttaagatgaaacatgagtttca

SEQ ID NO: 59212 - DNA, 50 bp, homo sapien
ctacacagccaaacctcactaaaaasgctggaccccaaggctaggtgagc

SEQ ID NO: 59213 - DNA, 50 bp, homo sapien
agacaggaatcttttagtaaaatagmagtgttttttgttgtttttgcatt

SEQ ID NO: 59214 - DNA, 50 bp, homo sapien
tttggcagtaattgactgaaatgaayctttctaaactttacagtactaaa

SEQ ID NO: 59215 - DNA, 50 bp, homo sapien
gcaggctttgccacctttggctatamctacacagcattaatttctggcac

SEQ ID NO: 59216 - DNA, 50 bp, homo sapien
acatagatgttacttctaatagtgcyataatgctggaaattgttcaagag

SEQ ID NO: 59217 - DNA, 50 bp, homo sapien
tgcaacaaagagaatgaaagaggtaygtcaaagatagaatcagaagtacc

SEQ ID NO: 59218 - DNA, 50 bp, homo sapien
aatgtttattatatgttgtagtgaaytaatatctaacagttcttagtcat

SEQ ID NO: 59219 - DNA, 50 bp, homo sapien
gcttcctggactgctgtagtaacccrccattagtcctcttgcttccatga

SEQ ID NO: 59220 - DNA, 50 bp, homo sapien
cttccataaggaactgccatctatarcaatcattatatcaccttagtctt

SEQ ID NO: 59221 - DNA, 50 bp, homo sapien
cctgttgaagttagtaacacttataktaaacattttctgttcaaattcct

SEQ ID NO: 59222 - DNA, 50 bp, homo sapien
agggggcaatctgcaatttgcatcaytaaaaatcttttttgaaagtgtgt

SEQ ID NO: 59223 - DNA, 50 bp, homo sapien
gcaatagttactaaatgatcattctracattatcttctttacttaaatac

SEQ ID NO: 59224 - DNA, 50 bp, homo sapien
tagagtttcatttgcttcttcctagycaatctcctgttgaagttagtaac

SEQ ID NO: 59225 - DNA, 50 bp, homo sapien
cttccttaggggtactagctctgtcrtaagagtcacagctgcttctttta

SEQ ID NO: 59226 - DNA, 50 bp, homo sapien
ctttcaaagctattgctctcaaacarctgacaactagccctttttaccat

SEQ ID NO: 59227 - DNA, 50 bp, homo sapien
gcaggtaagaaaatgtcaacttaacrgcagtcctttggatttgaaaagaa

SEQ ID NO: 59228 - DNA, 50 bp, homo sapien
ttctctgttgtaaagttattctcgtkttctccatttccatttcctttttt

SEQ ID NO: 59229 - DNA, 50 bp, homo sapien
gaatctttctccagaagtctcaataytacagaaacagttcctgagtcact

SEQ ID NO: 59230 - DNA, 50 bp, homo sapien
aattcataatttgattattagcgatmaattgtgaaactctgaaaacttat

SEQ ID NO: 59231 - DNA, 50 bp, homo sapien
tcagcttgagttaatagcaccctcaytcgtccccatgcctgggttttaga

SEQ ID NO: 59232 - DNA, 50 bp, homo sapien
ctccctactggcaaatgtactcactraatccaaatggttcacagaaatgg

SEQ ID NO: 59233 - DNA, 50 bp, homo sapien
tgtcttaaagtttccattgtacataygcatctagttaatggattggctgg

SEQ ID NO: 59234 - DNA, 50 bp, homo sapien
cccagaaattccacttggtttaataygtagatgatttccttctttgctct

SEQ ID NO: 59235 - DNA, 50 bp, homo sapien
gtactgcaggagccaggatagggaarttactagatggtattctctgtttc

SEQ ID NO: 59236 - DNA, 50 bp, homo sapien
ttcttttcttaaagcatggtgctcamtactttgggaatacttctagaatt

SEQ ID NO: 59237 - DNA, 50 bp, homo sapien
tctgttacatgctacaagagtacttracacatgcatgaactcagtaaatt

SEQ ID NO: 59238 - DNA, 50 bp, homo sapien
caaacatttcaatgtgataaataaaycaagagctgcactatatagtgaga

SEQ ID NO: 59239 - DNA, 50 bp, homo sapien
ccacagagctgaaggctaggatatcrctccaacacggtcaaacaggaaga

SEQ ID NO: 59240 - DNA, 50 bp, homo sapien
gctattttgtgatagagtatttgcayaatttatttcatttcagtgccatc

SEQ ID NO: 59241 - DNA, 50 bp, homo sapien
actaatttaagctgcctgctcgaaayggtatttgtaggccgccgggcaca

SEQ ID NO: 59242 - DNA, 50 bp, homo sapien
tcagaaaagacagtaattaagcagaycttagaagataaaacatatttata

SEQ ID NO: 59243 - DNA, 50 bp, homo sapien
attggtaacttgtccttactcctaaygatgtttaatgatgtttatagcac

SEQ ID NO: 59244 - DNA, 50 bp, homo sapien
aacaagtacttagcacaatgtgttayagagaatagttgttcaatgattct

SEQ ID NO: 59245 - DNA, 50 bp, homo sapien
ctctttctgtattttctgacctggcratttccagcctgccctctaagaag

SEQ ID NO: 59246 - DNA, 50 bp, homo sapien
cccacaaattgtcttatggtgaaagsagatgaaacctgaagcaacaaaac

SEQ ID NO: 59247 - DNA, 50 bp, homo sapien
ccttgttccaatcacagtactgacarataaaatagagaaagaggacgtca

SEQ ID NO: 59248 - DNA, 50 bp, homo sapien
agcagcagcagattcaaaatctaaarcatgtctgatattgatgaggtaaa

SEQ ID NO: 59249 - DNA, 50 bp, homo sapien
taagcattgaaaatattttatcttaygagaagacggcttacaccctggag

SEQ ID NO: 59250 - DNA, 50 bp, homo sapien
tgtcttcatattaactgtaaaattaragtaataatggtagtttaaattta

SEQ ID NO: 59251 - DNA, 50 bp, homo sapien
tagcaaagtcctttagcgaaggcacmagaactagactatagaaacattca

SEQ ID NO: 59252 - DNA, 50 bp, homo sapien
tgcgaattacatgagataacttatawagtgagtgctcaaaaacaacagtt

SEQ ID NO: 59253 - DNA, 50 bp, homo sapien
ttccattctattgtgatcataaaaartcattaaggtatttagtatttaga

SEQ ID NO: 59254 - DNA, 50 bp, homo sapien
gaaagaacacaatgaaagtgctgtaragaatagatttaatcaagttaaat

SEQ ID NO: 59255 - DNA, 50 bp, homo sapien
catagattaccaaggatgacgtctarctttgctcaataatgcaagacctc

SEQ ID NO: 59256 - DNA, 50 bp, homo sapien
ccagaaaaataaatgaacatataacyaaacatattgataagtattaatat

SEQ ID NO: 59257 - DNA, 50 bp, homo sapien
aaaaatcagtatattctagttataamattatggatgagtattatttttcc

SEQ ID NO: 59258 - DNA, 50 bp, homo sapien
gagtcagtgttattgtctaaaagaamgaactagttttatggagatagtaa

SEQ ID NO: 59259 - DNA, 50 bp, homo sapien
ttgagagcttctggttcatcgataaygctctccaagcacacccctgggtt

SEQ ID NO: 59260 - DNA, 50 bp, homo sapien
cttggaatcgaaggggagaccaggarcataaagaacacactggaaaggtg

SEQ ID NO: 59261 - DNA, 50 bp, homo sapien
gtaatagtaaccctcccattcataayctacatacgtgcctatctttcaga

SEQ ID NO: 59262 - DNA, 50 bp, homo sapien
tggctcagaggtttgcaatctgggcrgcaatgtaaagtttcattcataaa

SEQ ID NO: 59263 - DNA, 50 bp, homo sapien
tcctattctttaggggatactttacyaataatcatggatcaagttatatc

SEQ ID NO: 59264 - DNA, 50 bp, homo sapien
atttataatgatccttccttcacackgaaacatttcatcctataaaaaca

SEQ ID NO: 59265 - DNA, 50 bp, homo sapien
ttgttttgtgattcttaaagcccaawctgagaatgatcattatataagaa

SEQ ID NO: 59266 - DNA, 50 bp, homo sapien
actatcagtctctattttggttctargccaacctatgacctctaccctaa

SEQ ID NO: 59267 - DNA, 50 bp, homo sapien
ctgctttctgctgtctttaaatctcygagagcctaatattcatatcccgt

SEQ ID NO: 59268 - DNA, 50 bp, homo sapien
aagaccagtctttgtttgaaaggcgmaattctaaaaactgttagaagaaa

SEQ ID NO: 59269 - DNA, 50 bp, homo sapien
tcaatgacctatatgatacaataaakgatacaatttagaaacattacgat

SEQ ID NO: 59270 - DNA, 50 bp, homo sapien
cagagatgctatatccatgttgaagrctcattatctccttgatcttaatt

SEQ ID NO: 59271 - DNA, 50 bp, homo sapien
agacataatgaggctagggtaatcaygacaacacaatattggcacaagga

SEQ ID NO: 59272 - DNA, 50 bp, homo sapien
ataaattttagaattgttgtcttacwcatacacaatattgtgcttttgat

SEQ ID NO: 59273 - DNA, 50 bp, homo sapien
ttgtcattttaaagtaaatataagayacatgtttagtcaagtctaatcaa

SEQ ID NO: 59274 - DNA, 50 bp, homo sapien
tttgcctgtcattagttattgaaccmctatatagctgactatgattttca

SEQ ID NO: 59275 - DNA, 50 bp, homo sapien
aaacatacaaacaaactcatttagaytagagacactgtgattgatcttgc

SEQ ID NO: 59276 - DNA, 50 bp, homo sapien
aatattgacatctgttctaggatacmacaagaaggatccacgtttcaaca

SEQ ID NO: 59277 - DNA, 50 bp, homo sapien
tttgaaataacacaagtaaacataawatccactggaatactattttacta

SEQ ID NO: 59278 - DNA, 50 bp, homo sapien
gttccttctaggtctctaaacttgaygtgcaaagattcattttcattgtc

SEQ ID NO: 59279 - DNA, 50 bp, homo sapien
tgtttcctctatccttccacttcatktctatctctattatagaacttatt

SEQ ID NO: 59280 - DNA, 50 bp, homo sapien
gccatccttggggaaatttatatcckgccagatgataattaatatgcttc

SEQ ID NO: 59281 - DNA, 50 bp, homo sapien
atcaccttttcatatacctggttgcsagttgtacagcttctttggagaat

SEQ ID NO: 59282 - DNA, 50 bp, homo sapien
atggggctgtcatctcctgtgaaaasactaccttcttttggaaggccttg

SEQ ID NO: 59283 - DNA, 50 bp, homo sapien
tgacctgcttttgagagatgtctacyaatccaaccaacagtctagacaga

SEQ ID NO: 59284 - DNA, 50 bp, homo sapien
ctaaagagccacccagctaagatacrgatcaaagtaagccttatgtttat

SEQ ID NO: 59285 - DNA, 50 bp, homo sapien
ttgacactttattttctacattgcayaaatcgtccacacagaaaatacat

SEQ ID NO: 59286 - DNA, 50 bp, homo sapien
tacatgtttagtttaactcaaattaytaaccaatgtgtgccaggagagtc

SEQ ID NO: 59287 - DNA, 50 bp, homo sapien
ttccagttttagctctactactaacyagcaatgtaactgtgggctatccc

SEQ ID NO: 59288 - DNA, 50 bp, homo sapien
tttctctctgagggaacagagccacrcgttgtgcaggaaggcagggagat

SEQ ID NO: 59289 - DNA, 50 bp, homo sapien
ccctcagagagaaaacagtctgaacygtcctgagcccatttcctttccag

SEQ ID NO: 59290 - DNA, 50 bp, homo sapien
aattactctccagatgtgaacctgtraaaccagaaaagttgtgtgcttca

SEQ ID NO: 59291 - DNA, 50 bp, homo sapien
aatctatttgaacgtcttatggaaawgtgaggtccaaaccaagggtctgc

SEQ ID NO: 59292 - DNA, 50 bp, homo sapien
agttctcaaagccaggagattaacaytgatgcaataccattaactaaatg

SEQ ID NO: 59293 - DNA, 50 bp, homo sapien
tttttctgactcccccatccttttgracagacagcagacaaggactaggc

SEQ ID NO: 59294 - DNA, 50 bp, homo sapien
gcaactggcaaaaaccaattcaggcycacttagacaaaaaaccaactaga

SEQ ID NO: 59295 - DNA, 50 bp, homo sapien
ggggacatccacagcacagcatgacsaacacagcacggtggtgttcaggg

SEQ ID NO: 59296 - DNA, 50 bp, homo sapien
taagaaaagaagagggaggcaccaayggcacccttgtccacctagaattt

SEQ ID NO: 59297 - DNA, 50 bp, homo sapien
agggaataatcttgacgtagcttcaragatgaattaattatgaactaata

SEQ ID NO: 59298 - DNA, 50 bp, homo sapien
atattatcctaatggagattagtgayagaactaaaaccaattacataagt

SEQ ID NO: 59299 - DNA, 50 bp, homo sapien
acttctccacatgaaagtagggggarcatatccacgcctcatttattctt

SEQ ID NO: 59300 - DNA, 50 bp, homo sapien
acctagaagaatatcttaaccattcrcagagaaagcagcaatgaatggac

SEQ ID NO: 59301 - DNA, 50 bp, homo sapien
cgattcatgaaaacgaatatcatacrggatgtttagttccatttgtgacc

SEQ ID NO: 59302 - DNA, 50 bp, homo sapien
ctctatttaacaccaaaatgcttgcmatggtgccactaaatatctgttgg

SEQ ID NO: 59303 - DNA, 50 bp, homo sapien
caagttaagtacaatatgtagatggyagtctgaatactcatactctgagg

SEQ ID NO: 59304 - DNA, 50 bp, homo sapien
gcactttggcactaaaaatgcttgaygggacaaaaatataatttgaacat

SEQ ID NO: 59305 - DNA, 50 bp, homo sapien
tatttactgtttgtacatggtgtgaygtaactgcatatctatttatagct

SEQ ID NO: 59306 - DNA, 50 bp, homo sapien
ttcaaaatgataatttatagatgctsaaatgatccaaaaattgaccagtt

SEQ ID NO: 59307 - DNA, 50 bp, homo sapien
tcagaagaaaaggattttatgactcrcagtacaacaggcagctcttactt

SEQ ID NO: 59308 - DNA, 50 bp, homo sapien
aaacacagtccttttactttacatargcatatcctcatgcctctgatcaa

SEQ ID NO: 59309 - DNA, 50 bp, homo sapien
agagctagggatagagttagagatartagatttgagatagagatagatag

SEQ ID NO: 59310 - DNA, 50 bp, homo sapien
tctgtccccagtataataaatatgtsatggagaagtaatatttaaaataa

SEQ ID NO: 59311 - DNA, 50 bp, homo sapien
ggtaagctgtgttaaaactgtaggayagataagcatgggtccttaaggat

SEQ ID NO: 59312 - DNA, 50 bp, homo sapien
cagctgcattgctcttgatgggaccrccattttccctctgctcctgcttt

SEQ ID NO: 59313 - DNA, 50 bp, homo sapien
gaaatgcttatgatgtactgccacaygatagatccttagttcaaagacaa

SEQ ID NO: 59314 - DNA, 50 bp, homo sapien
ttaatgtggcataaaaagtaatgtgyactagatcacatattccacaacag

SEQ ID NO: 59315 - DNA, 50 bp, homo sapien
gccagtttaaatggtgatgtacatayagaatagagggggaaattgctgga

SEQ ID NO: 59316 - DNA, 50 bp, homo sapien
aatttttactcaactttttctaacastacaatgaatactttgtgcagtgt

SEQ ID NO: 59317 - DNA, 50 bp, homo sapien
tagaccccacaaaagcttcttcttayggaaaaataccggaaagatttctg

SEQ ID NO: 59318 - DNA, 50 bp, homo sapien
acaaagaggaactcaaggctacatamgacctagatatgctctctagatca

SEQ ID NO: 59319 - DNA, 50 bp, homo sapien
aacagtagactgatggtgctccattyaaataacaatgtctaggaaggcct

SEQ ID NO: 59320 - DNA, 50 bp, homo sapien
gacaaataacaaggatgtaaaaatartaatcaaccagatgagagagaatg

SEQ ID NO: 59321 - DNA, 50 bp, homo sapien
tcagtgttctgaattgttcagttggratttgagaaatactatcagtatat

SEQ ID NO: 59322 - DNA, 50 bp, homo sapien
agcacagaacccacgtccatagaacraaaggaagtttactttacagaatg

SEQ ID NO: 59323 - DNA, 50 bp, homo sapien
aaaataagacatatcctcaaagatargtcaaggaagtatcaaaaatatca

SEQ ID NO: 59324 - DNA, 50 bp, homo sapien
cggtgtctcattcctaatatctttargtcaaaatcagttgtccccagaat

SEQ ID NO: 59325 - DNA, 50 bp, homo sapien
tattgggaagtttaaaatctcctcarattgtcttctctaatacttattct

SEQ ID NO: 59326 - DNA, 50 bp, homo sapien
agaaaagatgtatttatctgagaaasatgttgctttctgtttgtttttct

SEQ ID NO: 59327 - DNA, 50 bp, homo sapien
aagggacaaggggtgatgggtaaacytaacaagaatcatcttcttttgtg

SEQ ID NO: 59328 - DNA, 50 bp, homo sapien
gaaacttttgctgactatcccaccargactgcatgccacggggataggac

SEQ ID NO: 59329 - DNA, 50 bp, homo sapien
gcattgaatagacgtggcaagcagaycgctgaaatgaaaatactaagaat

SEQ ID NO: 59330 - DNA, 50 bp, homo sapien
acttacatctttctaaaatctactcrcgctttcattcaaatattatatta

SEQ ID NO: 59331 - DNA, 50 bp, homo sapien
gagatacagaacatattttctggaaygaattcacggagtttctgacttaa

SEQ ID NO: 59332 - DNA, 50 bp, homo sapien
gccgaggtgactggaagaagccgtastacgcaggagcaagggccgagagg

SEQ ID NO: 59333 - DNA, 50 bp, homo sapien
cctaagccatttgatgcatttctccrtaccaagaaaattcaagcatccta

SEQ ID NO: 59334 - DNA, 50 bp, homo sapien
gctctgcaacctattgcagtaaccaygatggcagctggccctgacactct

SEQ ID NO: 59335 - DNA, 50 bp, homo sapien
ttgaggtgtctccccatcgcagctcrcctcactctttgctgcaccccagc

SEQ ID NO: 59336 - DNA, 50 bp, homo sapien
cccaaagccttgctctggctggaccrtgctaagcagacagtctagaacga

SEQ ID NO: 59337 - DNA, 50 bp, homo sapien
atcttaattccattggacttagcatkaataactaagggcataacgtacgt

SEQ ID NO: 59338 - DNA, 50 bp, homo sapien
cagcttttaattaagccaaattttgmacataaagctcattaaaaaaaaca

SEQ ID NO: 59339 - DNA, 50 bp, homo sapien
tctagggtatggtctttgatttcccrgagttcatgcctagagtatttgac

SEQ ID NO: 59340 - DNA, 50 bp, homo sapien
ggatataaaagctcttcctttgacckccaaatactcagaggattagggaa

SEQ ID NO: 59341 - DNA, 50 bp, homo sapien
taataattttaataggtatttgttcraaaacaggaggtgtgtagggggat

SEQ ID NO: 59342 - DNA, 50 bp, homo sapien
taggatggacatggagttgattataygtgtacaatatgttttagctgaag

SEQ ID NO: 59343 - DNA, 50 bp, homo sapien
tggctatgaactgtcgtgtaaatcakgtactttttctttaaacaatcaca

SEQ ID NO: 59344 - DNA, 50 bp, homo sapien
ttttcccttttgatcagagtacatcyctaggttaataactgaagtacttc

SEQ ID NO: 59345 - DNA, 50 bp, homo sapien
agctcttcacactctgcataagtaayataccccctattatgcacattcgc

SEQ ID NO: 59346 - DNA, 50 bp, homo sapien
ccataaagttagttaataaagcagamgcaaatttagaaaggattgactct

SEQ ID NO: 59347 - DNA, 50 bp, homo sapien
tgtattttctttttactataggcatyagaaatgtgagaaatgtccattca

SEQ ID NO: 59348 - DNA, 50 bp, homo sapien
tttcttccaaagcacacgcatagtakgatatctcttatctcccatgggag

SEQ ID NO: 59349 - DNA, 50 bp, homo sapien
ctctaactcttcctcataggaattcrctaatcttttgtcagttctgtggc

SEQ ID NO: 59350 - DNA, 50 bp, homo sapien
ttcaacagatagaatgtgttttagcyacactgtatagaaggtttcatttt

SEQ ID NO: 59351 - DNA, 50 bp, homo sapien
gaggttatatgagacactataaaagwattaatgaacagtataaaagatga

SEQ ID NO: 59352 - DNA, 50 bp, homo sapien
atagtttcctggctaatcctaaagawctctcaagaataagacaagtaaat

SEQ ID NO: 59353 - DNA, 50 bp, homo sapien
gccccttgtgttaaatggtgttggayttacataagagaaatacatattta

SEQ ID NO: 59354 - DNA, 50 bp, homo sapien
taatatttttagtttgtagactttcrgaaaaatttacatccactttatta

SEQ ID NO: 59355 - DNA, 50 bp, homo sapien
gttgcatatagctgttcagttgttcsagcgccatttgttgaaagacttct

SEQ ID NO: 59356 - DNA, 50 bp, homo sapien
acaaagagaaagtgcactgctgagayaataccttccagtgaagtttctaa

SEQ ID NO: 59357 - DNA, 50 bp, homo sapien
ttctagacatctcaactatatgacgratatgaaacctgcagtgtccaatt

SEQ ID NO: 59358 - DNA, 50 bp, homo sapien
tatttgagttaactatttgataagcragacatcttagtaaaaaggattta

SEQ ID NO: 59359 - DNA, 50 bp, homo sapien
tgtgtataacccctaaattgtaggamgaaataggcaaccgcaggagattt

SEQ ID NO: 59360 - DNA, 50 bp, homo sapien
tcatgaacagtatgtaataataaaartactcctgacttccagaagtcaac

SEQ ID NO: 59361 - DNA, 50 bp, homo sapien
ataacatatgctatgtccaagcagckacattgatctaccacagctccttt

SEQ ID NO: 59362 - DNA, 50 bp, homo sapien
cttaaataacctgagttctaaactascaaaatggttgatattattttgat

SEQ ID NO: 59363 - DNA, 50 bp, homo sapien
gcaaacaggttaagaaatagtcaacygaggctaactcagttctatgcatg

SEQ ID NO: 59364 - DNA, 50 bp, homo sapien
atattttattcaagagttgtctgagmaacagtttttataaccagatccac

SEQ ID NO: 59365 - DNA, 50 bp, homo sapien
tgagccaaaggtaaatcagaacttgwaattatagatagccctgagattat

SEQ ID NO: 59366 - DNA, 50 bp, homo sapien
ggtggtcgttgttgcaaaagatgaakcaaaaagagtagaagacttcatcc

SEQ ID NO: 59367 - DNA, 50 bp, homo sapien
ccattggaagagaaagaccataaagratgctgagaagaaaacaatgtcag

SEQ ID NO: 59368 - DNA, 50 bp, homo sapien
cttactttctctttaacttcctgcamcagatatttgattttctaacatat

SEQ ID NO: 59369 - DNA, 50 bp, homo sapien
ggtgttttgtagacatgatgggatgsaaaaccaaaaaacactatatccaa

SEQ ID NO: 59370 - DNA, 50 bp, homo sapien
cattttaatggaaaaattgaagtaamgcaagatagttcaaattaactgga

SEQ ID NO: 59371 - DNA, 50 bp, homo sapien
ctctccttttattttctttttgagakcaatactttaaacactaaggcatt

SEQ ID NO: 59372 - DNA, 50 bp, homo sapien
tgttttcattcacaagttaaatggawgaaatgaggtttttttccagcctt

SEQ ID NO: 59373 - DNA, 50 bp, homo sapien
ctttcccgcttgttatactgggtaayaggtaaaataaaggaataaacaaa

SEQ ID NO: 59374 - DNA, 50 bp, homo sapien
gcaaaggcaagttggacaatctttawgggaaaaacaattctaccatctcc

SEQ ID NO: 59375 - DNA, 50 bp, homo sapien
ttacccttcctttgtagatgaataawttaaaatatccagtaaattgattt

SEQ ID NO: 59376 - DNA, 50 bp, homo sapien
cttcaaaggaagtggctatcctactraaggaatgctacaaaccaagagat

SEQ ID NO: 59377 - DNA, 50 bp, homo sapien
attttcccagctgcctccaacagacsgaaacttgtcactggggagctgaa

SEQ ID NO: 59378 - DNA, 50 bp, homo sapien
taatatacatgagagtaaaactagcraaactgaaagagatatagacaaat

SEQ ID NO: 59379 - DNA, 50 bp, homo sapien
caaacactaacagatttgtcttaccragtttttaaagatatgacaatcta

SEQ ID NO: 59380 - DNA, 50 bp, homo sapien
ccttgctgtgaacttattcaggtcayggatggtttcttactcatttctgt

SEQ ID NO: 59381 - DNA, 50 bp, homo sapien
ctagcaccattcaaccaaagagtaayactgtgcttcagcacaaatagcta

SEQ ID NO: 59382 - DNA, 50 bp, homo sapien
aaatcctatgaatgccatacaagtayaagaacgagtttcagcaaatatca

SEQ ID NO: 59383 - DNA, 50 bp, homo sapien
atcactggattaaaattttatgtcaraagagtactttctgaaatattcac

SEQ ID NO: 59384 - DNA, 50 bp, homo sapien
tccatatgttccttagcctccattcrctttcttcaatcattattctttct

SEQ ID NO: 59385 - DNA, 50 bp, homo sapien
actatgagagagaagctgacttaacygaatttgataaatcatcttggttt

SEQ ID NO: 59386 - DNA, 50 bp, homo sapien
tcttggttggtccaaacagctatgascggaaatgttaagtggtagtgcaa

SEQ ID NO: 59387 - DNA, 50 bp, homo sapien
gaaggtagttacttttttagtaaaakttcgttgcatcctaccgcatttat

SEQ ID NO: 59388 - DNA, 50 bp, homo sapien
catttccttgtgctttgggatcttcmaatgaataaagtatgcacttacat

SEQ ID NO: 59389 - DNA, 50 bp, homo sapien
ggtatttggactttttcttttaggayatgagagaaaatgtgagtatctta

SEQ ID NO: 59390 - DNA, 50 bp, homo sapien
ttagaagttgatgtatcatgccaaaratttaaaagaggaaaattcagaga

SEQ ID NO: 59391 - DNA, 50 bp, homo sapien
aaagttagtttgcgaccatttgttayactgatgggttaccatggaaacaa

SEQ ID NO: 59392 - DNA, 50 bp, homo sapien
ttgaagttatcagcaagagttattakgttgttatcaggaagttatcaatg

SEQ ID NO: 59393 - DNA, 50 bp, homo sapien
taagcacaaagtgttgaaaggaagaygagacacataaacctgtgacgtgg

SEQ ID NO: 59394 - DNA, 50 bp, homo sapien
tccccgatcagacatttcaatatcayacttaagaaccaatgtggagcctt

SEQ ID NO: 59395 - DNA, 50 bp, homo sapien
gcctcatttctaccaataatttcaartgtttaatgggactatttcattag

SEQ ID NO: 59396 - DNA, 50 bp, homo sapien
ttgcagttggcattttcaaatggcakgtagtctcataggactgagccctt

SEQ ID NO: 59397 - DNA, 50 bp, homo sapien
aaactcttgataaaattagaaaatgycactaaataataagctatgaaatg

SEQ ID NO: 59398 - DNA, 50 bp, homo sapien
gaacactcttaaaagttgaacagaastcactctaaaagtttcttgtgcaa

SEQ ID NO: 59399 - DNA, 50 bp, homo sapien
aacatacaaatttcccagggaggaawctacaaattggataaaatattgac

SEQ ID NO: 59400 - DNA, 50 bp, homo sapien
aattttattcagttgtcttgctttayctgtaagattctttttctgtatga

SEQ ID NO: 59401 - DNA, 50 bp, homo sapien
cctttgcaataattaaatgatgataraattaaagttattatacttttcta

SEQ ID NO: 59402 - DNA, 50 bp, homo sapien
taccttgataaaaatcacttgaaacrgagcatttttatttctgactcatt

SEQ ID NO: 59403 - DNA, 50 bp, homo sapien
tctatctttatttctctattttccarcttacaggattcagatctgtattc

SEQ ID NO: 59404 - DNA, 50 bp, homo sapien
aaaactaccttctcattactgatcayataagctttacagattctcatgtt

SEQ ID NO: 59405 - DNA, 50 bp, homo sapien
atgttatgggaggaaactagtagaaygtaatgaatcatgggggcaggtct

SEQ ID NO: 59406 - DNA, 50 bp, homo sapien
cgcaatgagttaacactcctatcaaktacaatggatattatcgaaaagac

SEQ ID NO: 59407 - DNA, 50 bp, homo sapien
ctaaattcagcatttaaatgccaaargtttctgacttaggatgttctgac

SEQ ID NO: 59408 - DNA, 50 bp, homo sapien
taaaaataagacttaaaatataccartgagaatagttgtgagagaattta

SEQ ID NO: 59409 - DNA, 50 bp, homo sapien
aaaaggatttttgagcctaatgtgtsaacttcagatattcacatgattgt

SEQ ID NO: 59410 - DNA, 50 bp, homo sapien
acacttacaatatttagtacagttayctaagccatttttgaaaaccaaag

SEQ ID NO: 59411 - DNA, 50 bp, homo sapien
aactaaggtgtgtattaaactaaackacatttgcattgcaatgaatccca

SEQ ID NO: 59412 - DNA, 50 bp, homo sapien
aaaaactcagtaatggtactttttckcagacttttattcgctttagctgt

SEQ ID NO: 59413 - DNA, 50 bp, homo sapien
cccattttgccaagagcgcatagtaygacagaatcagtatgacatgaaga

SEQ ID NO: 59414 - DNA, 50 bp, homo sapien
agcgtaatggctagatgatcactcamtctcaggaacacatttccccacta

SEQ ID NO: 59415 - DNA, 50 bp, homo sapien
gattgagtgatcatctagccattacrctttctagctcatcttgccgcagt

SEQ ID NO: 59416 - DNA, 50 bp, homo sapien
agtctagaattatactttcaaagctkagcacctgctgtaaaataaccatc

SEQ ID NO: 59417 - DNA, 50 bp, homo sapien
caaaactgcctttgtaagactaatgraaggccacaagcttaggattatgg

SEQ ID NO: 59418 - DNA, 50 bp, homo sapien
ctctattccattctttcccttcggayattgtgatgactaatatacatttt

SEQ ID NO: 59419 - DNA, 50 bp, homo sapien
tctgaaaaatatccacttttaatcarataagaaatatatcattcagaaaa

SEQ ID NO: 59420 - DNA, 50 bp, homo sapien
agagttttctcctttcctcctctccwaggtaagaacaatcatatgctcat

SEQ ID NO: 59421 - DNA, 50 bp, homo sapien
agtaagggtgttaaacagtcaaaaamcggtgagatacatttattagagga

SEQ ID NO: 59422 - DNA, 50 bp, homo sapien
ttgaggataaagataaggaggtgaarataacaatgaacatctgagaataa

SEQ ID NO: 59423 - DNA, 50 bp, homo sapien
aaagactaatttctcaatatccaaarctactaaaataattatttagggta

SEQ ID NO: 59424 - DNA, 50 bp, homo sapien
tacgttgccaacaaattgccattgaraagtactgctccatagatctggaa

SEQ ID NO: 59425 - DNA, 50 bp, homo sapien
agcccagttatagcagagcccaaacrctgtggtaacaaaatgttccattc

SEQ ID NO: 59426 - DNA, 50 bp, homo sapien
caggtctcacccttctgctgcaaacycagacacaaagacaacccaaagct

SEQ ID NO: 59427 - DNA, 50 bp, homo sapien
ttcatttccacagatggcaaattagytgggtttataattacaaaggacaa

SEQ ID NO: 59428 - DNA, 50 bp, homo sapien
gcagagacagggtgctggaggcatcraacacaggcatcttcggctcccag

SEQ ID NO: 59429 - DNA, 50 bp, homo sapien
agcatctaagcatttacaatgattaygttcttacgcctctccaattaaaa

SEQ ID NO: 59430 - DNA, 50 bp, homo sapien
caggtatctagaagagctgtcatgarcccatgtcctctgacgtgaatgcc

SEQ ID NO: 59431 - DNA, 50 bp, homo sapien
ctaatacacaagaaatcaggaatagkctatataagggtgataatgctggc

SEQ ID NO: 59432 - DNA, 50 bp, homo sapien
atctatgactctgtacatcctcattsagaagcagtcattctaatagaaaa

SEQ ID NO: 59433 - DNA, 50 bp, homo sapien
atatccttaggtctattattaattayctgagtcactcaacctttttcgtc

SEQ ID NO: 59434 - DNA, 50 bp, homo sapien
ttcatcttgatgactaccttccctcragaacaatcacaaggttacagtgc

SEQ ID NO: 59435 - DNA, 50 bp, homo sapien
tatttactgtagtcagaagaatggaraattataggcctagaggaagaaaa

SEQ ID NO: 59436 - DNA, 50 bp, homo sapien
agctatgaaggtgttgttattgaggyctgtataacattctaagaagacca

SEQ ID NO: 59437 - DNA, 50 bp, homo sapien
ttaatcagctagacacatttcgattraactataacaatggcaggctgaag

SEQ ID NO: 59438 - DNA, 50 bp, homo sapien
ctcctctgacatactatctgtattayactttaaagcaaacaaacctgctc

SEQ ID NO: 59439 - DNA, 50 bp, homo sapien
atcagtcatagatcgatcaacctacyattttctttctgatatctctacct

SEQ ID NO: 59440 - DNA, 50 bp, homo sapien
tgcaaattatacaaagatgtcacaamacatgattccctgtaaaataaata

SEQ ID NO: 59441 - DNA, 50 bp, homo sapien
agattcccctctctttcttttcctcragacaatgtgatgtatatagtcag

SEQ ID NO: 59442 - DNA, 50 bp, homo sapien
tcataggaaaataagggagatatgaygagaaacccctcctagtaatgccc

SEQ ID NO: 59443 - DNA, 50 bp, homo sapien
gagtcaaaatttcatcagttttgcasaagataatatttttgattgcattc

SEQ ID NO: 59444 - DNA, 50 bp, homo sapien
tattcagctaaacaataataattaaraaagaggttattgcatattatctt

SEQ ID NO: 59445 - DNA, 50 bp, homo sapien
cattctagaaacagctaaggaattaraaaagtttgtatactttgtgaaga

SEQ ID NO: 59446 - DNA, 50 bp, homo sapien
acccacatagtaatcaatccaaaaartataaagggacacaagaaagatct

SEQ ID NO: 59447 - DNA, 50 bp, homo sapien
ttaaaaaaattaattgtaggtataaytactgctaaataccctgaaaataa

SEQ ID NO: 59448 - DNA, 50 bp, homo sapien
cagtttttaatcccacacatctcttyattgtgcttgtgatttaaaaaaat

SEQ ID NO: 59449 - DNA, 50 bp, homo sapien
atccagtgatatttctaaagtttaartgagttcaattgggatatggatat

SEQ ID NO: 59450 - DNA, 50 bp, homo sapien
tattcaatttgtggtatatttgacaytgagtatacatgtatttatcattg

SEQ ID NO: 59451 - DNA, 50 bp, homo sapien
ataaatatttgttcaacgaataaatrgatggatctttgactgtatcatat

SEQ ID NO: 59452 - DNA, 50 bp, homo sapien
cattggttttcctgtgtgtgctgaaragatgggacaaatgtcagccccaa

SEQ ID NO: 59453 - DNA, 50 bp, homo sapien
gttagggtatcccgaaattcaatgastagtttccttataagaaggccttg

SEQ ID NO: 59454 - DNA, 50 bp, homo sapien
ggtcaagggaggctgatgaggggttwgcacggaagaattgagagggggat

SEQ ID NO: 59455 - DNA, 50 bp, homo sapien
gacacatactgtgagccaggttgagrcccatcttttcttagttttatcga

SEQ ID NO: 59456 - DNA, 50 bp, homo sapien
ttcagcaccacctcatgtcgccccamgttcatgtttttcaggggccttct

SEQ ID NO: 59457 - DNA, 50 bp, homo sapien
acatgtatttttgcatattttttctsaattaatcctccaaaaattgaagg

SEQ ID NO: 59458 - DNA, 50 bp, homo sapien
catgaggtaaactctaatatcttacsagcataaactacctttaagaaaca

SEQ ID NO: 59459 - DNA, 50 bp, homo sapien
gttacctataagttaacaggctaatkcttacttgtggtatttgaccaata

SEQ ID NO: 59460 - DNA, 50 bp, homo sapien
caggtttgttcctgattatgataagmctgtaattaatgtttcgtaaacca

SEQ ID NO: 59461 - DNA, 50 bp, homo sapien
cccatgcacggctttcttcagctacratggatcacaacatcattctgtga

SEQ ID NO: 59462 - DNA, 50 bp, homo sapien
cattcagcacttacgatgtgctaaamgcttcatatgtattaattcgttta

SEQ ID NO: 59463 - DNA, 50 bp, homo sapien
aacacattaaccttggccttgcatgragcctaagagcccattaaaggtct

SEQ ID NO: 59464 - DNA, 50 bp, homo sapien
tatgtgcatgaaactgttgttcaaargtcaggataaaagtggcttttcta

SEQ ID NO: 59465 - DNA, 50 bp, homo sapien
tttgaagtataggctatattacttcygaaacatacatgaccatagtcttg

SEQ ID NO: 59466 - DNA, 50 bp, homo sapien
gaccaggaaggcaggtgtaggaagcmgcatttcactttagtaattcaatg

SEQ ID NO: 59467 - DNA, 50 bp, homo sapien
tctaactgactcttctatcatgtacrcttataacattgattttaaaaaac

SEQ ID NO: 59468 - DNA, 50 bp, homo sapien
ggctagccactgctgctttggttcayagtacacacaaggtacgctatatg

SEQ ID NO: 59469 - DNA, 50 bp, homo sapien
tgctgccatccaatcaactacattayctgaatgcttctttaaatgcctgc

SEQ ID NO: 59470 - DNA, 50 bp, homo sapien
agcaaacatacggttaagtagttaargtagccggtacactatgaacagcc

SEQ ID NO: 59471 - DNA, 50 bp, homo sapien
caaccaccacattggtttggttgcargggaaattcagcttttggcttagc

SEQ ID NO: 59472 - DNA, 50 bp, homo sapien
ctattccaacttcttataaaaatgcyctggagaaattgtctcaacaatgt

SEQ ID NO: 59473 - DNA, 50 bp, homo sapien
aattcctgattcttgttatataagargaacaacctatttcgctcccagaa

SEQ ID NO: 59474 - DNA, 50 bp, homo sapien
cttcttactccatacaattttcctaygttacctcagccattccctggact

SEQ ID NO: 59475 - DNA, 50 bp, homo sapien
ctgctatttcctgcttccctttttcktcagattaattcacaacaatttag

SEQ ID NO: 59476 - DNA, 50 bp, homo sapien
ttcaatctgtttaataaagacgtgcsaatagagtgccaaaaagcatttaa

SEQ ID NO: 59477 - DNA, 50 bp, homo sapien
tatctgctggcaaggagaccattgaygcaggatatgaaatttcagagatc

SEQ ID NO: 59478 - DNA, 50 bp, homo sapien
aaataatttgaacattcctaactcawgcttattggaattttatgactttc

SEQ ID NO: 59479 - DNA, 50 bp, homo sapien
gcattggacactagtttttccaacaytacacttacagcactgcttgggat

SEQ ID NO: 59480 - DNA, 50 bp, homo sapien
aagctttctagtactcttaaaataastaaatggagtattatatatcaatt

SEQ ID NO: 59481 - DNA, 50 bp, homo sapien
ggagctcccatggtcattattgctaygcctttacccaagcctccctatta

SEQ ID NO: 59482 - DNA, 50 bp, homo sapien
gtgtctctctcatatctgagatttcyttctgcgcctcagacttggtcatg

SEQ ID NO: 59483 - DNA, 50 bp, homo sapien
ccagttatggcctgggaaatggttawgtaagaggaactgcttttaatgag

SEQ ID NO: 59484 - DNA, 50 bp, homo sapien
aatcaatttccttgaatgaacacaayttaccaaaagtattgatcccattt

SEQ ID NO: 59485 - DNA, 50 bp, homo sapien
gttaagcaggtcttctctaggtttamaacagaaatagctaaggaggcaga

SEQ ID NO: 59486 - DNA, 50 bp, homo sapien
gggcaatggaggctttgggagccaastgaacctttaatctcctcccccat

SEQ ID NO: 59487 - DNA, 50 bp, homo sapien
tgcttaacatcttcttcttccttgaygtctattattttctttcccataaa

SEQ ID NO: 59488 - DNA, 50 bp, homo sapien
agtcaaatgaaaattgtgcatttacyctaaatagacttatacagataaaa

SEQ ID NO: 59489 - DNA, 32 bp, homo sapien
gcacatttaatcccaasttgacttctgctttt

SEQ ID NO: 59490 - DNA, 50 bp, homo sapien
ctaaggaggactaagagattttactsaatagacttatctagcaggttaac

SEQ ID NO: 59491 - DNA, 50 bp, homo sapien
ctgtttgacttgtaattagcaaaaarttctccttggctcacacctgtaat

SEQ ID NO: 59492 - DNA, 50 bp, homo sapien
tccacaaaccacagagataagtgaaycattgatgagaaccaaaatggtgt

SEQ ID NO: 59493 - DNA, 50 bp, homo sapien
ataggaaaacaggtttcttataaggmaatgacaactaggcctaagaatga

SEQ ID NO: 59494 - DNA, 50 bp, homo sapien
tctagaccagcctcatcactgctcaytcaacagaagtctgatgaggaaaa

SEQ ID NO: 59495 - DNA, 50 bp, homo sapien
tgtttggtaaggagattaataaggayagaaggaagtcaggtggtattcat

SEQ ID NO: 59496 - DNA, 50 bp, homo sapien
actaaccaagcctcattcatatttayatttttggtttattccctagcaca

SEQ ID NO: 59497 - DNA, 50 bp, homo sapien
atagataacttgacaaagcaagacaratgacctggaaattaaaatcactg

SEQ ID NO: 59498 - DNA, 50 bp, homo sapien
cctcaatgtttttgacagctatttaygcttacagacagctagattccata

SEQ ID NO: 59499 - DNA, 50 bp, homo sapien
gtccagggaaggacctttcaccttgwctatatggcattatgtcatcacaa

SEQ ID NO: 59500 - DNA, 50 bp, homo sapien
gatgtgtgaaactgacaaaaaaggaktaaatccaggtttctagatttaaa

SEQ ID NO: 59501 - DNA, 50 bp, homo sapien
aatgtttccagaaaagggtgagaacrcagagaacatcttagtatttatgg

SEQ ID NO: 59502 - DNA, 50 bp, homo sapien
gaaggggtatctgtgaaggtattgcyaaggcaccaggcagtgaggaagat

SEQ ID NO: 59503 - DNA, 50 bp, homo sapien
gcctgtgttcaaacttggtgctgagyagagaaaacaagaaagtacttaag

SEQ ID NO: 59504 - DNA, 50 bp, homo sapien
gaattaaaatctattaagagtgtggyaaaaggtaaacataataataagca

SEQ ID NO: 59505 - DNA, 50 bp, homo sapien
gagcttagacattggcgagaaatgaycctggcatcaaatcccagctctat

SEQ ID NO: 59506 - DNA, 50 bp, homo sapien
agtgcaaattaaatggcatgtacacwatcattcccattcttaaaggatat

SEQ ID NO: 59507 - DNA, 50 bp, homo sapien
attcttttaacctacattcagccacrccgggaatgatgcttcttgacctg

SEQ ID NO: 59508 - DNA, 50 bp, homo sapien
ctgtgctcactgtgttcaataactcrgaaggagactgatgcaggcaagca

SEQ ID NO: 59509 - DNA, 50 bp, homo sapien
tcagataaagtggaaagaggttttcyatcccaagtgtatcagatcatttg

SEQ ID NO: 59510 - DNA, 50 bp, homo sapien
tgttcctcctcactgatgggacccasgttctataagaccattcctgggca

SEQ ID NO: 59511 - DNA, 50 bp, homo sapien
gcctcctccagtaacgactgagtaaytctcacacggtaaactagaatatg

SEQ ID NO: 59512 - DNA, 50 bp, homo sapien
gtacttgtagacccactctgtcagaygattaaattagttcccaggtaggt

SEQ ID NO: 59513 - DNA, 50 bp, homo sapien
attttcaaatagacacattcaaaacygaaaagaggtgaaattaattttaa

SEQ ID NO: 59514 - DNA, 50 bp, homo sapien
aggttttgggctgagccactagaacratggtgctggagaaagctgggaga

SEQ ID NO: 59515 - DNA, 50 bp, homo sapien
atcacactctatttatgtatcacaaycttttaacctaccccagaataccc

SEQ ID NO: 59516 - DNA, 50 bp, homo sapien
ttgagtgctaactaaaatgctaaatsaactttcaagttaagattaaaata

SEQ ID NO: 59517 - DNA, 50 bp, homo sapien
aggttctcttcctcagatctttgaayaagaatacattagctgacaatagt

SEQ ID NO: 59518 - DNA, 50 bp, homo sapien
tccctgtctcactattgtaaattggyagtgtgtatggcacataagttgtc

SEQ ID NO: 59519 - DNA, 50 bp, homo sapien
tctttcacactgtttggtacagagaygctcaaagcttttcccagggaaag

SEQ ID NO: 59520 - DNA, 50 bp, homo sapien
ctctttttttaacgaatagtgtctaygttaaggtatattttgcctgatat

SEQ ID NO: 59521 - DNA, 50 bp, homo sapien
atgacaggggcttatataagactgasctaaggtttcttctgggcttgctt

SEQ ID NO: 59522 - DNA, 50 bp, homo sapien
tggagtgttcccttacaggttcctgragctctgatcaactcgggcaaacc

SEQ ID NO: 59523 - DNA, 50 bp, homo sapien
cccttatacccattattgatctttayctgctgttactctcaaagttgacc

SEQ ID NO: 59524 - DNA, 50 bp, homo sapien
ctaggctgtgttaggaaaggggagartccataatcagtggtcatctgaca

SEQ ID NO: 59525 - DNA, 50 bp, homo sapien
agtatgttccagtctgaggtacttaygagcctgaataccacggctcccag

SEQ ID NO: 59526 - DNA, 50 bp, homo sapien
ctttgataaagaattgcttcaaatgycatcagagatattactatagagtt

SEQ ID NO: 59527 - DNA, 50 bp, homo sapien
ttgggattgtattcttcctaagcaayggcagagaactcatacccagattc

SEQ ID NO: 59528 - DNA, 50 bp, homo sapien
cagatgaagggaacaatcttgcaaargctgtaaagtaggaatgagtacaa

SEQ ID NO: 59529 - DNA, 50 bp, homo sapien
cctgttctgagggatgacttggttarattttagcaccttcttattcatct

SEQ ID NO: 59530 - DNA, 50 bp, homo sapien
agacattagaaggatgtaaacaacaytatgcgagaggctgtttgtttctt

SEQ ID NO: 59531 - DNA, 50 bp, homo sapien
ccctgagtatcagggggcctgcctgrtaagtcacaatgaaacagacagtg

SEQ ID NO: 59532 - DNA, 50 bp, homo sapien
gtgcctgtcagcctctgctctgtgayccggaaatacagaaatctctgcaa

SEQ ID NO: 59533 - DNA, 50 bp, homo sapien
ttatttttttattggtgtttctactytttagcatacagatcttgtatgta

SEQ ID NO: 59534 - DNA, 50 bp, homo sapien
atacgtaggcctagcttgtcccataragtgttaggtaaattgaacaacat

SEQ ID NO: 59535 - DNA, 50 bp, homo sapien
ctttctcctaattagcctagctgaayatccagtactacaatagcatttga

SEQ ID NO: 59536 - DNA, 50 bp, homo sapien
aaccatcataagttagggaccatcartattttatttttcagatctagaag

SEQ ID NO: 59537 - DNA, 50 bp, homo sapien
acttaattagtcctatccagtattargtaaggccaaggaatttcttggta

SEQ ID NO: 59538 - DNA, 50 bp, homo sapien
agtgcaagaggagctagggagacagmctatcagatggcagcgccggggat

SEQ ID NO: 59539 - DNA, 50 bp, homo sapien
tgaactctctctttcttctttaaccrggacatctatctcctgccctcaga

SEQ ID NO: 59540 - DNA, 50 bp, homo sapien
ataataatattaactgactgtatacraattccttggagtagcaaacaagt

SEQ ID NO: 59541 - DNA, 50 bp, homo sapien
cttctctccttccttgaggagcaccwagatcgggtggacaaataaacata

SEQ ID NO: 59542 - DNA, 50 bp, homo sapien
aaggagagaagccagcctgcaaggargatgcctaacagaaaacccactcg

SEQ ID NO: 59543 - DNA, 50 bp, homo sapien
aagtagaaattcctctataaaaagayacaagagttagtcaaggaaatcta

SEQ ID NO: 59544 - DNA, 50 bp, homo sapien
atctacaagtcaatttgagcagaacyggtatctttgccatactgccttta

SEQ ID NO: 59545 - DNA, 50 bp, homo sapien
agaacaaatgagaatgtcaaaaaagsctcttcagtctaacaagaaaacag

SEQ ID NO: 59546 - DNA, 50 bp, homo sapien
tatcatttaaacatattaaatcactsttagtacgcagagtgggcatcatg

SEQ ID NO: 59547 - DNA, 50 bp, homo sapien
atagttaacagtgttaaatatcctgwtaagttcacagtactgtgtaaggt

SEQ ID NO: 59548 - DNA, 50 bp, homo sapien
tttcattttctaaatattgatggtawgaaagaaataatttacctacaata

SEQ ID NO: 59549 - DNA, 50 bp, homo sapien
ccaggcattgttcaatcatattgtawctatcatctccgtgtaaaccccgt

SEQ ID NO: 59550 - DNA, 50 bp, homo sapien
tttggtggttgttccaaagaaatackatcatccacaggcgtagattcaga

SEQ ID NO: 59551 - DNA, 50 bp, homo sapien
attttacaaatatgtggaaattaaayaacgtgcttttgaacaaccaatga

SEQ ID NO: 59552 - DNA, 50 bp, homo sapien
ggcagtctatagaactaatgcagtarcactgtgttttttacaagcagtaa

SEQ ID NO: 59553 - DNA, 50 bp, homo sapien
catattacatcaaacaatttatcagraatgggatttatcagaaatgtaag

SEQ ID NO: 59554 - DNA, 50 bp, homo sapien
tggaaagatgaaagaattgcccagaraacattaaattatgtacatagctt

SEQ ID NO: 59555 - DNA, 50 bp, homo sapien
ataactgcccacagcctgctcaaaaytttatttcacagcctgggtgcctg

SEQ ID NO: 59556 - DNA, 50 bp, homo sapien
cttaaaccctgtggattacgtgtaarctgagtcattcttacagtaagcag

SEQ ID NO: 59557 - DNA, 50 bp, homo sapien
cctcagaagcagaggaggtaaaaagmtgacaaacagcctgggcacaggag

SEQ ID NO: 59558 - DNA, 50 bp, homo sapien
agtcaggtggattctttgtaaaaacrattacctgccaatttatttactac

SEQ ID NO: 59559 - DNA, 50 bp, homo sapien
ttctatgattttctaagcccagcatmaagtgaagtcttctgcatgaatgc

SEQ ID NO: 59560 - DNA, 50 bp, homo sapien
ttgattatttgtgttttatacttcaytagattgttcttccgatgcattag

SEQ ID NO: 59561 - DNA, 50 bp, homo sapien
ttccctaacaggtggttgcaagagakattactatatttgaatagtttatt

SEQ ID NO: 59562 - DNA, 50 bp, homo sapien
gcttggaagtgggccagagaagtggwagctaagcatataaaattccagaa

SEQ ID NO: 59563 - DNA, 50 bp, homo sapien
gctctaatgtacttggtccacccgaygggcagagtctaggaggcatgcct

SEQ ID NO: 59564 - DNA, 50 bp, homo sapien
gatggagtttgctaaaggatagttaygaggaaacaggatggttatgagga

SEQ ID NO: 59565 - DNA, 50 bp, homo sapien
ttcagtgaataatcaattaggactayagtttcttgatgtatctagagcat

SEQ ID NO: 59566 - DNA, 50 bp, homo sapien
ctgaaagaaacggaaagctttgtaaygatacgtgtggttacgtgtggtct

SEQ ID NO: 59567 - DNA, 50 bp, homo sapien
gtgttctagccaggatccaaacataractgaatcaggagcccaagatctt

SEQ ID NO: 59568 - DNA, 50 bp, homo sapien
cctactatccattttatacatgagasaccttaggctcagggtcgataggc

SEQ ID NO: 59569 - DNA, 50 bp, homo sapien
aaaaatatcacacagacgcttagtgmaatatacatatacgtatcactcta

SEQ ID NO: 59570 - DNA, 50 bp, homo sapien
cccatttcccagaataagatccttarcaggtgctcatataccttgacact

SEQ ID NO: 59571 - DNA, 50 bp, homo sapien
ccaacactactcctagagaggattcraaactaagcttaaaacttgcattg

SEQ ID NO: 59572 - DNA, 50 bp, homo sapien
aaggaatactacacaggatagaacaygataatatgcgtgagccacactgg

SEQ ID NO: 59573 - DNA, 50 bp, homo sapien
ggagtcatacccattgactttctgckctcctggatgagatttaagtctct

SEQ ID NO: 59574 - DNA, 50 bp, homo sapien
cctcagttcatcctctgagagtacascaggtcaagagaatccccaggagg

SEQ ID NO: 59575 - DNA, 50 bp, homo sapien
attgaaaacacatagaagcatctacygaatcaacaaggggtcacaactcc

SEQ ID NO: 59576 - DNA, 50 bp, homo sapien
tatcttttttctctttagcctgtcayactggagatccaaccacatgctgc

SEQ ID NO: 59577 - DNA, 50 bp, homo sapien
tgtgccaaaaatgccttgacgcctcrttgagtttgaactttcctcaaata

SEQ ID NO: 59578 - DNA, 50 bp, homo sapien
ccttttagcagctgtagtccttacaraattgtccaatttgttccttttaa

SEQ ID NO: 59579 - DNA, 50 bp, homo sapien
acgacagctgaattattcattcgtgyattcgacattttttaaatgaatgc

SEQ ID NO: 59580 - DNA, 50 bp, homo sapien
ttaggaaaagggaacaaagttggatkagactgttcactcaagtcgtcctt

SEQ ID NO: 59581 - DNA, 50 bp, homo sapien
catcaaaactgtaactttaagtagcrgaataacttcacatttcacatcta

SEQ ID NO: 59582 - DNA, 50 bp, homo sapien
ataatattcttctgctcacctatcaktctactatattgtaggaaggctgc

SEQ ID NO: 59583 - DNA, 50 bp, homo sapien
agatcactagcagatgattaataaartacgttgcagataagaagaggaaa

SEQ ID NO: 59584 - DNA, 50 bp, homo sapien
agttagccacctaactgtaactgatwaatataatacaagaagaattttga

SEQ ID NO: 59585 - DNA, 50 bp, homo sapien
gtgtgtgattctcttacactgctcaygctaaagataactgactgcttgat

SEQ ID NO: 59586 - DNA, 50 bp, homo sapien
gttgcataaccaagcactgggtaagkcccttctgctagatctaaatgcct

SEQ ID NO: 59587 - DNA, 50 bp, homo sapien
gcttcactaaaattagatacagttarcaaataaacaaatgaaaaggtgat

SEQ ID NO: 59588 - DNA, 50 bp, homo sapien
tgataaatggggcaaagaagtgagamtaacaataggcaattagcagtgac

SEQ ID NO: 59589 - DNA, 50 bp, homo sapien
attcctgactcctgtgtccatgaaasacatcactaatcaatctggtactc

SEQ ID NO: 59590 - DNA, 50 bp, homo sapien
ctttgtttcctcatatgttttgccaratagcagtagcagaatgaaaagat

SEQ ID NO: 59591 - DNA, 50 bp, homo sapien
tacactttgtctttggagtggggaasaacacctgtatcaagaagcaggaa

SEQ ID NO: 59592 - DNA, 50 bp, homo sapien
ctaagtgcagcttgtctttttatcayggtcactggccagtctggttggcc

SEQ ID NO: 59593 - DNA, 50 bp, homo sapien
ctaatattatccaaataaaaatgtcragagtatgttgtgaacttgccaaa

SEQ ID NO: 59594 - DNA, 50 bp, homo sapien
ttttaaaagataaatttaatcttccmatttatcattctttaaaagattac

SEQ ID NO: 59595 - DNA, 50 bp, homo sapien
tgagacacaactctttcaaacggaamaaattcatttcaaaaggaaaccag

SEQ ID NO: 59596 - DNA, 50 bp, homo sapien
tttatatcttttgtgccacgccatamcactgtggaaacaacatgtagata

SEQ ID NO: 59597 - DNA, 50 bp, homo sapien
acaagttctcagatggagaaaaaaartactgtgaaagaccctcatgaatc

SEQ ID NO: 59598 - DNA, 50 bp, homo sapien
cagtctcattatgaaaaaaatatcasacaaattccaattggggaacattc

SEQ ID NO: 59599 - DNA, 50 bp, homo sapien
aatgcagacccactgaatccgaataragctgaataagctccctatgtgat

SEQ ID NO: 59600 - DNA, 50 bp, homo sapien
ttaaaagaactgccaaaaacaagccragtgagtaagccaagaagcagggc

SEQ ID NO: 59601 - DNA, 50 bp, homo sapien
tctctttgtacctgtttctggaatgyatcaagactaaatctgacactgaa

SEQ ID NO: 59602 - DNA, 50 bp, homo sapien
gacttgctaatgttaccttcaaaccraaagcttaatcttcaagataggaa

SEQ ID NO: 59603 - DNA, 50 bp, homo sapien
actgagcatttccagagcggcttaamatttctctcccaggacgtgtttca

SEQ ID NO: 59604 - DNA, 50 bp, homo sapien
aatcccagaaaactctgctgtggatsaagaagcctaagcccctctggtgt

SEQ ID NO: 59605 - DNA, 50 bp, homo sapien
tgcagtggtcacctttagcatgcacratttcaccatatatttgtgcctta

SEQ ID NO: 59606 - DNA, 50 bp, homo sapien
acagccacaggcagttagttgaaacrcgtcctgggagagaaatgttaagc

SEQ ID NO: 59607 - DNA, 50 bp, homo sapien
gtagtctctctgttctgagcaacccraagctggatgtggaatgacaaaag

SEQ ID NO: 59608 - DNA, 50 bp, homo sapien
atgaaagaggctaaaaaagatttaasgctaagcactgagaaatccacaga

SEQ ID NO: 59609 - DNA, 50 bp, homo sapien
cagagaggttaagtctcttgctaaakattgagaagtgcggtgattgtgtg

SEQ ID NO: 59610 - DNA, 50 bp, homo sapien
actgctctttcatgggcagcccacawataggatctctttttctatgccca

SEQ ID NO: 59611 - DNA, 50 bp, homo sapien
ggagggcacgcagtgatggacatacyggctctagagtactggttgtcaaa

SEQ ID NO: 59612 - DNA, 50 bp, homo sapien
aaccactgctttaaagcatgaaaccyaggacaggacaagctctagaagaa

SEQ ID NO: 59613 - DNA, 50 bp, homo sapien
ggataccttcttttaatatctcctayctgatttcccatatgcaaatcaac

SEQ ID NO: 59614 - DNA, 50 bp, homo sapien
tgtgacacgggtgggaagacacaaaygagtaattaacaacataatatttt

SEQ ID NO: 59615 - DNA, 50 bp, homo sapien
atcaataccttaattaaaaacccaaytgagagtgacatcagcaagacgaa

SEQ ID NO: 59616 - DNA, 50 bp, homo sapien
caggggctgagaaatgtagaggtgcraatgtaacttgtggtgagcgttac

SEQ ID NO: 59617 - DNA, 50 bp, homo sapien
gtgccttggtggttgtgcacaataartaattgaattatcctcctcataat

SEQ ID NO: 59618 - DNA, 50 bp, homo sapien
ctcatagagtgtgggagacaggcagwagacatataatttcaggtaggtat

SEQ ID NO: 59619 - DNA, 50 bp, homo sapien
acacggcaaaaggacccagcagtccragaacttgcccacctaaaatggtc

SEQ ID NO: 59620 - DNA, 50 bp, homo sapien
tgagatcctcttagccaaagtgtctyacatctaaatcttcctttgcttag

SEQ ID NO: 59621 - DNA, 50 bp, homo sapien
catatgcaggacaagggtggaaaaargaaatataggtgtaaaagtttatt

SEQ ID NO: 59622 - DNA, 50 bp, homo sapien
cttttttccacccttgtcctgcatawgtttattcacctttgcaaaccagt

SEQ ID NO: 59623 - DNA, 50 bp, homo sapien
gcaagttagcccataataactactayagcaagtgaaaaggaacccagcct

SEQ ID NO: 59624 - DNA, 50 bp, homo sapien
tagaaacagaaaaaaacatatatacsgatgttctgggggtaaagagcagc

SEQ ID NO: 59625 - DNA, 50 bp, homo sapien
cctattgcctcctggaaaaagttaamgattctatttgatcctcgctttct

SEQ ID NO: 59626 - DNA, 50 bp, homo sapien
acagagtctagacagtcagagcttayaacattcattgtcttagagacaaa

SEQ ID NO: 59627 - DNA, 50 bp, homo sapien
tggagcaagaagactattttgagcargatgggaaaggaagaagaatggag

SEQ ID NO: 59628 - DNA, 50 bp, homo sapien
gatgaagatatgtggtggggatccaygctggaaaaagatatcacagggag

SEQ ID NO: 59629 - DNA, 50 bp, homo sapien
tggttttaggagcgggtagagaagaycctagaaatgaaatgccaggctct

SEQ ID NO: 59630 - DNA, 50 bp, homo sapien
ctgcccagggctgctctgaaagtcartatcccagccttgccctgtagggg

SEQ ID NO: 59631 - DNA, 50 bp, homo sapien
gccaccaaagtatctgaacccagaaytcacaacaggaacgtgtactcaac

SEQ ID NO: 59632 - DNA, 50 bp, homo sapien
agaccgggggagaataactgtagtcragcagggtcattggaagaggggtc

SEQ ID NO: 59633 - DNA, 50 bp, homo sapien
tctccaaaatttaattcaggtagcartatatctcctataatacaccaaga

SEQ ID NO: 59634 - DNA, 50 bp, homo sapien
ccttcaaatgtactcagataagaccrggggagaataactgtagtcaagca

SEQ ID NO: 59635 - DNA, 50 bp, homo sapien
caggtattataagcactggctgtgascatttgtgcagagtagtgaatgag

SEQ ID NO: 59636 - DNA, 32 bp, homo sapien
cgcattttacacaaatyatagttttctgtgtg

SEQ ID NO: 59637 - DNA, 50 bp, homo sapien
aaacaaaaaaccttagcccatatgaraaagattccacactgatttgagcc

SEQ ID NO: 59638 - DNA, 50 bp, homo sapien
tcctgggcctcaactataaaatgaargcatgagataagttcatatttaaa

SEQ ID NO: 59639 - DNA, 50 bp, homo sapien
tacttttctaaacaactgggttatayggttaatgcagatcaattatctgg

SEQ ID NO: 59640 - DNA, 50 bp, homo sapien
cacactttattagaaatctctagccyattttttgacacatacttttgata

SEQ ID NO: 59641 - DNA, 50 bp, homo sapien
aaccaacatggtactggtctaaaaayaggtacgtagtcaaatggaataga

SEQ ID NO: 59642 - DNA, 50 bp, homo sapien
ctcagaataatgaaaccgtatatggmaaactcacaaccaacatcatactg

SEQ ID NO: 59643 - DNA, 50 bp, homo sapien
taagtgcttgctagcatgattatcaytattttagggtttgatgttttggg

SEQ ID NO: 59644 - DNA, 50 bp, homo sapien
agtaacatggaggcagttaataaatkaggtatacttcacagtgcaccagg

SEQ ID NO: 59645 - DNA, 50 bp, homo sapien
gtgacatctagaggccacattcccartaattaagagcaaatgccatagct

SEQ ID NO: 59646 - DNA, 50 bp, homo sapien
tgagtagctgagcttccataaatcaygtttcataacttggagctgcagag

SEQ ID NO: 59647 - DNA, 50 bp, homo sapien
tctagcccttgtctccacctctcaaraaaaagctagtgtggtttcagtgg

SEQ ID NO: 59648 - DNA, 50 bp, homo sapien
cagacagagctgggatctagggggartaaatcagtggcaggtttagttta

SEQ ID NO: 59649 - DNA, 50 bp, homo sapien
tttctttccatccagtcatatctgcraggcatagttatcccatcaagcct

SEQ ID NO: 59650 - DNA, 50 bp, homo sapien
gtgactcaggaatttgacattggttytcctgtgtgtgctgaaaagatggg

SEQ ID NO: 59651 - DNA, 50 bp, homo sapien
gcttggttgagtcccatgcacaagaytccattggttttaacatttgtgtg

SEQ ID NO: 59652 - DNA, 50 bp, homo sapien
ataggaactttggaccttgaacttaygtatcatgtggagaagagccaatt

SEQ ID NO: 59653 - DNA, 50 bp, homo sapien
gttagaagaggaaggaatgtataccwggggtgcactacaaactctagacc

SEQ ID NO: 59654 - DNA, 50 bp, homo sapien
gactggtgaagctctaagggtcataytatactccttccacccacctctcc

SEQ ID NO: 59655 - DNA, 50 bp, homo sapien
tttcaggtactggaaaggctgacaayaggatgactgcttgagcccaggag

SEQ ID NO: 59656 - DNA, 50 bp, homo sapien
gtactgcccagttgagtctccaggcsaataataaagactgtaccaaagat

SEQ ID NO: 59657 - DNA, 50 bp, homo sapien
cctcagagtgctgttgaggtttaaaraattcccacaggaggctctcaccc

SEQ ID NO: 59658 - DNA, 50 bp, homo sapien
ggccccaggcaggtaaatcctactayggaatggagagctcagactctaga

SEQ ID NO: 59659 - DNA, 50 bp, homo sapien
acttacagttaagcgggtgtaactayggtgcttttatactgccaaatgaa

SEQ ID NO: 59660 - DNA, 50 bp, homo sapien
tgaggacagtgtcatgtcccatacawcttactatttctctgtctacttgg

SEQ ID NO: 59661 - DNA, 50 bp, homo sapien
ctcagcttggagtggggtcaattctyaaaggaaatgacatcacctcatct

SEQ ID NO: 59662 - DNA, 50 bp, homo sapien
ggaaaacatgtccaagatagcctacrggacccaaaaggaggaatgaaaga

SEQ ID NO: 59663 - DNA, 50 bp, homo sapien
cttataatgaactatagaattttaaygggtactctcaaatacaggcttct

SEQ ID NO: 59664 - DNA, 50 bp, homo sapien
ttgtttcctgagatgtgcccgtttayatgactccagccacggctcatggc

SEQ ID NO: 59665 - DNA, 50 bp, homo sapien
ctccacttattcacatctaactaaaycctataagcgttgggatttagttt

SEQ ID NO: 59666 - DNA, 50 bp, homo sapien
cacagggacactgctccacacactasgctgtgcagatactagtgaattgc

SEQ ID NO: 59667 - DNA, 50 bp, homo sapien
aggagaatggttcccttaggctgagsattgttttttgtttgtttgtttgt

SEQ ID NO: 59668 - DNA, 50 bp, homo sapien
ctccctgaaaattctgatcaagttargattaaaggccattgaaaaggcat

SEQ ID NO: 59669 - DNA, 50 bp, homo sapien
ctccagcctgtcatggccaatccgargtagcaggaaacactctccaggaa

SEQ ID NO: 59670 - DNA, 50 bp, homo sapien
gaagggataaacaaaaataagatcamgtgaaatgggaaaaccctcaaaga

SEQ ID NO: 59671 - DNA, 50 bp, homo sapien
ggtgattagtgtggccagggaagaamgaaacttaagagtgaccacagttt

SEQ ID NO: 59672 - DNA, 50 bp, homo sapien
tttcttagctgtttctctgcctttcrccttcttagtttctctctctagct

SEQ ID NO: 59673 - DNA, 50 bp, homo sapien
tagtttctctctctagctcttcttcrttagaactgttctagaaataattg

SEQ ID NO: 59674 - DNA, 50 bp, homo sapien
ggaaagttaacaaaaggctggaaaastgttatagcaatttggcattttct

SEQ ID NO: 59675 - DNA, 50 bp, homo sapien
atctttcctgtttgttccctttagcrcttttatgtcctcacagaaagtag

SEQ ID NO: 59676 - DNA, 50 bp, homo sapien
tgtttgtaatagtgaatttggaaaayggataaagtatactatattcttat

SEQ ID NO: 59677 - DNA, 50 bp, homo sapien
ttgtaaattctttgttttcttatacwcaggcccacagtacagcctcacat

SEQ ID NO: 59678 - DNA, 50 bp, homo sapien
tatttttgctgggaaaggagagcgarcttttcgttggttgctttgacttc

SEQ ID NO: 59679 - DNA, 50 bp, homo sapien
cccataaagcactgacaagaccacaractccctgtcacatagttaaaaat

SEQ ID NO: 59680 - DNA, 50 bp, homo sapien
catttgcccaaacatgttctcaagaygtgtacctactaaaggtagtacac

SEQ ID NO: 59681 - DNA, 50 bp, homo sapien
gtaatctttaagtagcttaactgtaygccaggagaaaaaaaaaaattcca

SEQ ID NO: 59682 - DNA, 50 bp, homo sapien
tcatggtactcttctaaattggagayggtgataccttgaaatgaagggaa

SEQ ID NO: 59683 - DNA, 50 bp, homo sapien
tcagttaagatttacttaacttttcrctggttttctgtatctaagacttg

SEQ ID NO: 59684 - DNA, 50 bp, homo sapien
tgctactggatatgatctcagatagratgagatttgtcaaggcatgaagc

SEQ ID NO: 59685 - DNA, 50 bp, homo sapien
ttcacccttactttagcccctgtcaycttgttcaacttccgtggtgatgg

SEQ ID NO: 59686 - DNA, 50 bp, homo sapien
gaagtattttggaggaagtgcactawgctataaaggatttctcgaaaaag

SEQ ID NO: 59687 - DNA, 50 bp, homo sapien
aatgatgagctagcctgtaattatcrgtgcctatatcctctctacagctt

SEQ ID NO: 59688 - DNA, 50 bp, homo sapien
cgggttcaaagagagaccatctgagyacaagtgatgggcgtggcacatcc

SEQ ID NO: 59689 - DNA, 50 bp, homo sapien
ggtaacattgaaacagaaatttgaaygactagagggaactaaccacgtgg

SEQ ID NO: 59690 - DNA, 50 bp, homo sapien
agatgagatgagctaagtaaggtatkaaatagagtgtttacagaagtccc

SEQ ID NO: 59691 - DNA, 50 bp, homo sapien
acaaatgtaccagggatgtcttcacyaagcggtatagattaggattaata

SEQ ID NO: 59692 - DNA, 50 bp, homo sapien
acatgcaattcatgttagacctaacrctattcaaatccaagagtaatgtg

SEQ ID NO: 59693 - DNA, 50 bp, homo sapien
agctccagcacctcatctgctctgaygccctagggacatgtctgtgctct

SEQ ID NO: 59694 - DNA, 50 bp, homo sapien
tttttgaaaatctaaaaatttgaaarctcctcatttgtgaaatctcggtg

SEQ ID NO: 59695 - DNA, 50 bp, homo sapien
gtctgaatgtatcctaatcctctcaygggagttgttcactttagctgaga

SEQ ID NO: 59696 - DNA, 50 bp, homo sapien
ctgctcctttgagtagctactagackgctgtttttcaccatgaatgcaca

SEQ ID NO: 59697 - DNA, 50 bp, homo sapien
atatgaagacttacgaaggtgtctcrcatctgtttttttacagacaggtg

SEQ ID NO: 59698 - DNA, 50 bp, homo sapien
aaaaaaaagatgaattggcccataaygcttctcttgagttgttcaaacct

SEQ ID NO: 59699 - DNA, 50 bp, homo sapien
gttgctttcaacaaatgtcttctaaycaaagggctttttgtagtgggaga

SEQ ID NO: 59700 - DNA, 50 bp, homo sapien
gcgttgactttacaaaatcctttcaygccccacatcattgattaaagatt

SEQ ID NO: 59701 - DNA, 50 bp, homo sapien
tggctgtgtactgcaatggataacartaaatgcaaacaacagagtagcca

SEQ ID NO: 59702 - DNA, 50 bp, homo sapien
tacatccctgcagcactcaggaaaargatgaaatggacaacagggactct

SEQ ID NO: 59703 - DNA, 50 bp, homo sapien
gcacatgaggaaaaacatctggatartttagaacttctcaggtccacagc

SEQ ID NO: 59704 - DNA, 50 bp, homo sapien
cagccaaaggaccgggatggtttccrgattcacatgcacatgaggaaaaa

SEQ ID NO: 59705 - DNA, 50 bp, homo sapien
ggccctctgccaacatactggtacaygaaagggctgaggtccctgcccaa

SEQ ID NO: 59706 - DNA, 50 bp, homo sapien
tgccgctgtcagcatgccagctcacyggtcgatgtgcacagcgaacgctg

SEQ ID NO: 59707 - DNA, 50 bp, homo sapien
gttttctgtgaaattaatgaaagaayggtctgagaaactgtttgagggta

SEQ ID NO: 59708 - DNA, 50 bp, homo sapien
caaatatggagaaaaccttttatctkaaagagcaagattgttctgtaagg

SEQ ID NO: 59709 - DNA, 50 bp, homo sapien
aacttggagcagtggcccacgaattkaaactcaggcctctaggaaagggg

SEQ ID NO: 59710 - DNA, 50 bp, homo sapien
actggttatttcttcctgttcacatratattgttcatttgcttttttgaa

SEQ ID NO: 59711 - DNA, 50 bp, homo sapien
cagagaaactgcagggccaacacaayctgtctgttcagggattaggccca

SEQ ID NO: 59712 - DNA, 50 bp, homo sapien
taatagacagaagtttacataaaaawttgcttacttggcatcagagaact

SEQ ID NO: 59713 - DNA, 50 bp, homo sapien
gtgggaggtgatcggataatgggacraaatgcttatgaatggttcagtaa

SEQ ID NO: 59714 - DNA, 50 bp, homo sapien
gtcaggccttggacataagccatcaygtttgtaaaatacattatatgaca

SEQ ID NO: 59715 - DNA, 50 bp, homo sapien
ttccttcctgtagtctgaggaatacyggtaatgtagggagaaaaaaaaaa

SEQ ID NO: 59716 - DNA, 50 bp, homo sapien
actgtagccctatgaaaggtaatgcyattaagacattagtggtcaagtct

SEQ ID NO: 59717 - DNA, 50 bp, homo sapien
ctggaggtcagaattctggtacaagyctaattggaaaaaagtccttgtgt

SEQ ID NO: 59718 - DNA, 50 bp, homo sapien
tgacttctgagagaggaaacacctaygcaatccgctgacagtcttggttg

SEQ ID NO: 59719 - DNA, 50 bp, homo sapien
tcttagcagaaggaggagttaatagyaacatatgtaggccgggcacgtag

SEQ ID NO: 59720 - DNA, 50 bp, homo sapien
ctatgcctgagactagtcaggaagayggggtgatgcctgatgatctatgt

SEQ ID NO: 59721 - DNA, 50 bp, homo sapien
tacgtctattttataaaggcctggcraatgaaagaactcaatgggttttg

SEQ ID NO: 59722 - DNA, 50 bp, homo sapien
aggtaggagatgaagatgtaggagaygaagatgtaggagtggcaaaggaa

SEQ ID NO: 59723 - DNA, 50 bp, homo sapien
gcctgagatccaaatacgtgagagaktcactcattctttcattcatgcat

SEQ ID NO: 59724 - DNA, 50 bp, homo sapien
cattcaccctttactactctggctcyagctctaggtttttgcttggtgtg

SEQ ID NO: 59725 - DNA, 50 bp, homo sapien
gaagtctctgagtgagaaggtccaaytgtctgagagttcagtaactttat

SEQ ID NO: 59726 - DNA, 50 bp, homo sapien
cccccccactgcatctattacatacygatttactataaaatatacctatt

SEQ ID NO: 59727 - DNA, 50 bp, homo sapien
ataaatgccttccagaactatttacmatttctaacatttgttgagttttt

SEQ ID NO: 59728 - DNA, 50 bp, homo sapien
tccctcaggaaacattacatataacmaaagtgtcacttggagagtagtga

SEQ ID NO: 59729 - DNA, 50 bp, homo sapien
agacttgagtcttaataaattctcaracaattacatacttaactcaggag

SEQ ID NO: 59730 - DNA, 50 bp, homo sapien
cattcctttttagtttcccgagtacrcaatatgcaaaactgtggggttat

SEQ ID NO: 59731 - DNA, 50 bp, homo sapien
tcagggtgcacaaaggaatgaatagrtagaggacaaagattttagggcag

SEQ ID NO: 59732 - DNA, 50 bp, homo sapien
taaagaaaccagctgaattttacaaygaatcctgccctttaagtttggga

SEQ ID NO: 59733 - DNA, 50 bp, homo sapien
acttccatataatatgaaagtaacaytagaactaataggcactaagtctg

SEQ ID NO: 59734 - DNA, 50 bp, homo sapien
aaggtcttcggaacagtactagaaaygcagattacttgagcatctcaaaa

SEQ ID NO: 59735 - DNA, 50 bp, homo sapien
aggtaacactagcagttttaactgaygatcctagaaatcttaggagctct

SEQ ID NO: 59736 - DNA, 50 bp, homo sapien
ggtcaactctggacagctgtctgacygggaactcagtgtttaattatcct

SEQ ID NO: 59737 - DNA, 50 bp, homo sapien
ggaatgggcctggttgtgaatgtcayggtcaactctggacagctgtctga

SEQ ID NO: 59738 - DNA, 50 bp, homo sapien
ttgccagtttgacaactactcatcawcttgtaatgattctttggacaatt

SEQ ID NO: 59739 - DNA, 50 bp, homo sapien
aatacttacttcgtagcttatacacrcaggcattttgttcttatcggaac

SEQ ID NO: 59740 - DNA, 50 bp, homo sapien
gaaaaataagagtcatttctacatamccagcattgttacacagggatgtg

SEQ ID NO: 59741 - DNA, 50 bp, homo sapien
actttctgcttaattcaggagcttasaggattcttcaaagagtgtgtaag

SEQ ID NO: 59742 - DNA, 50 bp, homo sapien
tggagaatgttggggagtaaagagargagtttccttacaaataatggtgg

SEQ ID NO: 59743 - DNA, 50 bp, homo sapien
gttgattgatctatgctgtacaatckaagtaaaaacagagtgcttgctat

SEQ ID NO: 59744 - DNA, 50 bp, homo sapien
taacaggtactcaatgagtaaatgaygcactgtcctcagctatcattttg

SEQ ID NO: 59745 - DNA, 50 bp, homo sapien
atcatacatgggcatgaaatacagasagaagacataatagtaatagtaat

SEQ ID NO: 59746 - DNA, 32 bp, homo sapien
cttgttgtacagtgcarcagtttcatagctta

SEQ ID NO: 59747 - DNA, 50 bp, homo sapien
aaagggctaaagggatgcacatttargaatattgttgctgattgccaaaa

SEQ ID NO: 59748 - DNA, 50 bp, homo sapien
atgccactcatgcttttgggttacaytgcattcttgctgctaattttgca

SEQ ID NO: 59749 - DNA, 50 bp, homo sapien
ggctggctcacctgtattattctcayagatttccaataatatgaaaaaag

SEQ ID NO: 59750 - DNA, 50 bp, homo sapien
atataagcaaaaatatttaagggaayacaactaacttataaatatgtgtt

SEQ ID NO: 59751 - DNA, 50 bp, homo sapien
tgttctaaagattttactgcctctaygctctcttctttgagtgactttaa

SEQ ID NO: 59752 - DNA, 50 bp, homo sapien
ggaaagatgctgagctcaggttagcrctgttgagtttaaagtgccaatga

SEQ ID NO: 59753 - DNA, 50 bp, homo sapien
ggagatgattgtatgttaggtttccrcgaaaagaggtaggtatatgtaat

SEQ ID NO: 59754 - DNA, 50 bp, homo sapien
aaaagaggggccacaacactggtacragatgatattggtgtgcatccccc

SEQ ID NO: 59755 - DNA, 50 bp, homo sapien
tgttgcatgtatgatcttagttcaayctcatacgccatatggtacctgtg

SEQ ID NO: 59756 - DNA, 50 bp, homo sapien
gcagtgctggtctgttccagcttgasgactctatatggaggtagatgttg

SEQ ID NO: 59757 - DNA, 50 bp, homo sapien
tgtatgtaagttcttgagctccttarattttgttcttgtagccaaagcag

SEQ ID NO: 59758 - DNA, 50 bp, homo sapien
caacattgcttacctagagcagtaaytgtcaccaccttagaactggtttt

SEQ ID NO: 59759 - DNA, 50 bp, homo sapien
gttaaaatattctccatacctcactyagtagtatcattctttattttttg

SEQ ID NO: 59760 - DNA, 50 bp, homo sapien
ccctccaatgaatagatgagtgaaasagtgaccctaatgttgcactgaca

SEQ ID NO: 59761 - DNA, 50 bp, homo sapien
ctgcaataatgatgtcttaccaaaakatatcaaagttatttacatatgcc

SEQ ID NO: 59762 - DNA, 50 bp, homo sapien
ctactttatatcaccctttataaaaycactggtgtgaagaaaaactaaac

SEQ ID NO: 59763 - DNA, 50 bp, homo sapien
ggtaagcatgacagataaagcatagygaaggatggggaagtgggtgactt

SEQ ID NO: 59764 - DNA, 50 bp, homo sapien
tggatcaaaagaactgtggtagtcaygggagagaacaattaatttggtgg

SEQ ID NO: 59765 - DNA, 50 bp, homo sapien
ctggctgttttatgtatccttctacsagaaagacttcctgaactgatata

SEQ ID NO: 59766 - DNA, 50 bp, homo sapien
gagtgacgtcatttcatgtatttatsaaaaagcaagaataggtgaatagt

SEQ ID NO: 59767 - DNA, 50 bp, homo sapien
aaatgtagcctaatttgaatggcacmgtctgttagactcctcttgatacc

SEQ ID NO: 59768 - DNA, 50 bp, homo sapien
ggaaggtagtcatctgctcctgaacrgatagtgctcctcagtgtctccct

SEQ ID NO: 59769 - DNA, 50 bp, homo sapien
gtgtacctttcataaagatgaaagaygcatgaaaggctgaatagaaggta

SEQ ID NO: 59770 - DNA, 50 bp, homo sapien
gatgccctgctgtactctgttgacartaaaaactgattcaagcctttgga

SEQ ID NO: 59771 - DNA, 50 bp, homo sapien
acatggaaattgatcttgatactagrcctttacatcttaagtttgaagat

SEQ ID NO: 59772 - DNA, 50 bp, homo sapien
atttccatcctttatgtttgggttcragccctcattaactttaacatgga

SEQ ID NO: 59773 - DNA, 50 bp, homo sapien
atggttgaactaatatacattcctascatctgtgtaaaagccttcctatt

SEQ ID NO: 59774 - DNA, 50 bp, homo sapien
gtgctttctgctagtgagttaaaaakcctccttattctgatagctataca

SEQ ID NO: 59775 - DNA, 50 bp, homo sapien
aaccggtttggttcaattttagtaasatcagcaacaatggtaataatgat

SEQ ID NO: 59776 - DNA, 50 bp, homo sapien
ctctcccaggctgagatctcagaggracccagaaaattaaagaccctgag

SEQ ID NO: 59777 - DNA, 50 bp, homo sapien
caagacccaggaacaatttcaataaygagctagtagcagaatgacagagg

SEQ ID NO: 59778 - DNA, 50 bp, homo sapien
ttgctaattatgaaaaattcaagackggtataatctggacagtattgttc

SEQ ID NO: 59779 - DNA, 50 bp, homo sapien
tgaaaacatgccatctgaagtacaaytgaaaaagccggagagagatttag

SEQ ID NO: 59780 - DNA, 50 bp, homo sapien
aaacacttgcaagggctgcaaaagasgcaatcaaaacagaaactatgttt

SEQ ID NO: 59781 - DNA, 50 bp, homo sapien
gaagctggggcccagaatggtacaayggtcgggtctcttttctctctcta

SEQ ID NO: 59782 - DNA, 50 bp, homo sapien
gagtcgagcctagtaaatgtttttcmaagagcgcagtatggaaaggagga

SEQ ID NO: 59783 - DNA, 50 bp, homo sapien
agtgccacccacttgggctaatccargagaccttgcaaatgagagaggca

SEQ ID NO: 59784 - DNA, 50 bp, homo sapien
aagtgcttgtatgtacactatgataygattgtagagcctatggtggctgg

SEQ ID NO: 59785 - DNA, 50 bp, homo sapien
accccatgctggacttgaaggacaaygatggatcagggaaaacggtaagt

SEQ ID NO: 59786 - DNA, 50 bp, homo sapien
attatctcatttgatcctcaaaacartcgtgggaaataggcaccccagtc

SEQ ID NO: 59787 - DNA, 50 bp, homo sapien
gtttaccattccctagttatgagtayaaatatgcaccccagattacatca

SEQ ID NO: 59788 - DNA, 50 bp, homo sapien
ctgggtctgactcttagctgttagartaaaaaacaacatttttggggcct

SEQ ID NO: 59789 - DNA, 50 bp, homo sapien
tctcctggttaattaagttacatcayggagcccactgaactgggatttta

SEQ ID NO: 59790 - DNA, 50 bp, homo sapien
ctacttcaatatattggaagaaatgycagcaatttggaggttggtaacgt

SEQ ID NO: 59791 - DNA, 50 bp, homo sapien
ccggccagaatctgacttttgagtarctaattctgtcgacagtttaaacg

SEQ ID NO: 59792 - DNA, 32 bp, homo sapien
gtgcttctatgcttaakagtagtcataataat

SEQ ID NO: 59793 - DNA, 50 bp, homo sapien
atctgaaaatggttgaaagaaaatargtggccagctggcagggccttctc

SEQ ID NO: 59794 - DNA, 50 bp, homo sapien
aaatgaaaaatcttccagattccaarattaccggtgttttattttttatt

SEQ ID NO: 59795 - DNA, 50 bp, homo sapien
gtcctgtcctgcttgttgcttagacmatgcctagtccagataacactggc

SEQ ID NO: 59796 - DNA, 50 bp, homo sapien
tatgtgtatttttcaattactgagawtcctgttaagatcccctactgtga

SEQ ID NO: 59797 - DNA, 50 bp, homo sapien
tgtctcatacatcgttttattaccayaagaatttgcacaacatctgacac

SEQ ID NO: 59798 - DNA, 50 bp, homo sapien
ggccgaatgagtaaataatgaatgaracgaatgttgaaagaaaaacattt

SEQ ID NO: 59799 - DNA, 50 bp, homo sapien
gaggactttctagacccttattctayattcattgctccaacttctcttct

SEQ ID NO: 59800 - DNA, 50 bp, homo sapien
tcttcagggtggtgtcctaatctcaygatggaggagatgattgtacctgc

SEQ ID NO: 59801 - DNA, 50 bp, homo sapien
ggcctggacgtcccttaggaggtgascttcatgttgttcctgaaaggatt

SEQ ID NO: 59802 - DNA, 50 bp, homo sapien
gagaagggtggatggtgaggaagcastaacacttgttccaaggcttgatg

SEQ ID NO: 59803 - DNA, 50 bp, homo sapien
catataccactggtcctctttttaaytatgtatgctctaaggcacactag

SEQ ID NO: 59804 - DNA, 50 bp, homo sapien
aggtggtcaacaatattcattagtarattctttgtattcttcctgagggc

SEQ ID NO: 59805 - DNA, 50 bp, homo sapien
atccagaagtgcaagcagaaaaacayatgacaaggaacaatcaggagatg

SEQ ID NO: 59806 - DNA, 50 bp, homo sapien
tctgggctcaaagttctagcacaaartgaaaattaatgtccacattcatg

SEQ ID NO: 59807 - DNA, 50 bp, homo sapien
tccaccatctatatataatgttctgkatctaagtaagcattgaagaaatg

SEQ ID NO: 59808 - DNA, 50 bp, homo sapien
aaccctaatgaaagcccagggcttayacaaagtgcagcaagggagctggt

SEQ ID NO: 59809 - DNA, 50 bp, homo sapien
agagagcatagaacacgtgagaaacytaggccattatacaggcaatattt

SEQ ID NO: 59810 - DNA, 50 bp, homo sapien
gtagaaggaccacacaatacaaatargataaaaggctcctcaatatgtaa

SEQ ID NO: 59811 - DNA, 50 bp, homo sapien
ccttgacccttgctgtttaggatgcracgcaacttgttccccatctcatt

SEQ ID NO: 59812 - DNA, 50 bp, homo sapien
cagccagcactatctgctaaaaggarcctagcagggcctagaagggccta

SEQ ID NO: 59813 - DNA, 50 bp, homo sapien
catttttcacatgcctgaacttaacyaggatgttccaaatcgtgttgtgt

SEQ ID NO: 59814 - DNA, 50 bp, homo sapien
gggttatttgcacaaggatctgctayaccgaattctgcaatttcttggct

SEQ ID NO: 59815 - DNA, 50 bp, homo sapien
ttccttccgaatgtattcactgcacraggtcagaattcacattgcacttg

SEQ ID NO: 59816 - DNA, 50 bp, homo sapien
gttcattggcactgaacacttaagakctgggcattttaatgcatacacat

SEQ ID NO: 59817 - DNA, 50 bp, homo sapien
gagcaaaacatccaggagaaccaaaytgaaactcagaaaagagacaattt

SEQ ID NO: 59818 - DNA, 50 bp, homo sapien
cagctccaggcactcagcatcccaakacggtcaggacaccattcgtggac

SEQ ID NO: 59819 - DNA, 50 bp, homo sapien
cttgaggaggaagatgaagactgtgmatgaaggacagcagacttgcttct

SEQ ID NO: 59820 - DNA, 50 bp, homo sapien
agagtgaagatatgtgaaagtctttygattgtttccattttcttagagga

SEQ ID NO: 59821 - DNA, 50 bp, homo sapien
ctacttcattttgtgtttgtgaaaakaggtgaatggtatatatatatatc

SEQ ID NO: 59822 - DNA, 50 bp, homo sapien
aaatgtaatcttcctgtgtggccacraaaatacaaaggacatcatctgat

SEQ ID NO: 59823 - DNA, 50 bp, homo sapien
ttcttccaagtccctaattagataayagtcatcacttaaagaataaactg

SEQ ID NO: 59824 - DNA, 50 bp, homo sapien
gtggcttaaatttgaaatttgaacasagttttactatacttggctacctt

SEQ ID NO: 59825 - DNA, 50 bp, homo sapien
ctccaaatgaatgattcatgttcagractttcacaggtgagggctggaaa

SEQ ID NO: 59826 - DNA, 50 bp, homo sapien
tcctgaacgtgtaggatacaaaactyagagatggaggctgtgtaggcacc

SEQ ID NO: 59827 - DNA, 50 bp, homo sapien
ctgattgataaatgggaactcatgaygataataataataagagctagcaa

SEQ ID NO: 59828 - DNA, 50 bp, homo sapien
ggattactaatagatatctcataatyatatcatatacaaatttcattaat

SEQ ID NO: 59829 - DNA, 50 bp, homo sapien
aagggtagtttcttatttggaatacraagttaagttataggttttgccaa

SEQ ID NO: 59830 - DNA, 50 bp, homo sapien
accaccaagggaggcgtgtcattgcratagtgtttagacaggaatagtct

SEQ ID NO: 59831 - DNA, 50 bp, homo sapien
gatgagcacatttctgggaaaaagcmatgactccttagtctgagaagagt

SEQ ID NO: 59832 - DNA, 50 bp, homo sapien
ctatggaacagatttcaacctgttcrataagaggcttctaggttggggaa

SEQ ID NO: 59833 - DNA, 50 bp, homo sapien
tagggagtccacatttgagaagaaamgctcatctctcttcctgccctaag

SEQ ID NO: 59834 - DNA, 50 bp, homo sapien
aaatcattaagctcaacagatcctcrtgattttaccaaagatgtttaaaa

SEQ ID NO: 59835 - DNA, 50 bp, homo sapien
acccctatctgtccaattagctgaaractatgcaaatctatcagcctggt

SEQ ID NO: 59836 - DNA, 50 bp, homo sapien
tacttgacagaggggagttattttargatgcagggattggggcacagaaa

SEQ ID NO: 59837 - DNA, 50 bp, homo sapien
aataaagctcaaggggagaaaatcgractccattcagctgcttcttccta

SEQ ID NO: 59838 - DNA, 50 bp, homo sapien
gctagtattttgttgagaatttttgyatgtaagagatattggcttttgtt

SEQ ID NO: 59839 - DNA, 50 bp, homo sapien
attttatagtttcttgttgtaaaacrcatctcttagctcatttcaacctc

SEQ ID NO: 59840 - DNA, 50 bp, homo sapien
gacgactcctgggctccggcatcctrttttcctggacagactttggtcca

SEQ ID NO: 59841 - DNA, 50 bp, homo sapien
aaaggaactaaaatttagatcatccraattctctaaaacatgacaagttg

SEQ ID NO: 59842 - DNA, 50 bp, homo sapien
tcaggctttgaattagagggtattayataaaatgcattgtagggatattt

SEQ ID NO: 59843 - DNA, 50 bp, homo sapien
aaaaaaaaaaaaaactgcttagagcrctgatgaaaatgaacatgtagaaa

SEQ ID NO: 59844 - DNA, 50 bp, homo sapien
ttggccaattcatataagcacctaawacatcaatttctctgtacttaaaa

SEQ ID NO: 59845 - DNA, 50 bp, homo sapien
gcaagatcctttcatatttaagacarcaaaacgaaaacaacaaaactcta

SEQ ID NO: 59846 - DNA, 50 bp, homo sapien
acatctggaccgattacatccttcartctattgtatcatgatttatttaa

SEQ ID NO: 59847 - DNA, 50 bp, homo sapien
gacaaatgcctaccatttttgtaaayctacagagggaattataagcccat

SEQ ID NO: 59848 - DNA, 50 bp, homo sapien
ttaaatattttttttcaccaagctayatttgtaaaagtaagaaaattaaa

SEQ ID NO: 59849 - DNA, 50 bp, homo sapien
actggagggaccattaatttggcctsaagctttaacagtacagaaaatgg

SEQ ID NO: 59850 - DNA, 50 bp, homo sapien
acatatgacataataggaacttaacrcatgtttattgaataaaggaatgg

SEQ ID NO: 59851 - DNA, 50 bp, homo sapien
atttgttgaataatttagctggagaragcatcagaaaaatccattatgac

SEQ ID NO: 59852 - DNA, 50 bp, homo sapien
tgctccctgataaggcctgagttgamggaatcaaatccagggtttttaga

SEQ ID NO: 59853 - DNA, 50 bp, homo sapien
tcacagaatacccaacttattttctyaattatccatgtgctaaagagtca

SEQ ID NO: 59854 - DNA, 50 bp, homo sapien
tggtattcacactatttattccctarcattttgaaaattcagatttacca

SEQ ID NO: 59855 - DNA, 50 bp, homo sapien
aaaatcacttctcttcttcaaccttsgctttctggccttgaaggagtgga

SEQ ID NO: 59856 - DNA, 50 bp, homo sapien
cagtacaaattctcagaatttaaaamctgcatacctcccataaatatctg

SEQ ID NO: 59857 - DNA, 50 bp, homo sapien
ctcatcctttccagtctttctttaaytctcaaaactttaacacctgaagg

SEQ ID NO: 59858 - DNA, 50 bp, homo sapien
ccttctgtgactgcctgtgtcattaycacagctattgttgtcttttgctc

SEQ ID NO: 59859 - DNA, 50 bp, homo sapien
ggtcacctgaaatttagggaagtcastctttttataacattaaattcagt

SEQ ID NO: 59860 - DNA, 50 bp, homo sapien
gttgtcatgaagattgggtgagatcmattaaaggcaatatgtactttgtg

SEQ ID NO: 59861 - DNA, 50 bp, homo sapien
ggagaatgcaaggatagccgagaagracaaaacaatctggctgctggaaa

SEQ ID NO: 59862 - DNA, 50 bp, homo sapien
tatattcttattcttcgcttaaatayagaatttttaaatcaccaaattag

SEQ ID NO: 59863 - DNA, 50 bp, homo sapien
agtaaatttcagctttccaagagaawtaagcagtcacactgttatcctca

SEQ ID NO: 59864 - DNA, 50 bp, homo sapien
atcatactgcattatacttcatcaawgttaattcatttgggcatgaataa

SEQ ID NO: 59865 - DNA, 50 bp, homo sapien
ctaagagaagcagagtattataatcmgaaatcaaatctgggtatcacttt

SEQ ID NO: 59866 - DNA, 50 bp, homo sapien
ttagtagacttgaattatagatgccrcaactctcattcatgtgcatttct

SEQ ID NO: 59867 - DNA, 50 bp, homo sapien
ctctctagggtcttcccaatttagcsagcgtaaaaacaatggtggaaagg

SEQ ID NO: 59868 - DNA, 50 bp, homo sapien
ctcgtagatccaataaatttgaaaayaggtaggaccgcacaataatgaaa

SEQ ID NO: 59869 - DNA, 50 bp, homo sapien
taggggtacctggctgccttttaaakcactttatcccagttgctagttca

SEQ ID NO: 59870 - DNA, 50 bp, homo sapien
aatgccctgcaaacagaattagacartgtataagctctgagcaagaaatg

SEQ ID NO: 59871 - DNA, 50 bp, homo sapien
tgtggtttaaacgtgataacttggcrgacagtcacacatccaaggaaaaa

SEQ ID NO: 59872 - DNA, 50 bp, homo sapien
cacatggaaggatttcttgttcccayggaaagcagagacctagagacttt

SEQ ID NO: 59873 - DNA, 50 bp, homo sapien
cttcaatggggtcagaaagtagtgamgctcctgggaggaggtaaaatagt

SEQ ID NO: 59874 - DNA, 50 bp, homo sapien
actgtgctctttaagtaacacaaagwtcaatggatgtttctctagatggg

SEQ ID NO: 59875 - DNA, 50 bp, homo sapien
ttattttccagcaggacaagatcacsctgtttagctggtgtatcagtcag

SEQ ID NO: 59876 - DNA, 50 bp, homo sapien
atgttactaattcactgggtaagtcracggatatcccaagatgtaatgcc

SEQ ID NO: 59877 - DNA, 50 bp, homo sapien
attcttattctgtgctacctcttgcytaaatgtgttcttttatctagatt

SEQ ID NO: 59878 - DNA, 50 bp, homo sapien
cctgaatgctacagggagaaaattcragaaggaaaaggtactgaattttt

SEQ ID NO: 59879 - DNA, 50 bp, homo sapien
tgctcagtgaggatctcttactaaasgagctagacaataaggacagacac

SEQ ID NO: 59880 - DNA, 50 bp, homo sapien
agagagaggtgccctgatataaaccrcctgggaatctaagggtagagcta

SEQ ID NO: 59881 - DNA, 50 bp, homo sapien
tctaactaaaagtatcaaaatctaaraacattgatgggacaagtctcaga

SEQ ID NO: 59882 - DNA, 50 bp, homo sapien
tagataatttattataaagaaacaaygatagcataattttatcttgttct

SEQ ID NO: 59883 - DNA, 50 bp, homo sapien
agctgtgcattatttggggacaagargaataattactgctgaactgttct

SEQ ID NO: 59884 - DNA, 50 bp, homo sapien
caattaactgggaaaaaagtactggrattgtgtgtggcccctatggaatc

SEQ ID NO: 59885 - DNA, 50 bp, homo sapien
taacttcctccctctccacttctgtyaatgccacatatatccacctgtct

SEQ ID NO: 59886 - DNA, 50 bp, homo sapien
ctcttttgcatttggtatcattgatyaaaccctccttgaaactcgttttg

SEQ ID NO: 59887 - DNA, 50 bp, homo sapien
catctagacatacagctgtattttayggtatctcaattttacaaaacatg

SEQ ID NO: 59888 - DNA, 50 bp, homo sapien
agggctgaacatctgtgcaaggatcktctttatttactttaaataacgag

SEQ ID NO: 59889 - DNA, 50 bp, homo sapien
ttattataaaggatatgtggggcaarctaaatgggagagacgcatagggt

SEQ ID NO: 59890 - DNA, 50 bp, homo sapien
gctattctcattcctgtgacttatarataatgctttatgttctttagtat

SEQ ID NO: 59891 - DNA, 50 bp, homo sapien
catggaaaatgaaactatgtttgccrgaatagaaaataacagtatatttg

SEQ ID NO: 59892 - DNA, 50 bp, homo sapien
cctgttggtgatttaatcagatgacwctaaatttatggattgacttatat

SEQ ID NO: 59893 - DNA, 50 bp, homo sapien
cagccagatgtgtagttgtcttaaargaataggtgaggagaagagaagag

SEQ ID NO: 59894 - DNA, 50 bp, homo sapien
aaagcccgaatatctcacctgacgarcagagtaccaccaacactaaatgg

SEQ ID NO: 59895 - DNA, 50 bp, homo sapien
tcaagcagctcactattgatcttaasagaacgtagacaagactttgggaa

SEQ ID NO: 59896 - DNA, 50 bp, homo sapien
atctgccggtttcacatcctcctcakattgtaaattctaactccaattcc

SEQ ID NO: 59897 - DNA, 50 bp, homo sapien
gtatctatgagaaccaacaagacaartatacctctaggacttctctggaa

SEQ ID NO: 59898 - DNA, 50 bp, homo sapien
gagaattatgctttgttaacttagcytcttcctctatggagatttgtgcc

SEQ ID NO: 59899 - DNA, 50 bp, homo sapien
tgagactattgaggaaaaggagaaasatcttaagagagaagaggaaattg

SEQ ID NO: 59900 - DNA, 50 bp, homo sapien
gagctagggtagggaataggacaccyatcagtaaatctggaccctggcat

SEQ ID NO: 59901 - DNA, 50 bp, homo sapien
gtttaggtaccttgtcaagtaccttstcaataacacatgccagggtccag

SEQ ID NO: 59902 - DNA, 50 bp, homo sapien
ctactaagcctggctttctacaagarcttcattttatgcatcttttgtct

SEQ ID NO: 59903 - DNA, 50 bp, homo sapien
tttgaagtggtaataactgtaagaartggccttataattaattgaatata

SEQ ID NO: 59904 - DNA, 50 bp, homo sapien
agtggaggatcagtgccccatttaayatctggtagaactaaagaacgcaa

SEQ ID NO: 59905 - DNA, 50 bp, homo sapien
atatctttgctttttagtcctaaaamtcaataactgaactctcattgatg

SEQ ID NO: 59906 - DNA, 50 bp, homo sapien
aagtgatgaatgaatgagttagccartaaggactgagtgcttgtcacgtg

SEQ ID NO: 59907 - DNA, 50 bp, homo sapien
aagagatgaataaatttcattttccrctaacaagttgtcacaagatagga

SEQ ID NO: 59908 - DNA, 50 bp, homo sapien
ccctagaactctgcttggaccagaasatgtgaataaacttaagcttattt

SEQ ID NO: 59909 - DNA, 50 bp, homo sapien
gttttctgttaccatcaaaatttaasgatagcagttcagtttgttccaag

SEQ ID NO: 59910 - DNA, 50 bp, homo sapien
tcttttgttgctcaaatccacccaastagtagagagaagaaaattagctc

SEQ ID NO: 59911 - DNA, 50 bp, homo sapien
gagaagccctgcagagcctgggctaygcaaacatattcattaaatgacac

SEQ ID NO: 59912 - DNA, 50 bp, homo sapien
ttttattttctctgaacatcttatamccttagaatttggaggatatactg

SEQ ID NO: 59913 - DNA, 50 bp, homo sapien
gacaaagagtgtgttatgacccacaktccaatttctttcacaactttccc

SEQ ID NO: 59914 - DNA, 50 bp, homo sapien
agaaaaaggagacagaaagataccaytactgctgccaaccgtactctgtg

SEQ ID NO: 59915 - DNA, 50 bp, homo sapien
cttctttctttctttctggcttttcrattatgtatttgctacatcttaag

SEQ ID NO: 59916 - DNA, 50 bp, homo sapien
agaaacaggttcccaaggtaaagatkaaattcaccacagcaacatatctt

SEQ ID NO: 59917 - DNA, 50 bp, homo sapien
agcccatgtccctgtcctctccactrtgtttctaaaactttctgagggat

SEQ ID NO: 59918 - DNA, 50 bp, homo sapien
taccacagagcctgtgactttccaamatccatttaatatgtccctcctca

SEQ ID NO: 59919 - DNA, 50 bp, homo sapien
tctgctccgctgctgcatgccggttrcgtcctcactgttgttttatttat

SEQ ID NO: 59920 - DNA, 50 bp, homo sapien
cactaggaaaggaccaaggtctatakattgagagagatctggggtacagt

SEQ ID NO: 59921 - DNA, 50 bp, homo sapien
gagatactaagtgtttgtgtttaggytgtagctggccccttcttataaat

SEQ ID NO: 59922 - DNA, 50 bp, homo sapien
tggcttctacagaaacttataaacaraatggagtgagagatctttagaga

SEQ ID NO: 59923 - DNA, 50 bp, homo sapien
tatgaaataaaagacttgtatctacrcattgaaatgatccatcacccttt

SEQ ID NO: 59924 - DNA, 50 bp, homo sapien
acaagccacatgtgaccattcgacayaggtgtggattttccgaattgagg

SEQ ID NO: 59925 - DNA, 50 bp, homo sapien
ttcaaattatttacttatctgacccrattctcaagaaggacaaatcatct

SEQ ID NO: 59926 - DNA, 50 bp, homo sapien
atctgtatttaaaaagaagatctgcsaaagaagttatttctctcaaagtt

SEQ ID NO: 59927 - DNA, 50 bp, homo sapien
ggctgagagccaagagtcagttgaargttccggtactctgaatctcaaac

SEQ ID NO: 59928 - DNA, 50 bp, homo sapien
ttttgctactggacctcaaattctcrgccaaagaccctacacagagttga

SEQ ID NO: 59929 - DNA, 50 bp, homo sapien
tctctgtattgttgcccttttttgayatttctgatgatctcctctgagac

SEQ ID NO: 59930 - DNA, 50 bp, homo sapien
ttacctgcttttttctccacttagcratataatacagttatgaattttaa

SEQ ID NO: 59931 - DNA, 50 bp, homo sapien
atccaatctgaaatatacgctccaasgtacgtgaatttatgcagtgccca

SEQ ID NO: 59932 - DNA, 50 bp, homo sapien
ctcatcttttgttttgaaatcacaaycatatgacaagcactgtcctctgg

SEQ ID NO: 59933 - DNA, 50 bp, homo sapien
tgcaactcaagaactctgataaacartatgtttggcattctgttcctgga

SEQ ID NO: 59934 - DNA, 50 bp, homo sapien
atttttagatgatttcaagtcaaaarccctgatcttcctggacaatttta

SEQ ID NO: 59935 - DNA, 50 bp, homo sapien
aactcccactcaagtgcaaatatgasaaaagaagatgtgggactgcaaga

SEQ ID NO: 59936 - DNA, 50 bp, homo sapien
tactttttcttgcagatagaactacraaaatagaatacacactcaatggg

SEQ ID NO: 59937 - DNA, 50 bp, homo sapien
agagcagaattacgttatctcaagamgaaagttaaacagatgtacacaaa

SEQ ID NO: 59938 - DNA, 50 bp, homo sapien
gtcagcactgtgacattggtgctaaytccatgatggtgaacatcagatag

SEQ ID NO: 59939 - DNA, 50 bp, homo sapien
tgacttttgctttatgctttttccartcgtacctcactatcatcaggctg

SEQ ID NO: 59940 - DNA, 50 bp, homo sapien
catcccctgtcctggagtctgtgaartgaactaagagccaacagccacct

SEQ ID NO: 59941 - DNA, 50 bp, homo sapien
aaagaaccagatcctctcttgaaaartaataataggccgggcacagtggc

SEQ ID NO: 59942 - DNA, 50 bp, homo sapien
ttcttcaataaactctgctacttaasccttgctatacgtctcttggctgc

SEQ ID NO: 59943 - DNA, 50 bp, homo sapien
tagtactgttactgctgttactgtaygggaatcctaggttcttcttaact

SEQ ID NO: 59944 - DNA, 50 bp, homo sapien
gtgagatctagaagcctcaaacccarggaaggtattaacttctgattcat

SEQ ID NO: 59945 - DNA, 50 bp, homo sapien
ttggatgcactattctgggagacaayctgaacatgtttcatgagatccct

SEQ ID NO: 59946 - DNA, 50 bp, homo sapien
ccatgtggacagacccagaaacatargtgagaaaattgtatgagagtatc

SEQ ID NO: 59947 - DNA, 50 bp, homo sapien
tcttagataataggaactgacaggaraactgaaaaaaccctgagacctag

SEQ ID NO: 59948 - DNA, 50 bp, homo sapien
acacactgggaatcactgctccacaygatgaaaagtgagtctcatttcca

SEQ ID NO: 59949 - DNA, 50 bp, homo sapien
aatgaatgcagatgttgctatgagaygattgatttattcttgtcttcaag

SEQ ID NO: 59950 - DNA, 50 bp, homo sapien
gggtggggtaacagtattgggtccayctcgagtcaggatttcctttgccc

SEQ ID NO: 59951 - DNA, 50 bp, homo sapien
gctcatcagtgtctgtgaaataaccragttcagcaaagagagcagaatct

SEQ ID NO: 59952 - DNA, 50 bp, homo sapien
ataatagactatataggctctacacrgaattaaaaagactctgcaagcat

SEQ ID NO: 59953 - DNA, 50 bp, homo sapien
agcctaaactcacggtagacacatakattgtactgctgcatggtagagat

SEQ ID NO: 59954 - DNA, 50 bp, homo sapien
caagcaggggatatagttgtaattaygttcctgaagtccaaatatgtaca

SEQ ID NO: 59955 - DNA, 50 bp, homo sapien
gtaagagtttgcttacctggtctaamtgctgtgccgatgaacacaggcat

SEQ ID NO: 59956 - DNA, 50 bp, homo sapien
tatatcacaatatcacatccatatcrctgatatctgttttggtatttttt

SEQ ID NO: 59957 - DNA, 50 bp, homo sapien
gcttaataagcccctttcaaccttayctgtgtttatgttaatgagccaac

SEQ ID NO: 59958 - DNA, 50 bp, homo sapien
cctgtagtttttcaggccaaggagargtttatgtctattgcagttaaaaa

SEQ ID NO: 59959 - DNA, 50 bp, homo sapien
aatgagtctaaagtagaattggttayatctagttaagcataaaataaata

SEQ ID NO: 59960 - DNA, 50 bp, homo sapien
atataagatgatatcaaatggtgcakaaaggtaaagaaaaatgaagactg

SEQ ID NO: 59961 - DNA, 50 bp, homo sapien
atgctcaaatatggatctgcccctayaatgtgttccctaggcatgaaatg

SEQ ID NO: 59962 - DNA, 50 bp, homo sapien
attccaaagccttcagtatagagtamaattttaatgcatatactttagtt

SEQ ID NO: 59963 - DNA, 50 bp, homo sapien
tcagatagacagaaaggatagttccrcggcttaggaagggacgtcatctt

SEQ ID NO: 59964 - DNA, 50 bp, homo sapien
aacaatttttttgactgacacagaaragtagtcctcatttcattttagca

SEQ ID NO: 59965 - DNA, 50 bp, homo sapien
actggatgaaattccacatacaaccratggaaaaaataattaaagcttgg

SEQ ID NO: 59966 - DNA, 50 bp, homo sapien
tcatacagaaagtaggtgaagacackctttgctatgtgattgctcaacgt

SEQ ID NO: 59967 - DNA, 50 bp, homo sapien
atacactttcatgatgcctactctayggtcactctgagttaaatggaaaa

SEQ ID NO: 59968 - DNA, 50 bp, homo sapien
tattctatattttatacggcaattcyaggcattattttgtacccttagtg

SEQ ID NO: 59969 - DNA, 50 bp, homo sapien
ttccagaagaagatgacatgataaargtaattaactttgaaaaaaatgag

SEQ ID NO: 59970 - DNA, 50 bp, homo sapien
cattcaaagcataagatccagagcayagaaaaaatgagtaatacatctga

SEQ ID NO: 59971 - DNA, 50 bp, homo sapien
ctctctttaaaatgagctataactgsaaataaatggaaacttctcaggct

SEQ ID NO: 59972 - DNA, 50 bp, homo sapien
caactgatattgtagaaattcaaggratcattagagacaactatgaacaa

SEQ ID NO: 59973 - DNA, 50 bp, homo sapien
gaaaatcttcaaatatacaacataaytatgcatcttaaaacctagaaaag

SEQ ID NO: 59974 - DNA, 50 bp, homo sapien
ggtgtctcttcaaagagaagaaggayggttgggtattacatgacaaaggg

SEQ ID NO: 59975 - DNA, 50 bp, homo sapien
ccaagaaccactcttgctatcctaartcactcacgccagccatagaataa

SEQ ID NO: 59976 - DNA, 50 bp, homo sapien
ctcatagattatgggcttcagtgaawtatgtcaataacattagattagct

SEQ ID NO: 59977 - DNA, 50 bp, homo sapien
aatggtcttggacacctattatttckaaacaatgcaaagtctcatgaata

SEQ ID NO: 59978 - DNA, 50 bp, homo sapien
ctggaattctaaactacttggaaacyacatgatctttaaacaaccttgac

SEQ ID NO: 59979 - DNA, 50 bp, homo sapien
aaagaaaaaaagacccttaagccaasaagactctccttcctttccttctt

SEQ ID NO: 59980 - DNA, 50 bp, homo sapien
ttagggtagcatctgagtacatttcygggtcggctaatttcataaaaatt

SEQ ID NO: 59981 - DNA, 50 bp, homo sapien
ggagtggaattgggctaaagagctcragactttatgatactattgctttg

SEQ ID NO: 59982 - DNA, 50 bp, homo sapien
tttagatgtttggaaaatcagttacycaaatgtagattggagatgttgaa

SEQ ID NO: 59983 - DNA, 50 bp, homo sapien
ctagtaatatctcttaactgtaaaayagcaaatattagcatttgggatgg

SEQ ID NO: 59984 - DNA, 50 bp, homo sapien
tccagtctagagctatctgtaatgcrataaatctcttcacaggagcatat

SEQ ID NO: 59985 - DNA, 50 bp, homo sapien
cattctcgtgccttcctcaaaagacygggataactccaggcaccgcaaag

SEQ ID NO: 59986 - DNA, 50 bp, homo sapien
cctctccaaaaatccatattctcacyatccttctgggacaaactcaaatc

SEQ ID NO: 59987 - DNA, 50 bp, homo sapien
cagggctgagcaagagaagatcacaytggagtcataacaggaggatgagt

SEQ ID NO: 59988 - DNA, 50 bp, homo sapien
tgcctccctctgcctttctgataggratgtaatgataaatgatgactgca

SEQ ID NO: 59989 - DNA, 50 bp, homo sapien
aaaaaatttatagttacttaacagarcaacatggatttaaactctgcagc

SEQ ID NO: 59990 - DNA, 50 bp, homo sapien
ctctctctatccctgaggaggtaaartattatctcactccactctcagct

SEQ ID NO: 59991 - DNA, 50 bp, homo sapien
tctactctgctatgctttaagggtaycttccaataagctgatgatatcaa

SEQ ID NO: 59992 - DNA, 50 bp, homo sapien
aaaaatcgaactttgttaaactccastcccctagagatacactatctaaa

SEQ ID NO: 59993 - DNA, 50 bp, homo sapien
tggtttacaccctacaaatttaaccmagagatacctttggatcgcccctg

SEQ ID NO: 59994 - DNA, 50 bp, homo sapien
ttgaagatgtctgcttttagttataycacataggcagattaattaccttt

SEQ ID NO: 59995 - DNA, 50 bp, homo sapien
tatgttttacaggcttttagcagggycaatagtcttcattattataacct

SEQ ID NO: 59996 - DNA, 50 bp, homo sapien
ggttgctgcactgaaagaattgaaayggttccaacggtgctccaaaaaca

SEQ ID NO: 59997 - DNA, 50 bp, homo sapien
tttgactttttttcttcagggacacsagtagtataaataaatatttactg

SEQ ID NO: 59998 - DNA, 50 bp, homo sapien
ttcacaggagcatatacactgggaaygggaactctcacaggtaagaaaat

SEQ ID NO: 59999 - DNA, 50 bp, homo sapien
gatgtctaacagtccagttaaacttraaatatgcaaaactaaacttctag

SEQ ID NO: 60000 - DNA, 50 bp, homo sapien
ggacatacatacatacatttacacastcatattcatatttctagtagaaa

SEQ ID NO: 60001 - DNA, 50 bp, homo sapien
attttagggatcacttaaacacaccyagtgctcaaatcatacctattgtt

SEQ ID NO: 60002 - DNA, 50 bp, homo sapien
actatttgtgtatagcacacagaaartccattgagttttggtattgatat

SEQ ID NO: 60003 - DNA, 50 bp, homo sapien
ggcaaatgtagcacatgtgagggtayaaaattatgatgctacaatcagaa

SEQ ID NO: 60004 - DNA, 50 bp, homo sapien
agaagaaacagtggaacagtgtgcayggtcaatagagttaaaaatttcaa

SEQ ID NO: 60005 - DNA, 50 bp, homo sapien
ctcagtcctgataggtctgtcatccrgaatttaaagtgcagtctagaaaa

SEQ ID NO: 60006 - DNA, 50 bp, homo sapien
gcgtctgtgaccaaagctgctgtcawtcctgaggccagatataacaagat

SEQ ID NO: 60007 - DNA, 50 bp, homo sapien
gaaatgatcagagaggaaaaaaagartcaatagagcatttgtatttatgc

SEQ ID NO: 60008 - DNA, 50 bp, homo sapien
gaagcattttatgatgctcactaccragtgttcataagcggtaaataaag

SEQ ID NO: 60009 - DNA, 50 bp, homo sapien
cccgtgctacccctccctgccagcawcttatttcttctcagagcaatggg

SEQ ID NO: 60010 - DNA, 50 bp, homo sapien
atttaaaagcacacaacagtttttayaaggcctttcttgaccctggtact

SEQ ID NO: 60011 - DNA, 50 bp, homo sapien
gggaaatggcctagcactggcggacracattgatctcggaaactcacacc

SEQ ID NO: 60012 - DNA, 50 bp, homo sapien
acagaatattcattcaacctatttayatctttgggtaattctactggtgg

SEQ ID NO: 60013 - DNA, 50 bp, homo sapien
agatgtctaaaataatggttatccamtctcagcctgtggaatggacttgt

SEQ ID NO: 60014 - DNA, 50 bp, homo sapien
ggcccagctgtgccagtacagtacamtccctaccatttgattgcagagcc

SEQ ID NO: 60015 - DNA, 50 bp, homo sapien
ttgcaaactagtggcctacaggaatratcttgatgaggcgggtggtttaa

SEQ ID NO: 60016 - DNA, 50 bp, homo sapien
gtggtttttgttctttccagcatcartcccacatgtcagtgagttcttag

SEQ ID NO: 60017 - DNA, 50 bp, homo sapien
tgatgctggaaagaacaaaaaccacwgtggtgaacctaaaataaatttgg

SEQ ID NO: 60018 - DNA, 50 bp, homo sapien
taaaaatatatgttattttgtttcckctacctatacttagtcattctaga

SEQ ID NO: 60019 - DNA, 50 bp, homo sapien
gaaaaaactttctccctgcatctcayacctttacctctggccagttggcc

SEQ ID NO: 60020 - DNA, 50 bp, homo sapien
gatggtgcaaagcaagcccatctctragtagaaaaatcacccagagcaca

SEQ ID NO: 60021 - DNA, 50 bp, homo sapien
tcacctactggacctgtcctgaacamaactatttaagtgaaaaggatcag

SEQ ID NO: 60022 - DNA, 50 bp, homo sapien
gataacatgctcacataagttaacayacaacaatgaaagaattttaaata

SEQ ID NO: 60023 - DNA, 50 bp, homo sapien
aaggaggtcttcatggagacctaacmgctaagctaagacctgcctgttct

SEQ ID NO: 60024 - DNA, 50 bp, homo sapien
tagtaaggcaggacattatggtagargcaagatgagttcatagataggac

SEQ ID NO: 60025 - DNA, 50 bp, homo sapien
catttttgggtttgggggtttataarggatctcaattacatgaatatttg

SEQ ID NO: 60026 - DNA, 50 bp, homo sapien
cttagattcctgatctgtaaaataargattaaggatagttcattttaaac

SEQ ID NO: 60027 - DNA, 50 bp, homo sapien
tatagagaagactagattacatagartattaaggagactagattagataa

SEQ ID NO: 60028 - DNA, 50 bp, homo sapien
tcaaaagctgaagtgaccaccttgaraattggcgctactttagagtacta

SEQ ID NO: 60029 - DNA, 50 bp, homo sapien
ttgttttttagggactgttttctcayataaagacgggtatgataatacct

SEQ ID NO: 60030 - DNA, 50 bp, homo sapien
aatcaagcacgattttagtttaagcmaattgaaatgtacaggagactttt

SEQ ID NO: 60031 - DNA, 50 bp, homo sapien
acatttgactgagtggaatcctccaraaatgaacacagattcaccccaag

SEQ ID NO: 60032 - DNA, 50 bp, homo sapien
ggacgattcatcgttctctgattaartgaatattatctttgctctcatac

SEQ ID NO: 60033 - DNA, 50 bp, homo sapien
aatgtctcaaggagactaatagagarcaaactcagatttacctatgcagc

SEQ ID NO: 60034 - DNA, 50 bp, homo sapien
ctgtggcaaccaagatgagctaacamaaaataataataaaattaactagg

SEQ ID NO: 60035 - DNA, 50 bp, homo sapien
tttccagtgttgtatgtaatacaggkatatagaattcagattcaaagcct

SEQ ID NO: 60036 - DNA, 50 bp, homo sapien
catgctgttattttctttgccttcaygcacaattgaatctggatgctttc

SEQ ID NO: 60037 - DNA, 50 bp, homo sapien
ttctccattaaaattaatacttacartaggatgatttataccatatatat

SEQ ID NO: 60038 - DNA, 50 bp, homo sapien
ctgtaaactgactctacctcatcgcrcaatgttagtaagataaaacgtca

SEQ ID NO: 60039 - DNA, 50 bp, homo sapien
gagtctagaaggctggcacctgcacyggatggttgtgcaaaggactttgc

SEQ ID NO: 60040 - DNA, 50 bp, homo sapien
cagggtgcaattttgactagcaatayataaaatgtcacaacaaacataac

SEQ ID NO: 60041 - DNA, 50 bp, homo sapien
ttagcatatttgatcactgtcctatmaacatgcttctcagaggtaatgtc

SEQ ID NO: 60042 - DNA, 50 bp, homo sapien
gacataggactctcaggatgaagtasagtccaggattcctctgtgattgt

SEQ ID NO: 60043 - DNA, 50 bp, homo sapien
tcgcaaagcgggaaaaatgaaacagsctccgacagctctttcctctttcc

SEQ ID NO: 60044 - DNA, 50 bp, homo sapien
atgaattaattaattctacagaaggwagtagcagctaagaaatgctttgg

SEQ ID NO: 60045 - DNA, 50 bp, homo sapien
tgatctcacctacatgaggactctawaatagttaaagtcatagaaacaga

SEQ ID NO: 60046 - DNA, 50 bp, homo sapien
aggttatagccttagcaggatcaatraagacatgcaacaaagaaagtagc

SEQ ID NO: 60047 - DNA, 50 bp, homo sapien
atgggagggaagaattggggctaagwccataactggcatatttgctatct

SEQ ID NO: 60048 - DNA, 50 bp, homo sapien
cccttcccagcctgagctctgaaackctaaataaaccacatcactcattt

SEQ ID NO: 60049 - DNA, 50 bp, homo sapien
tattgcagtgctcttattttcccaaraggatcatctacacatcaatctct

SEQ ID NO: 60050 - DNA, 50 bp, homo sapien
tgtccaaggtcaccttgcaaggaacsgactgagatcactttcgtctctgc

SEQ ID NO: 60051 - DNA, 50 bp, homo sapien
ggaatgtttgcattaatgactttatrgaggcaaaagagtgagctgcatgg

SEQ ID NO: 60052 - DNA, 50 bp, homo sapien
aaagctgagtatttcggagttgagaygacttgagtaaaggtagtagtggg

SEQ ID NO: 60053 - DNA, 50 bp, homo sapien
ataatattaagatctgataatgttaygattctatcccattggctgatttt

SEQ ID NO: 60054 - DNA, 50 bp, homo sapien
ttccatattatagaaaaactttggarctgttagaaggaattacaactctc

SEQ ID NO: 60055 - DNA, 50 bp, homo sapien
tcttttaaagaaaaatgactttcaargaatgttttagtatgaactcagct

SEQ ID NO: 60056 - DNA, 50 bp, homo sapien
aataaaaattgcttatttcatcaacycagagattatacagtatatatagt

SEQ ID NO: 60057 - DNA, 50 bp, homo sapien
tgtgagcctaagaggatatttattcyaggataggattctcactgtaatcc

SEQ ID NO: 60058 - DNA, 50 bp, homo sapien
taaaatacatatagattgatagatayaaataagtatacacagagagagag

SEQ ID NO: 60059 - DNA, 50 bp, homo sapien
tgctccttctgacaatagtgattacmatgtcctctcctctcctcacacac

SEQ ID NO: 60060 - DNA, 50 bp, homo sapien
ctagaaaatagtctgaaaaatgcaartatttatgagttttggtgtatcag

SEQ ID NO: 60061 - DNA, 50 bp, homo sapien
gctgcaatctgtggagtggaaaagartaaattcacaagtgacttacctga

SEQ ID NO: 60062 - DNA, 50 bp, homo sapien
tttcatgttcacagattcacattaaygcgctttattaagagtatggggtg

SEQ ID NO: 60063 - DNA, 50 bp, homo sapien
aaggtttttagtggtttactttgtayagaaggcatatcattcagttttac

SEQ ID NO: 60064 - DNA, 50 bp, homo sapien
gttttaaaataacacaaaattatgtrtagttcctgacttctgttatttcc

SEQ ID NO: 60065 - DNA, 50 bp, homo sapien
aagcatactccagctttggcacttgytgttcctccagcctggattgctag

SEQ ID NO: 60066 - DNA, 50 bp, homo sapien
aacaggctatttcaggtatgtttgargtttttttaaggtacggagggtgg

SEQ ID NO: 60067 - DNA, 50 bp, homo sapien
aatattttgacagggtgagcgattartaagggaagacaaggagatagaat

SEQ ID NO: 60068 - DNA, 50 bp, homo sapien
ggatgccatttatccattaaacttargccttacatttaaccaagaaagct

SEQ ID NO: 60069 - DNA, 50 bp, homo sapien
attgaaacaagttgcctgttaatcargttcatctcaaaatctattcaagg

SEQ ID NO: 60070 - DNA, 50 bp, homo sapien
aatgccaaggggacatggatgaggcrcccataatatctcctgtactttgg

SEQ ID NO: 60071 - DNA, 50 bp, homo sapien
gaaaagacagtccaaggcttatcgaractcataggctaaaatccaagggg

SEQ ID NO: 60072 - DNA, 50 bp, homo sapien
tggtgagagaggccttgttgacacayaaattgtaacattatcaacaagtg

SEQ ID NO: 60073 - DNA, 50 bp, homo sapien
ctaaagcacagaccagggcttccatyaggattaggagcaaagtctacttg

SEQ ID NO: 60074 - DNA, 50 bp, homo sapien
acataattccaaattttgattctgaragttaaaaatccaaaaaatacaac

SEQ ID NO: 60075 - DNA, 50 bp, homo sapien
gcccagatgacacagctcttatggamcaatcaggttaattaatggaaagg

SEQ ID NO: 60076 - DNA, 50 bp, homo sapien
ggttcccacatttctggcatggaaasatcattaaagaaccaagagaaaaa

SEQ ID NO: 60077 - DNA, 50 bp, homo sapien
agagattcacttatgcttccataatkcaggaagaaaccttcgctttggtt

SEQ ID NO: 60078 - DNA, 50 bp, homo sapien
acctccagagtctaagcaatttctgkaccaatcagatcagaagcttctga

SEQ ID NO: 60079 - DNA, 50 bp, homo sapien
ttttcccttttcatggttgctttaaractacattatagagtaattttcca

SEQ ID NO: 60080 - DNA, 50 bp, homo sapien
taagaaactttaagaacaatactgaygagaaatgggaaatactatgtgct

SEQ ID NO: 60081 - DNA, 50 bp, homo sapien
tggtttctctgactgagaccattcaytttcctttaattcaatatcatgtg

SEQ ID NO: 60082 - DNA, 50 bp, homo sapien
actagtttctctgtggctcgtagtaygtcagagcattattgtgaggatta

SEQ ID NO: 60083 - DNA, 50 bp, homo sapien
actttggtattttatttcattcttcraaaaatgtggtcataatccattaa

SEQ ID NO: 60084 - DNA, 50 bp, homo sapien
tagaataggatgctggaagtatggaracagtcaatgaaaactgcccactg

SEQ ID NO: 60085 - DNA, 50 bp, homo sapien
gatatctctatctatctatatacacmgcattagtcatgatcctcttgtgt

SEQ ID NO: 60086 - DNA, 50 bp, homo sapien
ccaatatgtatttacctttcttagaktcataggaccagaggcaatattat

SEQ ID NO: 60087 - DNA, 50 bp, homo sapien
cagttccttacaacctaaattttcaygaatgtggatagatgttaaattag

SEQ ID NO: 60088 - DNA, 50 bp, homo sapien
tgcaactgtaactaatcacttaaaarctgtcactaaagggtttcaatttg

SEQ ID NO: 60089 - DNA, 50 bp, homo sapien
aagggaacaatgattaacattctccyaagatagttgaagtttattttcaa

SEQ ID NO: 60090 - DNA, 50 bp, homo sapien
atgattagcagatagatgggatttaygtgtcaatttgttaatttctaatc

SEQ ID NO: 60091 - DNA, 50 bp, homo sapien
cagatgtctccatccaagcctgtaaygtggaatgccattccttaatggag

SEQ ID NO: 60092 - DNA, 50 bp, homo sapien
ttctggggctccaggtgagcccttgytttgcccagtctccgtgtctttgt

SEQ ID NO: 60093 - DNA, 50 bp, homo sapien
aaggctggtacttagttaaggttggyactcttcagtagttaactgaaata

SEQ ID NO: 60094 - DNA, 50 bp, homo sapien
gggagaaaactgatgttgcaactatyaacagtaacagctgaaacttatcg

SEQ ID NO: 60095 - DNA, 50 bp, homo sapien
aatttccgagggagttcctcttggtyctccagacacgcctgctgcaggcc

SEQ ID NO: 60096 - DNA, 50 bp, homo sapien
ggttggcccattaaaagagaggatayaattagagtttattaaagcttaaa

SEQ ID NO: 60097 - DNA, 50 bp, homo sapien
ccctccactaagccggtttagcaaasagccctttcctcccagggtcttcc

SEQ ID NO: 60098 - DNA, 50 bp, homo sapien
acaaacccaatagattgcaagaaacrgatgtaaagagaaaaattagaaat

SEQ ID NO: 60099 - DNA, 50 bp, homo sapien
atgtctcctacctggcacatctcgcygagcctgcaattgtacacaccagg

SEQ ID NO: 60100 - DNA, 50 bp, homo sapien
agcacatgattatattcctctttgawgttttaatagtatttacacaaaat

SEQ ID NO: 60101 - DNA, 50 bp, homo sapien
atgatattttgagatagataatgaarggttactctagtcacacaaattaa

SEQ ID NO: 60102 - DNA, 50 bp, homo sapien
ttgacatcccagagattattacatcrcaagacaatgcatcgctccagcaa

SEQ ID NO: 60103 - DNA, 50 bp, homo sapien
agggacactgaagagaagattcctcrggtgaaaaatttctggaaggtatc

SEQ ID NO: 60104 - DNA, 50 bp, homo sapien
ccctaaaaaaaccacatcattggccyagtagatttacagcagaggacact

SEQ ID NO: 60105 - DNA, 50 bp, homo sapien
ttactcacatgtgttaccagaactcragcacacttaagatctatcttatc

SEQ ID NO: 60106 - DNA, 50 bp, homo sapien
caattggggttgggaggtctttgccygataatgaaagagagacttaacat

SEQ ID NO: 60107 - DNA, 50 bp, homo sapien
aagtattaaggacaaatgatatgtcraagcaggaagggaaaaattaaata

SEQ ID NO: 60108 - DNA, 50 bp, homo sapien
aactgagacattagacactataattkaaagttagttatttccttgttaac

SEQ ID NO: 60109 - DNA, 50 bp, homo sapien
agtttctactatgccccgcacatatyaggttcttatattgataatacttg

SEQ ID NO: 60110 - DNA, 50 bp, homo sapien
cttctaaatctcaaattacttgcaamtggtacatctgtgagttgctctta

SEQ ID NO: 60111 - DNA, 50 bp, homo sapien
cctgcttgtttcctgttaacagagtyctaactgagctggtttccaaaatg

SEQ ID NO: 60112 - DNA, 50 bp, homo sapien
tttttcacctctgctttgataatcaktatttgtctcatttatctcaaaga

SEQ ID NO: 60113 - DNA, 50 bp, homo sapien
tgtcaactatagtgcatagcatagayagggtaatgtttcaagaagtagtt

SEQ ID NO: 60114 - DNA, 50 bp, homo sapien
attgtcacttccatgaagcatttctyaatccatagctagagttaataaac

SEQ ID NO: 60115 - DNA, 50 bp, homo sapien
cccaaaaacctaccttttgcatacaragcatcaacgatatccagaaaagg

SEQ ID NO: 60116 - DNA, 50 bp, homo sapien
ctgatacaatggatagataggttgayacatagagggatcaatagatatat

SEQ ID NO: 60117 - DNA, 50 bp, homo sapien
aggactcaggtgttctgggccctaaygatccactcctgttttcactgcct

SEQ ID NO: 60118 - DNA, 50 bp, homo sapien
agaactgcagcctcagtcatttgctrttctcattgcacatcctgtccctg

SEQ ID NO: 60119 - DNA, 50 bp, homo sapien
cacagaggctgaaaaaagtagagtargcaaaacagataagctttttattg

SEQ ID NO: 60120 - DNA, 50 bp, homo sapien
gataatgaaagagagacttaacataygaaaagttgaatggtaacatttta

SEQ ID NO: 60121 - DNA, 50 bp, homo sapien
ctagccatgctaatttcagttaatasacaagttctgacctgagagggcaa

SEQ ID NO: 60122 - DNA, 50 bp, homo sapien
aaggctggtgtggcagtggatactcycgatgttcaaaaagattttgacaa

SEQ ID NO: 60123 - DNA, 50 bp, homo sapien
aaaatacctttggagttagatagggragtttaatttgtgaaaagtacact

SEQ ID NO: 60124 - DNA, 50 bp, homo sapien
ttttttaaaaaagaatctatggttcygtgatgctgactgatcttacacaa

SEQ ID NO: 60125 - DNA, 50 bp, homo sapien
tcagttctaaaatttgagcaacatamagagtaaggatatctattacagca

SEQ ID NO: 60126 - DNA, 50 bp, homo sapien
aattctactctagactcactgttttyctgaagtgggaagagggtgaggga

SEQ ID NO: 60127 - DNA, 50 bp, homo sapien
aagacttgaagaactaataccaaccrtactcaaactactctgaaacatag

SEQ ID NO: 60128 - DNA, 50 bp, homo sapien
taacattcatgagttagggttcatcygaaagcatcttgttcttgaaacac

SEQ ID NO: 60129 - DNA, 50 bp, homo sapien
tcattcatgagggatccacttccackatccaaatacctcccaccaggctg

SEQ ID NO: 60130 - DNA, 50 bp, homo sapien
tgttgggaatgccacacacctttaaycatatctcatgtgaactcagagca

SEQ ID NO: 60131 - DNA, 50 bp, homo sapien
gaaagaccagtccagagccagagaargtagtcatgggactgttgtatcaa

SEQ ID NO: 60132 - DNA, 50 bp, homo sapien
tatccattctgctgttcaaaccagamaccttgaagtccataacaattccc

SEQ ID NO: 60133 - DNA, 32 bp, homo sapien
ttcagtacttgtgtgaraaactttccaaccct

SEQ ID NO: 60134 - DNA, 50 bp, homo sapien
aatgaggtaggtcctattagtatcaycttcattttacaaatgaagcagcc

SEQ ID NO: 60135 - DNA, 50 bp, homo sapien
gtcaatagcgcatagatggaacaacrgcattctaagaggaaaccactatg

SEQ ID NO: 60136 - DNA, 50 bp, homo sapien
taagcgctctagaatttgagaaacartctataaaacacataagtcagggt

SEQ ID NO: 60137 - DNA, 50 bp, homo sapien
ggcaaactatctctttccatctctascaaactcaggaaccccacatttat

SEQ ID NO: 60138 - DNA, 50 bp, homo sapien
aattgctaatttttctgagatactaraagatgtggacaagtgacaaaaaa

SEQ ID NO: 60139 - DNA, 50 bp, homo sapien
gccaatatataagtgcagacaaataygttttatactgaaagactttcatt

SEQ ID NO: 60140 - DNA, 50 bp, homo sapien
gaagaacatcagggaaaactgcccaratgtaatatgctatagaaatatta

SEQ ID NO: 60141 - DNA, 50 bp, homo sapien
tcctggtccctgctttgctgatggcyttgaagcagcctcccaagcagatg

SEQ ID NO: 60142 - DNA, 50 bp, homo sapien
agacaactcaagacagtaaaagaagwgtaacaaaccagatgtgccctatg

SEQ ID NO: 60143 - DNA, 50 bp, homo sapien
tgagaaagagggaaatgaagacaatraatataacctccattattcagatt

SEQ ID NO: 60144 - DNA, 50 bp, homo sapien
ctgctctccactccacatgacacttytgacaccagctgtgtaggggtttt

SEQ ID NO: 60145 - DNA, 50 bp, homo sapien
ccagatgtgccctatgagcacctaarcttactgcttgaagagtgtttcca

SEQ ID NO: 60146 - DNA, 50 bp, homo sapien
agtcatttccaaatgcttcctggagkctggtattgtccctagttgggtgt

SEQ ID NO: 60147 - DNA, 50 bp, homo sapien
aagcagagttcagattaataaagcaytagaactgaatctaccatgaggta

SEQ ID NO: 60148 - DNA, 50 bp, homo sapien
ttgggtgttgtgtcccctaaaaggaycagcatgttcacctgttgttagaa

SEQ ID NO: 60149 - DNA, 50 bp, homo sapien
ggaagtatggtctcctatccataaayccagaacacaagatttgcacatat

SEQ ID NO: 60150 - DNA, 50 bp, homo sapien
gctcagacttctaatgggaactcaayggaaatgagagaggagacaacctg

SEQ ID NO: 60151 - DNA, 50 bp, homo sapien
tttgtgatattcattgtgaaacacartcatttagcaccttgcattgttgt

SEQ ID NO: 60152 - DNA, 50 bp, homo sapien
tttaaggataaaatgaaaagtgtaaygagagctggaaaaggtgaatatga

SEQ ID NO: 60153 - DNA, 50 bp, homo sapien
ggtgaaaaactcctgggcttttcagsatagaattccaccatcacatgtga

SEQ ID NO: 60154 - DNA, 50 bp, homo sapien
aaacaggatacatttcattagggtaraatgagagaactcctttgattggg

SEQ ID NO: 60155 - DNA, 50 bp, homo sapien
tagccaagggttgttacacttccaasggaactccagtctctgaatggggg

SEQ ID NO: 60156 - DNA, 50 bp, homo sapien
attgacataggatcctttaattccaraatgtcgggacacatttaataaga

SEQ ID NO: 60157 - DNA, 50 bp, homo sapien
gtaataaatgttttcgattactgtamattttacaaaaatgaatgactgaa

SEQ ID NO: 60158 - DNA, 50 bp, homo sapien
ataggcacttataaaatcatttgccraagactctaggattattttagatt

SEQ ID NO: 60159 - DNA, 50 bp, homo sapien
agacatgatatgagcactggatgccrgagaattgatgacttgcactgaga

SEQ ID NO: 60160 - DNA, 50 bp, homo sapien
agtctatatctgtaactaactttgayatgacttctttctttgtaaaataa

SEQ ID NO: 60161 - DNA, 50 bp, homo sapien
tatttataactaccttcttctacgasctattttgtatttcctgtgtcttc

SEQ ID NO: 60162 - DNA, 50 bp, homo sapien
ccacagaaaaactcctaaagttgcayaaacaatatttggtgataaagtgg

SEQ ID NO: 60163 - DNA, 50 bp, homo sapien
tcccacaatgtgaattcatccaccargtagtggcatcaatctttttggga

SEQ ID NO: 60164 - DNA, 50 bp, homo sapien
tagatttagattaaattctataatakcccagctagtgtggggtcagtggg

SEQ ID NO: 60165 - DNA, 50 bp, homo sapien
actaggatagctaaaataagaaaacmgacaatacaagtgttgataaggat

SEQ ID NO: 60166 - DNA, 50 bp, homo sapien
atcagtatttgtctcatttatctcaragaaagtcataatacatagctgtg

SEQ ID NO: 60167 - DNA, 50 bp, homo sapien
tatcatccaagaacgttaccttcaaktagtgaacgatatgaccccagtgg

SEQ ID NO: 60168 - DNA, 50 bp, homo sapien
ttccaatagcaaatccccttgttcartatgcagggtttctagctggactt

SEQ ID NO: 60169 - DNA, 50 bp, homo sapien
gtagaggctgtgaggtagctaattcrcagcacgattccatgagattccta

SEQ ID NO: 60170 - DNA, 50 bp, homo sapien
aggagtgcaatcaaaactccagccamaaagaggagagaggagtctcctgg

SEQ ID NO: 60171 - DNA, 50 bp, homo sapien
gatcagagaattgctgctactcataytataaaagaactgggaatggagta

SEQ ID NO: 60172 - DNA, 50 bp, homo sapien
ctcagggatatctgtaaatacatgarggctcttttttctggttgttagtg

SEQ ID NO: 60173 - DNA, 50 bp, homo sapien
cagttcttcatgaaggcaggtaactyaataaactctaaagtctgctccaa

SEQ ID NO: 60174 - DNA, 50 bp, homo sapien
acaaaataggaggaactaatgtaaaygctttatagagttctctaacaaca

SEQ ID NO: 60175 - DNA, 50 bp, homo sapien
ccataaaataatgacatattttatarattaaaggcagctgatatttgatg

SEQ ID NO: 60176 - DNA, 50 bp, homo sapien
atgatttgagctaacttagttttcartatggctagtgaaatcaattgcat

SEQ ID NO: 60177 - DNA, 50 bp, homo sapien
tcctcaccaaaatcctatgaggaaaktaagtttagtgtctgtattttaca

SEQ ID NO: 60178 - DNA, 50 bp, homo sapien
aaggacaaagcaaaaatattctagcrcaagagagcagacagaagcatgga

SEQ ID NO: 60179 - DNA, 50 bp, homo sapien
tctgagatatctggtaagttacttarcgtttctaatcctcaaggcactta

SEQ ID NO: 60180 - DNA, 50 bp, homo sapien
aagcatttaatgaacactttatgccragacttataaaactaaacacattc

SEQ ID NO: 60181 - DNA, 32 bp, homo sapien
tgagccttcttatttawcttatttggtagctg

SEQ ID NO: 60182 - DNA, 50 bp, homo sapien
tgactttgagtttaacatattctcaktccttcttatcctccaagtcatca

SEQ ID NO: 60183 - DNA, 50 bp, homo sapien
atatagggggcaggggagaaaaaacygctcagattaagacaaatagaacc

SEQ ID NO: 60184 - DNA, 50 bp, homo sapien
gccttcatgaagaactgcccctgagyatttaaagagtgttgaatggtagg

SEQ ID NO: 60185 - DNA, 50 bp, homo sapien
gttttgtaaaatgaaacctgtaaaaytgccagtgtccagaaataaagcgt

SEQ ID NO: 60186 - DNA, 50 bp, homo sapien
aaaaaacacaaaagcatgctcaggarataaatttattacacaaagtcctt

SEQ ID NO: 60187 - DNA, 50 bp, homo sapien
aaatcttgggttaaccactttcaagraaacgattagtaaaaattgatgtt

SEQ ID NO: 60188 - DNA, 50 bp, homo sapien
gtggttaacccaagattttattcaaygtagcaaacaggaagtatcccaga

SEQ ID NO: 60189 - DNA, 50 bp, homo sapien
attctctctctttttcttcttctaarattgtgattacacatttgatagat

SEQ ID NO: 60190 - DNA, 50 bp, homo sapien
ataactgaatgacttgtacttattasagattgttcacataaatataaatg

SEQ ID NO: 60191 - DNA, 50 bp, homo sapien
ttcctctgtaatcattacaaacagtrgatatgacacagttcgtgcactgg

SEQ ID NO: 60192 - DNA, 50 bp, homo sapien
cccacttcatttggctctatagacayaatcatagatataaagatgcattt

SEQ ID NO: 60193 - DNA, 50 bp, homo sapien
agaggcttcttcctctcccttcctcygtaatcattacaaacagtggatat

SEQ ID NO: 60194 - DNA, 50 bp, homo sapien
caaagaaagatgtatttgagaaaggmaaacatgggattcggagggtctgg

SEQ ID NO: 60195 - DNA, 50 bp, homo sapien
aaggaagcttagaacactctaaaacrcagttaaaattatcacagagagaa

SEQ ID NO: 60196 - DNA, 50 bp, homo sapien
ttttttcatgcaatttaaaataagckcaccatctagtttacagaaattca

SEQ ID NO: 60197 - DNA, 50 bp, homo sapien
agtgttaattctgtactccttccccrattctgagtaggtgccttttacat

SEQ ID NO: 60198 - DNA, 50 bp, homo sapien
gatgttggagagcccaatcttacaarcccaatcttgtcgtgcaaagtttt

SEQ ID NO: 60199 - DNA, 50 bp, homo sapien
attctaattacacatataatagacarcttgacatggttgcacagcagggc

SEQ ID NO: 60200 - DNA, 50 bp, homo sapien
aaccaaatgtagtagcttctcagtayagaaattcagtgtctaagaatgag

SEQ ID NO: 60201 - DNA, 50 bp, homo sapien
tggacagggacctgacagaggatatmaccaagctcagatcccagaggctt

SEQ ID NO: 60202 - DNA, 50 bp, homo sapien
tttcctggatagcatctctagctcaygctaaattattacatttttaactg

SEQ ID NO: 60203 - DNA, 50 bp, homo sapien
aagcagttatctctccttactcccartggaaacccttgactccaagttga

SEQ ID NO: 60204 - DNA, 50 bp, homo sapien
gttataactatcagatctcagtgatyaatttggtttatgatgcagaaaac

SEQ ID NO: 60205 - DNA, 50 bp, homo sapien
ttcaaaggagagactagacttggaartaataatgtacaatgttaaaagtt

SEQ ID NO: 60206 - DNA, 50 bp, homo sapien
aaaatgatataattgagaatttacartaagacagggttttggtttttgct

SEQ ID NO: 60207 - DNA, 50 bp, homo sapien
tggggcatttgatgaggaggctggamcagtttagcacacactccagtgtt

SEQ ID NO: 60208 - DNA, 50 bp, homo sapien
accttggtcactcatatttggctcayagtaaacttctttaaatattgtat

SEQ ID NO: 60209 - DNA, 50 bp, homo sapien
ctgaattaatttcagattctggttarcttcacataaatattttttttagg

SEQ ID NO: 60210 - DNA, 50 bp, homo sapien
acatcaaggcagccctgaccaaggcraattcatcagtcttctctgggcct

SEQ ID NO: 60211 - DNA, 50 bp, homo sapien
tctccttcagcagcccctgttccaarttctttcaggactgagtcttcatt

SEQ ID NO: 60212 - DNA, 50 bp, homo sapien
tgtgctcagtgttccatataatagaygaaagcacagtgcaggaccatgga

SEQ ID NO: 60213 - DNA, 50 bp, homo sapien
agtgggcttatgagatgtttgcccaytgccataggttctgggctatggat

SEQ ID NO: 60214 - DNA, 50 bp, homo sapien
agtcggcaaacattccttttgttagkaatgcaccctcacttccaaatcag

SEQ ID NO: 60215 - DNA, 50 bp, homo sapien
tcacccccagacacacacgaacaaakaatcatatggcttacaatggcaat

SEQ ID NO: 60216 - DNA, 50 bp, homo sapien
tttgagcaacaacaattttgaatcaygtactttaaattgggtctatagag

SEQ ID NO: 60217 - DNA, 50 bp, homo sapien
tcccagccatttagtttgctaaatawcattgggtagacgttttttataca

SEQ ID NO: 60218 - DNA, 50 bp, homo sapien
tctgggtccctgcctgtcgccataaytcttgcactattaaaatcttcaac

SEQ ID NO: 60219 - DNA, 50 bp, homo sapien
aggtgaacttggttgttgtcacagayatgtgagatgagtatttgacaagc

SEQ ID NO: 60220 - DNA, 50 bp, homo sapien
tgtgcctttccactgagccatgatargtggtaagttaaacctatgtgggg

SEQ ID NO: 60221 - DNA, 50 bp, homo sapien
tcctatgcacccaaaattatgctagyaaaacaaaaggggctgaatggctg

SEQ ID NO: 60222 - DNA, 50 bp, homo sapien
acacattttctttgcactgtacatayatgcgcagaaattacctctgtgtc

SEQ ID NO: 60223 - DNA, 50 bp, homo sapien
taggaaagtagttgatagacaagggyattgaggatgtttgccagggaatt

SEQ ID NO: 60224 - DNA, 50 bp, homo sapien
agagcatataggacaggagacaaggkttagagactattgagagtaagcga

SEQ ID NO: 60225 - DNA, 50 bp, homo sapien
tatcaactactttcctatattttccyagatttaacttagaaagttgaaca

SEQ ID NO: 60226 - DNA, 50 bp, homo sapien
ctgctgtgtggtcagttaaaggcaartggtctgaactttacagggcttaa

SEQ ID NO: 60227 - DNA, 50 bp, homo sapien
atctgttttctcagtgaaataggaarcaagtcaatgaacaagaatataaa

SEQ ID NO: 60228 - DNA, 50 bp, homo sapien
aggaattgaattcttaaaagttccaygtacactactatggtgcagttttt

SEQ ID NO: 60229 - DNA, 50 bp, homo sapien
cttgacaaagaatacacctatatcaraaagtgttcgtgcttatcctcatc

SEQ ID NO: 60230 - DNA, 50 bp, homo sapien
agctaaagcatattaactctgccccyaccaacaagtggtattagtagtca

SEQ ID NO: 60231 - DNA, 50 bp, homo sapien
attatatatttatacactatctgccrctgtactataaatccaacctgctc

SEQ ID NO: 60232 - DNA, 50 bp, homo sapien
tggatcaaaagctctgtatcttaaawgaatggtcattaaggcttatgtta

SEQ ID NO: 60233 - DNA, 50 bp, homo sapien
ctacagcacaaaaacatttactgaayggataaaaggttgactggatgtta

SEQ ID NO: 60234 - DNA, 50 bp, homo sapien
cccctaaggaacccctcacaagaccraactccaggcgctgcttttcaagt

SEQ ID NO: 60235 - DNA, 50 bp, homo sapien
cttgagaaataaggaagatcctccakgtttagctttagtaagtgttgata

SEQ ID NO: 60236 - DNA, 50 bp, homo sapien
tcacaagaacctctcaacaagcctayccagagattttaaagagttccctc

SEQ ID NO: 60237 - DNA, 50 bp, homo sapien
ttgaaatcctagccccagcatttaaytgctatatgacatggtatgtaagt

SEQ ID NO: 60238 - DNA, 50 bp, homo sapien
gttagaatggacaaagagtagcatgygattctaataatgaaagaccaagg

SEQ ID NO: 60239 - DNA, 50 bp, homo sapien
tgggccctgcttcatcagtgtgcacyttatcccactccaccccatctcac

SEQ ID NO: 60240 - DNA, 50 bp, homo sapien
acctctacaatctctaactggtgatraagcatcatgaaattcaaacaatc

SEQ ID NO: 60241 - DNA, 50 bp, homo sapien
aaggaccattttattagttcatgacrcaaagattaggaggcggtccatac

SEQ ID NO: 60242 - DNA, 50 bp, homo sapien
agtcttgaaagataagtgttagccargtaaagagatgtgggtaaataaac

SEQ ID NO: 60243 - DNA, 50 bp, homo sapien
agacacaagcttaaagaggttaaatwactcgtccagggtcacactgttag

SEQ ID NO: 60244 - DNA, 50 bp, homo sapien
agtttctagttgattgtgtctactarccgttctttcttctcctcttctct

SEQ ID NO: 60245 - DNA, 50 bp, homo sapien
acccttctctgccacctgtgactacrgagaaaacaaaataatgggccagg

SEQ ID NO: 60246 - DNA, 50 bp, homo sapien
aatgggacctaatcaaactaaagaastcctacatagcaaaagaaactaaa

SEQ ID NO: 60247 - DNA, 50 bp, homo sapien
caatatgggacttgtctgattgaacrctattgcctcttcatcgcacagac

SEQ ID NO: 60248 - DNA, 50 bp, homo sapien
gcacctgtcatttaatacatctgatraatcactagatcaaatctctaaat

SEQ ID NO: 60249 - DNA, 50 bp, homo sapien
agcacagccaagagcacaagggactrtttcttcaattactgctctgatac

SEQ ID NO: 60250 - DNA, 50 bp, homo sapien
atcagagttcacggcatttagcttasacaggaggaatgatttctttaccc

SEQ ID NO: 60251 - DNA, 50 bp, homo sapien
tttactttttttttgaggtcattaawaaaaaggagaagaagaatatataa

SEQ ID NO: 60252 - DNA, 50 bp, homo sapien
cttgtatacagttatggaatacaaaktaatgggctactgtggaaaaattg

SEQ ID NO: 60253 - DNA, 50 bp, homo sapien
attccagtaatatgttttattaaacyatgttcctttccttcagaacactt

SEQ ID NO: 60254 - DNA, 50 bp, homo sapien
ttcagaatcaaactggattaatcccwtgtgtttgagctctgattctggtt

SEQ ID NO: 60255 - DNA, 50 bp, homo sapien
gttttggccattttgagccgaactaygtaaatctagccttaaatcaagaa

SEQ ID NO: 60256 - DNA, 50 bp, homo sapien
caactctggctatgattttaccacamaaactaaatctaggtatacaaaat

SEQ ID NO: 60257 - DNA, 50 bp, homo sapien
gggagggaccctttaaagtgctgtcratgacccataaggctatcagtgca

SEQ ID NO: 60258 - DNA, 50 bp, homo sapien
tgaaaaaagattttagttatgccagkaatattccccaatgtttctagatt

SEQ ID NO: 60259 - DNA, 50 bp, homo sapien
atcaatcaatatgatacattttatcwacagaatgaaggacagaaaccata

SEQ ID NO: 60260 - DNA, 50 bp, homo sapien
tgcaggtgcatgttaccacctgggckgcattttgccaagtgagagatctg

SEQ ID NO: 60261 - DNA, 50 bp, homo sapien
tcccccattaaacatatgcaaatggmaatggtaataaactcagataatga

SEQ ID NO: 60262 - DNA, 50 bp, homo sapien
ctagagtagatggtattttggataayagatggacatctctaacttttaaa

SEQ ID NO: 60263 - DNA, 50 bp, homo sapien
atgtgtcattaatgtcaagacatccragaataacttatttatttgcattc

SEQ ID NO: 60264 - DNA, 50 bp, homo sapien
tttaactcctcatccacccattcacrcttgtactttttttattccatcct

SEQ ID NO: 60265 - DNA, 50 bp, homo sapien
caataactttggaatgcagtgtaagwaaaagaaaatattctttatgtgga

SEQ ID NO: 60266 - DNA, 50 bp, homo sapien
gagataggagaaattaatatttccaygaaacaaatcacatgcaccatata

SEQ ID NO: 60267 - DNA, 50 bp, homo sapien
tccaacaaccttcaaatgcacagaartcttagttatcattctctagcatt

SEQ ID NO: 60268 - DNA, 50 bp, homo sapien
acttttcacaagaaacaaggaaggcrtgagagacagcgaagaataataca

SEQ ID NO: 60269 - DNA, 50 bp, homo sapien
tctactttaaaatttatatagaacgraaaagagcccgtatggccaagaca

SEQ ID NO: 60270 - DNA, 50 bp, homo sapien
tccattgataacacttattccaaaakctattacaattaggtgggccagta

SEQ ID NO: 60271 - DNA, 50 bp, homo sapien
tgattgctatagcacagcacttttcratcatgaggaaactgagtcttaga

SEQ ID NO: 60272 - DNA, 50 bp, homo sapien
atgtctttgagatattgtggggtackctgagatattactttacttgatat

SEQ ID NO: 60273 - DNA, 50 bp, homo sapien
actacactctgactgctatggacaayctggacaattatctcaccacgcta

SEQ ID NO: 60274 - DNA, 50 bp, homo sapien
gtcattacagtcctattaagggaaawatgagagatttagataggggagct

SEQ ID NO: 60275 - DNA, 50 bp, homo sapien
ccagaagtagaatcctggtctaacartatcaagaacttgttcttttagcg

SEQ ID NO: 60276 - DNA, 50 bp, homo sapien
tgtataaagccccagtacgttcacaytgaatacagcagaacaggaaccag

SEQ ID NO: 60277 - DNA, 50 bp, homo sapien
ttttttagtttttttttcattttcaratcaagagcagtgtatcttgattc

SEQ ID NO: 60278 - DNA, 50 bp, homo sapien
aggaacagtattagtttgatcttgamatctcacagacatgatctcaaatt

SEQ ID NO: 60279 - DNA, 50 bp, homo sapien
gaaatgaggtgacatcctgaaataasagtgaggcaagccagaacactgtt

SEQ ID NO: 60280 - DNA, 50 bp, homo sapien
acacaagatgtgaaatatcaggaacygtgaatgatgaagaactagaaaca

SEQ ID NO: 60281 - DNA, 50 bp, homo sapien
gtctttcctccatgcttagaacatakcaacaggaataaatggacttgagt

SEQ ID NO: 60282 - DNA, 50 bp, homo sapien
ccaatatacatcatacttgaagcacycaacaatatggctattcagtttca

SEQ ID NO: 60283 - DNA, 50 bp, homo sapien
ttggaatgtactgagtttcacccaaygatcacctttatgatatccacaca

SEQ ID NO: 60284 - DNA, 50 bp, homo sapien
atgtaaaaaaaaaaaaaaaagaacamgaggaatataagagatttgcctcg

SEQ ID NO: 60285 - DNA, 50 bp, homo sapien
aaaatatcacaaccctatttttgctygctggttatatcctctctttcctt

SEQ ID NO: 60286 - DNA, 50 bp, homo sapien
caaccctgacaaatacatcagctaartggttccaaacccatcaaaaattg

SEQ ID NO: 60287 - DNA, 50 bp, homo sapien
tagcaaatgcctgatgttcaataggkactccatagatttgtgtggatttt

SEQ ID NO: 60288 - DNA, 50 bp, homo sapien
acctgcatattcagtattacccttcsagtgattatttacagatgctagag

SEQ ID NO: 60289 - DNA, 50 bp, homo sapien
agaaatgctctaaaaagccaagataraaatggctgcacatgactgtggat

SEQ ID NO: 60290 - DNA, 50 bp, homo sapien
tcctgctttatggtgaagacaaaggyatccacagtcatgtgcagccattt

SEQ ID NO: 60291 - DNA, 50 bp, homo sapien
ctaaaagtagttttaacaaagaataygaggcttgctatcatggctttctc

SEQ ID NO: 60292 - DNA, 50 bp, homo sapien
gaagtttagagaacttaggtcatacrgatttcaaaggcctttcttttaac

SEQ ID NO: 60293 - DNA, 50 bp, homo sapien
atatttaaatgaactatccataattytgtttcttttttcttcttttgaag

SEQ ID NO: 60294 - DNA, 50 bp, homo sapien
tgagtgatgtcaggctaagctgttawttgatgtgaacatcagtttctaat

SEQ ID NO: 60295 - DNA, 50 bp, homo sapien
tcttgacaagataagctcaaagtgaytaggtggaagctatagtgtaaagg

SEQ ID NO: 60296 - DNA, 50 bp, homo sapien
ccttgaaactattagactgtccatckcaatgtccgaaacagaggatggcc

SEQ ID NO: 60297 - DNA, 50 bp, homo sapien
atctagattagtaaattgtatgttcragattcatatcattatctctatgt

SEQ ID NO: 60298 - DNA, 50 bp, homo sapien
tgtgatagtcatggaaaaatatgtarcaacgatttctttctctttacagt

SEQ ID NO: 60299 - DNA, 50 bp, homo sapien
ctctttaaaaagaaagtgaagataaytgcaagtcagctggaagtgctgcc

SEQ ID NO: 60300 - DNA, 50 bp, homo sapien
gttagacattgcgctgtagcagtccrcacaatatcacttgtcttctgggc

SEQ ID NO: 60301 - DNA, 50 bp, homo sapien
gtatactgcctggtacagaaccaagsctgattttagcatgcatctttcat

SEQ ID NO: 60302 - DNA, 50 bp, homo sapien
taccaggcagtataccagtcctttaygcacttgaatatgctttgtccttc

SEQ ID NO: 60303 - DNA, 50 bp, homo sapien
tttcactctgatgccctgcctggtgygaccttagctcatttggtctcaac

SEQ ID NO: 60304 - DNA, 50 bp, homo sapien
ggaatgaatgaatgttggaggagatsaatactgttgaattcaaagggtaa

SEQ ID NO: 60305 - DNA, 50 bp, homo sapien
ctgcagttaatgtatcaaagcaatgrcaatgtgtaattacattttaatca

SEQ ID NO: 60306 - DNA, 50 bp, homo sapien
caaggaaaaagattaaatttgggctyaatatttcacatcattaagagttt

SEQ ID NO: 60307 - DNA, 50 bp, homo sapien
caggtaaaaccacccctgtggtaatwatgaactactgagggagacagtct

SEQ ID NO: 60308 - DNA, 50 bp, homo sapien
gtgcctataatgtattttaaattggycattccaccttacctaatggaaat

SEQ ID NO: 60309 - DNA, 50 bp, homo sapien
catgagttcaacagttagagacctaktaggctttattcttcattctgagg

SEQ ID NO: 60310 - DNA, 50 bp, homo sapien
gtgacatctgtatgatttgcactaaytcaaagatggttttcctggatgtc

SEQ ID NO: 60311 - DNA, 50 bp, homo sapien
atttgtatgttagagtcaccacttamaaaaatcataactccagttttcaa

SEQ ID NO: 60312 - DNA, 50 bp, homo sapien
tctagctatccttgttagggttccasgattcctagaaatgtggacctcat

SEQ ID NO: 60313 - DNA, 50 bp, homo sapien
aggaagctgcaaaggcaaaggtgaakaagcatgaaggtgagtagcaagta

SEQ ID NO: 60314 - DNA, 50 bp, homo sapien
aatagagtcaaggtttccagaataartcatgtctatttccacagttaaag

SEQ ID NO: 60315 - DNA, 50 bp, homo sapien
gtgatataaattactttgtttgactrgttctcattcaatattgcttttta

SEQ ID NO: 60316 - DNA, 50 bp, homo sapien
ttattgagcattaattatctggcagscattgcaaagtccagaaactagga

SEQ ID NO: 60317 - DNA, 50 bp, homo sapien
gcctctttatctttgctccattactmaaattgggagtgtgagagtgtatc

SEQ ID NO: 60318 - DNA, 50 bp, homo sapien
gctcccacagagttgggatggaacartattcagtcagacgattaacagtc

SEQ ID NO: 60319 - DNA, 50 bp, homo sapien
ccacaaaaccataccaaaaaagcccygcaatgaatggaaagaagaatatt

SEQ ID NO: 60320 - DNA, 50 bp, homo sapien
aagtaggtttgttattttatagacgmtgagttgaaagcccagagaggcta

SEQ ID NO: 60321 - DNA, 50 bp, homo sapien
attcctccgcaagaaccacatagacrgtcaggttttctgtgtagattttt

SEQ ID NO: 60322 - DNA, 50 bp, homo sapien
atagccacctcatgtgtttaacacaytaagtcctggtttctgtctctcaa

SEQ ID NO: 60323 - DNA, 50 bp, homo sapien
ctagtgggattttttttctgactaargataaagcatggggaaaaccaaat

SEQ ID NO: 60324 - DNA, 50 bp, homo sapien
aagataggatgtgggtggagaccgcrtaatcaaggaactgatagtgaaag

SEQ ID NO: 60325 - DNA, 50 bp, homo sapien
atgtgtccatctcttcctagaatgcracctatttgtaagttcagaactag

SEQ ID NO: 60326 - DNA, 50 bp, homo sapien
ccttccctcataatttttcccatcaygttttgtaaagaaggctatatctg

SEQ ID NO: 60327 - DNA, 50 bp, homo sapien
catgtttacactgatctaatcttgayctcctgaaaaatctttgtgacttt

SEQ ID NO: 60328 - DNA, 50 bp, homo sapien
agtcaaggatgagtctgaagtgcatragtcttgcatccacatgttaccat

SEQ ID NO: 60329 - DNA, 50 bp, homo sapien
cccctgagggcctacattgggactgmagagaatttacttacctcttcctc

SEQ ID NO: 60330 - DNA, 50 bp, homo sapien
gagaggctgcaaagtgggtaggcagraaatttgttacccaaacaataaac

SEQ ID NO: 60331 - DNA, 50 bp, homo sapien
tgttcagttaaagatacaattgggamgtactctttaaaatgatggagtcc

SEQ ID NO: 60332 - DNA, 50 bp, homo sapien
aggatatttccattagaaaattgccracactaaggctcatccagtaactg

SEQ ID NO: 60333 - DNA, 50 bp, homo sapien
tgactcaatgctcataactttcctcrctgattcctgcttatcctgctcct

SEQ ID NO: 60334 - DNA, 50 bp, homo sapien
tctcaggaatagcttttactaataartcacatgaagtcagtacatcacat

SEQ ID NO: 60335 - DNA, 50 bp, homo sapien
catttcccaaaggtagatccagtaarcaatactctcaaagcacccaccct

SEQ ID NO: 60336 - DNA, 50 bp, homo sapien
cattgaaatgaaaaggtcttcagaartaatctccctaatatggttggtct

SEQ ID NO: 60337 - DNA, 50 bp, homo sapien
ctaaataaagataaaaggcagcctcraaaaatgggttaaaattagattct

SEQ ID NO: 60338 - DNA, 50 bp, homo sapien
tcgtcacctcatacatgggtggataraagtttgcgacagaaagagtgaat

SEQ ID NO: 60339 - DNA, 50 bp, homo sapien
gtaaacaatatattgggacaagaaakactttaaggtaacaaaatgtagct

SEQ ID NO: 60340 - DNA, 50 bp, homo sapien
tttgaaaccaaatattatttacctcyatatcctctgtagtatctagctag

SEQ ID NO: 60341 - DNA, 50 bp, homo sapien
ggtaacaaaatgtagctttaagaacrgacagactgggtgcagtggctcat

SEQ ID NO: 60342 - DNA, 50 bp, homo sapien
agcagtgccttttagggtatcagaasagaagaatctctgcaactgcaggc

SEQ ID NO: 60343 - DNA, 50 bp, homo sapien
taggtgagtaagggaggaattcaaaygataggacctgaccttgaaaccca

SEQ ID NO: 60344 - DNA, 50 bp, homo sapien
tctgtcctacctgctgacccggggaycttgaagaagctaagataagcagc

SEQ ID NO: 60345 - DNA, 50 bp, homo sapien
aaattaagtcaaatttctatgaaaarctgtaacatttagccagctccact

SEQ ID NO: 60346 - DNA, 50 bp, homo sapien
gttaatcaaggcttagatgaaataaytgtatgtgaaaatgatttgctaac

SEQ ID NO: 60347 - DNA, 50 bp, homo sapien
ttgttttactttcccatatcataaasttgtgctgatatttatagaagttc

SEQ ID NO: 60348 - DNA, 50 bp, homo sapien
cttctgagacttttttttattagaayccatgcaaagctgtatcattcccc

SEQ ID NO: 60349 - DNA, 50 bp, homo sapien
agaatgggcgtcctcaggagattcaraggagctttctgccaattcaatca

SEQ ID NO: 60350 - DNA, 50 bp, homo sapien
ctctgtatctcttgtgtggtaattcraaaatatgttccccaaagcctttg

SEQ ID NO: 60351 - DNA, 50 bp, homo sapien
ctgacttttttgttaaggaactaaarccattcaaaatgaactacttcatc

SEQ ID NO: 60352 - DNA, 50 bp, homo sapien
ttcataaatactttcataggctccaytgatattcacagttttcagttaga

SEQ ID NO: 60353 - DNA, 50 bp, homo sapien
gttccaaagtctcccttcctgcagaraaataagtttcagtaaaatattct

SEQ ID NO: 60354 - DNA, 50 bp, homo sapien
gagattggatgaatacatgatcaggyacttacatgccatttctcacattc

SEQ ID NO: 60355 - DNA, 50 bp, homo sapien
cattgaaaattcattttaaagcacartatctttgaataaacccattgaaa

SEQ ID NO: 60356 - DNA, 50 bp, homo sapien
tttcctctggaagccaagatgctaaraaaggggtcactaatagtgtgact

SEQ ID NO: 60357 - DNA, 50 bp, homo sapien
acctttgaagatgttgttgctttaayagaagaaaaggtatgaacaaatac

SEQ ID NO: 60358 - DNA, 50 bp, homo sapien
caagataaggaggggctaatgggaasagcatacaacagaaaactcacttc

SEQ ID NO: 60359 - DNA, 50 bp, homo sapien
taaactatattaggaataattcagaygatcttaataggtgtgatctctag

SEQ ID NO: 60360 - DNA, 50 bp, homo sapien
gatgaaacttaaggtaagttttgaarggcatatccatataagggaggcat

SEQ ID NO: 60361 - DNA, 50 bp, homo sapien
atctataaaatggtagtaataatgayaccttaatcccatggtgttggtga

SEQ ID NO: 60362 - DNA, 50 bp, homo sapien
tgagtaggtaacacactccacattaycagtacagagactattctagcatc

SEQ ID NO: 60363 - DNA, 50 bp, homo sapien
taaagctcacaagcactctacaatamggaacatattaaaagttaccctca

SEQ ID NO: 60364 - DNA, 50 bp, homo sapien
gaaaagaatgcccaggaagctatatkagttcaagtttacatttccatagc

SEQ ID NO: 60365 - DNA, 50 bp, homo sapien
aaaagggaaagtacattggcagtctwaaaaatcatatccattccttagaa

SEQ ID NO: 60366 - DNA, 50 bp, homo sapien
ctctgtactactgacaagcctctaayaaaggcaagggaaaataaacagga

SEQ ID NO: 60367 - DNA, 50 bp, homo sapien
taatccagtatttaagatgagcctaraatttttaataattgcaagggaaa

SEQ ID NO: 60368 - DNA, 50 bp, homo sapien
tggtatatagtagattgtaagatacmggctaaattttcagaaacaaaatt

SEQ ID NO: 60369 - DNA, 50 bp, homo sapien
tttgaatgtataaatgtgtaaacagraatagaggttcaatgtgttctttt

SEQ ID NO: 60370 - DNA, 50 bp, homo sapien
acatagaaaacagcattctttttgcyaaatatgaccaaattacttttatt

SEQ ID NO: 60371 - DNA, 50 bp, homo sapien
agacttgctctgcaaaatattgttaraagatgatagatttttaaaattcc

SEQ ID NO: 60372 - DNA, 50 bp, homo sapien
aattagcccattcaaatttcctggargtcacattacccatttgacaggca

SEQ ID NO: 60373 - DNA, 50 bp, homo sapien
aacccatcctttcttgttcctgtggyaaattcatagatgtctaagatagg

SEQ ID NO: 60374 - DNA, 50 bp, homo sapien
actcatgcactgctggagtgagagaragttagtaaaccattccagaaaac

SEQ ID NO: 60375 - DNA, 50 bp, homo sapien
tcaattcaaggggtggggcaatagaytcaacctcttaatagtaagacatg

SEQ ID NO: 60376 - DNA, 50 bp, homo sapien
aaacttctacaataaaccacttatcygagtctgctcatctctagaataaa

SEQ ID NO: 60377 - DNA, 50 bp, homo sapien
aacctaacaggttgttggaatatcayagaaggttcagggaggtgaaaata

SEQ ID NO: 60378 - DNA, 50 bp, homo sapien
ttaacatttaagtatctacaatactsaaaatactgatatttagatatatt

SEQ ID NO: 60379 - DNA, 50 bp, homo sapien
ggaatttttagagtgtcatgtgacgyatcattgtttgagaggataccgtt

SEQ ID NO: 60380 - DNA, 50 bp, homo sapien
aagaaagagagtttgagaatagaaayaacaaatgatcgaataagaggcag

SEQ ID NO: 60381 - DNA, 50 bp, homo sapien
gctctcaccttcttcagcctccttayacctcactcttagagcatcactac

SEQ ID NO: 60382 - DNA, 50 bp, homo sapien
ttgtcaaggctgttttcattattcamgtgttaaaagtgacatcatcttcc

SEQ ID NO: 60383 - DNA, 50 bp, homo sapien
tactttaaataccttcaaattgtackagacctcatatccagattaagtaa

SEQ ID NO: 60384 - DNA, 50 bp, homo sapien
tgtctggcttcaaagcttccaaagaygggctgacttttttgttaagggct

SEQ ID NO: 60385 - DNA, 50 bp, homo sapien
actatttcataggtctgctaaagacmaagcacttaggataatgcctgata

SEQ ID NO: 60386 - DNA, 50 bp, homo sapien
agtgtccttaccagttaattgtacaraagatgctcttggaccaccctggt

SEQ ID NO: 60387 - DNA, 50 bp, homo sapien
cctttgcagaacaaagaggtgatccygaaccaggtcagtggatatgcgta

SEQ ID NO: 60388 - DNA, 50 bp, homo sapien
taaggggcttgcttattcaacttatyaaggacacagacatggctaaaatg

SEQ ID NO: 60389 - DNA, 50 bp, homo sapien
aagtccatgcctattttctcagcaargatctccctgtttgtgttaaatca

SEQ ID NO: 60390 - DNA, 50 bp, homo sapien
cccagcataattttccatttcttttrtacatcataggtagccattctctg

SEQ ID NO: 60391 - DNA, 50 bp, homo sapien
cttgttcgtgcgagctggaaaatacyaacggcaactccaccctgcttaac

SEQ ID NO: 60392 - DNA, 50 bp, homo sapien
aatgctctggaaccatattcttcccrggcctatctgttagtcatatttct

SEQ ID NO: 60393 - DNA, 50 bp, homo sapien
gtaactttgactttgcaatagctaayacgatcatctcaatgctctctgca

SEQ ID NO: 60394 - DNA, 50 bp, homo sapien
tgagaaccactgcactgtagtattcraaagaattcccttccatgtaaaac

SEQ ID NO: 60395 - DNA, 50 bp, homo sapien
cacagacgaagcccagagaatgtaaraacctgcctagagtcactcaactc

SEQ ID NO: 60396 - DNA, 50 bp, homo sapien
acaatataactgctggttgggataayacactagctgaaactcattcacat

SEQ ID NO: 60397 - DNA, 50 bp, homo sapien
ttaaatgtgaaaggcctaagttatckaaaaccaccaagtgcagcatgctg

SEQ ID NO: 60398 - DNA, 50 bp, homo sapien
agatccttcccacttaagtcttccawggtcatgtagcaatgtctgagctt

SEQ ID NO: 60399 - DNA, 50 bp, homo sapien
aaatatacttttagaaaaatttgccrccactacaataactctagtgcttt

SEQ ID NO: 60400 - DNA, 50 bp, homo sapien
gagccttataggtcacatttagttgsgttgaactcaaaatctcatgagaa

SEQ ID NO: 60401 - DNA, 50 bp, homo sapien
ctagtcaattttgctactgattaaaytctaattgagacaaagtgttgagc

SEQ ID NO: 60402 - DNA, 50 bp, homo sapien
tccaattcctgcccttcagaagctcrccatttactgcttgtgttgtataa

SEQ ID NO: 60403 - DNA, 50 bp, homo sapien
gatcctagtacactcaccatatgaasacagtacctgctaatccagccaat

SEQ ID NO: 60404 - DNA, 50 bp, homo sapien
gaaattgatgaggcttaccattagargacaatgatatatgtgatgatatt

SEQ ID NO: 60405 - DNA, 50 bp, homo sapien
agatatgtcctgccatttaaatagaraataaccaaataaatgactagaag

SEQ ID NO: 60406 - DNA, 50 bp, homo sapien
gaggggataatcccttgtctgtaccwgaaaattcctccaacgagggtctt

SEQ ID NO: 60407 - DNA, 50 bp, homo sapien
acctaaactatggtattcacatcatmaagaatgtacacgatggatatatg

SEQ ID NO: 60408 - DNA, 50 bp, homo sapien
cattttcatttgttgggtgatcataygcaaataacttccttctgaccctt

SEQ ID NO: 60409 - DNA, 50 bp, homo sapien
atttaggaatcccaagtcaataggaygaaccagcccacgcagagcttcct

SEQ ID NO: 60410 - DNA, 50 bp, homo sapien
taacatgatatgaatctatttttgasgtttgtaatgattatggtaaacaa

SEQ ID NO: 60411 - DNA, 50 bp, homo sapien
aaatgatcttagactcctattcataycttgtgtttagtcctccttgaatc

SEQ ID NO: 60412 - DNA, 50 bp, homo sapien
ctctgacaaggaaagaaatgatgagratgagatagttctatttattaaat

SEQ ID NO: 60413 - DNA, 50 bp, homo sapien
taccagacttaatgtaagtgagaaawgtaatggtaaatcactgcaatttt

SEQ ID NO: 60414 - DNA, 50 bp, homo sapien
ctcagtatcacggtgtcatgaagaamtctttttaacccagctgttatttt

SEQ ID NO: 60415 - DNA, 50 bp, homo sapien
ctgtaataaacacgaggaatataaamataaatgtgaccatcaaggagtct

SEQ ID NO: 60416 - DNA, 50 bp, homo sapien
tgtaatcctacagaaattctcattamagtcaagactaatgaaaggagtct

SEQ ID NO: 60417 - DNA, 50 bp, homo sapien
aattcaataatgtagtcagttacaawtcaaacatttaaaattccaaagtt

SEQ ID NO: 60418 - DNA, 50 bp, homo sapien
cgtctgttgttttcccaataagatgrattccactatatggtgaaatgtgg

SEQ ID NO: 60419 - DNA, 32 bp, homo sapien
tctatggatctgagtayctttagtagcacatt

SEQ ID NO: 60420 - DNA, 50 bp, homo sapien
cgaaaacaatgcagcaataactacartgagtcctagctcttgcaatagca

SEQ ID NO: 60421 - DNA, 50 bp, homo sapien
gttatattaacacttgatttggaaayactgatggcctatcttagagtcag

SEQ ID NO: 60422 - DNA, 50 bp, homo sapien
tggaaggaaaattgacttgctgtcartcataactaccttttcacacagtt

SEQ ID NO: 60423 - DNA, 50 bp, homo sapien
ctgacacttgagagtgtgtatgaacrgaatgaaatggtaggaagagaagg

SEQ ID NO: 60424 - DNA, 50 bp, homo sapien
ccaaacagtgtctcagcatcaataartaatttcaataattaaaaagtgtg

SEQ ID NO: 60425 - DNA, 50 bp, homo sapien
tagacttttaaagatattttcacagragtctactaaagacaccttccccc

SEQ ID NO: 60426 - DNA, 50 bp, homo sapien
aataactccagaagcaaggattaggmccagatatttagagtgtattcctg

SEQ ID NO: 60427 - DNA, 50 bp, homo sapien
aggatcatagggatcattaagctagwaaatttctgcaaataattactgat

SEQ ID NO: 60428 - DNA, 50 bp, homo sapien
gtagacctgataatgagaattctgasattatgttggttaggcctggaatg

SEQ ID NO: 60429 - DNA, 50 bp, homo sapien
ctcttcccctggagtagtccctcaayatatgcttctattttcattcctcc

SEQ ID NO: 60430 - DNA, 50 bp, homo sapien
gatccaggtttgcatttttcaacctyaaatgacatatcatatccctaagc

SEQ ID NO: 60431 - DNA, 50 bp, homo sapien
tagatattgtcctgtgaatgataaayttgggaactaaaagtctaatcatg

SEQ ID NO: 60432 - DNA, 50 bp, homo sapien
ttaaaccacgtgttcatcttctggayatataaccagtcagagatgaatga

SEQ ID NO: 60433 - DNA, 50 bp, homo sapien
taaaggctgccaagagcacctcatarggacatgtcaatgattagagcaaa

SEQ ID NO: 60434 - DNA, 50 bp, homo sapien
tcaagcccctaagcaagatatgagarattctatataaaaccaaatttgat

SEQ ID NO: 60435 - DNA, 50 bp, homo sapien
ggacaaagctggctgctgattttcargctcgccatattcattttctccca

SEQ ID NO: 60436 - DNA, 50 bp, homo sapien
agagggaaggtacttagcaaaatatkagataagtgtcagcaatgacaagc

SEQ ID NO: 60437 - DNA, 50 bp, homo sapien
aacattgcaacaataaacctaatgarcttcacaacttgtgaggtgagcag

SEQ ID NO: 60438 - DNA, 50 bp, homo sapien
gcaaactctttagagaaagtccaccracagtcttgaacaatcagttctat

SEQ ID NO: 60439 - DNA, 50 bp, homo sapien
gtagatcagctggatgtcaaatagaytccttaggtaatagcaatcacatt

SEQ ID NO: 60440 - DNA, 50 bp, homo sapien
agagcctaccaggaagtcacagcacrgctccagaggaattttagacaagc

SEQ ID NO: 60441 - DNA, 50 bp, homo sapien
tctaggtgataagctattaacataastgtttgtcttcctgatactcaaac

SEQ ID NO: 60442 - DNA, 50 bp, homo sapien
gcccacaatgagtggtcttccttcawgaaacttttaaataattcatggaa

SEQ ID NO: 60443 - DNA, 50 bp, homo sapien
acctattttttaatctaagagagaaytgacgatttataaattagaaaaaa

SEQ ID NO: 60444 - DNA, 50 bp, homo sapien
gcatagtattatttttaactgcactkaaaggcattattttctgtttagct

SEQ ID NO: 60445 - DNA, 50 bp, homo sapien
taagttcattattatttgttcattarggtgattattggattgatatctat

SEQ ID NO: 60446 - DNA, 50 bp, homo sapien
tactccaggtaaaataatgatgtaartatcaccatggttcataattttgc

SEQ ID NO: 60447 - DNA, 50 bp, homo sapien
actgtagacccctgaaaagatgataratgactacagagaagacaaatttt

SEQ ID NO: 60448 - DNA, 50 bp, homo sapien
tgtcaataccacattcttttttcacycacggatctgatcttgttgttcct

SEQ ID NO: 60449 - DNA, 50 bp, homo sapien
accttataaggcaagtaactttagcycactttcatagttcattttatatt

SEQ ID NO: 60450 - DNA, 50 bp, homo sapien
aagagagttttgacagtgcaaaatayattggtagagtgttagcattcttg

SEQ ID NO: 60451 - DNA, 50 bp, homo sapien
ctgttttaaagaaaatagtaagatayagtgtacatttttagcatatttat

SEQ ID NO: 60452 - DNA, 50 bp, homo sapien
tatattcccaccactagacataagamctagtaatattttgtaccatctcc

SEQ ID NO: 60453 - DNA, 50 bp, homo sapien
tatgctcatatatctaactgcataaycgaaatctccatttagatgggtaa

SEQ ID NO: 60454 - DNA, 50 bp, homo sapien
ataatgtcactagatagattcattasattagaaacatatccatttaatta

SEQ ID NO: 60455 - DNA, 50 bp, homo sapien
ggcaggagaggtgctactctgcaccrtggtatatttacttagtgtactat

SEQ ID NO: 60456 - DNA, 50 bp, homo sapien
caatgtttactttatcccttgcataygatgaaaataatctacttccctga

SEQ ID NO: 60457 - DNA, 50 bp, homo sapien
cagcagagggaacggaatgagaagamccttacagtagccaactgactatt

SEQ ID NO: 60458 - DNA, 50 bp, homo sapien
cagtccttagttttaggtttgaatgyatgtgagagagttttcatgaattt

SEQ ID NO: 60459 - DNA, 50 bp, homo sapien
gacatttttcctttacctttcacatkaagtcatttcaaataaagataaaa

SEQ ID NO: 60460 - DNA, 50 bp, homo sapien
ctacctttcccaagactctaaaatgyagcagtttctcacttaatatggct

SEQ ID NO: 60461 - DNA, 50 bp, homo sapien
tttacactgacattggtgaaatccakgttgaatattagtgttttaaataa

SEQ ID NO: 60462 - DNA, 50 bp, homo sapien
atattgcattctggagagaacaggarcaaataagattcagcttcataaac

SEQ ID NO: 60463 - DNA, 50 bp, homo sapien
ccactccagagcctggactcttaackgctgtgttatcctgcctgggttca

SEQ ID NO: 60464 - DNA, 50 bp, homo sapien
ccttcagttgcaagtgccatgaaccrattcaaactatctgtaaaacacac

SEQ ID NO: 60465 - DNA, 50 bp, homo sapien
ctgtacaatctcttatgggaatctaktcaggactctcagagtcaaccaga

SEQ ID NO: 60466 - DNA, 50 bp, homo sapien
cagaacaaatgccaagagagtatgasaacttgggaccttgacaactggga

SEQ ID NO: 60467 - DNA, 50 bp, homo sapien
aaggctgtctttcactggttttccayctgagagtgctgctaggcctcatg

SEQ ID NO: 60468 - DNA, 50 bp, homo sapien
aaagccaaaaccagctttaggataawcactttgtgtacttagcatatgcc

SEQ ID NO: 60469 - DNA, 50 bp, homo sapien
atgaggttaagttgcctgatgttacyggtgaggctggacctaatacttaa

SEQ ID NO: 60470 - DNA, 50 bp, homo sapien
tgtgaggattaaagtagatagcccamatgatgtactctcaaagcagtgtt

SEQ ID NO: 60471 - DNA, 50 bp, homo sapien
gcacccatagggtgatagttgcttcyaatgccgcatacattaaaatattt

SEQ ID NO: 60472 - DNA, 50 bp, homo sapien
aaatgaataacaattgtgaatgaatmaagtagctcagatacaatttttat

SEQ ID NO: 60473 - DNA, 50 bp, homo sapien
tttcactggatcgttagttgggagaygaatatctgaatgtaaccattttg

SEQ ID NO: 60474 - DNA, 50 bp, homo sapien
gtaactgggtaaacgaaaggaaaaastggtggatgagatgcatgagtgat

SEQ ID NO: 60475 - DNA, 50 bp, homo sapien
tgcacaaacatgtaggaagactctayaaggacatggcatggaatcgctgc

SEQ ID NO: 60476 - DNA, 50 bp, homo sapien
aagcagccccagaaacatgtgtagamgtctccttggttttttgggtgaaa

SEQ ID NO: 60477 - DNA, 50 bp, homo sapien
atcttaggactactaaggcttttaaytccatggtcaagcttgctcccagc

SEQ ID NO: 60478 - DNA, 50 bp, homo sapien
ataaaattttagtttgaagtactgaygaatatacaatttagtgacacatt

SEQ ID NO: 60479 - DNA, 50 bp, homo sapien
gtgtgaggcatagcccctaccctaaytctcactttcacaaaacacaggat

SEQ ID NO: 60480 - DNA, 50 bp, homo sapien
gttattcttcgggaaaagagccatcmgtgagaaagtggctaacatgacct

SEQ ID NO: 60481 - DNA, 50 bp, homo sapien
gacctaaaaatatatatttcttttgycaacctgcatctttaatggttaat

SEQ ID NO: 60482 - DNA, 50 bp, homo sapien
tacttaatctccttggtgcgtataawgactagttagaagtaagtgaattt

SEQ ID NO: 60483 - DNA, 50 bp, homo sapien
aaaatctctcatcaaacagagccggycatattaaaacaagaaagacagag

SEQ ID NO: 60484 - DNA, 50 bp, homo sapien
gtaggtagggaccatggtgaagcagyccaagctgaaagccagcacctgtc

SEQ ID NO: 60485 - DNA, 50 bp, homo sapien
aagtgggaaaatgtattaggcactcwatagatcctcacgtgatataatct

SEQ ID NO: 60486 - DNA, 50 bp, homo sapien
tgctatatccactgtatattcatatwaaaaaagtgaatctacagctgggt

SEQ ID NO: 60487 - DNA, 50 bp, homo sapien
acctgccaaacagggagcactgctaygaaaagtgaaattagctttataac

SEQ ID NO: 60488 - DNA, 50 bp, homo sapien
tatacttttacattttcattagtacractcaattcccttgctctctggcc

SEQ ID NO: 60489 - DNA, 50 bp, homo sapien
agcagatcctgctgtctgttacccaygaaagacatcatctgtccagatgc

SEQ ID NO: 60490 - DNA, 50 bp, homo sapien
acatttttatcaccacaaaaagaaasctatactcattagtgatcaatcct

SEQ ID NO: 60491 - DNA, 50 bp, homo sapien
tccactatccatcttgtttaatctaygcactcgtctgtcaatttatgtgc

SEQ ID NO: 60492 - DNA, 50 bp, homo sapien
tagtgtattcatagttatgcaacacratcacaatcaattttagtacattt

SEQ ID NO: 60493 - DNA, 50 bp, homo sapien
aagttttgaggttattttaaaagaaytgcaacatcataaagaatgccata

SEQ ID NO: 60494 - DNA, 50 bp, homo sapien
gatttaaaaattctctcagaaagcayatacatttgcaaagattaatttga

SEQ ID NO: 60495 - DNA, 50 bp, homo sapien
ctagccttagtagataaaaagctcaycaaaaactactaagattctagaat

SEQ ID NO: 60496 - DNA, 50 bp, homo sapien
tggagataatataacctctaccatgyttacagaatataaaatgctggcct

SEQ ID NO: 60497 - DNA, 50 bp, homo sapien
aaaccccagcaagttctactagttcrtcttctataagatcagtttcatca

SEQ ID NO: 60498 - DNA, 50 bp, homo sapien
tatattactcaaatataaataagaaycaagaacacagagacatctagaaa

SEQ ID NO: 60499 - DNA, 50 bp, homo sapien
caaaacctttaactcctactatatayataaaaacgtccccttctctccca

SEQ ID NO: 60500 - DNA, 50 bp, homo sapien
gtgttgagggcctctgctcaattgaygtctcaggatagctctaattctag

SEQ ID NO: 60501 - DNA, 50 bp, homo sapien
actccactgaaagtttccttgccaakatcaccatttaatgagtaatcccc

SEQ ID NO: 60502 - DNA, 50 bp, homo sapien
cgttgagtttttgtaagctataggcraaaaagaaaagtattcttgaaaat

SEQ ID NO: 60503 - DNA, 50 bp, homo sapien
cgtatgtacttgtaagggtttttgaygttatattttgcctcggctggcaa

SEQ ID NO: 60504 - DNA, 50 bp, homo sapien
aaagataaactctgtttatctaggasaaagtaaaagatgagaacaagagt

SEQ ID NO: 60505 - DNA, 50 bp, homo sapien
tctacagggaccagccagtcatgcargtgaataatgtggttgagagacta

SEQ ID NO: 60506 - DNA, 50 bp, homo sapien
ctttttaaggtttatttcatctctamcaaagcctccttaactcctcaaat

SEQ ID NO: 60507 - DNA, 50 bp, homo sapien
accttagataagaagttctggattcyaaattgagccctgctgtgaaaact

SEQ ID NO: 60508 - DNA, 50 bp, homo sapien
ccctaatttatttgtgggataaaaasgatattgaatatgagagtggtggg

SEQ ID NO: 60509 - DNA, 50 bp, homo sapien
tcttcagaatttactggaggagaacrccttcaaagaggctgaaatacaaa

SEQ ID NO: 60510 - DNA, 50 bp, homo sapien
tataagatcacagcatcaagtagacrggaaaagtggaaaatctctattct

SEQ ID NO: 60511 - DNA, 50 bp, homo sapien
aactctacctattttaaatttataarctggattctaattagcctgcaggg

SEQ ID NO: 60512 - DNA, 50 bp, homo sapien
tggcgtttcaggtgggccacatgggkcaattgagtcttatcaacttgtgt

SEQ ID NO: 60513 - DNA, 50 bp, homo sapien
tttggcagaactttgagatagaaccrctgaagtcaccctgactatctgtg

SEQ ID NO: 60514 - DNA, 50 bp, homo sapien
attgttgaatcatgttaaatatataygcttggagtaccctgaaggaaaaa

SEQ ID NO: 60515 - DNA, 50 bp, homo sapien
atgcctggtgccatcctaatgatgaygagttctccattcttgctctatta

SEQ ID NO: 60516 - DNA, 50 bp, homo sapien
aggaagagagcaagagcaaaagcaargagacaaattaagagatgatttca

SEQ ID NO: 60517 - DNA, 50 bp, homo sapien
ggtacagtattccagcaataatgtayaataggcagctggcaatttgtttt

SEQ ID NO: 60518 - DNA, 50 bp, homo sapien
aaggataaatgtaactatcagctatragaaagagttttatttggctgggt

SEQ ID NO: 60519 - DNA, 50 bp, homo sapien
aacagaattacaccaaaaattagtasatcaacactatattgaaattaaaa

SEQ ID NO: 60520 - DNA, 50 bp, homo sapien
tctctgccagtaataccaaagatcartaacagagaaaattagcaatggga

SEQ ID NO: 60521 - DNA, 50 bp, homo sapien
gactttcaatttaattactaaaaggycaggctctaacttaacagaatgtt

SEQ ID NO: 60522 - DNA, 50 bp, homo sapien
cacacaaacacaagaaacagaggtaratatacaccaagggatagcatata

SEQ ID NO: 60523 - DNA, 50 bp, homo sapien
ttcctgcaactgggcttaataaaacrgtgtaatgtagcttgtatgtggtc

SEQ ID NO: 60524 - DNA, 50 bp, homo sapien
attaggtgttagctaaagaatcttcrcttggcataaatgtgtcccatgaa

SEQ ID NO: 60525 - DNA, 50 bp, homo sapien
tggaaaaaataatctacaattagaaycctagggaataccagcatctaatt

SEQ ID NO: 60526 - DNA, 50 bp, homo sapien
catccactacttagtgctcatgtatsacaaaatgacgcacttttatgtat

SEQ ID NO: 60527 - DNA, 50 bp, homo sapien
gcaagtcacctcattgttcctttcaygtcagcctttagactttcagtgct

SEQ ID NO: 60528 - DNA, 50 bp, homo sapien
cagacgataaatatttcctaaataastagatggatatttgactagcatca

SEQ ID NO: 60529 - DNA, 50 bp, homo sapien
ttcacacgcatcctataccctctgaygtttcaagtattggaaaaaagaaa

SEQ ID NO: 60530 - DNA, 50 bp, homo sapien
atatacctcactggctgagtttagaraagtagtaattatctttcagtgat

SEQ ID NO: 60531 - DNA, 50 bp, homo sapien
agagctctacccacttttaggtaaaygaggactaagtgtgtcatagagtt

SEQ ID NO: 60532 - DNA, 50 bp, homo sapien
aactctgagtccacttaagttttgcragtgtataagtcatttttcagtac

SEQ ID NO: 60533 - DNA, 50 bp, homo sapien
caaatagatacctgcagactatgaamgagaagtatagagagctatgcaag

SEQ ID NO: 60534 - DNA, 50 bp, homo sapien
aggaattcgaggcttgttactttgaragcataatatcatgaacaggatga

SEQ ID NO: 60535 - DNA, 50 bp, homo sapien
caaatctgcctaagagttctatgacrctataattgggatttcagaatatt

SEQ ID NO: 60536 - DNA, 50 bp, homo sapien
accagaaaatattgccctattgagasgatatcgcaagggaaaatgtctag

SEQ ID NO: 60537 - DNA, 50 bp, homo sapien
acgtcaccaaagaacttttacaggaractcacattggaagacttactgct

SEQ ID NO: 60538 - DNA, 50 bp, homo sapien
gacaagtatttaactgaaataaagakatcctgtgtgctcagctttcttgt

SEQ ID NO: 60539 - DNA, 50 bp, homo sapien
ccctcaaagaacctatttatagctarctggatagataaggtagaaaacag

SEQ ID NO: 60540 - DNA, 50 bp, homo sapien
ttttttggttgtttgaagttaaacawagaccctattattccatcttggat

SEQ ID NO: 60541 - DNA, 50 bp, homo sapien
atgcctcacacttgggacacaaataygcaagaaagactcttggtttgact

SEQ ID NO: 60542 - DNA, 50 bp, homo sapien
ttgggtttagcaagtagagagtcatyagtaacctcagaaaaatggcttca

SEQ ID NO: 60543 - DNA, 50 bp, homo sapien
catgtttcacctgctgcttacacggyacacagtccagaattagaaggtga

SEQ ID NO: 60544 - DNA, 50 bp, homo sapien
gtgactcgctgtgtcctgtgatagcygaattagaaaagaccccagctaag

SEQ ID NO: 60545 - DNA, 50 bp, homo sapien
tgctgaactgacacaactttggtcaygtaggctcagtcaaaaatagaaaa

SEQ ID NO: 60546 - DNA, 50 bp, homo sapien
ctcttgcttagcacatgagaagacartacagaaaggtcagatacttttcc

SEQ ID NO: 60547 - DNA, 50 bp, homo sapien
gctacaaagctagagtgcgagaaacyaatttcctccagcctgaagtgctc

SEQ ID NO: 60548 - DNA, 50 bp, homo sapien
aggagagggaaatggttctgaaataygggcagaattctggcttacatctt

SEQ ID NO: 60549 - DNA, 50 bp, homo sapien
tattgtaattaactcaatccatggamctatttgaaagaattggtccaatg

SEQ ID NO: 60550 - DNA, 50 bp, homo sapien
aattggtgatatcaaagctatagtcraatgcagattttcccgctcgcatt

SEQ ID NO: 60551 - DNA, 50 bp, homo sapien
aagcaacagtcagtaagatctgatgyagttggacgatagctctgttctct

SEQ ID NO: 60552 - DNA, 50 bp, homo sapien
gttttaaagattatggaattatgtayagactcctacaaaataaatgggag

SEQ ID NO: 60553 - DNA, 50 bp, homo sapien
tgggatgccacttctgagatgagatyacaaaaagactcgggcttctaccg

SEQ ID NO: 60554 - DNA, 50 bp, homo sapien
tattaattcaatttactgaccttctraatcagatctctccagtagcaaac

SEQ ID NO: 60555 - DNA, 50 bp, homo sapien
agcaggcaaaaccaccagatccaaartgccatagaaaataaattcagtct

SEQ ID NO: 60556 - DNA, 50 bp, homo sapien
agtggaaatgaaaataagagttagaygtatagatcaaaaagacttacatg

SEQ ID NO: 60557 - DNA, 50 bp, homo sapien
ggaaaataaaattcccactgaatgaytaagattttaagaaggaaaccagg

SEQ ID NO: 60558 - DNA, 50 bp, homo sapien
agcattatttaagagatggacagaaracaagcttataaagatactcagaa

SEQ ID NO: 60559 - DNA, 50 bp, homo sapien
tgccaaaagcaaaagtaaggattcaytaagatacatagcagaaggaaaat

SEQ ID NO: 60560 - DNA, 50 bp, homo sapien
ggaagcatagccaggagtaatttgayattttaaaggacaccaaaaattag

SEQ ID NO: 60561 - DNA, 50 bp, homo sapien
ggggcccacttggaaaatctggatartctccccatcacatgattcttaat

SEQ ID NO: 60562 - DNA, 50 bp, homo sapien
tcggttatttagtatatgtcaatcaycatgaatacaaagattaataaggc

SEQ ID NO: 60563 - DNA, 50 bp, homo sapien
ctgataagacatttgtgaggattaaraagaaaaatatggagcataaacaa

SEQ ID NO: 60564 - DNA, 50 bp, homo sapien
acatgtagagaagggtgtcttaagckcagcattattggcatttctgagtc

SEQ ID NO: 60565 - DNA, 50 bp, homo sapien
agaccatgtattttgaataatttgcyataccaaccatacttggtttttgt

SEQ ID NO: 60566 - DNA, 50 bp, homo sapien
ttaaagtaaaaattaagcggtaatgycaagaccaagtcatctcaatatac

SEQ ID NO: 60567 - DNA, 50 bp, homo sapien
agtaatctagaactttatattagacrcaagtacttaggcagccctttaaa

SEQ ID NO: 60568 - DNA, 50 bp, homo sapien
gaagtacttagattgactttgatgayctttggttatatattagttatttt

SEQ ID NO: 60569 - DNA, 50 bp, homo sapien
aaatgccatgactagagatagggctrtagtaaggagtaaaacagagtcta

SEQ ID NO: 60570 - DNA, 50 bp, homo sapien
taggaaaaccatagaggatgttaaawgatccttaagttaaaggctaataa

SEQ ID NO: 60571 - DNA, 50 bp, homo sapien
cagcttactggcacgtttcaagataygctaggcctagactgcaggacagt

SEQ ID NO: 60572 - DNA, 50 bp, homo sapien
agctggtggttcagcaaaaggcatgrtcttgctgggacggctgcaagcta

SEQ ID NO: 60573 - DNA, 50 bp, homo sapien
accatgtaatcacagcctggggtaamaaagccgagtctgcacacagagga

SEQ ID NO: 60574 - DNA, 50 bp, homo sapien
caatttactgcctctcactaccagamatatgagggtttttttttttaata

SEQ ID NO: 60575 - DNA, 50 bp, homo sapien
ttttaacagcttaaattggaaaaatsaaccaacaatgttaatgtggaatt

SEQ ID NO: 60576 - DNA, 50 bp, homo sapien
ttcagactttattcagtcaacattargctcctacactgcctcaaagcaga

SEQ ID NO: 60577 - DNA, 50 bp, homo sapien
atcctagaatggatttttctgaagcrataggaaagaataaataaaaaggt

SEQ ID NO: 60578 - DNA, 50 bp, homo sapien
tctgaaacctggatcaccaagagtcractatagatcttttaaaaaagtag

SEQ ID NO: 60579 - DNA, 50 bp, homo sapien
tgcctgagtggaatttcgatggctcyagtactttacagtctgagggttcc

SEQ ID NO: 60580 - DNA, 50 bp, homo sapien
tcatatgcaattgggaatgttcaagkatggtatctaaattaaggttctga

SEQ ID NO: 60581 - DNA, 50 bp, homo sapien
tacacgccagctggtgcagctccacrgtaccattcctatttgacagatct

SEQ ID NO: 60582 - DNA, 50 bp, homo sapien
ataactgtctaccacaacgcttacartcccagaagaggagagattctttc

SEQ ID NO: 60583 - DNA, 50 bp, homo sapien
ggagaaatgtatataactctccaaayggacccaggttgtgaggataccta

SEQ ID NO: 60584 - DNA, 50 bp, homo sapien
tcctgccttctccttcttgcagttayttcctaacgctagatggttgcctc

SEQ ID NO: 60585 - DNA, 50 bp, homo sapien
gcaatcaggcaagaaaaacaaacaamggacatcgaaacaaaccatccctg

SEQ ID NO: 60586 - DNA, 50 bp, homo sapien
gtgaagcttccttccctgacctttcrcttatcataattgagacctattta

SEQ ID NO: 60587 - DNA, 50 bp, homo sapien
cacagaagaatccacttatccaaagmatgtttaaaaggctaatgtggctc

SEQ ID NO: 60588 - DNA, 50 bp, homo sapien
catcttgtatttcctgccccttagascttacaacatagtggatcacatct

SEQ ID NO: 60589 - DNA, 50 bp, homo sapien
gagatatactctatcctgagaaggaraatccaatgaggagggtaaatgga

SEQ ID NO: 60590 - DNA, 50 bp, homo sapien
gttgggaagacagaaatccaattcamacttgcttaacaaacacaatgaga

SEQ ID NO: 60591 - DNA, 50 bp, homo sapien
cctgtggggataaatttggccatcaytcgggaaaatccattttatgtttt

SEQ ID NO: 60592 - DNA, 50 bp, homo sapien
ctcagaacttgttctccagatagtamatagaacttgcttaaagcgcatac

SEQ ID NO: 60593 - DNA, 50 bp, homo sapien
gcagtgagccaagatcatttgggatyaattaagtctacctttaattttct

SEQ ID NO: 60594 - DNA, 50 bp, homo sapien
aatattttaattggtcaagtcagccraagtggtataagataagaattggc

SEQ ID NO: 60595 - DNA, 50 bp, homo sapien
tcagagttttgtagttttctactatmaatcttgcaaatattttgttaaat

SEQ ID NO: 60596 - DNA, 50 bp, homo sapien
agacatgaaaaggaaatagaaggtaygtggattagaaaggaagaaatcaa

SEQ ID NO: 60597 - DNA, 50 bp, homo sapien
gaaaatagagcaaatgcccaacttargctacaagtcaaattatggcacat

SEQ ID NO: 60598 - DNA, 50 bp, homo sapien
aacctcagttgacaaaggttgccagsctcaatccacaaacattaggcatc

SEQ ID NO: 60599 - DNA, 50 bp, homo sapien
cagatactttaattcaaatgtgcaamctcaaagcaaccactggaaacata

SEQ ID NO: 60600 - DNA, 50 bp, homo sapien
agtagttcttgacagtggctacataygagaatcagataggaagcttttta

SEQ ID NO: 60601 - DNA, 50 bp, homo sapien
tatcttcattttatggataacaagaktacagtttagataaattaagtcat

SEQ ID NO: 60602 - DNA, 50 bp, homo sapien
tccattggtaattccaagtctcacaytggatcatcttgaaaatagttcat

SEQ ID NO: 60603 - DNA, 50 bp, homo sapien
aactgaaattattctctgaggttcartcatttgtcacttttgcttttcta

SEQ ID NO: 60604 - DNA, 50 bp, homo sapien
tggaacagcaaagttcaaatgaacgratagacacaaactgtgaaagagtc

SEQ ID NO: 60605 - DNA, 50 bp, homo sapien
gtctaggaatggcacactctggtcamtccaaatttgctactcatcatgag

SEQ ID NO: 60606 - DNA, 50 bp, homo sapien
cacagtcctctccatctccttaaagrcagtaatgatgtatcatttctggc

SEQ ID NO: 60607 - DNA, 50 bp, homo sapien
ctgcatacataatctcctatttccasgttttggtgtttattgtggtgttt

SEQ ID NO: 60608 - DNA, 50 bp, homo sapien
gccaaatcaatctgtaaattgtctaygggtgagttgaaattgtaatctga

SEQ ID NO: 60609 - DNA, 50 bp, homo sapien
gagagattgggcagagaggcaggcaycgcaacagaggagcacccttgggg

SEQ ID NO: 60610 - DNA, 50 bp, homo sapien
tatcccaaagtggcgataagcatgcrcagtatggaattttgtgccacatg

SEQ ID NO: 60611 - DNA, 50 bp, homo sapien
gccttctatgtttctggccaactcawcgatacaaaaacattcaccagatc

SEQ ID NO: 60612 - DNA, 50 bp, homo sapien
attaaacacaacattatgtctgccamagctgcttaaattattttcctaaa

SEQ ID NO: 60613 - DNA, 50 bp, homo sapien
agacatgagccaggtctgatatcaasaagaagagtcaagtatttcaaact

SEQ ID NO: 60614 - DNA, 50 bp, homo sapien
caagctcagactattatcactatgcsgaaaataacttccagttgttctaa

SEQ ID NO: 60615 - DNA, 50 bp, homo sapien
ttggtattcggagagagatatgtgargaaagattaacgggaagggatgac

SEQ ID NO: 60616 - DNA, 50 bp, homo sapien
cccttcaacctgtataataaattaamaattaccataaggagaaatgactc

SEQ ID NO: 60617 - DNA, 50 bp, homo sapien
tcttatttaatttctctacatgtcayataaggcaatgctctctcctatga

SEQ ID NO: 60618 - DNA, 50 bp, homo sapien
ggtcttggaaaatcattacagtaaartgcagattctaataagccttgttt

SEQ ID NO: 60619 - DNA, 50 bp, homo sapien
catctacccagccaacatttatggawcatatgcagaactgagcatggtga

SEQ ID NO: 60620 - DNA, 50 bp, homo sapien
acctttgctgtacctgcaaatgatargagcttttcctgtttctttcactt

SEQ ID NO: 60621 - DNA, 50 bp, homo sapien
caattcctgagctagtactttctcckgctctgataaagaaagcaaaataa

SEQ ID NO: 60622 - DNA, 50 bp, homo sapien
gggtgtggaggtatcgaagctgaacrgcagcaggggtgcctgacagaatc

SEQ ID NO: 60623 - DNA, 50 bp, homo sapien
cttctctgtcattacatcatttcacygtcttctcatggatggtgcattgt

SEQ ID NO: 60624 - DNA, 50 bp, homo sapien
tagtatggcaaagaaatgaccatggytctttgatatctttgaagattttc

SEQ ID NO: 60625 - DNA, 50 bp, homo sapien
agctttggtcaacattctactttggraagaattttgagtctagatgtggt

SEQ ID NO: 60626 - DNA, 50 bp, homo sapien
tcctcctgaaggcaacagggagcgayggtcagaaccttcattcaaagttc

SEQ ID NO: 60627 - DNA, 50 bp, homo sapien
aagggttaacttaggtggctagatayaaagtttaaagtgatgtgtctaga

SEQ ID NO: 60628 - DNA, 50 bp, homo sapien
tggtggtatcaaaataagagttttaycagcatataggactctactccctt

SEQ ID NO: 60629 - DNA, 50 bp, homo sapien
tattttataaacaaggcatagcaagkacatattctggaacacagggtaaa

SEQ ID NO: 60630 - DNA, 50 bp, homo sapien
cttacagatatttctctggaatacastaaatcccagtaattattatgaga

SEQ ID NO: 60631 - DNA, 50 bp, homo sapien
caagcatggcatgcagaggaatagaraggctaataaaacaagttgttgac

SEQ ID NO: 60632 - DNA, 50 bp, homo sapien
agtggtcatttcatcctttatatcaytacttggacatatgttgaggtaga

SEQ ID NO: 60633 - DNA, 50 bp, homo sapien
aagtatgtcctagttgagttagtacygaaaacaaagagtgtaaataaatt

SEQ ID NO: 60634 - DNA, 50 bp, homo sapien
ccccttgatcattaggtagggaaacsatgtctcaggaagaaaagttgaag

SEQ ID NO: 60635 - DNA, 50 bp, homo sapien
caaactcctttgcaactaaatgggaktatgtagctgagttatggccaatg

SEQ ID NO: 60636 - DNA, 50 bp, homo sapien
gcatatttacgaggatattaatttcyaaagctctgtgtgatttgaatacc

SEQ ID NO: 60637 - DNA, 50 bp, homo sapien
cttgacaggagacaacagttgtaaaratgtacttagaacaagcagtttcc

SEQ ID NO: 60638 - DNA, 50 bp, homo sapien
ccactagcacctaaagcaacctatakcagagagaagccctgtgggccctg

SEQ ID NO: 60639 - DNA, 50 bp, homo sapien
cattggtaatcatctttagaccttayagggcctcctgaaaattttgaggt

SEQ ID NO: 60640 - DNA, 50 bp, homo sapien
aagattacacatcaaactgctaacaytggttggttatctcagaaagatga

SEQ ID NO: 60641 - DNA, 50 bp, homo sapien
catacattctaagcaatcaaatgcawgttgttaaagtgaatcactacttg

SEQ ID NO: 60642 - DNA, 50 bp, homo sapien
catggctgtcatttattgctactgargtaaaaccagaataatagtaatca

SEQ ID NO: 60643 - DNA, 50 bp, homo sapien
tgcaggtagggccattaaccgaatcratataaaatagagtcctcagccat

SEQ ID NO: 60644 - DNA, 50 bp, homo sapien
tcctgtttttgctctactatgatccygaacagctgtgcactttgaaacaa

SEQ ID NO: 60645 - DNA, 50 bp, homo sapien
caatgcttctattcttaaatgtccartgaaagggcacctgcaagactgca

SEQ ID NO: 60646 - DNA, 50 bp, homo sapien
ctggatagcagtaaactgaaaggtayaggacggacgataaggttggtgca

SEQ ID NO: 60647 - DNA, 50 bp, homo sapien
cttttacttggtgatagagcagtagyattatcttttactccagttttctg

SEQ ID NO: 60648 - DNA, 50 bp, homo sapien
ccgagattatggagtaatgcagttaygacaatgtccaggcagaccatgga

SEQ ID NO: 60649 - DNA, 50 bp, homo sapien
tcagggtgcaggaagggtcatctacrtggatactgaaatcactaagaact

SEQ ID NO: 60650 - DNA, 50 bp, homo sapien
caaaagtgctcaaattaatcctgtayacatataaaagaaaagatgaggag

SEQ ID NO: 60651 - DNA, 50 bp, homo sapien
gaatgctgtgcatctctgtacacacrcaaacatgctaagaatatttcagc

SEQ ID NO: 60652 - DNA, 50 bp, homo sapien
atgttcagttggaaagctctatagaragtaaaatgtagaggattttgtgt

SEQ ID NO: 60653 - DNA, 50 bp, homo sapien
agcaatgagggcttgtgtctgagctrtgagaaatcccggtcttttaatgg

SEQ ID NO: 60654 - DNA, 50 bp, homo sapien
aagtatttcaaaataggggacagatkaatcactcaataaattatgttaca

SEQ ID NO: 60655 - DNA, 50 bp, homo sapien
aaaattttgtgggttattacacaggwcattatactttcatagtatgtgta

SEQ ID NO: 60656 - DNA, 50 bp, homo sapien
agggaatcaaccctgaagttaggacsggaaagaaatttggtgaatttgga

SEQ ID NO: 60657 - DNA, 50 bp, homo sapien
gactatgcatacttgcttagaatccmaaaggcaaagagcagatgggttga

SEQ ID NO: 60658 - DNA, 50 bp, homo sapien
actacatttcgctgatggaatttaartgaaaatattgtgtgttaccttca

SEQ ID NO: 60659 - DNA, 50 bp, homo sapien
aaaaatgaaggaatttaaatggtaastaggaatataaaagaatactgttt

SEQ ID NO: 60660 - DNA, 50 bp, homo sapien
ggtatgatatttttgcaacagggagyccaaagaaaatacactgaggagat

SEQ ID NO: 60661 - DNA, 50 bp, homo sapien
ctctctactaccactgcttagcatartaattggcatttgttattactata

SEQ ID NO: 60662 - DNA, 50 bp, homo sapien
tgtatcggctattagtgactgttaaygaggagttggaataaagcaattta

SEQ ID NO: 60663 - DNA, 50 bp, homo sapien
cttctgttgaatacacatagaaatgrattctcccagtcttgaaacttgag

SEQ ID NO: 60664 - DNA, 50 bp, homo sapien
aatccttgcttttagttgtatcattraaaaaatgtcactggtaaaatgaa

SEQ ID NO: 60665 - DNA, 50 bp, homo sapien
ttacctatacaatctgcaacaagaawcattgtccatataggttctcctaa

SEQ ID NO: 60666 - DNA, 50 bp, homo sapien
tctctctctccctctttttatagacrctagtttcatcatgaggaccccaa

SEQ ID NO: 60667 - DNA, 50 bp, homo sapien
gtaaatgtttttgtctttaatagcartgaagaataactgaggcattttcc

SEQ ID NO: 60668 - DNA, 50 bp, homo sapien
ctcgactttccgcattacaccagcartcaaagggccacagttacagggga

SEQ ID NO: 60669 - DNA, 50 bp, homo sapien
taatgaccacacactcaaataagcastgagtacgcagttcaacaatgtta

SEQ ID NO: 60670 - DNA, 50 bp, homo sapien
atccctgcaccccacatggtctccaytgacaaagcacagtagtggaagtc

SEQ ID NO: 60671 - DNA, 50 bp, homo sapien
gaataaaaatgtgtgtttcataagcrataaatgatttgtagttatcctgg

SEQ ID NO: 60672 - DNA, 50 bp, homo sapien
agttaatgaaattatttgaatagcarcgcgaataaaaatgtgtgtttcat

SEQ ID NO: 60673 - DNA, 50 bp, homo sapien
ttgtttcattatttctatttatgtakcagttgtcttttaggaactaggtt

SEQ ID NO: 60674 - DNA, 50 bp, homo sapien
gttcttctcttgtactagtgtgcaayaggactttggcttatgtttatcat

SEQ ID NO: 60675 - DNA, 50 bp, homo sapien
cttagagggttttatgaggatagagraagataaaaatatttgcactcttc

SEQ ID NO: 60676 - DNA, 50 bp, homo sapien
ccaccttcaagtaaatatacctcacrattttagggaaccctactaaatgt

SEQ ID NO: 60677 - DNA, 50 bp, homo sapien
attcctttgggatgagagcagattcrttttcagaccagaataacatatgt

SEQ ID NO: 60678 - DNA, 50 bp, homo sapien
aaattattaatatttttggtacatakcttattaaggaaataattttcagc

SEQ ID NO: 60679 - DNA, 50 bp, homo sapien
aggtggtagcttagatgaaggaaacragagagaatgatgaggaaatagta

SEQ ID NO: 60680 - DNA, 50 bp, homo sapien
tatcttatgggcttgaagcttgagcrataagtcatccaaggcaataacca

SEQ ID NO: 60681 - DNA, 50 bp, homo sapien
ttaattgaagttatccctgtctttckccattaccgttaagtgtgtgtggg

SEQ ID NO: 60682 - DNA, 50 bp, homo sapien
tcagaggtctggcactttcagctaawcgacactactggatgtggctttgg

SEQ ID NO: 60683 - DNA, 50 bp, homo sapien
tctgagaatatttgtagtgtaaaaayaggtgtcaataagatttagaggct

SEQ ID NO: 60684 - DNA, 50 bp, homo sapien
aaataggtgtcaataagatttagagsctcagtaatcattgtttacaaagg

SEQ ID NO: 60685 - DNA, 50 bp, homo sapien
aaaaggaaaagaaaagtctactcgtkgtccctgaaatattctccatagat

SEQ ID NO: 60686 - DNA, 50 bp, homo sapien
gccgcttaactcttctcagtttttaygtcacttaaatgtgaatcctaaca

SEQ ID NO: 60687 - DNA, 50 bp, homo sapien
accaatctacccaatacatgcctgamaaagcactgaggtattaactttga

SEQ ID NO: 60688 - DNA, 50 bp, homo sapien
cagtacagaaagaaccatggcataasaagaacaatgtttaaaatgtataa

SEQ ID NO: 60689 - DNA, 50 bp, homo sapien
ttttgcaaattattactatttttcaygccagaatatataatggatccttt

SEQ ID NO: 60690 - DNA, 50 bp, homo sapien
tttttaatggaagaatgtagtcatawatttaatctgcgttgtagtacatt

SEQ ID NO: 60691 - DNA, 50 bp, homo sapien
aagtgtacttctacattgtttgcaayagctatctgatttatcacttcatt

SEQ ID NO: 60692 - DNA, 50 bp, homo sapien
gaagggagagtcgtaggcctggtaaygttcaccacaagttgactgaaaag

SEQ ID NO: 60693 - DNA, 50 bp, homo sapien
aaaaaaatacaaacaagatgtggcayaatgggaattaatacaggagataa

SEQ ID NO: 60694 - DNA, 50 bp, homo sapien
gctatacaaagacatggaaattacgmaatatactactgaaaaccagaaat

SEQ ID NO: 60695 - DNA, 50 bp, homo sapien
attaatttagcctcattccttaatamaaatgtgagcatgtggaaatgttt

SEQ ID NO: 60696 - DNA, 50 bp, homo sapien
cttagaagcccaatgttggactttarctatgtatcttggagaggaatggt

SEQ ID NO: 60697 - DNA, 50 bp, homo sapien
acatagaatcaacctaggtgcttatmaatggtagattaatttaaaaaatg

SEQ ID NO: 60698 - DNA, 50 bp, homo sapien
ttttaggagcttggcaattaaatacyactaaaggccatcaagctgtcata

SEQ ID NO: 60699 - DNA, 50 bp, homo sapien
acaccatcatagtgttttactaatcwaactacaagaaatgttgaaatgga

SEQ ID NO: 60700 - DNA, 50 bp, homo sapien
ggacatccatgcagcctgtaaggaayaagagacagaatgagaacccatgc

SEQ ID NO: 60701 - DNA, 50 bp, homo sapien
tttgaagtcaacctctaaacagcatraaagggatcagctcacaggaaact

SEQ ID NO: 60702 - DNA, 50 bp, homo sapien
accagtttcccctgctttctttctaygccctgaagatgaaacaaggagtg

SEQ ID NO: 60703 - DNA, 50 bp, homo sapien
cttatataacgtgaagagtttaaaaraagctatactcataggcaattctg

SEQ ID NO: 60704 - DNA, 50 bp, homo sapien
aaagaagtaacgtactgagttgtgtsaaatgaattgaatccaataaaatt

SEQ ID NO: 60705 - DNA, 50 bp, homo sapien
agaccatgatgtaaaatgatatgaaygaaggagaaagaacaaattttgat

SEQ ID NO: 60706 - DNA, 50 bp, homo sapien
ctgttccttttaagatttccctctcyatttgtattcctaagtcacagctt

SEQ ID NO: 60707 - DNA, 50 bp, homo sapien
taaaaactaaatattttgtgagctaygactctggaaaatctcataagctg

SEQ ID NO: 60708 - DNA, 50 bp, homo sapien
cctaataataatatggattcttgcamaagatagtaattcataaaataatc

SEQ ID NO: 60709 - DNA, 50 bp, homo sapien
ttgataatatttactaaacagatccygaataaagggtatgctgatagcct

SEQ ID NO: 60710 - DNA, 50 bp, homo sapien
ttaccattgtaaaatattattttccyatatatcaacctgctttccattaa

SEQ ID NO: 60711 - DNA, 50 bp, homo sapien
taatttagactctagctccattttcragactatagaaatatctgaatcct

SEQ ID NO: 60712 - DNA, 50 bp, homo sapien
atagaggtaaaggatgatacctagaygaggaaagatcagctggccttgat

SEQ ID NO: 60713 - DNA, 50 bp, homo sapien
ctcacatgttttcctggcactgagtmaaggatgtcttgtccatgtaatgt

SEQ ID NO: 60714 - DNA, 50 bp, homo sapien
actgatgcaaaccttctgtgacccaytgagatttttaagtcatcatttta

SEQ ID NO: 60715 - DNA, 50 bp, homo sapien
actatatccaattttcatgagagtaraaatgtatattattctattaaagc

SEQ ID NO: 60716 - DNA, 50 bp, homo sapien
tgaagaattaattggagtgatgtaayactgaagacattttcttcaagact

SEQ ID NO: 60717 - DNA, 50 bp, homo sapien
cagtgacatgaaatattctgtctacrggtgccttaaatatgttaccaaat

SEQ ID NO: 60718 - DNA, 50 bp, homo sapien
ttcaggatgcttttaggtaaatcaarccctgctaatttgacactagaaaa

SEQ ID NO: 60719 - DNA, 50 bp, homo sapien
aggaagtgccaaaagagagtggaaartgagaattatatctaatagagtaa

SEQ ID NO: 60720 - DNA, 50 bp, homo sapien
agaatagaactcgatttattgataakggaatcaaggaatttttaactttc

SEQ ID NO: 60721 - DNA, 50 bp, homo sapien
gttgaacaaatgaacagatccaagayggtagaaatgctgaattctatttt

SEQ ID NO: 60722 - DNA, 50 bp, homo sapien
actgatggacacattgttgctagaayattctcctaattaaatttgtttcg

SEQ ID NO: 60723 - DNA, 50 bp, homo sapien
acctctatcttgaggaatcttaggarctacatacagtgctagaaacaggc

SEQ ID NO: 60724 - DNA, 50 bp, homo sapien
caaatatgaattatcaaaatttcaaratattgcctttcattcatattttt

SEQ ID NO: 60725 - DNA, 50 bp, homo sapien
ggaatgataggcatgaaactaattasagaccaaaggataccctgccattc

SEQ ID NO: 60726 - DNA, 50 bp, homo sapien
aaactctgatattccacgtcatgcargttattcataatcatctcaacatc

SEQ ID NO: 60727 - DNA, 50 bp, homo sapien
atcttttcactaaaaagcactataamtaaatccaggtataccgctgacaa

SEQ ID NO: 60728 - DNA, 50 bp, homo sapien
ccatattgtccaaatcaaaaccctgyagtcatgagttcttccctttaacc

SEQ ID NO: 60729 - DNA, 50 bp, homo sapien
aaacaaaatacttttgtccttagtartaaatacaccattgcttttggaaa

SEQ ID NO: 60730 - DNA, 50 bp, homo sapien
gatatcttcacagaaactatgaaatraattattgctttaatcttaggttt

SEQ ID NO: 60731 - DNA, 50 bp, homo sapien
agtgtagttattccatttagtctacrtaatacatccctccctattgcaat

SEQ ID NO: 60732 - DNA, 50 bp, homo sapien
ttacacataatttatgatttggaacmacatggtaagaagactatgaaaaa

SEQ ID NO: 60733 - DNA, 50 bp, homo sapien
gtaccccactcctactcccagaaaaraaacggatggaaactgagtagtgt

SEQ ID NO: 60734 - DNA, 50 bp, homo sapien
aacagctgcctaataaatatatggtraattagccaaggttagcagttctt

SEQ ID NO: 60735 - DNA, 50 bp, homo sapien
tcaaaacagaagttctcctttagcayctgaattgttttaccagaagtttt

SEQ ID NO: 60736 - DNA, 50 bp, homo sapien
aaaaaagtttcttctaatgaatgtaygggttagcagggctcagttaggac

SEQ ID NO: 60737 - DNA, 50 bp, homo sapien
gtaatcactggatacgtttcattaargttttctgcagatgttgacaaaga

SEQ ID NO: 60738 - DNA, 50 bp, homo sapien
aaaaaaatcattacagcccaataaaygtgaagtaacaatgacaaagagtt

SEQ ID NO: 60739 - DNA, 50 bp, homo sapien
atggtctttaaacaactcttctataygatatgctattttcactgtctaga

SEQ ID NO: 60740 - DNA, 50 bp, homo sapien
atatggggaaatttacattggtatayaggagattctgatgcttgggtgca

SEQ ID NO: 60741 - DNA, 50 bp, homo sapien
agaacctcttttacttcacaatacayggaaaacgagaataaattcatggt

SEQ ID NO: 60742 - DNA, 50 bp, homo sapien
aaaaatagattacaatctttgatgasaggttcttgaaaatcctgttacaa

SEQ ID NO: 60743 - DNA, 50 bp, homo sapien
atgacataatgatctgtacagaaaayagtaagaaatcaatgaaaataact

SEQ ID NO: 60744 - DNA, 50 bp, homo sapien
ataaaaggagctaatatgactacatyaaaatagcagtcagaatagtgtac

SEQ ID NO: 60745 - DNA, 50 bp, homo sapien
tgagacattgaatgtaacttccttcmaagactgcagtgtactggttgtgc

SEQ ID NO: 60746 - DNA, 50 bp, homo sapien
cagaattcacaaaacgtttaaaagtraagacaggattatgaagtgagtag

SEQ ID NO: 60747 - DNA, 50 bp, homo sapien
gatattctcagataaataatctcaakagaagtagatcataacattacctg

SEQ ID NO: 60748 - DNA, 50 bp, homo sapien
ggaggcattagtaaatttagaattcrgaacaccaaaatcggatggtattt

SEQ ID NO: 60749 - DNA, 50 bp, homo sapien
ggcaacagtggcggtgaaaatgataytaaccttactaataataactttta

SEQ ID NO: 60750 - DNA, 50 bp, homo sapien
ttaggtgttagactttatttgggacrgaattaggtacagaagaaagaact

SEQ ID NO: 60751 - DNA, 50 bp, homo sapien
attacatgaatttctaagggaagacmaaattaattcttcttcttattttt

SEQ ID NO: 60752 - DNA, 50 bp, homo sapien
cttggatggaatatagttgggaaaaragtctacagagttccaaaaaagca

SEQ ID NO: 60753 - DNA, 50 bp, homo sapien
tctgcctttttacgtatgttgtaggmaacctgcaatattcagataatatg

SEQ ID NO: 60754 - DNA, 50 bp, homo sapien
ttttattttaacttctggaatacttrtgcaggacatgcaggtttgcgaca

SEQ ID NO: 60755 - DNA, 50 bp, homo sapien
ttgagtatttttaacagcatcttgawaggattaattcccatatgcatttg

SEQ ID NO: 60756 - DNA, 50 bp, homo sapien
agatattgactctcattggcctagayctaattcctatagcaaacaataaa

SEQ ID NO: 60757 - DNA, 50 bp, homo sapien
gaacagcattagaagagtcaggtaamcaataaaagtaagtacaaaataga

SEQ ID NO: 60758 - DNA, 50 bp, homo sapien
aattcacattcagaaattcacattamggaaaacttcagaaaaaatacaaa

SEQ ID NO: 60759 - DNA, 50 bp, homo sapien
tcttatgtactaagtactattcccasgacaaaactggcacatgatatttg

SEQ ID NO: 60760 - DNA, 50 bp, homo sapien
ctttgcagaggtgattaaggatcatragattgggagattaccctgggtga

SEQ ID NO: 60761 - DNA, 50 bp, homo sapien
tctaaaaccatggaatatgattgatmacaaaggcttaacatgaacaagac

SEQ ID NO: 60762 - DNA, 50 bp, homo sapien
gagagtagacaatcagtttatgcaaytctcttcattgtagcatcttcagc

SEQ ID NO: 60763 - DNA, 50 bp, homo sapien
cacacaggatagcaaaagttagctcrttacagatttcacatccatgagtc

SEQ ID NO: 60764 - DNA, 50 bp, homo sapien
tgtcccattgtatcagcatgtggaayataaagtgcttagaattaaaaaag

SEQ ID NO: 60765 - DNA, 50 bp, homo sapien
gtattttccacattttctacatgaayatatgctgttatatacaaatataa

SEQ ID NO: 60766 - DNA, 50 bp, homo sapien
atttgtttgcagtcctcctttttaaygcaggtacagattcactcttactt

SEQ ID NO: 60767 - DNA, 50 bp, homo sapien
gagtccaaatcatgctttgtgaccaytctttttccgtaaactgtctcatt

SEQ ID NO: 60768 - DNA, 50 bp, homo sapien
tgtgtgaacaggatgcatgatcagcraagtttttaagcaatgtaatgacg

SEQ ID NO: 60769 - DNA, 50 bp, homo sapien
tactgagagcacataatttaaataartgaaagatccatgtctttttctca

SEQ ID NO: 60770 - DNA, 50 bp, homo sapien
gtgttatttattggtagcttcaaacygaaatatctacgtgcttttgtcag

SEQ ID NO: 60771 - DNA, 50 bp, homo sapien
gcaattatttagtacattttttctgyaaagtgctagttatttattcaaca

SEQ ID NO: 60772 - DNA, 50 bp, homo sapien
atggtacaaatttcaatgattgttayataaagttgatacaaagttcttaa

SEQ ID NO: 60773 - DNA, 50 bp, homo sapien
tacatgtctgtttcctcactaaagaktccttgtcatagacacagtcatca

SEQ ID NO: 60774 - DNA, 50 bp, homo sapien
aacatccctgcttaaattatacttaycttgaacccctgatcttcactatc

SEQ ID NO: 60775 - DNA, 50 bp, homo sapien
ttcatcacatttgatcctcaacctaygttttaagcaaagcaaacatcatc

SEQ ID NO: 60776 - DNA, 50 bp, homo sapien
agataccctgaggctctgcaacatawccattcagaatatgggagctactt

SEQ ID NO: 60777 - DNA, 50 bp, homo sapien
tatattcctctattttaaaatgtgawtaaaacaacatagaagtttagagt

SEQ ID NO: 60778 - DNA, 50 bp, homo sapien
tttcaagttcatttttcataatgacyagtacttttaatacctgaactggt

SEQ ID NO: 60779 - DNA, 50 bp, homo sapien
aaaaagttcatgggattgctaatttwaaaaaaccaagagagagagagaaa

SEQ ID NO: 60780 - DNA, 50 bp, homo sapien
aaaaacatttcattccttcacgctamtaattcagtgcaaatgaaatttca

SEQ ID NO: 60781 - DNA, 50 bp, homo sapien
tgaaaacttagctgagtcatttttawttctctgagccacaatttcaagga

SEQ ID NO: 60782 - DNA, 50 bp, homo sapien
actggggaagaagaaggaacttcaayaggaaaaaatagtatcataaaaga

SEQ ID NO: 60783 - DNA, 50 bp, homo sapien
gaatttattgtatattaatgtccacrgtagatccattccactccattttt

SEQ ID NO: 60784 - DNA, 50 bp, homo sapien
gacttcaccaaacagtctctaaacaytggtctgcaaacacatgtataaac

SEQ ID NO: 60785 - DNA, 50 bp, homo sapien
acgaataaatgtgtatactttcacayggagagcctttcaaccgtttaaga

SEQ ID NO: 60786 - DNA, 50 bp, homo sapien
cctgttaagcaactaataccttagcsacgaataaatgtgtatactttcac

SEQ ID NO: 60787 - DNA, 50 bp, homo sapien
gtattggtgttattaaaaatggctasagaaagtggatggtagaatagatg

SEQ ID NO: 60788 - DNA, 50 bp, homo sapien
ctgaaattgattggctggtttgtaaraatgtgttagccaaggtaaattgt

SEQ ID NO: 60789 - DNA, 50 bp, homo sapien
catggttctcagctatgcaagtcccygaagaaggtaggctcctaaccaat

SEQ ID NO: 60790 - DNA, 50 bp, homo sapien
gtatggaagtctaatctctggttcaygtcatagaaatatgtcagaatttt

SEQ ID NO: 60791 - DNA, 50 bp, homo sapien
gtctggagaaggacataatggaagamtagatcagataaaataatagaaga

SEQ ID NO: 60792 - DNA, 50 bp, homo sapien
ttatttcagacaacagtcacacctcrctgtatccatatttccttctcagg

SEQ ID NO: 60793 - DNA, 50 bp, homo sapien
aaatattccccttcctttaattgaaycagtttttacatatgtgccccagc

SEQ ID NO: 60794 - DNA, 50 bp, homo sapien
atgacagtcagtaaagacacttttcktaaggaatgagacactgtaggggc

SEQ ID NO: 60795 - DNA, 50 bp, homo sapien
ttaagtgtttatatcagtttatggckcccacagcttctactccagaaaat

SEQ ID NO: 60796 - DNA, 50 bp, homo sapien
acttatttaataaaggttaagagtcwatttcgaacaactccatgaaaata

SEQ ID NO: 60797 - DNA, 50 bp, homo sapien
agaaatgttttcaccaaatatctaaygtggagataattcactctgtaaag

SEQ ID NO: 60798 - DNA, 50 bp, homo sapien
tgaattcctctggataattggcatawgtgtcacccaggaaaaagcaagca

SEQ ID NO: 60799 - DNA, 50 bp, homo sapien
atttctgattgtagtgaagatttctyacttggagacttataatttttcag

SEQ ID NO: 60800 - DNA, 50 bp, homo sapien
aaagatgagcaaacttagtaatcagkaaaataaagtttaaaaaaagtagt

SEQ ID NO: 60801 - DNA, 50 bp, homo sapien
cacacataaatagtgaagaatcttaygaacataatggtatgcttaaaaag

SEQ ID NO: 60802 - DNA, 50 bp, homo sapien
cttttaatcttttgaggaacctttayagtattttccacagtggctgcacc

SEQ ID NO: 60803 - DNA, 50 bp, homo sapien
gagtgtgccagtggaagctgtaacayagggaaaagcaacgactgaaccag

SEQ ID NO: 60804 - DNA, 50 bp, homo sapien
ttaatacataagacatgcatgcctaygatctcttatttcaggacaaccag

SEQ ID NO: 60805 - DNA, 50 bp, homo sapien
atgcaatatataaaacgtgtacaaawtacagcaaaggaacttaggtcacc

SEQ ID NO: 60806 - DNA, 50 bp, homo sapien
tgtcaactgagtatacactggagacygaaaccatgatgaagtcagttaaa

SEQ ID NO: 60807 - DNA, 50 bp, homo sapien
ggaacataaaaatatcagcagtgcakatgaagagacaaagaaggtcataa

SEQ ID NO: 60808 - DNA, 50 bp, homo sapien
ccatgaaatgagttctattttgatayagtttgttagaacctggggaaaat

SEQ ID NO: 60809 - DNA, 50 bp, homo sapien
cttctagctaattcgaacttacctcwtatttgtgttaatttctacaacat

SEQ ID NO: 60810 - DNA, 50 bp, homo sapien
ttccctttctacattctaggaaccartaatcagcacactcggcacaatta

SEQ ID NO: 60811 - DNA, 50 bp, homo sapien
tgaccatcttttctacaatgttcaarttaaaatcaaaaggttattgaact

SEQ ID NO: 60812 - DNA, 50 bp, homo sapien
aaagtatgttttatcaaatatgattrgaaaacaatgcattatgtatccaa

SEQ ID NO: 60813 - DNA, 50 bp, homo sapien
tattttaaaaccacatctaaaattgyatttattgtgtgcaacatgatgtt

SEQ ID NO: 60814 - DNA, 50 bp, homo sapien
aattaatcagctctgatatcaatcawccagttacacattaatatgtaatt

SEQ ID NO: 60815 - DNA, 50 bp, homo sapien
aagcttagacttcgctgagcatctcmaactatgaactgcagagtgtgggc

SEQ ID NO: 60816 - DNA, 50 bp, homo sapien
ccttgcaccaagaactctgcatagawatggaaggattactcaggctctta

SEQ ID NO: 60817 - DNA, 50 bp, homo sapien
taataaaaaatttaattttgtttagyattcagaaaaatgttatatgcagg

SEQ ID NO: 60818 - DNA, 50 bp, homo sapien
gagacagcacacactgctgatagaastatgacataattccacatttttcc

SEQ ID NO: 60819 - DNA, 50 bp, homo sapien
atgataggaatacggttgctagtgaraatcaagagaactaaaaagaagta

SEQ ID NO: 60820 - DNA, 50 bp, homo sapien
ctagctaaaatgcaaaattcatcccragttcatgttataatttaaagaaa

SEQ ID NO: 60821 - DNA, 50 bp, homo sapien
ttatttgccacaaattaggctgagaygtagtaatgttccccaagaagata

SEQ ID NO: 60822 - DNA, 50 bp, homo sapien
atgtaaaaccatcacatatgtgaccygtttagtgtcaactcacgtctcaa

SEQ ID NO: 60823 - DNA, 50 bp, homo sapien
ggaatatggacgtaacattctgatayctgttctatgagagccaaagtccc

SEQ ID NO: 60824 - DNA, 50 bp, homo sapien
tcgctaccgggttatgttttctttgmccttacttacagcagtttacccat

SEQ ID NO: 60825 - DNA, 50 bp, homo sapien
ttgagtaacactgatttagcacaaarggatagtaatgtatagttagagaa

SEQ ID NO: 60826 - DNA, 50 bp, homo sapien
taaactgttaaatatcctcaaattawactacactgttatagttatatttt

SEQ ID NO: 60827 - DNA, 50 bp, homo sapien
aaattaacaaataagcaagcacattrtatccagagatgattctgtagttg

SEQ ID NO: 60828 - DNA, 50 bp, homo sapien
aaaatcagaagaggccactatatcaragtcaataaaaaattattctttag

SEQ ID NO: 60829 - DNA, 50 bp, homo sapien
taaacagcctctaagtatagttgacrtaaccttggcagccagtggaacaa

SEQ ID NO: 60830 - DNA, 50 bp, homo sapien
gggaaccagagagaatgtaacacttyaaaggagaggacataaaatccagc

SEQ ID NO: 60831 - DNA, 50 bp, homo sapien
acttaacttaaactgagtatcaacaygtgaagataactagtctggaaagg

SEQ ID NO: 60832 - DNA, 50 bp, homo sapien
attgcatcagcaaataattattaagycatgttagcaatgaaataggtgaa

SEQ ID NO: 60833 - DNA, 50 bp, homo sapien
aaatctcattcttgatttaattttcyacttgtgcaaatcatattttccaa

SEQ ID NO: 60834 - DNA, 50 bp, homo sapien
gcaaacagcagactggaacagatacrcatttgataagcaaaataaagtgt

SEQ ID NO: 60835 - DNA, 50 bp, homo sapien
gacccaggcctaactatttatacccwacttgatatttaatttttaaaata

SEQ ID NO: 60836 - DNA, 50 bp, homo sapien
acatataagacacagccgagttttaycaattagcaagcacatgcacgcta

SEQ ID NO: 60837 - DNA, 50 bp, homo sapien
tctaataatcttattggtgttcggcmacataatagttaataatgacaaac

SEQ ID NO: 60838 - DNA, 50 bp, homo sapien
aagatttagaaattactgatacaaaygtcaataataaaagggaaattaaa

SEQ ID NO: 60839 - DNA, 50 bp, homo sapien
acagggttggtttcatcttcattaaragagtacaagaggggacaatctga

SEQ ID NO: 60840 - DNA, 50 bp, homo sapien
caaattattatttttaatgagactcragcttcaaatacaaaacatttggg

SEQ ID NO: 60841 - DNA, 50 bp, homo sapien
gtagattagcttgctactactctaaygtttcgtattattttattccactt

SEQ ID NO: 60842 - DNA, 50 bp, homo sapien
aaaaaaaatttaagctccgaattaarctcaatagttgaatagagttcatt

SEQ ID NO: 60843 - DNA, 50 bp, homo sapien
ttccaccacctcatcacgcccttcartcttaggcagaattcagaattttc

SEQ ID NO: 60844 - DNA, 50 bp, homo sapien
tactgatcaaaaaatgctaatctaayctaatcacaaattgccctgaagct

SEQ ID NO: 60845 - DNA, 50 bp, homo sapien
cccaagctcagaacctgtgttttccsagaatatttcatctgatttgattc

SEQ ID NO: 60846 - DNA, 50 bp, homo sapien
ctgattgcattagactataaatgaaygtatgtaaaacttttacaagaaag

SEQ ID NO: 60847 - DNA, 50 bp, homo sapien
agcagtctgtttatatcagaaagtasgtcatttaagtcaaatctttgcta

SEQ ID NO: 60848 - DNA, 50 bp, homo sapien
tttcctttcttggatttaaaagcatsactaattctttttctactttaaac

SEQ ID NO: 60849 - DNA, 50 bp, homo sapien
tgatttgtgagtgatagataatttcrcacaggttctatgtatcatcccaa

SEQ ID NO: 60850 - DNA, 50 bp, homo sapien
actgatttggggaagaatagagatgsaacaggtttgaagagtgggggtac

SEQ ID NO: 60851 - DNA, 50 bp, homo sapien
atataaatataaaggataagtattgraccttagagaatttcagctttaaa

SEQ ID NO: 60852 - DNA, 50 bp, homo sapien
agggaagaagaaaatctcatataagycaacattcaaactcaccacaataa

SEQ ID NO: 60853 - DNA, 50 bp, homo sapien
tcaccagaacaatttacctctggccragtgatctatttagtttgttggga

SEQ ID NO: 60854 - DNA, 50 bp, homo sapien
agtgataagaaacaagtaagccatasgaagcggttctagccaggcacggt

SEQ ID NO: 60855 - DNA, 50 bp, homo sapien
cattccctcttccagttctccagaawgaagtcacctccttctaatcctac

SEQ ID NO: 60856 - DNA, 50 bp, homo sapien
taaacccatcccttctctctcatgtwtgaacaaatcaaatggctttctta

SEQ ID NO: 60857 - DNA, 50 bp, homo sapien
aggtctgaaaaaaatgtagcaggccrgatagaaatgccttaaggtggtga

SEQ ID NO: 60858 - DNA, 50 bp, homo sapien
gaatatgaaagtctagttggccagaragtaataagagagagtggtatgag

SEQ ID NO: 60859 - DNA, 50 bp, homo sapien
aaattagtctattaaaatggcgttasaggcagaaattttgcctccatgat

SEQ ID NO: 60860 - DNA, 50 bp, homo sapien
tcatttcaggagcatcaagcatgaasagccaatccagtttaagtgtgggc

SEQ ID NO: 60861 - DNA, 50 bp, homo sapien
gtcatgttgctgcttcttctgtgaakgtatattcttcctcaatgagactt

SEQ ID NO: 60862 - DNA, 50 bp, homo sapien
aaccttttagatctctaatcaaaaaktcagtaattcagaaatcctcttct

SEQ ID NO: 60863 - DNA, 50 bp, homo sapien
aagcattcattatgctctatatggaycattaggttatttgataaatgtat

SEQ ID NO: 60864 - DNA, 50 bp, homo sapien
acatatgtacatgtccctaccactgyaaagttttcagcagtaaagatgct

SEQ ID NO: 60865 - DNA, 50 bp, homo sapien
aagggaccttaaagctcatctaataycttactactcaaaatgttgtctct

SEQ ID NO: 60866 - DNA, 50 bp, homo sapien
gccactggacagggtgtctagggctyagatcttgcagttcccttcctgta

SEQ ID NO: 60867 - DNA, 50 bp, homo sapien
aactctaactttttcttttatctccratgcttctttgactctccagggga

SEQ ID NO: 60868 - DNA, 50 bp, homo sapien
agcattaaactattctttatcaagarcacggttaaatattttcatatata

SEQ ID NO: 60869 - DNA, 50 bp, homo sapien
accattgaatttatgtgtaaattggratataatgcgaatacatcagttct

SEQ ID NO: 60870 - DNA, 50 bp, homo sapien
tctgaaggctgatgtgaaattgaagraggtttttccgttcaaacaaattt

SEQ ID NO: 60871 - DNA, 50 bp, homo sapien
aaaccaaaaatgagagcagaaactaygctgagatttaagagaatgaaaat

SEQ ID NO: 60872 - DNA, 50 bp, homo sapien
gctacatactgactttagcatttcamaaatataataagttcagttgcact

SEQ ID NO: 60873 - DNA, 50 bp, homo sapien
aaaaaaaaaagtcttattgctcaacractgttaatcagatattctcttag

SEQ ID NO: 60874 - DNA, 50 bp, homo sapien
gatagtggtcaatttacctagaatcracttcactcatgtgactttgcaat

SEQ ID NO: 60875 - DNA, 50 bp, homo sapien
gcaacacaattcaaaaaaatataagscacaataattatggcaacaacaag

SEQ ID NO: 60876 - DNA, 50 bp, homo sapien
gtaattttttataacaaagacctacygctgcaaggattttacatgtaatg

SEQ ID NO: 60877 - DNA, 50 bp, homo sapien
tcttgctttttatgaataaacatccrcaattggaaacctcattaacagat

SEQ ID NO: 60878 - DNA, 50 bp, homo sapien
agagaatccacacttatacaaatatsagtagtcctttcttgtgccaaggg

SEQ ID NO: 60879 - DNA, 50 bp, homo sapien
tgggagagcatgttgcatcaaaaackgacacagtctaaacattttttaaa

SEQ ID NO: 60880 - DNA, 50 bp, homo sapien
tcataatatggaagaacaattgagayccaaaatatttactcaacagaaag

SEQ ID NO: 60881 - DNA, 50 bp, homo sapien
aacaagaaaaggtttctgacttcggsaataattattttattgaagggctt

SEQ ID NO: 60882 - DNA, 50 bp, homo sapien
ctattccatactgctgccttagtctyttctgcccttataatatttgactt

SEQ ID NO: 60883 - DNA, 50 bp, homo sapien
tgagatgttaaagcttgaaaacagayaagaattgaacatattagtggtgg

SEQ ID NO: 60884 - DNA, 50 bp, homo sapien
catttggcagggtaattcttcactaygtgggtctgtttctagaatagcaa

SEQ ID NO: 60885 - DNA, 50 bp, homo sapien
gccagggctggtactcaaaacccaargaggcataagccctcttatttttt

SEQ ID NO: 60886 - DNA, 50 bp, homo sapien
cccagatttgtggtacaaatttccarcctccaggcatttaaaaatgcaga

SEQ ID NO: 60887 - DNA, 50 bp, homo sapien
caacacagtactggaaagcttgttgmataaaagatttataccaaattggt

SEQ ID NO: 60888 - DNA, 50 bp, homo sapien
gccagagagcctgaggattgtgaaaytggaccaggatagctccctccggg

SEQ ID NO: 60889 - DNA, 50 bp, homo sapien
gggctggtagctgaagcagaaatcarttatgcctgtgttgtttgtctccc

SEQ ID NO: 60890 - DNA, 50 bp, homo sapien
gggcagggacagggagagtctatacyagatgtgcatgcacatttcatata

SEQ ID NO: 60891 - DNA, 50 bp, homo sapien
ttaagggtttctattaattgcagctkaacttaaacccaattaatatgccc

SEQ ID NO: 60892 - DNA, 50 bp, homo sapien
gatttgtaggtaagggtttgagaagraatatgtcggcttaaatatggaga

SEQ ID NO: 60893 - DNA, 50 bp, homo sapien
taaaggttgtgtttgaccttcatgakaagctattacagaattcaccaaaa

SEQ ID NO: 60894 - DNA, 50 bp, homo sapien
ggatccaaatatggtttctaccgtgkaatggaaatgaagattaaaaagcc

SEQ ID NO: 60895 - DNA, 50 bp, homo sapien
ggtacttaagtgttgtcaggaggtcratttagccaggacaccaactttgt

SEQ ID NO: 60896 - DNA, 50 bp, homo sapien
tgttttgatcaaagtcacagattacrcttcaatatagctgccagtaaact

SEQ ID NO: 60897 - DNA, 50 bp, homo sapien
agctcgtgttctaaagactcagatcmcttaaaaattccttttgctcatgt

SEQ ID NO: 60898 - DNA, 50 bp, homo sapien
tctagagtggttggctgtccttccayggatacctgaagcattaaattcaa

SEQ ID NO: 60899 - DNA, 50 bp, homo sapien
attcacttactttctaaatacttgargacctgttatgtgctaggcattac

SEQ ID NO: 60900 - DNA, 50 bp, homo sapien
gtgtagataaaaacactaagaatcasagatactgagaaacatatctagta

SEQ ID NO: 60901 - DNA, 50 bp, homo sapien
cagtgtgacatgacttatgtggtacygtaacctaatgaagcctgaagtca

SEQ ID NO: 60902 - DNA, 50 bp, homo sapien
aaaaaggcctgtatgaggatgtttawctccaaggcaacttgagtatccat

SEQ ID NO: 60903 - DNA, 50 bp, homo sapien
gacctacttggattataatgtttacrgccatctccatgctccactccaca

SEQ ID NO: 60904 - DNA, 50 bp, homo sapien
ctctctcctttgcctttgacaagtawtactcaagcacccattgtatatct

SEQ ID NO: 60905 - DNA, 50 bp, homo sapien
cttcttctctgatccctatcccttcraaagcttagtttatgttattatgg

SEQ ID NO: 60906 - DNA, 50 bp, homo sapien
aaagtaaattgcattggaactgacaytcatttcttttgtattgggataat

SEQ ID NO: 60907 - DNA, 50 bp, homo sapien
ttattggttttgttttgacatgtacwatatttgggtctgggattaataat

SEQ ID NO: 60908 - DNA, 50 bp, homo sapien
ctacctttcttcttccagtcttccaygctgtttttaaacagtcagataaa

SEQ ID NO: 60909 - DNA, 50 bp, homo sapien
tcgaatgtggcattcctaggactaaygctgtctgagtgttgagaagcaaa

SEQ ID NO: 60910 - DNA, 50 bp, homo sapien
aagagaagttaaattgtttcatttcyctagtatctatatcactaggttaa

SEQ ID NO: 60911 - DNA, 50 bp, homo sapien
gtgacatttatgctgttaccagaagraagttatgtagagtggttggtggg

SEQ ID NO: 60912 - DNA, 50 bp, homo sapien
ggcttctcataatggctttaacctcsagtagattttaaaagctatcatgc

SEQ ID NO: 60913 - DNA, 50 bp, homo sapien
agatgagagggaactggccagtcagrtaagaaatacagtctaacactgag

SEQ ID NO: 60914 - DNA, 50 bp, homo sapien
atggaaagagaatacggacaaggagrccctttaggaagttgatgagaagc

SEQ ID NO: 60915 - DNA, 50 bp, homo sapien
tgctggctgggccacctgctatccaygtgatttgggaaagtcaccatacc

SEQ ID NO: 60916 - DNA, 50 bp, homo sapien
tttaccaatcagttttgagggatgaytagtaatccagacctactgattgc

SEQ ID NO: 60917 - DNA, 50 bp, homo sapien
catttagtgacatcgttactgcatartaagtttataaataacctttcttt

SEQ ID NO: 60918 - DNA, 50 bp, homo sapien
gtaagagcaatgtattacctattackatgtagcaagtcacctgcaaactt

SEQ ID NO: 60919 - DNA, 50 bp, homo sapien
catcactcactcactcgctaagtccygatcatcttttatgaagagggaaa

SEQ ID NO: 60920 - DNA, 50 bp, homo sapien
ctggggcttagtgaggcaaagcatcmaatccgaggccatgtgacagaatt

SEQ ID NO: 60921 - DNA, 50 bp, homo sapien
aaatgactttgtcagcttcatatgcyggaaattaagagtgactgcaggac

SEQ ID NO: 60922 - DNA, 50 bp, homo sapien
ccagcaaaaaaagtctgtaataactraggataaacctgaatattattcac

SEQ ID NO: 60923 - DNA, 50 bp, homo sapien
gacacagactgttaaacagtcaaaaygcaatgtcaagtgatagagtgtta

SEQ ID NO: 60924 - DNA, 50 bp, homo sapien
ccattgcaacatatcctgcaactagrctagacaaaaacaaaacaaggaaa

SEQ ID NO: 60925 - DNA, 50 bp, homo sapien
ctaaacttttcagaacagaaggttaragactacacatgcttcatggagag

SEQ ID NO: 60926 - DNA, 50 bp, homo sapien
gctgcccacaaagcaaagacacttcyctaaccttaactttagcccaattc

SEQ ID NO: 60927 - DNA, 50 bp, homo sapien
aattcttaatacataatatgtactawatgagtgtaaataactgttcttgt

SEQ ID NO: 60928 - DNA, 50 bp, homo sapien
aattgaaaagcatatagacttacagrcataaaataatgcttaaaattatg

SEQ ID NO: 60929 - DNA, 50 bp, homo sapien
aacaaaattattcaacttctctttayacaactagcaatatgtttggtagt

SEQ ID NO: 60930 - DNA, 50 bp, homo sapien
tgtggcttctacctggactgctgttyccccagatagcattgtgacttgtt

SEQ ID NO: 60931 - DNA, 50 bp, homo sapien
atgctaaacagaagactggtatctawgagtttgtaaggtgtcagattttc

SEQ ID NO: 60932 - DNA, 50 bp, homo sapien
tgaggaagctcatggagctgcgttcragggatgcactgacccagattaat

SEQ ID NO: 60933 - DNA, 50 bp, homo sapien
ggactccaccctcattagatggaaayatggtacccaaattcccccacatg

SEQ ID NO: 60934 - DNA, 50 bp, homo sapien
ctaacaatctctaaaggcaagtcatragggtcttttttttaaattcccat

SEQ ID NO: 60935 - DNA, 50 bp, homo sapien
tcctcttcctcctcctgacgtctacyactacagttgctggttgttgctaa

SEQ ID NO: 60936 - DNA, 50 bp, homo sapien
caaaaagaagtatggcaaaccttcamgagtgagacacagcgatatgcaaa

SEQ ID NO: 60937 - DNA, 50 bp, homo sapien
tggcataaagattttgcaaaagtcamaaagtaaacatatatttatttgca

SEQ ID NO: 60938 - DNA, 50 bp, homo sapien
ggcaatcaatggttgaatcttagtcrataggagagtcaggtgcacatggg

SEQ ID NO: 60939 - DNA, 50 bp, homo sapien
agggaaaaaagggtggaaagtcagaracccagatacacagcccctgcaat

SEQ ID NO: 60940 - DNA, 50 bp, homo sapien
agtctgcaaacagccatgtttacccrccaggctgatgaaatctcaccttt

SEQ ID NO: 60941 - DNA, 50 bp, homo sapien
atctagagaaaagtacatggaaacartagttcacccttaggcactacatc

SEQ ID NO: 60942 - DNA, 50 bp, homo sapien
caccttcttgtgagcactcaacaacmaacactgtaaagcattgctctact

SEQ ID NO: 60943 - DNA, 50 bp, homo sapien
agaataactgaaatctacatactatragaataatacagtcatgcgccatc

SEQ ID NO: 60944 - DNA, 50 bp, homo sapien
caaaagtgtaaccttgaacagaataygataaatttcatcttgaaaactgt

SEQ ID NO: 60945 - DNA, 50 bp, homo sapien
ctctgttggacatacatttaagacawctagtggtatgaaaaagcactcag

SEQ ID NO: 60946 - DNA, 50 bp, homo sapien
aagttgaaaactgcctaaatgtctamcagtggaatggctaaaaaaattat

SEQ ID NO: 60947 - DNA, 50 bp, homo sapien
ttactatatccaataaacttcatcaktaaggtactcaaaatactttgatg

SEQ ID NO: 60948 - DNA, 50 bp, homo sapien
tttatatttaacatgtacaaaaaaamcatataaacagaaagtaaatagga

SEQ ID NO: 60949 - DNA, 50 bp, homo sapien
taccaatttttttcagaaagcaaaaygtattagaagacatcttttagggg

SEQ ID NO: 60950 - DNA, 50 bp, homo sapien
tttattcactcagggactaattaccractttttatatgaagcagcattac

SEQ ID NO: 60951 - DNA, 50 bp, homo sapien
cagatattgtctatttgaaaatttcmctattttgtcatcatgtttgaatg

SEQ ID NO: 60952 - DNA, 50 bp, homo sapien
cttggaatgtctgcagtactgcacaraagacatccttacattttttaata

SEQ ID NO: 60953 - DNA, 50 bp, homo sapien
gctgcaggaacacagatgagaaatayggcggccaaggaggtggggaggga

SEQ ID NO: 60954 - DNA, 50 bp, homo sapien
gcctttgccttttgctaacgtaacaygtacctctctagggcctggactac

SEQ ID NO: 60955 - DNA, 50 bp, homo sapien
taggacatggtgagatagatgtcaarctctctttatgttttgtgtcgata

SEQ ID NO: 60956 - DNA, 50 bp, homo sapien
aactgcagattttagtttgaggacayaattaaaagattcaaatagcagat

SEQ ID NO: 60957 - DNA, 50 bp, homo sapien
ctgatgtagatcgtggacaactgtayatagttaaataaatatgaatagaa

SEQ ID NO: 60958 - DNA, 50 bp, homo sapien
gagtttgggaaagattgtgaaggaasgattgacagaatttgatccctgat

SEQ ID NO: 60959 - DNA, 50 bp, homo sapien
tttgagtaacttctttttattagtcmctttaaagctttcaagtcctgtag

SEQ ID NO: 60960 - DNA, 50 bp, homo sapien
gagattcaaagatatagggtctagckccaaaatattgtatataagaaggg

SEQ ID NO: 60961 - DNA, 50 bp, homo sapien
tgaagataattcttaacttgaataakaagtatcaaatgaagactgtgtca

SEQ ID NO: 60962 - DNA, 50 bp, homo sapien
ctacactggatctccaagtttaaacrattatctggttccgattcattcag

SEQ ID NO: 60963 - DNA, 50 bp, homo sapien
ttaaataagcttcaagagttgaaaaygaagataattcttaacttgaataa

SEQ ID NO: 60964 - DNA, 50 bp, homo sapien
gctaggcaagcatattaggtttggamcattctgtcatgccttcctctagc

SEQ ID NO: 60965 - DNA, 50 bp, homo sapien
cagaagagttaatataagtaggggcwctatcccaggttacttccaagttt

SEQ ID NO: 60966 - DNA, 50 bp, homo sapien
aagactacagaggcttagataagaargggtcatgttctcaaactgacata

SEQ ID NO: 60967 - DNA, 50 bp, homo sapien
ctttatcactgagaaacaaccagacygttagaagtgttgaaggcatatgt

SEQ ID NO: 60968 - DNA, 50 bp, homo sapien
agtctgtttgtaattcacatctaatraaagagtgagagtggacgataaag

SEQ ID NO: 60969 - DNA, 50 bp, homo sapien
agttataataacagtttaatagaaasaaatccagtttttcattcttctgt

SEQ ID NO: 60970 - DNA, 50 bp, homo sapien
aagtgaacctaaggtattcatttgargcattagaggttaaaaaaaaagaa

SEQ ID NO: 60971 - DNA, 50 bp, homo sapien
ctgccatgaacaaactataaacattraaaatattagggataaattcttct

SEQ ID NO: 60972 - DNA, 50 bp, homo sapien
atctcaactaagtaaaaaatatatcrctcaaaccattaaaagtcaatcta

SEQ ID NO: 60973 - DNA, 50 bp, homo sapien
atactactttatatcatagaacttgragaggaaatgaaaagatcagctgc

SEQ ID NO: 60974 - DNA, 50 bp, homo sapien
gtaaaataattgctttctctttcaamattttaagatagaacattctagat

SEQ ID NO: 60975 - DNA, 50 bp, homo sapien
agattgattctttgagcatttaggayattcctcccttgtggatcatgata

SEQ ID NO: 60976 - DNA, 50 bp, homo sapien
tattttttcccaaataatcaagaacyggagagtacaactaaatgtatttc

SEQ ID NO: 60977 - DNA, 50 bp, homo sapien
gtccgtttctctgttctaccatcaaytacatcattcgcaaacacttcaac

SEQ ID NO: 60978 - DNA, 50 bp, homo sapien
tttatagaaactttagaatctgtaarttaatacttttcaaaagatttaga

SEQ ID NO: 60979 - DNA, 50 bp, homo sapien
aagatatgttattattcaataccacrggctctgtctatagctggacaagc

SEQ ID NO: 60980 - DNA, 50 bp, homo sapien
aactatgaaaacactatgtccctaakagcatctctttccctattttgtgg

SEQ ID NO: 60981 - DNA, 50 bp, homo sapien
catgcaacatcaaggtgattaggcaygatttctggccctgagaatcttgt

SEQ ID NO: 60982 - DNA, 50 bp, homo sapien
aacatacatgtcagaaattgtagtargagacactgaattgatagtaatta

SEQ ID NO: 60983 - DNA, 50 bp, homo sapien
tctagtcccttgagtttcaaaggaaygtaaggtcttcaccactcaaaatt

SEQ ID NO: 60984 - DNA, 50 bp, homo sapien
ggagaaagaatgctaagctaattgawgacaataagaggttcacttggttg

SEQ ID NO: 60985 - DNA, 50 bp, homo sapien
taatttgaaagataaagggattaggwagagtataataacaagtataatcc

SEQ ID NO: 60986 - DNA, 50 bp, homo sapien
aaaaaaaaggatcatctaaagagatyaactttcttgactaacattacaca

SEQ ID NO: 60987 - DNA, 50 bp, homo sapien
tgtaactgaaaacttacaacatgaaktgataaaggttatgctagagagat

SEQ ID NO: 60988 - DNA, 50 bp, homo sapien
gagttgtgtccctgttgcaaagtacyacttattactattgtgaaaagtaa

SEQ ID NO: 60989 - DNA, 50 bp, homo sapien
agctactaatagcagagctaccctcraaactataatggagtttgcctctc

SEQ ID NO: 60990 - DNA, 50 bp, homo sapien
aaatgcttcctttgaatctttcttasacacaggactttgaggaatataat

SEQ ID NO: 60991 - DNA, 50 bp, homo sapien
atctaaggactcacagctgtaataaytgagcttcagatttgctcttgggt

SEQ ID NO: 60992 - DNA, 50 bp, homo sapien
cagaagtgtgcctaatacatcttaawcacatcagtgtggcaactaaagaa

SEQ ID NO: 60993 - DNA, 50 bp, homo sapien
ctgaggatagcttagtgaatagtacragtgtaacgtgactgacaagaaca

SEQ ID NO: 60994 - DNA, 50 bp, homo sapien
acattcctggggaaaattggcacttrtgaaagtggagctgtgagtttctt

SEQ ID NO: 60995 - DNA, 50 bp, homo sapien
tcaccccaaagaaggcaagaatttaygtgcagaaagttatagattgcagc

SEQ ID NO: 60996 - DNA, 50 bp, homo sapien
gaattgtgggttttccttccactgcrcatgaaacataagcaatcatttat

SEQ ID NO: 60997 - DNA, 50 bp, homo sapien
ccttagtcttcagaacataggaacaygataataaagctgtttgattcaag

SEQ ID NO: 60998 - DNA, 50 bp, homo sapien
aggaaactaatggtatggcataaackctattaataagaagaaaaggctta

SEQ ID NO: 60999 - DNA, 50 bp, homo sapien
tctcgatgttagcacacaaatacacrcaaagtcaggaattgtcatcaatg

SEQ ID NO: 61000 - DNA, 50 bp, homo sapien
cacattgttaaaattcccaatctgaratataagaccaaaaacatgatcaa

SEQ ID NO: 61001 - DNA, 50 bp, homo sapien
agagctagacagtgggaaaatttgarcttgtgaggccctaaagagttttt

SEQ ID NO: 61002 - DNA, 50 bp, homo sapien
ccattcctcccatttatgatatgaamattcttatgttacctcttgccact

SEQ ID NO: 61003 - DNA, 50 bp, homo sapien
aatactgtggtaatgaatcctaataygtttgaaatcaaatatttaaaagg

SEQ ID NO: 61004 - DNA, 50 bp, homo sapien
accaatgatatattttagaaactaartccggctacagtagatttaggttg

SEQ ID NO: 61005 - DNA, 50 bp, homo sapien
aatgaaccaaactgtagcaaaaaggratgcaatcagatatccagaaaaaa

SEQ ID NO: 61006 - DNA, 50 bp, homo sapien
ttaagtttatgaaatcaaagataacsgtctgaatctctattatgttactt

SEQ ID NO: 61007 - DNA, 50 bp, homo sapien
tttttgcctgggcttctgttttaacsattgaccttcatctctcctgtcct

SEQ ID NO: 61008 - DNA, 50 bp, homo sapien
tttgtactcagggtaaaactaagacracaatcatgataacgatgatgacc

SEQ ID NO: 61009 - DNA, 50 bp, homo sapien
tatttctcctcttcatatgtctgtaraatttgtatggtatttaataaaat

SEQ ID NO: 61010 - DNA, 50 bp, homo sapien
gacttcctaagggaaagagccatcaragaagaagtaaaacaacaacagta

SEQ ID NO: 61011 - DNA, 50 bp, homo sapien
aaaacagttctaaatttgccaagcawgacgttgaacaggaagtcacacac

SEQ ID NO: 61012 - DNA, 50 bp, homo sapien
tctcttcttacctggagatacaactracttctggatctgtagcaagacag

SEQ ID NO: 61013 - DNA, 50 bp, homo sapien
tttttcttaaataatcaagactaaamaactatgtcaaaaatctcaaatac

SEQ ID NO: 61014 - DNA, 50 bp, homo sapien
tttaagtatttctgccagtttattamaagttatagaatcctttagtaaat

SEQ ID NO: 61015 - DNA, 50 bp, homo sapien
cactttgggaagagctctcaacatayctctgtaggtttaattttaacaac

SEQ ID NO: 61016 - DNA, 50 bp, homo sapien
tttatttgtgtttgtgtgtatctcartctcctccagttcatgtttgattt

SEQ ID NO: 61017 - DNA, 50 bp, homo sapien
acttaatgggaaataagtatagatayagcaagtgccattataacaaagtt

SEQ ID NO: 61018 - DNA, 50 bp, homo sapien
ttttcggagattcgtaagtttgccayaaaaatatctactgtaggctgaaa

SEQ ID NO: 61019 - DNA, 50 bp, homo sapien
acatctagagaacccttcttggatayaccttttgtcatttaaagaccaaa

SEQ ID NO: 61020 - DNA, 50 bp, homo sapien
gttcggtatagtgcatccctttcaargagttgagcatagattttctttac

SEQ ID NO: 61021 - DNA, 50 bp, homo sapien
ttagctcaagatagttcctcatatawtactgctctttgtttttatgtcaa

SEQ ID NO: 61022 - DNA, 50 bp, homo sapien
taaaaatagaagagacagtcacaaartttagataatatagaaatgcatac

SEQ ID NO: 61023 - DNA, 50 bp, homo sapien
taaagggaaaaaatgccaatgaagayaagccatgtacatagtcaagatgt

SEQ ID NO: 61024 - DNA, 50 bp, homo sapien
ataaaatagaaggtttataatatagracatcttttcattaaaaacctaaa

SEQ ID NO: 61025 - DNA, 50 bp, homo sapien
acagaataactgaaggtagggacgtraatgtggatttttaaaaataccat

SEQ ID NO: 61026 - DNA, 50 bp, homo sapien
ttataccagagtaaagcatagagaawcagttggaaattatagcattaaat

SEQ ID NO: 61027 - DNA, 50 bp, homo sapien
aaagctcatataagaaaccaaaatayggaattgaatgaaagaagacaaga

SEQ ID NO: 61028 - DNA, 50 bp, homo sapien
tttcattcagggactgtattctaaarctcttagttctgggagtagagggc

SEQ ID NO: 61029 - DNA, 50 bp, homo sapien
attttaagaccatctatttgctttaygatctatggagactggtatttttc

SEQ ID NO: 61030 - DNA, 50 bp, homo sapien
aatcaaattatcaaaagttatagacsaagtattgaaaaaagccaatgaaa

SEQ ID NO: 61031 - DNA, 50 bp, homo sapien
ctggtagtttttgtgagtatttctayattcagatcaaaagatttgcgtac

SEQ ID NO: 61032 - DNA, 50 bp, homo sapien
ataaacccaatagttgtagagattaytaacagtgagtaaaggaaaggcta

SEQ ID NO: 61033 - DNA, 50 bp, homo sapien
ccttcttgctggacttttccacctaygtttcacccacgtctcaaactcgg

SEQ ID NO: 61034 - DNA, 50 bp, homo sapien
ttatacaattccttttctctacttcyataagtgggtatttgggagatgta

SEQ ID NO: 61035 - DNA, 50 bp, homo sapien
ataatgatagattgaacactaaaaaygcactgctaaatcagttataaata

SEQ ID NO: 61036 - DNA, 50 bp, homo sapien
caggccatccactacctctttatccygacctgaggaacgtgcacttagcg

SEQ ID NO: 61037 - DNA, 50 bp, homo sapien
tgattttaaaacacattatagagtgrataatcaaactcaaatattgtctt

SEQ ID NO: 61038 - DNA, 50 bp, homo sapien
tcatgtagcaaatcacacatgctgaytagttgcttgtgatttctgagaaa

SEQ ID NO: 61039 - DNA, 50 bp, homo sapien
ctgatagtaaaattaatggagagagycatttaaatatggtacctctactt

SEQ ID NO: 61040 - DNA, 50 bp, homo sapien
aggtgacatggtagcttcctcttagyccttcctaatgtttctccaccttc

SEQ ID NO: 61041 - DNA, 50 bp, homo sapien
aagttgtccactctccatcaacacaytgaattttattaggtcccttcatt

SEQ ID NO: 61042 - DNA, 50 bp, homo sapien
ataactctcccaattacttcttgaamatatgaagagtcaatctctctttc

SEQ ID NO: 61043 - DNA, 50 bp, homo sapien
atcatattttcaaatagtctcagaarggtatagatgaattacaaattttg

SEQ ID NO: 61044 - DNA, 50 bp, homo sapien
tctatacttgactggcagggactttktttggctttgtgtggaaatgaatg

SEQ ID NO: 61045 - DNA, 50 bp, homo sapien
cctttttatgcacatatggtcataawctctcaacactaggtggcaggata

SEQ ID NO: 61046 - DNA, 50 bp, homo sapien
aggggagacctgctcagagcagggartaacatgttggacacagaggtgga

SEQ ID NO: 61047 - DNA, 50 bp, homo sapien
gtatcttaacgaggtgttaacttgartaatcagcatgttgaataaacctt

SEQ ID NO: 61048 - DNA, 50 bp, homo sapien
agattacatgctactctgctactcasatgggcttcctctctgttcctgca

SEQ ID NO: 61049 - DNA, 50 bp, homo sapien
acatatggctttttgggagaacagastcctttagagcacatcccattctt

SEQ ID NO: 61050 - DNA, 50 bp, homo sapien
gcatcaagggtgtgtgatataaagaycatgtgttggattaagaatgggat

SEQ ID NO: 61051 - DNA, 50 bp, homo sapien
tttaaacacctcccagtctcagaaaycatggagccatattgtatcagtca

SEQ ID NO: 61052 - DNA, 50 bp, homo sapien
atggtcactagaactgacaagaatcrcattctaatggttttattacaact

SEQ ID NO: 61053 - DNA, 50 bp, homo sapien
tctccgaatctaattaggaatagtasatggtcactagaactgacaagaat

SEQ ID NO: 61054 - DNA, 50 bp, homo sapien
tggtcaggggactttgtagtagaacwattgaagaaagagatagcacagtt

SEQ ID NO: 61055 - DNA, 50 bp, homo sapien
acactattctattcactttctacacmatttcacgagcattggtacctgac

SEQ ID NO: 61056 - DNA, 50 bp, homo sapien
ttgtagaattgtgattggcaatgtasctaattttatcatacttaacaatt

SEQ ID NO: 61057 - DNA, 50 bp, homo sapien
tgtctcatatttggaatgctttatakctaattgaaatcttttctgccata

SEQ ID NO: 61058 - DNA, 50 bp, homo sapien
atcctagaaagggaggaataacaaartatagtaatcttattcatctgcca

SEQ ID NO: 61059 - DNA, 50 bp, homo sapien
ttattaagtacttacttatgtaccartaattagcaaatcatatcttactt

SEQ ID NO: 61060 - DNA, 50 bp, homo sapien
gctaggaagggcagctcaagtcttaygtggttcattggttatagggcttg

SEQ ID NO: 61061 - DNA, 50 bp, homo sapien
tggggagtttatcatagcctaagacmgccaaataatgcccatgggcattg

SEQ ID NO: 61062 - DNA, 50 bp, homo sapien
ccaagatgtgcctggaaaatgattcwactatttctttgttggtcatgagg

SEQ ID NO: 61063 - DNA, 50 bp, homo sapien
taaaagccattcaccatccctagacrtcctgacaagtctgagatgctggt

SEQ ID NO: 61064 - DNA, 50 bp, homo sapien
aatgacaatgttagttttaggcatayacctggagaatgtgtcttccaccc

SEQ ID NO: 61065 - DNA, 50 bp, homo sapien
gcatccaagcaattgtatctgatgcraatgaataactctcagaagaacca

SEQ ID NO: 61066 - DNA, 50 bp, homo sapien
tgggccctgtaaattaggtcctgcckatgcttgtatgttgtccattagat

SEQ ID NO: 61067 - DNA, 50 bp, homo sapien
atctcttattgctattctcttggtgyctctgtcacattgcctttctttca

SEQ ID NO: 61068 - DNA, 50 bp, homo sapien
agaaggatgaagaaatcagtagactraaaaatcaaattcaagaccaagag

SEQ ID NO: 61069 - DNA, 50 bp, homo sapien
aaagttattggctggcaaactgagamtaattcaaaagttcacaaaggtaa

SEQ ID NO: 61070 - DNA, 50 bp, homo sapien
gcttttatacatttgttaaagatatraagtagatataaacaaactgaaag

SEQ ID NO: 61071 - DNA, 50 bp, homo sapien
gaatagcaaccatggcacatagagarcaatacatctggataagacagtag

SEQ ID NO: 61072 - DNA, 50 bp, homo sapien
gaacaaacagacaaataaaaattgaygacatccagcattagtaaggatat

SEQ ID NO: 61073 - DNA, 50 bp, homo sapien
tctctccaaggaagccagagatgackcttcacattctcccttgctctgca

SEQ ID NO: 61074 - DNA, 50 bp, homo sapien
aaggaaaatgccgtaggatcacagasaaggatacagatgaagtgacagga

SEQ ID NO: 61075 - DNA, 50 bp, homo sapien
ttaaccaaaaatctcacacttacttkaaaaaatatggtttcaaaatattt

SEQ ID NO: 61076 - DNA, 50 bp, homo sapien
gactcctttatggctaggtcttaaamacttggaaaaataagttcactggt

SEQ ID NO: 61077 - DNA, 50 bp, homo sapien
catttgtaataaaacttgccaaatckgaagtaatttaaagacaggatcag

SEQ ID NO: 61078 - DNA, 50 bp, homo sapien
ttcagtgaactgggtgtaaacaatayagattttcaaattaacaaggaaaa

SEQ ID NO: 61079 - DNA, 50 bp, homo sapien
cttctttagatgttcaaagctttaartgaagttctaatcatattctagtt

SEQ ID NO: 61080 - DNA, 50 bp, homo sapien
tgacataagtcagtagataaatatcmctgcctatgtgtttcattgaaatg

SEQ ID NO: 61081 - DNA, 50 bp, homo sapien
gaaggctgggccaattaacgcttccraaggaggagatccatttttctgta

SEQ ID NO: 61082 - DNA, 50 bp, homo sapien
agctcttgcagctgtctgcatacacragaaaagctgaagttctggatctt

SEQ ID NO: 61083 - DNA, 50 bp, homo sapien
accaaggcagaccctgttccttttayagccctaggaagctctgcaagtgt

SEQ ID NO: 61084 - DNA, 50 bp, homo sapien
tgaaactgtatgcacgactggtaacyggcaaaggattgagggcatgtgag

SEQ ID NO: 61085 - DNA, 50 bp, homo sapien
ctaaaattttacgaattgacaaaccrctaactacaagatgaacattccat

SEQ ID NO: 61086 - DNA, 50 bp, homo sapien
caaaccactaactacaagatgaacaytccataaatactaagccacattct

SEQ ID NO: 61087 - DNA, 50 bp, homo sapien
caggtctaaagcaatgtcctggttaygaataagtggctggttcctcaaaa

SEQ ID NO: 61088 - DNA, 50 bp, homo sapien
tatgtaattggtgaggaaaggatgawtacatttttcgggctttcaatatg

SEQ ID NO: 61089 - DNA, 50 bp, homo sapien
atggcatggtagtgttcagccaggawctaagaaagaagattatttaatga

SEQ ID NO: 61090 - DNA, 50 bp, homo sapien
caccccttgcctgttctcgcacttaygcttattctcacatcattgttcta

SEQ ID NO: 61091 - DNA, 50 bp, homo sapien
aataatggacaaagaccggtgttacsaagacttgcatgccgaatatgaga

SEQ ID NO: 61092 - DNA, 50 bp, homo sapien
ggctatgcaatctccgtgtttttcargtcaccatagtgaggactcaatga

SEQ ID NO: 61093 - DNA, 50 bp, homo sapien
agcatctagaccctgcttcctaaatrtgctctgtaaaacactagctctag

SEQ ID NO: 61094 - DNA, 50 bp, homo sapien
ctaaatggcactaagaccttaacaargagaatctggaagtagactgttga

SEQ ID NO: 61095 - DNA, 50 bp, homo sapien
tgttaggcaggaaaacagcctggacyaggggctataagcctgttatctct

SEQ ID NO: 61096 - DNA, 50 bp, homo sapien
tccaccccaattttctaagctagtakcgccaccccatatataccctgggg

SEQ ID NO: 61097 - DNA, 50 bp, homo sapien
aacttggcagatgggttcgaaatgtraaatttggctaggccaaagaaaga

SEQ ID NO: 61098 - DNA, 50 bp, homo sapien
gcttaccaaaagcaaaggctagaatraaaacctccatgacttactgtcaa

SEQ ID NO: 61099 - DNA, 50 bp, homo sapien
aaggcttaaaaattagaacttagaarccgatctgtattaaattcggtatt

SEQ ID NO: 61100 - DNA, 50 bp, homo sapien
ggagtataggctacatagtgaggaayggtagttgattaaatggattggag

SEQ ID NO: 61101 - DNA, 50 bp, homo sapien
gcttggttctccagtagatacttaayagtcaaagctgcaggaagagagcc

SEQ ID NO: 61102 - DNA, 50 bp, homo sapien
aactcctacactagttgtaaaggccractcttaaatatatattgtactat

SEQ ID NO: 61103 - DNA, 50 bp, homo sapien
gttgcacacacacaggagtttcattkaagacctacattcaattaatattt

SEQ ID NO: 61104 - DNA, 50 bp, homo sapien
ggtctatcccctcagcacattttcastcttatcttgcactgtttagtcgt

SEQ ID NO: 61105 - DNA, 50 bp, homo sapien
gaaaccagggcagtgcacacataaakagtatgccgttcactggatgggaa

SEQ ID NO: 61106 - DNA, 50 bp, homo sapien
ccactctgaaatactcatcacggaawaatctcatgaggaagaagtaaact

SEQ ID NO: 61107 - DNA, 50 bp, homo sapien
ttatttccttggatccatccgataayaggacattcaccaccttataactt

SEQ ID NO: 61108 - DNA, 50 bp, homo sapien
aggaaactgaatcctagtgagattaygcaacttggctaattagtaagtga

SEQ ID NO: 61109 - DNA, 50 bp, homo sapien
gctatatattataagaaattttaccmagccagttcactaggagaagttta

SEQ ID NO: 61110 - DNA, 50 bp, homo sapien
gcaatgttatatataaaagagatccygaaataagtaagctattatcatat

SEQ ID NO: 61111 - DNA, 50 bp, homo sapien
gtcatgctcaaaagatggatgaaaaygagggacagggataccaaggaggc

SEQ ID NO: 61112 - DNA, 50 bp, homo sapien
caaggaatgtccactatcagctagaygcaaagtaatggactagggcataa

SEQ ID NO: 61113 - DNA, 50 bp, homo sapien
ccatgtatatataggaatttagtgasagagtgacctcatggcaagacgat

SEQ ID NO: 61114 - DNA, 50 bp, homo sapien
atctaaagagggtcagggtatttaamggtccttgtaaacactaagaagtt

SEQ ID NO: 61115 - DNA, 50 bp, homo sapien
gctgccttcccatctaatttattgtraagtcatatagtccatgtctgtga

SEQ ID NO: 61116 - DNA, 50 bp, homo sapien
acaacacaacaggtacataaataagsaagaaggttttagatggtgatagg

SEQ ID NO: 61117 - DNA, 50 bp, homo sapien
aacataatacacacttgttggttgcygacagtgaagggattagcatttgg

SEQ ID NO: 61118 - DNA, 50 bp, homo sapien
cagtaagaatgcaaagtctaaaacayagctctgtaaagtatttccataga

SEQ ID NO: 61119 - DNA, 50 bp, homo sapien
cccaacaaatatgacacggactgcasatattagatatttattaggtacgt

SEQ ID NO: 61120 - DNA, 50 bp, homo sapien
gctgtcttattccgcttgaaaatagscaaaaagtctactgtggtatttgt

SEQ ID NO: 61121 - DNA, 50 bp, homo sapien
acaggttccttgtcatcaagctgagracattacttcatgattcttattaa

SEQ ID NO: 61122 - DNA, 50 bp, homo sapien
acgttcctatcattttcccgattatstctgtttcatgtgaccaagacaat

SEQ ID NO: 61123 - DNA, 32 bp, homo sapien
tctttttaaggaacatraagtaatccgaaaaa

SEQ ID NO: 61124 - DNA, 50 bp, homo sapien
taacggccaacgtttgaagtgaagckatactgaccataaaaaaggactgc

SEQ ID NO: 61125 - DNA, 50 bp, homo sapien
cagtgcctggctaataggctctgatrtagctctcaccaaagatctactga

SEQ ID NO: 61126 - DNA, 50 bp, homo sapien
taggtgaggtcactgagcagaccccrcatactcacagttcatgcaaccca

SEQ ID NO: 61127 - DNA, 50 bp, homo sapien
tgggtcccaaagtgtaggcacattaragagtcaattaatttatacttagt

SEQ ID NO: 61128 - DNA, 50 bp, homo sapien
cggaagttatttttcagtcttcccarattaatgatgtggaatccttgagt

SEQ ID NO: 61129 - DNA, 50 bp, homo sapien
aaaaattaaaaaaaatctcttcccaytcattaagtaactgcagataggtg

SEQ ID NO: 61130 - DNA, 50 bp, homo sapien
cagttgcatgaagcttatgactttgkgttccttattaatgtcataaagtc

SEQ ID NO: 61131 - DNA, 50 bp, homo sapien
gagagggtctaagcaaagatgtcaartatttcaaactagaaaatgaatag

SEQ ID NO: 61132 - DNA, 50 bp, homo sapien
ttccagccatcaccaccaaggggacmaaagaatgaccaggaaggggagcc

SEQ ID NO: 61133 - DNA, 50 bp, homo sapien
attttgaggaaattcctttttgtcasaatggatcagagtcatcaaacgct

SEQ ID NO: 61134 - DNA, 50 bp, homo sapien
ataaatctaaatattcaccagtctgwaccaacatgctaaatataaaatga

SEQ ID NO: 61135 - DNA, 50 bp, homo sapien
acacagcaaaacactacaagattggmattttaagtagatcactgtggcag

SEQ ID NO: 61136 - DNA, 50 bp, homo sapien
tggattgtaaattccctagagaaaarctacatgtctaactacttcgagca

SEQ ID NO: 61137 - DNA, 50 bp, homo sapien
cttttcttgactgaagtgactttcawactagggtgaggctagacagaata

SEQ ID NO: 61138 - DNA, 50 bp, homo sapien
catgacaaattgggttttatttcagraacacaaggttagtttagcaaagg

SEQ ID NO: 61139 - DNA, 50 bp, homo sapien
gggctgtggagtgtcattcccagacyaagtgctatgggagggaatgtctg

SEQ ID NO: 61140 - DNA, 50 bp, homo sapien
ttaaaagaaatgcctggtcaaatacygtagggaattactgaggaagaact

SEQ ID NO: 61141 - DNA, 50 bp, homo sapien
tttgtatgtctgtgttacatattccygagaagtatatttcaagtttaaaa

SEQ ID NO: 61142 - DNA, 50 bp, homo sapien
ccccactttcagataaattagttcaratggttgtctatttacacctcagt

SEQ ID NO: 61143 - DNA, 50 bp, homo sapien
ggaagggcatcaaaaaacttcacaayggtaattaaaatctgcattaaaag

SEQ ID NO: 61144 - DNA, 50 bp, homo sapien
tcaaaacaggaaaggtctttctgaaygtgacatataatccagaagctata

SEQ ID NO: 61145 - DNA, 50 bp, homo sapien
acctgctggggtgaaggtgagaattyaatctttctgtataaattaaggtt

SEQ ID NO: 61146 - DNA, 50 bp, homo sapien
atctattgtctcatttgttggttcartagattagtcggagaaggccttgt

SEQ ID NO: 61147 - DNA, 50 bp, homo sapien
caaacccagcttgcatgattcctaarcgttatgtccctgccccacaaccc

SEQ ID NO: 61148 - DNA, 50 bp, homo sapien
ggagccaccaaaccagttgtgaacayctatcctgggattcttgttgcatg

SEQ ID NO: 61149 - DNA, 50 bp, homo sapien
ggtatagctgtttgctggttctctgratctttcctgcagagttttcctgt

SEQ ID NO: 61150 - DNA, 50 bp, homo sapien
aggtcacatagtgagtggcaagctcwaatttaaactctagcagtctggct

SEQ ID NO: 61151 - DNA, 50 bp, homo sapien
acttaatagcaattgttttggctcaygtaaaaggaagttcagaggtagga

SEQ ID NO: 61152 - DNA, 50 bp, homo sapien
taaatcctgatgtcaaaaagagccawtctggcacaatgagggaagccagt

SEQ ID NO: 61153 - DNA, 50 bp, homo sapien
ctttgagacgggttcccaacaggaaragggaagagtgtgaaaatcaaatt

SEQ ID NO: 61154 - DNA, 50 bp, homo sapien
tttattgaagacttattatgtaccargggtttattaatttatttaatgct

SEQ ID NO: 61155 - DNA, 50 bp, homo sapien
ccattaatccctttgctcttgaacaytcatttctttctcctggttatttt

SEQ ID NO: 61156 - DNA, 50 bp, homo sapien
cccaagtgagcgattcacactaaacrctatgttgacatattctatgggat

SEQ ID NO: 61157 - DNA, 50 bp, homo sapien
atatgagttcttgagataattggaaracatggtatttctattgtcccacc

SEQ ID NO: 61158 - DNA, 50 bp, homo sapien
caaatggcatgacgaaggaaagagasatatacagcaaattctctgagccc

SEQ ID NO: 61159 - DNA, 50 bp, homo sapien
tgtgtctgattttctttcctgttacyatcaagagcatgtctgtggcatta

SEQ ID NO: 61160 - DNA, 50 bp, homo sapien
ttttttcaattatctctttttttcartagtgtaaagatctattatacagt

SEQ ID NO: 61161 - DNA, 50 bp, homo sapien
tattattttttccagctcttttatcragtttatagactacattaatcttt

SEQ ID NO: 61162 - DNA, 50 bp, homo sapien
atggttaaaggcgagagtggttcctyacttcctgaatccctttagtcagg

SEQ ID NO: 61163 - DNA, 50 bp, homo sapien
ggtgcggctgtcaagggctgttcagwctccatatgctttggtttttgcat

SEQ ID NO: 61164 - DNA, 50 bp, homo sapien
tgacagcaccaggccctgtataatcrgatactaattccaaggtcctgact

SEQ ID NO: 61165 - DNA, 50 bp, homo sapien
tgtcataatagggtacacgatttcayccaaaagagtgctatcctatcacc

SEQ ID NO: 61166 - DNA, 50 bp, homo sapien
gcccagggatgacagcagagagggaygcagactatgggacattctaaatc

SEQ ID NO: 61167 - DNA, 50 bp, homo sapien
tctgcctgctttcctccagcctgcartatgcccagagacagccatcctct

SEQ ID NO: 61168 - DNA, 50 bp, homo sapien
gggtttaggtagactggttaaactgwactaggtgagatgattcaagctta

SEQ ID NO: 61169 - DNA, 50 bp, homo sapien
gcatatttatcttggaaagtttctayagacctctgcatttagaagacaag

SEQ ID NO: 61170 - DNA, 50 bp, homo sapien
ttggctacagtgttgctttgtgctcrctagggatgtagagatcattcatg

SEQ ID NO: 61171 - DNA, 50 bp, homo sapien
gggatatgactcactcggcaaggccrcacttggaattcactcagtccttc

SEQ ID NO: 61172 - DNA, 50 bp, homo sapien
gctttttaaggtctaagacacttaaytctttacctttgtaacctctataa

SEQ ID NO: 61173 - DNA, 50 bp, homo sapien
tgtgttgttttaagccaccaagttcrtgttaatctattatagcgcaatag

SEQ ID NO: 61174 - DNA, 50 bp, homo sapien
ctggaagtaaaaaccttattaatagkagcataaattcaagggagaaaatt

SEQ ID NO: 61175 - DNA, 50 bp, homo sapien
ttattttagggggttggtgttttcayacagctgcataagatatgtcatta

SEQ ID NO: 61176 - DNA, 50 bp, homo sapien
tattgattgatataaatgcaatagayaagctatcctaaatctcaaaacat

SEQ ID NO: 61177 - DNA, 50 bp, homo sapien
tggctaaaatgatatcatcgaaagcyaagtctatatgacatctaatgagg

SEQ ID NO: 61178 - DNA, 50 bp, homo sapien
tgacatcttgctatttattgttacaractttcttaggcacatgtgtatga

SEQ ID NO: 61179 - DNA, 50 bp, homo sapien
tggtaatatgtgctctctatattgcygaatctaatggccagttctcagtc

SEQ ID NO: 61180 - DNA, 50 bp, homo sapien
attctggggaatatccctctgttackccaaagatcccttctctgtagtgg

SEQ ID NO: 61181 - DNA, 50 bp, homo sapien
tttaagagctgaaaagtatcctacawgttgaatagcatatgacttcctta

SEQ ID NO: 61182 - DNA, 50 bp, homo sapien
ctgtttttctcattaagtattaataygtgacatgccaacatatcacatct

SEQ ID NO: 61183 - DNA, 50 bp, homo sapien
tactacttgcatcagaatcacctatsacgctttttaaaaagcaggttctc

SEQ ID NO: 61184 - DNA, 50 bp, homo sapien
gtaccagtccctggcctgttaggaastggcatcacaggaggaggtgagta

SEQ ID NO: 61185 - DNA, 50 bp, homo sapien
tagaggagagcaataattgttttccractgcaggcgataaaatgcgtatc

SEQ ID NO: 61186 - DNA, 50 bp, homo sapien
cagatcttgtgagatttactcactayaagaacagtatgggggaaaccacc

SEQ ID NO: 61187 - DNA, 50 bp, homo sapien
agggtaggaaccgggaagagtcaagycgggctctgccctacagtgtagga

SEQ ID NO: 61188 - DNA, 50 bp, homo sapien
gagatatataaagaagtggctctgargacagaaggagtagactgtgtgga

SEQ ID NO: 61189 - DNA, 50 bp, homo sapien
aatatacttttgcattggtttctcamcttaaagcagttccccattcttta

SEQ ID NO: 61190 - DNA, 50 bp, homo sapien
acttaggagactgcatttagaagtcragaaacctgctttcctgccccttc

SEQ ID NO: 61191 - DNA, 50 bp, homo sapien
gtgtcaccatttggcttataaagtaycaagcatttttccattaagaatga

SEQ ID NO: 61192 - DNA, 50 bp, homo sapien
tttaagagaaaaagtaatgtttgaarccagtcttgaaacaaaacaaaggc

SEQ ID NO: 61193 - DNA, 50 bp, homo sapien
aaccgagtttcatgcagaaacatcartaagtaagagtatacagaatacct

SEQ ID NO: 61194 - DNA, 50 bp, homo sapien
ttttacagatagtgagttataacacmgaggatttaaactacttatctcaa

SEQ ID NO: 61195 - DNA, 50 bp, homo sapien
acttagatctttgtttgctgtagaayactgtaagactcacttttagtaat

SEQ ID NO: 61196 - DNA, 50 bp, homo sapien
atggggctctggcctctcctaccacrcataacgccaaggggagactcgtc

SEQ ID NO: 61197 - DNA, 50 bp, homo sapien
ctgagaaggtaaggcctctgaacctrtgaattttggacagtaaagtttgg

SEQ ID NO: 61198 - DNA, 50 bp, homo sapien
gagctgactttgtattgccatgtgayattcaccttttacatcaaacaaca

SEQ ID NO: 61199 - DNA, 50 bp, homo sapien
tgtactgtgaaaaaacagctgccaarcaagatagggactgaatggagtgt

SEQ ID NO: 61200 - DNA, 50 bp, homo sapien
gctcaataaatgttgctcatgattayggattaagtaattgctgtagatcc

SEQ ID NO: 61201 - DNA, 50 bp, homo sapien
ttcgtaaaatcatcttgtagggaaayatagaagcactttaacttgaaaac

SEQ ID NO: 61202 - DNA, 50 bp, homo sapien
ttataagtgctcagaataaaaatacraaacacagtaagtgctcaataatg

SEQ ID NO: 61203 - DNA, 50 bp, homo sapien
gcgaggtgctgagattatctgaaaargttggacaatgtggaaagttatac

SEQ ID NO: 61204 - DNA, 50 bp, homo sapien
aaatggataaaacttctctgactaawtattctaatcaaatactggcttct

SEQ ID NO: 61205 - DNA, 50 bp, homo sapien
gtccctaccctatattactacagtaygtacttttgtgtttctttgcttct

SEQ ID NO: 61206 - DNA, 50 bp, homo sapien
aacgtggctatgaccaccagtagaawttcctccttatcaaggaaactgat

SEQ ID NO: 61207 - DNA, 50 bp, homo sapien
cctctatgcctaagtctaggtgttcraaccaactcctagtaatgcagctg

SEQ ID NO: 61208 - DNA, 50 bp, homo sapien
cagtacaaatgataacaatacctaayagcttatctgtctcttacaggtag

SEQ ID NO: 61209 - DNA, 50 bp, homo sapien
attcacaagtgtttgtttgatcccaytgcccaaagtagatcccactgcca

SEQ ID NO: 61210 - DNA, 50 bp, homo sapien
ttcctcttacctcatttttggacaayggtcatctcagaactgaacttgaa

SEQ ID NO: 61211 - DNA, 50 bp, homo sapien
tgtgaaggttattttaaatgctaaartgatgtgtaaaatatagcattatt

SEQ ID NO: 61212 - DNA, 50 bp, homo sapien
aggtgggctttataggcaaaaaaagyctgaagaaaggaaaaacacggaac

SEQ ID NO: 61213 - DNA, 50 bp, homo sapien
caagtacgaagaactgggaaataaasagacgagttatctgtaccctacac

SEQ ID NO: 61214 - DNA, 50 bp, homo sapien
cttgggtcagctccgtcctaccctgrattgaggacaaggggtcaatctcc

SEQ ID NO: 61215 - DNA, 50 bp, homo sapien
ctttagaaagacagaattttcaatcyattggctgttgtattttaagaagt

SEQ ID NO: 61216 - DNA, 50 bp, homo sapien
aggaggcaggacacagaatttccaaygctcaggatccagctcatccaaat

SEQ ID NO: 61217 - DNA, 50 bp, homo sapien
tagaatacctgcattctttctatggyaatgcgaatcatgcagagtgatgg

SEQ ID NO: 61218 - DNA, 50 bp, homo sapien
aatgcagagcacttaaatcataccaycttaagtttttcaaatcatactaa

SEQ ID NO: 61219 - DNA, 50 bp, homo sapien
cctcgcccaaatccttcaccttgtgyacctaattctagctcatccttcta

SEQ ID NO: 61220 - DNA, 50 bp, homo sapien
aaccagagccaaggttatatttctawcaacttagacaaacttacttggat

SEQ ID NO: 61221 - DNA, 50 bp, homo sapien
catcacttttactccaagcatctcgrattccctgacaatgatagcctcgt

SEQ ID NO: 61222 - DNA, 50 bp, homo sapien
caagaccactcaaactttctccatawcaataggctgttttatcatttgtg

SEQ ID NO: 61223 - DNA, 50 bp, homo sapien
caactagctaaatacataaagcaaartcattaggaatttgataagcctaa

SEQ ID NO: 61224 - DNA, 50 bp, homo sapien
ctatcattcatacaattgagtgagcraccttaggtagttgtgtatatcca

SEQ ID NO: 61225 - DNA, 50 bp, homo sapien
agtcaccatcctaattctacactttsaaaatgtctccctgattaccccct

SEQ ID NO: 61226 - DNA, 50 bp, homo sapien
cctaaatgcccccagtaagagggacsagtttgagcagagagagctttgca

SEQ ID NO: 61227 - DNA, 50 bp, homo sapien
tatacctagacaggggccgttaagayacacgcgagaggtttcctacaccc

SEQ ID NO: 61228 - DNA, 50 bp, homo sapien
ggctctacctgggacctactgagtcrtaatctgcagactaacatctgcgc

SEQ ID NO: 61229 - DNA, 50 bp, homo sapien
aacagtaacctcttcaataaattcasacagtcacaaagacagaactgtgt

SEQ ID NO: 61230 - DNA, 50 bp, homo sapien
tgcagcactattcagtaatagaaagraagaaaccactgacaaatgcaaca

SEQ ID NO: 61231 - DNA, 50 bp, homo sapien
gaggtctttcactagtactgatgaastccctgaaattacaagcaaaaatg

SEQ ID NO: 61232 - DNA, 50 bp, homo sapien
tttgctgccacctgacttgaagctcygaccaccccagtgctacttctgct

SEQ ID NO: 61233 - DNA, 50 bp, homo sapien
gttcaatctatcaccagaacctccasatttttcttcataaacatttctct

SEQ ID NO: 61234 - DNA, 50 bp, homo sapien
tcatcctcttccactttattatacaygaactgcagcaaatctctccccat

SEQ ID NO: 61235 - DNA, 50 bp, homo sapien
agtgttgaaagttaagaaaatattayggacttacgtctgttatcagatat

SEQ ID NO: 61236 - DNA, 50 bp, homo sapien
ggtagggacttgcccacccttgttasactaaatgcttcctgacaacaaag

SEQ ID NO: 61237 - DNA, 50 bp, homo sapien
gaggaagaagatgtaggaacctcgaycttctctctcctgcagatttcatc

SEQ ID NO: 61238 - DNA, 50 bp, homo sapien
aaatataacatgagaacaagactgcyatgactagaggtagctggcaggaa

SEQ ID NO: 61239 - DNA, 50 bp, homo sapien
ctgttcgtttccatttttattctgcratagtcagagaacacaagctttta

SEQ ID NO: 61240 - DNA, 50 bp, homo sapien
ttggataactgtgtggctgaagaacracacggagcattaagctaggcccc

SEQ ID NO: 61241 - DNA, 50 bp, homo sapien
gactaagattcccaggaactccttcragatactcctcttgatccaggtgc

SEQ ID NO: 61242 - DNA, 50 bp, homo sapien
ctgcccccatccccaggcctctttasttttggttatgctgtgtcctccag

SEQ ID NO: 61243 - DNA, 50 bp, homo sapien
ctaacctattcactcctaccataaakgattcaagaaaactggtgtgagtt

SEQ ID NO: 61244 - DNA, 50 bp, homo sapien
gtctgaaatagtttggaaatggataratgctgaaggcaaggagacacaac

SEQ ID NO: 61245 - DNA, 50 bp, homo sapien
cctcctacaacagtctgtaaatatcyaaaggcagctactactgtgccctt

SEQ ID NO: 61246 - DNA, 50 bp, homo sapien
ttgtcagttctggagcacaaaattarggtctaagtaagtgaagtccaagg

SEQ ID NO: 61247 - DNA, 50 bp, homo sapien
atctcctttattctctagtccataarcctacaacctacggcatgtcttgc

SEQ ID NO: 61248 - DNA, 50 bp, homo sapien
gtttggtacaactttccagtgcctayggaaatgaaaagcatttacatgaa

SEQ ID NO: 61249 - DNA, 50 bp, homo sapien
aaggaatgaatctttcttgaagtagycatactataccctaggatagtcct

SEQ ID NO: 61250 - DNA, 50 bp, homo sapien
tttgcatgtgagatgtctggtgcaayacaataggcactaaataaaagtag

SEQ ID NO: 61251 - DNA, 50 bp, homo sapien
tttttctaacctacagacctttagcrcatactaagaactacacattgtgc

SEQ ID NO: 61252 - DNA, 50 bp, homo sapien
gaaacagcagatacataccattctcyattccaggctacagcttcagtccc

SEQ ID NO: 61253 - DNA, 50 bp, homo sapien
tatctaaaaagagaaaaatcttgacwacaattaactataacatcgtggat

SEQ ID NO: 61254 - DNA, 50 bp, homo sapien
ttctatgcttgggaatgaggtaaacraaatgataacactatattgttgaa

SEQ ID NO: 61255 - DNA, 50 bp, homo sapien
attaactataacatcgtggatatttwaaacactttaggagagaaatggaa

SEQ ID NO: 61256 - DNA, 50 bp, homo sapien
gattctagaatttctagccataaaarttaactaatcacaaatatgtgtag

SEQ ID NO: 61257 - DNA, 50 bp, homo sapien
atgggaaatatttcagactgaatccrgccttgaaaacgtcggaagagtca

SEQ ID NO: 61258 - DNA, 50 bp, homo sapien
tagtaattgtgcagctaataaagtarcatagctctcacaaacatctcgca

SEQ ID NO: 61259 - DNA, 50 bp, homo sapien
atgtgtatcacgtggcattatgttaygtagattttaaaagaatgttaata

SEQ ID NO: 61260 - DNA, 50 bp, homo sapien
cctgagatagaaaggttgttagattstaaatttactacttcaagcttttt

SEQ ID NO: 61261 - DNA, 50 bp, homo sapien
agctacagataataaaataatcatawcaatacaacttttatttttattca

SEQ ID NO: 61262 - DNA, 50 bp, homo sapien
gaataataactgccaccaactccctrgattatgttgaggatttgattagg

SEQ ID NO: 61263 - DNA, 50 bp, homo sapien
ttggagagttgaaaaatcagctacgraaatcttactcacatgacacaatc

SEQ ID NO: 61264 - DNA, 50 bp, homo sapien
taatccatcataatctgatattgatyaccttattacctagacttttcatt

SEQ ID NO: 61265 - DNA, 50 bp, homo sapien
agaataatatctttaatgatacacaragtacctgatacttcggggaaggt

SEQ ID NO: 61266 - DNA, 50 bp, homo sapien
accccatttgccaaaccaaatgcttraagtttcaaatgctttatctcatt

SEQ ID NO: 61267 - DNA, 50 bp, homo sapien
tcagatgatgccaattatagctatayattgagacaaccaaaaatgtctct

SEQ ID NO: 61268 - DNA, 50 bp, homo sapien
agatacctatgttttggactttatasaggaaataattccatttcttagta

SEQ ID NO: 61269 - DNA, 50 bp, homo sapien
taaactcttttttcggtcagtttccrattttcatttattataatgctcta

SEQ ID NO: 61270 - DNA, 50 bp, homo sapien
acatgtggacaaaccaaaggagaacygatgaaggtagtttgtagaataaa

SEQ ID NO: 61271 - DNA, 50 bp, homo sapien
tcctccttcctccttttctttggaarataatctgtgtcctaacttaagta

SEQ ID NO: 61272 - DNA, 50 bp, homo sapien
gttaaaaaattgttaactaaattacmgaccatagaaaactgatgaaagag

SEQ ID NO: 61273 - DNA, 50 bp, homo sapien
tagagaatttaaaagattgaacgacyctcaaggaaaagaaaaaaaagcaa

SEQ ID NO: 61274 - DNA, 50 bp, homo sapien
tagaaaatctcatttatgccttgagmctaaaccagaggtccacctatccc

SEQ ID NO: 61275 - DNA, 50 bp, homo sapien
aaattgagtaaatattagtgattgtraaatggtgatttagtctgttttgt

SEQ ID NO: 61276 - DNA, 50 bp, homo sapien
agaggtggtcagggcctgagtgttayatttcatttgatttcttccatccc

SEQ ID NO: 61277 - DNA, 50 bp, homo sapien
aatggaataagcacttcagttcaaasacaaatattatcagataataaaaa

SEQ ID NO: 61278 - DNA, 50 bp, homo sapien
agatttacctatttaggcaaatgcayctctcgaatcctggaatggcaaat

SEQ ID NO: 61279 - DNA, 50 bp, homo sapien
caattttcaatttgtagttaataaayaggagactcactaatcaatttcaa

SEQ ID NO: 61280 - DNA, 50 bp, homo sapien
accaaatatgttattggttctacaaragaaaagttaaatcactgaaaaag

SEQ ID NO: 61281 - DNA, 50 bp, homo sapien
gttttgcttgtccgtaagtaaaaaawgttatgatattagattcaaacaca

SEQ ID NO: 61282 - DNA, 50 bp, homo sapien
cttgagaatatgtacttttagtatayatcatcagacaagtcataaaaaga

SEQ ID NO: 61283 - DNA, 50 bp, homo sapien
gctaacagcagagagatcagcattcytacttcaccaaaaccccatgccac

SEQ ID NO: 61284 - DNA, 50 bp, homo sapien
caacatttcctttctcttcattttcyctctaatttagacctaaaactttg

SEQ ID NO: 61285 - DNA, 50 bp, homo sapien
atttttttttgtgaggtaaattatayactgttcttgaatttgggggttct

SEQ ID NO: 61286 - DNA, 50 bp, homo sapien
cctctctcagagaacaggataaaacrcagaacctgaggtgaggaaatggg

SEQ ID NO: 61287 - DNA, 50 bp, homo sapien
tacctttagcttatgtgtcttttgcraccctttaaatgttgatattcccc

SEQ ID NO: 61288 - DNA, 50 bp, homo sapien
gaagaagaacattttgaactggacawcgctaaagaggttggcacagatcc

SEQ ID NO: 61289 - DNA, 50 bp, homo sapien
aaatatcaaagaatatagaaatataycttctgtttgtataatgtataaat

SEQ ID NO: 61290 - DNA, 50 bp, homo sapien
aagacctggatatttaatgtaaatayaggcagttggcttctgtctagaga

SEQ ID NO: 61291 - DNA, 50 bp, homo sapien
aaaaaatgtctggactgagggaagargtatcctaacgtcctcataagaag

SEQ ID NO: 61292 - DNA, 50 bp, homo sapien
ccatgtctgataccttcagtgttacrgaaactactacgtctcagacaaag

SEQ ID NO: 61293 - DNA, 50 bp, homo sapien
aacacatatcgttggccaacacatgmcatcatatggaaatttctgagttc

SEQ ID NO: 61294 - DNA, 50 bp, homo sapien
acagctaagccactctggaattccamagttttaaggcagtttttgttatg

SEQ ID NO: 61295 - DNA, 50 bp, homo sapien
ttgaatcttaatgtaaagcacatgayggaaatagatttcacttattttac

SEQ ID NO: 61296 - DNA, 50 bp, homo sapien
aattaagcagatttttacatggtagraagctaggtctcaaagaggtaagg

SEQ ID NO: 61297 - DNA, 50 bp, homo sapien
gctggacactatctttacaaagcaayaatatccctccttaagaaactgaa

SEQ ID NO: 61298 - DNA, 50 bp, homo sapien
aaattcctgtgcaaatagatcgttargtatgtagatgagagaacaggggc

SEQ ID NO: 61299 - DNA, 50 bp, homo sapien
tttgtcctgaaaacactcagagagasatctagtacttgtggagcttggca

SEQ ID NO: 61300 - DNA, 50 bp, homo sapien
ctctatttgctatattttcatggtcratttctagacactttaattttttt

SEQ ID NO: 61301 - DNA, 50 bp, homo sapien
tcctgtatttcatgagttgtattcasgtggttaggtgctatgcttctgta

SEQ ID NO: 61302 - DNA, 50 bp, homo sapien
ttttgatcctctttctcagaaacaasattattttgtcaaaacttccaata

SEQ ID NO: 61303 - DNA, 50 bp, homo sapien
aataagtgttaacctctatcaaatayctacccaggctggagtcaacgtcc

SEQ ID NO: 61304 - DNA, 50 bp, homo sapien
caccattctaagtttgaatacctggrattgactaaaattgcaaaactagt

SEQ ID NO: 61305 - DNA, 50 bp, homo sapien
ccattgtggcaatagtctgaattgaygttcacaaattacttgaaggccag

SEQ ID NO: 61306 - DNA, 50 bp, homo sapien
ctgtggagcccctattccgtctataygaaacaatctccctctgcctcaaa

SEQ ID NO: 61307 - DNA, 50 bp, homo sapien
caaggtgagctagcaactactggacrctcatttaatctttatcaaatgaa

SEQ ID NO: 61308 - DNA, 50 bp, homo sapien
aaccaataggtgaaaataggctttcraggattccatcaatcaaaaaaccc

SEQ ID NO: 61309 - DNA, 50 bp, homo sapien
cacccccatcctagtaggagtttaayatgcaacacatatgtgtttctctt

SEQ ID NO: 61310 - DNA, 50 bp, homo sapien
cctcatgtatctaatacagtaaagasagtggattttttttttttttttgc

SEQ ID NO: 61311 - DNA, 50 bp, homo sapien
atgctagcttttttttcctaagcgayagtgtcatgtagtcattgtacatg

SEQ ID NO: 61312 - DNA, 50 bp, homo sapien
ccagatttgctgagaattgtgcctaycttacctttgtgagagcgtatttc

SEQ ID NO: 61313 - DNA, 50 bp, homo sapien
aataggtgaaacttggaaggccagasaagccagcataatttggcacaagg

SEQ ID NO: 61314 - DNA, 50 bp, homo sapien
cccatttcatataaaaagagtttcaygatcttgtttattttgtgtttact

SEQ ID NO: 61315 - DNA, 50 bp, homo sapien
gctggaatagagacttgaactgacarataagcataacaataggtgaaact

SEQ ID NO: 61316 - DNA, 50 bp, homo sapien
tcacgatcttgcttccagcatgctcrgactatcataataacttcttaacc

SEQ ID NO: 61317 - DNA, 50 bp, homo sapien
ttattctttaggcactggagagccayggaaggtttgtgagcctaggaatg

SEQ ID NO: 61318 - DNA, 50 bp, homo sapien
aaatatttctatgttctgcaaactayaatagcagggtgtgttcacgatca

SEQ ID NO: 61319 - DNA, 50 bp, homo sapien
gccagcattaccaaatatctaggtayggagacagccttgaaggtcatctc

SEQ ID NO: 61320 - DNA, 50 bp, homo sapien
cagtttttagatacttgactctctargaatttaagatttgagaattaaaa

SEQ ID NO: 61321 - DNA, 50 bp, homo sapien
aaagaaaccatggtaactctaaaaaytgcacgtattaagggaagatgtat

SEQ ID NO: 61322 - DNA, 50 bp, homo sapien
ataaatacttagttgtatctatgcawgccaaattattggcatcacctggt

SEQ ID NO: 61323 - DNA, 50 bp, homo sapien
gtaatttttcactttcttaccaagaytacaagccgctcagagatatttta

SEQ ID NO: 61324 - DNA, 50 bp, homo sapien
taaatgtcttggtcagaaacctccayggggaattggaatgagtggcagtt

SEQ ID NO: 61325 - DNA, 50 bp, homo sapien
caacaaaggtaggtccttgcttatcrattccagcccatctgcaccaccat

SEQ ID NO: 61326 - DNA, 50 bp, homo sapien
tccaacaactctccttctttacttaractttatatgaagtgcttcattcc

SEQ ID NO: 61327 - DNA, 50 bp, homo sapien
tagcagtgtgcttgcaaatctcataytaagctagtttacttccattatta

SEQ ID NO: 61328 - DNA, 50 bp, homo sapien
cccaggtagcaaaagagtagaggttmgtggaattgttttttccatcctaa

SEQ ID NO: 61329 - DNA, 50 bp, homo sapien
ctgggcttagagagtccggttcctgrcaatattacaaagatgagggtaag

SEQ ID NO: 61330 - DNA, 50 bp, homo sapien
gctgtttgtctgaataatccatagcmaaagtccctaattctgtgtatctt

SEQ ID NO: 61331 - DNA, 50 bp, homo sapien
tgctttaagcaattggaaactattgmaagtctatgatcttaaaaattcaa

SEQ ID NO: 61332 - DNA, 50 bp, homo sapien
acaaataccaaccatcatcttggagrcattaaaggagaccctcccagtga

SEQ ID NO: 61333 - DNA, 50 bp, homo sapien
cacatatacacacacacaaccatcartatagaagaaacaaattgcaggat

SEQ ID NO: 61334 - DNA, 50 bp, homo sapien
tttctagagccccagtaactaattayaatcaataacactatcataacaaa

SEQ ID NO: 61335 - DNA, 50 bp, homo sapien
tctagacattaagcagcgaaaaaaawtcatttcaactgacaattgtttgg

SEQ ID NO: 61336 - DNA, 50 bp, homo sapien
aaaagacttttatcctagaagagtayacccagtgaaaatacccattaaac

SEQ ID NO: 61337 - DNA, 50 bp, homo sapien
gctatgtgacccgtaagatttagttmtaatgaaaggaagttccaaaatag

SEQ ID NO: 61338 - DNA, 50 bp, homo sapien
aactatcctttaaaccttgtaaaacraaaatgcatcatctttccactcat

SEQ ID NO: 61339 - DNA, 50 bp, homo sapien
atgttgttcaagggtcaactgtaacraccattttaatttatcgcactgat

SEQ ID NO: 61340 - DNA, 50 bp, homo sapien
agaattgagagaactagatgaaaaasgagtgtgcaaggacaggcctggtg

SEQ ID NO: 61341 - DNA, 50 bp, homo sapien
ctcaaaagcagtcaacaagctcataytaagaatgtatttaacgttacttc

SEQ ID NO: 61342 - DNA, 50 bp, homo sapien
taaaggaaaagcaccagtatttctayattgtacgttaaacctaaatgact

SEQ ID NO: 61343 - DNA, 50 bp, homo sapien
atttcttctgtagctgtctctctcayacctaaaattagaaaaaaaattat

SEQ ID NO: 61344 - DNA, 50 bp, homo sapien
gtagtgagcaatcattcttaaggtayagtgtattcagtggatgagtccct

SEQ ID NO: 61345 - DNA, 50 bp, homo sapien
ggcaaatcctttacatgcaatactaragaaatcataaattaccagctgcc

SEQ ID NO: 61346 - DNA, 50 bp, homo sapien
tgttctgactgaggcaaagacagcayattacctgacatggccatatgaag

SEQ ID NO: 61347 - DNA, 50 bp, homo sapien
aatagtttttagcagcatcatcaaaragaacttgtaatcatctctcaatc

SEQ ID NO: 61348 - DNA, 50 bp, homo sapien
ttatgtacttggccacaaaagaaaaytcacaggctaaatgtattataaat

SEQ ID NO: 61349 - DNA, 50 bp, homo sapien
tataaatgttttataacgactagaakgattgaattaaatccttgtttttc

SEQ ID NO: 61350 - DNA, 50 bp, homo sapien
taaggagtctcaagatatctatagawgttccctgaagttgtcaaataaat

SEQ ID NO: 61351 - DNA, 50 bp, homo sapien
gaatttgcagtctgggcttaaaacartaggtggaacagtcaaagttgaca

SEQ ID NO: 61352 - DNA, 50 bp, homo sapien
gatagtaaccatcagcaactatattyaagcattaaacttgggggaatata

SEQ ID NO: 61353 - DNA, 50 bp, homo sapien
gtattagaatttctctgatcgaatayggacaggactagaatactagaata

SEQ ID NO: 61354 - DNA, 50 bp, homo sapien
ttatttagtggaaacgataagaaaastatcatctaatcaacaagcacaat

SEQ ID NO: 61355 - DNA, 50 bp, homo sapien
ccgctttgcttttattgtctccttcrctgatttctcttcctctttctgcc

SEQ ID NO: 61356 - DNA, 50 bp, homo sapien
ggaagttcagatcgagagtaataaartacatgaaataatgcaaaagggcc

SEQ ID NO: 61357 - DNA, 50 bp, homo sapien
gagctgtattaggatcttacttaacygatattaatagagttcatgtgaga

SEQ ID NO: 61358 - DNA, 50 bp, homo sapien
gatgcagtttagtttggaatcaagasgcttttaagagggaaagtaaaaat

SEQ ID NO: 61359 - DNA, 50 bp, homo sapien
tatagaaaatttaagcattgtatccmaagttttataaaatgttcaaatat

SEQ ID NO: 61360 - DNA, 50 bp, homo sapien
aaaaggagggtttgtgtgactgctarggagatgttttatattcattggtc

SEQ ID NO: 61361 - DNA, 50 bp, homo sapien
tgaaaataatagtaatggaaagtaawtgattataacatctcaaaacaata

SEQ ID NO: 61362 - DNA, 50 bp, homo sapien
attcttctatctttaatagggcagaygctttttaataggataatatttag

SEQ ID NO: 61363 - DNA, 50 bp, homo sapien
tttaggggtctaaacattaatataasatttcttggaagaggaaattcttc

SEQ ID NO: 61364 - DNA, 50 bp, homo sapien
tacaaatacatttagagcaatatgaraaaaagaaaaggtaatgtttaatc

SEQ ID NO: 61365 - DNA, 50 bp, homo sapien
gcaattttatgtttttcattcgttaycctgaactttcttgaagagattaa

SEQ ID NO: 61366 - DNA, 50 bp, homo sapien
aatagaagaattaaaattcattatgsatgtagtatttggctatttcaagt

SEQ ID NO: 61367 - DNA, 50 bp, homo sapien
ccccagcttctcaataaagtatggtyaataggcatttatacattttcaga

SEQ ID NO: 61368 - DNA, 50 bp, homo sapien
atttgaaacacaatgtatttaaccayagaaagtattgtgcttactaccac

SEQ ID NO: 61369 - DNA, 50 bp, homo sapien
ggagacttaggatttagaaagacagsatcactaaaagacacattacttgg

SEQ ID NO: 61370 - DNA, 50 bp, homo sapien
ggcgctctagaaaatgtatcttaaamtataaaatcagagaatgaaataat

SEQ ID NO: 61371 - DNA, 50 bp, homo sapien
tctcttgttttgtctttattatttarcattttgtagattggcaaaagtgc

SEQ ID NO: 61372 - DNA, 50 bp, homo sapien
actaaaggtcacgagattgttaacaygtgtgaggagattgtaggcttagc

SEQ ID NO: 61373 - DNA, 50 bp, homo sapien
taacagaggaaagcagtcaccaactraagataatatgtcacatgtataca

SEQ ID NO: 61374 - DNA, 50 bp, homo sapien
cttcccagctttaatttctcctacawtccaggcacgcagatgcaattttc

SEQ ID NO: 61375 - DNA, 50 bp, homo sapien
tgacatcataatatcattaaaacaayttacagctgtattgtcaactggac

SEQ ID NO: 61376 - DNA, 50 bp, homo sapien
aaactatatacaaacaccctgtaaaygctgtaaaaatagaaacaaatgat

SEQ ID NO: 61377 - DNA, 50 bp, homo sapien
ctactgagagagacacaaagatctawgagacctaagcccttttaccaatg

SEQ ID NO: 61378 - DNA, 50 bp, homo sapien
gcaacacttcattccataaaataggwtaagtgtctcgatgagtggagcag

SEQ ID NO: 61379 - DNA, 50 bp, homo sapien
cttgagaccctatgctatggctacaycaatcatcgtgaaaattactacta

SEQ ID NO: 61380 - DNA, 50 bp, homo sapien
ctaacattccaaggaatcagaagaaraagataacagccaatttcccaaac

SEQ ID NO: 61381 - DNA, 50 bp, homo sapien
attttgttctaatttttgtgtggtcycttgaaagattggattgactttct

SEQ ID NO: 61382 - DNA, 50 bp, homo sapien
gtcatcaaactgaaactaagttgttstctaacattccaaggaatcagaag

SEQ ID NO: 61383 - DNA, 50 bp, homo sapien
aaaaataaattacagattgattagasagccaaaggttaaaaataaaagtg

SEQ ID NO: 61384 - DNA, 50 bp, homo sapien
ttacaatttgttggtcaatcgattaygtatcaacactataccattactaa

SEQ ID NO: 61385 - DNA, 50 bp, homo sapien
atggttatgccaaaacacaaagagaygaaccaacaattgtctttggttga

SEQ ID NO: 61386 - DNA, 50 bp, homo sapien
tccaggtgccactggagtacgaaaamaaactcctgcagttagctcagtgt

SEQ ID NO: 61387 - DNA, 50 bp, homo sapien
tatagaaactagtcacatttgagtakgccaagccatttgatatccaaaaa

SEQ ID NO: 61388 - DNA, 50 bp, homo sapien
taggttttgacattaggattaggaaratgagctcacttaacatgttagga

SEQ ID NO: 61389 - DNA, 50 bp, homo sapien
atagtaaaataacttcttgagtagtraaaattgtaccattaaaaacaaaa

SEQ ID NO: 61390 - DNA, 50 bp, homo sapien
gcctgccagtcatttttcacatgccyagtatcatcttttaaggtctctaa

SEQ ID NO: 61391 - DNA, 50 bp, homo sapien
actaaggatgtatacacatgtagtaraattataatgagaatgataaaaca

SEQ ID NO: 61392 - DNA, 50 bp, homo sapien
ccaagtagagccaagtaaaatttgcygaatcccctaaattatttacaagt

SEQ ID NO: 61393 - DNA, 50 bp, homo sapien
aaacagctggtcacataggtacataytagagttccttcttgattaagagc

SEQ ID NO: 61394 - DNA, 50 bp, homo sapien
tttgaaagccctaagctctggtatawcttaaaaaggcaaatcaatttaac

SEQ ID NO: 61395 - DNA, 50 bp, homo sapien
aagcttctcaatagaagcttcatccyattttatcatatgaaattgtttct

SEQ ID NO: 61396 - DNA, 50 bp, homo sapien
aaggatggccttagctgctttgcaaygaaatagattaaagatcactggct

SEQ ID NO: 61397 - DNA, 50 bp, homo sapien
tctggccattaaatgtcagtcttccsatatcctaatttgttggccaccca

SEQ ID NO: 61398 - DNA, 50 bp, homo sapien
tattctaaaatgaaactaattaaaaygaacatgaatggaattaaccttag

SEQ ID NO: 61399 - DNA, 50 bp, homo sapien
acataattgggagtttctgttaccayacaacgaaattctaaatagagagg

SEQ ID NO: 61400 - DNA, 50 bp, homo sapien
aacaaaaacatctgttcttttggcayataagcatactatcaaacaattat

SEQ ID NO: 61401 - DNA, 50 bp, homo sapien
tggaacttcagatggaaaagagactraaagattcatatgcttcaaatagt

SEQ ID NO: 61402 - DNA, 50 bp, homo sapien
tgttagtacgtaatgacctccaagaytaagaggagaaaaaaggtcactat

SEQ ID NO: 61403 - DNA, 50 bp, homo sapien
taggtgacagggtattcccaaaatakacataaattcacacacacacacac

SEQ ID NO: 61404 - DNA, 50 bp, homo sapien
ctgaagaaacacagatcatttccaastcaaagcacttatgagtctgtatg

SEQ ID NO: 61405 - DNA, 50 bp, homo sapien
atctctatgtagttaccatgttggayctttgctgattatcatgcatcttt

SEQ ID NO: 61406 - DNA, 50 bp, homo sapien
gacagaagaaattttcagataaaacratgaacatgaactgtcagaactcc

SEQ ID NO: 61407 - DNA, 50 bp, homo sapien
gacacatgattggtcaccgacttgarcttccaatgaatgcgagtgagtgc

SEQ ID NO: 61408 - DNA, 50 bp, homo sapien
aagaatgaatagaagagggctcagaktacagcctcaaggaacactagtat

SEQ ID NO: 61409 - DNA, 50 bp, homo sapien
aataataacaataacaacaataatartaccgatgcggtgcttcatatact

SEQ ID NO: 61410 - DNA, 50 bp, homo sapien
cgagtccagttctgttctcatttgcyttacgggtgtctgaggtactggct

SEQ ID NO: 61411 - DNA, 50 bp, homo sapien
cggcctccagggtaaatctgagtcastgattgatgtaaacttggggttct

SEQ ID NO: 61412 - DNA, 50 bp, homo sapien
accatttaaattttaaaatatagtcrgaagataaaagctatcttctgtaa

SEQ ID NO: 61413 - DNA, 50 bp, homo sapien
gttctgtttgcacatcaagtagcctrtttcctctaaataacacagtattt

SEQ ID NO: 61414 - DNA, 50 bp, homo sapien
ctcattcctcactctcagttgaagayctcacttattattttatggagaaa

SEQ ID NO: 61415 - DNA, 50 bp, homo sapien
agtcactcaacttctgagcctctatrttttcatttctaagctagatatag

SEQ ID NO: 61416 - DNA, 50 bp, homo sapien
cttctgtcaattccttttaaaatgayggttgtgaagactgatgaaaacac

SEQ ID NO: 61417 - DNA, 50 bp, homo sapien
ttgtatctctgagtgttttgtcataycttaactcttgtcatagtgaatga

SEQ ID NO: 61418 - DNA, 50 bp, homo sapien
tactaaaactaaaactgtgttagtaygtaatgacctccaagattaagagg

SEQ ID NO: 61419 - DNA, 32 bp, homo sapien
taacgtaatcagtctaycactacatttgtata

SEQ ID NO: 61420 - DNA, 50 bp, homo sapien
ctgagaataaaatagatgcagagaayattgcaggggtaagaaccccacag

SEQ ID NO: 61421 - DNA, 50 bp, homo sapien
tctctaccaaaaaaagttggaataayatgaataagcagattgaacttggt

SEQ ID NO: 61422 - DNA, 50 bp, homo sapien
taaactcaagattagtgtctggttgmatagaaagtcttggtgatggtgag

SEQ ID NO: 61423 - DNA, 50 bp, homo sapien
ctttatccaccaatggtcctcataamagtaggcaatacatagaaaggagg

SEQ ID NO: 61424 - DNA, 50 bp, homo sapien
atgtgttagatattattactatctamagtgtaaaccttactgggcaacaa

SEQ ID NO: 61425 - DNA, 50 bp, homo sapien
caggtgctgttatgttaaatactgastcacaggagagggccctatatcag

SEQ ID NO: 61426 - DNA, 50 bp, homo sapien
aattttagtttttataactgattaaktatttgtatttaaaaggttggtgg

SEQ ID NO: 61427 - DNA, 50 bp, homo sapien
gggatgatgaaacgttcttatttcasgaccagtttgtggcagtagagact

SEQ ID NO: 61428 - DNA, 50 bp, homo sapien
atcagtgagaatagacaactgttccmgactcttgcctccaggccattgaa

SEQ ID NO: 61429 - DNA, 50 bp, homo sapien
tcatgattaaggaaattgccatataygttgatggaatgataattaaacat

SEQ ID NO: 61430 - DNA, 50 bp, homo sapien
aggcaacaaacccagttgtttctgawgtccaatatctcgacaaccattaa

SEQ ID NO: 61431 - DNA, 50 bp, homo sapien
gctctcttctctctggtactctgctytttgtactctagctgacttgtcct

SEQ ID NO: 61432 - DNA, 50 bp, homo sapien
aatatcatgggtgctaactatgatgkacattattaatcttgttaaaaatg

SEQ ID NO: 61433 - DNA, 50 bp, homo sapien
gcaaaataagtgaaataatgttgaargtttcttaagggagaataaaaggt

SEQ ID NO: 61434 - DNA, 50 bp, homo sapien
ctgggtgaatttatctggaatgataratgcacatgtctcattagtcagta

SEQ ID NO: 61435 - DNA, 50 bp, homo sapien
actaatacctttaaaatattcaaacsaaccattttagcagaaacaaacaa

SEQ ID NO: 61436 - DNA, 50 bp, homo sapien
acatgacaaaatagaactgtgtaagyaatagctataattaaagcatactc

SEQ ID NO: 61437 - DNA, 50 bp, homo sapien
ccagatagctaattagactcagaggwaacacaagaattagtaatgactgt

SEQ ID NO: 61438 - DNA, 50 bp, homo sapien
gtggtgttttcccccagtgtaactarataaattgatgattactttcagta

SEQ ID NO: 61439 - DNA, 32 bp, homo sapien
gaaagctttatgagcartaatactaagaagtt

SEQ ID NO: 61440 - DNA, 50 bp, homo sapien
agtatcccatgacttggttacgttamagcagggagtcagagcaagtgggt

SEQ ID NO: 61441 - DNA, 50 bp, homo sapien
aacgtggctaggatgaatttacagayactacaggtgaagtctgaagtcgg

SEQ ID NO: 61442 - DNA, 50 bp, homo sapien
aaatctagagacagtctgactaaaargaattgattgtatggcacagtatg

SEQ ID NO: 61443 - DNA, 50 bp, homo sapien
tgttcgttaagagtttctaaaaatayagcaccatgtgaaaatacatgata

SEQ ID NO: 61444 - DNA, 50 bp, homo sapien
gtgctatatttttagaaactcttaaygaacaaaatgagatgtaaccaaca

SEQ ID NO: 61445 - DNA, 50 bp, homo sapien
gtcttctcctcttttgccaacatttktactcctctctaattgccctcccc

SEQ ID NO: 61446 - DNA, 50 bp, homo sapien
tctgctcctcttcttataaggacacsagtcgttggatttagggcccactc

SEQ ID NO: 61447 - DNA, 50 bp, homo sapien
ataatagctgtggctgtacaagtcayctatgaaactgttctctcataggt

SEQ ID NO: 61448 - DNA, 32 bp, homo sapien
gtaggtatggctattaygtgtattttacagac

SEQ ID NO: 61449 - DNA, 50 bp, homo sapien
gtaaaaaaatcctcagccttctgacraaaaagatgttaataaatgacaga

SEQ ID NO: 61450 - DNA, 50 bp, homo sapien
agttggccatgagtttgaaatcgggratacaatgataagtaagataaaac

SEQ ID NO: 61451 - DNA, 50 bp, homo sapien
ctcattcccgtccaccctgtagatayacgcttcatgagggtaggatctct

SEQ ID NO: 61452 - DNA, 50 bp, homo sapien
gtgagctagaggctaggacttactayactctgaacatctggggagtaatt

SEQ ID NO: 61453 - DNA, 50 bp, homo sapien
actccccagagaacaacactttcccratatccctggaggaaagaatgctg

SEQ ID NO: 61454 - DNA, 50 bp, homo sapien
tattatataaatcctaataaacacastatcgtcaatacccacatccacat

SEQ ID NO: 61455 - DNA, 50 bp, homo sapien
agggttttgagggaggggtcatttawctctctttaacttatagcaacctc

SEQ ID NO: 61456 - DNA, 50 bp, homo sapien
cctaaaatcaaatagatcaaagagcragctaaacagtccactcgcttaac

SEQ ID NO: 61457 - DNA, 50 bp, homo sapien
gacactgaaaatagtatgtagggctsagataagacaattccagaatagtt

SEQ ID NO: 61458 - DNA, 50 bp, homo sapien
ttgccaccgagatatgcttgctggawataagcagttatggatgttgataa

SEQ ID NO: 61459 - DNA, 50 bp, homo sapien
ttctgcccaccgagaatattacagartccgtctttcttgctcccaatctg

SEQ ID NO: 61460 - DNA, 50 bp, homo sapien
atgttgataataatgattatgcatayaaggtgatagctcttaagattgtc

SEQ ID NO: 61461 - DNA, 50 bp, homo sapien
tgatttatccagagtctcacagttaygaagtggtttctgctatgtaaaaa

SEQ ID NO: 61462 - DNA, 50 bp, homo sapien
ttggtgaataaatatgtatggcttayaaaacatgtgtttctaaatttatg

SEQ ID NO: 61463 - DNA, 50 bp, homo sapien
ttactgactagggaaatatgagagargttatggcatttaaaagttgggga
